United States Patent 12,569,549 (FLAVIVIRUS VACCINE) - sequence listing, part 61

SEQ ID NO: 21345 - RNA, 9879 nt, synthetic construct
  misc_feature 1..9879: note = derived and/or modified CDS sequence (opt6) from DENV-1__KF973475__SS-prME
  source 1..9879: mol_type = other RNA
tcagtgactatgctcctcatgcttatgccaacagctttggcatttcatcttacgacgcgaggaggtgaaccacacatgatagtatctaaacatgaacgaggaaaagcgttactctttaaaacgtctactggtgtgaatatgtgcactttaatagccatggacctaggagaactttgcgaagacacaatgacatacaaatgtccacgtataacagaagctgaaccagatgacgtagactgttggtgtaatgcaactgatacatgggtgacatatggaacatgttcacaaactggggaacatagacgggacaaacgaagtgttgccctggccccacacgtaggtttaggactcgaaacacgcaccgagacctggatgtcgagcgagggagcatggaaacaaatacaacgagtcgaaacctgggccttacggcatccaggatttacagttatagctttatttttagcacacgccatcgggacatcaattactcaaaaaggaataatattcattctgttaatgttagtaacgccttctatggctatgagatgcgtaggcatcgggaacagagactttgttgagggcctcagtggggccacatgggtcgatgttgtcctcgaacatggctcctgcgttactacgatggctaaaaacaaacctaccttagatatcgaactgttaaaaaccgaagtgacaaacccggccgttctaaggaaattatgcatagaagcgaaaatatcaaatactacgactgactcacggtgtcctacacaaggtgaagctactttagtcgaggaacaagacgctaatttcgtatgtcgcaggacatttgtagatagaggctgggggaacggatgtggtctatttggaaaaggatcactcttaacttgcgccaaatttaaatgtgtgactaaactagaaggaaaaattgtacaatacgaaaacttgaaatacagtgtcatagtaacagttcacaccggggatcaacaccaagtagggaacgaaacaactgaacatggtacgattgcaacgatcactcctcaagccccaacgtcagaaatacaattgacggactatggagccttaacgcttgactgctcccctagaacaggtttagacttcaatgaaatggtacttctcaccatgaaagagaaatcatggcttgtccacaaacaatggtttttagatctaccattgccatggacatcgggcgctagcacatctcaagagacatggaatcgacaagacttattagtaacctttaaaacagcacatgccaagaaacaagaggtagtagtattaggatcacaggaaggggctatgcacacagcacttactggggcaactgaaattcagacgagtgggactacaacgatttttgcgggacatctaaaatgtcgattaaaaatggataaacttacattgaaaggcacatcttacgtgatgtgtaccggatcctttaaactagagaaggaagttgcagaaacgcaacatggtaccgtcctagtacaagtaaaatatgaggggaccgacgcaccctgtaaaataccgttctccacacaagatgaaaaaggagttacacaaaacggtcggttaatcacagcaaatccgatagttacagataaagaaaaacctgtaaatatagagactgagccgcctttcggcgaaagctatatagtagtcggagcgggtgaaaaggcgcttaaactaagctggtttaagaaagggtcctcaataggaaaaatgtttgaagcaacagcgcgaggggcaaggagaatggccattctaggggataccgcgtgggattttggttctattggaggggtcttcactagcgtaggaaaattggtacaccaagttttcggcacagcttacggtgtactgttctccggagttagttggactatgaaaattggaattggaatattattaacatggctaggtttaaattcgcgctcaacctcactttcaatgacatgcatagctgtaggcatggtcaccttgtatcttggtgtaatggtccaggccgatagcgggtgtgttataaactggaaaggacgagaattaaaatgcggtagcggaattttcgtcacgaatgaagtacatacatggacagaacaatataaatttcaggcagactccccaaagcgtctgagtgctgcgataggcaaagcatgggaagaaggagtttgcggcatccggtcagcaacgcgtcttgaaaacataatgtggaaacaaataagcaacgagttaaatcatatattacttgaaaacgggatgaaatttacagtcgttgtaggagatgctaacggcattctagctcaaggcaagaaaatgatacgaccacaacccatggagcacaaatattcatggaaaagttggggaaaagcgaaaatcataggggcagatattcagaacacaacgtttattattgatggacccgatacacccgaatgcccggatgaccagagagcttggaacatttgggaagtggaagattatggcttcggaatttttactactaatatatggctcaaactgcgagacagctatacccaaatgtgcgaccaccgattaatgagtgcagctattaaagattcgaaagccgtccacgcagatatgggctattggatagagagtgaaaagaatgaaacctggaaactagccagagcatcttttatagaagtcaaaacttgcacttggccgaaatcgcatacactgtggagtaatggtgttctagagtcggagatgataatacccaaaatatatggaggacctatatcacaacacaattatcgtcccggatattttactcagacagcaggcccgtggcatttaggaaaattagaacttgatttcgatctctgtgagggaacaacagtggttgttgatgaacattgcggaaatagaggtcctagtcttagaactacaacagtaacgggaaaaattatacatgaatggtgctgtaggtcctgtactttgcctcctttacgatttcgaggggaagatggttgttggtacggcatggaaataaggccagtaaaggaaaaagaggagaacttagttagatcgatggtctcagcaggaagtggagaagttgattcattctcactgggaatattatgtgtatcaataatgattgaagaggtaatgcgatctagatggtccagaaaaatgcttatgacggggactttagctgtcttcttgttattaataatgggccaattgacatggaatgacttaattcgtctgtgtataatggtaggagcaaacgcctcagaccggatgggcatgggaacaacctatctagctctaatggcgaccttcaaaatgcgtcccatgtttgcggtggggatcttattcaggaggctcacctccagagaagttttgctgcttacaattggattgtcactggtagcttcagttgaactaccaaactcactagaagaattgggagatggcctggcgatgggtatcatgatgttaaagctgcttacggagttccagccgcatcaactttggacaacattgttgtcactaactttcataaagaccacattaagtcttgactatgcgtggaaaacaaccgcaatggcactctcaatcgtatctctttttccactctgtttgagcacaacctcgcagaaaacaacttggcttccagtcctcctaggtagtttcggttgcaaaccattaacaatgttcctaatcacagagaataagatctggggccgtaaaagctggcccataaatgaaggcatcatggcaatcggaatagtaagcattttactgtcatcattgcttaaaaacgatgtgccactagcaggaccattgatagccggcggtatgttaatagcatgttatgtcataagcggcagctccgcagacctctctttagaaaaagccgccgaagtaagctgggagcaggaagccgagcattcgggcactagccacaatatactcgtcgaagtacaagacgatggaaccatgcgcatcaaagatgaggaaaaggatgacaccctgaccatactactaaaagcaacccttcttgcagtatccggagtataccccatgtcaataccagcaacactgttcgtatggtacttttggcagaagaagaaacaaagaagtggagtactgtgggataccccgagtccaccggaagtagaacgtgcggttcttgatgatggaatatacaggattttacagagaggtctattaggacgaagccaagtgggtgtaggcgtgtttcaagacggagtctttcacactatgtggcatgtaacaagaggagcagtgttaatgtatcagggtaagagattagaaccgagttgggcctcagtcaagaaagacctaatctcgtatgggggcggatggagattccaaggctcttggaatacgggagaagaagttcaagtcatagccgtcgagcctggaaagaatccgaaaaatgtgcaaacgacacccgggaccttcaagacctccgaaggggaagtgggtgccatagccttagactttaaaccaggaacgtcgggctctccaatagtaaacagagagggaaaaatagttggactgtatggtaacggagtagtgaccacgtcaggcacgtatgttagtgctatagcgcaagcaaaaacgtcacaagaaggtccgcttcccgaaatagaagacgaagtattcaaaaagagaaatttaacaattatggacttacatcccggaagtggtaaaacgcgaagatatttaccggcaattgttcgagaagcaattaagcgaaaacttagaacattaatcttagctcctacgcgcgtcgttgcaagtgagatggccgaagctctcaaaggcatgcctataaggtatcaaacaacagcagtaaaatctgaacatacaggtagggagatagttgatctaatgtgtcatgccactttcactatgaggttactctcacctgtgcgcgtgcccaattataatatgattatcatggacgaagcccattttactgacccagcttcgattgcggcgcggggatatatatcaacaagagttggcatgggtgaagccgcagcgattttcatgacagcaactccacctggatcagtagaggctttccctcaatccaatgcggtcatacaagatgaagagagagatatacctgaaagatcttggaactccggatatgattggattacggattttcctggaaaaacagtgtggtttgtcccttcaattaagagcgggaatgacatagcaaattgcctcagaaagaatggaaaaagagttatacaattaagcagaaaaacattcgatactgagtatcagaaaaccaaaaacaacgattgggactacgtcgtcacaacagatatttctgaaatgggagcaaactttagagctgatcgagttatagatcctaggagatgtctaaaacccgtgatactaaaagatggacctgaacgcgtaatattggcaggacctatgcccgttacagtcgcatcggcggcgcaaaggcgaggcagaataggacgaaatcaaaataaagaaggcgaccagtatgtttatatggggcaacctttgaacaatgatgaagatcatgcccactggaccgaagcgaaaatgctgcttgataatataaatacacctgaaggaattatacccgcactgttcgagccagaacgtgagaaatcagcagcaatagatggggaatatcggcttagaggagaggcccgtaaaacattcgtggaactaatgagacgaggagatttaccagtttggttatcttataaagtcgcctccgaaggattccaatatagtgacagaagatggtgtttcgatggtgagagaaataaccaggttctagaagaaaacatggatgtcgagatttggacaaaagaaggggaaagaaagaaattaagaccacgatggttggacgcccgtacatattcagacccattagctttaagggagttcaaagaatttgcagcgggaagacgatctgtcagtggtgacctaatattagaaatcggaaagttgccccaacatttaacgctgagagctcagaatgctctcgacaacttagtaatgttacataattcggagcaaggtggaaaagcgtataggcacgcgatggaggaactaccagacacaatagaaacactgatgttactcgccttgatagccgtcttaacaggcggagtaacattgttctttttatctggtaagggcctcggcaagacgtcaattggattattatgtgtaacagcctcaagtgcactactatggatggctagtgttgaaccccactggatagcggcctccataatactcgagttctttttaatggtcttattgatacctgaaccagatagacagcgcactccacaagataaccaactagcttacgtcgttataggtctactctttatgattttaacggttgctgcaaatgaaatgggactcttagaaacaacaaagagagacttaggaataggtcacgtagctgctgagaatcaccaacatgctaccatgttagacgtcgacttgcgcccggcaagtgcttggacactctatgcggtagcgaccacagtaattacaccaatgatgcgccatacaatagaaaatacaactgctaatattagcttaacagccatcgcaaatcaagcagcgattctcatgggacttgacaaaggatggcccatcagtaaaatggacataggtgtcccactacttgctttagggtgctattctcaagtaaacccccttacacttacagcggctgttttaatgttagtagctcactacgcaatcattggaccagggctccaggctaaagctacacgtgaagcgcaaaaacgaacggccgcaggaatcatgaaaaatccaacagtagatggaatagtagctattgacctagatcctgtcgtctacgacgcaaaatttgagaaacagctaggtcagattatgttgttaatactctgtacttctcaaatattattaatgcgcacgacatgggcactatgtgaaagtataacacttgccacagggcctctgactactctttgggaaggatctccgggcaaattttggaatacaactatagctgtgtcaatggctaacattttcagaggctcgtacttggcgggagcgggactagcatttagtttaatgaaaagcctaggaggagggcggcggggcactggggcacaaggtgaaaccttaggcgagaaatggaaaagacaattgaaccaattaagcaaaccagagtttaacacatacaaacgatccggaataatggaggtggaccggagcgaggctaaagaagggttaaaaaggggagaaaccacaaagcacgctgtatcgcgaggaacagcaaaactcaggtggttcgttgagagaaatttggtaaaaccagagggcaaggtaatagatctgggatgcggtcgaggaggttggagctactactgcgccggattaaagaaagtgactgaagttaaaggatatacgaaaggaggacccggacacgaagaaccaattcctatggcaacctatggttggaacttagttaaacttcatagtggtaaggatgtatttttcatgccacctgagaagtgtgacaccctactctgtgacattggtgaatcctcgcctaatcccaccattgaagaaggcagaacactaagggttctaaaaatggtcgaaccttggcttaggggtaatcaattctgtattaaaattctcaatccatatatgccatcggttgtggaaacactagagcagatgcaacgcaagcatggcggaatgttagtgaggaaccctttatcacgtaactccacacacgaaatgtattgggttagctgcggtacgggaaatatagttagtgcggtaaacatgacctcaaggatgctgctaaatcgattcacaatggcgcacagaaaacccacgtatgaacgagacgtagaccttggtgccggtacaaggcacgtagcagtcgaaccagaggtggcaaatttagatattataggccaaagaatagaaaatataaagaatgagcacaaatccacttggcattacgatgaagataatccctataaaacttgggcgtaccacgggtcatacgaggtgaagcctagtgggtcggcgagctcaatggtaaacggagttgttagattattaactaaaccgtgggacgtaattcctatggtaacacagatagccatgactgacacaacaccatttggtcaacaaagagtattcaaagaaaaagttgacacaagaacaccaagagccaagaggggaacaacacaaataatggaggtaacagccaaatggctatggggattcttatcacggaataagaaaccaagaatatgtacaagggaagagttcacccgaaaagtgagatctaatgcagctataggtgctgtttttgtagacgagaaccagtggaacagtgcaaaggaagccgttgaggatgaaaggttttgggatctggtacatagagagagagaactacataaacagggtaaatgcgcgacttgtgtttataacatgatgggtaagagagagaagaaactaggcgagttcggtaaagctaaaggaagtagagcgatttggtatatgtggcttggagcacgcttcctagaatttgaggcgctcggatttatgaacgaagatcactggttttcgcgagaaaattcgctgtctggcgtagaaggggaaggcttgcataagctaggatacatacttcgggatatctcaaagatacccggaggcaatatgtacgccgatgacacggcgggatgggatacccgtataactgaagatgatttgcaaaacgaagccaaaatcacagacatcatggaaccagaacacgcactactagcaacatctatattcaaattaacataccagaataaagttgtaagagtacaaagacccgctaaaaacggaaccgtcatggatgtaatctctaggcgagatcaaagaggaagtggacaggtaggtacatatggactaaatacattcacaaatatggaagtccagctcatccgacaaatggagagtgaaggtattttccttccgtcagaattagaaactccaaacttggcggaaagagttctagactggcttgaaaaacacggcgctgagcgtcttaaacgtatggctatttcgggagacgattgcgttgtcaaacccatagacgatagatttgctacggcattaactgcactaaacgatatgggaaaagtcaggaaagacatacctcagtgggaaccaagtaaaggatggaatgactggcaacaggtccccttctgcagccaccattttcatcagttaataatgaaagatggaagagaaatagtagtaccttgccgaaatcaagatgaacttgttgggagagcgagagttagtcaaggagctggatggagcttaagagaaacagcatgtttagggaaatcatacgcgcagatgtggcaactaatgtatttccatcggagagacttgagactagctgcaaatgccatatgcagtgctgtaccagttgattgggtaccgacgtcacgcacaacgtggtccattcatgcccatcaccaatggatgaccaccgaagatatgttatcggtctggaacagggtttggatagaggaaaatccctggatggaggataagactcatgtatccagttgggaagaagtcccttatttgggaaagagagaagaccaatggtgcggatccttgataggcttaacagcgagagcaacatgggcaactaatatacaagttgcaatcaatcaagttagacgtctaataggaaatgagaactacttagattatatgacaagtatgaaaagattcaagaacgaatccgaccccgaaggggcattatggtga

SEQ ID NO: 21346 - RNA, 9879 nt, synthetic construct
  misc_feature 1..9879: note = derived and/or modified CDS sequence (opt6) from DENV-1__FJ898448__SS-prME
  source 1..9879: mol_type = other RNA
agcgtaaccatgttattaatgttattacctaccgttttaacgtttcatttaaccacaagaggaggtgagccccatatgattgttagcaaacaagaaaggggtaaaagtttactattcaaaacttcggcaggagttaatatgtgtactcttattgctatggacttaggtgagctatgcgacgatacaatgacatataaatgcccgaggattactgaaacagaacccgatgacgtagactgctggtgtaatgcaacagagacatgggtaacgtatggaacatgttcacaaacaggagaacacagaagagataaaagatcggttgctttggcgccacatgtcggattaggattagagacccgaacggagacatggatgagcagcgaaggcgcgtggcggcaaatacaaaaagttgaaacgtgggctctcagacatcctggattcactgttattgcattatttctggcacatgcaataggtaccagcataacgcaaaaaggtatcatattcatactactgatgttagtgacaccaagcatggcaatgcgatgtgtagggatagggaatagagattttgttgaaggcttgagtggggcaacatgggtagatgttgtacttgaacatggaagttgtgtaacaacgatggcgaaagataaacctactctagacattgaattgctaaaaacggaagttaccaatccagctgtactccgaaaattatgcatagaagcaaaaatatctaatacgacgactgatagcagatgtccaacgcaaggggaagccacgctcgtagaggaacaagatactaactttgtttgcagacgtactttcgttgacagaggctgggggaatggttgcggccttttcggaaaaggttcactaattacttgcgcgaaatttaaatgtgttacaaaactggaaggtaaaatcgtccaatacgaaaacctaaaatattctgtcatagttacagttcatacaggagaccaacaccaagtaggtaatgaaacaacagaacatggcactatagcgactataactccgcaagcgcctacgagtgaaatccaattaacagactacggggcactaacgctagattgtagcccgcgaacaggcttggattttaacgaaatggtgttattgacgatgaaagaaaaatcgtggttagtccataaacaatggttccttgacttacctctcccgtggacaagcggagcttctacgtctcaagagacttggaatcgccaagatttattagttacatttaaaactgcacatgctaagaaacaagaggtggtcgttctaggaagccaagaaggggctatgcacaccgccttaacaggggctacagaaatacaaacatcaggaaccaccaccattttcgcaggccatctcaaatgtcgtttaaaaatggacaagctgaccctaaagggaataagctatgtgatgtgtaccggcagcttcaagctagaaaaggaggtggcggagactcaacatggaaccgtgttagtccaagttaagtatgagggcacagatgcaccatgcaaaattccgttttctagtcaagacgaaaaaggcgttacacagaacgggaggctggtaactgctaatcccatagtgacggataaagaaaaacctgtaaatatcgaagctgaaccacctttcggtgaatcatatattgtagttggcgccggggagaaggcacttaaactaagttggttcaagaaaggtagcagcatcggtaagatgttcgaagcgactgcaagaggtgcaagaaggatggctatattaggagatacagcttgggattttggtagtataggtggtgtatttacgtctgttggcaaacttgtacaccaaattttcggaaccgcttatggggtattattcagtggcgtatcatggacaatgaaaattggtatagggatcttattaacatggctaggtctcaatagcagaagcaccagcttaagtatgacatgcattgcggtaggcatggtgactttatacttgggagtcatggttcaggccgattcagggtgtgtaataaactggaaaggccgtgaactcaaatgtggatcggggattttcgttacgaatgaggtgcacacttggacagaacaatacaaatttcaggcagattctccaaaacgtctatctgctgcgatcggcaaagcctgggaagaaggcgtctgcggcattcgcagcgctaccagattagaaaatataatgtggaaacaaatctcaaatgaattaaaccatatcctattagaaaacgatatgaaatttacagtagtagtcggagatgtgtcagggatactagcacaaggcaagaaaacgatcagaccgcagcctatggagcacaaatactcgtggaaaagctggggaaaggctaaaataatcggtgcagatgtgcagaacacgacattcatcatagatggtccaaatacaccggaatgcccagacgaccaaagagcttggaacatatgggaggttgaggattacggattcgggattttcacgactaatatttggctcaaattaagggattcctacacacaagtctgcgatcaccgcctaatgtcagcagctataaaagactccaaagcggtccacgcagacatgggctactggattgaaagcgagaaaaatgaaacttggaaactcgcacgggccagctttattgaagtgaaaacatgcgtttggccgaaatctcacaccctttggtccaatggggtacttgagtctgaaatgatcattcccaagatatatggaggaccaatctcccaacacaattacaggcctggatactttacccaaactgctggcccgtggcacttagggaaattagaactcgactttgacctttgcgaaggcactacagtagtagtagacgaacactgcggtaacagaggtccttcactacgaacaactaccgtaacaggtaaaattatccatgagtggtgctgcagatcgtgtactctaccgcctttaagatttaaaggcgaagacggttgttggtatggtatggaaataaggcctgtgaaggaaaaagaagagaatttagttaagagtatggtatccgccggatcaggggaggtggatagcttcagtctaggacttctctgcataagtataatgatagaagaggtaatgagatcacgttggtccaggaaaatgctgatgaccggaacgttagttgtctttttacttctcacgttaggacaattaacttggaacgatctaattaggttatgtatcatggtaggtgcaaatgcgtctgacaatatgggcatgggaactacatatctagcgctaatggctacttttagaatgaggcctatgttcgccgttggtctactgtttcggcgtctaacctccagagaagtcttattactgaccgtaggactcagtttagtagcttcagtagagttaccaaattctttggatgaattaggcgacggactagctatgggcataatgatactaaagctgctaacagattttcagagccatcaattatgggcgacattgctctcactgactttcgtaaaaactactctgagtttacactatgcctggaaaacaatggctatgatactaagcattgtatctctactcccactttgcttaagtactacaagccagaaaactacctggctaccagttttactcggaagcctaggatgcaaaccattaactatgttcctaataacagagaacaagatttggggtagaaaatcgtggcctttaaacgaaggtataatggcagtaggtatagtctctattctactatctagtctgcttaagaacgatgtgccgctggcaggtccactgattgcaggcggaatgttgatagcatgttatgtcataagcggatcatctgccgatttatcattggagaaagctgcaaaagtctcatgggaggaggaagctgaacattcgggtgcaagtcataacatattggtagaaatacaagatgacggtactatgaagataaaagacgaagagagagacgataccataacgatccttttaaaagcaacacttcttgccattagcggggtctacccaatgtcaataccagctacacttttcgtctggcacttctggcagaaaaagaaacaaagatcaggggttttatgggacacacccagtcctcccgaagtggaaaaagcagtacttgacgacggtatatatagaatattacaacgagggctactaggaagatcccaagtcggagttggagtcttccaggaaggtgtattccataccatgtggcatgtgacccggggtgccgtcctaatgtaccaaggaaaacgattagagcctagctgggctagtgtcaagaaagatctgattagctatggtggcggatggagatttcaaggaagttggaacactggagaagaagttcaagtcatagcggtagagccggggaagaatcccaaaaatgtgcaaacagcaccaggaacatttaaaacaagtgaaggagaagtaggagcaatagcacttgacttcaaaccaggcacgagcggttcacccatagtgaatcgcgaaggaaagatagtaggactatatggaaacggagtagttactacgtccggtacatatgtatcagcaatagctcaagctaaagcaagccaagaaggccccctgcctgaaatagaagacgaggtcttcagaaagcgtaacttaacgataatggacttacaccccggtagtggcaagacccgaagatatttaccagcgattgtccgggaagcaataaaaagaaagctaagaacacttgtattagctccaacccgagtggtagcctcggaaatggctgaagcattaaagggcatgcctatacgataccaaacaacagccgtcaaatccgaacatacaggcaaagaaatagtagatctaatgtgtcatgcgactttcactatgcgtttgctaagcccggttagagtaccaaattacaacatgatcattatggatgaagcacatttcacagaccccgctagtatcgcagcaaggggttacatttcaacgagagtcgggatgggagaagcagcggctatatttatgactgccacaccgccaggaagtgtagaagcgttcccacaatccaacgcagttattcaggacgaagaaaaggatatcccagaaagaagctggaactccggatatgactggataacagattttcccggaaaaacagtatggtttgtaccaagtataaaatccggaaacgacatagcgaactgtctaaggaaaaatggtaaacgagtaatacaattaagcagaaagacctttgataccgagtatcagaaaaccaaaaataacgattgggactatgtcgtcacgacagatatatcagaaatgggcgcgaattttcgggctgatcgagtcattgatccacgacgttgtttgaagcccgtaattctcaaagatggacccgaaagagtaatattagcgggtcccatgccagttacagttgcctccgccgcacagagaagaggaaggataggtagaaaccagaataaagaaggtgatcaatatatatatatgggacaaccattgaacaatgatgaagaccacgctcattggaccgaagctaaaatgttgcttgacaacataaacactcccgaggggataatccctgcactttttgagccagaacgggaaaaatccgcagccatcgatggggagtataggttgaggggagaggcgcgaaaaacttttgtcgaacttatgagaagaggagatcttccggtatggctatcatacaaagtagcttcggaaggattccaatatagcgataggcgctggtgtttcgatggtgaaaggaacaaccaagttttggaagaaaacatggacgtggagatatggacaaaagagggcgagcgtaagaaactacgaccaagatggcttgacgccaggacatatagtgaccctctcgccctgagagagtttaaggaatttgccgcaggcaggaggagcgtttccggcgatctcatactagaaataggtaaactaccacaacatttaactcaaagagctcaaaacgcgttggacaacttagtcatgctccataactccgaacaaggaggtaaagcgtataggcacgctatggaagaattgcccgatacaatagaaacgataatgctattggccctaatagctgtcctcaccggtggtgttaccttattctttttatccggtcgaggactagggaaaacgagtatcggactattatgtgtcacaagttctagcgcgttactttggatggcatcagtagaacctcactggattgctgcgtcaattatactcgagttctttctcatggtactccttatacccgaacctgaccgacagcgcactccccaagataatcaattggcatacgttgtaataggacttttatttatgatcctaacagtagcggctaatgaaatgggactcttagaaacaactaagaaagatctcggtataggccatgcggcggctgaaaatcaccatcatgccgcaatgcttgatgttgacttacaccccgctagcgcatggacattatacgcagtagccactacgattattactccaatgatgcggcacacaatcgaaaatactacagcaaacatcagcttgaccgctatagcgaaccaagctgctattttaatgggtctagacaaaggatggccgatatcgaagatggacataggagttccgttattagcactggggtgttattcacaagtgaaccccttaacactaacagccgcggtgctgatgttagtagcacactacgcaataattggacctgggttacaagcaaaagcaacacgagaagcacagaagagaaccgcagccggaatcatgaaaaacccgactgttgatggaatagtagctattgatttagatcctgtcgtctacgatgcaaaattcgaaaaacaacttggtcaaataatgcttctgatactatgtacatcccaaatactgttaatgaggacaacttgggctttatgtgaatctataactctagcgacaggtcccttgacgacgttatgggaaggtagtcctggcaaattttggaacacaacaatagcagtcagtatggcaaacatcttcagaggaagctatctagccggagctgggctagctttttctctaatgaaatctttaggtggtggccgaagagggacaggtgcacaaggtgaaacactgggagaaaaatggaaaagacaacttaatcaactgtccaaatctgaatttaatacttataagagaagtggaattatagaagttgatcgttcagaggccaaagaaggattaaaacgaggggaaacaacgaaacacgctgtatcacgtggaacagcgaaattacgctggttcgtggaacgtaacctggtaaagccagaaggaaaagtgatagatctgggttgtggaagaggtggttggagttactactgcgcaggtctaaagaaagtaacggaagtaaagggttataccaaaggaggtcctggccacgaggaacctataccgatggcaacttacggctggaacttagtgaaactgcattcagggaaagacgtattctttatccctccagaaaaatgtgatacgttactatgtgatatcggtgagagttcgccgaaccctacaattgaagaaggaaggacgcttagagtcctcaagatggtagagccctggttaagaggaaatcaattttgtataaaaatattaaatccgtatatgccaagcgtcgttgaaaccctagagcagatgcaacgcaaacatggaggtatgttagtacgtaacccattaagtagaaactccacgcacgagatgtactgggtaagttgcggcaccggaaatatcgttagtgcagtaaacatgacaagtagaatgctattaaaccgttttacaatggcacatagaaaaccaacgtacgagcgtgatgtagatctcggagcaggcacacggcatgttgcagtcgaaccagaagttgcgaatttggatattataggtcaaaggattgaaaacataaagaacgaacacaaaagtacgtggcactatgatgaggacaatccatataaaacttgggcctatcatggttcctatgaagtaaaaccgagcggctctgcttcatccatggtaaatggggtagttagactacttacaaaaccctgggatgtgattccaatggtcactcaaatagctatgaccgacacgacaccctttggtcaacaacgtgtcttcaaagaaaaagtagacactcgaacgccgaaagcgaagagaggaactgctcagataatggaagtcactgcaaaatggctatggggattccttagtcgtaataagaaaccacggatctgtacccgagaagaatttactagaaaagttcgctccaatgctgccataggagccgtatttgtggatgagaatcaatggaactcggctaaggaagcggttgaagatgaaaggttttgggacttagtcaggagagaaagggaactgcataaacagggaaaatgtgcaacatgcgtgtataatatgatgggaaaaagagaaaagaaactaggcgaatttggaaaagcaaaaggatcccgtgctatttggtatatgtggttaggagcgagattcctagagtttgaagcactaggattcatgaacgaggatcactggttctcccgagaaaattcacttagtggggttgaaggagaaggcttgcataaactgggttatatactccgtgatattagcaaaatacccgggggtaacatgtacgcagatgatacggcgggctgggataccagaataactgaggatgaccttcaaaacgaagcgaaaattaccgatattatggaaccagaacacgcactgttagcgacttcaatctttaaacttacatatcaaaacaaagtcgtacgagtgcaaaggccggcaaagaacgggactgttatggatgtgatcagcagaagggaccagcgagggtctggtcaggttgggacatatggtctaaacacattcacaaatatggaagcccaattgataagacaaatggaaagtgaaggaatattttctcccagtgagttggaaacacccaacctagcagggcgcgtattagactggttagaaaagcacggcaccgaaaggctacgcaggatggcgatcagcggtgatgattgtgtcgttaaacctatagacgatcgtttcgctactgcgctaacagcactaaatgatatgggaaaggtacgcaaggatataccccaatgggaacctagtaaaggttggaatgattggcaacaggtaccattctgctctcatcacttccatcaattaataatgaaggacggtagagaaatagttgttccatgtagaaatcaagacgaattagttggtcgggctagagtttcccaaggagctggctggagcttgagggaaactgcatgcctcggcaaatcttatgctcaaatgtggcaattaatgtatttccaccgacgtgacttaagattagcggctaacgcaatatgcagcgctgtgcccgttgattgggtacccaccagtcgaacaacgtggtcaatacatgcgcaccaccagtggatgacaacagaagacatgctttccgtctggaaccgtgtatggatagaagagaacccatggatggaagataagactcacgtgagtagctgggaagacgtaccatatttgggaaaaagagaggatcaatggtgcggatctctcattggtttaaccgcaagagcaacatgggctacaaacatccaagtcgccataaaccaagtaagaaggctaattggtaatgaaaattatcttgattatatgacaagtatgaaacgttttaaaaatgagtccgacccagaaggcgccctatggtga

SEQ ID NO: 21347 - RNA, 9879 nt, synthetic construct
  misc_feature 1..9879: note = derived and/or modified CDS sequence (opt6) from DENV-1__GQ868602__SS-prME
  source 1..9879: mol_type = other RNA
agtgtaactatgttactaatgttactaccgacagcgctagcgtttcatttaacaacacgaggaggggaacctcacatgatagtgtccaaacaagaaagggggaaaagtctactctttaaaacaagtgcgggagttaatatgtgtactttaatagctatggatcttggtgaattatgcgaagatactatgacgtacaaatgccccagaataacggaaacagaacctgatgatgtcgattgttggtgtaacgcaacagaaacttgggtaacatatggaacgtgttcccaaacaggtgaacatagaagagataaacgatcagttgctttagctccgcacgtcggattaggtctcgaaacgagaacagaaacgtggatgtcctcagaaggagcatggagacagatacaaaaagtagaaacttgggccttacgacatccaggtttcacggtaattgcactatttttagcacatgccattggaacgagtattactcagaaaggcattatatttatcctactaatgttagtaactccgagtatggcaatgcgatgcgttggaattggcaatcgtgactttgtcgaaggtttatcaggagctacttgggtggacgttgtactagaacatgggtcttgtgttacaacaatggctaaagataaaccaacattggacatcgaattactaaaaacggaagtcacaaatcctgcggtgctgagaaaactctgtattgaagcaaaaatttcgaacacgacaacagactcacgatgtcccacacaaggtgaagctaccttggttgaagaacaagataccaactttgtatgccgcaggactttcgtagaccgaggttggggaaacggctgtggcctattcgggaaaggctcgttaatcacgtgcgcgaaatttaaatgtgtgactaaactggaaggaaaaatcgtacaatatgaaaatttaaaatattcagtaatagtgacagtccacacaggtgaccagcaccaggtaggaaacgaaactaccgaacacggtacaacagctacaatcacacctcaggcaccaacgagtgaaatacagctaactgactatggagctttaactcttgattgctcaccaagaactggtctagattttaatgaaatggtactactaacaatgaaagaaaaatcatggctggtgcacaaacaatggtttttagatcttccactgccatggacatccggagcgtcgacttcacaagaaacctggaataggcaagatttactggttacctttaaaacggcgcatgctaaaaagcaggaagtagttgtgcttggatctcaagaaggggcaatgcacaccgcgttaactggagcaacagaaattcaaacatcagggaccacaacaatctttgcagggcacctaaaatgcagactcaagatggacaaactaactctcaagggagtttcctacgtgatgtgtacgggttcattcaagctggaaaaagaagtagctgaaacacaacacggaacagtcctagtacaagtcaagtatgaaggaacagatgcaccatgcaagatccccttttctagccaagatgaaaaaggagtcacacagaacgggcgcttgatcacagcaaaccctatagtaacggataaagaaaaaccagtcaacatagaagctgaacccccatttggagaatcctacttagttgtaggtgcaggggaaaaagcactaaaactatcttggtttaagaaaggttcaagcatcggcaaaatgtttgaagctaccgcaagaggcgcaagacgtatggcaattctaggcgacacagcctgggactttggaagtataggaggcgttttcaccagcgttggaaagctgatccatcaaatattcggtactgcatatggggtattatttagtggagtaagctggacaatgaaaatagggatcggaatcttacttacctggttggggctaaactcgaggtcaaccagtttgtcaatgacctgcatagctgtcggaatggtaacactttacctaggggtgatggtgcaagcagactcaggatgtgtaatcaactggaaagggagagaactaaaatgcggaagcggtatcttcgtgactaatgaagtccatacttggacagaacaatacaagtttcaggctgacagtccaaaaagactatcagctgcaataggaaaagcatgggaggaaggagtttgtggtattcgttctgccactagactcgaaaacataatgtggaagcaaattagtaatgagttaaatcacattctactagaaaacgatatgaaatttaccgtagtagtaggagacgtgaatggtgtcttagcgcaagggaagaagatgataaggccacagccaatggaacataaatactcctggaaaagttggggcaaggcaaaagtaataggagctgacgtacaaaatatcacattcataattgacggacccaatactcccgaatgcccagatgatcaaagagcatggaatatctgggaagttgaggattacggcttcggaatctttacaacaaatatatggttaaaattgcgggacagttatacacaagtatgtgaccaccgccttatgtctgcagcaataaaagactcgaaagcggttcatgcggacatgggatattggatagaatcagagaaaaacgaaacttggaaattaacacgcgcgtcatttatagaagtgaaaacatgcatttggcctaagtcgcatactctgtggtcaaacggagttttagagagtgaaatgatcatccctaagatatatggaggtccaatcagtcaacacaattataggcccggatacttcacccaaacagcgggcccttggcacctcggaaagctagaactagattttggcttgtgtgaaggaactacagtggtagtcgacgaacattgtggcaatagaggtccaagcctaagaacaaccacagttacaggaaaaataattcatgaatggtgttgtcggtcctgtactttgcctccattaaggtttaaaggagaagacgggtgttggtacggaatggaaatccgacctgtaaaagaaaaagaagagaatcttgtaaagagcatggtatcggcaggatcgggggaagtcgattcgttttcattgggactactctgtatatcaataatgatagaggaagtgatgcgcagtagatggagtaggaaaatgctaatgacaggaactcttgcggtatttttgctactgatcatgggtcaactcacatggaatgacctgatacgattatgcataatggttggagccaatgcaagtgataagatgggtatgggaacaacgtacttagcattaatggcgacgttcaggatgcgacctatgtttgcagtaggactattatttagacgactaacctcacgcgaagtactattactcacggtaggactatcgctagtagcttcagtagaattacccaacagcttagaagagttaggtgacggattggccatgggcatcatgatgttaaagctcttaacagatttccaaagtcaccaactgtgggcaactcttctaagcctcacgttcgtgaaaactacgttcagtttgcactatgcatggaaaacgatggcaatgatcttgagtatagtatcactttttcctttatgcttgtccaccacctctcagaaaacaacctggctcccagtgcttttaggaagtttaggatgtaagccattaacaatgttcctaataacagaaaataagatttggggacgaaaatcatggccgttaaacgagggaataatggcagttggcattgtatctatactccttagctcactattaaagaacgacgtacctttagctggaccactcattgccggagggatgcttattgcatgttatgtcatatcgggatcgagcgcagatctatcgcttgaaaaagctgctgaggttagttgggaagaagaagctgaacatagtggtgcatcgcacaacatcctcgtggaggtccaagatgatgggacaatgaagatcaaagacgaagaacgtgatgacacgcttacaatacttttaaaggcaactttgttagctatctccggagtttaccccatgagcatcccagcgacactctttgtatggtacttctggcagaagaagaaacaaagatcaggggtactttgggatacaccctctcctccagaagttgagagagcagtactggatgatgggatctatcggatcctacaacgaggattgcttggaaaatcccaagtcggtgtcggagttttccaagaaggagtttttcatacaatgtggcacgtaacacgtggtgctgttttgatgtatcaaggaaaaagattggaaccatcctgggcatcggttaagaaagatttaataagctatggtggtgggtggcgattccagggatcatggaatatgggtgaagaagtacaagtcatagctgtcgagccgggcaaaaatcccaaaaatgtgcaaacagcacctggtacattcaaaacaccagagggagaggttggtgcgatcgcactagatttcaaaccaggaaccagcgggtctccaatagtgaatagggaaggcaagattgtcggactttacggtaacggtgttgtcacaacgtcaggaacatatgtttccgcaattgcccaagcgaaggcaagtcaggaaggaccactccccgaaattgaagacgaggtatttagaaaacgaaacctaactatcatggatttgcaccctggatcaggtaaaaccaggagatatttacccgctattgtgcgtgaagctataaaacgaaaattgagaacattagttttagcaccgaccagagtagttgcaagcgaaatggctgaggctttaaaaggcatgcctatacgttatcaaacaacagcagtaaaaagcgaacacacgggaaaggaaatagtggacctgatgtgccacgctacttttactatgcgacttctttctccagtgagagttcccaactataatatgataatcatggatgaagcacactttacagaccctgcaagtatagcagcccgcgggtatatctcaaccagggtcggcatgggtgaagcggcagcgatttttatgactgccaccccaccagggagtatggaagcgtttccgcagagcaatgcagccatacaagatgaagaaagagatatacctgaacgatcttggaactcaggatatgattggatcacggactttccaggaaaaactgtctggtttgttccatcaatcaaatccggtaatgacattgcgaattgccttaggaaaaacggtaaaagagttgtgcaattgagtagaaagacattcgatacagaataccagaaaaccaaaaataatgattgggactatgtggttactacagacatctccgaaatgggagcaaactttcgagctgacagagttatagaccccaggagatgcttgaagccagtgatcttaaaggatggaccggaaagggtcatattagctggtccaatgcctgttactgtggcatcggctgcacaaaggcggggacgtatcggccggaatcaaaataaagaaggcgatcaatacatatatatggggcaaccgttaaataatgatgaagatcatgcacactggactgaagcgaaaatgctccttgacaacataaataccccagaaggcatcataccagcactctttgaaccagagagagagaagtctgctgccatagacggagaatatcgcctacgtggtgaggcaagaaaaacctttgtggagctaatgagacgtggggatctaccggtttggctcagttataaagtagcatcagaaggttttcaatattcagaccgccggtggtgcttcgatggtgaacgaaataatcaagtgctccttaagaatatggatgtcgaaatatggactaaagaaggtgaacggaaaaagttaagacccagatggctggacgcgagaacatactcagatcctttagctttaagggaatttaaggaatttgcggcaggccgaagatctgtgagtggagatttaatcttagaaatcggaaaactgccccaacatctcacacaaagagctcaaaatgcactagataacttggtgatgttacataactctgagcaaggaggaaaagcatatcgccatgcaatggaagaactaccggacacgattgaaacactaatgcttcttgctctgatagcggtattaaccggcggagtgacattatttttcttgtccggacgaggtcttggaaaaacctctatcggtctcttatgcgttatggccagcagcgccctactttggatggcgagtgtagagcctcattggatagcagcctcaataatattggagttcttccttatggtgttattgatcccagaaccagataggcaaagaacccctcaagataaccaacttgcctatgtggtaatcgggctgttattcatgatcctaacagtagccgccaacgaaatggggctgttggagactaccaagaaagacttaggtattggacatgtggctgcagaatcacaccaccatgcggctatgttagacgtggatttacaccccgcgtcagcgtggaccctttacgcagttgctacgacgatcataacaccaatgatgagacacacaatagaaaatactacggccaacatatctctgacggcgatagctaatcaagcggctatacttatgggtttggataaaggctggccaatcagcaaaatggatatcggcgttccattattagctctaggctgctacagccaggtgaaccctctaaccttgacagctgctgttttaatgttagtcgctcattacgccataataggtccaggcctacaagcaaaggcaacgagagaagcacagaaacgaactgccgccggcattatgaaaaatccaacggttgatgggatagttgcaatagacttagaccccgtagtgtatgatgccaaattcgagaagcaactcgggcagattatgttattaatactttgtacctctcagatattactcatgaggacgacatgggcactatgcgaatccataactctagctacaggtccgttaacaactctatgggaaggaagtccgggcaaattttggaatacaacaatcgccgtcagtatggctaatattttcaggggttcttacctcgcaggagctggtttggcattctccctgatgaaatctttaggcggagggagacgtggcacaggggcccaaggggaaacactgggggagaagtggaagaggcaacttaatcaattgtccaaaagcgaatttaatacatacaaaagatctggaattatagaagtagatcgaagtgaagctaaagaaggtctgaagcgtggagaaacgaccaagcatgccgttagccgcgggacagcaaaattaagatggttcgtggaacgtaacttggtgaagcctgaaggaaaagttattgacctaggatgtggcagagggggatggagttactattgcgcaggtctcaagaaagtaacagaggttaaaggatatactaagggagggccaggtcatgaagaaccaataccgatggcaacttatgggtggaatctcgtgaaactttatagtggaaaagacgtatttttcacacctccagaaaagtgtgacactctactatgtgacattggtgaatcatcacctaatccgacgattgaagaaggtagaactttaagggtcctgaaaatggtggagccatggttgagaggaaatcaattttgtatcaaagttcttaatccgtatatgccgtcagtagttgaaacgctcgaacaaatgcaaaggaaacatgggggaatgttggtgagaaatccattgtcacgcaacagtacgcacgaaatgtattgggtttcatgtggtactgggaacatagtaagtgcagtaaatatgacaagtagaatgctattaaatcgatttaccatggctcatagaaagcctacttatgaacgcgacgttgatctaggagcaggtacccgaaatgtagctgtagaacctgaagttgcaaacctagacataataggacagaggattgaaaacatcaaaaatgaacacaagtccacatggcattatgacgaagataacccatataagacgtgggcatatcatggatcatatgaagtaaaaccaagcggtagtgcgtcgtcaatggttaacggagtggtacgtttgttaaccaaaccgtgggacgtaatccccatggtgacacaaatcgccatgacagacactacgcccttcggacaacaacgtgtctttaaagaaaaagtcgacacaagaacacctaaagctaagaggggaacagctcagattatggaagtgaccgccagatggctctgggggttcctttcacgaaacaagaaaccacgcatctgtacacgagaggaatttacaaggaaggtaagatccaacgctgctatcggggcggtatttattgatgaaaaccaatggaactctgccaaagaagcagttgaggacgaacgattctgggatttagtacatcgagaaagggagctacataaacaagggaaatgtgcaacttgtgtatacaatatgatgggcaaacgtgaaaagaaactaggagagttcggaaaagcaaaaggcagtagagcaatatggtacatgtggttaggcgcgcgatttcttgagttcgaagctctgggatttatgaacgaagatcactggttcagcagggaaaacagtctatcaggagtagaaggagaaggtctacacaaactcggttatattctacgggatataagtaaaatccccggcgggaacatgtacgctgatgatactgctggatgggataccagaattactgaagatgatctacaaaacgaagcaaaaatcaccgatataatggaacccgaacatgcacttctagccacgagtatattcaaattgacttatcaaaacaaagttgtgcgagtccagagaccagcgaaaaatggcacagtaatggatgtaataagtagacgggatcagaggggaagcgggcaggtcggaacttacggactaaacacctttacaaacatggaagcacaactaatacgtcaaatggagagtgaggggatattccttccttcggagctagagactcccaatcttgctgaaagggtattagattggttagaaaaacatggaattgaaagactaaaacggatggctatcagtggagacgactgtgtagtcaagccgatagatgataggttcgcgacggctttaacggccctaaatgatatggggaaggtaagaaaagatatcccccaatgggagccctcaaaaggctggaacgattggcaacaagtacccttttgctcacatcattttcatcagttaattatgaaagacggtcgagaaatcgtagtaccttgcagaaaccaagacgaattagttggtcgagcacgggtatcgcagggagctgggtggtcattaagagagacagcatgtctaggcaaatcttatgcccaaatgtggcaacttatgtactttcacagaagagacctgaggcttgcagcgaatgcaatctgcagtgcagttcctgtcgactgggtacccacaagtcgaacaacttggtcaattcacgctcatcaccaatggatgacaacggaagacatgctaagcgtatggaatagagtttggatcgaggagaacccctggatggaagataaaacacatgttagctcgtgggaagatgtaccatacctcggcaaaagagaagatcaatggtgcggcagcctaataggattgactgccagagcaacatgggcaacaaacattcaagtcgcaataaaccaggtaagaaggctgattggcaacgaaaattacctagattatatgacctcaatgaaacgttttaaaaacgaaaacgatccggaaggtgcattatggtga

SEQ ID NO: 21348 - RNA, 9879 nt, synthetic construct
  misc_feature 1..9879: note = derived and/or modified CDS sequence (opt6) from DENV-1__KF921911__SS-prME
  source 1..9879: mol_type = other RNA
tctgtaacaatgttactgatgctactaccaacggcactagcttttcaccttacgacacgtgggggtgaaccgcatatgatagtaagtaaacaagagcggggaaaatccttactttttaaaacatcagtaggaatcaacatgtgcacactaatagcaatggacctaggtgaactatgtgaagatactatgacatataaatgtccgcgaattacagaggccgagccagatgacgtagactgctggtgtaatgcaacagacacctgggtaacatacggaacatgtagccaaacaggagaacacagaagagacaaaagatctgttgcattagcccctcacgtcggactaggactcgaaacaaggactgaaacctggatgagttcggagggggcttggaaacagattcaaaaagtcgaaacatgggcactacgccacccgggatttacagtaactgcactgtttttggctcatgctattggtacttcgattacacaaaaaggaataatctttatattgttaatgctggtaacaccatcaatggctatgcggtgcgtaggaatcgggaatcgcgattttgttgaagggttatcaggcgccacttgggtcgatgtagtccttgaacacggaagctgtgtaaccaccatggcaaaagacaaaccaacactagatatagaactccttaaaacagaagtaactaatcctgcggtgttaagaaaattatgcatagaagctaaaatatcaaatacaactacggatagccgttgccccactcaaggtgaggcaaccctggtagaagaacaagactctaatttcgtttgcagaagaacatttgtagacagaggatggggaaacggttgtggactttttggaaaaggaagtttattgacatgtgcaaaatttaaatgtgttacaaaactagagggaaaaatagtccagtatgagaatcttaaatattcagtgattgtgacagtgcatacaggagatcaacaccaagtaggaaatgaaaccacggaacacggtaccatcgctacaattactccccaagcaccgacgtcggaaatccaacttactgactatggagcgttaacactggactgttcgcctagaactggcttagattttaatgagatggtacttttaacaatgaaagagaaatcctggttagtacacaagcaatggttcctcgatctcccactaccatggacatcaggagcatctacttctcaggaaacatggaatcgacaggatctacttgtaacgttcaaaacagctcacgcaaagaaacaagaagttgtagtgttaggctcacaagaaggtgctatgcatacagctcttaccggagccactgagattcagacaagtggaaccactaccatatttgcaggacatctaaagtgcagattaaagatggacaaactaacattaaagggtatgtcttatgttatgtgtaccggatccttcaaactggagaaagaagttgccgagactcaacatggtaccgtcctagtccaagttaagtatgaggggaccgacgcaccgtgcaaaattccattttcagcacaagatgaaaagggagtaacacaaaacggccgattaataacagcaaaccccatagttacagataaagaaaaaccagttaacattgaaacagaacctccatttggtgagtcttacattgtaatcggggcaggggagaaggctttaaaactatcatggtttaaaaaggggtcatcaattggaaagatgtttgaagccacagcaagaggagcacggagaatggcgattcttggtgacactgcttgggattttggctccatagggggagtattcacttcagtcggcaaattagttcatcaagttttcggtgctgcctacggagtactttttagtggcgtatcttggactatgaaaattggtatagggattttattaacttggcttggattaaattcgagatcaactagcctctccatgacatgtattgctgttggcatggttactttgtatttaggtgttatggtacaagcagatagcggatgtgttattaattggaagggaagagaattaaaatgcggcagtggaatatttgtgacgaacgaggttcacacctggactgagcaatataaattccaagctgattccccaaaaaggttgagcgcagcgattgggaaagcatgggaggaaggtgtctgtggaataaggagcgctacaagattagaaaatattatgtggaagcaaatatccaatgaactaaatcatatattactcgagaacgacatgaaattcactgtagttgtaggagacgctaatggcatactagctcaaggcaagaaaatgatacgcccccagccaatggagcacaggtactcttggaagtcatggggaaaagcaaaaatcataggtgctgacatacaaaacacaacttttataatagacggacctgatactcccgaatgtcccgatgaccagcgtgcatggaatatatgggaagttgaagactatgggttcgggatattcacaacgaatatatggcttaagttacgggatagttacacgcaaatgtgtgatcatcgcctgatgagtgcagcaatcaaagattcgaaggctgtacatgctgatatgggttactggatcgagtcagagaaaaacgagacctggaagttagctagagcttcgtttatagaagtaaaaacttgtatttggccaaaaagtcacacattgtggagtaatggagttttggagagtgaaatgataatcccaaaaatctatgggggtccaataagtcaacacaactacagaccaggctactttacgcaaacagcgggtccctggcacttaggcaaactagaattagattttgacctgtgcgagggtactactgttgtagtagatgagcattgcgggaacagaggaccatcgcttaggacaactacagtcacaggaaaaataattcacgaatggtgctgtcgatcctgcacactaccacccctacgttttagaggagaagacggatgctggtacggtatggaaattcggccagttaaggaaaaggaagaaaatctggtgaggtccatggtttcggcggggtcaggagaagtcgatagctttagtttagggattctatgcgtcagcataatgattgaggaagtgatgcgttctaggtggaatagaaaaatgttaatgacggggactttagctgtgttcctacttctgatcatgggtcagctcacctggaacgacctaatcaggctgtgtattatggtaggtgcaaatgcaagtgatcgaatgggaatgggcacaacgtacttagcgttaatggctacctttaagatgagaccgatgtttgcggttgggcttttattcaggcgcttgacatctagagaagtcctcctactaacgataggcctgtcactggttgcctctgtagaactaccaaactccttggaggaacttggggatggattagctatgggaatcatgatgttgaagctcctgacagaatttcagccacatcaattgtggactacactgttatccctgactttcattaaaaccaccttatcactagactatgcctggaggacaatggcaatggtattgtcaattgtatctctatttcccctgtgtttatcaacaacatctcagaagacgacttggcttcctgtgttactgggctcttttggttgcaaacctttaactatgttcttaataacggaaaataaaatctggggaagaaagtcttggcctctaaacgaagggataatggcgattgggatagtgtctattttattaagcagcttgctcaaaaatgacgtccctttggcagggcctcttatagctggtggaatgttaatagcctgttatgtaatatctgggagtagcgccgacctctcactagaaaaagcagccgaagtttcctgggaagaagaagcagaacatagtggaacctctcataatatcctagtggaggtacaagatgatgggacaatgaaaatcaaggatgaagaaagagacgatactttaactatactactaaaagcgactcttttagccgtttcaggcgtatatccaatgagcataccagctaccttattcgtatggtacttttggcagaagaaaaagcaaagaagcggcgtactatgggatacgccaagccctccagaggtggaaagagctgtgttagatgacggcatttataggattctacaacgaggtcttctgggcagatcccaggttggcgttggtgtattccaagatggagtctttcacactatgtggcacgttacaagaggagcagtacttatgtatcagggaaagagactagaacccagttgggcctctgtcaagaaagatcttatctcatacggaggagggtggaggtttcagggtagttggaatactggggaagaagttcaagtcatcgcagtagaaccaggcaaaaatcccaaaaacgtacagaccacgcctggaacttttaaaactccggaaggagaagtaggtgctattgccctagattttaaacctgggacttcaggaagcccgattgtaaatagggaaggtaaaatagtcagcttatacgggaacggcgttgttacgacgagcggaacctatgtaagtgctatagcgcaggcaaaaacaagtcaagaaggaccactccccgaaattgaggatgaggtattcaagaaaagaaatttaacgatcatggatttgcatccaggatcaggtaaaacccgaagatatttgccagcgatagtacgagaagccatcaaaagaaaattgcgcacgctcatattggcaccgacaagagtagtagcatcggaaatggctgaagcacttaaaggtatgccaataagatatcaaacaacagcggttaaatctgaacatactggcagagagatagttgatttaatgtgtcacgcaacattcacaatgaggctgctttcaccagtgcgtgttccaaactacaacatgataataatggatgaggcacacttcactgaccctgcgagtatagcggcaagaggttatatatcaacacgagttggcatgggtgaagccgcagctatttttatgactgcaactccccctggatccgtggaggcattcccgcaatcaaatgcggtcatacaagatgaggaaagagacataccagagcggtcctggaatagtgggtatgactggataactgattttccaggaaagactgtttggtttgtaccaagtatcaagagtggaaacgacatagctaactgtcttaggaaaaacggaaaaagggtaatacaactttcacgtaaaaccttcgacactgaataccaaaagactaaaaacaacgactgggattacgtggttacgacagacatttccgaaatgggggctaacttcagggccgatagagtcatagacccccggagatgcctaaaaccagtaattctaaaagatggacccgaaagagtgatattggcaggacctatgccagtaacggtagcctcggctgcacagagacgtgggcgaattgggagaaaccaaaataaagagggtgatcaatacgtttatatgggtcaacccctaaataatgacgaagaccacgcacattggactgaagctaaaatgctactcgacaacattaacactcccgaaggaataattcctgcactgtttgaaccagagagagaaaaatctgcagccatagatggagaatatcgacttcgaggtgaggcgcgcaaaacctttgttgaattgatgagacgaggcgacctacctgtgtggctttcctataaggtggcctctgaaggcttccaatacagtgatagaagatggtgtttcgatggcgaaagaaataaccaggttcttgaagaaaacatggatgtagaaatatggacaaaggaaggcgagagaaagaaactgcgaccgcgctggttagacgctagaacttattcggatcccctagccttacgagaatttaaagagttcgctgcaggaagaagatctgtatccggtgatttgattctagaaattgggaaactacctcaacacctcacgttaagggcacaaaatgcgctagacaacctggtaatgttacataattcagaacaaggtggtaaagcgtacagacatgcaatggaagaacttccagatacaatcgaaactttaatgctgttggcactgatcgcggtactgacgggcggggtcacactattctttttatccggaaaaggattgggaaagacatcaataggtttactctgcgtaatggcttcaagcgcacttctttggatggcaaatgttgaacctcattggatagcagcaagtataattctggaatttttcttaatggtactactgattccagaaccggacagacaaagaacaccacaagataatcaattagcatatgtagttataggtctactttttatgattttaacagtagctgctaatgaaatgggtctgttagaaacgaccaagaaagacttaggcataggacatgttgcagcagaaaatcaacaccatgcgacaatgctcgacgtagatttaagacccgcatctgcgtggactctctacgcagtggcaacgacagtaataacgccaatgatgagacatacaattgaaaatacaacagccaacattagcttaacagctattgcaaatcaggcggcaattctaatggggttggataaaggctggcccataagtaaaatggatataggcgtaccattactcgccttaggctgctacagccaagttaatcctctcaccctaactgccgcagttcttatgttagtagcacattacgctataattggtccaggactccaagctaaagctacgagagaagcacagaaaaggacggctgcaggaatcatgaaaaatccgacagttgacggtatcgtagctattgacttagacccggtagtgtatgatgcaaaatttgagaagcaattaggacaaattatgctactaattctatgcaccagtcaaatcctattaatgagaacaacatgggcactctgtgaaagtatcacattagctactgggccactaaccactctatgggaaggttcaccaggaaaattctggaacacgactattgccgtgagtatggccaatatatttcgaggttcatatctagccggtgcaggcctagcgttttcactcatgaaaagtcttggaggaggacggagagggacaggagcgcaaggcgaaactcttggggaaaagtggaaaagacagttgaatcaactgagcaaatcagaatttaatacctataaacgctctggtatcatggaggttgatagaagcgaggctaaagagggccttaaaaggggtgagacaacaaaacatgctgtatcacgggggaccgctaaactacgatggtttgtagaaagaaatttagtaaaacctgagggaaaagtaatagatttaggttgtggaagaggagggtggagttactattgcgcgggattgaagaaagtaaccgaggtaaagggttacactaaaggaggaccgggacacgaagaaccaatacctatggccacctacggatggaacttagtaaagttgtatagtggtaaagacgtgttctttacccctcctgagaaatgtgatacattgttgtgtgatataggggaaagctcaccgaatccaacgatcgaggaaggcagaacactaagggtactcaagatggtcgagccatggttacggggtaatcaattctgtatcaaaatattgaatccctatatgccatccgtagtagaaacactggagcaaatgcaaagaaagcatggaggcatgcttgttcgaaatcccttgagtagaaattcaacacatgaaatgtattgggtgtcgtgtggaactggaaacattgtttctgctgttaacatgacatcccgtatgctgttaaatcgattcactatggcacatcgaaaaccaacgtacgaacgagacgtggaccttggggcgggcactagacatgttgctgtcgagcctgaagttgctaatctagatataatcgggcaaagaattgaaaacattaagaatgaacacaaatcaacctggcattacgatgaagataacccatataaaacgtgggcatatcacgggagctacgaagtcaaaccctcaggttccgcatcgtctatggttaatggtgtagtccgtttactaacaaagccttgggacgttatacctatggtaacccagattgctatgacagatacgactccatttggtcaacagagagtatttaaagaaaaggttgatactcgaacaccacgcgcgaagcgtggaaccgcacaaataatggaagtcactgcaaaatggctctggggatttttaagtcgaaataagaaacccaggatatgtacaagggaagaatttacacgtaaagtacgaagcaacgcagccattggagccgtgtttgttgacgaaaaccagtggaacagtgcaaaagaagcagtggaagacgagaggttttgggacctagtctatagagaacgtgaattacacaaacaaggaaaatgtgcaacgtgcgtatacaatatgatgggaaaaagggagaagaaacttggagaatttggaaaagctaaaggtagtagagcaatttggtacatgtggttaggtgcgaggtttctagaatttgaagcactaggattcatgaatgaagaccattggtttagcagagaaaactcattttcaggagttgaaggggaaggccttcacaaactagggtatatactaagggacatcagtaaaatcccaggtgggaatatgtacgcagacgacacagcagggtgggacacaagaataacagaagacgacctacagaacgaagcaaaaattactgatattatggaacccgaacatgctttacttgccacgagcatttttaagctgacttatcaaaacaaagtagtacgagtacagaggccagcaaagaatgggacagttatggacgtaataagcagaagggaccaaagaggaagtggccaagtcggcacatacggtcttaacacttttactaacatggaagtccagttaattaggcagatggaaagtgaaggcattttcctaccaagcgagctagaaacccctaacttagcggaacgtgtactggattggttagagaaacatggtaccgaacgcttgaaaagaatggccatttccggagacgactgcgtggtcaaacccgtagatgatcgatttgctaccgctttaatagcgttaaatgatatgggcaaggtaagaaaagatatcccacaatgggaaccgtccaaaggttggaatgattggcaacaagtgccattttgctcccatcactttcatcaactgataatgaaagacgggcgagagatagtagttccatgtagaaatcaagatgagcttgtaggtcgagccagggtatctcaaggagcaggatggtcactgagagagactgcttgcttaggcaagtcctacgcacaaatgtggcaactaatgtacttccatcgcagagatctcagactcgcagcgaacgcgatctgcagtgcagtaccggtagattgggttcccacctcgagaactacatggagtattcatgcacaccaccagtggatgaccacagaagatatgctctcagtttggaatcgtgtgtggattgaagaaaatccatggatggaagacaagacacatgtaagcagctgggaggaagtaccatatttaggtaaaagggaggatcagtggtgtggcagtcttattgggctaacagcacgtgcgacctgggctacgaatatacaggttgccatcaatcaagtacgaagattaataggtaatgaaaattatctagattatatgacatccatgaagagattcaaaaatgaatctgaccctgaaggagcactgtggtag

SEQ ID NO: 21349 - RNA, 9879 nt, synthetic construct
  misc_feature 1..9879: note = derived and/or modified CDS sequence (opt6) from DENV-1__KJ189350__SS-prME
  source 1..9879: mol_type = other RNA
tcagtaacaatgttgttaatgctcctgccgacggcgttagcgtttcacttgaccacaagaggtggagaacctcacatgatagtaagcaaacaagaacgaggaaagagcttattgtttaaaacgtctgctggggtcaatatgtgcactctaatagcaatggacttaggtgaactgtgtgaggatacaatgacttataaatgcccgcggataactgaggcagaaccggacgatgtggattgctggtgtaatgccacagatacatgggtaacgtatgggacatgttcccaaaacggagaacaccggcgagagaaaagaagtgtagcactagctccccatgttggacttggcttggaaaccagaactgaaacatggatgtcatctgaaggagcttggaaacaaatacaacgtgtagagacatgggcgttaaggcatccgggttttacagttattgcatttttcctagcacatgctattggcacaagtataacacaaaaaggaataatattcattctactaatgcttgtaacaccaagtatggccatgcgatgcgtgggaattggaaatagagatttcgttgaagggttaagcggcgcgacatgggttgacgtggtactcgaacacggttcatgcgtcactacaatggctaaaaacaaacctactctcgatatcgaactattgaaaaccgaagttacaaatcctgcagtattaagaaaattatgtattgaagctaaaatatcaaatactacaacagatagccgctgcccaacacaaggtgaagcaaccttagtagaagaacaagacgctaattttgtatgccgtcgaacattcgtagatagaggttgggggaacggctgcggactcttcggaaaaggaagtttacttacctgtgcaaaattcaagtgtgtcactaaattggagggcaaaatcgttcaatatgagaacttaaaatatagcgtaatcgtaacagtgcatactggtgaccaacatcaagtcggaaatgaaacaacggaacatgggactatcgctacgattacccctcaagccccaacttctgaaatacaattgacagactatggcgcacttacactggattgttcacctaggacaggacttgattttaatgaaatggtactactaactatgaaagagaaaagttggttagtacataaacagtggtttctagacctacccttaccatggaccagtggggcctctacatctcaggaaacatggaatagacaagacttattggtaacgttcaaaacagcacatgcgaagaaacaagaggtagtagtactaggtagtcaagaaggagcaatgcatactgctttaacaggtgctacggaaatacaaacatctggaactactacaatctttgctggacacttaaaatgcaggcttaaaatggataaattgacgttaaaaggaatgagctatgtgatgtgcacaggttcttttaaacttgagaaagaagtagctgagactcaacatgggactgttcttgttcaagtgaaatacgaaggaacggatgcaccttgcaaaataccgttcagtacgcaagacgaaaaaggagtaacgcaaaacggaagattaatcactgccaatcccattgttactgacaaagagaaaccagtcaacatcgaaactgaaccgcccttcggtgaatcttatatcgttgtaggagccggcgaaaaggctttgaagttgagttggtttaaacggggctcatcaatagggaaaatgtttgaagctactgcaagaggagcacggagaatggcaattttaggtgatacagcatgggacttcggaagtatagggggagttttcacatcggttggaaagctcgttcaccaaatatttggaactgcatatggggttctttttagcggcgtgtcgtggacaatgaaaataggaataggaatattactaacatggttaggcctcaattcaagatcgacatctctaagcatgacctgcatagcggtaggcatggtaacactttatctcggcgtaatggtacaggctgacagcggatgtgttataaattggaaaggccgagaactgaagtgcggatccggtatattcgttacaaatgaggtacatacctggacagaacaatataaatttcaagccgattctcccaaacggttgtcggcagcaatcgggaaagcatgggaagagggagtgtgcggtataaggtctgccactcgtcttgaaaatataatgtggaaacaaatctcaaacgaacttaaccatatattgctagaaaatgacatgaaatttacagttgtagttggcgatgcgaacgggatacttgctcaaggaaagaaaatgatccgaccacaaccaatggaacataaatactcgtggaaatcttggggtaaggcgaaaataataggagcggatatacaaaatacgacattcataatagacggcccagatacacctgagtgtccagacggccaaagagcctggaatatctgggaagtagaagactatggctttggagtgtttactaccaatatatggctaaagttgcgggattcttatacacaaatgtgtgaccacagactaatgtcggcggctataaaagacagcaaagcagtccacgcagatatgggttattggatcgaatcggaaaagaacgagacttggaaattagcgagggcaagttttatcgaagtgaaaacttgcacatggcccaaatctcatacactatggtctaacggggtgctagagtcagagatgatcataccgaaaatctatggtggcccaatatctcaacataattatcgtccaggttatttcacacaaactgcggggccctggcatttggggaaattggaactggacttcgacctttgcgaaggcacaacggttgtagttgatgagcattgtgggaataggggcccttctcttcgtacaactactgtaacagggaagataatacatgaatggtgttgcagatcatgtaccctgcccccgttgagatttcgcggtgaagatggatgttggtatggaatggagataagaccggttaaagagaaagaggagaacttagtcagaagtatggtatcagcaggtagtggagaagttgactcttttagcttaggcatcctatgtgtatctataatgatagaagaagttatgagaagcagatggagtcgaaaaatgttaatgactggtacattagcggtttttcttctgttgataatgggccaactgacatggaacgatctcatacgattgtgcataatggtcggagccaatgcttcagaccgaatgggcatgggaacgacttatctagcattaatggcaacatttaagatgcgaccaatgtttgcagtagggctgttattccggcgtttaacttcacgtgaagttcttttattaactatcggcctatcacttgtagctagcgttgagttgccaaattcgctagaagaattgggagatgggttagctatgggaataatgatgctaaaactcttgacggaatttcagcctcatcaattgtggacgacccttttgtccctaacctttgttaagactacgttgagcctggattacgcttggaaaactaccgctatggcactatctatagttagtctgtttcctctctgtctatctacaacatctcaaaagactacgtggctaccagtactactcggttcctttggatgcaaacccctaacaatgtttctgataaccgaaaacaaaatttggggacggaaatcttggcctctgaatgaaggaataatggccataggtatagtttccatcttattatcaagtttgttgaagaatgacgtacccctagcaggacctcttatagctggaggaatgcttatagcttgctacgttattagcggaagtagcgcagatttgagtttagaaaaagcagcagaagtgagttgggagcaggaggcagaacattctggtgcatcacatagtatcttggtagaggtacaggacgacggaaccatgaagataaaggacgaagagagggatgataccttaaccatactgctaaaggcaacattactagccgtttcaggtgtataccctatgtcaattcccgccacgttatttgtttggtacttttggcaaaagaagaaacaacgttccggagttttgtgggatactccttctcccccagaagtagagagagcggtattagacaacggaatttaccgcatattacaaagaggactattgggtcgaagtcaagtcggcgttggagtcttccaggatggagtatttcatacaatgtggcacgttacaagaggagctgtactgatgtaccaaggaaaacgcctagaaccttcatgggcaagcgtcaaaaaggacttaatttcgtatggcgggggttggcgttttcagggctcctggaatacaggtgaggaagttcaagttatagcagttgaacctggtaaaaatcccaaaaatgtgcaaacgacaccaggaactttcaaaacacctgaaggagaagttggcgcaatagcactggactttaaacccggaacaagcggttcaccgatcgtcaatcgtgagggcaagattgtcggtttgtatggtaacggagtagtaacgacatcagggacttatgtttcggcaattgcacaagctaaagcctctcaagaaggacccttacccgaaattgaagatgaagttttcaagaaaagaaatctcacaataatggatctacatcctggcagtggcaagacgcgcagatatcttccagctatagttagagaagcgattaaacggaaattaagaacgctcattctcgcaccaacaagagtggtagcttcagagatggcggaagcacttaagggcatgcctatcagataccaaacaacagccgttaaatcagaacacactggccgagaaatagtagatctcatgtgtcatgctacctttactatgagattgctatcaccggttcgggtcccaaattataatatgataatcatggacgaagcgcactttaccgatcctgcatctatagctgcgagaggctatatctctacacgagtcggtatgggagaagctgcagcaatctttatgacagcaactcccccgggatctgttgaggcttttccacaatcgaatgcggtgatccaggacgaagaaagggatatacctgaaaggtcttggaatagtggctacgactggatcaccgatttcccagggaagaccgtgtggtttgttccatcgataaaatccggtaatgacattgcaaattgtttgaggaaaaatgggaagcgagtaatacagttgtctcggaagactttcgacaccgagtatcagaaaacgaaaaacaacgattgggattacgttgttacaaccgacattagcgaaatgggcgctaatttcagggcagacagggtaatcgatccgcgtagatgtttaaaaccagtgattcttaaagatggaccagaaagagtgattctcgccggccccatgccggtcaccgctgcctccgctgcacagagacggggtagaataggaagaaaccaaaataaagaaggagaccaatacgtgtatatgggtcaaccgcttaacaatgacgaggaccacgcacactggaccgaggctaagatgttattagataatataaatacacccgaaggtatcatcccggctctgttcgagccggaacgggagaaatccgcagcgatagacggagaatatcgtcttaggggagaagcacgcaaaacgtttgtggaattaatgagaagaggagatcttccagtatggttgagctataaagtagcttcagagggctttcaatattctgatagaagatggtgttttgacggcgagcgtaacaatcaagttcttgaagagaatatggatgtagaaatctggactaaagaaggagaacgtaagaaactgagacctcgatggctagacgcacgcacctactcagatccgcttgctcttagagaatttaaagaatttgccgcgggtcgaagaagtgtgtcaggcgatctaatacttgaaatagggaagctaccacagcacctaactctacgggctcaaaacgctctagataacttagtaatgctacataattcagaacaaggaggtaaggcatacagacatgccatggaggaattaccagacacaatagaaacgctgatgctgctagctctgattgcggtattgaccggcggtgtaacattgtttttcctcagcggtaagggccttggaaagacctcaattggattgttatgcgtaacggcttcttctgcgcttctttggatggcttcggtggagcctcactggatcgcggcttcgataatactagagttcttcctcatggtactgttaattcccgaaccagacagacaacgcacccctcaggacaatcaacttgcctacgtagttatcggcttactcttcatgatcctgacggtcgcggcaaacgaaatgggactgttggaaacgactaagaaagatcttgggataggttatgttgcggctgaaaaccatcaacacgcaactatgttggatgtggacttacatcccgctagcgcatggactctttatgccgtagcaaccacagtgattacaccgatgatgcgccacactatcgaaaataccacagccaacatatctctcacagcaatagctaaccaagctgcaatcctcatgggtctagataaaggatggccgattagcaagatggacattggcgtaccgttacttgcactgggttgttattcacaagtcaatccactaactctaacagctgccgtcctgatgctcgttgcccattatgcaataataggacctggactacaagcgaaagcaacgcgagaagcgcagaaaaggacagcagcaggcatcatgaaaaatcccacagtagacggaatagtagccattgatctagatcccgtcgtatatgacgcaaaatttgaaaagcaactgggacagattatgctacttatactatgtacttctcaaatcctcctaatgcggacaacctgggcactatgtgaatcgataaccctagcgacgggacctttgactactttatgggaaggttcaccagggaaattttggaatactactatagcagttagcatggcaaatatatttcgaggaagttatcttgcgggagcgggacttgcgttttctttaatgaaatccttaggtggtggtaggcgaggaactggtgcacagggggaaacgctgggggaaaaatggaaaagacagcttaatcaattatcaaaatcggagttcaatacatacaaaagatccggaatcatggaggtagatagatcagaagcaaaagaaggacttaaacgaggggagacaactaagcatgctgtttccagaggcacagccaaattaagatggttcgtagaaagaaatctcgtgaaaccagaaggcaaagtcatagacctcggctgcggacgaggaggatggtcatattattgtgctggactaaagaaagtaacggaagtaaaagggtacacaaagggaggacctgggcatgaagaaccgataccaatggccacttatggttggaatttggttaagctacatagcggaaaggatgtcttcttcatgccaccagaaaaatgtgatacattactttgtgacattggagaaagcagtccgaatccaacgatcgaagaaggtagaactcttagggtccttaagatggtcgaaccttggcttagaggcaaccaattttgcattaaaattctaaatccttatatgccgagcgtggtggaaaccttagagagaatgcaaagaaaacatggaggaatgctggtgaggaacccattgagccgcaacagcacacacgaaatgtactgggtctcttgtgggacaggaaacatcgtaagtgctgtaaacatgacatcaaggatgttattgaataggtttacgatggctcatagaaaaccaacttacgagagagatgtagacttgggggctgggaccagacacgttgctgtagagccagaagtcgcaaatttagatattattgggcaaagaatagaaaatatcaaaaatgaacacaagtcgacatggcactatgacgaagataacccatacaaaacatgggcgtatcatggtagttatgaagtaaaaccgagcggaagtgcctcttcgatggtcaatggagtggtaagactacttacaaaaccatgggacgttatacctatggtcacacaaatagcaatgactgacactacaccattcggccaacaaagagtattcaaagagaaagtcgatacacggacgccacgggcaaaaagaggtaccacccaaataatggaggttacagctaaatggttatggggattcttatccagaaataaaaagccaagaatatgcacacgagaagagttcacacggaaagtaagaagcaacgcagcgattggtgcggtttttgtagacgaaaaccaatggaatagcgcaaaagaagcagtcgaagatgagagattctgggacctggtacaccgagagagagaacttcataaacaaggtaaatgcgcaacgtgcgtatataacatgatgggtaaacgcgagaagaaactgggagaatttgggaaagcaaaaggtagtcgagctatttggtatatgtggttaggtgcaagattcttggagtttgaggccctaggtttcatgaatgaagatcactggttttcacgagaaaatagtttaagtggagtagaaggggaaggacttcataaactaggttatattttgagagatataagcaagataccaggaggaaatatgtatgcagacgataccgcaggatgggatacaagagtcactgaagatgatttacaaaacgaagccaagataactgatataatggaacctgaacacgctttgcttgccacaagtattttcaaacttacctaccagaataaggtcgtgagagtgcaacgcccagccaaaaatggtactgtaatggatgttatatctcgacgtgatcaacgtggttcaggacaagttggcacatatggtttaaatacattcaccaatatggaagttcaactcatacgtcaaatggaatcggaaggcatctttttgccaagtgaattagaaacgccaaatttagcagaacgagcgcttgattggttagaaaaacacggtgcagagagattaaaacggatggctatatctggcgacgactgcgtcgtcaaaccaatcgatgatagatttgccactgcattaacggcattaaatgacatgggcaaagtcagaaaggacatacctcagtgggaaccaagtaaaggatggaatgactggcaacaagtaccattctgtagccaccatttccatcaattaataatgaaggatggacgtgaaatagtagttccctgcagaaatcaagatgaattagtaggtagagcccgtgtaagtcagggtgctggttggagcttaagggagacggcctgcctaggaaaaagctatgcacaaatgtggcaacttatgtactttcatagacgagatcttagattggcagctaacgctatatgcagcgctgttccggttgattgggttccaacctctcgcacaacatggagtatacacgctcaccaccaatggatgacaacagaagatatgctgtccgtttggaatcgagtctggatagaagaaaatccatggatggaaaataaaactcatgtatcatcatgggaagaggtgccatatttaggaaaaagggaagatcagtggtgcggttccctcattggtctaacggctagagcaacatgggctactaacatacaagttgccataaatcaggtgcgaagattgattggaaatgaaaactatttagactatatgacaagtatgaagaggtttaaaaacgaaagcgactcggaaggtgcgttgtggtag

SEQ ID NO: 21350 - RNA, 9879 nt, synthetic construct
  misc_feature 1..9879: note = derived and/or modified CDS sequence (opt6) from DENV-1__KJ189351__SS-prME
  source 1..9879: mol_type = other RNA
agtgtcactatgctattaatgcttcttcctacagtactagcgtttcacttgaccactaggggtggggaacctcacatgattgtatctaaacaagaaagaggtaaatctttattatttaaaacttcagcgggagttaatatgtgtacactaatcgcaatggacttaggagaattatgcgaagacacaatgacttacaaatgtcccaggatcactgaagccgaaccggacgatgtagattgctggtgcaacgcgacggacacatgggtaacttacggaacatgcagtcaaacgggagaacataggagggagaaaaggtcagtcgctctagcaccacatgtaggtttgggccttgaaacaagaactgaaacatggatgtcttcggaaggggcgtggaaacaaatccaacgagtagaaacatgggcacttcgacaccctgggtttacagtaattgcatttttcctagcacatgccattggaacaagcattacacaaaaaggaattatatttattctactcatgctagtaactccttctatggctatgcggtgcgtagggataggaaatagagactttgtagaaggccttagtggtgcaacatgggtagacgtggtacttgaacacggttcatgcgtgacaactatggctaaaaataaaccaacactggatatagaactactaaaaacggaagtaaccaatccagcggtattacggaaattatgtatagaagctaaaattagcaatacaactactgacagcagatgtccaactcaaggggaagcaactcttgtcgaagaacaagatgcaaattttgtttgtagacgtaccttcgtagatagaggttggggcaatggttgtggactcttcgggaagggatcactcttaacctgtgcgaaattcaagtgtgtaaccaaattagaaggaaaaatagtacagtatgagaacctaaaatatagcgttatagttacggtacatacgggcgaccaacatcaagtaggcaacgaaacaacagaacatggaaccatcgcaacaataactccccaagcacctacgtcggaaatacaattaacagattatggtgctctaacgctagactgttctccgagaacaggattagacttcaatgagatggtgttactaacaatgaaagagaaatcctggctagtacataaacaatggttcttagatctaccgcttccctggacaccgggcgcgtcaacaagccaagaaacatggaataggcaagacctgttggttacatttaaaaccgctcatgctaagaagcaagaggttgtagtcttgggcagtcaagaaggcgccatgcatacagcattaaccggagcaacagaaatacaaacttcaggtaccacaacaattttcgcagggcatttaaaatgcagacttaaaatggacaagctcacgttaaaaggaatgtcatacgtcatgtgcacgggatcatttaagttagaaaaagaagtagctgaaacacaacacggaacagtgttagtccaagtgaaatacgagggaaccgatgccccgtgtaaaatcccatttagcacgcaagacgaaaaaggagtcacgcaaaacggccgattaataacagctaatccaattgtcacagacaaagaaaagcccgtaaacattgaaacggaaccaccctttggtgagtcctatatagtagtaggtgcgggggagaaagcattaaaattaagctggttcaaacgtggatcctccatcggaaaaatgtttgaagcaacagcaagaggcgctagacgaatggctattttgggcgatacggcatgggattttggatcaattggtggagtgtttacatcagtggggaagttggtacaccaagtatttggaactgcatacggtgtactatttagcggagtatcctggacaatgaaaatagggataggaatactgcttacgtggctaggactcaatagcagatctacctcactctccatgacttgtattgctgtaggtatggtaacactttatctgggagtaatggtccaagccgatagtgggtgtgtcattaattggaaaggaagggagctaaaatgtggaagcggcattttcgttactaatgaagtacatacctggacagaacaatataaatttcaggctgactcacctaaacgcttaagcgccgctataggcaaggcatgggaagaaggcgtatgtggcataagaagtgcaacaagactagaaaacataatgtggaaacaaatttctaacgaattaaatcatatattgttagaaaatgacatgaaatttacagttgtagtaggcgatgctaacggtatactcgcacagggtaaaaagatgataaggccccaaccaatggaacataaatattcgtggaaaagttggggcaaggccaaaataataggagctgatatccaaaacactaccttcataatagacgggccagatacacccgagtgtcctgacggacaacgtgcttggaacatatgggaagtggaagactatggatttggagtattcacaacaaatatttggttaaaactgcgagattcatatacccaaatgtgtgaccacaggcttatgtctgctgcaatcaaggatagcaaagctgttcatgccgatatgggttattggatagaatcagagaaaaatgaaacatggaaattggcccgagcctcatttatagaagtcaaaacatgcacttggcctaaatcccatactctttggtctaatggggtattagaaagtgaaatgattataccaaaaatctacggtgggccgatatcgcaacacaattacagacccggctactttacacagacagcaggcccatggcatctcggaaagttagaactagacttcgatctatgtgagggaacaacggtggtcgtagatgaacattgcggtaatagggggccatccttgcgtactaccactgttacaggcaaaatcatccatgagtggtgctgccggagttgcacgctaccaccgttaagatttaggggcgaagacggttgttggtacggaatggaaataagaccagtgaaggagaaggaagaaaacctggtacggagcatggtctcagcaggtagtggtgaagtcgattcgttctcgctaggcatcctatgtgtatccataatgatagaagaagtaatgcggtcacgttggtcaaggaagatgttgatgaccggaacacttgctgtatttctacttttaattatggggcaattgacctggaacgatctcacacgactgtgcatcatggtaggtgctaatgcgtctgatcgaatgggaatgggaactacatatcttgctttaatggcgactttcaaaatgcggccaatgttcgcggtaggactactattccgacgattaaccagtagagaggtgcttctcttaaccattggtttgtctctagttgcctcagtagaactgcccaatagcctcgaagaactaggtgatggactcgcaatgggaattatgatgttgaagttgttgacggagtttcaacctcaccaattatggactacattacttagtttaacgtttgttaagacaacgttatcgttagattatgcatggaaaactacagctatggcactaagcattgtgtctctattccccttatgcttatcaacaaccagtcagaaaaccacatggttaccggttctactcggcagttttgggtgtaagcctttaacgatgttcctgattgcggagaacaggatatggggccgaaaatcgtggcctcttaatgaaggtataatggccattggtatagtaagtatcctcttaagttctttgctcaaaaatgatgttccactagctgggcctctaatagctggtgggatgttaattgcttgttatgtgatatctggttcttcagcagacctgagcctagaaaaggccgcagaggtgtcttgggaacaggaagcagaacattctggtgcatcacactccatattggttgaagtacaggacgacgggacaatgaaaattaaagatgaagaaagagacgacacgttgacaattttattgaaagcgacactgctcgctgtgtcaggagtgtacccaatgagtattcccgccacactctttgtatggtacttttggcagaagaagaaacagagatccggcgttctctgggatacgccaagtccaccagaagtggaacgcgcagtgctcgacaatggaatatatagaatcttacagaggggccttttgggacgatcccaagtaggcgtcggcgtatttcaggatggagtgtttcatactatgtggcatgtaactagaggtgcagttttaatgtatcaaggaaaaagattagaaccctcgtgggctagtgtgaagaaagatttaattagttacggtggcggatggcgctttcaaggatcttggaatacaggtgaggaagttcaagtcatagctgtcgagccggggaaaaaccccaaaaacgttcaaactacaccgggcacattcaaaacgcctgaaggggaggtcggagcgattgcgctcgatttcaaacctggaacttctggaagcccaattgtcaacagggaaggaaaaattgttggtttatacgggaacggggtggtaacgacgtcaggaacttacgtttcagccattgcccaggcgaaggcttcgcaagaaggaccattaccagagatagaagatgaagtatttaagaaacgtaatttaaccattatggatctgcacccagggagcgggaaaactagacgttacttaccagctattgttagagaagctattaagagaaaacttagaacactaatactagctccaacccgagtcgttgcctcagaaatggccgaggctcttaaaggaatgccgattcggtatcaaacaactgccgtaaagtcagaacatactggccgtgaaatagtggatctaatgtgtcatgcaacttttacaatgagactgctaagtcctgtccgcgtaccaaattacaatatgataataatggatgaagcccatttcaccgaccctgcttcaattgcagctaggggatacataagtacgagagtaggaatgggagaagcagccgctatattcatgacggcaacccctcctggatcggtagaagcatttccccaaagtaatgctgtgattcaggatgaagaacgagacatacctgagcggagctggaactcgggttacgactggataacagatttcccgggtaaaacagtatggttcgtaccatcgataaaaagtggtaacgatatagctaactgtcttaggaaaaacgggaaacgagtcatacaattaagtcggaagacgttcgatacagagtatcagaaaacgaaaaataacgattgggattacgttgtaactactgacatatccgaaatgggagcaaattttcgcgcggatagagtcatagatccaagacgctgtctaaaacctgtaattctaaaagatggccccgaaagagtgatcctagcaggaccgatgccagttacagtagcttctgccgcacaaaggaggggacgaatcggcaggaatcagaataaagagggtgatcagtacgtatatatgggacaaccactgaataatgacgaggaccacgcacattggacagaggcaaaaatgctacttgataacataaacacaccagaaggtattataccagcactatttgagcctgaacgcgaaaaatctgcagcaatagacggcgagtacagattaaggggtgaagcgcgcaagacctttgttgaattaatgcgaagaggcgacctcccggtatggttatcttataaggtagccagtgagggattccaatactctgatcgaagatggtgttttgacggagagcgtaacaatcaagtacttgaggaaaacatggacgtggaaatctggacaaaagaaggagaaagaaagaagctgagaccaagatggcttgacgcgagaacttacagcgatccattagcactacgggagtttaaagaatttgccgctgggaggagaagtgtgagcggagacttaatattggagatagggaaattaccacaacacctcacattaagagcacaaaatgcactcgacaatttggttatgttgcataattccgaacagggtggtaaagcgtacaggcatgcgatggaggaacttcccgacacaatagagacattaatgttacttgcgttaatagcagtacttacaggaggcgtaacactcttctttctatcgggaaaagggctcggtaagacgtcaatagggttgctatgcgtaacagcgtcaagtgcactgctatggatggcatccgtagaaccccactggatagctgcaagcataattctggagttcttcttgatggtactactaatacccgaaccggaccgacaaagaacaccacaagataatcaattagcatatgtcgtaatcggcttattattcatgattttgacagtcgccgcaaatgaaatgggacttctagagacgacaaagaaagatttaggcataggctatgtcgctgctgaaaatcatcagcacgctactatgttagatgtagatctgcacccagcatcagcatggaccctatatgcggtagctacgacagttataacacctatgatgcgacataccatagaaaataccactgcgaatatcagcctcacggcaatagctaatcaagcagcgatcttaatgggcttggacaaaggttggccaatatcaaaaatggacataggagtaccattattggctttgggatgctattcccaagtaaacccgttgactctaacggccgctgtcctaatgttagtagcacactatgccataataggtccaggattacaagcaaaagcaacacgagaagctcaaaagaggacagcggcaggaattatgaaaaatcccacggttgacggcattgtagccattgatttggatcccgtagtatatgatgctaaatttgaaaagcaactaggtcaaattatgttattgatactctgcacaagtcaaattctcctcatgagaactacttgggcattatgtgaaagcataacattggctacaggaccactgacgacactttgggagggatcacccgggaaattttggaacacaaccatagcagtttcaatggcgaacatctttagaggcagctatctagctggtgccggactagcctttagcttaatgaagtcattgggagggggcagaaggggaacaggagcacaaggcgagactctgggagaaaaatggaagaggcaactaaaccaactatcaaaaagtgaatttaacatatacaaaagatctggaattatggaagttgacagatcagaggcgaaagaaggtctgaaaagaggagaaacaacaaaacatgcagttagccgaggaacagcaaaattacgatggtttgtagaaagaaatttagtaaaaccagagggaaaggttatagacctaggatgtggcaggggtggatggtcatactactgtgcggggctaaagaaagtaacggaggtaaaaggttacaccaaagggggaccagggcatgaggaacctataccaatggcgacttatggttggaatctcgtaaaactgcattcgggcaaggacgtatttttcatgccaccggaaaaatgcgatacactattatgcgatatcggcgaatcaagtccaaatccaacaatcgaagaagggagaacattacgagttctaaaaatggttgaaccatggttaaggggaaaccaattttgtgttaaaatacttaatccctatatgccttctgtcgtagagacgctagagaggatgcaacggaaacacggaggcatgcttgtacgcaatccgctctcccgaaattccacacatgagatgtattgggtatcgtgtggtaccggaaatatagtgtccgccgtaaacatgacctctagaatgctcctgaatagatttacaatggctcacagaaaacctacctatgagagagatgtcgatcttggagctggaacccgacacgtcgcagttgaaccggaagttgcaaacctagatatcataggtcaaagaatagaaaacattaaaaatgaacacaaaagcacgtggcactacgatgaggacaacccttataagacctgggcctaccatggatcttatgaagtaaaatcaagtggttcggcaagctccatggttaatggagtagtgaggttgttaacaaagccatgggatgttataccgatggtaactcaaattgctatgacggacacaacaccattcggtcaacaaagagtattcaaagaaaaggtagacactaggactcctagggccaaaagaggtacgacccaaattatggaagtcactgcaaaatggttatgggggtttttgtctcgtaacaagaaaccccggatttgtacacgagaagaatttactcgtaaagtcaggagcaatgctgccataggagcagtatttgtcgatgagaaccagtggaactcagcaaaagaagcagtcgaagatgaaaggttttgggatttagtgcatagggaacgagagctccacaaacaaggaaagtgtgctacctgtgtgtataatatgatgggaaagcgtgagaagaaattgggagaatttggaaaagctaagggaagtagggccatatggtacatgtggctaggtgcaagatttttagaatttgaggctttgggcttcatgaatgaagaccactggttttcaagggaaaacagcttaagcggagtagagggtgaaggactgcacaaactgggatatatcttaagagatattagtaagattccaggagggaacatgtatgcagacgatacggccggctgggatactcggattacagaagatgatttgcaaaatgaggctaagataacggacataatggaaccagaacatgccttactagcaacatcaatctttaaattgacatatcaaaacaaagtggtgcgcgtccaaaggcctgctaagaacggtactgtcatggatgtcatttcaaggagagaccaaagaggatccggacaagttggaacgtacggattgaatacctttactaatatggaagtgcagttaataaggcaaatggaatcggaaggaatatttttgccgtccgagctagagacccctaatttagcagaaagagcgttagactggttagagaaacacggggctgaacgcctaaaaagaatggcaataagtggtgatgattgcgtcgtaaagccgatcgatgacagattcgcaacagcattgacagctctgaatgacatgggcaaagttagaaaagatataccacaatgggagccgagtaagggatggaacgactggcaacaagtaccattctgcagtcatcactttcaccaattaatcatgaaggatggaagggaaatcgtagttccatgtagaaatcaagatgaattagtaggcagagctagagtatcacagggtgctggctggagcctccgagaaacagcatgtttaggtaaatcatatgctcaaatgtggcaattaatgtatttccatagacgtgatctacgtttagcggcaaacgcgatatgtagtgctgtgcccgttgactgggttcccacgtctcggaccacatggtcgattcacgcacaccaccaatggatgaccactgaggatatgctatcggtttggaatcgagtatggatagaggaaaacccttggatggaggacaagacacacgtctctagttgggaggaggtaccatatttagggaagagagaagatcaatggtgcggctcattaataggattgactgcacgggcgacgtgggcaaccaatattcaagtcgcaataaaccaggtacgaaggttaattggaaatgaaaactatctcgattatatgacaagtatgaaacgatttaagaacgaatcagattcagaaggggccctatggtaa

SEQ ID NO: 21351 - RNA, 9879 nt, synthetic construct
  misc_feature 1..9879: note = derived and/or modified CDS sequence (opt6) from DENV-1__KJ189352__SS-prME
  source 1..9879: mol_type = other RNA
agtgtaacaatgctgttaatgctactacctaccgcgttggcttttcacctcaccacccgaggaggtgaaccccacatgattgtctctaaacaggaacggggaaaatcattactcttcaaaaccagcgcgggcgtgaatatgtgtactcttatagcgatggacttaggggaattatgcgaagatacaatgacatacaaatgcccacgcataacagaagcagaaccggacgacgtagactgttggtgtaacgcaaccgacacatgggtcacctatggaacgtgtagccaaaccggcgaacaccgaagagaaaaacgatcagttgcactagcgcctcatgtgggacttggtttagaaacgcgtaccgaaacctggatgagttcagaaggtgcctggaagcaaatacaaagagtcgaaacatgggctcttagacacccaggatttactgtaatcgccttctttcttgcacatgcaattgggacatccattacgcaaaagggaattatctttatattactcatgcttgtaacacctagcatggccatgaggtgtgtaggtatagggaatcgagatttcgtcgaaggattatcgggtgctacttgggtagacgtagttttagaacatggaagctgcgtaacaacaatggctaaaaacaaacccactctcgatattgaactactaaaaaccgaagtcaccaacccagcagtattgagaaaattgtgtattgaagccaaaatcagtaatacaactacggatagtcgttgtcctacacaaggagaagcaactttagttgaagaacaagacgcgaatttcgtttgtagaaggacgtttgtggatcgaggttggggcaatggttgcggactgtttggtaaaggaagtctgttgacctgtgcgaaattcaagtgcgtaacaaaattagaaggaaagattgtacaatacgaaaatcttaaatactccgtcatagtcacagtccataccggcgatcaacatcaagttggcaacgaaaccacagaacatggcacgattgcaacaataactccacaagccccaacaagtgaaatccaactaacggattacggagcattgactttggactgcagtccgagaactggactggattttaacgaaatggtgctactaactatgaaagagaaaagctggcttgtccacaaacaatggttcctagacttaccattaccatggacaagtggcgcgagcacatcacaagaaacgtggaatagacaagatctgttggtgacctttaaaaccgctcatgccaagaaacaggaagtagtcgtattaggatcacaggaaggcgcgatgcacaccgcactcacgggggcaacggagatacagacaagcggaacaacaacaatatttgcagggcatctaaaatgtagattgaaaatggacaagctaaccctaaagggaatgtcttatgtaatgtgcactggcagctttaaattagagaaagaagtggcagaaactcagcatggaacagtcttagtacaggtaaagtatgaaggaactgacgcaccgtgtaagataccattctcaactcaagatgaaaaaggagtgacacaaaacgggcgtttgataactgcaaatcccattgtaacagataaagaaaagccagtcaatatcgaaacagaaccaccctttggggaaagctacatagtcgttggagcaggcgaaaaggctttaaaattatcatggtttaaaagaggtagtagcatagggaaaatgtttgaagcaacagctcgaggcgctagacgcatggctatattaggtgatacagcttgggactttggctctatagggggcgtttttacatctgtgggaaaattagtccatcaaatttttggcaccgcatacggggtcctattttccggagtttcatggacaatgaaaatagggataggaatactcctaacgtggctaggattaaattccagatctaccagtttgtccatgacttgtatagcagtcggaatggtgacattatatcttggtgtcatggttcaggcggactcaggatgtgttatcaattggaaaggacgagaattaaaatgcggctcgggtattttcgttacaaatgaagtgcacacctggacagaacagtataagtttcaagcagacagtcccaaacgcttgtccgcagcaattggaaaggcctgggaagaaggagtctgcggtatacgatcggcgactcgcctagaaaacattatgtggcgtcaaatatcgaatgagcttaatcatatattactagagaacgatatgaagttcactgtagttgtaggtgatgctaacggaattttagcacaaggtaagaaaatgataagaccgcaaccgatggaacataaatatagttggaaaagttggggaaaagctaaggtaataggcgcagatatacagaataccacatttataatagatggtccggataccccagagtgtcctgatggtcagagagcatggaacatatgggaagtagaagattatgggtttggcgtcttcacgacgaatatatggttgaagttacgtgacagttatactcaaatgtgtgaccatcgtctaatgtccgcagcaattaaagactcgaaagctgttcacgcggatatgggatattggattgagtcagagaaaaatgaaacgtggaaattagcgagagcatccttcatagaagttaaaacatgcacttggccaaaatcacatacactatggtcaaatggagtattagagtcagaaatgattattccaaagatttacggcggccctatttcacaacataactaccgaccagggtattttacacagacggcaggtccgtggcaccttggaaaactggaattagattttgatctttgtgaaggcactacggtcgtagtagacgaacattgcggtaatcgtggaccatcattgagaacaacgacagttactggaaagataatacacgaatggtgttgcagatcctgtacactccctccattacggttccgaggagaggacggctgctggtatggaatggagataagaccagtgaaagaaaaagaagaaaacttagtaagaagtatggtttcagcagggtccggcgaagtagactcattctctttgggtatattatgcgtttctataatgattgaagaagtaatgaggtcaaggtggagtcgaaagatgttgatgaccgggacactagcagtattcttgctattaattatgggtcaattgacatggaatgatctgatacggttatgcatcatggttggtgcaaacgcttcggatagaatgggcatgggaactacctacttagcgcttatggcaactttcaaaatgcgaccaatgtttgccgtaggtcttctatttagaaggctgacaagtcgtgaagtactgctactgacgatcggattaagtctcgttgccagcgttgaattgccaaacagccttgaagagttaggagatggattagcaatgggcatcatgatgttgaaacttctaacagagttccaaccacatcaattatggacaactctacttagcctaacattcgtgaaaaccactttaagtctggattatgcatggaaaaccacggcaatggcattaagcatcgtctcattatttcccctatgcctgtcaacaacttcacaaaagactacgtggttaccagtattacttggatcatttggttgtaaaccactaacaatgtttttaatcactgaaaataaaatatgggggcgaaaatcctggcccctcaatgaaggaattatggcaataggcatagtatctatattactttcttcattgcttaagaatgatgttccgctagcgggaccattgattgctggaggtatgctaatagcgtgttatgtaatatctggaagcagcgctgacttatccttagagaaagcagccgaagtttcctgggagcaggaggcagagcatagtggcgcgagtcattcaattctagtagaagttcaagacgatggcaccatgaaaatcaaagacgaagaacgtgacgatacactaactatactcctgaaggctactcttcttgccgtctcgggtgtatatcctatgagtattccggcaacattattcgtgtggtacttttggcagaagaagaaacagaggagcggggtattgtgggacacgccctcgccacccgaagtagaacgagcggtgctggacaacggaatttacagaattttacaacgtggcctgctcggacggtcacaagttggagtgggggtctttcaagacggagtttttcacactatgtggcatgtgacgagaggggcagtattgatgtatcaaggaaagagactggaaccgagttgggcatcagtaaagaaagatttaatttcttatggaggaggatggagattccaaggatcatggaatacaggcgaagaagttcaagtcattgcagtcgaacccggtaaaaatcccaaaaacgtccaaacgacaccgggaacctttaaaacccccgagggcgaagtaggggcaatagccctcgattttaaaccagggacaagtggaagtccgattgtgaacagagaaggaaagatagttggtttgtacggaaacggtgtagtgacaacatcaggaacatacgtgagcgcaattgcgcaagcgaaagcatcgcaagaaggtcccctcccagaaatcgaagatgaagtatttaagaagcgaaatttgacaattatggatttacacccaggttcaggaaaaactcgtaggtacctacctgctatagtcagagaagccattaaaaggaaattgagaacactcatacttgcaccaacccgtgtagtagcgtctgaaatggcagaagcgttaaagggaatgccgattagatatcagacgactgcagttaagtcagagcacacgggtcgcgaaattgttgacctaatgtgccacgctacatttacaatgcgtctattaagcccagtccgagttccaaactacaacatgataataatggacgaagcacactttacagaccctgccagcatagctgcacgaggctacatcagcacgagagtcgggatgggtgaagcagcagcgattttcatgacagcgacaccccctggaagcgtagaagcctttcctcaatcaaatgccgtcatacaggatgaggaaagagacatacctgagcgaagttggaatagcggatacgactggatcactgacttcccaggtaagactgtgtggtttgttccatcaataaaatcgggcaacgatatcgcgaattgtttaaggaaaaatggaaaaagagttatacaattaagccgtaagacatttgatacggaataccaaaagactaaaaataatgattgggattacgttgttaccacagatatctctgagatgggagcaaatttccgagccgatagagttattgatccaagacgatgcttaaaacctgtcatattaaaggatggccctgaacgagtgattcttgccggaccaatgccggtaaccgcagcttccgccgcacaaagaagagggcgaataggacgaaatcagaacaaagaaggtgatcagtacgtttatatgggacaaccactgaacaacgatgaggatcacgcccattggacagaagccaaaatgttactagataatattaacaccccagagggaattattcctgcattatttgaacctgaaagagaaaagtcagccgcgatagatggtgagtatagacttaggggagaggctcgcaaaacctttgttgaactcatgcgccgaggggacttgcctgtatggctctcttacaaggtcgcgtcagaaggattccaatactcggatagacgttggtgtttcgacggtgaacgcaataatcaagtgttagaagaaaacatggatgtcgaaatctggacaaaagaaggggaacgcaaaaagctgagaccaagatggctcgatgcacggacgtatagtgacccacttgctctgagagagttcaaggagttcgcagcaggaagacgttccgtctcaggagacctaatcttggagattggaaaactaccgcagcacttaactttaagggctcaaaatgcgttagataacttagtcatgctccacaatagtgaacaaggaggtaaggcctatcgacatgccatggaggaattaccggacacaatagagacattgatgctcctagcattaatagcagtactaacaggtggagtcactttattcttcttaagcggaaaaggattaggtaaaacaagtataggattactttgcgttacagcctcgtcagcgctcttgtggatggcgtccgttgagccacattggattgccgcatcgataattctagaatttttcttaatggtcctactaatacctgagccagatagacaaagaacaccacaagataatcaattagcatatgttgtaataggactattatttatgattttgacagttgctgcaaatgaaatgggattactagaaactacgaagaaagacctaggaatcggatacgtagccgcggaaaatcaccaacacgcaacgatgttagacgtggatttgcaccccgcatcggcctggacactatacgcagtggctacaacagtgataacacccatgatgagacatacaatagaaaatactacagccaacattagtttgaccgccatcgccaaccaagcagccatactcatgggattagataaggggtggcctatctcaaagatggatataggagtgcccctgcttgccttaggatgctactcacaagtgaatcccttaactctcactgcagcagtccttatgttggtggcacattacgcgataataggtccaggattgcaagctaaagctacaagggaggctcaaaaacgaacagcggcaggtattatgaagaacccgacggtggatggaattgtggccatagatttggaccctgtggtctatgatgcaaaattcgaaaaacaactagggcaaataatgttattgatattgtgtacaagtcaaattcttttgatgagaacaacttgggcactatgcgagagcataacactcgcaaccggacctctaactacattatgggaaggttctcccggtaaattttggaacacaacaatagccgtaagcatggcaaatatatttagagggtcatacttagctggagccggactcgcattttcgttaatgaaaagtctaggaggtggcagacgaggtacgggagcacaaggcgaaactcttggagaaaaatggaaaagacagttaaaccaattatcgaaatccgagttcaatacatacaaacgatcggggataatggaagttgacagatctgaagcgaaggaaggccttaagagaggcgagactacgaaacatgctgtctcaaggggaacagcaaaattgagatggttcgttgagagaaatcttgtgaaaccagagggaaaagtaatagatctcggctgtgggagaggaggatggagctattattgcgcaggtctaaagaaagtaacagaagttaaaggatacacaaaaggaggacctggtcacgaagaaccaatacccatggcaacttacggatggaatctcgttaaacttcatagtggaaaagacgtcttctttatgccaccagagaaatgtgatacgcttttatgtgatataggcgaaagttcaccaaatccaaccattgaagaaggcagaacattaagagtattaaagatggtagaaccatggcttagaggtaatcaattctgtatcaaaattctaaacccatatatgccatcagtagtagaaactctagaacgtatgcagcgaaaacatggaggtatgttagtaagaaatccgttaagcaggaacagtactcacgaaatgtattgggttagttgtggtacaggaaacatcgtgagtgccgtcaatatgacaagtcgaatgctgttaaatagattcacgatggcccacaggaaacccacctatgaacgagacgtggatttgggtgcaggtacaaggcatgtagccgtagaaccagaagtggcgaacttagacataataggacaacgaatagaaaacatcaagaacgagcataaaagcacatggcactatgatgaagataacccatataaaacatgggcttatcatgggtcctatgaagtaaaaccatcaggctcagctagctcaatggtcaatggcgtagttagattattgactaaaccgtgggacgtcatacctatggtaacacaaattgcaatgactgatacaacaccattcgggcaacaaagagtctttaaagagaaggttgatacgcgaacaccaagggcaaagagaggcacaacacagattatggaagtaacagccaaatggctctggggatttctatcaagaaacaagaaaccacgaatttgcactcgggaagaatttacgagaaaagttagatccaatgctgccataggggcagtatttgtcgacgagaaccaatggaactcagctaaagaagccgttgaggatgagcggttttgggacctcgtacacagagaacgagaattgcataaacaaggcaaatgtgcaacttgtgtatataatatgatgggtaaacgtgagaagaaattaggcgagttcggtaaagctaaaggttcacgcgccatctggtatatgtggcttggagcaagattcttagaatttgaggctttaggattcatgaatgaagatcattggttcagcagagaaaattcattgtcaggcgtcgagggagaagggttacataaattggggtacatactcagagacatttctaagataccgggtggaaatatgtatgctgacgacaccgcaggttgggatacacgagtaacagaagatgatttacaaaacgaagcaaaaataacagatataatggaacctgaacacgcattgttagccacttcgattttcaaattgacgtaccaaaataaagttgtacgggtacaacgtccagctaaaaatggtacggtaatggatgtaatatcacgacgagaccaaagaggcagcgggcaagtaggaacgtatggtctaaatacgtttactaacatggaggtccaactgataagacagatggagagcgaaggtatattcttgccatctgaactcgaaactccaaacctcgcagaacgcgcattggattggttagagaaacatggggcagaaagactaaaaagaatggctatctccggcgacgactgcgtagttaaaccgattgacgatcggttcgcgactgcactcacggcgctaaacgacatggggaaagttaggaaagacatcccacaatgggaaccatctaagggatggaacgattggcaacaagtacctttctgtagtcaccattttcatcagctgattatgaaagacgggagagagatcgtggtaccctgcagaaaccaagatgaattggtcgggagagcacgagtaagccaaggtgcaggttggagtctacgtgagactgcatgtttaggaaaatcatatgctcaaatgtggcagctaatgtactttcacaggagggatttacgccttgcagccaacgctatatgttccgctgtccccgtagactgggtccccacgtcacgaactacatggagtatacatgcacatcatcagtggatgacaacagaagacatgcttagtgtatggaaccgggtctggattgaagaaaatccgtggatggaaaataaaacacatgtttcaagctgggaagaagttccataccttggcaaaagagaggatcaatggtgcggatccctcattggcctcacagcgagagcgacatgggccactaacatccaagtggcaattaaccaagttcgacgacttataggcaacgaaaattatctcgattatatgacttcgatgaaacgatttaagaatgaatcagatagtgaaggagctctctggtga

SEQ ID NO: 21352 - RNA, 9879 nt, synthetic construct
  misc_feature 1..9879: note = derived and/or modified CDS sequence (opt6) from DENV-1__KJ189353__SS-prME
  source 1..9879: mol_type = other RNA
agtgtaactatgttgttaatgctgttgccaacagccctcgcattccaccttacgacaaggggaggtgaaccacacatgatagtaagtaaacaagaacgtggtaaatctttattattcaaaacttcagctggagtcaatatgtgcactttgatagctatggacttaggagaactatgcgaagacaccatgacttacaaatgcccacgaatcactgaagccgaacctgacgatgttgattgttggtgtaacgccaccgatacatgggttacatacggtacatgttctcaaacaggagaacacaggcgggaaaaacgctcggtggcactagccccacatgttggattagggttagaaacgagaacggaaacctggatgagttcagaaggagcttggaagcaaattcaaagagtggaaacatgggcgttgcgacatcccggcttcacagtaattgcatttttccttgcacacgcaattggcacctcaataactcaaaaaggaattatattcattttacttatgcttgtaactccaagtatggcaatgaggtgtgtaggaattggtaatcgagattttgtcgaaggattatccggagcaacgtgggtcgacgttgtgctagaacatggaagctgcgttactacaatggctaaaaataagccgacgttagatatagaacttctaaaaactgaagtcactaatcccgccgtattacgaaaattatgcattgaggcaaaaatttctaacactaccacagacagcagatgcccaacccagggagaagcaactctagtagaagaacaagacgctaattttgtatgccgaagaacgtttgtggaccgaggatggggcaatggttgtggattattcggaaaaggatcgttgttaacctgtgcgaaattcaaatgtgtcacgaaattggagggtaagatcgtccaatatgaaaatttaaaatatagcgtcattgtgactgtccacacaggagaccagcatcaagttgggaacgaaacaaccgaacatggtaccattgcaacgattacaccacaagcaccaacctcagagatacaacttacagattatggcgcactcacattagattgctcaccacgaacaggtctcgatttcaatgaaatggtgcttctcacaatgaaagaaaagtcttggttagtccacaaacaatggtttctggacctgcccttaccctggacatctggtgccagcacaagccaagaaacatggaacaggcaggacctactggtaacctttaaaacggctcatgcgaagaaacaggaagttgtggtccttggatcacaagaaggagcaatgcacactgcactaacaggagctacagaaatacagacaagcggcaccacaacgatattcgctggacatctaaaatgccgtttaaagatggacaaactcacacttaaaggaatgtcttacgtaatgtgtaccggttcctttaaactggaaaaagaagttgcggaaacacaacatggtaccgttctggttcaagtgaaatatgaagggaccgatgcgccatgtaaaataccattctccacacaagacgaaaaaggggtaacacaaaacggacgactgataacggcaaatcccattgtgacagacaaagaaaaaccagtaaacatcgaaactgagcccccattcggagaatcttacattgtagtaggcgcgggagagaaagccctaaagttatcttggtttaaaagaggaagcagtatcgggaaaatgttcgaagccaccgctagaggggcacgtaggatggccatattaggagatacggcgtgggacttcgggagtataggcggtgtttttacgtcagtagggaaacttgttcatcaaatcttcggtacagcttatggagtactattcagtggtgtctcgtggacgatgaaaattggaatagggatactgctcacatggctagggctcaatagtagaagtacgtcattgagtatgacatgtattgcggtcggcatggtaaccttatatttgggtgtgatggttcaggctgatagtggttgtgtaattaattggaaagggagggagttgaaatgtggctcaggaatttttgtaactaacgaagtccacacttggacggaacaatacaagttccaagcagatagccctaaaaggctatcagctgcaataggaaaggcttgggaagagggggtatgtggaatacgtagcgcgactcgtcttgaaaacatcatgtggaaacaaataagtaatgagctaaaccacatactcctagaaaatgatatgaaatttacagtagtcgttggtgacgctaatggtatcttagcacaaggcaagaaaatgataagaccccagcctatggaacacaaatacagttggaagtcctggggcaaagcgaagataatcggagcagacatacagaataccacgtttatcatagatggacctgatacaccagaatgccccgatgggcaacgtgcatggaatatctgggaagtagaagactacggttttggagtcttcacaactaatatttggcttaaacttagggattcatatactcaaatgtgcgaccataggctgatgtcagcggcaataaaagattcaaaagccgtacacgcagatatgggatactggattgaatcagagaaaaatgaaacatggaaattggcaagagcgtcgtttattgaagtgaaaacgtgcacatggccaaaatctcacactttatggagtaacggtgtgttggaaagtgaaatgataatacccaagatatatggcgggccaatatcacaacataattacagaccaggatatttcacccaaactgcgggtccctggcatctcggcaaacttgaacttgattttgagctttgcgaaggcactacagtagtagttgacgaacattgcggtaataggggaccaagtctccgtacgacgacagtcactggtaagataatacatgaatggtgttgtagaagctgcacattacctccattgagatttaggggagaagacggatgttggtacggcatggagatacgaccagtaaaagaaaaggaggaaaatcttgtaaggtccatggtctcagcaggaagtggagaagttgacagtttctcattgggcattctatgtgtatcgattatgatcgaagaagtgatgcgcagtcgatggtctcggaaaatgttaatgacagggacattagcagtctttctgctactaattatgggacaacttacatggaacgatctcatacgtttatgcattatggttggcgcaaatgcttcagaccgaatggggatgggcaccacttatcttgccttaatggctactttcaaaatgcgaccaatgttcgccgttggcctactatttcgacgtttaacaagtcgagaagtcctactacttactattggactaagtttagtcgcttcggtcgaactgcctaactcactagaagaattaggcgacgggttggctatgggcatcatgatgctgaaattattaactgagttccagccacaccagctttggacaacgttactttcacttacatttgttaagacaactttatcactggattacgcttggaagaccaccgcaatggccctctccatagtatccctttttccactgtgtttatcaaccacaagccagaaaactacatggctaccagtcctactaggtagttttggttgtaagccattaaccatgttcctaattaccgaaaataagatatggggcagaaaatcatggcccttgaatgaaggtataatggcaatcggtatagtttcaattctattatcgtcattgcttaaaaacgatgtcccattggcaggtcctttaatagctggaggtatgctaatagcctgctatgtcatatctggatcaagtgccgacttatcattagaaaaagcggctgaagtgtcttgggaacaagaggcagaacattcaggcgcatcacacagcatattggtagaagtacaagacgatggaacaatgaaaataaaagatgaggagcgagacgataccttgactatactgcttaaagcgaccttacttgcagtgagtggtgtctatccaatgtcaataccagcaacgttattcgtgtggtacttttggcaaaagaagaaacagcgatcaggagtgctatgggacactcctagtccacctgaggttgaacgagcagtgctagacaatggcatttataggatcctgcaaagagggttattaggacgatcacaggtaggagtaggagtattccaagacggcgtatttcatacaatgtggcacgttacaaggggtgcagttcttatgtatcagggtaaaaggttggagccgtcgtgggcgtcagttaagaaagatttaatatcctatgggggtggatggcgcttccaaggtagctggaacacgggtgaggaagttcaagtgatcgcagtcgagccaggcaaaaaccccaaaaatgtacaaacaacgcctggaacatttaaaaccccagaaggagaggtaggagctattgcgttggacttcaaacccggtacatcagggagtcccatagtcaacagggaaggaaagatagtcggtctttatggcaacggtgtggtaacgacttcgggaacctatgtaagcgcaattgctcaagcaaaggcttcacaggaaggacccttgcccgaaattgaagatgaagttttcaagaaaaggaatctaacaataatggatttgcatccggggtcaggcaaaactagacgatatttaccagcgatagtaagagaagcgataaaaaggaaactcaggacactcatattagcacctacgagagttgtggcttcagaaatggcggaggctttaaaagggatgcccatacgataccaaacaacagcagtaaaaagtgaacacacaggaagggaaatagtcgatttaatgtgtcacgccacattcacaatgagattattatctccggtcagggtgccgaattataatatgattataatggatgaagctcatttcactgatccggcatctattgcagctagaggttacatatctacgagagtcggaatgggggaagcagcagcaatatttatgacggctacacctccgggttcagtcgaggctttcccacaatccaacgctgtaatccaggatgaagaaagagatattcccgagaggtcgtggaactcaggctatgattggattacggactttccgggaaaaaccgtatggtttgtaccatcgattaaatcaggtaacgatatagccaattgcttgcggaagaacggtaagcgagtcatacagctatcaaggaaaacattcgatacggaatatcaaaagactaaaaataatgattgggactatgtagttactaccgacatctcagaaatgggggcaaattttagggcagatcgcgtaatagatccgagacggtgtttaaaacccgtaatattaaaagacgggccggagcgagtaattttggctggtccgatgccggtcacagcagcatcagctgctcaaagaagaggccgaattggacgaaatcaaaataaagaaggtgatcaatatgtctacatgggtcaacccttaaacaacgacgaagaccacgcgcactggactgaagctaagatgttactagataatattaacactccggaaggcattatcccggctctgttcgaaccagagcgggagaaaagtgcggccatagacggcgaatatagattgagaggtgaagctcggaaaacgtttgttgaacttatgagacggggagacttaccagtttggttgagttataaagttgcttcagagggttttcaatattctgatagaagatggtgttttgatggtgaacgaaacaaccaggttttggaagaaaatatggatgtcgaaatctggacgaaggaaggtgaacgcaagaaactaaggcctcgttggcttgatgcgagaacttatagtgatcccttggctcttagagaatttaaagagtttgcagccggaagacgctcagtatcaggagacctgattctggagattggaaaacttcctcaacatttgacattaagggcacaaaacgcgttggataacctagtaatgttacataacagcgaacaaggaggcaaagcgtaccgacatgctatggaggaattaccagatacaatcgaaacgctcatgctcctggcgctaatagcagtactaacgggaggggtgacactatttttcttaagtggaaaaggactcggcaaaacatcaattggactactgtgtgtaacagcgtccagcgcactactttggatggcatctgtggagcctcattggattgcagcttccataatattagagttcttcctcatggtcttactcatacccgagcctgatagacagagaactccacaggataatcaacttgcatatgtggtgataggactactatttatgatattgacggttgcggctaatgaaatgggtttgttagaaacgaccaagaaagatctcggtatagggtatgtagcagcagaaaatcatcaacacgctacaatgctcgacgttgatttgcatccagctagcgcgtggacgctatacgcagtagcaacgacagtgataactcccatgatgagacacacaatagaaaacaccacagccaatatctccctaacagcaatagctaatcaagcagcaatattaatggggttagacaaaggatggcccatctccaagatggatattggggtaccattgctcgcactcggatgttactctcaagtcaatccattaactctaacagcagcagtgttaatgctagttgcacattatgcaataatcggcccgggactacaggccaaggcgacgcgcgaagcacagaaaaggacagccgcaggcataatgaagaatcccacagtagatggaatagtagccatagatctagaccctgttgtgtatgacgctaaattcgaaaaacaattgggacaaattatgttattaattttatgtacatcacagatcctactgatgaggacgacatgggcattgtgcgaatccatcaccttggctactgggccgttgactacgttatgggaaggatcaccaggtaaattctggaatacgacaatagcagtcagcatggccaacatattcagggggtcttatcttgcaggagcaggattggcattctcacttatgaagtcgttaggaggaggtcgcagaggaacaggggcgcaaggcgagacgttgggagagaagtggaaacgtcaattgaaccaattatcgaaatcagaatttaatacatacaagagaagcggcataatggaagtagataggtctgaagctaaggaaggacttaagagaggggaaaccactaaacacgcagtcagtagaggcacagccaagttgcgatggtttgtcgaaagaaacttagtaaaaccagaaggtaaagttattgatttaggttgtggaagaggtggatggtcatactattgtgccggtttgaaaaaggtaaccgaagttaaaggatacacaaaaggaggccctggtcatgaagaaccaattccaatggcaacatacggttggaatctagttaaactgcattccggaaaagatgtcttctttatgccaccagaaaaatgtgataccctattgtgtgatataggagaaagctcgcctaatccaacaattgaagaaggaaggacactacgggtactaaagatggtggaaccttggcttaggggtaaccaattttgcattaaaatacttaatccatacatgccatctgtggtagaaactttagagaggatgcagagaaaacatggaggtatgctagtcagaaatccactcagtcgaaattcaactcatgaaatgtactgggtatcatgcgggacgggcaacattgttagtgcggtaaatatgacaagtcgtatgttactgaacagattcactatggcacataggaaacctacttacgagagagacgtggacctaggtgctggtacgcgtcatgtagcagtcgaacccgaagtggctaatttagatattataggacaaagaattgaaaatatcaaaaatgaacacaaaagcacatggcactatgatgaagacaatccgtataaaacctgggcttaccatggatcatatgaggttaaaccatccggaagtgcttcttctatggtcaacggagtagtaagactattgacaaaaccctgggatgtaattccgatggttacacaaatagcaatgacagacaccacgccgtttggtcaacaacgagtctttaaagaaaaggtagatacaagaactccaagagcaaaacgtgggactacacaaattatggaagtaacagccaaatggttatggggcttcctatctagaaacaagaaaccgcgcatctgcacgagggaagagtttactcggaaagttagatcaaacgccgccataggagctgtatttgtggatgagaatcaatggaatagcgctaaggaagcggtcgaggacgaaagattttgggatttggtgcaccgagaacgagaacttcataagcaagggaaatgtgctacctgcgtttataacatgatgggaaaaagggagaagaaactaggtgagttcggcaaagccaaaggatccagagcaatatggtatatgtggttaggagcacgattcttagagttcgaagccctaggtttcatgaacgaagaccattggttctcaagagaaaatagtttatcgggagtagaaggagaggggcttcataaactcggatatatactccgcgatattagtaaaatccccggtggtaatatgtacgcggatgacactgcaggatgggatacaagagtgaccgaggatgatttgcaaaatgaagcgaaaataacagacattatggaacccgaacatgccttgctagcaacatcaatatttaaactaacctatcagaacaaagtcgtcagggtacaacggcccgccaaaaacggaacagtcatggatgttatcagtaggcgagatcagcggggcagtggacaggtcggcacgtatggcctcaatacattcacgaacatggaagttcaactgataagacagatggagtcagaaggaatatttctaccctctgaattagagacacccaacttagctgaacgagctcttgattggttagaaaaacacggcgctgaaagactcaaaagaatggcaatatccggtgatgattgcgttgttaaaccaattgacgatcgattcgcaactgccctaaccgcactcaacgacatgggcaaggttcgaaaggacattccccaatgggagccatctaaaggttggaacgactggcaacaagtaccattctgtagtcatcactttcaccaactgattatgaaagacggacgggaaatagtggtgccatgtagaaaccaagatgagctagtggggcgtgcccgcgtttcacaaggtgcagggtggtcattacgagaaacggcatgcttgggtaagagctatgctcagatgtggcagttaatgtattttcacagaagagacttacggttagcagccaatgcaatttgttcagccgtaccagtggattgggtacctacaagtcgaacaacatggtcgattcatgcacaccatcagtggatgacgacggaggatatgctatctgtgtggaatagggtctggatagaagagaacccatggatggaaaacaaaacccatgtaagttcatgggaggaggttccctatttagggaaacgtgaagatcaatggtgtggctctttaatcggcttaactgcaagagcaacttgggcaactaacatacaagtagctattaatcaagtaaggaggctaattggcaatgagaattaccttgattacatgacttcaatgaagagatttaagaacgagtccgattctgaaggtgcattatggtga

SEQ ID NO: 21353 - RNA, 9879 nt, synthetic construct
  misc_feature 1..9879: note = derived and/or modified CDS sequence (opt6) from DENV-1__KJ189354__SS-prME
  source 1..9879: mol_type = other RNA
tcagttacaatgctcttaatgcttctaccaaccgcgttagcattccacttaacgacgcgaggaggtgaacctcacatgattgtaagcaaacaagaaaggggaaaatctttacttttcaaaacatcggctggtgtaaacatgtgcacactaatagcaatggacttaggagaattatgcgaagatacaatgacttataaatgcccacgaatcacggaagcagaaccagatgacgtagattgctggtgcaatgcaactgacacgtgggttacttacgggacatgtagtcaaaccggcgaacataggagagaaaaacgttctgttgcactagcaccccatgtcggactcggattagaaacacgtacagagacctggatgagctcggaaggagcgtggaaacaaattcagagggttgaaacgtgggctcttagacaccctggattcactgtgattgctttcttcctagctcatgccatagggacgagtatcacgcaaaaagggataatcttcattctgctgatgctcgtaacgccgagtatggctatgcgctgtgtaggtatagggaatagggatttcgttgaaggactcagtggggctacctgggtcgatgtagtactagaacatggttcatgtgtgacgacaatggccaaaaataaaccgacgctagatattgaacttttaaaaacagaagtgaccaatccagcagtactaagaaaactatgcatagaagcaaaaatatcaaatactacaactgactcgaggtgccccactcaaggagaagccacattggtagaagaacaagatgcgaattttgtatgccgaagaactttcgtagatagaggttggggaaatggatgtggtctatttggcaaaggttctttattaacatgcgccaaattcaaatgcgtaacgaaattagaaggcaaaattgtacaatacgaaaatctaaaatatagcgtaatagttacagtccatacaggggaccaacaccaagtaggaaacgagacaactgagcacgggacgatcgctacaattactccacaagctccaaccagtgaaatacaactgacggattacggagcactaaccttggactgtagcccaagaactggactagacttcaacgaaatggtacttctgacaatgaaagagaaaagttggttggtacataaacaatggttcttagacttgccacttccttggacttcaggagcatcaacgtcacaagaaacgtggaatcgacaggacttgttagtcacatttaaaacggctcacgctaagaaacaagaagtagtggtgttaggatcccaagaaggggcaatgcatacagccttgacaggtgccaccgaaatacaaacatctggaacaacaactatttttgcgggtcacctgaaatgtagattgaaaatggataaactaaccctaaaaggcatgtcgtacgtaatgtgcacagggtcgttcaaacttgagaaagaagtggcggaaacacaacatggtacagtcctagtacaagtcaaatatgagggaactgacgctccctgcaaaataccattcagtacacaagatgagaaaggagtcacacagaatggtagactaattaccgccaatccaatagtaacggacaaagaaaaacccgttaacatagagacagaaccacccttcggcgaatcttatattgtcgtcggagcaggagaaaaagcattgaaattatcttggttcaaacgcggtagcagcattggaaaaatgttcgaagcgactgcccgtggcgctaggcgaatggcaattctgggagatacagcttgggactttggaagcataggcggggtatttacaagcgtaggtaaattggtccatcaaatttttgggactgcttatggagtactcttctcaggggtgagttggacaatgaaaattggtataggcattctccttacttggctaggcttaaattccagatccacatcacttagcatgacgtgtatcgccgtcggtatggtgacgctgtacctaggggtaatggtccaagctgacagtgggtgcgttataaattggaaagggagagaattaaaatgtggatccggtatttttgtaacaaatgaagtgcacacttggacagaacaatataaatttcaggctgattcgccgaaaagactatcggcggcaataggcaaggcttgggaggaaggagtatgtggtataagatcagcaactagattagaaaatataatgtggaaacaaataagtaatgaattaaatcatattctgttggaaaatgatatgaaatttacggtagttgtaggcgacgctaatggcattttagcacagggcaaaaagatgataaggcctcaaccaatggagcacaaatactcatggaaatcatggggaaaagcgaaaattatcggggcagatattcaaaatactacatttataatcgatggcccagatactccagaatgtccggacggacaacgtgcatggaacatttgggaagttgaagattacggatttggtgttttcacaacgaatatttggctaaaactaagggatagttatactcaaatgtgcgatcacagacttatgtcggctgctataaaagatagtaaagccgtacacgcagacatgggatattggatagaaagtgagaaaaacgagacatggaaattagcgcgagcgtcatttatagaagtcaaaacctgcacttggccaaagagtcatacattgtggtcaaatggcgtacttgagagcgaaatgattattccaaaaatatatggcggacctatatctcagcacaactaccgaccgggttacttcacgcaaacagcaggtccgtggcatttaggcaaattagaactggatttcgatctatgcgaagggacaactgttgttgtcgatgagcattgtggaaaccgagggccatcattgagaacaacaacagtcactggaaaaatcatacatgaatggtgttgcagaagctgtacactcccacctctacgattcagaggcgaagacggctgttggtatggtatggaaataagaccagtaaaagaaaaagaagaaaatttagtcagatcaatggtaagcgctggttcaggggaggtagatagcttttcgttaggcatcctatgtgtgtccataatgatagaagaagtcatgcgatcacgctggagtcgtaaaatgttgatgacaggtacgttagcagtattcttactactgattatgggtcaacttacatggaatgatctcataagattgtgcataatggtaggtgctaatgcaagcgatcgcatgggtatgggaacaacatatttagccctaatggctacgttcaaaatgagacctatgtttgccgttggcttattatttagaagactgacaagtagggaagttctactactgacaataggtttaagtcttgtggctagtgtagagttaccgaacagtttagaagaactcggggatgggctagctatgggaataatgatgttgaagctattaaccgaatttcagccacaccaactttggactactctgctatctctgacatttgtcaaaactacactctcactagattacgcttggaaaactacagcaatggcactatcaatagtctcactattccctttatgtttaagtactacgtcgcagaagactacatggctgcctgtcttactaggctcattcggctgcaagcccttgacaatgttcctgattactgaaaataaaatatggggtagaaagtcttggccattaaacgaggggataatggcaattggtatagtcagtatccttctctcttctttattaaagaacgatgtgccactcgcaggtccactaattgccggtggaatgttaattgcatgttatgtaatttcagggagcagcgccgatctatcactagaaaaggctgctgaagtttcatgggagcaagaagcagaacatagcggggctagtcattcaatcctggtggaggtacaggatgatggaactatgaaaataaaagacgaagaacgagatgacactctgactatcctacttaaggccacattactagctgtatctggcgtataccctatgtcaataccggccactttatttgtatggtacttctggcagaagaagaaacagagaagtggtgtcttatgggacacacctagtcctcccgaagttgaacgagcggtcctcgacaacggaatctatagaattttacaacgtggcctactcggtagaagtcaggtgggagttggagtttttcaggatggagtcttccatactatgtggcacgttaccagaggagctgtgctaatgtatcagggcaaaagacttgaaccttcatgggcgtcagtcaaaaaggatcttatcagttatggtggcggatggcgcttccagggcagttggaacacaggagaggaagtgcaagttatagctgtcgaaccaggcaaaaacccgaaaaacgtccagacgacgcctggcacgtttaaaacgcccgagggtgaagttggagccatcgctctggactttaagcccggcacatcaggttccccaatcgtaaatcgagagggcaaaatagtaggactatatggaaatggcgtggtcacgaccagtggcacatatgtttcagccatcgctcaagcaaaggcttcgcaagaaggtccactgcccgagatagaagacgaggtatttaagaaaagaaatcttacgattatggacttacaccccggatcgggtaaaactaggcggtatctacctgcgatagtaagagaagccatcaaacgcaaactacgaacgttaatactagcgccaacgagagttgtagcttccgagatggctgaagctctaaaaggaatgccaataagataccaaaccacggcagtgaaatcggagcatacaggtagggaaatagttgatctgatgtgtcatgcgacattcaccatgcgtctcctctctccagttcgtgtacctaattataatatgataataatggacgaggcacactttaccgatccagccagtattgctgccagaggttacatcagtacaagagtgggaatgggtgaagctgcggcaatcttcatgactgctacaccaccaggttcggtagaagcgtttcctcaatcaaacgctgtaattcaggatgaagaacgagatataccagagcgatcctggaactcgggatatgattggattactgactttcctggtaagaccgtgtggtttgttccttctattaaatctggtaacgatatagcaaactgtcttcgtaagaacgggaaaagagtaattcaactaagcagaaagacattcgacacggaatatcagaaaactaagaataatgattgggactacgtggtaactacagatatatcagaaatgggcgcaaattttagagccgatagggtgatagaccctcgcagatgcctaaaaccagttattctaaaagacgggccggagagagttattttggcgggacccatgccagtaacggccgcatcagcagcacaaagaagaggaagaataggccggaatcaaaataaagagggagatcaatacgtttatatgggtcaaccactcaacaatgacgaagatcacgcccattggaccgaagcaaaaatgctcttagacaacataaatacaccagaagggataattcccgccttatttgagcccgagagagaaaagtcagcggccattgacggagaatatagactcagaggtgaggctagaaaaacttttgtagaactcatgcgacgaggagatctacccgtatggctaagttataaagtcgcttcagaaggttttcaatattcagatagacgatggtgtttcgacggcgaacgaaataatcaagtacttgaagagaatatggacgtggagatttggaccaaagaaggagaacgcaagaaattaagaccgagatggttagacgcacgaacgtattcagatccgctcgctcttagagagtttaaagaatttgcggccggacgacgatccgtcagtggggatctaattctagagataggaaagttaccccagcacttaactctacgtgcacaaaatgcactagataacttagttatgctacacaattcagaacaaggtgggaaagcatatcgacatgcaatggaagaactaccagataccatagaaactcttatgctactcgcactcatagcagtcttaacaggaggagtcaccctattctttctatcggggaagggtcttggcaaaacttctataggactcttatgcgttactgcatcgtctgcacttttatggatggcgtcagttgaaccgcattggatagctgcttcaatcatattagaatttttcctaatggtccttctcattccagaaccagaccgccaaagaacacctcaggataaccaactcgcttacgtagtgattggactactatttatgatattaacagttgcagctaacgaaatgggcctactagaaactaccaagaaagatttgggtataggatatgtagcagctgaaaatcatcaacatgcaaccatgttagacgtcgatttacaccctgcaagcgcgtggaccttatatgctgtagctacgacagtaataacaccaatgatgaggcatacgatagagaacacaacagctaatatttcactaacagccatcgccaatcaggctgcaatattgatggggctcgataaaggttggccaatatccaaaatggatataggagtgcccctcctagcactcggatgttactcacaggttaaccccctaacactcactgcggcagtattaatgctggtagctcattatgccattatcggaccaggattgcaagcaaaagccacgagagaagcacagaaaaggacagctgctggcatcatgaaaaacccaacagtcgacggtattgtcgctattgatttagatccagtggtgtacgatgccaaatttgaaaaacaactaggacaaataatgttactgatattatgcacatctcaaatcttgcttatgaggacgacttgggctttgtgtgagagtataaccttagcaacaggtccactaactactttgtgggaaggttcaccgggtaaattctggaatactacaatcgcagtaagtatggcaaatatatttagagggtcttatctagctggcgcaggtctagcgttctcactcatgaaaagtctgggaggaggacgaaggggcaccggagcgcaaggtgaaaccttgggtgaaaaatggaaaagacagttaaatcagttaagtaaatcagagttcaacacttataaaagatcaggaatcatggaagtagatagatcagaagctaaggaaggattgaagcgaggtgagacgactaaacatgccgtaagcagaggtaccgccaaattacgatggtttgtggagcgaaatcttgtgaagcccgaaggaaaagtaattgacttaggttgcggccgagggggatggtcatactactgtgcggggttaaagaaggttacagaggtaaaggggtacaccaaaggtggcccaggccatgaagaaccaataccgatggccacctatgggtggaatttggtcaaattacacagcggcaaagacgtattcttcatgccacctgaaaaatgcgatacactcttatgtgacattggagaatcctcacctaacccaacaatagaagagggtagaacactaagagtcttaaaaatggtagaaccatggcttcggggaaatcaattttgtatcaaaatattaaatccttacatgcctagcgtagtcgagactctagaacgtatgcaacgcaaacatggaggaatgttagttcgcaatccattaagtagaaatagcacacatgagatgtactgggtctcctgtgggacaggtaatatagtatcagctgtaaatatgacatctcgcatgcttttaaatcgattcacgatggctcataggaaacccacatacgagagggacgtggacctaggagctggtacccgtcatgtagccgtagaaccagaagtggcgaacttagatataataggccaacgaatagagaatattaaaaatgaacataaaagcacatggcattacgacgaggataatccatacaagacatgggcttatcatggtagttatgaagtaaaaccttctggaagcgcttcttcaatggttaacggggtagtaagacttctcacaaaaccttgggatgtaatacctatggttacacagattgccatgactgacacaactccttttggacaacagagagtttttaaagagaaggttgatacaaggacaccccgagcgaaacgaggcactacacaaatcatggaggtaacagcaaagtggctttggggcttcctcagtcgtaataagaaacctcgaatttgcactagagaagaatttactaggaaggtgagaagtaacgccgcaatcggtgcggtcttcgtcgacgaaaatcaatggaactctgcgaaggaggcggtcgaagacgaaaagttttgggacctcgtgcatagagagcgcgaattgcacaaacagggtaagtgtgccacgtgtgtctacaacatgatgggtaaaagagagaagaaactaggggaatttgggaaggcaaaaggatcacgagcaatatggtatatgtggttaggagcacgatttcttgagttcgaggctctgggattcatgaatgaagatcattggttctcgagggaaaattcactatcaggagtagaaggagaaggactccacaaacttggatatattctaagggacatatcgaaaatacccggaggaaatatgtatgcggatgatacggctggttgggatacaagggtaacagaagatgatcttcagaacgaagctaagataaccgacataatggaaccggaacatgcattactagcaacatcaatatttaaactaacgtatcaaaataaagtagttcgtgttcaaagaccagctaagaatggaaccgttatggatgtgatatcaaggagagatcaaagaggatccggccaagtaggaacttatgggttaaacacatttactaatatggaagtacagcttattagacaaatggaatctgaaggtatatttctgccatcagaacttgagactccgaatctagctgaaagagctctggactggctagaaaagcacggggcagaaagattaaaaagaatggccatctcgggagacgattgtgttgtgaagccaattgatgatcgatttgccacagccttaacagccctaaatgatatgggtaaagttaggaaagacataccgcaatgggagccgagtaaaggttggaatgattggcaacaagtgccattttgttcacatcatttccaccagctaataatgaaagatggacgggagatagtggttccgtgtcgtaaccaggatgagcttgttgggcgggcgcgagtgtcacaaggcgcggggtggagtctccgagaaacagcctgtttaggaaaatcctatgcccagatgtggcaattgatgtattttcaccgaagagacttacggctcgcagcaaatgcaatatgctctgctgttccggttgactgggtacctacgagtagaacaacctggtcaatacatgctcaccaccagtggatgaccactgaagatatgctttccgtatggaatagagtatggatagaagaaaacccttggatggaaaacaaaacccacgttagctcgtgggaagaagtcccatacctaggtaaacgagaagatcaatggtgtggctctcttatcggcctaacagcgcgagccacatgggcaactaacattcaagtggcaataaaccaagttagacgactaatcggaaatgaaaactatctagactatatgacttcaatgaaacgatttaaaaacgagtccgactctgaaggtgctttatggtaa

SEQ ID NO: 21354 - RNA, 9879 nt, synthetic construct
  misc_feature 1..9879: note = derived and/or modified CDS sequence (opt6) from DENV-1__KJ189355__SS-prME
  source 1..9879: mol_type = other RNA
tctgtaactatgctactgatgctgctgccgacagctttggcatttcacttaacgacgagaggcggagaaccccatatgatagtatcaaaacaagaacgaggcaaaagtttgctttttaaaacatctgctggtgtaaatatgtgtacattaatagcaatggatttaggagaattgtgtgaagatacaatgacttataaatgtcccagaattactgaagcagaacccgacgatgtcgattgctggtgtaatgcaacagatacttgggttacatacggcacgtgcagccaaacaggagaacatagacgtgagaaaaggtccgtagcattagcaccacatgtgggattgggattagaaacgcgaacggaaacgtggatgagtagtgaaggagcatggaaacaaatacaaagagttgaaacatgggctctgagacatccgggatttaccgttatagcattctttttagcgcatgcaattgggacaagcataactcaaaaaggcattatctttatattattgatgttggtaacaccgtcgatggcaatgcggtgtgtgggaataggaaacagggatttcgtcgaaggcttgtccggcgcaacttgggttgatgttgtattagaacacggtagctgtgttaccactatggctaaaaataaacctaccctagacatagaattgcttaaaaccgaagtaacaaacccagctgtcctacgaaaattatgcatagaagcaaaaatttcaaacacaacgactgatagtcgctgccctactcaaggagaagcgactcttgtggaggaacaagatgcaaatttcgtttgtcgaagaacttttgtagacagaggatggggtaatggatgcggtttattcggaaaagggagcttattgacctgcgcaaaatttaaatgtgtaacgaaactagaaggaaaaatagttcagtatgaaaacctgaaatatagcgtcattgtgacagtccatacaggagatcaacaccaggtcgggaacgaaacaacagaacatggtacgatagctacaataactccacaagcacctacatcagaaatacaacttacagactatggcgccttgacacttgactgctctcccagaacaggactagatttcaacgaaatggttttgctaacaatgaaagaaaaatcttggctagtgcacaaacaatggtttttagaccttcctttgccatggacctcaggtgctagtacatctcaagaaacatggaatagacaagacctcctagttacattcaaaaccgctcatgctaagaaacaagaagtagtcgtacttggtagtcaagaaggggcaatgcatacagccctgaccggggctacggaaatccaaacatccggcacgacgactatatttgccggacacctcaaatgtcggcttaaaatggataaattaacattaaaaggaatgtcatatgtaatgtgtactggctcgtttaaacttgaaaaggaagttgcagaaacacagcacggaactgtcctagttcaagtcaaatacgaaggcactgacgccccatgtaaaatcccgtttagcacacaggatgaaaaaggagttacacaaaatgggcgcttaataacagcaaacccaattgttatcgacaaagagaagcctgtaaacatagaaactgagccaccttttggtgagtcatacatagtcgtaggagccggcgaaaaagcacttaaactttcgtggttcaaacgggggagttctataggaaaaatgttcgaggccacagctagaggtgcgagaaggatggcaatactaggcgacacagcctgggattttggttccattggaggtgtattcacaagtgtgggaaagttggtacatcagatttttggaaccgcatacggggttctatttagtggggtatcctggacgatgaagatcgggataggaatacttctcacgtggttaggtctaaactcaaggtccatgtccctttcaatgacatgcattgcggtaggtatggttacactatacctgggcgtgatggtgcaggccgattcaggctgtgtgatcaactggaaaggcagggagttgaaatgtgggtctggaatattcgtcaccaacgaagtacacacctggactgaacaatacaagtttcaagctgacagccccaagagattgtccgcggccataggcaaagcgtgggaggaaggggtatgtggtatacgctcggctacacgtctggaaaatataatgtggaaacaaatatctaatgagttaaatcatatcttgctagaaaatgacatgaaatttactgtcgttgtaggggatgcaaatgggattttagcccaaggaaagaaaatgataagaccacaacccatggaacacaaatattcatggaaatcttggggaaaagcaaagattatcggggctgacatccaaaataccactttcattatagatggtcctgatacgccagaatgtccggacgggcaaagagcttggaatatttgggaagttgaggattacggatttggagtattcaccacaaatatctggctaaaactcagagatagctatacacaaatgtgcgaccatagattaatgtcggccgcgatcaaagacagcaaagcagtgcacgcggatatgggatactggatcgaatccgagaaaaacgagacatggaaattagcacgagcatcattcattgaggttaagacgtgcacatggcccaagtcacatactctatggagtaacggagtcctcgaatcagaaatgattatcccaaaaatctatggcggtccgatcagccagcacaactaccgacctgggtattttacacaaacggcagggccgtggcatttgggtaaactcgaattggattttgacttatgtgaggggactacagttgttgttgacgagcattgcgggaatcggggcccctccttacgcactacgacagtcactggtaagatcatacatgagtggtgttgtcgatcatgcacactaccgccgcttagattcagaggtgaagacgggtgctggtacgggatggaaataagaccagtaaaagaaaaagaggagaacttagttagatctatggtgagtgcaggaagtggagaagttgactccttctctctaggcatattatgcgtctcaatcatgattgaggaagtcatgagatccaggtggtctcgaaaaatgcttatgacgggaacacttgcggtatttttattattaataatgggtcaactaacctggaatgatttaattcggttatgtattatggtaggagcaaacgcctcagatagaatgggtatgggaacaacctacttggctctgatggccacttttaagatgcgaccaatgttcgcagtgggcctactgttccggaggctgacttcacgtgaagtattattactgacgataggcttatctttagtcgcatccgtagaattaccaaattcactagaagaactgggagatggattagcaatgggcataatgatgttaaagttactaacagaatttcaaccacatcaattatggacaacgctactatcactcacgtttgtaaaaacaaccttatcattagactacgcgtggaaaactactgcgatggccttatctatagtatccctatttccgctgtgcctaagtacaacaagtcagaaaactacatggctcccggtattattgggatctttcggttgtaagcctctcactatgttcttgattacagagaataaaatatggggccgtaaatcatggccattaaacgaaggtataatggcgataggaatcgtgtctattctcctaagctcattactaaagaatgatgtcccattggcaggtcctttaattgccggagggatgctaatagcatgttatgtaatatctggatcatctgctgacttaagcctcgaaaaggcggctgaagtaagctgggaacaagaggcagagcactcaggtgccagtcattcaatattagtagaagtgcaagacgatggcacaatgaaaattaaggatgaggaacgagatgacacgttaacgatactactaaaggctaccctcctagctgtctctggagtatatcctatgagtatcccggccactttattcgtttggtatttttggcaaaagaagaaacaacgctctggagtcctgtgggatacaccgtcacctccagaggttgagcgagcagtactagataacggtatataccgtattcttcagagagggttactggggagatctcaggttggagtgggtgtatttcaggatggcgtctttcatacaatgtggcatgtcacgagaggagcggttttgatgtatcaaggaaaacggctagaaccaagttgggcgtcggttaaaaaggatttaatatcatatggcggaggatggagatttcaagggtcatggaacacaggagaggaagtgcaagtcattgccgttgaacctggaaagaaccccaaaaatgtccagacaaccccaggcacatttaaaacccccgaaggagaagtaggcgcgatagccctcgacttcaaacccggaacatcagggagtcctatagtcaatagggaaggcaaaatagtaggtttatatggaaatggcgtagtaaccacatcaggtacctatgtgtcagcaattgctcaagcaaaggcttcacaagaaggtccgttaccagaaattgaagatgaagtattcaagaaacgaaacctcacaataatggatctacaccccgggagcggaaaaaccagaagatacctacctgcaattgtacgagaagccattaagagaaagctacgaactctaattctagccccaacacgagtcgttgcttcagaaatggctgaagcattgaaaggcatgcctatacgttatcaaacgactgcagtcaagagtgaacatacaggccgggaaatagtcgatctaatgtgccatgctacatttacaatgaggctcttgagtccagtacgcgtgccaaattataacatgataattatggacgaagctcactttacagatcctgctagcattgcagcgcgagggtatatatcaacccgagttggtatgggagaggctgcagccatatttatgactgcaacacctccaggtagtgtcgaagcatttcctcaaagtaatgcagtaattcaggatgaggaacgtgatataccagaacgatcatggaactctggatatgattggatcaccgattttccagggaaaaccgtttggtttgttccatctataaaaagcggtaatgacatagcaaattgtcttaggaaaaatggtaaaagagtaatccaattatcacgcaaaactttcgacacggaatatcagaaaactaaaaataacgactgggactatgttgtaacaactgacatatctgaaatgggtgccaatttccgagcggaccgagtcatagatcctagaaggtgtcttaaaccggtaattttgaaagatggacccgaaagggttatattagcggggcctatgcctgtcactgcagcaagcgcagctcaaagacgaggccgcattggcaggaatcaaaacaaagagggagaccagtatgtgtacatggggcagcccttaaacaatgatgaagatcacgcgcactggactgaagcaaagatgttactagacaatatcaacacacccgaagggatcatccctgctctcttcgaaccagaacgtgaaaaatctgctgcgattgatggtgaatatcgattaagaggagaagctagaaaaacctttgttgaactcatgcggaggggagatttaccggtttggctgtcatacaaagtagcctcagaaggtttccaatattcagatagaagatggtgttttgacggggagagaaataatcaagtgttagaggagaacatggacgtggaaatttggaccaaagaaggcgaaagaaagaagttgcgcccacgatggttggacgcgcgaacatattcagatccactagcattaagggaatttaaggaatttgcagcaggccgcagaagtgtgtcaggagatttgattttggagattgggaagttaccacagcacttaaccttacgagcacaaaatgctctggataatcttgtcatgttacacaattctgagcaagggggaaaagcatatagacatgctatggaagagttacccgatacaattgagacattaatgctattagccttgatcgcagttctaacaggaggggtgactctatttttcttatcggggaaaggcctaggtaaaacaagtatagggctactttgcgtgacagcaagtagcgcgttactctggatggcgtcagtagaaccacactggatagcagcatcaattattttagagttcttcttgatggtactattgataccagaacctgatcgacagaggaccccgcaagataatcaattggcttatgtggttattgggttactttttatgatattgacagttgcagccaacgaaatgggcttgttggaaacgactaaaaaggaccttgggattgggtacgtagcagccgaaaaccatcaacatgctacaatgctagatgtagatttacatccagcttctgcctggacattgtatgctgtggccacaacggtcataactcctatgatgcgacacacaatagagaatactacagcaaacatttctctaactgcaattgctaaccaagctgcaattcttatggggctagacaaaggctggccgataagtaaaatggatattggggtgcccttgttagccttggggtgttatagccaggtgaacccattgactttgacagccgcagtacttatgttggtggcacattatgccataataggcccaggactgcaagcaaaagcgaccagagaagcacaaaaacgaactgcggctggtattatgaaaaatcccacggttgatggtatagtggcaatagatctagaccctgtagtatatgatgcaaaattcgagaagcaattaggtcaaataatgctgctaattctttgtacaagccaaatacttttaatgcgaacaacctgggcactatgtgagtctataacactcgctacagggcccttaacgaccttgtgggaaggttcaccaggtaaattctggaacacaaccatcgcagtctctatggctaatatttttaggggtagttatttagcgggggcaggactcgcattttccttaatgaaatcattaggtggcggacgacgtggtacaggtgcacagggagaaacattaggtgagaagtggaaaagacaactcaatcaacttagtaagagtgagttcaatacctacaaaaggtcggggatcatggaggtagatagatcagaagcaaaagagggattaaaacgcggcgaaacgacgaaacatgcagtgagccgcggaactgctaaattgcgatggtttgttgaacgaaacttggtaaagccagaaggaaaagttatagatctcggttgcggtcgaggtggttggtcctattattgtgccggcctaaagaaggttacagaggtaaagggttacacaaaaggaggtcctggacatgaagaacctataccaatggctacatatgggtggaacttagttaaattacatagtggtaaagacgtattcttcatgccacccgaaaaatgcgatacgttgttgtgtgatattggagaaagttccccaaatcccacaattgaagaaggaaggaccctgagagtcttaaaaatggttgaaccgtggcttaggggcaatcaattctgtattaaaatattaaatccatacatgcctagtgtcgtggaaacattggaacgtatgcagcggaagcatggaggaatgctcgttagaaatccattaagtagaaacagtacgcacgaaatgtattgggttagctgcggtacaggaaacatcgtctcagcagttaatatgacgagtagaatgcttctaaacagattcacaatggcacaccgaaaaccaacatatgagagggatgtggacttaggagctgggacacggcacgtagcagtcgaaccggaggtcgcaaatttagacattatcggtcaaaggatagaaaacatcaaaaacgagcacaaaagcacgtggcactatgatgaggacaacccttataaaacatgggcataccatggaagttacgaagtcaaaccctcaggatctgctagttctatggtaaatggtgtcgtaagattactaactaaaccctgggatgtaatacccatggtaacacaaattgcaatgactgacaccacgccatttggacaacaaagagtatttaaggaaaaagtggacacaagaacacctcgagctaaaagaggtacaactcagataatggaagtaacagcaaaatggttatggggttttctgtcacgtaataagaaacccagaatatgcacccgtgaagagttcactagaaaagtaagatctaatgccgcaattggagcggtattcgtagatgaaaaccaatggaacagtgcaaaggaagcagtagaggacgagagattctgggatctggtgcaccgcgaaagggaattacacaaacaaggtaaatgcgctacatgtgtttataacatgatggggaagcgtgagaagaaattgggggaatttggaaaggcgaaaggatctagagcaatctggtacatgtggctaggcgcaagatttttagagttcgaagcacttggtttcatgaatgaagaccactggttttcacgagaaaattcgctgtcaggtgtagagggcgaaggcctccacaagttaggatatatacttagggatatatctaagataccgggcggaaacatgtatgcggacgacacagccggatgggacacaagagttacggaggacgatctccaaaacgaggcgaaaataacagacattatggaaccggaacatgccttgctcgctacgagcattttcaagttaacataccaaaataaggtcgtaagagtgcagcgaccagctaaaaacggtacggtaatggacgtaataagtaggagagaccaaagggggagcggtcaagtaggtacgtatggtttgaatacctttaccaatatggaagtacaattaatccgacaaatggaatcagaagggatattcctcccttcagaactagagacacccaacttggcagaaagagcattagggtggcttgaaaaacatggtgcagaaagacttaagcggatggcaataagcggggatgattgtgtagtaaagccaatagacgatcgctttgctacagccttaacagcgcttaatgatatgggtaaagtaagaaaagacataccgcaatgggaacccagcaaaggatggaatgattggcaacaggttcctttttgtagccatcattttcatcaattgatcatgaaagatggtcgagaaatcgtagttccatgcagaaaccaggatgaacttgtgggacgagcccgagtatctcagggagcaggttggtctctcagagagacagcatgcctaggaaagagctacgcacagatgtggcaactcatgtactttcatagacgagaccttagacttgcagcaaatgctatttgttcagccgttccagtcgattgggtacccacttcgcgtacaacttggagtatccatgcacatcaccaatggatgacaacagaagatatgttatctgtatggaacagagtttggatcgaagaaaatccttggatggaaaataaaacccatgtctcgagctgggaggaagtcccatacctaggtaagcgtgaagatcaatggtgtggtagtcttatcggactaactgccagagcaacctgggccaccaacattcaagtcgcaatcaatcaagtccgaaggttgatcgggaatgaaaattacttagattatatgacctctatgaaacgattcaaaaatgagagtgacagcgaaggggcgctctggtga

SEQ ID NO: 21355 - RNA, 9879 nt, synthetic construct
  misc_feature 1..9879: note = derived and/or modified CDS sequence (opt6) from DENV-1__KJ189358__SS-prME
  source 1..9879: mol_type = other RNA
tcagtgactatgcttcttatgctattgccaactgtactggcttttcatttgactacacgaggaggggaaccacatatgattgtatcgaaacaagaacgaggaaaatcgctactctttaaaacttcagcaggggtaaatatgtgcacgctaatagcaatggacttaggagaattatgcgaagatacgatgacatataaatgcccaagaataactgaagcagaaccagacgacgtggattgttggtgtaatgcaacggacacgtgggttacatatggaacctgtagccaaactggggaacacagacgtgaaaaacgctcagttgctcttgctccacatgttggactaggattagaaacccgtacggaaacttggatgtcttctgaaggagcgtggaaacaaatacaacgagttgaaacatgggcacttcgccatccaggatttacagtaattgctttcttcttagcacatgctataggaacgagtataacgcaaaaaggaattatattcatactattaatgctcgtcaccccttcaatggctatgaggtgtgtaggaataggtaatcgagacttcgtagaaggactcagtggtgcaacatgggtggatgtagttctagagcacggaagttgtgtgacaactatggccaaaaataaaccaactctagatatcgaattactcaaaacggaagtaacaaatccagctgtactccgaaaactttgtatagaagctaaaataagcaatactacaacagattcccgatgcccgacccaaggtgaggcaacccttgttgaagaacaagacgcaaatttcgtttgcagacggacattcgtagatcgaggttggggtaatggatgtggattgtttggcaaaggcagcttacttacatgtgccaaatttaaatgcgtaacaaagctagaaggcaaaatagtccaatatgaaaatttaaaatatagtgtgattgtaacagtccacactggagaccaacatcaagttggaaacgaaacaacggaacatggtacaatagccactatcacaccgcaagccccaacatcagagatccaattaacggattacggagctcttacattagactgttcccctagaaccggacttgattttaacgagatggtcctacttacaatgaaggagaaaagttggctagtacataaacaatggttcttagacttaccattgccgtggacttcaggagcatcaacaagccaagaaacctggaatagacaagacttattggtaacatttaaaacagcacacgcaaagaaacaggaagtggtggtactagggtcacaggagggcgctatgcacactgcgcttaccggcgccacggagatacaaacttcaggtactacaacgatattcgcgggacatctaaaatgtcgtttgaaaatggacaaactcaccctcaaaggaatgtcatatgtaatgtgcacagggagttttaaactggaaaaagaggtagctgaaacgcaacacggtacggtgctagttcaagttaagtacgagggtacggatgcaccctgtaagatcccattttctacacaagacgaaaaaggtgtaactcaaaacggaaggttgatcacagcaaaccctatagtgaccgacaaggaaaaacctgtgaacatagagactgagccccctttcggggaatcgtatattgtagtcggcgcaggagaaaaagcacttaaattaagctggttcaagcggggatcatcaataggtaaaatgtttgaagctaccgcaaggggcgcacgaagaatggcaattcttggtgacactgcttgggattttggctcaataggaggtgtgtttacctcggtaggaaaattagtacatcaagtttttggaacggcgtatggggtcctattttcgggagtatcgtggaccatgaaaattggaatcggaattttgttaacatggctcggcctgaacagtcgctcaacctctctatcaatgacttgtatagcggtaggaatggtaacactctacttgggagtcatggtgcaagcagactccggttgcgttataaactggaaaggacgtgaactcaaatgcggctccggaatcttcgttacaaacgaggtgcatacctggacagagcaatacaagttccaagctgatagtcccaaaagactgtctgctgcaatcggtaaggcttgggaagaaggggtgtgtggaatcagatccgcgacaaggttagagaatataatgtggaaacaaattagcaacgaactaaaccacatactactagaaaatgatatgaagtttacagtcgtagtaggtgacgctaatggaatattagcacaaggcaagaaaatgattcgaccgcaacctatggaacataaatatagctggaaatcttggggtaaagccaaaataattggcgcggatatccaaaacacaacgttcataatagatggacctgatacacctgaatgtcctgatgggcaaagggcctggaatatatgggaagtggaagattatggcttcggagtttttacgacaaacatctggcttaaactaagggattcatacacacagatgtgcgaccatcgtttgatgtcggccgcgataaaagacagtaaagcagtccatgctgatatgggttattggatagaaagcgagaaaaacgaaacctggaagttagcaagggctagttttattgaagtgaaaacttgtacatggccaaaatcacatactttatggtcaaacggagtgttagagagcgagatgattatacctaaaatatatggagggcccatatcgcaacataattataggccggggtacttcacacaaacagccggaccttggcatttaggcaaacttgaacttgacttcgatttatgtgaaggtactacggtagttgttgatgaacactgtggcaatcgtggcccaagcctaaggacaactacggtaaccggcaaaataatacatgagtggtgttgtaggagttgcacgttaccaccattgcgatttagaggtgaagatggatgctggtacggaatggaaattcgacctgttaaggaaaaagaagaaaatttagtacgatcaatggtaagcgcggggagtggagaagtcgattcgttctcattagggatattatgtgtttccattatgattgaagaggttatgcgatcccggtggtctcgaaaaatgttaatgaccggaacactcgcagtattcttgctgcttataatgggccaactaacttggaatgacctaataaggctatgtattatggtgggagcgaacgcatctgatcgaatgggaatgggtactacacatttagctttaatggctacatttaagatgagaccaatgtttgcagtcggactcttatttcgaagacttacatcaagagaagttctcctattgaccattggtttgagcctagtagcctctgttgaactaccaaattctttagaggaactgggcgatgggcttgcaatgggcataatgatgctaaaactacttacagaatttcaaccataccagctgtggacaaccttactctcattaactttcgtaaaaacaacactatcattggactatgcttggaaaactacagccatggcgctgagcatagtgtctttatttcccctttgtttatctactacaagtcagaaaacgacatggttacctgtactattgggcagctttgggtgtaagcctctcaccatgtttttgattaccgaaaataagatatggggcagaaaatcctggccgctaaatgagggaataatggccatcgggatcgtaagtatccttttatcgagtctacttaaaaatgacgtacctttagccggtcccttaattgccggaggaatgcttatcgcatgttacgtcattagtgggtcttccgctgaccttagccttgagaaagcagctgaagtcagctgggaacaagaagctgaacattcaggtgccagccatagtatcctagttgaagtacaagatgatggcaccatgaaaataaaagatgaggaaagagacgacacactcactatattgctcaaagcaacacttctagctgtgagcggtgtttatccgatgtcaattccagcaactctgttcgtatggtatttctggcaacgcaaaaagcaaagaagcggagttctttgggatactcccagtcctcctgaagttgaacgtgcagttctagacaatggtatatatagaattttacagcggggcctgcttggaagatcccaagttggcgtaggtgttttccaagatggagtattccatacgatgtggcacgtaactaggggcgctgtattaatgtatcaaggaaaacgacttgaaccgtcatgggcaagcgtcaagaaagacctgataagctacggtggtggatggaggtttcaagggtcgtggaatacaggggaggaagtacaagtgatagccgtcgaacctggcaaaaatcccaaaaacgtacaaactacaccaggtactttcaaaacgccagaaggcgaagttggggcaatcgcattagatttcaaacctggaacaagtggctcccccattgttaatagagaaggtaaaattgtagggttatatggaaatggagtagttaccaccagtggtacttatgttagtgcaatagcacaagcaaaagccagccaagagggtccactaccagaaatagaagatgaggtgttcaagaaaagaaatttaacaataatggacctccaccccggttcaggaaaaacccgaaaatacttgcccgcaattgttcgagaggctataaaacggaagttaagaacgttaatactagcaccaacacgagtggttgcctctgaaatggccgaggctcttaagggaatgcctataagatatcaaactacagccgtgaaaagtgaacatactggccgagaaatagtagatctaatgtgtcatgctacatttacaatgagactattatcccccgtcagggtaccgaactataatatgataatcatggatgaggcgcactttaccgatccagcatcaattgcagcgagggggtacatctcaactagagtaggcatgggagaagcagccgctatcttcatgaccgcgacccctcctgggagcgtcgaggcttttccgcaatcgaatgccgtgattcaagatgaggagagggacatacccgagaggtcttggaacagtggttatgactggataacagattttccaggtaaaacagtatggtttgtaccatcgataaaaagcggtaatgatattgcgaattgcttaaggaaaaatggaaaaagagtcatacaattaagccgaaaaacctttgataccgaatatcagaaaacgaagaataacgactgggactacgtggtaactacagacataagtgaaatgggagcaaactttcgagccgatcgagtcattgatcctagaagatgcttaaaaccagtaattttgaaagatggacccgaaagagtaattctagcaggtccaatgccagtaaccgttgcatcagcagctcaaagaaggggtaggataggtaggaatcaaaacaaagagggagatcaatacgtgtatatgggccagccgttaaacaacgacgaggaccatgcacattggaccgaggctaagatgttattggataacatcaacaccccagagggcataatccccgcccttttcgaaccagagcgtgagaaaagtgcagccatagacggtgaatatcggttacgaggagaggcgaggaaaacgttcgtagaacttatgagacggggagaccttcctgtatggctctcctataaagttgcgtcagagggctttcaatactctgatcgcagatggtgcttcgacggagagcgcaataatcaggtcttagaggaaaacatggatgtggaaatctggacaaaggagggagaaaggaagaagctaaggccaaggtggttagatgctcgtacttattcagaccctttagcactaagagagttcaaagagtttgcagcgggcagacgatcagtttccggcgacttaatattggaaataggcaaacttccacaacatctcacactacgagctcaaaacgcgttagataatttggtaatgttacataatagtgagcaaggcggaaaggcttacagacatgctatggaagagttaccagacactatagaaactctcatgcttttagccctcatagccgtcttaacaggaggagtgacactcttctttctctcgggaaagggattaggtaaaacaagcataggcctactatgtgtcacagccagttccgccttgttgtggatggcatcggttgaaccgcattggattgctgcaagtataattttggagttctttctgatggtgttactaattccagaaccagatagacaaagaactccacaagataatcaattagcatacgtagtcataggtctactttttatgatactgacagtagccgcaaacgaaatgggtttacttgaaacaaccaagaaagatttaggcatcggatacgttgcagctgaaaatcatcagcatgccacaatgctagatgtagatttacacccggcgtcagcttggactctatatgcggttgccacaacagtgattactcccatgatgcgccacaccatcgaaaatactaccgcaaacatcagcttgaccgccatagctaaccaagcagcgattttaatggggttagacaagggttggccaatatcaaaaatggacataggagtaccactactcgctttaggatgttactcgcaagtaaatcccttgacattaactgcagcggtgctaatgctggtcgcacattatgcaataatcgggccgggtcttcaagctaaagccacgagggaagcccagaaaaggacagcagcaggcataatgaaaaatcccacagttgacggtatagtagcaatagaccttgatcccgtagtgtatgacgcgaagttcgaaaagcaactaggacaaattatgctactaatcctatgtacgtctcaaattctattaatgcgcacaacatgggcgttatgtgaaagcataacgcttgctacaggacctttaactaccttatgggaaggttctccaggtaaattctggaataccactattgccgtaagtatggcaaatatctttagaggctcttaccttgctggtgcaggtctggccttcagtctaatgaaaagcctcggtggtggacgtcgcggtacaggagcacagggagaaactttgggggaaaaatggaaaagacaattaaaccagctatcaaagagcgaatttaacacgtataaaaggtctgggataatggaggtagaccgaagtgaggcaaaagaaggtctaaagaggggagaaacaacaaaacatgccgtcagtaggggtacagcaaaattacgatggttcgtagagagaaatcttgttaaacctgaaggaaaggtaatagacctgggctgcggcagaggcgggtggtcgtactattgcgcaggacttaagaaagtcacagaagttaagggttacacgaaaggaggtccggggcacgaagaaccaatacccatggctacatatggctggaatttagtgaaacttcatagcggaaaagacgtcttctttatgcctcccgaaaaatgcgatactctgctctgtgacataggtgaaagtagccctaacccaacaattgaggagggtaggacattacgtgtattgaagatggtagaaccatggcttaggggaaaccaattctgtattaaaatcttaaatccgtacatgccatcagtagtggagaccctagagcgaatgcaacggaaacatggtggaatgctagtgagaaacccgttaagtagaaatagtacacatgagatgtactgggtcagctgcggtacaggaaacatagtttctgcggtaaatatgacttcaaggatgctactaaatagatttactatggcacacaggaaacctacttatgaaagggatgttgacctcggagctggaacgagacacgttgctgtggaaccggaggtcgctaatcttgatataattgggcagagaatagaaaatattaaaaatgaacataaaagtacgtggcattatgatgaagacaatccatataagacttgggcatatcacggcagttatgaagttaaacctagcggtagcgcctcctcgatggtaaatggtgtcgtaaggctcttaacaaaaccatgggacgtcatcccaatggtcacacaaattgcaatgacagatactacaccatttggtcaacaacgggtatttaaagaaaaggttgatactagaacccctagagcaaaaaggggaaccacacagattatggaagttactgctaaatggctatggggctttctgagtcgtaataagaaaccccgtatttgcaccagggaagagttcacaagaaaagtccgaagtaacgcggcaataggcgcagtctttgtagatgaaaaccaatggaacagtgccaaggaggcggttgaagatgaaagattttgggatcttgtacacagggaacgagagctacataaacagggaaagtgcgcaacttgtgtatataatatgatgggaaaacgcgagaagaaactgggagaatttggaaaggcgaagggttcgcgtgcgatatggtatatgtggctgggcgcacgctttttagagttcgaagccctaggattcatgaatgaggatcactggttttcgcgcgaaaattcattatctggagttgaaggtgaaggattgcacaaattgggatatatccttcgggatattagcaaaatacccggaggtaacatgtacgctgatgatacagcaggatgggacacacgaataacagaggatgacttacaaaacgaagctaaaatcacagacataatggaacctgaacatgcacaactagcaacctctattttcaagctaacatatcaaaataaggtcgtacgtgttcaacgaccagccaagaacggcaccgtgatggacgttataagtcgacgtgatcaacgtggttccggacaggtgggaacctatggcttgaacacgtttacaaacatggaggtacaacttatccggcaaatggaatccgagggcattttcctaccctcagaactagaaacgcccaacctagcagagcgggcactcgattggcttgagaaaaatggagctgaaaggctaaaaaggatggcaatctcaggcgacgactgtgtcgttaaaccaatcgacgatagatttgccacagctctgacagcattaaacgatatgggtaaagtaagaaaagatattcctcagtgggaaccgagtaaaggatggaacgattggcaacaggttcctttctgtagtcatcactttcatcagctcattatgaaagatgggcgcgaaatagtcgttccgtgtcgtaatcaagacgagctagttggcagagcacgcgttagtcagggagcaggctggagtctcagagaaacggcttgtttaggaaaatcatatgcacaaatgtggcagttgatgtactttcacagaagggatctgagattggcagccaacgctatatgtagtgcagtccctgtcgattgggtgccaacaagcaggaccacttggagtatacacgcgcaccatcagtggatgacaacagaagacatgttaagtgtctggaacagagtatggattgaagagaatccatggatggaggataaaactcatgttagttcatgggaagaagttccttatctcggaaaaagggaggatcagtggtgtggatcattaattggattaacagcaagagcaacatgggcaacaaatatacaggtggcgattaatcaagtacgtcgtctaataggtaacgaaaattatttagattatatgacatcaatgaagcgattcaagaatgaatccgattcagagggcgcattatggtaa

SEQ ID NO: 21356 - RNA, 9879 nt, synthetic construct
  misc_feature 1..9879: note = derived and/or modified CDS sequence (opt6) from DENV-1__KJ189359__SS-prME
  source 1..9879: mol_type = other RNA
tctgtcacaatgctactcatgctattaccgacggtcctagcttttcatttaacaactaggggaggcgaaccccacatgatagtaagtaaacaagaacgtggaaaatcattattatttaaaacctctgctggtgttaatatgtgcacattaattgccatggatttaggggaactatgtgaagacacaatgacttataaatgccctagaattacagaagcggaacccgatgatgtagattgttggtgtaatgccaccgatacgtgggttacatatggtacatgctcccaaacaggcgaacacagacgtgaaaaacggtctgtggcactagcaccgcatgtaggactcggtttagaaactcgcacagaaacgtggatgagtagtgaaggtgcttggaaacaaatacaacgagtagaaacatgggcattacgtcatcccggattcacggttatcgctttcttcctagcacacgctattgggaccagtataacacaaaaaggtattatttttatccttcttatgttagtcactcctagcatggctatgcgatgtgtaggaataggaaatagagactttgtagagggtctctctggagcgacatgggtagatgtagtactagagcacggatcatgtgtaacaaccatggctaaaaataaacctacactagatatagaactcctgaaaactgaagtaacaaaccctgcagtactgagaaaattatgtatagaagcaaaaattagcaatactacaacagattcgagatgccctacacaaggagaagcaacattagttgaagaacaagacgcaaattttgtttgtcgcagaacattcgtagatcgaggctgggggaacggctgcggcctattcggtaaaggaagtctattaacatgcgcaaaatttaaatgcgtcacaaaactagaaggaaaaatcgttcaatatgagaaccttaaatactcggtgatagtaacagttcacaccggcgatcaacaccaagtaggaaatgaaactactgaacacggaaccatagccacaattaccccacaagccccaacctctgagattcaactaacagattatggagcgctaaccctggattgttctccacgtacaggattagattttaatgagatggtactacttacaatgaaagaaaaatcatggctagtacataaacaatggtttttggatcttcccttaccctggacatcaggagcaagcactagccaggaaacctggaacaggcaagatttactggtcacgtttaaaacagcgcacgcaaagaaacaagaagttgtcgtattaggaagccaggagggcgcaatgcacaccgctttaacaggagctaccgaaatacagacaagtgggaccactacgatatttgctgggcacttaaaatgccgcttaaaaatggataaactcactttaaaaggcatgagctacgtaatgtgcaccggatcatttaaattagaaaaagaagtagctgaaacacagcatggaacagtattagtacaggtaaaatatgagggaacggatgcgccgtgcaaaattcccttttcaacgcaggatgaaaaaggagtaacacaaaatggcagacttataacagcgaaccccatagtaacggataaggagaaaccagtaaatattgaaactgagccgcctttcggagaaagctatatagttgtaggtgcaggagagaaagcattgaaactatcatggtttaagcgcggaagtagcattggtaagatgtttgaagcgaccgcacgtggggcgcgaagaatggcgatattaggagatactgcttgggattttggctcaataggtggtgttttcacctcggtcggtaagctagttcaccaagtgtttggcacagcatatggggttctattctctggagtatcatggacaatgaaaatcggtattggcattctattaacatggctaggcttaaactctcgttctacttctttgtctatgacatgcatagcagtaggcatggttaccttatatttaggcgtgatggtccaggcagactcaggttgcgtaattaattggaagggtcgtgagttaaaatgtggatcaggcatttttgtaactaatgaggtccatacttggactgaacagtataagttccaggcggatagtcctaaacgcctaagcgcagccatcggaaaggcttgggaagaaggagtttgtggcataagatcagcaacaagacttgaaaatataatgtggaaacaaatttccaatgaactgaaccacatacttttagaaaacgacatgaaattcactgttgtggtaggagacgcaaacggaatactagctcaaggaaagaaaatgatacggccacaaccaatggagcacaaatacagctggaaatcctggggtaaagcaaagataataggagccgacattcaaaacacgactttcataattgacgggcccgatactccagagtgtcccgacggtcaacgagcatggaatatctgggaagtagaggactatgggttcggggtatttactaccaacatatggttgaagctaagagacagctacactcagatgtgtgaccatagattgatgtcagcagcaataaaggactcgaaggcggtccatgccgatatgggttattggatagaatctgagaaaaatgaaacgtggaaactagctagagcatcgttcatagaggtaaaaacttgcacatggccaaaatctcatacgctttggagtaacggggtactcgagagtgaaatgataataccaaaaatatacggtggaccaataagccagcacaattatcgcccggggtattttacccaaaccgctggcccatggcatttgggaaagctcgaactggattttgatttatgtgagggaacaactgtagtcgttgacgagcattgcggaaaccgaggtcctagcctgaggacaacgaccgtcacaggcaaaataatacatgagtggtgctgccgctcatgtacattaccacccttacgatttcgaggagaagatgggtgctggtacggaatggagatacggcctgtgaaagaaaaagaagaaaatttggtaagatcaatggtctccgccggatctggggaagttgattcattctctttaggaattttatgcgtctccataatgattgaagaagtcatgcgatcacgttggtctcgcaagatgttgatgacaggaactcttgcagtatttttacttctaataatgggacaattaacatggaatgatctaataagactgtgtattatggtaggagcgaatgctagcgatcgaatggggatgggcacaacatatttagcgttaatggcgaccttcaagatgagaccgatgttcgccgtagggctactttttaggaggctaacaagccgagaggtactccttttaacaattggattatctttagtcgcttctgttgaacttcctaactcattagaagaattgggtgacgggttagccatgggaattatgatgcttaaattgctaactgaatttcaacctcatcaactatggactacactgctgtcactaacatttgttaagacaacactatcacttgattacgcatggaaaacaacagcaatggcattatcaatagttagtttatttcctttatgtttgtcaactacaagccagaaaacaacatggctaccagttttgttgggtagtttcggatgtaaacccctaacgatgtttctaataacggagaataaaatatggggtaggaaatcatggccgttaaatgaaggtattatggctattggaatcgtaagtattctcctaagcagtctattgaaaaacgacgtgcctttagcaggacccttaattgcaggaggtatgctcatcgcttgttatgttatttcaggaagtagtgccgatctttcattggaaaaagccgcagaagtatcatgggagcaagaggctgaacattcaggggccagccattcaatattagtcgaagttcaagacgacggtactatgaaaattaaggatgaggaaagggacgatacacttacaattctgctaaaagcaacgttactcgcagtctcgggagtatatccaatgagcatacccgccacgctttttgtctggtatttctggcagcgaaagaaacaacgtagtggcgtcttatgggacactccctccccacctgaagtagaacgcgccgttctagacaacggaatctatcgaatccttcagagaggattattgggtcggagtcaagtcggcgtaggagtatttcaagatggagtatttcacacaatgtggcatgtcactaggggtgcagttctgatgtaccaaggaaaacggctggaaccgtcttgggcatcagttaaaaaggatttaatatcgtatgggggcggctggagatttcaaggtagttggaacacaggagaagaagtacaagtaattgcggtagaacctggaaagaaccctaaaaatgtccaaacaactccaggaacattcaaaaccccggagggagaggttggggccattgctctagactttaaaccgggcacgtcaggtagccctatcgttaaccgcgaaggtaagatagtcggtctttatggtaacggtgtagtcacaacaagcggtacttatgtttctgctatcgcacaggccaaggcttctcaggaaggtccgcttccagaaatagaagatgaagtatttaagaaaagaaaccttacgataatggacctacatccagggtccggtaagacgcgtagatatcttccagcaatcgtcagagaagcaataaaacgcaagttaagaacgttaatcctagctccaacgcgagtcgttgcctcagaaatggcagaggctcttaaggggatgcctatcaggtaccagacgacagcagtcaaatccgaacacaccggcagggaaatagtagatttaatgtgtcatgctacttttacaatgagactccttagtcctgtccgtgtcccgaactacaacatgatcatcatggatgaggcacattttacagatcccgctagcatagcagcacgaggatatatatcgactagagtcggtatgggggaggctgcagcgattttcatgacggcaacgcctcccggaagcgtggaagcctttccccagagtaatgcggttattcaagatgaagagagagacataccagaacgttcatggaactcaggatatgattggataacagatttccctggaaaaacggtatggtttgtgcctagcattaaaagtgggaacgatatagcaaattgcctacggaaaaatggaaagagggtgatacaactcagtaggaaaacgttcgatacagagtatcagaaaactaaaaataatgactgggattatgttgtgacgactgacataagtgagatgggagccaattttagggcggatagagtaattgacccccgccgatgtctaaagcctgttattttaaaagacggcccggagagagtcatattggcagggccgatgccggttacagttgcatctgcggctcagagaagggggcgaatagggagaaaccaaaacaaagaaggagaccaatatgtctatatgggacaacctctgaataacgacgaagatcacgcgcactggaccgaagcaaagatgcttctggataacataaatacccccgaaggtataatccctgccttatttgaaccagagcgtgaaaagagtgctgcgatcgatggtgaatatagactacgtggggaggcacgcaaaacgtttgtggagcttatgagaagaggagatctaccagtatggctgagttacaaagttgcctcagaaggatttcaatactcagaccgaagatggtgctttgatggtgaacgcaataatcaagtattggaggaaaacatggatgttgagatatggacaaaagaaggagaacgcaagaaacttagaccacgatggctcgacgccagaacttattctgacccattggcacttcgcgagtttaaagaatttgcagcaggcagaagaagcgtaagtggtgatttaatattagaaatcggtaaactcccgcaacaccttacgctgcgggcccagaacgcattggacaacttagtgatgttacacaactcagaacaaggaggcaaagcatatcggcatgctatggaggaattgccagatacaatcgaaactctaatgctgttggctttgatagcagtattgacaggtggtgtcaccctgtttttcctgtcaggcaaagggctggggaagacgagcattggactactctgtgtcacagccagttcagcgcttttatggatggccagtgtagaacctcactggatagcagcttcaattatactagagttctttcttatggttttacttattccagagccagatcgccaaaggacaccccaagataatcaactagcttatgtagttataggcctattatttatgatcctaacggtagcagcaaatgaaatgggacttcttgaaacaaccaagaaagatttaggcataggctatgttgctgctgagaatcatcaacatacaactatgctagatgtcgatttgcacccggcatcagcatggacactatatgccgtagcaaccacggtaataactcccatgatgaggcatactattgaaaacactacggccaacataagtttaacggcgatagcgaatcaagcagccatacttatgggacttgataaaggctggccaatttcaaagatagatataggtgttcctttactagcattaggatgctatagtcaagtaaacccgctcactttaaccgctgcagttctaatgctcgttgcacattacgctataattggcccggggctacaagcaaaggctacaagagaagcgcagaaaaggacagcagcggggattatgaagaatcctacagttgatggaattgtggcgattgacttagatccagtcgtctacgacgcaaaattcgaaaaacagctcggtcagattatgctcctgatactatgtacaagtcagatattactgatgagaactacttgggctttatgtgaatctataacgctagctaccggtccgctaactacgctttgggaaggtagtccaggaaaattttggaacaccacaattgctgtctcgatggcaaatattttcaggggttcatatttagcgggagcgggcttagccttctcgcttatgaagagtttaggtgggggaagaagaggtacgggagctcaaggcgaaaccctcggagaaaaatggaaaagacaattaaatcaattaagcaagtcagaatttaatacttacaagcggtcgggaattatggaagtagataggagcgaggcaaaggaaggtctaaaaagaggcgaaacgacaaaacacgcagtatcaagaggtacagcaaaacttcgttggtttgtagaacgtaatttagtaaaaccagaaggaaaagtaattgacttaggctgtggtcggggtggatggtcctattattgtgcaggtttaaagaaagtcacagaagtgaaaggttatacaaaaggcggcccaggtcatgaagaaccaataccgatggcaacttatggttggaacctggtaaaattacattcaggcaaagatgtattctttatgccaccggaaaaatgtgacaccctactatgtgatataggtgagtcgagtcctaatccgacgattgaggaaggcaggaccttgcgcgtattaaaaatggttgaaccatggcttaggggaaatcaattttgtattaaaatactaaacccttacatgccttcagtagttgagacgctagaaagaatgcagaggaaacatgggggcatgctggtaagaaatccattaagtagaaattctacacatgaaatgtattgggtatcgtgcggcacgggcaacatagtctcagcagtcaatatgacctcaagaatgctactaaatcgttttactatggcgcatagaaaacccacttatgagagagatgttgatctgggggctggaaccagacacgttgctgtagagccagaggtagcaaatctcgatattataggacagcgcatcgaaaacataaagaatgagcacaagtctacctggcattatgatgaagataatccatataaaacttgggcatatcacggtagctatgaagttaagcctagtgggagcgcatcaagtatggttaacggtgtagtacgtttgcttacaaaaccatgggatgtgatccctatggttacccaaatcgccatgactgataccacaccctttgggcaacaacgagtatttaaagaaaaggtagataccaggacgccacgtgctaagcgaggcactacacagattatggaagttacggcgaagtggctatggggctttttatcgagaaataagaaaccaagaatctgtactcgtgaggagtttaccagaaaggtaagatctaatgcagccattggagcagtatttgtcgacgaaaatcagtggaatacggcgaaggaagctgtagaagacgagagattttgggatcttgtacaccgagaaagggaactgcataaacagggaaaatgcgcaacgtgcgtatataacatgatgggaaaaagagagaagaaattaggagaatttggcaaagctaaaggcagtcgtgcaatctggtatatgtggctaggagcaagattccttgaatttgaggctttaggatttatgaatgaggatcattggttttctagagaaaactccttgagcggcgtcgaaggagaaggattacataaattgggatatatattaagagatataagtaaaatacctgggggtaatatgtatgcggatgacactgctggttgggatacacgtatcacagaggatgatctacaaaatgaggcaaaaatcacagatatcatggaacctgagcacgcattattggccacgtctatattcaagctaacttatcaaaataaggttgtccgcgttcaaaggccagcgaaaaatggaactgttatggacgtaatctcgagaagagatcaaagaggatctggtcaggttggaacttacggtttgaacacatttaccaatatggaagtccaattgataagacaaatggagtctgaaggtattttcctgcctagcgagttagaaactcccaatttagcagaaagagcgttagactggctagagaaacacggggcggagagactaaaaagaatggctatatctggggacgattgcgttgtaaaaccaattgacgatcgatttgctacagcattaacggcacttaacgacatgggtaaagtacgaaaggatattccacaatgggaaccttcaaaaggatggaatgactggcaacaagttcccttctgctcacaccattttcaccaactaataatgaaagacggcagggaaattgtggttccttgtagaaatcaagatgaactcgtcggcagagcacgcgtttcgcagggtgcgggctggagtttaagggaaactgcgtgtctcggcaagtcttatgcacaaatgtggcaattaatgtatttccacagaagagacctcagattggccgccaatgcaatatgttcagcagtacctgtcgattgggtaccgacaagtcgtacaacatggtccattcacgcacatcatcaatggatgacgactgaagacatgctctcagtctggaatagagtatggatagaagaaaacccatggatggaagataagacccatgtgagcagctgggaagaagttccctatctcggtaaaagagaggatcaatggtgtggatcgttaatcgggctaacagctcgagcgacatgggctacaaacatccaagttgcgataaatcaagttcgtagattgatcgggaatgaaaattacttagactacatgacatctatgaaacgatttaagaatgaaagcgactctgaaggtgctctatggtga

SEQ ID NO: 21357 - RNA, 9879 nt, synthetic construct
  misc_feature 1..9879: note = derived and/or modified CDS sequence (opt6) from DENV-1__KJ189360__SS-prME
  source 1..9879: mol_type = other RNA
tctgttactatgttactcatgcttctcccgacggctctagccttccacctgactacaagaggaggggaaccacacatgatagtatcgaaacaagaaagaggtaaatcgttgttatttaaaacttcagctggtgtgaatatgtgtaccttaattgctatggacctgggggaactatgtgaagacacaatgacgtacaaatgtccacgcataacagaagcagaaccagatgatgtagactgctggtgtaatgccacagacacctgggtcacttatggaacttgttcccaaacaggtgaacacagaagagaaaaacgaagtgtagcattagctccacatgttggattggggttagaaacaaggactgaaacatggatgtcttctgaaggagcatggaaacaaatccaacgcgtcgaaacatgggctctgagacatccaggctttacggttatagctttctttctagcacatgccatagggacatcaatcacacaaaaaggaattattttcattttattaatgctagtaacaccctctatggcaatgagatgtgtagggatcggaaatagggattttgtagaaggtctatcaggggctacttgggtagatgtagtgctagaacatgggagctgcgtcactacaatggccaaaaataaaccaacattggacattgaattactaaaaactgaagttacaaacccagcggtattaagaaaactgtgcatagaagcgaaaatttcaaacactactacggatagccgatgtcctacgcaaggtgaagcaacattagtggaagaacaagacgctaattttgtgtgtagaagaaccttcgtagaccgggggtggggaaatggatgtggtctctttggcaaaggttcacttctaacttgcgcaaaattcaaatgcgtaactaaactagaaggtaaaattgtacaatacgagaatctgaaatattctgtgattgtaacagtacataccggcgatcaacatcaagtaggtaatgaaaccactgaacacggcacaatcgcgacaattacgccccaagcacccacaagtgaaatacaattgacagattatggcgctctaacactagattgctcccccagaacaggactggattttaatgagatggttctactaacaatgaaagaaaaatcttggttagtccataaacaatggttccttgacttgccgttgccatggacaagtggggcgtctacatctcaagagacttggaatagacaagatcttttagtcacattcaaaactgcgcatgccaagaaacaagaggtcgtagttctgggttctcaagaaggagctatgcataccgctttgaccggagctactgaaatccagacctccggaacaactacaattttcgctggacatttgaaatgtagattaaaaatggataagttaactcttaaaggaatgagctatgtcatgtgtacaggatcatttaaattggaaaaagaggttgcagaaacacaacatggtacagtattagtacaagttaaatatgaaggtacagatgctccatgcaagataccattttccactcaggatgagaaaggagtgactcaaaatggaagactaattacagctaacccgatagttactgataaagagaaacccgtcaatatagagactgagccaccgttcggagaatcctacatagtggttggtgctggtgagaaagcactaaaactgagctggtttaagcgaggcagttcgatcgggaaaatgtttgaagccactgctagaggggcgagacgcatggcaatactaggggacacggcgtgggattttggctctatagggggtgtttttacatctgtaggaaagttagtccatcaaatattcggaaccgcatatggagtattatttagcggagtttcatggacaatgaaaatcggcattggtatactactaacttggctaggattgaactcacgatccacctctttatcaatgacctgtattgcggtaggtatggtaacgttatacttaggggtaatggtacaggcggatagtggatgtgtaattaactggaagggtcgggaacttaaatgtggttcaggaatttttgttaccaatgaagtacatacatggaccgagcagtataagtttcaagcagattctcccaaacgtctatcagctgccatagggaaggcttgggaggaaggggtatgcggaatacgctctgccacaagactagaaaatattatgtggaagcaaatatcgaatgaattaaatcatatactccttgaaaacgacatgaaatttacagtggttgtaggagatgctaatggaatactagcgcaaggcaagaagatgatacgtcctcaaccaatggaacataaatattcatggaagtcttgggggaaagcaaaaataatcggagctgatatacagaatacaactttcataatagacgggccggatacacccgagtgtccagatggccaaagagcctggaatatatgggaagtagaagattacggtttcggtgtgttcacaacaaatatatggcttaaattacgtgattcctatacacaaatgtgtgatcacaggcttatgtcagcagcgattaaggattctaaagcggtgcacgccgatatgggatactggatagaaagtgagaaaaatgagacatggaaacttgccagggcgagtttcatagaagttaaaacatgtacatggccaaagtcacatactctttggtcaaatggtgttctagagagtgaaatgattatacccaaaatttatggagggcccatatcacaacacaactatagaccaggatattttacacaaactgccggtccgtggcatttaggcaaacttgaactagactttgatctttgcgagggaactactgttgtagtcgatgaacattgtggaaaccgaggaccctccctgcgtacaacgacggtgacaggtaagattatccatgaatggtgttgtcgatcatgcactctaccacccctcaggttcaggggagaggacggatgctggtacggaatggagattcgacctgtaaaagaaaaggaagaaaacctagtgcgcagtatggtatcagccggtagtggtgaggttgattcatttagtcttgggattctttgtgtatcaataatgatagaagaagtaatgagatcacgatggagtagaaaaatgctaatgactggtactctagccgtctttctgctccttatcatgggacaactaacttggaacgatcttatacgactttgtataatggtaggtgcgaacgcttctgatagaatgggcatggggacaacatacctagccctgatggctactttcaaaatgagaccgatgtttgcagtgggattattattccgacgattaacttccagagaagtgcttctcttaactataggtttgagcctagttgctagcgttgaactcccaaatagtctagaagaactaggagacggactagcaatgggaattatgatgttaaaattgctaactgaatttcaaccgcaccaattgtggaccacactactaagcctgacatttgtcaaaactaccctaagcctagattacgcatggaagacaactgcgatggctttatctatcgtttcactttttccactctgcctatccactacttcgcagaaaactacctggttaccggtgctattagggtcattcgggtgtaagccactaacaatgttccttataactgaaaataaaatatgggggcgtaagtcatggccgttaaatgaaggtatcatggcaataggtatcgtatcgatcttactatcttcattgctaaagaacgatgtccctctagcaggtccattaatagcaggagggatgctaattgcgtgctatgtcatatctggttcaagtgcggatttatctctggaaaaagcggccgaagtcagttgggaacaagaagctgaacacagtggcgcaagccatagcattctcgttgaagtacaagacgacggcacaatgaaaattaaagacgaagaaagagacgatacattaacaatattattaaaagcaaccttattagcggtaagcggagtgtatcctatgtctatacctgccactctatttgtatggtacttttggcagaagaagaaacaaaggtctggcgtattatgggatacaccatcgccgccagaagtcgaacgcgctgttttggacaatgggatttatcggatattacaacgaggattacttggaagatctcaagtcggagtaggcgtattccaagatggcgtatttcatacaatgtggcatgttactaggggagctgtgttgatgtaccaaggtaaaagattagaacctagttgggcaagcgtaaagaaagatcttatatcatacggcgggggctggaggtttcagggaagctggaatacaggagaagaagtacaagtaatcgctgtagagccaggcaaaaatcccaaaaatgtacaaacaacacctggaacattcaaaacgccggaaggggaggtcggtgcaatcgccctcgatttcaagccgggaacgagtggaagtccgatagtgaacagggaaggcaaaatcgttgggttatatggaaatggagtggtaactacatcaggtacatatgtatcagcaatcgcccaagcgaaggcgtcacaagaaggtccactcccggaaattgaagacgaagtatttaagaagagaaacttaaccataatggacctgcatccagggtcgggcaaaacaagaagataccttccagcgattgttagagaagctatcaaaaggaaactgaggacactaatcttagctccaacaagagtagtagccagtgaaatggcggaagcattaaaaggtatgccaataaggtaccaaacaacggcagtaaaatctgaacatactgggagagagatagtggatctaatgtgtcatgctacttttacaatgcgattgttatccccagtacgagtacctaattataatatgataataatggacgaagcacatttcacagatccagcgtcaatcgcggcaaggggttacatatcaacacgagttggaatgggagaagccgctgccatcttcatgacagccaccccaccaggcagcgtcgaagcgtttccacaatcaaatgcggtgatacaagatgaagaacgagacatacccgaaaggtcatggaactcaggatatgattggataactgactttccaggaaaaacggtgtggttcgttccatcaatcaaatcaggaaacgatatagcgaactgtttacgtaaaaatggtaaacgcgtaattcaactatcacgcaagaccttcgacacagaatatcagaaaaccaaaaacaacgactgggactacgtagttacaacagacataagcgagatgggagcgaattttcgagccgatcgagtaattgacccaagaaggtgtctaaaacccgtaatattaaaagatggccccgaaagagtaatactggctggaccgatgccagtgactgcagcatccgcggcccagaggcggggtcgcatcggtcgcaaccagaataaagagggagaccagtatgtttacatgggtcaaccactaaataatgacgaagaccacgcgcactggacagaagcaaagatgctacttgataatataaacacccctgaaggaattattcccgcgttatttgaacctgaaagagagaagagtgcagcaattgacggtgagtacagattaaggggtgaagcgagaaagacctttgtagaactaatgagaagaggggacctgccagtttggttaagttacaaagtcgcgtccgagggttttcagtactcagatcgacgttggtgcttcgatggagagcgaaataatcaagttctggaagaaaatatggatgtcgagatatggactaaagaaggggaaaggaagaaacttaggccccgttggttggacgcacgaacgtatagcgaccctttagcattaagagaatttaaagaatttgcagcaggcagaagatcagtatcgggagatttaatccttgaaataggcaagctaccacaacatctaactttacgagcacaaaacgctctagacaatttagtaatgctccacaattcggaacaaggaggtaaagcataccgacatgcaatggaggaattaccagatacaattgagactttaatgcttctagctttgattgcggtactgactggaggtgtaacactattctttctatcaggcaaaggactaggaaaaacaagtataggtctcctatgtgtaactgcatcgtccgcacttctttggatggcatcagttgaaccacattggattgctgcatcaataattctggaatttttcttaatggtcctcctaatacctgaaccagaccggcaaagaacccctcaagataaccaattagcctatgtagtcattggattgctattcatgattttaaccgtagctgcgaacgagatggggctgttagaaacgaccaagaaagatctaggaataggttatgtcgcagcagaaaatcatcaacatgcaactatgctcgatgtagatttacatcctgcatctgcctggacgctatatgctgttgcgactacagtaattacaccaatgatgaggcacacgatagaaaatactacggccaatatatccttaactgcaatagcaaatcaagcagctatattgatgggacttgataaaggttggccaatttcaaaaatggacatcggagtacccttactagctcttggatgttattcacaagttaatcctctaacgctaacggcggcagtattgatgttggtagcacactatgcaataatcggtcccgggttacaagctaaagcaacacgagaagcccagaaaagaacagcagcgggtattatgaaaaacccaacagtcgatggaatagtagcgatcgacttggacccagtagtttatgatgcaaaattcgaaaaacaactaggacaaataatgctccttattctatgtacatcgcaaatacttttaatgcgaacaacttgggcgctctgcgaaagcattacgcttgcaacaggtcctttaacaactctctgggaaggcagtcccggtaaattttggaatacaactattgcagtcagtatggcaaacatctttagagggtcgtacctagctggagccggtttagctttcagccttatgaaatcactagggggtggtcgtagagggacaggagcgcagggcgaaacactaggtgaaaagtggaagaggcaacttaatcaattatctaaatcagaatttaatacgtataaaagatctggcatcatggaagttgaccgatcggaagccaaagagggcctaaagagaggcgaaacgacaaagcatgccgtctcccggggcacagctaagctacggtggttcgttgaaaggaacttggttaaacccgaagggaaggttattgacctcggttgtggccgagggggatggagttactactgcgcgggcctcaaaaaggttacagaggtcaaagggtacacgaaagggggaccagggcacgaagaaccgattccaatggccacatacggttggaatttagtaaaactacattcaggtaaagatgtatttttcatgccgccagagaagtgcgataccctcctatgtgatataggtgaatcaagtccgaacccaactatcgaggaaggtcgaactttaagagtattgaaaatggtcgaaccatggttaaggggaaaccagttttgtatcaaaatcttgaatccatatatgccaagtgtagtcgagacgttagaacgaatgcaaagaaaacatgggggaatgttagtccgaaatcccttatcaagaaacagtacgcatgaaatgtattgggtttcgtgtggtactggaaacatagtttccgcagtcaatatgacgtcgaggatgctactaaaccgttttacgatggcacatcggaaaccaacatatgaacgagacgtagatttgggggcaggaacaagacatgttgcagtggaaccggaggttgcgaatctcgacatcattgggcagcgtattgaaaatattaaaaacgaacataaaagtacctggcattacgatgaagacaatccctacaaaacctgggcgtatcacggtagctatgaagtgaaaccaagtgggagtgcttccagtatggttaatggagtcgttaggcttctgacgaaaccgtgggatgttatacctatggtcacgcagattgcaatgaccgatacaactccgttcggacaacaaagggtatttaaagaaaaggtagataccaggactcccagggcaaaaagaggtacaacgcaaattatggaagtaacagcaaaatggttatggggtttcctatcccgaaataaaaagcctcgtatatgcaccagggaagaatttacaagaaaggttagatcgaacgccgcaataggtgcggtatttgtagacgagaatcaatggaactcggcgaaagaagcagtagaagatgaacgattctgggatctagtgcatcgagaaagggaattacacaaacaaggaaagtgcgcaacgtgtgtctacaacatgatgggcaaaagagagaagaaacttggggaatttggaaaagcaaaaggaagcagagctatttggtacatgtggctaggcgcaaggtttctagagttcgaggctttgggttttatgaatgaggaccattggtttagtcgagagaactcattaagcggcgtcgaaggtgaaggattgcataaattagggtatattttgagagatattagtaagataccaggcggcaatatgtatgcagatgatacggccggttgggacactagagttacagaagatgatttacaaaatgaagctaaaatcacggatataatggagccggagcacgctctcctagccacctccatattcaagctaacctaccagaataaggtggtaagggtacaaagacctgcaaagaacggcacagtaatggacgtgatatccagacgagaccagcgagggtcaggccaggtaggcacgtatggcctaaataccttcacaaatatggaagtccaactcatacgacagatggaaagtgaaggtatatttcttccatcagaactagagacgcctaatttggcagaacgtgcattagattggcttgaaaaacacggggcagaaagactcaaacgtatggcaataagcggtgacgattgtgtagttaaaccgatagatgaccggtttgctacggccttgactgcgttaaacgatatgggaaaagtcagaaaagatatcccacaatgggaaccatcaaaaggctggaacgattggcaacaagtccccttctgctcgcaccacttccatcaattaattatgaaagacggtcgcgaaatagtagttccatgtcgaaatcaagacgaacttgtagggagggcacgggttagtcagggagctgggtggagtctaagagaaacggcctgcctaggaaagtcttatgctcagatgtggcaacttatgtattttcatcggcgagacctaagactcgcagcaaatgcaatttgctccgctgtcccagtagactgggttcccacaagcagaacgacatggtcaattcatgcacatcatcagtggatgaccacagaagatatgttatcagtttggaacagagtatggatagaagaaaatccctggatggaaaacaaaacccatgtatcaagttgggaagaagtgccctacttagggaaacgagaggatcaatggtgcggatcacttataggcttaacggctcgggctacttgggcaacaaatatacaggtagctataaatcaagttagaagactgattggaaatgaaaattatttggactacatgacaagtatgaaacggtttaaaaatgaatccgattcagaaggagcgttatggtag

SEQ ID NO: 21358 - RNA, 9879 nt, synthetic construct
  misc_feature 1..9879: note = derived and/or modified CDS sequence (opt6) from DENV-1__KJ189361__SS-prME
  source 1..9879: mol_type = other RNA
agtgttacgatgttgctaatgctacttcccacggctatggctttccacctaacgactcgagggggagaaccgcatatgatagtgtctaaacaagaacgtggtaaatccttactcttcaaaacctctgcaggggttaatatgtgcacattaatcgcaatggacctgggagaactatgtgaagatactatgacatacaaatgtccccgaattacagaagcagaaccagatgatgtggattgctggtgtaacgcaaccgacacatgggtaacatacggcacctgttcgcaaacaggagaacacagaagggaaaaacgatcagtggcgctagcgccacacgtgggcctaggactcgaaacacgaaccgaaacttggatgtccagtgaaggggcttggaaacaaatccaacgggtagaaacttgggcattaaggcatccaggatttacggtaattgctttcttcctcgcgcacgctataggtacaagtataacgcaaaaaggtatcatatttatcctacttatgttagtaaccccatcgatggctatgagatgcgtaggaatcggaaatagagatttcgtagaaggattatccggagccacatgggttgatgtagtgttagaacacggtagctgcgttacaaccatggcgaaaaacaaacctacgctggatatcgaactcctaaaaacagaagtgacgaatccagcagtcctcagaaaactgtgcatagaagcaaaaatctctaacacaacgacagactcaagatgccctactcaaggagaagccaccttggtagaagaacaagatgcaaatttcgtatgccggagaaccttcgtagacagaggatgggggaacggatgtggattatttggcaaaggttccctcttaacctgtgcaaaatttaaatgtgtgactaaactggaaggcaaaattgtgcaatatgaaaatctaaaatattctgttattgtaacagtacacacaggagatcagcatcaagtaggtaatgagaccacagaacacggcacaatagcgactataactccacaagcaccgacatctgaaatacaactcactgattacggagcgttgacactggattgctctccaaggaccggacttgattttaatgaaatggttctgttgactatgaaagaaaaatcctggctggtacacaaacagtggttcttagaccttccattgccatggacctcgggagcttccacgtcacaagaaacatggaaccgacaagatttgttggtgactttcaaaactgcccatgccaagaaacaagaagttgtagtactcgggtcacaagaaggcgcaatgcatacagcattaactggcgctaccgaaatccaaacctccggcactacgactatatttgcaggacatttaaaatgtcgactgaagatggataaattaaccctcaaaggaatgtcgtatgtaatgtgcactggaagttttaagttagaaaaagaggtggcggaaacacagcatggaacagtattagtacaagtaaaatacgaaggtacagatgcaccttgcaagatcccgttctccacacaggacgaaaaaggtgtcacgcaaaacggtaggctaatcacagcaaacccaatcgtaactgacaaggagaaacctgttaacattgaaaccgaaccaccgtttggcgaatcttatatcgtagtaggtgctggtgagaaagcactaaaattaagctggtttaaaaggggaagctctataggcaaaatgtttgaagccacagctcgcggagcacgaaggatggcaatcctgggcgacactgcgtgggacttcggaagtattggaggcgtttttacctcagtcggaaagctcgtacatcaaatatttggtactgcttatggtgtactattttcgggagtcagctggacgatgaaaatcggcataggtatacttttaacatggcttggactaaacagtcgttccaccagtctgagcatgacatgtattgccgtaggtatggtaacactctatttaggtgtgatggtccaggctgacagtggatgcgtaataaattggaagggaagagagctaaaatgtggaagcgggatctttgtaactaacgaagttcatacatggaccgagcaatataaatttcaagctgattcaccaaagcgactaagcgcagctataggaaaagcatgggaagagggagtttgtggcatacgtagcgcaacaagactggagaacattatgtggaaacagatcagtaatgaattaaaccacattctattagaaaatgatatgaagtttacagtggtagtaggggatgctaacggcattcttgcacaaggcaagaaaatgatcagaccacaacctatggaacataagtacagctggaaatcctggggtaaggcgaaaataatcggtgctgatatacaaaacactacctttatcatagatggaccggacacacccgagtgtccagacggtcagagagcatggaacatatgggaagttgaagattacggcttcggagtattcaccaccaatatatggttaaagctacgagattcatacactcaaatgtgcgatcaccgactcatgtccgcagctattaaagattctaaagctgtgcatgcagacatggggtactggatcgagagtgagaagaatgagacatggaaattagcaagagcttcgttcatcgaagtaaaaacttgcacgtggccaaaatcacatacactatggtctaatggagtactagaatctgagatgatcatccctaaaatatacggaggtccgatcagtcaacataattatcggcctggctactttacacaaactgcagggccatggcatctaggtaaactcgaacttgactttgatctttgcgaaggaacaactgtagttgtagatgagcattgcggcaatagaggacctagtcttcgaacaacaacggtaactggaaaaataattcatgaatggtgttgccgatcttgtacgctgcctccactaagattcagaggagaagatggttgttggtacgggatggagattaggccagttaaggaaaaggaagaaaatttggtgagatcaatggtctccgccggttcaggtgaggttgactcattcagccttggcattctatgtgtctcgattatgatagaagaagtgatgagatccagatggtcacgtaaaatgcttatgacagggacattagcagtttttctattattgataatgggtcagttgacgtggaatgacttgatacgattatgtataatggttggggccaatgccagcgacaggatgggtatgggcacaacatatttggcgctcatggccacattcaagatgagacccatgtttgcagtaggtctgctttttcggagactaacaagtagagaagtactgctactaaccatcggtctgtctttagtcgcctcagttgaactaccaaattccctcgaagaactcggtgacgggctggcgatgggtattatgatgctaaaacttttaacagagttccaaccacatcaactatggactacacttcttagcttgacctttgtgaaaactaccttgtctttagactacgcttggaaaacaacagcaatggccctatccatagtctccttattcccgctatgtttatcaactacgagtcaaaagacaacttggttacctgtactgctaggttcctttggctgcaaaccattaacaatgttcttaataacagagaacaaaatttggggacggaaaagttggccattaaatgaaggtataatggcaattggcatagtctcgatattactaagtagcctattgaaaaatgatgtaccactggcgggtccattgatcgcaggcggcatgcttatagcctgttacgtcatcagtggaagctcagcggacttatctttagaaaaagcagctgaagtatcgtgggaacaagaggcggaacattcaggcgcctctcactcaattttagtggaagtccaggatgatggaacaatgaagataaaagatgaggaacgagacgacacacttacaattcttctaaaagctacattgctagcagtgagtggtgtttatcctatgtcaattcccgctactttatttgtctggtacttttggcaaaagaagaaacagcgctcaggagtcctgtgggacacaccttcccctccggaagtagaacgggcagtattagataatggaatatatcgtatcttacaaaggggtttgttaggtcgatcacaggtaggagtaggggtcttccaggatggagtttttcatactatgtggcatgtaacgaggggcgcggttttaatgtatcaaggaaaaagactagagccaagctgggcatccgtcaagaaagaccttataagttatggcgggggatggcgattccaaggcagctggaacacgggagaggaagtacaagtgattgctgtggaaccgggtaaaaatcctaaaaatgttcaaacgacaccggggactttcaaaacaccggaaggagaagtaggagccatcgccctagattttaagccggggacttcaggatcacccattgtaaatcgcgagggtaagatagtgggactgtatggcaatggtgtagtaacaacaagcggtacatatgtcagtgcaatcgcacaagctaaagcatcgcaagaaggacccttgccagagatcgaggatgaagtgtttaagaagagaaacttgactataatggatctacaccccggctccggaaagacccggcgatacctaccagcaatagtaagagaggctataaaaagaaagttacgaactttaattctagcaccaacccgagtagtggcttctgaaatggctgaggccctcaaaggtatgccaatcaggtatcaaaccaccgctgttaagtcagaacacacgggacgcgaaattgttgacctaatgtgccatgcaacatttacaatgagattactgagtcctgttagagtcccaaactataatatgattataatggatgaggctcactttactgaccccgcatctatagccgcccgaggttatataagcacaagggtaggaatgggagaggcggccgctatatttatgaccgcaactccacccgggagcgttgaggcttttccacagagcaacgccgttattcaagatgaagaaagggatatacctgagagatcatggaactcaggctatgactggatcacagattttccaggaaagacggtttggttcgtaccaagcataaaatcagggaatgatatagctaactgtttgcgcaaaaatggaaaaagagttatacaactaagcagaaagacctttgatacggagtaccagaaaacgaaaaacaatgactgggactatgtagtcacaacagacatatctgaaatgggagcaaatttccgcgccgacagagtcattgacccaagacgatgtcttaaaccggtaattctcaaagacggccccgaacgcgtaattctagctggaccaatgccagtgacggcggcatctgccgcacaacgacgaggtagaataggtagaaatcaaaacaaagagggggatcaatatgtctatatggggcaaccgttaaataacgatgaagaccatgcgcattggactgaagcaaaaatgttattggataacataaacactccagaaggcattatacctgccttatttgaaccagagcgagagaaaagcgcagctatagacggtgagtatagactaagaggcgaagcgagaaaaacctttgtcgagcttatgcgaagaggggatttaccagtatggttatcatataaggtcgcatcagaaggatttcaatactcagataggcgctggtgtttcgatggagaaaggaacaatcaagtacttgaagaaaacatggacgttgaaatatggacaaaagaaggagaacgaaagaaacttcgaccaagatggcttgacgctagaacttactcggatccacttgcacttcgagaatttaaggagttcgccgcaggtcgtaggagcgtttcaggggatcttattttagagatcggaaaactgccacaacatctaacactccgtgctcaaaatgcgctcgataatttagtaatgttacataatagcgaacaaggtgggaaagcataccgacacgcaatggaagaactaccagacacaatcgagactctaatgttacttgcactcatcgcagtgttaacagggggagttacattattctttctgtccggcaaaggtttaggaaaaacctccatagggctactctgtgtgacagccagttctgcactattatggatggcctcagtagaaccccattggatcgcagccagcattattttggagttctttcttatggtacttctcatcccggaaccagatagacaacgaacacctcaagataatcaattggcctatgttgtcataggcttattattcatgatactcacagtagcagcaaatgaaatgggattactcgaaaccactaagaaagacttgggaataggatacgtagcagccgaaaaccatcaacatgccactatgttagatgtggacctacatcccgcatcagcatggacattgtacgcagttgcaacaaccgtaatcacgcctatgatgagacacaccattgagaacacaaccgcgaatatatcacttaccgcaattgcaaatcaagcagctatattgatgggattagataaaggatggccaatatcgaaaatggatataggagttcctcttctagcactagggtgctatagtcaagtaaacccattaactttaaccgcagccgtactaatgctcgtagcgcactatgcaatcattggtcctggccttcaagctaaggctacaagagaagcgcagaaaagaactgctgcaggcataatgaagaatccaactgtagacggtatcgtagcaatagatctggacccagtagtctatgacgcgaaatttgaaaagcaattaggccaaattatgttactaattctatgcactagccaaatattactaatgcggactacctgggctctctgtgagtcaattacgttagcaacgggtccactgactaccttatgggaaggatcccccggcaagttctggaatacaaccatagcggtatcaatggcaaatatatttaggggctcttatctagctggcgcgggtctggccttctcacttatgaagtcattagggggtggaagaagaggaacaggtgcacagggggaaactttaggtgaaaaatggaaaaggcaactcaatcaactgagcaaaagcgagttcaacacttataaaagaagtggaataatggaagtcgatcgctctgaggcaaaagaaggattaaaacgtggagaaaccactaaacatgcagtcagtcgtggaacggcaaaattgagatggtttgtagaaagaaatcttgttaaaccggaggggaaagtaattgatttgggttgtggcaggggtggttggagctactactgtgcaggcctaaagaaagtcaccgaagtaaaaggttatacaaaaggaggtccgggccatgaagaaccaataccgatggccacgtacggatggaacctagtgaagctacactccggtaaagatgtatttttcatgccaccagagaaatgcgacacactattatgtgacattggcgaatcttctcccaatcccactatagaagagggaagaaccttacgggtactcaagatggtagagccctggctaagaggaaaccagttctgtatcaaaatacttaacccatatatgccatcagtagtcgaaactcttgaacgaatgcagcgcaaacacgggggcatgttggtaagaaatcctctgtcccgaaattccactcatgaaatgtattgggtaagttgcggtactggaaacattgtatcggctgtaaacatgactagcagaatgttattaaacaggttcacaatggctcatagaaagccaacatacgaacgtgatgtagacttaggcgcaggaacgagacacgtagccgttgaacctgaagttgcaaatcttgatattataggacagcgtattgagaatattaaaaacgagcataaatccacttggcattacgatgaagataacccttacaaaacatgggcatatcatggaagctatgaagtaaagccttccggatcggcaagttctatggtaaacggggttgtcagactactcacaaagccctgggatgtaatacctatggtcacacaaattgccatgacagatacgactccatttggtcaacaacgcgtgttcaaagaaaaagtcgacaccagaactcctagggcgaaacgcgggacaacccaaattatggaggtgactgctaaatggctctgggggtttttatcgagaaataagaaaccgcgaatatgcacacgcgaagaatttacccgcaaagtcagaagtaatgctgcaataggcgctgtgtttgtagatgaaaatcaatggaactccgctaaagaagctgtagaggatgaacgcttttgggatttagttcacagagagcgagaactacacaagcaaggaaaatgtgccacttgtgtttacaatatgatgggtaaacgtgagaagaaattaggagagttcggcaaagcaaaaggatcacgagcaatttggtatatgtggttgggcgcaagatttctagaatttgaagctcttggcttcatgaatgaagatcactggtttagcagagaaaactcactttccggagttgagggtgaagggttacacaaactgggatatatactaagagacatcagcaaaataccagggggaaacatgtacgcagatgacactgcgggatgggatacccgtgttacagaagatgacttacaaaacgaagcaaaaataacagatataatggaaccagaacacgccctactagcgacaagtatttttaaactcacgtatcagaataaagtagttagagtacagagaccggctaagaatggcacggtgatggatgtaataagtcgacgtgatcaaagggggtcggggcaagtcggtacttacggtttaaataccttcaccaatatggaagttcaactaatcagacaaatggaatcggaaggaatatttctcccgtctgaactagagacgccaaacctggccgaacgtgccttggactggctagaaaaacatggagcggaacgccttaaacgcatggccattagtggagatgactgcgttgtaaagcccatagacgacagatttgcaaccgctctcacagcccttaacgacatggggaaagtaagaaaagacattccacaatgggagcctagtaagggatggaatgattggcaacaagttcccttttgcagccatcacttccaccaacttataatgaaagatggtcgcgagatagtagtaccatgccgtaatcaagacgagttggtcggtcgagcaagggtaagtcaaggggctggctggagcttacgtgaaaccgcttgccttggaaaatcttacgcgcaaatgtggcaacttatgtattttcatagaagagacctgcgcctcgcggcgaacgctatttgttctgcagtaccagtggattgggtaccaacttcgcgcacaacttggagcatacacgcgcatcaccaatggatgacaaccgaggatatgttaagtgtatggaatagagtttggatagaagaaaacccatggatggaggataaaacccacgtctctagctgggaagaagttccatatctaggcaaacgggaggatcaatggtgcggatcactcataggcctaactgcgagggccacttgggcaacaaatatacaagtagccattaatcaagtacgtagactcatcggaaatgaaaactatttggattatatgacaagcatgaaaagatttaaaaatgaatcggatagtgaaggagctctctggtaa

SEQ ID NO: 21359 - RNA, 9879 nt, synthetic construct
  misc_feature 1..9879: note = derived and/or modified CDS sequence (opt6) from DENV-1__KJ189362__SS-prME
  source 1..9879: mol_type = other RNA
tcagtaactatgctactaatgttattaccaactgcactagcatttcacttaacgactcgagggggagaaccacacatgatagtttcgaaacaagaacgaggaaaatcactactttttaaaactagcgctggtgtaaatatgtgtacactcatagcaatggacttaggggaattgtgcgaagatacaatgacctataaatgcccacgaattactgaagcagaaccagatgacgtcgactgctggtgtaacgcaacagacacatgggtaacttatggcacatgcagccaaactggagaacacaggcgagaaaagagaagtgtagcactggcacctcacgtaggactaggacttgaaacacgaacagaaacctggatgtcttcggaaggcgcatggaaacaaatacaaagagtggagacttgggcattaagacatcctggatttacggtcattgcatttttccttgctcacgcgatcgggacgtcaattacccaaaaagggattatatttatcctactaatgttagttacaccctccatggcaatgaggtgcgtggggattggaaatagagacttcgtagaaggcttaagtggtgccacatgggtggatgtggtactggaacatggatcgtgcgtaacaacaatggccaaaaacaaaccgacgctggatattgaacttttgaaaacggaagtcacaaacccagctgttttaagaaaattgtgtattgaagcaaagatatcaaatacaaccactgattcccgatgcccgacccaaggagaagctacacttgtggaggaacaagacgccaacttcgtgtgtcgaagaacactcgtggacaggggatggggaaacggatgtgggctatttggcaaagggtcattactaacttgtgctaaatttaagtgcgtgacaaaattagaggggaaaattgtacaatacgaaaacttaaagtattctgtaatagtcactgttcatacaggcgatcaacatcaagtcggtaatgaaacaactgaacacggaaccattgctacaataacaccacaggcacctacatctgaaatacaactaacagattatggagctctaacattagattgtagtcccagaacaggactggactttaatgaaatggtacttctcacaatgaaagagaagtcatggttagtacacaagcaatggtttctagacttaccactcccttggacaagtggggcatcaacaagccaagaaacatggaaccgacaagatctgctcgttaccttcaaaacagcgcacgctaagaaacaagaagtagtagtactaggctcacaagaaggtgctatgcacactgctttaacaggagctacagagatccaaacaagtggaacgaccacgatcttcgcaggccaccttaaatgtaggcttaaaatggacaaattaactttgaaaggtatgtcatatgtgatgtgtaccggttcgtttaaactcgaaaaagaagttgccgagacccaacacggaacagtcttagttcaagtaaaatatgaaggtaccgatgcaccctgcaaaataccattttcgacacaagacgagaaaggaatgacgcaaaacggaaggctaattacagcaaatccaatcgttactgacaaggaaaagcctgtcaacatagagactgaaccgccatttggagagagctatatagtggtaggggctggagagaaagcgttaaaactatcctggtttaaaaggggctcaagcatcggtaaaatgtttgaggcaacagcaagaggagcaagacgtatggctatcttaggggacacggcttgggattttggcagtataggcggagtttttacttctgtgggaaaattagtacatcaaatctttggtactgcttatggcgttctgttctcgggtgtttcatggacgatgaagataggtattggcatccttttaacatggttaggccttaattcccgaagtacctcattatcgatgacctgtatagctgtgggtatggtgacattgtatctcggggttatggttcaagcagacagtggatgtgttattaattggaaaggaagagaattgaaatgcggatcaggaatttttgtgaccaatgaagtccatacctggacagaacagtataaatttcaagcagacagtccgaaaaggctctctgcggcaatcggtaaggcatgggaagaaggagtatgcggcatacgcagtgcaactagactagagaatattatgtggaaacaaatttcgaatgaattaaatcatatacttctggaaaatgacatgaaatttacagtagtagtaggagatgccaacggtatattagcacaaggcaagaaaatgattaggccacaaccaatggagcataagtattcctggaaaagttggggaaaagcaaagattataggggcagatattcagaatacgactttcataatagatggacctgatactccagagtgtccggacggtcaacgggcctggaacatttgggaagttgaggactatggctttggagtttttacaaccaatatttggttaaaacttagagactcctacactcaaatgtgcgatcaccgactaatgtcagcagcgatcaaggatagtaaggcagtacacgcagatatgggctactggatagaaagcgagaaaaacgagacatggaaactagcaagggcaagttttatcgaagtgaagacttgtacgtggccgaaaagtcatacattgtggagcaatggcgtactggagtcagagatgataataccaaaaatctacggcggacccataagccagcacaattatcgtcctggatattttacgcaaacagctggaccatggcaccttggcaaattagaactcgattttgacctttgtgagggtacaactgtggtcgtagacgaacattgcggaaaccgtgggccttcactgaggactacaacagtaacaggcaagattattcatgagtggtgttgtcgaagttgtaccctaccacctttaagattccgcggagaagacggttgttggtatggtatggagatccgccccgtaaaagagaaggaagagaatttggtacgaagtatggtatcagcaggaagcggagaggtagattctttttcattaggcatcctatgcgtatcaataatgatagaagaagttatgagatcaagatggtctagaaaaatgctaatgactggtactctagcagtctttttactgctaataatgggacaactaacatggaatgacctcatacgtctgtgtattatggtaggagccaacgcgagtgatagaatgggaatgggtacaacatacctcgctctcatggcaacttttaaaatgaggcctatgttcgctgtaggattgttatttagacgactaacatctcgtgaggttctattgctaacaattggattgagcttagttgcttccgtcgaattaccaaattcgttggaggagttaggagacggattagctatgggaataatgatgttaaaactactgacagagttccaacctcatcaactctggacaacattattatcattgacgtttgtacgtactacattaagtctagattacgcctggaagacaacggctatggcactaagtatagtatcactcttcccattgtgcctatcgaccacaagtcagaaaaccacatggctgccggtacttctgggcagcttcggctgcaaacctctaactatgtttctgataacagaaaacaaaatatggggaagaaagtcatggccactaaatgagggaataatggcaatcggcatagtttcaattctattatctagtttattaaagaatgatgtgccgttagcaggtcccctcattgctggcggaatgcttatcgcttgttacgtaatttcgggatctagtgctgatctctctttggaaaaagcagcggaagtatcatgggagcaggaggcagagcactcgggagctagtcactctatcttagttgaagtacaggatgatggcacaatgaaaattaaagatgaagaaagggacgatactcttacgattttacttaaagctactttactagctgtcagtggagtctaccccatgagtattccagcaacactttttgtctggtacttttggcagaagaagaaacaacggtcaggagttttatgggatactccttcgccgccagaagtagaacgagcggtcttagacaacggcatctatcgaattttacaaagaggattactgggccgtagccaagtaggagtcggagttttccaagatggagtcttccacacaatgtggcacgtcaccaggggagcagtactaatgtaccaaggaaaaaggctagaaccaagttgggcaagtgtgaagaaagacttaatctcctacggtggaggatggagatttcaagggagctggaacacaggggaagaagttcaagtaattgctgtagagccaggtaaaaaccccaaaaatgttcaaacgacaccgggaacgtttaaaactccagagggggaggtcggggcgattgctctggactttaaacccggaacgtctggatcacctatagttaatagggaaggaaaaatcgttggtctttacggtaatggagtcgttaccacatcaggaacttatgtatccgcaattgcccaggcgaaagcgtctcaggaaggcccgttacctgaaatagaagatgaggtattcaaaaagcgcaatttaactatcatggatttgcacccggggagtggtaaaactagaaggtatttgcctgcaatagttagagaagctataaagagaaagctaagaacgttaatcctagctcctacaagagtagttgcatcggagatggctgaggctttaaaaggaatgcctatacgttatcaaacgacagctgttaaaagtgaacatacgggtagagagatagtagaccttatgtgccatgcaacctttactatgcgtttactaagccccgttagagtaccaaactacaacatgattatcatggacgaggcccactttacagacccagcttcgatagccgctcgaggatacatatctacacgagtcggaatgggggaggcagcggcaatcttcatgactgcgactccgcccggttcagtagaggcttttccccaatccaatgcagttatacaagacgaagaacgagatataccggagaggtcatggaactcaggttacgactggataacagacttccccggcaaaacagtatggtttgttccctctataaagagtggaaatgatatcgcgaattgtcttcgtaagaacggtaaaagagttatccagcttagtcgaaaaaccttcgataccgaataccaaaagaccaaaaataatgactgggattatgtagttactacggatataagcgagatgggcgccaattttcgtgcggacagggtaatagatccaaggaggtgccttaaaccagtaatactaaaagatgggccagagcgtgtaatcttagcaggccctatgccagtgaccgcagcaagtgcagcacaacggcgaggtcggatcggcagaaatcagaacaaagaaggagatcaatatgtatatatgggacagccacttaataacgatgaagatcacgctcactggacggaagcaaaaatgctgctagataacattaatacacctgagggtatcatcccagcattatttgagccggaaagagagaaaagcgccgcaatcgatggggagtatagattgagaggcgaagcacggaagacatttgtggaattaatgcgtagaggagatttgccagtatggctatcatataaggtagcaagcgagggtttccaatattccgatcgacgttggtgcttcgacggagaacgcaataatcaagttttagaagagaatatggatgtagagatctggacgaaagaaggagaaagaaagaaactaagaccacgttggttggatgctagaacatattcagatcccttagcactgcgggaatttaaagagttcgcagcagggagacgttcagttagcggtgatttaattttagagataggtaaacttcctcagcatttaaccctaagagcacaaaatgcacttgataatcttgttatgcttcataattcagagcaaggcggtaaagcatatagacacgctatggaagaacttccagatactattgaaactttaatgttattagctcttatcgccgtcctcacaggcggtgttactttattcttcttatccggcaaaggcttagggaagacatccattggattactctgtgttacagccagctcagttttactatggatggcatctgtagaacctcattggatagcggcaagcattatcttggaatttttcctaatggtcttacttattcctgagcctgaccggcaacgtactccccaagataatcaattagcctatgtagtcatagggctattatttatgatattaaccgtggcagctaatgaaatgggcttacttgagacaactaagaaagacttgggaataggctacgtggccgcagagaaccatcaacatgcgaccatgctggacgtcgatttgcaccctgcctctgcatggactctatatgcagtagcaacaacagttattacgccgatgatgagacacactatagagaatactacagccaatatttcactaactgcaatagctaaccaggctgcaatcttaatgggtttagacaagggatggcctatttcgaaaatggatataggagtaccattattagcgcttggatgctactcgcaagtaaacccacttacactgactgctgcagttctaatgctagtagcacattatgcaataattggcccgggcttacaagctaaggctacaagagaagcacaaaaacggacagcagctggaataatgaaaaacccgaccgtagatggaattgtagctatagatctagatccggtggtctatgatgcaaagtttgaaaaacaactaggccaaattatgctcttaatattatgcacgagtcagatattactcatgcgaaccacatgggcgctttgcgaaagcataactttagccactggtcctttgacaacgttatgggaaggttcacctggaaaattctggaacacaaccatcgctgtgtcaatggccaacatattcagaggatcatatcttgccggagcagggctcgctttttcgctgatgaagtcattaggtgggggtcggagaggcaccggagcacaaggtgaaactttaggagaaaaatggaaaagacaactcaaccaactaagcaaatccgagttcaacacttataaaaggagcggtataatggaggttgatagatcagaagctaaagaaggattaaaaagaggggaaaccactaaacatgctgtaagcagaggaactgcgaaactaagatggttcgtcgaaagaaatcttgtaaaaccagagggtaaagtaattgatttagggtgcgggagaggtggatggagctactattgtgctggtctaaagaaagttacagaagtaaaaggttatactaaaggaggacccggtcatgaagaaccgataccaatggcaacatacggatggaacttagtcaaacttcattcaggcaaagatgtattctttatgccaccagaaaaatgtgacacccttttatgtgatataggcgaaagcagtccaaatccaactatagaagaagggagaacattgcgagtattgaaaatggttgagccatggttgagaggaaatcaattctgcataaagatactaaacccttacatgccgagtgtcgttgaaaccctagaacgtatgcaaaggaaacacggaggaatgctagtgcggaatccattgtcacggaatagcactcacgaaatgtattgggtatcatgcggtaccgggaatatagtttcagcagttaatatgaccagtagaatgctcttaaatcggtttaccatggctcatagaaaaccaacctacgaacgagatgtagacttaggagcaggtacgcggcatgtagcagtagagccagaagtggcgaatctcgatatcatcgggcaaaggatcgagaatattaaaaacgagcataaatcgacatggcattacgacgaagacaacccatacaaaacttgggcgtaccatggaagttatgaagttaaaccatcgggaagtgcttcatctatggtaaacggagtagtaagattattaacgaaaccatgggatgtcataccaatggtaacacaaattgcaatgacagacacaacgccatttgggcaacaacgtgtgtttaaagaaaaagttgatacaagaaccccacgagctaagagaggaaccacacagataatggaagttacagcaaaatggctttggggattcctttctagaaacaagaaacctcgaatatgtacacgtgaagagtttacacgaaaggttagatcaaacgcagcaataggcgcagtatttgttgatgagaaccaatggaactcagcgaaggaggcagtggaggacgaacgtttctgggaccttgtacacagagagcgtgaacttcataaacagggcaaatgtgctacttgtgtatataatatgatgggaaagcgtgagaagaaattaggggagttcggaaaggccaaagggagtagagcgatatggtatatgtggttaggtgcgagatttctagagtttgaggccttgggtttcatgaatgaggatcattggttcagccgcgaaaattcattaagcggagtagagggagaaggacttcacaaacttgggtatatacttcgggatatcagtaaaataccaggaggaaatatgtacgctgatgacactgctggctgggatacaagagtcactgaagatgaccttcaaaatgaagcaaaaatcacggatataatggagcccgagcacgcattactggcaaccagtatctttaaattaacatatcaaaataaggtcgtccgtgtacagagacctgctaagaatggaacagtaatggatgttatttctaggcgcgaccaacgtggttcgggtcaagtagggacctacggcctcaatacttttaccaacatggaagtacaattaattcgacagatggagtcggaaggaatctttctaccttccgaactcgaaaccccgaacttagcagaacgggcactcgattggctcgagaaacatggcgcggaaagactgaagcggatggcgatttcaggtgacgattgtgttgtaaagcctatagatgatagattcgcaaccgcccttactgctttgaatgatatgggcaaagtccgaaaagatatacctcaatgggagccaagcaaaggctggaatgactggcaacaggtaccattttgtagccatcatttccatcagttaatcatgaaggacgggagggagatagtcgtaccctgccgtaaccaagacgaacttgtaggacgtgcaagagtatcgcaaggcgcagggtggtcactgagggaaacggcttgtttagggaaaagttatgcacaaatgtggcaactaatgtactttcatcgaagagatctacgcctggccgcgaacgcaatctgtagtgctgtccccgtagattgggtacctacatcacgaacgacttggagtatccacgcacaccaccaatggatgactactgaagacatgcttagtgtctggaatagagtctggatcgaagagaacccttggatggagaacaaaacacacgtaagtagttgggaagaagtcccataccttggcaaaagagaggaccaatggtgtggttctttgatagggttaaccgctagagcgacgtgggcaactaatattcaagtagcgatcaaccaagtgcggagacttatagggaatgaaaattacctagattatatgacttcgatgaaaaggttcaaaaatgagtcagactctgaaggagccctctggtag

SEQ ID NO: 21360 - RNA, 9879 nt, synthetic construct
  misc_feature 1..9879: note = derived and/or modified CDS sequence (opt6) from DENV-1__KJ189363__SS-prME
  source 1..9879: mol_type = other RNA
agtgttactatgctattaatgcttcttcccacggcattagcatttcacttaactacgcgtggcggtgaaccacatatgattgtatcaaaacaggaaagaggcaaatcacttctttttaaaacaagtgcaggcgtcaatatgtgcactcttatcgcgatggaccttggggaattatgtgaagacactatgacgtacaaatgcccacgtataaccgaagcagaacctgatgatgttgattgctggtgtaatgcgactgatacatgggtgacatacggtacttgttcacagacaggcgaacatcgaagggaaaaacgatccgtggctcttgcacctcacgtgggtttaggtttagagacacggaccgagacgtggatgtctagtgaaggtgcttggaaacaaatccaacgagtggaaacttgggcattacgtcatcctggatttatggttatcgctttcttcttagcacacgctataggtacaagtattacacaaaaaggaataatttttattctattaatgttagtaacaccatcgatggcaatgagatgtgtaggaataggaaaccgtgattttgtggaaggattgagtggagccacatgggttgatgtagtattagaacatggatcatgcgttactacaatggcgaaaaataaaccaacattagacatagaactacttaaaacagaagtaacaaatccggcggttcttaggaaactatgcatagaagctaaaatatctaacaccactactgatagccgatgcccgactcagggagaagcgacgttggtcgaagaacaggacgcgaattttgtatgcagacgaacctttgttgaccggggttggggaaacggatgtggattattcggaaaaggttctttattgacatgtgcaaaatttaaatgcgtaactaaattagaaggaaaaatagtacaatatgaaaaccttaaatacagcgtcatagtaacagtgcatacaggggatcaacatcaagttggtaacgaaacaacagaacatggaacaattgcgaccattacaccccaggcgccaacatcagagatacaattgactgactatggagcactaacattggattgtagtccacgtacaggtctagacttcaacgaaatggttttgcttacgatgaaagagaaaagctggttagtacataaacagtggttcttagatttaccgttgccctggacaagtggcgcgagtacctcacaagagacatggaacagacaagacctgttagttacctttaaaaccgcacatgctaagaaacaggaagttgtagtactcggctctcaagagggagcaatgcatacagcacttactggcgcaacggagattcaaacatcgggcacgaccacaatttttgccggtcatttgaaatgtagacttaaaatggataagttgacgttaaaaggaatgtcgtacgtcatgtgcacagggtcatttaaactagagaaagaggtcgcggaaacccaacatggcaccgtcttggtgcaggttaaatatgagggaacggatgccccatgtaaaatcccgttttcaacgcaagatgagaagggcgtaactcagaatggtcggttgattaccgcgaatcctatagtgactgacaaagaaaagccggtgaacatagaaacagagcctccttttggagagtcatacatagtagtgggagcaggcgaaaaagcgctaaaattatcatggttcaaaagagggtcatctattggtaagatgtttgaggcaacagcacgcggggccagaaggatggcaatattgggcgacacagcttgggatttcggatctattggcggagtgttcacgtctgtagggaaattagtccaccaaatattcgggacagcatatggcgtcctattcagtggtgtatcctggacaatgaaaataggtattggaatcttgcttacttggttaggccttaacagtcgatccacatcactttctatgacatgcattgccgttggcatggttacattatacttaggcgttatggtacaggcagacagtggttgcgttattaactggaaaggtagagaactaaaatgtggttcgggaatttttgttacaaacgaagttcatacatggacagaacagtataaatttcaagcagatagtcctaaacgtttatcagctgctattggaaaggcatgggaagaaggagtatgtggaattagaagtgccacaagactagagaatataatgtggaaacaaatatcaaatgaactcaatcacatactgttggagaacgatatgaagtttactgtagtagtaggcgatgcaaacggaatactagcgcaaggaaagaaaatgattcggccacaacccatggaacataagtactcatggaaaagttggggcaaagcaaaaattattggtgctgacatacaaaatacaactttcataatagacggtccggatacccccgagtgtcctgacggacaaagagcatggaatatttgggaggtcgaagattacgggtttggagtgtttactacaaatatatggttgaagctacgagattcatatactcaaatgtgtgatcatcgactaatgtcggcagcgattaaagatagcaaagccgtacatgcagacatggggtactggatagaaagtgaaaagaatgaaacttggaaattggctcgtgcgagctttatagaagttaaaacatgtacatggcctaaaagccacacattatggagcaacggagtcctagaatctgaaatgatcattccaaaaatttatggagggccaatctcacaacataattatcggccaggctattttacacaaactgcggggccgtggcatttaggaaaacttgaattagactttgatctatgtgaaggtacaactgtcgtcgtagacgaacattgtggtaatcggggacctagtctgagaactacgaccgtcacaggaaagatcatccacgagtggtgttgtagatcttgcactctgccgccgttacgctttagaggggaggatggttgttggtatggtatggaaatcaggcctgtaaaagaaaaagaagagaatttagtacgctcgatggtatcagcagggagcggtgaagtcgattcatttagtctgggtattctctgcgtatctattatgattgaagaagtaatgcgatctagatggtctagaaaaatgctaatgactggaacactcgccgtatttttactgttaatcatgggacaattaacatggaacgacctaattagactctgtatcatggtaggcgctaatgctagtgacaggatgggtatgggcacaacatatttggcacttatggcaacgttcaagatgcggcccatgtttgcggttggacttttattccgtagactaacaagcagagaggtcttgcttttgacaattggactttcattagtcgcatcggtagaacttccaaacagtctagaagaattaggggatggattggccatgggaataatgatgttaaaactactcacggagttccaaccacatcaattgtggacgacattgttatcactgacgtttgtgaagacaactctcagcttagactatgcatggaaaactactgctatggccctttctatagtaagtttatttccactctgcttaagtacaacatctcagaaaacaacttggctacccgtgttactaggatccttcgggtgcaaaccactgacaatgtttttaataactgaaaacaaaatttggggacgaaaaagctggcctttaaatgaaggaatcatggccataggaattgtgagtatacttttaagctcgcttttaaagaatgacgtccctctggctggaccactgatcgcaggcggtatgttaatagcatgctacgtgattagtggttctagcgcagatcttagtcttgagaaagctgctgaagtttcatgggagcaggaagccgaacactcgggggcatctcattctatcttggtggaggttcaggatgacgggactatgaaaataaaagacgaagaacgggacgatactttgaccatattgttaaaggccacgttattagcggtcagtggagtatatcccatgagtatacctgccactttattcgtatggtacttttggcaaaagaagaaacaaaggagtggagttttatgggatactcctagcccacccgaagtagagagagcagtcttggataacgggatatatagaatattgcagcgcggtttactaggtagatcgcaagtcggtgtaggtgtatttcaagacggagtctttcacacaatgtggcacgttacacgtggcgcggtgttaatgtaccaagggaaaagactagagcccagttgggcgtcagtcaagaaagatttaatatcctacggtggagggtggcgatttcaaggcagctggaatactggcgaagaagtccaagtcatagctgtagaaccaggtaagaaccctaaaaatgtccaaaccacacctggaacctttaaaaccccagaaggagaagtaggagcaatagctctggacttcaagcccgggacttcgggcagcccaatcgtaaatcgggagggcaaaatagtcggcttatacggcaacggagtggtaacaacatcaggtacatacgtctcagctatcgcgcaagctaaagcaagccaggagggtcccctccctgaaatagaggacgaagtctttaagaaacgcaatcttactattatggacttacatcctggatccggaaagaccagaagatacttgccagccatagtgcgcgaagccattaaacgtaaattgagaactttgatactagcgccaacaagagttgtcgctagtgaaatggccgaagcattaaaaggcatgccaatcagataccagactaccgcagtaaagtcggaacataccggtagggagatagtagatttaatgtgtcatgcaacctttactatgcggcttttaagccctgtaagagtgccaaattataacatgataataatggatgaggcacattttacagaccctgcctcaatagcggccagaggatacatatcaacccgagtaggaatgggtgaagcagctgctatatttatgacagcgacccctccgggatcagtggaggctttcccacaatccaacgctgtcatacaagatgaagaacgggacataccagaaagaagctggaactcaggttacgactggataacggattttccaggtaagacggtctggttcgttccaagtattaaaagtggtaatgatattgcaaactgtctaaggaaaaatggtaagcgtgtcattcagttatcacggaagacatttgatacagagtaccaaaagaccaaaaataatgactgggactacgttgttacgacagacatctcagagatgggagccaattttcgtgcagacagagtaatcgaccccaggcgatgtctcaaacctgtaatattaaaagacgggcctgaaagagtaattctcgccggtcctatgccggtcacagcagcgtcggccgctcagagaagagggagaataggccgaaatcaaaacaaagaaggagatcaatacgtttacatgggacagccacttaataacgacgaggatcatgctcattggaccgaagcgaaaatgctgttagataacattaatactccagaaggaatcattcctgctttattcgagccggaaagggaaaagtcggccgccatagacggtgaatatcgtctacgtggagaggctaggaagacattcgtggaactaatgagaagaggtgatctaccagtctggctaagttataaagtggcttcggaaggatttcagtacagtgatcgtagatggtgttttgatggagaaaggaataatcaagttttagaagagaatatggacgtagagatttggaccaaagagggggaacgtaagaaactgcgcccccggtggttagatgcacgcacatactcagatcctttagcattaagagaatttaaagagtttgcagcaggacgcagatcagttagcggagaccttatcttagaaatcggaaagctaccacaacatctaacactgcgtgctcaaaacgcactagataacttggtaatgttgcacaactccgagcaaggtgggaaagcgtacagacatgcaatggaagagttgccggatacgatcgaaactctaatgcttttagcgttaatagcggttctgactggtggggtaactctgtttttcctaagtggtaagggtttaggaaagacatctatcggtctcttatgcgtgactgctagcagtgcactactttggatggcctctgttgaacctcactggattgcagcaagtataatattggagtttttcttaatggtgctactaataccagagccggatcgacagcgaacaccacaagataatcaactcgcctatgtcgttataggattacttttcatgatcttaacagttgcagctaatgagatgggattactagaaacaactaagaaagacttgggtattggatacgtagccgcagaaaatcatcaacatgcaacaatgttggatgtggacttgcatcccgcttcggcttggactctgtatgcagtagcaacaactgtcataaccccaatgatgcgtcacacaatagaaaacacgactgccaacataagtcttacagcgatcgccaatcaggctgcgatattaatgggattggacaaaggatggccgatatcaaagatggacatcggggtacctttacttgcactcggttgttacagccaagtgaatccgttaacactaactgcagcggtcttaatgcttgtagcccattatgcaataattggaccagggctacaagcaaaggctactcgagaggcccagaaacgaacagctgccggtattatgaaaaatcctactgtagatggcatagttgctatagacctagatccggtcgtctacgacgctaagtttgaaaaacaattaggccaaataatgttactgatactatgtacatcacaaatattgctaatgagaactacgtgggcactatgcgaatccatcaccttagcaacgggtccattaacaactttgtgggaaggatctccaggaaaattttggaataccactattgccgtttcaatggcaaatatatttcgaggatcttatcttgctggagcgggattggccttctccctcatgaaatcactagggggaggaagacgcggcacaggcgcccaaggggaaacattaggtgaaaaatggaagcgacaactaaatcaactatcaaaatcagaatttaacacatacaaaagaagtggaataatggaggtagacagaagcgaagctaaagagggtttgaaacgaggtgaaaccacgaaacacgcggtaagtagaggaactgccaaattgcgatggtttgtcgaaagaaatttagtcaagccagaaggtaaagtaattgacctaggatgcggacgcggaggctggagctattattgtgctggattaaagaaagtaactgaagtaaaaggctacaccaaaggaggaccgggccacgaagaaccgattccaatggctacgtatggatggaatctagtaaaattacatagcggtaaagatgtgtttttcatgcctcctgaaaaatgcgatactcttctttgtgatataggagagtcttcccccaatcccactatagaagaaggaagaacactgagagtattaaaaatggtagaaccctggttgcgaggcaatcaattttgtattaaaattctaaacccttatatgccatctgtagtagaaactttagaacggatgcaacgtaagcacggcggaatgttagttcgcaatcccctgtcacgaaattctacgcatgagatgtattgggtaagttgcggaacaggcaatattgtttccgcagtaaatatgacctctagaatgctgctcaataggttcaccatggcacaccggaaaccgacatacgaacgagatgttgacctaggagctggaactagacacgtggcggtcgaacctgaagtagctaacctggatatcattgggcaaaggatcgagaacattaaaaatgaacataagagtacatggcactatgacgaggacaatccctacaagacttgggcgtaccatggttcatatgaggtcaagccttcaggatcggcttcatcaatggttaatggagtagttcgtctcctcacaaaaccttgggatgtaattcccatggttactcaaatagctatgacggataccaccccgtttggacaacaaagagtattcaaggaaaaggtagatactagaacgcctcgggctaaacgaggaacaactcaaataatggaagtaacggcaaaatggttgtgggggttcttaagtcgaaacaagaagcctagaatttgcactagagaggagtttacacgaaaagtcaggagcaatgcagcgataggagccgtatttgtcgacgaaaatcaatggaactctgcaaaggaagctgtggaagatgaacgcttctgggacttagtacacagagaaagagaattgcataaacaaggcaagtgcgccacttgtgtttacaatatgatgggaaagagggagaagaaactcggcgagttcggcaaagctaaaggatctcgagctatttggtatatgtggctaggcgccagatttttagaatttgaagcacttggtttcatgaacgaagaccactggttttctcgcgaaaattccttatcaggagtcgaaggagaagggctacacaaactaggatacattttacgagacatatctaaaataccaggaggaaacatgtatgcagatgatacagcaggttgggacacaagagtaacagaggacgacttacaaaatgaggccaaaattacagacataatggaaccagagcatgcattacttgcaacaagtatatttaaactaacttatcaaaataaagtagtacgtgtgcaacgacctgccaaaaacggcaccgtaatggatgtaatatctagacgagatcaacgcggttcaggccaagtagggacttacggattgaacacttttactaatatggaagtacaacttatccgacaaatggaatcagaaggaattttccttccaagtgaactagagacacccaacttagccgaaagagctctggattggttagaaaaacacggggctgaaaggttaaaaagaatggcaattagcggtgacgattgtgtagtaaagcctatcgatgaccgatttgcaactgccttgaccgcgctaaatgacatgggtaaggttaggaaggatataccacaatgggaaccaagcaaggggtggaacgactggcaacaagtacccttctgtagtcatcattttcaccaattaatcatgaaagatgggagagaaatcgtagtcccgtgcagaaaccaggatgagttggttggtagggcgcgtgtaagccaaggtgcaggttggtctttacgtgaaacagcatgtctaggaaagtcgtatgcacagatgtggcagctcatgtattttcatcgacgagacctaagattggcagctaatgcaatttgctcagctgtacctgtcgattgggtgccaacctctcgaacgacttggagcattcatgcccatcaccagtggatgacgactgaagacatgctcagcgtttggaatcgtgtgtggattgaagaaaacccgtggatggaaaataaaactcatgtctcatcatgggaagaagtaccatatttagggaaacgtgaagatcaatggtgtggttctctaataggacttactgcaagggcgacgtgggcaacaaacatacaggtggctatcaatcaagtcaggcggttgatcgggaatgaaaactacttagattacatgacaagcatgaaaagattcaaaaacgaaagtgattcggaaggtgcactgtggtaa

SEQ ID NO: 21361 - RNA, 9879 nt, synthetic construct
  misc_feature 1..9879: note = derived and/or modified CDS sequence (opt6) from DENV-1__KJ189364__SS-prME
  source 1..9879: mol_type = other RNA
tccgtgactatgttattaatgcttctacctactgcactggcgtttcatctaactacaagaggcggagaacctcatatgattgtaagtaaacaagaacgtggtaaaagtttactctttaaaacaagtgcaggcgtgaatatgtgtaccctaatcgcaatggacctaggagaattgtgcgaagatacgatgacctacaaatgtcctcgtatcacagaagcagaaccagatgatgtagactgttggtgtaatgcgacagacacttgggtcacgtatggaacatgcagtcaaacaggagaacatagaagagagaaaagatctgtagcgttggccccacatgtaggtttaggacttgaaactcgaaccgaaacttggatgagtagtgaaggggcttggaaacagatacaacgcgtcgaaacatgggcattaagacatcctgggttcacggtcatagctttctttctggcgcatgcaattggaacaagtatcacacaaaaaggaataatttttattcttctaatgttagtaactccatccatggcaatgcggtgtgtgggcataggaaaccgagacttcgttgaaggtctaagtggagctacatgggtagacgtggtactggaacatggatcatgcgtaacaacgatggccaaaaataaacccacactagacatagaattactaaaaacagaagtcactaaccccgctgtgctaagaaaactatgtattgaagcgaaaatctcgaataccactacagattccagatgcccgacacagggagaagctactttagtcgaagaacaagacgccaatttcgtctgccgaagaacattcgtagaccgagggtggggaaacggttgtggtttattcggtaaaggctccttgctaacctgtgccaaatttaaatgcgttaccaaactcgaaggaaaaatagttcagtatgaaaacttaaagtattctgtgatagtgacagtccacacgggagatcaacatcaagtagggaacgaaacaactgaacatgggacaattgccactataactccacaggcacctacgagcgaaatacaacttacagactacggagcgctaacattagattgctctcctcgtacagggctagattttaacgaaatggtactacttaccatgaaagagaaaagctggttagttcataaacaatggtttttagatttgcctttgccatggacttcgggagcttctacaagtcaagaaacttggaaccgccaagatctacttgtaacattcaaaacggcccacgccaagaaacaagaggtggtcgtactgggttcgcaggagggagcgatgcatacagctctaacaggagccacggaaatacaaaccagtggcacaacaacgatattcgctggccatctaaagtgtcgactaaagatggacaaactcacccttaaaggaatgagctatgttatgtgtacaggaagttttaaattggagaaggaagtagcagagacgcaacacggtactgtattagttcaggtcaaatatgaaggaacagatgccccctgtaaaattccattttcgacccaagatgaaaagggaatgactcaaaatggacgtctgatcacagccaatccaattgttacggacaaggaaaagccagtaaatatcgaaacagagcctccattcggtgaatcatatatcgttgttggcgccggggaaaaggctttaaaattgtcttggtttaaacgcggaagctcaattgggaagatgtttgaagcaaccgctagaggtgccaggagaatggcaattctaggagacaccgcatgggacttcggaagtattggaggagtttttacatctgtaggtaagctagtacatcaaatttttggcacagcttacggtgtactgtttagcggtgttagctggactatgaaaataggaataggtattcttttaacgtggctaggactaaatagtagatctacaagtttatcaatgacatgtattgcagtagggatggttactctttatctaggagtaatggtgcaagctgactcaggttgtgtcattaattggaagggaagggagctaaaatgtggaagcggtattttcgtgacaaacgaggtacatacctggacggaacagtataaattccaagcagatagtccaaaaagattatcagcagcaataggcaaggcttgggaagagggtgtttgcggtatcagaagtgcgacaagactagaaaatattatgtggaaacaaatatcgaacgagctgaaccacattcttctagaaaatgacatgaaattcacagtagtagttggagatgcaaatggcatattggcacaaggtaagaagatgatcagaccacaaccgatggaacataagtattcatggaaatcatggggtaaagctaaaataataggtgccgatatccaaaatacgacatttattattgacggtccggatacaccagaatgtcccgacggtcaaagggcatggaatatttgggaggtagaggattacggattcggggtctttacgactaacatatggctgaagttgcgagattcatatactcaaatgtgcgaccataggttgatgtcagccgctattaaggacagcaaggcagtccatgcggacatggggtactggattgagagtgaaaagaatgagacatggaaactagctagagctagctttattgaagtaaaaacgtgtacgtggccaaaatcgcatacattatggagtaatggtgtactcgaatctgagatgataattccaaagatatatggcggtccgataagccagcataattacaggccgggctattttacacagacagcagggccttggcacttagggaagttagaacttgattttgatttatgcgagggaacaaccgttgtagtggatgagcattgtgggaaccgtggaccgtctttacgaacaactaccgttacaggcaaaataatacatgaatggtgctgtagatcttgcacactccctcctcttcggtttcgtggagaagatggttgttggtacggaatggaaataagaccagttaaggaaaaagaagaaaatcttgtacgtagtatggtatcagcagggtcaggagaggttgattcattttcattgggaatattatgtgtatctatcatgattgaagaggttatgaggagcagatggagccgaaagatgttaatgaccggaacacttgccgtgtttctactgttaataatgggtcaactcacatggaacgatttaattagactttgcataatggttggcgccaatgcgtctgataggatgggaatgggaacaacgtacttggctctaatggctacttttaaaatgagacctatgttcgcagtaggtttactatttcgacgactaacttcaagagaagtgctcttattaaccattggcctatctctagtagcctcagtagaattgccaaactcgcttgaagagttgggggacggactggctatgggaataatgatgttaaaactgttgacggaatttcaaccgcaccagctatggaccacattgctttcattaacctttgtaagaacaacattaagtctagactacgcctggaaaaccacagcaatggcattatcaattgtgtcattattcccactatgtctatcaacaacaagtcagaaaacgacttggcttccagtactactgggatcatttggctgcaaaccactgacgatgtttttgattacggagaacaagatttggggacgaaaaagctggcctctaaacgaaggaattatggcaatagggatagtgagcattctattaagctcccttttgaaaaatgatgttccgctggcgggaccccttatagctggaggaatgcttatcgcgtgttatgttataagtggttcatcagcggatctaagtctagaaaaagcagcagaagtgagttgggagcaagaagctgagcattcaggagcttcacacagtattttagtagaagtgcaagatgatggaacgatgaaaataaaagatgaagagagggatgacactctaacaattcttttaaaagctacattgctggctgtaagcggtgtttacccgatgagtatacccgccacacttttcgtttggtacttttggcaaaagaagaaacagagatcaggggttttatgggatacaccgtctccgccagaagtagaacgagcagtgctagacaatggcatttacaggatattacaaagaggcttgctcggaagaagtcaagtaggtgtaggagtttttcaggacggtgtatttcatactatgtggcatgtcacccggggagcagtactcatgtatcaaggtaaacggctggaaccctcttgggcctccgtcaagaaagatttgatatcgtatggaggtggttggcgatttcaaggcagctggaatacgggagaagaagtccaagttatagcagttgaaccagggaaaaacccgaaaaacgtgcaaacgactcctggtacatttaaaacgccggaaggggaagtcggagcgattgctttggattttaagcctggtacctccggcagtccaatcgtaaatagagagggtaagattgtcggcctatatggcaatggggttgttacaacatcaggtacatacgtctcggcgatagcccaggcgaaagcctcacaagaaggacctttgcctgaaattgaagatgaagtctttaagaaacgtaatttaactataatggacttgcacccgggatctggtaaaacgagaaggtatctcccagcaatcgtacgagaagcgattaaacggaagctacggacacttatattagcgcccactcgggttgtagcttctgaaatggcagaggcattaaagggcatgccaattaggtatcaaacaacagcagtaaagtccgaacacacaggacgcgaaatcgtcgacctgatgtgccatgccaccttcactatgcgactactgagcccagtacgtgtacccaactacaatatgataataatggatgaagcacatttcacagacccagcctcaattgcagcccggggctatataagtactcgagtagggatgggagaggccgcagcaatattcatgacagccactccacccggttctgttgaggctttccctcagagcaatgccgttattcaagatgaagagagagacatacctgaaaggagctggaactcgggatatgactggataaccgattttcctggaaaaacagtgtggttcgtccccagcattaagagcgggaatgatatcgcgaattgcttaaggaaaaatgggaaaagagtaatccagttgtcaaggaaaacatttgacactgagtaccaaaagactaaaaataatgattgggattatgtggtaacgacagacatatccgaaatgggcgcgaacttcagagctgatagggtaattgatccccgacgatgtttaaagccagtaatattaaaggatggacctgagagagtaatacttgctggaccaatgccagtaacggcagcctcagctgctcaaagacgtggaagaattgggagaaaccaaaacaaggagggagatcagtatgtttatatgggacaaccactcaataacgatgaagaccatgcacattggaccgaagcgaaaatgctcctagataatataaatactcctgaaggcataataccagcgttatttgaaccagaaagagaaaaatctgccgccattgatggtgaatatcgtttacgtggtgaagcacgaaaaaccttcgtagaattaatgagacgtggagacttgccagtgtggttatcgtacaaagttgcgagcgaagggtttcaatactcagatcgtagatggtgcttcgacggggaaagaaataatcaggtactcgaagagaacatggacgtggaaatatggacgaaagaaggtgaacgcaagaaacttagacctcgatggttagatgcgagaacgtactcagatccattagccttacgcgaatttaaagagttcgcagccggcagaagatcagtttctggcgacttgatactcgaaataggtaaattaccccaacacttaaccctaagagcacaaaatgcattagataatctagtcatgcttcacaactccgaacaaggtggtaaggcttaccgccacgccatggaggaattaccggacactatcgagacacttatgttattagcccttatagctgtccttaccggtggagtaacgttattctttctatcaggcaaaggactagggaaaacaagtataggactcttgtgtgtcacagcgagctctgcgttactgtggatggcttccgtagaaccacattggatcgccgcatcaattatactagagttctttctaatggttttacttatccccgagcctgacagacaaaggacacctcaagataaccagcttgcctacgtggttatcggattactattcatgattcttactgtggccgcaaatgaaatgggtctattggaaacaactaagaaagatttgggaattggctacgtagccgcagaaaatcatcaacatgcgacaatgctggatgtagacttgcacccggcttcagcatggactttatatgcagttgcgactacagttataacgccaatgatgagacataccattgagaatacaaccgctaatatttcactaaccgcgatagctaatcaggcagcaatactaatgggtcttgacaaaggatggcccattagcaagatggacataggcgtacctctgctcgctctgggttgttattcacaagtcaatccactgacattgacagcagctgtcttaatgcttgtagcacactatgctatcataggccccgggctccaagcgaaggcaacaagggaagcacaaaagaggacagctgcagggataatgaaaaacccaacggttgatggaattgtagcaatagacttagacccagtagtatacgatgccaaattcgaaaaacaacttggacagatcatgttactcatcctatgtacttcccagattctactaatgcgaacaacttgggctttatgtgaaagcataactttggcaacgggaccgttgacaacactatgggaagggagtcccggaaaattctggaatacaacaatagcggttagcatggcgaacatattccgcggatcatatctagctggtgcaggactagctttcagtttgatgaaatccttaggtggaggacgtcgaggaactggagctcaaggagagacgttaggggagaaatggaagcggcaattaaaccaactaagcaaatccgagttcaacacttataaacgatctggcattatggaagtggaccgatcggaagctaaagaaggtttgaagcggggagagacgacaaaacacgccgtctcaagaggaacggctaaactacgatggttcgtggaacggaatcttgtaaagcccgaaggtaaagtaatagatttaggatgtggtcggggaggctggtcctattactgtgcaggcctaaagaaagttacagaagtcaaaggatatactaagggcggcccaggtcatgaagaaccgattccaatggctacatatggatggaatcttgtgaaattacattccggcaaagatgtcttctttatgccacctgagaaatgtgatactttgttgtgcgacataggtgaaagctctccaaatccgacgatagaagagggtcgaacacttagagttctaaagatggttgagccctggctgcgaggcaatcaattttgtataaagattctcaatccttatatgccaagtgtcgtagaaaccctagagagaatgcagcgaaaacatggtgggatgcttgtacggaatcctctgtcccgaaatagtacacacgaaatgtactgggtaagttgtggaacaggaaatatcgtgtcggcagtcaatatgactagcaggatgttattaaacaggttcactatggcgcacagaaaaccgacatacgagagagacgtcgatttaggagcgggtactcgccatgtagcagttgagcctgaggtcgcaaatctcgatataattggacaaagaatcgaaaacattaaaaatgaacacaaaagcacatggcattatgatgaagataatccatacaaaacgtgggcttatcacggaagttatgaggtaaaaccttcaggatcagcttcatcaatggttaacggtgttgtacgactcctaaccaaaccatgggatgttataccaatggtaacccagatcgcaatgaccgacactacaccttttggccaacagagggtatttaaagaaaaagtggatactagaacaccaagggcaaaaagaggtacaacccaaataatggaagtaaccgcaaaatggctttggtcgttcttatcaagaaataagaaaccgagaatatgtacaagagaagagttcactagaaaggtaagatcaaatgccgcaataggagcggtatttgtagatgagaatcaatggaactctgcaaaagaggcagtagaggatgaaagattctgggatcttgtacacagagagagagaactacataaacagggaaaatgcgcaacctgtgtatacaatatgatgggaaaacgagagaaaaagctaggtgaatttggaaaagcaaaaggaagcagagcaatatggtatatgtggttaggagcacgattcctagaatttgaagcgttaggctttatgaacgaagaccattggtttagccgcgaaaattccctctcaggagtggagggagagggattacataagctagggtacattttgagagatataagcaagatacccggaggaaacatgtatgctgacgatactgcaggatgggacacacgagtaactgaagatgaccttcagaacgaagctaagataacagacattatggagccggagcatgcattattggcgacaagtatatttaaattaacttaccaaaacaaggtggtcagagtgcagaggccagcgaagaacggcacggtaatggatgtgatatcgagacgcgatcagaggggctctggtcaagtgggcacctacggcctaaacactttcaccaacatggaagtgcaattgatacgacaaatggagagcgagggtatatttcttccctctgaactagagactccaaatctcgctgaacgagccttagactggctagaaaaacatggagcggagagattaaagagaatggcaatcagcggtgacgattgtgtcgtaaagccaattgatgatcgattcgctacagccttaacagctttaaatgacatgggcaaggttcgaaaggatatccctcagtgggagccctcaaaagggtggaacgattggcaacaagtacctttttgttcgcatcattttcatcaattgattatgaaggatggcagagaaatcgttgtgccttgcagaaatcaagacgaacttgttggacgagcacgcgtaagtcaaggcgcaggctggagtcttagggaaaccgcctgcttagggaaaagttacgctcaaatgtggcaattaatgtatttccatcggagagacttacgattagctgcaaatgcaatttgctcagcagtaccagtagattgggtccccacgtcaagaactacttggagcatacatgcacatcaccaatggatgactacggaagatatgctatccgtatggaatagagtgtggatagaggaaaacccctggatggagaataagacccacgtaagcagttgggaagaagtaccttacctaggaaaaagggaagatcaatggtgcgggagtttaataggattaaccgcacgtgcaacgtgggcgaccaatatacaagtggcgattaaccaagttaggagactaataggaaatgaaaactatcttgactacatgacatcaatgaagagatttaaaaatgaatctgactcagaaggagccctgtggtaa

SEQ ID NO: 21362 - RNA, 9879 nt, synthetic construct
  misc_feature 1..9879: note = derived and/or modified CDS sequence (opt6) from DENV-1__KJ189365__SS-prME
  source 1..9879: mol_type = other RNA
agtgtgactatgttgttaatgctactacctactgcacttgcgtttcatcttacaacacgtggaggggaaccacatatgattgtaagtaaacaagaacgaggtaaaagtttattatttaaaacttccgcgggggtcaatatgtgtacgcttatagcaatggatctaggagagctctgtgaagacacgatgacatacaaatgtcctaggataaccgaagcagaaccagatgatgtagattgctggtgcaacgcaaccgacacgtgggtaacatacggaacgtgtagccaaaccggcgaacatagacgagagaaacgatcagttgcactagcaccacatgtaggcttaggtttggagacacgtacggaaacttggatgtcgagtgaaggtgcatggaaacaaatccaaagagtggaaacctgggcgttgcgacatcccggttttacagtgatcgcattctttttagcgcatgcaattggaaccagcatcacgcaaaaaggaattatttttattttattgatgttagtgactccaagcatggccatgcgatgcgttgggatcggcaatagggatttcgtagaagggcttagcggagccacctgggtggacgtcgtcttggaacacggtagctgtgtgacgactatggcgaaaaataaacccacactggacattgaattgttaaaaaccgaggttacaaatccggctgtcttgcgaaaattatgtatagaagcgaaaataagcaatacaacaaccgattcgagatgtccgacccagggagaagcaaccttagtagaagaacaagatgcgaattttgtctgtcgaagaacttttgtagacagaggttggggtaatggatgtggtctctttgggaaaggttctctacttacgtgtgccaaattcaaatgcgtcactaaactcgaggggaaaatagtccaatatgaaaacttaaaatatagtgttattgtcacagttcatacaggcgatcaacaccaagtgggcaatgaaacaacagaacatggcacaatagccaccatcacgccgcaagccccaacaagtgagatccagttaaccgattatggagcgcttacattagattgctcaccacgaactggactcgattttaatgaaatggttctactaacgatgaaagagaaaagctggttagtacacaaacagtggtttcttgatttaccacttccatggacttcaggagctagtacttcccaggaaacttggaatcgacaagatttgttggttaccttcaaaacagcacacgccaagaaacaagaagtagtagttctcgggtcacaggaaggtgctatgcatactgctctaacaggcgctacagaaatacaaacaagtggaactacaaccatattcgctgggcacttgaaatgtcggttaaaaatggataaattaacgttgaaaggcatgagttatgtgatgtgcacgggtagttttaaacttgagaaagaagtagctgaaacacaacacggaacagtactcgttcaggtaaaatacgaaggaacagatgctccctgcaaaattccattcagtactcaagacgaaaaaggggtaactcaaaatggacgtcttattactgcaaatccaatagtcacagataaagaaaaaccagtaaacatcgaaaccgaaccaccgttcggagaatcgtatatagtagtcggcgccggtgaaaaagctctgaaattaagctggttcaaaagaggtagttcaatcggcaaaatgttcgaagctaccgcacgcggagcccgaagaatggctatactaggtgacacagcatgggattttggaagtatagggggagtgttcaccagtgttggtaaattggtgcatcaaatattcgggacagcctatggagtattattttccggtgtctcttggacaatgaaaatcggaattggtatactattgacctggttgggattaaattcacgatcaacctcattgtcgatgacatgtattgttgtcggaatggtaacgctatatctaggagtcatggtgcaagcggattctggctgcgtaataaattggaaaggtcgtgaactgaaatgtgggagtggaatttttgtgactaacgaggtgcatacgtggacggaacaatacaagttccaagcagattcccctaaaagactgagtgccgccattgggaaagcctgggaggagggagtttgtggcattcggtctgctacccgattagaaaatataatgtggaagcagattagcaacgaattaaatcatattctactagaaaacgacatgaagtttacggtcgttgtgggcgacgcaaacggtattcttgctcaaggaaagaagatgatcagaccccaacccatggagcataaatattcgtggaaatcatggggaaaagcaaagataattggagctgatatacagaatactacttttataatcgatggacccgatactcctgagtgcccagatggtcaaagagcatggaacatatgggaagtagaagactatggctttggggtatttaccactaatatatggttaaaacttagagactcctatacacaaatgtgcgatcaccggctaatgtctgcagccatcaaagattccaaagcggtacatgctgacatggggtattggatagaatcagagaaaaacgaaacatggaaattagctagggccagctttattgaggttaagacatgcacgtggcccaagtctcatacactatggtcaaatggcgttctagaatctgaaatgatcataccaaagatatacggtggtccgatctctcaacataactatagacctggatattttactcagacagcgggtccttggcatctaggaaaattagaattagacttcgacctatgtgaaggaaccacagtagtggttgatgaacattgtggaaacagagggccatcactgagaaccacaacggtgacaggaaaaataatacacgaatggtgttgtagaagttgtacacttccacctctaagattcagaggagaagatggttgctggtatggaatggaaatccggcccgtaaaagaaaaagaggagaatttagtaagaagtatggtcagtgccggttcaggtgaggtcgactcgttttctttgggcatactttgcgtcagtatcatgattgaagaagtgatgcgaagcagatggtctcggaagatgttaatgacgggtacattagcggtatttttattgttaataatggggcaactaacatggaacgatctgattagattatgcataatggtgggtgcaaatgcatcggacagaatgggaatgggcaccacgtacctcgcattaatggcgacctttaaaatgaggccaatgtttgcggtagggctattatttcgtagattaacatccagagaagtgctactattgacgataggtctctctttagtagcgagcgtagagttaccaaattcacttgaagaattgggtgacggcctcgcgatgggaattatgatgctaaaactccttaccgagttccaacctcatcaattgtggactactctattgtcgcttacatttgtgaaaacaaccttaagcctagattatgcatggaaaacaacagctatggccctgagcatcgtttctttatttccgttgtgtttgagtactacatcccagaaaactacatggttgccagtgttattaggaagttttgggtgtaaaccacttacaatgtttctcattacagaaaacaagatttggggaagaaaatcttggcctctcaatgaaggtataatggcaatagggattgtttccatattactgagctcattattaaagaatgatgtccctttagcagggcccctcattgccgggggtatgctgattgcgtgttatgttatttccgggtcatctgctgatttatccttagaaaaagctgcggaagtgtcatgggaacaagaagcagaacactcaggagccagtcacagtatcctagtggaggtacaagatgacggaaccatgaaaataaaagatgaagaaagagatgataccctgacaatcttattaaaagcaactttactagcagtgtcaggagtttatcctatgtctatcccggcaacgctctttgtatggtatttttggcagaagaagaaacaaagatcaggtgtactctgggataccccctcaccccctgaagttgagagggccgtgttggataatggaatctatcggatcttacaacgcgggctactcggaagatcacaagtaggagtgggtgtatttcaagacggagtctttcacactatgtggcatgtgacaagaggagctgtattaatgtaccaaggaaagcgattagagccaagctgggcatcagtgaagaaagacttaataagctatggcggaggttggagattccaaggatcatggaatacaggagaagaggtacaggtaatcgcagttgaaccgggaaagaaccccaaaaatgtacaaacaactccaggaacttttaagaccccagagggagaagtaggcgcaattgcgctagattttaagccggggacaagtggttcaccaatagtgaatagggaaggtaaaatagtaggactttatgggaatggtgtcgtgaccacaagcggtacttatgtatcggcaatcgctcaagctaaagccagccaagagggaccactcccagagattgaggatgaagtgttcaagaaaaggaacttaactatcatggacctacacccaggatcaggcaaaacgcgcagatatttgcccgcaatagtcagagaagctattaaacgaaaactcagaaccctcattttggccccaacaagagtggtagcgagcgaaatggcagaggctttgaaggggatgcccatacgatatcaaacaactgcggtaaaatcagaacatactgggcgtgaaatcgtagacttaatgtgccatgctacatttacaatgagattactctctccagtacgggttccaaactataatatgataataatggatgaggcgcactttacagatcccgcgtcaattgcagctcggggttatataagtacccgagtaggaatgggagaagcagctgcaatattcatgacggcaacgccacctgggagcgtagaggcttttcctcaaagtaacgccgtcatacaggatgaagaacgagatatacctgaaagaagttggaacagtggatatgattggataactgatttccctggaaagactgtttggtttgtaccctcgattaagtctggtaacgacattgccaattgcctaagaaagaatggaaagagagtcatccaactctcaagaaaaacatttgatacggagtaccagaaaactaaaaataatgattgggattatgtcgttacgactgatatatcagaaatgggagccaattttcgcgcagacagggttatagacccgaggcgatgtttaaagccagtaattttaaaagacggaccagaacgtgtaatcttagcagggcctatgcccgtaacagctgcctccgctgcccagaggagaggtagaatcggccgaaaccaaaacaaggaaggagaccaatacgtatacatgggacagcccttgaataatgatgaggatcacgctcattggacagaagctaaaatgctcttagacaatataaacacaccagaaggcatcatacccgcgttatttgaacctgaacgagaaaagtcagctgcaattgacggtgagtaccgtctacgcggtgaagcccgtaagacatttgttgaacttatgcgacgcggagacctaccagtatggctgtcgtataaggtggcaagtgaaggatttcaatacagtgataggaggtggtgctttgatggagagagaaacaatcaagtgcttgaagaaaatatggatgtggaaatttggacaaaagaaggcgagcgcaagaaacttagaccaagatggttagacgctcgcacctattcagacccattggccttacgtgaatttaaggagttcgctgccggtcgacggagtgtatcaggcgatctaatcctagaaattgggaaactaccccaacatctaactctaagagcgcaaaatgcattggataacctagtgatgttacacaatagtgaacagggtggtaaggcatataggcatgcaatggaagaattaccggacacaattgaaacactgatgctcctcgcattaatagcagtactgacaggtggagtcacactatttttcctatcaggcaaaggacttggaaaaacctccataggcttgctgtgcgtcactgcaagtagtgccctattatggatggctagtgtcgaacctcattggatagcagcaagcattatattggaatttttcctcatggtattactcataccagagcccgacaggcaacggacaccccaagataatcaattagcatacgtggttataggattactattcatgatactaacagtcgcggcaaatgagatgggattgttggagacaactaagaaagatttgggaatcggctacgtagcggctgaaaaccatcaacacgccactatgttagatgttgatttacatcctgcatccgcttggacgttatacgcagtagctactacagttatcacaccgatgatgcggcatacgatcgaaaataccacggctaatatctcattaactgcgatcgctaatcaggccgctattttaatgggattggacaagggttggccaataagtaaaatggacattggcgtaccactactggcacttgggtgttattcacaagtcaacccactaactcttacggcggctgttttaatgttagtagcacattacgcaataatcggtcccggtttacaagcaaaagcaacccgtgaagcacaaaaacggactgcagcgggcattatgaagaaccctacagttgatgggatagtagccatagatctagatcccgttgtgtacgatgcaaaatttgaaaagcaactcggccaaatcatgctattgattttatgcacttcgcagattttactaatgcgcactacttgggcgttatgcgaatctatcactctagctactggaccactaactactctgtgggaaggaagtccaggaaaattctggaataccacgatagctgtttcgatggccaatatatttagaggaagctaccttgcgggggcagggttagcattctccctaatgaaatcactaggaggcggaagaagaggaacaggcgcccagggtgaaaccttgggcgaaaaatggaaacgacaattgaatcaattaagtaaatcagaatttaacacgtacaagcggtcaggaattatggaagttgacagatccgaagccaaagaaggtctcaagcgaggagaaactaccaagcacgctgtatctcgtggaacagctaaattacgatggttcgtggaacgtaacttagtgaaacctgaaggaaaagtgatagatttgggctgtggtaggggcggatggtcatactactgcgcaggactaaagaaagttacagaagtcaagggatacactaaaggcggaccaggtcatgaagaacccattccaatggcaacttatggttggaatcttgttaaactgcattccggcaaagatgtattctttatgccaccagaaaaatgtgatacacttctatgtgatataggtgagtcatctcctaaccccacaatagaagagggtagaactttgagagttttaaagatggtagaaccatggttaagaggaaaccaattttgtattaaaattctgaacccatatatgccaagcgtcgtagaaacccttgaaagaatgcaaagaaaacatggaggcatgcttgttcgaaaccctttatctaggaatagcacacatgagatgtattgggtatcgtgtggaacaggaaacatcgtatccgcggttaatatgacgtcgcgtatgctactgaatagatttacgatggcgcatagaaaacccacttacgagagagatgttgatcttggtgctggaactcgacatgtagcagtggagcctgaagtagctaatttagatatcataggtcaaagaatcgagaacattaaaaacgagcataaatcaacatggcactatgacgaagataacccttataaaacatgggcataccacggtagctatgaagtaaaaccaagcggaagcgcaagctctatggtgaatggcgttgtccgtcttctaactaagccgtgggacgtaataccaatggtcacgcagattgctatgaccgacaccacgccattcgggcaacaacgagtattcaaggaaaaagttgatacaagaacgccaagagctaaaaggggcacgacgcaaataatggaagtgactgctaaatggttatggggctttttatctagaaacaagaagcccagaatttgcacaagagaagagtttacgagaaaggtacgatcgaacgccgcaataggggctgtcttcgttgacgaaaaccaatggaacagtgctaaagaagctgttgaagatgagagattttgggatttagtacatcgagaaagagaactgcataaacaaggtaaatgtgcgacctgcgtctataatatgatggggaaaagagaaaagaaactgggtgagttcggaaaagcaaaaggttcgcgagctatctggtacatgtggctcggagcaagatttttggaatttgaagcacttggatttatgaacgaagatcattggttctctcgtgaaaattcactttcgggtgttgaaggcgaaggattgcataaattaggctacatattacgtgacatcagtaaaatccccggagggaatatgtatgcagatgacactgctggatgggacacacgagttacagaagacgacttacagaatgaagccaaaattacggacatcatggaaccagaacacgccttactagcgacaagcatattcaaattgacctaccaaaacaaggtagtccgtgtacaaaggccagccaaaaatgggaccgtaatggacgttatctcgagaagagatcagagaggttctggtcaagtgggaacttatggtctaaacacctttaccaacatggaggttcaacttattagacagatggaatcggaaggaatctttctaccgagcgagcttgaaactcctaatttagcagagcgagcgttggattggctagagaagcacggtgctgagagacttaaaagaatggccatcagcggagatgattgtgttgtcaaacctattgacgatagatttgccacagcactgacagctttgaacgacatggggaaggtaagaaaagacattccccaatgggaaccctctaaggggtggaatgattggcagcaagtcccattctgcagtcatcattttcatcaactaattatgaaagatggaagagagatagttgtcccttgcagaaatcaggacgaattggtgggacgagcgagggtaagccaaggggcagggtggtctctcagggaaaccgcatgtctaggcaaaagctatgcacaaatgtggcaattaatgtactttcacagaagagacctgcgactagctgccaacgcaatctgtagcgcagttcctgtagattgggtaccgaccagtagaaccacctggtctattcatgcacatcatcaatggatgacaactgaagatatgttatctgtatggaatcgggtatggattgatgagaatccatggatggaaaataagacacatgtttcatcctgggaggaggtaccatatttaggaaaaagagaagaccaatggtgtggaagcctaataggcttaactgcgagagcgacatgggcaactaacatacaagttgcaataaaccaggttagaagattaataggtaatgagaattatttagattatatgacttcaatgaaaagatttaaaaatgaatcagatagtgaaggggcactctggtag

SEQ ID NO: 21363 - RNA, 9879 nt, synthetic construct
  misc_feature 1..9879: note = derived and/or modified CDS sequence (opt6) from DENV-1__KJ189366__SS-prME
  source 1..9879: mol_type = other RNA
agtgtcactatgttgttgatgctgttgcccaccgctttagcatttcacttaacaactaggggcggcgaaccccatatgatcgtttccaaacaagaaagaggtaagagcttgctatttaaaacaagcgccggcgtaaatatgtgcacacttatagccatggacctgggtgaattgtgcgaagatactatgacgtataaatgcccacgcattgcagaagctgaaccagatgacgtagactgttggtgtaacgcaacagacacttgggtaacttatggtacctgcagccaaacgggtgagcatcgacgagaaaaacgaagtgtcgctttagcaccacacgttgggttaggtctggaaacaagaacagaaacatggatgagttcggaaggcgcctggaagcaaatacaaagagtagaaacttgggccttacgccatcctggattcacagtaatagcatttttcctggcccacgcaataggaacatccataacacaaaaaggaataatttttatcttactcatgttagtaaccccaagtatggccatgcgatgtgtaggaataggaaacagagattttgtagaaggacttagcggagcaacgtgggttgacgtagttttagaacatggaagttgtgtcactaccatggccaaaaataaaccaacactcgatatagaactccttaaaacagaagttaccaatccagccgtcttacgaaaactttgtattgaagcaaaaataagcaataccactacagacagtcgatgtccaacacaaggggaagcaactttagtagaagaacaagatgcaaactttgtctgtagaagaacattcgttgaccgcgggtggggcaacggttgtggattattcggcaagggctccctgctaacttgtgccaaattcaaatgcgtgactaaattagaaggtaagattgttcaatacgaaaatttgaaatatagtgtgattgtaacagtacatactggagatcaacaccaagtaggaaatgaaacgacagagcacgggactatcgcaacaataacaccacaagctccaacaagtgaaatccaattaacagattatggcgcattgactctagactgcagtccgcgcacagggctagactttaacgaaatggtcttactcactatgaaagaaaaatcgtggctagttcacaaacagtggtttctagatctaccactaccatggacgagtggggcaagtacaagtcaagaaacttggaaccggcaggatttattagtaacgtttaaaacagcccatgcaaagaaacaggaagttgtggttctagggagccaagaaggagcaatgcatacggctctcaccggtgctacggaaatccaaacaagtggtactacaacaatctttgctggacacttaaaatgtcgacttaaaatggataaactaacactcaagggcatgtcatatgttatgtgcacgggtagctttaaactagaaaaagaagtagctgaaactcaacacgggacggtcctagttcaagtaaaatatgaggggacagatgctccgtgcaagatcccattctcaacacaagatgaaaaaggagtgacacaaaatggaaggctgataaccgccaacccaatagtgaccgacaaagaaaaaccggtaaatatagagacggagccgccatttggcgaatcatatattgtagtaggcgccggcgaaaaggcattaaaactttcatggtttaaaagaggatcatcaataggtaaaatgtttgaagccacagcacgaggggcacgaaggatggctattctcggagatacagcatgggatttcgggagcattggtggagtctttacatccgttggtaagctagtacaccaaatatttgggaccgcgtatggggtactattctcaggagtaagctggacgatgaaaataggaatcggtatactcttaacgtggttaggacttaacagtagaagcacaagtctcagtatgacttgtatagcagttgggatggtaacactttacctaggcgtaatggttcaggccgattccgggtgtgtgatcaactggaaaggaagagagttgaagtgtggatctggaatattcgtaaccaatgaggttcacacatggacggagcaatataaattccaagcagattctcccaaacgtctatccgccgctatagggaaagcctgggaagagggtgtgtgcggtatccgaagtgctacaagattggaaaacattatgtggaaacaaatatccaatgaattgaaccacattttgcttgagaacgacatgaaattcacggtggttgtaggagatgcaaacggaatattggcacagggaaagaaaatgatcaggccacaaccaatggaacataaatactcatggaaatcatggggaaaagcaaaaatcatcggggcagatatacaaaatacaacttttataattgatggtcctgatacacctgaatgtccggatggtcaaagagcttggaacatttgggaagtggaggattatggatttggagtctttactacgaacatctggttaaaactccgtgattcttatacccaaatgtgcgaccacagactgatgtcagctgcaattaaagactcgaaggccgtccatgctgatatgggatattggatagaaagcgagaaaaatgaaacatggaaattagctcgtgccagtttcatagaagtaaaaacatgcacatggcctaagtctcatacactttggagtaatggcgtgttagaatcagagatgattataccaaagatttacggaggccctatatcacagcataactatagaccaggttactttacgcaaacagcggggccttggcatttaggtaagctagaacttgattttgatctgtgtgaagggactaccgtcgtggtcgatgagcattgcggaaacagaggtccaagtctaaggacaacaaccgttactggaaaaatcatacacgaatggtgttgtagatcctgtactctacctcccctcagattcagaggggaagatggttgttggtacggaatggaaattagacctgtcaaggaaaaagaggaaaaccttgtaagatcaatggtatcggcaggttcgggtgaggtggacagtttctcgttggggatattgtgcgtctcgatcatgatagaggaagtgatgaggagtcgctggtcacgtaagatgcttatgacaggaacactggcagtatttctccttttaatcatgggacaactgacctggaatgacttaattagactatgtattatggtgggagccaacgcctctgaccgaatgggaatggggacaacataccttgcacttatggcaacttttaaaatgagacccatgttcgctgttggacttttatttagaagactaacaagtagggaagtccttctcttgactatcggactaagcctagtcgcgtcagttgaattacctaatagcttggaagaattaggagatgggttagctatgggtatcatgatgctcaaacttttaaccgagtttcaaccacatcaactgtggactacattgctcagcttaacattcgtcaagacaacgttatccctagattatgcatggaagacaactgcgatggcactttcaatcgtttctctatttccattgtgtttaagtacaacttcgcagaaaacaacctggttaccagtgctgttagggagttttgggtgcaaaccgctcacgatgttcttaataacggagaacaaaatttgggggagaaagtcttggccattgaacgagggaataatggcaataggtatagtatcaatattattaagctctttattgaaaaatgacgtccctctagctggcccgctaatagcaggaggcatgttgatagcttgttacgtaatatccgggtcttctgctgatctatcgttagaaaaggcagcagaggtaagctgggagcaagaagccgaacactctggcgcttctcacagtattttagttgaagtacaggatgacggaacaatgaagattaaagacgaagaacgtgatgataccttaacaattctgttgaaagctactttattagctgtaagcggagtatatcctatgtctattccagcaacgttatttgtttggtacttctggcagaaaaagaaacaaagaagtggcgttctgtgggatacaccatctcctccagaagtcgaaagagcagtactagacaatggcatttatcgaatattacaaaggggattactgggacgtagtcaagtaggagtaggagtgtttcaggacggagtctttcatacgatgtggcatgtgaccaggggagctgtgttaatgtatcagggtaaaagattagaaccgtcttgggcaagtgttaaaaaggatctaatttcatacgggggcggatggagatttcagggatcatggaatacaggtgaagaggtccaggtgatagccgtggagccagggaagaaccctaaaaatgtacagactacacccgggacattcaagacaccagaaggagaagtaggggcgatagcactagattttaaacccggcacttcaggtagcccaatagtgaatcgggaggggaaaattgtaggattgtatgggaacggagtcgtgactacaagtggaacttatgtatcagcaatcgcgcaagccaaagcatcacaggagggtccgcttccagaaatcgaggatgaagtcttcaagaaacgcaatttaaccatcatggatctacacccaggatcggggaaaacacgtaggtatctgcccgcaatagttcgagaagcgatcaaaaggaaattaagaacattaattctcgccccaacgagagtggtggctagtgaaatggccgaggctttgaaaggaatgccgattcggtaccagactaccgcggtaaaatcagaacataccggcagagaaatagttgatttgatgtgtcatgctacattcacaatgagattactatccccggtacgcgttcccaattataatatgatcataatggatgaggcacacttcactgatcccgcgtcaatagcggcaagaggatatataagcactagggtaggtatgggggaagccgccgctattttcatgactgcaacccctccaggatcagttgaagcattcccacaaagtaatgcagtcatacaagatgaagagagagacataccagagagatcctggaatagcggatatgactggataacagattttcccggcaagacagtctggtttgtccctagcattaaaagtggcaatgatattgctaactgtctgaggaagaatggaaagagagtaattcaattatcgagaaaaacttttgacacagagtaccagaaaacgaagaatagcgactgggattatgtagtaactacagatatttctgaaatgggcgccaacttccgagctgaccgtgtgatagaccctcgtcgttgcttaaaacctgtgatattaaaagacggaccagagagagttattctggctggacccatgccagtaacagctgcatccgcggcacaaaggagagggagaataggaagaaatcaaaataaggaaggtgatcaatatgtctacatggggcagccgctaaataatgacgaggaccacgcacattggacagaagctaaaatgcttcttgataatataaatacgccagaaggcatcattcctgccttatttgaaccagaaagggaaaaatcagccgctatagatggagaatataggctaagaggcgaggcgcgaaaaacattcgtagagttaatgcggaggggtgatctaccggtgtggttatcttacaaagtagcatcagaaggctttcaatactcggatcgaagatggtgctttgacggtgagcgtaataatcaagtgttggaggagaatatggacgttgaaatatggacaaaagagggcgaaagaaagaaacttaggccgaggtggttagacgctagaacttattcagatccgctagccttacgagagtttaaagaatttgcggcaggaaggcgcagtgtatcgggtgaccttattttggaaataggaaaattacctcaacacttaacattaagagctcaaaatgcgctagacaacctagtaatgctccataacagtgaacaagggggtaaggcatatcgacacgccatggaagaattacccgatacaatagaaaccttaatgttattggcacttattgcagtgctcacaggcggagtaaccctatttttcttatcgggcaaaggcttaggtaagacatccattggcctactctgcgtaacagcaagtagcgctctcttatggatggcatctgtcgagcctcattggatagcagcgtcaattatactcgaatttttccttatggtattactgattcctgagccagacagacaacggacaccacaggataatcagttggcgtatgtagtaataggcttactattcatgatattgaccgttgcagccaatgaaatgggactcttagaaacgacaaagaaagatttggggattggttacgttgctgccgagaatcatcaacatgtcacgatgctggatgttgatctacacccagctagtgcctggacactctatgctgttgccacgacagttataactccaatgatgcgacatacaatagaaaatgctacggcaaatatctctttaacagcaatagcgaaccaagcagcgatactaatgggtttagataaaggatggcctataagcaaaatggacatcggcgtccccctattagcccttggctgctactctcaagttaatccgttaacattgactgctgctgtattaatgttagtagcacattatgcgatcattggaccgggtttacaggcgaaggcaacaagggaagcgcagaaaaggacagctgcgggcataatgaaaaatcctacggtcgacgggatagtcgcaatcgatttagatcctgtcgtttacgatgcgaagttcgagaagcagctgggacaaataatgctgctaatattgtgcacaagtcagatccttttaatgcgaactacttgggcactgtgtgaaagtataacactagcgaccggaccactaacaacactatgggaaggcagtccaggaaaattttggaatacaacaatagccgtctcaatggccaacatctttagaggcagttacttggctggagccgggcttgcattctcattaatgaagtcactaggtggcggtcgaagaggcactggagcacaaggagaaacacttggggagaagtggaagcgccaattaaaccaactaagcaagtcagaatttaatacatataagagatcaggaatcatggaggtagatagatctgaagccaaagaggggctcaagcgaggggaaacaacaaagcatgcggtaagcagaggaacagcaaaactcagatggttcgtcgagcgaaatctagtgaaaccagaaggaaaggtgattgatttgggttgtggaaggggcggttggagctattattgtgcgggattaaagaaagttaccgaagtcaagggctataccaaaggcggtccgggtcatgaggaaccaatcccaatggctacttacggatggaacttagtaaaactacacagtggcaaagatgtattctttatgccacctgaaaagtgtgatacattgttatgcgatataggcgaatcaagcccgaaccccacagttgaggagggtagaacgttaagagtgttaaagatggtcgaaccatggttacgaggtaatcagttttgtataaaaatcctgaacccatacatgccatcagtagtggagactttagaaagaatgcagcgaaaacatggagggatgttagtgagaaacccgcttagtagaaacagcacccacgaaatgtattgggtgagttgcggaactggaaatattgtctctgctgtcaatatgacgtcacggatgttattaaatagatttacaatggcacataggaaaccaacttatgaaagagatgtagaccttggtgcaggaacacgacatgttgccgtagaacctgaagtcgcgaatctagatattattggacaacggatagaaaatatcaaaaacgaacacaaatcaacctggcactatgatgaggacaatccctacaagacatgggcctaccacggtagttacgaagtgaagccatcaggtagtgcaagttccatggtgaatggagtagtgaggctgttaaccaaaccatgggatgtaatacctatggtgactcaaatagcaatgaccgacacgacaccattcgggcagcaaagagtatttaaagagaaagtggatacaagaacgcctagggccaaaagaggcactacgcaaataatggaagttaccgccaaatggttgtgggggttcttaagtcgaaataagaaaccaagaatatgtacaagggaggaatttacacgtaaagtaagaagcaatgcagccgtcggagcagttttcgttgacgaaaaccaatggaactccgcaaaagaggcagtagaggatgaacgattctgggacttggtacaccgagaaagggaacttcacaaacaaggtaagtgcgctacgtgtgtatataatatgatgggtaagagagagaagaagctgggagagttcggaaaagctaagggaagtcgagccatatggtacatgtggctaggcgcacgtttcctagaatttgaggctttagggtttatgaatgaggaccactggtttagcagggaaaacagtttgtccggcgtggagggagaaggtttacataaacttggttatattctgagggatataagcaaaatacctggagggaacatgtatgcagatgatacagcaggttgggacaccagagtaaccgaagacgatctacaaaatgaagcaaaaattactgacattatggaacctgagcatgctcttttagctacttccatatttaaactaacttatcaaaataaagttgtaagagttcaacgaccagctaagaacggcactgttatggacgtaatatctagaagggatcaaagaggaagcggacaagtaggaacctatggactcaacacatttactaatatggaagtacagctgatccgacagatggaatctgagggaattttcttaccctcggagctagaaacaccaaacctagcagaacgagcactggattggctagagaaacatggagcggaaagattgaagagaatggccataagcggagatgattgtgtagtaaaaccaatagacgatcgcttcgctaccgcactaacggctcttaatgacatggggaaggtaagaaaagacattccacaatgggaaccatccaaaggatggaacgattggcaacaggtgccattttgttctcaccattttcatcaactgattatgaaagatgggagggagatcgttgttccttgtagaaaccaagatgaactcgtcggtagagcaagagtaagtcaaggagccggatggtctttaagggaaacagcgtgcctgggaaagtcgtatgcgcaaatgtggcaactaatgtactttcacagaagggatcttaggctagcagctaatgcaatttgttcggctgtaccagttgattgggttcccacgtcacgaactacgtggtcaatccacgcacatcaccaatggatgacgaccgaagacatgctcagtgtttggaatagggtgtggatagaagaaaacccctggatggaaaataaaactcatgtgagctcatgggaagaggttccatatcttggcaaacgtgaagatcagtggtgtggttcattaataggccttactgctagagcgacttgggcaacgaacatccaggttgcaattaatcaggtaagacgattaataggaaatgaaaattacctagattatatgacaagtatgaaaagatttaaaaacgaatcagactcagagggtgcattatggtag

SEQ ID NO: 21364 - RNA, 9879 nt, synthetic construct
  misc_feature 1..9879: note = derived and/or modified CDS sequence (opt6) from DENV-1__JN819417__SS-prME
  source 1..9879: mol_type = other RNA
tctgtgacaatgcttctcatgttactaccgacggctctggcattccatttgaccactcgaggaggggaacctcacatggtggtttccaaacaagaaagaggaaagagcttactttttaaaacttcagctggtgtaaatatgtgtacccttattgcaatggacctgggagaattatgcgaagacacaatgacttataaatgtccaagaattacagaagcagaacctgatgatgtagattgctggtgtaatgcaaccgacacttgggttacatatggaacatgcagtcaaaccggagagcaccgccgtgataaacgaagcgtggcgctagcaccacatgtcggtttagggttagaaacacgaactgaaacctggatgagttcagaaggagcatggaaacaaatacaaaaagtagaaacttgggctttaagacatcctggtttcaccgtaatagcactttttctcgcgcacgctataggaacttcaataacccaaaaaggcataatattcattttgttaatgttggttacaccatcgatggcaatgcgatgtgtcggtataggcaaccgagactttgtagaaggcctttcgggagcaacttgggtggatgttgtccttgaacatggatcctgtgtgacaacaatggccaaaaataaaccaacactagatatagaattattaaaaacagaggtgacaaatcccgctatacttagaaaactttgtattgaagccaaaatatctaatacaacgacggactcaagatgtccgacacaaggagaggctactttagtcgaggaacaagacgcaaacttcgtgtgcaggagaacatttgtggacaggggatggggaaacggatgtggactgtttggaaaaggatctctacttacctgtgctaaatttaaatgcgtcacgaaattagaaggaaaaattgtccaacacgaaaacctaaaatacagtgttattgttactgtacatacaggcgatcaacatcaagtcggaaacgaaacaacggaacatggtactattgctacgataactccacaagcgcctacaagtgagattcaacttacagattatggggccttaacattagattgcagcccacgaaccggattggactttaacgaaatggtcttgctaaccatgaaagagaaaagctggttagtgcacaaacaatggttcttggatttaccactgccctggaccagcggagcatcgacctcccatgaaacatggaaccgccaagatttactcgttacctttaaaaccgctcatgccaagaaacaggaagtggttgtacttggatcccaagaaggggcgatgcacacagcccttacgggtgcaacagagatacagacttcaggaaccaccactatatttgcggggcatttgaaatgcaggttaaaaatggataaactaactcttaagggcatgagttacgtcatgtgtacaggatcattcaagctcgaaaaagaagttgctgaaactcaacacggcactgtattggttcaagtaaaatacgaaggtacggacgcgccatgcaagattccttttagcacccaagacgaaaagggggtgacacagaatggtagattaataacagcgaatcctatagtaactgataaagaaaaaccggtgaacatagaaactgaaccacccttcggagaatcttacattgtagttggagccggagagaaagctcttaagctaagctggttcaaaaagggatcatcaataggtaaaatgttcgaagctactgcaagaggggctagaagaatggctatcctcggggataccgcctgggatttcggtagcattggtggcgtattcacaagtgtaggcaagttagttcaccaagtattcggcacagcatatggagtcctgttctcaggcgttagttggacaatgaaaattggaataggaatattactaacctggctcggattaaactctagaagtacctccttatctatgacatgtatagcagtagggatggtaactctttatctaggagtcatggtacaagcagactcaggttgcgttataaactggaagggaagagaattaaaatgtggaagtggcatatttgtcaccaatgaggttcacacatggactgaacaatacaagtttcaggcagattcacctaaaagactgtctgcggctataggtaaagcgtgggaagaaggcgtgtgtggcattagaagtgctactcgcttagaaaatattatgtggaagcagattagcaatgagcttaatcatatactcctagaaaatgatatgaagttcacagtagttgtaggagacgcttcaggaattttagctcaagggaagaaaatgataagaccacaacctatggagcacaaatacagctggaaatcatgggggaaagctaagatcataggcgccgatacccaaaatacgacatttattattgacggtcccgacacaccagaatgcccagatgaccaaagagcatggaatatatgggaagttgaagattacggttttggaatatttacaaccaacatatggctaaaattacgcgacagttatacacaaatgtgcgaccaccggctaatgtcagcagcaataaaagactcgaaagcggtacacgcagacatgggttactggatagagtcagaaaagaatgaaacgtggaaattagcacgtgcctctttcatagaagtgaagacgtgcatttggccgaagtcacacactctctggagcaatggggtactagagagtgaaatgataatacccaaaatttatggtggtcccataagtcaacacaattataggccagggtactttacacaaacagcaggaccatggcatctaggcaaattagagcttgattttgacttatgtgaaggaactaccgtagtcgtcgatgaacattgtggtaaccgcgggccgtccttaagaacaacgacagtaacaggtaaaataatccatgaatggtgctgtagaagctgtaccctgcccccattaagatttagaggtgaagacggatgttggtatggtatggagataaggcccgtaaaagaaaaagaagaaaatttggtaagatcaatggtaagtgcgggatccggagaggttgactccttttcactgggtattttatgtgtcagcatcatgattgaagaggtcatgcgtagccgatggagtagaaaaatgctcatgactgggaccctagcagtattcctactccttattatgggacaactaacttggaatgacctgatccgtttatgcataatggtcggtgcaaatgctagtgaccgaatgggaatgggaactacatacttagcattaatgggaacctttaaaatgcgtccaatgtttgctgtaggccttctatttcgacgtttgacttcaagggaagtcttactacttactatcggattatcactcgtagcgtcagtggaattaccgaatagtcttgaagaactaggggacgggttagctatgggaattatgatgcttaaattgttaactgagttccaaccccaccaactatggactactttattatctttaacctttatcaaaacgacattgtcactagattatgcttggaaaaccatggctatggttctttcaattgttagtctatttcctctgtgtcttagtacgaccagtcagaaaactacatggttaccagtcctgctaggaagttttggctgtaagcccctgactatgtttttaataaccgagaataaaatttggggtcgcaagagctggcccctaaacgaagggatcatggccattggtatagtttcaatactattgagtagcctattgaaaaatgatgtaccgctagcaggtccactgatcgcaggcgggatgcttattgcatgttatgtaattagtggaagtagtgctgacctgagtctagaaaaagctgcggaaataagttgggaggaagaagctgagcattcaggaacaagtcataatatcctagttgaagtacaagacgatggaaccatgaagataaaggatgaagaacgggacgacacactaactattttactaaaagctactctacttgctgtttccggcgtatatccgatgtcaatacctgcaacgttatttgtatggtatttctggcagaaaaagaaacaaaggtcaggagtactctgggatactccgagcccgcccgaagtagaacgagcagtattagacgacgggatataccgtatattgcagagaggccttttaggacgtagtcaagtcggagtaggggtatttcaagacggtgtttttcacacaatgtggcatgtgactagaggagcagtcctcatgtaccaaggaaaaagattagagccatcatgggcttcagttaagaaagatctaatttcttacggcggaggatggcgattccaaggaagttggaacacgggggaggaagtgcaagtaattgcagtagaaccagggaaaaaccccaaaaacgtccagacgacaccaggtacttttaagacaccagagggagaagtaggagcaattgcgctagattttaaaccgggaacatcaggctcaccaatcgtgaaccgagaaggtaaaatagttggcctatatggcaacggcgtagtaacaacctccggcacatatgtaagtgctatagctcaggcgaaagcatcacaagaaggaccactacctgaaatcgaagacgaagtcttcaagaaacggaatctaacaataatggatttacatccaggtagtggaaaaacacgtcgttatcttccagcaatcgtgagagaagctattaaaagaaaattaagaacattaatactggcgccaacgagagtggtggcaagtgagatggctgaggcacttaaaggaatgcccataagatatcaaacaacggcagtaaagtcagaacacactggcagagaaatagtagacttaatgtgtcacgccacgtttacaatgagattgttgtctccagtacgggtcccgaattataacatgattattatggatgaagctcattttacagaccccgcatctatcgctgcacgcgggtatataagtacacgggtgggcatgggagaagctgctgcaatctttatgactgcgacacctccagggtcggtagaagcattccctcaatcgaatgccgtaatacaagatgaagaacgagatattcctgaacggtcatggaactcgggctatgattggatcaccgacttccctggtaaaaccatttggtttgttccaagcatcaaaagcggaaacgatatagcaaactgccttaggaaaaacggtaaaagggtaatacaactctcacgcaaaaccttcgacacagaatatcaaaagaccaaaaacaatgattgggattatgtagtcactactgatatatctgagatgggagcgaacttcagagcagatagagttatagatccccgtcggtgtcttaaacctgtaatactcaaggacggtccggaaagagttatattagcgggaccaatgcccgtaactgtagcaagtgcggcgcagcgaaggggccgaatagggcgtaatcaaaataaggagggtgaccaatatgtctacatgggacaaccgctcaacaacgacgaagatcatgctcactggacggaagcgaaaatgttactcgacaatataaacaccccggaagggataataccagcgctattcgaacctgagagagaaaaatcagccgccatagacggagaatatagattgcgaggagaagcacggaaaacatttgtagaattaatgcgcaggggagacctccccgtatggctatcatataaagtggcatcggaaggtttccaatactcggacagacgttggtgttttgatggcgaacgaaataaccaggtcctagaagagaatatggatgtcgaaatctggacaaaggagggagaaaggaagaaactacgccctagatggctagatgcaaggacatactcagatcccctagcgttacgtgaatttaaagagtttgccgctggtcgtcgctccatatccggtgacttaattctagaaattggaaaactgccacagcacctgacactaagagctcagaacgcgttagacaatcttgtgatgctacataactccgagcaaggagggaaagcctacagacatgcgatggaagaattacccgatacaatagaaacgctcatgctattagcgctcatagctgtacttacgggaggggtcacattattctttttgagtgggaaggggttgggtaaaacctcaataggtttattatgcgttatggcgagttcagcgctcttatggatggccaatgtggaacctcattggatagctgcatccataattcttgaatttttcctaatggtactattaatacctgaacctgacaggcaacgaactccccaagacaatcagttagcctatgtggtcattggtctcctatttatgatattgaccgttgcagcaaatgaaatgggtctgttagagaccactaagaaagatcttggtattgggcatgtcgcagcggaaaaccatcaccatgctacgatgctcgacgtcgatttaagacccgcaagcgcatggactctctatgcagttgcaaccactgttattaccccaatgatgagacacactatagaaaatacaaccgcaaacataagtctaacagcaatagcgaatcaagcagctattttgatggggcttgataagggatggccaatctctaaaatggatataggagtaccgctcttggcattaggttgttattctcaagtaaatccgttaacgcttacagcggcagtattaatgttggtcgcgcattatgctattataggtcccggactacaggctaaagcaactcgagaagcgcagaaaagaacagctgctgggataatgaagaatcccacggtagatggcattgtagcaatagatttagatccagtagtatacgacgcgaaatttgagaaacagctaggtcagataatgcttctaattctttgtacaagccaaatactattaatgaggaccacttgggcattgtgtgagtctataactttggcaactggtccgttgaccacactatgggaggggagtccaggaaaattctggaacaccactatagcagtgtcaatggctaatatattcagaggatcatatcttgctggcgcaggattagccttctcgttaatgaaatcgctaggtggaggcagaagaggaacaggtgcgcaaggcgaaaccctgggtgagaaatggaaacgtcagctgaaccagttatccaaatctgagtttaacacctataaacggagcggaataatggaagttgatagaagtgaagcgaaagaaggtttaaagagaggggaaactacaaaacacgcagtatcgcgagggacagctaagttacgctggtttgtagaaagaaatcttgttaaacccgagggaaaagttatagatctcgggtgcgggagaggaggttggtcgtattattgtgcaggcttaaagaaggtcacggaagtaaaaggatatactaaaggaggaccgggacacgaggaaccgattcctatggctacttatggatggaacttagtaaaattacatagtggaaaagacgtgttctttactccacccgagaaatgtgatacactcttatgcgatattggcgagtcatcccctaatccgacaatagaagaaggtcggacattacgtgtactcaaaatggttgaaccatggctgcggggcaatcagttttgcatcaaaatactcaatccttacatgcccagtgtcgttgaaacacttgagcagatgcaacgaaaacatggaggtatgttggtaaggaacccattaagtagaaactcgacacatgaaatgtattgggtatcgtgcggaaccggcaatattgtaagtgcagtgaatatgacttcgcggatgctactaaaccgcttcacaatggcgcatcgaaaaccaacatacgaaaaagatgtagacttaggagcaggaacacgacatgttgcagtggaacctgaggttgcgaacctagatattataggtcaacgcatagagaatatcaaaaatgaacacaagtcaacgtggcattatgatgaagataacccctacaaaacatgggcttatcacggctcctatgaagttaaacccagcggaagcgcgagttctatggtaaatggggtagtaagattgcttacgaagccttgggatgtaatccccatggttacacaaattgccatgactgacacaaccccattcggacaacaacgcgttttcaaagaaaaagtagacacgcgaacacctagggcgaaacgaggaacggcgcaaataatggaagttaccgcaaaatggttgtgggggttcctgagcaggaataagaaacctagaatatgcactcgcgaagaatttaccaagaaagtaaggagtaatgccgcaatcggtgcagtgtttgtagatgagaaccaatggaactcagcaaaagaggcagttgaggatgaaagattctgggacctcgttcacagagaaagggaattgcataaacaagggaaatgtgcaacctgcgtgtataatatgatggggaagcgtgagaagaaactcggtgagttcggcaaagcaaaaggaagtcgagcgatatggtatatgtggctaggcgcacgatttctagaatttgaagcgttaggatttatgaacgaagaccattggtttagtcgcgagaactctctatctggagtagagggggaagggcttcataaactaggttacattcttcgcgacataagcaaaatacccggaggcaacatgtatgctgatgatacagcaggttgggacacgcgcataacggaagatgatttacaaaacgaagcgaaaatcaccgacataatggaacccgaacatgcccttttagcaacgtcaatctttaaactgacttatcaaaacaaagttgttcgagtacagcgtccggctaaaaacgggaatgtcatggacgtcatttcaagaagggatcagagagggagcggacaagtaggaacatatggattaaatacttttaccaatatggaagtacaattgataagacaaatggaaagcgaaggtatatttttaccaagtgagttagaaacacctaatctagcagaacgggtactagattggttggaaaaacatggagcggaacggctcaagagaatggctatatcaggagatgactgtgtggttaagcctatagatgatcggttcgctaccgccttaattgcattaaatgacatgggaaaggtacgtaaggatatcccacaatgggaaccaagtaaaggctggaatgattggcagcaagtgccattctgtagccatcattttcatcaattgatcatgaaagacggtcgagaaatcgtcgtaccctgtagaaaccaagatgaattagtcggcagagcaagggtaagtcaaggcgcagggtggagcttacgagaaacagcgtgtctaggtaagtcctacgcacagatgtggcaacttatgtattttcatcggcgagacttgagactagctgcgaacgccatctgtagtgccgtccccgtggattgggtaccaacgtcgcgtactacatggagcattcacgcacatcaccaatggatgacaacagaggatatgctatcagtatggaacagagtatggatcgaggaaaacccatggatggaagataaaacccatgtaagttcatgggaagaggttccttaccttggcaagagggaagaccaatggtgcggtagcctaataggacttacagcaagagccacatgggctacaaacattcaggtcgctatcaatcaagtaagaagattgataggcaacgaaaactacttagactatatgacaagtatgaaaagatttaaaaatgaaagtgacccagaaggagcattatggtag

SEQ ID NO: 21365 - RNA, 9879 nt, synthetic construct
  misc_feature 1..9879: note = derived and/or modified CDS sequence (opt6) from DENV-1__FJ687426__SS-prME
  source 1..9879: mol_type = other RNA
tcagtcactatgctgctaatgcttatgcctactgcgctagcatttcacctaacaacacgtggaggggaaccacacatgatagtatctaaacaagaacgaggaaaatcgttgttgtttaaaacaagtgcaggggtaaatatgtgtacgctcatcgcaatggacctaggagagctgtgtgaggacacgatgacatacaaatgcccgagaatcactgaagcagaacctgatgatgtagactgctggtgcaacgccacggatacatgggttacttatggaacgtgtagccaaactggtgaacacagacgagataaaagatccgtcgcattggcaccacacgttggacttgggttagaaacacgtacagaaacatggatgagctcagaaggtgcatggaaacaaatacaaagggtagaaacatgggcgcttagacatccaggatttacagtcatagcactgtttctagcccacgcaatcggaaccagtattacacaaaaaggaataatatttatcttgcttatgttggttaccccatcaatggcaatgcgctgcgtaggcatcggcagtcgagactttgtggaaggattaagcggagcaacgtgggtagatgtagtattagaacatggatcctgcgtaacaactatggcgaaagataaaccaaccctagatatagaattacttaaaactgaagtcacaaaccccgctgtcttacgcaaactttgtattgaagctaaaatatcaaataccacaactgattctcgttgcccaacccaaggtgaggccactttagttgaagaacaagacgctaacttcgtttgtaggagaacattcgtagatagagggtggggcaacggatgtggtttgttcggtaaaggcagtttactaacgtgtgcgaaattcaaatgcgttactaaattggagggaaaaattgtgcaatatgaaaacttaaaatactctgtaattgttaccgtgcatacaggcgatcaacatcaagttggaaatgaatccacagaacatgggacaacggcgactatcacccctcaggccccaacaactgaaatacagttaaccgattacggagctcttaccttggactgcagtccaaggaccggtctcgactttaatgaaatggtattactaaccatgaaagagaaatcatggttggtacacaaacagtggtttctagacctccctctaccatggacaagtggtgcatcgacttctcaggaaacgtggaataggcaagatctcctagtaacattcaaaaccgcacatgccaagaaacaagaggttgtagttcttggatctcaagaaggagcaatgcatacggctctgactggcgccaccgaaatacaaactagcggtacaacaaccatcttcgcgggccatttaaaatgccgtcttaaaatggacaaattaacgctgaaaggaatgagttatgttatgtgtaccggatcatttaaattagagaaagaggtggccgaaacgcaacatggaactgtattagttcagataaaatatgaaggtacagatgctccgtgtaaaatacccttcagcacacaagatgaaaaaggtgtaacccagaatggacgactaatcacggcgaatcctatagttactgataaagaaaaacctgttaacatagaagccgaaccaccttttggggaatcatatatagtaataggagccggtgaaaaagcattaaaactatcttggttcaagaaaggaagtagcataggaaaaatgtttgaagctacggcgagaggagcccgacgaatggcgattcttggagatacagcgtgggattttgggtcaataggcggggtctttactagcgtaggaaagctagttcaccagatattcggtacagcatacggcgtactattttcaggggtctcatggactatgaaaatcggaataggggtgctactaacttggctcgggttaaatagtaggagtacaagtctaagtatgacttgcattgctgtcggtctagtgacattgtacttaggagtcatggttcaagcggatagtggatgcgtgataaattggaaaggaagagaattaaaatgtggaagcgggatattcgttacgaatgaggtacacacatggactgagcaatataaattccaagcagatagtcctaagaggctcagtgccgcaatcggtaaagcatgggaagaaggcgtatgcggaatacgctctgcaactcgactagagaacattatgtggaaacagatctctaatgaactaaatcatatactcttagaaaatgacatgaaattcacagtagtagttggtgacgtcgccggcatattagcgcaaggaaagaaaatgataaggccccaacctatggagtataagtacagctggaaatcatggggaaaagcaaagattatcggagctgatgtacaaaattcaacgttcataatagacggaccgaatacacctgaatgccccgatgatcaaagggcgtggaatatttgggaggttgaagattatggctttggaatttttacaaccaacatatggttaaaactgcgggacagctacacgcaagtttgtgaccaccgtttaatgtcggctgcaataaaagatagcaaggctgtacatgcagatatgggatactggatagagagtgagaaaaacgaaacgtggaaactagcgggagcttcattcatagaagttaagacctgcatatggccaaagagtcatactctatggtcgaatggagtattggagtccgaaatgattataccgaagatatatggcggcccaatcagtcagcataactaccggcctggatactttacgcaaacagccggcccatggcatttaggtaagctcgaactagacttcgacctctgtgagggtacaacagtagtagtagatgagcattgtggtaatcgtggtccatcactaagaacaactaccgtaacaggtaaaataattcatgaatggtgttgcagatcatgtacattgcctccactacgttttcgcggggaggacggttgttggtatggaatggaaataagaccagtaaaagaaaaagaagaaaatttagtaaaatccatggtttccgcgggatcaggggaggtagatagtttttcgttaggattactgtgcataagtataatgatcgaggaggttatgagatctaggtggagtagaaaaatgttaatgacaggtacattagctgtattctttctattaattatgggtcaattaacatggaatgatttaatacgattgtgcattatggtaggagctaatgcttccgatagaatgggaatgggcacaacatatctcgcgttgatggcaacatttaaaatgagacctatgtttgccgtaggtttattatttcgaagattaacatctagagaggtattgcttctcactataggattatcattagtcgcaagtgttgaactccctaattctttggaggagctaggcgatggtctcgcaatggggataatgatcctaaaactattaactgacttccaaagccatcagttatgggcaacattgctctctcttacattcataaagactacgttatctttgcattacgcttggaaaactatggccatggttctcagtatcgttagtttatttcccttgtgtctatctacaacatctcagaaaactacctggctacccgttcttttaggttcgctcggatgtaagcccctaacaatgtttctaatagcagaaaacaaaatttggggtcgtaaatcctggcccttgaacgaaggcatcatggcagtaggaattgtttcaattttactttcatcactattgaaaaacgacgtaccattggcaggtccattgatagcgggaggaatgcttattgcctgttatgtcatatcagggtcaagtgccgatttgtctcttgaaaaagcagctgaggtgtcctgggaagaggaagcggaacatagtggggcctcgcataacattctcgttgaagtccaagacgatggaacaatgaaaataaaagacgaagaacgagatgacacactaacaattctgctcaaagcgacgctgcttgctgtatcaggagtgtatcctctatctatccccgcaacattgtttgtttggtatttctggcagaagaagaaacagagatctggagtactttgggacactccctctcctccggaagtagaaagagctgttttagatgacggaatttacaggattatgcaaagaggcctccttggaaggagtcaagtaggcgttggtgtgttccaggagaacgttttccatacaatgtggcatgttacacgcggggcagtgttaatgtatcaaggcaaacgactcgagccttcatgggcctctgttaagaaagatttaatcagttatggaggcggatggcgactacaaggaagttggaatacaggcgaagaagttcaggttatagctgtagaacccggtaagaaccccaaaaatgttcaaaccgccccagggacatttaaaaccccagaaggagaagttggagcgatagcattagatttcaaacctggaacaagtggttctccaatagttaatagggagggaaaaatagtcggcttatatggcaatggtgtagttacaacctcaggtacgtatgttagtgccatagcacaagctaaagcatcgcaggaaggcccacttcccgaaatagaagacgaagtattcaggaagcgcaatctaactattatggaccttcacccaggaagcggaaaaacgagacgatatcttcctgccattgtgagagaagctataaagagaaaactaagaactctaattttggccccaactagggtagtcgcgtcagagatggcagaagctctaaaaggtatgccaatcagatatcagacgacagctgtaaaatcagaacataccggcaaggagatagttgatctaatgtgtcacgcaacgttcaccatgaggttactgtcccctgttcgggtcccaaactataacatgatcataatggatgaagcacactttactgacccttcaagtatcgcagccaggggttatatctcaactagagtaggaatgggtgaagcggcggcaattttcatgactgcgaccccgccaggaagcgtagaggcatttccacaatcaaatgcggttattcaggatgaagagagagatattcctgagcgtagttggaatagtgggtacgaatggataaccgacttcccagggaaaacggtgtggttcgtgccatcaataaaggcaggaaacgatatagcaaattgtttaaggaaaaacggaaaaagagtaattcaactaagcagaaagacttttgataccgaataccagaaaactaaaaataatgattgggattacgttgtcactactgacatatctgagatgggtgcaaactttcgtgctgatcgtgttatagatcccagacgatgcttaaaacccgtgattctaaaagatggaccggaacgagtcatcctagctggacctatgccagtcacagttgctagtgcagcccaacgcagaggaagaataggaaggaaccacaacaaagaaggagaccagtatatttacatgggacaaccacttaataatgacgaagatcatgcacactggactgaggcaaaaatgcttttagacaacattaatactccagaaggaatcataccggcattatttgagcctgaacgagaaaaatctgcagctatcgatggtgaatacagattaaggggtgaagcgagaaaaacgtttgttgagttgatgaggcggggtgacctaccggtatggctcagttataaagttgcttccgagggattccaatacagtgaccgtagatggtgttttgatggggagagaaacaaccaagtactggaggaaaacatggacgtcgaaatatggaccaaagaaggtgaacgcaaaaagctaagacctagatggcttgacgcacgtacatacagtgatccgctagcccttagagaatttaaagagtttgcagcaggaagaagatcggttagcggcgatctgatattggaaattggtaaattaccgcaacatctaacgcaacgagctcaaaacgcattagataacctagtaatgctccataatagtgagcaaggaggcagagcatatagacacgctatggaggaactaccagacactatagaaactttaatgttattggcactcatagcggtcctaacagggggagtgacactatttttcttgtcaggcaagggattaggcaaaacttctatcggactgttatgtgtgatggcatccagtgttctattatggatggcttccgtagaacctcattggatagcagcaagcataatcttagagttctttttaatggtactcctgatcccagagcccgatcgacaaaggacaccacaagataaccaattggcgtatgtagtgataggtctcctatttatgattttaacagttgcagcaaatgaaatggggttattagaaactaccaagaaagaccttggcataggtcatgtagccgtcgagaatcaccaccacgcagctatgctggatgttgacttgcaccccgctagcgcttggactttgtacgcagtcgctactacaataattacacccatgatgcgtcacaccatagagaatacgaccgctaacattagtttaactgcaatagccaatcaggccgccatattaatgggcttagataaaggatggccaataagcaaaatggatattggtgttcccttgctagcactcggttgttactctcaagtaaaccccctaactttgaccgccgcagtattgatgttagtagcacactatgcgataattgggcctggattgcaggcaaaagcaacccgtgaagcacagaaaagaacagctgctggcataatgaaaaaccccactatcgatggaatagttgctatagatttagatccggtagtgtatgatgcaaaatttgaaaaacaattaggacaaatcatgctattaatattatgtacaagccaaattcttctaatgagaaccacatgggcattgtgcgaaagtataaccttagctacgggtcccttaaccactttatgggaggggtcgccgggaaagttttggaacactacgattgccgtaagtatggctaacatatttaggggatcttacttagcgggtgcaggactggctttttctctaatgaaaagtctcggaggcggacggcgagggaccggggctcagggagagactcttggggaaaaatggaaaagacagcttaaccaactaagtaaaagtgagttcaacacttataaaaggtcaggaataatggaggtcgatcgaagtgaggcgaaagaaggattaaagagaggtgagacgacgaaacatgccgtttcacgcggaacggctaagctaagatggtttgtcgaacgaaatctagttaaaccagaaggtaaagtgatagacttaggttgtggtaggggaggttggagctactattgtgccggactaaagaaagtaacagaagttaagggctatactaaaggaggacccggccacgaggaacccataccaatggcaacgtacggatggaaccttgtcaaattgcacagtggaaaagacgtattcttcatacccccagagaaatgcgataccctattgtgtgacataggtgaaagctctcccaacccgacaattgaagagggaagaaccttaagagttctaaagatggtggaaccgtggctgcgaggaaaccagttctgcataaagattttaaacccttacatgcccagtgtggttgagacacttgaacagatgcaaagaaagcacgggggtatgctagtaagaaacccgttaagcagaaatagtacacatgaaatgtactgggtcagttgcgggacaggtaatatagtatcagcggttaacatgacaagcagaatgctcttaaatagattcacaatggctcatcgaaagcctacctacgaaagagatgtagacttaggtgcgggcacccgacacgtggcagttgaaccagaagtggctaacctcgacattattggccagagaatagaaaatattaagcatgagcataagagtacctggcattacgatgaggataacccctataagacttgggcctatcatggttcgtacgaagtgaagcccagtggtagcgcatcatcaatggtcaacggagttgtaaagttgcttactaaaccatgggacgtgatccccatggtaactcaaattgcaatgacagataccactccatttggacagcaaagagtttttaaagaaaaagtagatactcgaacgcccaaggctaaaaggggaactgcacaaattatggaagtaacagcaaaatggttgtgggggttcctaagcagaaataagaaacctagaatttgcacacgggaagaatttacgcgaaaggtacggagtaatgccgcaattggagccgtgtttgttgatgaaaatcagtggaacagtgcgaaagaggctgtagaagatgatcgcttttgggacctcgtacacagagaacgagagctacataaacaaggtaaatgcgctacctgtgtatacaatatgatgggtaaacgcgagaagaaactgggagaatttggaaaagcaaaaggtagtcgagcaatttggtacatgtggcttggtgcaagatttcttgagtttgaggcacttgggttcatgaatgaagatcattggttttcacgcgagaacagtctgtcaggagttgaaggcgaaggtttacacaaactaggctacatcttacgagacataagtaaaatacctgggggaaatatgtatgccgacgatactgcagggtgggacaccagaatcacagaagacgatttacagaacgaagccaagatcacagatatcatggaaccagagcacgcgcttctggcaaaaagtatcttcaaattgacatatcagaataaagtggtacgcgttcaaaggcctgccaaaaatggaaccgtaatggatgtaataagtagacgagatcaaaggggttcagggcaagtggggacatacggactaaacaccttcacaaacatggaggcccaacttatcaggcaaatggaatcagaaggaatatttagccctaatgaactagagactcccaacctagcagaacgtgtcttggactggttagaaaagtatggggtcgagagactcaaacggatggccattagtggggacgactgtgtagtaaaacctattgacgatcgatttgctactgcgttaacagcgcttaatgacatgggaaaagtgcgcaaagacataccgcagtgggagccctcaaaaggctggaatgactggcaacaagtaccattttgctcccaccactttcatcagctaattatgaaagacggtcgtgaaatagtggtaccttgccgaaaccaggatgagctagttggacgtgcccgagtatcgcaaggtgcggggtggtccttaagggaaacggcctgtttgggtaagtcttatgcacagatgtggcaacttatgtattttcatcgacgagacctaagacttgcagcaaacgctatctgctcggcagtgcctgtagattgggttccaacaagtagaactacatggtccatccatgcacaccatcaatggatgactacagaggacatgctatcagtatggaatcgcgtatggattgaggaaaacccatggatggaagacaaaacccgaataagctcttgggaggacgttccatacctaggaaagagggaagaccaatggtgcggcagtcttatcggactgaccgcgagagctacttgggctactaacatacaggtcgctataaatcaggtaagaagattgataggaaatgaaaactatagcgattatatgaccagcatgaaaagatttaaaaacgaatcggaaccagaaggagctctatggtaa

SEQ ID NO: 21366 - RNA, 9879 nt, synthetic construct
  misc_feature 1..9879: note = derived and/or modified CDS sequence (opt6) from DENV-1__FJ687428__SS-prME
  source 1..9879: mol_type = other RNA
agtgtgacgatgctattgatgcttatgcctactgcattagcgtttcatctcacaacacgtggcggggaaccacatatgatagtatccaaacaagagagaggtaagagcttattatttaaaacaagtgccggtgtgaatatgtgcacgctaatagcaatggatctgggagaactatgcgaagatacaatgacttataaatgtcctcgaataaccgaagcggaacccgacgacgtggactgttggtgtaatgctaccgatacttgggttacttatgggacatgttcccaaacaggtgaacatagaagggataaaagatcagtagcactggctccgcatgtagggctaggcctcgaaactcgtactgagacttggatgagctccgaaggagcatggaaacaaatccaaagagtagagacttgggcattacgacatcctggatttactgttatagcattgtttcttgctcatgcaataggaacctcaataacacaaaaaggtataatatttattttacttatgttagtcacaccaagtatggcaatgcgatgcgtaggcataggatcaagagatttcgttgaagggttaagtggcgcaacgtgggtagatgtagttttagaacatggatcatgcgtcacaactatggcaaaagataaacctactttagatatcgagctattgaaaacagaagtaacaaaccctgcagtgctaagaaaactatgcattgaagcgaaaataagcaacacaaccactgattctcggtgcccgacccaaggtgaagccacgttagttgaggaacaggacgccaattttgtgtgtcgaagaaccttcgtggatagaggatggggaaacggttgcggattgttcggaaaaggctccctattaacttgcgcaaagttcaagtgtgtaacaaaattggaaggaaaaatagtacagtatgagaatctgaaatactcagtaatagtaaccgttcacactggtgatcaacaccaggtggggaatgaaagcacagagcatggcactacagcaacaataacacctcaagcacctacgaccgaaatacaattgacagattatggagcacttactcttgactgtagtcccagaacaggcctagacttcaacgaaatggtcttattaactatgaaggaaaagtcttggctagtacacaaacaatggttcttagatcttcccttaccatggacaagcggggcgagcacttcgcaagaaacctggaataggcaggacttgctagtaacttttaaaaccgcacacgccaagaaacaagaagtcgtagtactcggtagtcaagagggggcaatgcatactgcccttactggagccaccgagattcaaacatccgggacaacaactatatttgcaggacacctgaaatgtagactaaaaatggataaattaacgttgaaaggaatgtcctacgtaatgtgtacggggtctttcaaattagaaaaggaagtagcagaaacgcagcacgggacagttttagtacagataaagtacgaaggtaccgacgctccctgtaaaatacctttcagcactcaagacgaaaagggcgttacgcaaaatgggagactaataacagctaatccgatagtaactgataaagagaaacctgtaaatatagaggcggaaccaccattcggagaatcgtacattgtaatcggcgcgggtgaaaaagcactaaagttatcctggtttaagaaagggtcttcaatcggaaaaatgtttgaagcaacagctaggggcgcacgaaggatggctatattaggggataccgcttgggactttggaagcataggcggagtttttacatccgtaggaaaattagtccatcaaatatttggaacagcatacggagtcctgttcagtggagtctcttggacaatgaagataggaattggcgtgttgcttacatggctaggtctaaacagccgttccactagcctgtccatgacctgtattgcagttggtttagtaacactgtatttaggagtgatggtgcaagccgattctggatgcgtgatcaattggaagggacgagaattaaaatgtggctcaggaatattcgtgaccaacgaagtccatacctggactgaacaatataaattccaagcggactcaccaaaaagattatctgccgccattgggaaagcgtgggaagagggggtttgcggcatacgttctgctacgaggttagaaaatattatgtggaaacaaatatccaacgaattaaatcatatcttattagaaaacgacatgaaattcacagtggtggtaggagacgtagccggaatactagcccaaggaaagaaaatgattcgtccacagccaatggaatataaatatagctggaagagttggggtaaagccaaaataatcggtgctgatgtacaaaatagtacatttataatagatggacctaatacaccggaatgtccagatgatcaacgagcatggaacatatgggaagtcgaagattacggattcggtatctttaccacaaatatctggttaaaactacgagactcgtacacccaagtctgcgatcacagattgatgtccgcagcaattaaagattctaaagcagttcatgcagatatgggatactggatagaatcggagaaaaatgaaacttggaaattagccggtgcaagtttcatagaagtaaaaacttgtatttggccaaaatcacacacactctggtcgaatggggtacttgaaagcgaaatgatcattccgaaaatctatggtggtccaataagtcaacacaattatagaccgggctatttcacacaaacagctggcccatggcacctgggcaagctagaattggactttgatttatgcgaaggcaccaccgttgtcgtagacgaacactgcggtaaccgagggccttcattacgcactaccacagttacaggaaaaattatacatgaatggtgctgtagatcatgtactttacctccactgcggttccgaggagaagatggatgctggtatgggatggaaatacgtcccgtaaaggaaaaagaagagaacctcgtcaagagtatggtttccgcgggttcgggcgaagttgacagtttcagtcttgggcttctgtgtatctctatcatgatagaagaggtcatgagatcaagatggtcacgtaaaatgctgatgacaggtacgcttgctgtattctttttactgattatgggtcaacttacttggaatgacttgatacgattatgcattatggtcggtgctaatgcaagcgacaggatgggaatgggtacaacttaccttgcactcatggcaacgttcaaaatgcgcccaatgttcgcagtcgggttactttttcgaaggctaacgagcagagaagtcctccttctaacaataggcctctcattggtagcaagtgtagaactacctaattcattggaagaacttggagatggtcttgcaatgggtataatgatattaaaattattaacagactttcaaagccatcaactatgggctacgcttttgagcttaacattcatcaaaacgacattgagcctccactatgcatggaaaacaatggcgatggttctttcgatagtgtccttgttcccattatgtttaagcactacatctcagaaaactacatggctccctgttttattaggtagtttgggctgtaaaccactcaccatgtttttaatagcagaaaataaaatatggggaagaaaatcatggcccttaaatgagggtataatggcggttgggatagtgtcaattttactttcttcactactcaaaaatgatgtacctctggccgggccactgatagcgggtggtatgttaatagcatgttacgtgatttcaggttcaagcgctgacctaagtcttgaaaaagctgcagaagtttcctgggaggaggaagcggaacactctggagcaagtcacaacattttggttgaggtacaagatgatggaactatgaagattaaagatgaagaaagagacgatactttaacaatcttgctaaaagcgacgttactagctgtgtctggagtatatccgctatcaataccagcaacactattcgtatggtatttctggcagaagaagaaacaaagaagtggagtgctatgggatactccaagtcctccagaagtagaaagagctgtactagatgacggaatttaccggataatgcagcgaggactattaggaagatcacaagtaggtgtcggtgtatttcaagaaaacgtttttcatacaatgtggcacgtaacacgcggagccgtattaatgtaccaaggtaaaagattagaaccgtcgtgggcatctgtcaaaaaggacctaatatcatatggtggcggatggagattacaaggctcatggaatactggagaggaagtacaagtaatagcagtcgaacctgggaaaaatcccaaaaatgttcaaacggccccgggaacattcaaaaccccagaaggagaagttggagctatagcactagattttaaacctggaacttctggttctccaatagtcaatcgcgaaggaaagatcgtaggactttatggtaacggcgtagtgaccacaagcggaacttacgtatcagcaatagctcaagcaaaggcgagccaagaagggccgttgcctgagatcgaagatgaagtttttcggaaaaggaaccttaccatcatggacttacatccgggttcgggaaaaactagacgatacctccctgcaattgtcagagaagcgataaaaagaaaattgcgtactttgatactagctcctacacgcgtggtagcctcagagatggccgaggcactcaagggcatgcctatcaggtatcaaaccaccgctgttaaatcagaacacactgggaaggaaatagtcgacttaatgtgtcacgctacttttacgatgcgtctccttagccctgtaagagttcctaactataacatgatcataatggacgaggcacactttacagatccaagtagtatcgcagcccgaggatatatatctactcgcgtaggaatgggtgaagccgcagcaatctttatgacagcaactccgccgggctcagtagaggcctttccacaaagtaatgctgtaatccaggatgaagaacgagatattccagaaagaagttggaactcaggatacgaatggataacagacttcccagggaaaacggtatggtttgtaccctcgatcaaagcaggtaacgatatcgcaaattgtttaaggaagaacggaaagcgcgtcatacaattgagcagaaaaacctttgacactgaataccagaaaaccaaaaataacgactgggactatgtggtaactacggatatatctgaaatgggagctaacttccgagcagatagagtcatcgatccaagaaggtgtttaaagccggttatattaaaagatggaccagaacgagtaatattagctggtccgatgccggtcacggtagcaagtgcagcacagagaagaggtcgaataggacgtaatcacaataaagaaggagaccaatacatatatatgggtcaaccgttaaacaatgatgaagatcacgcacattggaccgaggccaaaatgttgttagataatataaacaccccggaaggcattatacctgctttgtttgagccggagagagagaaaagcgcggccatcgatggtgaatacaggttaagaggagaagcgcgaaaaaccttcgtagaactaatgagaaggggtgacttaccggtctggttaagttacaaagttgccagtgagggcttccaatattccgacagacgatggtgctttgacggggaaaggaataaccaggtattggaagaaaatatggatgtcgaaatatggacaaaagaaggagaacgcaagaaactaagacctcgttggttagatgccaggacttatagcgatccactcgcccttcgtgaatttaaagaatttgcggcgggaagaagaagtgtaagtggtgatttaattttagaaattggcaaattaccgcaacatcttacccaaagagcgcaaaatgcattggacaatttggtaatgctacataatagtgaacagggtggtagagcctatagacacgcaatggaggagttgcctgacacaattgaaactctaatgttactcgcattaattgcggttctgactgggggagtaaccctattctttctgtctggaaagggactcggtaagacgagcattggcttattatgtgttatggcatcatcggttttgctatggatggctagcgtagagcctcattggatagcggcctcgataatactagaatttttcctaatggttttactgataccagaacctgaccgtcagagaactccacaggataatcaactagcgtatgttgtcatcggcttgctatttatgatactaaccgtggccgcaaatgaaatgggtctcttagaaactaccaagaaagaccttggaattggacatgtcgcggtagaaaatcatcatcatgctgcaatgcttgatgtagatttacatccagcttcagcctggacactctatgcagtggccacaactataattacgccaatgatgcggcacacaatagaaaatacgacggcaaatataagtctgactgctattgcgaatcaagcagccatactgatggggctagacaaaggttggcctatttcaaagatggacatcggcgttcctttactcgcactaggatgttactcccaagtaaatcctctaaccttaaccgctgccgtacttatgctagttgcccattatgccattattggtccgggattacaagctaaagccaccagggaagctcagaagcgaacggcagcgggaatcatgaaaaatccaaccatagatggaattgtagcaatcgatctggatccggtagtttacgacgctaaatttgaaaaacaattaggtcaaataatgctcttaatactctgtacatcacaaatcttgctcatgagaactacttgggcgctgtgcgaatccattactctagcgactggaccattgacaactctatgggaaggatccccaggcaaattttggaataccacaatcgcagtatcaatggcgaatatattcagaggaagttatttagccggtgctgggctagcattttccctgatgaaatcattaggaggtggtaggagaggtacaggagcacagggagaaacccttggagaaaagtggaaaaggcaactaaaccagttgagcaagagtgagtttaatacatacaaaagaagtggtataatggaagttgaccgatccgaggctaaagaaggattaaaacggggcgaaacaacgaaacacgcagtttcgagggggactgccaaattaagatggttcgttgaacgcaatttagttaaacccgaaggtaaggtcatagatctgggctgcggaagaggtgggtggtcatactattgcgcaggactaaagaaagtaactgaagtcaaaggatacacaaaaggaggacctggacatgaagaacctattccgatggccacatatggttggaatctagtgaagttacactcaggaaaagatgtcttcttcattccacctgaaaaatgtgatactctcctttgcgacattggagaaagctcgcctaatcctacaatcgaagaaggccgaacattaagagtattaaaaatggtcgaaccatggttaaggggaaaccagttctgtataaaaatcctcaatccatatatgccaagcgtcgtcgaaactctcgagcaaatgcaacggaagcacggaggtatgttggtcaggaacccattaagccgaaacagtacacacgagatgtattgggtaagttgcgggacgggaaatatagtatccgcggtcaatatgacaagtcgcatgttattaaacagatttactatggctcacagaaagccaacttatgaacgagatgtagatttgggagccggcacacgccatgtcgccgtggagcccgaagtagccaatttagatatcataggacaacgcatcgaaagcataaagcacgaacacaaatcaacatggcactatgacgaagacaacccatacaaaacgtgggcttatcatggctcttacgaagttaagccttcagggtctgcaagctcaatggtaaatggagtagtcaaacttcttactaagccatgggatgtgattccaatggtaacacaaatagcaatgaccgacactactccttttggacaacaaagggtattcaaggagaaagttgatacaaggaccccgaaggcaaaaaggggcaccgcacaaataatggaagtgactgctaaatggttatggggatttttaagccgtaataagaagccaagaatatgtactagagaagagttcacaaggaaggtacgctcaaacgcagctataggagcagtattcgtagatgagaaccaatggaactcagctaaagaggcagtcgaagatgaccgcttttgggacctagtccatagggaaagagaattgcacaagcaagggaaatgcgccacttgcgtatataatatgatggggaaaagggagaagaaattaggtgagtttggaaaggccaaggggtcaagagccatatggtacatgtggctaggcgcacgatttttagagtttgaagctctcggattcatgaacgaagatcattggttttcacgggaaaatagtctcagtggggtagaaggcgaaggattgcacaaattaggatacattctacgtgacataagcaagataccaggtggaaacatgtacgctgacgatactgcgggatgggataccaggattaccgaagatgatttacaaaatgaggccaaaataacagatataatggaacctgaacacgctctcctagcaaaatcgatatttaagctaacttatcaaaataaagtagttagagtccaaaggcctgcgaaaaatggaaccgtgatggatgtaataagcagaagagaccaaagaggctcaggtcaggtaggaacatacggcctcaatacatttaccaatatggaagcacaacttataaggcaaatggaaagcgaaggaatattctcaccgaatgaattagaaacaccaaacttggccgaaagagttctagactggctagagaaatatggagttgaaagactgaagagaatggccataagtggagacgactgcgtagtcaaacctatagatgatcgatttgctactgcacttacagcactaaacgacatgggaaaggttcgtaaagatataccacaatgggaaccctctaaagggtggaatgattggcagcaagtaccattttgttcgcatcattttcatcaactcattatgaaggacggaagagaaatcgtggtgccctgtcgaaatcaagacgagctagtcggtagagcaagagtaagtcagggggcgggatggagccttcgcgaaacagcatgtctcggtaagagttatgcacaaatgtggcaattaatgtactttcaccgcagggacctcagattagcagcgaacgcgatatgctcagcagtaccggtagattgggtccctacgtcgcgaacgacctggagcattcatgcacaccaccaatggatgacaactgaagacatgttaagtgtttggaatagggtatggatagaagaaaatccttggatggaagacaaaacacgcatttctagttgggaagatgtcccgtatctcggcaagcgagaggatcagtggtgcggtagtctgattggactaacagctagagcaacgtgggcaaccaatatacaagtggccattaatcaagtacgtagactaattggaaacgaaaattactcagattacatgacatcaatgaaaaggtttaaaaatgaaagtgaaccagaaggagcattgtggtaa

SEQ ID NO: 21367 - RNA, 9879 nt, synthetic construct
  misc_feature 1..9879: note = derived and/or modified CDS sequence (opt6) from DENV-1__FJ687429__SS-prME
  source 1..9879: mol_type = other RNA
tcggtaacaatgctcttaatgctcatgcctacagcactcgcatttcacttaacaacgagaggtggtgaaccacatatgattgttagtaaacaagaacgtgggaaatcgcttctgtttaaaactagcgctggagttaacatgtgcacattaattgcaatggatctaggagaactttgtgaagatacaatgacttacaaatgtccacgaataacagaagcagaacccgatgatgttgactgctggtgtaatgcaacggatacatgggtgacatatggaacatgcagtcaaaccggtgaacatagaagagataaaagaagtgtagcactcgcacctcatgtcggcttgggcctggaaaccagaactgagacatggatgtcctcagaaggcgcgtggaaacagatacagcgcgttgaaacatgggcattaaggcatcctggatttacagttatcgcactttttctagcacatgcgattgggacttcaatcacacaaaaaggtataatcttcatactactaatgctcgttaccccctcaatggcaatgagatgtgtaggaataggctctagggatttcgtagaaggactctcaggtgcgacatggatagatgtggtcctcgaacacggatcatgcataacaacaatggctaaagacaaaccaaccctggatattgaactgctgaaaacagaggtaacaaaccctgcagttttacggaaactatgcatcgaagccaaaatatcgaatacgacgactgactccaggtgtcccacacaaggagaagcgacactggttgaagaacaggatgctaactttgtatgtaggagaacatttgtagaccgtggatgggggaatggatgtggattattcggaaaaggcagtttactaacgtgcgcgaaatttaaatgcgtaactaaactagagggtaaaattgtgcagtacgaaaatttaaaatactctgttattgtcactgtacacacaggagaccagcatcaagtaggaaacgaaagtactgaacatggaacgactgctaccataacgccacaagcacccactacagaaatccaattaacagactacggtgcattaactttagattgttctccccgaacaggtcttgactttaacgaaatggttttactcactatgaaagaaaaatcatggctggtacacaaacagtggttcctggatttgcctcttccatggacgagtggagcatcaacaagtcaagagacatggaatcgtcaagacctattggtgacttttaaaactgctcacgctaagaaacaggaagtagtagttttaggatcgcaagaaggcgcaatgcataccgcgcttactggcgcaacggagatccagaccagcggaactaccaccattttcgcaggacatttaaaatgtcggttaaaaatggacaaactaacattaaaaggtatgtcgtatgtgatgtgcaccggttcatttaaacttgaaaaagaagtagcggaaacacaacacggaacggtactggtacaaatcaaatatgaaggcactgatgcgccttgcaaaattccgttttctacccaagacgagaaaggagtaacacaaaatggtaggctgataacggccaacccaatcgtaactgacaaggaaaagccagttaacattgaagccgaaccaccatttggtgagagttacatagtaattggcgccggagagaaggcattaaaactctcttggtttaagaaaggatcctctattgggaaaatgtttgaggctacagcacgtggagcgaggcgtatggcgatcttaggggataccgcgtgggattttggctcaataggtggcgtcttcacatctgttggaaaattggttcaccagatattcggaacagcctatggtgttctattttcaggcgttagttggacgatgaaaattggaatcggagtattattaacgtggctgggattaaacagccgttcgacctcattaagtatgacttgcatagcagtcgggctagtaacattatatctcggcgtaatggtacaagctgattcaggatgcgtaattaactggaaaggacgagagttaaaatgcgggtcaggaatattcgtcactaatgaagtacacacttggactgagcaatacaaatttcaagcagattcaccgaaacggctgagtgcagcaattggaaaggcttgggaggaaggtgtgtgtggaattagatcggccacacgtctcgaaaacataatgtggaaacaaatttcaaatgaacttaaccacatattgctcgaaaacgatatgaagtttactgtagtcgtaggtgatgtagcagggatactagcacaaggcaagaaaatgatacgaccgcagcctatggagtataagtacagttggaagtcatgggggaaggctaaaataataggagcagacgtccaaaattctacatttataatagatggaccaaacactcctgaatgtcccgatgatcaaagggcatggaacatatgggaagtagaagactacggatttggaatttttaccacgaacatatggctaaaattaagagactcctatacacaagtctgtgaccatagacttatgtcggcagcgataaaggacagtaaagcggtgcatgccgatatgggttactggattgagtcggaaaagaacgaaacctggaaactagcgagagcaagtttcatcgaagttaagacatgtatatggccaaagtcgcatactctctggagcaacggagtacttgaatcagaaatgattataccaaagatatatgggggaccaatcagtcagcacaattacaggcctggttattttacccaaactgccggaccgtggcacttgggtaaattagaattggattttgacctttgtgaaggaacgacggttgttgtagacgaacattgcggtaaccgtggtcctagtcttcgtactacaacagtaacaggaaaaatcatacatgaatggtgctgtcgctcatgtaccctaccgccactgagatttagaggagaagatggatgttggtacgggatggaaattagaccagtcaaagagaaagaggaaaacctagtcaaaagcatggttagcgctggttcgggagaagtcgactcattctccctaggtttactttgtatatcaattatgatagaagaggtcatgagatctagatggagtagaaaaatgttaatgacaggcacacttgcagttttcttcttgctgattatggggcaactcacatggaacgacctaatacgcctatgtatcatggtaggagctaatgcaagtgataggatgggaatgggaacaacatatctcgcactcatggcaacgtttaaaatgagacccatgtttgctgtgggtctactgttcagaagattaacatcaagggaggttttattattaactatagggctgtctcttgtagcgtcagtcgaattgcccaatagtttagaagaactaggagacggactagccatgggtatcatgatattaaaattactaaccgattttcaaagtcaccagttatgggctacattactgagcttaacattcataaaaactactttcagccttcactatgcatggaaaacgatggcaatggttttatcaattgtatcactgttcccactgtgtttgagtactactagccaaaagactacctggcttccagtcctacttggaagtttagggtgtaagcctctaacaatgtttttaatagcagaaaacaaaatatgggggaggaaaagctggcccttaaatgaaggcataatggcagttggaatagtctcaattcttttgagcagcttactaaagaatgatgtacctttagctggtccgttaattgccggtgggatgctcattgcatgctacgtgatttctgggagttcagctgacttatcactcgaaaaagctgctgaagtcagctgggaggaagaagcagaacactccggggctagtcataatatactggtagaagtacaagatgatggtacaatgaaaataaaagatgaagaacgtgatgataccctaacaatacttctaaaagcgactttattggctgtttcgggtgtctaccctctttcaataccggctaccctatttgtctggtacttctggcaaaagaaaaagcagagaagtggtgttttatgggacacaccaagcccacccgaagtggaacgagctgtacttgatgatggaatctacaggattatgcaaagaggattgttagggcggagccaagtaggggttggcgtattccaagagaacgtttttcatacgatgtggcatgttactcgaggcgctgtactgatgtatcaaggaaaacgattggaaccttcatgggcaagcgtgaaaaaggacctgatcagctatggaggtgggtggagactacaaggatcttggaacactggtgaagaagtccaagtgattgctgttgaacctggtaaaaatcccaaaaacgtccaaacggcgccgggaacgttcaagacacctgaaggagaggtaggtgctatcgccctagattttaaaccggggacgagtggtagtccaatcgttaacagagaagggaagattgtaggcttatatggtaatggtgttgttaccacgtcgggaacttatgtaagtgcaatcgcacaggccaaggcttcacaagagggcccacttcctgaaatagaggatgaagttttccgtaagagaaatttgacaattatggatctccaccccggtagcggcaaaacacgacgatatttaccagccatcgtcagagaagcgataaaaagaaaattacgaacgttaatattggctccaacaagagtagtagcgagtgaaatggccgaagcactgaaaggaatgcctattaggtaccaaaccacagcagtaaaaagcgaacatacagggaaagaaattgtagatctgatgtgccacgccacattcacaatgaggcttctatcacccgtacgtgttcccaactataatatgatcatcatggacgaagcacacttcaccgacccgtcatccattgctgcaagaggttatattagcactagagtggggatgggagaggcagccgcaatattcatgacagccactcctcctggaagcgtcgaagcattcccgcaaagtaatgctgtcattcaagatgaagaaagggatataccagaaaggagctggaatagcggctatgaatggataactgacttccccggcaaaacggtttggtttgtgccttccataaaagcagggaatgacattgctaattgcttacgtaaaaacggaaaaagagtgatacagttaagtagaaaaacctttgatactgagtaccaaaagaccaagaataatgactgggattacgtcgtaacaacagatattagtgaaatgggagctaacttccgtgcagatcgagtcatcgaccccaggcgctgcctcaaacctgttatcttgaaagacggaccggagcgagtaattttagcaggtccgatgccagtcaccgtagcttcggccgcacaaaggcgaggaaggatcggacgcaaccacaataaggaaggagatcaatacatctacatgggacaacccctaaataatgacgaagatcatgcccattggacagaagcaaaaatgctattggataacatcaacacccccgaggggataattcccgccctctttgaacctgagcgtgaaaaatctgcagcgattgacggagaatataggttaagaggagaagcgcgaaaaacatttgtagaactaatgcgaagaggcgacctaccagtatggctctcctataaagttgcatcggaaggtttccaatatagcgacagaagatggtgttttgacggtgagcgtaataaccaggtactagaagaaaacatggacgtagaaatctggaccaaagaaggggaacgaaagaaattacgcccacgttggctagatgcaagaacatactcagatcctcttgcgttacgagaatttaaagagtttgctgctggtaggcgaagtgttagcggtgatctgatactagaaatagggaagctgcctcaacatcttacacagcgagctcagaatgcgctagataatctagtaatgttacataacagtgaacaaggagggagagcttatagacacgctatggaggagttaccagatacaatagaaaccttaatgctattagccctaatagccgtacttacaggaggggtgacattatttttcttatcaggaaaagggcttggtaaaacatccataggactattatgcgtaatggcatcatcggtactattatggatggcttcagtggaacctcattggattgccgcaagcattatccttgaatttttcttaatggtcttattaattcccgaaccagataggcagagaactccacaagataatcaactagcttatgtagtcataggtctactatttatgatactgaccgtagcggcaaatgaaatgggactgctagaaacaactaaaaaggaccttggaatcggacacgtagcggttgaaaaccaccatcatgcagcgatgttagacgtagatttgcaccctgcgtcagcctggactctatacgcggtcgccacaacaataatcacacccatgatgagacatactatagaaaatactacggcgaacatatcgctaacggcgatagcaaatcaagcagcaatcctgatgggactcgataaaggttggcccatatcgaagatggacataggggtcccgttactcgccctcggatgttactcgcaggttaatccattgactcttacagctgcagttctaatgttagttgcacactatgccattataggacccgggttacaagcaaaagccacaagggaagcacaaaagcggacagccgcaggaataatgaagaaccctactattgatggaatcgttgctattgacttagacccagtggtctacgatgcaaaattcgagaaacagcttggtcaaatcatgctattgatactatgcacgtcacaaatcctgctaatgagaacaacatgggcactgtgtgaatctatcacactagctacaggtcctttaacgaccctctgggaaggttcaccgggtaaattttggaatacaacaatagctgtatcaatggctaatattttccgtggatcgtacctcgccggagctggactggccttttcgctgatgaagtctttgggaggaggacgaagaggaactggtgcacaaggtgaaacgcttggcgaaaaatggaagcgccaactaaatcaactaagcaaaagtgagttcaatacatataagcggtcaggcataatggaagtagatcggtctgaagcaaaagaaggattaaaaaggggcgagacgaccaaacacgcagtctcgagaggaacagctaaattgagatggtttgtcgagcgtaacctcgtcaaaccagaaggcaaagttatagacctgggatgtggaagagggggctggtcatattattgtgcgggtctcaagaaagtcacggaagtaaagggatacacaaaaggtggtccgggccacgaagaaccaatcccaatggctacatatggatggaacttagtaaagttacacagtggtaaagacgtattcttcatacccccagaaaaatgtgatacactcctatgtgatattggcgagtcaagcccaaatccaaccatagaagagggccggaccttaagagtcttaaagatggttgagccatggctcagaggaaatcaattttgcataaaaatactaaacccctatatgccatcagtagtagaaacgcttgaacaaatgcaaagaaaacatggcggaatgctcgtccggaatccattgtcgcgaaacagcactcacgaaatgtactgggtatcttgtggtaccggaaacatagttagtgcggttaacatgacaagccgcatgttattaaaccgctttacgatggctcaccgaaaaccgacatatgaacgagatgttgatttaggggccggcactagacacgttgccgtcgaaccggaagtggcaaacctagacataattgggcaacgaatagaaaacattaagcacgagcataaatctacatggcattatgacgaggataacccttataagacatgggcatatcacggaagttatgaggttaaaccaagtggtagtgccagctctatggtcaacggagtagtaaaacttttaacgaagccctgggacgttatacccatggtgacacaaattgcgatgactgataccactccgttcggacaacagcgagtattcaaagaaaaagtcgacacccgaacacctaaggctaaaagaggaacagctcaaatcatggaggttacagcacgatggctatggggctttttatctaggaataagaaacctagaatttgcactagagaagaatttactaggaaagtacgcagcaatgccgccatcggggccgttttcgtcgatgaaaaccaatggaatagtgcaaaggaagctgtggaagatgatagattttgggatttagtccacagagaacgagagttgcataagcagggaaagtgtgctacatgtgtgtataacatgatgggaaaacgtgagaagaaactaggagaatttggaaaagcaaaaggctcaagagcaatttggtatatgtggctcggtgcgcgttttctagagttcgaagccttaggttttatgaacgaagaccattggttctcgagagaaaactcactgagcggcgttgagggggaagggctacacaaactgggttatattcttcgcgatataagcaagataccaggaggtaacatgtacgctgatgatactgctggttgggacactagaattaccgaagacgatttacaaaacgaagcaaaaattacagacatcatggagcccgaacacgcgttactagcaaaatcgatcttcaaactaacgtatcagaacaaagttgtccgggttcaacgaccagccaaaaacggaacagtgatggatgtgattagcagacgtgaccagcgtggaagcggccaagtcggcacttacggcctcaatacatttactaatatggaagcacaactgataagacagatggaatcagaaggcatattctccccgaatgagttagaaacgccaaacttagcagaaagagtactcgattggttggaaaaatatggtgttgaaagactaaaaagaatggcaattagcggggatgactgcgtagtgaagccgattgacgaccgttttgcaactgccttaacggcgttaaatgatatgggcaaagtacgtaaagatatccctcaatgggaaccttcgaaaggatggaacgattggcaacaagtaccattttgctcgcatcattttcatcaactaataatgaaggatggtagagagatagtagtaccctgtagaaatcaggatgagttagtcggacgtgcacgcgtttcacaaggtgctggttggtccctacgagaaacggcgtgtctaggtaagagttacgcacaaatgtggcagttgatgtatttccatagaagagatcttcgattagctgctaacgctatatgctctgcagtaccggtagattgggtaccgacgagcagaactacctggagtatccacgcacaccaccaatggatgacaactgaagacatgttatcggtctggaacagagtatggattgaagaaaatccttggatggaagataaaacgagaatatcttcgtgggaagatgtaccgtacttagggaaaagggaggaccaatggtgtgggtcgctaataggcttaacagcacgggcaacatgggcaactaacattcaagttgcaataaaccaagttcgacggctaatcggaaacgaaaattattcagactacatgacttccatgaaaagatttaagaatgaatcagagccagaaggagcactgtggtaa

SEQ ID NO: 21368 - RNA, 9879 nt, synthetic construct
  misc_feature 1..9879: note = derived and/or modified CDS sequence (opt6) from DENV-1__FJ850068__SS-prME
  source 1..9879: mol_type = other RNA
tcagtgacgatgctcctaatgctgatgccgactgcgttagcttttcatttgacaacacgcggaggggaaccccacatgatagtgagcaaacaagaaagaggcaaatccctattatttaaaacttcggctggagtcaatatgtgtactcttattgctatggatttaggagaattgtgtgaagacacaatgacgtataaatgtccaagaattacagaggctgaacctgacgacgtggactgctggtgtaacgcaacagatacctgggtcacctacggaacgtgcagccaaacaggtgaacaccggagggacaaaagatctgtggcgctcgcccctcatgtagggctcggattagaaacaagaacagaaacctggatgagcagtgaaggtgcatggaaacaaatacagcgtgtcgaaacatgggcactcagacacccaggtttcacagttattgccctcttcctcgcacatgcaattgggacgagcataacacaaaaaggcataatttttatattgctaatgctagtgacacctagtatggccatgcggtgcgtagggattggatcgagagattttgtagaaggtttatcaggcgcaacgtgggtggatgtcgtgttagagcacggtagttgtgttacaactatggctaaagacaaacctactcttgacatcgaactactgaaaacagaggttacaaatcccgccgtattgcgtaaactatgtattgaagccaaaatctctaacaccactacagattcgcggtgtcccacacagggagaggcaaccctagttgaggaacaagacgccaatttcgtctgtagaagaacttttgtagatcgaggttggggaaatggttgtgggctttttggaaaaggtagcctgttaacatgtgctaaatttaaatgtgtaacaaaactagaaggtaaaatagtacaatatgagaacctaaaatatagtgtgatagttactgtgcacacaggagatcagcaccaggttgggaacgagagtaccgaacacggtaccactgcaaccattacaccccaagcaccaacgacagaaatacaactaacagactacggtgctctaacattagactgttcaccacgtacgggtctcgattttaatgaaatggttttgcttactatgaaagaaaaatcatggttagttcataaacaatggttcttagatttgccattaccatggacaagtggtgctagtacgagtcaagagacatggaataggcaggatttattagttaccttcaaaaccgcccacgccaagaaacaagaggtagttgttctcggatcgcaggagggagctatgcatactgcactaacgggcgcgactgaaatacaaacatccggaacgacaacaatttttgcaggacatttaaaatgtcgactaaaaatggacaaactaactttgaagggtatgagctatgtaatgtgcaccgggtcatttaagctagaaaaagaggttgctgagacacaacatggaactgtgcttgttcagattaaatatgaaggcacagatgccccttgtaagattccgttttccacacaagacgaaaaaggagttacacagaatggcagattaatcactgcaaatcccatagtgactgacaaggaaaaaccagtaaatatagaggctgaaccaccttttggtgaatcatatatcgtaataggagcgggagagaaagccttgaaactcagctggtttaagaaaggttcctccataggaaaaatgtttgaggcgacagctcggggtgcaagaagaatggctattttaggtgacacagcatgggatttcggatcaattggcggagtatttacatcagtaggaaaattagtacaccaaatctttggcactgcttacggcgtgctcttttctggagtgagctggaccatgaaaattggaataggcgtgttgttgacatggctcgggctaaattcgagatcaacgagtttgtcaatgacttgtatcgcggttggtttagttacgttatatttaggcgtgatggtacaagcagattctggctgcgttattaattggaaaggtcgtgaattaaaatgcggatcggggatcttcgtaacaaatgaagtccatacatggaccgaacaatacaagtttcaagcagactccccgaaaagactgtcggcggcaataggaaaggcctgggaagaaggcgtttgcggaatacgatcagctaccagactagaaaacataatgtggaaacaaataagcaatgagttgaatcatatattattagaaaatgacatgaaatttacagtggttgtgggtgacgttgcaggaatattggcgcaggggaagaaaatgatacgcccacaacctatggagtataaatactcctggaaatcatggggtaaagcaaaaatcataggagctgacgtacaaaacagcacgttcattattgatggtcctaacacaccggaatgcccggatgaccaaagggcttggaatatatgggaggtagaagattacggttttggaatatttacaaccaatatttggttaaagttgcgagactcttacactcaagtatgcgatcatcgattaatgtccgctgcaataaaagatagcaaagcagtacacgcagacatggggtactggatagaatcagagaaaaatgaaacttggaaacttgctggagccagcttcatagaagtcaaaacttgtatttggcccaaaagccatacgttatggtcaaatggtgtattagaatcggaaatgataataccgaaaatttacggcgggcctattagtcaacataattaccgtcctggttattttactcaaacagcaggtccatggcatctaggaaaacttgaacttgactttgatctatgtgaaggaactacggtggtagtagatgagcactgtggtaacaggggcccatcgttaaggacaactacagttacaggaaaaattatacacgagtggtgttgtcgtagttgtactctaccacccttaagatttagaggagaagacggctgttggtatggaatggagattagaccagttaaagaaaaggaagagaatctcgtgaaatcaatggtatcagcaggaagtggcgaagtagattcatttagtttaggattgttatgcatatctatcatgatagaagaagtcatgaggagtcgatggtctagaaaaatgttaatgacaggaacattagctgtattctttcttcttatcatgggtcagctaacttggaatgacttaataagactctgtataatggtgggagcgaatgcttctgatcgaatgggaatgggcaccacatatcttgctctgatggccacattcaaaatgcgacctatgtttgctgtaggattactcttcagaagattaacaagtagagaggtactgttgttaactattgggctgtctctcgttgcctctgttgaactccccaactcattagaagaacttggagacggcctagcgatgggcatcatgatacttaaactactcacggattttcaatcgcaccaattgtgggcgaccttattgtctctaactttcatcaaaaccacattctcgttacattatgcctggaaaaccatggcaatggttttatcaatagtaagcctattccctctatgcttgtcaactacgagtcagaaaacgacgtggctacccgttcttttaggctcattaggctgtaagcctctaacgatgtttttaattgcggaaaacaaaatatggggtcgaaaatcctggccgttaaatgaaggtataatggccgtaggcattgtttcaatactattgtcatcattattaaagaacgacgttcccttagccgggccacttattgcgggaggcatgttaatagcatgttacgttataagtgggagttcggcggacttaagtttagaaaaagcagccgaggtttcatgggaagaagaagctgagcattcaggggcttcccacaacatcctagtggaagtacaagatgatggaactatgaagataaaagacgaagagagagacgacactctaactattctactgaaagcaacactattagctgttagtggtgtttatcctctaagtattcccgccacactctttgtatggtacttttggcagaagaagaaacagagatccggggttctatgggatacaccttctcctccagaggtagaaagagcagtattggatgacgggatatatcgtatcatgcaacgaggtctattaggccgctcacaagtgggcgtcggagtattccaagaaaatgtttttcatacaatgtggcatgtgactcgcggagcagtactcatgtaccaaggcaaacgactggaaccatcgtgggcgagtgtgaagaaagacctgatcagttatggagggggatggagactacaggggtcatggaataccggggaagaagtccaggtaattgccgttgaaccaggaaagaaccccaaaaatgtacaaaccgcacccggaacgttcaaaaccccagaaggcgaagtcggagctatcgcactcgattttaaacccgggacctcaggatctcctatagtcaatcgggaaggtaaaatagtgggattatacggtaatggagtagtaaccaccagtggtacatatgtgtcggctatagcacaagctaaggccagtcaggaaggaccgttgccagaaatagaagacgaagtttttcgtaaaagaaatcttacgattatggacttacacccaggatctggaaaaactcgtaggtacctgcctgcaatagtccgtgaagcaattaaaagaaaactaaggacgctaatacttgcaccgactagagtcgtggcatcagagatggcggaagcgctgaaaggaatgccgatccgctatcaaactacagcggtgaaaagtgagcatactggaaaagagattgtagatttaatgtgtcatgcaacattcacaatgcggctattatctcctgtaagagttccaaattataatatgataattatggatgaggctcacttcacagatcctagttccattgctgctagaggctacataagtacacgtgtggggatgggagaagctgctgcgatattcatgactgcgaccccgccaggttctgtcgaagcgtttcctcaatccaatgccgtaatacaggacgaagagagggacatacccgaaaggtcttggaactcgggttatgaatggattactgactttcctggtaaaacagtttggtttgtgccgtctattaaggctgggaatgatattgccaattgtctgcgtaagaatggaaaacgagttattcaactttcaagaaaaactttcgataccgagtaccagaaaactaagaataacgattgggactatgtggtaactacagatataagtgagatgggagccaatttccgagcagacagagtgattgatccccgtagatgtttgaagccagtgatattgaaagatgggccagagcgagtaatactagctgggcctatgccggtaacggtagcctcagcggcacaacgacgaggtcgaataggacgaaaccataataaagaaggagaccaatacatatatatgggacaacccttaaataacgatgaggaccatgcgcactggacggaagccaaaatgttattagataacataaacacaccggagggaataatacctgcactattcgaaccagaacgtgagaaaagcgccgcaatagatggtgagtatcgtttaagaggagaagctagaaaaacttttgtagaactgatgaggagaggagatcttccagtctggttaagctacaaagttgccagcgagggcttccaatacagcgatagaaggtggtgttttgacggagaacggaataaccaggtattagaagaaaacatggatgtagaaatatggacgaaagaaggcgagagaaagaaactacgacctcgatggcttgatgctcggacatactccgatccattggcacttcgtgagtttaaggaatttgcagcagggaggcgctcagtgtctggcgacctaatacttgagattggcaaattaccgcaacacctaacacaaagagcgcaaaacgctctcgataaccttgttatgttgcataattcggaacagggcgggcgggcatatagacatgccatggaggagctcccagacacaatagaaacgttaatgctacttgcccttatagctgttctaaccggtggagtaacactattcttcttgtcaggcaaaggtctagggaaaacatcgatagggttattatgtgtaatggcctctagtgttttattgtggatggccagtgtagaaccacactggatagccgctagtataatattagagttctttttaatggtattgcttataccagaaccagacagacaacgaacacctcaggataatcaattagcttacgtagtaataggactcctgttcatgatactaactgttgcggcgaatgaaatggggttactagaaacaaccaagaaagatttaggaattggtcacgtagcagtagaaaatcatcaccacgcggccatgctagatgtagatttgcatccagcatcggcatggactctctacgcagtagcaactactattataactcctatgatgaggcataccatcgaaaatacaacggcaaatatatcactgacagcgatcgccaatcaagcagccattttgatgggattggacaaaggatggcctatctcgaaaatggacataggggtaccattacttgcgctaggctgttactcacaagtgaatccgttaacattgacggccgccgtcttgatgttggtcgcacactatgcaattatcggcccagggctacaggcgaaagcaactagggaagcacaaaaacgaacagcagcgggtataatgaaaaatccaacaatcgacgggatagtagccatagacctagacccagtagtttatgatgcaaaattcgaaaaacaattaggtcaaattatgttattaatcctatgcacttcgcagatacttcttatgcggacgacgtgggcattgtgtgaatctattacactagcaacaggaccgttgacaacactgtgggaaggatcgccaggaaaattttggaacacaactattgctgtttcaatggctaacatttttcggggatcgtacttagctggtgccggactagcattcagcctcatgaagtccctaggaggaggtagacgtgggactggagcccaaggagaaactttgggggaaaaatggaaaagacagttgaaccagttatctaagagcgaatttaacacatacaaaagaagtggaataatggaagttgatcgcagtgaagcaaaggaaggcttaaagcgtggtgaaactacaaaacatgctgtgtcgaggggtacagcaaaattaaggtggttcgtcgaaagaaatctcgtaaagccggagggaaaagtaatagacctaggatgtggtcgtggcgggtggtcatattattgtgcgggtcttaagaaagtgactgaagtcaaagggtacacaaagggaggaccggggcatgaggaacccattcctatggccacgtacggctggaaccttgttaaactacatagcgggaaggatgttttctttataccaccagagaaatgcgacacactattatgtgatattggtgaatctagtccaaatccaactatagaagaaggtagaaccttgcgcgtactaaaaatggtagaaccatggttaagaggcaatcagttttgtattaaaattctcaatccatatatgccttctgttgttgagaccctcgaacaaatgcaacgaaaacatggaggaatgttggttcgtaatccacttagtagaaatagcacacacgaaatgtactgggtatcatgcggaaccggcaacatcgtctcagccgtaaatatgacttctcgtatgctattaaatagatttacaatggcacatcgaaagcctacatatgaacgtgatgtggatctcggagcgggtactaggcacgtagctgtagaaccggaagttgctaatttagatatcataggacagagaatagaaaatataaaacatgaacataaaagcacatggcattacgatgaagacaatccctataaaacttgggcatatcacggttcttatgaggtcaaacctagtggttctgctagctctatggttaacggagtagtgaaattactcacaaagccatgggatgtgatccctatggtgacacaaatagcaatgacggacacaaccccttttggtcaacagcgtgtattcaaagaaaaggtagatacaaggacgccaaaagcaaagagaggtaccgctcaaataatggaggtaacagcacgctggctatggggcttcctaagtcgtaacaagaaaccaagaatatgtactagagaagaatttacaagaaaagtccgttctaatgcagccattggagcggtctttgtggacgaaaatcaatggaactctgccaaagaagcggtagaagatgatcgattttgggatttagtgcatagagagcgcgaattacacaaacaaggcaagtgtgcaacgtgtgtgtataatatgatggggaagagagagaagaaattaggagaatttggaaaggcaaaaggatcgcgtgcaatatggtatatgtggttaggcgcaaggtttttggaatttgaggcccttggttttatgaatgaagaccattggttttccagggagaacagcttatctggtgtcgagggtgaaggacttcacaaactagggtatatccttagagacatctcaaaaatcccagggggaaatatgtatgcggatgatactgctggctgggacactagaataacggaagacgatctacaaaatgaagctaaaattacagacataatggaaccagaacatgcactattagcaaaaagcatatttaaacttacttaccaaaataaagtagtacgagtacaaagaccagcgaaaaatggcacagttatggatgtaatttcaagaagagatcaaaggggaagtggtcaagtcggaacatacgggctaaacactttcacaaacatggaggcgcagctaataagacagatggaatcagagggtatattcagcccaaatgaacttgaaacacctaatcttgcagaacgtgtactcgattggcttgaaaaatacggtgttgaacgattaaagagaatggctattagtggtgatgattgcgtagtaaaaccgattgatgatcgatttgctacggctctcaccgccctcaatgatatggggaaagttcggaaagacatccctcaatgggagcccagtaaaggatggaatgattggcaacaggtaccattctgctcgcatcacttccatcaattaatcatgaaggacggaagagaaatagtggttccttgcagaaaccaagatgagttagttggaagggcccgtgtaagccagggcgcggggtggtctttgcgcgaaacggcttgtctaggtaaatcttatgcacagatgtggcaattgatgtatttccatagacgtgatttaaggctagcagcaaatgctatatgctcagcagtacccgtagactgggtacccacatcacggacaacttggagtatccatgcacatcatcaatggatgactacagaagatatgttaagcgtttggaacagagtttggatcgaagaaaacccatggatggaggacaaaactcgaatttcctcatgggaagatgttccgtacctaggtaagcgtgaagatcaatggtgtggttcccttataggattaacagccagagcaacatgggctacaaacatccaagtggcaataaatcaagtaagaaggcttattggaaatgaaaattacagcgattatatgacaagtatgaaacggttcaaaaatgaaagtgaacctgagggtgcattatggtaa

SEQ ID NO: 21369 - RNA, 9879 nt, synthetic construct
  misc_feature 1..9879: note = derived and/or modified CDS sequence (opt6) from DENV-1__FJ687430__SS-prME
  source 1..9879: mol_type = other RNA
agcgttacaatgctattaatgctaatgccgacagcactagctttccatttaacaactaggggcggcgaaccacatatgatagtatctaaacaagaaagagggaaatcattactattcaaaacaagcacgggcgtaaacatgtgtacattgatagcgatggatcttggagaattgtgcgaagacacaatgacatataaatgtcctagaattactgaagcagaaccggatgatgtagattgctggtgcaatgcgacagatacttgggtaacttatggaacatgttcacaaacaggcgaacatcgcagagataaaagatctgttgcattagctcctcatgtagggttagggttagaaacaaggaccgaaacttggatgtcaagtgaaggagcatggaaacaaatacagaaagtggaaacatgggcacttagacaccctggattcacagtaatagctctttttcttgctcatgccatagggacaagtataacgcaaaaaggtattatattcattttactaatgctagtaacgccctctatggcgatgagatgcgtaggaataggcagtagggacttcgtagaaggactatctggagctacatgggttgatgttgtgctagaacatggctcctgcgtgacgacaatggcgaaagacaaaccaacattagatatagaattattaaagacagaagtcacaaacccagctgtactgcgtaaattatgtatagaagctaaaattagtaacacgacaacagatagtagatgtccgactcaaggcgaagcaaccctagtagaagaacaagacgctaactttgtatgtagacgaacgtttgtggaccggggttggggcaatggttgtggactattcggtaaaggctcactaattacgtgcgcaaaattcaaatgtgttacaaaacttgaaggcaaaatagtacaatatgaaaatctaaaatactctgtaatcgtaacggtccacactggggatcaacatcaagtagggaacgagtctaccgaacatggtacaactgcaaccatcactccacaagcgcctacaacagaaattcaactaacggattatggcgcccttacactggactgctcaccaagaactggacttgactttaacgaaatggttcttctaaccatgaaagaaaaatcatggctcgtacataaacagtggtttttagaccttccactgccgtggacaagtggagcttctacaagccaagagacatggaatagacaagatctcctagtaacatttaagaccgcacatgcaaagaaacaagaggttgtggtcttaggttctcaagaaggggccatgcatactgcacttactggtgcgacagaaattcaaacgtcggggacaactaccatatttgcagggcaccttaaatgtcgactaaaaatggacaaattaacgcttaaaggaatgtcatacgtaatgtgcacaggtagtttcaaattggaaaaagaagtggcagaaacacagcatggaaccattctggtgcaaataaagtacgaaggcacggatgctccatgtaagatacctttctctacccaggatgagaaaggagtgactcaaaatggacgtttaataacagcgaatcccatagtcaccgataaggagaaacccgtaaatatagaggcagaaccgcctttcggcgaatcgtatattgtaataggggccggagaaaaagcgctaaaattgagctggttcaagaaaggttcctcaatcggaaaaatgttcgaggcgacggcaagaggggcaaggaggatggctatattaggggatacagcctgggactttggttctattggaggagtatttacttcagtcgggaagctagtacaccaaatattcggcacggcatatggcgtactgttctcaggggtttcctggacaatgaaaataggcattggagtgctcttgacttggctgggtctaaactcaaggtcaacaagtttgtcaatgacctgtattgccgtaggcctagttacgctatatttaggtgtcatggtgcaggcagactctgggtgtgtaattaattggaagggcagagaattaaagtgtggcagtggtatatttgtcacaaatgaagtccacacatggactgaacaatataagttccaagcagattccccaaaaagactctctgctgctattggcaaagcgtgggaagaaggtgtttgcggcattaggtcagctaccaggctggaaaatattatgtggaaacaaataagtaatgaattaaatcacatactactagaaaatgatatgaaatttacagtagttgtgggagatgtcgctggaatacttgcacaaggcaagaaaatgattagaccacaaccgatggaatacaagtacagttggaaatcttggggaaaagcgaaaataatcggtgctgacgtgcaaaacgcgactttcatcatagacggccccaatacccctgaatgcccagatgatcaaagagcttggaatatttgggaagttgaggattatgggttcgggatattcacgacgaacatctggttaaagctccgagattcgtatacacaagtttgtgaccatcgtctaatgagcgcagcaattaaggattccaaagccgtccacgccgatatgggatactggatagagagtgagaaaaatgaaacgtggaaattggcgcgtgcatcctttattgaagtgaaaacttgtatatggccaaaatctcacacactatggagcaatggtgtactagaatcagaaatgattatcccaaaaatatatggcggcccgatttcacaacataattatagaccgggttactttacgcaaacagcaggaccatggcatctaggaaaattagagctagatttcgatctatgcgaaggcactaccgtcgtagtagacgaacattgtggtaatcgaggaccttccttgcgaacaacgactgtgacaggtaaaattatacacgagtggtgttgccgttcttgtactcttccgccgctcagatttcgaggggaggacggatgttggtacggaatggagattcgaccggtaaaagaaaaagaggaaaacctagtgaagtccatggtatctgctggatcaggagaagttgactcgttcagtctaggcctattgtgtatcagtataatgatagaagaagtaatgaggagtagatggtccagaaaaatgctaatgacaggtaccctagcagtcttctttctcttaataatgggacaattaacatggaatgacttaattcgattatgtataatggtcggagcaaatgcatctgataaaatgggaatgggtactacttatttagctttaatggctacatttaagatgcggccaatgtttgcagtgggcttactattcagaaggctgactagcagagaagtattgttgttaacgatcgggttatccctagtcgcttcagtagaactaccaaattctctggaagaactaggggacgggctcgctatgggtataatgatcttgaagttactaacagacttccaaagccatcaactatgggccacattattatcgttgacgtttattaaaactacattcagtttacactatgcttggaaaacaatggcgatggtcctaagcatagtatccttattcccactgtgcctatcgacaacctcacagaaaactacatggctcccagttcttctagggagtttaggttgcaaacctttgaccatgttcttgattgcggaaaataaaatctggggcagaaaaagctggccattgaacgaagggataatggctgtggggattgttagtatactacttagtagcttgcttaagaatgacgtgcccttagcaggaccattaattgccggaggtatgttaattgcatgttatgttatcagtgggagctccgcagatttatcattggaaaaagcagcagaggtctcatgggaagaggaagcggaacattcaggggcatcccataatatattagttgaagtgcaggatgatggaacaatgaaaatcaaagatgaagaacgtgatgatacattaacgatattattaaaggcgactttgctagccgttagtggagtttatcctttgagcatccccgctacgttgtttgtatggtatttttggcagaagaagaaacaaagaagcggagtactttgggacactccatcgccgcctgaagttgaacgagcggttctagacgatggcatttaccgaataatgcagcgaggactgttaggtcgctcacaagtcggagtgggtgtatttcaggaaaatgtattccacactatgtggcacgttaccagaggggccgtactcatgtatcaagggaaaagattagaaccatcatgggcaagcgtcaagaaagatctgataagttatggtggagggtggcgcttacaagggtcttggaacacaggtgaagaagttcaggttatcgcagttgaacctgggaaaaatccaaagaacgtacaaacagcccctggcacttttaagacaccagaaggagaagtcggtgcaatcgcacttgattttaaacctggtacatctgggtcacctattgttaatagggaaggaaaaatagtgggattatacgggaatggagtagtaaccacttcaggtacatatgtatctgcaatagcacaagccaaagcatctcaggaaggtccactacctgaaatagaagatgaggtattcagaaaaaggaacctgactattatggaccttcaccctggaagtgggaaaacacgtcgttatcttccagctatagtaagggaagctattaaaagaaaacttaggacgttaattcttgctcctacgcgcgtggtggcctcggaaatggctgaagcccttaaggggatgccaattagataccagacaacggctgttaaaagcgagcacaccggcaaagaaatagtggaccttatgtgtcatgcaacgttcactatgcgcttgctttcaccagttcgagtgcctaattataacatgattattatggacgaggcccattttactgatccaagcagcatagctgcaaggggttacatctccacaagggttggaatgggtgaagccgctgccattttcatgactgctactccccctggatcagtagaagcatttccgcaatcaaatgcagtcatacaagacgaagaaagggacattccagagagatcatggaactccggatacgagtggattaccgatttccccggtaaaacagtctggtttgtgccgtccatcaaaagtggaaatgatatcgccaattgcctcaggaaaaatggtaaaagagtcattcaattatccagaaaaacgttcgatactgaatatcaaaagacgaaaaataatgactgggactatgtagtaacaactgacatatcagaaatgggagcaaactttagagctgacagggttattgatccgcgtagatgtctaaagcccgtgatacttaaagacggtccggagcgagtaatactcgcgggccctatgccagttacagtggcatctgcagctcagagaaggggacgaatcggacggaatcataacaaagagggagaccaatatatatatatgggacaaccattgaataatgacgaagaccatgctcactggacggaggcgaaaatgctgttagataacataaacacgccagagggcatcatacctgccctgttcgaaccagaacgcgagaaatcggcggcgatcgatggagaatatagactacgtggagaagctcgaaaaactttcgttgagctaatgcgtaggggtgacctgcctgtatggttaagctataaagtcgcatcagagggatttcaatattctgaccgacgatggtgttttgacggggaaaggaacaaccaagtgctcgaagaaaacatggacgtggagatatggactaaagaaggagagagaaagaaactacggccacgatggctcgatgcaagaacatacagtgacccccttgctcttagagagttcaaagaatttgcagctggaagaaggagtgtttcaggagatttaatacttgaaattggtaaattacctcaacacttaactcaaagggcgcaaaacgctttagacaatctggtaatgttgcataacagcgaacaagggggtagggcgtatagacacgctcttgaggagttaccggatacaatagagactttaatgttattagcgttaatagcggttctaactggaggcgttacactgttctttttatcgggtcggggtcttggtaagacaagtattggactgttgtgcgtgatggcaagcagcgtactattatggatggcctcagttgagccccattggatagccgctagcataatattggaatttttcctaatggtacttctaatacctgaacctgacagacaacgtacacctcaagataatcaactagcttacgtagtaataggactattgtttatgatcctcacagttgcagctaacgaaatggggttactagaaacgacgaagaaagatttgggtataggccatgtagcagtagaaaatcatcaccatgcaagtatgcttgacgtagatttacatccggcgtcggcctggaccttgtacgcagtagctacaactataatcacaccaatgatgcgacatacaatagaaaatactacagccaatatttctctaacagccatcgctaaccaagcagccatactcatggggctggacaaaggatggccaatctcaaagatggatattggggtaccattacttgccttaggctgttattctcaagttaaccccctcactttaacagctgctgttttgatgcttgtagctcactatgctataatagggcctggactgcaggccaaagcgacgagagaagctcaaaaacgaactgcagcagggatcatgaaaaatccgacagtagatggaatcgttgctatagaccttgatcctgttgtatacgatgcaaaatttgaaaaacaactcggacaaataatgcttttaatattatgcacatcacaaatattgttaatgcgaacaacgtgggcattatgtgaatcgattaccctagcgacgggtcctctaacaacattatgggaaggaagccctggaaaattctggaacacaacgattgcagtgtcaatggcaaatatattccggggctcctacttagccggagctggacttgcgttttccttaatgaaatcattaggagggggaagacgaggaacaggcgcacaaggagaaacgctcggagaaaaatggaaaaggcaacttaaccagttatcgaaaagtgagtttaatacgtacaaaagaagtggcattatggaagtagataggtcggaagcgaaagaaggactaaagcggggtgaaaccactaaacacgcggttagccggggtaccgcaaaattacgttggttcgttgaaagaaaccttgtaaaacctgaaggaaaagttatagacctgggttgcgggcgcggaggctggtcttattactgtgcaggtctgaagaaggttacagaggttaaaggttataccaaagggggacccggacacgaagaaccaatccctatggctacttatggatggaatcttgttaagctacactctggaaaagatgtcttctttattccaccggaaaagtgcgatacattgctctgcgatataggagaatcatcccccaatcctactatagaagaaggaagaactctcagagtcctaaagatggtagaaccttggcttaggggaaatcagttttgtataaaaatacttaatccttacatgccttcagtagtagagacactcgaacaaatgcaaagaaaacatggcggaatgttggttcggaatccgctgagtcgaaacagtacccacgaaatgtactgggtatcatgtggtacaggaaatattgtatcggccgtaaatatgacttccagaatgcttctcaaccggtttacaatggcccacagaaaaccaacctatgaacgggatgtagatttaggtgcaggcacaaggcatgtagcagtagagcccgaagtagcaaacctagatataattggccaacgaatagaaaatataaaacatgaacataaatccacatggcattacgatgaagataacccctataaaacatgggcataccacggttcatacgaggtcaaacctagtgggagcgcctcaagcatggtcaatggagtggtaaaacttttaacgaaaccatgggacgtgattccaatggttacgcaaacagctatgacagacactaccccgtttggacagcaaagggtttttaaagaaaaagtagataccagaacccctaaagctaaacgaggcacagcgcaaattatggaagtaactgcacgatggctatggggattcctaagcagaaataagaaacctaggatatgcacgcgggaagagtttactaggaaagtcagatcaaatgccgcgattggagcagtttttgtagacgagaatcaatggaactccgctaaagaagcggtggaagacgaaagattctgggacctggtacatagagaacgtgaattacacaaacaaggcaaatgcgcaacatgcgtatataacatgatggggaaacgcgagaagaaactaggtgagttcggaaaagcaaaaggatctagagctatctggtatatgtggttaggggcaagatttttggaatttgaagccttgggatttatgaatgaagaccactggtttagcagagaaaattcgctatcaggtgtagagggagaaggtcttcataaattaggatatatattaagagacatttctaaaatccccggaggtaatatgtacgcagatgatacggcgggttgggacacccgaataactgaagatgatttgcaaaatgaagctaaaattacagatataatggaacctgagcacgcgctattagctaaatctatatttaaactgacttaccaaaacaaagttgtaagagtacagcgacccgcaaagaatggaacagttatggacgtaatttctcggcgggaccagaggggatccggacaagttggaacctatggcttaaatacgttcaccaacatggaagcccaattaatacgacaaatggaatcagaaggaatcttctcacccagcgaattagaaactcccaatctcgcagaacgagttttagattggttagagaagtatggagtagaaaggcttaaaaggatggcaatatcaggcgacgattgcgttgtaaagcccatagatgaccgatttgccacagcacttaccgcacttaacgatatgggtaaggtaagaaaagacataccgcaatgggaaccaagtaagggctggaatgactggcaacaagtgccattctgttcacatcattttcatcaattaatcatgaaagatggtagagaaattgttgtaccatgtagaaatcaagatgagttagtcggaagggctagggtatctcagggggccgggtggtcgttaagagagaccgcttgcctaggaaagtcctacgcgcaaatgtggcaactcatgtacttccataggagggatctgcggctggcagccaatgctatatgtagtgcagtaccggtagactgggttccgacttctagaactacctggagtatacatgcgcaccaccaatggatgaccacggaggatatgttatcagtttggaaccgtgtctggattgaagagaatccgtggatggaagataaaacacatataagttcatgggaagatgtcccctatttaggaaaacgagaagatcaatggtgcggaagcctcattggtctcacggcaagagctacatgggctaccaatattcaagtagcaattaatcaagtgagacgtttaattggaaacgaaaattatttagactacatgacaagtatgaaaaggtttaaaaacgagtcggaccctgaaggagcgttatggtaa

SEQ ID NO: 21370 - RNA, 9879 nt, synthetic construct
  misc_feature 1..9879: note = derived and/or modified CDS sequence (opt6) from DENV-1__FJ687432__SS-prME
  source 1..9879: mol_type = other RNA
agtgtcactatgttactaatgttgatgccaacggcattagctttccacttgacgactcgaggtggagaaccccacatgattgtgagcaaacaagaacgtggaaaaagtttattatttaaaaccagcactggtgtaaatatgtgtacattaatagctatggatttgggagaactatgcgaagacacaatgacgtataaatgtccccgcattacagaagcagaaccagatgacgtcgattgctggtgcaatgcaactgacacctgggtaacttatggtacatgctctcaaaccggagaacacagaagagataaacggagcgttgccttggcaccgcatgttggtttaggtctagaaacgaggaccgaaacctggatgagtagcgaaggtgcgtggaaacaaatccaaaaagttgaaacatgggcactacgacaccccggattcacagtaattgctctatttttggcacatgcaataggtacctccatcactcaaaaaggaataatcttcatactcttgatgttagtaactccctcaatggcgatgcgctgcgtcgggataggaagtcgcgacttcgtcgagggactttccggtgcaacttgggttgatgtggtcctagagcatggaagctgtgtcacaacaatggctaaagacaaacctaccctagatatagaacttttgaaaaccgaagttacaaacccagctgtcctgcgaaaactctgtattgaagccaaaatatctaatacaacgacagactccagatgccctactcagggggaagcaacattagttgaagaacaggacgccaacttcgtatgtaggcgcacctttgttgataggggatgggggaacggatgtggtttatttggcaaagggtctctcataacctgtgcgaaatttaaatgtgtaaccaaacttgaaggcaaaatagtacaatacgaaaacttaaaatattcggttatagttacagtacacacaggggatcaacatcaagtaggtaacgaaagcacagaacatggcactacagccacgatcactccacaagcaccaacgacagaaatacaattgacagactatggtgccctaacgctcgactgcagtccccgaactggattagattttaacgagatggtattgctcacgatgaaagagaaatcgtggctggtgcataaacaatggtttttagatttaccactaccatggacctctggcgctagtaccagtcaagaaacctggaataggcaggatcttctcgtaacatttaaaacagctcacgcgaagaaacaagaagttgtcgtcttaggaagtcaagaaggagctatgcataccgctctaactggtgcgaccgaaatacaaacaagtggaacaactaccattttcgccggacacctaaaatgtaggttgaagatggataagttgacgctcaaaggcatgtcctacgtaatgtgcaccggcagctttaaactggagaaagaagttgcagagacccaacacggtacgatcctagtacaaataaaatacgaaggtaccgatgcaccatgcaagatacccttttcgacccaagacgaaaaaggagttactcaaaacggacgtttaataacagcaaatcccatcgtcactgacaaagagaaacccgtaaatatcgaagcagaaccgccgtttggtgaatcttacatcgtaattggggcaggagaaaaagcacttaaactatcgtggttcaagaaaggatcgtctattggaaaaatgtttgaagcaacagcacggggagcacgtcgaatggcgattttaggagacacagcttgggattttggttctataggtggagttttcacatccgttgggaaattggtgcatcaaattttcggtactgcatatggtgtactattctcaggggtctcatggacgatgaaaatcggtataggcgtactcttaacttggctaggacttaattccagatcaacaagtctaagcatgacttgtatagcagtcgggttagtaaccttatacttaggagtaatggttcaagctgatagtggatgcgtgataaattggaaagggagagaactgaagtgtggttctgggatttttgttacaaatgaagtacacacgtggaccgaacaatacaagttccaagcagattcaccgaagcgactttcggccgctatcgggaaagcatgggaagaaggagtctgtggcattcgatcagcaaccagacttgaaaatataatgtggaaacaaatcagtaacgaattgaaccacatattgctagaaaatgatatgaagtttactgtagtagtaggagatgtagcgggtatactagcgcaaggcaagaaaatgatacgtccccaaccaatggaatacaaatatagctggaaaagctggggcaaagctaaaataataggagcggacgtgcaaaacgcgacattcataatagatggacctaatacacctgaatgtcccgacgatcagcgtgcatggaatatatgggaagtagaggattatggttttggcatatttaccacaaatatatggttaaaacttagagattcatacacacaggtctgtgatcaccgtcttatgtcggctgctatcaaagactccaaagcagttcatgccgatatgggttattggatcgaaagtgagaaaaacgaaacgtggaaactagcgagggccagctttatagaagtaaaaacgtgtatatggcccaaatcccatacattgtggtctaatggtgtacttgaaagcgaaatgatcatccccaaaatctacggtggaccaatcagccaacataattaccgaccaggatactttacacaaacagcagggccttggcacctcggaaagttggaactggactttgacttgtgcgaaggaacaacggtggtagtcgatgagcattgcggaaataggggtccttcgttaagaacaacaacagttaccggcaaaataatacatgagtggtgttgtcgctcttgcaccctacctccactaagatttcgaggagaggatggttgttggtacggcatggagattcgacccgtaaaagaaaaagaagagaacttagttaaatcaatggtaagtgcaggtagcggggaagtggactcattttcattaggtttactatgcatttccattatgattgaggaggttatgcggagccgatggtcccggaagatgctcatgacaggcactctagcggtctttttcttgttaattatgggtcaactcacttggaacgatttaattcggctttgtataatggtaggtgcaaacgcatcggaccgtatgggtatgggtacaacttatctcgccctaatggcaacgtttaaaatgcgcccaatgttcgcagtaggcttattattcaggagattaacttcgcgtgaagtcttacttttaaccatcggcttaagcctagtggcatcagtcgaattacccaattccttagaagaactaggcgatggcttagcaatgggcataatgatactaaaactattaacagactttcaatcccatcaattatgggccacactgcttagtcttacgtttattaagacgacgtttagcctacattatgcatggaagactatggcgatggttctatcaatagtttctttattccctctatgtctctcgacaacttctcaaaagactacgtggctgcctgtacttcttggcagcctgggatgtaaaccgttaactatgttcctaatagctgaaaataaaatatggggaagaaaaagttggccccttaatgaagggataatggctgttggtattgtatcaattttgttatcgtctctcttgaaaaatgatgtccctttagccggtccacttatagcaggcggtatgcttattgcttgctatgtcatcagtggcagcagcgctgatctctccttagaaaaagctgctgaagtatcgtgggaagaagaagcggaacatagcggagcatctcataacattttagtagaggtacaagatgatggtactatgaagatcaaagacgaggaacgggacgatactctaacaatacttttaaaagcaacactactagcagttagcggcgtttatccactttcaataccagcaacacttttcgtatggtacttttggcaaaagaagaaacaaaggtctggtgtcttatgggatacgccctcgcctcctgaagtcgaaagagctgtcttagacgacggaatatacagaattatgcaaagaggcctactaggtagaagtcaagtaggcgttggcgtttttcaagaaaacgtgttccacacaatgtggcacgtgactagaggagctgttttaatgtaccaaggaaaaagactagagccatcctgggcaagcgtcaagaaagatctcatatcgtatggaggtggatggagattacaaggcagctggaacactggggaagaagtacaagttatagccgttgaaccaggtaaaaacccaaagaatgtacaaaccgcacccggaacctttaaaacaccagaaggtgaggttggagcaattgcactagattttaaaccaggtacatcgggatcaccaatcgttaaccgcgaagggaaaatagtggggctatacggtaatggagttgtaactactagcggtacatatgtgtccgctatcgcacaagctaaagcctctcaggaaggccctttaccagagatagaagatgaagtgtttcgtaaaagaaatcttacaatcatggatttacatcctggttcaggcaaaaccagacgctatttacccgcgattgttcgagaagctattaaaagaaagttaagaaccttaatcttagcgcccaccagagtcgtagcaagtgagatggcagaggcacttaaaggtatgccaattcggtaccaaacgacagccgtcaaatcagagcatactggcaaagagatcgtagatctaatgtgccatgcaactttcactatgagattactttccccagttagagtgcccaattacaacatgataatcatggacgaagctcattttactgatccgagttctatagcagcacgaggatatatttctacgcgtgtcggaatgggagaagcagctgcaatcttcatgactgcgactcctccagggtcagtggaggcgttcccgcagtctaatgcagtcatccaagatgaggaacgggatataccagagcgttcatggaactctggttatgaatggattaccgacttcccaggcaaaaccgtatggttcgtaccttcaataaaatctggaaacgatattgcaaactgtctaaggaaaaacggcaaaagagtgatacaactctcaagaaagacctttgatactgaataccaaaagactaagaataacgattgggattacgtagtgaccaccgacatcagtgaaatgggcgctaattttagagccgacagagtaatagacccaaggcgttgcttaaaacctgtgatactaaaagatggacctgagagagtgatattagcagggcccatgcctgtaacagtagcgagtgccgcgcaaagacgcggcagaataggaagaaatcacaacaaagagggggaccaatatatatacatgggacaacctttaaataatgatgaagatcatgcgcattggacggaggcaaaaatgctactagataacataaatacgccggaaggcataatcccagcattatttgagccggagcgtgaaaaatctgcagccatagacggggaatatagattaagaggcgaggctaggaaaacatttgtcgaattaatgaggaggggtgatttaccggtttggttaagctacaaagtagcaagtgaaggtttccaatattctgataggagatggtgctttgacggagaacgtaacaatcaggttctagaggagaatatggacgtagaaatttggacaaaagaaggcgaacgtaagaaattaaggccaaggtggttagatgctcgcacttacagtgacccactcgctctacgagagtttaaagaatttgctgcaggtagaagaagcgtaagcggagatttaatattggaaataggcaaattacctcagcacctaacacagagagcacagaatgcgctggataatttggtaatgttacataattctgaacaaggaggtagggcatacaggcatgcactcgaggagttaccagatacaatagagacgctaatgttattagcattaatagcggtgttaaccggtggcgtaactttgttctttctatctgggcgtggattaggaaaaacaagtataggcctgttgtgtgtcatggctagttcagtattgctttggatggctagcgtagagccccattggatagccgccagtataatacttgagttcttcctcatggtactgttgattcctgaacctgacagacagcgtacaccccaggataatcaactagcatacgtagtgatagggttattgttcatgatattaacagttgctgctaatgaaatggggctactggaaactacgaagaaagacctggggatcggtcatgttgcagttgaaaatcatcaccacgctagtatgctggatgtggatttacatcctgcttccgcttggacgttgtatgcagtagcgacaacaataataacacccatgatgcgacacacgatcgaaaatactaccgcaaatatatcattaacagcgattgcgaaccaagccgccatacttatgggactcgacaaaggatggccaattagcaagatggacatcggagtaccattgttagcactcggatgttattcccaagtcaatccattaactcttacagcagcagtattgatgttagtagcgcactatgcaataataggaccgggcttacaagcaaaagcaactcgcgaagctcagaaaagaactgccgcagggataatgaagaacccaacagtagatggaattgtggcaatagacctagatcctgtagtatatgacgcaaaattcgagaaacaattaggtcaaataatgttactaattttgtgtacttctcagatattgctaatgagaacaacttgggctctatgcgaaagcatcacgcttgcaacaggaccattgacgacgttatgggaaggatcgccgggaaaattttggaacacaactattgcagtatctatggcaaatatctttcgcggatcatacctggcaggcgctggattagcgttttcgttaatgaaaagccttggaggaggcagaagggggaccggagcacaaggggagaccctaggagaaaaatggaaacgtcaactaaatcagctatcaaaatctgagtttaacacttataaaaggtcagggataatggaagtagaccgcagtgaagcgaaagaaggcctaaaaagaggtgaaacgactaaacacgctgtgagcagagggacagctaagctgcgctggtttgtcgagcgaaatcttgtaaagccagaaggaaaggtcatagacctagggtgtggaagaggtggatggtcctattattgtgcggggctcaagaaagtaacggaagtgaaaggatatacgaaaggtggcccaggtcatgaagaacccatccctatggctacgtatggttggaaccttgtcaaactgcactccgggaaagatgtgttctttatacctccagagaaatgcgacacgcttctgtgcgatatcggagaatcatcaccgaatccgacaatagaagaaggccggaccttacgtgtgttaaaaatggtagagccatggttacgtggaaaccagttttgtataaagatcttaaatccatacatgccgtctgtggtagaaactttagaacaaatgcagagaaaacacggaggtatgttggtaaggaatccattatcaaggaatagtacacacgagatgtactgggtatcatgcgggacagggaacattgtcagtgctgtaaacatgacatcaaggatgctcctaaacagatttactatggcccacaggaaaccaacttatgaaagagacgtcgatttaggagcagggacacgacatgtagcagtcgaacctgaagttgcaaacctggatataattggccagcgtatcgagaatatcaagcacgaacataaatctacatggcactacgatgaagataatccgtataaaacttgggcatatcatggaagttatgaagtaaagccaagtggttcagcttcaagcatggtaaacggagtggttaagctactgactaaaccatgggacgtgatacccatggtaacacaaacagcgatgacagatacaactccgttcggtcagcaaagagtctttaaggaaaaagttgacacacgcactcctaaagccaaacgcggtacggcacaaataatggaagtaacagcgaggtggctatggggtttcctaagcagaaacaaaaagccccgaatatgtactcgtgaggagttcacaagaaaagtaagatctaatgcggcgattggagcagttttcgtagacgaaaaccaatggaacagcgccaaagaagcagtcgaagacgaacgattttgggacctggtgcatcgagaacgagaacttcataagcaaggaaaatgtgcaacttgtgtatataatatgatgggaaaaagagagaagaaattgggcgagttcggaaaagccaaggggtcaagagcgatctggtacatgtggttaggagctagatttcttgagttcgaagctctgggctttatgaacgaggatcattggttttcacgcgaaaattccctttcgggagtagaaggcgaagggctccacaaattagggtacattctcagagatataagtaagatccccggtggtaacatgtacgcagacgacacagcaggatgggatactagaattacagaagacgatttacagaacgaagcgaaaattacggatataatggaaccagaacacgccttactagctaaaagtatattcaagctgacatatcaaaacaaagtggtccgagtgcaacggccagccaaaaacggaacggtcatggacgtaatttcacggagagaccaacgaggaagtggacaagtaggtacgtacggcctgaacacttttacaaatatggaagcacaattaattcgacaaatggaaagtgaaggaatcttttcaccaagtgaactcgaaacaccgaatttagcagaaagagtactagattggctagaaaaatacggcgtagagagactcaaacgtatggctatctctggtgacgactgtgtagttaaaccaatagatgaccgattcgcaacagcattaactgccttaaacgatatgggcaaagttcgaaaagacattccacaatgggagccgtcaaagggatggaatgactggcaacaggttccattttgctctcaccatttccatcagctaataatgaaagacggacgtgaaattgtcgtcccatgtagaaaccaagatgagctagtagggcgagctagagtgtcccaaggagctggttggtcactacgagaaacagcatgcttaggtaagtcctatgcacaaatgtggcagttaatgtatttccacagaagggatctgagactagcagctaacgcaatatgtagcgctgtaccagtagactgggtccctactagccggacgacatggagcatacatgcacatcaccaatggatgacaaccgaagacatgttatcagtttggaacagagtatggatagaggaaaatccatggatggaggataagacacatattagctcgtgggaggacgtaccttatttagggaaaagggaagatcaatggtgtggttcactaatcggcctgactgcaagagcgacctgggccacaaacatacaggttgccataaatcaggttcggcggctgattggcaatgagaactatcttgattatatgacatcaatgaaaagatttaaaaacgaaagtgatcctgaaggcgcactctggtaa

SEQ ID NO: 21371 - RNA, 9879 nt, synthetic construct
  misc_feature 1..9879: note = derived and/or modified CDS sequence (opt6) from DENV-1__JQ922547__SS-prME
  source 1..9879: mol_type = other RNA
tccgttacgatgctgttaatgctactccccacagcattggcgtttcatctcacaacgagaggtggagaaccgcatatgatagtctctaaacaagaaagaggtaaaagtctattattcaaaacaagtgcaggagttaacatgtgtacccttatagctatggaccttggagaactttgtgaagataccatgacttataaatgccctaggataacagaagcagaacccgatgacgtagattgctggtgcaatgcgacagacacgtgggttacatatggaacctgcagtcaaacgggagaacacaggcgagataaacgctcggtagcgttagcaccacacgtcggcctcggacttgaaacaagagcggaaacatggatgagtagtgaaggagcatggaaacaaatacaaaaagtagaaacgtgggcgcttcgacatccgggtttcactgttatagcactatttttagcgcatgcaattggaacttcgattacacaaaaagggattatatttatactattaatgctagtaacaccatctatggctatgagatgtgtagggataggaaacagagacttcgtagaaggattgtctggtgccccgtgggtagacgtagtattggaacatggaagttgtgtaactacgatggctaaaaacaaacctactctggacatcgaacttttaaaaacagaagtaacgaaccctgcagttctacgaaaattatgcattgaagcaaaaatatcgaatacaacaactgacagtagatgccctacacaaggagaagcaacgttagtggaagaacaagacgccaactgcgtgtgtcgtaggacatttgtggatcggggttggggaaatgggtgtggattgtttgggaaggggtcacttataacttgtgcgaagttcaagtgtgtcactaaactagaaggaaagatagtacaatacgaaaatttgaaatatagcgttattgttactgtccacacgggcgatcaacatcaagtcgggaatgaaactactacacatggaacaacagcaacaattacaccacaagcaccaacttctgaaatacagctaacggattacggggcacttactctggactgttcacctaggaccggattagactttaatgaaatggtgctattaacaatgaaagaaaaatcctggttagtgcacaagcaatggtttttggatttaccgttaccatggacctctggcgcatcgacatctcaggaaacttggaacagacaggatttattggtaacctttaagacagctcacgccaagaaacaggaagtagttgtcttggggtcccaagaaggggccatgcacaccgcattaaccggggcaaccgaaatacaaacaagcggaactactacaatatttgcaggacacttaaaatgcaggttgaaaatggacaaactaacattaaaaggtatgagttatgtgatgtgcacaggcagctttaagttagaaaaagaagttgcggagactcagcacggaaccgtgttggtacaagtcaaatacgagggtaccgatgcaccttgtaagatacccttttcaacacaggatgagaagggagcgacacaaaatggcaggttaataacagcaaatcctatagtaaccgacaaagaaaaaccggttaacatagaggcagagccaccttttggtgagagttacatagtagtaggcgccggagagaaagccttaaaactatcctggtttaagaaaggtagttctataggaaagatgttggaggcgactgcaagaggagcaagaaggatggcaatcctaggagacaccgcttgggacttcggttccattggtggagtatttacatcaatgggaaaacttgtccaccaagttttcggcaccgcttatggtgtcctattttcgggggtaagttggactatgaaaatcggtatagggattctcctaacctggttaggattaaattcacgaaacacctccctaagtatgatgtgtatagccgtaggaatggtaacattatacctaggagtgatggttcaggcggacagtggttgtgtgataaattggaagggaagagaattactatgtggcacaggcatatttgtaactaacgaggtgcatacttggacagacccgtataaatttcaagccgatccaagcaatcggctatcaccaataatcggtaaggcatgcgtgatccgagtatgcggaataagatctgcaacaaggctagagaatattatgtggaaacaaataagtaatgaactgaaccacatattacttgagaatgacatgaaatttacagtcgtcgtaggtgatgtttccgggattctagcacagggagagaaaatgattagaccacaacccatggagcataaatatagttggaaaagctggggaaaagcgaaaataataggagcagatgtgcaaaataccacattcataatcgacggaccgaatactccagaatgtcctgacaaccaacgagcatggaatatatgggaagttgaggattacggattcggtatatttacaacgaatatctggttgaaattacgggatagctatactcaagtatgtgatcatagattaatgagtgcagcaatcaaagattctaaagccgtgcatgctgatatgggctactggatagagagtgagaaaaacgaaacttggaaactggcacgtgcgagcttcatcgaagtcaaaacatgtacatggcccaaaagtcacaccctgtggagtaatggagttctagagtcggaaatgatcatacctaaaatatatggtgggccgatatcacaacataattaccgaccagggtattttacccagacagcgggcccatggcatttaggaaaattagagttggatttcgacttttgtgaaggcaccacggtcgttgtagatgaacactgcgggaataggggaccatccctacgcacgacaacggtaaccggtaaaatcatacacgaatggtgctgccgcagttgtactttaccaccactacgcttcaaaggtgaagatggatgctggtacggaatggaaatcagacctgttaaagataaagaggaaaacctagtaaaatcgatggtaagtgctggtagtggtgaggtcgattcattcagcctaggactactatgtattagcatcatgatagaagaagtaatgaggtcacgatggtcaaagaaaatgcttatggttggaactttagcagtttttctgctattaatcatgggacaactgacctggagcgatttgattagactttgcataatggtcggggcaaatgcaagtgacagaatgggtatgggaacgacttatcttgcacttatggcaacatttaaaatgagacccatgtttgcggtagggttgctattcccaaaattaacaagccgagaagtactattgctcaccataggattgtctctagttgcgtctgtagaattgccttctagtctagaagaacttggagatggactagccaaaggaattatgatgctaaagttactaacagattttcagtcacatcaactatgggccaccctattaagtctcacattcataaagacgacttttagtttgcattatgcgtggaaaacaatggcaatggtactcagtatagttagtctctttccactttgtctcagtaccacgtcccagaaaactacgtggctccccgtgttgctaggttcactagggtgcaagccattaccaatgtttctaattacggaaaataaaatttggggtcgaaaaagttggccattaaacgaaggaataatggcagttggaattgtaagcatacttctatctagcttattgaaaaatgacgtaccactcgcagggccgctgatagcaggaggcatgctagtagcgtgctatgttatatctggaagcagcgcagacttaagtctagaaaaagctgcagaagtttcatgggaggaagaagcagaacacagcggagcatcccataacatattagtggaagttcaagatgatggtacaagaaaaataaaagacgaagaacgtgatgatacactgaccatactcctaaaagcgactttactagcagtgtcaggtgtctacccaatgtccattccagcgacattatttgtttggtatttttggcagaagaaaaatcaacgtagtggagtaggactcattactccttctccgcccgaagtagaacgtgcagttttagatgacggaatctatagaatactacagaggggcctattaggtaggtcccaagttggcgtcggtgtattccaagaaggtgtatttcacacgatgtggcatgttacgagaggagctgtactaatgtaccaaggaaaaaggcttgaaccaagttgggcaagtgtgaagaaagatctaattagttatggagggggttggaggttccagggaagctggaacacaggtgaagaagtgcaagtcatcgctgttgaaccggggcgcaatcctaagaatgtccaaacggcccccggtacttttaaaacgccagaaggagaagttggagcaattccattagacttcaaaccaggaactagcggtagcccgatagttaaccgtgaaggaaagatagtcggactatacggtaatggggtcgtaactacatcgggaacatatgtatccgccatagcgagagcaaaagcctcccaggagggtccgctgccggaaatagaagacgaagtctttcgaaaaagaaacctcactatcatggatcttcatcctggatccggaaaaaccagacgatatttacctgcgatagttagggaagctataaaaaggaaattaagaacgctaatcctagcaccaacaagagtggtggccagtgaaatggcagaggctttaaaaggtgttcctataagatatcaaactaccgctgtaaaaagcgagcacactggaaaagagatcgttgatctcatgtgtcacgccacgttcacgatgcggctcttatcaccagtaagagttcctaattacaatatgataatcatggatgaagctcactttactgaccctgcttctatagccgccaggggatacatatctacgagagtaggtatgggtgaagcagccgcaatctttatgacggcaacgcccacagggtcagtggaagcatttccccaatcgaacgcgataatccaagacgaggaacgcgatattccagagagaagttggaatagcgggtatgactggataactgactttcccggtaagacagtctggtttgtaccatcgataaaatccggaaacgatattgcaaactgcttaaagaaaaacgggaagagagttatacagctatcgaggaagacttttgatactgaataccagaaaactaaaaataatgactgggactatgtagtaactacagatatatcagagatgggagcaaatttccgagcagatagagtaatagatccacgaagatgcctaaagccagtcattttaaaagacgggcctgaaagagttatactagccggtccaatgccagttacagtagcgagtgcagctcaaagacgaggtcgtataggaaggaatcaaaataaggagggagatcagtacatttatatggggcaaccctcgaataacgatgaagatcatgcgcactggacagaggcgaaaatgttgcttgataatattaatacaccagagggaatcataccggcactgttcgagccggaaagggaaaagtctgctgcaatcgatggagaatatagattgagaggagaggctcgaaaaacttttgtagaattaatgagacgcggagacctacctgtttggcttagctacaaagtcgcgtccgaaggatttcaatattccgatagaagatggtgctttgacggtgaaagaaacaatcaagtactagaagaaaacaaggatgtcgaaatttggacgaaagagggagaaagaaagaagttgaggacttgctggttagatgcgagaacatacagtgatcctttagccttaagagaatttaaggagtttgcagctggaaggcgctcagtaagtggagatctgatactcgaaattggaaaactcccacaacatctaacacaaaaggcccaaaaagcacttgacaacttagttatgctacataactcggaacaaggtggaaaggcatataggcatgccatggaagaactcccagatactattgaaacgttaatgttgttggcgcttatagccgtgctaaccggtggggttactttgtttttcttgtccggcaggggtctaggtaaaacgtcaatcggtttactctgtgtaatggcctcctctgttctcttatggatggcatcagttgaaccgcattggatcgccgcctcgatcattcttgagttcttcctaatggtacttctgatcccagaaccggacagacaacgcacaccacaagataaccaattagcatacgttgtaataggtctgctattcatgatattaacggtagcagccaacgagatgggactattagaaactaccaagaaagacctaggtattggacatgtagcagccgagaatcatcatcacgccacgatgcttgatgtggatttacgtccggctagtgcttggacactgtatgcagtggcaacaacaatcataaccccaatgatgcgacatacaatagaaaataccaccgcaaacatcagtctgacggcaatcgccaatcaagcagcaatcttaatgggtctagataaaggctggccaatatctaaaatggatataggggtgcctttattagctttgggttgttactctcaagttaatccgcttacattaacagctgcagtattaatgttagtagcacactatgccattatcgggcctggcctacaagctaaggcaacgagggaggcccagaaacgaactgcagctggaattatgaagaacccaaccgtggatggaatagtagcaatagatttagatccggtagtttacgatgccaagttcgaaaaacaacttgggcaaattatgttattaatattatgtacaagtcaaatactactaatgaggaccacatgggcgctatgtgaatctataacattagcgacgggaccactaacaacactatgggaaggcagtcctggacgtttttggaatacgacaattgcagtgtcgatggccaatatatttcggggaagctatttagctggagcaggcctagcgtttagtctgatgaagtcattaggcggaggacgtagagggacgggagcacagggagaaactttaggtgagaaatggaaaagacaactcaatcaattgtctaaaagcgaatttaacacgtacaaacgctcaggaataatggaagttgacagaagtgaggctaaggaaggactgaaaagaggcgaaacaaccaaacacgcagtaagtcgtggaactgcaaaattacgttggtttgttgaacgaaatttagtaaaaccagaaggaaaagttatagatctaggttgtgggagaggaggatggtcttactattgcgcaggcctcaagaaagtgacggaggtaaagggctatacaaagggaggacctgggcacgaagaaccaattcctatggcaacatatggatggaatctcgtaaaactgcacagcggcaaagatgtattctttattcctcctgaaaaatgtgacactctattatgtgacataggtgaaagttccccaaatcccacaatcgaagagggcagaactctgcgtgtgctaaaaatggttgaaccctggcttagggggaaccagttttgcatcaaaattctgaatccatatatgcctagtgtagtagaaaccctcgagcaaatgcaaagaaaacacggtggtatgctggtgcggaatccgctgagtaggaacagtacgcacgagatgtattgggtatcatgtggtacagggaatattgtttcagctgttaatatgacttcacgtatgctactaaatcgtttcacgatggcacatcgaaaaccaacatatgaacgggacgtagatttaggggcaggaacgagacacgttgcggtagaacctgaagttgcaaatttggatataatcggacaaagaattgaaaacattaagaatgaacacaagagtacgtggcactacgacgaagacaatccatacaaaacgtgggcgtatcatggaagttacgaagttaaaccctccggttcagcatcctcgatggtgaatggtgtagttagattactcactaaaccatgggacgtaattccaatggtgacccagattgcaatgaccgatacgacaccatttggccaacagcgagtattcaaagagaaagtagatacacgaacaccaaaggcgaaaagaggaaccgctcaaataatggaagttacagcaagatggttatggggatttctgtcacgaaataaaaagccgaggatatgcacgagggaagaatttacacgaaaagtaagaagtaacgcggctattggtgcagtattcgtggacgagaatcagtggaatagtgctaaagaagcagtagaggacgagaggttctgggacctagtacacagagagcgtgaattgcataaacaaggaaaatgcgctacttgcgtttacaataaaatgggaaagagagagaagaagttaggagagttcggcaaagcaaagggatcaagagctatatggtacatgtggttaggagcacggtttctggagttcgaagcccttggttttatgaacgaagatcattggttcagtagagaaaattccctctctggtgtcgagggagaaggactacataaattggggtatatcctacgggatattagccgcattccaggagggaacatgtatgctgatgatacagcaggctgggacacaagaattacagaagatgacttgcaaaacgaagcaaagataaccgacataatggaaccggaacatgcccttcttgctacgtcaatattcaaacttacttaccagaataaggtcgtaagagtacaaagaccagccaaaaacggcacggtaatggatgcaatcagcagaagagatcagagaggatccggacaggtgggaacgtatggtttgaacacgttccttcataaagaggctcaattaattagacaaatggagttcgaaggcatcttcttaccctctgaactagaaacccctaacctggcaggacgtgtgctcgattggttggaacaatacggagtggaaaggttgaaaagaatggctataagtggtgatgattgtgtcgttaagccaatagatgatagatttgccaccgccttaaccgcattaaatgatatgggtaaggtgcggaaagacattccacaatgggaaccaagtaaaggatggggagattggcaacaagtgcctttctgctctcaccactttcaccaattgataatgaaagatgtgagggaaatagtagttccttgtaggaatcaggacgagcttgtaggcagagcacgagtatctcagggagctgggtggagtttgcgggaaacagcatgtcttggcaaaagttatgcacagatgtggcagctcatgtatttccaccgtcgagacttacgactggcggccaatgctatttgttctgctgttccagtcgattgggtgccgacttcgagaactacatggagtatacacgcccatcatcaatggatgacgacggaagatatgttgagtgtgtggaatagagtatggattgaagaaaatccatggatggaagataaaacacacgtatcgagttgggaggacgtaccttatttaggtaaacgagaggatcaatggtgtggatctttaataggtctgacggccagggcaacatgggctactaatatacaagtagccataaaccaagtaagaagactaataggaaatgaaaactacttggactatatgacatccatgaaaagatttaaaaacgaaagtgaccctgaaggcgcattgtggtag

SEQ ID NO: 21372 - RNA, 9879 nt, synthetic construct
  misc_feature 1..9879: note = derived and/or modified CDS sequence (opt6) from DENV-1__EU482567__SS-prME
  source 1..9879: mol_type = other RNA
tcagttacaatgttattaatgttattgcctacagccttggcatttcatctaaccacccgaggaggcgaaccacatatgattgtaagtaaacaagaaagagggaaatctttattattcaagacatcggcaggaataaatatgtgtactctaattgctatggatttaggtgagttatgtgaagacactatgacatacaaatgtcctcgcataacagaagctgaacctgatgatgttgattgttggtgtaatgcaacagatacttgggtaacttatggcacgtgttcacagactggtgagcatagacgcgataaaagatccgtggcattagcacctcacgtggggttaggccttgaaactagaacagaaacctggatgtcatcggaaggggcatggaagcaaattcagaaagtagaaacatgggctctgagacacccaggatttacagttactgctttgtttctggctcacgcaattggtacttcgataactcaaaaagggataatcttcatattacttatattagtcacaccttcgatggcaatgcgttgtgtaggtatcggaaatcgggactttgttgaagggttaagtggggcaacatgggtagacgtcgtactagaacatggaagttgcgttaccacaatggctaaagataagccaacgttggacatagaattactaaagacagaagtgacaaatcccgcagtccttagaaaactctgtatagaagctaaaatatccaatacaactactgactcaaggtgcccaacccaaggtgaagccaccttagtggaggaacaagactcgaatttcgtctgcaggagaacctttgttgatagaggatgggggaacggatgcggattattcgggaagggctcgctgttgacctgtgcaaaatttaagtgtgttactaagctagaaggcaaaatagtacaatacgagaatctaaaatactcagtaatcgtaactgttcacacaggagaccaacaccaagtaggtaacgagacaactgaacatggaacgattgcaacgattaccccacaggcgccaacgagcgagatacaattaactgactacggagcgcttaccctagactgttctcctcgcacaggcctcgactttaatgaaatggttctcttaactatgaaagagaaaagctggcttgtacacaaacagtggttcctggacttgcctttaccttggacaagtggcgcgagcacttcacaagagacgtggaacagacaagatctgttagtgacatttaagacagctcacgctaaaaaacaggaagtagttgtattaggatcgcaggaaggcgcgatgcacacagctttaaccggagcaacggaaattcagacatctggaacaactaccatctttgcaggtcatctcaaatgtaggttaaaaatggataaattaacactcaaaggtatgagttacgttatgtgtactggctcattcaagttggaaaaagaagtggcagaaacacaacatggaacggtattggtgcaggtgaaatacgagggaacagacgcaccttgcaaaattccattcagtgcgcaagatgaaaaaggagttacccaaaacgggcgcttgattaccgcgaatcctatagtaacagataaggaaaaaccagtcaatatagagacggaaccccctttcggcgaatcgtatatagttgtcggagccggcgagaaggcattaaaattgtcgtggtttaaaaagggatcatcgatcggaaaaatgtttgaagcaaccgcccgaggagcgcgtcgaatggcaatactgggagataccgcatgggattttggatccataggcggcgtttttacatcagcgggtaaattggttcaccaagtctttggagcagcctacggtgtcctcttttcaggagtcagctggacaatgaaaataggaattggtatccttttaacatggttaggtttgaattcacgctctacttcactatcaatgacctgtattgcggtaggtatggtaacactatatcttggagtggtggtgcaagctgattccggatgcgtaattaattggaaagggagagaactaaaatgtggatcaggcatatttgttacgaatgaggtgcatacctggacagaacaatacaagtttcaggcagactctcctaaaaggctttctgcggcaatcggtaaagcatgggaagagggagtttgtggaatcagaagtgcaacaagattggaaaacataatgtggaaacaaatatcaaacgaacttaaccacattctactggagaatgatatgaaattcaccgtagtagttggtgatgcaaatgggattttggcgcaaggaaaaaaaatgattaggccgcaaccaatggagcatagatactcctggaaatcctggggaaaagcaaaaataattggggcagatattcaaaatgcgacctttatcatagatggcccggatacaccagaatgcccagacgatcaaagggcatggaacatttgggaagtcgaagactatggatttggcattttcacaactaatatatggcttaaattgcgagattcctatacacaaatgtgcgaccaccgattgatgagtgctgcaataaaagatagcaaagcagtacatgcagatatgggatattggatagaatcagagaaaaatgagacctggaagctggcaagagcaagttttattgaagtaaaaacatgtatatggcctaaaagccataccctctggtctaatggagtgttagaatccgaaatgataatacctaaaatatatggaggaccaattagccagcataattatcgtccaggttatttcactcaaactgcagggccctggcatcttgggaaattggaactcgattttgacttatgcgaagggactacagtagttgtcgatgaacactgtggaaatcgaggcccatcgcttaggactacgaccgtcacaggtaagataattcatgaatggtgttgtagatcatgcacattaccgcctctaagattccgtggtgaggatggatgttggtatggtatggaaataagacctgtcaaagaaaaagaagagaatttggttagaagcatggtaagtgcgggaagtggagaagtagatagttttagtcttggaatactctgtgtatcaatcatgatagaggaagtgatgcggtcgagatggagtcgaaaaatgctcatgactggaactctagcagtctttctgcttttaattatgggccagctaacttggaaggatctaattcgactttgcataatggtaggagctaacgcatcggatagaatgggcatgggaacaacttacttagcattaatggcaacatttaaaatgagaccgatgttcgcagtaggtcttctttttcgcagactaacatcaagggaggtattactgttgactataggcttgtcactagtggcttcagtagaattgccaaattcgctggaagaattgggcgatggtttggcaatgggaatcatgatgttaaaattattaaccgagttccaaccacaccaactctggacgactcttctgtcactcacatttataaatacaacactaagcttagactatgcgtggagaacaatggctatggtcttaagtataatcagtcttttcccactatgtctttcaacaaccagccaaaaaactacatggttacccgtattacttggtagttttggttgtaaaccattaactatgttcttaatcacagagaataaaatttgggggcggaaaagctggccactgaatgaaggtataatggcgataggcatagtgtcaatcttgttgtcttctctgctaaaaaatgatgtaccattggcaggaccgttaatagcaggagggatgcttatagcatgctatgtaatttctggctctagtgcagatttgtcattagaaaaggcagcggaagtctcctgggaagaagaagcagaacacagcggaactagtcataatattctcgtagaagtacaagacgacggaacgatgaaaattaaagacgaagaacgtgatgatacgctgactattctattaaaagcaacgctcctagctgtatcgggggtatatccaatgtccatcccagcaaccttgtttgtatggtacttctggcagaaaaaaaaacaaagaagtggtgttctttgggatacaccttcacctccggaggtcgaaagagctgtactagatgacggaatctatcgcattttacagagaggactactagggaggtcacaagttggagtcggagtgtttcaagacggagtatttcatactatgtggcatgtgacgcgaggtgccgtgctaatgtaccaaggaaaaagactagaaccctcatgggcgtcagtcaaaaaggatctaatatcttatggaggtggttggcgatttcaaggtagctggaatacaggagaggaggttcaagtgatagctgttgaacctggtaaaaatccaaaaaatgtacaaacaactccaggtacgtttaagactcccgaaggtgaggtaggagcaattgccttggatttcaaaccgggaacgtcagggtcccccatagtcaatagagaagggaaaatcgtgggcttatatggaaatggagtggtaactacaagtggtacctatgttagtgcgatagcgcaagctaaaactagccaagagggacctctgccagagatagaggatgaagtttttaaaaaacgcaatctcacaataatggacctacacccgggctcaggaaaaacgagacgatatttgccagcaattgtaagagaagctattaaaagaaagttgagaacactgattttagcaccaacccgagtcgttgcgtcagagatggcagaagcgttaaagggtatgccgattagatatcaaacaacggctgtgaaaagcgaacatacaggccgagaaatcgtagatttgatgtgtcatgcaacttttactatgagacttcttagtccagtaagagtcccgaactacaatatgattataatggacgaggctcactttacagatcctgcatcgatagcggcaagaggctatatctctaccagagtaggtatgggcgaggctgcggcgatattcatgactgcaacgcctcctggttcggtagaagcatttccacaaagcaatgcagtaatacaagacgaagagcgagatataccagaaagatcttggaattcaggttatgactggataacagattttcccggaaagacagtttggttcgttccgagtattaaaagcggaaatgatatagcaaactgcttgcgtaagaatggaaagagagtcatccaattatctcgtaagactttcgacactgaataccaaaaaacgaaaaataatgattgggactatgtagttaccacagatataagtgaaatgggcgccaattttcgagcagatcgcgtaatcgatcctagaagatgtctaaaacccgtgattctaaaagatggcccagagagagtgattctggccggtccgatgcccgtaacagtagcatccgcagcccaacgaaggggtcgtataggtcggaatcaaaataaggaaggcgatcaatatgtatatatggggcaacccttaaataatgatgaagaccacgcacactggacagaagcaaaaatgttactggacaatattaacacaccagaaggcataattccggcgctattcgaaccagaacgtgaaaaatctgctgcaattgacggcgaatacagactaaggggggaggcgcgaaagacatttgtggaattaatgaggagaggagatttaccagtctggctgtcttataaggtcgctagcgaagggtttcaatactctgaccgaaggtggtgtttcgatggcgaaagaaacaatcaagtactggaagaaaacatggatgttgaaatatggactaaggaaggcgagcggaaaaaattaaggccaagatggctggatgctcgaacatacagtgatcctttagctttgcgagaatttaaggaatttgcagctggcagaagatcagtaagtggagatcttatccttgagataggtaaactcccacagcacttaactctgagagctcaaaacgcattagataaccttgtaatgttacataatagcgaacaaggtggtaaggcgtatcgacatgccatggaagagttaccagacacaatagaaaccctaatgttactagcattaatcgcagtgttgaccggtggggtaactctgttctttttgtcagggaagggactaggaaagacgtcaataggacttctatgcgtaatggcttcgagcgctctactttggatggcaaatgtagaaccacactggatcgctgcgtcaattattctggaatttttcttaatggttttgttaatcccagaaccggatagacaaaggacaccgcaagataaccaactagcatatgtagtaataggcctattatttatgattctcaccgtggccgctaatgaaatgggcctattagaaaccaccaaaaaagatctgggtattggacatgtagccgccgaaaatcaccatcatgcgacgatgttggacgtggaccttaggcccgccagcgcatggacactgtatgctgtagctactactgttatcacgccaatgatgagacataccattgaaaatacaactgcaaacatttccttgacagcaatagccaatcaagcagcaattttaatgggcttagataaaggttggcctatttctaaaatggacataggtgtaccactacttgcccttggatgttactcgcaagtaaatccactcacgttaactgcggcggtcctcatgttagtggcccattatgcaataataggtcccgggctgcaagcaaaggctacaagagaagctcaaaaaagaacggccgcggggattatgaaaaatcctacggtagacggtattgtagcaatagaccttgatcctgtagtatatgatgcaaaatttgaaaaacaactagggcaaataatgctgttaatattatgcacgagtcagattctactaatgcggaccacttgggctttatgcgaaagcataaccttggctactggccctctaacgacactatgggaaggttcccccggtaagttctggaacacgacgattgcggtatccatggccaacatttttaggggtagttacctggcaggagcgggccttgcgttttcactgatgaaatccctcgggggaggcagacgaggcacgggcgcgcaaggagaaaccttgggggaaaaatggaaaagacaattaaaccaattatccaagtcagaatttaatacatataaacgtagtggcataatggaagttgacagatctgaagcaagagagggcttaaagaggggcgaaacgacaaagcacgccgtgagccgaggcactgcgaaattaagatggtttgtcgagcgtaacctagtaaagcctgagggtaaagttattgatttaggatgtgggcgggggggttggtcatattattgtgctgggcttaaaaaagtaactgaggttaaaggttataccaaggggggaccaggccatgaagaaccgattccaatggccacttacggctggaacttagtgaaactatactcggggaaggacgtgttttttatacccccagaaaagtgcgacacattgctatgcgatataggggagtcaagtccaaaccccacgatagaagagggcaggacattaagagtcctgaaaatggttgaaccctggctgagaggtaatcaattctgtattaaaatacttaatccgtatatgccttccgtcgttgaaacgctagaacaaatgcaacgtaaacacggaggtatgctagtaagaaatcccttatcgcgcaactcaacacatgaaatgtactgggtcagttgtggcactggaaatattgtgtctgcagtcaacatgacaagtagaatgcttttaaatagatttacgatggcccataggaaacctacgtacgaacgcgacgttgatttgggggcgggaacacggcatgtggctgtggaaccagaagtagcaaacttggacataataggacagcggattgagaacattaagaatgaacataaaagtacgtggcactacgatgaggataacccatacaaaacgtgggcataccacgggtcgtacgaagtaaaaccgtctggaagtgcaagttcaatggttaacggtgtggtaagacttctgacaaaaccttgggatgtcatccctatggttacacagatagctatgactgatacgacaccgtttggtcaacagcgtgtctttaaagaaaaagtagatacacgtacgcctagagctaaacgcggtacggcacaaattatggaggtaaccgctaaatggctatggggatttttgagccgaaataagaagccaagaatttgtacacgtgaggaattcactcggaaagtcagatccaacgctgcaataggtgcagtgtttgtcgacgaaaatcaatggaatagtgcgaaggaggctgtagaagacgaaagattttggaatcttgtacatagagaaagagaacttcacaaacaaggaaagtgcgccacgtgtgtctataatatgatgggtaaacgtgagaaaaagctcggagaatttggaaaagctaaagggtcacgtgcaatatggtacatgtggctgggagctagatttctggaattcgaggcgctaggatttatgaacgaagaccactggttttcaagagagaattctttctctggagtagagggagaaggtttgcacaaactaggttatatcttacgtgacatatccaagattccaggtggaaatatgtacgctgacgatactgcgggatgggatacacgaatcactgaggatgatttgcagaacgaagcaaaaatcaccgatattatggagcctgaacacgctctactggcaacctcgatatttaaacttacatatcagaacaaagttgtacgtgtacagagaccagcaaaaaatggaacagtgatggatgtaattagccgtcgtgatcagcgaggaagtggacaagtcggaacctatggactaaacacatttactaatatggaagttcaattaatcaggcaaatggaatctgaaggtatatttcttccgagtgagctggaaactccaaatttagcggaacgggtgttagattggttagaaaaacacggaactgaaagactcaaaaggatggcgataagcggcgatgattgcgtagtaaaaccggtggacgagcgtttcgcaacagccctgattgcacttaatgatatggggaaagttagaaaagatatccctcagtgggaaccttccaaaggatggaatgactggcaacaggtcccattctgcagtcaccattttcatcaactcataatgaaggatggacgtgaaatagtcgtaccgtgtagaaaccaggatgaacttgttggtagagcacgtgtcagtcaaggcgcaggatggagtctaagggaaacagcatgcttaggtaaaagttatgcccagatgtggcagctaatgtattttcatcgtagggatcttagattggcagctaacgcaatctgttcggcagtaccagttgattgggtaccaacgtcacgtactacatggtcgatccacgctcatcatcaatggatgacaacagaggacatgctatctgtttggaaccgggtttggattgaagaaaacccatggatggaagacaaaacacatgtatcaagttgggaggaagtaccttatttaggaaaacgagaagatcagtggtgtggttctttaattgggttaacagccagggccacatgggcgaccaatatccaagtagcaataaatcaagtacgcaggctcattggaaatgaaaattatctagattatatgacaagcatgaaaaggttcaagaatgaatcagacccagagggagcgttgtggtaa

SEQ ID NO: 21373 - RNA, 9879 nt, synthetic construct
  misc_feature 1..9879: note = derived and/or modified CDS sequence (opt6) from DENV-1__FJ390378__SS-prME
  source 1..9879: mol_type = other RNA
tcagtgacaatgttactcatgttgctacccactgcactagctttccatctcacaacaagaggaggagaacctcacatgatcgtatccaaacaagaaaggggtaaatctctactattcaaaacatcagcaggaatcaatatgtgtactttaatagcaatggatctaggtgaactgtgtgaagacactatgacatataaatgtccaagaataaccgaagccgaaccagatgatgttgactgctggtgtaatgctactgatacgtgggtaacatatggcacgtgttcacagacaggcgaacatcgacgtgacaaacgttctgttgcattagcaccgcatgttggactaggtttggaaacgagaacagaaacgtggatgtcttctgaaggagcatggaaacaaatccaaaaagttgaaacctgggcattaagacatcctggatttaccgtaacagcactatttttagcgcatgccattggcacatcaataacccagaaaggcataatatttatactattgatgctagttacaccgagtatggcaatgaggtgcgtaggaatcgggaatagagattttgtggaaggactatcaggcgcaacatgggtagacgtagtattggaacatggttcatgtgttactacaatggcgaaagacaaacccacgctagatatcgaattactcaaaacagaagtcacgaaccctgcagtcctgaggaaactgtgtattgaagccaaaatatccaataccaccaccgattcacgatgcccaacgcaaggagaagccactttagtagaagaacaagattctaattttgtgtgtaggagaacattcgttgaccgcggttggggaaacggatgcgggttatttggaaaagggtcactgttaacgtgtgctaaatttaaatgtgtaacaaaattagaaggtaaaatagtccaatacgaaaacttgaaatattctgttattgtaacagttcatactggtgaccagcatcaagtaggcaacgaaactacagaacatggaacaatagcaaccattacgcctcaagctcccacttctgaaatacaactcacagattatggggcattaacattggattgttctccacgtaccggattagatttcaacgaaatggtattgcttaccatgaaagaaaaatcctggttagtccacaaacaatggttcctcgatctcccattaccctggacctcgggagcaagtacatcacaagaaacatggaacagacaggatctactcgtaacattcaaaactgctcacgcaaagaaacaagaggtagtagtactaggttcgcaggagggcgcaatgcatacagcattaacaggtgctactgaaattcaaacgtctggcacgactaccatattcgcaggacaccttaaatgtagattaaaaatggacaaactaacgctaaaaggaatgtcatatgtcatgtgcacaggctcatttaaactggaaaaagaagtagcagaaacccaacacggcacagttttagttcaggtaaagtatgaaggcactgatgcaccatgcaaaatacctttctcggctcaagatgaaaaaggagtaacacagaatggaagacttataaccgcaaatccaatagttaccgacaaggaaaaacctgtgaacattgagacggaaccaccttttggagaatcatacattgttgtaggagcgggagagaaggctttgaaattgagttggtttaaaaagggtagctcaattggcaaaatgtttgaagcaactgcgaggggagctaggaggatggcgatacttggagacacagcttgggactttggctcaataggtggcgtgtttacgagtgtaggtaagttggtgcatcaagtatttggggcagcctacggagtactatttagtggtgtttcatggacaatgaagataggaataggcatcttactaacttggcttgggctcaacagtcgatctacctccctctcaatgacatgtattgctgtgggtatggttaccttatacctgggagtcatggtccaagcagactcagggtgtgtaatcaattggaaaggtagggagctcaaatgtggtagtggcattttcgtgaccaacgaggtgcacacctggactgagcaatacaaatttcaagccgactcgcctaaaagattatcagccgctataggaaaggcttgggaagagggtgtatgtggaataagatcagcgacccgcttagaaaacattatgtggaaacaaatatcgaatgagctaaaccatatcctattagaaaatgacatgaaattcacagtagtagtaggagatgcaaacggaatcttagcgcaagggaagaaaatgattaggccacaacccatggaacatcgatatagttggaaatcctggggaaaagcgaagattataggtgcggatatacagaatagtacttttataatcgatgggccagatacacccgaatgtccggatgaccaacgtgcatggaatatatgggaagtagaagattatggctttggtatttttacaacgaacatctggttgaaactaagagactcatacacccaaatgtgtgatcatcgattaatgtctgccgcgattaaagacagtaaggcagtacacgcggacatggggtactggatagagagcgagaagaacgaaacttggaaactcgcgagagcatcatttatcgaagtaaaaacgtgtatctggccaaaaagtcacaccctatggtctaatggggtattggaatcagaaatgattatcccaaaaatttatggagggcccataagccagcacaattatcgaccagggtattttacgcaaacggcaggaccatggcatctaggaaaattagagctcgactttgacctctgtgaaggtaccacagttgtagtcgatgaacactgtggcaacaggggaccgtctctgcgcaccacgacggttactggaaagatcatacatgaatggtgttgtagatcctgcactctaccacctctacgctttagaggtgaagatggttgttggtatggaatggagatacggccagtcaaagaaaaggaagagaacttagtccgttctatggtaagcgcaggttctggcgaggtagattcgttcagcttaggtatactctgtgtctcgataatgattgaagaagttatgaggtcacgctggagcagaaagatgttaatgactggaaccttggctgttttcttattactaataatgggacaactaacctggaatgatctgataaggctttgcataatggtaggtgctaatgcaagcgatcggatgggcatgggcacgacatatctggcattgatggcaacatttaaaatgcgaccaatgtttgcagttggtctcctattcagaagattaacctcacgagaagtattattacttaccatcggattaagcctagtagcttcagtagaattacctaatagccttgaagaactaggagatggtttggccatgggtataatgatgttaaaattgctgaccgagttccagcctcaccaattgtggactacattattatcccttacattcattaaaacaacactgtcacttgattatgcatggaggacaatggctatggtcctatcaatagtttcactgttcccgttatgtttaagtacgacatctcaaaagaccacatggttgccagttttattaggatcattcggatgcaagccattaacgatgtttttaataacagaaaacaagatatggggaaggaaaagttggccacttaatgaaggaattatggcgattggtattgtatctatcctactaagttcacttctcaaaaacgacgtcccattagccggaccactcatagcgggcggcatgctcatagcttgttatgtgatatcggggagttcagctgacctaagtttagaaaaagcggctgaagtatcttgggaagaggaagcggaacatagtggaacatcgcataacattttagttgaggtacaagatgacgggactatgaaaataaaggatgaggaacgggatgatacccttactatactgctgaaagctactctcttagccgtaagcggagtatatccaatgtcaataccagcaacactttttgtatggtacttttggcagaagaagaaacaacgatcaggagttctatgggataccccgtctccgcctgaagttgagcgcgcagtattggacgatggcatataccggatacttcaaagaggattactaggtcgaagtcaagttggagttggagtatttcaagatggagtatttcacactatgtggcacgtaactagaggagccgttcttatgtatcagggtaaaagactagaaccaagctgggcgagcgtcaagaaagatttaatttcgtatggaggtggttggaggttccaagggagttggaacacaggggaagaagttcaagttatcgcagtagaacccgggaaaaatcccaagaatgtacaaactacacccggcacctttaagactccagaaggagaagtcggagctatagccttagatttcaaacctggtacgtcggggtctccgattgtaaatcgagagggaaaaattgtgggactatacgggaacggagtagtgactacaagtggtacatatgtaagcgccattgcgcaggccaagacttcccaagaaggacccctaccagaaattgaagaagaagtcttcaagaaaagaaatctaacgataatggacttacatccaggaagtggtaagacacggagatacctaccagcaattgtaagagaggccatcaaacgtaaactccgtaccctaatcttagcaccaactcgggtagttgcttctgagatggcagaagcccttaagggaatgccaattcgctaccaaacgactgccgttaaaagcgagcataccgggcgagaaatcgtagacttaatgtgccatgccacatttaccatgaggttattatcacctgtacgtgtgccgaattataacatgataattatggatgaggcacactttaccgatccagcgagcatcgcagctcgtgggtatatttctacacgcgtcggcatgggagaagcagctgccatatttatgactgccacacctccgggcagcgtagaggcttttcctcaatccaacgctgttatacaagatgaagaaagagacattcctgagagaagttggaacagtggatacgattggatcactgactttccagggaagacagtatggtttgtaccttcaataaaaagtggaaatgatatagccaattgccttcgtaagaacgggaagcgcgttatccaactatctcggaaaactttcgacacagagtaccagaaaactagaaataatgactgggactatgtagttacaacagatatctctgaaatgggtgccaattttcgagcagacagagtgatcgatccccgtagatgtctaaaaccagtaattctcaaggatggccccgaacgggttatcctagcaggacctatgcctgttacggtggcctcggcagcacaaagaagagggagaataggaagaaaccaaaacaaagaaggcgaccaatacgtatatatggggcaaccgctgaacaacgacgaagatcacgcccactggacagaggcaaaaatgctcttagacaatattaatactccggaaggaataatcccagctcttttcgagccagagcgcgaaaaatcagcagcaatagatggcgagtacagacttcgaggtgaggcgcgtaaaacttttgttgaattaatgagaagaggtgacctaccagtgtggcttagttataaggttgcttcagaaggatttcaatattcggacaggagatggtgctttgatggtgagcgaaataaccaagtacttgaagaaaatatggatgttgagatctggactaaagagggtgaacgtaagaaactgagaccaaggtggttagatgcaagaacctactcagacccactagcacttagggagttcaaggaatttgcagcagggcgaagaagtgtttcgggagatttaattctagaaattgggaaattaccgcaacacctcacacttagagctcaaaatgctttagataatctagttatgttacacaatagtgaacaaggtggaaaagcatacagacatgcaatggaggaactgcccgatacgatcgagaccttaatgttacttgcgctaatagccgtgctgacaggtggagtaaccctgttcttcttatcaggaaaaggtctaggtaaaaccagtattggtttactatgtgtcatggcttcttcagcgctcttgtggatggcaaacgtggaaccgcattggattgccgcgtcaatcattcttgagttctttctaatggtgctactaatacctgagccagatagacaaagaacgccacaagacaaccaactagcttacgtggtgatcggactattgtttatgattctaacggtagcagcaaatgaaatgggactactagaaacaacaaagaaagacctaggaattggttatgttgctgcagaaaaccaacaccatgctacaatgttggatgtggacttgagacctgcaagtgcatggaccctctacgccgttgctacaacggtgatcacacctatgatgaggcacacaatagaaaatactacggcaaacataagcctgacagccatagccaatcaagctgccatactgatggggttagataaaggatggcctattagcaaaatggatattggtgttcctctacttgctctgggatgttactctcaagtaaatcctctaactttgactgcagctgtattaatgttagtagcccattatgctataattgggcctggtttacaagccaaagcgacaagagaggcgcagaaacggactgctgccggaatcatgaagaaccccacagtcgatgggatagtcgcgattgatttggatccagtagtttacgacgctaaatttgaaaagcaattaggtcaaattatgcttctaatcctttgtaccagtcaaattttactcatgagaacgacatgggcactttgcgaaagtatcacactcgctactgggcccttaaccacattgtgggaaggatctccagggaaattttggaatacaactattgcagtatcaatggctaacattttcagaggtagctacttagctggagcagggttagctttcagtcttatgaaaagcctaggtggaggcagacgaggtaccggtgctcaaggagaaaccttgggagagaaatggaaacgtcaattaaaccaactttccaagtcggagtttaatacctataaacgtagtggaataatggaagtcgatcgtagtgaagccaaagagggcttgaaacgaggcgaaacgaccaaacacgccgtttcacggggaacggctaaattgcggtggttcgtagaaagaaatttagtgaaaccagaaggaaaagtgatagaccttggatgtggcagaggaggttggagttattattgtgcgggactaaagaaagttacagaagttaaagggtacactaaaggagggcctggtcatgaagaaccgattccaatggcaacatatggatggaatttagtgaaattatactctggtaaagacgttttctttacaccaccagagaaatgtgacacactattatgcgatatcggagagtcaagcccaaacccaacaattgaagaaggtagaactcttcgagtattaaagatggtagaaccatggcttagaggaaaccaattctgcatcaaaatattgaatccctatatgcctagcgttgtcgaaactctagaacaaatgcaaagaaaacacggtggaatgttagtgcgaaatcccctttcccgtaattcaactcacgaaatgtattgggtcagttgtggaacaggaaatatcgtaagtgccgtaaacatgacctcccgtatgctcctaaataggttcacgatgacgcaccgaaagccgacatatgagcgtgacgtagatttaggggcaggaacaagacatgtagcagtggagccagaagtcgcaaatctagatataattgggcaacgaattgaaaatattaaaaatgaacataaatcgacatggcattatgatgaagataatccatacaaaacttgggcttatcatggtagctatgaagttaaaccaagcggatctgcttcatcgatggtaaatggtgtagttcgactactaacaaaaccttgggatgtaataccgatggtaacgcaaatagcaatgacagatactacaccctttggccaacagagggtcttcaaagagaaggtagacactcgaactccgcgtgcgaaacgtggtactgcacaaatcatggaagtaacagcaaaatggttatggggctttctctccagaaataagaaaccacgcatctgcactagagaggagttcactagaaaagtaaggtcaaacgctgcgataggtgcggtttttgtagatgaaaatcaatggaactcagcaaaggaagcggttgaagatgaaagattctgggatttagtacatagagaaagagagttacacaaacaaggaaaatgtgcaacatgtgtgtacaacatgatggggaaacgagaaaagaaacttggagagtttggtaaggcaaagggatcaagagcgatatggtacatgtggctcggtgcaagattcttagagttcgaagccttgggatttatgaatgaagaccactggttctcacgagagaacagttttagcggtgtcgagggagaaggtcttcacaaacttgggtacatactgcgagatatttctaaaattccaggtggcaatatgtatgcagatgataccgcaggatgggacacacgtattactgaggatgacttacaaaatgaagcaaaaataacagatataatggaaccggaacacgctctattagcaacttcaatatttaaactcacatatcaaaataaagttgtccgagtacaaagacccgctaaaaatggtacagtaatggatgtaatttcgaggagagaccaacgcggaagtggtcaagtaggaacttacggattaaacacctttacgaatatggaagttcaacttatacgacagatggagtctgaaggaatctttctaccatcagaattagaaacacccaatcttgcagaaagagttttaaactggctcgagaagcatgggaccgaacggttaaaacgcatggcaataagcggggatgattgcgtggttaaacccgtagatgacagatttgctactgcattgatagcgttaaatgatatgggaaaagtcagaaaggatattccacaatgggaacccagcaagggatggaatgattggcaacaagttccattttgctcgcatcatttccatcaattaatcatgaaagacggtcgggaaatagtagtcccatgtagaaatcaagatgagcttgttggacgagcacgagtaagtcaaggcgccggctggtccttgagggaaacagcttgtcttggtaaatcgtatgcgcaaatgtggcaacttatgtactttcatcgaagggatttgcgattggcagctaatgcgatttgttcggcagtcccggttgattgggtacctacgtctagaacaacatggtcaatacacgcacaccaccaatggatgacaactgaagacatgttatcggtgtggaaccgtgtttggatagaagaaaacccgtggatggaagacaaaacgcacgtaagctcgtgggaagaggtaccatatctaggcaaacgcgaagatcaatggtgtggctctctgataggacttactgcccgcgctacctgggcaacgaatatacaagttgcaatcaatcaggtgcgacggctaataggtaatgaaaattacctagattatatgacgtcaatgaaacgatttaagaatgaatcagatccagaaggagctctctggtaa

SEQ ID NO: 21374 - RNA, 9879 nt, synthetic construct
  misc_feature 1..9879: note = derived and/or modified CDS sequence (opt6) from DENV-1__FJ205872__SS-prME
  source 1..9879: mol_type = other RNA
agtgtgactatgctactaatgctacttcctactgctttagcgtttcacttgacaacaagaggtggagaaccccacatgattgtctctaaacaagaaagaggaaagagcttattatttaaaacgagcgcgggaattaatatgtgtactctaatagcaatggatctaggtgaactgtgtgaagacactatgacatataaatgtccaaggatcacagaagcagagccggacgacgtcgactgctggtgtaacgctacggatacatgggtaacgtatggaacttgctcgcagactggtgaacatagacgagataaaagatcggtagctcttgctccccatgttggactaggattagagactagaacagagacctggatgtcgtcagaaggagcatggaaacaaattcaaaaagtcgaaacctgggcactccgacatcctggctttactgtcactgctttctttcttgctcatgcaataggaacttcgataacacaaaaaggaataattttcattctgctcatgttagtaacacccagcatggcgatgagatgtgtgggcataggtaatagagactttgttgaagggttatcgggagcgacatgggtagacgtagttctagagcatggtagttgtgtaactacaatggcaaaagacaaacccaccttagacattgaactactgaaaacggaagtaactaatccagcagtattacgtaaattatgcatagaagcgaaaatatcaaatactacaacagacagccgatgcccaacacaaggagaggcaactcttgttgaggaacaagacagtaactttgtatgtaggcgcactttcgtagatcgcgggtggggtaatggatgcggattatttggtaaaggttctttactcacatgcgcaaaattcaaatgtgtgacaaaactagagggtaaaatcgttcaatatgaaaacttaaaatactcggtaattgtgacagtccatactggtgaccaacatcaagtaggaaatgaaactacagagcacggaactattgcaacaataaccccgcaagcacccacttctgaaatacaactgactgattatggcgctctgacactggattgctcgccacgaacgggcttagattttaatgaaatggtgttactaacaatgaaagaaaaatcatggctcgtacataaacaatggtttcttgatctaccgcttccttggacttccggtgcttctacttcacaggagacatggaatcgtcaagacctacttgttactttcaaaacagcacacgcgaagaaacaagaagtcgttgtgcttggttcgcaagaaggagcaatgcatacagcattaactggtgcaacggaaatccaaacctcaggtacaaccacaatatttgctggccacttaaaatgcaggttaaaaatggataaactaactctcaaaggtatgtcctacgtcatgtgtacgggatcatttaaacttgagaaagaagttgccgaaacacaacacggaacagtattagttcaggtaaaatacgagggaactgacgccccttgtaaaatccctttctctgctcaagatgaaaaaggagtgacccaaaatggtagactaatcacggcaaaccctatagttaccgacaaagaaaaaccagtcaacattgagactgaacccccatttggggaatcctacatagtcgtaggcgcaggggaaaaagcgctaaaattatcatggtttaagaaaggatcatctatcggcaaaatgtttgaggcaacggcgaggggtgctaggagaatggcgatactcggagacacggcatgggactttggtagtataggaggggtatttacctcagtagggaaactcgtacatcaggtatttggtgcggcttatggcgtgctatttagcggggtttcttggactatgaaaattggaattggaattttattgacatggcttggactgaatagccgctcgaccagtctaagtatgacctgtattgcagtcggtatggttactctatatctcggagtgatggtacaggccgatagtggctgtgtaataaattggaaaggaagggaactgaaatgtggctcaggaatcttcgtcacgaacgaagtacacacttggacagaacaatacaaatttcaagcagattcgccaaaacgtttatccgcagccatcggtaaagcatgggaagagggggtgtgcggaatacgctcagctacaaggcttgaaaacataatgtggaaacaaatatctaacgaattgaatcatatattattggaaaacgatatgaaattcacagttgtagtcggggatgcaaacggtattctggcccaaggaaagaagatgatacgacctcaaccaatggaacacagatactcatggaaatcgtggggaaaagcgaaaataatcggggcagacattcaaaattcaaccttcatcatagacggcccagacacacctgaatgtccagacgaccaacgggcgtggaatatatgggaagtagaagactatggattcgggattttcaccacgaacatttggctgaaactgcgagattcatacactcaaatgtgcgatcacaggctgatgagtgccgcaataaaagactctaaagctgtccatgccgatatgggatactggatagaaagcgagaaaaatgagacgtggaaactggcaagagcgtcgtttattgaggtgaaaacatgtatatggccaaaaagtcacacattatggagcaacggagttttagaaagtgagatgatcataccgaagatatatggcggtccaatatctcagcataattacagaccgggatattttacacaaactgctggaccatggcacttgggaaagctagaactagacttcgacctatgcgaaggtaccacagtagttgttgatgaacactgcggtaaccgaggaccatctctacgaacaactacggtcactggaaagattattcatgagtggtgttgccggagttgcaccttgccgccattacggtttagaggtgaggacggttgctggtatggaatggaaatacgaccagtcaaagagaaggaggaaaatttagtacgttcaatggtttcagcaggatcgggagaagtggattcgttctcactagggatcctatgtgtgagcataatgatagaagaagtaatgaggtcgaggtggtcccggaaaatgctaatgactggcactctagctgttttcttattactaatcatgggtcaacttacttggaacgatttaataagattatgtattatggtgggtgctaatgcatcagatcggatggggatgggcacaacttatttagctcttatggctacatttaagatgagaccaatgttcgccgtaggccttttattcaggcgtttaacaagtagggaggtgctattactaactattggcttgagtcttgtcgcgagtgttgagcttccaaatagccttgaggaactaggagatggtcttgccatgggaattatgatgttaaaattgttaaccgagttccaaccacaccagctttggaccacattactatcattgacctttatcaaaacaacacttagtcttgattacgcatggaggacaatggctatggttctatcaatagtgtcattgttcccattatgtcttagtactacgtcgcagaaaactacttggctcccggttctgcttggatcattcgggtgcaaaccgctgactatgttcttgatcactgaaaataagatatggggaagaaaaagttggccattaaacgaaggtataatggcaatcggaatagtctcaatcttacttagttcgctactcaaaaacgatgttcctttagcgggtcctttaatagcagggggtatgttaatcgcatgctacgtgatctctgggagctcggctgatctttccttggagaaagcagctgaagtgagttgggaagaagaggcagaacattctgggacatcacacaatattctagtggaggttcaagacgatggaaccatgaaaataaaagatgaagaacgggatgataccctaacgattctacttaaggcaacactattagcagtaagcggcgtatatccaatgtcgatacccgccaccttgtttgtgtggtacttttggcaaaagaagaaacagagatcaggggtgctatgggatactcctagccctcctgaagttgaacgagctgtcctagacgatggcatttacagaattttacagcgaggactccttgggagatcacaggttggggttggagtctttcaggacggtgtgttccatactatgtggcacgttacgagaggggctgtccttatgtaccaaggcaagagattagagcccagttgggcgtctgtcaagaaagacctaataagttacggaggaggttggagatttcaaggaagctggaatacaggagaagaagtccaagtaattgcggtggaacctggcaaaaatcccaagaatgttcaaactacacctggaacattcaagacacccgagggagaagtcggggcaatagccttagactttaaaccaggtacaagtggttcacccatagtgaaccgagaaggcaaaattgtaggattatacggcaatggagttgtcactactagcggaacctatgtatccgcaatagcacaagcaaagacaagtcaggaagggccgttacccgagatagaggaggaagttttcaagaagcgaaacttaaccataatggatttacatccgggtagtggtaaaactcgaaggtacttacctgccatagtcagggaagcgattaaaaggaagttgcgtaccctaatccttgcaccaaccagagtagtagcttcggaaatggcggaagctcttaaaggaatgccgattcgatatcagactacagcagtaaaatctgaacacactgggcgcgaaatcgttgatctaatgtgtcatgccacatttactatgaggttgctatccccggttcgagtcccaaattataacatgataattatggatgaagcccattttacggaccccgcaagtattgcggctcgtgggtatattagtacaagagtcggaatgggggaagcagcagcaatattcatgacagctacaccaccagggtctgttgaagcattccctcaaagtaacgctgtaatacaagacgaggaacgagacataccggaacgctcttggaacagcggatatgactggataacagatttcccagggaaaacagtttggtttgtcccaagtataaaatcggggaatgatatagccaattgtctacgcaagaatgggaaacgcgttatacagctatcacgaaagacatttgatacagaatatcagaaaacgaggaataatgattgggattacgtggttacaaccgacataagcgaaatgggagccaactttagggcagatagagtcatagatccaaggcgatgtcttaaacctgtaatcctcaaggatggacctgaacgagtaatactggcaggtcccatgcctgtaaccgtagcctctgccgcacaacgcagaggtcgtataggcagaaaccaaaacaaggaaggagatcaatacgtctacatgggacagccacttaacaatgacgaagatcatgctcattggacagaagcaaaaatgctactagataacattaatacgcctgaaggaataatccctgcgttatttgaacccgaaagagaaaagtctgctgcaattgacggggaatatagactaagaggtgaagcacgaaagacatttgtagaactcatgcgtcgaggtgacttacccgtatggcttagttataaagttgctagtgagggcttccaatattccgacagacgctggtgttttgatggagaaagaaataatcaagtcctagaggaaaacatggacgttgaaatttggactaaagaaggagaacgtaagaaattaagacccaggtggttagatgcaaggacctattcagatcctctagctttaagagaatttaaggagttcgcagccggaagaagatcagtttcaggcgacctcatactagaaataggtaagttgcctcagcaccttacattacgggctcagaatgccctagataacttagtcatgttgcacaattcagaacaaggtggaaaggcatacagacacgccatggaagaattacctgatacaatcgaaacattgatgcttctagcgctcatagcagctttgaccggcggcgtgacactgtttttcttgagtggaaagggactgggaaaaacctcaattggattgctctgtgtaatggcttcatcagcgttattatggatggctaatgttgagcctcactggattgcagcgtcaattatattagagttctttttaatggtacttttaataccggaaccagacagacagaggaccccacaagacaaccaattggcttatgtagttataggccttctcttcatgattttaacggttgcggcgaacgaaatgggactacttgagacgactaagaaagatctcggcataggatacgtagcggcggaaaatcagcaccacgccaccatgcttgatgtagatttgaggccggcatcagcctggacgttatatgctgtggctacaacagtaataactccgatgatgcgccacacaatagaaaacacaaccgcaaacatatcgttaacagcgatagctaaccaggcagctatacttatgggtttagacaaaggttggcccattagcaaaatggatataggggttccattactagcattagggtgctatagccaagtaaacccattaacactaaccgcagccgtgttaatgttggttgcacattacgctattattggaccgggtttacaagcaaaagcgactcgagaagcacaaaagcgtacagcagctggtataatgaaaaaccctacagtcgatggaattgtggcaattgatctagatcctgtagtctacgacgcaaagtttgagaagcaattaggtcaaataatgctattaatactgtgcacttctcaaatcttgctaatgagaactacgtgggcgctatgcgaaagcataaccttagccactgggcctttaactacactgtgggaaggatccccggggaaattttggaacacaactatcgcagtatctatggcgaacatatttagaggatcttacctggccggtgcgggactggccttctcgctgatgaaaagtttaggaggtgggagaagaggtacaggagcccaaggtgaaacactgggggaaaaatggaaaagacagctgaatcaactaagcaaatctgaatttaacacttataaaagaagtgggataatggaagtggataggtccgaagcaaaagaaggactgaagcggggagaaacaacaaagcacgcagtgtcacgagggacagcgaagttacgttggtttgtagaaaggaatttagttaaacctgaaggaaaggtgatagatttaggatgtggtagaggaggatggagttattattgtgctggcctcaagaaagtaaccgaagtaaaagggtatacaaagggaggtccgggtcacgaagaaccaataccaatggcgacatacgggtggaatctcgttaaactctactctggcaaagatgtcttctttacaccaccagagaagtgtgatactttgctatgcgacattggagaaagttcaccaaatccaacaatcgaagaagggcgtactctgagagtactgaaaatggtcgaaccgtggttacgagggaaccagttttgcatcaaaattctgaatccatacatgccgagtgtagtagaaacgcttgagcaaatgcagcgaaaacacggaggaatgttagtgagaaatcctttgtccagaaatagtacacatgaaatgtattgggtgagttgcggtactggtaacattgttagtgctgtgaacatgacaagtaggatgttacttaatcgattcacaatgacccaccgcaaacccacttatgagagagatgtcgatctaggcgcgggaacaagacacgtagcagtagagccagaagtagcgaacctcgatatcataggacaaagaatagagaatataaagaacgaacataaatctacatggcactatgacgaggataatccatataaaacgtgggcctatcatggatcatacgaagtaaagccgtcaggaagtgcaagtagtatggttaacggagttgtccggctccttaccaaaccatgggatgtcattcctatggtaacacagatagcaatgacggatacaacaccgttcggacaacaaagagtgtttaaggagaaggtagacacacggactccaagagccaaacgcggaacagcgcaaataatggaagtaactgcaaaatggttgtggggttttctttcaaggaacaagaaaccacgaatatgcacccgggaggaatttacacgcaaagtcaggagtaatgcagctataggagcagtattcgtagacgagaaccaatggaatagcgctaaagaagcagtagaagatgaaagattctgggacttagtgcaccgagaacgagaattacacaaacaaggaaaatgtgccacttgtgtgtacaatatgatgggtaagagagagaagaaacttggagaatttggtaaagcgaagggatcgagagcaatctggtatatgtggttaggggctaggttcctcgaatttgaagcgctaggatttatgaatgaagatcactggtttagtcgtgaaaattctttttcaggagtcgagggagaagggctgcacaaattagggtatattttacgcgatatatcaaaaattcctgggggcaacatgtatgccgatgatacagctggatgggatacccgtataactgaggacgatcttcaaaatgaagcaaaaataacagatataatggaaccagaacatgcattgctagcaacgagtatatttaagttgacataccaaaataaagtggtccgggtgcaacggccagctaagaacggcacagtcatggacgtgattagtagaagagatcaaaggggaagtggacaagtcgggacgtatggcctcaacacgtttacaaacatggaagtgcaattgataagacaaatggaatcagaaggaatcttcttaccatccgaattagagaccccaaatcttgcagaacgagtgttgaactggctcgagaaacacggaaccgaaagattaaaacgaatggcaattagcggcgatgattgtgttgtaaaaccagtagacgataggtttgcaacagcgttgattgccttaaacgatatgggtaaggtaaggaaagacataccgcagtgggaaccgagtaaaggatggaatgattggcaacaagtacctttctgctcacaccatttccatcaattaataatgaaggatggacgcgagatagtagttccttgtagaaatcaagacgaattagttggcagagctagggtcagtcaaggggccggatggtcgcttagggaaacggcgtgtttaggaaagagttatgcgcaaatgtggcaattgatgtactttcataggagggatctaagattagcagctaacgcaatatgttcagcagtcccagtagattgggtcccgacctcaaggacgacgtggagtattcatgcacaccaccaatggatgaccactgaagatatgttaagcgtatggaacagagtttggatcgaagaaaacccgtggatggaagacaaaacacatgtcagtagctgggaggaagtaccatatttgggaaaacgcgaggatcagtggtgcggcagtttaattggacttacagcaagagctacgtgggcaacgaatatccaagttgccataaaccaagtaaggaggttaataggcaatgagaattacctagattatatgacaagtatgaagagattcaaaaatgaatcagatccagaaggcgctctttggtag

SEQ ID NO: 21375 - RNA, 9879 nt, synthetic construct
  misc_feature 1..9879: note = derived and/or modified CDS sequence (opt6) from DENV-1__FJ205873__SS-prME
  source 1..9879: mol_type = other RNA
tcggttactatgcttcttatgttgctcccaacagcattagcattccatctcacaactcgaggcggggaaccgcatatgattgtaagtaaacaagagcgagggaaatcgctattgtttaaaacgtcggctgggataaatatgtgtacactcatcgcgatggatttaggtgaattgtgcgaagatacaatgacatacaaatgtccacgaataactgaagcggagcctgatgatgtagattgctggtgtaatgcaacagatacttgggtgacatatgggacatgtagccaaacgggggagcatagacgtgataaaagaagtgtagcgctggctcctcatgtaggacttggattggaaacgagaacagaaacctggatgtcaagtgaaggagcatggaaacaaatacaaaaagtggagacgtgggctttaagacacccaggatttacagtaacagcactattcttggcgcatgccattggcaccagtattacccaaaaaggtatcatattcattttgttaatgctggtgactcctagcatggcaatgcgatgcgtcggcataggcaatcgagattttgttgaagggctaagtggtgccacatgggttgatgtagttctagaacacggatcttgcgtcacaacgatggcaaaagacaaaccaactctcgatatagaactactgaaaactgaggtcacgaatcctgctgtattaagaaaactctgcatcgaagcgaaaatatctaacacaacaacagatagtaggtgccccacacaaggcgaggcaacactcgtcgaggaacaggacagtaactttgtgtgtcgaaggactttcgtagataggggctggggcaacggatgcgggctttttggaaaaggatcgctcctaacttgtgcaaaatttaaatgcgtaacaaaattagaaggcaaaatcgttcaatatgaaaatcttaaatatagcgttatagttacagtccacactggggaccaacaccaggtagggaatgaaaccacggagcatggaaccatagcaaccataaccccacaagcacctacatccgaaatacagttaactgattacggtgcactcacactagattgttcgccaagaacaggccttgactttaatgagatggtattactaacgatgaaagagaaaagttggttagtgcacaaacaatggttccttgatctaccattaccatggacatcaggcgcgtccacgtcacaagaaacctggaacagacaagatttattagttacttttaaaaccgcgcacgccaagaaacaagaggtagtagtcttaggcagtcaggaaggggcaatgcatacagcactaacaggtgcaaccgagattcagacgtcagggactacaacaatattcgccggacatctaaaatgccgtttgaaaatggacaaactgacactaaaaggcatgtcttatgtaatgtgcacagggagcttcaaactagaaaaagaggtagcagaaactcagcatgggacggtcttagtacaagtcaaatacgaagggacagatgctccatgcaaaattccattctcagcgcaagacgaaaaaggagttactcaaaacggtcgactaattacggctaaccctatcgttaccgataaagaaaaaccagtgaatatagaaacagaaccaccttttggggagagttatatagtcgtaggggccggtgaaaaagcgctgaaattgtcgtggttcaagaagggttcatccataggtaaaatgtttgaagcaacagctagaggcgcaagacgtatggcaatactaggggacacagcatgggattttggaagcattgggggagtgttcacctcagtaggaaaacttgtgcatcaagtctttggggctgcatatggtgttttattttcaggggtgtcttggacgatgaaaattggaataggaatacttctcacatggctgggactaaattccaggagtacatcattatcaatgacatgtattgccgtaggaatggtaacgctatacttaggtgtcatggtccaagcagactcaggttgcgttataaattggaaaggtagagaattaaaatgcggatcaggcatatttgtaacaaatgaagttcatacttggacagagcaatacaaatttcaagcagattcgccaaaacggctaagtgcagctatcggcaaggcatgggaggaaggagtatgcggaatacgaagtgctacacgattagagaacataatgtggaagcaaataagcaatgaactaaatcacatccttttagaaaatgatatgaaatttacagtggttgtaggtgacgcaaatggaatattagcacaaggtaagaaaatgattaggccccaacctatggagcacaggtactcatggaaaagttgggggaaggctaaaattattggtgccgacatccaaaattcaaccttcataattgacggtccagataccccagaatgtcccgacgatcagagagcatggaatatctgggaagtcgaagactatggattcggaatatttactacaaacatttggctaaagttacgcgactcttatactcaaatgtgtgaccatcgactgatgagtgctgcgataaaagactcaaaggcagtccatgcagacatgggatattggatagaatctgagaaaaatgaaacatggaaacttgccagagcttcatttattgaagtaaagacttgtatatggccaaaaagccatactctatggtcaaatggagtattggaatccgagatgatcataccaaaaatctacggaggacctataagtcagcataactacagacccggatattttacacagaccgcgggtccttggcacctgggaaaattggagttagatttcgatctatgtgaaggcaccacagttgtggtagacgaacactgtggcaatagaggcccctctctacggacgacaactgtcacaggtaaaattatacatgaatggtgctgtagaagttgtactttaccgccgttgcggttccgtggcgaggatggatgttggtacggaatggaaatacgccccgtcaaagaaaaagaggagaacttagttagatccatggtatcagcaggatcgggagaagtagattctttcagtctaggtatattgtgtgtcagtattatgatagaagaagttatgagaagccgttggtcccgaaaaatgttgatgactggaactttagcagtttttctcttattaattatggggcagctaacttggaatgatttaattcgcctctgtatcatggtaggagcaaatgccagtgatagaatggggatgggaacaacatacttagcactcatggcaactttcaaaatgaggccaatgtttgctgtaggtctgctatttaggaaactaacgtctagagaagttctcttactaacaatagggttgtctctagtagctagcgttgagttaccaaattccctagaagaactgggagatggacttgcaatgggtattatgatgctgaagttattgacggaatttcaacctcatcaactatggacaacactactttccctaacattcataaaaactactttgtcgttggactatgcatggcgcacaatggcaatggtactctcaatagttagcctattcccactttgtttatcaacaacatctcagaaaactacgtggttgcctgttttgttaggatcttttggatgtaaacctcttaccatgtttttgatcacagaaaacaaaatctggggaaggaaatcgtggccccttaatgagggtattatggctatcggtattgtttccattttactttccagcctacttaaaaatgatgtaccactggcaggaccattaattgccggaggaatgctgatagcttgctacgtcatttctggatcaagcgctgatctaagtttggaaaaagccgctgaagtgtcatgggaagaagaagctgaacactcaggaacatctcataatatattggttgaggtgcaggacgatggaactatgaaaatcaaagatgaggaacgagatgacacattaactatattactgaaggcaacactattagcggttagcggagtttacccaatgtctatccccgccactctctttgtatggtatttttggcagaagaagaaacaacggtccggtgtcctttgggataccccatctcctcctgaagtggaaagagcagtactggatgatggtatatataggatattgcaacggggactattaggtcgctcacaagttggagtaggagtatttcaagacggggtttttcacacaatgtggcatgtcacacgaggagcggtgttaatgtatcagggaaaacgactggaaccgtcatgggcatctgtgaagaaagatttaatcagttatggtggaggatggaggtttcagggtagctggaatacaggtgaagaggtacaagttatagcggtagaaccaggtaaaaatcccaaaaatgttcagacaacgcctggcacttttaaaacaccagaaggggaagttggagcgatagcactcgattttaaacctggaacaagtggaagtccaatagtaaaccgggagggaaaagtagttggactgtacggtaatggtgtagtgacaactagcggtacctacgttagtgctatagctcaggccaagacatcccaagaaggcccgctgcccgaaatagaagaagaagtctttaagaaacgtaatttaactataatggatcttcaccctggaagtggcaagactcgcagatatcttccagctatcgttagggaagcaataaagcgcaagctgaggactttaatacttgcaccaacaagggttgtagcgtcagagatggccgaggctcttaagggtatgccaatacgatatcaaaccactgcagttaaaagtgaacacactggaagagaaattgtagacctcatgtgccatgctacattcacaatgaggctattaagtccagtacgtgtaccaaactacaacatgatcataatggacgaagctcattttacagatccagcaagtattgctgctagaggttacatctcaaccagagtaggcatgggagaagctgcagcaatatttatgactgcaacaccccctggatctgttgaagcattcccacaaagcaatgctgtgattcaggacgaggaacgggacatacctgaaagaagttggaactcagggtatgactggataacagatttcccaggcaaaacagtatggtttgtgccatcgatcaaatcggggaacgacatagcgaactgcctaaggaaaaatggtaaaagagtgatacagctgagtcgcaaaacgttcgatacagaataccagaaaacaaggaacaacgattgggattacgtagtaaccacagatatctccgaaatgggtgcgaacttccgcgcagatagagtaattgaccctagaagatgtctaaagccagtaatactcaaagatggtcccgaacgagttatcttagcaggcccgatgcccgttaccgtggcttctgcagctcaacgccgaggccgaatcggaagaaaccaaaataaagaaggggaccaatacgtttatatgggtcaaccattgaataatgacgaggatcatgcacattggactgaagcgaagatgctccttgataatataaatacaccagagggtataataccagccctttttgaacctgagcgagaaaaatccgccgcgattgatggagagtacagactaagaggggaagcacgaaaaacctttgtagagctcatgcgtcggggtgatttgcctgtatggttgagctataaggtcgcttcggaaggattccaatatagtgatagaagatggtgttttgacggagaacggaacaaccaagtcctagaagaaaatatggatgtagagatctggactaaagagggggaaagaaagaaactcaggccgagatggcttgatgctcgaacatattccgacccactagcgctgcgagagttcaaagagtttgcggcaggacgacgctcagtatccggcgacttgattttagaaataggcaaattgcctcaacatttaaccctccgagcccaaaatgctttggacaatctggtcatgctacataactcagaacaaggtggtaaagcgtatagacatgcgatggaagaattgccggacacgatagagaccttaatgttactcgctttaatcgccgtacttacaggcggagtcacgttattcttcttgtccggtaaaggtctaggaaaaacaagtataggcttattatgtgtaatggcttcgtcggcattactttggatggcaaacgtagaaccccactggatagctgcgagtatcatccttgaatttttccttatggtcttgctaatacctgaacctgatagacaacgcacaccgcaagataatcagcttgcttatgtagtaattggactactatttatgatactgacagttgcggcaaatgaaatgggccttctagaaacaactaagaaagatttgggaataggacatgtggcggcagaaaatcagcaccacgcgacaatgttggatgtggatttacgtcccgctagtgcatggacactttatgcggttgctacaactgtgattacacccatgatgcgacatacgattgaaaacacaactgcaaacatatcgctgaccgcaatagcgaatcaagcggcaatattgatgggactggataaaggctggccaatttctaagatggatataggcgttccactattagctctaggatgttatagtcaagttaacccattaacacttacagcagcagttcttatgctcgtagcacactatgcaattattgggccaggtttacaagcgaaagctactagagaggcgcaaaaacgaacagccgcaggcatcatgaaaaatcccacggtggatggcattgtagcaatagacttggatccagttgtctatgacgcgaaatttgaaaaacaactcggacaaataatgctccttatactgtgcacaagccaaattctgttaatgagaacgacttgggcgttgtgtgaatcaataacgttagcgacagggccattaacgaccttatgggagggcagccccggtaaattttggaatacgacaatagcggtatccatggcaaatatatttcgcggtagttatttagccggagcaggattggcattttcattaatgaaaagtttaggtggagggagaagaggcacgggagcacaaggtgaaacgttgggagaaaaatggaaacgacagctgaaccaattatccaagtcagagtttaatacatacaaacgtagtggtataatggaggtcgacagatccgaagcgaaggaaggcctaaaaagaggagaaaccacaaaacacgccgtctcgaggggaactgctaagctgagatggtttgtagagcgtaacttagttaagcctgagggaaaagtcattgatctagggtgtgggaggggaggatggtcatactactgtgctggactaaagaaagttacggaagttaaaggatatacaaaaggaggaccggggcatgaggaaccgatcccaatggccacatacggatggaacctagttaaattgtatagtggcaaggatgtgttctttactccgcccgaaaaatgtgatacgttactatgtgatatcggagaatcatctccaaatccgacaatcgaagaaggtagaacattaagggttttaaaaatggtggagccttggctcagaggcaatcaattctgtattaaaatacttaacccatatatgccctctgtcgtggaaacgttagaacaaatgcagagaaaacacggaggtatgttagttagaaatcccttgtctagaaattctacgcatgaaatgtattgggtttcatgcgggacaggtaatatagtttccgctgtaaatatgacgagtagaatgttactgaatcgatttactatgactcacagaaagccaacctacgagcgtgatgtagaccttggtgcgggtacacggcatgtagctgtagaaccagaagtagcaaatttagatataatcggtcaacgtatagaaaatatcaaaaatgaacacaaatcaacatggcactatgacgaagacaacccttacaaaacctgggcttaccatgggtcgtatgaagtaaaacctagcggatccgccagctccatggtaaacggagtagtacgtctgcttacgaaaccctgggatgtgattcctatggtcactcaaatagctatgactgacaccacgccatttggtcaacaaagagtatttaaagaaaaagtagacacaagaactcctagagccaaacgaggtacagcacaaattatggaggtaactgcaaaatggctgtggggattcttatctagaaataagaaaccaagaatatgtactagagaagaatttactcggaaagtacgatccaacgctgccataggcgcagttttcgtagatgaaaaccagtggaactcagcaaaggaagccgtagaagacgagaggttctgggacctagttcatagagagcgagagctacacaaacaaggtaaatgcgcgacatgtgtttataatatgatgggtaaaagagagaagaaactcggagaatttggtaaggcaaaaggatcacgtgctatatggtacatgtggttgggggcacgatttctggaatttgaagctctaggttttatgaatgaggatcactggttttctagagaaaactcgtttagtggcgttgaaggtgaaggtcttcataaactggggtacatcttacgtgatatttcgaaaattccaggaggcaatatgtatgcagatgatacagccggttgggatacaagaataacggaagacgatttgcaaaatgaagctaaaataacagatataatggagccagaacatgcgttattagctacaagtatatttaagttaacataccagaacaaagtggtgcgcgtacagcgccccgccaaaaatggtacggtaatggacgtaatatccagaagagatcaaaggggttcaggacaagtaggtacatacggccttaacacatttactaacatggaagtgcaacttataagacaaatggaatctgaaggaatatttctgccatcggagctagaaacacctaatttagcagagcgcgttttaaattggctcgaaaaacacgggaccgagagacttaaaagaatggccataagtggagacgactgtgtagtaaaaccagtcgacgacaggttcgcgaccgctttaatagctctaaacgacatgggaaaagtgcgaaaggatataccacagtgggaacctagcaaaggatggaacgactggcaacaagtacccttttgttctcatcactttcatcaactaataatgaaagacggaagggaaattgtcgtaccatgccgcaatcaagatgaattggtagggcgtgcaagagtatcacaaggcgccggatggtcattaagagagacagcatgcctgggaaaatcatacgcacaaatgtggcaactgatgtacttccaccgtcgtgatctaaggctggcagcgaacgccatatgctctgctgtgcctgtggattgggttccaactagccgtacaacttggagtatacacgctcaccatcaatggatgaccacagaagacatgctatcagtctggaatagagtttggatagaggaaaatccttggatggaagataaaacacatgtttcttcatgggaggaagtaccatatttaggcaaaagggaggatcaatggtgcggaagtttaatcggtctgactgctcgcgctacttgggcaacaaatatccaagtagcaataaatcaagtacgaagattaataggaaacgaaaattatctagactatatgaccagcatgaaaaggtttaaaaatgagtctgatcccgaaggagcactatggtaa

SEQ ID NO: 21376 - RNA, 9879 nt, synthetic construct
  misc_feature 1..9879: note = derived and/or modified CDS sequence (opt6) from DENV-1__FJ390379__SS-prME
  source 1..9879: mol_type = other RNA
tcagtaactatgctattaatgctactccctacggcactggcatttcacttaactactagaggtggcgaacctcacatgattgtaagtaaacaagaacgaggaaaatcgttactattcaaaacttcagcaggaattaacatgtgtactcttattgcaatggatttaggcgaactatgcgaagatactatgacatataaatgtccacgtataacagaagcagaaccggatgacgttgattgctggtgtaatgctacagacacttgggtcacatatggtacatgtagtcaaacgggtgaacatagaagagataaaagaagtgtagctctagcacctcatgtcggactaggcctcgaaactcgcacggaaacatggatgtcatctgaaggggcatggaaacaaatacagaaagtagaaacgtgggctttaagacatccagggtttacggtaaccgcgctattcctagcgcatgctattggaacgagtattacacaaaaaggtattatatttattttattaatgttggtaacacctagtatggccatgcgatgtgttgggataggaaacagagatttcgttgaaggtctatcgggagcaacatgggttgatgtcgttttagaacatggtagttgcgtaacgacgatggcgaaagacaaaccgacactagatatagaactattaaaaacagaagtaacaaatcccgcagtcttgcgcaaactatgcatagaagcaaaaatatccaatacaacaacagactctagatgcccgacgcaaggcgaagccaccctggtagaagaacaagatagtaatttcgtttgcagacgaactttcgtagacaggggatggggcaacgggtgcggactttttggaaaaggaagtttattaacttgtgcaaaatttaaatgcgttactaaactagaaggtaaaattgtacaatatgaaaatctaaaatatagtgttattgtgactgttcacactggagaccagcaccaggtgggcaatgaaaccacagaacatggaaccatagctacaataacaccacaagcccccacgagtgagattcaattaaccgattacggtgctttgacacttgactgcagtcctcgaacaggtctagattttaacgaaatggtacttttgactatgaaggagaaatcttggctggttcataaacagtggttcctggatctccctttaccatggacaagtggagcgtccacttcgcaagagacctggaatcgccaagatttgcttgtgacgtttaagaccgcacacgccaagaaacaagaggttgtcgttctaggcagtcaggaaggggccatgcacactgctctgacgggagcgacggaaatacagacatccggtacaaccacaatatttgcaggacacttaaagtgtcgactgaaaatggataagttaacattaaaaggcatgagctatgtaatgtgcacggggtcatttaagctggaaaaggaagtcgcagaaactcagcacggcactgtactcgtacaggtaaagtatgaagggacagatgcaccttgtaagatacctttctctgctcaagatgaaaaaggagtgacacaaaatggtagattgatcacagccaatcctattgtaaccgacaaagaaaaacccgtaaatatagagacagaaccaccctttggtgagtcatatatagtagtgggagcaggagagaaagcactaaaattgagttggtttaagaaaggaagcagtattggtaaaatgttcgaggcaacagctagaggagcaaggaggatggcgatactaggagacacagcctgggactttggcagcataggaggggttttcacaagtgtaggcaaattggtacaccaagtttttggggccgcatatggcgttctatttagcggagtatcctggactatgaaaattggaataggtatcttattaacgtggttaggtctaaattctagatcaacgtcactgtcgatgacatgcattgcggttgggatggttactctatacttaggagtaatggtacaggctgatagcggatgtgttattaattggaaagggcgcgaattaaagtgtggttcaggtatctttgttactaacgaagttcatacttggaccgaacagtataagtttcaagccgattcaccaaaacgtctttcggcggcaataggaaaagcatgggaagagggtgtatgtggcattcgaagtgcaacaaggctagaaaacatcatgtggaaacaaatttccaacgaactaaaccatatacttcttgaaaatgacatgaagttcactgtggttgttggagatgctaacggtattctagcacaaggtcgaaaaatgatacgtcctcaacccatggaacatcgatacagttggaaaagttggggaaaagctaaaatcattggagcagatatacaaaattcaacattcataatagatggaccagatacacccgaatgtccggatgatcaacgtgcctggaatatctgggaagtagaggattacggatttggcatatttactactaatatctggctaaaattacgcgactcttatactcaaatgtgtgatcacagattaatgagcgccgcaataaaggatagtaaagcagtacatgcagacatgggttattggatcgagagtgagaaaaatgagacctggaaattagcacgtgcatcttttattgaagtgaaaacgtgtatttggccaaaaagtcatacattatggtcgaatggtgttctagagtctgaaatgataatacccaaaatatacggaggaccaatttcccagcataactatcgcccaggatattttactcagacggctggtccatggcatctaggtaaactagaactagattttgacttatgcgagggaacaacagtagtcgtagatgaacattgcggaaaccgaggaccatccctacgaacaaccacagtaacggggaaaatcatccacgaatggtgttgccgtagctgtacattaccaccgttgcggttccgaggtgaagacggatgttggtacggtatggagattaggccagtgaaagaaaaagaagaaaacttggtaaggtccatggtttcagccggctcaggtgaagtagacagtttctccctcggcatattgtgtgttagtattatgatcgaagaagtgatgaggtcccgctggtcacgcaaaatgctaatgacaggaactttagctgtgtttctgctcctaataatgggccaactaacatggaacgatctgatacgcttatgcataatggttggtgccaacgccagcgatagaatgggaatgggcactacttatctggctttaatggcgacatttaaaatgagaccgatgttcgctgtcggactattattcagaagattaacatcacgcgaagtacttctattaacgataggactttcattagttgcctctgtcgagttacccaacagtctagaagaactaggagatggcttagcgatgggaataatgatgctaaaactcctcacggaatttcaaccacatcaattatggacaacactgctcagtctaacgttcataaagacgacattatcgttagattatgcatggagaacaatggcaatggttttaagcatagtgtctttgtttccactctgtctaagtaccacatcacagaaaactacatggcttccggtacttcttggctcgtttggatgtaaaccgttaacaatgtttctgattactgaaaacaagatttggggacgtaagtcttggcccttaaacgaaggtataatggccatagggattgtttcgattttgctatcatctctactgaaaaacgatgtaccgcttgctggtccattaattgccggcggaatgctgatagcttgctatgtcatttcaggatcatcggccgatttatcacttgagaaggcagcagaagtatcttgggaagaagaagcagagcattcaggtacttcacataacatattagtagaagtgcaggatgatggaacgatgaaaattaaagatgaggaacgcgatgataccttgacaatcctactaaaagccacattgctagctatcagtggtgtataccctatgtcgataccagccacattatttgtatggtacttctggcaaaagaaaaagcagagatctggagtactttgggatacaccatctcctcctgaggtcgagagagctgtactagatgacggaatatacaggatcctacaacgtggtctattaggtcgcagtcaagtcggagtgggagtattccaggatggagtttttcacaccatgtggcacgtgacaagaggcgcggtacttatgtatcaagggaaaagacttgaaccgtcatgggcaagtgtcaagaaagatctaataagttacggaggagggtggcgatttcaaggaagttggaatactggagaagaagtacaggtaattgctgttgaacctggtaagaatccgaaaaatgtacaaactactcccgggacgtttaagacccccgaaggggaagtaggggcaattgctctggattttaaacccggaacatcagggtctcctatagtaaatcgtgaaggtaaaatagtgggtttatatggaaacggggtggtaacaacctccggaacctatgtgagtgccattgcacaggcaaaaacgagtcaggaaggtccgttaccggaaattgaagaagaagtgtttaaaaagaggaatctaaccatcatggatctacacccaggctccgggaagaccagaagatacttaccggcaatagtgcgcgaagcaataaaacgaaaactgaggaccttaatattagcgccaacaagggttgtggcctcggaaatggcagaagcactgaaaggtatgcctatacgctaccagacaacagcagtcaaatcagagcatacaggtcgagagatcgtcgacctcatgtgtcatgctacattcacaatgagactcttaagtccagtaagagtccccaattataatatgatcataatggacgaagctcacttcacagatccagcgagcattgcagcaagaggctatatatcaactagagttgggatgggagaagcagcagcgatattcatgacagctacaccccctggctcagtagaggcatttccacagtctaatgctgtgatccaggatgaagaacgagacatacctgaaaggtcttggaatagcggctatgattggataaccgactttcctggtaaaacggtatggttcgtaccatccatcaaaagtggtaatgatatagcaaattgcctaaggaaaaacggaaaacgagttattcaattaagtagaaaaactttcgatacggaataccaaaagacaaggaataacgattgggactatgtagtcacaacagatataagtgagatgggggcaaactttagagcggaccgcgtcattgaccccaggcgatgtctgaaacccgtaatcttgaaggatgggcccgagcgagtcatactggctggccctatgccagtgacggtagcatcagcagcgcaaagaagaggtaggattggacgcaatcaaaataaagagggcgatcaatatgtatatatgggccaaccattgaacaatgatgaagatcatgctcactggactgaagctaaaatgctactagataatattaacacacctgaaggtattatacccgcactttttgaacccgaacgcgaaaagtcagccgctatcgacggcgaatatcgtttgcgaggagaagcaaggaagaccttcgtggaattgatgcgaagaggagatctaccagtatggctcagttacaaagtagcgtccgaaggtttccaatattcggatagaagatggtgttttgatggtgaaagaaataaccaggtattagaagaaaacatggatgtcgaaatatggacaaaagaaggtgaacgcaaaaagttacggcctcgttggctcgatgcgagaacttattcagatccgctcgcattgagagaatttaaagagtttgcggcaggacggaggtctgtatccggagacttgattttagaaatagggaaacttccacaacatcttactcttagggctcagaatgctttggataacctggtaatgcttcacaacagcgaacaaggtggtaaggcttacagacacgcaatggaagagttgccggatacgatcgaaacattaatgctacttgcattgatcgcggtccttactggaggagtaaccttatttttcttaagtggcaaaggcttagggaaaacttctataggactattatgtgtaatggcttcctcggcgcttttatggatggctaacgtagaaccacactggattgcagcctccattattctcgagttctttcttatggtattactaatcccggaaccagatcgtcaaaggacaccccaggataaccaattagcatatgtcgttatcggactactatttatgatactaacagtagcagcgaatgagatgggccttttagaaacaactaagaaagatttaggtattggacacgttgccgccgaaaaccaacatcatgccacaatgcttgacgtcgatttacgacctgctagtgcgtggacactatatgcagtagcaacgaccgtgataacgcccatgatgagacacacgatagagaataccactgcgaatataagtcttacagcgatagccaaccaggcagcaattcttatgggattagataaaggatggcccataagtaaaatggatataggtgttccactcttggctcttggatgctactcacaagtaaatccgctaacactaactgcagcagtattgatgctagtagcacactatgcgattatcggacccggattacaagcgaaagccaccagagaagctcaaaaacgtactgctgccggaattatgaaaaatccaacagtagatggcatcgtcgctatagacttagatcctgttgtatacgatgcaaaatttgaaaaacaactcgggcaaataatgttgctgatactctgtacatctcaaatactccttatgcgtacaacatgggcactatgtgagtctatcactttggctacggggcccttgacaactctatgggagggatcccctggcaaattttggaatacaacaatagcggtcagtatggcgaatatatttagaggtagctatttagcaggagcaggacttgcatttagcctaatgaaaagtctagggggcggtcgacgtgggacaggtgcacaaggcgaaacgttaggagaaaaatggaagcgacagctcaaccaattaagcaaatcagaatttaatacatataaacggtctggaatcatggaagtagatcgatctgaagctaaagagggtctgaaaagaggagaaacaaccaaacatgctgtaagtcgcggtactgccaaattacgttggtttgtggaacgaaatctcgtgaaaccagaaggaaaggttatagatttagggtgtgggcgaggaggctggagttattattgcgcagggctcaagaaagtgactgaagtgaaagggtatacaaaaggcgggccgggtcacgaagaaccggtgcctatggcaacttacggttggaacctggtcaagctctactctggtaaagacgtattctttaccccaccagagaagtgtgacacgttattatgtgacattggtgaaagcagtccaaatccaacgattgaggagggacggacgcttcgagtattgaaaatggtcgaaccgtggctaagaggtaatcaattctgtataaagatattgaacccctatatgccaagtgttgtagaaacacttgaacaaatgcaaagaaagcacggaggtatgttagttcgaaatcctctaagcagaaattctacacatgagatgtattgggtatcatgtggaacaggcaacattgtaagcgcagtgaatatgactagcagaatgctactcaatcgatttacgatgactcacagaaagcctacctatgaacgtgacgtggatttaggtgctggcacacgacatgtggcagtagaaccagaagtagctaacttagatatcataggccaaagaattgaaaacatcaaaaacgagcataagtctacatggcactacgatgaagataatccctacaaaacttgggcatatcatgggtcatacgaggtgaaaccatccggttctgcttcatctatggtaaacggagtagtccgtctactcacaaagccttgggacgttatccctatggtaacacaaatagcaatgactgatacgactccatttgggcaacaacgagtcttcaaagaaaaggtagatactagaacaccgcgggccaaaagagggacagctcaaataatggaagtgacagcgaaatggttgtggggattcttatctcggaataagaaaccccggatatgcaccagagaggagttcaccaggaaagtgagatctaatgcagcaattggcgccgtattcgtagacgagaaccaatggaacagtgcaaaagaagcagtggaagatgaaaggttctgggacctcgtacatcgcgaacgagaactccacaaacagggaaaatgtgcaacttgtgtatataacatgatgggaaaaagagagaagaaactaggggagttcggcaaggcaaaaggatcacgtgcaatatggtatatgtggctaggagcccggttcctagagttcgaggcactaggttttatgaacgaagatcattggttctcaagagaaaactcatttagtggagtagaaggggaaggtttacataaactaggttatattctcagggacatcagcaaaatacccggcggcaatatgtatgcagacgataccgcagggtgggatactcgcatcactgaggacgatctacaaaacgaggcaaagatcaccgatatcatggagccggaacacgcattattagccacatccatatttaagctaacttatcagaacaaagtggtcagagtgcaaagaccagccaaaaacgggacagtaatggatgtgatatcacgtcgagatcagcgcggctctggacaagttggcacctatgggctcaatacgttcaccaatatggaggtacaacttataagacaaatggaatcagagggaatattcttaccttctgaacttgaaactcctaacttagccgaacgcgtccttgactggttagagaaacacggtacagaacgattaaaacgaatggctataagtggcgacgactgcgttgttaaaccagtagatgatagatttgccacagccctaatagcactaaatgacatgggaaaagtgagaaaagacattcctcaatgggaacctagcaaaggctggaatgattggcaacaagtcccattttgtagccaccattttcatcaacttataatgaaggatggtagagaaatagtggtaccgtgccgtaatcaggacgagctagtagggagagcacgtgtctctcagggagctggctggtcgttgcgcgaaacagcttgtctgggtaaatcctacgctcaaatgtggcaattaatgtacttccatcgaagagacctcaggttggctgctaacgctatttgttcagcagtaccagtggactgggtacccacctcacgaacaacctggagcattcacgcacatcatcaatggatgacaacagaagacatgttgtcagtatggaacagagtatggatcgaggaaaacccttggatggaagacaagactcacgtatcttcatgggaagaagtcccatatctaggaaaaagagaagatcagtggtgcggatcgttaataggactgacagctagagcaacatgggcaactaatattcaggtagcgatcaaccaagtccgtcgattaataggtaatgagaactatctagattatatgacatcaatgaagcgttttaagaacgaaagtgatccggaaggagctctttggtaa

SEQ ID NO: 21377 - RNA, 9879 nt, synthetic construct
  misc_feature 1..9879: note = derived and/or modified CDS sequence (opt6) from DENV-1__FJ390380__SS-prME
  source 1..9879: mol_type = other RNA
tcagtaacaatgttactgatgttattacctactgctctagcattccatctaacaacaagaggtggagagcctcatatgatcgtaagtaaacaagaaagaggtaaatcacttttattcaaaacgtcggcaggtataaatatgtgcacattgatcgctatggaccttggggaattatgcgaagacacaatgacttataaatgtcctagaattactgaggctgaacctgatgacgttgattgctggtgtaatgcaactgatacatgggttacatatggaacatgcagtcagaccggtgaacatagacgagataaaagatcggtagcattggcaccccacgtaggacttggtttagagactaggacagagacttggatgagtagtgagggcgcatggaaacaaatccagaaagtagagacatgggcattaagacacccaggattcacggttacagcactattcttagctcatgcaattggcacgagcataactcaaaaaggaataatttttatcctcctgatgctggttacaccaagtatggcaatgcgatgtgttggtattggcaaccgagatttcgttgaaggattatcgggcgcaacttgggtagatgtggtattggaacacggatcctgtgtgactactatggctaaagacaaaccgacacttgatattgaattacttaaaacagaggtgaccaaccctgccgtcctaagaaaactttgtatcgaagctaaaattagcaatacaacaactgattcacgttgccctactcaaggtgaagctacgttagttgaagaacaagatagcaatttcgtctgtagaagaacatttgtagatcgaggatggggtaatggatgtggacttttcggaaaaggttcattgttgacatgcgcaaaatttaaatgcgttacaaaattagagggtaaaatagtgcaatacgaaaatttaaaatactcagtaattgtaaccgtacataccggtgatcaacaccaggtcggcaatgaaacaactgagcatggcacgatagcaaccattacaccgcaggcaccgacttctgaaatacaattgacagattatggtgctctaactcttgattgttccccaagaacagggttagatttcaatgaaatggttctattaacgatgaaggagaaaagctggctggttcacaaacaatggtttctggacttaccacttccctggacgtcgggagcttcaacaagtcaagaaacatggaaccgacaagatctcttagtaacttttaaaactgcgcatgccaagaaacaagaagttgttgtgttaggatcgcaagagggggcgatgcacacagctctgactggagcaactgagattcaaactagcggcacaactaccatattcgcgggacatttgaaatgtagattaaaaatggataaattgaccctgaaagggatgtcatatgttatgtgtacgggtagttttaaactcgagaaagaagtagcagaaactcaacacggaacagtattagtccaggtcaaatatgaaggtacagacgccccgtgcaaaattcctttcagcgcacaagatgagaaaggagtcacacagaatgggcgactaatcaccgctaacccaatagtcacagataaggaaaaaccggtaaatatcgaaaccgaaccgccgtttggtgagagttatattgtagtaggtgctggagagaaagctctaaagttaagttggtttaagaaaggaagtagtataggaaagatgtttgaagccaccgctcggggtgccaggcgaatggcaatactcggcgatacagcgtgggacttcggatccatcggcggcgtatttacctcggtaggaaaactggttcatcaagtctttggcgccgcatacggagttttattcagtggggtttcctggactatgaagatcggcattggtattttgctaacgtggcttggactaaattcgagatcaactagcttaagtatgacctgcatagccgtaggaatggtaaccttatatctgggagtgatggtacaggcggattcaggatgtgtaatcaattggaaaggtcgcgagttaaaatgtggtagtggtattttcgtaacaaacgaagtacacacctggacggagcaatataaatttcaggcagatagtccaaaaaggttatctgccgcaataggtaaagcctgggaggagggagtatgtggtatacgctctgcaacaagacttgaaaacataatgtggaaacaaataagtaacgaactaaatcatattttactggaaaatgatatgaaatttacagtagtagtaggagacgcaaacggcatactggcacagggtaagaaaatgataagaccccagccaatggaacatagatattcatggaaatcttggggtaaggcaaaaatcattggtgcagatattcagaatagcacatttataatagacggcccagacacaccagaatgtcccgacgaccaacgtgcctggaatatctgggaggtggaagactacggatttgggatttttacaactaacatatggctaaaactgcgagatagctatactcaaatgtgtgaccaccgcttgatgtccgctgctataaaagatagtaaagcagtacatgccgatatgggatattggatcgagtctgagaaaaatgagacatggaaactagcaagggctagtttcattgaggtaaagacgtgtatatggccaaaatcacacaccctctggagtaatggtgtattagaatccgaaatgataatacccaaaatttacggaggtccaatatcccaacataactatcgtccagggtattttacccaaacagccgggccctggcacttagggaaactagaactagacttcgagttatgtgaaggcactactgtagttgttgatgagcactgtggtaataggggaccgtcactgcgcacgacaactgttacaggaaaaataatacatgaatggtgttgtaggtcttgtacattaccaccgttacgattccggggagaggacggatgttggtatggtatggaaattaggccagtaaaggaaaaggaagaaaatttggttagatcaatggtatctgcagggtcgggagaagtggactctttttccctagggatactgtgtgtcagtattatgatagaggaagtgatgaggagtagatggagtcgaaagatgctaatgactggaactttagtagtattcttcctactaataatgggacaactaacctggaatgatttaatacgactctgtattatggttggtgcaaatgcgagtgatagaatgggaatgggaacgacttatttggcgctcatggcaacgtttaaaatgagaccaatgtttgcggttggcttgttatttcggcgattaacatctagggaagtattgcttctaacaatcgggttaagtctcgtggcctcagtagaactaccaaactcattagaggagctaggggacggtttggcgatgggaatcatgatgctaaaattattgacagaatttcaacctcaccaactatggacaacgctcctatccctaacgtttataaaaaccacgctcagcttagattatgcgtggcgaactatggccatggtcttaagcatagtatccttattcccgctgtgcttatctacgacctcacagaagactacgtggctaccagtcctgctaggttcatttggttgcaaacccctaacaatgtttttaattaccgaaaacaagatatgggggcgcaagtcatggcctttaaacgaagggatcatggccatcggtattgtaagtattcttctatctagtctgttaaagaacgacgtgccgttagcaggacctttaatcgcaggaggtatgctaatagcatgctatgttatctccggctcgtcggcagatttgagtttagagaaggcagcagaggtaagctgggaagaagaagctgaacattcaggtacttctcataatatcttggtggaagtccaagatgatggaacgatgaaaataaaagacgaagaacgcgatgatacgctcacaatactactaaaagcgacgttacttgcagtgagtggagtttatcccatgtcaataccagcgacattcttcgtgtggtacttttggcagaaaaagaaacaacgatcgggagttctttgggatactccgtcgccacccgaagtcgaacgtgcagtgcttgatgatggaatttatcgtatattacaacgaggactattgggtagatcacaagtcggggttggagtattccaggacggggtttttcatacaatgtggcatgttacaagaggagccgttttaatgtaccagggtaaaagattagaaccaagctgggcatctgtaaagaaagaccttataagttatggaggagggtggcggtttcaagggagctggaacaccggcgaagaagtgcaagtaatagcagtagagcctggcaaaaatcctaaaaacgtgcaaacaaccccaggaaccttcaagacacccgaaggagaagtgggagcaatcgcactagatttcaaaccaggtacttccgggagcccaatagtaaatagggaaggaaaaatagtcggactgtatgggaacggcgtagtaaccacatccggcacctacgtttctgcgattgcacaagcaaaaacgtcccaggagggaccactaccggaaattgaagaagaggtgtttaagaaaaggaatttgacaattatggacctacaccctggatctgggaaaactaggcgatacctccccgctatagttagggaagcaattaaacgcaaactaagaaccctaatcttagctcctacgagagtagtagcgagcgagatggccgaagcactgaaaggaatgccgattaggtaccagacgaccgcagtaaagtcagagcatacaggtagagagatagtagaccttatgtgccatgccacatttacgatgagactactcagtccagtaagagtacccaattataatatgattataatggacgaagcccactttacagatccggcgtctatagctgcgaggggctatatatcaacaagggtaggaatgggagaagcagcggcaattttcatgacagctacaccccctggcagcgtagaagcatttcctcaaagtaatgcagtgattcaagacgaagaacgagatattcctgaaagatcttggaactccggctatgactggatcacagacttcccaggaaaaactgtctggtttgtaccaagcattaaaagtgggaatgatattgcgaattgtttacgcaaaaatggtaaaagagtcattcaactctctcggaagacgtttgatactgaataccaaaagacccggaataacgactgggactatgtagtaactacagatattagcgaaatgggtgcaaatttccgcgctgatagggtgatagatcctaggcgatgcctaaaaccggtcattctcaaagacggacctgagagagtcatcttagctggtcctatgccagtgaccgtagcatccgcagcccaaaggagaggcagaataggcagaaatcaaaataaagaaggagatcagtacgtctatatgggccaaccattaaataatgatgaggaccacgcgcactggaccgaggccaaaatgctactcgataatattaacaccccagaaggaataattcctgcattattcgaaccggagcgagaaaaatccgcagcaattgacggtgagtatcgattacgaggggaagcaaggaaaacatttgtagagctaatgagaaggggcgatctacctgtttggctatcatataaagtagcctcagaaggattccaatattcagatagaagatggtgctttgatggtgagaggaataatcaagtattggaagaaaatatggatgttgaaatatggacaaaagaaggagaaagaaagaagttgcgacccagatggctagacgctagaacatatagtgatcccctagctttacgtgagttcaaggaatttgcagctgggagaaggtctgtatcaggtgatctcatattagaaataggcaagttaccacaacatttaacgctccgagcgcaaaacgcactagataatttagtaatgttacacaacagtgaacaagggggcaaggcttataggcatgcgatggaagagttaccagacacgatcgaaaccttaatgttgttagctttaatagccgtactgacgggaggagtaactctattctttctttcaggtaaaggtttagggaagacatctataggattgctatgtgttatggccagcagtgccttgctatggatggcaaatgttgaacctcactggatagctgcaagtataatactcgaatttttcttaatggtcctattaataccggaaccagaccgacaacgcactccccaagataaccaattggcctacgtagtaatcgggttattgtttatgattttaacggtagcagcgaatgaaatgggactactagaaactaccaagaaagatttagggatagggcacgtagccgctgaaaaccaacatcatgcgaccatgctagatgtcgacttaaggcctgccagtgcctggactctttatgcagtagctaccaccgtcatcacccctatgatgcgacataccatagagaatacaactgctaacataagtttgacagcaatagctaaccaggccgctatacttatgggtctcgataaaggatggccaataagcaagatggacattggcgtcccattgctcgcactaggatgctattctcaagtaaatcctctgacacttaccgccgctgtactaatgctagtagcgcactatgcaataatcggacccggattacaggctaaagctacgcgtgaagcccaaaagcgaacagcagcaggaataatgaaaaatccgacagtggatggaattgtcgcgatcgacttagacccagttgtatatgacgcaaaatttgaaaaacaactcggacaaatcatgttgcttattttgtgcacatcccaaatactattaatgagaactacatgggcattatgtgaaagtataacgttagctactggcccattaacaacattatgggaagggagcccaggaaaattctggaacacaacaatagctgtgagtatggctaatatattccgcggttcttatctcgccggtgctggactagcattcagtttaatgaagtcattaggaggaggacgaagagggacgggggctcagggcgaaacccttggagaaaaatggaaaaggcagctaaatcagttgtccaaatctgaatttaatacatacaaacgctctggtattatggaagttgatcgatctgaggctaaggaaggtttaaagagaggtgaaacaactaagcatgcggtcagtcgtgggacagcaaaattgaggtggttcgtagaacgcaatctggtgaaaccagaagggaaggtgatagaccttggctgtggcagaggaggatggtcgtactattgtgctggattgaagaaagtaactgaagttaaaggctatacaaaaggtgggccgggacacgaagaacccatacccatggcaacttacggttggaacttagtaaaattatatagtggtaaagatgttttctttacaccccctgaaaaatgtgatacattactgtgtgatattggagagtcttcacccaacccaactattgaggaaggaagaacccttagagtattgaaaatggtggagccctggttacggggcaatcaattttgcataaagattttgaacccatatatgccaagtgttgttgaaacactagagcaaatgcaaagaaaacacgggggcatgctagttcgcaaccctctatctagaaactcaacgcatgaaatgtactgggtcagttgtggaacgggtaatattgtctcagcagtgaatatgaccagtagaatgctcttaaacaggttcactatgacccatcgtaaaccaacctatgaaagggatgttgatcttggagctggcactcgacacgttgcagtagagcctgaagtagcaaacttagacatcattggtcaaaggatcgagaatattaaaaatgagcacaaaagtacttggcattacgatgaagataatccttacaaaacatgggcctatcatggcagctatgaggtaaaaccatcgggatccgcatcatcaatggtcaacggagtagttcgattactgacaaaaccgtgggacgtaataccgatggtaacccaaatagctatgacggacactacaccatttgggcagcaacgagtattcaaagagaaagtagacactcggacaccaagagctaaacgaggaacagcgcagataatggaggttacagcaaaatggttatggggatttctaagtcgtaataagaagccaagaatttgtactcgtgaagagttcacaagaaaagtccggagcaatgctgccatcggagcagtctttgtcgatgagaatcaatggaactcagcaaaggaagctgtggaggatgaacgcttctgggacctagtccaccgtgagagagaactgcataagcaaggcaaatgcgctacgtgtgtatacaatatgatgggcaaacgagaaaagaaactaggcgaatttggcaaagcaaaaggcagtcgagcgatatggtatatgtggttaggggcaaggtttctagaatttgaagcgttgggatttatgaacgaagaccattggttctctcgtgagaacagtttcagcggtgttgaaggagaaggattacacaaattgggatacatattacgagacataagcaaaataccgggcggaaacatgtatgctgacgatactgccggatgggatacacgaattactgaagatgacttacaaaatgaagcaaaaataactgatatcatggagcctgaacacgcattgctcgcgacttcaatatttaaattaacttatcaaaataaggtagtaagagttcaacgacctgccaaaaatggtacagtgatggacgttatttcacgaagagaccagagggggtccggtcaggttggaacgtatggtctcaacacatttacaaatatggaagtccaattgattagacagatggaatcagaaggtatatttttaccctctgaactcgagacacctaacctagcggaaagagtcttgaactggctagagaagcatggaacggaaagactaaaaagaatggcaattagcggggatgattgtgtagtaaaaccagtggatgatagattcgcaactgccttaattgccctcaacgatatgggtaaagtgcgaaaggatataccacaatgggagcccagtaaaggttggaatgactggcaacaagtacctttctgcagtcatcatttccatcaactcataatgaaagacgggagggagattgtcgtaccgtgtcgaaaccaggatgaattggtcggtagggccagagtatcacaaggcgcaggatggtcattgagagaaacggcttgtttagggaaatcctatgcacaaatgtggcagttaatgtatttccacaggcgtgatctacgtctggccgctaatgctatatgtagtgctgtaccggtagattgggtaccaacctctaggacgacgtggtcaattcatgcacatcaccagtggatgaccacagaagatatgttgagcgtgtggaaccgtgtttggattgaagaaaacccttggatggaagacaaaacacatgtctcgtcctgggaagaagtcccctatctaggcaaacgcgaggatcagtggtgtggatcccttatagggctaaccgctagggcaacttgggcaacgaatatccaagtcgcgatcaaccaagtcagacgactaatcggtaatgaaaattacttggactacatgacaagtatgaaacggtttaaaaatgaatctgacccagaaggcgcactatggtga

SEQ ID NO: 21378 - RNA, 9879 nt, synthetic construct
  misc_feature 1..9879: note = derived and/or modified CDS sequence (opt6) from DENV-1__FJ205874__SS-prME
  source 1..9879: mol_type = other RNA
agtgtaacaatgttgttaatgttattaccaacggtattggcatttcatcttacaacacgagggggagaaccgcacatgattgttgggaaacaagaaaggggaaaaagtcttctatttaaaacatctgcaggagttaatatgtgcacattaatagcgatggatctcggagaactgtgtgaagatacaatgacttacaaatgtcctcgaattacagaagctgaacctgacgatgtggattgctggtgtaacgcaacggatacatgggttacttacggtacatgtagtcaaacaggggaacatcgtcgagacaaaaggagtgtagcattagctcctcacgtaggactcggtctagaaacacgtacagaaacatggatgagcagtgaaggagcttggaaacaaattcaaaaagtagaaacgtgggcacttcggcatcccggttttaccgtcatagcgttctttctagcccacgccattggaacgtctatcactcaaaaaggaattatattcattctactgatgttagtaactccgagtatggcaatgagatgcgtcggcataggaaatagggatttcgttgaaggattgtcaggggccacatgggtagatgttgtattggagcatgggtcatgcgtgacaacaatggctaaaaataaaccaactttagatatagaattgttaaaaacagaagtgacgaatccggcagtattgcgcaaactctgcatagaagctaaaatctctaacacaacaactgatagtcgttgcccaacacaaggtgaggcaactttagtcgaagaacaagatgcaaactttgtttgccgtaggacatttgtagatagaggctggggtaacgggtgtgggcttttcggaaaaggttcactgctaacgtgcgcaaaattcaaatgtgttacaaaattggagggtaaaatagtacaatatgaaaatctaaaatatagtgtaatagtaaccgtccatactggagatcaacaccaagtgggtaatgaaacaacagaacacgggaccatagcgacaataacaccacaagcaccaacgtcagaaattcaacttacagattacggtgcactgacactagattgctcgccacggaccggtttggactttaatgaaatggtgttacttacaatgaaagagaaaagttggcttgtccataaacaatggttcttggatctacctttgccatggacatcaggcgcttcaacatcacaagaaacatggaataggcaagatcttttggttacatttaaaaccgcacatgcgaagaaacaagaagtggtagtcttaggatcgcaggaaggtgcgatgcataccgcactcacaggagctaccgaaatccaaacttcaggaacgacgaccatcttcgcgggacatctcaaatgtagattaaaaatggataaactgactctcaaaggtatgagttatgtaatgtgcaccggcagttttaaactcgaaaaagaagtcgcagagacacagcatggtacagtgttggttcaagttaaatatgaaggtacggatgcaccatgcaaaatccctttgtcaactcaagacgagaaaggtgtaacacaaaatggtcgtctcatcactgcaaacccaatagttacggataaagaaaaacccgttaatattgagacagaaccaccgttcggggaaagttacatcatagtaggggctggggaaaaagccttgaaattatcatggtttaagaaaggcagctcaatcgggaaaatgttcgaggctactgctaggggagctagaagaatggcaattttaggtgatacagcttgggactttggaagtatcggaggcgtattcacaagtgtgggtaaactggtccaccaggtgttcggaacagcatatggagtactctttagcggggtatcctggactatgaaaataggcataggaatacttttaacttggctcggattaaatagcagatcagcttcattatcaatgacgtgcattgctgtaggaatggttaccctctatcttggagtaatggttcaagccgactccggatgtgtaattaattggaaaggcagagaacttaaatgtgggagtggaatcttcgtcacaaacgaagtacacacgtggacagaacagtacaaatttcaagcagatagccccaaaagactatctgctgccataggcaaagcatgggaagagggtgtttgcggtgttagaagcgctacaagacttgaaaatattatgtggaagcagatcagtaacgaactcaaccacattttattagaaaatgatatgaaatttactgtggtagtgggcgacgctaacggcattctggcgcaaggtaagaagatgatacgtccccaaccaatggaacataaatatagttggaaaagttggggtaaggcgaaaataataggagcggatatccaaaatactacattcataattgatggtccggataccccagaatgcccagatgaccaaagagcatggaatatatgggaggtggaagattatggctttggcatattcactacaaacatatggttaaaattaagagactcttatacacagatgtgcgatcatcgactaatgtctgcagcaataaaagattcaaaagcagtccatgccgatatggggtactggattgaaagcgagaaaaacgagacttggcgtcttgctcgagccagctttatagaagtcaaaacatgtatatggccgaaatcgcacactctctggtccaacggggtacttgaatcggaaatgatcattccaaaaatatacggaggtccaatctcacaacacaattacagacccggctactttactcagacagcaggaccgtggcatctaggcaaacttgaacttgatttcgacctctgcgagggtaccacagtagtggtagatgaacattgtggcaatcggggaccttcacttaggacaacaactgtgaccggaaaaatcattcacgaatggtgttgtagatcttgtactctacctcctttaagattcagaggcgaagatggatgctggtatggcatggaaattagaccagtaaaagaaaaggaagagaatctagtgcgttccatggtgtccgcaggttctggggaagtagactcattctcactagggatactatgtttatctataatgatcgaggaagtcatgcgttcacggtggagccgaaaaatgcttatgacagggacacttgctgtatttctgttgctaattatgggtcaactaacttggaatgatctcatcaggttatgtattatggtcggcgccaatgcctctgatcgcatgggcatgggcacgacatacttagcattaatggcaacctttaaaatgaggcctatgttcgcagtggggttgctctttaggcgattaacaagtcgagaagtattgttactaacaatcggcctatcactggtcgcctccgtcgaattacccaattccttggaagagttaggggatggcctcgcaatgggtattatgatgctgaaattactaacggaatttcaaccacatcaactatggactactttattgagtctcacttttattaaaacaactctttcactagattatgcatggaagacgatggcgatggtattatcaattgtctcattatttccattgtgcttatccacaacatcccagaaaaccacctggttacccgtgctgctaggtagctttggatgtaaaccgctgacgatgtttctaattacggagaataaaatatggggcaggaaaagttggccgctaaatgaagggataatggcaattgggattgtatctatcctgctctcgtcgctattgaagaatgatgtacctctagcggggcctttaatagcagggggtatgctcatagcttgttacgtcatttcaggttcaagtgcagacttaagtctagaaaaagctgctgaagttagttgggaagaagaagctgagcactcggggacgtcgcacaacatccttgtagaagttcaagacgatggaactatgaaaataaaagatgaagaacgagatgacacactcactatattattaaaagcgacactcctagctgtatctggtgtgtacccgatgtccataccagctacactatttgtatggtatttctggcagaagaagaaacaacgctccggcgtactctgggataccccttcacctcctgaggtagaaagagcagttctggatgacgggatttaccgtattcttcaaagaggactgttgggacgcagtcaagtcggagtaggagtctttcaggacggagtatttcacactatgtggcacgtaacaagaggggctgttttaatgtaccaaggtaaaagattagaaccttcatgggctagtgttaagaaagatttgataagctatggtggaggatggagatttcaaggatcttggaatacgggcgaagaagtacaagtgatagcagttgaacccggcaaaaatcctaaaaacgttcagaccactcccggtacatttaaaacaccagagggcgaagtaggggctgtcgctttagattttaaaccaggaacaagcgggtctccaatagtaaatagagaaggaaaaatagtaggtctctacggcaacggagtagtaacaacttccgggacttatgtaagtgcgatagctcaagcaaaagcctcacaggagggtcccctaccagagatagaagacgaagtctttaagaaacgtaaccttacaataatggacttacatccagggtcagggaaaacacgaaggtatctacccgcgatcgtaagggaagcaataaaaagaaaactcagaacactcatcttagcccctaccagagttgttgcaagtgagatggcagaggcattaaaaggaatgcccatccgatatcagaccacagccgtcaaatccgaacatacaggacgtgaaattgtcgacttaatgtgccatgccacattcacaatgagactacttagcccagtccgagtccctaattataacatgatcataatggatgaagcacacttcacagatcctgcatctatcgcggcccgaggatatataagcacgcgcgttggaatgggagaggctgcggcgattttcatgacagccactcctccaggctcagttgaagcctttccacaaagtaatgcggtaatacaagatgaggaacgagatattccagagcgatcatggtcgagcggttatgactggatcacagatttcccaggaaagacggtctggtttgtcccaagcataaaatccggaaatgacatcgccaattgcttgagaaagaatggaaaacgagtaatacaactttcgcggaaaacatttgatactgaataccagaaaacaaagaataacgattgggattatgtagttacgacagacataagtgaaatgggagctaactttcgagcagaccgcgtcattgatccaagacgatgtcttaaacctgtgatcctgaaagacggaccagagcgagtaatacttgcaggtccaatgcccgttactgttgccagcgctgcccaaagaagaggacgaataggtagaaatcaaaataaagagggagaccaatacgtctacatgggacaacctctgaacaatgatgaagatcatgcgcactggacagaagcaaaaatgttattagacaatataaataccccagaaggaattataccagctttatttgaaccggaacgagaaaagtcggctgcaatagatggcgagtataggttaagaggggaagcacgtaagactttcgtggaattaatgaaaagaggagacttgccagtctggttatcatataaagtagctagtgaaggtttccaatactctgatcgacggtggtgcttcgacggtgaaagaaataatcaagtattagaggagaacatggacgtagaaatttggacaaaagagggagagagaaagaaacttagacctagatggttggacgcacgcacatattctgacccattagcgcttcgtgaatttaaagagtttgcagcaggaagacgaagtgtgagtggcgacttaatcttagaaattggaaaattgccccaacatctgaccttgagagcacaaaatgctctagataacctagttatgttacataactcggagcaaggagggaaagcgtatcgccacgccatggaggagctcccagacacgatagaaaccctaatgctactagcacttatagctgtgttaacaggaggtgtaatgctgttcttcctatcaggtaagggactcggtaaaacatccataggactattatgtgtaatggctagcagcgctctattatggatggcaagtgtagagccccattggatcgcagcatctatcatattagaatttttcttgatggtgctattgataccggaaccagacaggcaaagaacacctcaagataatcaacttgcctatgtggtcataggactgctatttatgatccttactgttgcagctaacgagatgggcctacttgagactaccaagaaagatttggggataggtcatgttgctgcagaaaatcatcatcatgttacaatgctagatgttgatcttagaccggcttccgcttggacgttatacgcagttgctactaccgtcataacaccgatgatgcgtcatactattgaaaataccacagcaaatattagcctgactgcaatagcgaaccaagcagcaattcttatgggcctagataaaggctggcctatctctaaaatggatattggcgttccattattagcgctcggatgttattcccaagtcaatccgctcactctaacagctgcagtgttaatgcttgtggcacattatgctataataggacccggcctgcaagctaaagccaccagagaggcacaaaaacgaactgcagctggcataatgaaaaatccaacagtagatggaattgtagctattgatttagatccagtagtatatgatgcaaaattcgaaaaacaactcggccaaataatgctgttgatattatgtacctcccaaatactcctaatgaggacaacatgggctctgtgtgaatccattaccctggcgacaggtcccctaacaactttatgggaaggtagtcctggtaaattttggaatactacgatagcagtgtccatggcaaatattttcaggggaagttatctagccggggccggcctcgctttttctctaatgaaaagtctcggaggtggcagacgtggtacaggtgctcaaggggaaacactaggtgaaaaatggaaacggcagcttaaccagctgtcaaaaagcgaatttaatacttacaaacgttcaggtataatggaagttgatcgttccgaagcaaaagaaggactcaaaagaggtgaaactactaaacatgctgtaagtaggggcacggctaagttgagatggttcgttgaacgaaacttagtgaaaccagaaggaaaggtgatcgatcttggatgcggcagagggggatggagttactactgcgcgggtttaaagaaagttacagaggtaaagggttacaccaaaggaggtcccggacatgaagaaccaattcccatggcaacgtacggatggaatttagtgaaattgcatagcggaaaggatgttttctttaccccaccagaaaaatgtgataccttgctatgtgatatcggcgaatcatctccaaatccgactatagaagaaggtcgcacgttaagagtactaaaaatggttgaaccgtggttgaggggtaatcagttttgtatcaaaatactgaatccttacatgccatcggtcgtcgagactctagaacagatgcagaggagacatggaggcatgctagtaagaaacccgctctcgagaaattcaacacatgagatgtattgggtaagctgtggcacaggaaacatagtatcggccgtaaatatgactagcagaatgttactaaatagattcacgatggcccatcggaaacctacttatgagcgagacgtcgatttaggcgcagggacaagacatgtggccgtggaaccagaggttgctaatttaggaattataggacagcgaattgaaaacattaaaaatgaacataaaagcacgtggcactatgacgaagataacccctacaaaacctgggcttaccacggatcctacgaagtaaaaccctctggttcagctagctcgatggtaaacggcgtagtacgtctattaactaagccatgggatgtaataccaatggtcacacagatagcgatgaccgatacaacaccgttcgggcagcaaagggtattcaaagaaaaggtagataccagaacgccgcgagccaagcgtggaaccgcacaaattatggaggtaactgcaaagtggttatgggactttttatctagaaacaagaaacccagaatatgcacaagggaagaatttatcagaaaagtccggagtaacgccgcgatcggggccgtctttgtagacgaaaatcagtggaactctgcaaaagaagctgtagaagatgaacgattctgggatctggtacacagagagcgagaattacacaaacaaggcaaatgtgcaacctgtgtttataatatgatgggaaaaagagagaagaaattaggagagttcggtaaagccaaaggcagtagagcaatctggtatatgtggctaggggcaagatttcttgagttcgaagctctcggcttcatgaatgaagatcattggttcagtcgcgaaaactctttatcaggagtcgagggtgagggactacataagttaggttacatactcagagacatatctaagatacctggaggtaatatgtatgcagacgacactgcaggttgggacacaaggattacagaggacgacttacaaaatgaagctaaaattaccgatataatggaaccagaacatgcactactggccaccagtatattcaaattgacataccagaacaaggtggtgagagtacaaagaccagcaaagaatggcactgtcatggacgtaatttcgcgaagagatcaacgaggatcaggtcaggtaggaacatatggattaaacacgtttacaaatatggaggtccaactcatacgtcaaatggagtccgaaggaatatttctcccgagcgaattagagactacaaatctggcagaacgagtactggattggcttgagaaacatggagtagaacgactaaaaagaatggccataagtggagacgactgcgtggtaaaacctatagacgatagatttgcgactgctcttatagctctcaatgacatgggaaaagtacgcaaggacattcctcagtgggaacctagtaaaggatggaatgactggcaacaggtacctttttgttctcaccattttcaccaacttataatgaaagatggcagagaaatcgtggtgccatgccggaatcaagatgagctagtgggccgggcgagggtatcacagggcgcagggtggtcattaagagaaactgcctgcctgggtaagtcttatgcccagatgtggcagcttatgtactttcacaggcgcgatctacggttagcggctaatgcgatctgcagcgcggtccccgtagattgggtgccgacgagtcgaactacttggagcatacacgcgcatcaccaatggatgacgactgaagatatgttatcagtttggaatagggtatggatagaagaaaatccttggatggaagacaagacacatgtttcaagctgggaagaagtaccttatcttggaaaacgagaagatcagtggtgtggctcactaataggtctgacggcacgagccacttgggccacgaacatacaagtagccataaaccaggttaggagattaatcggaaatgagaactacctagattacatgacttctatgaagagattcaaaaacgaaagtgacccagaaggcgcgctttggtag

SEQ ID NO: 21379 - RNA, 9879 nt, synthetic construct
  misc_feature 1..9879: note = derived and/or modified CDS sequence (opt6) from DENV-1__FJ205875__SS-prME
  source 1..9879: mol_type = other RNA
agtgtaacgatgttgcttatgctacttccgaccgcactggcattccatctaacgacgagaggtggtgaaccacatatgattgtttcaaaacaagaacgtggaaagtctctcctctttaaaacttcggccggaataaatatgtgcacattgatagcaatggacctaggagaactctgcgaagacacaatgacatataagtgcccgcggattacagaagcggaaccagacgacgtcgattgttggtgcaacgccacagatacctgggtgacttacggaacttgtagtcaaactggggaacataggagagataaacgttccgtcgcactagccccacatgtgggattaggattggaaactcgaaccgaaacatggatgagtagcgaaggagcgtggaagcaaattcaaaaagttgaaacatgggccttgcgacatccaggattcacggtgattgcactatttttggcgcatgctattggcactagcataactcaaaaaggaataatctttattctcctcatgcttgtcacaccatcaatggccatgagatgtgtcggaataggaaatagagactttgtagaaggattatcaggagcgacctgggtggatgtcgtattggaacatggatcatgtgtaactacaatggcaaaagataaaccaacattagacattgaactacttaaaactgaagtcactaatcctgcaatcctcagaaaactttgtatagaagcgaaaattagcaacacaactacagacagtagatgcccaacacaaggtgaagcaactttagttgaggaacaagacgccaattttgtctgtcgtagaactttcgtagatcgtggatggggaaatggttgtggattattcggaaaaggttcacttttaacgtgtgcaaaatttaagtgtgtcacaaagctcgaaggcaagatagtacagtatgaaaacttaaaatattcagtcatagtgacagttcatacgggagaccaacatcaggtgggcaatgagactacggaacatggcacgatagccacgatcacacctcaggcgccaactagcgagattcaactaacggattatggagccttgacgcttgactgctctccccgcaccggattagattttaacgaaatggtattacttacgatgaaagagaaaagttggctagtgcataaacaatggttcttagatctacctttgccatggacaagtggtgcttcaactagccaagagacttggaatagacaagacttactcgtaacctttaagacagcccatgctaagaaacaggaagtagtcgttcttggttctcaagaaggagcaatgcacacggcccttactggagcaacggagattcagacatcaggtacaactaccatatttgccggacacctaaaatgtcgcttaaaaatggataaactaactctaaaaggcatgagttacgtcatgtgtacgggctcatttaaactggaaaaagaggtcgcagagacccaacacggcacggtattggtccaagtgaaatatgaaggaactgatgcaccttgcaaaataccattttcaactcaagatgaaaagggtgtaacgcaaaacggacgactaataactgccaatccaatcgtaacggataaagaaaagcctgtcaatatagaaacagaacctccttttggggaatcatacatagtagtaggggctggagagaaagctctcaaattatcatggtttaaaaagggctcgtcgattggtaaaatgtttgaagcaacagctagaggggctagaagaatggcaatattgggtgacactgcatgggactttggttcgattggtggcgtatttacaagtgtaggaaaattggtacatcaagtattcgggacggcctacggcgtcctttttagtggagttagctggactatgaaaataggaattgggatactgcttacatggttgggattaaacagccgaagtacatcactcagcatgacgtgtattgccgtaggaatggtcacgctatacttaggtgttatggtccaagcagatagcggctgcgtaataaattggaaaggccgtgagttaaaatgtggaagcggaatttttgtaactaatgaggtgcatacttggaccgaacaatataaatttcaagccgactctccaaaaagattaagtgcggcaattggaaaggcatgggaagagggagtatgtggtattagaagtgccactaggttagaaaacataatgtggaaacaaataagcaatgaattaaatcacatactactggaaaacgatatgaaattcacggtagttgttggggacgccaatggaatacttgcgcaaggcaagaaaatgattcgaccacaaccaatggaacacaaatatagttggaaaagctggggtaaggctaaaataatcggtgccgatatacaaaatactacatttattattgatggcccggatacacctgaatgtccagatgatcaaagagcatggaacatatgggaggtagaagattacgggtttggaatatttacaacgaatatttggctaaagctacgagactcatatactcaaatgtgcgatcataggctaatgagtgctgcaatcaaagactctaaggctgtacatgctgatatggggtactggatagaatccgaaaagaacgagacttggaaattggctcgagcatcttttatcgaagtaaaaacttgcatttggccaaaatcacacaccttatggagcaatggcgttctggaaagtgagatgataattcccaaaatttatggcggaccgatctcccaacacaactacagacccggttactttactcaaacggcaggtccatggcaccttgggaaattggaactagacttcgatttatgcgaggggacgacagtagtagtagatgaacattgcggaaatcgaggaccatcgctacgtacaactaccgtcactggcaaaattatccacgagtggtgttgcagatcatgtaccctcccaccactaagatttcgcggtgaagacggatgttggtatggtatggaaataagaccagtaaaagaaaaagaggaaaatctggttcgatccatggtgagtgccggttccggagaagtagatagcttctcgttagggattctttgtgtgagcattatgatagaagaggtaatgagatcaaggtggagtaagaaaatgctgatgacaggtacacttgcggttttcttgttacttattatgggtcagctgacatggaatgacttaatacgtttatgtataatggtaggagcaaacgctagtgacaggatgggcatgggcaccacttatctagcattaatggctacattcaaaatgagacctatgtttgcggtcggattgttgtttagacgactaacatcacgcgaagtactgttattgacgataggactatcattagtagccagcgttgaactgccaaatagcctagaagaactcggcgatggactagcaatgggaataatgatgttaaaactactgacggaatttcagcctcaccaattgtggaccactttattatcattaacattcataaaaacgacattgagtctagattacgcatggaggacgatggctatggtgctatctatagtttcattgtttccactctgcttgagtactactagccagaaaacaacttggctacctgtgttgttaggaagtttcgggtgtaagcctctaacaatgtttctcatcactgagaataaaatatggggaaggaaaagctggcccttaaatgaaggaatcatggctattggtattgtttcaatccttttatcaagtctactaaagaatgacgtaccgctcgccggcccattaatagcagggggcatgctcattgcttgctacgtcatatcaggaagttcggctgatctgagtcttgaaaaagcggccgaagttagctgggaagaagaagcagaacatagcggaacaagccataatatcctagttgaagttcaagacgatgggaccatgaaaataaaagacgaagaaagagacgataccctcactatattacttaaggcaaccctgcttgcggtaagtggagtctatccgatgtcaattcccgctaccttatttgtttggtacttttggcaaaagaagaaacaaaggtcgggcgtgttgtgggatacccccagtcccccagaggtggagagagcggtacttgatgacggaatttatcgaatattacagcgaggactactcggtcgaagtcaagttggagtgggggtatttcaagacggagtgtttcacactatgtggcatgtcaccagaggagccgttctaatgtatcaagggaagagactagaaccttcttgggcatctgtgaagaaagacctgattagttacggtgggggttggcggtttcaaggatcctggtccaccggagaagaggtacaagttattgctgtagaaccaggcaaaaaccccaaaaatgtgcagacaactccgggtacttttaagacgcccgagggtgaggtaggagcaatcgcactagactttaagccgggaacttctggaagccctatagtaaacagagaaggcaaaatagtaggactctatggcaacggagtggtgacgacgagcggaacatatgttagcgcaatagctcaagcaaaaacgagtcaagagggaccattaccggagattgaagatgaagttttcaagaagagaaatctaaccatcatggacctacatccgggttcaggaaaaacccgaaggtatcttcctgcaatagtgcgcgaggcgatcaagcgaaaattacgaacactaattcttgcacccacaagggtggttgcgtcggaaatggccgaagcattgaaaggtatgccaattagatatcagactacagcagtcaaaagtgaacacacaggccgcgaaattgtagacttgatgtgccacgccactttcactatgcgattattatcgccggtcagagtaccaaactacaatatgataataatggatgaagctcatttcactgatccagcaagcatagcggctcgtggttatatttctactagagtgggtatgggtgaagctgcggcaatatttatgactgcaacaccaccaggatctgtggaggcgtttcctcaaagtaacgcggtaattcaagatgaagagagagacattccggaaaggagctggaactcggggtacgactggataactgattttcctggaaagacagtttggtttgtaccgtcaataaaatcggggaacgacatcgcgaattgcctgaggaaaaatggcaaaagagtaattcaactttcaagaaaaacatttgataccgaatatcagaaaacgaaaaacaacgattgggattatgtggtgaccacggacatttctgagatgggagctaatttcagggcggatcgtgttatcgatccaagacgttgcttaaagcccgttattttgaaagatggtcctgaacgcgtgatactagcaggaccaatgcccgtaactgttgcatcagcagcccaaagacgcggacgtattggcaggaaccaaaataaagaaggtgaccaatacgtatatatggggcaaccactgaacaacgatgaggaccatgcacattggaccgaggcaaaaatgctcttagacaatattaatacccctgagggcattataccagcgttattcgaacccgaacgcgaaaaatcagctgcaattgatggtgagtacagactgaggggtgaagctaggaaaacttttgtagaattgatgcgtcgcggggatctgcctgtctggctaagctataaagtagcatccgaaggtttccaatatagcgatcggagatggtgttttgatggagagcggaataatcaagtacttgaagaaaatatggacgtagagatatggactaaagaaggcgaacgaaagaaattgcgacctagatggctcgacgcgaggacgtactcggatcccttggcattgagggaatttaaagaatttgcagcggggcgacggtcggttagtggtgacctaattctagaaataggaaaattaccacaacatctaacactacgagcccaaaatgctctcgacaacttagtaatgctgcataattcagaacaaggaggaaaagcctatcgacatgcaatggaagaattacctgacacaatagaaactttgatgcttttagcattgatagcggttttaactggcggtgtaacactcttctttctatctgggaaagggctcgggaaaacaagtattggtcttttatgcgtgatggcatcaagcgcattactgtggatggcgaacgtcgagcctcactggatagcagcttcgattatattagaatttttcctgatggtgcttttaattcccgaacctgatcgacagaggaccccacaagacaatcaacttgcctacgttgttataggtttactatttatgatattgacggtcgcagcaaatgaaatgggattactcgaaacgactaagaaagatttgggaatcggtcatgtcgcggcagaaaatcaccatcacgcgactatgctggatgtagatttgagaccagcaagcgcctggacattatatgcagtggcgacgaccgttattactcctatgatgagacatacaatagaaaatacaacagctaatatatcacttactgcgatcgcaaaccaagccgctatactaatggggttagacaaaggatggcctatttcaaaaatggatatcggtgtgcccttgctagctctgggctgttactcgcaagttaaccctcttactctgaccgctgcagtattgatgcttgtcgcgcattatgctattatcggtccaggtcttcaagcaaaggcaacacgtgaagcgcagaaacgaactgcggctggcataatgaaaaatccgactgtggatggaatagtagcaatagatcttgacccagttgtttacgatgcaaaatttgagaagcaattaggtcagataatgctccttattttatgcacatcacaaatactattaatgagaacgacatgggcactttgtgaatcaattacactcgccacaggaccactcactacactttgggaaggttcccctgggaaattttggaacacaacaattgctgtgagcatggcaaacatctttcgaggctcatatttagctggtgcagggctcgcgtttagcttaatgaagtcacttggaggtggccgacgaggaactggcgcccagggcgaaacactgggagagaaatggaaacgtcaactaaatcaattaagtaaaagtgagtttaatacatacaaacgatctgggataatggaagtggacaggtcagaagcgaaagaaggacttaaaagaggagagacaacaaaacatgcggtgtccagagggacggcaaaattaaggtggctggtagaacggaatttagttaaaccagaaggtaaagtaatagacttaggttgtggacgcggtggatggtcatactattgcgctgggctcaaaaaggtaaccgaggttaaaggatataccaaaggagggcctggtcacgaggaacccataccaatggctacatatggctggaacttagtcaaactttacagtgggaaggatgtattctttacaccacccgaaaaatgtgacacactattatgtgatataggcgaatcgagcccaaatccaaccattgaggaggggcgaacattgagggtacttaaaatggtagaaccgtggttacgaggcaatcaattttgtataaaaatcttaaatccgtatatgccgagtgttgttgagacacttgagcagatgcaacgtaaacacggtggcatgctagttagaaacccattatctaggaacagtacacatgagatgtactgggtatcatgtggaactgggaacatagtttctgcagtaaacatgacgagtcgtatgttgttaaacagattcactatggtccaccgaaaaccaacatatgagcgggatgtcgatttaggagctggtactcgtcatgtagcagtagaaccagaagtagcgaacctcgatatcatcggacaacgtattgaaaacattaaaaacgaacataaaagtacatggcattatgatgaagataatccgtataaaacttgggcttatcatggaagctacgaagtaaagccaagtggatcggcatcaagtatggtaaatggtgttgtaagattacttacaaagccatgggacgtaatcccaatggtgacgcaaatcgcaatgacggacacaacaccttttggacaacaaagagtcttcaaagaaaaagttgacactcgtacaccaagagctaaacgtggcactgcacaaataatggaggtaactgccaaatggctatggggtttccttagtagaaacaagaaaccaagaatctgtacacgggaagagttcaccagaaaggtaagatctaacgccgcgattggcgcagtatttgtagatgaaaaccaatggaacagtgccaaagaggctgttgaggatgaaagattctgggacctcgtgcatcgagagcgtgaattgcataaacaagggaaatgcgcgacatgtgtatataatatgatgggaaagagggaaaagaagctaggcgagttcggaaaggctaaaggatctagagcaatctggtacatgtggcttggggcaagatttttggagttcgaagcgctagggttcatgaatgaagaccactggttttcaagagaaaattcatttagcggagtagagggcgacggattgcataagctcgggtatatcctacgagatatatctaagattccgggaggaaatatgtatgcagatgacacagcagggtgggatactagaataaccgaggacgatctgcagaacgaagcaaaaataaccgatataatggaacccgaacatgcattgctagctacttccatcttcaagctaacttaccagaataaagtcgtaagggtccaacggcctgcaaagaacgggactgtaatggatgtaatatcgagaagagatcaaagaggttctggccaggtgggaacatatggattaaatacttttacgaacatggaagctcaacttattaggcagatggaaagcgaaggaatatttttaccatccgaattagaaacaccaaatcttgcagagcgagtattagactggttagagaagcatggaacggaacgcctaaaacgcatggcaatttcaggtgatgattgtgtggtgaaaccagtggatgatagatttgcgactgcactcacagcacttaatgatatgggcaaagttaggaaagatattccacaatgggaaccttcgaaaggatggaatgactggcagcaagtaccgttttgttcacaccattttcaccagctaatcatgaaagatggaagagagattgtggtaccatgtagaaatcaagatgagcttgtgggacgtgccagagtaagtcaaggtgctggctggtctttgagagaaactgcatgtctcggcaaatcttacgcacaaatgtggcagttaatgtatttccatagacgggatcttcgactagcagctaatgccatatgttcagccgtacctgtggattgggtaccaactagcagaacaacatggtcaatacacgctcatcatcaatggatgacaactgaagatatgttatctgtatggaacagagtttggatcgaagaaaatccatggatggaagataaaactcacgtgtcaagttgggaagaagtaccttatcttggaaaacgagaagaccaatggtgtggaagtctaataggcctgacagccagagctacttgggctacaaatatacaagtggcgatcaatcaagtgaggagacttatagggaacgaaaattacctagattacatgacaagtatgaaaagattcaaaaacgagtcagatcccgaaggagccctgtggtaa

SEQ ID NO: 21380 - RNA, 9879 nt, synthetic construct
  misc_feature 1..9879: note = derived and/or modified CDS sequence (opt6) from DENV-1__FJ410173__SS-prME
  source 1..9879: mol_type = other RNA
tccgttaccatgttactgatgctcctccctactgcgttagcattccatctaacgactcgaggaggagaaccgcacatgattgtgagcaaacaagaacggggaaaaagccttctatttaaaacttccgcaggaataaacatgtgtacgctgattgcaatggacttaggggaactttgcgaagataccatgacatataaatgtccacgaattaccgaagcggaacctgatgacgttgattgctggtgtaacgcaactgatacatgggtgacctatggcacatgttctcaaacgggagaacacaggcgagacaaaagaagcgtggctttagcaccacacgtaggccttggcttggagacacgcacagagacctggatgtcatcagaaggcgcatggaaacaaattcaaaaagttgaaacatgggctctaaggcatccaggatttacagtcactgcactattcctagcacacgcaataggaacatcgataacccaaaaaggcataatctttatacttcttatgctcgtgactccaagtatggctatgagatgtgtaggaataggaaatcgtgattttgtggagggactaagtggcgcaacgtgggtagatgtagttcttgagcatggatcatgtgttacaacaatggcgaaagataaaccgacattagacattgaattactgaaaacagaagtaacaaatccagcagtattgagaaaactctgtatcgaggctaaaatatccaatactactacagattccagatgcccaacacaaggcgaagcaactctagtagaagaacaagatagcaacttcgtgtgccgcagaacctttgttgacagaggatggggtaatggatgtggcctctttgggaaaggatctctacttacctgtgctaaattcaaatgcgtcacaaaactagaaggaaaaatagtgcaatatgaaaatttaaagtacagcgtgatagtcacagtacacaccggggatcaacaccaagtaggtaatgaaacaacagagcacgggacaatagcaacaatcacacctcaagcgcctacaacagaaatacagttaacagattatggagcattaacacttgactgctcaccgagaacgggcttagacttcaacgaaatggtattgttaacaatgaaagagaagtcatggcttgtgcacaaacaatggtttttagacctcccgttgccgtggacgtcaggcgcttctacaagccaggagacatggaatagacaagatttacttgtcacatttaaaacagctcatgcaaagaaacaagaagtagtagttctaggatctcaggagggagcaatgcacacagctttaactggagcaacagaaatacaaacctcaggaaccacaacaatatttgcgggacatctaaaatgtcgcctaaaaatggataaactaaccttaaaaggaatgtcatacgtaatgtgtactggcagttttaagctggaaaaagaagtagctgaaactcaacacggcacagtgttagtacaggtaaaatatgaaggcacggatgcgccatgcaaaattccattcagtgcacaagatgagaaaggcgtaacgcaaaatggtcggctaataactgctaatccaatcgtgacggataaggaaaagccggtaaatatagagaccgaacctccattcggagaaagctacatagttgtaggagcgggagaaaaagctctaaaacttagttggtttaaaaagggttcgtccataggtaaaatgttcgaagccactgctcgaggggccagaagaatggccattctaggagacacagcatgggattttggcagtatcggcggagtatttacatcagtaggtaaacttgtccaccaagtattcggtgcagcatatggagttcttttctccggagtatcatggactatgaaaattggtattggtatcctactaacctggttaggcttaaactccagatctaccagtttgagcatgacttgtattgctgtaggcatggtgaccctttacctgggtgttatggtccaggcagattcaggttgcgttataaattggaaaggaagggagctaaaatgcgggagtggaatttttgttacgaatgaagtgcatacttggacggaacaatataaatttcaagccgacagtcctaaaagactatctgctgcaataggtaaggcctgggaagaaggcgtgtgcgggataagaagcgcaacaaggcttgaaaacatcatgtggaaacaaatatctaatgagctcaatcatattctattagaaaatgatatgaaatttacggtcgtagtaggagatgcaaacggaatattagctcagggcaagaaaatgattagaccacaaccaatggaacatcgttattcttggaaaagctgggggaaagctaagataattggcgcagatatacaaaacagcacatttataatagatggaccagatacacctgagtgcccggatgatcaaagggcatggaacatatgggaagtggaggattatggatttggaatctttactacaaatatctggcttaagctacgcgatagctatacccagatgtgtgatcaccgcctaatgagcgccgcgattaaagatagtaaggccgtccatgcggatatgggatactggatagaatctgagaaaaatgaaacatggaagctagcaagagcgagcttcattgaagtaaaaacatgtatttggcctaaaagtcacacactttggagcaatggtgtattggaaagcgaaatgataataccgaagatctacggtgggccaatatcacaacataactatcgaccgggttactttacacaaactgcaggaccttggcacttgggtaaactagaattagattttgacctgtgcgaaggaactactgtcgtagtagacgaacattgtggcaaccgagggccttcattaagaacaactacagttacaggaaagatcatacatgaatggtgttgtcgaagttgcacactaccgccgctaagattcagaggcgaagatggatgctggtatggtatggaaattagaccagtaaaagaaaaggaagaaaatttggtacggagcatggtaagtgcgggtagtggagaagtagattcattttcactggggatcttatgtgtatcaattatgatagaagaagtgatgagaagtagatggtcaagaaagatgctaatgacgggtacgctagcagtatttttgctactaataatgggtcagctcacatggaacgatttaataagactttgcataatggtaggagccaatgccagtgacagaatgggaatgggtacaacatatttggcgcttatggctacgttcaaaatgaggcccatgtttgcggtagggctcctgtttaggcgtttaacttcacgtgaggtcctactattaacgattgggttatccttggtagcatctgtagagttacccaattcattggaagaattaggagacggactcgcaatgggaatcatgatgttaaaacttttaactgagtttcagccccatcaattgtggaccacgttgctatcattgacctttataaagacaacattgtcactagattacgcatggagaacaatggctatggtgttaagcattgtaagtcttttcccattgtgtttaagcacaacgtcacagaagaccacttggttacctgttttactgggaagttttgggtgtaagccattaacaatgttcttgattaccgaaaataagatatgggggagaaaaagctggcccttaaatgaaggaataatggccataggaattgtaagtatactactttcaagtttactaaagaatgatgtccccttagcaggaccattgatcgccggtggtatgttaattgcttgttatgtaatatctggtagctcagccgatctttcattggaaaaagcagcggaggtttcatgggaagaagaagccgagcattcaggtacctcgcataacatcctagttgaagttcaagatgatgggaccatgaaaatcaaagatgaggagagagacgatacattaactattcttcttaaagccaccctattggcagttagtggtgtgtatccgatgtcaatacctgcaaccttctttgtatggtatttctggcagaagaagaaacagagaagtggtgtattgtgggacacgccgtcgccgccggaagtagaaagagccgtactggatgatgggatatatcgcatactacaaagaggattactaggcaggtctcaagtaggtgtgggtgtttttcaagatggagtatttcacacaatgtggcacgttacgagaggagcagtcttgatgtatcaaggaaaaaggcttgaaccctcttgggcaagtgtcaagaaagatcttattagttatggaggtggctggagattccaagggtcatggaacacgggagaagaggtccaagtaattgccgtagagccaggcaagaaccccaaaaatgtacaaaccacacctgggactttcaagacaccggaaggtgaggttggtgcaatagcgctcgactttaagccggggacgagtggatcccctattgtaaacagggaagggaaaattgtcggattatatggaaatggggttgtcacaacaagtggcacttacgtatcagctattgcacaggcaaaaacttcacaagagggacccttaccagaaatcgaggaagaagtatttaagaaacgaaatctcacaataatggacttgcacccaggatcaggaaaaacgagacgttacctacctgcaattgttagagaggccatcaagaggaaattgcgcacactaattttagcacctactagggtcgtcgcttcagaaatggcggaagccctaaaaggaatgcctatccgttaccaaacgacagcagtgaaatctgaacataccggacgagaaatcgtagatctaatgtgtcacgcaacgttcaccatgcgcctattatccccagttagagtgccgaactacaatatgataattatggacgaagctcatttcacagacccggcgagcatagctgcaagaggatacataagtactagagtaggaatgggagaggcagcagcaatatttatgacggcaacgcctccaggaagtgtagaggctttcccacaaagtaatgcagtgatacaagatgaagaaagagatataccagaacggtcatggaactctggatacgattggattacggacttcccaggtaaaacagtatggtttgtgccctcaattaaatctggtaatgatatagctaactgcctaaggaaaaacgggaagcgggtaatacaattaagcagaaaaacgttcgatacagaatatcagaaaacccgaaataacgattgggattatgtagtaacaacagacatatcagaaatgggagctaacttcagagctgatagagtaatcgaccctcgaagatgtctgaaaccagtaatactaaaagacggaccagagcgtgttattctagcgggtccaatgccagtaactgtggctagtgcggcccaaaggcgagggagaataggtcgaaatcaaaataaagaaggggatcaatatgtatatatgggacaaccactaaataacgatgaagaccacgcacactggactgaagccaaaatgttacttgacaatattaatactccagaaggaataattcctgccttgttcgaaccagagcgtgaaaaatctgcagcaatagacggagaataccgcttacgaggcgaagccagaaagacttttgtagaacttatgagaagaggagatttacctgtgtggctgtcttacaaagtagcgagtgaaggtttccagtattcagatagacgctggtgttttgacggagaaaggaataatcaggtactcgaagagaacatggatgttgagatttggactaaggaaggagagagaaagaaactaagaccacgctggttggacgcacgaacttacagcgaccctttggcgttaagagaatttaaggaatttgcagcaggacgacgatcggtatccggcgatctaatcttggaaattgggaaactaccacaacatctcacgttaagagcccaaaatgcactcgacaatcttgtgatgctacataacagcgaacaaggtgggaaggcttaccgccatgcaatggaagaattacctgatacgatcgaaactctaatgttactagcattaatcgctgtactaacaggaggagtaacactattctttttaagtgggaagggcctagggaaaacaagcatcggtctattgtgtgtaatggcaagtagtgcacttttatggatggcaaatgtcgaaccgcattggatagctgcgagtataatacttgaatttttcttgatggttttgttgataccggaacccgacagacagagaaccccgcaggacaatcaattagcatacgtagttataggcttactgtttatgatcttgaccgtagctgccaatgaaatgggattattggaaactacgaaaaaggacctgggaataggtcatgtagctgcagaaaatcaacaccacgccacaatgttggacgtcgatctaagaccagcatctgcttggactttatatgcagtagcaactacagtaatcacacctatgatgcgacatacaatagaaaacaccaccgctaatatatcgctaacggcaattgctaaccaagcggcaattctaatgggattagacaaaggctggccaatcagtaagatggatataggggtacctttactggcactaggatgttattctcaagttaatccattgacactaacggccgctgtgttgatgctagtggctcactacgccattatcggccccggtttacaggctaaagcgacccgggaagctcagaaaagaactgcagctggtattatgaaaaatccaacagtagatggtattgttgcaatagatcttgatcctgtagtttacgatgcaaagttcgaaaagcagcttgggcagatcatgcttcttatactgtgcacttcacagattttattaatgcgtactacatgggcactgtgtgaatcgatcacactcgctacaggcccactaacgacgttgtgggaaggaagtcctggaaaattttggaacacaacaatcgcagttagtatggcaaacatttttagaggatcttatcttgccggtgcaggtctagcctttagtctgatgaagtcacttggtggaggaagacgcgggacaggtgcgcaaggagaaacacttggggagaaatggaaacgtcaactaaaccaactatcaaaatcagaatttaatacctacaagcgaagcggtattatggaagtagacagatcagaagcaaaagagggattgaaaagaggcgaaactacaaaacatgccgtttccagaggcactgcaaaactcagatggtttgttgaacgaaatctcgttaaacctgagggaaaagttatagaccttggttgtggtagaggcggttggtcatattattgtgcgggactgaagaaagtaactgaagtaaaaggttatacaaaaggcggacctggtcacgaggagccgattccaatggcgacgtatggttggaatctcgtgaaactctattctggtaaggacgtcttctttaccccacccgaaaagtgtgatacattattgtgtgacataggagagtcttcacctaaccctacgattgaagaggggagaactcttcgtgtgttgaaaatggtcgagccttggctacgaggtaatcaattttgtataaaaatactgaatccatacatgccatctgtagtagaaaccctagagcaaatgcagaggaaacacggtggcatgttagttagaaacccactaagtaggaacagcacacacgaaatgtattgggtgtcttgtggaactggaaacatcgtatctgccgtcaacatgacttcaagaatgctcttaaacaggtttacgatgacacataggaagccgacgtacgagagggacgtcgatctaggtgcagggacgcgacacgtagccgtcgaacccgaggttgcgaatctagatataataggacaaaggatagaaaatatcaaaaatgagcataaatctacatggcactacgatgaagacaatccatataagacgtgggcttaccatggtagctacgaagtcaaaccctcaggaagcgcttcaagtatggtaaatggggtagtgagacttttaacaaaaccttgggatgtgattccgatggtcactcaaatagccatgacagacacaacccctttcggccaacagcgagtgtttaaagaaaaagtagacactcgcacaccaagagcaaaacgcggaacggcacaaataatggaagtaacagccaagtggttatggggctttctttcacgtaataaaaagcctcgaatatgcacgagagaagagttcacgagaaaggttagatctaatgcggcaataggcgccgtgttcgtagacgagaatcaatggaactccgcgaaagaggcggttgaagacgaacgcttctgggacttagtgcaccgtgaaagagaactacataaacagggcaagtgtgctacgtgtgtatataatatgatgggaaaaagggagaagaaattgggcgaatttggaaaggctaaaggaagtagggcgatttggtatatgtggctaggtgctcggtttcttgaatttgaagcattgggatttatgaacgaggaccactggttttcgagagaaaatagttttagcggggtagagggcgaaggtttacacaagttgggatatatacttcgcgatatcagcaaaattccaggaggcaatatgtacgctgacgacactgctggatgggatacccgtataacagaagatgacctacaaaacgaagcaaaaataacagatataatggaacccgaacatgctctattggcgacaagcatatttaaactaacttaccaaaataaagtagttcgagttcaaagaccagctaagaatggcacggtgatggacgtcattagccgcagggaccagcgtggatccggccaagttggtacttatggacttaatacttttactaatatggaagttcaactcattaggcaaatggaatctgaaggtatcttcttgccttcagaattagaaacaccaaatctagctgaaagagtgctcaattggctggagaaacatggaactgaacgtttgaagagaatggcgatatcgggagatgactgtgtagtcaaacctgtagacgatagattcgctacagctttaatcgcgttaaacgacatggggaaagtaagaaaagacatcccacaatgggagccatctaaaggttggaatgactggcaacaggtgccgttttgctcccaccattttcatcagttaataatgaaagacggacgggaaatagttgttccatgcagaaaccaggatgaattagtaggccgagcgcgggttagtcaaggagcaggttggtctctcagagaaacagcatgtctcggcaaaagttatgcccaaatgtggcaattaatgtattttcataggagagacttgagactggccgcaaatgccatatgttcagccgttcccgtcgactgggtaccaacgtctagaactacatggagtatccatgctcaccatcaatggatgaccacagaagacatgctctccgtctggaaccgggtgtggatagaggaaaacccatggatggaagacaaaacgcatgtaagttcctgggaagaggtcccctatctaggaaagcgcgaggatcaatggtgcgggagcctaataggcttaacagcccgcgcgacatgggcgactaatattcaagtcgccatcaatcaagttagaaggctgattggaaacgaaaactacttagactatatgacaagtatgaagcgatttaaaaatgagagtgatcccgaaggagccctatggtaa

SEQ ID NO: 21381 - RNA, 9879 nt, synthetic construct
  misc_feature 1..9879: note = derived and/or modified CDS sequence (opt6) from DENV-1__FJ410174__SS-prME
  source 1..9879: mol_type = other RNA
tcagtcactatgctgctcatgctcttaccaactgcacttgcttttcatttaactactagaggaggagaaccccatatgatagtatctaaacaagaacgaggaaaaagcctgctattcaaaacctcggctggtataaacatgtgtacacttatagctatggatttaggtgaattgtgcgaagacacaatgacttacaaatgcccgagaatcaccgaagctgaaccggatgacgtcgattgttggtgtaacgcaactgacacgtgggtgacgtatggtacttgcagtcaaacgggagaacataggagagataaacggtcagtagcgctagcacctcacgtaggattagggttagaaacacgtacagaaacatggatgtcgtcagaaggggcttggaaacaaatacaaaaagtagaaacgtgggcgttaagacaccctgggtttactgtaacagcgctatttctagcacacgcaataggtacaagtatcactcagaagggtatcatctttatactcttaatgcttgtaacaccaagtatggcgatgagatgtgtgggaattggaaatcgcgattttgtagaaggattgtcaggcgcaacctgggttgatgtagttttagaacatgggtcgtgcgtgactaccattgcaaaagacaagccgacgttagacattgaattgctgaagactgaagtaacaaacccggctgtattaagaaaactatgtatagaagctaaaatttcaaatactacaacagattccaggtgtcctacacagggtgaagcaacattagtggaagaacaggactcaaacttcgtttgcagaagaacctttgttgatagaggttgggggaacggatgcggtttgtttggaaaggggagcttactgacatgtgccaaattcaaatgcgtcacaaagttagagggtaagatagtacaatacgaaaacttaaaatactccgtgatagttacagtccacacaggtgaccaacaccaagtaggtaacgagacaacagagcatggtacaatagctacgataacaccacaagcgcccacgagtgaaatccagttaaccgactatggtgcattaacattagactgttccccacggacgggcttggattttaacgagatggtcctgcttacgatgaaagaaaaatcatggcttgtacataaacagtggtttttggatctaccattaccatggacctcaggtgcatcaacaagccaagagacttggaaccgtcaagatcttttggtcacttttaagaccgctcatgcaaagaaacaggaagttgtagtgctaggtagccaggaaggagctatgcatacggccctaaccggagcgacagagatacaaacatcaggtacaacaactatctttgccggtcacctaaaatgtcgccttaaaatggacaaacttacactcaaaggaatgtcatatgtaatgtgtacaggctcgtttaaactggaaaaagaggtagccgaaactcaacacggcacagttttggtgcaggtcaaatacgaagggactgatgccccctgtaaaatacccttttcggctcaggatgagaaaggagtaacccaaaacggtcgacttattactgccaatcctatagtaacagacaaggaaaagccagttaatatcgagactgaacctcctttcggagagtcgtacattgtagttggagccggcgagaaagctcttaaattaagttggttcaagaaaggatcctcgatcggcaaaatgtttgaagctacggcgagaggggcaagaagaatggcaatcctaggcgataccgcgtgggattttggaagcatagggggagtttttacttctgtagggaaattggtacatcaagtctttggagcagcttatggtgtactattctccggggtaagttggactatgaaaatagggattggaatcctattgacctggttggggttaaatagtcgtagtacgagtttaagcatgacatgcatagctgttggaatggtaactttatatctaggtgtaatggtacaggcagacagtggatgtgtaattaattggaagggccgtgaacttaaatgcggatctggaatatttgttacaaacgaagtccatacatggactgagcaatataaatttcaagccgactcaccaaagagattaagcgccgccataggtaaggcttgggaagagggagtatgtggcatccgttcagcaacgaggttagaaaatattatgtggaagcaaatatctaatgaattgaaccacatcttgcttgagaatgacatgaagtttactgtggtcgtaggagatgcaaacggcatattagcccaaggcaagaaaatgattaggccacaaccaatggaacatagatactcgtggaaatcgtggggaaaagctaagattataggcgcagatattcagaatacaaccttcatcatagatggacccgacaccccagaatgtccagatgatcaaagagcttggaacatttgggaagtcgaagattatggcttcggcatatttacgactaacatatggttaaagttaagagattcatatacacaaatgtgcgaccaccgactaatgtccgcggcaataaaagattccaaagctgtacacgccgacatggggtattggatagagagcgagaaaaacgaaacatggaagctggctcgagcatcttttattgaagttaaaacatgtatatggccaaaaagccacactttatggtcaaacggcgtgttggagtcagaaatgatcattccaaaaatatacggtgggcctattagccagcataactatcgccctggatattttacgcagacggcgggaccgtggcacttgggcaaactggaactagattttgatctctgcgaaggcacaactgtggttgtagatgaacactgcggcaacagaggtccaagccttagaacaacgactgtcacaggtaaaataatccacgaatggtgttgtagaagctgtaccttaccgcctttgagatttagaggagaagacgggtgctggtacggaatggagattaggccggtaaaggaaaaggaagaaaacttagtaagatcgatggtgtcagcgggctcaggggaagttgatagcttttcattaggaatactttgcgtttctataatgatagaagaagttatgagatctcgatggtctcgaaaaatgttaatgacaggcacattagcagtctttctattattaataatgggtcaattaacttggaacgatttaatacggctatgtatcatggtcggggctaatgcatcggatagaatgggcatgggtatcacatatttagcacttatggcaacatttaaaatgcgaccgatgtttgctgtggggttattattccgccgtctaacatctagggaggtcttactactgaccataggtcttagtttagtagccagcgtagagctgccgaacagtctagaagaattgggagatggtttggcgatgggaattatgatgctaaagctactaacggagtttcagccacaccagttatggaccacgctcctgtctttaacgtttataaaaacaacactaagtctggattacgcatggcggacaatggctatggtactgtccattgtcagtctgttcccattgtgtctttccaccacatcacaaaagacaacttggcttcctgttctactaggatcctttggttgtaaaccacttaccatgttcttaatcacagaaaataaaatatgggggcgaaaaagttggccattaaacgaaggtataatggccattggaatagttagtattctcttatcatccttgctgaaaaatgatgtaccactagcaggaccactcattgcaggaggtatgttgatcgcgtgttacgttatatcgggatcaagcgctgatttaagtttagaaaaagcagcggaagttagctgggaagaagaagccgagcactcaggtacgtcacataacattttggtagaagtgcaagacgatggaacgatgaagataaaagatgaagaacgagatgatactttaacgatactattaaaagctacacttctagctgtatcaggtgtttatccaatgagcataccagctacgcttttcgtttggtatttttggcaaaagaagaaacaaagatccggcgtactatgggacacaccctcgccaccagaagtagaaagagcagtactcgatgatggcatatacaggatcttacagagaggtctattgggtcgatcacaagttggggtgggtgtcttccaggacggagttttccacacgatgtggcacgtcaccagaggtgcagtccttatgtatcaaggaaaacgactagaaccctcgtgggcgagcgttaagaaagacctaatttcatacggaggtggctggagatttcaaggatcgtggaatacaggcgaggaagttcaagtcattgccgtggaacccggcaaaaaccccaaaaacgtacaaacaacaccagggaccttcaagacgccagaaggagaagtcggagcaattgcactagattttaaacctggcactagcggaagtccaatagtaaatagagaaggaaaaatagttggcttgtatggaaacggcgtagtaacgacaagtggcacttatgtaagtgctatcgcacaagccaagacatcccaggaaggtcctcttcctgagatagaagaggaagtatttaagaaaaggaacctgactattatggatttacatccgggaagtggaaaaacacgccggtacttaccagcaatagtccgagaagccataaaacgtaaactacgcacactgatactagcaccaacacgagtagttgcaagtgaaatggcagaagcattaaaaggcatgcccattagatatcaaacgacagccgttaagtcagagcatacaggacgtgagatagttgacctaatgtgtcatgcgactttcacaatgagattattatcaccagtacgagtgcccaactataatatgataatcatggatgaagcacatttcacagatccggcctcaatagcagctcgtggatacataagtactagagttggcatgggagaagcagccgcgatattcatgactgctacgcctccaggaagtgttgaggcatttccgcagtctaacgcggtaatacaagatgaggaacgagacatcccggaaaggtcttggaactctgggtacgattggataactgacttcccgggcaaaaccgtatggttcgtccctagcatcaagagtggtaatgatatagcaaactgtcttaggaagaacggcaaacgtgtaatacaactttccagaaaaaccttcgatacggagtaccagaaaacgaaaaataacgattgggattatgtggtcactaccgacatatccgaaatgggtgccaacttcagagcagaccgtgtcattgatccacgaagatgccttaaaccagtgatcttaaaagatggaccagagcgagtaatactagcgggaccgatgccagttactgtggcctcagcggcgcaaagaagaggtcgtataggacgaaaccaaaataaggaaggcgaccaatatgtttatatgggtcagccgttaaacaacgatgaggatcacgctcattggacagaagcaaaaatgttgctcgacaatatcaataccccagaagggatcattccagctttatttgagcctgaaagagagaaaagtgcagctattgacggggaatatcgactcagaggggaggctagaaaaacttttgttgagttaatgagaaggggtgacttacccgtatggctttcatataaggtagcaagtgaaggattccaatattctgaccgcagatggtgcttcgatggagaacgcaacaatcaggttctagaagaaaatatggacgtagaaatttggaccaaggagggtgaaaggaagaaattacggcctagatggttagatgcacgcacatacagcgatccattagcactcagagagttcaaagagtttgccgcgggaaggcggagtgtgagtggagatttgatactagaaataggtaaattgccacaacacttaactttacgtgcgcaaaatgctctagataatctcgtaatgttacataatagtgaacaaggaggaaaagcctatcgacatgcgatggaggaactgcctgatacaattgaaactttaatgttattagctttaatagctgtgttaacaggtggtgtgactttatttttcctatcaggtaaaggtttggggaagacaagtataggactgttatgcgtaatggcttcatctgcgttactctggatggcaaatgtggaaccccattggattgcagcatcaataattcttgagttcttcttgatggtattactaataccagaaccagataggcaaagaacaccgcaagacaatcagctggcatatgtagttataggattactatttatgattttaactgttgcagctaatgaaatgggccttttagaaacaactaagaaagacttgggtataggacatgtagctgccgaaaaccagcaccatgcaactatgttagatgtagacctacgacccgcaagcgcgtggacgctttacgctgtcgctactacagtaataactccaatgatgcggcacacaatagaaaatacgacggccaacatatctctcacagcaattgcaaatcaagcagccattctaatgggactagataaaggatggcccatttccaaaatggacattggtgtcccactgcttgcattgggttgctatagccaagtaaatccgttgacattaaccgctgctgtactaatgttagtagcacactatgctattatagggccaggtttacaagctaaggcgacaagggaggcccagaaaagaactgcggctggaataatgaagaatcccacagtagatggtattgtagcgatagatttggatccggttgtatatgacgccaagtttgaaaagcagttggggcaaattatgcttctaatcttatgcacctctcagattctattaatgcgcactacttgggcattgtgcgagtctatcacattggcaacaggtcctttaacaacattatgggaaggtagtcctggcaaattttggaatacaacgatagcggtctcaatggcaaatatatttagaggtagttacttagccggtgcagctcttgcgttcagtcttatgaaaagtttaggaggaggaagacgaggtacaggtgcgcaaggcgaaacgttaggagaaaaatggaaacgacagttgaaccagctcagtaagtctgaatttaatacgtataagagatctggaatcatggaagttgatcgcagtgaagcaaaagaaggactaaaaagaggagaaacaacaaaacatgccgtaagtagaggtactgcaaaactccgctggtttgtggagcgaaatttagtcaagccagagggaaaagttatagatttaggatgcggacgaggaggttggtcctattattgtgcaggactgaagaaagttacagaagtcaagggttacactaaagggggaccgggacacgaggaaccaataccaatggcaacatatggttggaacttagtaaaattatactctgggaaagatgtcttcttcacacctcctgaaaaatgtgacaccctcctctgcgacattggggaatcttcaccaaatcctacaatagaagaaggacgaacactacgagttctaaaaatggtcgagccatggttaagaggcaatcagttttgtattaaaattctgaacccgtacatgcccagcgtcgtcgagacattagaacaaatgcagcgtaaacatggaggtatgttagtccgaaacccattaagtcgaaatagtacacacgagatgtactgggtttcatgtggtactggaaatatcgtatcagctgttaatatgacttcacgcatgcttctaaatagattcaccatgacccacaggaaaccgacgtatgaacgagatgttgacttaggtgcaggtacaagacacgtagcagtggaacctgaagtggctaatttagacataattggacaaagaattgaaaacatcaaaaatgaacataaaagtacgtggcactacgacgaagacaatccgtataaaacctgggcttaccatggtagctatgaggtaaaaccaagtggttcggcgagcagcatggtaaacggagtagtacggctcttgacgaagccgtgggatgtgattccgatggtgacgcaaatagcaatgacagacacgactccattcgggcaacaaagagtatttaaagagaaagtagacacaagaaccccaagggccaaaagaggaacggcccaaatcatggaagtgacggcaaaatggctatggggatttttaagtagaaataagaaacctagaatttgtacaagggaagaatttacccgaaaagtaagatccaatgcagctataggagcggtcttcgtagacgagaaccagtggaatagtgcaaaagaggcggtagaagatgaacgattttgggatctagtgcaccgggaacgagagttacataagcaaggtaaatgtgctacatgtgtctacaatatgatgggcaaacgtgagaagaaacttggagaatttggtaaagcaaaaggatcacgggcgatatggtacatgtggctgggcgcgagattccttgagttcgaggcactaggatttatgaatgaagatcattggttctcaagagaaaatagcttctctggcgtagaaggagaagggttacataaattaggttacatactacgagatatatcaaaaatcccgggcggaaatatgtacgcagatgacacagctggatgggacacacgaataacagaggatgatcttcagaacgaagccaaaataaccgacatcatggaagcagagcacgcgcttctggcgacttctatatttaaattaacctatcaaaataaagtagttagagtgcagagaccagccaaaaacggtacagttatggacgtaataagtagacgggaccagaggggatcaggtcaagttggaacctatggtctaaacacctttactaatatggaggttcaactgatacgacagatggaatcagaggggatctttcttccttcagagctagagactcctaatctcgccgaacgagtattagactggctagagaaacatggcacagagcgactgaaacgcatggctatatctggagatgattgcgtagttaaaccagtcgatgaccgttttgcaaccgcacttatcgccctgaatgatatgggaaaggtgcgaaaagatattccgcaatgggagcccagtaaaggttggaacgattggcaacaagttcctttttgttcccaccattttcatcagttaataatgaaggatggcagagagatagtggtgccttgtagaaatcaagatgaactcgttggtagagcgagagtttctcaaggggcggggtggtctttacgcgaaacagcatgtttaggaaagagctatgcgcaaatgtggcaattaatgtactttcataggagagatctaaggcttgcagcaaacgcaatatgtagtgcggtaccagttgactgggttccaacttcccgaacgacatggagcatacatgctcatcatcagtggatgacaactgaagacatgctctccgtctggaacagagtatggattgaggagaacccgtggatggaagataagacccacgtttcttcctgggaggaagtaccttacctggggaaaagggaagatcaatggtgtggatcgctaattgggttgactgctcgagctacttgggcgactaacatacaagtcgccattaaccaagtccggcgattaataggcaatgaaaattatctcgactatatgacttccatgaaaagattcaagaatgaatcggatccagaaggcgccctatggtaa

SEQ ID NO: 21382 - RNA, 9879 nt, synthetic construct
  misc_feature 1..9879: note = derived and/or modified CDS sequence (opt6) from DENV-1__FJ410175__SS-prME
  source 1..9879: mol_type = other RNA
agtgttactatgttattaatgctactaccaactgcgctagcttttcatttaactactcgaggaggtgaacctcatatgatcgtatcaaaacaagaacgagggaaaagtttattgttcaaaacaagtgcaggtataaacatgtgtacattaattgctatggatcttggagaactatgcgaagataccatgacttacaaatgtccgcggattactgaagctgaacctgacgacgttgactgctggtgtaacgctactgatacttgggttacatacggaacgtgctcacaaacaggagagcacaggagggacaaaagaagcgttgcgttagcaccacatgtaggtctcggtttggaaacacgaactgaaacatggatgagttcggaaggggcgtggaaacaaattcaaaaagtagaaacatgggcattacgtcatccgggattcaccgtaactgctcttttccttgctcacgcaatcggaacgtccataactcaaaagggaataatattcatactactgatgttagtaacaccttccatggcaatgcgctgcgtcgggattggtaaccgagactttgtggaaggtctatcgggtgccacatgggtagatgttgttctggagcacggcagctgcgttacgacaatggccaaagataaacctacgttggacatcgagttactaaagactgaagtaactaacccagcagttttaagaaaactttgtattgaagcaaaaataagcaacacaacaacagacagcagatgcccaacacaaggagaagcaaccttggtggaagaacaagatagtaattttgtatgcagaaggacctttgtagataggggctggggaaacgggtgcggactatttggtaaaggatctttgctcacctgtgccaagtttaaatgcgtcacgaaattggagggtaagattgtacaatacgagaatctaaaatattcagtaatagtcacagtgcacacgggggaccaacatcaagtaggaaatgaaactactgaacatgggacaattgcaactataacaccgcaagcacctacaagcgaaatacaattaacagattacggagcactcacattggattgtagtccacgaactggtctagattttaacgagatggtattattaactatgaaagagaaatcatggttagttcataaacagtggtttttagatcttccgctcccgtggaccagcggagcgtctacatctcaggaaacgtggaatagacaagacctattggttacgtttaagactgcacacgctaaaaagcaggaagtcgtcgtattaggatctcaagaaggagctatgcacactgctttaacaggagcaaccgaaattcaaacaagtggtacaacaactatctttgcgggtcatcttaaatgccgtctcaaaatggataaactcacactaaagggcatgtcatacgtgatgtgtacaggatcatttaaactagagaaagaggtagccgagacccagcacgggacagtgttagtacaagttaaatatgagggaactgacgcgccctgcaaaatacctttctctgctcaggatgaaaagggagttactcaaaatggtcgcttaatcacagctaacccaatagttactgataaagagaaaccggtgaatatagaaaccgaaccgccatttggcgaaagttacattgttgtaggcgccggtgaaaaagcattaaaactgagctggtttaagaaaggtagcagcattggcaaaatgttcgaggctactgctagaggggctagaaggatggctatattaggagataccgcatgggatttcggaagtataggaggtgtcttcacctcagtaggcaagttagttcatcaggtgtttggtgcggcatatggggtactattctcaggcgtctcctggacgatgaagatagggattggtattttattgacatggttaggtttaaattcccgatccacaagtttgtccatgacatgcatagcagttgggatggtgacattatatctcggagtaatggtacaagcagattcagggtgtgtcattaactggaaaggaagagaacttaaatgcggatcaggtatctttgtaacaaatgaagtacatacatggacggaacagtacaaattccaagcagatagtcctaaaagactatcggcagccataggaaaagcatgggaggaaggagtgtgtggaataagatctgcaacaagattagaaaatattatgtggaagcagatttctaacgaacttaaccatattctcctagagaatgatatgaaatttacagtagtggtaggcgatgcaaatgggatactagcacagggaaagaaaatgatacggcctcagcctatggaacataggtactcatggaaatcatggggtaaagcgaaaattataggggcagatattcaaaacacgacttttatcatcgacggtccagacacgccggaatgccctgatgatcaaagagcctggaatatctgggaggttgaagattatgggtttggtatcttcaccaccaatatctggctgaaactcagagactcatacacacagatgtgtgatcatcgactaatgagtgcagctataaaagactctaaagcagtccatgcagatatgggctactggatagaaagcgagaaaaatgaaacttggaaactagcacgagcctcattcattgaagttaaaacctgtatatggcctaaatctcatactctatggtcaaatggagtactcgaatcagagatgatcattccaaaaatttacggcggcccaattagtcaacataattaccggccaggatattttactcagactgcaggaccatggcacctaggtaaattagaattagactttgatttatgcgaaggaacaaccgttgtagtggatgagcactgtgggaaccgaggacccagcctcagaacaaccaccgtaaccgggaaaatcattcacgaatggtgttgtagaagttgtactttaccacctttacgttttaggggtgaagacgggtgttggtatgggatggaaataagaccagttaaagagaaagaagaaaatctggtacgctcgatggtaagtgctggcagcggagaagtagactccttttcactgggcatactgtgcgtaagcattatgatcgaggaagtcatgaggtctcgctggtcaaggaaaatgctgatgacaggaacacttgcagttttcttattattgataatgggtcaactgacttggaatgacttaatcagattgtgtattatggtgggagctaacgctagtgaccgaatgggcatgggcacaacatatcttgcccttatggcaacatttaaaatgcgacccatgtttgctgtcggcctattatttaggagactcactagcagagaggtactactactaacgatcggactcagtttagtagcatctgtagagctacctaatagtctagaagaattaggggacggcttagccatgggtataatgatgctcaagctcctaactgagtttcagcctcaccaactatggacgacacttctatcccttacattcataaaaacaacgttaagcctagattatgcatggagaacaatggccatggtactaagtattgttagcttgtttccattatgtttatcgaccacaagccagaaaacaacatggctgcctgtgttactaggatcctttggctgtaaacctttaaccatgtttttgattacggaaaacaaaatatggggacgaaaaagctggcctctaaatgaaggtataatggcaataggcatcgtctctattttgctaagttcactactcaaaaatgatgttccgttagcaggacccttaattgccggtggtatgttaatcgcgtgttatgtcatcagtgggagtagcgcagacctttcattagaaaaggctgcagaggtgtcttgggaagaagaagcagaacactcaggtacatcgcataacattctggtagaagtacaagatgatggtactatgaaaataaaagatgaagagagagatgacaccctaacgattctactcaaagcgactttacttgcagtgtctggtgtatatcctatgagtatccccgctacattgttcgtttggtacttttggcagaaaaagaaacaacgctctggtgtgttatgggacacaccttctccgccagaagtcgaaagagccgttctagatgatggtatatataggattcttcaacgtggactcttaggaaggtcacaggtaggagtgggagtgttccaggatggtgtgttccataccatgtggcacgtaacgcgaggggcagtattaatgtatcaaggtaaacgtcttgaaccctcttgggcttcggtcaagaaagatctcatttcatatggcggcggttggcgatttcaaggctcttggaatactggtgaagaagtacaagtgatagctgtagagcctggcaaaaatcccaaaaatgttcaaacaacgcctggaactttcaaaacacctgaaggagaagttggtgcaatcgcattggatttcaaaccgggaacctcaggcagtcccattgtcaatagagaggggaaaatagtcggcttgtacggaaacggtgtcgtgactacaagtgggacctacgtatctgcaattgcgcaggctaaaacgtcccaagaaggtcctttacctgaaatagaagaagaagtttttaagaaacgtaacctaacaattatggacctacatccaggttcgggcaagaccagacgatacttaccggcaatagtccgtgaggcaatcaaacgaaagttaaggactttgatattagcgccgacacgagtagtagcatccgaaatggctgaggcattgaaaggaatgccaatacgttatcaaacaacagccgtcaaatccgaacatacaggaagagaaattgttgacctaatgtgccacgccacctttacaatgaggttattgagcccggttagggtcccaaactataacatgattataatggacgaagcacatttcactgacccggctagcatagctgcgagaggctacatttcgaccagagtcggtatgggtgaagccgcagcaatattcatgacagccacgccaccaggatcagtcgaagcgtttccccaaagtaatgcagtaatacaagatgaagagagggacataccagaaagaagttggaactccgggtatgattggataactgattttcctggtaagacagtctggttcgtaccaagtataaaaagtggtaatgacatagcgaattgtttacgaaagaatggtaaaagagtaatacagttaagcagaaaaacttttgacaccgaataccagaaaaccaaaaacaatgactgggactatgttgtgacaactgatatttcggagatgggagcaaacttccgtgcggatcgtgtgatagaccccagaagatgtcttaagcctgtcatattaaaagacggacccgaacgagttattttagccggaccgatgcccgttacggtagcatcggcagcccaaagacgtggaaggatcgggcgaaaccaaaataaggaaggcgaccaatacgtctatatgggtcagccattgaacaacgacgaggatcacgcgcattggactgaggcaaagatgctattagacaatataaatactccagagggcatcatccccgctctctttgagcctgaacgtgaaaaatctgcagctatcgatggcgaatacagacttcgaggtgaagcaaggaaaacatttgttgaattgatgaggagaggagacttacctgtctggttatcctataaagttgcttctgaaggattccaatattccgatcgaagatggtgctttgacggagagagaaataaccaagtcctagaagagaatatggatgtagaaatatggacgaaggaaggcgaaaggaagaaactccgccctagatggctggacgccagaacatacagtgatcctctcgcattaagagaatttaaagagtttgctgcgggacgacgcagcgtatcaggtgaccttatcttggagatagggaaattgccgcaacacctaaccttaagagcccaaaacgcgctcgacaacctagtaatgcttcataattcagaacaaggtgggaaagcatacagacacgcaatggaagaattacctgacaccatcgaaactttaatgctactagcattaatagccgtattaactggtggagttactctattctttctcagtggaaaaggtctcggcaaaacgtctataggtctattatgtgtcatggcatcatcagccttactatggatggctaatgttgaacctcattggatcgcagctagtataatattagaatttttcttgatggtattattgatcccagaaccggaccgtcaaagaacacctcaagacaatcagttagcatatgtggtcataggacttttgttcatgattttaacggttgcagccaacgagatgggactactcgagacaactaagaaagacttaggaataggacacgtcgcagcagaaaaccaacatcacgcaaccatgctagatgttgacttaaggcctgcaagcgcttggactctttacgctgtggccacgacggttataacacccatgatgcgacacacaattgagaataccaccgcaaatatatctttaacggcaatagcgaaccaagcagcaatattgatgggacttgacaaaggatggcctatatcgaagatggacattggcgtccctttattggcgctaggctgctactcacaagtaaacccattaaccctaacagcagcggttctaatgttagtcgcacactacgccataatagggccgggacttcaagcaaaggctacacgagaggctcagaaacgaactgctgcaggaataatgaagaatcccacagtcgacggaatagtagctatagatctggacccggttgtatacgacgcaaaatttgagaaacaactaggtcagataatgctcctgatattatgtacctcgcagatattactaatgagaacaacttgggcgttatgtgaatctatcacacttgcaacaggaccacttacaactctatgggaaggttcgcctggtaaattttggaacacaacgatagccgtgtcgatggccaacatattccgtggtagctatttagctggtgcggggctcgcattttcactaatgaaatcactcggcgggggtaggcgaggtacaggagcgcaaggagaaacccttggggaaaaatggaaaaggcagcttaaccaactttctaaatcagagttcaatacgtataaacgaagcggcataatggaagtagatcgctctgaggcgaaggaggggctcaaacgaggcgaaactactaaacacgcagtcagtagagggacagccaaattaagatggttcgttgaaaggaacttagttaaaccagaaggaaaggtaattgatttagggtgtggtagaggtgggtggtcatattattgtgcaggtctaaagaaagtgacggaggtaaaaggatatactaaaggtgggcctggacatgaggaacctatacccatggcaacatatggctggaatctcgtaaaactatactcaggtaaagatgtattctttactccaccggagaaatgtgataccctactatgtgatataggagaatcatccccaaatcctacaatcgaagaagggcgtacgctacgggtactaaaaatggtggaaccctggctaagaggaaatcagttttgcattaaaatccttaatccatacatgccaagtgttgttgagacattagaacaaatgcaaagaaagcacggaggaatgttagttcgaaaccctttaagtagaaatagtacacacgaaatgtactgggtaagctgtggaaccggtaatattgtgagtgcagtcaatatgacgtcaaggatgctcttaaacagatttacaatgacacacagaaaaccaacctatgaacgggacgtcgacttaggtgcgggcactaggcatgtagcagttgaaccggaagtagctaatctagatataatcgggcaaaggatagaaaatatcaaaaacgaacacaaatcaacatggcattacgatgaagataacccatacaaaacgtgggcttatcacggatcatatgaagtgaaaccaagcggatctgcatcttcgatggtaaatggggtggtaagactgctcaccaaaccgtgggacgtaataccaatggtaacccaaatagcgatgacagacaccacgccgtttggccaacaaagagtattcaaagaaaaagttgacacgagaacgccacgggccaaacgagggacagcacaaataatggaagttacagcaaaatggttgtggggatttttaagtaggaataagaaacccaggatatgcacccgtgaagagtttactcgaaaagtgcgttctaatgctgcgataggagctgtttttgttgatgaaaatcagtggaatagcgccaaagaggcagtcgaagatgaaagattctgggatctggtccaccgtgaaagagaactacacaaacaggggaaatgtgcgacatgcgtatataatatgatggggaagagagaaaagaagctaggtgagtttggcaaggcaaaaggctctcgagcaatttggtatatgtggttaggcgcccgatttttagaatttgaggctttaggatttatgaatgaagaccattggttctcaagagagaacagtttttctggcgttgaaggagaaggactacacaaattgggttacatacttagggatataagcaaaatccccggcgggaacatgtacgctgatgatacggcaggatgggacactagaataacggaagacgatttgcaaaatgaggcaagaattacagatataatggagcctgaacatgcgcttctagcaacgagtatattcaaattgacttatcaaaacaaggtagtccgagtccaacgtccagccaaaaacgggacagtaatggatgttataagcaggcgagaccaaagaggtagtggacaagttggcacttatggattaaatacgttcactaacatggaagttcaattaatcaggcagatggaaagtgaaggaattttcctcccttcagaactggaaactcccaatctagcggaacgagttttagattggttagagaaacacggtacagagcgacttaaacggatggcaatcagtggggatgactgtgtcgttaaacctgttgatgatcgctttgctacagctcttattgccttgaatgatatgggaaaagttcggaaagatattccacaatgggagccctccaaaggttggaacgattggcaacaagttccattttgttcgcatcactttcatcaattaataatgaaggatggacgtgaaatcgtggtgccatgtcgaaatcaggatgaattggtgggcagagcacgtgtatcccaaggcgcaggttggagtttaagggagacagcttgtctagggaaaagctacgcacaaatgtggcaacttatgtatttccacagacgagatttaaggttagccgcaaacgctatatgttcagctgttccggtagattgggtaccgacttcgcgaacgacatggtcgatccatgcacatcatcaatggatgacaactgaagatatgctatcggtttggaatagagtgtggattgaagaaaacccttggatggaggacaaaacccacgtctcctcatgggaagaagtaccctatttaggaaaaagagaggatcaatggtgtggaagtttaattggtctcaccgcacgagctacctgggcaacgaacatacaagtagctataaaccaggttcgtaggctaatcggaaacgaaaattatcttgactatatgacgtcgatgaaacggtttaagaatgagagtgatcctgaaggggcgttatggtaa

SEQ ID NO: 21383 - RNA, 9879 nt, synthetic construct
  misc_feature 1..9879: note = derived and/or modified CDS sequence (opt6) from DENV-1__FJ562105__SS-prME
  source 1..9879: mol_type = other RNA
tcagttacaatgctactgatgctattgccaactgtattagctttccatttgactacaaggggaggagaaccacatatgatagttggaaaacaagaacgagggaaaagtttattgtttaaaacaagcgcaggagtcaatatgtgtactctaatagcaatggatctaggagaattgtgtgaagatactatgacttataaatgtcctagaataacagaagcagaacccgatgacgtagactgttggtgtaacgcaacggacacatgggtgacatatggtacatgttcacaaaccggagaacaccgacgcgataagagatcagtagctctagcgccgcatgttggattaggcctagaaacccgaacagaaacgtggatgtcatcggaaggagcatggaaacaaattcaaaaagtcgaaacttgggctttacggcaccctggattcacagtcatagcattcttccttgcacatgccataggtacctcaatcacacagaaaggaattatcttcatcttattgatgctagtcacaccatcaatggcgatgcgctgtgtcggtatcggaaacagagacttcgtagaaggtttgagtggggctacatgggtagatgttgtattagaacacggatcgtgtgtaacaacaatggctaaaaataaaccgacacttgatatagaattactaaaaaccgaagttacaaaccctgcagtactacgtaaattatgtatcgaagcaaaaattagcaacactaccaccgatagcagatgccctacgcaaggagaagcaactttggttgaagaacaagatgcaaactttgtatgccgaaggacattcgttgacaggggttggggcaatgggtgtggcttatttgggaaaggaagtttactaacgtgcgctaaattcaagtgtgtgactaagctagaggggaaaatagttcaatatgagaacctaaaatattcagtgattgttacagtgcacactggagaccaacatcaagtaggaaacgaaactacagaacatggaacaatagcaactataacccctcaggctcccacatcggagatacagctgacggattatggtgcgcttactttagattgttctccacgaactggtctagattttaatgaaatggtgctacttactatgaaagagaaatcttggctcgtccacaaacaatggtttttagaccttcccctaccctggacgagtggagcctcaacctctcaagagacatggaacagacaagatctcttagtcacattcaagaccgctcatgccaagaaacaagaagtcgttgtattaggatcacaagaaggagcaatgcatacagccttgactggggccactgaaattcagacaagtggaacgacaactatatttgcaggacacttaaaatgtagactaaagatggataaattaacactaaaaggaatgtcctatgtcatgtgtactggatctttcaaactagaaaaagaggttgcggaaacgcagcacggaaccgtgttagtacaagttaaatatgaggggacagatgcaccctgtaagatccctcttagtactcaggatgaaaaaggcgtcacacaaaacggaagattaataacagcaaaccctatagtcacagacaaggaaaaaccagttaatattgagactgaaccaccttttggcgagagttacataatagtaggtgccggtgaaaaagcactcaaactctcatggttcaagaagggttcaagtattggaaaaatgtttgaagcaacagctcgaggcgctaggagaatggcgattctaggcgatactgcatgggactttggatctataggaggtgtattcacaagtgttgggaagctagttcatcaagtattcggaaccgcctatggagtattattcagtggagtttcatggacaatgaaaataggaatcggcattcttctaacatggctaggtttaaattctaggtcagcgagtttatcaatgacctgcattgctgtaggtatggtgacgttatacttaggcgtaatggtacaagcagattctggctgtgtaataaactggaaaggacgtgagcttaaatgcggcagcggaatattcgttacgaatgaggttcatacatggactgaacagtacaaatttcaagctgactcaccaaaacgtctctcagcagcaatcgggaaagcatgggaggaaggtgtgtgcggggttcgaagtgccacccgccttgaaaacatcatgtggaaacaaataagcaacgaattgaatcatatcctcctagaaaacgacatgaaatttacggtagtagttggtgacgcaaatggtatccttgctcaggggaaaaagatgatccgcccacaaccaatggaacataaatactcgtggaaatcatgggggaaagccaaaataataggtgctgatattcaaaacaccacgtttataatagacggaccagacacgcctgaatgcccggacgatcaaagggcttggaatatctgggaagttgaggattatggctttggaatatttaccactaatatatggttaaaactccgcgattcatatactcaaatgtgtgatcatagattaatgtcagctgctataaaagactccaaagcagttcatgcagatatggggtactggatagagtcggaaaagaatgaaacatggaaactcgctcgagcatccttcatcgaagtaaaaacatgcatatggcctaaatctcacacactatggagcaacggagtcttggaatctgaaatgataataccaaaaatctatggtggacctataagccaacacaactaccgaccgggatactttacacaaactgcaggaccatggcatcttggcaaactagaactagacttcgatctgtgcgaaggtactacagttgtggttgatgagcattgcggaaatagaggtccttccctacgtacgacaacggttacaggaaaaatcattcacgagtggtgttgtcgatcatgtactctaccacccctaaggttcagaggagaagacggttgttggtacgggatggaaatacggccagtaaaagagaaagaagagaacctagtgcgatccatggtgtcagctggaagtggagaggtagattcatttagtttaggaatcctttgcttatcgattatgatagaagaagtcatgagatctagatggtcacgaaaaatgcttatgacaggaacactagcagtatttctattattaataatgggacagttaacttggaatgatctcatcaggctgtgtattatggtgggagcgaacgctagtgatcgaatgggtatgggtacgacgtacctagctctaatggccacctttaaaatgagaccgatgtttgctgttggcttactattccgtcggttgacatcacgtgaagtattgctattaactataggactgtctttagtagcttcagtagaactgcccaattcgcttgaggaattgggagatggtttagccatgggaataatgatgttgaaacttttaacagaatttcaaccacaccagttgtggacgaccttgctaagcctgacgttcatcaagacaaccttatcgctggattacgcatggaaaactatggccatggtattatccattgtaagcctattcccactatgtctgagcacaacaagtcagaaaactacctggctaccagtattactcgggtcatttggatgtaaacctttaacaatgtttctaataacggaaaacaaaatttggggacgtaaatcttggccactaaacgaagggatcatggccataggaattgtgtcaatattgcttagctccttactaaagaacgatgtacctctagcaggacccttaatagctggaggtatgcttatcgcctgctatgttatttcgggttccagcgcagacctaagtttagaaaaagcagcagaggtaagctgggaagaagaggcagaacactcaggaacttcacacaatatactggttgaggtacaggatgatggaactatgaaaataaaagacgaagaaagagacgacactctgactatactcctaaaagctactttattggccgtttctggggtataccctatgtcaatacccgcaactctattcgtttggtatttctggcaaaagaagaaacaaagatctggagtgctttgggataccccatcaccacccgaagtggaaagggccgttttagacgacggaatatatcgcatattacaacgaggcctgctagggaggtctcaggtaggagtgggagtatttcaggatggggtctttcatacaatgtggcacgtcacacgaggtgccgtgctcatgtatcaaggaaaacgtctagaaccctcgtgggcatcagtgaagaaagacctaatatcttatggagggggctggagattccagggttcatggaacacaggcgaagaagttcaagtgattgccgtagaaccaggcaaaaaccccaagaacgtacaaaccactccgggaacctttaaaacccccgaaggcgaagtgggagcggtagcattagacttcaaaccaggcacatccggttccccaatcgtaaacagagagggcaagattgtcggactatacggtaacggtgttgtgactacttctggaacatatgtttctgcaattgctcaggctaaagcgtcacaagagggaccgttgcctgagatagaagacgaggtgtttaagaaacgaaatctaacaataatggatctgcatccaggctccggaaaaactagacgatatctaccggccatagtcagagaggccataaaacggaaattacgaaccttaattttagcaccaacgagagtcgttgctagtgaaatggctgaagcgcttaagggaatgccaataagatatcagactactgcggtgaaaagcgaacatactggaagagaaattgtagatcttatgtgccatgctactttcactatgaggttattaagtccggtcagagtacctaattataatatgattattatggacgaggcccatttcacagatcccgcaagcattgcagccaggggttacattagtacacgagtcggaatgggtgaggccgcagctatatttatgactgcaacgccaccaggttccgttgaagcatttccacaaagcaatgctgtaatacaagacgaagaaagagacatacctgagcgaagttggaacagtggttatgattggattacagattttcccgggaaaactgtgtggttcgtaccgtcgataaaaagtggtaatgatattgctaattgtctaagaaagaacggtaaacgggttattcaattatctaggaaaacatttgacaccgaataccaaaagactaagaataatgattgggactacgttgtcactactgatataagtgaaatgggagccaactttcgcgccgaccgggtcatagatccgcgcagatgcctaaaacccgtaatacttaaagacggtcccgaaagagtaatactagctggccccatgccagtgacagttgcgagtgcagctcaaaggcgcggacgaattggcagaaatcagaataaagagggcgaccaatatgtatacatgggacagccactcaacaatgacgaagatcatgcgcactggacagaggcaaaaatgctactagataacattaataccccagaaggcataattccagccttatttgaaccggaaagagagaaaagcgcagccattgatggggaatacagactccgaggcgaagctcggaagacattcgtagaactaatgagaagaggcgacctccctgtttggctaagttataaggtagcttctgaaggcttccaatacagcgatagaaggtggtgttttgacggcgaacgaaacaatcaagttttagaggaaaatatggatgtagaaatatggaccaaagaaggggagaggaagaagctacgaccgcgttggcttgacgcgagaacttactctgatccattggcactaagagaatttaaagagttcgctgcaggaaggcggtcagttagtggagatctgattctagaaattggaaaacttccccaacatctcacgcttcgagcgcaaaatgcattagataatctagttatgttgcacaatagtgagcaaggtggtaaggcttaccgtcatgcaatggaagaattaccggataccatagaaaccctaatgcttctagcactaatcgctgttctaacaggtggcgtgatgctattctttctaagtgggaagggtttagggaaaacgtccataggccttctgtgtgtaatggcatcctctgcgctattgtggatggcaagtgtagaaccacattggattgcagcatcaattatactggagttcttcctaatggtactactcattccagaaccggatagacaacgaacaccacaggacaatcaacttgcgtatgtagtcattggattgctattcatgatattaactgtggccgcaaatgaaatgggtctattagagacaactaagaaagatttaggaattgggcacgttgcagctgaaaatcaccatcatgtcacaatgctcgatgtggatttaaggcctgcctcagcatggaccttatatgctgttgcgacgacagttataactcctatgatgcgtcatacaatagaaaacactaccgccaacatttctttaacagctattgcaaaccaagcagccattcttatgggactagataaaggatggcctatatcaaaaatggatataggtgtcccactgttggctctgggatgttactcacaagtaaacccgttgactctcacagcagctgtgctaatgttagtagctcactatgcgattataggccctggactacaggctaaagcgactcgagaggcgcaaaagcgaacagctgccggtataatgaagaatccgacagtagatggcatcgtagctatcgatttggaccccgtcgtatatgatgctaagtttgaaaaacaattaggccaaataatgctcttaattctctgcacgtcccaaatcttgctaatgagaacaacttgggcactatgtgaaagtataacattagccacgggaccactgaccacgttatgggagggaagtcctggaaaattttggaacactactatagcagtcagtatggccaatatattcagaggttcgtacctggcaggagcaggcctggccttctcccttatgaaatcactagggggtggacgaagaggaacaggtgcccaaggggagacgttgggtgaaaaatggaagagacaactaaatcaactttcgaaaagtgagtttaatacttacaaacgatcaggcataatggaggtcgatagaagcgaagcaaaggagggtttgaaaaggggagagactacgaaacatgctgtcagtagggggacagcaaaactacgctggtttgtcgaaaggaatttagtaaaaccagagggtaaagttatagatctaggttgtgggagaggagggtggagctattattgtgcgggcctaaagaaagtgactgaagtgaaggggtacactaaaggtggtccaggacacgaggaaccaatccctatggccacgtatggttggaatttagtaaaattgcatagcggaaaagatgtgttctttacgcctccagaaaaatgtgacacgttgctgtgcgatatcggagaatctagcccaaatccaacgattgaagaagggcggacattaagggttttaaaaatggttgagccatggttaggaggaaatcaattctgtattaagatcttaaacccctatatgcctagcgtggttgaaacattagaacaaatgcagcgaaaacacgggggaatgttggttcggaacccactttccagaaactctacacacgagatgtactgggtatcttgcggaactggcaatattgtgagcgcagttaatatgacatcaaggatgcttctgaatagattcaccatggcccatagaaaacccacttatgaaagggacgttgatctgggtgcgggaacgagacacgtagcggtagaaccagaagtagccaatctgggtattatcggccaacgtatagaaaatatcaaaaatgaacacaaaagcacatggcactacgatgaagataacccatacaaaacatgggcgtatcacgggtcctacgaagttaaaccatccggatccgcgtcttcaatggttaatggtgttgtccgattactcacaaaaccatgggatgttatacccatggtgacacaaatagcaatgaccgatactaccccgttcggacaacagagagtctttaaagagaaagtagacacaagaactccgcgagcaaaacggggaacggctcagataatggaggttacagccaaatggttatgggactttttgtcacgtaacaagaaaccgagaatttgtactagagaggagttcattcgcaaggttaggagtaacgcggccattggagcagtgtttgtggacgagaaccaatggaatagcgcgaaagaggctgtagaggacgaaagattctgggatttggtgcatagagagcgtgaactgcataaacaaggaaagtgtgcgacatgtgtgtacaacatgatgggcaaaagagagaaaaagttaggagagttcggaaaagccaagggttccagagctatatggtatatgtggctgggcgcaagattcttagaatttgaagcgttaggcttcatgaatgaagaccactggttcagtagagaaaattcactcagtggggtggaaggcgaagggctacacaaattagggtatatactcagagacatatccaaaataccaggaggaaatatgtacgcagatgatacagcaggatgggatacaagaattacagaagatgatctgcaaaatgaagcgaaaataacagatattatggaaccggaacatgctctattggctacctctatattcaagctcacgtatcaaaacaaagtggtaagagtccaaaggccggccaaaaatggaactgtaatggacgtgataagcaggagagaccaacgtggatcgggacaggttggtacatatggtttaaatacattcactaatatggaagtccaattaatacgacagatggaaagtgagggaatatttcttccttcagaactggaaacaaccaacttagctgagagagtgctcgattggttggaaaaacacggagttgaaagactaaagagaatggcaatatcgggcgatgattgcgtagtaaaaccaatcgatgacaggtttgcaacagccttaatagcactaaacgatatggggaaagtacgaaaagacataccccagtgggaaccttcaaaaggctggaacgattggcaacaggttccattttgcagtcatcactttcatcaactgataatgaaagacggtagagaaatagtagtaccttgcagaaatcaagatgagctagtagggagagcacgggtatcacaaggcgcgggttggtcactacgagaaaccgcatgcttaggaaaatcatatgctcaaatgtggcaacttatgtactttcatagacgagatttacgacttgcagccaatgccatctgctctgcagtaccagtagattgggttccaacttcaaggacaacttggtcaattcatgctcatcatcaatggatgacaacggaagatatgctgtccgtctggaatagagtatggatagaagaaaacccatggatggaagataaaacgcatgtatcctcatgggaggaggtcccttatttgggaaaaagagaagatcaatggtgcggatctttgatagggttaactgcaagggcaacatgggcaacaaatatacaggtagctatcaaccaagtgcgacgactgataggaaacgaaaactatctggattacatgacaagtatgaagaggtttaaaaacgaaagcgaccccgaaggagctttatggtaa

SEQ ID NO: 21384 - RNA, 9879 nt, synthetic construct
  misc_feature 1..9879: note = derived and/or modified CDS sequence (opt6) from DENV-1__FJ562106__SS-prME
  source 1..9879: mol_type = other RNA
agtgtaactatgttgttaatgttactacccactgctctagcttttcatctaactacaagaggtggagaaccacatatgattgtaagtaaacaagaaaggggtaaatcgctattatttaaaaccagcgcgggtgtgaacatgtgtacactaatagcaatggacctaggagaactctgtgaagatacaatgacatacaaatgccctcgaataacagaagcagaacccgacgatgtagactgttggtgcaatgcgaccgatacctgggtcacctacggtacatgttcacaaacaggagagcaccgcagggacaaaaggagcgtagcgctagcaccgcacgtaggacttggattagaaacacgaacagaaacgtggatgagttccgagggggcttggaaacaaattcaaaaagtagaaacatgggcattaagacatccaggcttcacagttatagcgctgtttctcgcccatgcaattggaacaagtataacccaaaaaggtataatatttattctattaatgttagtgactccttctatggcgatgagatgcgtaggaataggcaaccgagactttgtcgaagggttgtcaggtgctacttgggtggatgtcgtcctggaacatggatcctgtgtgactactatggccaaaaataaacctacattagatattgaacttctaaaaacagaagtcactaatccggcggtattgcgaaaattatgcattgaagcaaaaattagtaatacaacaaccgatagtcgctgcccaacacaaggtgaggctaccttggtagaggaacaagacgccaattttgtatgcagaaggacttttgttgatcgcggttggggaaacggttgtggattattcggtaaaggctcacttttaacttgcgcgaaatttaaatgtgttaccaaactagagggtaaaatagtgcaatatgaaaatcttaaatattccgtaatagtaaccgtgcataccggtgatcaacaccaagtgggcaatgaaactacagagcacggaaccatcgctactataactccccaggcgcccacttcagaaatacaactaaccgattacggtgcactgacattagattgttcgccaagaacaggattagattttaacgaaatggttctccttactatgaaagaaaagtcttggctagtccataagcaatggtttcttgatttaccactgccatggaccagcggagcttccacatctcaagagacatggaataggcaagacctcttagtcacatttaagacagcacatgccaagaaacaagaggttgtagttctcggttcacaggaaggcgctatgcatacagcacttactggagcaacagaaatacaaacgtctggaacaaccaccatctttgcaggccacttaaagtgcagactaaaaatggataaacttacccttaaaggaatgtcatatgtcatgtgcacaggatcttttaaacttgaaaaagaagtagcggaaacacagcatggcacggtcttggtacaggtaaagtatgaaggcacagacgcaccgtgcaaaattccttttagtacacaggatgagaaaggagtaactcaaaatggcaggttgatcaccgcaaatcctattgtaacagacaaagagaaaccagtcaatattgaaacggagccacctttcggagaaagttatataatggtaggtgccggtgaaaaggctctaaagttatcatggttcaagaaagggagttctattggtaaaatgttcgaggcaactgcaaggggagcaagacgaatggcgatactaggcgacacagcttgggattttggaagcataggaggagtgtttacctcggttggcaagctagttcatcaagttttcggtacagcatatggagttctttttagcggagtgtcttggaccatgaaaattggtatcggaatcctgctcacgtggttaggattgaacagtagatcagcatctctcagcatgacttgtattgccgtcggaatggtgactctatatttaggcgtaatggttcaagctgactctggatgtgtcataaactggaaagggcgtgaactaaaatgcggaagtggtatattcgttacaaatgaagtacacacctggactgaacaatataaatttcaagccgattcacccaaacgattgtcagcagcgataggaaaagcatgggaagagggagtgtgcggcatcagatccgcaacccgattagagaatataatgtggaaacaaataagcaatgagctcaatcatatactgttagaaaacgatatgaaatttacggtagtcgtaggcgatgcaaatggaattttagcccaagggaagaaaatgatacgtccacaaccaatggaacacaaatattcgtggaagagttggggaaaagcaaaaattataggggctgatattcaaaatactacattcataatcgatggaccagacacacccgaatgcccagatgaccagcgtgcctggaatatctgggaggtggaagactatggatttggcattttcacaaccaatatttggctaaaactcagagattcttacacacagatgtgcgatcaccgactaatgagtgcagctatcaaaaactcaaaggctgttcacgctgatatgggttattggattgaatctgagaaaaacgagacgtggaaattagcaagagctagtttcattgaagttaaaacttgcatttggcctaaatcccatacactctggagcaatggcgttttagagtctgagatgattatacctaaaatatatggaggtccaatctctcaacataattatcgaccaggatacttcactcaaaccgcaggaccatggcatctaggaaagctcgaattggactttggtttatgtgagggaacaactgttgtagtagatgaacattgcggaaatcgaggtccatcattacgtacaaccactgtaacaggaaagatcatccatgaatggtgttgccgttcttgtacattacccccgctaagatttagaggagaggacggatgttggtacggaatggaaatacgaccggttaaagaaaaggaagagaatctggttcgtagtatggtatcagcaggaagtggggaggtagacagtttttcactaggcattctttgtgtctcaataatgatagaagaagttatgagaagtagatggagcagaaaaatgctcatgacaggcacgctagctgtattcctacttttaataatgggtcaacttacgtggaacgatttaataagattgtgtataatggtaggggcaaatgcctcagatcgaatgggtatgggtacaacatacttagccttgatggcaacgtttaaaatgcgccccatgtttgccgtaggtttgttatttcggagattaacttcacgcgaagttttactcttgacaataggcctcagcctcgtcgcttcagtagaactccctaactcgttagaagaactaggagatggtctagcaatggggattatgatgctcaaactattgacagaatttcaaccacaccaattgtggacaactttattatctctaacatttataaaaaccacatttagcttggattacgcctggaaaaccatggctatggtactatcaatagtttcactctttcctctgtgcctatcaactacaagtcagaaaactacttggcttcctgtactattaggctcgtttgggtgtaaacccttaacgatgtttcttattacagagaataaaatatgggggcgtaagtcatggccactgaatgagggtataatggctattggaattgtaagcatattgctgtctagcttacttaaaaatgatgttcctctcgccggcccgcttatagcaggaggaatgctcattgcatgctacgtaatatctggcagttctgctgatctatcattagaaaaagcagcagaggttagttgggaagaagaagctgaacatagcggaacctctcataatattttagttgaagtacaagacgacggaaccatgaaaataaaagatgaagaaagagatgataccctgaccattttgcttaaggccacactactcgctgtatctggtgtctatcctatgtcaattcctgcaactctgttcgtatggtatttctggcagaagaagaaacaacgttcaggtgtactttgggatacgccatcaccccctgaagtggaacgagccgtactggatgatggcatatacagaattttacagcgcggactacttgggaggtcccaagttggcgtgggcgtatttcaggatggagtatttcacactatgtggcatgtcactcggggagccgtactaatgtatcaggggaagcgccttgaaccctcgtgggcttcagtcaaaaaggatttaataagctacggtggaggatggcgctttcaaggttcctggaataccggtgaagaagtccaagtgatagctgttgagccgggaaagaaccccaagaatgtacaaaccacccctggtacttttaaaacacccgaaggcgaagtaggtgccatagctctagactttaaacctggaacaagcggatcgccaattgtcaatcgcgagggtaaaatcgtgggtttatatggaaacggagtagtaactacatcgggaacctacgtaagcgcaattgctcaggctaaagcgagtcaagagggtccactgccagaaattgaggacgaggtgtttaagaaacgcaatctgactatcatggatcttcaccccggtagtggcaagacaagaagatatcttccggcaattgtccgtgaagcaatcaaaagaaaattgagaacgttaatattggctcctacacgcgtagtggctagtgagatggctgaagcattaaaaggaatgccgatccgataccaaacaacagcagttaaatcggaacacacaggcagggagatagtggacctgatgtgtcacgcgacattcactatgagattattatcgccagtacgtgtacctaattataatatgatcataatggatgaagctcactttacagatcccgcatctatcgctgcccgcggttatatatcaacgcgcgtcggaatgggggaggcagcagcgatattcatgactgcaacgcctccgggatccgtggaggcatttcctcaatcaaatgcagtaatacaagatgaagaaagagatataccggaaagatcttggaactctggatacgactggataactgatttcccagggaaaacggtatggtttgtaccttcgattaaatctggaaacgacattgctaattgtttgaggaaaaacggaaaaagggtaatacaactaagcagaaaaactttcgataccgaataccaaaagaccaagaataacgactgggattacgtcgtgactacagatatctcagagatgggagcgaactttcgggccgatagagtaattgacccaagaaggtgcctaaaacctgtaatattaaaggatggcccagaacgtgttatcttggcaggcccaatgccagttacggtggcttcagctgcgcaaagacgagggaggataggaagaaatcaaaacaaagagggagatcaatacgtttatatgggtcagccattaaataatgacgaagatcatgcccactggacagaggccaagatgctattagataatataaatactcctgaaggaattatccccgctttgttcgaaccagaaagagaaaaatcagcggcaatcgatggcgaatacagactaagaggggaagcaagaaaaacgttcgtagaactaatgcgtagaggggatttgcctgtatggttatcgtataaggtagcttcggaaggtttccaatattctgaccgacgttggtgctttgatggtgaacgaaacaatcaagtgttggaagaaaatatggatgtggaaatatggacgaaagaaggagaacggaaaaagctacgccccagatggctagatgcgcgtacatacagtgatccacttgcactaagagagttcaaagaatttgctgcagggcgacgaagtgtatcaggagatcttattttagaaattggaaagttaccacaacacctgactcttcgggcgcaaaatgccttagacaatttagttatgcttcacaattcagagcagggtggcaaagcatatagacacgcgatggaagaattaccagatactatagaaacacttatgctactagcgcttatagctgtactaacaggaggagttaccctattctttctctcaggtaagggtctgggaaagactagcataggattactctgcgtcatggcatcatctgcactattgtggatggcaagcgtggagccgcattggatagcggcgagcataatattagagttctttctcatggtccttttaatccccgaaccggaccgtcagaggacaccacaagataatcagctagcttatgttgtaattgggctattattcatgatactgactgtagcggccaatgaaatggggctgctagaaacgactaagaaagacctcggtattgggcatgtagctgccgaaaaccaccatcacgcaacaatgttagatgtcgacttaaggccagctagtgcgtggacgctatatgccgtagccacaacagtgataacgcctatgatgcggcatacaatagagaacaccacagcaaatattagtcttacagctattgcgaatcaggcagccatacttatgggcctcgacaaagggtggcccataagtaaaatggacataggagtaccgctactagcattgggttgctactcacaagtaaatccactaacattaacagcagccgtactcatgctagtcgcccactatgcaattatcgggccgggtctgcaagcaaaagcaacacgcgaagcgcaaaaacgtacagctgccgggattatgaagaatccaacggtagacggaatagtcgctattgacctcgatcctgttgtttatgatgcaaagttcgagaaacagttagggcaaatcatgctactcattttgtgtacttcacaaattctattgatgcgtactacgtgggcattgtgtgaatccattacgttggccacaggtccacttacaaccctttgggaaggatcacccggtaagttctggaacacgactatagcagtatccatggctaatatatttagaggtagttatttagcaggagcaggacttgcattcagcttaatgaaatctcttggaggagggaggcggggcacaggagcgcagggggaaaccctcggggagaagtggaaaagacagctaaatcaactgtcaaaatctgaatttaatacgtataagcgctcaggtataatggaagtagatcgatctgaggctaaagaaggcttaaagcgaggagaaactacaaagcacgcagtttcaaggggtactgccaaacttcgatggtttgtagagcgaaacctcgtaaaaccagaaggaaaagtgatcgatctgggatgtggtaggggtggatggagctattactgtgcaggtctaaagaaagttacagaggtaaaaggttatacaaagggtggtccaggacatgaagaacccataccaatggcgacttatggatggaacttagttaagctacattcagggaaagatgtcttcttcacacctcccgaaaagtgtgacaccctcttgtgcgacattggagaaagcagtccaaatccgacaatcgaagaaggacgaacgctgcgtgttctaaagatggtagagccgtggctgcgcggtaatcaattctgtataaaaattttaaacccgtatatgccgtctgttgtagaaactcttgaacaaatgcaaaggaagcacggaggtatgctcgtaagaaacccattgtccaggaatagtactcatgaaatgtactgggtgagctgtgggacgggtaatatagttagcgccgttaacatgacatctagaatgctgctaaatagatttacaatggcacatcggaagccgacttacgaaagggacgtcgacctcggggctggaaccaggcacgtggctgtcgaacctgaagttgccaatctagacataattggacaaaggatcgaaaacatcaaaaacgaacataaatctacctggcactacgatgaggataatccatataagacctgggcttaccacggctcttatgaggtcaaaccttccggatctgcgagttctatggttaatggggtcgttcgcctattaacaaaaccttgggatgtcatacccatggtaacacaaattgcaatgaccgacactacaccattcggccaacaaagggtatttaaagaaaaagtagatacaaggacaccgcgtgccaagagaggcacagcccaaataatggaagttacggcaaaatggctttggggctttttaagtaggaacaagaaacctagaatatgtacaagagaggaatttacgagaaaagtgcgttcaaacgctgcaataggagcggtattcgtagatgagaatcagtggaactcagcaaaagaagcagttgaggacgaacgtttctgggacttggtacatcgagaaagagaacttcacaaacagggtaagtgtgcaacctgtgtgtacaacatgatgggaaaacgggagaagaaattaggtgagtttggtaaagccaaggggagtcgagctatttggtacatgtggttaggcgcgcggtttctagaatttgaggctttgggttttatgaatgaagatcactggttttctagggagaacagtttatctggggtagaaggcgagggattacacaagctcggatatatcttacgcgatatatcaaaaatacctggtggaaatatgtacgctgatgacacagctggatgggatacgaggataactgaagatgatttacaaaatgaagccaagattaccgacataatggaacccgaacacgctctgttggcaacttctattttcaaattaacgtaccaaaacaaagtcgtaagagttcaacgtccagccaaaaacggcacagtcatggatgttatatcacggagggatcaaagaggttcaggacaagtaggtacttatggattaaatacatttacgaatatggaggtacaattaataagacaaatggagtcagaagggatattcctaccgtgcgaactagaaactccaaacctagcagaacgggtattagattggctggaaaaacacggggcggaaagactaaagagaatggcaatatccggagacgattgtgtagttaaaccaatagatgacaggtttgcaacggcgttaatcgcgcttaatgatatgggaaaagtcagaaaagatattccccaatgggaaccaagtaaagggtggaatgactggcaacaagtgccattctgcagtcatcattttcaccaattaatcatgaaagatggaagagaaatagtagtgccttgtcgaaatcaagatgagttagtaggaagggctcgtgtgtcacagggtgctggatggagcttacgggaaaccgcatgtcttggaaaaagctatgcgcaaatgtggcaactcatgtattttcatagacgtgacctccgcctggcagctaatgcaatatgttcagccgtgccagtagattgggtccccacaagtagaactacttggagtattcatgcccaccaccaatggatgactacagaggatatgttatcagtatggaatcgagtttggatagaagaaaatccgtggatggaagacaaaacacatgtaagtagttgggaagaggtgccatatcttggaaaaagggaagaccaatggtgcggaagtctaatcggattaactacaagagcaacatgggcaacaaatatacaagtagctataaatcaagtgagaagactcatcggtaatgaaaattatttagattatatgacaagcatgaaacggtttaaaaatgaatcagacccagaaggagcgctatggtag

SEQ ID NO: 21385 - RNA, 9879 nt, synthetic construct
  misc_feature 1..9879: note = derived and/or modified CDS sequence (opt6) from DENV-1__FJ410179__SS-prME
  source 1..9879: mol_type = other RNA
agtgttactatgctcctaatgctgctcccaactgcgttagcatttcaccttactacaaggggaggagaaccacatatgattgtttctaaacaagaaagaggcaaaagcctactattcaaaacatccgctggaatcaatatgtgcacattaatagcaatggatctaggagaattgtgtgaagatactatgacctataaatgtccacgaattactgaagcagaacctgacgacgttgactgttggtgtaatgctactgatacatgggtaacatacggcacttgcagtcaaactggggaacatagacgggataaaagatcggttgcacttgccccacacgtgggtctcggtctggaaacacgtacagaaacatggatgagcagtgaaggtgcatggaaacaaatccaaaaagtggaaacttgggccctacgacacccaggatttaccgtaacagcgttatttttagctcacgctattggtactagcatcacgcaaaaaggaataatttttatactactcatgctagtaacaccaagcatggcgatgaggtgtgtaggtataggtaacagggattttgttgaagggctttccggagccacttgggtcgatgtcgtcttagaacatggtagctgcgtgactacaatggcaaaagataaaccaactctcgatattgaactattaaaaaccgaagtaacaaatccagcagtattacgtaaactttgcatcgaagcgaaaattagtaatacaacgaccgacagcagatgtcccacacaaggtgaggctacattagtcgaggagcaagattccaatttcgtctgtagaaggacctttgtagatcggggttgggggaatggttgtggactatttggaaaaggttctttattaacatgcgcgaaatttaaatgtgttacaaaattggaaggaaaaattgttcaatacgaaaatttaaaatactctgtaatcgttacagtacacactggagaccaacatcaagtaggaaatgagacaacagagcacgggacaatagccaccataacgccgcaagctcctacctctgaaattcaactaacggactatggtgctttaactctagattgtagtccgcgtacgggattggatttcaatgagatggttttgttgaccatgaaagagaaaagttggctagtgcacaaacaatggtttttagacttaccccttccgtggacgagtggtgcatctacgtcccaagaaacatggaacagacaagatctcttggttacattcaaaactgcgcatgctaagaaacaagaagtggtcgtcttaggatcccaagaaggagcaatgcacaccgccttaaccggtgcaactgaaatccaaacatcgggaacaacaactatttttgcaggacatctgaaatgccggttaaaaatggacaaattaacattaaagggaatgtcatacgtgatgtgtactggcagctttaaattagaaaaagaagtagcggaaacgcaacacggcactgtattagtccaagtaaaatatgagggcacagatgccccatgtaaaataccattttcagcacaagacgaaaagggtgtaacgcaaaacggtaggttaattactgcgaatccaatagtgaccgataaagagaaacctgtaaatattgagacagagccaccatttggggaatcctatattgtagtcggggccggtgaaaaagcactgaagctatcttggttcaagaaaggctcatccatcggaaaaatgtttgaggccacagcgagaggagctagaagaatggcaatcctaggagacactgcatgggatttcggaagcatcggcggtgtatttacgagcgtcgggaaactggttcatcaagtgttcggcgctgcgtatggcgttttattttcaggcgttagctggacgatgaaaattggtataggtatattattgacttggctagggcttaactcacgctctacgagcttgtcaatgacctgcatcgctgttggaatggtaaccttgtatctaggagtaatggtacaagcagactcgggttgtgtcataaattggaaaggaagagagctaaaatgcggaagtggcattttcgttacaaacgaggtgcacacctggacagagcagtataaattccaagcagactcacccaaaagactttccgctgctattggaaaagcatgggaggaaggagtttgtggcatacgctccgcaactaggttggagaatataatgtggaaacagatatcgaatgagctaaatcacatattgcttgagaatgatatgaagttcaccgtagttgttggagatgcaaacggcattctagctcagggcaaaaagatgattcggccacaaccgatggagcaccggtatagctggaaaagttggggaaaagccaaaattattggagcagatatacagaactcgactttcataatagacggaccagatacccctgaatgccccgatgatcaaagggcatggaatatttgggaagtagaggattatggctttggaatattcactactaatatttggttgaaactgagagattcctatacacaaatgtgcgaccaccgactaatgagcgcggctataaaagattcaaaagcggtgcatgctgacatgggttattggattgaatctgagaaaaacgagacttggaagctagcgcgagcgagtttcatagaggtcaagacctgcatatggccgaaaagtcacacactatggtctaacggggtgttagagagcgaaatgataatacctaaaatgtatggtggaccaatatctcaacacaattatagacccggatattttacacaaaccgctgggccatggcaccttgggaaacttgaactagacttcgatctatgcgaaggaacaactgtagtagtagacgaacattgcggcaatcgtggaccgagccttagaaccaccacagtaaccggaaaaataattcatgaatggtgttgtcggagctgtaccttgcctccattacgttttaggggtgaagatggttgttggtatggcatggagattcgcccggtaaaagaaaaggaagagaatttggttagatcgatggtaagtgctggatctggagaagtagacagtttttctttaggaatattatgtgtatctataatgatagaggaggtcatgagatctagatggagtcggaagatgctaatgacaggaactcttgcagtatttttgttactaataatgggtcagttaacttggaacgatttaatacgactatgtattatggtaggcgctaacgcttcagatagaatgggcatgggaactacttatctcgcgctcatggcgaccttcaagatgcgaccgatgttcgcggttggactcttatttaggcggttgacttccagagaagtgttgctccttaccattggattaagtctcgttgcttccgttgagctccccaattccttagaagaattaggagacggactggccatggggattatgatgctaaagctactaacagaatttcaaccccatcaactgtggacaacactgttgtcactaacttttattaaaacaacgttatcattagactacgcatggagaacgatggcgatggtcctaagcatagtaagcctatttcctttatgtttaagcacgacatcgcagaaaactacttggttgcctgttctcttgggctcatttggatgtaaacccttaactatgtttttgataacagaaaataaaatatggggacgtaaatcctggcccctaaacgaaggaataatggcaataggaatagtgtcgattctattaagtagcctactcaaaaacgatgtacctttagcaggccctttgatagctggtggaatgttgattgcttgttatgttatctcaggttcatctgctgacctaagtctggaaaaggcagcagaagtttcatgggaagaagaggcggaacattcaggaacatcacataatattcttgtagaagtccaagacgatggtacaatgaaaataaaagacgaggaacgcgatgatactctgactatactgttaaaagcgacgttactagccattagcggagtttatcccatgagtatacctgctaccttattcgtatggtatttttggcagaagaagaaacagagaagtggtgtactttgggacactccaagtccgcctgaagtagaaagagccgttctagatgatgggatatacaggattctacaacgaggactactcggaagatcgcaagtcggggtaggtgtcttccaagatggagttttccacacaatgtggcatgtgacgagaggcgcggttctgatgtatcagggaaaaagattagaaccatcttgggcctcggtgaagaaagatttaatatcttatgggggcgggtggcggtttcaaggaagttggaatactggtgaagaagtgcaagttattgcagtcgagcctggcaaaaatcccaaaaatgtccagacaactcctggtacgtttaaaaccccagagggggaagttggagccatagcattagactttaaaccaggaacctcaggttcaccaattgtgaaccgcgaaggtaaaatagtcggattgtatgggaatggtgtcgttactaccagtggcacatacgtgagtgcaatagcacaggctaagaccagtcaggaaggccctttaccggaaattgaagaagaggttttcaagaaaagaaacttgacaataatggacttgcatccagggtctgggaaaacgagaaggtacttacctgctatagtacgggaggcgataaaaagaaaactacgaacgttaattttagctcccaccagagtggtggcttcggaaatggctgaggctttaaaaggtatgccaataagataccaaacaacagccgttaaaagcgaacatacaggacgagaaatcgtcgatcttatgtgtcacgcgacatttacaatgcgtctattatccccagtacgcgtgcctaattataatatgataataatggacgaagcacacttcactgatcccgcttcgatagcggcacgcggctatatatctactcgagttggtatgggagaggcagcagcaatttttatgacggcaactccacctggttcagttgaagcatttccacaatcaaatgcggtaattcaagacgaagaaagagacattccggagcggtcgtggaacagcgggtacgattggattacagatttcccaggtaaaacggtatggttcgtgcccagtatcaaatctggaaatgatatagctaattgccttaggaaaaacggtaagagagttatacaattaagcaggaaaacattcgatacagagtatcagaaaacgaggaacaatgattgggactatgtagtcacaactgatatctcagaaatgggtgcgaattttcgagcagatcgagtaatagatcctcgacgctgtctcaaaccagttattttaaaggacggcccggagcgtgtaattttagccgggcctatgccagtaaccgtagcatcagcggcacagcgacgtggacgtattggcagaaatcaaaacaaagagggtgatcagtatgtatacatgggacaacctctaaataatgatgaggaccatgcacattggacggaagctaagatgttattggacaacattaatacccctgaaggcatcatacccgctctatttgaaccagaaagagagaaaagtgcagcaatcgacggagaatatagacttcgaggagaagccagaaaaacgttcgttgaactaatgcggagaggcgacttacccgtttggctgagttacaaagtcgcatcagaaggctttcaatattctgatagaaggtggtgttttgatggagaacgtaacaaccaggtattggaagaaaacatggatgtcgaaatctggacaaaagaaggagaacggaagaaattgcgcccaagatggttggacgccaggacttattccgatccgctcgcattgcgagaatttaaagagtttgcagcaggtagacgatctgttagcggcgacctcatactagaaatcggcaaacttccacaacatttgactttgagagcacaaaacgcactggataacttggtcatgttacataactccgaacaagggggaaaggcctacagacatgcaatggaggaattaccggatacgatagaaacattaatgttgttagccttaatagcagtactcactggtggtgtaacgttattcttcctatctgggaaagggcttgggaaaacaagcattggtctattatgtgtaatggcttcttcagcgctgttgtggatggcaaacgttgagccacactggatcgcagcctcgataatcttagagttctttttgatggtactattaataccagagcccgaccgccaacgaacaccacaagacaaccaactggcgtatgttgtaataggattattattcatgatattgactgttgcggctaacgaaatggggttactggagacaactaagaaggatcttggaataggtcacgttgcagcggaaaatcagcaccacgctacaatgctagatgtggatttaagaccggcatctgcatggaccctatacgcagttgcaacaactgtaataactcccatgatgagacacacaattgaaaataccacggcaaacatttctctaaccgctattgctaatcaagcagcgatactaatgggattggacaaaggatggccaataagtaagatggatataggagtccccttgctagcgttgggatgctatagccaagtcaaccctttgacattaactgcagcagtgctcatgctagttgcacactatgcaattatcggcccaggtctacaggcaaaagctacgcgtgaggctcagaagagaacagcagccggaataatgaaaaaccccactgtagacgggatcgtagcaatagacctcgatcctgtagtatacgatgcaaaatttgaaaagcagctaggtcagataatgctcttaatcttatgtacatctcaaatattgctaatgaggactacatgggcactctgtgaaagtataactctagccacaggtccacttacgacgctatgggaagggagccctggcaaattttggaataccacgatagccgtaagtatggccaacatttttcgaggaagttatttggcgggtgctggcctagccttcagcctaatgaaaagcctaggcggtggaaggagaggaaccggagctcaaggagaaacgctaggcgaaaaatggaagcgtcaattaaatcaattaagtaaatctgaatttaatacgtacaagagatctggaattatggaagttgaccgatcagaagcaaaagaaggactgaaaagaggggaaaccactaaacatgcggtatcacgaggcaccgcaaagctcagatggtttgttgagcgtaatttagtaaagccagaaggaaaggttattgatttagggtgcggacgaggaggatggtcctactattgtgcgggactaaagaaagtaaccgaagttaaaggatatactaaaggcggtcctgggcatgaggaaccaatccctatggcgacatatggatggaaccttgtaaaactctatagtggaaaagatgttttctttacaccaccagaaaaatgcgacactctcctttgcgacataggagaaagtagtcctaatcctacaattgaggagggaaggaccttgagagtattaaaaatggtagagccatggttgagaggaaaccagttttgtataaaaatattaaatccatacatgccatcagtagtagaaacattagaacaaatgcaaagaaaacatgggggaatgcttgtcagaaatccgctgagccgcaactctacgcacgagatgtattgggtttcgtgtggaacaggaaatatagtcagcgctgtgaacatgacctctcggatgttgctaaacaggttcaccatgacccatcgtaaacctacttacgaacgtgacgttgaccttggggcgggaacacgacatgtggcagtggagccggaagtagcaaacctagatatcataggccaacgaatagaaaatatcaaaaacgaacataagtccacttggcattacgacgaagataatccttacaaaacatgggcgtatcatggtagttatgaagtcaaaccgtctggcagtgcgagctccatggttaacggagtagtgcgactacttaccaagccatgggacgtaatcccgatggtaacgcagattgctatgacagacaccaccccgttcggtcaacaaagagtattcaaggagaaagttgatacacgcactccacgtgcaaagcgaggtaccgcacaaattatggaagtcacagcaaaatggttatggggattcttatcgaggaacaagaaaccccgaatatgcactcgcgaggaatttacgcgtaaagtaaggtcgaatgctgccataggggcagtttttgtagatgaaaatcaatggaactccgccaaagaagcagtggaggatgaaagattttgggatttggtccacagggaacgagaattacacaagcaaggcaaatgtgcaacctgtgtatataatatgatgggaaaacgagagaagaaactcggtgaatttggcaaagcaaaaggatcccgagccatctggtatatgtggcttggagcacggtttctggaatttgaggctcttgggtttatgaatgaagaccattggttttcaagggaaaacagctttagtggagtagaaggagaaggcttacacaagttagggtacattttgagggacatctccaaaatacccggaggaaatatgtatgcggatgacactgccggctgggatactagaataacagaagatgaccttcaaaacgaagctaaaatcacggatattatggaaccagagcatgcattattagcaacaagtatttttaagttaacctatcagaataaagtggtcagagtccaacgaccagcaaagaacgggaccgtaatggacgtaatctctagacgagaccaaagagggagtggacaagtcggtacgtacggactgaatacttttacaaatatggaagtacagttgatacgacagatggaaagtgaagggatcttcttacctagtgagctagaaacacctaatttagcagagagagtcctagattggttagagaaacacggaactgaacgtctcaaacggatggcaatatctggagacgattgcgtcgttaagccggttgatgataggtttgctactgcactgatcgccctgaacgacatggggaaagtccgaaaagacatcccccaatgggaaccttcaaaaggttggaacgattggcaacaagttcctttctgtagtcatcattttcaccaacttattatgaaagatggtcgagaaatagttgtaccatgcagaaaccaagacgagctagtcggtagggcaagagtatctcagggagcaggatggtcattaagagaaacagcatgtctcggcaaatcttatgcgcaaatgtggcagctaatgtattttcacagacgggatttaagactagcggccaacgccatatgtagtgccgtcccagttgactgggtaccaacttcccgcacgacttggagtatccacgcacaccaccaatggatgacgacggaggatatgctttctgtctggaatcgagtgtggatagaagaaaacccctggatggaagataaaacccatgtttcaagctgggaagaagtaccatatctaggaaagcgcgaagaccaatggtgcggatccctgattggattaacagctagagccacctgggctacaaatattcaagttgccataaatcaggttaggaggttaatcggcaacgaaaattacttagattatatgaccagtatgaaaaggttcaaaaacgaaagcgatccagagggagcactctggtaa

SEQ ID NO: 21386 - RNA, 9879 nt, synthetic construct
  misc_feature 1..9879: note = derived and/or modified CDS sequence (opt6) from DENV-1__FJ410181__SS-prME
  source 1..9879: mol_type = other RNA
tcagtaaccatgctattgatgctgctaccaacggcactcgcattccatctcacaacaagaggaggagaaccgcatatgatagtttccaaacaagaaaggggaaaatcgttactattcaaaacatcagtaggcataaatatgtgcacgttgatagcaatggacttaggcgaattatgtgaagacaccatgacttataaatgtccccgaataactgaagcggaacccgacgacgtggattgttggtgcaacgctaccgatacttgggtaacatatggtacatgctcacaaacaggagaacatcggagagataaaaggtccgtggcacttgcaccacatgtaggacttggactcgaaactaggacagaaacctggatgtcatcagaaggagcttggaaacaaatacaaaaagtagaaacgtgggccctacggcatccgggcttcactgttaccgcattgttcctagcacacgctatcggtacatctataacccaaaaaggaataatattcatcctgttgatgttagtaacaccatcaatggcgatgaggtgtgtgggtataggcaatagagattttgtcgaagggcttagcggtgcaacatgggtggatgtagtgctcgaacatggtagttgtgttactaccatggcaaaagataaacccacactagacatagaattactaaaaaccgaagttactaatcctgcagtcttaagaaaactatgtattgaagctaaaataagcaatacaacaacggatagtagatgccctacgcaaggagaagcgacgctagtggaagaacaagattccaattttgtatgcagacgaacgtttgtagatcggggttggggaaatggatgtggcctatttggaaaaggatcactgctcacatgtgcaaaatttaaatgcgtcacgaaattagagggaaaaattgttcagtatgagaatcttaaatatagtgtaatagtgaccgtacatactggcgatcagcaccaggtaggcaatgagactaccgaacacgggacgatagcaactattacgccccaagcccctacttcagagatccaacttacagattacggggcactcacacttgattgttcacctcgaacgggtctagatttcaacgagatggtattactaactatgaaagaaaaatcctggcttgttcacaaacaatggtttttagatctcccacttccttggacctcgggtgctagtacaagtcaagaaacatggaatagacaggatctcctagtaacatttaagactgcgcatgcgaagaaacaagaagtagtagtgctaggatcgcaagagggagcgatgcatacggccctgactggtgcaacagaaatacaaacctcaggaacaacaacaatcttcgcgggacatctaaagtgtagattaaaaatggataaactgactcttaaaggaatgtcatacgttatgtgcacaggaagttttaaattagagaaagaagtggctgagactcaacacgggaccgtcttggtacaagtgaaatacgaaggtaccgacgctccctgcaaaatacctttcagcgctcaagatgaaaagggagttacccaaaacggtagattaataacagccaatccaatcgtaactgacaaagaaaaaccggtaaacatagaaactgaacctccgtttggggaatcatacattgtgataggagcaggagagaaagcactaaaactcagttggttcaagaaaggtagcagcatcggtaaaatgttcgaagctaccgctcggggagcgcgtaggatggcaatattaggggataccgcatgggattttggatcgattggaggagtatttacgagtgtgggaaaattagtacatcaagtttttggcgctgcatatggagttctatttagcggcgtctcatggactatgaaaatcggaattggaatcctactaacctggttaggacttaactcaagatctacaagtttaagcatgacatgtatagccgtgggaatggtcacgctttatttaggggtgatggtgcaagcagacagtgggtgtgtcatcaattggaaaggtagggaactaaaatgcggaagtggcatattcgttaccaacgaagtacatacatggacagaacaatacaagtttcaagctgactcgccaaaaagattgtctgcggcaatcggtaaggcttgggaggaaggagtttgcggcatccgatcggcaaccagattggagaatataatgtggaaacaaataagtaatgaactaaaccacatactattagagaatgacatgaaattcaccgtagtggtgggagacgctaatggaatattagcccaagggaaaaagatgataagaccacaacctatggaacaccggtatagctggaaatcttggggaaaagcaaaaataattggagcagacattcaaaatacaacatttattattgacggccctgatacgccagagtgtcctgatgaccaaagggcatggaatatttgggaggtcgaagactacggctttggtatattcacaacaaatatttggttaaaactaagagactcatatactcagatgtgcgatcataggttgatgagtgctgcgataaaagattctaaagcagttcacgctgatatgggatattggatagaaagcgagaaaaatgaaacatggaaattagctcgtgcttctttcatcgaggttaaaacatgtatctggccaaaaagtcatacactatggtcaaacggagtacttgagagtgaaatgataattcctaaaatctatggaggcccaatatcacaacataattatagacctggttacttcacacagactgcaggtccgtggcatcttggaaaactagagctagatttcgacctatgtgaaggaacgacagtagtagtggatgaacactgcggtaataggggtccaagtctaagaacgaccactgttacaggtaagataatacatgagtggtgttgtagatcatgcactttacctccccttagattccgtggcgaggacggctgttggtatggaatggaaataaggccagtaaaagagaaagaagaaaatttggtaagatctatggttagtgcgggtagtggagaagtagatagcttctcgttgggcattctttgtgtatcaataatgatagaggaagtgatgcgttcgagatggtcaagaaaaatgctaatgaccggaacacttgctgtgttcctattactgataatgggacaattgacgtggaatgacctaatacgtttatgcataatggttggggccaatgcgagtgaccggatgggaatggggacaacatatttagcactcatggcaacatttaagatgagaccgatgttcgcggtaggactgctattcagacgactaacgtctcgggaagtattacttttaactataggattgagcttagtggcaagtgtcgaactacctaacagcctagaagaactaggggacggtctagccatgggtatcatgatgctaaaactcttaaccgaatttcaacctcaccaactctggacaacattgttaagtttaacatttattaaaacaacgctctccctggactatgcatggcgcacaatggcaatggttttatctatagtcagtttatttccgttatgtttatcgacaacatcgcagaaaactacctggcttccagtgctcctaggatcatttggctgcaaacctttaactatgtttttaatcacagaaaacaaaatatggggaagaaaaagctggcctctaaacgaaggcatcatggcaataggaattgtgtcgatcttattatctagtctacttaaaaatgacgtacctttagcgggaccgttaatcgccggtgggatgttaattgcatgttatgtaatttcaggttcttcggctgacttatcacttgaaaaagcagccgaagttagttgggaagaagaggctgaacacagcggaacatcgcataacatcttagtggaggtccaagatgacggcactatgaaaataaaggatgaagaaagagatgatactctgaccattctactcaaagcaactttgctagcagtatcaggggtatatccgatgtccataccggcaaccctattcgtgtggtatttctggcagaagaagaaacaaagaagcggtgtactatgggatactccgtctcctcctgaggtagaacgagcagtattagacgacggaatatatcgaatcctacaaaggggacttttaggaagatcccaagtaggagtaggagttttccaggatggagtctttcatacaatgtggcatgtgactcgtggcgcagtcttaatgtaccaaggcaagcgtcttgaacctagctgggcttccgtaaagaaagacctaattagttatggtggcggatggcgtttccaaggcagttggaatactggagaggaggtacaagtcatagcagttgaaccaggtaaaaatccgaagaatgtacagacgactccgggaacctttaagactccagagggagaagtaggggccattgctttagacttcaagccagggacaagtggtagtccaatcgtaaatcgcgaaggcaaaatcgttggcctctatgggaacggggttgttacgacctccgggacttatgtatccgccattgcgcaagccaaaacgagtcaagaaggacctttacctgagattgaagatgaagtatttaagaaacggaatcttacaatcatggatcttcatccgggtagcggtaagactaggaggtacttacctgctatagtacgcgaagcgattaaacgaaagttgcgaacattgattctagctccaacgagggtggtcgcctcagaaatggcagaggcgttgaaagggatgccaatacgataccagaccaccgctgttaaatcagaacatacagggagggaaatcgttgacctaatgtgtcatgctactttcaccatgagattattatctccagtacgtgtgccaaactataacatgataattatggatgaggcacacttcacagaccccgctagtatcgctgctcgtgggtatatctcgacaagggtaggcatgggtgaggcagccgcaatatttatgacggcaacacctccgggatctgttgaagcatttccacagtcaaatgccgtcatccaagacgaagaacgagatatcccggaacgatcgtggaacagcggatacgattggattactgattttccaggcaaaacagtctggttcgtgccatcaataaaaagtggtaatgatatagctaattgcttgcggaagaatggaaaacgggtgattcagttaagtcgaaaaaccttcgatacagaataccagaaaactaaaaataatgattgggattacgtagtaacgacagacataagcgaaatgggcgcaaattttagggcagatagagtcattgacccacgtagatgccttaaaccagtaatacttaaggatgggccagaacgagtaatcttggcaggaccaatgccagttacagtagcatcggctgctcaacgccgcggaagaataggaaggaaccaaaataaagaaggggaccaatatgtctacatgggacaaccattaaataacgatgaggatcatgcgcattggacagaagcaaagatgctactggataacattaatactcccgaaggaattataccggctttatttgaacccgaacgtgagaaaagtgccgccatagacggcgagtataggctaagaggcgaagcaagaaagacatttgttgaactaatgcgaaggggagatctgccagtttggttaagttataaggtcgctagcgaaggttttcaatactcagataggagatggtgtttcgacggtgaaagaaataatcaagtgctagaagaaaacatggacgttgaaatttggacaaaagagggagaaaggaagaaactaagaccccgatggctggacgctcgaacttactcagatccattagcattacgtgagttcaaagaatttgctgctgggcgacgatctgtctcgggtgatctgatccttgaaataggaaaattgcctcaacacttaaccttacgcgcgcaaaatgcattggataatttggtcatgttgcacaattcagaacaaggaggaaaagcatataggcatgcgatggaagaactacctgatacgattgaaacattaatgttgcttgcattaattgctgttttgacaggtggagttacattattctttttaagtggaaaaggcctcggcaagacaagtatcggtttactatgtgttatggcctcaagtgcattattgtggatggccaatgtcgaacctcattggatagcagcttcaataatattagaatttttcttaatggtactattaatccctgagcccgataggcaacgtacgcctcaagataatcaactggcgtatgtcgtcataggactactcttcatgatattaacagtagctgccaatgaaatgggattgttagaaacaacgaagaaagatttaggtatcggtcacgtagcagcggaaaaccaacatcatgcaacgatgttagatgtagatctacgtcctgcctctgcatggactctatatgctgttgccacgacggtgattacaccaatgatgagacatacgatagagaacacgactgctaatatatcattgactgctatcgccaatcaagccgcaattttaatgggtctcgataaaggctggccaatttcaaaaatggatataggagtcccgttattggcgctgggatgctactctcaagttaatccccttacattaacggcagcagttctcatgttagtggcccactacgcaataatagggcctggattgcaagctaaagccacgcgtgaggcacagaaacgcacagccgcaggtattatgaaaaatccaacagttgatggcatagttgcgatagaccttgatccagtagtgtatgatgcaaaattcgaaaaacaactgggacagattatgctgctaatactctgcacatcgcaaattcttttaatgagaacaacgtgggcactctgtgaaagcataacattagccacgggaccactaacaaccctatgggaaggaagtcctggcaaattctggaacactacaatagcggttagcatggcaaacatattccgaggaagctacttagccggtgcaggtttagcttttagcttaatgaagtcattaggaggaggtaggaggggtaccggcgcacaaggggaaactcttggtgagaaatggaaacgacaattgaatcagctatccaaatctgagttcaatacctataagcgaagcggaataatggaagtagaccggtctgaagccaaagaagggctcaaacgcggcgaaaccaccaaacatgcggtctccagaggaaccgcaaaattgagatggtttgtagaaagaaatctagttaaacctgaaggcaaggtaattgatttgggctgtggaagaggcgggtggtcgtattactgtgctggcctcaagaaagtgacagaggttaaaggttatacaaaaggcggtccaggccatgaagaacctattccgatggctacatatggttggaacctagttaaactatattccggaaaggacgtattctttacaccccctgaaaagtgtgatactttattatgtgacataggcgaatcgtcaccgaatccaacaatcgaggaagggaggacacttagagttttgaaaatggtagaaccttggttaagaggaaatcaattttgtataaagatactaaatccctacatgcctagcgtcgtagaaacgttagaacaaatgcaacgcaaacacgggggcatgctagttagaaatccattaagccgaaactctactcacgaaatgtattgggtaagctgcggaacaggtaatatagtatcagctgtcaacatgacgagcagaatgttactcaacagatttacaatggcacatagaaaacctacatatgagagagacgtagatctgggagctgggacacgacacgtggcagtagaaccagaagtagccaatttggacattataggtcaacgaattgaaaacattaagaatgaacataaatcgacctggcactatgatgaggataacccatacaaaacatgggcatatcacggcagttacgaggtcaaacctagtggaagcgcgtcgagtatggttaatggggtcgttagacttctgacaaaaccttgggatgtgattcctatggttacacaaatagccatgacagacactacaccgtttggtcagcaaagggttttcaaagaaaaggtcgatactagaacaccccgggccaaacgtggaacagcacaaatcatggaagtcacagctaaatggttatggggatttctatctaggaataagaaaccccgaatatgtactagggaggagttcactagaaaagtgagaagtaatgcggcaataggagccgtattcgtggatgagaatcagtggaatagtgcaaaggaagctgtggaggatgaaagattttgggacttagtttaccgcgaaagggagctacacaaacaaggtaaatgtgcaacatgcgtgtacaacatgatggggaagagagagaagaaactaggtgagtttggtaaggcgaaaggtagccgtgcaatctggtacatgtggttaggagcacggtttttagaatttgaagcactaggattcatgaatgaagatcattggttttctagagaaaattcattcagcggtgtagaaggcgaagggctacacaaactaggatatatattacgggacatctctaaaataccaggaggtaatatgtacgcggacgacacggccggctgggatacgcggataactgaggatgatctgcaaaatgaagcaaagataaccgatatcatggagccagaacatgcacttttagcaacaagtatattcaaacttacgtaccaaaataaagtagtaagagttcagaggcccgctaaaaatggtaccgtaatggatgttattagcaggcgagatcagaggggatcaggacaggttggtacttacggactgaatacgttcacgaacatggaagttcagcttatacgccagatggagtccgagggaatcttcttgccgagcgaattggaaacacctaatttagctgaaagagtgctagactggctagaaaaacacggtacggaacgactcaaaaggatggccatttcaggtgatgactgtgttgtaaaaccagttgacgaccgattcgcaacagccttaatagcattaaacgatatgggtaaagtacgaaaagacataccacaatgggagccctccaaaggttggaatgattggcagcaggtaccattttgctcacaccatttccatcaattgataatgaaagacggacgagagatagtagtaccatgcaggaatcaagacgagttagtaggacgagcaagagtctcacaaggtgctggatggtctttacgagaaacagcatgcttaggtaagtcatacgcccaaatgtggcaactcatgtattttcaccggcgcgatttacggctagccgcaaacgctatatgttcagcggtcccagttgattgggttcctacatctaggacaacttggagtattcatgcccaccatcaatggatgacgactgaagatatgttatcagtttggaatcgagtttggatcgaggaaaacccatggatggaagataagacacatgtctcgagttgggaagaagttccatatctgggcaaacgtgaagaccaatggtgcgggtcattaatcggattgactgcaagagctacatgggccactaatatccaagtagccataaaccaagttcgaagactcataggaaatgagaactacttagactatatgacatcaatgaagcgatttaagaatgaaagcgatccagaaggagccttatggtga

SEQ ID NO: 21387 - RNA, 9879 nt, synthetic construct
  misc_feature 1..9879: note = derived and/or modified CDS sequence (opt6) from DENV-1__FJ547086__SS-prME
  source 1..9879: mol_type = other RNA
agtgtgactatgctattaatgctattaccaactgcacttgcatttcatcttactacacgtggtggggaacctcatatgatagtttctaaacaagagagaggaaagagcttactttttaaaacttctgcaggagttaatatgtgtacacttatagcaatggaccttggagagttatgtgaagataccatgacatataaatgcccccgaattacagaggctgaacccgatgatgttgactgttggtgtaacgcaacagatacctgggttacatatggaacctgtagtcaaacaggcgaacatcggagagacaaacgcagtgtggccttagctccccacgtcggattaggattggagacgcgaacagaaacttggatgagctcagaaggagcatggaaacaaatacaaaaagtggaaacatgggctttgaggcacccgggatttacagtcattgcattctttctagcgcacgcgataggaacatccataacccaaaaaggcataatctttatactactgatgttagtcacaccatcaatggctatgcgatgtgtagggatcggaaatagagattttgtagaagggctgtcgggcgcaacatgggtggacgtagtattagagcatggatcatgcgtaactacgatggctaaaaataaaccaacccttgacatagagcttttaaaaacagaagtcacgaatccggctgtacttagaaaactatgtatagaagcaaaaataagcaataccacgacggacagtcgttgccccacccaaggtgaggccaccttggttgaggaacaagatgccaactttgtgtgccgccgtacattcgttgaccgaggttgggggaatggatgcgggcttttcggcaaaggtagtcttttaacatgcgccaaatttaaatgcgttacaaaattggaaggtaaaatagtccaatatgaaaacctaaaatacagtgtaattgtaacagtgcatacaggagatcaacaccaagtcggcaacgaaaccacagaacatggcacaattgccactataaccccgcaagctccaacgtctgaaatacaattaactgattacggggcgctgactctcgactgttctccaagaacgggattggattttaatgaaatggtattactgactatgaaagagaaatcatggctcgttcacaaacaatggtttttggacttgccgttaccgtggacatcaggagcctcgacttcccaggagacttggaaccgccaggatctactcgttacatttaaaacagctcatgctaagaaacaagaagttgttgttctgggaagccaagaaggtgctatgcacacagcattaaccggagcgacggaaatacaaacgtcaggtacaacaacaatatttgcgggtcacctaaaatgcagactcaaaatggataaattgacactaaaaggcatgagttatgtgatgtgcacagggagcttcaaacttgagaaagaggtagccgagactcaacacggtacagttttagtacaagtaaaatatgaaggcacagatgccccatgcaaaattccatttagcacccaggacgagaaaggtgttactcaaaacggtagactcataacggcaaatccgattgttacagacaaagagaaaccggttaatattgaaacagaaccaccgttcggagaaagttatatcatggtaggcgcaggagaaaaggctttaaaacttagttggtttaagaaaggaagtagcatcggaaaaatgtttgaggcgacagcaagaggcgccagaagaatggctatactgggtgacacagcgtgggatttcggatcaattggcggtgtattcacaagtgttggtaagctagtccaccaagtttttggaacagcgtatggtgttctattttcaggtgtcagttggacgatgaaaatcggaataggcattttgctcacatggcttggcttaaactccagatcggctagtttatcaatgacatgtattgcagtcggtatggtaactttatacttaggtgtgatggtacaagcggatagtggttgcgcgataaactggaagggtcgtgaacttaagtgcgggagtggtatatttgttacaaacgaagtccacacctggacggaacagtacaagttccaggctgacagtcccaagagattatcggctgcgattggtaaagcgtgggaagaaggagtatgcggtattcgttccgccacaagattagaaaacataatgtggaaacaaattagtaacgaacttaatcatatactactggaaaatgatatgaaatttaccgtggttgtaggagatgcgaatgggattcttgcacaaggaaagaaaatgattcggccacaaccaatggagcacaagtattcatggaaaagttggggtaaggctaagataattggcgcagatatacagaatacaacgtttataattgatgggcccgataccccagagtgccctgacgatcagcgtgcatggaacatttgggaagtagaagactatggtttcggaatatttacaacaaatatatggcttaaactaagagatagctatacacaaatgtgcgatcaccgactgatgagcgccgctataaaagacagtaaggctgtccacgctgacatgggatattggattgaaagtgagaaaaatgaaacatggaaattagctagggcctcatttatcgaagttaagacatgcatatggcccaaaagtcacacgctgtggagcaatggcgtactggaatcggaaatgattatcccaaaaatatacggaggcccaatttctcaacataattatcgacctgggtattttacacaaactgcgggaccgtggcacctgggtaaattggaattagacttcgatttatgtgagggtacgactgtagttgtcgatgaacattgtggtaacaggggtccaagtttacgtaccacaacagtcacaggtaaaattatccacgaatggtgttgtaggagctgtacattgccacccttaagatttagaggagaagacggctgttggtacggtatggagattagacccgtaaaggaaaaggaagagaacctggttaggagtatggtgtcagccggttcaggagaggtagattcattttcactcggtatactttgcgttagtataatgatagaggaggttatgcgcagcagatggtcacggaaaatgttaatgaccggtacgctagccgtctttctactattgataatgggtcagcttacatggaatgatctaatacgattatgtataatggtaggcgctaatgccagcgatcgaatggggatgggaaccacctacttagcattaatggcaacattcaaaatgcgaccaatgttcgccgtcggactcttatttagaagattaacaagtagggaagtgcttttattgacaattggattaagtctagtagcttccgtagagctgcccaattcattggaggagctgggtgatggtttggcaatgggcataatgatgctaaaactacttactgagtttcaaccacaccaactatggacgaccctgctttcacttacatttataaaaacaacgctgtcactagattacgcttggaaaacaatggccatggtacttagtatagtttcattgttcccactatgcctttcaacaacatctcagaaaaccacatggctccccgttctattaggcagctttggttgtaaacctttaacaatgtttctgataacagagaataaaatctggggtcggaagtcctggccactgaatgaaggaataatggccatagggatagtatcaattctgctaagttcattattaaagaacgacgtgccgttggcaggaccgctaatcgcaggcggcatgttaattgcatgttatgtcatatcaggatcatcggcagacttatcattagagaaagcagcagaagtttcctgggaggaggaggcagaacatagcggcacttcacataatattctagtagaagtccaagatgatggaacaatgaaaataaaggacgaagaacgagatgacaccttaaccatattgcttaaggcgacacttctagcagtaagcggagtatatcctatgagcattcctgcgacattgtttgtctggtacttttggcagaagaagaagcaaagaagtggtgttttgtgggatacacccagcccgccagaagttgaaagggcagttttagatgatgggatctatcgtatacttcaaagaggactactaggacgttcacaggtaggtgttggtgtatttcaggatggagtattccatacgatgtggcacgtaacaagaggcgcggtgctaatgtaccagggaaaacgattagaaccaagctgggcaagtgttaagaaagacctaatttcgtacggaggtggttggaggtttcaaggtagttggaatacaggggaagaagtccaggttatagcagtcgaaccaggcaaaaatccgaaaaatgtccaaaccacgccaggcacttttaagacaccagaaggagaagtaggtgcgatagcacttgactttaaaccaggcacatcgggaagtcccatcgtaaatagggaagggaaaatagtaggattgtatgggaacggcgtagtaacaaccagtggtacatacgtcagcgcgatagcgcaagctaaggcatcacaacaaggaccgttacccgaaatcgaagatgaagtcttcaagaaacgcaacttgacaataatggatctccatccaggtagtggcaaaacacgaaggtatttgcctgcaatagttcgtgaagcgataaaaagaaaactaaggacattgatcctagcaccgacaagagttgtagcatccgagatggcggaagcattgaaaggtatgccaataaggtatcaaacgactgctgttaaaagcgagcacacaggacgcgagatagtcgacctgatgtgccacgcaactttcactatgcgcctattgtctcctgttagagtcccaaattataatatgataattatggacgaagctcattttactgacccagctagcatagctgcgcgtggatatattagcacaagagtcggcatgggagaagcggctgctatatttatgactgcaactcctccaggttctgtagaagcatttcctcaaagcaatgccgtaatacaagatgaggagcgagatataccagaaagatcttggaactcgggctacgactggataacagacttccccggtaaaacagtatggtttgtaccttcgataaaatccggaaacgatatagcgaactgtctaaggaagaacggcaaacgtgttatccaattatctcgcaagacgtttgatacagaatatcagaaaaccaaaaacaatgactgggactatgtagtaacgactgatatctctgaaatgggagccaattttcgcgctgatcgagtaattgacccgcgtcggtgccttaaaccagtcatattaaaagatggtcctgagagagtcatattagccggtccaatgccagttactgtagcgagtgctgcccaacggcgaggtcggattgggagaaatcagaataaagagggagaccaatacgtctatatggggcaaccactaaataatgatgaagaccacgcccactggacggaagcaaagatgcttcttgacaacataaatacgccggaagggatcataccggccctctttgaaccagaaagagagaaaagtgcagcaatagacggagagtataggcttaggggagaagcacgtaaaacttttgtagagttaatgcgacgaggcgacctaccagtgtggttgagctataaagtagcttccgaaggatttcagtactcagatagaagatggtgttttgacggagaacgtaacaaccaagtcttagaagagaatatggacgtagagatctggactaaagaaggagagagaaagaaattacgacctaggtggcttgacgcgaggacttatagtgaccccttagctctacgagaatttaaagaatttgcagccgggaggcgatcagtatcaggagacctgatcctagaaataggtaaactcccccaacatctcacactaagagcacagaacgcactcgataacctagtaatgctacataactccgagcaaggaggcaaggcttaccggcatgcaatggaagaattaccagatactatagaaacgctcatgttacttgcactaattgcagtgttaactggtggagttacattgttctttctttccggtaaaggattaggaaaaacatcgattggcctcctttgtgtaatggcaagtagcgcattattatggatggccagcgtagaaccacattggatagcagcatccataatcctagagttctttttaatggttctattaataccggaacccgatcgacaacgtacaccacaggataaccaactcgcatatgttgtgatcggacttctattcatgatactcaccgtcgcagcgaatgaaatgggtttactagaaaccaccaagaaagacttaggcatcggacatgtagcggcagaaaatcaccatcacgcgaccatgttagatgtggacctccgacccgcaagcgcttggaccctttatgccgtagcaacaacagtaattacgccaatgatgcgccatacaatcgagaacacaactgcaaatatctcgctaaccgctattgctaatcaagctgcaatattaatgggattagataaaggctggccaatctcaaaaatggatataggtgtacctctattagcgttaggctgctatagtcaagtgaatccgttaacgctgactgctgctgtcctaatgttggtagctcattatgcgatcattggcccaggcttacaagcaaaggcaaccagagaagctcaaaaacgaacagcagcaggaatcatgaaaaatcctacggtagatggtattgtagcaattgacttagacccggttgtatatgatgcaaagtttgagaagcaactaggtcaaattatgcttctcatcctatgcacaagtcaaattctcctaatgcgcacaacgtgggcgctgtgcgaatcaataacgctggcgaccggacccttaacaacattatgggaaggatctccaggaaaattttggaatactaccattgccgtatcaatggcgaacatcttccggggatcatatttagcgggcgccggacttgcattctctttgatgaaatcactaggaggcgggagacgaggaaccggcgcccaaggagaaacattaggtgaaaagtggaagagacaacttaatcaactatctaaatccgaatttaatacatataaacggagcgggataatggaagttgatcgatcagaagccaaggagggtttaaaaagaggcgaaacgacaaaacatgctgtctcccgaggtacagcgaagttacgttggtttgtcgagagaaacttagttaagccagaaggcaaagtcatcgatctaggatgcggtaggggtggatggtcctactattgcgcaggactcaagaaagtaacagaagtaaaaggctacacaaaaggaggaccgggtcatgaggagcccatacccatggcgacctatggctggaatttggtaaaactacatagcggaaaggatgtattcttcacccctccggaaaaatgtgatacactattgtgtgacattggagaaagttctccaaatccgactatcgaagagggcagaacattgagagtacttaagatggtagagccatggttgcgcggaaatcaattttgtataaaaatactaaacccttacatgccatctgtcgtcgaaactctagagcaaatgcagaggaagcatggcggtatgctagttagaaatccattatcaagaaattcaacacacgaaatgtactgggttagctgcggcaccggcaacatagtcagtgcagtcaacatgacttctagaatgcttttaaatcgattcacgatggcacatcgaaaaccgacatatgaacgtgacgtcgatcttggagcgggaacaagacacgtggcagtagaaccagaagtagcgaacttggatattatcgggcagagaattgagaatatcaaaaatgaacataagtctacatggcattatgatgaggataatccgtataagacatgggcgtaccacggttcttatgaagttaaaccttccggttcggcgtcttctatggtgaatggtgtcgtaagattattaacgaaaccgtgggatgtgattccaatggtaactcaaatagcaatgaccgacacgactccgtttggccaacagagagtgtttaaagaaaaggtagatacccggacgccaagagctaaacgaggaacggcacagattatggaagtaacagcaaagtggttgtggggatttctaagcagaaataagaaacctaggatatgcactagagaagaatttacgagaaaggtccggtccaacgcagcaataggtgctgtatttgtcgacgaaaatcagtggaactcagcgaaagaggcagtagaggacgagagattttgggatctggtccatcgagaaagagaattacataaacagggaaaatgtgccacctgtgtctacaatatgatgggaaagcgagagaagaaactcggagaatttggtaaagcgaaaggatcacgggcaatatggtatatgtggttaggtgcacgattccttgagttcgaagcactaggttttatgaatgaagaccactggttttctagagaaaatagtctatcgggagttgaaggagaaggcctgcacaaactcggatatattttaagagacattagcaaaatacctggcggaaatatgtacgctgatgatacggctggttgggatacaagaataactgaagatgacttgcaaaatgaagcaaagataaccgacataatggaacccgaacacgctttactcgctacatcaatatttaagctgacctaccagaacaaagtggtgagagtacaaagaccagcgaaaaatggaaccgtaatggacgttatctctaggagagaccaacgggggagtggccaagtcggaacctatgggctcaacacgttcaccaacatggaagttcaattaatacgacaaatggaaagtgaaggaatattcctaccttgtgaattggaaacgcctaacttagcagaaagagtattagactggctcgagaagcatggagccgagagacttaaaagaatggctatttcaggtgacgattgtgttgttaagcctattgatgacagattcgccacagctttgatagctctcaacgatatgggaaaagtgagaaaggatattccacagtgggagccttcaaaaggatggaatgattggcaacaggtacccttttgttcacatcatttccatcaactcattatgaaagatgggcgtgaaatagttgtaccatgccgaaaccaggatgaattagtaggacgggctcgtgtgtcacaaggcgctggatggtcactaagggaaacagcttgtttaggaaaaagctatgcacaaatgtggcaactaatgtattttcataggagggatctgagacttgcggcaaatgcgatatgttcggcagtacctgttgactgggttcctactagcagaactacatggagtatccacgcccatcaccagtggatgacgaccgaggacatgttgagtgtatggaatagagtatggatagaggaaaatccatggatggaagataagacacacgtatcttcgtgggaggaggttccataccttggaaaaagagaggatcaatggtgtggcagtttgatagggcttacagcaagagcaacatgggcaactaacatacaagttgccattaaccaagtaagaagattaatcggaaatgaaaattatttggactacatgacttccatgaaaagatttaaaaacgagtcaaaccccgaaggagcactctggtaa

SEQ ID NO: 21388 - RNA, 9879 nt, synthetic construct
  misc_feature 1..9879: note = derived and/or modified CDS sequence (opt6) from DENV-1__FJ410183__SS-prME
  source 1..9879: mol_type = other RNA
tcggtaacaatgctcttaatgttattaccaactgcgttagcttttcacctaactactcgaggaggggaacctcatatgattgtctccaaacaagaacgagggaaatctcttttatttaaaacttcagcagggatcaatatgtgcacacttattgctatggatcttggcgaactatgtgaagataccatgacatacaaatgtcctcggataacagaagctgaaccggacgacgtggattgttggtgcaatgccacagacacttgggttacatacgggacttgctctcaaacgggtgaacatcgacgtgacaaacgttcggttgcattagcaccacatgttggtcttggtttagaaacacgaacggagacttggatgagctcagaaggagcttggaaacaaattcaaaaggtggaaacatgggcactaagacacccgggttttacagttactgcgttctttttagcacacgctattggtactagcatcacacaaaagggcataatttttatcctgctaatgttggtaacacctagtatggcaatgagatgtgttggtataggaaatagagactttgtggaaggtttgtcaggagcaacgtgggtagacgtggtacttgaacatggtagttgcgttactactatggcaaaagataaaccaacgctcgatatagaattgttaaaaacagaagtaacaaaccctgcagttctacgcaaactctgcatagaagcaaaaatctcaaacaccaccacagacagtcgctgtcctactcaaggcgaagcaactttggtagaagaacaagatagtaattttgtttgtcgacgtacctttgtggataggggttggggaaatggatgtggtctctttggaaagggatcgttattaacatgtgccaaatttaagtgtgtaacgaaattagaggggaaaatagttcaatacgagaacctaaaatattcagtcattgtaacagtacacactggcgatcaacatcaagtgggaaatgaaacaacagaacatggtaccatagcaacaattacaccacaagcccccacaagtgagatacaattaacggattacggagctcttactttagattgtagccctaggactggactagattttaatgagatggttctactaacaatgaaagagaagagttggttggttcacaaacaatggtttctcgatttacccttaccttggacatcgggcgccagtacatctcaagaaacatggaatcggcaagatttattggtcacctttaaaactgcacacgctaaaaagcaagaagtggtcgtacttggatctcaagaaggggcaatgcacactgcactaacaggagctacagaaatacaaacatccggcaccacgactatatttgcagggcacttaaaatgtagattgaaaatggataaactcacattaaaaggtatgtcttacgtaatgtgtacaggttcgtttaagttagagaaagaagtggctgaaacgcaacatggaactgttttggtgcaggttaaatatgagggaacagacgcaccttgtaaaatacctttttccgcgcaagatgaaaagggagtaactcagaatggtcgcttaatcacggcgaatccaatagtcacggacaaggaaaaacccgtcaatatagagacagaaccacctttcggggagagctatattgtagtaggagcgggcgaaaaggctctaaaactcagttggttcaagaaaggttcatcaataggaaaaatgttcgaagccacagcacgcggggctagaagaatggcaatattgggagataccgcatgggatttcggaagcatcggaggggtgtttacttctgtaggtaaattggtacatcaggtctttggcgccgcatacggggtactattcagcggagtatcatggacgatgaagataggcattggaatactactcacctggttgggactaaatagccgatcaacaagtctatcaatgacttgtatcgctgtcggaatggttactttatatttaggggttatggtacaagcagattctggatgtgtaattaattggaaaggacgagaactaaaatgcggcagcggaatttttgttacaaacgaggtacatacatggactgaacaatacaagtttcaggctgatagtcctaagaggcttagtgcggctattggaaaagcatgggaagaaggagtctgtggtatccgttcggctacacgccttgaaaatataatgtggaaacaaatatcaaacgagcttaatcacattcttcttgaaaacgacatgaagtttacggttgtggtgggtgacgccaacgggatccttgcccaaggtaaaaagatgataagaccgcaacctatggagcataggtattcttggaaatcatggggaaaagcaaaaattataggagctgacatacaaaataccacatttatcatagatggtccggacactcccgaatgtcccgacgaccaaagagcttggaatatatgggaagttgaagactatggattcggtatttttacaacaaatatatggttaaaattaagagatagctatacgcaaatgtgcgatcacagattaatgtctgccgcgataaaggattcaaaggcagttcatgccgacatgggttactggattgaatccgagaaaaatgaaacttggaaactagcgcgagcgtctttcatagaggttaaaacatgtatttggcccaaaagccacacactatggtctaatggtgtactagaaagcgaaatgataattccaaaaatgtatgggggcccaacttcccaacataactatcgcccgggttattttacccaaacagcgggtccttggcatttaggtaaactcgaacttgattttgatttgtgtgaaggaactacagtagttgttgacgaacattgtggaaatagaggaccttcacttcgaacaacaacagtaacaggcaaaatcatacatgaatggtgttgtcggtcgtgtacactccctccactacgattccgaggagaagatggatgttggtacggcatggagataagacctgtgaaagaaaaggaagaaaatttggtcagatcaatggtctcggcggggtcaggggaaatggactccttttcactcggaatcttatgtgtcagtatcatgatagaggaggttatgcgatctaggtggtcaagaaagatgttaatgacagggacattagctgtatttctactattaattatgggtcaactcacctggaatgacttaataagactgtgtataatggtgggagcaaacgcaagtgatcgcatggggatgggcacaacataccttgcgctaatggccacatttaaaatgagacctatgttcgcagtaggactattatttagaagacttacatctcgggaggttctactgctcactatcggtctatccctggtagctagtgtagaattaccaaattctctcgaagagttgggcgacggcctggcaatgggcataatgatgctgaaactgctcacggaatttcaaccacatcaattatggactacattactgtcgttaacctttattaaaactactctaagtctagattacgcttggcgcaccatggccatggtattaagtatagtatcattattcccgctatgcttatcaacaactagccagaaaacgacttggctaccagtactacttgggagtttcgggtgcaaacctttaaccatgttcttaattacagagaataagatatggggaagaaaaagttggccgttaaatgaaggtattatggcaattggaatagtgagtattcttctatcatctttgcttaaaaatgatgtaccgctagctggacctttaattgccggaggtatgctaatagcgtgctacgttatttctggcagctctgctgatttatcactcgaaaaggctgcggaggtttcatgggaagaagaagctgaacatagcggtacatcccacaacatcctagtggaagtgcaagacgatggtacaatgaagattaaagacgaagaaagagacgacacgctaactatattacttaaggctacattattagctgtgtcaggcgtatacccaatgagtataccggcaactttattcgtatggtatttttggcagaaaaagaaacaacgttcaggtgtactatgggatacacccagtcctccagaggttgaacgggcggtattagatgacggaatctacagaattttacaaagaggcctcctaggacgtagtcaagtcggggttggtgttttccaagatggcgtattccacacgatgtggcacgttactagaggggctgtgctgatgtaccaagggaaacgtctagaaccctcatgggctagcgttaaaaaggatcttatttcctacggagggggttggagattccaaggaagttggaatacgggagaggaagttcaagtaattgcggtagaacctggcaaaaatccgaaaaatgtgcaaactaccccaggaacttttaaaactccagaaggagaagtcggagctatagctctggactttaagccgggcacgtcgggaagtcctatagtaaatagagaaggcaaaatagtagggttgtatggcaatggggtagttactacgtccggtacatatgtgtcagcaattgcacaagccaaaaccagccaagaaggaccactaccagaaatagaagacgaagttttcaagaaaaggaacctaacgataatggatcttcaccctggaagtggaaaaaccaggagatatctacccgctattgtacgagaagcaattaaaaggaaactaagaacattaatcttggcacctacacgggtggtagcttctgaaatggccgaggctttgaaggggatgccaataaggtaccagactacagccgttaagtcggagcatacaggaagagagatagtagacctaatgtgccatgccacgttcacaatgcgcctacttagtccagtcagagtacctaactataatatgattattatggatgaagcacatttcacggatccagcaagtatagccgcacgcggttatatatcaacaagagtaggcatgggggaagctgcggcaatatttatgacagcaaccccaccgggatctgtcgaggcttttccacagagtaatgctgtgatacaagatgaagaaagggatatcccagagcgttcctggaacagcggctatgattggatcactgacttccctggaaaaacagtatggttcgtaccttcgataaaaagtggaaatgatatagcaaactgcctacgaaagaatgggaaaagagtaatacagctgtcgaggaaaaccttcgataccgaataccagaaaaccaaaaacaatgactgggactatgtagtcaccacagacatatcagaaatgggggcgaactttagagctgatcgtgtaattgacccgcgacgatgtttaaaacctgtaatattaaaagacggtcctgagcgagtgatcttggcaggacccatgccagtaacagtagcgtcggcagcccagcgcagaggtagaattggaagaaaccaaaataaagagggcgaccaatacgtttatatgggtcaaccgttgaataacgacgaggatcacgctcattggactgaggctaaaatgctgctagataatattaacacgcctgaaggcattatacctgctctattcgagcccgagagagaaaaatcggcagcaatagatggtgaataccgtcttagaggtgaagcacgaaaaacatttgttgagctaatgcgaaggggtgatttgccggtatggctcagttacaaagtagcgagtgaaggctttcagtatagcgatcgtcgttggtgttttgacggagaaagaaacaaccaagtcctagaggaaaatatggatgtagaaatttggaccaaagagggcgaaagaaagaaactaagacctcgatggctcgacgctcgcacatattcagatccacttgcactaagggaatttaaagaatttgcggctggtagaagatcagtatctggcgatcttatactagaaataggaaaattaccacaacacctaacattaagggctcaaaacgcattagacaatcttgttatgttacacaatagcgaacaaggcgggaaggcatacaggcacgcaatggaggagctaccagataccatagaaacattaatgctcctagcgttaatagctgtccttactggaggtgtcactctgttctttttatctggtaaagggttgggcaaaacttcaattggactattatgcgtaatggcttcaagtgccttactctggatggctaatgttgaacctcattggattgctgcaagtatcatcttagagttctttttaatggtattactcataccggaacctgataggcaacgtacacctcaagacaatcagctagcatacgtggttataggattactatttatcatactaactgtagcagccaatgaaatggggctactagaaacaacaaagaaagatctgggcataggccacgtcgcagcagaaagtcaacaccacgcaactatgctcgatgttgatttacgtccagctagcgcgtggacactatacgccgttgcgacgactgtcattactcccatgatgcgacataccattgagaatacaacagcaaatatatcacttactgccattgctaaccaagcagcgatactaatgggtctagataaaggatggcctataagtaaaatggacataggggtccctttgctagcacttggctgttacagtcaagtaaatccactcacacttaccgctgctgtactaatgcttgtcgcccattatgcaatcattggacccgggcttcaagcgaaagctactagagaagcgcagaaaagaacagcggcgggcataatgaaaaatccgacagttgacggaattgtagccatagacttagaccctgtcgtttatgatgcaaaattcgaaaagcagttaggacaaattatgttgctgatactctgcacctcacaaattctattaatgagaacgacatgggcattatgcgagagtataacactcgcgactggcccattgactacactctgggagggctctccgggaaagttttggaataccacaatagctgtgagcatggcgaacattttcagaggaagctatctagccggcgcaggtttagcgttctccctaatgaaaagcctaggcggtggaagacgaggcacaggagcgcagggtgagacacttggcgaaaagtggaaacgacaattaaatcaactgagcaaaagcgagttcaacacttataaaaggagtggtatcatggaagtagacagaagtgaggcaaaggagggattgaaaagaggagagaccacaaaacacgcagtttctagaggaaccgccaagctgcggtggtttgtagaaagaaacttagtaaaaccagagggaaaagtcattgatttgggctgtggcaggggtggttggagttactattgtgcgggtttgaaaaaggtcactgaagtaaaaggatacacaaagggtggaccaggacatgaagaacctatccctatggcaacctatggctggaacctagtcaaactatattccgggaaagacgtattctttacgccgcctgaaaaatgtgataccttactatgtgatataggcgaaagctccccaaatcctaccattgaggaagggaggacgcttagagtactaaagatggtcgagccgtggcttcggggaaatcaattctgcatcaaaatactaaacccatacatgccgtctgtagttgaaacattggaacagatgcagaggaagcacggaggaatgttggtaagaaacccgttatcccgaaattctacccacgaaatgtattgggtttcttgtggtactggtaatattgtaagcgctgtgaatatgacctcaagaatgttacttaataggttcacaatggctcataggaaaccgacgtacgaacgcgatgtcgacctcggagcaggtacaagacacgtagctgtcgaaccagaggtagctaacctggatatcattggccaacgcatagagaacatcaaaaatgaacataaatctacatggcactacgatgaggataatccgtataaaacgtgggcgtaccacggatcttacgaagtgaagccttctggctcagcatcgtcaatggtaaacggagtagtacgactactcacaaagccctgggacgttatccctatggtaacccagatagccatgacagacacgacacccttcggccagcaacgtgtctttaaagaaaaagtagatactaggacacctcgcgcgaaaagaggtaccgcgcaaataatggaagtcactgcaaaatggttgtggggatttctttctagaaacaagaaaccccgaatttgtacgcgggaagaatttacaaggaaagttcggagtaatgcagccattggtgccgtatttgttgacgaaaatcaatggaatagtgcaaaagaagcggtggaggatgaaagattttgggacttagttcatagagagagagaattacataaacaagggaaatgcgcaacatgtgtatataatatgatgggaaaacgagagaagaagctaggtgaatttgggaaagctaaaggatcccgagcaatctggtatatgtggctgggagcaagatttcttgagtttgaagcattgggttttatgaatgaagaccactggtttagtcgtgagaacagcttttctggagtagaaggtgaaggactgcataagctcggttatatcctacgcgatatcagtaaaatccctggaggaaatatgtatgctgatgacacagctggctgggacacgagaattacggaagatgacttacaaaatgaggccaagatcacagacataatggaaccagagcacgcactattggctacctcaatctttaaacttacctaccaaaacaaagtagtcagggtacagagacccgccaaaaatggtaccgttatggatgtcatatcaaggagggatcaaagagggagcgggcaggtcggaacatacggtttgaatacgtttacaaacatggaggtgcaacttatacgacaaatggaaagtgaaggaatattcctaccatccgagttagaaacacctaacttggcagaacgcgtcttagactggctagaaaagcatggtactgagagacttaaaagaatggcgataagcggggatgattgtgttgtgaagccagtagacgataggttcgcaacagctctcattgctctaaacgatatgggtaaagttcgtaaagacattccacagtgggagccatcgaaaggatggaacgattggcaacaagtcccgttttgtagccaccatttccatcaattaattatgaaggatggacgagagattgtagttccatgtcgcaatcaggacgaattagtcggccgagctagagtaagccaaggcgcaggttggtcgcttcgagagacagcatgcctaggtaaatcatacgcccagatgtggcaattaatgtatttccaccgtcgagatctaaggcttgcagcaaatgcaatctgctcagcagtaccagtagattgggtccccacttcaagaacgacatggagtatccatgcgcaccatcaatggatgaccactgaggatatgttatcagtctggaacagggtttggatagaggaaaatccttggatggaggataaaacccatgtatcatcttgggaagaagttccttatttgggtaaaagggaggaccaatggtgcggtagtttaataggactcacagcaagagccacatgggccacaaatatccaggtagctattaaccaagttagaaggttaataggtaatgaaaattatctagactacatgacgagcatgaaaagatttaaaaacgaatcagatccagaaggagccctatggtga

SEQ ID NO: 21389 - RNA, 9879 nt, synthetic construct
  misc_feature 1..9879: note = derived and/or modified CDS sequence (opt6) from DENV-1__FJ410184__SS-prME
  source 1..9879: mol_type = other RNA
agtgtaactatgttattgatgttattgccgaccgctttagcgtttcatctaacgactagaggaggcgagcctcatatgatcgttagtaaacaagaaagaggtaaatcacttttgttcaaaacttcagcaggaataaacatgtgtacacttatagcaatggatctaggcgaactatgtgaagatacgatgacgtataaatgtcctaggatcacggaggctgaaccggatgatgtggactgctggtgtaatgccacagatacttgggttacttatggaacatgctcgcaaactggggagcacaggcgagataaaagatccgtggcccttgcccctcacgttggattagggttagagaccagaacagaaacttggatgtcaagtgagggtgcttggaaacaaatacaaaaagtagaaacatgggcattaagacatcccggtttcactgtgatagcactctttttagcccacgcaatcggaaccagcataacacaaaaaggtataattttcatactcctgatgttagttaccccaagcatggcaatgcgctgtgtggggattgggaatcgtgacttcgtagaaggattatctggagccacatgggttgatgtcgtattagaacatggaagttgtgttacgactatggcgaaagataaacccacgttagacatagaattacttaaaaccgaagttacaaatccggccgtgttaagaaaactctgtattgaggctaaaatttcgaataccacaacggatagtcggtgcccaactcaaggagaagccaccctagtagaggagcaagatgcaaattttgtgtgtcgacggacattcgttgatagaggatgggggaacggatgcggcctatttggaaaagggtctttattgacttgcgctaaatttaaatgcgtaacaaaactagaaggtaaaatcgtccaatatgagaatctgaagtattctgtcatagttacggtccatacaggagaccaacaccaagttggaaacgaaacaactgaacacgggactattgcaacaataactcctcaagctccaacatctgagatccaattaactgattacggtgcgttgacactagactgtagtccacgtacagggctcgacttcaatgaaatggtgctcttgacaatgaaagaaaaatcatggttggtacataaacaatggtttcttgatcttccacttccatggacaagtggtgctagtaccagtcaagaaacctggaacagacaagacctattagtaacttttaagaccgctcatgccaagaaacaggaagtagtagtcctaggcagtcaagaaggggcgatgcatacagcattaactggcgcaacggaaatccaaacctcaggcactactacgatcttcgctggtcatcttaaatgtagactcaaaatggataaactaacgttaaaaggtatgtcatacgtcatgtgcacaggatcattcaaacttgaaaaagaagttgcagaaactcaacatggaactgtgcttgtccaagtcaagtacgaagggaccgatgctccttgcaaaataccattttctgcacaggatgaaaaaggggtaacacaaaacggcagattgatcacagccaatcctatagtaacagacaaggaaaaaccagtcaacatcgaaactgaaccccctttcggcgaatcttatatagttgtaggcgccggcgaaaaggcattaaaactaagttggttcaagaaaggttcatcaatagggaaaatgtttgaagcaaccgcaagaggggcaagaaggatggcaatcctaggtgatacggcatgggattttggctccataggaggtgtattcacatcagtgggtaaattagtgcaccaagtttttggaacagcttacggagttctttttagcggcgtaagctggactatgaaaatcggtattggaatcttattaacgtggctaggcctgaatagtaggtcaacttcattatcaatgacatgcatagccgttggaatggtaacactttacctaggggtaatggtacaagcagactccggctgtgtaattaattggaaaggaagggaactaaaatgtggtagtggcatctttgtaactaacgaagttcacacatggacagaacaatacaaatttcaggccgatagccctaaaagattaagcgcggcaataggtaaggcttgggaagagggagtctgcggaataagaagtgcaacacgattagaaaatataatgtggaaacaaatctcaaatgagttaaatcacatacttttagagaacgacatgaaattcactgtggttgtcggggatgcaaatggaatattagcacaaggaaagaaaatgatacgtccgcaaccaatggagcataggtattcgtggaaaagttggggtaaagcgaagataataggcgcagatatccaaaacaccacttttattatagacggcccagacactccagagtgcccagacgatcaacgagcctggaatatatgggaggtcgaggattacggattcggaatattcacaacaaacatatggttaaaattgagggactcatacacccagatgtgtgatcataggctcatgtctgcagccattaaggatagtaaagcagtacacgccgacatgggatactggatagaatccgagaaaaatgaaacctggaaacttgctagagcatccttcattgaagtcaaaacctgtatttggcctaagtctcacacactatggtccaatggagttcttgaatctgagatgataatcccaaaaatttatggagggccgatatcgcaacacaattataggcccggatatttcactcagacggctggaccttggcatcttggaaaactagaattagactttgatttgtgtgaaggtacaacagtggttgtcgacgaacactgtggaaatcgaggaccatcgctaagaaccacaaccgtaaccggaaaaattatccatgaatggtgttgtaggtcatgtactcttccacctctaagatttcgcggtgaggacggatgttggtatggtatggaaattcgaccagtaaaagaacgcgaagaaaatctggttaaaagcatggttagtgctggattgggcgaggtagattcatttagtctgggcattttatgtgtatcaattatgatagaggaagttatgcgatccaggtggtcgaggaagatgttgatgaccggaacattagctgtatttttactcttaataatgggacaactaacatggaatgatcttattagattatgcataatggtcggcgctaacgcgtcagacagaatgggaatgggcacaacttacttagcattgatggcaaccttcaaaatgcgaccaatgtttgcggtggggctcctattcaggagactcacctcaagagaggtcctgttactaacgatcggcctatctttagttgcaagcgtcgaattacccaatagccttgaagaacttggtgacggcctagcgatgggaatcatgatgcttaaactattgacagagttccaaccacatcaactatggacgacattattaagtttaacatttattaaaacgaccctatcgctcgattatgcttggaaaactatggcaatggttctcagcatagtatcattgtttccactttgtctttcaacgacaagtcagaaaaccacatggttaccggtcttgctaggttcattagggtgcaaaccattaactatgtttttaataactgaaaacaaaatttggggaagaaaatcttggcccttaaatgaggggattatggcaataggtatagtttcaattctattaagtagtttgttgaaaaacgacgttccattagcaggacctttaatagctggaggcatgctcatcgcatgttacgtcatctcgggttcatcagcagatttatcccttgagaaagccgccgaagtgtcctgggaagaggaagctgaacatagtggtacaagtcataatatattagttgaagtacaggacgatggaacgatgaaaataaaagatgaagaacgagatgacacgttaacgattctcttaaaagcgactctacttgcagtctcgggcgtttatccaatgtctatcccagcgactttatttgtatggtacttttggcaaaagaagaaacaacggtcaggagtcttgtgggatactccgtcgccgccggaagtggaaagagcggtcttggatgacggaatctatagaatccttcaaagagggctactgggtcgatcacaagtgggagtcggagtatttcaagatggcgtattccacacaatgtggcatgtgactagaggagccgtcctaatgtatcaaggcaaaagattagaacccagttgggcgagtgttaagaaagacttaattagctatgggggcggctggcgattccaaggtgcgtggaatacaggagaagaagtccaagttatcgctgtagaaccaggcaaaaatcctaaaaatgtccaaacgactcctggcacttttaaaacgccagagggtgaagttggtgctatagcattagattttaaaccaggtacgtccggaagtccaatagttaacagagagggaaaaatcgttggtctgtatggaaatggggtggtaacgacaagtggtacatatgtctctgctatagctcaagcaaagacatcacaagaggggtcgttaccggagatagaggatgaagtttttaagaaaagaaaccttactattatggatttgcacccaggatcaggcaaaacgagaagataccttcccgccattgtacgtgaggcaataaaaagaaaacttagaacactaatccttgcgcctactagagtagtagcttcggagatggcagaggccctaaagggtatgccaatacgctaccagacaactgcagtgaaaagtgagcacacagggcgcgaaattgttgatttaatgtgccacgcaacattcaccatgcggttattgtctccagtaagggttccaaactataatatgataataatggacgaagctcacttcacagatccagcatccattgcggctcgagggtacatatccacaagagtcgggatgggggaagcagcagcgatatttatgacagcaacacctccaggttcagtcgaagcatttccacaatctaatgcagttatccaagatgaggaaagagatatcccggaacggagttggaacagtggatatgattggataacagattttccgggaaaaaccgtctggttcgtaccatcgataaagagcgggaacgatatcgcaaactgccttcgaaagaatgggaaaagagtaatacaattaagtcggaaaacatttgataccgaatatcagaaaacgaagaataatgactgggattacgttgtcacaactgatatctcggaaatgggagctaactttcgggccgacagagttatagatcctcggagatgtctaaagccagtaatcttaaaggatggccctgaacgcgttatattagcaggtcctatgcctgtaaccgtcgcaagtgctgcacaacgaaggggccgaattggtagaaatcaaaataaagaaggagatcaatacgtctatatgggacagcccttaaacaacgacgaagatcatgcccattggacagaggcgaaaatgttattggataatataaacacacccgaaggtataatacccgcactcttcgagccggaacgcgaaaaatccgctgctatcgatggcgaatataggttaagaggggaggccagaaagaccttcgtagaactaatgcgaagaggcgaccttccagtgtggttatcttataaggttgcgtcagagggatttcaatattctgataggagatggtgctttgatggagaaaggaacaaccaagtattggaagaaaacatggacgtagagatttggacaaaagaaggcgaaaggaagaaactgcgaccccgctggttagatgcaaggacgtacagcgatccgcttgcattacgagagtttaaagaatttgcagccggccgtcgatcagtaagtggtgaccttatcctagaaataggaaaattaccgcaacatttaacattacgagcacaaaatgcattagataaccttgtgatgctgcataatagtgaacaaggaggaaaggcttacaggcatgcgatggaagagttacctgatacaatcgaaaccctgatgcttctcgcgctcatagcagtattgaccggtggtgtaaccctctttttcctcagcggaaaagggcttggaaagacaagtattggacttctttgcgttatggctagctctgcattactttggatggcatcagttgaacctcattggatagcagcctctataatattagaatttttcctaatggtacttttaatccccgagccagacaggcaacgcacacctcaggacaatcaattagcatacgtggtgatcggattgttgttcatgatcctcacagtggcagcaaacgagatgggacttttagaaactactaagaaagatttgggcattggatatgtagctgcagaaaatcatcatcatgcaacaatgcttgatgtagaccttcggccagcttcagcttggaccctatatgcagtagcaactacagtaattacacccatgatgagacacactatcgaaaataccactgcaaacatatcattgaccgcaatagcgaatcaagctgcaattctaatgggtctcgacaagggctggccaatatctaaaatggatattggggtccctctactagcgttggggtgttattcccaagtaaacccactaaccctaaccgcagcagtactaatgttggtcgctcattatgcgattatcggtccgggtttacaagcaaaggcaactcgagaagcccagaaaagaaccgccgctggaattatgaaaaaccctacggtcgatggaatagtcgcaatagatctcgatcctgtagtttatgatgccaagtttgagaaacaactaggccaaataatgttgttgattttgtgcacatctcaaatactgttaatgagaacgacatgggctttatgcgagtcgattactctagctacagggccgctaacaacattgtgggaaggaagccccgggaaattttggaacacaacaattgcagtgtcaatggcaaatatttttagggggtcatatttagcgggagcagggttagctttttcattaatgaaatccttgggaggtggcagaagagggaccggtgcacaaggcgagacactaggtgagaaatggaaacgtcaactaaatcaattgagcaaatctgaatttaacacctataaaagaagcggtataatggaagtcgaccgaagtgaagcaaaggaaggtttaaaacgtggagaaactaccaaacatgccgtatctagaggaaccgcaaagttgaggtggtttgtagaacgaaatttagtcaaacccgaaggaaaggtaatcgacttaggatgtgggcggggaggctggtcctactactgtgcgggattaaagaaagtaacggaagtgaaaggatatactaagggtggaccgggtcatgaagaaccaatcccaatggcaacatacggttggaacctagtgaaattacattcgggaaaagatgtcttcttcacacctcccgagaagtgtgacacactcctttgcgacataggggaatcctcacccaatcccacgattgaggagggtagaacgctcagagtcttaaaaatggtcgaaccttggttgaggggaaaccaattctgcataaaaattctaaacccctatatgccctcagtagtagaaactttggaacaaatgcagcgtaagcatggagggatgcttgtgcgtaaccccttaagtcgaaatagtacacacgaaatgtattgggtttcatgcggtacaggaaacatcgtgtctgcggtgaacatgacatcgagaatgttattaaatagatttacgatggcgcatcgcaaacctacttacgaaagagatgtggatttaggtgcgggtacacgacatgttgccgtagaaccggaagtagctaatttagacataattggacaacgaatagagaatatcaagaatgaacacaaatctacgtggcattatgatgaggataatccgtataaaacatgggcctaccacggatcatatgaagtcaaaccttctggaagcgcatctagcatggtaaacggggtcgttagactccttacaaaaccttgggacgtcattcctatggttactcaaatcgcaatgacagatacaacaccatttggacagcaacgtgtttttaaagagaaagtcgacaccagaacaccaagagctaaacgtggcaccgcacaaataatggaggtaacagcaaaatggttatggggatttttgtctcgaaacaagaagccacgcatttgtactagagaggaatttacacgtaaggttcgatccaatgcagcaataggagcagttttcgtcgacgagaaccaatggaactctgccaaagaggccgtggaagatgagcgattctgggatctagtacatcgtgaaagggagcttcataagcaaggaaagtgtgcaacttgtgtatataatatgatgggtaaacgagaaaagaaactaggtgagttcggaaaagctaaaggaagtcgcgctatttggtatatgtggttaggtgccagatttctcgagttcgaggctcttggatttatgaacgaagatcactggttctcaagagaaaactcctttagcggggtagaaggggaagggttacacaaactcgggtacatccttagagatatttctaaaatccctggtggtaatatgtacgcagacgataccgccgggtgggacacgcgtataacggaagatgatcttcaaaacgaagcgaaaataacagatataatggagccagagcacgccctcctggcaacatcaatctttaaactgacttaccaaaataaggtagtcagagtacaaaggccagcgaaaaatggaacggtcatggatgtaatttctagaagagatcaacgtggaagtggacaggttggaacatatggcttaaatacctttaccaatatggaagttcaattaatacgtcagatggaatctgaagggatatttttaccatcggaattagagaccccaaacctggctgagcgagtccttgactggctagaaaaacacgggaccgaaaggctaaagagaatggcaatttccggcgatgactgcgtcgttaaacctgtagatgacagatttgccacagcactcatagcgctaaatgacatgggtaaagtacgcaaagacataccacaatgggaaccctctaaaggatggaacgattggcaacaggtacctttctgttcacatcatttccatcaattaattatgaaggacggcagagaaatagttgtgccatgtagaaatcaagatgaattagtcggacgggccagagtatctcaaggggccgggtggtcattaagagagaccgcatgtctaggcaaatcgtatgcacaaatgtggcaactaatgtactttcaccgtagagacctaaggcttgctgcgaacgcaatatgttcagctgtccctgtagactgggttccgacttcacggacaacgtggtcaattcatgcacaccatcaatggatgactacagaagatatgcttagtgtgtggaatagggtgtggatagaagaaaacccctggatggaagataaaacacacgtcagcagttgggaggaagtaccatatctcggaaaacgggaggaccaatggtgtggctctttaataggacttacagcacgtgctacttgggcaactaatattcaagtagctataaaccaagttagaagactgataggcaacgaaaactatctagactatatgacatcgatgaaacgattcaaaaatgaaagtgatccagagggggcactctggtag

SEQ ID NO: 21390 - RNA, 9879 nt, synthetic construct
  misc_feature 1..9879: note = derived and/or modified CDS sequence (opt6) from DENV-1__FJ410185__SS-prME
  source 1..9879: mol_type = other RNA
tctgttacaatgctgctcatgttactaccgacggccctagccttccatttaacaactcgaggaggtgaacctcacatgattgtatcgaaacaagaaaggggaaaatcactattatttaaaacatccgtagggataaacatgtgcacccttatcgcgatggatctcggagaactctgtgaagatacaatgacgtataaatgcccgagaattacagaagctgaaccggacgacgtagattgctggtgtaacgctaccgatacatgggtaacttatggaacctgttcacaaacaggagaacaccgtcgcgacaaacgatcagtggcattagcgccacacgtgggattaggactagaaaccagaacagaaacatggatgagtagcgaaggtgcatggaaacaaatacaaaaagttgaaacatgggcactcagacatccgggcttcaccgttatagcactattcctcgcgcacgctataggaacctctattacacaaaaaggcattattttcatacttcttatgctcgtgacgccatccatggcaatgagatgcgttggaataggcaacagagatttcgtagaaggattatcaggcgcaacgtgggttgatgtagtactagaacacggttcatgcgtaacgactatggcgaaagacaaacctactctggatattgaattgctaaaaactgaagtcactaatccagccgtactacggaaactgtgcattgaagccaaaatatcaaatacgacaacggatagtcgctgccctacacaaggcgaagcaacattggttgaggaacaagacagcaattttgtttgtaggcgaacttttgtcgatcgaggttggggcaacggctgtggcctttttggtaaaggttcgttattaacatgtgccaaattcaaatgtgtaaccaaattggaaggcaaaatagtacaatacgaaaatctcaaatatagcgtaatagtgacggtccatacaggggatcaacatcaggtaggcaatgaaaccacagaacatggaactatagctaccataacaccacaagcccctacgtcagagatacagctcacggattacggggccctgactctcgattgttctccaagaaccggtctcgattttaatgaaatggtcctactaacaatgaaagagaaaagttggctagtccacaaacaatggtttttagatctaccactgccatggacgtccggtgcatcaacatctcaagaaacctggaatcggcaagacctgttagttacattcaaaacagctcacgccaagaaacaagaagtggttgtcttgggttctcaggaaggggcaatgcacactgcgctgactggagcaacagaaatacaaacatctggaacaacaaccatatttgcaggacacttaaaatgtagactaaaaatggataaattgacactaaaaggaatgtcatatgtgatgtgcacgggtagcttcaaactagaaaaagaagtcgcagaaactcagcacggtacagtcttagtacaagttaaatacgaaggcacagacgccccatgcaagataccattctcagcacaagacgaaaaaggtgttactcaaaatggtcgtttaataacagcgaaccctatagtaactgacaaggagaaaccagtaaatattgaaacagaaccgcctttcggcgaatcatacatagttataggagctggagaaaaggctttaaaattaagctggtttaagaaaggaagctcaataggaaaaatgttcgaggcaactgcgcgcggagcgagacgtatggcaattctcggtgataccgcctgggattttggcagtattggcggcgtgtttacaagtgtgggaaaactcgtgcaccaagtgtttggagcagcttatggggtattatttagtggcgttagttggaccatgaagatcggaattggtatattgctaacatggctaggtcttaactcgagaagtacgagcttatcaatgacatgtatcgcagttggaatggtaaccctctatttgggtgtgatggtacaggccgactcaggttgcgtaatcaattggaaaggtcgagaactaaaatgtggatcaggaatatttgtgacaaatgaggtccatacttggacggaacaatataagttccaagcagattctcccaaaagattatcagcagccataggaaaagcctgggaggaaggtgtctgtggtataagaagtgctacccgccttgagaatattatgtggaagcaaatttctaatgaactgaatcacatactcttagaaaatgatatgaagtttaccgtggttgtaggagatgcaaatggtatactagcacaagggaagaaaatgatacgaccacagcctatggaacacaggtacagttggaaatcatggggtaaagctaagatcattggggccgatatacaaaatacaacgtttataatcgacggtccagatactccagaatgtcctgatgaccaaagggcatggaacatttgggaggtcgaggattacggcttcgggatattcacgactaatatctggttaaagctccgcgattcttacacccaaatgtgcgatcacagactaatgtctgcagctataaaagatagtaaagctgttcatgctgatatgggctattggatagaatccgagaaaaatgagacttggaaactggcgagggcatcatttattgaggtaaaaacttgtatctggcctaagtcccacacattgtggtctaatggggtattggaaagtgagatgatcataccaaaaatctatggtggacctatcagtcaacacaattatagaccagggtactttactcagacagcaggaccatggcacctcggaaaactagaacttgactttgatttgtgtgaaggcacgacagtcgttgttgatgaacattgtggcaaccgtggaccgtcactgagaacgactacagtgacaggtaaaataatacatgaatggtgctgcagatcatgcacattgcctcctctgcgatttagaggagaagatggttgctggtatggaatggagataagaccagtgaaagagaaagaagaaaatttagtacgatcaatggttagcgcaggaagtggagaagtagattcattctcattaggaattttgtgtgtgtcaattatgatagaagaagtgatgagatcgagatggtcacgaaaaatgctgatgacaggaacgttagcagtctttttattacttataatgggacaacttacatggaatgacttaatacgattatgtataatggtaggggctaacgcttccgacaggatgggaatgggaactacttatctagcattaatggctacatttaaaatgcgtccaatgttcgcagtgggcctattatttcgtcggctcacaagccgagaagtactattattaacaataggtctgagcctagtagcttcagtagaattgccgaactctttagaggaactaggtgatgggctggctatgggcataatgatgttgaagttgcttaccgagtttcaaccacatcaattatggacaacattattgagcttaacattcattaaaacaactttaagcctagactacgcttggcgcacgatggctatggttctgtccattgtatccttattccctctgtgtttatcaacaacaagtcaaaagacaacctggttaccagttctactgggcagcttcggatgtaagccactaacaatgttcctaatcaccgaaaacaaaatttggggtcgcaagagctggccgctcaatgagggaataatggcgattggaattgtaagtatattgctatcttcattattgaagaatgacgtccctcttgcaggaccccttattgcgggtggtatgttaatagcatgctatgttatcagtgggtcctctgcggatctgagtctggaaaaagctgcggaagttagctgggaagaagaggcagagcactctgggacaagccataatatattggtagaagtccaagatgatggaacaatgaaaattaaagacgaggaaagagacgataccctgactatcttactcaaggccactctacttgccgttagtggcgtatatccaatgtcgatccccgctacattattcgtgtggtatttttggcagaagaagaaacaacgaagcggggtattgtgggatacaccatctccgcctgaagttgagagagcagttctggatgacggtatatataggatattacaaagaggattactgggtaggtcccaagttggagtaggtgtattccaggacggagtgtttcatacgatgtggcatgtaactcgtggagccgtactgatgtaccaagggaaacgtttagaaccatcgtgggccagtgtgaagaaagacctaatctcttatggcggaggatggagattccaaggatcttggaataccggagaagaagtacaagttatagctgtagaacctggcaaaaatcctaagaacgtccaaacaacgcctggcacatttaaaacacctgaaggagaagttggcgctatagcactggactttaagcctggcacatctggatcaccaatcgtaaatagggaagagaaaatagtcggtttatacggaaacggagtcgtcacgacatcaggtacgtacgtaagtgcaatagcccaagcaaaaaccagccaagaaggaccattaccagaaattgaggatgaggtatttaagaaacgtaatttgactattatggatcttcatccaggaagcggaaaaactagacgataccttccagctatcgtgagggaggcaataaaacgtaaattacgaacgctgatattggctcctacaagagtagttgcatcagaaatggccgaagccctcaaaggaatgccaataagataccagaccaccgcagtaaaaagcgagcatactgggcgagaaatagtagacctaatgtgtcacgcaactttcacgatgcggctattatctccggtacgagtgccaaattataatatgattattatggacgaggcgcacttcacagacccagcgtcaattgctgccagaggatacatatcgactagagtaggcatgggcgaagcagctgccattttcatgactgcaacccctcctgggtcagtagaagcatttccgcaatcaaacgcggttatacaagacgaggaaagggacataccagaaagaagttggaatagtggttacgactggattactgactttccaggaaaaactgtatggttcgtaccgagtataaagtcgggaaatgatatagcgaattgtttacgtaaaaacggcaagcgagtgatacaactttcacgaaagacatttgacactgaataccagaaaacgaaaaacaatgactgggactatgtggtcacaactgacatcagcgaaatgggggcaaattttagagccgatcgagttattgatcctagaaggtgcttaaaaccagtaatactaaaagatggtccggaaagggtcattcttgcgggaccaatgccggtaactgtagcatccgcagcacaaagaagagggagaataggacgtaatcaaaacaaagaaggagatcaatacgtatacatgggacaaccattaaacaacgatgaggaccacgcacattggacagaagcgaaaatgcttttagataacataaatacaccggaaggaataatcccagcactatttgaaccagaaagggagaaaagtgctgcgatagatggtgaatacagattaaggggtgaagcgcggaaaacatttgttgagctcatgaggaggggagacttaccggtatggttatcttataaagtcgcatcagaaggtttccagtatagcgatagacgctggtgctttgatggagaacgcaataatcaagttcttgaggaaaacatggatgttgagatctggacaaaagagggagaaagaaagaaattgcgaccaaggtggttagatgcgagaacctattctgatccgctagctctgcgagagttcaaagagttcgcagcaggacgaaggagtgtctcgggtgaccttatacttgaaataggtaagctcccccagcatcttaccctcagggctcaaaatgcattggataatttggttatgttacacaactcagagcaaggtggaaaagcctatagacacgcaatggaagaactacccgacactatagaaacccttatgttattagcccttatcgcagtacttacgggaggagtgacactcttcttcttgtcagggaagggattgggaaaaacatccattggccttttatgcgtgatggcttcatctgcattactttggatggcaaatgtggagccacactggatagcagcatctataatcctggagtttttcctaatggtattgttaattccagaacccgatagacaacgtacaccccaagataatcaactagcatatgtagtaattggtttattattcatgatacttacagttgcagcaaatgagatgggattgctggaaacgacaaagaaagatctagggattggacatgtagctgcagaaaaccaacatcatgcgactatgttagatgtcgatctaagacctgcatccgcctggactttgtacgctgtagcgacaaccgtcattacgccaatgatgagacacaccattgaaaacaccactgcaaatatatcgctcaccgcaatagcaaaccaagcagcaatcttaatgggtttagacaaagggtggcctatatctaagatggacataggggtgcctttgctagctctagggtgttattcgcaagtaaacccacttacactaacggcagccgtgctcatgttagtagcccactatgccataatcgggcccgggcttcaagctaaagctactagggaagcacagaaacgaacagctgctggtataatgaaaaatccaacggttgatggaatcgtggctatagatcttgatcctgtagtttacgatgctaaatttgaaaaacaacttgggcagataatgctattaatcctttgtacttcacaaatactcttaatgaggacaacctgggctctttgtgaaagtattaccttagcgacaggacctctcacaaccctttgggaggggtcgccaggtaagttctggaatactacaatagcggtaagcatggcaaacatctttagggggagttatctggctggagcagggctagcattttccttgatgaaatcactaggtggaggcagaaggggtacgggagctcaaggtgaaacattgggggaaaaatggaaacgtcaactaaatcaattatcaaaatctgagttcaacacatacaaacgtagtggaataatggaagtcgataggtctgaggcaaaagaaggacttaaacgcggggagacaacgaaacatgcagtttctagaggtaccgctaaactgaggtggttcgtcgaacgtaatttagtgaagccagaaggcaaagtaattgatctcggatgtggtagaggtggatggagttactactgtgccggtctaaagaaagtaacggaagtaaaaggatacacaaagggtggaccggggcacgaagaaccgataccaatggcgacttacggctggaatttagttaaattatactctggtaaagacgtatttttcacaccaccagaaaaatgcgacacactattgtgcgatataggtgaaagcagccctaacccaaccattgaggaaggccgaactctaagggtactaaaaatggtagagccttggctcagaggcaaccagttttgcataaagatcttgaacccgtatatgccgtcggtggtggaaactttagaacaaatgcaacgaaaacatgggggcatgttagtgcgaaaccccttaagcagaaattcaacacacgagatgtattgggtcagttgtggtactggtaatattgtatcagcggtgaatatgacatcaaggatgcttctaaataggtttactatggcacaccgcaaaccaacttatgaaagggatgtagacttgggggctggaacccgtcacgtagcggtcgaaccagaagtggcaaatttggacataattggacagcgtattgaaaacatcaaaaatgaacacaagtcaacctggcattacgacgaagataacccttataaaacttgggcataccatggttcatacgaagtaaaaccgtcgggatccgcaagcagtatggtaaatggtgttgtacgattactcaccaaaccatgggatgtaataccaatggttacacaaatcgccatgacagatacaacgccatttggacaacaaagagtatttaaagaaaaagtcgacacaagaaccccaagggctaaacggggcacagcccagataatggaggtcacagcaaagtggctatggggtttccttagcagaaataagaaaccgagaatatgtactagggaagagttcaccaggaaagtacgctccaatgctgcgattggcgctgtatttgtggacgaaaatcagtggaactcagcaaaagaagcggtcgaagatgagcgattttgggacctagtacatagagaaagagaattgcataaacagggtaagtgcgcaacatgcgtctacaatatgatgggtaagcgtgagaagaaactaggcgaatttggtaaagccaaaggctcaagagcaatatggtacatgtggcttggggcaaggttcctggagttcgaggcattaggatttatgaatgaagatcactggttttccagagaaaatagcttctctggagtagagggtgagggcctacataaattaggttacatactaagagatatcagtaaaatacccggaggcaatatgtatgcagacgacactgctggatgggatacaagaataacagaagatgacctacaaaatgaagctaagatcacagacataatggaacccgaacatgctctgttagctactagcatattcaaactaacataccagaacaaagtagttagggtacagagacccgcgaaaaacggtacagtgatggacgtaatctctcgtagagatcaacgaggctcgggccaagtcggtacttacggactaaatacattcacaaacatggaagttcaacttatacgacaaatggaatcagaaggaatttttctaccaagtgaattagaaacacctaacctagctgaaagagttctcgattggttagaaaaacacggtaccgagagactgaaaagaatggcaatctcaggggacgattgcgttgttaaacctgtcgatgacaggtttgccacagctctgatcgcactgaatgatatgggtaaagtgcgtaaggatatccctcagtgggaacctagcaaaggatggaacgactggcagcaagttcctttctgctctcatcattttcaccaattaattatgaaagatggaagagagatagtggtcccatgtagaaatcaagacgaattagtcggacgagcgcgtgtgagccaaggtgccggttggtcacttagagaaaccgcttgtctaggaaaatcatatgcccaaatgtggcaactgatgtactttcacagaagagacctacgcctagcagcaaatgccatatgttctgccgttcccgttgattgggttcctacaagtagaaccacctggtctatacatgcacaccaccaatggatgactacggaggacatgctgagcgtgtggaaccgcgtttggatagaagaaaatccatggatggaagataaaactcatgtgagttcctgggaagaagtgccgtacctaggaaaacgggaagaccaatggtgcggcagtctaataggccttactgcaagggcaacatgggcaacaaatatacaagttgctataaatcaggtgagaagattaataggcaatgaaaactatttggactacatgacatcgatgaagcgctttaaaaacgaaagcgaccctgaaggagcattatggtag

SEQ ID NO: 21391 - RNA, 9879 nt, synthetic construct
  misc_feature 1..9879: note = derived and/or modified CDS sequence (opt6) from DENV-1__FJ547087__SS-prME
  source 1..9879: mol_type = other RNA
tcagtgactatgttacttatgttgcttcccactgctttggcattccatcttaccactcgaggaggggaacctcatatgatcgtctctaaacaagaaagagggaaaagtttactgtttaaaacaagcgcgggtgtgaacatgtgtactttaattgcaatggatctaggtgaactttgcgaggatacaatgacgtacaaatgccctcgaatcacggaggcggagccggatgatgtagattgttggtgtaacgcaactgatacatgggtcacatacggaacgtgtagtcaaacaggtgagcatagaagagataaaaggagtgttgcactagctccccatgtcggtctaggacttgagactagaacggagacatggatgtcatctgaaggagcatggaaacaaattcaaaaagtggaaacgtgggcactgagacatcctggatttacggttatcgcactttttcttgctcatgcaatcggtacctccattacgcaaaaaggaattatatttatactcctcatgctagtgacaccttcaatggctatgcggtgtgtagggattggaaacagagactttgtagagggattatctggagccacgtgggtagatgttgtactagagcatggatcatgtgtaacgaccatggccaaaaataaaccaacactcgatattgaactacttaaaacagaagtaacgaatccagccgtgttacgtaaactatgcatagaagctaaaataagcaacactacaacagatagtaggtgtccgacgcaaggagaggctacattggtcgaagaacaagatgcaaactttgtttgtcgtaggacatttgttgatcgaggatggggaaatggatgcggattattcggaaaaggtagccttttaacttgtgcgaaattcaaatgtgttacaaaattagaaggaaaaattgtacaatacgaaaacctgaaatacagtgtgatcgtcacagtccacacgggtgatcaacatcaagtcggaaatgaaaccacagaacatggaaccatagctaccataacgccccaggctcctactagcgaaattcaactgacagactatggggccttgactttagactgctccccaagaactggtcttgatttcaacgaaatggtcttgttaaccatgaaggagaaaagttggttggtccataaacagtggtttttggacttgccgttaccttggacttctggtgcatcaacgagtcaagaaacttggaatcgccaagatttgcttgtaacatttaagacagcacatgccaagaaacaagaggtagtagtattgggatcacaggagggcgcaatgcacacagccttaacaggtgcaacggaaatacaaacaagtggaacaacaactattttcgcagggcatttaaaatgtcgactaaaaatggataaactgacactcaaaggcatgtcctacgtcatgtgcaccgggtcttttaagttagaaaaggaagtcgcagagactcagcatggaaccgttttagtgcaagtgaagtatgagggcactgatgccccttgtaaaatacctttttccactcaggacgaaaaaggagtgacccaaaatggaaggctaataaccgctaacccaatagttactgacaaggaaaaacctgtaaatattgaaacagaaccaccttttggcgaaagttatattatggttggcgcaggggagaaagccttaaagctatcatggttcaaaaaggggtcatcaattgggaaaatgttcgaagctaccgcaagaggtgcaagacggatggctatattgggagatacagcttgggactttgggtctatcggcggagtgtttacaagtgtcgggaaattggtacatcaggtatttggcaccgcatatggggtattattttcgggagtgtcatggaccatgaaaataggaataggaatcttattgacttggctaggattgaacagccgaagtgcttcattatcaatgacatgtattgcggtcgggatggtaacattatacttaggtgtcatggtacaagcagattccggatgtgtaataaattggaagggccgcgaattaaagtgcggaagtggaatattcgtgaccaacgaagtacacacttggaccgaacaatataaatttcaggcagactctcctaaacgtttatcggccgcgattggaaaggcatgggaggagggtgtttgtggaatacggtcagcaacacgcttagagaatataatgtggaaacagatatcaaacgaacttaatcatatattattagaaaacgatatgaaattcaccgtagtggtgggcgatgcaaatggaatattagcacaaggcaagaaaatgattagaccacagcctatggaacataaatatagctggaaatcatggggtaaagcaaaaattatcggtgcggatatccaaaacactacgtttatcattgatggtcctgacacgccagagtgcccagatgaccaacgtgcgtggaatatatgggaggtagaggactatggattcggtatctttactacaaatatttggttaaagttaagggatagttacacacaaatgtgtgaccataggctaatgagtgccgccataaaagactctaaagcagttcacgcagatatgggttactggatagaatccgagaaaaatgaaacttggaaactggcaagagctagttttattgaagtaaaaacgtgcatttggccaaaaagccatactctatggagcaatggcgtattagagtcagaaatgatcatacccaaaatatacggaggacctatcagccaacataattatcgtcccggatatttcacacaaacagccggtccatggcacctaggcaaattagaattagatttcgacttatgtgaaggaacaacggtagtggtagatgaacactgtggaaatcgtgggccatcacttagaacgactacagtgacaggaaaaattatacatgaatggtgctgtagatcgtgtacattacctccattacgtttcagaggggaagatggatgctggtacggtatggaaataagaccagtaaaagaaaaggaagaaaacctggtaaggagcatggtatctgcgggatcgggggaagtcgattctttctcactaggtattctttgcgtcagtataatgattgaagaagtaatgcgctcaaggtggtcgagaaaaatgctcatgaccggtaccctagcagtatttttattgctaataatggggcaactcacttggaatgatcttattagattgtgtataatggtcggtgcaaatgcatcagacaggatgggtatgggcaccacatatttagcgttgatggcaaccttcaaaatgagaccaatgttcgctgtgggattactcttccgacgattaacatcaagagaagttcttttattaacaattggattaagcctagtcgcctctgttgagctgcccaacagcttagaagaattgggagacggccttgccatgggcataatgatgctaaaacttcttacggaatttcagcctcatcaactctggactacattattatcattgacattcataaaaactacactatcgttagattacgcatggaagacaatggcaatggtattgtcaattgtcagcttattccccttgtgccttagcactacatcacagaaaactacatggcttcctgttctcctaggaagttttggctgcaaaccattaacgatgttcctgataaccgagaataaaatctgggggagaaaaagttggcccctgaatgagggaataatggcaatcggaattgtaagcatactgcttagctccctattaaagaacgatgtaccgctagcagggcccttgatagcaggaggaatgttaatagcctgctatgttataagtggatcaagtgcagatctatcattagaaaaagcagctgaagtatcatgggaagaagaagcggaacactcaggaacgtcccataatatcctcgtagaggttcaagatgatggaaccatgaaaatcaaggacgaagaacgagatgatactctaaccatactacttaaagctaccctcttagctgtcagcggagtatatccaatgtctataccggccactctctttgtgtggtatttctggcagaagaagaaacagagatcaggagtcttgtgggatacacctagcccgccggaagtagaacgtgcagttcttgatgacggaatctatcggatcttacaaagggggctcttaggtcgaagccaggtaggcgtgggagtatttcaggacggtgtatttcacacgatgtggcatgtaacccggggtgctgtgttgatgtaccaagggaaaagattagaaccatcatgggcaagtgtgaagaaagatttgataagttatggaggagggtggagatttcaaggatcatggaataccggtgaggaagtccaagttatagcggtcgagccaggcaaaaaccccaaaaacgtgcaaacgaccccgggaacattcaaaacccccgaaggggaagtaggagcaatcgcattggattttaaacctggtacttccggatctcctatagtgaatagagagggaaaaatagttggcttatacggtaacggtgtagtaacaacgtcaggtacttatgttagtgcaattgcacaagccaaagcaagtcaagatggaccactacctgaaattgaagacgaggttttcaagaaaaggaacctaacgataatggatctgcaccccggatcaggtaaaacacgccgttacctacctgccatagtccgcgaggccatcaagaggaaattaagaaccctaattttggctccaacaagggtagtcgctagcgaaatggccgaagcactaaagggaatgccgatccgttatcaaacaaccgcagtgaaatcagaacacacggggcgtgaaatagtcgaccttatgtgccacgctactttcaccatgagattgttatcaccagtaagagttccgaactataacatgattattatggatgaagctcatttcactgatcccgccagcattgccgctcgtggatatattagtactagggtaggtatgggagaagctgcagctatattcatgacagcaacacctcctggttcagtagaggcctttccacagtcaaacgcagtgattcaagatgaagagagagacattcccgaacgctcatggaactcaggttacgattggatcaccgactttccaggtaaaacagtatggtttgtaccgtccataaaatctggaaatgacatagctaactgcctaaggaagaacggcaagagagtaatacaattgtcacgaaaaacttttgacaccgagtaccagaaaactaaaaacaatgactgggattatgtcgtgacgactgacatctcggagatgggagcaaactttagagcagatagagtcatagatccacgaaggtgtttaaaacctgtaattctaaaagatggacccgagagagtaattcttgcgggacctatgccggttacagttgcgagcgcggcacaaagacgcggtagaatcggaaggaatcagaacaaggaaggcgatcagtatgtatacatgggtcaacctcttaacaatgatgaagatcacgctcattggactgaggcgaagatgctcttagacaacattaataccccagaaggcattatccccgcgctgttcgaacctgagcgggagaaatcagcagccatagatggtgaatacagactacggggtgaagcgagaaaaacttttgtggaactaatgagaagaggcgatttaccagtgtggttgtcatataaagtggcatccgaaggatttcaatattcagataggcgatggtgttttgacggagaaagaaataaccaagtacttgaagaaaacatggatgttgaaatttggacaaaagaaggcgaaaggaagaaactaagaccacgttggttagatgcccggacatacagtgatccgcttgccctcagggagtttaaagaatttgcagcaggacgtagatctgtcagcggtgatttaatactagaaataggaaaattaccacagcatctaaccattcgagcacaaaacgcgttggataacctcgttatgctccacaactccgaacaaggtggtaaagcatatcggcatgctatggaagagttaccggatacaatcgaaactctaatgttgttagctcttattgcagttttgactggaggcgtcacattattctttttaagcggaaaaggcttagggaaaacttcaattgggctactgtgcgtcatggcctcgtcagctctattatggatggcctcggttgaaccccactggatagccgccagcattattttagaatttttcttaatggtactgttaattccagaaccagacagacaaagaacgccacaagataatcagctagcatacgttgtaattggactactatttatgattttaaccgtagcagctaacgagatgggtcttctagaaacgacgaaaaaggatcttggaatcggccatgtggcagcagaaaaccatcaccacgctacaatgttagatgtcgatctaagaccagctagtgcctggactttgtatgcggtagctacgactgtcattacacctatgatgcgccatactatagagaatacaacagccaatatctcattaacagcaatagccaaccaggcagctatcttgatggggttagacaaaggatggccgattagtaaaatggacattggtgttcccttattagcactaggctgttacagccaagtcaacccacttacgttaaccgcagcggtattaatgttagtcgcccattatgctattataggaccaggtttacaagcgaaagcaactcgtgaggcgcagaaacggacggccgctgggattatgaagaaccctacagttgatggcatagtagcaattgatctcgacccagtcgtatacgatgcgaaatttgagaaacaactaggtcaaataatgttacttatactttgtacctctcaaattttactgatgagaactacgtgggcattgtgtgaaagtataacgttggctacaggacctctaacaactctatgggaaggatccccagggaagttttggaacacaacaatagcagtttctatggcgaacatattcaggggatcctaccttgcaggagcaggactagccttcagtcttatgaagtcgttgggtggagggcgccgaggaacaggagcacaaggagaaacattgggagaaaagtggaaacgccaactgaatcaactaagcaaatcagaatttaatacttataaaagaagcggcatcatggaggtagatcgcagtgaagcaaaagagggcctaaaaagaggggaaaccacaaaacacgcagtttcaagaggaaccgcaaaactacggtggtttgttgagagaaatcttgtaaaaccagagggaaaagtcatagacctcggatgtggtcgcggtggatggtcttattattgtgcagggctaaagaaagtcacggaagttaaaggttatacaaagggtggcccaggtcatgaagaaccaatcccaatggctacttacgggtggaacttagtaaaattgcacagcggaaaagatgtattctttacgccccctgaaaaatgcgatacgttattgtgcgatatcggagagagctcacctaatccgaccatagaagaaggaagaactttaagggtacttaaaatggtcgaaccatggttaagaggaaatcaattctgtatcaaaattctcaatccgtatatgccatctgtggtagaaaccctagaacaaatgcagagaaaacacggcggtatgttggtaagaaatccattatccaggaatagcacacatgaaatgtattgggtaagttgtggaacaggcaacatagtaagcgcagtaaatatgacaagccgaatgcttttaaatagattcactatggcacatcggaagccaacctatgagcgtgatgtagatttaggggcgggtacgagacacgttgctgttgaaccagaagtcgctaatttagacatcatagggcaacggatcgagaatatcaaaaacgaacacaaaagtacttggcattatgacgaagataatccctataagacatgggcgtatcatgggagttatgaagtgaaaccatcaggttcggctagtagcatggtgaatggtgtagtaagattacttacgaaaccatgggatgtaataccgatggtaacccaaatcgctatgactgacaccacaccatttggtcagcaaagagtattcaaggaaaaggtagacacccgtacaccacgtgctaaacggggaactgcacagataatggaagtaactgcaaaatggctatggggttttctgtcgcgcaacaagaagcctcgtatctgtactagggaagagtttaccagaaaggtaaggtcaaatgcggccataggggccgtgtttgtagatgaaaatcaatggaactctgcaaaggaagcggttgaagatgagaggttctgggacttagtacacagagaacgtgaactacataaacaaggaaaatgcgccacttgcgtgtacaacatgatgggaaagagagagaagaaactaggggagttcggcaaagctaaaggctcacgtgccatatggtatatgtggttaggtgctagattccttgagttcgaggctttaggatttatgaatgaagatcattggttttctcgtgaaaactccctttctggtgtagaaggagagggtctccacaagctgggatatatactcagagatatttcaaaaataccaggtggtaatatgtatgccgacgatactgcggggtgggatactagaatcaccgaagatgacttacagaacgaggccaaaatcacagatattatggagcctgagcatgcgctactcgcgacctccatttttaagttaacttaccagaacaaagtagtcagagtgcaaagacctgctaaaaacggaacagtaatggatgtaatatccagacgagatcaacgaggatccggacaagtgggaacctacggactgaatacatttaccaatatggaagtacaattgataaggcagatggaatcagaaggtatattcttgccatgtgagttagaaacgccgaatctagcggaaagagttttagactggctcgagaaacacggtgctgaaaggcttaaaagaatggccatttccggagatgattgcgttgtcaaaccgatagatgataggtttgccactgcattaatagcattaaacgacatggggaaagtgagaaaggacataccgcaatgggagccatctaaaggatggaacgattggcaacaagtaccattttgctcacaccatttccaccaattgatcatgaaagacggaagggagatcgtagttccatgtcgaaatcaagacgaactggtaggcagagctagagtgagtcaaggagcggggtggtcactgagagaaacagcatgccttggaaaatcatatgcacaaatgtggcaattaatgtattttcatagaagagacctaagactagccgcaaatgctatctgtagcgctgtaccagtagactgggtcccgacatctagaacaacttggagtatacacgcacatcatcaatggatgacaaccgaagatatgctgagcgtatggaatcgagtatggatagaagaaaatccatggatggaggacaaaacacatgtaagcagttgggaagaagtgccttacttgggtaaaagagaggatcaatggtgcggcagcttaattggattaactgcacgggcgacctgggctacaaatatccaagttgcaataaatcaagtacggcgactaatcggtaatgaaaactatttagattacatgacatcaatgaaaagattcaagaatgagagtgatccggaaggggcgttgtggtag

SEQ ID NO: 21392 - RNA, 9879 nt, synthetic construct
  misc_feature 1..9879: note = derived and/or modified CDS sequence (opt6) from DENV-1__FJ410186__SS-prME
  source 1..9879: mol_type = other RNA
agtgttactatgttattaatgttattacctacagccttagcgtttcatctcaccacgcgcggcggcgaaccacatatgattgtatcaaaacaagaaaggggcaaatcccttctattcaaaacgtccgccggcgttaacatgtgcacattaatagcaatggatttaggcgaactttgcgaagataccatgacttataagtgtccacgaattacggaagttgaacccgacgatgttgactgctggtgtaatgcaaccgatacctgggtaacttatggaacatgctctcaaacaggggaacaccgacgagataaaaggagtgtggctttagctccacacgttggactgggtttggaaacacgaaccgaaacgtggatgtcctcagaaggagcttggaagcaaatccaaaaggtcgaaacatgggcactccgtcatcctggtttcaccgtaatagcattctttcttgcccacgctataggtacatcaataacacaaaaaggaatcatattcatactgctaatgttagttacgccttctatggcaatgagatgcgtaggaatcggaaatagagacttcgttgaaggtctatcgggagcaacttgggtcgatgtagtcttggaacacggatcgtgtgtaactacaatggctaaaaacaagccaactttagacatagaactactgaaaacggaagtaacaaatcccgctgttttgcgtaaactatgtatcgaagcaaagattagtaacaccacaactgatagtcgatgcccgacccaaggtgaagccaccctagttgaggagcaagacgctaatttcgtctgccgtcgcacatttgtagacagagggtggggaaatggatgcggcttgtttggaaagggctcactgctgacatgtgcaaaatttaaatgcgttactaaactagaaggtaaaattgtacagtatgaaaacttaaaatacagtgtgatagttaccgtacataccggtgaccagcaccaggtcggaaatgaaacaacagaacatggtacaatcgcaacaatcacaccacaagcacccacttcagagatacaacttaccgattacggcgctttaacacttgattgctcaccgaggacaggcctagatttcaacgagatggtcttactaacgatgaaggagaagtcctggttagttcataaacaatggtttctagatctacctttaccctggacatcaggtgcgtcaacatcccaagagacatggaatcgtcaagacctgcttgtaacatttaaaacagctcatgccaagaagcaggaggtggtcgttctagggtcacaggaaggtgcaatgcatacagctcttacgggggccacagaaatacaaacaagtggaaccacgaccatctttgcggggcatctcaaatgtagactcaaaatggataaattaaccttaaaggggatgagctacgtcatgtgtactggttcttttaaacttgagaaagaagtcgccgaaacacagcatggtaccgtgttagtacaagtgaaatacgaaggaaccgacgctccgtgtaaaataccatttagtactcaagacgaaaaaggtgtaactcaaaatggacgacttatcacagcaaatccaattgtaacggacaaagagaaaccggttaatatcgagacggaacctccgttcggggaatcatatattatagtcggcgccggtgagaaagcactcaaactttcctggttcaaaaaggggtcatccatcggtaagatgtttgaagctactgcgaggggcgctaggcgtatggcgatattaggcgacaccgcttgggattttggctctataggtggagtattcacttctgttggaaaattagttcaccaggtattcgggactgcctatggggtgctctttagtggcgtcagttggacgatgaaaataggaataggaatattattaacttggcttggactgaactcacgatcagcctcactctcaatgacatgtattgctgtaggtatggtgactctgtatttaggcgttatggtacaggccgattcaggatgcgttattaactggaaaggtcgggaattaaaatgtgggagcggtatatttgtaacaaacgaggtccacacatggactgaacaatacaagtttcaagctgacagtcctaaaagactgtctgctgccatagggaaggcttgggaagaaggtgtttgtggtatacgttctgcaactaggctagaaaatattatgtggaagcagattagcaacgaattaaaccacatactactagaaaatgatatgaaatttacagtagtcgtgggagacgctaatgggatacttgcccaaggaaagaaaatgattcgcccccagccgatggaacataagtatagttggaaaagttggggtaaagcaaaaataatcggtgcagacatacaaaatactacgtttataatagacggacccgacacaccggagtgtcctgatgaccagagagcttggaacatatgggaggtagaagattatgggttcggcatttttacaaccaatatttggcttaaactcagggacagttacactcaaatgtgtgatcataggttgatgtctgcagccataaaagactcaaaagctgttcacgcagatatgggttactggattgaatcagagaaaaatgagacctggaaattagcacgagcttctttcattgaagtaaaaacatgtatatggcctaaaagtcacactctctggtctaatggggtactcgaatcagaaatgattatcccaaagatctacggcggtcctacgtcacaacacaattatagaccaggctattttacacagactgctggaccttggcatctaggaaagttagaattagattttgatctttgcgaaggaaccacagtagtcgtagacgaacattgcggtaatagaggtccttcactccgcacaactacagttaccggaaagatcattcatgaatggtgctgtcgttcgtgcaccttacccccattacgttttagaggagaagacggatgttggtacgggatggaaatcaggccagtgaaagagaaagaagagaatctggttaggtcaatggtaagcgccggatctggagaggttgactcattctctttgggaattttgtgtgtaagcataatgattgaagaagttatgcgaagtagatggagccgaaaaatgttaatgacaggaacacttgcagttttcttactcttaataatgggccaactaacttggaatgacctaattagactttgtataatggtaggagcgaacgcatcggatcgtatggggatgggcacaacctacttagcattaatggcaacattcaaaatgcgccccatgttcgcagtcggtcttttatttcgcagattaacttcgagggaagtacttcttttaacaataggactatcacttgttgccagtgtagagttacccaactcattagaggaactaggtgatggattggctatgggaattatgatgttgaaattattaacagaatttcaaccccaccagctatggactacgttattgagccttacattcatcaaaacaacattatctttggactacgcatggaagactatggcaatggtattatcgatagtatccctgttccccctatgtctatcgacaacttctcagaaaacaacatggctccccgtcctcctgggcagttttggatgtaaacctcttactatgttcttgatcacagaaaataagatctggggccgtaaaagctggccattgaacgaaggaataatggcgataggcatagtatccatactattaagctcactactcaagaacgatgtacccttagctggaccgttgatagctggcggcatgttaatagcatgttatgtgatttcaggatcctcggcggacctaagcctagaaaaagcggcagaagtatcgtgggaagaagaggcggaacactcaggaacctcgcacaatattctggtggaagttcaggatgacggcactatgaagatcaaggatgaggaacgagacgacacattaactatattattaaaggcaaccttactggcggtgtcaggagtctatccaatgtcaattccagccacgttattcgtctggtacttttggcaaaagaagaaacaacgatcaggggttctatgggacaccccgtccccaccagaagtagagagagcagtattagacgatgggatctatagaatattgcaacgtggattactaggtagaagtcaagttggtgtgggcgtttttcaagatggagtgtttcacactatgtggcatgtaacccgtggcgccgtattaatgtatcaggggaaaaggctagaaccatcatgggcctccgttaagaaagatttaatatcctacggaggaggatggagatttcaaggattatggaacacaggagaggaagtccaagtcattgcagtagaacctggtaagaaccctaaaaatgtacagacaacgccgggtacatttaaaacacccgagggagaagttggagcaattgctctggactttaaaccgggaacctcaggttcaccgattgtgaatagggagggaaagattgtgggtctctatggaaacggagtagttacaacgtctggaacttacgtatctgcaattgctcaagctaaagcaagccaagagggtcctctaccagaaatagaagacgaagtcttcaaaaagcggaacttaactataatggatcttcatcctggtagcggcaagacgagacgttacctgcctgcaatcgtaagggaagcaattaaaagaaaattaagaacattgatactggctccgacacgagtagtggcctccgaaatggcagaagcactgaaagggatgcctataagatatcaaactacggcggttaagtcagagcatactggacgcgaaatagttgatctaatgtgccacgcaacattcacaatgagactattatctccagttagggtgccaaactataatatgataataatggatgaggcacacttcacagatccagccagcatagccgcgagaggctatatatccactagggtaggtatgggtgaagctgctgccatatttatgacagcgaccccacctggatcggtagaggcttttccccaatcaaacgcggtaatacaagatgaagaaagagacataccggaacgtagttggaactctggttatgactggattacggatttcccaggtaaaactgtctggttcgtaccaagcattaaatcaggtaatgatatagcaaattgtctgagaaagaatggtaaaagagtcatacaattgtcacgcaagacgtttgacacagaatatcagaaaacaaagaataatgactgggactatgtcgtcacaacggacatctctgaaatgggggccaactttagagcagacagagttatagatcctagaagatgtcttaagccagttattttaaaagatggacctgagagagtcattttagctggtcctatgccagtaacggtagcgtcagctgctcaacgaagaggaagaataggtcgaaaccagaacaaagaaggagatcaatacgtttatatgggacaacctcttaataacgatgaagatcacgctcattggaccgaagcaaaaatgttattagataatattaacacccccgagggtatcatacctgccttattcgaaccagagcgcgaaaaatcagcagccattgatggggaatatagactaagaggagaggcacgaaagacatttgtagagctaatgcgtcgtggggatttgccggtctggttaagctataaagtggcaagcgaaggtttccaatactccgatcgacgatggtgtttcgatggcgaacgtaacaatcaagttctggaggaaaatatggacgtggagatttggacaaaagagggagaacgcaagaaactcagaccacgatggcttgacgcacgcacgtatagtgatccattagctctacgcgaatttaaagagtttgcagccggcagaagaagtgtatcaggcgacctaattttggaaataggaaaattacctcaacatctgacgttaagagcacaaaatgcgcttgacaatttagttatgttacacaatagtgagcaaggaggcaaggcttatcgccatgccatggaagaattaccggatacaattgagacacttatgctgctagcactgatagctgtccttaccggaggagttacactgttctttctaagcggaaaaggattgggaaaaacgtctattggactgctatgtgtcatggcgtcctctgcattactgtggatggcaagcgttgagcctcattggatagcagctagtatcattctagagttcttcttaatggtactccttataccagagccggatagacaacgaactccgcaagacaatcaattagcatatgtcgtaataggtcttctatttatgattttgacagtcgccgcaaatgaaatgggactactagaaactactaaaaaggatctggggataggacacgttgcagctgaaaaccaccaccatgcaaccatgctcgacgtagatttgaggccagcatcagcttggaccttatacgccgtcgctacgacagtcattacacctatgatgaggcacactatagagaataccacggcgaacatatctttaacagccatcgccaatcaggccgcaatattaatgggtttggataaagggtggcctatctctaaaatggacattggagtaccattgcttgccttaggctgttacagccaagtaaacccgttaacactcaccgctgctgtattgatgttggtagctcactacgcgattatcggtcccgggttacaagccagagctacgagagaagcacagaaacgtaccgctgctggaataatgaaaaatcccacagtcgatggaatagtagcgattgatctagatcccgtcgtttatgatgccaaatttgagaagcaacttggacaaataatgctcttaatattatgtacatcacaaatcctacttatgcgaacaacttgggcactttgtgaaagtattacgcttgcaacaggaccgttgacaacgttgtgggaagggtcaccagggaaattttggaatactacaatcgcagtatctatggcaaatatatttagaggaagttatcttgccggtgcagggttagcattctcactgatgaaaagtttaggtggaggtagacgtggaacaggagcacaaggagaaacgttgggagaaaaatggaaacgacagctgaatcaactgagcaaatccgaatttaatacatataaaagatccggcataatggaagttgatcgctctgaggccaaagaaggactgaaaagaggggaaactacaaaacatgcagtgtctcgcggcactgccaaactgagatggttcgtggaaagaaatcttgtaaaacctgaaggaaaagtaatagatcttggatgtggaagaggaggatggtcttactactgtgccggattaaagaaggtaacagaagtaaagggatatacgaaaggagggccgggacacgaagaaccgataccaatggctacatatggttggaatctcgtaaaactacattcgggaaaagacgtattctttactcccccggagaaatgcgacacccttctgtgtgatattggcgagtcctcaccaaatccaactatagaagaaggaaggaccttaagggtattaaaaatggtagagccgtggcttcgaggaaaccaattctgcataaaaatcttgaatccctacatgccatcagtagttgaaacattggaacaaatgcaaaggaagcatggcggcatgctagtaagaaatcctttatcaagaaatagtacccatgaaatgtattgggtttcatgtggcactggtaatatcgtaagcgcagtgaatatgacaagtcgcatgttactaaatagatttacaatggcgcataggaaacctacatacgaacgtgatgtagacttaggagctggaactagacatgttgcagtcgaaccagaggtggcaaacttggacattataggacaacgcattgagaatatcaagaacgaacacaaatcaacgtggcattacgatgaagacaacccatataaaacgtgggcctatcatgggtcgtatgaagtaaaaccgagcgggtcagcttcgagcatggtaaatggggtcgtaaggcttctaacgaagccgtgggatgtaataccgatggttacacaaatagcgatgaccgacacaacgccatttggtcaacagagagttttcaaggaaaaggtcgataccagaacacccagagccaagcgcggtacggcacaaataatggaagtaaccgcgaagtggctatggggttttctatcaagaaacaagaaaccgcgaatatgtacaagagaggaatttacacgtaaagttagatcaaacgcggctatcggagctgtattcgtcgatgaaaatcaatggaactcggcgaaagaagcagtggaagatgaacggttctgggatctagttcgccgtgaacgagaactacacaagcaggggaaatgtgcaacttgcgtgtataacatgatggggaagagagaaaagaaactaggcgaatttggaaaggcaaagggaagcagagcgatttggtacatgtggctgggggcaagattcttggagttcgaagcactaggctttatgaatgaagaccactggttctctcgagaaaattcattatcaggcgtagaaggtgaaggactacacaagttggggtatatactaagagatattagcaagatcccaggcggcaacatgtacgcagacgacacagccggttgggatacccgaattacagaagacgacctacaaaatgaagcaaaaataacagatataatggagccagaacatgccttactagcaacgagtatattcaagttaacataccagaacaaagttgtaagggtacagaggccagcgaaaaatggaacagttatggatgttattagtcgtagagaccaaagaggtagtggccaagttggtacttatggattgaatacattcacaaacatggaagttcaattaattcgtcaaatggaatctgaaggaatatttttaccatccgagcttgaaacgcccaatctagccgaaagggtcttggactggctggaaaaacatggagccgaacgactaaaacgaatggccatatcaggtgatgattgcgtagtaaagccagttgatgacagattcgcaacagctctaatcgcattaaatgatatgggaaaagtacgaaaagacataccacaatgggaaccctctaaaggctggaacgattggcaacaagtcccattctgctcgcatcacttccatcaactaataatgaaggatggccgggaaatagttgttccgtgtcgtaatcaagatgagctagtaggaagggcacgggtgagtcaaggcgctgggtggtctcttagagaaacagcatgtttaggaaaatcctacgcacagatgtggcagttaatgtattttcatcgacgcgacctaagattggcagccaatgccatatgctcagcagaccccgtagattgggtacccacgtccagaacaacttggagcatccacgcacaccaccaatggatgaccaccgaagacatgcttagtgtgtggaatagagtttggattgaggaaaacccctggatggaggacaaaacacacgtaagctcgtgggaggaagtaccctatctaggaaaaagagaagaccaatggtgtggttccttgataggccttaccgcgcgtgcaacttgggcgacaaatatacaagtggccattaatcaagtcagaagactgataggaaatgaaaactatttggactacatgatatcgatgaagcgattcaaaaacgaatcagatccagaaggagcactttggtaa

SEQ ID NO: 21393 - RNA, 9879 nt, synthetic construct
  misc_feature 1..9879: note = derived and/or modified CDS sequence (opt6) from DENV-1__FJ410187__SS-prME
  source 1..9879: mol_type = other RNA
tctgtaactatgttattaatgttactgcctacggcactagccttccatttgactactagagggggagagccacacatgatagtgtctaaacaagaacgaggaaaatcccttctctttaaaacaagcgccggaataaatatgtgtactctcatagcaatggatctcggagaattatgcgaagacactatgacctataaatgtcctagaattaccgaagcggaaccagacgacgtagactgttggtgtaacgcaacagatacatgggtaacatatggaacttgcagccaaacaggggagcatagaagagacaaaagaagcgtagcattagcgccacatgttggtctcggccttgaaactaggactgaaacttggatgtcatctgaaggtgcttggaaacaaatacaaaaagttgagacgtgggcactaagacatccgggcttcactgtaacagccttgtttctggcacacgcgataggtacttctattacacaaaaaggtattatatttattttattgatgctggtaaccccttcaatggcaatgcgatgcgtaggaatcggaaatagagacttcgtcgaagggctatcgggagcgacctgggttgacgtcgtattggaacacggaagctgcgtaactactatggcaaaagataaaccaacactagatatagaattattaaaaactgaagtaacaaaccctgcagtattgcgcaaactctgcatagaagcgaaaatttccaacacaaccactgattcaagatgtcctactcagggggaggcgacgctagtcgaagaacaagattcaaattttgtttgcagacgcactttcgtggatagaggatggggcaacgggtgcggtctattcggtaaagggtcactattaacttgtgcaaaattcaaatgcgtaacaaaattggaaggcaaaattgtacaatatgaaaatcttaaatatagtgtaattgtaactgtgcacaccggagaccagcatcaggtaggaaatgagacaacagaacatgggacaattgcaactataaccccacaggcgcctacttctgaaatacaactaacggattatggggctttgacccttgattgctcaccaagaacaggcctagacttcaatgagatggtgcttttaacgatgaaagaaaaatcctggctagttcataagcaatggttcctagacttacctttaccctggacatcgggcgcgtcgacttcacaagaaacatggaaccggcaggatttgctggttacctttaagactgcacatgccaagaaacaagaggtcgtagtattagggtctcaagagggtgcaatgcacactgcattaaccggggccactgagattcaaacttcagggacaacaactatattcgccggtcacctaaaatgtcgcctcaaaatggacaaacttacactcaaaggaatgtcatatgtgatgtgtactggaagttttaaactggaaaaagaggttgcagaaacccaacacggaactgtcttagttcaagttaaatacgaaggaactgatgcgccatgcaaaattcctttcagtgcccaagacgagaaaggagtaactcaaaacggtagattaataacggccaatccaattgtaactgacaaagagaaaccggtaaacatagagacagaaccacccttcggcgaatcgtacattgtcgttggagcaggcgagaaagccttgaaactaagctggtttaagaaaggatcgagtataggcaaaatgttcgaggctactgctaggggtgctcgtcggatggcaatattaggggacactgcttgggattttggttcaataggaggggtttttacaagcgttggtaagttagtacatcaggtgtttggagctgcgtacggcgttctattttcaggtgtttcatggacgatgaaaattggcataggtattttgctaacttggctgggcctaaactcaaggagtacttccttgtccatgacgtgtatagctgtgggaatggttacactctaccttggtgtaatggtgcaggccgacagcgggtgcgtaattaattggaaaggcagagagttaaagtgtggttcaggaatatttgtcaccaacgaggtccatacttggaccgaacaatacaaattccaagcagactctcccaaacggttaagtgctgccatcggaaaggcttgggaagaaggagtttgtggtatacggagtgctactaggttagaaaatataatgtggaaacaaattagcaatgaattaaatcatatattgctcgaaaatgacatgaagtttacagtggttgtgggtgacgccaatggaatattagcgcaagggaagaaaatgatccgacctcagcctatggaacatagatattcttggaaatcatggggaaaagctaaaattataggagcagatattcaaaactcaacgtttatcattgatggaccggatacacctgaatgcccggatgatcagcgggcatggaatatatgggaagtagaagactacggattcggtatttttacaactaacatatggctcaaactaagggattcttacacacaaatgtgtgatcatcgcctaatgagtgcagcaataaaagatagtaaagctgtccacgcggatatgggatactggattgaatcagaaaagaatgaaacttggaagctagcaagagcgtcctttatagaagttaaaacctgtatatggcctaagagtcataccctttggagcaacggagtactggaatcagaaatgataatcccgaagatctatggcggaccgataagtcaacataattatcgtcctggatattttactcaaactgcaggaccttggcatctaggaaaattggagttagattttgatttatgtgaggggactactgttgttgttgatgaacattgtggaaatagaggtccgagtctccgtactacgacagtaactgggaagataatacatgaatggtgttgccgtagttgtacgttgccaccacttagattcagaggtgaggatggttgctggtatggaatggaaattcggccagtaaaagagaaggaagaaaatcttgtacgatcgatggtttcagcaggatcaggcgaagttgattctttctcattaggtatcttgtgcgtttctattatgatagaggaagttatgagatcgaggtggagtagaaaaatgttaatgaccggtacattagctgtattcctattactcataatgggacaactaacatggaacgatttaatccggctctgtataatggtcggggccaacgcatcagatagaatggggatgggtactacttacctagccttaatggcaacgttcaaaatgaggccaatgttcgccgtcgggttgctatttaggcgtttgacgagtagggaagtcctgttactcacaataggtctatcattggttgcaagtgttgaactacctaatagcttggaagaattgggagatggtttggctatggggataatgatgttaaaacttctaacagaatttcaaccacatcaattgtggacaacactacttagtctaacctttataaaaacaacacttagcttggactatgcgtggcgaacaatggccatggtcttgagtatagtttctctgttcccactgtgtcttagtactacttcccagaaaactacatggctaccggtgttactcggttcatttggttgcaaaccacttaccatgtttttaatcacagaaaacaaaatttggggtcgcaagtcttggccattgaacgaaggaattatggcgataggaatagtgagtatattgttgagtagcttactaaagaatgatgtcccactagccggcccattaatcgctggaggtatgttaatcgcatgctacgttatatccgggtcgtcagcagatttaagcctggaaaaagccgcggaagtaagctgggaggaagaagccgaacactctgggacttcacataatatattagttgaagtccaagacgatggtacaatgaaaataaaagatgaggaacgcgacgatactttgacgattctattaaaagccactctcttagcagttagcggagtttatcccatgtctattccagcgacactatttgtatggtacttttggcagaagaagaaacagagaagcggtgtactatgggatacaccctcaccacctgaagtagaaagggcagtactggatgatggaatatacagaatattacagcgtggtctgctggggcgtagtcaagtaggtgtgggtgtttttcaagacggagtgtttcatactatgtggcacgtaacgagaggagcagtgttgatgtatcagggcaaaagattagagccttcttgggcaagcgttaagaaagacctaatcagttatggtggcggttggaggtttcaaggtagttggaacacaggagaagaagtacaagttattgctgtagaacctggcaaaaatcccaaaaacgtgcaaacgacaccgggaacttttaaaacgccagaaggggaagtaggtgcaatagccttggactttaaacccgggacctcaggatctcctatagtaaatcgagaggggaaaattgtaggtctctacggtaacggcgtagtaacaacatcaggaacctacgtctccgcgattgctcaagccaaaacaagtcaagagggaccattgcctgagatagaagaagaagtatttaagaaaagaaatttaacaattatggacctacatcccggcagtggtaaaactcgtcgttatctacctgcaattgtaagagaagctatcaagaggaaattaaggacattgatcctggcacccacacgggtagtcgcttctgaaatggcggaagcgctgaaagggatgccaatacggtatcaaactaccgcagtaaaaagcgagcatacgggaagagaaatagtcgacttaatgtgtcacgcaaccttcaccatgagacttttaagtcctgtgagggtgccaaactataacatgataataatggatgaagcacatttcactgaccccgcttctatagctgcacgaggatatatttcaacaagagtaggtatgggagaagccgccgccatctttatgacggcaaccccgcctgggagcgtggaagcatttccacaatcgaacgcggtcattcaagatgaagagagagacataccagaaaggagctggaactcaggatacgactggattactgacttcccaggtaaaacagtttggtttgtgccatcaattaaatcggggaacgacatagctaattgtcttagaaagaacggaaaacgagtaatacagttgagcagaaagaccttcgataccgagtatcagaaaaccaggaacaatgattgggactacgtcgtaactacagacatatctgaaatgggagcaaactttcgtgcggatagagttatagaccctagaagatgcctcaaaccagtcatactcaaagatggtcccgaaagggttattttagcgggtcctatgcctgtaactgtcgctagcgctgcacagcggcgagggcgcatcgggcgcaaccaaaacaaagagggagaccaatacgtttacatgggtcaaccgctcaacaacgacgaagaccatgcacattggactgaagcaaaaatgcttttagataacataaataccccagaaggtattatccctgctttatttgaaccggaaagagaaaagtctgcggcaatcgatggagaatatcgacttcgtggagaagccagaaaaacattcgtagaactgatgcggagaggtgatttacccgtctggttaagctataaagtggcttctgaaggatttcaatattccgatcgtaggtggtgttttgatggtgagaggaacaaccaagttctggaagaaaacatggatgtagaaatatggacgaaagaaggtgaaaggaagaaattacgacctcgttggttagatgcccgcacgtatagtgatcctctcgcgctaagagagtttaaagagttcgcggctggcaggaggtccgtaagtggagatttgatacttgaaataggaaaattacctcaacatctaacactaagagcacaaaacgccctcgataatctagttatgcttcataactctgaacaaggtggcaaagcgtataggcacgccatggaagaattacctgataccattgaaacattaatgttactcgcactaatcgcggttttaacagggggtgtaactctattctttctctcaggaaaaggactaggtaagacaagcataggattactatgtgtcatggccagttctgctctcttatggatggctaacgtggaaccacactggatagctgcatccataattcttgagttctttctaatggttctcctaataccagaaccagacagacaaaggacaccgcaagataatcaattagcgtatgttgtgatagggttattattcatgatcttaaccgttgccgctaatgaaatgggcctactagaaaccactaagaaagacctcggcattggacatgtagcagcggaaaaccaacatcatgcgacaatgttagatgtagatttacgtccggccagtgcgtggactttatatgccgttgctacaactgtgatcacacctatgatgagacataccattgaaaacacaacagcgaatatctccctgacggctatagcaaatcaagcagccatattgatgggcctcgataaaggctggccaataagtaagatggacataggggttccgttattagctttgggatgttattcacaagttaatccgcttaccttaacagctgctgttctgatgctggtagctcactatgctattattggcccaggtctacaggcaaaagccaccagagaagcacagaaaagaacagcagctggaataatgaagaatcctactgtggatggtatagtcgcaatagatctagacccagtagtatatgatgcaaaatttgaaaaacaattaggacaaattatgttattaatcctttgcacttctcagatacttctcatgcgaacaacctgggcactatgcgaatccataaccctggcaaccgggccattaacgacattatgggaggggtcaccgggtaaattctggaacacaacaatagctgttagtatggccaatatttttagaggatcttacctggccggtgcaggattagctttctctctgatgaaatccttgggtggcggtagaaggggaacgggagcacaaggcgagaccctcggggagaagtggaaacgccagctcaatcaacttagcaaaagcgaatttaacacatataaacgaagcggcattatggaagtagaccgatccgaggccaaagagggcttaaagcgaggcgaaaccacaaagcatgcggtaagtcgtggaactgcgaaattacggtggtttgtggagcgtaatttagtaaaaccggaaggtaaggttattgatttagggtgtggacgaggagggtggtcctattactgtgcgggtcttaagaaagtgactgaggttaaaggatatacgaagggcggaccaggacatgaagaacctataccaatggcaacatatgggtggaacctagtaaaactgtatagcggaaaagacgtattcttcacccctccagagaaatgtgatacattactttgtgacattggggagagcagccctaatccaacaatcgaagaggggagaacattacgagttcttaaaatggtagagccctggctccgtggaaaccaattttgcataaaaattctgaatccgtatatgccatcagttgtcgaaacgcttgaacaaatgcaaagaaaacacggcggaatgttagtaagaaatccgctatcaagaaattcaactcatgaaatgtattgggtatcatgcgggactggaaatatagtttcagctgtcaacatgacatccagaatgctattgaatcgattcacaatgactcataggaaacccacttatgagagagacgtagatctaggggccggcacacgacatgtggccgtcgaacccgaagtcgcgaacttggacataataggacaacgaattgaaaatatcaaaaatgagcataaatccacttggcactatgacgaagataatccctataaaacttgggcatatcacgggagctatgaggtaaaaccatccggatcagcaagcagtatggtaaacggagttgtccgattgttaacgaaaccgtgggacgttattccgatggtcacccaaatcgcaatgacagacactactccctttggtcaacaaagggtattcaaggaaaaggtggatactcgaaccccaagggcgaaaagaggaactgcccaaatcatggaggttacggcaaaatggttatggggattcttgtcaagaaataagaaaccgcggatatgtactagagaagagttcacacgcaaagtaagatctaacgcagcgattggtgcggttttcgttgacgaaaatcaatggaatagtgcaaaggaagctgttgaagacgaacgattttgggacctagtgcatagagaacgagaattacataaacaaggtaaatgcgccacgtgcgtatacaacatgatgggtaaaagggagaagaaactaggagagtttggaaaagccaaaggctcacgagcaatttggtacatgtggctaggggcaaggttcttagaatttgaagcactaggctttatgaatgaagatcactggtttagtagagaaaatagcttcagtggggtagagggcgaaggattacataaacttggatatatacttagggatatatcaaaaattcctggtggtaacatgtacgcagacgatactgcaggatgggatacgaggattaccgaagacgatctacagaacgaagctaaaattacggacattatggaaccggagcatgcattgttagctacctcaatctttaagctgacttatcaaaataaagttgttcgagtacagcgacctgccaaaaatggtacggtaatggatgttatctctagaagagaccaacgtggtagcggacaagtcggtacctacggactaaacacattcacgaatatggaagtacaattaattaggcagatggaatctgaaggaatatttctccccagcgagttggaaactccaaatcttgcagaaagagtattagactggttggaaaaacacggaacagaaaggctaaaacgaatggcaatatctggtgatgattgtgtggtaaagcccgttgatgacaggtttgctacagcactaattgccttaaacgatatgggaaaagttcgaaaagacatacctcaatgggagccaagcaaaggttggaacgattggcaacaagttccgttttgttcacatcactttcatcagttaattatgaaagatggcagggaaatagtagtgccttgcagaaatcaagatgaactcgttggtagagctagagtgagtcagggagctggatggtctttacgagaaacagcttgcttaggaaagtcatacgcacaaatgtggcaattaatgtatttccaccgaagagacttacgacttgccgcaaacgctatatgctctgctgtcccggtagactgggtgccgacatcaagaacaacatggagtattcatgcgcaccatcaatggatgactaccgaagatatgctttctgtctggaatcgtgtatggattgaggaaaatccttggatggaagataagactcatgttagtagttgggaagaagtgccatacctcggaaagagagaagaccagtggtgtggaagtctcatcgggttaaccgcacgggccacgtgggctactaacatacaagtggcgataaaccaagtccgacgactaataggtaacgaaaattatcttgattacatgacatcgatgaaaagattcaaaaatgaaagtgatccagaaggagcattatggtaa

SEQ ID NO: 21394 - RNA, 9879 nt, synthetic construct
  misc_feature 1..9879: note = derived and/or modified CDS sequence (opt6) from DENV-1__FJ478457__SS-prME
  source 1..9879: mol_type = other RNA
agcgtaaccatgctgctcatgctattacccacagcactcgcttttcacttaacaactagaggaggtgaaccacatatgatagtaagcaaacaagaaagaggtaaatcccttctattcaaaacatctgcgggagtgaatatgtgcaccctcattgcaatggatttgggcgaattatgtgaagataccatgacatataaatgtcccagaataacggaagcagaacctgacgatgtcgactgctggtgcaatgcaactgatacttgggtaacttatggtacatgcagtcaaactggggaacatcgaagagataaaaggtccgtagcacttgcaccacatgtgggattaggtctagaaacgcgaactgaaacttggatgagttcagagggtgcttggaaacaaatacaaaaagtagagacatgggcacttcggcatcccgggttcacagtaattgcgctttttctggcgcatgctataggtacatccatcacgcaaaaaggaataatatttatcttattgatgctcgtcacaccatccatggcaatgagatgtgtaggaatagggaatagggattttgttgagggtttgtctggtgcaacatgggtggatgttgtcctagaacatggatcttgcgtgacaacaatggccaaaaataaaccaacactagacatagagcttctcaaaactgaagttacaaacccagctgtattgagaaaactctgtatagaagcaaaaattagcaatactacgacggattccagatgcccaacacaaggtgaagcaacgctagtagaagaacaagatgcaaattttgtatgcagacgtacgtttgtagaccgtggctggggaaatggttgtggactattcggaaaaggtagcttactgacttgcgcaaaatttaaatgtgtgacaaaactggaaggcaaaatagtacaacatgagaacttaaaatattcagtgatagttacggtacatacaggtgaccagcatcaggtaggtaatgagacgacagaacatggtacgatagccacaataacaccccaggcaccaacatccgaaattcagctaacagattatggtgcccttactcttgactgttcaccacgtactggtctggacttcaatgaaatggtcttacttactatgaaagaaaaatcatggctagtacacaaacaatggtttttagacttacctctaccctggactagcggtgcatcaaccagtcaggaaacttggaatcgacaggacctattagtcaccttcaaaacagcacacgccaagaaacaagaagttgtcgtccttggtagtcaggaaggggctatgcataccgctctgacgggtgctacagaaatccagacaagtggaactaccacaatatttgcaggacatttgaaatgtagactcaaaatggacaaactaacactcaaaggaatgtcgtatgtaatgtgcactggttcgtttaaattggaaaaagaagtagccgaaacgcagcacggaactgtacttgttcaagtcaagtacgaaggcactgacgctccctgcaaaatcccgtttagtacccaagatgaaaaaggagttacacaaaacggacggctcataaccgccaaccccatagttacggataaagagaagcctgtaaacatcgaaacagaacctccttttggtgaaagttacatcgtcgtaggcgccggggagaaagccttgaaactcagttggtttaagaagggctcatccattggcaaaatgttcgaagcaacagcaagaggagctcgaagaatggcaatacttggtgacacagcttgggactttggtagcataggcggaatgttcacaagcgtaggtaaattagtgcaccaagtttttggcacagcatacggtgtcctattttcaggtgtgtcgtggacgatgaagatcgggataggaatcttattaacatggctaggtttaaacagtcgcagcacatctctctccatgacgtgtatagcagttggaatggtaacactctaccttggtgtaatggtacaagctgattccggatgtgtgataaactggaagggtcgtgaattgaaatgtggatctggaatatttgtaactaacgaggttcatacatggacagaacagtataaatttcaagcggacagtcctaaacgcttgtctgccgccatagggaaagcctgggaagaaggcgtgtgcggaattaggtcagcgacaagattagaaaatattatgtggaaacaaatctcgaatgaactaaatcatatacttcttgaaaacgatatgaaattcacagtagttgttggagacgcgtcgggaattttagcgcaaggcaagaaaatgataagacctcaaccaatggaacataaatattcatggaaaagttggggaaaagctaagataataggcgccgacatccagaacaccacctttataattgatggaccagatacgccagagtgttcagatgatcaacgagcatggaacatatgggaagttgaagactatggttttgggatttttaccactaatatatggctgaaactacgagattcttacactcagatgtgcgatcacaggttaatgagtgcagcaataaaagattcaaaagctgttcatgctgacatgggatattggatagaaagtgagaagaatgaaacatggaagttggcgcgagccagctttatagaagtcaaaacttgtatatggcctaaaagccataccttatggtcaaatggagttctagagtcagaaatgataatcccaaaaatatatgggggtccaatctcacaacacaattaccggccagggtatttcacccaaacagcggggccatggcaccttggtaaacttgaactggacttcgatctttgtgagggaacgaccgttatcgtagatgagcattgtggcaaccgcggacccagtctccgaactacgactgtgacaggaaaaataatacatgaatggtgttgcagatcatgcacactacccccgttacgtttccgaggtgaagacggttgctggtacggaatggaaataaggccagtgaaggaaaaggaagagaacttagtacgaagtatggtttcagcggggtcgggtgaagtcgattcgttttctctaggcatcttatgtgtatctataatgatagaggaggtaatgaggtcgagatggagtcgaaaaatgttaatgacaggtacgctagctgtcttcttactattgattatgggacaactaacgtggaacgatttaataaggttatgtataatggtcggagccaatgcctcagaccgtatgggtatgggaacaacatatctggcgttaatggcaacattcaaaatgcggcctatgtttgcagttgggttattattccgccgactaacgtctagagaagtgctactattaacaataggtcttagtctggtcgcttccgttgaactaccaaacagtttggaagaacttggtgacggtctagcgatggggattatgatgttaaaattactaacggagttccaacctcatcaattatggacaacattattgagccttacgtttattaaaacgaccttgtcattggattatgcatggaaaactatggctatggctctcagtattgtttcactatttccattatgtttaagcacaacttcacagaaaactacgtggttgccggtattactgggtagcttcggctgtaaaccattaacaatgtttctcatcactgagaataagatatggggacgaaagtcctggccattaaatgagggcatcatggccataggcattgtatcaatcctgctttcttcattattgaaaaacgatgtcccactagctggaccattaattgccggaggaatgctaatagcatgctacgtaatatcaggtagttctgcagacttgtcacttgaaaaggcagcagaagtatcttgggaagaagaagcggagcattcggggacatcacataacatgcttgtcgaggttcaagacgatggaactatgaaaattaaagacgaagaacgtgatgatactttaacaattctattaaaagcaacccttctagcagtaagcggtgtatacccaatgtcaatcccagcaactctttttgtctggtacttttggcaaaagaagaaacaaaggagtggcgtattatgggataccccaagtccaccagaagttgaacgggcggtgctagacgatgggatatacagaatactgcagcgaggcttactaggccgttcacaagtcggagttggagtatttcaagacggtgtattccatacaatgtggcacgtgacacgaggagcggtgttgatgtaccaaggaaaaaggcttgaaccaagttgggcatcggttaagaaagatttaataagttatgggggaggatggagattccaaggtagttggaacacaggcgaagaagtacaagtaattgccgtagaaccaggcaaaaatcctaagaacgtccaaactactcctgggacattcaaaactccagaaggtgaggtgggagctattgccttagattttaaaccaggcactagcggtagtccgatagtgaaccgagaaggcaagattgtgggattatacggaaacggcgtagtcactacgtcgggaacatacgtttcggcaattgctcaagcaaaggcttcgcaagaaggtcccctgcctgaaatagaagacgaagtctttagaaagagaaacctcacaatcatggatctccatcctggtagcggaaaaacgaggcggtatttgcctgctatagtacgcgaagcgataaaaagaaagttgaggaccttgattttagcacctactcgtgttgtagcttccgaaatggctgaggctttgaaagggatgcctattcgatatcaaaccactgctgtaaagagcgagcacacggggagagaaatagtggatctgatgtgtcatgccacttttacaatgagattattatctccagtgagagtccctaactataatatgataataatggatgaagctcattttacagacccagcatccattgcggcacgaggatatattagcacgcgagtaggaatgggggaagcagcggcaattttcatgactgcaaccccacccgggagcgtagaggcttttcctcaaagtaatgcagtcatccaagacgaagaaagagacatacctgaacgttcctggaactcggggtatgactggattaccgatttcccagggaaaacagtttggttcgtaccatcaattaaatccggaaatgatatcgctaattgtctaaggaaaaacgggaaaagagtgatacaattaagtagaaaaacatttgacactgagtatcagaagacaaagaataatgattgggattatgtagttacgactgatatatctgaaatgggcgccaattttcgcgctgaccgagtgatagatccaagacgatgccttaagcccgtaatactaaaagatggaccggaacgggtaatcctagcaggaccaatgccagtgaccgttgcctcggcagcacaacgtaggggaagaatcggtcgaaaccagaacaaggaaggcgatcagtatgtttatatgggtcagccattgaataatgatgaagatcatgcgcactggaccgaagcaaaaatgctcctggacaacataaacacccctgagggcattataccagccctgttcgaaccagaaagagaaaaatctgctgctattgatggcgaatataggttaaggggtgaggctcgcaaaacatttgtcgaattgatgagacgcggagatctgccagtatggctttcatataaggtcgcctcagaaggttttcaatattcggacagaagatggtgcttcgatggcgaaaggaataatcaagtattagaagaaaatatggatgtagaaatttggacaaaagaaggcgaaaggaagaaattaagaccaagatggttagacgctcgaacatactcggatccactagcacttagagaatttaaagagttcgcagctggtagaagaagcgtgtcaggtgacttaattctggaaataggaaaacttccacaacacctaacactcagagcccaaaacgctctagacaatctggtaatgttacataatagcgaacaagggggaaaagcctacagacatgcgatggaagaacttccagatacaatagaaacacttatgctattagcattaatagctgtactcaccgggggagttactttatttttcctctcggggaaaggcttaggtaaaacttcaataggtttactatgtgtcatggcgtcatcagctttactctggatggccagcgttgaacctcactggattgcagcgtcgattatcttggagttcttcctaatggtgctactaatacccgaaccagataggcaaagaactccacaagataatcagctggcgtatgttgtgatcggactactttttatgatactcacagtcgcagccaacgaaatgggacttctggaaacaaccaagaaagatctaggaataggccatgtagccgcagaaaatcatcaccatgcaacaatgctcgatgtcgacctgcgaccagcaagtgcttggacgttgtatgccgtagcaacaactgttattactcctatgatgagacataccatcgaaaataccactgcaaatatatcattaacagcaatcgctaaccaagctgctattttaatgggactagataaaggttggccaattagtaaaatggacataggagtaccgctattagctctgggatgctattcccaggttaatccactaactttaacggccgcagtattgatgctcgttgctcattacgcgataattggtccaggcctacaagctaaagcgacgagggaagcccagaaaagaacggcggccggtatcatgaaaaaccccaccgttgatggaatagtagcaattgatctagacccagtcgtatacgacgcaaagttcgaaaaacaactgggccaaatcatgctattgattctatgcacaagtcaaattttattaatgcgaaccacatgggcactatgcgagtcaataacgttagcaacaggaccgcttaccacattgtgggaaggaagtcccggtaagttttggaatacaacaatagccgtaagtatggcgaacatatttaggggttcttatttagctggggctggattagctttttcgctaatgaaatcactcggcggtggacgtagggggactggtgcacagggtgagacgcttggagaaaagtggaaaagacaacttaatcaattaagcaaaagcgagtttaatacctataaacggagtggtattatggaggtcgaccgatcagaggctaaagagggtctaaaacgtggagaaactactaaacatgcagtgtcaaggggaactgccaagctccgctggtttgtagaacggaatcttgttaaacccgagggaaaggtaatagatctaggttgcggacgaggtgggtggtcgtactactgcgcaggtttaaagaaagtaactgaggtgaagggttacaccaaaggaggacccgggcacgaagaacccataccgatggcaacatacggctggaatttggtgaaacttcattcaggaaaggatgtctttttcacacccccggaaaaatgtgacaccctattatgcgatataggcgaatcaagtcccaaccccacaatcgaagaaggtagaaccctacgtgtactaaaaatggtagaaccctggttacgcggaaatcaattctgtattaagattttaaacccatacatgccgagcgtcgtagaaacattagaacaaatgcagcgtaaacatggcggcatgcttgtaaggaacccattatcgcgcaattcaacccatgagatgtactgggttagttgtgggacaggtaatatagtctctgcagttaatatgacttcacggatgttattaaatcgatttactatggcccatagaaagcccacatacgagcgagatgttgacttaggagcgggcactagacatgttgcagttgaaccggaagttgcaaatctagatatcattggccagaggatagaaaacataaagaatgaacataagtccacctggcattacgacgaggacaatccatataagacatgggcatatcatggttcatatgaagtgaaacccagcggcagtgccagttcaatggtcaatggagtcgtacgacttcttacgaaaccgtgggatgtgataccaatggtaactcaaatagctatgacagatacaactccatttgggcaacaaagagtctttaaagaaaaagtagatactagaacaccacgggcaaagagagggactgcgcaagttatggaagtaacagctaaatggctgtggggcttcctctccagaaataagaagcctcgaatttgcacacgtgaagagttcacgagaaaagttcgatcaaatgcagccatcggagccgtcttcgttgacgaaaatcagtggaactcggccaaagaagcggtggaagatgagaaattctgggacttagtccaccgtgagcgagaacttcataaacaaggtaaatgtgcgacatgtgtctataatatgatgggaaaacgagagaagaaacttggtgaatttggaaaggctaagggatcgagagcaatttggtatatgtggctaggagcacggttcctagaatttgaagctcttggattcatgaacgaagatcactggttttcgcgtgaaaacagtttgagcggcgttgagggagaaggcttgcacaaacttggatatatattgcgagacatcagtaaaattccaggaggaaatatgtatgcggacgatactgcaggttgggatactagaataacagaagatgacctacaaaatgaggctaagataactgacattatggaacctgagcacgccctactagctacatccatattcaaactcacataccaaaataaagttgtaagagtgcaacgcccagctaagaatgggacggttatggatgtaattagcaggagagatcagcgagggtctggacaagttggaacttatggtctcaatacttttaccaatatggaagtacagttaattcgtcaaatggaaagcgaaggaattttccttccaagcgaactagaaacgccaaatctcgctgaaagagttctagactggcttgaaaaacatggaacggaacgtcttaaacgaatggcgatcagtggtgacgactgtgtcgtaaaacccattgatgatagatttgctacagccttaatagctttaaatgacatgggaaaggtgcgaaaagacatccctcaatgggaaccatcaaaaggatggaacgaatggcaacaagttccattctgttctcatcattttcatcaattgataatgaaggatggtagagaaattgttgtaccatgtcgtaaccaagacgaattagtaggtagggcaagagtatcacaaggagcgggctggagtctcagagaaacagcgtgtttaggaaagtcttacgcccagatgtggcagctcatgtacttccatagaagagatctgagacttgctgcgaatgctatatgttcagctgtgccagtagactgggtacccacatctcgtacaacatggtctattcatgcacaccatcagtggatgacaactgaagatatgctgagtgtgtggaatcgagtctggatagaagagaatccgtggatggaagataagacacatgttagtagctgggaggaagtaccttatcttggaaaacgcgaggatcaatggtgcgggtccctaattggattaacagcaagagcaacatgggcaaccaatattcaagtagctattaaccaggtgagaagattaataggaaatgaaaattatctagactatatgaccagcatgaaacgatttaaaaacgagagtgatccggagggggcattatggtaa

SEQ ID NO: 21395 - RNA, 9879 nt, synthetic construct
  misc_feature 1..9879: note = derived and/or modified CDS sequence (opt6) from DENV-1__FJ410188__SS-prME
  source 1..9879: mol_type = other RNA
tctgtcacaatgttattgatgctcttgccaacagtactggcattccatttaactactagagggggtgaacctcacatgatagtttctaaacaagaacgaggaaagagcttactattcaaaactagcgctggggtcaacatgtgtacattaatcgcaatggacttaggtgaattgtgtgaagacactatgacatataaatgcccgagaataacggaagcagaacccgatgatgtcgattgttggtgtaacgccactgatacttgggttacttacggtacgtgcagtcagacgggtgaacatcgtagagataagagaagtgtcgcattagctccacacgttgggttaggactagaaacccgaacggaaacctggatgagcagtgaaggtgcctggaaacaaatccaaaaagtcgaaacatgggcactacgacatcctgggttcacagtcatagctttatttctagctcatgctatagggacaagtatcactcaaaaaggaatcatatttatattactaatgttagtgacacctagtatggcaatgagatgtgtaggaatcggcaaccgggacttcgtggaaggactcagtggcgcgacgtgggtcgatgtcgtacttgaacatggtagttgtgtcacaaccatggcgaaaaacaaacctacattggacatagaactcctaaaaacggaagttaccaaccccgctgtattaagaaaattgtgtatcgaagcaaagattagtaacactacgacagactcgcgatgtcccactcaaggggaagcaacacttgtagaagaacaagacgcaaattttgtttgcagacggacttttgtagacagagggtggggtaatggttgcggcctatttgggaagggttccttactcacatgtgcaaaatttaaatgtgttaccaaattagaaggtaaaatcgtacaacacgaaaatttgaaatatagtgtaattgttactgtacacacaggtgatcaacaccaagtaggtaacgaaaccacagagcatggtacaattgcaacaataacacctcaagcaccaacatcagaaatacaacttacagattacggggcattaacacttgattgttcaccaagaacaggccttgactttaatgaaatggtactattgacaatgaaggagaaaagttggttagtacataaacagtggttcttagatttacctttaccatggacatcgggggcttccacaagtcaagagacatggaaccgacaagacttgctagtgacttttaagacagcacacgctaagaaacaagaagttgtcgttttgggcagccaagagggtgcgatgcacactgcactaacaggtgcgacagaaatccaaaccagtggaaccaccacaatatttgcaggacatcttaaatgtagactcaaaatggacaaattgactttaaaaggaatgtcgtatgtcatgtgtacaggtagtttcaaactggaaaaggaagtagcagaaacacagcatggcaccgtattagtgcaggttaaatacgagggaacagatgcgccgtgcaagatcccattttccacccaagacgaaaaaggtgttactcaaaatggaaggctgatcacagctaacccaatcgttaccgacaaagaaaaaccagtaaatatagaaacagaacccccgtttggagaatcatatatagtcgtgggagccggagaaaaagcattaaagttatcttggttcaagaaaggatctagtattgggaagatgtttgaagcaaccgccagaggggctcgccgcatggcaattttgggtgacacggcatgggattttggaagcattggagggatgttcacgagtgtcgggaaacttgttcatcaggtcttcgggacggcatacggtgttctatttagtggagtgagttggactatgaagataggtataggaatattactaacgtggttgggcttaaactcaagaagcacatctttatcaatgacgtgtatagccgtaggaatggttaccctttatctcggcgttatggtacaagcagactctggatgtgttatcaactggaaaggacgtgaactgaaatgcggaagcggcatctttgtaaccaacgaagttcacacgtggacagaacaatacaagttccaagccgacagtccaaaaagattatcggcagcgataggaaaagcatgggaagaaggtgtatgcggaattaggtcagccacacgactcgagaatataatgtggaaacaaatcagcaacgaattaaatcatattctcttagaaaatgacatgaaattcacagttgtcgtgggcgatgccagtggcatcttagcacaaggcaagaaaatgataagacctcaaccaatggaacataaatatagttggaaatcatggggtaaggctaaaatcataggtgcagatatccaaaatactaccttcataatagacgggccagatacgccagaatgttcagatgaccaaagagcatggaatatatgggaggtcgaagattatggatttggcatctttacaacaaacatatggctcaagctaagggatagttacacgcaaatgtgtgatcacagattgatgagcgctgctattaaggactccaaagcagtacatgcggacatgggatattggatagaaagtgagaaaaatgaaacatggaaattagcacgagcttcattcatcgaggtaaaaacatgtatatggcctaaatcccacacgctctggtcaaacggagtgttagaaagtgaaatgattataccaaaaatatatggaggtccaatttcgcagcacaactatagaccaggctatttcacgcagacagctggaccttggcacttaggcaagctagaattagatttcgacctatgcgagggaaccacagtgatagttgatgaacattgtgggaacagaggaccatcccttagaacgacaacagttaccgggaaaatcatacatgaatggtgttgtagaagctgcaccctgcccccgctaagattcagaggtgaggacggttgctggtatgggatggaaataaggccagtcaaagaaaaagaagagaatctagtacgctcaatggtcagcgcaggatcgggcgaagttgattcgtttagcctaggaatattatgtgtttcaatcatgatagaagaagtaatgcgaagccgatggtcaagaaaaatgctaatgacaggtacattagcggtatttctattactaataatgggacaattaacatggaacgacctaattagactttgtataatggtaggagcgaatgcttcagataggatgggaatggggaccacgtatttagctctgatggctacatttaagatgagaccaatgttcgcagtaggactactattccgtaggttgacttccagggaggttttgcttttaacaatcggtctatcattggttgcatctgtagaacttcctaattcattagaagaactgggagatggtctcgcaatgggaattatgatgctaaaacttttaactgaatttcaaccacatcaactatggacgacactactcagtcttacattcataaaaacaacactctctttagactatgcttggaaaacaatggcaatggccttgagtatagtgagcttattcccattatgcttatctactacgagtcagaagactacatggttgcccgttttattaggcagtttcggttgtaagcctctgactatgttcttaattacagaaaacaagatatggggcaggaaatcctggcctctcaacgaaggaataatggcaataggtattgtctcgattcttttgagttcacttttaaagaatgacgtaccactcgctgggcccttaatagccggtggaatgctaattgcgtgttacgtgatatcagggagttcagctgacctatccttagaaaaagcagcagaagtaagttgggaagaagaggcggaacattcaggaacctcacataatatgcttgtagaagttcaagatgacggaactatgaagattaaagacgaagaacgcgatgacacgctaacgattctattgaaagctactttactggcagtttctggggtttatccaatgtcgataccagccactctttttgtgtggtacttttggcagaagaagaaacaaaggagcggcgtgttatgggatactccatctccgccggaagtcgaaagagctgtactagatgacggcatctacagaatactacagaggggcctattaggaaggtcccaggtcggggtcggggtattccaagacggtgtatttcacactatgtggcacgtgacaaggggtgcagtactaatgtaccagggaaaacgcctagagccatcatgggctagtgttaagaaagacctaatatcttatggaggagggtggcgttttcagggaagttggaatacgggcgaggaagtccaggtaatagcggttgaaccaggcaaaaatcctaaaaatgtccaaaccactccaggcactttcaaaactccagaaggagaagttggtgcgattgccttggacttcaaacctggaacatctggttcaccgatagtaaatagggaaggaaaaattgtagggttatatggaaatggagtagtaacaacgtcaggtacatatgtatcggccatagcccaagccaaagcgtcacaggaaggaccgttaccggagatcgaggatgaggtgtttcggaaaagaaatttgactataatggatctacaccctggtagtggcaaaacccgaagatatttaccagcaatcgtgagagaagcaataaaaagaaagctacgcacccttatactagcaccaacgagagttgtagcctctgaaatggccgaagcgctcaaaggcatgcctatacgataccaaaccactgctgtaaaaagcgagcatacaggccgcgaaatcgttgacttaatgtgccacgcaacgttcactatgaggctactttcgccagtacgagtaccgaactacaacatgattattatggatgaagcccattttacagatcctgcttcgatcgctgcacgaggatatatttcaaccagagtgggaatgggcgaagcagcagcgatctttatgacagcaacacctcctggaagcgtagaagcgtttccccaatccaatgcggttatacaagatgaagaacgagacatccctgagaggtcctggaactctgggtacgactggatcacagactttccgggaaagacagtatggtttgttccgagtatcaaaagtggcaatgatatcgccaattgcttaaggaaaaatggtaagagagttattcaactatccagaaagaccttcgatacggaataccagaaaaccaaaaataacgattgggattatgtcgttaccactgatatatcagagatgggagcaaattttagagccgaccgtgttattgacccgagacgatgcctcaaaccagtgatattaaaagatggaccagagcgcgtaatattagccgggcccatgcctgtcactgtagcatcggctgcacagagaagaggtcgcattggaaggaatcagaacaaagagggtgatcaatatgtctatatgggacaaccattaaataatgatgaagaccacgcgcattggactgaagcaaaaatgttattggacaatataaacacaccagaaggaataataccagcgttatttgagccagaaagagaaaaatctgcggctattgatggagaatatcgcttaagaggcgaagcaagaaagacatttgttgagctcatgagaagaggtgacctacccgtgtggttgtcgtataaagtggcaagtgaaggctttcaatactcagatagaagatggtgttttgatggggagcgaaataaccaggtattggaagagaacatggatgtagaaatttggacaaaagaaggagagcgaaagaaactacgaccgcgatggttggacgcaaggacatatagtgacccacttgcattgagagaatttaaagagtttgccgcaggtagacgctcggtttccggagacctaatccttgaaattggaaaattgcctcaacacctcacactacgcgcccaaaacgccctagataatctagtgatgttacataattccgaacaaggtggtaaagcgtacagacatgcaatggaagaactcccagatacgatagaaactttaatgttattggcactaatagcagtactaacaggcggggttactttgttcttcctttcaggtaagggcttaggaaagacaagtattggacttctttgcgtaatggcttcatctgcattactgtggatggcatctgtggagccacactggatagccgcctccataatattagagttctttcttatggtactgttaatacctgagccagataggcaaagaactccacaagataaccaactagcctacgtggtaattggactattattcatgattctgaccgtggcagccaatgaaatgggcttgttggaaacgactaagaaagatttggggattgggcacgtagcagccgagaatcaccaccatgctacgatgctagatgtagatctcagacccgcttctgcttggacattatacgccgtagctaccacggttataacgcctatgatgagacatacaatcgagaatactaccgcaaacatctctctcacagcaatagctaaccaagccgcaatactaatgggtctagacaaaggatggcctatatcaaaaatggatattggagtgccactacttgcgctgggatgttacagccaagtaaatccgttaacattaaccgctgcagttttaatgcttgttgctcactacgctatcatcggccctggtctacaagctaaagcaaccagggaagcacaaaagcgtactgccgctgggataatgaaaaaccctacggttgacggtattgtcgctatagacttggatccagtggtctatgacgcaaaatttgaaaagcagttagggcaaatcatgttgcttatattatgcaccagccaaatattattaatgcgaacaacttgggcgctttgtgaatctattacattagcaacaggaccactaacaactttatgggaaggttcacctggtaaattttggaatacaactatcgcagtatctatggcaaatatctttaggggctcatatttagccggtgccggactggcatttagtctaatgaaatcacttggtggaggccgacgagggacaggcgcacaaggtgagacgcttggagagaaatggaaaagacaactcaaccaactgagcaaatcagaatttaatacatacaaaaggagcgggataatggaggtggaccgatcagaggctaaagaaggattaaaaagaggtgaaacaacaaagcatgcggtaagtaggggaacagccaaactccgttggtttgttgagagaaatctggtgaaaccagagggaaaagtaatagatttagggtgtggtaggggaggatggtcgtactattgtgcgggtttgaagaaagttactgaggtaaaaggctatacaaaaggaggaccagggcatgaagaaccaattccaatggccacctatggatggaatctcgtaaaattgcactctggaaaagatgtatttttcacaccaccagaaaagtgcgatacacttctctgcgacatcggagaatcctcaccaaatccaaccatcgaagaaggaaggacattgagagttttaaagatggtagaaccttggttaagaggtaatcagttttgcattaaaattcttaacccctatatgccctcagtagtcgaaacattagaacaaatgcagagaaaacatggagggatgttagttcgcaatcctttaagcaggaacagcactcatgaaatgtactgggtgagttgtggtactggcaacattgttagcgctgtaaatatgactagccgtatgttactcaaccggttcaccatggctcatcgtaaaccaacatatgaacgcgatgtcgatttgggggctggaacaagacatgtagccgtcgaacccgaagttgctaaccttgatattatagggcaacgtatcgaaaatatcaaaaatgaacataaatcaacttggcattacgacgaagataacccttacaaaacatgggcgtatcatggtagttatgaagtaaagccaagtggatccgcaagtagtatggtaaacggcgtggtacgcctactaacgaaaccttgggatgtaatacccatggtgacacagattgcgatgacagataccacaccattcggtcaacaacgtgtgttcaaagagaaagtagacacgaggacgccaagagcaaaaagaggaactgctcaagtgatggaggtaactgccaaatggctctggggcttcctgagccgcaacaagaaaccaagaatatgtactagggaagaatttacaaggaaagtaagaagtaatgccgcaattggcgcggtatttgtcgatgagaaccaatggaactccgcaaaagaagctgtagaagacgagaaattctgggacttagtccatcgtgaaagagaactacacaaacaaggtaaatgtgccacatgtgtttataatatgatgggaaagcgtgagaagaaactaggagagttcggaaaagctaaagggtctagagctatatggtatatgtggcttggtgcacgcttcttggagttcgaagcgctcggatttatgaatgaagatcattggttctcgcgagaaaattcactctcgggagtcgaaggcgaagggctgcataaactaggatacatattgagagatatttcaaaaataccgggtgggaatatgtacgctgatgatacagcaggctgggatacacgtataacagaggatgatttacaaaatgaagctaaaataacagacattatggaaccggaacatgctttactcgcaacctcgatctttaaacttacctatcagaataaagtagttagagttcagagaccagccaaaaacggtactgtaatggatgtcatatcacgcagagaccaacgtggtagtggtcaagtgggaacttatggattaaatacgttcacgaacatggaggtacaattaatccgtcaaatggagtctgaaggaatattcttaccatcagaactagaaacaccaaatttagctgagcgagtattagattggctagagaaacacggtaccgagagactaaaaagaatggcaatatcgggggatgattgtgttgtcaaacccatagatgacaggtttgccacagctttaatcgcactgaacgatatgggaaaagtaagaaaagatataccccagtgggaaccaagtaaaggttggaacgaatggcaacaagttccgttctgttctcatcatttccaccaacttattatgaaagacggtagagaaatagtagtaccttgccggaaccaagatgagctagtgggtcgtgcaagagtatctcaaggtgccggctggtctctgcgtgagacggcgtgtctaggaaaaagttacgcgcaaatgtggcaactaatgtattttcaccgacgcgacctacgactagcggcaaacgcaatatgctccgcagtaccagtcgattgggtaccgacttcacgaacaacctggtcaatccacgcacatcaccagtggatgactacagaagatatgctatcggtatggaaccgagtatggatagaagaaaatccctggatggaagataaaacacatgtgtcatcttgggaagaagtaccttatctgggaaagagggaagaccaatggtgcggttcgttaatcggacttacagctagagctacatgggcgactaatattcaagtcgcaataaatcaagttagaaggttaatcgggaacgaaaattaccttgactatatgacaagtatgaaacgctttaaaaacgagtctgatcctgaaggagccttgtggtaa

SEQ ID NO: 21396 - RNA, 9879 nt, synthetic construct
  misc_feature 1..9879: note = derived and/or modified CDS sequence (opt6) from DENV-1__FJ478458__SS-prME
  source 1..9879: mol_type = other RNA
agcgtaactatgctgttaatgttattaccaacggctctagcatttcaccttacgacccgaggaggagaaccacatatgatagtttctaaacaagaaagaggaaaatcactattatttaaaacttcggcaggtataaatatgtgtactttaattgctatggatcttggagaactatgtgaagacactatgacttacaaatgtccaaggatcacagaagcagaacctgatgacgtagattgttggtgtaatgcaactgacacatgggtaacctacgggacgtgcagccaaacaggggaacaccggagagacaaaagaagcgtagcactcgcaccacatgtagggttgggattagaaacacgaaccgaaacctggatgagtagtgaaggtgcgtggaaacaaatccaaaaagtagaaacgtgggcattgaggcaccccgggtttaccgtaactgcattgttcctggctcatgctattggaacgagtataacacaaaaaggtataatattcattttgctgatgctagtcacaccctctatggccatgagatgcgttggaataggtaatagggactttgttgaaggcctcagtggtgcgacatgggtagacgtggtgttagaacatggaagctgtgtgactactatggcaaaagataaacccacactggacattgaactattaaaaacggaagtaacaaatccagctatactacgaaaactttgcattgaagctaaaatatccaatacaactaccgactctcgatgccctactcaaggtgaagcaacactggttgaagaacaggattctaatttcgtatgccgtagaacttttgtcgatcgaggatggggtaacggatgtgggttgtttggtaaagggtcgttactaacgtgtgctaaatttaagtgtgtaacgaagttggaagggaagatagtacaatacgaaaatctgaagtattccgtgattgttacagtgcacactggggaccaacatcaagtcggtaatgaaaccacagaacatggtactatagcgactattacaccccaagctccaacctcggaaattcagcttaccgattatggagcattgacattagattgttccccacgaacgggtcttgattttaatgaaatggtactcttaactatgaaggagaaaagttggttggttcataaacagtggtttttagatctaccacttccttggacttctggagcctccacgagccaagaaacatggaatagacaagatttgttagtaaccttcaaaacagcgcacgcgaagaaacaggaagtagtggtactaggttcgcaagagggagcaatgcatacagccctaacaggcgctacagaaatacaaacgtccggaacaaccacaatttttgctggccatctaaaatgtagactaaagatggataaactgacactgaaaggcatgtcatacgttatgtgcacaggaagtttcaaactagagaaagaggtcgcggaaacacagcatggaacagtacttgtccaggttaaatatgaaggaacagatgcaccatgcaaaatccctttcagcgcacaagacgagaaaggcgtgacacaaaatggcagactaataacagctaatcctatagtaacagataaagaaaaaccagttaacattgagacagaacccccttttggagaatcttatatagttgtaggagctggtgagaaagcattaaaactatcatggtttaaaaagggtagttcaataggaaaaatgttcgaggctacagctcgtggggctaggcgaatggcaatattgggtgataccgcctgggactttggaagtataggtggagttttcacgtcagtaggcaaattagttcatcaagttttcggtgcggcctatggtgtattattttctggggttagttggactatgaagattggtattggaatattgcttacgtggttgggtttaaatagccgctctacctcattgtcaatgacatgcatagcggtgggtatggttactttgtatttaggtgttatggtacaagcggactccggttgtgtcataaattggaagggccgcgaactaaaatgtggttctggtattttcgttacgaatgaagtgcatacatggaccgaacagtataagttccaggcagactcacccaagagactatcagcagcaatcggtaaggcttgggaggaaggagtttgtggaataaggagtgcgacaaggttggaaaacattatgtggaaacaaatttcgaatgagttaaatcatatactgctcgagaatgatatgaagtttactgtagtggtcggcgatgctaatggcattctggcgcaaggaaagaaaatgatacggcctcagccaatggaacatagatactcgtggaaatcatggggcaaagctaaaattataggcgccgacatacaaaacactacctttatcatcgatggaccagatactcccgagtgtccagacgatcaaagggcgtggaacatatgggaggttgaagattatggatttggcatatttacaacaaacatttggttaaaacttagagactcatatacacagatgtgtgatcatagattgatgtcagctgcaattaaagactcaaaagctgttcatgctgatatgggatactggatcgagtcggagaaaaatgaaacatggaaacttgcgagggcttcatttatcgaagtaaagacttgtatttggccgaaatcccacacactgtggtctaacggggtgctagaaagcgagatgataataccaaaaatttatgggggacccattagtcagcataactatagaccaggatattttacccagacagcgggaccatggcatctaggaaaacttgaacttgactttgatttgtgtgaaggcaccaccgtagtagtagatgaacattgtggtaatagaggtccgtctcttagaactacgacagtaacggggaaaataattcatgaatggtgttgtaggagctgtaccttaccacccctacgattccgaggcgaggatgggtgttggtatgggatggaaattcgaccagtcaaagaaaaagaagaaaatctagtacgatccatggtttccgcagggagcggagaagtggattcatttagtttgggaatactctgcgtaagtatcatgatcgaagaagttatgagatctcgctggtccagaaaaatgttaatgacagggaccttagctgtattcttattgctgattatgggtcagcttacatggaacgatctaattcgcctttgcattatggtcggcgctaacgcatcagataggatgggaatggggacgacgtacctcgcattaatggcaacatttaaaatgcgaccaatgtttgctgtaggattactatttcgtagactaacaagccgagaggttttactgctaacaatcggattaagtttggtcgcttcagtcgagttaccaaactctttagaagagttaggagacggactagcaatgggcatcatgatgttaaaattattaactgagtttcaaccccatcaactatggacgactttactgtcactcacttttataaaaaccacgttgtcactagactatgcatggagaacaatggctatggtattgtctatcgcaagtctattccccctatgcttaagtacaacaagtcaaaagacaacgtggttaccagtactacttggttcattcggttgcaaacctctaactatgtttttaataacagagaataagatatgggggcgaaaatcgtggccactaaacgagggtataatggcgattggcatagttagtatcttactcagttcgcttttgaaaaatgatgtgccgctagcaggcccactaattgcaggaggaatgctaatagcatgttacgtaataagcggttcttcagcggatttgagtctagaaaaggctgctgaagtgagttgggaagaagaagctgagcactcaggcacaagtcataatattttggtagaagtacaagatgacggaactatgaaaataaaagacgaagaaagggatgatacgctgacaattttactaaaggctacattactagcagtatctggtgtataccctatgagtataccggcaacactttttgtatggtacttctggcagaaaaagaagcaacgatcaggagtactgtgggacacgccttcaccacccgaagtcgaaagagctgttttggacgatggtatttacagaatcttacaacgtggacttttaggtagaagtcaggtaggtgtcggtgttttccaagatggtgtatttcatacaatgtggcatgtaacaaggggagcggtgttaatgtaccaaggaaagcggttggaaccatcatgggcgtccgttaagaaagatcttatatcctacggtggtggatggagattccagggttcttggaatacaggagaggaagtgcaagtaattgcagtggaacctgggaagaatccaaagaatgttcaaaccacacctggcacattcaagacgccggaaggagaagtaggagctatcgctcttgattttaaacccggaacgagcggaagccctatagtaaatcgagaaggaaaaattgttggtctatacggtaatggagtggtgacaacgtcagggacatatgtttcagctatcgcacaggctaaaacatcacaggaggggccgcttcctgaaattgaagaagaagtatttaagaaaagaaaccttacaatcatggatctccatcctggttccggaaaaacccgtcggtatctacctgcaatcgtaagagaggctattaaaagaaaattaagaacactaattttggctcctactagagttgtcgcttctgaaatggcagaagctctaaaaggcatgcctataagatatcagactacggcggtgaagtcagaacatacggggagggaaatagtggacctaatgtgtcacgcgacatttacgatgcgattactatcaccagtgagagttccaaattacaacatgattataatggacgaagcgcatttcactgatccagccagcatagcggctagaggttacatttcaactcgagtgggtatgggagaagcggccgcgatatttatgacagctacccctcctggttcggtggaagcatttccacagagtaatgcagttatccaggacgaagaaagagacataccagaacgatcttggaactcggggtatgactggattacagactttcctggcaagactgtatggtttgtaccatcaatcaaatcaggaaacgacatagcgaattgcttgaggaaaaatggaaaacgagttatacagctatcaagaaagacatttgatacagagtatcagaaaaccaaaaacaacgattgggactacgttgtgaccacagatatatcagaaatgggtgcaaacttcagagctgaccgagtgatcgaccctagaagatgcctaaaacccgtaatactaaaagacggtccagaaagggtaatcttggctggcccaatgccggtaacagttgcaagcgccgctcaaaggcgaggacgtataggccgaaatcagaacaaagaaggcgaccagtacgtatacatgggacaacctctaaacaatgatgaagatcatgcccattggacagaagcaaaaatgcttctagataatatcaatacgccggaaggaataatcccagccttattcgagccagaacgagaaaagtctgcagctattgatggtgaatacaggcttcgcggagaagcgcgaaaaacttttgtagaattgatgcggcgaggagatctgcccgtttggttaagttataaagtcgctagtgaagggtttcaatactcggatagacgatggtgcttcgatggagaaagaaacaatcaggttctcgaggaaaatatggacgttgaaatatggactaaggagggagaaagaaagaaactacgacccagatggttagatgcacgaacttactcagatccgttggcattaagagaatttaaagaatttgctgccggaagacgatcggttagcggtgacttaattctagagatcggtaaattgccacagcacttaacattaagagctcagaacgctctcgataacctagtaatgctccataacagcgaacaaggagggaaagcatacagacatgctatggaggaattacctgatacaatcgaaacgctcatgctcctggcgttgattgcagtacttacgggcggcgtaacgttgtttttcctgtcaggtaaaggattgggcaaaacgtctataggtctcttatgcgtaatggcatcatcagctctattgtggatggcgaacgtagaacctcattggattgccgcaagcattatcctggagtttttccttatggtattattgattcccgagccagacagacaaagaactccacaagacaaccaactcgcatatgtcgtaataggattattgttcatgatcctcactgttgccgcgaatgaaatggggttgttagaaactactaagaaagacttaggaataggccatgttgctgctgagaaccaacatcatgctacgatgttagatgtagatttaagaccagcatcagcatggacgttatatgctgtcgctaccactgtaataactccaatgatgagacacacgatagagaacactactgccaatatttcactaacagcaatagcaaaccaagccgccatattaatgggtttggacaaaggttggccgatatcaaaaatggatataggggtcccactcttagcactaggttgctattcacaagtaaatccactcaccctaactgcagcagttttaatgttagtggcgcattatgctataattggaccaggattgcaagcgaaagctactcgtgaagcacaaaaacgaactgccgcaggcataatgaaaaatccgacagtagatgggatagtagctatagatttggatcctgtagtttacgatgcgaaattcgaaaaacaattgggccaaataatgttattgatattgtgtacatctcaaatactgttaatgagaacaacgtgggcactatgcgaatcgattacgttagcaacgggtcctttaaccacactatgggaaggttcgccgggcaaattctggaatacaactattgcagtctcaatggcaaatatattcagagggagttatctagccggtgcaggattggcattttctttaatgaaatcactaggcggaggaagacgaggcactggggctcagggtgagacattgggtgagaaatggaagagacaactaaaccagctatctaagtcggagtttaacacatacaaaagatccggcattatggaggtagatagatcggaagctaaagaaggactcaaacgcggagaaacaacgaaacatgcagtcagcaggggaactgccaaactgagatggtttgtcgaacgcaatctagtaaaaccagaagggaaggtaatagacttgggatgtgggagaggaggatggagctactactgcgccggactcaagaaagttacggaagtcaaaggatatactaaaggagggcctggtcatgaagaaccaatacctatggcaacgtatggttggaacttagtaaaattatatagtggaaaagacgtattctttacaccaccggaaaaatgcgacactctcctttgtgatataggagaatcctccccaaatccaacgattgaagaaggacgcacccttagggtcttaaaaatggtcgaaccttggctcaggggcaatcaattctgtatcaaaatactaaatccgtatatgccatccgtagttgaaactttagaacaaatgcaacggaagcacggtggaatgttggtaagaaaccccttatctcgaaattcgacacacgaaatgtattgggtctcgtgtggaacaggtaatatagtaagcgcagtaaatatgacatcaagaatgttattgaatcgtttcacaatgacacatcggaaacccacgtatgaaagagatgttgacctaggggccgggacaagacacgtagccgttgagcccgaagttgccaatctcgacatcatcggtcaacgtattgaaaatatcaaaaatgaacataagtccacttggcattatgacgaagataatccgtataaaacatgggcttaccatggatcgtatgaagtcaaaccatcaggttctgccagttcaatggtgaatggtgtagtgcgtttattgactaaaccatgggatgtaatacccatggttactcaaattgcaatgacggataccactccttttgggcaacaacgagttttcaaagaaaaagtagatacccggacaccaagagctaaaaggggaaccgctcaaataatggaagtgacggcaaagtggttatgggggtttctctcaagaaataagaaaccacggatctgcacaagggaggagttcactagaaaggtccgatctaacgcagctataggagctgtattcgtagatgaaaatcagtggaactctgctaaggaagcagtagaagacgaaaggttttgggacctagtacatagagaaagggaactgcacaaacaaggaaaatgcgccacgtgtgtatataatatgatgggtaaaagagagaagaaattaggagagttcggtaaggcaaagggaagtagggccatctggtatatgtggttaggcgcccgctttcttgaatttgaagctcttgggtttatgaacgaagatcattggttttcgagagaaaacagtttttcaggggttgaaggtgaaggacttcataaattaggatatatactaagagatatatctaagataccgggaggcaatatgtatgcggatgatacggcaggctgggatacgcgtataacggaagatgatttacagaatgaggcgaaaattactgatataatggaaccagaacatgctctattggctaccagtatatttaaacttacatatcaaaataaagttgtccgcgttcaaagaccagccaaaaatgggacagttatggacgtaatcagtaggcgagatcaacgcgggtctggacaagtgggaacatacggcctaaatacattcacgaatatggaagtacaactaatccgtcaaatggagagcgaaggaatctttttaccgtcagaattggagacaccaaatctggccgagagagtattagactggttagagaaacatggaactgaaaggctaaaaagaatggctatatccggtgatgattgtgttgttaaacctgtagatgatcggtttgcaacagctttaatagcattaaatgatatgggaaaagttagaaaggatattcctcaatgggaaccaagcaaaggttggaatgactggcagcaagtacccttctgttcacaccattttcaccaactaataatgaaggatggtcgggaaatagtagtcccgtgtaggaaccaagacgaactcgtaggtcgtgcaagagtatcacaaggagctggttggtctctacgggagaccgcctgcctcggtaaatcctacgcacagatgtggcaacttatgtatttccaccgtagagatttacggctggctgctaatgcaatatgctctgcagtgcccgttgattgggttccaaccagcagaactacctggagcatacatgcacatcaccaatggatgaccacagaagatatgctatccgtttggaatagagtctggatcgaggaaaatccctggatggaagacaaaacacatgtatcgtcgtgggaagaagttccatatttgggtaaaagggaggatcaatggtgtggaagtctaataggcttaacagcccgtgcaacttgggcaacaaacatacaagtagctattaaccaagtaagacgccttatagggaacgagaactacctcgactatatgacttcaatgaaacgtttcaagaacgaatcagatccagaaggggcgttatggtaa

SEQ ID NO: 21397 - RNA, 9879 nt, synthetic construct
  misc_feature 1..9879: note = derived and/or modified CDS sequence (opt6) from DENV-1__FJ410190__SS-prME
  source 1..9879: mol_type = other RNA
tccgtcactatgttgttaatgttattgccgacggcgttagcgtttcatcttaccaccagaggaggagaaccgcacatgatcgtctcgaaacaagaaagaggcaaaagtctcctttttaaaacaagtgtaggtattaacatgtgcacactaatagctatggatctaggcgaactctgcgaagatacaatgacctacaaatgccctagaattacggaagcagaaccggatgacgtggactgttggtgtaacgcaactgatacatgggtaacgtatggaacatgttcccaaactggtgaacacagaagagataaacgttcagtagcattggcaccacatgtcggtctgggccttgaaacaagaacagagacatggatgagcagtgaaggagcatggaaacaaattcaaaaagttgaaacgtgggcattgagacacccaggatttacagttattgcgctgttcttggcgcatgcaataggtacaagtattacacagaaaggaattatattcatactactaatgctagtcacaccaagtatggccatgcgttgcgttggaatagggaaccgcgactttgtagaaggactaagtggagctacttgggtagatgtagtgcttgaacatggttcgtgcgtcacgacaatggccaaagacaaaccaacattagatattgaattgctaaaaactgaggttactaatcccgccgtattaagaaaactatgtattgaggccaaaatctcaaataccacaaccgatagtagatgtccaacccaaggtgaagcaacccttgttgaagaacaggatagtaattttgtttgtcggcgtacgtttgtggacagaggatggggcaacggttgtggattgtttggcaaagggagtctactgacatgcgccaaatttaaatgtgtaaccaaattagaaggtaaaatagttcaatatgaaaatctaaaatactccgtaatagtaacagtccatacaggcgaccagcatcaagttggaaatgaaacaacagaacacggaacgatcgcaacaattacaccccaagcacccacaagtgaaatccaattaactgattatggcgcactgacactggattgttctccacgaacaggtcttgatttcaatgaaatggtcttactgacaatgaaagagaaatcttggttagtccataaacaatggtttctagatctacccctaccatggacttcgggagcatccacatcacaagaaacgtggaacaggcaagacttgctagtaacatttaaaacagctcacgccaagaaacaagaagtagtcgtcctaggttcacaagaaggtgccatgcataccgcactaacaggagcaacagagatacaaactagcggaacaacaaccatatttgctggacatttgaaatgtcgcctaaaaatggacaaactaacgttaaaagggatgagttatgtaatgtgcacaggaagtttcaaattagaaaaagaagttgcagaaacccagcacggaacggtgttagtccaagtaaaatacgaaggcaccgatgctccctgtaaaataccattttctgcccaagatgaaaaaggagtaacacagaatgggagattaattacagccaaccctattgtgacggacaaagaaaaacccgtcaacattgagacagaacctccatttggagaatcatacatagtaataggagcaggagaaaaagctctaaaactttcctggtttaagaaaggaagttcaattggtaaaatgttcgaagctacagctcgaggagctagacgtatggccattttaggcgacaccgcatgggattttggatctattggtggagtctttacatctgttgggaaattagtacaccaggtatttggtgctgcgtacggggtactattttcaggtgttagctggacaatgaaaataggcatcggtattttgttaacgtggctaggcttaaatagtcgaagtacctcattaagtatgacttgtatagccgtgggcatggtcacgctgtacctaggtgtaatggttcaggcagattcaggttgtgtaattaactggaaaggccgggagcttaagtgcgggagcggaattttcgttacaaacgaggtccatacgtggacagaacaatataaattccaagccgatagtcctaagcggctctctgcagcaataggaaaggcttgggaagaaggagtatgtggtattagaagcgcaactagacttgaaaatataatgtggaaacaaataagtaacgaacttaatcatatcctgcttgaaaatgatatgaaatttacggttgttgttggagacgctaatggaatacttgctcaaggcaagaaaatgattagaccacaaccaatggaacaccggtacagttggaaaagttgggggaaagctaagataataggcgccgatattcaaaatacaacctttataatagacggaccagatactcccgaatgtccagatgatcaaagagcttggaatatatgggaggtagaggattacggctttggcatattcaccacgaacatctggttaaagttacgtgactcctacacccagatgtgtgaccatcggctgatgtcagcggctatcaaagactcaaaggccgtacatgctgatatgggatattggatagagtcagaaaagaatgagacatggaaattagctcgggcctctttcatagaggtgaaaacatgtatttggccaaaatcccatacattatggagtaatggggtcctagaaagcgaaatgatcatcccgaaaatttatggcggacctattagtcaacataactaccgaccaggatacttcacacagaccgcaggtccttggcacctgggaaagctagaacttgacttcgacctatgtgaaggaactaccgtggtggttgatgaacactgtgggaacagggggccttcattacgaactacgacagttaccggtaaaattatacacgagtggtgttgccgttcttgtacactaccgccattacgttttaggggagaagacggttgttggtatggaatggaaattcgaccagtgaaagaaaaagaagaaaatctagtaaggtcaatggtcagtgctggttcaggagaagtcgacagcttctcactaggaatattatgcgtgagtattatgatcgaagaagtcatgcgaagccgatggtcccgaaagatgcttatgacagggacattagccgtctttctactgttaattatgggtcaactaacttggaacgatctcatccgtctatgtataatggtcggtgcaaatgcatcagatagaatgggcatgggaacaacttatttggcattgatggcgacttttaagatgagacctatgtttgctgttggcctgctattccgaagactaacttcgagggaggtgttgttgttaactatcggcctatcattagtggcctctgtggaactacctaactcattagaggagttaggtgatggacttgctatgggaattatgatgcttaagttgctaacagaatttcaacctcatcaattgtggactacattgctatcattaacgttcataaaaaccaccctaagtttggattacgcctggcgcacaatggcgatggtgctctcgatcgtttcgctattcccgttatgtcttagtactacaagtcagaaaacaacatggctgccagtgctactaggaagtttcgggtgtaagcccttaactatgtttttaatcacagaaaacaaaatatggggaagaaagtcgtggcctctcaatgaaggtataatggcaattggtattgtctcaatcctcttaagcagtctactaaagaacgatgtaccactggctgggcccttaattgccggtggtatgttaattgcgtgttacgttatctcaggttcatcagcagatctgtccctagaaaaggccgcagaggtatcttgggaagaagaagccgaacacagtggtacatctcacaacatcctggttgaagttcaagacgacggcacaatgaaaattaaagatgaagaacgtgatgatacgttaaccatattactcaaagcaaccttactagcagtgtcgggagtgtacccgatgagtattccagcaaccctatttgtatggtatttttggcagaagaagaaacaaaggtctggtgttctttgggacacaccatccccacccgaagtagaaagagcagttcttgatgatggcatatataggattttacaaagaggattactaggtcgctcccaggttggagtaggtgtttttcaagacggtgtctttcacaccatgtggcatgtaaccagaggagcagtattgatgtaccaaggaaaaaggttagaaccaagctgggcctcagttaagaaagatctaatatcgtatggagggggctggcgattccaaggcagttggaatacaggggaagaagttcaagtcatcgcagtagagccgggcaaaaatcccaagaacgtacaaactacgcccggaacatttaaaacacccgaaggagaagtcggtgcaattgctttagactttaaaccgggcacatcaggatctccaatagttaatcgtgaagaaaagatagttggactttacggtaatggtgttgttacgacatcgggaacttatgtttccgcaatagctcaagccaagacctcgcaagaaggcccgctaccagaaatagaagatgaagtatttaagaaacgaaatctcactataatggacctgcatcccggctctggtaaaactcgtcggtacctccccgctattgttagagaagcaatcaaaaggaaattaagaacgttaatattagccccgactcgagtagtggcttctgaaatggccgaggctttgaaggggatgccgattagataccaaacaaccgcagtgaagtcagaacatactggaagagaaatagttgatctgatgtgccacgctactttcactatgcgattactttcacctgtgagagtaccaaattataacatgataatcatggatgaggctcatttcactgatcctgcgagtattgcagcccgtgggtatataagtacaagagttggcatgggagaagcagctgcaatcttcatgactgcgacaccaccaggatcagtcgaagcgttccctcagagcaatgctgttattcaggacgaagagagagatattccagagcgaagttggaatagcggttatgattggataacagattttccaggaaaaacagtatggtttgtaccatcaataaaatcaggtaacgatatagccaattgcttacgaaagaacggcaagagagtaatccaattatcaagaaagacatttgacacagagtatcagaaaacgaaaaataatgactgggattacgtggtaacaaccgatatcagtgaaatgggtgctaatttcagagcagatagagttatagatcccagacgttgtttaaaacctgttatcctcaaagatggaccagaacgggtaattcttgctggtcctatgcctgtcactgtagctagcgctgcacagcgacgtggcaggatcggaagaaatcaaaacaaagaaggagatcaatatgtatacatgggccaaccgctcaataacgatgaagatcatgcccattggacagaggcgaagatgttactggataatataaacacaccagagggcataattccagcactattcgaaccggaacgcgaaaaatcagcggctatagacggcgaatatagattgagaggagaagccagaaaaacatttgtagaattaatgcggcgtggcgatctgcccgtttggctaagttataaggtcgcatccgaagggttccaatatagcgacagacgctggtgttttgatggagagagaaataatcaagtcttagaggagaacatggacgtagaaatatggactaaggaaggggaacgcaaaaagctaaggcctaggtggctagacgctcgtacttattctgacccgttagctctacgagagttcaaagagttcgcagcgggcaggagatccgtgtccggcgatcttattctagagattggaaaattacctcaacaccttacgcttagagcccaaaacgcattggacaatttagtcatgctacataactcggagcagggagggaaagcctatcgccacgcaatggaagaactccccgacacaatcgaaacacttatgttactagcattaattgctgtcctcacaggaggagttactctatttttcttaagtggcaaaggacttgggaaaacaagtattggattgctatgcgttatggccagttcagcacttctctggatggcgaacgtagagccacattggattgcggctagcattattctagagttctttcttatggtactgctcatccccgagccagaccggcaaagaacaccacaggacaaccaacttgcttatgtagtaataggcttattgttcatgatactaaccgtggcagctaacgagatgggtttgttagaaaccactaagaaagacctaggaatcggccacgtggcagcagagaatcagcaacacgccactatgttggatgttgatctaagaccagccagcgcttggaccttatatgcagtcgcaacaactgttataacacccatgatgcgccatacaatagaaaatacaaccgcaaatatatctctgacagcgatagcaaatcaagctgcaatattgatggggcttgacaaaggatggccaatctccaagatggatatcggtgttccgttactggcattaggatgttacagccaagtaaatcccctaactttaacggctgcagtgctgatgttagtagctcattatgcgattatcggacccggattacaggctaaagctaccagagaagcacagaaacgtacagcagcaggtataatgaaaaacccgacggtcgatggaatagtagcaatagatctagaccctgtggtgtatgatgccaaattcgagaaacaactcgggcaaataatgcttctgattctatgtacatcgcaaatactccttatgaggacgacatgggcactttgcgaatctatcactctcgcaacgggaccactgactacattatgggaaggttctccaggcaaattttggaataccactatagcggtatccatggcaaatatatttagaggaagctacctagcaggggcagggttggcgttctcattaatgaaaagtcttggtggagggcgaagagggactggcgcccaaggtgaaacactaggagaaaaatggaagaggcaattgaaccaactaagcaaatccgagttcaacacatataagagatctgggataatggaagttgatagatcggaagcaaaagaaggtctaaagcgtggagaaaccaccaaacatgcagtatccagaggaacggcaaaattaagatggtttgttgaacgtaacttagtaaaaccggaaggaaaagttatagacctcggttgtgggagaggcggctggtcctattactgtgctggactaaagaaagttactgaagtgaaaggttacactaaaggaggacccggccacgaagaaccaatcccaatggcgacatatgggtggaacctggtcaaattatattcagggaaagacgtatttttcacaccgcccgagaaatgtgatacactactttgtgacataggtgaatcttcgccaaatcctactatagaagaaggccggacgctcagagtcttaaagatggttgaaccctggctaagaggaaaccaattctgtattaaaatactaaatccttacatgccaagtgtagttgaaacgttagaacaaatgcaaagaaaacatggcggtatgttagttagaaatccgcttagccgtaacagtacacatgaaatgtattgggtctcttgtggtactggaaatatagtctcagccgtaaatatgacaagccggatgctcttgaaccgtttcaccatggcgcatagaaagccaacgtatgagagagacgttgatcttggagccggaacaagacacgtagcggtagaaccagaggtagcaaacctcgacattataggacaacgcatcgaaaacataaagaacgagcacaagtcaacatggcactatgatgaagacaatccttataagacctgggcctaccacggttcttacgaagttaaaccatctggtagtgcgtcaagtatggtaaacggtgtagtaagactactaacgaaaccttgggacgtcattccaatggtcacgcaaatagccatgacggacaccacaccattcggtcaacaacgagtattcaaagaaaaagttgatacgcgaacccctagggctaaaagaggcacagctcaaataatggaggtgacagcgaagtggctttggggatttctatcgagaaacaagaaaccgaggatatgtacgcgcgaagaatttacgaggaaggtgcgttctaatgcagcaattggcgcagtttttgttgacgaaaatcaatggaactccgctaaagaagctgttgaagacgagagattctgggatttagtacatcgtgaacgcgagctccataagcaaggtaagtgcgcaacatgtgtgtacaacatgatgggcaagcgagagaagaagttgggtgaatttggaaaggccaaaggttccagagcaatttggtatatgtggctcggcgctcgattcttggaatttgaggcattaggctttatgaatgaagaccattggttcagccgggagaactccttctcaggagttgaaggtgaaggtttacataagctaggttacatattacgtgacatttctaaaatacctggaggcaatatgtatgcagacgacactgccggctgggacacacgaatcacagaagatgatttacaaaatgaagcaaagataaccgatattatggagcctgaacatgcacttctagctacttctatattcaaattgacgtaccaaaataaagtagtacgagtgcaaaggccagccaaaaatggaaccgttatggatgtaataagtcgtagagatcaaaggggctctggacaagtaggaacatatgggcttaatacctttacgaacatggaagtgcaactgattaggcaaatggagagtgaaggcattttcctaccatctgagcttgagacaccaaacttggcagaacgtgtgttagattggttggaaaaacatgggactgagcggctaaaaaggatggctatttctggggatgactgcgtagtcaaacctgttgacgaccgttttgcaacagctttaatagctcttaatgatatgggaaaggttagaaaggatatacctcaatgggaaccatcaaaaggatggaatgactggcaacaggttccattttgcagtcatcattttcatcaattgatcatgaaagacggacgggaaatagttgtgccatgcagaaatcaggatgaattagtcggcagagcgagggtgagtcagggtgcaggatggagcctccgagagacagcatgtttagggaaatcttatgctcaaatgtggcaacttatgtatttccaccgtcgtgacttaagacttgcggcaaacgcaatttgttcagccgtccctgttgattgggttcctacatcgcggacaacttggagtatacatgctcatcatcaatggatgacaaccgaagatatgttatcagtttggaacagagtctggatagaagagaatccatggatggaagataaaacacatgtaagctcttgggaagaagttccatatctaggaaagcgagaagatcaatggtgcggttcactaataggcttaacagcgagagcaacctgggcaacgaatattcaagttgcaatcaaccaagtcaggagactaatcggcaacgaaaattatttagactacatgacatctatgaaaagatttaaaaacgaaagtgacccagaaggcgcactgtggtag

SEQ ID NO: 21398 - RNA, 9879 nt, synthetic construct
  misc_feature 1..9879: note = derived and/or modified CDS sequence (opt6) from DENV-1__EU482591__SS-prME
  source 1..9879: mol_type = other RNA
agtgtaacaatgctactaatgttacttcctacagctttagcatttcaccttactactaggggtggtgaaccacacatgatagtgtcgaaacaagaaagaggaaaatctctgctttttaaaacatcagcaggggtaaatatgtgtactttaatagcaatggatcttggtgaattatgtgaagatacaatgacatacaaatgtcctagaattacagaagctgaacccgatgacgttgattgctggtgtaacgcgacagatacatgggtaacgtatggaacatgctcccaaaccggggaacacaggcgcgagaaaaggagcgtggcactagcaccacatgtaggtttgggacttgagacaaggacagaaacctggatgtcaagcgaaggcgcatggaaacagattcaacgtgtagaaacatgggcgctaagacatcccggctttactgttatagcattctttctagcccatgccatagggaccagtataacacaaaaaggaataattttcatattactaatgttagtaacgccaagtatggctatgcggtgtgttggaattggaaatcgggactttgtggaaggattaagcggagccacgtgggtagatgttgtacttgagcacggaagttgtgtaacgaccatggccaaaaataaacctacactggacattgaacttttgaaaacggaggtcactaacccagctgtactccgaaagttatgtatcgaagccaaaatctctaacacaacaacagattcaagatgccccacacaaggcgaagcaacactcgtcgaagaacaagatgctaactttgtatgtaggaggacgtttgtagatagggggtggggaaatggttgtggattgttcggtaaaggatcattgctaacatgcgcaaagtttaaatgcgtaacaaaattagagggtaaaatagtacaatatgaaaatctaaagtatagtgttatagttactgttcacactggagatcagcatcaagtaggaaacgagactactgagcacggcacaatagcgacaataacgccacaggcacccacttccgagatccaactaactgactatggcgcattaacgcttgactgttcaccaagaactggacttgattttaacgaaatggtcttactgacgatgaaagagaagtcttggctcgttcacaaacagtggtttctagatttaccattaccatggacatcaggggcgtctacatctcaggagacctggaatagacaagatctcctggtgactttcaaaacagcccatgcgaagaaacaagaagtagtagtattgggaagtcaggaaggggcgatgcatactgcactaacgggagcgaccgagatccagactagcggaactacaactatatttgctggacatttaaagtgccgtttaaaaatggataaattgacattgaaaggaatgtcctacgtgatgtgcacagggagttttaaattagaaaaggaagtcgctgaaactcagcatggaacagtactcgtacaagttaagtatgagggaacagacgcaccgtgcaaaattcccttttcaacacaagacgaaaagggtgtaactcaaaacggaaggctaataaccgctaatccgattgtgaccgataaagagaaaccagtaaatatcgaaactgagcctccatttggtgaatcgtatattgttgttggagcaggggagaaggcacttaaactctcgtggtttaagagaggtagctcaatagggaaaatgtttgaagctaccgctagaggggcaagacgaatggcaatattgggcgatacagcatgggacttcggttcaatagggggagtattcacatcagtaggaaaactcgtccaccaagtattcggcacagcttatggagtattattttcgggtgttagttggactatgaagatcggaattggaatacttctgacttggttaggactaaactcacgttcaacatcccttagtatgacttgtatagccgtcggaatggtcacgttatacttaggggtaatggttcaagcggacagtggatgcgtaattaactggaagggcagggagctcaagtgtggctcagggatatttgtgacaaatgaagttcacacatggactgaacaatacaaattccaggcggattcacctaaaaggctatcagcagcgatcggaaaagcatgggaagagggcgtatgtggcattagaagtgctacacgtttggaaaatataatgtggaaacaaatatccaacgaactaaatcatatactattggaaaacgatatgaagttcacagtcgtagtaggtgacgcaaatggcattttagcccaaggcaagaaaatgatacgaccacagccaatggaacacaaatatagctggaaatcctggggtaaagcgaaaataattggtgcagatatacaaaatacaacgttcatcatcgacggaccggacaccccggagtgtccagacggacagcgtgcatggaatatctgggaagtggaagattacggatttggcgttttcacaactaatatatggctcaagctgcgagactcttatactcaaatgtgcgatcaccgcttgatgtctgctgccataaaggattcgaaagcagtacatgccgatatgggctactggatcgagagcgagaaaaatgaaacttggaagctagcgagggcttcttttatagaggttaaaacatgtacatggccaaaaagtcatactttatggtcaaatggagtgttagagagtgagatgataatacctaaaatctatggaggtccgataagtcaacacaattacagacctggatattttacacaaacggcgggcccgtggcacttaggaaaactcgaactggattttgacttatgtgaaggaactactgtagttgtcgatgaacattgtggcaatcggggtccttcacttcgaacgacaacagtgaccggaaaaattatacatgaatggtgttgccgttcttgtaccttacctcctctcagattcaggggagaagacggatgctggtatggtatggaaatacgcccagtaaaagaaaaagaagaaaatttagtaagaagtatggtatcagctggatctggtgaggtcgactcatttagtcttggtattttgtgcgtctcaatcatgattgaagaagtaatgagatcaagatggtcaagaaaaatgctaatgacaggaaccttagccgtgtttttattgttaataatgggacaattgacatggaatgacctaattcgattatgcattatggttggagcaaatgcgtcagacaggatgggcatgggcaccacatatctcgccctaatggccacttttaaaatgaggccgatgttcgcagtaggattactattcagaaggctaacctccagagaagttttattattgacgataggtctttctctagtagcatcagtggaattaccaaattccctagaagaattaggagacgggctggcaatgggaatcatgatgctcaaattgctaacagagtttcagcctcatcaactatggacaacattactcagcttgactttcgtaaagacaacgctaagtctcgattacgcttggaaaactactgccatggccctttccatagtgagcttattccctttatgcctatccacaacgtctcagaaaacaacttggctacctgtgcttctgggttcgtttggctgtaaacctttgacaatgttcttgattacggaaaataaaatttgggggagaaaatcatggccactaaatgagggaataatggctatcggtatagtaagtatacttctatcaagtctcctcaaaaatgacgtgcccttggcaggacctctgatagcgggaggtatgctaatagcctgttatgttatatctggcagctcagccgatctttctctcgaaaaagctgccgaagtaagttgggaacaagaggcggaacactcgggagcatcacatagtatattagtcgaggttcaagacgacggtacgatgaagataaaagacgaagaacgagacgacacactaaccattttactaaaagctactctcctagcagtaagtggtgtataccctatgtcaatacccgcaacgttatttgtatggtacttctggcagaagaagaaacaaagatctggtgtactttgggatacaccttcgccacccgaagtagagcgtgctgtgttagataacggaatatacagaatccttcaacgcgggttactagggagaagtcaagttggagttggggtatttcaggatggggtgttccacactatgtggcacgtgactcgaggggcagtattgatgtaccaaggaaaaagactagaacccagctgggcgtctgtcaagaaagatctaatctcatatggcggtggctggcgttttcaaggctcttggaatacaggagaagaagtacaagtcatagcagtagaaccgggcaaaaaccccaaaaacgtacagacaacgccaggtacattcaagacacctgagggagaagtcggcgcgatagcattagatttcaaaccaggaaccagcggctcacctatcgtcaacagagagggaaaaattgttggactatatggaaatggggtagtaaccacatctggtacatacgtatccgccatcgcacaagcaaaagccagccaggagggaccgctccccgagattgaagacgaagtttttaaaaagaggaaccttacgataatggacttacaccctggttcaggtaagactagaagatacctcccagccatcgtacgagaggctattaaaagaaaactgagaacactgatattagctcccactagagtagttgcatctgaaatggctgaagctcttaaaggaatgcctataaggtatcaaacgacagcggtaaagagtgagcatactggcagagaaatagtggaccttatgtgccatgcaacctttactatgcggcttctctcccctgtaagagtccccaattacaacatgataataatggatgaagcccacttcaccgatcctgccagcatcgcagcacgagggtatataagcactagagttggtatgggagaggccgctgcaatcttcatgactgctacaccccctggttcagttgaagcattcccccaatccaatgcggttatacaagacgaagaacgtgatataccagagagaagttggaatagtggttatgactggataacggattttccaggaaaaacagtatggtttgtgccatcgataaagtcaggaaatgacatagcaaattgtttgcggaaaaatggcaaaagggtaatacagctatcaagaaaaacgttcgacactgaataccaaaagaccaagaataatgattgggactatgttgtgacaacagatatttctgaaatgggagctaacttccgtgcagaccgggtaatagacccaagacgatgtttaaaacctgtaatattaaaagatggtccagaaagagtaatccttgcaggaccgatgcctgttacagtagccagcgcagcgcaaagaagggggcgtatagggcggaatcaaaacaaagagggcgaccagtatgtctatatgggacagccattgaataatgacgaggaccatgcacattggaccgaggctaagatgttattggataacataaacactcctgaaggaattattcccgcactatttgaacctgagcgtgagaaatcagctgcaattgatggagaataccggttacgcggcgaagctcggaaaaccttcgtcgagttgatgcgaaggggtgacctacccgtctggctctcatacaaggtagcatccgaaggtttccagtattctgatcgccgatggtgtttcgatggtgaaaggaacaatcaagttctagaggaaaacatggacgttgaaatatggacaaaagaaggcgaacgcaagaaactgcgaccaagatggttagatgccagaacttacagtgatcccttagccctgagagagtttaaagagtttgcagccggcagacgtagcgtatctggggacctaattctggaaatcggaaaactaccacaacaccttacacttagagctcagaatgcattagataatttagtaatgctacacaactctgagcaaggtggtaaggcatataggcacgccatggaggaattaccagatacaattgagacgctgatgttgctcgctttaattgcggttctgacgggaggtgtaacactgttctttttgagcggtaaaggactaggcaaaacctcaattggactattatgcgtcacggccagttctgcattactatggatggcatccgtagagccacattggatagcagcatccataatattggaatttttcctaatggtccttttaatacccgaaccagatcgtcagcgaacgcctcaggacaatcaattagcatatgtcgtgataggattactttttatgattttgaccgtcgcagcgaacgagatgggattattagagaccaccaagaaagacctaggcattggatatgtagcggctgagaatcaccaacatgcaacaatgttggatgtggacttgcaccccgcttcggcatggactttatacgcggttgcaacgactgtaataacacccatgatgaggcacaccattgaaaacacaacagcaaatatcagcctaacagcaattgcaaaccaggctgctattttaatgggattagataaaggttggcctatatcaaagatggatataggggtacccctgctcgcgttgggatgttactcacaagttaaccctttaacgttgacagcagcagtacttatgctagttgcacactatgctataattgggcccggcttacaagcaaaggctaccagggaagcacagaaaaggacagcggcaggtataatgaagaatccaacagtggacggcatcgtggctatagacctagatcccgtggtatacgatgctaagtttgagaaacaactaggccaaataatgctattgatattgtgcacatctcaaatattacttatgcgtacaacatgggctttatgcgaatcaataacactcgccacgggacccttaacaacgctatgggaggggtccccaggaaaattctggaacactacaattgcagtgtcaatggcaaacattttccgcggtagttatttagctggtgcaggacttgccttttctctgatgaaatcgctcggtggaggtagaagaggcacgggcgcacaaggggaaactctaggagaaaaatggaaaagacaacttaatcaactatcgaaaagcgaatttaatacttataaaagatcaggaattatggaggtagatcggtccgaagcgaaagaggggctgaaaagaggagaaacaacaaaacatgctgtttctcggggtactgcaaaactgcgttggttcgtcgagcgcaacttagtcaaacccgaaggaaaagtcattgatctcggttgcggaagaggaggctggtcatactattgtgcaggcctaaagaaagtgactgaagttaaaggatatacgaaaggaggccctggacacgaagaaccaatcccaatggcaacttacggatggaatcttgtcaaactacactcagggaaggatgttttcttcatgccaccagaaaaatgtgacaccctattgtgtgatattggtgagtcctcaccaaatcccactatagaagagggtcgaaccctacgagtactgaaaatggtagaaccatggcttaggggaaatcaattctgcataaagattcttaacccttatatgccttctgtggtagaaacattggaacggatgcaacgcaaacacgggggcatgttagttcgaaacccgctgtccagaaattcaactcatgagatgtattgggtctcatgcggaactggaaacattgtatccgcagttaatatgacttcgaggatgctacttaacagattcacaatggcgcataggaaacctacctacgaaagagatgtagatctgggggctggaactagacatgtagcggtagaaccagaggtggcaaacctcgacattataggtcaaagaatcgaaaatatcaaaaacgaacacaaatctacttggcattacgatgaagataatccttataaaacttgggcataccatggtagctacgaagttaaaccatcagggtccgcgtcaagcatggtaaacggagtggttagactactaactaaaccatgggatgtaataccgatggttactcaaatcgctatgacagatactacccctttcggacaacaaagagtatttaaggaaaaagtcgatacgcgtacacctagggcaaagagaggaacgacacagattatggaagtcactgctaaatggttgtggggttttctatcaaggaataagaaaccaagaatatgcacaagagaagaatttacccggaaagtgaggtcgaacgccgcaataggtgctgtatttgtagacgagaaccaatggaactccgcaaaagaagcagttgaagatgaaaggttctgggatctggtacaccgtgagagggagcttcataagcaaggaaaatgcgctacatgcgtttataatatgatggggaaaagggagaagaaactaggcgagttcggaaaagcaaaaggcagtagggcaatttggtacatgtggcttggtgcgcgtttcctagaatttgaagccctcggcttcatgaatgaagatcattggtttagcagagagaactccttaagtggagtagaaggagaaggacttcacaaacttggatacatcttaagagatataagtaaaataccgggaggcaacatgtacgcagatgatacggcgggttgggacacacgaataacggaagatgacctccagaatgaagccaaaataacagatataatggagccagaacacgcacttcttgcaacctcaatttttaaactaacttatcaaaacaaagtagttcgagtacaacgacccgctaaaaatggaacagtaatggatgtaataagtagaagggatcaaaggggaagtgggcaagttggtacctacgggctgaacacttttacaaacatggaggtacagttaattcgccaaatggaaagcgagggtatatttctccccagtgagctagaaactccgaatttggcagagagggccctcgattggctcgaaaaacatggtgcagaaaggttaaaacgtatggcaattagtggtgacgattgcgttgttaaacccattgatgatcgatttgcgacggctttaaccgcgctaaacgacatgggaaaggtgcgaaaggacattccgcaatgggagccaagcaaaggatggaatgattggcagcaggtaccattttgttctcatcactttcaccaactaataatgaaagatggtagggaaattgtagtcccgtgtcgaaatcaggatgaactggtcggaagggcgagagtcagtcaaggggcgggatggtcgctgagagaaacagcatgcttgggaaaatcgtacgctcagatgtggcagttaatgtatttccatagaagagatcttagactggcagccaatgctatctgctcagccgtacctgttgattgggtaccgacaagtagaacaacttggtctattcacgcacatcaccaatggatgactacggaagatatgttatccgtatggaaccgagtgtggatagaggaaaacccgtggatggaagacaaaacccatgtcagtagttgggaagaagtcccatatctaggtaaacgggaagatcaatggtgtgggtccctcataggtttaacggcgagagcaacatgggcaactaatattcaagttgcgatcaatcaagtgaggagattaataggaaatgaaaactacctggactatatgacttcgatgaaacgattcaaaaacgaatcagactcagaaggagcattatggtaa

SEQ ID NO: 21399 - RNA, 9879 nt, synthetic construct
  misc_feature 1..9879: note = derived and/or modified CDS sequence (opt6) from DENV-1__EU482592__SS-prME
  source 1..9879: mol_type = other RNA
tctgtaactatgttattaatgttattaccaacggcattagcctttcatttaactactagaggaggggaaccacatatgattgtatctaaacaagagagagggaaaagccttcttttcaaaacatcggccggtatcaatatgtgtacgcttattgcaatggatttaggggaattgtgtgaagataccatgacctataagtgtcctaggataacagaagctgaaccagacgacgtagactgctggtgtaatgcaacagacacatgggttacctatggtacctgttctcaaacaggtgaacatagaagggataaaagaagtgtggccctagctccacacgtaggattgggactagaaacgagaacggaaacatggatgagtagtgagggtgcatggaaacaaatacaaaaagtagaaacctgggccctacgacatccaggtttcacagtcactgctctatttttagcgcacgccatagggacgtcaattacacagaaaggaattatatttatacttttgatgcttgtaactccatctatggctatgcgctgcgttggtataggaaatagagattttgttgaaggtctaagtggggccacctgggtcgacgtggtactcgaacacggatcatgcgtcacgacaatggcaaaagataaacctacgttagacattgaattattaaaaaccgaagtaacgaacccggctgtattaagaaaactctgcatcgaagcaaaaatatcgaataccacaaccgacagtaggtgtcctacgcaaggtgaagccactctagttgaggaacaagatagtaatttcgtctgcagacgaacctttgtggatagaggttggggaaacggctgcggattgttcgggaaaggatcactcttgacatgcgctaaattcaaatgtgtaacgaaacttgaaggtaagatagtccaatatgaaaatctaaaatactccgtaatagttaccgtgcataccggagaccagcaccaggtaggaaatgaaacgactgaacacggaaccatagccacgattaccccacaggcccctacaagtgagatccaactaactgattatggcgcgctaacactagactgctctcctagaacggggctagattttaatgaaatggttctgttaacaatgaaagagaaatcatggcttgtacacaaacagtggtttctagatctgccgctgccatggacaagtggggcttcaacatcacaagagacgtggaatagacaggatctgttggtaacattcaaaaccgcacatgccaagaaacaagaagttgtggtcctgggtagtcaagaaggtgccatgcatacagcacttactggtgctactgaaatccaaacgagcggtactaccacaatattcgcaggacacttaaaatgtagactaaaaatggataagctaaccctaaagggaatgtcatatgttatgtgcacaggatcatttaaactagagaaagaagttgctgaaacccagcacgggacagtattagtccaggtaaaatatgaaggcacagatgcaccatgtaaaatacctttttccgcacaagatgagaagggagttacacagaatggcagattaataaccgcaaatccgattgtaaccgataaggaaaaaccggtaaacatcgaaaccgagccgccatttggcgagtcttatatcgtcgttggcgccggagaaaaggcattaaaactcagctggttcaaaaaggggtcgtcaataggaaagatgttcgaggctacagcacgtggagctcgacgtatggcaatcctaggagacacagcttgggactttggcagcataggtggtgtcttcacatctgttggcaaacttgttcatcaggtgtttggggcggcctatggggttctatttagtggggtatcgtggactatgaaaataggaataggaatcctacttacttggctcggtctaaattcaaggtccacgagtctgagcatgacttgtatagccgttggtatggtaaccctttatcttggagttatggtccaggccgatagtgggtgtgtaataaactggaagggacgtgaattaaagtgtggttccggcatatttgtaacaaatgaagtgcacacgtggacagaacaatacaaattccaagccgactcgcctaaaaggctaagcgcggctataggcaaagcctgggaagaaggcgtatgtggtattcgaagcgctacaaggcttgagaatattatgtggaagcagatatctaatgaattaaatcatattctgttagaaaacgatatgaagttcacagtagtcgtaggagatgccaatggtatactagcacaaggtaagaaaatgatccgcccacaacccatggaacataggtattcatggaagtcatggggaaaggcaaaaataataggggccgacatccaaaatagtacattcattatcgacggccctgatacaccagaatgtccagacgatcaaagagcatggaatatatgggaagtggaagattatggatttggaatctttaccacgaatatatggctaaaattaagagattcttatactcaaatgtgtgatcaccggctaatgtctgcagctataaaagattctaaagcagtgcacgcagatatgggctactggatagagagcgaaaagaatgaaacgtggaagttagcacgagcatcgtttatagaggtgaagacatgcatttggccaaaaagtcatacattatggagcaatggagtattggaatcagaaatgatcatacccaagatttatggtggacctataagtcaacacaactatcgacctggatatttcacacagacagctggaccgtggcacctaggcaaattagagctggacttcgatctatgtgagggaacaacagtagtagtagacgaacattgtggtaatagaggacctagtttaagaaccaccacagttacaggtaaaattatacatgaatggtgctgcaggtcatgcactctacccccgctaagatttagaggcgaagacggatgttggtacgggatggagatcagacctgtaaaagaaaaagaggaaaatttagtgagatcaatggtttcggctggatccggggaagttgactctttttcacttggtattttatgtgtttccataatgatcgaagaagtgatgagaagcagatggtcacgaaaaatgttgatgacagggactttagctgtttttctattactcataatgggacagttaacatggaatgacctaattagattgtgcattatggtgggagcaaacgcatccgaccgtatgggaatgggcactacatacctagcattgatggccacattcaaaatgagacctatgttcgcggtgggattactctttagaaggcttacttctagggaagtgctattactgacgatagggctgagtttagtagcatccgttgagttgcctaacagtctcgaagaactgggtgatggcttagcaatgggtattatgatgttaaagttgttaacagagtttcaaccgcatcaattatggacaactctactcagcttaactttcatcaaaactaccttatcactcgactacgcatggcgaacgatggcgatggtactgtcaatagtgagcctatttccattatgcttatcaactaccagtcagaaaacgacatggttgcctgtattgctaggttcgttcggctgtaaaccattaacaatgtttttgatcactgaaaataaaatttggggacgcaaatcatggccgttgaatgagggaataatggcaattggaatagtatcaattttattgtcatccttattaaagaatgatgttccattagctggacctttaatagccggtggaatgttgatagcttgttatgtcattagtggatcctcagcagacctctctttagaaaaagcagcagaagtctcatgggaagaagaagcggagcattcaggaacctcgcacaatatattagtagaagtgcaagacgacggcaccatgaaaattaaagatgaagaacgagacgacactctgacaattctactaaaggctactcttcttgctgtaagtggtgtctatccaatgtcaataccagcaaccttgtttgtatggtatttctggcagaagaagaaacagcgctctggagtactttgggacactccctcaccgcccgaggtcgaaagagcggtacttgatgacggtatttatcgaatactacaaagaggactcttagggcggagccaggttggtgttggtgtgttccaggacggtgtatttcataccatgtggcatgtcactagaggagcggtattaatgtaccagggaaagcgtttagaaccatcatgggcaagtgtgaagaaagatttaatttcgtacggaggagggtggcggtttcaaggttcgtggaacaccggggaagaagtacaagtaattgcagttgaaccgggcaaaaatccgaaaaacgtacaaaccacaccgggtacctttaaaaccccagaaggtgaagtcggtgctatagcccttgatttcaaaccaggaacgagcggctcccctatcgtcaacagagaaggaaaaatagtaggcctgtatgggaacggagtagtaacaacatcaggtacctatgtatctgcgatagcacaagctaaaacctcccaggaggggcccttgcccgaaattgaggaggaagtttttaagaaacgaaacttgaccataatggacctacacccaggttctgggaaaacgaggagatacctacctgcaatagtaagagaggcaataaaaagaaaactccgcactttaattctcgcaccaacccgtgtggtggcctccgagatggcagaagcattaaagggaatgccaatacgctaccagacgacggcagtaaaatctgaacatacgggacgagaaattgtcgacctcatgtgccatgccacttttacgatgaggttattaagcccagtacgagtacctaattataacatgataattatggacgaggcccactttaccgatccagcgagcattgcggcaagaggatatataagcacacgagttggcatgggggaggctgctgccatcttcatgacagcaacacctccaggtagtgtagaagcattcccacaatctaatgcggtgattcaagatgaagaacgagatatacctgaaagatcttggaactctggttatgattggatcactgatttccctgggaaaacagtttggttcgtaccttctatcaagagtggaaatgatattgcaaattgtctacgtaagaacgggaagagggtcatccagctgtccagaaaaacgttcgacacagagtatcagaaaacccgcaataacgattgggactacgtagtcacaaccgatatatcggaaatgggggcaaactttagggcagaccgggttattgatcccagacgatgtctaaaacccgtcatattaaaagatggacccgagagagtcatactcgcgggtccgatgccagttacagtagcgagcgcagcacagagaagaggtagaataggcagaaatcaaaacaaagagggagatcagtatgtatatatgggccaacctctaaacaacgatgaggatcacgctcactggactgaagcgaaaatgctactcgataatatcaatactccagaaggcatcatccctgcactctttgaaccagaaagggaaaaatctgcagcaatagacggagaatatagattaagaggtgaagctcgaaagacattcgttgagctaatgcgaagaggcgatttacctgtgtggttaagttataaagtcgcaagtgaaggttttcaatattctgacagacggtggtgcttcgacggtgaacgtaacaatcaggtgttagaagaaaatatggatgttgagatttggacaaaagagggtgaaagaaagaaacttaggccacgttggttagacgctagaacatattctgatcctttggctctaagagagttcaaagagttcgcagctggcagacgatctgtctcaggagatttaatactagaaattggtaagctaccacaacatttaactttaagagcacagaacgctttagacaatcttgtgatgttacacaatagtgaacaagggggaaaagcatacaggcatgcaatggaagaactacctgatacaattgagactctcatgttactcgcattaatagccgtgcttacaggtggagtaactttatttttcctatcaggaaaggggttaggaaaaacaagtataggacttttgtgtgttatggcttcatcggccctattgtggatggctaatgtcgaaccacattggattgctgcatcaatcatcctggaatttttcttgatggttttactgatacccgaaccggatcgtcaaagaacacctcaagataatcaattagcctacgtagttattggacttctctttatgattttaactgttgcagctaacgaaatgggtttactagaaacaactaaaaaggacttgggcatagggtacgtcgccgctgagaaccagcaccacgctacaatgctcgatgtagatctaaggccagctagtgcgtggacactttatgcagtcgcgactactgttatcacacccatgatgcgtcatacaatcgaaaatacgacagcaaacatctcgctaactgcgatcgctaaccaagctgccatacttatggggctcgacaaaggctggccgataagcaaaatggatatcggagtgccactactcgctctaggttgctacagtcaagtgaatcctttaacgttaacagcagcagtacttatgctcgtggcacactacgcaataatcggtcctggattacaagctaaagctaccagggaagcacaaaaacgaaccgcagctggaattatgaaaaatccaacagtagatggtattgtagctatagacttggatcccgtggtatatgacgcgaaattcgaaaaacagctaggtcaaataatgctgttgatactctgcacaagtcaaatacttttaatgcgcacaacttgggccctatgcgaatccataacgctagcaacaggaccccttactacgctctgggaaggtagtccaggaaagttctggaatactacaatcgccgtaagtatggcgaatatatttagagggagttatcttgcgggggcagggctagcattctctttaatgaaatctttgggagggggcagaagaggtacaggtgcacaaggagaaactttaggcgagaagtggaaacgacaactgaatcaactcagcaaaagtgaatttaacacatataaaagatcggggattatggaagttgatagaagtgaagcaaaagagggtttaaagagaggcgaaaccactaaacacgcagtatcaagaggcacggccaaacttcgctggtttgtagagagaaacttagtgaaacctgaaggcaaggttatagatctaggctgcggaagaggtggctggagttactattgtgctggattaaagaaagttactgaggtaaaagggtacactaaagggggtccaggacatgaagaacctatacccatggcaacctacggctggaacctagtcaaattgtattccggaaaagacgtattcttcacaccgccagaaaagtgcgatacactattatgtgacatcggcgaatcttctccaaatccaacaatagaggaagggagaacactacgagtcctaaagatggtcgaaccgtggttaaggggcaaccagttctgtataaaaatccttaatccatatatgccaagtgtagtagaaactttagagcaaatgcaacgaaaacatgggggaatgttggtacgaaatccattatccagaaactccacacatgaaatgtactgggtttcatgcggaacaggaaatattgtgagtgcagtgaatatgacatcccgcatgctattgaataggttcacaatgacacacagaaagccaacgtatgaaagagatgtcgatttgggcgcaggaacgcgacatgtagcagtggaaccggaagtagccaacctagacatcataggtcaaagaatagaaaatatcaagaatgaacacaaatccacttggtattatgatgaagataatccatataaaacatgggcttaccacggttcctatgaagtaaaacccagtggttccgcctcatcaatggtcaatggagttgtgcgtcttttaaccaaaccatgggacgtaatcccaatggtgactcaaatcgccatgaccgatacaacccccttcgggcaacaacgggtattcaaagaaaaggtcgacacacggacgcctcgtgcaaagagagggacggcacaaatcatggaagttaccgccaaatggctctggggatttctatctcgcaacaagaaaccaagaatctgcaccagggaagagttcactagaaaggtaagatccaacgcagcaatcggagccgtctttgtagacgaaaaccaatggaacagtgccaaggaagctgttgaagacgaacgattttgggatctagttcatagagaaagagaattacataaacaagggaagtgtgcaacatgtgtttacaacatgatggggaaaagagagaagaaattaggagagtttggaaaggcgaaaggttcgagggcgatttggtatatgtggttaggggctagattcttggagttcgaagcattgggctttatgaatgaagaccattggttcagcagagaaaactccttttcaggagtcgaaggagaagggttgcacaaattaggttacattttacgcgatatatcgaaaataccaggaggcaacatgtacgctgatgataccgcaggatgggacactcgaataaccgaagatgatctccagaatgaagcgaaaattacagatattatggaaccagaacacgcattattggcaacatcgatatttaaacttacttaccaaaataaagttgtgagggtacagcgcccagctaaaaatggaacagttatggacgtaatatcacggagggaccagcgtgggagcgggcaagtgggaacttatggattaaatacatttacaaatatggaagtgcagttaatccgacaaatggagagcgagggaatctttctaccttctgaattagagacgccaaatttagccgagagagtcctaaactggttagaaaaacacggaactgaacgattgaaacgaatggctatatctggtgacgactgtgtagttaaaccagtagatgataggttcgctactgcattaatagcgttaaacgacatgggcaaagtaagaaaagacataccccaatgggaaccatcaaaaggctggaacgattggcaacaagtacccttttgctcacaccacttccatcagttaataatgaaagacggacgcgaaattgtcgtaccatgtcgaaatcaagacgaacttgtagggcgggcccgcgtgtcgcaaggagcaggatggtcattgagagaaacagcatgtttaggcaaatcctacgcacagatgtggcaacttatgtacttccacagacgcgatctacgactagcagcaaacgcgatatgttctgcagtcccagttgattgggtacccacatctcgaactacctggagcattcatgcacaccaccaatggatgactacggaggacatgttatccgtatggaaccgggtgtggattgaagaaaatccttggatggaagacaaaactcacgtttcatcgtgggaagaagtaccttatctaggaaaaagagaggatcaatggtgcggttctctgattggcctcactgcgcgagcaacttgggccacaaatatacaagtagcaattaaccaagttagacggctgataggtaatgagaattatctagactacatgacatcgatgaaacgcttcaagaatgagagcgatccggaaggtgccctgtggtag

SEQ ID NO: 21400 - RNA, 9879 nt, synthetic construct
  misc_feature 1..9879: note = derived and/or modified CDS sequence (opt6) from DENV-1__EU482609__SS-prME
  source 1..9879: mol_type = other RNA
tccgtaacaatgctattaatgcttctacctacagcgctagcatttcatctaactactcgcggaggggaaccgcacatgatagtttccaaacaagaacggggaaaatcattattattcaaaacaagtgcaggagtaaacatgtgtacattaatagcaatggacttaggggaactatgtgaagacaccatgacttataaatgcccacgtataaccgaggcggagccggacgatgtcgattgctggtgcaacgcaactgatacgtgggtgacttacggaacatgttcacaaacaggagagcatagaagggataaaagaagcgtcgcactcgctccccatgtagggctaggcctagaaacaagaacagaaacatggatgagctcagaaggtgcgtggaaacagatacaacgagtagagacttgggcactacgacatcccggattcacagtgatagcactatttttggcacacgcaattggtacttccattacgcaaaaaggtatcatatttatattacttatgttggtaacaccgagcatggcaatgagatgtgtaggtattggaaaccgtgactttgtagaaggactaagcggagcaacctgggtggatgtggtattagaacacggtagctgcgtaacaacaatggccaaaaataaaccaactctagatattgaactcttgaaaacagaagtaacaaatcctgctgttttgagaaaattatgtatagaagcaaaaatctctaacaccactacagattcccgttgtccaacgcaaggggaagcgactttggtagaagaacaagatgcaaattttgtgtgtagaagaaccttcgttgatcgtggatgggggaatggctgtggtttgtttggcaaagggtcgttattgacgtgtgcaaaatttaaatgtgttacaaaactagaaggaaaaatagtccaatacgaaaatttgaaatattcggttatagtaacagttcatacaggcgaccaacaccaagttggaaatgaaacgaccgaacacggaacaattgcgacgattacgccacaagcacccacctccgagatccagttaacagactacggtgcactcacgctagactgctcgccacgtactggtttagattttaatgaaatggtattgctaacaatgaaagaaaaatcttggttagttcataaacaatggtttctagatttaccattgccctggacctctggtgcttccacctcacaggaaacctggaatcgacaggatctcctagtgacatttaaaacagcacatgccaagaaacaggaagttgtagtactaggatcgcaagaaggagcgatgcatacggcattaacaggagcaacagaaattcaaacctctggcactacaacgatattcgcaggccacctaaaatgtaggttaaaaatggataaactcaccctcaaaggcatgagttatgtcatgtgtactggttcattcaaacttgaaaaagaggttgcggaaacacaacatggaactgtattggtacaagtcaaatatgagggtacagacgcaccttgtaaaataccattttctacgcaagacgaaaaaggggtcacacaaaacgggcgtttaatcacagctaaccctatagtgactgacaaagaaaaaccggtgaatatagagacggaacccccatttggagaaagctatatagttgtgggtgcgggagagaaggcattaaaactatcttggttcaagaaaggttccagtattggcaaaatgtttgaagccacggcccgaggcgctagacgtatggcgatcttgggagatacagcatgggattttggtagcattggtggagtctttaccagtgtaggtaaattggtgcaccaagtttttggaacagcctacggcgtcctattttctggagtaagttggacaatgaaaataggtataggtatcttgcttacctggttgggcctaaactcgagatcaacgagtctatcgatgacatgcatagctgtaggtatggttaccttgtacctcggggtgatggtgcaagcagattcaggctgcgtgataaattggaaaggaagagagttaaaatgtggatcaggtatttttgtgactaatgaggtacatacatggaccgagcaatataaatttcaagccgactcaccgaaaagactatcagctgcaattggaaaagcatgggaagagggtgtatgcggaattagaagtgcaacccggctggaaaatatcatgtggaaacaaatctccaacgaacttaatcatatactattagagaatgacatgaagttcacagtagtagtgggggatgctaatggcattctggcacaaggcaagaaaatgataaggccacaacctatggaacataaatattcatggaaaagctggggaaaagcaaagattataggagctgatatacaaaatactacatttatcatagacggacccgatacaccggaatgccccgacggccaaagagcttggaatatatgggaagtagaagattacgggttcggaatattcacaacaaacatatggctaaagctaagagattcatacacacaaatgtgtgatcacagactaatgtcagccgcaattaaagacagtaaagctgtccatgctgacatgggctattggatagaatctgagaaaaatgaaacatggaaacttgctagagccagctttatagaagttaaaacatgtacatggccaaaatcacacacactttggagcaacggcgttctcgaaagcgaaatgatcatcccaaaaatatatggaggtccaatttcacaacataattatagaccaggttattttacacaaaccgccggaccatggcatttagggaagttagagctagacttcgatttatgcgagggtacaaccgtagtagtcgatgagcattgtgggaaccgcggtccgagtttaagaacaactacggtgacgggaaagattatacacgaatggtgctgcaggtcatgcacactgccaccgttacgattcagaggagaagacggctgctggtatggcatggaaatacgacctgtgaaagaaaaagaagagaacctggttaggagcatggtaagtgctggaagtggagaagtagattcattcagtctaggtatactatgcgtaagtatcatgattgaagaagtcatgaggtccagatggagcagaaaaatgttaatgacgggaactctagccgtcttccttctgcttattatgggacaattaacatggaatgacctaatacggctttgcatcatggtgggagcaaatgcgagcgatagaatgggaatgggaacaacatacttagccttaatggctacattcaaaatgcgtcctatgttcgccgtaggcttattattcagaagattaacatcaagggaagtattactactgactataggtctatccctggttgcctccgtggaactaccaaattccctagaagaactcggtgacggtctcgctatggggattatgatgctaaagttacttaccgaatttcaacctcatcaactatggacaacactcctctctctgacatttgtaaaaacaactctctctttagattatgcgtggaagacaacagcgatggtactatcgatagtatcactcttcccactatgtttaagcactacgagccagaaaactacctggcttccagttctgcttggatccttcggatgtaagcctttaactatgtttttgattaccgaaaataagatatggggccggaaatcatggccattgaatgaaggtattatggcgatagggattgtatctatacttcttagttctctgttaaagaatgatgtacccttggccggtccattaatagcgggtggaatgttaatagcatgttatgttataagcgggtcatctgcagacttaagtctagaaaaagcagcagaagtgtcttgggaacaagaagcagaacatagtggagcatcacacaacatacttgttgaagtgcaagacgatggaacgatgaaaataaaagatgaggaacgagacgacaccttaactatcctactaaaggccacgcttttggcagtatctggcgtttatccgatgtctatcccagcaacgttatttgtgtggtacttttggcagaagaagaaacagagaagtggtgtcctatgggatacaccgtcgccaccagaagtggaacgagcggtcttggacgacggtatatatcgcatattacagagagggctgttgggccgatcacaagtaggagtgggagtattccaagatggagtttttcacacaatgtggcatgttacgagaggtgcagtattgatgtatcaaggcaaaagactagaaccatcttgggcaagtgtgaaaaaggatttaataagctacggcggagggtggcgttttcaagggagctggaatactggggaagaagtccaggtcatcgcagttgagccaggcaaaaatcccaaaaatgtacaaacaacacctggaacttttaaaactccggagggcgaagtaggagcaatagcactagattttaaacccggtacctcaggctcacctatagttaatagagaaggtaaaatagttggactttatggaaacggtgtagttactaccagtgggacatatgtcagcgcaattgctcaggctagagcttcacaagagggacccctaccagaaatcgaagatgaagtgtttaagaaaagaaatttgacgataatggatcttcatccaggctctgggaaaacaagaagatatttaccagcgattgttcgtgaagcaattaagagaaaattaagaactctgattctcgcacccacaagggtcgtcgcatcagaaatggcagaggcactaaaaggaatgccgataagatatcaaaccactgctgtgaaatccgaacacacaggcagagagatcgtagatcttatgtgtcacgctacatttactatgagactcttatctcctgtgagagtaccgaattataatatgataataatggacgaggctcacttcactgatcccgcaagtatagcggcacgtggatatatctctacgagagtaggaatgggagaagcggccgccatatttatgaccgccacaccacccgggagcgttgaagcgttcccccaaagcaacgctgtgatacaggatgaagaaagagatattcccgagagaagttggaatagtggttacgactggataactgattttcctggaaaaaccgtatggtttgtacctagtatcaaatcagggaatgatattgcaaattgcttgagaaagaacggcaaaagggtaatacaactaagccgaaagacattcgatactgaatatcagaaaactaaaaataatgactgggattatgttgtaaccacagacatatctgaaatgggcgcaaattttcgtgccgaccgtgttatagacccaagaagatgcctaaaacctgtaatactaaaagacggaccagagagggtgatcttggcaggcccaatgcccgtcacagtcgcttccgcggctcagaggcgtggacgaattggacgtaaccagaataaagaaggtgatcaatatgtatatatgggtcaaccattaaacaatgacgaagaccatgcacactggactgaggccaaaatgttattagacaatataaatacaccagaaggcatcatcccagcattattcgagcccgaaagagaaaagtctgctgctattgatggcgaatataggctaaggggcgaagcccgtaaaacattcgtagaattaatgagacgcggcgatctaccggtgtggctaagctacaaagtagcgtctgaaggatttcaatacagcgatcgtaggtggtgtttcgacggggaaagaaacaatcaagtacttgaagaaaatatggatgtggagatatggacaaaagaaggggagaggaagaaattacgtccaagatggctcgacgcacgtacatatagcgatccgctggccttgagagaatttaaagaatttgctgccggacgccgttcggttagcggggatttaattcttgaaatcggaaagctaccacaacacttaaccctcagggcacagaacgccttggacaatcttgtcatgctgcataacagtgagcagggaggcaaagcatatcgccatgcgatggaagaacttcccgacacaattgaaactcttatgctactagctttaatagcagtactaacgggaggcgttacgttgtttttcctaagtggaaaaggattaggaaagacctcaataggtctcctatgcgtaaccgcgtcttctgctttgctatggatggcaagtgttgaaccgcactggatcgcggcttccataatacttgagttctttctaatggtcctcctaatcccggaaccagaccgtcagagaacaccacaagacaatcaattagcctatgtcgtcattggccttttgtttatgattctcactgtagctgctaacgaaatggggctcttagaaacgacgaagaaagacctcggtattggatatgtggccgctgagaatcaccaacacgcaactatgctagatgtagacttaagaccagcaagcgcgtggaccttgtacgcggtagcgaccacagttattacgccaatgatgcgacacaccatagaaaatacaaccgcaaacattagcctaacagccattgcaaaccaggccgcaatattaatgggactggataaaggatggccaattagtaaaatggatattggtgtacctttattggcgctaggctgttatagtcaagtaaaccccttaacattgacagctgctgtactaatgcttgtggcacactacgcaataataggaccaggcctccaagcaaaagcaacacgtgaggcgcaaaagcgaaccgcggcaggaataatgaaaaatccaaccgtagacggcattgttgccattgatctcgatcctgtcgtctatgacgctaaatttgaaaaacaactcggacaaattatgttactcatattatgcacaagtcagatcctcctcatgcgaactacatgggcattatgtgaatctataacattggctacagggccactcacaaccttatgggaaggtagccctggaaaattttggaatacaacaattgcagtatccatggcaaacatatttaggggctcgtacttagctggcgctggtcttgcgtttagtcttatgaaatcattgggtggtggcagaaggggcacaggcgctcaaggagaaacattaggagaaaagtggaaacggcaactcaaccaactaagtaaatcagagttcaacacctacaaacggtctggcataatggaagtggatcgaagcgaagcgaaggaaggtcttaaacgaggtgaaacaacgaagcacgcggttagtagaggtacggcgaaactacgatggtttgtggaacgaaatctagtaaaacctgaaggcaaagttatagacttaggatgtggacgaggcggatggtcgtactactgtgcaggccttaagaaagtgactgaagtaaagggatacacaaaaggaggacctggccacgaagaaccaatccccatggccacttacggctggaacctcgtgaaattgcattcgggtaaagatgtattctttatgcccccagaaaaatgcgatacactactatgtgacataggagaatcctcccccaatccgacaatagaagaagggcgcacgctaagagtattaaagatggttgaaccttggctgaaaggaaatcaattctgtataaaaattttaaatccatacatgccctccgtcgtggaaaccctagaacaaatgcagaggaaacatgggggtatgcttgtacgcaacccattaagtagaaattccacacacgaaatgtattgggtatcgtgcggcacagggaacatcgtttcggccgttaatatgacatcaagaatgctgctcaaccgatttacaatggctcatagaaaaccaacgtatgaaagggacgtagatttaggtgcaggaacaagacatgtggcagttgaacctgaagtggccaatctggatataataggacaaagaattgaaaacattaagaatgaacacaagtcaacatggcattacgatgaagacaacccttacaagacttgggcatatcacggaagttacgaagttaaaccatccgggagcgcatctagtatggtaaacggcgtagtgagactccttacaaaaccatgggatgtaattcctatggtaacccagatagcaatgaccgatacaacaccattcggacaacagagagttttcaaggaaaaagtagacacaagaactcctcgagcaaaaaggggtactacgcaaatcatggaagtaacagccaggtggctttgggggtttttgtcaagaaacaagaaaccacgcatctgtacccgcgaagaatttacacgaaaagtacgaagcaacgccgcgataggagcggtattcgttgatgagaaccagtggaactctgcaaaagaagcggtagaggatgaacgtttctgggatctagtacatagagaaagagaattacataaacaggggaagtgcgcaacctgcgtatataacatgatgggaaaaagagagaagaaactaggagaatttggtaaagccaagggctcacgtgcgatctggtacatgtggcttggagctcggttcttagaatttgaagcactcggttttatgaatgaggaccactggttcagtcgtgaaaattcgctttcaggtgtagaaggagaaggtttacataaattaggctacatcttacgggacatttcaaaaattccaggaggcaatatgtatgctgatgacacagctgggtgggacaccagaataacagaagacgacttgcaaaacgaggccaagataacagacataatggaaccagaacacgcactgttggccacatcaatatttaagctaacttatcagaacaaggtagtacgagtacagcgccccgccaaaaacggaacggttatggatgtaatttcgcgaagagatcaaagaggcagcggacaagtaggtacatacggcctcaatacattcacaaacatggaagtacagcttatccgacaaatggaatcagaagggattttctcaccgtcagagttagaaacaccgaacttagccgaacgcgtattggattggttagaaaagcacggtgcagaacgtctaaagcgcatggcaatatcgggagatgattgtgttgtaaagccaatagatgaccgctttgctactgctttgactgcgctcaatgatatgggcaaagtccgaaaagacattccccaatgggagcccagcaaagggtggaatgattggcagcaagtcccgttctgcagccatcacttccaccaactaataatgaaggatggcagagaaatagtagtaccttgtcgcaatcaggacgaattggtcggccgagctagagtttcgcaaggagctggctggagtttaagagaaacggcttgtctaggaaaatcgtatgcacaaatgtggcaattaatgtatttccaccgtcgagacttgagattagcagcaaatgcaatatgcagcgccgtaccggtcgattgggtacccacttctagaacaacctggagcatacatgctcatcaccaatggatgacaacggaagatatgttaagtgtgtggaatcgtgtctggatcgaagaaaatccatggatggaggataaaacacacgtctcaagttgggaagaagttccgtacttaggaaaacgtgaagaccaatggtgcggatcgcttatcggccttacagcaagagcaacgtgggctaccaacatacaggtagcaataaatcaagtaagaagattaatcggtaacgaaaactatcttgactatatgacaagcatgaaaagatttaaaaatgagtcagacccagaaggagcactatggtag

SEQ ID NO: 21401 - RNA, 9879 nt, synthetic construct
  misc_feature 1..9879: note = derived and/or modified CDS sequence (opt6) from DENV-1__EU482610__SS-prME
  source 1..9879: mol_type = other RNA
tcagtaactatgctacttatgcttcttccaaccgctctggcttttcatctgaccacgaggggaggagaaccacatatgatagtaagtaaacaagaacggggaaaaagtttactcttcaaaacttctgccggtgtgaatatgtgtactctcatagctatggacttgggagaattatgtgaagatacgatgacttataaatgtccacgaataactgaagctgaaccagatgacgtagattgttggtgcaatgcaaccgacacttgggtaacctatggaacttgttcacaaactggagagcatagacgcgagaaaaggtccgtagcacttgcaccgcacgttggtctaggacttgaaacaagaactgagacatggatgagctcggaaggtgcatggaaacaaattcaacgagtagaaacatgggtattacgacatccgggttttaccgtcatagcatttttcctggcgcacgcaataggaacaagtattactcaaaaaggaataatctttatactactaatgctcgtaacaccatcaatggcaatgcgatgtgtaggcatcgggaacagagatttcgtagaaggcctgagtggggctacttgggttgacgtagtactggaacatggttcctgcgtaacaactatggccaaaaataaaccaaccttggacattgaattactcaaaacggaagtaactaaccccgctgtcttaaggaaactctgcatagaagcaaaaataagtaatacgacaacagattcacgatgcccaactcaaggcgaagcaacactggtggaggaacaagatgcaaacttcgtttgcaggcgtacattcgtggatagaggttgggggaacggatgcgggctatttggcaaaggcagcctgctcacatgtgcaaaattcaaatgcgtaacaaagctagaaggaaaaattgtgcaatacgaaaatcttaaatatagtgtaatagttacggtccacactggagatcaacatcaagttggaaatgagacaaccgagcatggaacgatagctacaataacacctcaagcgccaacaagtgaaatacagttgactgactatggagcattgacattggactgtagtccaagaacaggactagactttaatgaaatggttcttttaactatgaaagagaaatcctggctagtacacaaacaatggtttctcgacttgcctctcccatggacaagtggggcttccaccagccaagagacttggaacaggcaagatttattagtaacctttaaaactgctcacgccaagaaacaagaggtcgtagttttaggaagtcaggagggtgcaatgcatactgcactgactggggctacagagatacaaacaagtggtacaacaacaatttttgctggccatctgaaatgcagacttaaaatggataaactaacacttaaaggtatgtcttatgtgatgtgtacgggatcgtttaaattagaaaaagaggtagcggaaacccaacacgggacagtactggtgcaagtaaaatacgaaggaacagacgcaccatgcaaaattccgttttcaacgcaagacgaaaaaggcgtaacacaaaacggtcgactgattacagcaaatcccattgtcaccgataaagagaaaccagttaatatcgaaacggagcctccattcggagaatcttatatagtagtaggagcaggggaaaaagcgctgaaattgtcatggttcaaaagaggcagttccattggtaaaatgtttgaggccacagcaaggggtgcaagaagaatggcaatcttaggggatacagcatgggattttggttcaattggtggagtattcacaagtgttggaaaacttgttcaccaagtatttggaaccgcttatggtgtgctattctcaggtgttagctggaccatgaaaattggaattggcattctccttacatggctcggactgaatagtcgtagtacatccttgtcgatgacatgcatagcggttggaatggttacactttatttgggagtaatggttcaagcagattcaggatgtgtcatcaattggaaaggacgagaactaaaatgtggaagcggaatcttcgtaactaacgaagtccacacttggacagaacaatataagtttcaagctgattcaccgaaaagattatcggcggcaatcggaaaggcttgggaggagggcgtgtgtggaatcagatcagcaacaagacttgaaaacattatgtggaagcagatatcaaacgaattaaatcacatacttttggagaacgatatgaaattgacagtggtagtgggtgatgcaaacgggatattagcacaaggcaagaaaatgatccgaccacaaccaatggaacacaaatactcttggaaaagctggggtaaggcgaaaataatcggcgcagacatccaaaacacaactttcataatagatggtccagatactcccgaatgtccagacgggcagcgagcctggaacatttgggaagttgaagattatggcttcggagtgttcactacaaacatttggttaaagttaagggattcttatactcaaatgtgcgaccaccgtctaatgagtgcagcaataaaagatagtaaagcagtacacgcagatatgggctactggatagaatccgagaaaaatgaaacctggaagttagcacgtgcaagtttcatcgaagtaaaaacgtgtacatggccaaaatcccataccctctggtctaacggagtactagagtctgagatgattataccaaaaatttatggaggaccaatttctcaacacaattaccgtcctggttactttacccaaactgctggaccgtggcaccttggaaaattggagttagactttgacttgtgtgaagggacgacagtcgtagtggacgaacattgtggaaacagaggcccaagcctcagaaccacgacagttacgggtaaaataatacacgaatggtgctgcagatcatgtactcttccaccattaaggttcagaggcgaagatggttgctggtatgggatggaaataagaccagttaaagaaaaggaagaaaacctcgtacgatccatggttagtgcgggatcgggggaagtagatagcttttccttagggatcctatgcgtctctataatgattgaagaggtaatgcgatctcgatggtctcgaaaaatgttgatgacaggtactttggcggtgttcctcctgttaataatgggccaattaacgtggaatgacctcatacgactctgcattatggtcggagcgaatgcttcagatagaatgggaatgggaacgacatacctcgccctaatggctacatttaaaatgcggccaatgtttgcagttggtcttctttttcgtcgccttacaagcagggaagtacttttgttaacgataggactctcactggtagcttcagttgaattacctaactccctagaagaactcggagatggccttgccatgggaataatgatgcttaaactattgactgaatttcaaccccatcaattgtggaccacactattatctttgacatttgtaaagacaacccttagcttagattacgcttggaaaacaaccgcaatggtactctctatcgtatctctttttccgctatgtttatcaacgacatcgcaaaagaccacatggttgccagtactcctaggcagctttgggtgtaagccacttactatgtttttaataacagaaaacaaaatttggggacgtaaatcatggccgctcaatgaaggaattatggcgatcgggattgtatccatattactttcgtctcttctgaaaaatgatgtccctctagctggacccttaatcgctggtggaatgttgatagcctgttacgtgatttctgggagttctgctgatctttccttggaaaaagcagcagaagtgtcatgggaacaagaagccgaacattcgggggctagccataacatattagtggaagtacaagatgacggaacaatgaaaataaaagacgaagaacgagacgacaccctaactatactactcaaagcgactttactggcagtctcgggagtgtatcccatgtctattccagcaactttatttgtttggtacttttggcagaagaagaaacaaagaagcggagttttgtgggataccccatcaccaccggaagttgagcgagcagtattggacgatggaatatacaggattctacagagaggcctgctaggacgttcacaagtaggagttggcgtatttcaggatggcgtgtttcacacaatgtggcatgttacgagaggggctgtactaatgtaccaaggaaaaagactagaaccatcgtgggcatcagtcaagaaagatctaatttcatatggaggtggttggagatttcagggtagttggaatactggggaagaggttcaagttatagcagtggaacctggaaagaatcctaagaatgtacaaaccactccaggaactttcaagactccagaaggagaagtaggagcaatcgcattggattttaaacctggtaccagtggaagcccaatagtaaatcgtgaaggaaagattgtaggattatacggaaacggggttgtcacaacaagtggtacctatgtatcggcaatcgcacaagcaaaagcatctcaggaaggacccttacccgaaatagaagatgaggtttttaagaaacgtaacctcaccataatggatctccatccaggcagcggaaaaacaagacgttacctccctgcaatagtacgtgaagcaattaagcgaaaactacgaaccttaattctcgcaccgacgcgcgttgtagcaagtgaaatggctgaggctctcaagggaatgcctattagataccagactacagccgtaaaatcagaacacacgggacgagaaatagttgatctgatgtgccacgctacctttacaatgcgattgttgtcaccagtaagagtacctaactataatatgatcattatggacgaagcacactttacagatccagcgagtatagctgcccgaggttatatatcaacaagggtggggatgggcgaagcagctgcgatatttatgacagctacacccccaggatctgttgaagcatttccgcaatcaaatgctgttatacaagatgaagaaagagacatccccgaacgatcgtggaatagtggatatgattggataactgatttccccggaaaaactgtttggtttgtgccgtcaataaaatccggtaatgacatagctaattgtctaaggaaaaatggcaaacgtgtcatacagttatcaagaaaaacatttgatacagaataccagaaaacgaaaaacaacgattgggattatgtggtaacaactgatatttcagagatgggagcaaattttcgagctgatagagtaatagatcccagacgttgccttaagccagtaatattaaaagatggtcctgaacgcgtcattctcgcaggaccaatgcccgtaacggtagcctcagctgcgcaaagacgaggcagaattggtaggaaccagaataaggaaggggatcagtacgtctacatgggacaaccattaaataacgatgaagatcatgcccactggaccgaagcgaagatgctattggataatattaacacgcccgaaggtataattccagcgttgtttgaacccgaacgagagaaaagtgccgcgatagatggagagtatcgtctacgaggagaagcacgtaaaacatttgtagaattaatgcgaagaggtgatttaccggtatggttgagctacaaagttgcatcggagggattccaatactctgatagaaggtggtgtttcgatggtgaaagaaacaatcaagtattagaagaaaatatggatgtagagatttggacaaaagagggcgagcgaaagaaattgaggccaaggtggttggatgcaaggacctattctgacccactagctttacgtgaatttaaagaatttgcggccgggagacggtccgtaagtggtgatctcatactagaaataggaaaattgccccaacacctcacgctaagagcgcagaatgctctagataatctagtcatgctccacaacagtgaacaagggggcaaagcgtacagacatgcaatggaggaactgccagatacgatagagacgttaatgttactggctttgatagcggttcttaccgggggagttacactatttttcctgtctggaaaaggattggggaaaacaagtatagggttactttgcgtgacagcctctagcgcactcttgtggatggctagtgttgagccacattggatagccgcgagcataatattagagttctttttaatggtacttctaattccagaaccagatagacaaagaacaccacaagataaccagttagcctatgtcgttataggtctcctgttcatgattttaacggtcgcagcaaatgaaatgggtctgctagaaacaactaagaaagatctagggattggttatgtagccgccgaaaaccaccaacacgcaaccatgttagacgtcgacttacatcccgcatccgcatggacgctttatgctgtagcgactacggtaatcacaccaatgatgagacacactatcgagaacacaactgcgaacatatcactcacagccatagcgaatcaagcggcaatactgatgggactagataaaggatggccaatatcgaaaatggacatcggagtaccactattggcattaggatgttattctcaagtaaatcctttaaccttaactgctgctgttcttatgctggttgctcattatgcaatcataggaccaggcctacaagccaaagccacacgcgaggctcaaaaacgcacagcagcagggataatgaaaaatccaacagtcgacggcatagtagcgatcgacctagatcctgtagtatatgacgccaagttcgaaaaacaactgggacagataatgttactaattctatgtacatcccaaattttacttatgcgaacaacttgggcattatgcgaatcaatcacactagctaccggccctctaacaacattatgggaaggttcaccagggaaattctggaacacaacaatagctgtctcaatggctaacatattcagaggtagttatttagccggagcaggactggcttttagcctgatgaagtccttaggaggaggacgaagaggaacgggtgctcaaggcgaaacgttaggagaaaaatggaaacgtcagctcaatcaactttcgaaaagcgagttcaatacttataaacggtcagggattatggaagtggacaggtccgaagctaaagaagggcttaagagaggagaaacaaccaaacacgcggtgtcccgaggaacagccaaactaagatggttcgtggaaagaaacttggtcaaaccagaggggaaagtgattgatttaggatgtgggagagggggatggagttattattgcgcgggactcaagaaagtaacagaagttaaaggttacacaaaagggggtccaggccatgaagaacctattccaatggcaacttatggatggaatttagtaaaactacactcaggaaaagatgtattctttatgcctccagaaaagtgtgatactttattatgcgatattggagaaagcagtccaaatccaacaatagaggagggtcgaaccttaagagtgctaaagatggtggaaccgtggttacgcggaaaccaattttgtattaagatattaaatccctacatgccaagcgtagtagaaactctggaacaaatgcaaagaaaacatggaggaatgttagtacgaaatcccttaagtaggaactcgacacatgaaatgtattgggtcagctgcggaacaggaaatatagtatctgcagttaatatgacaagtaggatgctattaaacagatttactatggcgcaccgaaaaccaacatatgaaagagacgtagacctgggagcaggaacaaggcacgtagctgttgagcctgaagtcgcaaatcttgatataattggccaaaggatcgagaacatcaaaaatgaacacaaaagcacctggcactacgatgaagataacccgtataaaacatgggcatatcatggaagctacgaagtgaagccttcgggaagtgcgagttctatggttaacggcgtggtccgactactaactaaaccatgggatgtaataccgatggtaacccaaatagccatgaccgacactacacccttcggacaacaaagggtcttcaaagaaaaagtcgataccaggacccctcgtgcaaaaagaggcacgacacagatcatggaagtcacagctaaatggttatggggatttttatcaaggaataagaaaccgcgcatatgtactagagaagagtttacgcggaaagtgcgatcaaatgctgcaattggtgcggtttttgtcgatgagaatcagtggaatagcgcaaaagaagcagtggaagatgagagattttgggatctcgttcatcgggaacgagagttacacaaacagggtaaatgtgcaacatgtgtatataatatgatgggtaaacgagagaagaaactcggggaatttggcaaagctaaagggagtagggcgatttggtacatgtggctaggagccaggttcttagagttcgaagcattgggctttatgaatgaggatcattggtttagcagagaaaactctttgtcaggagtcgaaggggaaggattacacaaactcggctacatattaagggatataagtaaaataccaggcggtaacatgtacgcagacgatactgcgggatgggacacgcggattaccgaagacgatctacaaaatgaggcgaaaataaccgacatcatggagccagaacatgcacttctagctacgtcaatatttaagttaacttaccaaaacaaagtagtaagagtccaacgacccgccaaaaacgggacagtcatggacgtcatcagtagacgagatcagagagggtcgggccaagtagggacttacggactgaatacatttacgaatatggaagtacaacttatccggcaaatggaaagtgagggaatctttcttccctctgagctcgagacgccaaacctggcagaaagagcattagactggctggaaaaacacggagcagagcggcttaaacgaatggcaatttctggcgatgactgtgtagtaaaaccgatagacgacagatttgccactgcattaacagccctcaacgacatgggaaaggtcaggaaggatatcccacaatgggaaccgagtaaaggttggaatgattggcaacaagtacctttttgttcacatcattttcatcagctgataatgaaagatggaagagaaatagtagtgccgtgcagaaatcaagatgaactggttggtcgtgccagagtttcgcaaggcgctgggtggagtttacgggagaccgcttgccttggcaaaagttatgctcaaatgtggcagttaatgtatttccaccgccgagatctacgattggctgcaaacgcaatctgctcagcggtcccagtagattgggtaccaacaagtcgaacaacatggtctatccatgcgcatcaccaatggatgacaacagaagatatgctgtccgtatggaatagagtgtggatagaggaaaacccatggatggaagacaaaacacacgtgagtagctgggaagaagtgccatatttaggtaaaagggaagatcaatggtgtgggagtttaatcggcctcacagctcgagccacctgggcaactaacatccaggtagccattaaccaagtaagacgattaattggaaatgagaattacttagactatatgacatccatgaagagatttaaaaatgaatctgatcccgaaggtgctctatggtaa

SEQ ID NO: 21402 - RNA, 9879 nt, synthetic construct
  misc_feature 1..9879: note = derived and/or modified CDS sequence (opt6) from DENV-1__EU482611__SS-prME
  source 1..9879: mol_type = other RNA
agcgtaaccatgttattaatgttattaccaaccgcattggcatttcacttaaccactagaggaggagaaccacatatgatagtttctaagcaagaaagaggaaaaagcctattatttaaaacaagcgctggggtcaatatgtgcacattgattgcgatggacttaggcgaactctgcgaagatactatgacatacaaatgtccgagaataacagaagcagaaccagacgatgtggattgttggtgtaacgccacagacacatgggtaacatacggaacatgctcacaaacaggcgaacatcgacgagaaaaacggtcagtagcactagcaccacatgtcgggcttggcctcgaaactagaacggaaacctggatgtcatctgaaggcgcttggaaacaaatacagcgagtagaaacatgggctttaagacatcccggatttacagtaattgcgttctttcttgcacacgcaataggaacgtctataactcaaaaaggcataatatttatcctcctaatgctagttacaccaagtatggcaatgagatgtgttggcatcggaaatagagattttgtggaagggctaagcggggctacttgggtagacgtagtgttagaacacggtagttgtgttactactatggccaaaaataaacccactctagacatcgaattattgaaaactgaagtgacaaatcctgcggttctccgtaaactttgtattgaagcaaaaatatctaacaccaccactgacagtaggtgtccaacgcagggagaagctacactggttgaagaacaagatgcaaactttgtgtgtagaagaacattcgtggatagaggatggggcaatggatgcggactattcggaaaaggaagtctcttaacatgcgcaaagttcaagtgtgtaactaaattagaaggaaagatagttcaatacgaaaatctgaagtattcagtaatcgtcacagtacatacgggagaccaacatcaagtagggaacgagaccacagaacatggtacgatagcaacaataaccccacaagcccccaccagtgaaattcaactaacagactatggagccttgactcttgactgttcgccacgaacaggcctagatttcaatgaaatggttttacttacaatgaaagagaaaagctggctagtgcacaaacaatggtttctagatttaccactaccatggacatcgggagcttcaacaagccaggaaacttggaaccgccaggatctattagtgacgtttaaaacggcacatgccaagaaacaagaagtggtagtcctgggtagccaagaaggcgctatgcacacggcactcacgggcgcaacggagatacagacatcgggaacgaccacaattttcgcgggtcatctaaaatgccgattaaaaatggacaaactgaccctaaagggtatgtcgtatgttatgtgtaccggttcattcaagctcgagaaagaagttgcagagacccaacacggtacagttttagttcaggtaaaatatgaaggaaccgacgcgccatgcaagatccctttttcaacgcaggacgaaaaaggtgttacacaaaacggcagactaattaccgccaatcccatagtaaccgataaagaaaaaccagtcaatattgagaccgagccgccattcggggaatcatatattgtcgtgggagccggtgagaaagcactaaagctctcgtggtttaaacgagggtcatcaattggaaaaatgtttgaagcaacagcaaggggagcgcgacgaatggcaatattgggagacacagcatgggatttcggttcaataggcggcgtttttacgagtgtaggcaaattagttcatcaagtatttggtacagcctatggggtcctattttctggtgtctcatggactatgaaaataggaataggaatcttactaacctggcttggtctcaattcaagatcaacatccttgtcgatgacatgcatcgcagtgggcatggttacgctatacctaggagtaatggtccaagccgactcaggatgcgtaataaattggaagggacgagaacttaaatgtgggagcggtatttttgtcactaacgaagtacacacctggactgagcagtacaaatttcaagccgattccccaaaacggttatcagccgctataggaaaagcatgggaggaaggagtttgtgggatacgttcggctacaagattagaaaatataatgtggaaacagataagcaatgaattaaatcatatcctactagaaaacgatatgaaactgactgtagtagtaggggatgctaacggtattctggcacagggaaagaaaatgataagacctcagcctatggagcataagtattcatggaaatcgtggggaaaagccaaaattattggagcggatatccaaaacacaactttcataatcgacggtccagatactccagaatgcccagacggacaaagagcctggaatatttgggaagttgaagattatggtttcggggtatttacaaccaacatctggctaaaattacgagattcatatacacaaatgtgtgatcacagattaatgtctgctgctatcaaagacagtaaggcggtacacgcagacatgggatattggattgaaagcgaaaagaatgaaacgtggaaactcgctagagcatcattcatagaagtaaagacttgcacatggccaaagtctcatactctatggagtaatggcgtcttagagtctgaaatgataataccaaagatctatggcggccccatatcacagcacaattatcgaccaggctactttacacaaaccgctggtccctggcatttgggaaaattagagttagatttcgacctgtgtgaaggaacaacggtagtagtcgatgaacattgtggaaatcgaggtccatctctccgcacaacaaccgtaactggcaaaatcatacatgagtggtgctgcagaagttgtacactaccgcctctcagatttagaggtgaagatggatgttggtacggaatggaaataagaccggtaaaagagaaagaagaaaatctggtcagaagtatggtatccgccggaagcggagaagtagatagttttagtttaggtattctttgtgtaagcattatgatagaggaagtaatgagatcccgatggagtcgaaagatgctaatgacgggaacactagcagtgttcctattgttaattatgggtcaattgacatggaacgacctaatccgactgtgcataatggtaggtgcaaatgcaagtgaccgtatgggtatgggtacaacgtatttggcattgatggctacatttaagatgcgacctatgtttgccgtaggactcttattcaggcgcttaacttcacgcgaagtacttttgcttacaataggtcttagcttggtggcaagtgttgagctaccaaattctctcgaagaattaggagatggactagcgatgggcattatgatgctaaagctcctaacagaatttcaaccacaccagctgtggacaacactcttatcactaactttcgtcaaaaccacattaagcctagattatgcatggaaaacgacagctatggtattaagtatagtgtcattattcccgttgtgtttatcaacaacgagccagaaaactacctggcttccagtattactcggatcattcgggtgtaaacctctaactatgtttttgataacagaaaacaagatatggggtagaaaatcgtggcctctaaatgagggcataatggcgataggaattgttagtatattgttatccagtttgctcaaaaatgatgtaccgttagccggtccattaatagctggaggtatgttgatagcatgctacgtcatatcagggtcatccgctgatttatctctcgagaaagcggccgaagtaagttgggaacaagaagctgaacacagtggcgcatcgcataacattctagtagaagtgcaagacgacggaacgatgaaaataaaagatgaagaaagagatgatacactaacaattttactaaaagccacactactcgctgtatcgggcgtatatcctatgtctatcccagccacactattcgtatggtatttttggcagaaaaagaaacagagaagtggggttctatgggacaccccaagtcccccagaagttgagcgtgctgtactagatgatggaatatataggattctgcagagggggttattaggtagatcccaagttggtgtgggagtatttcaagacggggtatttcatactatgtggcatgtcacacggggtgcggtgctgatgtaccaggggaaacgtttagaaccatcctgggcatcagtaaagaaggatttaatatcctacggcggaggatggaggtttcagggatcctggaatacaggtgaagaagtccaggtaattgccgtagaaccaggtaagaaccccaaaaacgttcagacaacaccgggaacatttaaaactcctgaaggtgaagtaggtgccattgctcttgacttcaaacctggtacaagcggtagtcccatagttaatagagaaggaaagatagtgggtctttatggaaatggggtagtaactacttccggtacttacgtatccgctatcgctcaagcaaaagccagtcaagaaggacctctccctgaaattgaagatgaggtgtttaagaaaagaaacctaaccattatggacttacatccggggtcaggcaaaacaaggcgatacctaccagctatcgttagagaggcaatcaaaagaaaactcagaacgctgatactcgctccaacccgtgttgtagcaagcgaaatggcagaagccctaaaaggaatgccaatacgctatcagacaacggctgtgaaatccgaacatacgggtcgagaaattgttgatttaatgtgccatgctacatttacgatgagactattatcaccagtacgcgtgccaaactacaatatgataataatggatgaagcacattttacagatcctgcgagcattgcggcaagggggtatattagtacaagagtagggatgggggaagcagccgcgatcttcatgactgcaacaccaccagggagtgtcgaagccttcccgcagtctaacgctgtgatacaggatgaggagcgcgacataccagaacgtagctggaactcaggatatgactggataacagacttccctggtaaaactgtgtggtttgttccgtcaattaagtcaggtaatgacatagccaactgtttgcgtaaaaacgggaaaagggttatacaattatccagaaaaacattcgatacagaatatcaaaagacgaaaaataatgattgggattatgtcgttacaacggacataagcgaaatgggagccaacttcagagcagatagagtgattgaccctagacgttgtttaaaacctgtaatcttaaaggatgggcccgagcgagttattttagcgggacctatgcccgtcaccgtcgcttctgcagcgcagagaaggggacgaataggacgaaaccaaaataaggaaggagaccagtacgtatacatgggacagcccttaaataacgacgaggaccatgcgcattggacagaggcaaaaatgctattagacaatataaatacaccggaaggaatcataccagctcttttcgagcctgaacgtgagaagtcagcagcaatcgacggcgagtatcgtctaaggggagaagctcgaaaaacatttgttgaactaatgcgaagaggggacttaccagtatggttgtcctataaggtagcttcagaaggattccaatactctgacaggaggtggtgcttcgatggagaaagaaataaccaagtcttagaagaaaatatggatgtagaaatctggactaaagaaggtgaaagaaagaaattacggccacgctggttagacgctagaacatactcagaccctctggcccttcgagagtttaaagagttcgctgctgggcgacgtagcgtatctggtgatttaatcttggagattggtaagttacctcagcatttgaccttacgtgctcaaaacgcattagataatctggttatgctacacaactcagaacaaggagggaaggcatatagacacgcaatggaggaactcccagacacgatagagacattaatgctcctcgcccttattgcggtcctaactggaggagtcactcttttcttccttagtggaaagggactaggcaaaacttccattgggttactttgtgttacagcctcttctgctttattatggatggcaagcgttgaaccacattggattgcagcaagcataatactagagttctttctaatggtactactaattccggaacctgatcgtcaacgaacaccacaggacaaccaactagcgtatgttgtaatcggtctcctattcatgatacttactgtcgcggcgaacgaaatgggtctgctcgaaaccactaagaaagatttaggcatagggtatgtcgcggctgaaaatcatcaacatgctactatgttagatgtagatttacacccggcgtcagcatggacactttatgccgtggctacaacagtaataactcctatgatgagacatacaattgaaaatacgactgcgaatatatccttaactgcaatcgcaaatcaagcagctatactaatgggattggataagggttggcccataagtaaaatggacatcggtgtcccattattagctttaggatgttattctcaggtgaatcctttaactttaacggcagcagtacttatgctagtagcgcactatgcaataattggacctggcctacaagccaaagcgactagagaagctcagaaaaggactgccgccggaataatgaaaaatccgacggtagatggcatagtagcaatagatcttgatccagtagtgtacgatgcaaaatttgagaaacaactgggacaaataatgctgctaattctatgcaccagtcaaattcttttgatgcggacgacatgggcgctatgcgagtctataacccttgcaaccggaccactaactacattgtgggaaggctcacctggtaagttttggaataccacgatagcagtttccatggcaaatatatttcgaggctcctacttagcaggcgctggattagcattttcattaatgaagtcgctaggaggcggtagaagaggaacaggcgcccaaggcgaaacgctaggagagaaatggaaaaggcaactcaatcaattatctaagagtgaatttaacacctacaagcgaagtgggatcatggaagtagacagaagcgaagccaaagaaggactaaaacggggagaaacaaccaagcacgctgtatcccgtggcacagccaaattacggtggttcgtagaaagaaacctggttaagcctgaaggcaaagttattgatcttggttgtggaagaggaggatggagttattattgcgcaggtcttaaaaaggtgaccgaagtaaagggatatacaaagggaggaccaggccacgaagaacctatacctatggctacatatggctggaatttggtaaaactacacagtggtaaagatgtattctttatgccacccgaaaagtgcgataccttactctgtgatataggggaatcctcgccaaatcctacgattgaagaaggccgaacgcttcgtgttcttaaaatggttgaaccatggctacgcgggaatcaattctgcatcaaaatactaaatccttatatgccgtcagtagtagaaacactggaacaaatgcaacggaagcatgggggaatgctagtgcgaaacccactatcaagaaacagcactcacgaaatgtactgggtatcttgtgggactggaaatatcgtatcggctgtcaatatgacctcacgcatgttattgaatagattcactatggcccatagaaagcctacatacgaaagggatgttgatctaggggcaggaacacgacacgtggcggtagaaccggaagttgctaacttagacatcatcggccaaagaattgaaaacatcaaaaacgaacacaagagtacatggcattatgatgaagataatccatataaaacgtgggcctatcacggaagctacgaggtgaaaccatcaggatcagcgtctagcatggtcaacggggtggtgagattactaactaaaccgtgggatgtgattccaatggttacccaaatagccatgacggacactacaccttttgggcaacagagagtgtttaaagagaaggtagacacacggacccctcgagcaaaacgcggaacaactcagattatggaggttacggcaaaatggctgtggggattcctgtcaagaaacaaaaagcctcgtatatgtactagggaggagttcacacgaaaagttcgaagtaacgctgcaataggtgctgtgtttgtggacgaaaatcaatggaactccgcaaaagaagccgttgaggatgaacgattttgggacttagtacatcgagaacgcgaactccataagcaaggaaagtgcgcaacctgtgtatataacatgatgggaaaaagagagaagaaattaggcgagttcgggaaagcaaagggctctcgagcgatatggtatatgtggctcggcgctcgctttctagagttcgaggctttagggttcatgaatgaggaccactggttttcacgcgagaatagtttatctggcgttgaaggtgaaggattgcataaacttggatatattctaagggatatatctaaaatcccgggtggtaacatgtatgccgacgacacagcagggtgggatactagaataactgaggatgatttacaaaatgaagctaagatcactgacataatggaacctgaacacgcacttttagctaccagtatatttaaacttacttatcaaaataaagtagtgcgtgttcaacgacctgcgaagaatgggactgtaatggatgttatttctagacgggatcaaaggggatccggacaagtaggaacttacggccttaatactttcacaaatatggaggttcagctaattagacaaatggaatcagaaggcatatttctcccctcggaattagaaactccaaacttagctgagcgtgctctagactggctagaaaaacatggagccgaacgactgaaaagaatggccatatccggtgatgactgcgtagtcaaaccaatcgatgatcgttttgcaacagcattgaccgcactcaatgatatgggtaaagtgagaaaagacattcctcagtgggaaccaagcaaaggatggaatgactggcaacaagtaccattttgctcacatcacttccatcaactcatcatgaaagacggaagagaaatagtcgtaccctgcaggaatcaagatgaacttgtaggcagagcgcgagtaagccaaggagcgggatggtcgcttcgtgaaaccgcatgtctgggaaaaagttacgcccaaatgtggcagcttatgtactttcatcgcagagatctccgccttgcagctaatgctatttgctcggcagttcctgtagattgggtaccgacaagccgaaccacatggtcaatacatgcccatcaccaatggatgacaactgaagacatgctgtctgtctggaacagagtatggatagaagaaaatccgtggatggaagacaaaacacacgtatcatcttgggaagaagtgccatatctgggaaaaagagaggatcaatggtgtggatcattaataggcctgactgcaagagctacctgggcaacaaacatccaagttgcaattaatcaggtacgtaggttgattggcaacgaaaattatttagattatatgacgtctatgaaacgatttaaaaatgaaagtgaccccgaaggggctctttggtga

SEQ ID NO: 21403 - RNA, 9879 nt, synthetic construct
  misc_feature 1..9879: note = derived and/or modified CDS sequence (opt6) from DENV-1__FJ639735__SS-prME
  source 1..9879: mol_type = other RNA
agcgtgacgatgttattaatgcttttaccaacagccctggcattccatctcacgactcggggaggagaaccacatatgatagtctcaaaacaagaacgaggcaaaagcctactctttaaaacaagtgccggggtcaatatgtgtaccctaattgcaatggatcttggcgaattgtgcgaagacacgatgacttacaaatgccctcgaattactgaagcagaacccgacgatgtagattgctggtgtaatgcaactgatacttgggttacgtatggcacatgctcgcaaacgggtgaacatagacgtgataaacgaagcgttgctttagctcctcacgtaggtcttggattagaaaccagaacggaaacctggatgtcctccgaaggagcatggaaacaaatacaacgggtcgaaacttgggccttgagacatccgggttttacggtaactgctttgttcctggcccatgcaataggtacgtcgattacccaaaaaggaatcatttttattctgctaatgttagtaactccatctatggcaatgaggtgtgtcgggataggaaaccgggactttgtagaaggcttgtcaggggcgacgtgggttgatgtagtactggaacatggttcatgcgtaactactatggcgaaaaataaacccaccctagacattgaactacttaaaacagaagttactaacccagcagtgctcagaaaactttgcattgaagccaaaatatcaaacacgacaaccgatagtcgatgccctacacagggtgaagcgaccttggttgaagaacaggatgcgaacttcgtctgccgtcgtaccttcgtcgaccgaggatggggaaatggctgtggactttttggcaaaggatcattactcacatgtgcaaaattcaaatgtgtgaccaaattggaaggaaaaattgtgcaatatgaaaacctcaaatactcagttatagtcacagtacacacgggagatcaacaccaagttgggaacgaaacaaccgaacacggaacaattgcaacaattaccccacaagctccaacctctgaaattcaactcaccgattatggagctcttacattagactgcagtccgagaactggcttagactttaatgaaatggtcctcctgactatgaaagaaaagtcttggctagttcataaacagtggtttcttgatcttccattaccgtggacatctggagcatctacaagccaagaaacctggaatcggcaggatttattagtaacatttaaaactgctcatgcgaagaaacaggaagttgtggttctaggaagccaagaaggcgccatgcataccgctctaaccggggctaccgaaattcaaacaagtggtacaactacaatttttgctggtcacttaaaatgccggctaaagatggacaaattaacattgaaaggcacgagttacgtcatgtgcacaggcagcttcaaattagaaaaggaagttgctgaaacacagcatggtaccgtgttagtacaagtaaaatacgaaggcacggatgcaccctgtaaaatacccttttcaacacaagatgaaaagggagtaactcaaaatggacgattaatcacagccaacccaattgtaaccgataaagaaaaaccggttaatatagaaacagaaccgccatttggagaatcttatattgttgtcggagcgggtgagaaggctttaaaactctcttggtttaagaaaggttcctccatcgggaagatgttcgaagcaacagctagaggcgctcgccgaatggcaattctgggagacacagcatgggactttggatccataggtggtgtattcacaagtgtcggtaaattagtacatcaagtttttggtacagcgtatggggtcctattctcaggtgtgtcatggacaatgaagattggtattgggatactattaacatggttgggcctaaattccagatccacctctttatccatgacatgcatagccgtaggtatggtaacactatatctaggagttatggtgcaagccgactcaggatgtgtgataaactggaaaggtagagagctgaaatgtggcagcggtatttttgtgacaaatgaagtacacacatggactgagcaatataagtttcaagcggactcgccaaaacgcctaagtgctgctataggtaaggcttgggaagagggagtgtgtggtataagaagtgcaacacggctcgaaaatatcatgtggaagcagatttcgaatgaattaaatcatattttattagaaaatgatatgaaattcacagtcgtggtgggggatgctaacggcattctagctcagggtaagaagatgattagaccacaaccgatggaacataaatatagttggaagtcatgggggaaagcaaaaataatcggtgcagatatacaaaataccacatttattattgacggacctgatacccctgaatgtccagacgatcaaagagcctggaatatctgggaagtcgaagattacggcttcggaatcttcactactaatatttggttaaaacttagagatagctatacacaaatgtgcgatcaccgtctaatgagcgctgcgataaaagactccaaagcggtacacgccgatatgggatactggattgagagcgagaaaaatgaaacgtggaaattggcaagagcatcattcatcgaagttaaaacttgcacgtggccgaaaagtcacacattgtggagtaacggagtattagagagtgagatgattatacctaagatttacggaggccctattagtcaacacaattaccgaccagggtattttacacagacagcaggcccatggcacctgggcaaactggagctcgattttaatttatgtgaaggaacgactgtcgtagtcgatgaacactgcggtaacagggggccctcattacgaactacaactgtaactggcaaaataatacacgaatggtgttgcagaagttgcacattaccaccgcttaggttccggggcgaagacggttgctggtatggtatggagataaggccagtaaaagagaaagaagaaaatctcgtacgatctatggtttcagccggtagtggggaagtcgattcctttagtcttggaattttatgtgtatcaatcatgatcgaggaagttatgaggagccgttggtcacgcaagatgctgatgaccgggacgctcgccgttttcttactgctcattatgggacagctgacatggaatgatttaattcgtttatgtattatggtaggtgcaaatgcaagtgatcgcatggggatgggcacaacgtatctagctttaatggccacgttcaaaatgagacctatgttcgccgtaggactcctcttcagacgactgacatcacgagaagtactactactaaccatagggctgagcttagtcgcatcagtagaactcccaaacagtttagaagaattgggcgatggactcgccatggggattatgatgctaaaattattaacggagttccaaccgcatcaactatggacaaccttgctttcactaacattcattaaaacaactctaagtttagattatgcttggaaaactactgcaatggcactctctatagtatcactatttcctttatgtttatcaacgactagccaaaagactacgtggcttccagtattgttaggttccttcgggtgcaaacccctgacaatgttcctgataactgaaaataaaatatggggacgaaaatcgtggccactaaacgagggcattatggctatagggattgtgtcaattctgttaagttcgctattgaaaaacgacgtaccgctagcaggtcctctaatagccggcggaatgctaattgcatgttatgtgatatcaggatcaagcgccgatctctcgttagagaaagctgcagaagtaagttgggaacaagaagctgagcattccggcacttctcataatatactcgtggaggttcaagatgatggtaccatgaaaattaaggacgaggagaaggatgatacgttaacgatcctactaaaagctacacttttagctgtctcaggtgtctaccccatgagtatacctgccacattattcgtatggtacttttggcagaaaaagaaacaaaggagcggagtgctttgggatacaccgtctcccccagaagtggaaagggctgtactggatgacgggatatatcggatcttgcaaagaggcctcttaggcaggagccaagttggagtcggtgtattccaagatggagtatttcacacaatgtggcacgtcacaaggggtgctgtccttatgtaccagggaaaaagattagaaccctcttgggcaagtgtaaagaaagacttaataagctatggaggaggttggcgtttccaaggctcttggaatacaggagaagaagtacaagttatagccgtcgaaccgggcaagaacccgaagaacgttcagaccactcctggaacattcaagacccctgagggagaggtcggagctatcgctctagactttaagccaggcacttcaggatcaccaatagttaatagggaaggaaaaattgttggactatacggaaatggggtagtaacaacatccggaacttacgtatcagctattgcacaggcaaaagctagtcaagaaggaccactgccagaaatcgaagatgaagtgtttaaaaagagaaacctaaccatcatggatctacaccctggtagcggaaaaactcggaggtacctcccagctatagtacgagaggcgataaaaaggaaattaaggaccctgatcctggcaccaacaagagtagtagcatcagagatggccgaggctttgaaaggcatgccaataagataccaaacgacagcagttaaatcagagcataccggacgtgaaattgtagacctaatgtgccacgccacattcacaatgagattactaagcccagtgagagtcccgaattataatatgatcgttatggacgaagcacactttacagacccagcgagcatcgcagctagaggatatataagtacacgagtaggcatgggcgaggcagcagcaattttcatgacggctaccccaccaggatcggtcgaggcttttcctcaaagtaatgctgtaatacaagacgaagaacgcgacatacctgaacgatcttggaactcgggttatgactggataacagattttcccggcaaaacggtgtggttcgttccaagtattaaatcaggtaacgacatagccaattgtttaaggaaaaatggtaaaagagtgatacaactaagtcgtaaaacatttgacacagaataccagaaaacaaagaacaatgactgggattatgtagtaacgaccgatatatccgaaatgggagccaacttcagggcagatagagtcatagatccaagaagatgcttaaagcccgtaatcttaaaagatggccctgaacgggtgattctagctggacccatgcccgtcaccgtagcatcagccgcacaaaggagaggacgtataggtagaaatcaaaacaaagagggcgatcaatatgtatatatgggacaaccattaaacaatgatgaggatcacgcacactggacagaggcaaagatgttattagataacataaacactcctgaggggatcatacccgcgttattcgaaccagagcgagagaagagtgcagcaatagatggggaatacaggcttagaggagaagccagaaaaacattcgtagagcttatgagacgtggagatttgccagtatggttatcgtacaaagtagccagcgaaggcttccaatattcagatcggaggtggtgttttgacggtgaacgaaataatcaggtactggaagagaacatggatgttgaaatttggactaaggaaggcgagaggaagaaattacgaccacggtggttagatgctagaacatattctgacccactagcattgagagaatttaaagagttcgctgccggtcgtcgatcagtttctggtgatcttattttagaaatcgggaaactaccacaacacttaacactacgtgcacaaaacgccttagacaatctagtaatgttacataattccgaacaagggggtaaagcctataggcatgcaatggaggaactgcccgatactatagagactctaatgctattagccctgattgcagtcctgaccgggggagtaactttattctttctttcgggtaaaggacttggtaagacaagcatcggtctactatgtgtgaccgcaagttcagctctattatggatggcgtcggtggagccacattggattgctgcaagcataatattggagtttttcttaatggtgctgctcatccccgaaccggataggcaaagaaccccgcaggataatcaattagcttacgtagttatcggtctgttatttatgatattaaccgtagcagcaaatgaaatgggattattggaaacgacaaaaagggacttgggtattggccatgtggctgctgagaatcaccaacatgcaactatgttagacgttgatctaaggcccgctagcgcatggacactttatgctgtcgctacaacggttataacaccaatgatgagacatacaatagaaaatactactgccaacatatctcttacagcgatagcaaaccaggcagcgattctcatgggactagacaaaggatggccaataagtaaaatggatattggggttcctcttcttgcattaggctgttactcgcaagtaaatccattaacgttaactgccgccgttctaatgctggtagctcattacgcaattattggaccagggttacaggcaaaggcaactagagaagcacaaaagagaactgcagcgggaataatgaaaaatcccaccgtcgatggtatcgtagctatagacttagatcctgtagtttacgatgcaaaatttgaaaaacaattgggccagattatgcttctgatattatgtacttcacagattcttttgatgagaacaacatgggccttgtgcgaatccatcacgttggccacaggaccgttaactacgttgtgggaaggttctccaggaaaattctggaacacaactatcgcggtaagcatggcgaatatatttcgtggcagttatctggcgggagcaggtttagcgttcagtctaatgaaatctttaggtggaggaaggcggggaacaggtgctcaaggtgaaactctcggcgagaagtggaaaagacaattaaaccagttgtctaagtctgagttcaacacctataaaaggagcggaataatggaagtagatcgttcagaagcaaaggaaggcttaaaaaggggtgaaactacaaaacacgccgttagccgcggaaccgccaagctaaggtggttcgtcgaacgaaatctcgtgaaacctgaaggtaaagtcatcgacctaggctgtggcaggggaggttggtcgtattattgtgcagggctaaagaaagtcactgaagttaaaggatatacaaaaggaggaccaggccatgaagaaccaattccaatggcaacatatggttggaatcttgtcaaattacatagtgggaaagatgtgttcttcatgccacctgaaaagtgcgatactttattgtgcgatataggggaatcatctcccaacccgacaatagaagaagggagaacactacgtgtactgaaaatggtagagccttggcttaggggaaatcaattctgtataaaaatactcaatccttacatgccgtcagtagtagagacactagagcagatgcaacgtaaacatggcggtatgcttgtaagaaacccactaagtagaaattccactcacgaaatgtactgggttagctgtggaacagggaatatcgttagtgctgtaaatatgactagcagaatgttattaaatagattcaccatggcacatcggaaacctacatatgagagagatgtagacctaggagcgggtacgcggcatgtcgcagtagaacccgaagtagcaaatctagatattatcggtcaacgcatagagaacatcaaaaatgagcacaaaagcacgtggcactatgacgaagataatccatataaaacctgggcgtatcacggatcttacgaagtcaagcccagcggcagtgccagttcaatggtaaatggagtagtacgcctcttaacaaaaccctgggacgtaatacctatggtaacacaaatcgccatgacagacacaacaccctttggacagcaacgtgtgtttaaggaaaaggtagataccaggaccccgagagccaaacgaggaacaacacaaattatggaagtgacagcaaagtggttatggggctttttgtcccgaaataagaaacccagaatatgtacaagagaggaatttacacggaaagtgcggtcaaatgcggcaattggcgcagttttcgtggacgaaaatcaatggaactctgcaaaagaagcagttgaagacgaaagattttgggacctagtacatagagaaagggagctacataaacagggaaagtgtgccacgtgcgtatacaatatgatgggcaaaagagagaagaaattgggggagttcggtaaggctaaaggttcaagagcgatatggtatatgtggttgggtgctcgttttctggaatttgaggcactaggtttcatgaatgaagaccattggttctctcgagaaaactctttgtcgggagtagagggtgaaggtctccataaactaggttacattttgagagacatatccaagattcctggcggtaatatgtacgccgatgatacagcgggatgggatactagaataactgaagatgacctccaaaatgaagctaaaataactgacataatggaaccagaacacgcattattagcaacatccatattcaaactaacgtatcagaataaagtggtcagggtacaacgtccggccaaaaatgggacagtcatggatgtaataagtcgccgagaccagaggggaagtggacaggtagggacttatggattaaatacttttaccaatatggaggtacaacttattaggcagatggaatctgagggtatttttctacccagcgaattggaaacaccaaatctagcagaaagagttctcgactggttagaaaaacacggtgccgaacgattgaaacgaatggccatttctggtgatgactgcgtcgtgaagccaatagacgatcgtttcgcaacagctcttactgcactcaacgatatgggaaaagttagaaaagacataccgcaatgggagccttccaaaggctggaatgattggcaacaggtccctttttgtagtcatcattttcatcaactaatcatgaaagatggtcgggaaatcgtagtaccttgtagaaaccaagacgaacttgttggaagggctcgtgtatctcaaggcgcaggatggagtctacgagaaacagcatgtttagggaaatcgtacgctcagatgtggcaactgatgtattttcacaggcgcgaccttagattggcagcaaatgcaatttgtagtgcagtgccagtagactgggttcctacatcgaggactacctggtcaatacacgcccaccaccaatggatgactacagaagacatgttatcagtatggaatagggtttggatcgaagaaaacccctggatggaagataaaactcatgtatcgtcatgggaagaagtaccttatttaggaaagcgtgaagatcaatggtgtggcagcttaataggactgactgcaagagctacatgggcaacgaatatacaagtcgctataaatcaagtcaggcgactaataggtaacgagaattatcttgactacatgaccagtatgaaacgattcaaaaacgaaagcgaccctgaaggggcattgtggtag

SEQ ID NO: 21404 - RNA, 9879 nt, synthetic construct
  misc_feature 1..9879: note = derived and/or modified CDS sequence (opt6) from DENV-1__FJ639740__SS-prME
  source 1..9879: mol_type = other RNA
agtgttacgatgcttttgatgttattaccgaccgctctggcgttccacctcaccacacggggtggcgaaccccatatgatcgtaagtaaacaagaaagagggaaaagccttttattcaaaacatccgcaggagtcaacatgtgcacgttgattgctatggatttaggagaactctgtgaagataccatgacttataaatgtcctcggatcacggaagcagaaccagatgatgtagattgctggtgtaacgcgacagacacatgggtcacatatggcacctgttcacaaaccggtgaacacaggcgggataagcgctctgtagccctcgcaccgcacgttggactaggtttagaaactcggacggaaacctggatgagtagcgaaggagcttggaaacaaatacaacgtgtagagacgtgggcgttgagacatcctggcttcactgttattgctttatttttagctcatgctataggaacatcaatcacacaaaaaggaataatcttcatcctgctaatgttagtaacaccctccatggcaatgcgatgtgtaggcatcggtaacagagactttgtcgaagggttgtcaggcgctacttgggtagacgtggtattggaacatggctcgtgtgtcacaacaatggccaaaaataaacctacactggacattgagttacttaaaaccgaagtcacgaacccggcagtacttcgtaaactgtgtattgaagcaaaaatatcaaacaccacaacagactcacgctgtccaacgcaaggtgaagcaactctggttgaagaacaagatgctaatttcgtttgccgaagaaccttggttgatagaggttggggaaatggatgcggactgtttggtaaaggttctttactgacatgcgcaaaattcaaatgtgtaaccaaattggagggaaaaatagtacaatatgaaaatttaaaatactcagtaatagtgactgtccatactggagaccaacaccaagttgggaatgaaactaccgaacatggaactatagcgactataacgccccaagcacctacatcagagattcagttgactgattatggagcactaacactagattgttcaccaagaacgggcctcgactttaacgaaatggtgctgttgacaatgaaagaaaaatcctggcttgtccataagcaatggtttttggatttgccacttccatggacctccggagcaagcacttcccaagagacttggaaccgtcaggatcttttagtcacattcaaaactgctcacgccaagaaacaagaagtagttgtcttaggatcccaagaaggtgcgatgcataccgcactaactggagcgactgagattcaaacatctgggacaacgacaatatttgcagggcatctaaagtgccgtctaaaaatggacaaattgacacttaagggcatgagctatgtcatgtgtacagggtcgttcaagttagaaaaggaagttgccgaaacccaacatggaactgttttagtgcaagtaaaatacgagggaacggatgcaccttgtaagatcccattcgcaacacaagatgaaaaaggagtcacccaaaacggacgactcattacagccaacccgatcgttacggacaaagagaaacccgtaaacatagaaacggaaccaccttttggagagagctacattgtggtgggagcgggcgagaaggcattaaagctcagttggttcaagaagggttcaagtataggaaaaatgtttgaggcaacagcacgaggcgccaggagaatggcgattctgggcgacactgcgtgggattttggatccataggaggagtatttacgtcagtcggtaaattggtacaccaagttttcggcactgcctacggagtcttatttagtggagtttcctggacaatgaaaatcggtatcggaattttgctgacgtggttggggttgaatagcagatcaacatcactatccatgacgtgcattgcggtgggtatggtaactctctatttaggggtaatggtgcaagcagactcgggatgcgtaattaattggaaagggcgcgaactcaagtgtggctcagggatattcgtaacaaacgaagtacatacttggactgaacaatacaagttccaagccgacagtcctaaacgcctctctgctgctattggaaaagcatgggaagaaggagtatgcggtataagaagcgcaacaagattagaaaatatcatgtggaagcagatctcaaatgaactgaatcatatactactggaaaatgatatgaaatttactgtcgttgtaggcgatgctaatggaatactagcacaaggcaagaaaatgatccgaccgcagcctatggagcacaaatactcatggaaaagctgggggaaagcaaagataatcggtgcagatatccagaatactactttcattatagatgggccagacacgccggagtgtccagatggtcaaagagcgtggaatatttgggaagtagaggactatggattcggtattttcactacgaatatctggttaaaattaagagatagctatactcaaatgtgtgatcacagactaatgagtgccgctataaaagatagtaaagcagttcatgctgatatgggttactggatcgaaagtgagaaaaacgaaacgtggaaattagctcgagcgagcttcatcgaagtcaaaacatgtacatggccaaaatcacacacattgtggtcaaatggggttcttgaatccgagatgataatacctaaaatttacggcggaccgatatcacagcataattaccgtccgggttattttacacaaacggctggtccatggcacctcggtaagttagagttggacttcgatttgtgcgagggaactactgtagttgtcgatgagcattgtggcaaccggggaccaagtttaaggactaccacagtaacgggcaaaataatccacgaatggtgttgtagatcttgcacattaccaccactaagattccgaggtgaagacggatgttggtatggaatggaaatcagaccggtaaaagaaaaagaagaaaacttagtacgttcaatggtctcggctggttcaggagaggtagattcatttagcttaggaattttgtgtgtatccattatgattgaggaggttatgagatcaagatggtcaaggaaaatgcttatgactggaacattagctgtatttcttttactaatcatgggtcagttaacttggaacgatttgatacgactctgtattatggtaggggctaacgcctcagacaggatggggatggggactacatacctcgcccttatggctacgtttaaaatgagaccaatgtttgctgtagggttgctatttaggagactcacttctagagaggttctgctattgaccattggtttgagcctggtagcatctgttgaactgcctaactctctagaggaattaggtgatgggttagcaatgggaataatgatgctcaagttattaacagagttccaaccccaccagttatggactactctgctaagtctaacatttgtaaaaactacactgtcgttagactatgcatggaaaacgactgccatggtattaagtatcgtttccctttttccgctttgcctgtctactacatctcagaaaactacctggttacctgtgttgttaggaagtttcggttgtaaacctcttacgatgttcttgataacggaaaataaaatatggggtcgaaagtcatggccgcttaacgaaggaattatggcaattggaatagtttcaatattgctttcctccctactcaaaaatgatgtgccactggcgggtccattaatagctggaggcatgttaatcgcatgttacgtaatatctggttcttctgctgatttatcactagaaaaggcagctgaagtcagttgggaacaggaagcggaacattcaggggccagccataatattttagtagaagtgcaagatgatgggacaatgaaaattaaagacgaagaacgagatgacacattaacaatacttcttaaagcgacccttttagctgtatcaggtgtgtatcccatgtcaataccagcaactttatttgtgtggtatttctggcagaagaagaaacagagaagcggtgtattatgggacaccccaagcccaccagaagtagaaagagcggtattggacgatggtatttataggattttacaaagaggtttactaggaagatcacaagttggagttggtgtattccaggatggtgtgttccacacaatgtggcatgtcacgagaggggctgtacttatgtatcaaggtaaacgtttggaaccatcgtgggcgtcagtaaagaaagacttgatttcgtacggcggtggatggagattccaaggtagttggaatactggtgaagaagtccaagtaatagcagttgaacctgggaaaaatcctaaaaatgtacaaacaacaccaggaaccttcaaaacgcccgaaggagaagtaggagccatcgcactagatttcaaacctggtacgtccggctctcccatcgtcaacagagagggtaaaatcgtagggttatatggaaatggtgtagtaaccacatcaggcacatacgtatctgcaatcgctcaagcaaaggcaagtcaagagggaccgttgcccgaaatcgaagacgaagtattcaagaaacgtaacttaacaattatggacctgcatcctgggtctggtaaaactaggagatatctacctgctatagtccgtgaagctatcaaacgaaaactaagaactttaattctagctcccacaagggtcgtcgctagcgaaatggctgaggcattgaaaggtatgcccataagataccaaactaccgccgtgaaatcagaacatacaggacgcgaaatagtagatttaatgtgccacgcgacatttaccatgagactattaagcccggtgcgagttcctaactacaatatgataattatggacgaagctcactttacagatccagcgtcaatagcagctagaggttatatctcgacgcgcgtaggtatgggtgaggcagctgctatctttatgaccgcaacccctccaggaagtgtagaggcgttcccacaatcaaacgctgttattcaagatgaagagagagacatccctgaacgcagttggaactcgggctatgattggataacagacttccccgggaaaacagtctggtttgttccaagcataaaaagcggaaacgatatagcaaactgcctcagaaagaacggaaaaagagtaattcaattatcaaggaagacatttgacacggagtatcagaaaacgaagaataacgactgggactacgtagtcactacggacatttcagagatgggagcaaattttagagcagacagggtaatcgatcctagaagatgtctaaagcctgtaattttgaaagacggcccggaacgtgtaatactagcaggtccaatgcctgtaactgtggcgagtgcggcacaacggagaggaaggatcggccgaaatcaaaataaagaaggagaccaatatgtatatatgggacaacctctaaataatgacgaagatcatgctcattggaccgaagccaaaatgttattagataatataaacacacccgagggtattatacccgcattatttgaaccagagcgagaaaaatctgctgctatagatggagaatatcgcttgcgaggtgaggcccgcaaaacgtttgtggaacttatgagaagaggagacttaccagtttggttatcatacaaagtcgcaagtgaggggtttcaatattcagatcgacggtggtgctttgatggtgaaaggaataaccaagtactagaagagaatatggatgttgaaatatggacaaaggaaggtgaaaggaagaaattacgaccaagatggctagatgctcgaacttattcagatcctcttgccttaagagaatttaaagaatttgcagctggtagaagatctgtgtccggggatcttatcttagaaatagggaaacttccacagcatttaacactacgagcacagaatgctctggacaatttagtaatgttacacaactcagagcagggtgggaaggcctacagacatgcaatggaggaattacctgacacaatagaaaccttaatgctactggccctcatcgcagtattaactggcggtgtaacactatttttcctatcagggaaaggtctcggaaaaacaagtataggattattatgtgtaacggcatcgtctgctctattatggatggcctcagtagagccccactggattgcagcaagtattatcttggagttctttttgatggttctattaatccccgagccggatcgacaaaggacaccacaagacaatcaactagcatatgtagtaataggactgctattcatgatattaacagtagcagcaaatgagatgggattattggagacaaccaagaaagacttaggaataggatacgttgccgcggaaaatcaccaacacgctacaatgttagatgtcgacttaagaccagctagcgcctggactctttatgcagtagccacaactgtaatcacacctatgatgagacatacaatagaaaatacaaccgctaatataagcctaactgcaatagccaaccaagcagctatcctcatgggattagataaaggttggccaatctctaaaatggatataggcgttcctttgcttgccttgggttgctattcccaggtcaatccgttaacattgacagcagcggtgctcatgttggtagcacattacgctattattgggcccggccttcaagccaaagcaactcgggaggcacaaaagagaaccgctgctggaattatgaagaatccaacagtggatggaatcgttgcaatcgatctggacccagttgtatatgatgctaaatttgaaaaacaactaggacaaataatgttacttatattatgcactagccaaattttactgatgcgtaccacgtgggctctatgtgaaagtatcacattggcgacaggaccattaacgactttatgggaaggtagtcctggtaaattctggaataccacaatagccgtaagtatggcaaatatcttcagaggatcctatttagcgggagcagggctggcatttagcttgatgaaatcactaggtggcggacgtcggggaacgggagcccagggcgaaaccctaggagaaaaatggaagcgccagcttaatcagttatcaaaatctgagtttaatacttataaacgaagtggaatcatggaagtcgaccgaagtgaagcaaaggagggtctcaaaagaggagagaccacaaaacatgcagtgagccgaggtactgcaaaacttcgatggtttgtagaacgcaacctagtgaagcctgagggaaaagtcatcgatctagggtgcggcagagggggatggtcatactattgtgcagggctaaagaaagtgacagaggttaaaggttatacaaaaggcggtccgggacatgaagaaccaatccctatggcaacttatggttggaacttagtaaaattgcattctggcaaagatgttttcttcatgccacccgaaaaatgtgataccctactgtgcgacataggtgaatcgtcacccaatcccacaatagaagaaggtagaacgctgcgagttctaaaaatggttgaaccatggctgcgcggcaatcaattttgtattaaaatcttaaatccctacatgccatcagtcgtcgaaacattagaacagatgcaaagaaagcacggcggaatgctagtgaggaaccctttatctcgtaatagcacacacgaaatgtactgggtatcctgtggcacgggaaatatagtatcagcagtcaatatgacatcacgaatgcttctaaatcgttttactatggctcataggaagcctacatacgagagggatgtggacctgggagctggcacaagacatgtagccgtagagccagaagaggccaatcttgatatcataggacagcgtatagaaaatataaagaacgaacataagtctacatggcactatgatgaagacaacccgtataagacttgggcataccacggaagctatgaagtcaaaccttcagggtctgctagcagtatggtaaacggtgtagtacgactcctaacgaagccatgggatgtaatacccatggtgactcaaatagcaatgacagacactaccccttttggtcaacaaagggtttttaaagaaaaagtagatactcgaacaccccgggcaaaacgaggaaccacccagattatggaagtgacagcaaaatggctctggggtttcttatctcgtaataagaaacctaggatatgcacacgagaggagttcacccgtaaagtacgaagtaatgccgcaataggtgcggtttttgtagatgaaaaccaatggaactcagccaaagaggcagtagaagatgaacgtttttgggacctagttcatagagagcgagaattacataaacaaggcaaatgtgcgacatgcgtttacaatatgatgggtaaaagagagaagaaattaggtgagtttggaaaagctaaaggcagtcgagccatttggtatatgtggctcggagctagatttctagaatttgaggctttgggattcatgaatgaggatcactggttttcgagagagaatagtttatcgggtgtggaaggtgaaggtctacacaaacttgggtatatcttaagggacatatcaaaaattccaggagggaatatgtatgctgatgacaccgctggatgggacactagaatcacagaggatgatttacaaaatgaagctaagattactgatataatggagccagaacatgccctgttagcaacaagcatctttaaacttacttatcaaaacaaagtcgtcagagtccaaagaccagccaagaatgggactgtcatggatgtcatatcgcgccgggatcaaagaggatcaggacaagttggtacctatggtttaaacacgtttactaacatggaagtacaactaatcaggcaaatggaatccgagggaatatttttaccgtcagagctggaaacaccgaatttagcagaaagagtattagattggctagagaagcacggagcagaaagattaaaaagaatggctatttctggagatgactgtgtggtaaagcccatagatgatcggtttgctacggccttaacagctcttaacgatatgggaaaagtaagaaaagacattcctcaatgggaaccttcaaaaggatggaatgattggcagcaagtaccattttgctcacatcatttccaccagttaattatgaaggatggccgagaaattgtagtgccgtgccggaaccaagatgagctagttggtagagcacgggtgagccagggcgcagggtggtcccttcgcgaaaccgcttgcctaggaaagagttatgcacaaatgtggcaactaatgtattttcatcgccgtgacctgcgattggcggcaaacgcaatatgtagcgccgtaccagtcgattgggtacctacctctagaaccacctggtcgatacatgcccatcaccagtggatgaccaccgaggacatgttatccgtttggaacagagtatggatagaagaaaatccatggatggaagacaaaacacacgtatctagctgggaagaggtaccctacttaggtaaaagagaagaccaatggtgtggttctttaattggtttaaccgctagagcaacctgggccacgaacattcaagtggcaataaatcaggtaaggcgacttatagggaatgagaactatttagattacatgacatctatgaaacgattcaaaaacgaatctgaccccgaaggcgcattatggtag

SEQ ID NO: 21405 - RNA, 9879 nt, synthetic construct
  misc_feature 1..9879: note = derived and/or modified CDS sequence (opt6) from DENV-1__FJ639741__SS-prME
  source 1..9879: mol_type = other RNA
tcggtaactatcttgctaatgctactacctactgcgctggctttccacctgacaactcgagggggtgaaccacatatgatcgtaagcaaacaggaacgcggaaaatctctcttatttaaaacgtcagcaggcgtaaatatgtgtacattaattgctatggatttaggtgagctatgtgaagatacaatgacgtacaaatgtccgcggattacagaagctgaacctgatgacgttgactgctggtgcaacgcaacagatacatgggttacatacgggacatgcagtcaaacaggcgagcatagacgagacaaacgaagtgtggcgttagcgccccacgtagggttgggattagaaacccgaaccgagacttggatgagctcagaaggggcctggaaacaaatacaaagggtggaaacctgggccttgaggcatcccggttttacggtaatcgcgcttttcctagcacatgctataggaacttctattacacaaaaagggattattttcattcttttgatgctagtgacaccctctatggcgatgagatgcgtcggaataggcaacagagacttcgttgaaggactttcaggagctacatgggttgacgttgtgctcgaacatggatcctgtgtcaccacaatggccaaaaacaaaccaaccctagatatagaactactgaaaacggaggtcaccaatcccgcagttctgaggaaattgtgtattgaggctaaaatttctaataccaccactgattcacgatgtccgacgcaaggagaagctaccctggtggaagaacaagatgctaacttcgtttgtcgtaggacatttgtggacagaggatggggaaatggatgtggcctgttcggtaaaggatccttacttacatgtgcaaaatttaaatgtgtaacaaaattagagggaaaaatagtccagtatgaaaatcttaaatattcagttatagttacggtacatacaggcgatcaacaccaagtgggtaatgagacgaccgagcatggaactatagcaacaataacaccccaagctccaactagcgaaatacaactaaccgattacggggctttaacattggactgtagtcctcgcacaggattagactttaacgagatggttctcttaacaatgaaagaaaaatcgtggctggttcacaaacaatggtttttagatttacccttgccctggactagcggcacatctaccagtcaagaaacatggaatcgacaggacctcttagtgacatttaaaacggcccacgctaagaaacaagaagtagtagtattgggaagtcaagaaggcgcaatgcacacagcacttacaggggccacagaaatacagacgtctggtaccactacaatatttgctggtcacctaaaatgccgattaaaaatggacaaacttacactcaaaggaacatcatatgtcatgtgtactgggagttttaagctcgaaaaagaagtagcagagactcaacatggaacagtcctagttcaagtaaagtacgaagggacggacgcgccatgcaaaatacctttctcgacacaggatgaaaaaggggtgacgcaaaatggcagactcataacagcaaacccaatagttactgacaaagagaagcccgtaaacatagagacagagccaccctttggggagtcatacatagtagttggtgctggagaaaaagctcttaaactatcatggttcaagaaaggctcgtcaataggaaagatgtttgaagccaccgctcggggagcccgccggatggcaatcctaggagacaccgcgtgggactttgggtcaattggcggggtattcacaagtgtcggcaaattggtacatcaagtttttggcaccgcatatggtgtcttgttttcgggagtatcgtggacgatgaaaattggaataggaatattgctaacgtggctaggactaaattcaagaagcacatccctgagcatgacctgtattgccgtcggaatggtaacactttatctcggagtaatggtacaagctgacagtgggtgcgttataaattggaaaggcagggaactgaaatgcggcagtgggattttcgtgacaaatgaagtgcacacatggactgaacagtataaatttcaagctgatagtcccaaacgtctctcggctgcaataggaaaggcttgggaagaaggcgtatgtggaatacgatcagccacgagactggagaacataatgtggaaacaaatatctaacgagctaaatcacatattacttgagaatgacatgaaatttaccgtagtagtaggcgatgccaatggaatattagcgcaaggcaagaaaatgataaggcctcaacctatggagcacaaatatagttggaaaagctgggggaaggcaaagattatcggtgcagatatacaaaatacaacatttattattgatggtccagacacaccagaatgtccagatgaccaaagagcatggaatatatgggaagttgaagattacggtttcggaatatttactacgaatatatggttgaaactacgcgattcttatactcagatgtgtgatcaccgattaatgtccgcagcaattaaggatagtaaagccgtacacgcggacatgggatactggatcgagtcggagaaaaatgaaacgtggaaattagcaaaagcctcttttatcgaggtaaagacctgtatatggccaaagtctcacactctatggtccaacggagttctagaatcagagatgataattccaaaaatatatggagggcccattagtcaacacaattacaggccaggatatttcacacaaactgcggggccctggcacctgggaaagctggagttagattttgacctttgcgaaggcacgaccgtagtagttgacgaacattgtggaaatcgcgggccatctctaagaactacaacggtcacaggaaaaattatacatgaatggtgctgtcggtcatgtacgttacctcctctacgctttcgtggagaggacggatgctggtacggaatggaaattagacctgttaaagaaaaggaggagaatttagtgagatccatggtgtcagctggcagcggggaagtagattcttttagtttaggaatcctttgcgttagtataatgatagaagaggttatgcgatcaagatggtctaggaaaatgttgatgacaggaacactcgcagtatttttgttactaataatgggacagctcacttggaacgacttgataagactgtgcatcatggtaggggccaatgcatctgataggatgggtatgggtaccacatatctagctctaatggcgacatttaaaatgagaccgatgttcgctgtgggccttctattcagaagattgacgtcccgagaagtgctcttattgacaattggcttgtctctagtggcatcggttgaactccccaactctctagaagaacttggagatggactggcgatgggcataatgatgttaaagctattaactgaatttcaaccccaccaactatggacaacattgctctcattaacattcataaaaaccaccttatccctcgattatgcctggaaaacgacagcaatggtactaagtatcgtttctttattccccctctgtctcagtaccacgagtcagaagacgacatggttacctgtcttattaggttcatttgggtgcaaaccattgacaatgttcttgatcacagaaaacaagatttggggacgaaaatcatggccgttgaatgaaggcattatggcgataggaatcgtgtccatactccttagttcattgttgaaaaacgatgtacctctagcaggacccctaatagcgggaggaatgttaatagcttgctatgtaatatctggcagttcagctgacttgagccttgaaaaagcagcagaggtaagttgggaacaagaagctgaacactctggcacgtcacacaatatattagtagaagttcaagacgatggaacgatgaaaattaaggatgaggaaagggatgacaccttaacgatcctattaaaagcaacattactagctgtctctggagtttatcctatgtcgatacccgcgaccctctttgtttggtatttttggcagaagaagaaacagaggtcgggtgtgttatgggatacaccttcacctccagaagtagaaagagcagtgcttgatgacggtatttatcgtatcctacaacgcggattgttaggacggtcccaggtcggggtaggtgtatttcaagacggcgtgttccatacaatgtggcatgtaacaagaggcgcagtactaatgtatcaagggaaaagacttgaaccatcatgggctagtgtcaagaaagatttaatctcatatggtggcgggtggaggtttcagggtagttggaatacgggcgaagaggtacaagtaatcgcagtagaaccaggcaaaaaccccaaaaacgtacaaacgactcctggaacttttaagaccccagagggcgaggtcggagccattgctcttgattttaaaccagggacatcgggtagcccaatagttaatcgtgagggcaagatcgtaggcttatacgggaacggggtagtaacaactagcggtacgtacgtgtctgccatagcccaggcgaaggcgagccaagaaggccctctccctgagatcgaggatgaggtatttaaaaagagaaacctaacgataatggatttgcatcccggcagtggcaaaacgcggagataccttccagcgatagtcagggaggccataaagcgaaaacttcgcacactaatactagcacccactcgagtcgtggctagcgaaatggcagaggcacttaaagggatgcctatcagatatcaaaccacagcagtaaaaagtgaacatactggacgggaaatagtggatttaatgtgccacgccacctttacaatgaggttgctaagtccggtaagggttcccaattataatatgataataatggacgaagctcattttacggacccagcatcaatcgcagctagaggttatatttccacacgggttggtatgggagaagcagccgctatcttcatgactgccacaccccctggatcggttgaagcatttcctcagagtaatgcagtgatacaagatgaagaacgagacattccagaaagatcatggaatagtggctatgactggataacagactttccaggtaaaacagtatggtttgttccgtcaattaaatcaggaaatgatattgcaaactgtttaagaaagaatgggaaaagggttattcaattaagtcgtaagacttttgatacagagtaccaaaagaccaaaaacaatgattgggactatgtagttactacagatataagtgagatgggcgcgaacttcagagctgatagagttatagatccacgaagatgtctcaaacctgtaattctcaaagacggcccagaaagagtgatattagctggacctatgcctgttaccgttgcaagtgctgctcaaaggcggggtaggatagggcgaaatcagaataaagagggtgatcagtatgtatatatggggcaaccactcaacaatgatgaagatcacgctcattggaccgaagcaaaaatgttgctggataatataaatacaccagaaggaataatacctgcattgtttgaacctgaacgagagaaaagtgccgccatagacggagagtacagattaagaggcgaagcaagaaagacatttgtcgaactaatgcgaagaggtgacctaccagtttggctttcatacaaagtcgccagtgaaggctttcaatacagtgacagaagatggtgcttcgacggtgaaaggaataaccaagtccttgaagaaaatatggacgttgaaatatggacaaaagaaggagaacgaaagaaattacgaccccgatggttagatgcacgaacatattcggatcccctcgcactaagggaatttaaagaatttgcagcagggaggcgaagcgtttctggagatttgatactagaaataggcaaattaccacaacatctgacactgagagctcaaaatgccctagataatttggtaatgctgcataattcagaacaaggaggtaaagcgtataggcatgccatggaagagttaccagatacgattgagacactaatgctcttagcacttatcgctgtactaacgggtggagtaacgctattctttctcagtggaaaaggtctagggaaaacatctattggattattatgcgttacagctagtagcgcactcttatggatggcaagcgtcgaacctcattggatcgctgcatctataatactcgagttctttttaatggtgttactaatacctgaaccggacagacagagaactcctcaggacaatcaactcgcgtatgtagtgatcgggttactattcatgatattaactgtagctgctaatgaaatgggattattagaaacaacgaagaaagacttaggaattggacatgtcgcagctgaaaaccaccaacatgcgacgatgttagatgtggatctacgaccagccagtgcatggacactgtacgctgtggccacaactgtaataacaccaatgatgagacacaccatcgaaaatacaaccgcaaatatctcattaacggcaatagctaaccaagcagcaatacttatgggactcgacaaagggtggccaatatctaaaatggacataggtgttccactattggctttaggatgctactcccaagtcaatccgcttacactaaccgcagcagtcctaatgcttgtagcccattacgcaattataggcccaggattacaggcaaaagccacaagagaagcacaaaagagaacagcagccggaatcatgaaaaatcctacagtagatggtatagttgctatagatttagatcccgttgtatatgacgccaaattcgagaaacaattaggccaaatcatgttattaatactttgtacatcgcaaatcctactaatgagaacaacatgggcgctctgcgagtcaataaccttagctaccggaccattaacaactttatgggagggcagccccggcaaattctggaacacaaccatcgccgtttcgatggctaacatatttcgcggctcctatctagctggggcgggattagctttttcactcatgaagtctttgggagggggtaggaggggcacaggtgctcaaggggaaactctcggcgaaaaatggaaaagacagctgaatcagttaagcaaatctgagttcaatacgtataaacgaagtggcataatggaagttgatcgaagtgaagcaaaagaaggtctaaaaagaggagaaaccactaaacacgcagtgagtcgtggcaccgcaaaactgagatggttcgtcgagcgaaacctagttaagcccgaggggaaagtaatagacctaggatgtggtagaggaggatggtcttattattgcgctgggcttaagaaagtaacagaagtaaagggctatactaagggcggcctaggacatgaagaaccaatcccaatggctacctatgggtggaacttggtaaaattgcacagtggtaaggacgtattcttcatgccaccagaaaaatgtgacacacttctgtgtgacattggggaatcttcgcctaatccaactattgaggagggaaggacactccgagtactgaaaatggttgagccttggttaagagggaaccaattttgcataaagatacttaacccctatatgccctcggtggtagaaacattagaacaaatgcaaagaaaacatgggggcatgttagttagaaacccactatcccggaactcaacacacgaaatgtattgggtttcatgtggtaccggaaacatagttagtgcagttaacatgacgagtagaatgttattaaataggtttaccatggctcatcgtaaacccacatacgaacgtgacgtagatttaggagcagggacacgccatgtagcggtggagccagaagttgcaaatttagatattataggccagaggatagaaaacattaaaaacgaacacaaatcaacatggcactacgacgaagataatccctacaaaacttgggcctatcatggcagttatgaagtcaaacccagtggttcggccagtagtatggtgaatggcgtagtaaaattattaaccaaaccgtgggatgtaattccgatggtaacccaaatagctatgacagatacaacgccattcggtcagcaacgtgtatttaaagaaaaagtagacacgagaaccccgcgagcgaagcgtggtaccactcaaatcatggaggtcactgctaaatggctatggggtttcctttcccgtaacaagaaaccaagaatctgcacccgcgaggaatttacgcgtaaagtaaggagcaacgcagctattggagccgtatttgtagatgaaaatcaatggaacagtgcaaaagaagcagttgaagatgaaagattctggaatttagtacacagggaaagagaacttcataaacaggggaaatgtgcgacatgtgtctacaatatgatgggaaaaagggagaagaaattaggtgagttcggaaaggccaaaggctctcgtgcaatatggtatatgtggttaggagcgagatttttagaatttgaagctctgggatttatgaacgaagaccattggttcagtagagaaaactctcttagtggagtcgaaggagagggccttcacaaactcggatacatcctcagagatatctctaaaatacccgggggaaacatgtatgctgacgacaccgcagggtgggatacacgcataacagaagacgatctacaaaatgaagcaaaaataactgatattatggaacccgagcacgcgttactagctacaagcatatttaagttgacataccaaaataaagtagttcgagtacaaagacctgctaaaaacgggacggtaatggatgttatatctcgacgtgatcagagaggcagtgggcaagtaggcacttatgggcttaacactttcactaacatggaagtccaacttataaggcaaatggaaagtgaaggaatattcttgccgtctgaacttgaaactccaaacctagcagaacgtgttctagactggcttgaaaagcatggggcagaaaggctaaaaagaatggccataagtggagatgattgtgtagtcaagcctatagatgaccgcttcgctactgcgctaactgctttaaatgacatgggaaaagtgaggaaagacataccccagtgggaaccttcaaaagggtggaatgattggcaacaagttccattttgttcccatcattttcaccaattaattatgaaggatggccgcgaaatagtagtaccatgtagaaaccaagacgagctagttggcagagcccgggtaagccaaggagctggatggtcattacgtgagacagcttgtctcgggaaaagttatgctcaaatgtggcagttgatgtattttcaccgccgagacctaagattagcggctaacgcgatttgctcagctgttccagttgattgggttcccactagcaggacgacatggagcatccatgcacaccatcaatggatgacaactgaagacatgctctccgtatggaatcgagtatggattgaagaaaacccatggatggaggataaaacgcatgtgtcatcgtgggaagaagtcccttatctgggcaaaagagaagaccagtggtgcggttcactcataggcttgactgctagagcgacgtgggcaacgaacattcaagttgccataaatcaagtacggagacttataggaaatgaaaattatctagactatatgacttcaatgaagcgcttcaaaaatgaatcggatcccgaaggagccctatggtaa

SEQ ID NO: 21406 - RNA, 9879 nt, synthetic construct
  misc_feature 1..9879: note = derived and/or modified CDS sequence (opt6) from DENV-1__FJ639743__SS-prME
  source 1..9879: mol_type = other RNA
tcagttacaatgctactaatgttactgccgacagcattagcattccatcttacaacacgcggtggggaaccacacatgatcgtatcaaaacaagaaagagggaaatctttgttattcaaaacatcagctggtgtgaatatgtgcacactaatcgcaatggatctaggggaactttgtgaggataccatgacgtacaaatgcccgcgaataacagaagccgaacctgatgatgtcgattgctggtgcaatgcgaccgacacatgggtaacctacgggacttgctcacaaaccggtgaacatcgacgcgacaaaagaagtgttgcactagcaccccacgttggacttgggctagaaactagaaccgaaacatggatgtcatcagagggagcatggaaacaaatacaaagagtcgaaacgtgggcactaaggcacccaggatttacagtaatggctctttttctcgctcatgcaataggcacgagtattactcaaaaaggcatcattttcattctcttaatgttagtgaccccttctatggctatgcgttgcgtaggcataggaaacagggactttgtagagggactctcaggggcgacgtgggtcgatgttgtactcgagcacggcagctgcgtcacaacaatggctaaaaataaacccacattggacatcgaactactaaaaaccgaagtgacgaacccggccgtattaaggaaattatgtattgaagcgaaaatttcaaatacaacaacagattcacgatgcccgacgcaaggggaagcaacgctcgtagaagaacaagatgcaaactttgtttgcagaagaacttttgtcgatcgcggatgggggaatgggtgtggattgtttggaaagggctcacttttaacatgtgctaaattcaaatgcgtcacaaaactcgaaggaaaaatagtacaatatgaaaacttgaaatacagcgtaatagtgactgtgcatactggcgatcaacatcaggtaggaaatgaaacaacagagcatggtacgatagcaactataacaccccaggccccaacaagtgagattcagctaactgattacggagcactaacgttagattgttcccctcgcacaggcttggacttcaacgaaatggtgcttttaacaatgaaagagaaatcttggctggtacacaaacagtggttcctagacctgccactaccttggacatccggagcatcaacaagccaagaaacgtggaacaggcaagaccttttagttacttttaaaaccgctcacgcaaagaaacaagaagttgtcgtcttaggctctcaagaaggtgctatgcacaccgctctgactggtgcaacagagattcaaacgtctggaaccacgacgattttcgcaggtcatttaaaatgtcgtttaaaaatggataaacttactttaaaagggatgagttatgttatgtgtactggttcttttaaacttgagaaagaagttgccgaaactcagcatgggacggtacttgtacaggtacgatatgaggggaccgatgcgccctgcaaaattccatttagcacacaggacgagaaaggtgttacccaaaatgggcgactgatcaccgctaaccctattgtaacagacaaagaaaaacctgtaaatatcgaaacagaaccaccatttggcgaatcgtatattgtagttggagcaggagaaaaagctcttaaattaagctggttcaagaaaggaagtagtatcggaaaaatgtttgaggctactgcgagaggagctcgaaggatggctattttaggggacaccgcttgggacttcgggagcataggtggcgtttttacaagtgtaggaaagctagttcaccaagtattcggtactgcttatggtgtgttgttcagcggtgtaagttggacaatgaaaataggtataggaatactattaacctggctaggtttaaacagtagaagcactagcttatcaatgacatgcatcgctgtgggaatggttacattgtacctgggtgtaatggtacaagccgactctggctgcgtaattaattggaaaggaagagaactgaaatgtggttcgggaatattcgtaacaaatgaagtccatacatggactgagcaatacaaattccaagctgattccccaaagaggctctcagcagcaatcgggaaagcatgggaggaaggcgtctgtgggattcgatctgcaacgcgattggaaaacatcatgtggaaacaaatctcaaatgagttaaaccacatcctactagaaaatgacatgaaattcacggtagttgttggagatgcaaatggaatccttgcacaaggcaagaaaatgattcgacctcaaccgatggagcataaatattcatggaaaagctggggtaaggcaaaagtaataggagcagatatacagaataccacttttatcatcgatggaccagatacaccagaatgtcctgatggacaacgagcctggaacatttgggaggtcgaggactatggatttggaatttttactacaaatatatggttgaaactgagagattcctatacacaaatgtgtgatcacagattaatgagtgcggcgattaaggattctaaagcggtacatgcggatatgggttactggatagaatcagagaagaatgaaacatggaaattggctagagcttcatttattgaagtaaaaacgtgcacctggcctaagagtcacaccttatggtccaacggagtcttggaaagcgagatgatcataccgaagatatacggcggtccaatatcacaacataattataggccaggatattttacacaaactgccggcccttggcacctaggaaagctggaattggatttcgacttatgtgaagggacaactgttgttgtagacgaacactgtggcaaccgaggacctagtcttaggacaacaacagttacagggaaaataatacatgaatggtgttgtagaagctgtactctcccaccacttcgtttcagaggcgaagacggatgttggtacgggatggagatacgacccgtaaaggagaaggaggaaaacttagtcaggagtatggtgagtgcgggcagcggggaagtggattcattcagcctcggtattttgtgtgtatctataatgattgaagaggtgatgagaagtaggtggagtcgtaagatgcttatgacaggaacgttagccgtatttcttcttctcgtaatgggtcaactcacatggaatgatttaatacgattatgcatcatggtaggtgccaacgcttcagacaggatggggatgggcactacatacttggcactaatggcgacctttaagatgcgcccaatgttcgcagtagggctgctgttccgtcgccttacatcccgggaagtcttattgcttacaataggactatctcttgttgcatcagtggagctgccaaattctttagaagaattaggggatggtttagcaatgggaattatgatgttgaaattactgacagaatttcaaccacatcaactttggacaacgctactatcactcactttcgttaaaacaacattgagtcttgactatgcatggaaaacaactgctatggtattgtccattgtatctttgttcccgttatgcttatcgactacttctcaaaagacaacctggttaccggtcttattagggtcatttggatgtaaaccattaacaatgtttctaattacagaaaacaagatctggggtcgtaaaagttggccgttaaatgaggggatcatggcaattggtatcgtatcaatacttcttagtagcttactcaagaatgacgtaccattagcaggacctctgatagcgggtggtatgcttattgcatgttatgtaatttcaggatcttccgctgacctcagtttagaaaaagcggcggaggtgtcgtgggaacaagaggcggaacatagcggagcgtctcataacattttggttgaggtacaagacgacggaacgatgaagattaaagacgaagaaagggacgatactctaaccatacttttgaaagcaacgctattagcggtatccggtgtctatcctatgtcaatcccagccaccttatttgtatggtacttctggcagaagaagaaacaaagaagcggagtactatgggacacaccaagtcccccggaggttgaacgagcagtactagacgatggaatttacagaatactccagagaggactgttaggtagatctcaggtcggagtaggcgtattccaagatggagttttccacactatgtggcacgtcacgcgaggagcggttttaatgtatcaagggaaaagattggaaccctcatgggcatctgttaagaaagatttgattagctatggtggtggatggagatttcaaggaagttggaatacaggtgaagaagtccaggtgattgctgtagaaccaggtaaaaatcccaagaatgttcaaacaactccgggcacattcaagacatcggaaggggaagtgggagcgatcgcactagattttaagccgggtacgtcaggatccccaattgtaaacagagagggaaaaattgtaggtctatacggaaatggtgtagtcacaacttcaggaacatatgtatcagcaattgcccaagctaaggcttctcaggagggcccgttacctgaaatagaagatgaagtgttcaagaaaagaaacttgacaataatggatttacatcccggtagcggcaaaacacggcgttaccttcccgcgatagtcagggaagcgattaaacgtaagctaaggactttgattctcgcgccaacaagggtggtagcaagtgaaatggctgaagcattgaagggcatgccaattaggtatcaaacaacggcagtaaaatccgaacacacaggtcgtgaaatagtagatttaatgtgtcacgctactttcacgatgagactactctctccagtaagggtacctaactataatatgattataatggacgaggcacattttacagacccggcaagtatagcagcacgcgggtacatatctacaagggtaggaatgggtgaagctgcggcaatttttatgacagctacaccaccagggtcagttgaggcctttccccagagtaatgcggtaattcaagatgaagagagagatattccggaaagatcttggaactcaggatacgactggataacagacttccccggaagaactgtttggtttgtcccctctataaaatcgggtaatgacatcgcaaactgcctgaggaaaaatggcaagcgagtcatacaactcagtagaaaaacttttgatactgaatatcagaaaaccaaaaataacgattgggattatgtagtaacgactgacatatcagaaatgggtgctaatttccgtgcggatcgagtaatagatccgagaagatgccttaaacctgtaatattgaaagatggtcctgaaagggtaatcctagccggaccaatgccagttacggtagctagtgcagcacaaagacgtggtcgtattggtaggaatcaaaataaggaaggagatcaatacgtgtacatggggcaaccgttaaataacgacgaagaccacgcacactggacagaagcaaaaatgctactcgataatattaatacaccagaaggaataattcccgcactatttgagccggaaagagagaaaagtgcagcaatcgatggagagtataggctccgtggtgaagctagaaaaacattcgtagaactaatgagaaggggcgatttacctgtttggttgtcttacaaagtggccagcgaaggttttcaatactccgatcgacgttggtgtttcgatggtgaaagaaacaaccaggtcctagaagaaaacatggacgtagagatttggacaaaagaaggagaacggaagaagctccgacccagatggctagatgctaggacatattcagatcctttggcactacgtgagttcaaagagttcgccgcgggacgcagatcagtctcaggcgatttaattctagagattggaaaacttcctcaacatctcacgttaagagctcaaaatgccctcgataacttagtcatgttacacaacagtgaacaaggagggaaagcgtataggcatgcaatggaagaactaccagacacaatcgagactcttatgctcctagcgttaatagctgttttaacgggcggagtgaccctgttctttctatctggcaagggactagggaagacctctatagggttgctgtgcgtcacagcatcaagcgcactcctatggatggcatcagtagaacctcattggatcgctgcctcgataatactggaatttttcctaatggttttacttattcctgagccagacagacaaaggactcctcaagataaccaactagcgtatgtggtgataggtctcctttttatgatattaactgtagctgctaacgagatgggattactggaaacgacaaagaaagatctagggattggatatgtagctgcggagaatcatcaacacgccacaatgttagacgtggatctgcgaccggcctctgcctggactctctacgctgtcgcgacgacggtaataactccaatgatgagacatacaattgaaaacactacagctaatatctctttaactgccatagctaatcaggctgccatactaatgggtctagataaagggtggccaatttccaaaatggatattggagttccactcttagcattggggtgttattctcaggtgaatccactaacattgacagctgcagtccttatgcttgtcgcacactatgctattatcgggccagggttacaagcaaaagctacgcgcgaagcacagaaaagaactgcagccggcataatgaaaaatccaactgttgatggaatagtcgcgatagacttagacccagtagtctatgatgcgaaatttgaaaaacaattaggacagatcatgttactcatcttgtgcacaagtcaaatacttttaatgagaactacatgggcgttatgtgagtctataacccttgctactggcccgttaacaacactatgggaagggagtcctggaaaattctggaatactacgatcgctgtctccatggctaatatttttcgtggttcatatctggccggagccggactagcattcagtcttatgaagagtcttggagggggtaggagaggtacaggagcacagggtgagacactaggggaaaaatggaaaagacaactaaatcaactttctaaatcggagttcaatacatacaaacgaagtggaataatggaagtagacaggtccgaggcaaaagagggcctcaaacgaggtgaaaccacaaaacatgcagtttctcgtggtaccgcaaagttgaggtggtttgtagaaagaaatttagtaaaacctgaaggaaaagtgatagacctaggatgtggtagaggagggtggtcatactattgtgcgggtttaaagaaagtgacagaagtaaaaggatataccaagggaggtcctggacatgaggagccaatacccatggcaacctacggatggaatttagttaagctccattcagggaaagacgtattctttatgtcccctgaaaaatgcgatacactgctttgtgatattggggaatcgtcacctaatccaacaatagaggaagggaggaccttgagagttttaaaaatggttgaaccatggttgcgaggaaaccaattttgcataaaaatattaaatccctacatgccttcggtagtagagacgttagaacaaatgcagagaaaacacggtggaatgcttgttaggaatccactttccaggaactctacgcatgaaatgtactgggtgagctgtggaacaggaaacatcgtgtcagcagttaacatgacaagcagaatgctgttaaatagattcactatggctcacagaaagcctacatatgagagagatgttgatttgggagctgggacccgccatgtagcggtagagcccgaagaggccaacttggatataataggccaacgcattgaaaacatacgaaacgaacataaaagtacgtggcattacgacgaagacaacccgtacaaaacttgggcgtaccatggctcttatgaagtaaagccttcgggaagtgcctcttccatggttaatggagtggtaagacttctaactaaaccatgggacgtaatccctatggtgacacaaatagcaatgaccgatactactcctttcggacaacagcgagtattcaaagagaaagttgacacacgcacgccccgagccaaacgtggaactacacaaataatggaagtcactgcgaagtggctttggggttttctatcaagaaacaagaaacccagaatctgtacccgtgaagaatttactcgaaaggtcagatccaatgcagctattggggcagtatttgtggatgagaatcagtggaacagcgccaaagaggcagtggaagacgaacggttttgggatctagtgcatagagaacgtgaactacacaaacaaggaaaatgcgcaacctgcgtatacaatatgatggggaaaagagagaagaaattaggcgaatttggaaaagcaaagggaagtagagcaatatggtacatgtggcttggggcacgatttctagagtttgaggctctcggattcatgaatgaagaccattggttttcaagggaaaattcactttccggcgtcgaaggtgaaggcttacataaattaggttacattctacgagatataagtaaaataccaggcggaaatatgtatgctgatgataccgctggctgggacacgaggattacagaagatgacttacaaaatgaagcaaaaataacagacatcatggaaccggaacatgcattgctagccacatcaatctttaagctcacttatcaaaataaagtagtaagagtgcaacgtccagcgaaaaacggtacagtaatggacgtgataagcagaagagaccaacggggttccggtcaagtaggtacgtacggtctcaatacctttacgaatatggaagttcagttaataagacaaatggaaagcgaaggcatttttctaccctccgaattagagacacctaatctggctgaacgagtattggattggctggaaaaacatggtgcggaaagattaaaaagaatggccataagcggggacgactgcgtggttaaaccgattgacgaccgatttgctactgcactgaccgcactcaatgatatgggcaaggttcgtaaagatatcccacaatgggaacctagcaagggatggaatgattggcaacaagtaccattttgtagtcaccatttccaccaattaattatgaaagatggtagagaaatcgtagtgccatgtcgaaatcaggacgaattagtaggtagagctcgtgtttcacaaggagcaggttggtccttaagggaaaccgcttgtttgggtaaaagttatgcccaaatgtggcagttaatgtatttccacaggcgagatctcagattagctgcaaacgcaatctgtagcgcagtcccagttgattgggtcccaacaagccgtacgacatggagtatacacgctcaccatcaatggatgactaccgaagatatgttgagtgtttggaatagagtctggatagaagaaaatccctggatggaggataaaacacatgtatcatcatgggaagaagttccctatctaggtaaacgcgaagaccaatggtgcggaagcctcattggactcacggccagagctacttgggctactaatattcaagtggcaattaatcaagtacgacgtttaataggcaatgaaaattacttagactatatgacaagtatgaagagatttaaaaatgaatccgacccagaaggagccctatggtag

SEQ ID NO: 21407 - RNA, 9879 nt, synthetic construct
  misc_feature 1..9879: note = derived and/or modified CDS sequence (opt6) from DENV-1__FJ639794__SS-prME
  source 1..9879: mol_type = other RNA
agcgtgactatgcttttgatgctacttcccacggcattagctttccacttaactaccagaggaggtgaacctcacatgattgttagtaaacaagaacgcggaaaatccctactattcaaaacgagtgctggtgtcaatatgtgtactctcattgcaatggatcttggcgaactatgtgaagacactatgacgtacaaatgcccgaggataaccgaagcagaacctgacgacgtcgactgttggtgcaacgccactgatacgtgggtaacgtatggtacttgcagtcaaaccggtgaacacaggcgagacaaaaggtccgtagctttggctccacatgtaggactagggttagaaacgcgcaccgaaacgtggatgtcttccgaaggggcatggaaacaaattcaaagggtagaaacatgggcactacgacatcccggctttacagtaatagccctatttctagcacacgcgattggaacgtctataacacaaaaaggtataattttcattttattaatgctcgtaaccccatcaatggcaatgcgttgtgtaggaataggtaatcgagattttgtggaaggcctttcaggcgccacatgggtcgatgtagtactagaacatggatcctgtgttaccacaatggccaaaaataaacctactctggatatagaattgttaaaaactgaagttactaatccggcagtcttaagaaaactatgcattgaagcaaaaatatctaacacaactacagatagccgctgccctacgcaaggtgaagcgactcttgtcgaagaacaagacgcaaacttcgtctgccgccgcacatttgtagatagagggtggggaaatggctgtggattattcggaaaaggtagtcttctgacatgtgctaaattcaaatgtgtaaccaaactcgaaggcaaaatagtccaatacgaaaatctaaaatacagcgtaatcgtgaccgtacatacgggggatcaacaccaagttggcaatgaaaccactgaacacgggactatagctactataaccccacaagctcccacatcagaaatccaacttacggattacggagcactaactttagactgtagccctaggacgggtctagatttcaacgaaatggtactactaactatgaaagaaaaatcatggttagtccataaacaatggtttctagatttaccattaccatggacatccggagcgtcaacgtcacaagaaacttggaaccgacaagatctattagttacgtttaaaacagctcatgccaagaaacaagaagtggtagttttgggatcgcaagaaggggctatgcatacggctcttacgggcgcaacagaaattcaaacaagtgggacaacaactatattcgctggtcatttaaaatgccgtttaaaaatggataaactcacactgaaagggatgtcttacgttatgtgcactggctcctttaaattagaaaaagaagttgcggaaacacaacatggcactgtgcttgtacaagtaaaatatgagggcacagatgctccgtgtaaaataccattttcaacgcaagatgaaaaaggagtgacacaaaatggccgccttataaccgctaaccctattgttacggataaagaaaaacccgttaacatagaaacagaaccaccctttggcgagtcgtatatcgtagtcggtgctggggaaaaagcattgaaactcagctggtttaaaaagggatcaagtattggtaaaatgtttgaagctacagcgcgtggagcacgcagaatggcaatattgggtgacacggcttgggacttcggctcgataggtggcgtatttacaagtgttggtaaattagtgcaccaagtatttggtacagcctacggcgtccttttcagtggagtttcatggacaatgaaaattgggatcggcattttgcttacgtggttaggattgaatagccgttctacgtcacttagtatgacgtgtatagtcgttggtatggtaacattatatcttggagtaatggtacaggcagattctggttgtgtaataaactggaaggggagagaactgaagtgcggatcaggaatcttcgtcacaaatgaagtacacacatggaccgaacaatataaatttcaggccgacagtcctaaaagattaagcgcagcaatcggtaaggcttgggaagaaggcgtgtgtggcattagatcagccacacgacttgaaaacattatgtggaaacaaatatcaaatgaattaaatcatatactactcgaaaatgatatgaaattcacagtagtagtaggagatgctaatggaatactagctcaaggtaaaaagatgattaggcctcagcccatggaacataaatatagttggaaatcttggggtaaagcgaaaataataggagcagatatacaaaacacgacatttataatcgatggcccagacacaccagaatgtccagatggacaaagggcatggaacatttgggaagtcgaagactacggtttcggaatattcacaactaacatatggcttaagttaagagacagttacacacaaatgtgtgaccatagactaatgtcagccgccataaaagactcgaaagcagtacacgcagacatgggttattggattgagagcgagaaaaacgaaacatggaaattagctagagcttcatttatagaagtgaaaacgtgtacttggccaaagtcacatacactatggagtaatggtgtactcgaatctgagatgataataccaaaaatctacggaggtcctatctctcaacataactatcgaccaggctattttacacaaactgctgggccgtggcatttagggaaactagagctggattttgatctatgtgaaggaacaacggtcgtagtagacgagcactgtggaaatcggggcccaagtttacgcacaactacagtaacaggaaagataatacatgagtggtgctgtagaagctgtactttaccaccacttagattcagaggcgaagatgggtgctggtatggaatggagatacgaccagtaaaagaaaaggaggagaatctagtccgatcgatggtttcagcaggttcaggcgaagtagactcatttagtttaggtatcctttgcgtaagcattatgatcgaagaagtcatgcgtagtcgttggtcacgtaaaatgttaatgacgggtactctcgcggttttcttgcttttaataatgggacagttgacgtggaatgatttaatcaggctgtgcataatggtaggggcaaatgcatcagatagaatgggtatggggacgacctatctagcgctaatggctacttttaaaatgaggccaatgtttgcggttgggttattattcagacgtctcacttctcgtgaagtgctacttcttacaattggtttaagcctcgttgcaagcgtagaattacctaacagtttagaagaattaggagacggtttggcaatggggataatgatgctaaaattactcactgagttccaacctcaccagttatggacaacgctgttatcattaactttcgtaaaaacaacactatctctcgattatgcttggaaaactactgcaatggtactttcaattgtcagcttgttccctctatgcctctcaacaaccagtcagaaaactacttggttgccagtacttctggggtcatttggttgcaaaccgttaactatgtttctaattacagaaaataagatttggggtagaaagagttggccccttaatgagggtattatggcaatagggatagttagtatcctactaagttcattacttaaaaatgatgttcctttagcaggaccactcatcgccggaggcatgttaattgcttgttatgttatcagtgggtcctctgcagacctatcgttggaaaaggctgccgaggtaagttgggagcaagaagcagagcatagtggagcctcacataacatattagtagaggtccaagacgatgggaccatgaaaattaaagacgaagagagagatgacacattaactatacttttaaaagctactctccttgccgtgagtggagtgtatcccatgtcaatacctgccacacttttcgtttggtacttctggcagaagaagaaacaaaggtcaggagttttatgggatacaccatcgccacctgaagtagagcgagcagtactagacgatgggatatatagaatactgcagagagggttactaggaagatcacaggttggagtaggtgtatttcaagatggagtttttcatacaatgtggcacgtgacaaggggtgctgtactaatgtaccaaggaaaaagactagaacccagctgggcttctgttaagaaggaccttatctcatatggagggggatggcgattccaaggtagttggaacacaggtgaagaagtgcaagtaattgcagtagaaccaggcaaaaatcccaaaaatgtgcagaccacaccaggaacatttaaaacgcccgaaggcgaagttggggctattgcgctggattttaaacccggaacaagtggatcaccaatagtaaacagagagggtaaaattgtgggcttgtatggtaatggagttgtcacaacgtcaggaacatacgtgagtgctatagcacaggcaaaggcgagccaggaagggcctctacctgaaattgaagatgaagtattcaagaaacgtaatttaactatcatggatcttcatccaggatcagggaaaacaagaagatatctaccagccatagttagagaagcaattaagagaaaattgagaacactaatactagcgccaactagagtagtagcctctgaaatggcagaagctctaaagggcatgcctatcagatatcagacaaccgcagtcaagagcgaacatactggtcgtgaaatcgtagatctgatgtgtcatgcaacctttaccatgcgattgttgtcaccggtgcgtgtaccaaactataatatgataataatggatgaagcacactttactgaccctgcatctatagcggcaaggggatacatatctactagagtaggcatgggcgaggctgcagcgatttttatgacggcaacgccgccaggttcggtagaggcttttccacagtcaaatgcggtgatccaagatgaggaaagagatataccagaacgttcgtggaacttaggttatgattggattaccgactttccaggtaaaaccgtgtggtttgtgccctcaataaaatcaggtaatgatatagcgaattgtctgcgtaaaaatggcaaaagagtcattcaattaagtagaaagacgtttgatacggaatatcagaaaaccaagaataatgattgggattacgtagtgacgactgatatatcagagatgggtgcgaactttcgagcagatcgcgtgatagatcctagaagatgtttaaagccagttattttaaaagatgggcccgaacgagtgatactcgcggggccaatgccagtgacagttgccagcgccgcacaaagaagaggaagaataggacgcaatcaaaataaagagggtgaccaatacgtatatatgggacaacccttaaacaatgatgaagatcatgcacactggacggaagcaaagatgttactagataatataaataccccggagggaataatccccgctttattcgaaccagagagggagaaatcggctgctattgacggggagtatcggctacgaggagaggcccgtaagacgtttgttgaattgatgaggaggggtgatttgcctgtgtggctctcgtacaaagttgcaagcgaagggtttcaatacagtgatcgaagatggtgtttcgatggggaacgaaacaatcaagtactagaggagaatatggacgttgaaatatggacaaaagagggagaacgaaagaaactaagacctagatggttagatgctcgtacgtattcagatcccctagcactcagggagttcaaggagtttgccgcgggtcgaagatccgtttctggcgatttaattttagaaataggaaaactacctcagcatcttaccttacgagcgcaaaacgctctagataatttggtaatgctgcataacagcgagcaagggggtaaagcatatcgtcatgctatggaagaactcccagataccattgaaacattaatgctactcgctttaattgctgtactaacaggaggggtaacacttttctttttatctggtaaaggcctgggaaagacaagtattgggttattgtgtgtaacggcgagtagcgcattactttggatggcgtccgtggaaccacattggatagccgcttctatcatcttagagttctttctaatggttttgcttattccagagcctgaccggcagcgtacgccacaggataatcaactagcgtacgttgtaatcggacttctctttatgatcctaacagttgcagcgaatgaaatgggcctattagaaacgactaagaaagatctcggaataggttatgttgcagcagagaatcaccagcacgcgacaatgttagacgtcgacttgcgacctgcaagtgcttggacattatatgccgttgcgacgaccgttataacacccatgatgcgccataccatagagaatacaacggcgaatataagcctcacagcaatagcaaaccaagcagctatattaatgggtttagacaaagggtggcctatcagcaagatggatataggcgtaccacttctagcgctgggttgctattcgcaagtaaaccctctaaccttgacagccgctgttctaatgttagtggcgcattatgccatcataggtccagggttgcaggctaaggccacaagagaagcccagaaaaggacagcggctggaattatgaaaaatcctacagtagacggtatcgtggcaattgatttagacccggtagtatatgatgcgaaattcgagaaacagttagggcaaataatgctgttaatattatgtacatcacaaatccttctaatgagaacaacgtgggccctatgtgagtctataacccttgctactggacccttgaccacactatgggaaggctctccaggcaaattctggaacactaccatagcagtctctatggcgaacatattcagaggaagctatttagcaggagctggacttgcttttagcctgatgaaaagtctaggcggcggccgaagaggcacgggggcccagggagagacactcggggaaaaatggaagcgtcaactcaaccaactttcaaaatcagagttcaatacgtataagagatcaggtataatggaagtagacagatccgaagcaaaagaagggctaaaaagaggagaaactaccaagcacgcagttagtagaggcaccgcgaaattgagatggtttgtagaacgaaatttagttaaacctgaaggcaaggtcatcgacctaggctgtgggcgaggaggatggtcttattactgtgctggactcaagaaagtcactgaagtaaaaggatatactaagggtggtcctgggcatgaagaacccattccaatggcaacctacgggtggaatcttgtcaaacttcattcaggaaaagacgtctttttcatgcccccagaaaaatgcgatacattactatgtgatataggcgaatcttccccaaatccgacaatagaagaagggaggaccttaagggtattgaaaatggtagaaccctggctcaagggcaatcaattctgtattaaaattctaaacccatatatgccctcagttgttgaaactttagaacaaatgcaaaggaaacacggcggaatgctcgtccgaaatcctctcagtaggaactcaacccatgagatgtattgggtaagttgtggaactggtaatatcgtcagtgcagtcaacatgacttctcgaatgttactgaatcgattcaccatggtacaccgtaagcctacatacgaaagagatgtagatctaggagcaggaactaggcacgtcgctgttgagccggaagtggcgaacctagatattataggacagagaatagaaaacatcaaaaacgaacacaaatccacttggcattatgatgaagacaacccatataaaacgtgggcttaccacggtagctatgaggtgaaaccatcaggttcagcttcatctatggttaacggtgtcgtaaggttattaactaaaccgtgggacgttatacctatggttacgcagatcgcaatgaccgacactacaccatttggccaacaacgggtgtttaaagaaaaagtggacactaggacaccaagagctaaaagaggaacaacacaaatcatggaagttaccgctaaatggttatggggatttctgtcaagaaataagaaaccgcggatttgtacgagggaagagttcacacgaaaagtacggtcaaacgcggcgattggagctgtattcgtcgatgaaaatcaatggaatagcgcaaaagaagcagttgaagacgaaagattctgggacctagtccaccgagagagagagctccacaaacagggaaagtgtgcgacgtgtgtctataatatgatgggaaagagagagaagaaattaggagagttcggaaaagctaagggatcccgtgctatctggtatatgtggctgggggcccgatttttagaatttgaagccttaggattcatgaatgaagatcattggttcagcagagagaatagcctctcaggagttgagggggaaggacttcacaaactaggttacatattgcgagacatatctaaaattcctggaggaaacatgtacgctgacgataccgccggctgggatacgagaataacagaagatgatctacaaaacgaagcaaaaattaccgacatcatggagcccgaacatgccctactggccacgtcgatatttaaactaacgtaccaaaacaaagtagtaagagtacagagacccgcgaaaaatggaacagtaatggacgtaatctctaggagagaccaacgaggatctggccaagtaggtacttatggtctaaataccttcacaaatatggaagttcaactaataagacaaatggaaagcgagggaatatttttgccatcagaactagaaactccaaatttagccgaaagagtcctagactggctcgaaaaacacggagccgaacgattaaagagaatggctatcagcggggatgattgcgtcgtgaaacctatagatgaccggtttgctaccgcgttgaccgcactaaatgacatgggcaaagtaagaaaagatatcccccagtgggaaccatctaaggggtggaacgattggcaacaagtacctttttgtagccatcattttcaccaattggtaatgaaagatggaagagaaatagtcgttccttgtcgtaatcaagatgagctagtaggacgtgctcgagtgtcacaaggagccggatggtcattaagggaaacggcctgtctaggaaagagttatgcacagatgtggcaactcatgtatttccacaggagggatttgcgattggccgcaaacgcaatttgtagcgcggtaccggtcgactgggtaccaacttcaagaacaacttggagtattcatgcacaccatcagtggatgactacagaggatatgttgtcagtttggaatagagtctggatcgaggaaaacccttggatggaagacaaaacccacgtcagttcttgggaagaagttccttatttaggtaaaagagaagatcaatggtgcgggagcttaatcggactcactgcgagggccacttgggcaacaaatattcaggtcgcaattaatcaagttagacgattaataggtaatgagaactatctggactacatgacatcaatgaaaagattcaaaaatgagagtgatccagagggcgcactctggtag

SEQ ID NO: 21408 - RNA, 9879 nt, synthetic construct
  misc_feature 1..9879: note = derived and/or modified CDS sequence (opt6) from DENV-1__FJ639796__SS-prME
  source 1..9879: mol_type = other RNA
tcagttactatgttactaatgcttttgccaactgcgctcgcatttcacttgaccactcgcggaggagaacctcacatgattgtatcaaaacaagaacgaggaaaatcgctactctttaaaacttctgcgggggttaacatgtgcacactcatagcaatggatctcggggaattgtgcgaagataccatgacctacaaatgtcctcgaataactgaagcagaaccagatgacgttgattgttggtgcaatgctactgacacctgggttacctacggcacatgttcccaaactggagaacaccgtcgagataaacggtctgttgcacttgcgccacacgtcggtttgggactagaaacgcgtactgaaacctggatgtcaagcgagggagcatggaaacagatacaaagagtagaaacttgggctttacgtcatcctggatttacagttatagcactatttctagctcacgctataggtacgagcattacacaaaaaggaataatttttatacttttgatgcttgtcacccctagtatggctatgaggtgtgtcggaattggtaatcgggactttgtagagggactaagcggagcaacttgggttgatgttgtattagaacacgggtcgtgcgtgactacaatggccaaaaacaaacctacactggatatagaattgttaaaaacggaagtcacaaacccagcagtattacgtaaattatgcattgaagctaaaatatccaacacaaccacagattcgagatgccccactcaaggcgaagctacactggtggaagaacaagacgccaactttgtgtgtaggaggactttcgtagataggggatggggtaacggatgtggtttattcgggaaaggaagtttattgacttgtgcaaaattcaaatgtgtcactaaactggaaggaaaaattgtacaatacgaaaatctaaaatacagcgtaattgtaaccgtacataccggcgaccaacatcaagttggaaatgaaacaacagaacatgggactatagcgacgataacacctcaagctccgacaagtgaaatacaattaactgattacggagccttaacattagactgttccccgagaacaggactagatttcaacgagatggtactcttaacgatgaaagaaaaatcttggctagtacataaacaatggttcttggatcttcctctaccctggacatcgggggcaagcacctcacaagaaacgtggaataggcaagacctattagtgacctttaaaactgcgcacgctaagaaacaagaggttgttgttctgggttcccaagaaggagcgatgcacacagccttaacaggagctaccgagattcaaacttcaggtacaacgacaatatttgcagggcatctaaaatgtcgtctaaaaatggacaaattaacactgaaaggaatgtcctatgttatgtgtactggatcttttaaattagaaaaagaggtcgcagaaacacaacatggaaccgtactcgtccaagttaaatatgaaggtacagatgctccctgcaaaattccattcagtacgcaagatgaaaaaggtgtaacacaaaacggacgtttgataaccgcgaatccgattgttacagataaagaaaaacccgtgaatatagaaactgagccacctttcggggaatcctacatagtagtaggagccggtgagaaagctctcaaattatcatggtttaagaaaggcagctcaattggaaaaatgttcgaagctacagccagaggggcgaggaggatggcaatactcggcgataccgcatgggatttcggttctataggtggtgtttttacatcagttggaaaattagtgcatcaagtgttcggtacagcatatggagtcttatttagcggggtctcttggacgatgaagattggtataggtatattactcacatggctaggtttgaatagtaggtcgacttcgttatcaatgacatgtattgctgtaggaatggtaacattatacttaggtgtaatggtccaggcagatagtggttgtgtaattaactggaaaggaagagaactgaaatgcggctcaggaattttcgttacaaatgaagtacacacttggaccgagcagtataaattccaggctgattctcctaaacgtctttcagcagccattgggaaggcttgggaagaaggtgtatgtggaatacggtcagcaactcgtttagaaaatattatgtggaaacaaatttctaacgaactaaatcacatcctgcttgagaatgatatgaaattcacggttgtagtaggagacgcaaatgggattctagcccaaggtaagaaaatgatccgccctcaaccgatggaacacaaatacagttggaaaagttggggcaaagcgaaaataatcggagcagatatccaaaatacgacatttattattgacggaccagatacccctgaatgtccagatgggcaacgagcttggaatatatgggaagttgaagattacggattcggcatattcaccactaatatatggttaaagttgcgagactcttacacccagatgtgtgaccaccgtttaatgtccgccgcaataaaagacagcaaagcggtacatgcggatatgggatattggatagaaagcgaaaagaatgagacatggaaattggctagagcctctttcatcgaagtaaagacgtgcacatggccaaaaagccacactctttggtctaatggagtactggaaagtgaaatgatcattccaaaaatctatggcggcccaatatcccagcacaactatagacctggatattttacacagacggcaggaccttggcacttgggaaaattagagctagattttgatctgtgtgaaggaactacagttgttgtggacgaacattgtggaaaccgaggtccatcacttcgtaccacaactgtcaccggaaagataattcatgaatggtgttgcagaagctgtactttgcccccactacggttccgtggggaagatggttgttggtatgggatggagattcgacccgttaaggaaaaagaggaaaatttagtaaggtcaatggtttcagcaggtagtggtgaagttgactctttcagcctaggtatattgtgtgttagcataatgattgaagaagttatgaggtctcgatggagccgtaaaatgcttatgaccggcactctcgccgtatttcttctgttaatcatgggccagttgacatggaatgatctcataagactatgtatcatggtgggggccaacgcttctgacaggatgggtatgggtactacgtacttggctctaatggccacgttcaagatgcgacccatgtttgccgttggacttcttttccgaagactaacttcgagagaagtactcctactgacaataggcctatctctggtagcgtctgttgaactcccaaattctctcgaagaacttggtgatgggctagcgatgggaattatgatgctaaaacttctaacagagtttcaaccacatcaattatggaccaccctcttaagtcttacattcgttaagacgacattatcacttgactatgcatggaagacaaccgctatggtactatcaatagtttctctatttccactatgcttatcaacaacaagtcagaaaactacttggctaccagtcctattagggagtttcgggtgtaaaccattgacaatgttccttattacggaaaacaaaatatggggtagaaaatcctggcctctgaatgaaggaatcatggccattggaatagtgtctatactcttgtcttctcttcttaaaaacgatgtcccattagccggaccattaattgctggtggaatgttaatagcatgttatgttataagtggtagttcagcagatctttcactcgagaaagctgccgaagtttcttgggaacaagaagctgagcatagtggggcaagccacaacattttagtggaggttcaagatgacggtacaatgaagattaaagatgaagaacgagatgatacacttacaatactattaaaagccacgttactagcagtatcgggagtatatcccatgagtatacctgcgacacttttcgtatggtacttttggcaaaagaagaaacagagatctggtgtattgtgggatacaccaagcccacctgaggtggaaagagcagtactagacgatggcatataccgaatattacaaaggggactcttaggaagatcacaagtaggtgtaggggtattccaagacggagtatttcatactatgtggcacgttacaaggggtgcagttctaatgtaccagggcaaacgtttagaaccttcatgggcatcagtcaagaaagaccttataagttatggcggcggatggcgctttcaaggctcctggaatacaggagaggaagtgcaggtaatagcagttgagccaggtaaaaatcccaaaaatgtccaaacaacacctggaacatttaaaacgccggaaggagaagtaggagctatcgctttagattttaaaccaggaacaagtggaagtccgattgtaaatagggagggtaagatagtaggtctatacgggaatggagtagttactacatcgggcacctatgttagtgcaatagctcaagcgaaagccagccaggagggccccctgcctgaaattgaagatgaagtcttcaagaaacgtaatcttacaatcatggacttacatccagggagtggtaagactcgtcgatatctcccagcaatagtcagagaagccattaaaagaaaactaagaactttaatactggcaccaactagagtggtagcctcagaaatggcagaggctttaaagggtatgcctataagatatcaaactaccgcggttaaatcagaacataccggaagagaaatcgtagacttaatgtgtcacgcgacgtttactatgcgactattaagtccagtaagagtaccgaattacaatatgatcataatggacgaagctcatttcactgatcctgcatccattgctgctagaggctatatcagcacgcgagtagggatgggagaagcagcagcaatatttatgacagctacacccccaggttcagttgaagcatttccacaatcgaatgccgtgatacaagatgaggagagggatattccagagagatcatggaatagcggatatgattggattacggactttccaggaaaaacagtatggtttgtgcctagtatcaagtcggggaacgacatagctaattgtctcaggaaaaatggaaaaagagttatccagctctcacggaagacttttgacactgaataccagaaaacgaagaataacgattgggactacgttgtcacaacagacatctctgaaatgggtgccaatttccgagcagacagagtaatcgatccaagaagatgtctgaagccagttattctaaaggacggaccagaacgggtaatattagctgggccaatgccagttaccgttgcaagtgctgcccaacgaagaggacgaattggaaggaaccaaaataaagaaggagaccaatacgtatatatgggtcaaccgcttaacaatgatgaagaccatgcacactggacagaagctaagatgcttttagataacataaatactcccgaaggtataattcctgctttattcgaaccagaaagggaaaagtcggccgcgatagatggagaatataggctacgaggagaagccagaaaaacatttgttgaattaatgagaaggggcgatttacctgtctggctaagctataaggtcgcgtcagaaggattccagtattccgaccggagatggtgctttgacggagaacgaaataatcaggtactagaagaaaacatggatgtagaaatctggacaaaagagggtgagagaaagaaactaagaccacgatggttggacgcaaggacttattcagatccattagcacttagagagtttaaagaatttgctgccggtcgacgtagcgtgtctggtgacttaattcttgaaatcggaaaactaccacaacacctaaccctacgagctcaaaatgctttagacaacctggtaatgctgcacaacagtgagcagggcggtaaggcatatagacatgcaatggaagaattacccgacacgattgaaacattgatgctcctcgccttaattgccgtcctaacgggtggtgtaacgctattctttttgagtggtaaggggttaggcaaaacatcgataggattactatgcgtaacagcttcatccgctttactatggatggcgagcgtcgaaccacattggattgcagcttccataattctagaatttttcctaatggtattactcatacctgaaccagaccgtcaaaggaccccacaagataatcagcttgcatatgtagtcataggacttctgtttatgatactaacagttgctgcgaacgagatgggactcttagaaaccacaaagaaagacttaggaattggttacgtcgcagcagaaaaccatcaacatgcgactatgcttgatgtagacttacgtccagccagcgcttggaccttatacgcagtcgctacaacggtcataacaccgatgatgagacacactatagaaaacaccacagctaatataagtcttacagcaatagcgaatcaagctgcaattttaatggggttggataaaggctggcctataagtaagatggatataggagtacctctattggcactaggctgttattcacaagtaaatccactgaccctaacagctgctgttcttatgttagtagcgcactatgctataattggacctggcctgcaagctaaagcaacaagagaggcacaaaaacgaactgcagcaggtattatgaaaaatccaacagtcgacggaatagtagcaattgacctcgatcccgtcgtttacgatgcaaaattcgaaaagcagttgggtcaaataatgttactgatcctttgtaccagccagattctactcatgcgtacaacatgggcattatgcgaaagtattactctggccacaggtccactaaccaccctatgggaaggaagtcctggaaaattctggaatacaacaatagctgtctctatggccaacatattcaggggctcctatctagctggtgcaggcttagcattttcacttatgaaatcacttggcggtggtagaagaggtacgggagcacaaggggagacactgggtgaaaagtggaagagacaactaaatcaattatcaaagagtgagttcaatacatataaaagaagtggaattatggaagttgataggagtgaagcaaaagaagggctgaaaagaggggaaaccacgaaacatgccgtatcacgtggaaccgccaagctcaggtggtttgtcgaacgaaatctggtaaaacctgaaggaaaggtaatagacttaggatgcggtaggggcggctggtcttattattgcgcgggccttaaaaaggttacagaggtaaaaggatatacaaaaggtggacccggacatgaagaaccaattccgatggccacttacggatggaatctggtaaaactacactccggtaaagatgtcttctttatgccaccagaaaaatgtgacacactattatgcgacatcggagaatcctcgcccaaccccacgatagaagaaggaaggacactcagggtattaaaaatggtcgagccgtggttgaaaggaaaccaattctgtataaaaatcctcaatccatacatgccctcggtagtcgaaacgctggaacagatgcagaggaaacatggcgggatgctcgttagaaaccctctctcaagaaacagtacacacgaaatgtattgggtatcctgtggcaccggtaacatagtgtccgcggtaaatatgacttctaggatgttgctaaatcgttttactatggctcacagaaaacctacctacgaacgtgatgtcgatttgggggcaggaactaggcacgtcgctgtcgaaccagaagtcgcaaacttggatataattggccaaagaatagaaaatatcaaaaacgagcacaaatccacatggcattatgatgaagacaacccgtataagacatgggcctaccacggatcatacgaagtgaaaccatctgggtcagcctcgtctatggttaatggagtggtccgattattaacgaaaccttgggacgtgataccaatggttacacaaattgcaatgactgatactacaccatttggacagcagagggtctttaaggagaaagtcgatacaagaaccccacgggcgaaacgaggaactacccagattatggaagtaacagcgaagtggttgtggggtttcctttcacgaaacaagaaaccaagaatttgtactagagaagaatttacccgcaaagtaagaagcaacgcagcaataggcgcagttttcgtagatgaaaatcaatggaatagcgccaaggaagcggttgaagatgaaaggttttgggaccttgtgcacagagagagagaactccacaaacagggaaaatgcgctacatgtgtttacaatatgatgggtaaaagagagaagaaattaggggaatttggaaaagctaagggatctagagctatctggtatatgtggctgggagcaagatttttagaatttgaagcactgggatttatgaatgaagatcattggttttctcgagaaaattctttatcgggtgttgaaggagaaggtctacataaactagggtacattctaagagatatcagtaagattccaggaggaaatatgtatgccgatgacactgcaggatgggataccagaattacggaggatgatttacaaaacgaagctaagattacagatataatggaacctgagcatgccctattagctacttcgatatttaaactaacataccagaataaagttgttagagttcaaagacccgccaaaaatggcactgttatggatgtaatcagccggagagatcaaaggggctcgggccaagtaggcacgtacgggctaaacacattcactaacatggaagtacagctcataagacaaatggaatctgaaggaatattcttaccgtcagagttagaaactccaaatctagcagaacgtgtactcgattggcttgaaaaacacggagcggaaagactaaaacgtatggcgatatctggagatgactgtgtggttaaacccattgatgatcgtttcgccacagcattgaccgccctcaacgacatgggtaaagtccgaaaagacattcctcagtgggaaccctcaaaaggatggaacgattggcaacaagtcccattttgtagccaccatttccatcaactaataatgaaagatggaagagaaatagtagtcccctgtagaaatcaggatgaattagtgggtcgagcacgggttagccagggtgcaggatggtctctcagagaaacagcttgtcttggaaaaagttatgctcaaatgtggcaattaatgtatttccaccgccgagatttaagattggctgcaaatgcaatctgctcagctgttcccgtcgactgggtaccaacatcacgcacaacctggagtatacacgcccaccaccaatggatgacaacagaagacatgctttctgtctggaatcgagtttggattgaagaaaatccttggatggaggataaaactcatgtaagttcgtgggaggaagtcccatatcttggaaaacgggaagaccaatggtgtgggtcgttgataggactaactgcgcgtgcaacatgggcaacaaacatacaagttgcgatcaaccaagtacgacgattaatagggaatgaaaactatttagattatatgacaagtatgaaaagatttaaaaatgagtcggatccagagggagcattatggtaa

SEQ ID NO: 21409 - RNA, 9879 nt, synthetic construct
  misc_feature 1..9879: note = derived and/or modified CDS sequence (opt6) from DENV-1__FJ639797__SS-prME
  source 1..9879: mol_type = other RNA
tcagtcactatgctactaatgctgctaccaactgcattagcgtttcacttgacaacgagaggtggtgaaccgcatatgatcgttagtaaacaagaacgtggcaaatcattattatttaaaacttctgcaggcgtaaatatgtgcacgttaattgcaatggacttaggtgaactctgtgaagatacgatgacttataaatgtccacgaattacagaagcggaacctgatgatgttgactgctggtgcaacgcaacggatacatgggtgacgtatggtacatgcagccaaacgggcgaacaccggagagacaaacgttctgttgctcttgcaccacacgtgggactaggccttgaaacgagaacagaaacatggatgtcatctgaaggagcatggaaacaaatacaaagagtcgaaacatgggccttacgacaccccggatttactgttatagcactgttcttagcacatgctataggtacgagtataactcaaaaagggattattttcattttgcttatgttggttaccccatctatggccatgagatgtgtcggtataggtaatagggacttcgtcgaaggattatctggtgctacatgggttgatgtggttttagaacatggatcttgtgtaacgacaatggcgaaaaataaaccaacactagacatagaactcctaaaaacagaagtcacaaacccggcagtattaagaaaattatgtattgaagcaaaaataagtaatacgacaacagattcgagatgtccaactcaaggcgaagctaccttagtagaggaacaagacgcaaattttgtctgtcgtaggacttttgttgatcgcggttggggaaacggttgcggtctatttggaaaaggatcattgttaacatgcgctaaatttaaatgcgtaacaaaacttgaggggaaaatcgttcaatacgagaaccttaaatattcagtcatagtaactgtacatactggcgaccaacaccaagttggaaatgaaactacagaacacggcacaattgctactataactccacaagcgcctaccagcgaaatccaattaactgactatggcgcgctcactttggattgttcacctagaacaggactcgattttaatgaaatggtactcctaaccatgaaagaaaagtcgtggttagtgcacaaacaatggttcttggatctcccgctcccatggacctctggcgcatcaacatctcaggagacatggaatagacaagatttattagttacattcaaaacagcacatgccaagaaacaggaagtagtggttttaggttcgcaggaaggagctatgcatactgcgttaacaggtgctaccgaaatacaaacctcaggaactactacgatattcgcgggacacttaaaatgccgtttgaaaatggataaattgactctgaagggaatgagctatgttatgtgtacagggtcattcaagttggagaaggaagtggcggaaacacagcatggtacagtcttggtacaagttaaatatgaaggcacggatgcaccgtgcaaaataccgtttagtacccaggatgaaaaaggggtgacacagaatggaagacttataactgcgaacccaatagtgacggacaaagaaaaaccagtgaatatagaaaccgagccacccttcggagaatcatatattgttgtcggtgcgggtgagaaagctcttaaattaagttggtttaaaaaggggtcaagcataggaaaaatgtttgaagcgacagcaagaggagcccgaagaatggcaattttaggagacactgcctgggattttggatccataggcggggtatttacgtctgtcggaaaacttgttcatcaggtttttggaaccgcttacggtgtattattttctggagttagttggaccatgaaaattggaataggtatattgctcacctggctcggactaaatagtcgttctacctcgttaagtatgacatgtattgcagtcggtatggtgacactctacttaggagtaatggtccaagccgactccggctgcgtcatcaattggaaaggtagagaattgaaatgtggatctgggatattcgttacaaacgaagtacatacttggactgagcaatataaatttcaggcagatagtcctaaaagattgtccgccgcaataggcagagcgtgggaagaaggcgtttgcggtatccgcagcgcaacacgattagagaatataatgtggaaacaaatctcgaatgaactaaatcatatattactggaaaatgacatgaaatttactgtagtcgtcggggacgcgaatgggattctggctcagggaaagaaaatgattcgaccgcaacccatggaacataaatatagttggaaatcatggggcaaagcaaaaattataggggctgatatacaaaatacaacattcataatcgatggtcccgatacaccggaatgtccagatggtcagagagcttggaacatctgggaagtagaagactacgggtttgggatatttacaactaacatttggctgaaattaagagatagttacacgcaaatgtgtgatcacagattaatgtcagcggcaataaaagattcgaaagccgtacacgccgacatggggtattggatagagagtgagaaaaacgaaacttggaaactagctagagcaagtttcatagaagtcaagacatgcatatggccaaagtcacacacactatggtcaaacggggtattagaatcggaaatgattatccccaaaatatacggtggacccatttcgcagcacaactacagaccaggatatttcactcaaacagctgggccttggcatctcggaaagttagaactcgacttcgacttgtgtgaaggcaccacagtagtagtggacgagcattgcgggaacagggggcccagtctgcgtacaactacggttacgggaaagataatacatgaatggtgttgtagatcttgtaccctaccaccattacgatttaggggagaagacggatgctggtatgggatggagatacgtccagtaaaagaaaaagaggaaaacctagtacgttcgatggtgtcagcaggctctggtgaagtagactctttttctctaggaatattgtgtgtttcgataatgatcgaagaagtcatgagatctcgctggtcgagaaaaatgttaatgactggtacactagcagtctttttactattaatcatggggcaattaacatggaatgacttaataagactttgtatcatggtaggagcaaacgcttctgaccggatgggtatgggaacaacttatctagcacttatggcaacattcaagatgagacccatgtttgctgtagggttactattcaggcggctgacttcaagagaagtcttgctactgacgatcggcttgtcacttgtcgcatcagttgagttacctaactcgctagaggagttgggagacggtttagctatgggaattatgatgttaaaattgctaacagagtttcagccgcaccaactatggacaactttactctcattgacattcgttaaaacaaccctgagcttagattacgcatggaaaaccacagcaatggttctgagtatcgtatcgctatttccattatgtctaagtactacgagtcaaaagactacttggttacctgttttgttgggttcatttggatgtaaacccctcacaatgttcctgataacagaaaacaaaatatggggaagaaaatcttggccattgaatgagggaataatggcaataggaatagtaagcatacttcttagttcattgttaaagaatgatgtcccactagcgggaccactaatagctggagggatgcttattgcatgctatgtaatatctggaagctctgcggacctaagtctagaaaaagcagccgaagtttcctgggaacaggaagctgaacattccggagcatctcataatatattggttgaagtacaggacgacggtacaatgaaaataaaagacgaagagagagatgacaccttaacgatattgttaaaagcaacgttactcgcagtatcgggcgtctaccctatgtccattccagccacgcttttcgtatggtatttttggcagaagaagaaacaaaggagcggagtgctatgggacacaccttcgcctccagaagtcgagcgagcagtactagacgacggcatttaccggattctacaacgtgggttattagggagatcgcaagttggagtaggtgtgttccaagatggagtattccatacgatgtggcatgtaacacggggagcagtattaatgtaccaaggcaaacgtctggagccatcatgggctagcgttaagaaagatcttatttcgtatggaggagggtggaggtttcagggaagctggaatacaggtgaagaggtacaagtaattgcagtggaaccgggcaaaaaccccaaaaatgtccagactactccaggaacattcaaaacgccggaaggcgaagtaggagctatcgcgttagattttaaaccgggaacatcaggaagtccaatcgtcaaccgcgaaggaaaaatcgtaggactctatggaaatggcgtggtaactacctctggcacttatgtctccgcgatagcacaggccaaggccagtcaagagggaccattaccagaaatagaagatgaagtattcaaaaagcgaaacttgacaataatggacctacacccaggttcaggaaaaacgcgacgttatttgccagcaattgtacgtgaagcgataaaaaggaagttaaggacgttaatcctggcaccaactagagtggttgccagtgaaatggcagaagcactgaaaggcatgccaatacgatatcaaaccactgcagtcaaaagcgaacacacgggaagagaaatcgtagacttaatgtgccatgcaacgtttacaatgcgattactatctccagttcgagtacccaactataatatgataattatggatgaagcacactttactgatccagcaagcatagccgccaggggatatatatcgacgagagttgggatgggcgaagcagcagcaatatttatgacggctacacccccgggatcggtagaggcctttccccaatcgaacgccgtcatacaagatgaggaaagggacattccagaaagatcttggaatagtggctatgactggatcacagattttccaggtaaaaccgtatggttcgtaccaagcataaaatcaggcaacgacattgcaaattgtttacgtaaaaacggcaagagggtgattcaactatcccgaaaaacgttcgatacagaatatcagaaaaccaaaaataacgattgggactatgtagtgactactgatattagtgaaatgggtgctaactttcgtgctgacagggttatagatccaagacgatgtttgaaaccagtaatattgaaagacggccccgaacgagtaatactagcaggacctatgcccgtgacagtcgcttctgcagcccaaaggagagggagaatcggcaggaatcagaacaaagaaggtgaccaatacgtttacatgggacaaccattgaacaacgacgaagaccatgcccactggaccgaagcaaagatgctccttgataatataaacacacctgagggcataatcccagcactttttgaaccagaaagagagaaatctgcagcaattgacggtgagtatagactcaggggagaagcaagaaagacattcgttgagctcatgagaaggggcgaccttcccgtgtggctatcatacaaagtcgcctcagaaggctttcagtatagtgatcgtagatggtgttttgacggtgaaagaaataatcaagtgctagaggaaaacatggatgtcgaaatctggacgaaagaaggggaaaggaagaaattgaggccacgatggctcgatgcaagaacttattctgaccctctagcgttaagagaatttaaggaatttgcagctgggcggagaagtgtatctggtgacctcatcctggaaataggtaaactaccacaacatctgactttaagggcgcaaaacgcactagataacttagtaatgttacacaactcggaacaaggagggaaagcctatcgtcacgccatggaggaacttcccgatacaatcgagaccctaatgttgttagcgctaattgctgtcctaaccggcggagtaacgttgttctttttaagcggtaaaggactggggaaaacttccattggacttctatgtgtgactgccagctcagccttactttggatggcttctgtcgaaccacattggatcgctgcttcaatcatccttgagttctttcttatggttttattaattcctgaacccgacagacagcggacaccgcaagataatcagcttgcatacgttgtcatcggattactgtttatgattttgaccgttgcagcaaacgaaatgggcctactagaaacaaccaagaaagatctaggaataggatatgtagcagctgaaaaccatcagcacgccactatgttagatgtagatcttcggccagcaagtgcttggaccttatatgcagttgcgacgaccgtaataacaccaatgatgagacatactatagaaaatacaacagccaatataagtcttacggcgattgctaatcaagcagctattttaatggggttagataaaggttggccaataagtaagatggatattggggtccctctactggcgttaggatgctattcacaagtaaatccgctaacattaactgctgctgttctcatgctagtcgcacattatgccataatagggcctggattacaagcgaaagccacaagggaagcacaaaaacgcacagcagctggcataatgaaaaatcctactgtagatggtatagtcgcaattgaccttgatccagttgtctatgatgcaaaatttgaaaagcaactgggtcaaattatgctgctcatattatgtacaagccaaatattgttaatgagaacaacttgggcgttatgtgaatcaatcaccctagcgacggggcctcttaccaccctgtgggaagggagcccaggtaaattttggaacaccacgatagctgtatcaatggcaaatatcttccgtgggagctatttagcgggggctggtttagccttcagtctaatgaaaagcctaggaggcggaaggcgcgggacaggtgcacaaggcgaaacattaggcgaaaaatggaaacgacagttgaatcagctttcaaaaagtgagttcaatacatacaaacgtagtggcattatggaggtggatcgatcagaagcaaaagagggcttgaagagaggggaaaccacaaagcatgccgttagcagaggtacggcaaaactacggtggtttgttgaaagaaatttagtgaaacccgaaggcaaggtaattgatttaggttgtggtaggggtgggtggtcctattactgcgcaggactcaagaaagtaacagaagtgaagggatatacaaaaggtggtccaggccatgaggaaccgataccaatggcaacatatggttggaatttagtcaaacttcactcaggaaaagatgtgttctttatgccaccggagaaatgtgacacacttctatgtgacattggtgaatctagtcccaatccaactatagaagagggacgtacgttacgtgttcttaaaatggtggagccatggttaaagggaaaccagttctgcataaaaatactcaatccgtatatgccgagtgttgtggaaacactagaacagatgcaaaggaaacacggtgggatgttagtgcgaaatcctctaagtcgaaattccacgcacgaaatgtactgggtaagctgtggtacaggaaatattgtaagcgccgtcaatatgacttcccggatgctattaaacagatttacaatggctcataggaagccaacatacgagcgagacgttgatttaggagctggaacaaggcacgtggctgtagagcctgaagtagcaaaccttgacatcatagggcaacgaatagagaatattaaaaatgagcacaaaagtacatggcattacgacgaagataatccgtacaagacatgggcataccatggatcctacgaagtcaagccttctggttcggcatctagtatggtaaatggagtagtaagacttttaacaaaaccgtgggatgttatcccgatggtaacacaaatagcaatgacagatacaactccttttggacaacaaagggtattcaaggaaaaagttgatacccgaacaccaagagctaaacgaggcactactcaaattatggaagtaaccgcaaagtggttatggggattcctatcacgaaacaagaaaccgcgtatttgcacccgtgaagaatttacaaggaaggtccggagtaacgcagcaattggtgctgtatttgtcgacgaaaaccagtggaacagtgcgaaggaagccgtcgaagacgagagattctgggaccttgtgcatagggaaagagaattacacaaacaaggaaaatgtgcaacctgcgtatacaacatgatgggtaaacgtgagaagaaactaggtgaatttggcaaggccaaaggatcacgagccatatggtatatgtggctaggagctcgattcctagaatttgaagcccttggttttatgaacgaagaccattggttttcaagagaaaattcattaagcggtgtggagggcgaaggtcttcataaactaggttatatcttgcgcgacatttcaaaaatccccggtggaaacatgtatgcagatgatacggcaggatgggatacgaggataacagaagatgacttacaaaatgaagcaaaaataaccgatataatggagccggaacacgcgctattagcgaccagcatatttaaattaacataccaaaataaagtagtacgtgtacaacggccggccaaaaatggcacagtaatggacgttatatcgaggagagatcaacgtgggtcaggtcaggttggtacttacggattgaacacttttaccaatatggaagtgcaacttataaggcaaatggaatcagaaggaatcttcctcccttctgaattggaaacccccaatttggctgaaagagtattagattggctagaaaaacatggtgccgaacgcttgaaaagaatggcaatttccggcgacgattgtgtagtcaaacccattgatgacagattcgcaaccgcccttaccgcattgaacgacatggggaaagtaagaaaggacattccgcaatgggaaccaagcaaaggatggaatgactggcaacaagtcccattctgcagccatcatttccatcaattaattatgaaagacggtagggaaattgtagtgccctgcaggaatcaggacgagctagtgggtagggcacgcgtaagtcagggggccggctggagcttacgcgaaacggcctgtctaggtaaaagttacgcgcaaatgtggcaacttatgtactttcatagacgagatttaagactcgcggctaacgcaatatgttccgctgtcccagtagattgggttccgacgtctaggacaacatggagcatccatgcacatcatcaatggatgactacagaagacatgttgtccgtatggaaccgtgtttggatagaagaaaatccgtggatggaggataaaacacacgtatcttcctgggaagaggtgccatacctaggaaaaagagaagatcagtggtgcggatcacttataggactaactgcaagagctacatgggcgacaaatatccaagtagctataaatcaagtacgaagattaattggcaacgaaaactacttagattatatgacatcaatgaaacgttttaaaaacgaaagtgatcctgaaggagccctatggtag

SEQ ID NO: 21410 - RNA, 9879 nt, synthetic construct
  misc_feature 1..9879: note = derived and/or modified CDS sequence (opt6) from DENV-1__FJ639802__SS-prME
  source 1..9879: mol_type = other RNA
agcgttacaatgcttttaatgttacttccgacagcattggcattccatctgactacccgtgggggagaacctcacatgatagtttcgaaacaagaacgaggtaaaagtttgctgttcaaaacgagcgcaggagtcaatatgtgcacgttaattgcaatggatctaggagaactatgcgaagatacaatgacttacaaatgtccacgaattacggaagctgaaccagacgatgtggattgttggtgcaatgcaacggatacatgggtaacatatggcacatgctcgcagactggtgaacatcggcgagataaaagatcggtagcactagcaccacatgtaggtttaggtcttgaaactcgcactgaaacgtggatgtctagtgaaggtgcatggaaacaaatacaaagagttgaaacatgggcattgcgtcacccaggctttacagtcattgcattattcctagctcacgctatcggtacaagcattacacaaaaaggtattatattcatactcctcatgttggtaacgccatctatggctatgagatgcgtcgggataggaaaccgagacttcgtcgaaggcttgtcgggcgctacctgggttgatgttgtattggaacatggaagttgtgtcactacaatggccaaaaataaaccaaccttagacattgaactgcttaaaacggaagtaacgaaccctgcagtcttacgaaaactatgtatagaagcaaaaatttcaaacacaacaacagatagcagatgccccacacaaggggaagcaacgttggttgaggaacaagacgcgaacttcgtatgccgcagaaccttcgtagatcggggatggggcaatggttgtggtctgtttgggaaaggaagtttattgacttgtgcaaaattcaaatgtgtcaccaaattagaaggaaaaattgtacaatacgagaatcttaaatattccgtaatagtcactgtacacacgggcgatcaacaccaagttggtaatgaaacgacagaacatggaaccattgcgactataacccctcaggcccctacctcggaaatacaactaactgactatggtgcgctcactcttgactgctctccacgcacaggcttggattttaacgagatggttttattaacaatgaaagaaaaatcatggttagtacataaacaatggtttttagacttaccactaccatggacctctggagcatctacttcacaagaaacttggaatagacaagacctattagtcacatttaaaacggctcacgcaaagaaacaggaagtggtggtactgggttcccaagaaggagcaatgcatacagccctcacaggcgctactgaaatacaaacaagtggaacaacaacaatttttgctggccacctcaaatgtaggttaaaaatggataaactaacactgaaaggcatgagctatgttatgtgtacaggaagtttcaaattggaaaaagaagtcgccgaaacgcaacatggaaccgtcctagtacaagtcaaatatgaaggcacagatgccccatgtaaaatacccttctctacccaggacgagaagggtgtgacgcaaaacggtcgactaatcaccgccaacccaatcgtaaccgataaggaaaagcccgtaaatatagagacggagcccccgttcggcgaatcttatattgtagtaggagcaggagaaaaagcattaaaattatcttggtttaaaaagggctcctctatcggcaagatgttcgaagctacagcgagaggagcaaggcgtatggccatattaggtgacacagcctgggactttgggagtatcggcggggtattcactagcgttgggaaacttgtacatcaagttttcggtacagcgtacggagtactgttttccggagtaagctggacaatgaagataggaataggtattttactaacatggctcgggttaaatagcagatcaactagcctatcaatgacatgtatagccgtaggcatggttacactatatttgggtgttatggtacaggccgatagtgggtgtgtaatcaattggaaaggacgggagctaaaatgcggaagcggcatatttgtaacaaacgaagtgcacacatggacagaacaataccgctttcaagcagatagcccaaaaagattatctgcggctattggaaaagcatgggaagagggcgtttgtgggattagaagcgctacaagattagaaaatattatgtggaaacaaatcagcaatgaacttaaccatatattacttgaaaacgatatgaaatttaccgttgtagttggtgacgctaacggcatattggctcaaggcaaaaagatgatccgtccacaacccatggaacataaatactcatggaaaagctggggaaaagcgaagattattggagccgatatacaaaacacaacatttattatcgacggccccgacacacccgagtgtccagatggacaacgggcgtggaacatatgggaggtagaagattacggtttcggaatctttacgacgaatatatggttgaagttaagagatagttacacacagatgtgtgatcatagactcatgtctgcggcaattaaggactcaaaggcggtccatgctgacatgggttattggatagaatctgagaagaatgaaacatggaaactagcccgagcctctttcatagaggtgaagacctgcatctggccaaaaagccatacattatggagcaatggggtattagaatctgagatgattattcctaaaatatatggaggacctataagccaacacaactatcggccaggatattttacgcaaacagctggaccatggcatcttggtaaactcgaactcgactttgatctatgtgagggtacgaccgtagtcgtcgatgaacactgtggaaacaggggaccctcattacgtacaacaaccgtaaccggaaaaataattcatgaatggtgctgtagaagctgcactctccctcctctccgatttaggggagaagatggatgttggtacggaatggaaattagaccagtgaaagaaaaagaagaaaatttggttagaagtatggtaagcgcgggttctggggaagtagattccttttcattaggtatcttatgtgtatctatcatgattgaagaagtcatgcggagtcgatggtctaggaaaatgctgatgactggtacactagctgtgtttctattactaataatgggacaactaacctggaatgacctgataagactatgcataatggtaggagctaacgcgagcgatcgaatggggatgggtactacatatttagcactaatggcaacctttaaaatgagacccatgttcgcggtcggactgctctttcgtaggttaacaagcagagaggtacttctacttacaatcggtctttctctggttgcaagtgttgaacttcctaattcactagaggagttaggagatggattagcaatgggtatcatgatgttaaaactattgacagagtttcaaccccaccagttatggacaacattattatcactaacattcgttaaaacaactttaagcctcgactatgcatggaaaacgacagcaatggttctttcaattgtttcgctttttccgttgtgtttaagtacaacaagccagaaaacgacctggctaccggtattgctaggttcattcggatgtaagccgcttacaatgtttctcatcacagaaaacaagatttggggccgtaaatcgtggcccttaaatgagggtataatggcaattggaatagtatctatacttctaagcagtttactaaagaatgacgttccactggctgggccattaatagcaggaggcatgctcattgcttgctacgtcatttccggtagctctgcggatctcagcttagaaaaagccgccgaggtttcatgggaacaagaagctgaacactcaggggcatcacataacatcctcgttgaagttcaagatgacggtacgatgaagattaaggacgaagaaagagacgacacactaacaattctcctaaaggcaacattattggccgtcagtggggtgtatccgatgagtattccagcaacactcttcgtgtggtatttttggcagaagaagaaacagcggagtggcgtactttgggatacaccaagcccgcctgaagttgaacgcgcggtattagatgacggaatttatcgtattctacaaagaggattactagggaggagtcaagtaggagttggagtattccaggatggagtttttcatactatgtggcatgtcaccagaggagcagttctgatgtatcaaggaaaacgcctagaaccaagttgggcaagtgttaagaaagatttaataagctacggaggcggttggaggtttcaaggatcatggaatacgggagaagaagtacaagttattgcagtagaaccaggcaaaaatcccaaaaatgtccaaacgacaccaggcacgttcaagacaccggaaggtgaagttggggccatagctctcgattttaaaccggggacatcaggaagccccattgtaaatagggagggcaaaatagttggtctctacggaaatggtgtagttaccacttccggcacgtatgtatcagcgatagcccaagccaaagcctcccaagaagggccattacccgaaattgaagatgaggtttttaaaaagcgaaatcttacaatcatggacttacatccaggtagcgggaaaacgagacgttacctaccagcgatagttagggaggctattaaacgaaagttacgcacacttattcttgctccgactagggtagttgcatcggagatggctgaagcgttaaagggaatgccaatcagatatcaaacaacggctgttaagtccgaacatacaggaagagagatcgtagacctcatgtgtcacgccacgtttacaatgagactattgtccccagtccgagtaccaaactacaacatgataattatggacgaagctcactttacagatccagcttctattgcagctagaggctacataagcactcgagtcggtatgggagaagcagcagctatttttatgactgcaacacctccaggctccgtagaggccttcccgcagagcaacgcagttattcaagacgaagaacgagatatcccggaaaggtcttggaactccggatatgactggattacagacttcccagggaaaacggtttggtttgtccccagtataaaaagtggaaatgatatagcaaactgtttgaggaaaaacggcaaacgcgtcattcagctgtcgcgaaaaaccttcgatacagaatatcaaaagactaaaaacaacgattgggactacgtcgtcactacagacatcagtgagatgggtgcaaattttcgagcggatagagttatagaccctcgacgatgcttaaaaccagtaatccttaaagatggacctgaaagagttatattagctgggcctatgcctgtaactgtggcatcagccgctcaaagaagagggcggataggcaggaaccagaataaagaaggcgatcaatacgtttatatgggacaaccactaaataatgatgaggatcatgcgcattggacagaggctaaaatgttactagataatataaacacaccagaaggaatcataccagcactttttgaaccagaaagagagaaatcagcagccatagatggtgaatacagattacgaggggaagctagaaaaacattcgtcgaattaatgagacgaggggatctaccagtatggttatcttataaagtagctagcgaaggctttcaatactctgacagacgctggtgttttgatggagaaaggaacaatcaagtacttgaagaaaacatggacgtggaaatatggacgaaggaaggggaaaggaagaaattgaggccaaggtggctggacgcaagaacatatagtgacccactagcattacgagaatttaaggagttcgccgcaggacgaaggtctgtttcgggcgatcttatactggagataggtaaactaccacagcacctaacgctcagggcacagaatgccttagacaacctcgtgatgctccacaattctgagcagggagggaaagcatatcgacatgcgatggaagaattaccagatacaatagagacactaatgctactagctctcatcgcagtcctcactggaggtgtaacgctattctttctatctgggaaaggactaggcaaaacctctattggtcttttatgtgttactgcttcatcagcattactttggatggcgagtgttgagccacattggatcgctgcctcgataattctcgagttcttcctaatggtactcctaataccagaaccagatagacaacgaactcctcaagacaaccaattggcgtacgtggtaattggtttattatttatgattcttacagtcgctgcaaatgaaatgggtctacttgaaaccactaagaaagatttaggaattggatatgttgcagcagaaaaccatcagcatgctactatgctcgacgtggatctccgtccagcaagcgcctggaccttgtacgcagtcgcaacaacagtgataacaccaatgatgagacacacgatcgaaaatactactgccaatatcagcttaactgcaatcgcgaaccaggccgctatattaatgggattagacaagggctggccaatatctaaaatggacataggggtcccactgctggcgttggggtgctacagtcaggttaatccccttactttgactgctgctgtgctaatgttagttgcacattatgcgataattggtccggggcttcaagcaaaagcaactcgtgaagctcaaaagagaacagcagctggaataatgaaaaacccaacagttgacggaatagtagctatcgatcttgaccctgttgtatatgacgctaaattcgagaaacaattaggtcaaatcatgttattgattctctgtacttcgcagatactgttgatgagaactacctgggcattgtgtgaatcaatcaccttggcgacaggaccacttactacattatgggaaggaagccccgggaagttttggaatacaaccattgctgtaagcatggcaaatatattcagaggaagttacttggctggtgctggattagctttctcattaatgaaatctctaggcggaggtcgtagaggaactggagcacaaggagaaacactaggcgagaaatggaaaaggcagttgaaccaattaagtaaatctgaatttaacacatacaaacgttctggtataatggaagttgaccgatcagaggcgaaagagggccttaaacgaggtgaaactacaaaacacgcagtgtcacgtgggacagccaaactacgatggtttgtagaacgtaacttggttaaacctgaagggaaagtaatagatttaggatgtgggagagggggatggagttattactgtgccggactcaagaaagtaacagaggtgaaaggatatacaaagggtggccctgggcatgaagaaccaataccaatggcaacctatgggtggaacctagtgaaactacattcaggaaaagatgtgttctttatgccgccggaaaaatgcgatacactgttatgtgatattggggaaagctcacccaacccaactatcgaagaaggacgtactctaagggtcttaaagatggttgagccctggcttaaaggaaatcagttctgtataaaaatactgaacccttatatgccctctgtagtcgagacattggaacaaatgcagagaaagcacggcggaatgctagtaaggaatcccttgtcaagaaactccacacatgaaatgtactgggtatcctgtggtacaggcaacatagtttccgcagtaaatatgacgtctcgaatgcttttaaacaggtttacaatggcacatagaaaaccaacatatgagcgagatgtcgacctcggtgctggaacacgtcatgtggctgttgaaccagaagtggcaaatttggatataatcggacagagaatcgagaacataaagaatgaacacaaaagtacatggcattacgatgaagacaatccatataaaacttgggcttatcatgggagttacgaagtgaaaccttccgggagcgcgagttcaatggtaaatggagtcgtccgattactaaccaaaccatgggatgttattccaatggtaactcaaatagccatgacagatacgacaccattcggacaacagagggttttcaaggagaaagtcgacactagaaccccgcgggcaaaacgaggaacaactcaaataatggaagttactgccaaatggctgtggggattcctttccaggaataagaaaccacgaatttgtactcgggaggagttcacgcgaaaagtacgaagtaatgcggcaattggtgcggtttttgtagatgaaaatcaatggaacagtgcaaaagaggcagttgaagacgagaggttctgggacttagtacacagggaacgagaactacataaacaaggtaaatgcgcaacatgcgtatacaatatgatgggaaaaagagagaagaaactcggtgagttcggaaaagcaaagggtagccgtgccatttggtatatgtggttgggagcacgattcctagaatttgaagcattaggattcatgaatgaagatcactggttctcaagagaaaattcactaagcggagtggaaggcgaaggcttgcacaagctgggatatatccttagggatatatcgaagataccgggtggtaatatgtatgcagacgataccgctggttgggacaccagaatcacagaagacgatctacaaaatgaggctaagataactgacataatggaacctgaacacgcactactagcaacatctatttttaagctgacttaccaaaataaggtagtaagggtacagaggccggccaaaaatggaaccgtcatggacgtaatcagtcgtcgagatcagcgggggtccgggcaagtcgggacatacggactgaatacattcacaaacatggaagtacagcttattcgacagatggaatccgagggtatatttttaccaagtgagcttgaaaccccaaacctagcggaacgagtattagactggctcgaaaaacatggagcagaacgtttaaagcgtatggctattagcggggacgactgcgtagtaaagccaatcgatgatagattcgcgacagcactaactgctctcaatgatatgggaaaagttcgaaaagatattcctcagtgggaaccatcgaaaggatggaatgattggcaacaggttcctttttgctcacaccactttcatcaattgatcatgaaggacggtagggagatagttgtcccatgtagaaatcaagacgaattagttggcagagcacgcgtatcacagggcgcaggatggtcacttagagaaaccgcttgcttaggaaaaagctatgcgcaaatgtggcaactcatgtacttccatcgaagggatttacggctggctgctaacgcaatctgttcggctgtgcctgtcgactgggttccaacatcaagaaccacatggtcgattcacgcacaccaccaatggatgactacggaagacatgctgagcgtgtggaatcgcgtatggatagaggagaatccgtggatggaggataaaacccatgttagttcatgggaggaagttccctatctaggaaaaagagaagatcaatggtgtggctcactaattggtttaaccgcaagagccacgtgggccacaaatatacaggtagcgattaaccaagttaggcgactaataggaaatgaaaattatttagattatatgacctcaatgaagcgttttaaaaacgaaagcgatccggaaggtgcactatggtaa

SEQ ID NO: 21411 - RNA, 9879 nt, synthetic construct
  misc_feature 1..9879: note = derived and/or modified CDS sequence (opt6) from DENV-1__JN819410__SS-prME
  source 1..9879: mol_type = other RNA
agtgtaactatgcttcttatgttactacctactgccctagcgtttcatcttacgactaggggaggggaaccgcatatgatagtctccaaacaagaacgtggaaaaagtttactgtttaaaacaagcgctggagtgaatatgtgtacactgattgcgatggatctgggagaattatgcgaagatacaatgacatataaatgtcctcgtataactgaagccgaaccggatgatgtcgattgttggtgtaatgcaacggatacttgggtgacatatggaacatgcagtcaaacaggcgaacatcgcagagagaaaaggagtgtagcactagcaccccatgtaggtttaggcttggaaacaagaaccgaaacgtggatgagttcagaaggcgcttggaaacaaatacaacgagtggaaacttgggcgttaagacacccagggtttacagtgatagcgtttttcttagctcatgcgatcggcaccagtatcactcaaaaaggtataatattcattttgctcatgttagtcacaccaagtatggcaatgcgttgtgtaggaattggaaatcgagattttgtcgaagggttgtccggggcaacatgggttgatgttgttttagaacatggtagttgcgtaactacgatggccaaaaacaaacctacactcgacatagaacttttaaaaacagaagtcacaaaccccgcggtcctgaggaaactatgtatagaagcgaaaatatcgaataccactaccgacagcagatgtcctactcaaggagaagcaacactggtagaggaacaggatgcgaatttcgtatgtaggcgtaccttagtagatcgaggatgggggaacggttgtggattgtttggtaaaggaaatctattaacatgcgctaaattcaaatgtgtcaccaaattagaaggtaaaatcgtgcaatatgagaatctaaaatattctgtcatagttactgttcacaccggagaccaacatcaagttggaaatgaaactacggaacatggaacaatcgctaccatcacacctcaggcccctacttcagagattcaattgactgattatggagcgctaaccttagactgtagtccaagaacaggtctagactttaacgaaatggtacttttgactatgaaagagaaaagttggctggttcataaacaatggttcctagacttaccactgccttggacatctggggcatctacatctcaagaaacatggaatcgacaagatctcttagtaacctttaaaaccgcccacgcgaagaaacaagaggtcgtggttctaggatcacaggagggcgcaatgcacacggcgctaacaggggcgacggagatccaaacgtccggaacgacaaccatttttgcaggccacctgaaatgtagattaaaaatggataaactaacattgaaaggaatgtcctacgttatgtgcacaggctccttcaaattagaaaaagaagtcgcagaaacacagcatggaactgtgctcgtgcaggttaaatacgaaggaactgatgcaccatgtaagataccattttcaacgcaagatgaaaaaggggtaacccagaacggaaggcttattaccgccaatcctatcgtcactgataaagaaaagcctgtgaatatagaaaccgagcctccttttggagaaagctatattgtagtgggtgccggagagaaagcattgaaactatcttggttcaaacgcggttcatcaataggtaaaatgtttgaagcaactgcgagaggagcgcggagaatggcaatactaggagacactgcatgggatttcggttcgattggaggggttttcacatcggttggaaaactggtccatcaagtttttggaacagcctacggagtattattctcaggggtaagctggacgatgaaaatagggattggaattttactaacgtggctaggtttgaactcaagatcaacatctctgtccatgacatgtatcgcagttggaatggtgactctctacttaggggtcatggttcaggcagatagcggatgcgtaataaattggaagggaagggaattaaagtgtggcagtgggatattcgttactaacgaagtacacacatggacggagcaatataaatttcaggcagatagtcccaaaagattatcagccgctataggtaaagcatgggaagaaggggtatgtgggatacgatcagcaacaagacttgaaaacataatgtggaaacaaatctccaatgaattaaatcatatcctattggagaatgatatgaaattcactgtggtcgtaggagacgccaatgggattcttgcacaaggaaagaaaatgatacgaccccagccgatggaacacaaatacagctggaaaagctggggaaaagctaaaataataggcgctgacatacaaaacactacatttatcatcgatggaccggatacacccgaatgtccggacggtcaaagggcgtggaatatctgggaggtagaagattatgggttcggcgtattcaccaccaacatatggctaaaattaagggattcttatacacaaatgtgtgatcacagactaatgagcgcagccatcaaagacagcaaggctgtacacgcggacatgggctattggatcgaatctgagaaaaatgaaacttggaaattagcaagagcaagttttatcgaagtgaagacttgtacatggcctaagtcacacacattatggtcaaatggtgtgctcgaatctgagatgataatacctaaaatctatggtggtcctatatcccagcacaactatagaccaggatactttacacaaactgcaggcccatggcatttgggtaagctagagcttgattttgatttatgtgaaggaaccacagttgtagtagatgagcattgcggaaatcgtggaccgtccttaaggactacaaccgtaacaggcaaaattatacacgaatggtgttgcaggtcatgcacattgccacctctaagatttcgcggtgaggacggatgttggtatggcatggaaattcgccctgtaaaggagaaagaagaaaatcttgtacgtagcatggtaagcgcgggatctggagaagtggactcattttctttagggatactttgcgtgtcaattatgattgaagaagtaatgagaagtcgttggtctcggaaaatgcttatgacaggaacattagcagtgttcttgttactcataatgggacaactaacatggaacgatctaataaggttgtgtataatggttggtgctaatgctagtgatcgcatgggcatgggcacaacatatttagcacttatggccacttttaaaatgaggcctatgttcgctgtaggtctactgttccgacgtttgacgtccagagaagttctgttattgacaataggactgtctttggttgcaagcgtcgagctaccaaattcactagaagaattgggagacggcttagctatgggaatcatgatgttaaagttattaactgaatttcaacctcatcagctgtggacaacattattatcattgacgtttataaaaacaacactttcgttagattacgcttggaagacaacggccatggttctaagcattgtcagcttgttcccattgtgcttaagcacgacatctcagaaaacgacctggttaccagtactactaggctctttcgggtgcaaaccattaacaatgtttctgattactgagaataagatctggggccgtaagtcatggcccttaaatgaaggtataatggcaattggcattgtcagcattttgctgtccagtttacttaagaacgatgtaccactagcaggaccacttatagctggtggaatgctaatcgcttgttatgtgattagtggttctagtgcggatctttcgctggaaaaagctgccgaagtttcatgggaacaagaagccgaacatagcggcgcctcacataatatcttggttgaagtccaagatgatggtactatgaaaatcaaagacgaggaacgtgacgataccctgacaatattgctaaaagcgacgcttctggctgtatcgggagtatacccgatgtctataccagctaccctatttgtatggtacttctggcaaaagaagaaacaaagatcaggagttttatgggatactccgtcaccacctgaagttgaaagagcggtattagatgatggcatataccgcatcctacaaagaggactattaggccgttcgcaagtaggcgtgggggtctttcaagatggagtttttcatactatgtggcacgttacacgtggcgcagttttaatgtaccaaggtaaaagattagagccatcatgggcaagcgtcaagaaagatttgatttcttatggtggaggatggcgatttcaaggctcgtggaataccggagaagaggtacaagtaatagcagtagagccaggtaaaaatccaaagaatgtgcaaactacaccaggaaccttcaaaacaccggaaggggaagtgggcgctatagcattggattttaagcctggaacgagtggcagtcctatcgttaaccgagagggaaaaatagtcgggctctatggaaatggcgtagtcacaacaagtggtacttatgttagtgctattgcacaagctaaagcgtcacaagaagggccattgcctgaaatagaagatgaagttttcaagaaacggaacttgacaataatggacttacacccgggtagcgggaagacgagacgttatctacccgcaatagtacgtgaagcaataaagcgtaaattaagaacacttatattagccccgaccagagttgtggcctccgaaatggcagaggccttgaaaggaatgcccatacgataccaaaccacagcagttaaatctgaacatacgggtcgtgagatagttgatctgatgtgtcacgcaacatttactatgcgactattatctccagtaagggttccaaattataacatgattataatggacgaagctcactttactgatcctgccagcatagcagccagaggctacatcagtacaagggtaggcatgggggaggctgcagctatattcatgacagctactcctcctgggagcgtcgaagcattcccacaaagtaacgctgtcatccaggatgaagaacgcgatattccagaaagaagctggaactcaggttacgattggatcacagattttccaggaaaaacagtctggtttgtgccatctataaaatcaggaaacgatatagcaaattgcctgaggaaaaatggtaaaagggtgatccagctaagtcgaaaaacctttgacacagagtaccagaaaaccaaaaataatgactgggactatgtcgtaacgactgatatatcagagatgggtgcgaacttcagagctgatagggtaatcgatccaaggaggtgtttaaaacccgtgatactgaaagacgggcctgaacgtgtcatattagcggggcccatgcccgttacagttgcgagcgcagcacagagaagagggcggattggtcgaaatcaaaataaagagggtgatcaatacgtatacatgggccaaccactaaacaatgatgaagaccacgcacattggacagaagcgaaaatgctgttagataatattaatactcctgaaggaataataccagcgcttttcgagccagagagagaaaaatcggcagccatcgatggagaataccggctaaggggagaagcccggaaaacttttgtagagttaatgagaagaggggacctccccgtatggctaagttataaggtcgccagtgagggtttccaatactcagatagacgttggtgtttcgacggcgaacgaaataaccaagtgttggaagagaatatggatgtagaaatatggacgaaagagggggaaagaaagaaactcagacctagatggctagacgcccgtacgtattccgacccgctagctttaagagaatttaaagagtttgctgcgggcagacgatcggtgagtggcgaccttatattagaaattggtaaactaccccaacacctcacactcagggcacagaacgcactggataacttggttatgctgcacaattcagaacaaggcggaaaggcttatcgccacgcaatggaagaattaccagacacaatagaaactttaatgctgttagcattaatagcagtactcacagggggcgtaacattgtttttcttatcaggtaaaggactcggaaagacgagcataggtttattatgtgttaccgcaagcagcgcgttactatggatggcgagtgtagaaccacactggattgctgctagtataattctcgagttctttctaatggttctattaattccagaacccgatcgacaaagaacgcctcaagataatcagctagcatatgtagtcatcggactgttgtttatgatattaacagtagctgctaacgagatggggcttttggaaactacgaagaaagacctaggaataggctacgtagccgcggaaaaccaccaacatgctacgatgctggacgtagacttacaccctgcctcagcatggacgctgtacgcagtcgcaacaaccgtaattactcctatgatgaggcacactattgaaaatactacagccaatatcagcttaactgcgatagccaatcaagctgctatcttaatgggtttggacaaaggttggccgatcagtaaaatggatattggtgtcccattattggcattaggctgttactctcaagtaaatcccttaactttaacagcagccgtgctaatgctagtcgcccattatgctataataggccctggacttcaggcaaaagcaacacgagaagcacaaaaacgaaccgcagcaggcattatgaagaaccccacagtagatggtattgtagctatcgatttagatcctgtggtatatgatgcaaaatttgaaaaacagctgggacagattatgctattgatcctatgtacctcccagatcttactgatgagaacaacttgggcactatgtgaaagcattacactagccaccggacctctcacaaccctctgggagggctcgccgggaaagttttggaataccacaatagcggtgtctatggctaatatatttagggggtcgtatctagctggggcggggttggctttctctttaatgaagtcgttgggtgggggtaggagaggaactggagcacagggagaaacgcttggagaaaaatggaagaggcaacttaatcaactaagcaaatctgaatttaatacgtataaaaggagtggtataatggaagtggacagatcagaagcgaaagagggtctaaaacgcggtgaaacaacgaagcacgcagtgagccgaggaacagcgaagctacgatggtttgtggaacgcaaccttgtaaaacctgaaggcaaagtgatcgatttaggatgcggcagaggagggtggtcctactactgcgcagggctaaagaaagttactgaagttaagggatatacaaaaggagggcccggccatgaagaacccataccaatggcgacatacggatggaacttagtgaaattgcattcaggaaaagacgtattctttatgcctcctgaaaaatgtgatacactattatgtgatattggagaaagctcaccaaatcctacaattgaagaagggagaacacttcgagtcttaaaaatggtagagccatggttgcgaggtaatcaattttgcattaaaattttgaatccctacatgcccagtgttgttgaaaccttggaacagatgcaacggaaacatgggggcatgttggttagaaacccactatctagaaattcaacacatgaaatgtattgggtaagctgtggtacagggaacatagtttccgcagtaaatatgactagcagaatgttgttaaataggttcaccatggcacaccgaaagcccacctatgaaagagatgttgacttgggtgctggaacaagacatgttgccgtagaaccggaagttgcaaatctggacataataggtcagcgaattgaaaacattaaaaatgagcataagagtacatggcattacgatgaagacaacccgtataaaacctgggcataccatgggtcatatgaagttaagccatcgggatcagcgagcagcatggtaaatggagttgtaagattactcacaaaaccatgggatgtgatcccaatggtcacacaaattgctatgacagatacaacacctttcgggcaacaaagagtcttcaaagaaaaagttgacacacgaactccacgtgcaaaacgaggaacaacgcagattatggaagtcacagcaaagtggttatggggatttctgtccagaaataagaagcctcgtatttgtactcgggaagaatttaccagaaaagttcgatctaatgcagcaattggggcagtatttgtcgacgaaaatcaatggaactctgccaaagaagccgtagaagatgaacgtttttgggacctggtacacagagaaagggaattacataaacagggcaaatgcgcgacgtgtgtttacaatatgatgggtaaaagagaaaagaaactgggtgagttcggaaaggcaaaaggatcgcgagcaatatggtatatgtggctcggtgcacggtttctcgaatttgaagcactcggatttatgaatgaagatcattggtttagtcgcgagaactcgcttagcggggtcgaaggtgaaggcttgcacaagttaggttacatactacgagacatctctaagataccaggcggaaacatgtacgcagacgacacagccggatgggatacacgaataacagaagacgatctgcagaatgaggctaaaataacagatataatggaaccggaacatgctcttttagctacatctatatttaaattaacgtaccaaaacaaagttgtcagagtacaaagaccggcgaagaatgggacagtaatggatgtcatttcacgtcgagaccaacgaggatcaggacaagtcggaacctacggtctgaacacctttaccaatatggaggtgcaattgatacgtcaaatggagagcgaaggtatctttttgccttctgaactcgaaacaccgaacctcgcggagagagcgttagactggttagaaaaacacggagcagaaaggttaaaaaggatggcgatcagtggagatgattgtgtagtcaaacctattgatgatcgcttcgcaacagcattgaccgcgttaaacgatatgggaaaagtccgaaaagatataccacagtgggaaccatcaaagggctggaatgactggcagcaagtacctttttgcagccaccatttccatcaattgatcatgaaagacggaagagagatagtggtaccatgcaggaaccaggatgaattagtgggtagggctcgagtttcacaaggagcagggtggagtttaagggagactgcatgcttgggtaaaagttacgctcaaatgtggcaattgatgtactttcataggcgagatctgagactagcagcaaacgcaatttgcagcgctgtcccagtggattgggtcccaacctcgcgaaccacatggagtattcatgcacatcatcagtggatgactacagaagatatgttaagtgtttggaacagggtttggatagaagagaatccatggatggaagacaaaacacatgtttctagttgggaagaagtaccgtatttaggcaaaagagaggatcagtggtgcggcagcttaatcggtctaaccgcgcgtgccacatgggcaaccaatatacaagtcgcaattaaccaggtacgacgtcttatcggaaacgaaaactatctagactacatgacaagtatgaaacgtttcaagaacgaatcagatcctgaaggtgctctatggtaa

SEQ ID NO: 21412 - RNA, 9879 nt, synthetic construct
  misc_feature 1..9879: note = derived and/or modified CDS sequence (opt6) from DENV-1__FJ639806__SS-prME
  source 1..9879: mol_type = other RNA
tcagtgacaatgctcctcatgctcctaccaacagcacttgctttccacctaactactcgaggaggggaacctcatatgatagtctctaaacaagaacgaggaaaatcactcctatttaaaacgtcggcgggtgtcaatatgtgtaccctgatagcaatggatctaggagaactgtgtgaagatacaatgacatacaaatgtccgaggataacggaggcagaacctgatgacgtagactgctggtgtaatgcaacggacacttgggttacttatggaacgtgctctcagactggggaacaccgaagagataaaagaagtgttgcattggctccacatgtaggattagggttagaaacgcgaactgaaacttggatgtctagcgaaggcgcatggaaacaaatacaaagggtagaaacctgggctctgcgacatccaggtttcacggtaatagcattattcttggcacacgcgataggcacaagtataacacaaaaagggattattttcatcctgctaatgttagttacaccatctatggcaatgcgttgcgtaggcatcggcaaccgagattttgtggaaggactctcaggcgccacgtgggttgatgtagtattagaacatggttcttgtgtcactaccatggcgaaaaacaaaccaacgttagatattgaattactcaaaacggaggttactaatccagcagttttaaggaaattatgtattgaagcaaaaatcagtaacaccacaaccgattcgagatgtccaacacaaggggaagcaactttagtagaagaacaagacgcaaattttgtatgtagaagaacatttgtcgaccgagggtggggaaacggatgtggtctttttggaaaaggcagtttactaacgtgtgcgaaatttaaatgcgttaccaaattagagggaaaaattgtacaatacgaaaatctgaaatactctgtgattgtaactgtccacactggagatcaacatcaagtcggaaacgaaacaacggaacacggcacaatcgcaactataacgccacaagccccgacatctgagattcaattgactgattacggcgctctaacattagattgttctccgagaactggattggactttaacgaaatggtgttactaactatgaaagaaaaatcttggctagttcacaaacaatggtttcttgatttaccactgccgtggacatctggggcatctacatctcaagagacatggaacagacaagacttattagtaacttttaaaactgcccatgccaagaaacaagaagtagtggttttaggaagccaagaaggtgccatgcacacagcgctaacgggagctacagaaatacaaacgagcggtacgactacaatttttgctggtcacttgaagtgtcgattaaaaatggataaacttaccctcaaaggaatgtcgtacgtcatgtgtactggatcatttaaactagaaaaagaagtagcagaaacccaacacgggacggtcttagtacaggtaaaatatgaaggcaccgatgcgccttgtaagatcccattttcaacacaagacgagaagggagtaacacaaaacggacgtcttataacggctaatcccatagtcactgataaggaaaaacctgtaaatatcgaaacggaaccaccctttggagagagttatattgtagtaggtgcgggggaaaaagccttaaaattatcgtggtttaagaaaggatcgagcatcggaaagatgttcgaagctaccgcacgcggagcgcgaagaatggcgatattgggggatactgcatgggattttgggagtattgggggcgtctttacatcagtggggaaattagttcatcaagtatttggaacagcgtacggagtattattttccggggtcagttggacaatgaaaatcggtatcggcattctactaacttggcttggattaaatagcagatcaacttctcttagtatgacctgtattgcagtcgggatggtcacactatatctcggagttatggtgcaagctgacagtggttgtgtgattaactggaaaggaagagaattgaaatgtggttcagggatatttgtaaccaacgaagtacatacttggacagagcaatacaagtttcaggcggactctcctaaaagactaagtgccgctattgggagagcgtgggaagaaggcgtttgcggcataagatctgccacgagacttgaaaacataatgtggaagcaaatttccaatgaattaaatcacatactactcgaaaacgacatgaagttcaccgtggttgttggagatgctaatggaatcttagcgcagggaaagaaaatgatcagaccccagcccatggaacacaaatattcttggaagtcgtgggggaaagctaaaattataggggccgatattcaaaacacaacattcataatagatggacctgatacgccagaatgtcccgacgggcaaagagcgtggaatatatgggaagttgaagactacggttttggaatattcacaacaaatatatggctcaagctaagggattcatacacacaaatgtgtgaccaccgattgatgtcggcagcaataaaagattcaaaagccgtccacgctgatatgggttactggatcgagtcggagaaaaatgaaacctggaagttagcacgagcatctttcatcgaagttaaaacatgtatatggccaaagtctcatactttgtggtccaatggagttctcgaatctgagatgataataccaaaaatatacggtggtcctatatcgcaacataattatagaccaggttattttacccaaaccgcaggaccctggcacctagggaaactggaacttgacttcgatctgtgcgaaggtaccactgtagtagtcgacgaacactgcggtaacagaggaccaagtctaagaacaacaacagtaacaggaaaaattattcatgaatggtgttgcagatcttgcaccttaccaccattacgatttcgaggagaagacggatgttggtatggaatggagatcagaccagttaaagaaaaagaagaaaatctagtacgctctatggttagtgcaggatcaggagaagtagatagttttagtttgggaatactgtgcgtatcaattatgattgaagaagtgatgcgttcaagatggtcacgaaaaatgcttatgacagggaccctagctgtatttttactcctgataatggggcaactgacatggaacgatctaattcgactatgtattatggtaggtgcaaacgctagtgacagaatgggtatgggcacgacttatttagcgttaatggcaacatttaaaatgaggccaatgtttgctgttggactactcttcagacgccttacctctagagaagtcttactcctgaccatagggctgagcctggtggcaagcgtagaactacctaatagtcttgaagaacttggcgacggacttgcaatgggtattatgatgctaaaacttttgacagaatttcagccacaccagttgtggaccacactcttatcacttacctttgtgaaaaccacactgagtctagactacgcctggaagacaacagcgatggtactgagtatagtctcgctatttcccctttgcctttccaccacatcacagaaaactacttggcttcccgtattgttaggttcatttggctgtaagccattgaccatgtttctaattactgagaataaaatttggggaagaaaaagttggcctttgaatgaaggtattatggcaatcggtatagtcagcatactcctatcttcactgttaaagaacgacgtgccacttgctggaccattaatcgcaggaggaatgcttatcgcgtgctatgtaatctcaggcagcagtgctgatttatcactcgaaaaggcagcagaagtatcatgggaacaagaagcggaacatagtggtgcatcgcataacatacttgtggaggtccaggacgatggaaccatgaaaattaaggatgaggaacgtgacgatacactaaccatattgctgaaagcaacattactcgcagtgtcaggggtgtaccctatgtcgattccagcaacccttttcgtgtggtatttttggcagaagaagaaacaaagatcgggcgtattatgggatacaccgagtcccccagaagtcgaaagagctgttcttgatgacggtatttacagaatattgcaacgcggacttttagggagatctcaggttggagtgggagtttttcaggacggagtctttcacacaatgtggcatgttactagaggcgcggtactaatgtatcagggtaaaagactcgaaccctcttgggcaagtgtcaagaaagatctcatatcatacggaggaggctggagatttcaaggtagctggaataccggtgaggaggtacaagtaatagcagtggagcccggtaagaatcccaaaaacgttcaaactactcccggaacgttcaagaccccagaaggagaagtaggcgccattgcattagacttcaaaccgggtacttcaggctctccaatagtaaaccgggagggcaaaatagtaggactttatggtaatggtgtcgttactacgagcggaacctatgtctctgccatcgcacaagcaaaggcctcgcaagaagggccgctaccggaaatagaagacgaagtatttaaaaagcgtaatttaactattatggatttacaccccggatccggaaaaactcgtcgatatctaccggcgatcgtcagagaggctattaaacgaaaactaagaacattaattttggcacccacgcgagtcgtcgcaagcgaaatggctgaagctcttaaaggaatgccaattagataccagactacggccgtcaagtcagaacatacaggcagggaaattgtggatctgatgtgtcatgccacctttaccatgaggctcttaagcccagtcagagttcccaattacaacatgattattatggatgaagcccacttcaccgatccagcttcaatcgctgcaagaggatacatttcaacacgcgtcggaatgggggaagctgcggctatatttatgacggcaacaccccctggatctgtggaggcattcccacaatcaaacgcagtaatacaagatgaagaaagagatataccagagagatcttggaactcaggttatgactggataacagattttccaggtaaaacagtctggtttgtgcccagcattaaaagcggtaatgatatcgccaattgcctgaggaaaaatggaaaaagagtgatccaactaagcagaaaaacattcgatactgaataccaaaagaccaaaaataatgactgggattatgtagttactacagatatttcagaaatgggagcgaattttagagcggatcgagtcatagacccacgaagatgtttgaagccagtcatcctaaaggatggtccagaacgcgtgatcctcgctggacctatgccagtaaccgtagcatctgccgctcaaagacgaggtcgaatcggacgcaatcagaacaaggaaggagatcagtatgtttatatgggacaaccacttaataatgacgaagaccatgcacattggacagaagcaaaaatgttattggacaacataaatacccctgaaggaataatacccgcactattcgagccagagagagagaaaagtgcagcaattgatggagaatacaggttacgaggcgaagcacgtaaaacatttgttgaacttatgcggcgtggcgatctacccgtatggttaagctataaagtcgcctcagaaggttttcaatactctgaccgtagatggtgttttgatggagagagaaataatcaagttctggaagagaatatggacgtagaaatatggacaaaagaaggagaaaggaaaaagttaagaccgcggtggctcgatgcaagaacgtactcagacccactcgcgcttcgagaatttaaagaatttgctgcaggccgaaggtcagtttcaggcgatctaatactagagattggaaaattaccacaacatctcaccttacgagcacaaaacgcactcgataatctagtaatgcttcacaatagtgaacaaggaggaaaggcatatagacacgcaatggaagaactgccagacaccatagagacactaatgctactagcgctgatagccgttttaactggtggtgttacgctattctttttgagtggtaaaggtctaggcaagacaagtattggtctattatgcgtaacggcttcctctgcattgttgtggatggcaagtgttgaaccacattggatagcagcatccattatattggagttcttcctgatggtgttactcattccggaaccggatagacaaaggacgccacaggataatcaactcgcttacgtcgtaataggtttactgtttatgatcctgactgttgcggcgaacgaaatgggacttctagaaactactaagaaagatctaggaattggttatgtagcggctgaaaaccaccaacatgcaacgatgttagatgtggatctaagacccgcttcggcatggacactttatgcagtagctacaacggttattacaccaatgatgaggcatacaatcgaaaatacaacagctaacatctccttgacggcaatcgcaaatcaagcagcgatcctaatgggcttagataaagggtggcccattagtaaaatggacataggtgtcccgttattagcactaggttgttattctcaagtgaaccctcttacgcttacagcggcggtcctaatgttagtagctcattacgcaatcataggtccgggtttgcaggcaaaagcaacacgtgaagcccaaaagaggactgctgcaggaataatgaagaacccgacggtcgacgggatagtggctatagacctcgaccctgtagtctatgacgccaaatttgaaaagcagctgggacaaataatgctcctaattctatgtacctcgcaaatcttactgatgagaacgacctgggcattgtgtgaatctataacattagcgacagggccattgactacactttgggaaggttctccgggtaagttctggaatacaacaatagcggtaagtatggcaaatatttttcgtggatcatatttggctggagctggtttggctttttcactcatgaaatctctgggtggtggtaggcgtggaacgggcgctcaaggtgaaacgctcggcgaaaaatggaaaagacagttaaatcagctatccaaaagtgagtttaatacatataaaaggtcaggtatcatggaagtcgatcgtagcgaggcaaaagaagggctaaaaaggggtgaaactactaaacatgctgtctcgcgtggaacagcaaaactaaggtggtttgtcgaaagaaacttagtaaaaccagaaggaaaggtaatcgacttaggatgtgggagaggcggctggagttactactgtgctggactaaagaaagttaccgaagttaaggggtatacaaaaggagggccaggccatgaggaacctatccctatggcaacctacggatggaatctggtcaagttacactcagggaaagatgtatttttcatgcctccagaaaaatgtgatacactgctgtgtgatattggtgaatctagcccaaatccgacaatagaagaaggacgaacactaagagtcttaaaaatggtggaaccgtggttaaaaggaaatcaattttgtataaaaattctaaatccttatatgccttctgtagttgaaaccttggaacaaatgcaacgtaaacatgggggcatgcttgtgcgcaacccactttcaagaaattctacacacgaaatgtattgggtttcatgcggaacagggaacatagtcagcgctgttaatatgacatcgagaatgttacttaaccgatttacaatggctcatcgaaaaccaacctacgaaagggatgtggatttaggagcaggtacgcggcacgtggccgttgaaccagaagttgcaaatcttgacataatagggcaacggattgaaaacattaaaaacgagcacaagagtacatggcactatgatgaagacaacccttataagacatgggcatatcacggtagttacgaggtgaaaccgtcgggatcggcatcaagcatggttaacggagttgtcagactattaactaagccatgggatgtaattccaatggtaacacagatagcaatgacggataccacacccttcggccaacagagagtcttcaaggaaaaggttgatacaaggaccccgagggcgaaaagggggacaacgcagataatggaggttacagccaagtggctttggggttttctgtctagaaataagaaacccagaatatgtactcgtgaagaatttacacgaaaagttagaagtaacgccgcgattggggctgtgtttgtagacgaaaatcaatggaacagtgcaaaagaagctgtagaagacgaacgtttctgggatcttgtccatagagaacgcgaattacataagcaagggaagtgtgctacatgcgtttataacatgatgggcaaacgtgagaagaaattaggggaatttggaaaagctaaaggcagcagagcaatatggtatatgtggcttggtgcgcgcttcctggagttcgaggctttaggtttcatgaatgaagatcactggttttcccgcgaaaattctttaagtggggttgaaggtgaaggtctccataaattaggctacattttaagagatatttcaaaaattcctgggggcaatatgtacgctgatgacacagctggatgggatacacgaatcacggaagatgatctacagaacgaggctaaaataactgatataatggaacctgagcatgcattgttagcgacaagtatattcaaactgacttatcaaaacaaggtcgtaagagtgcaaagacctgccaaaaacggcacagttatggatgtaattagtaggcgagatcagcgcgggagtggacaagttggaacgtacggactaaataccttcaccaacatggaagtccagttaatcaggcagatggaatcagaaggaatttttcttccaagcgaattagaaaccccaaacctggcggaaagggtattagactggctaaagaaacatggagctgaaagattaaaacgcatggccatttcaggcgacgactgtgtagtgaaacctatcgatgatagattcgcaacggcacttaccgcactgaacgatatgggtaaagttagaaaagacattccacaatgggaaccctcaaaaggttggaatgattggcaacaggtcccattttgctcacaccattttcaccaactaattatgaaagatggaagagaaatagttgtaccgtgtcgcaatcaagacgagttagttggccgtgcaagagtatcgcaaggcgcaggctggagcctacgggaaaccgcttgccttgggaaatcctacgcacaaatgtggcagcttatgtatttccacagacgagacttgagactagccgcgaacgcaatttgtagtgctgtgcctgtcgattgggtaccaacatcccgaacaacatggtctatacacgcccatcaccaatggatgacaacagaagacatgttatcagtatggaatagagtctggatagaagaaaatccatggatggaggataagacccacgtttcatcatgggaggaggtaccttacctaggtaaaagagaagatcaatggtgtggaagtttgataggtcttacagcgagagcaacttgggcaacaaatattcaagtagcgataaatcaagtaagaagactaataggtaatgagaactatttagattacatgacgtcaatgaaaaggtttaagaatgaatcagacccagaaggcgctctatggtga

SEQ ID NO: 21413 - RNA, 9879 nt, synthetic construct
  misc_feature 1..9879: note = derived and/or modified CDS sequence (opt6) from DENV-1__JN819411__SS-prME
  source 1..9879: mol_type = other RNA
agtgtaactatgttgttaatgctcttgcctacggcacttgcatttcatcttacgacacgaggaggtgaacctcatatgatagtcagtaaacaagaaagaggtaaatcactactcttcaaaacatctgcgggagttaatatgtgtaccttaatcgcaatggatcttggagaactatgtgaagatactatgacatataaatgcccgagaataacagaagctgaaccagacgatgtagattgttggtgcaatgcaactgacacatgggtaacctatggcacgtgctcacaaaccggcgaacacagaagagataaacgatctgtagctcttgctccgcatgtaggtttaggattagaaactagaacagaaacatggatgtctagtgaaggtgcatggaaacaaattcaacgagtagagacgtgggctcttagacacccaggattcacagtaatcgcattgttccttgctcatgcaataggtacttctataacgcagaaaggtataatctttattttattaatgttagttacaccgtctatggcaatgagatgcgtaggaataggcaaccgagattttgtagaaggcttatccggggcaacgtgggtagacgtagtcttagagcatggaagctgtgtcactacaatggctaaaaataaaccaactctagatattgagcttttaaaaacggaagtaacaaatcctgcagtattaaggaaattatgtattgaagcgaaaatttccaacactactaccgactcaagatgcccgactcagggagaagcaacattagtagaagaacaagatgcgaattttgtatgtcgcagaacttttgtagatcgcggttggggaaatggttgtgggttgtttggcaaaggcagtttattaacgtgcgcaaaattcaaatgtgttactaaattagagggaaaaattgtacaatatgaaaatttaaaatatagtgtcattgtaacagtccacaccggagaccaacatcaagtaggaaatgaaacaactgaacatggtacaatagcaacaataacacctcaagcaccgaccagcgagattcaactcacggattatggtgctcttacgctcgactgttcacccaggacgggccttgatttcaatgagatggtactactcactatgaaagaaaaatcgtggcttgtacataaacaatggtttttggacttacctttgccttggacgagtggagccagcacaagtcaggagacctggaatagacaagatttgcttgtaacttttaaaacagcacatgccaagaaacaagaggttgtagttctaggctcacaagagggggcgatgcacacagctttaacgggtgctaccgaaattcaaacgagtggaactaccaccatctttgctggacacttaaaatgtagattgaaaatggacaaattaacactaaaggggatgtcgtatgtcatgtgcacaggaagtttcaaattggagaaggaagttgcggaaacccagcatggaacagttctagtccaagtgaaatatgagggcaccgatgcaccgtgcaaaattccattcagcacgcaagatgaaaaaggagtaacacaaaatggaagactgataacagccaacccaattgtgactgacaaagaaaaacccgtcaacattgaaacagagcctccatttggggaatcatatatcgtagtaggagctggagagaaagctctgaaattatcgtggtttaagaaaggcagttccatagggaaaatgttcgaggctacggcacgcggtgcacgtcggatggcaatcctgggtgacactgcatgggattttgggtcaattgggggtgtctttaccagtgttgggaaattagtccatcaagtattcggaactgcctatggagtattattttcgggtgtttcatggacaatgaaaataggcattggaatactgcttacatggctgggactaaacagtagatcaacaagtctgagtatgacgtgcatagctgtagggatggtaacattatatttgggagtaatggtacaggccgattcaggttgtgtaatcaactggaaaggtagagaactcaaatgtggttcaggtatctttgtaacaaacgaggtacatacatggacggaacaatataagtttcaagcagatagccctaaacgcttaagcgcagctattggtaaggcatgggaagaaggagtatgcggcatacgatccgccactagattggaaaacattatgtggaagcaaattagcaatgaactgaatcacattttgttagagaatgacatgaaatttactgtagtagtaggagacgctaacggaatactagcacaaggcaagaaaatgattcggccacaacctatggaacacaaatacagttggaaatcgtggggaaaagcgaaaatcatcggcgcagatatacagaacactactttcataatagatggccccgatacgcctgaatgtccagacggtcaaagagcttggaatatttgggaagtagaggactacggttttggcatttttaccacaaatatctggctgaaattacgggactcctatacacaaatgtgtgatcacaggttaatgtctgcagctattaaagattctaaagccgttcacgctgatatgggttactggattgagtcggagaaaaatgaaacctggaaactagctagagcgtcgtttattgaggttaagacatgtacttggccgaagagtcatacactttggagtaatggtgttctcgaaagcgaaatgattataccaaaaatttatgggggaccaattagtcaacataattataggcctggctatttcacacagaccgcgggaccctggcacctagggaagttggagttagattttgatctgtgcgagggaacaacagtggtagtcgacgagcattgtggtaatagaggcccgagtctaagaacaactaccgtcacaggtaagattatacatgaatggtgctgcaggtcgtgtaccttacctccattgcgatttaggggcgaggacggttgctggtacggaatggaaattcgacctgtcaaagagaaggaagaaaatcttgtaaggagtatggtatctgcaggatctggagaagtagactccttttcattgggtatattgtgcgtatctatcatgatagaagaagttatgcgttcacgatggagcaggaaaatgttaatgacaggtacactagccgtattcttattacttatagtaggtcagcttacctggaacgatctaataagactatgtataatggtaggtgccaatgcgagtgaccgaatgggcatgggtacaacatatctagctctcatggcgacctttaaaatgagaccaatgtttgcagtaggattgctgttccgacgactgaccagtagggaagtattactcctcactattgggctcagtctagttgcctcagtagaactcccaaacagtctcgaggagttaggagatggactagcaatgggaataatgatgctgaaattgctaactgaatttcaaccacatcaattgtggacaacactactgagtctaacatttgtaaagaccacactaagcctcgattatgcgtggaagacaacagctatggtgctcagtattgtgagcctatttcctctatgtctaagtactacaagccaaaagacaacatggctaccagttctactcggcagctttggttgtaaaccacttactatgtttttaataaccgaaaacaagatatggggacgaaaatcctggcctctaaacgaaggaataatggcaattggtattgtatcgatactacttagcagtttactaaagaacgatgtccctcttgctggcccactgatagctggaggaatgcttatcgcatgctacgtgatctctggtagttccgctgatctaagtttagagaaggccgcagaagtcagctgggaacaagaagcagaacattctggtgcaagccataatatattggtagaagtgcaagacgacgggaccatgaaaattaaagatgaagaacgcgatgataccttaacaatattactaaaagcaacattgctcgcagtgtcaggagtgtatccaatgtctattcctgccacgctttttgtatggtatttttggcagaagaagaaacaacgaagtggtgtactttgggacacaccgtcgccaccggaggtagaaagagcagttctggatgacggtatctatagaatactacaaaggggattacttggtcgatcacaggtgggagtaggtgtatttcaagatggagtctttcatacaatgtggcatgttacaagaggagcggtactcatgtatcaagggaaaaggttagagccaagttgggcttcagtcaagaaagaccttatatcgtacggaggtggctggcggtttcaaggtagctggaatacaggagaagaagtacaggtcatagcagtagaacctggcaaaaatcccaagaatgtacaaactacccctgggacgtttaaaactcccgaaggcgaggtcggagccattgcgcttgattttaaaccaggtacaagtggatcgccaatcgtaaacagagaaggaaaaatagttggtttatatggtaatggcgttgtaacgacttccggtacatatgtctccgcgatagcgcaagcaaaagcatcacaagaaggccctttacccgagatcgaggacgaagtctttaagaaaaggaacctgactattatggaccttcacccaggctcaggcaaaacacgacgttacctaccggcaatcgtacgagaggcaataaaacgcaagttaagaacgctcatcttagctcccactagagtggtcgctagcgaaatggcagaagcgttaaaaggcatgccaattagatatcaaacaacagctgtgaaatcggaacacactggtagagaaatcgtggatctaatgtgtcatgccaccttcaccatgcggctcctttcaccggtgagggtaccaaactataatatgataataatggatgaggctcacttcaccgatccggcatcgattgcggcgcgaggatatatcagtacgcgggttgggatgggcgaggcagccgcgattttcatgactgcaacgccgcccggatcggtagaagcgtttccacaatcgaacgcagttatacaagatgaagagagagacatacctgagcgctcttggaactcggggtatgactggattactgactttccggggaaaacagtctggttcgttcccagtatcaaaagtggtaatgacatagcaaattgtctaaggaaaaacggcaaaagagtaatacaactaagtagaaaaacattcgacactgaatatcagaaaactaagaacaatgattgggactatgttgtaacaacagatattagtgaaatgggcgctaattttagagctgaccgagtcatcgacccaaggcggtgcctgaaaccagtgatcctaaaagatggaccggaacgtgtcattcttgcaggcccgatgccggtaacagtcgcgtcagctgcccaaaggagaggcagaataggaagaaaccaaaacaaagagggtgatcaatatgtatacatggggcaaccgctaaataatgatgaagatcatgcacattggacggaagcaaaaatgttattagacaatatcaatactccagaagggataatcccggctttgttcgaacccgaacgtgaaaaatcagcggcaattgacggtgaatataggttacgtggagaggcaagaaagacatttgtagagttaatgagaagaggggaccttccggtatggctcagttataaagtcgcgtccgaaggttttcaatatagcgatcgaagatggtgtttcgatggagaaagaaataatcaagtactagaggagaatatggatgttgaaatatggacaaaagaaggcgaaagaaagaaattaagaccgagatggctcgacgcacgtacctactctgatccattagcattacgcgagttcaaagagttcgccgcaggaaggagatccgtctccggcgatctaatcttggaaattgggaaattacctcagcatctgactcttcgagctcagaacgctttggataatcttgtcatgttgcacaactctgaacagggcgggaaagcatatagacacgccatggaagaattacctgatacgattgaaacattgatgctactggcacttatagcagttttaacaggcggtgtaactctgttctttctctcaggaaaaggactagggaaaacctccataggactattatgcgtaaccgcctcttcagctctattatggatggcatcagttgaaccgcactggatagcagctagcataatcttagaatttttcctgatggtgctactaattccagaacccgacagacaaagaactcctcaggataatcagctcgcgtatgtagttatcggtttactatttatgatcctcacagtagcggccaatgaaatggggttattagaaaccaccaaaaaggacctagggataggatatgtggccgctgaaaatcatcaacatgcaaccatgcttgatgtagatttgagaccagcttccgcatggactttatatgcagttgcaaccacggtaataactcctatgatgaggcatactatcgaaaacacgactgctaatattagtcttaccgcaattgccaatcaagctgctatactaatgggacttgataaaggatggccaatctccaagatggatataggagtccctctgttagccctcggatgttacagccaagtgaacccactaaccttgaccgctgccgtcttgatgcttgtagctcattacgctattataggacccggtctacaagcaaaagccacacgagaagctcagaaaagaactgcggccggaatcatgaagaatccaactgtagatggtattgtagcaatagaccttgacccggtggtctacgacgcaaagttcgaaaaacaactaggacagataatgttgctaattttatgtacaagccaaattctgctaatgcgtacaacatgggcattatgcgagtccataacgcttgcaacagggccattaactaccctctgggaaggttcaccgggcaaattttggaataccacaatagcagtatccatggcgaatatttttaggggttcatacttagccggtgcaggattggccttcagcttaatgaaaagtctaggaggaggacgacggggtactggagcacaaggagaaaccttaggggaaaaatggaaacgtcaactcaatcaattgtccaagtcagaatttaatacatataaaaggtcaggaatcatggaggtggacaggtcagaagcaaaagagggacttaaaagaggtgaaacgacaaaacatgctgtatcgcgaggtacggcaaaactacgatggttcgtagaacgtaacttagtgaaacccgaggggaaagtaattgatctcggatgcggacggggcggatggagttattattgtgccggcttgaagaaagttactgaagttaagggatatactaagggcggacccggtcatgaagaacctgtgccgatggctacttacgggtggaaccttgttaagttgcattcaggaaaggacgttttctttatgccacccgaaaagtgcgacactctactctgcgacataggtgaatcaagtcctaatcccacaatcgaagaaggaagaacactccgtgtattaaagatggttgagccatggctcaaagggaatcaattttgcattaagattcttaatccctatatgccaagtgtagtagaaaccttggaacaaatgcaaagaaaacacggagggatgctagttaggaatcctttatccagaaacagcacacacgaaatgtattgggtcagttgtggtacaggaaatatcgtgtcagcagtgaacatgacatcgcgtatgcttctaaatcgattcacaatggcacatagaaaacccacatacgaacgtgatgtcgatcttggagcaggaacaagacacgtagccgtagagccagaagttgccaatttggacatcatcggtcagcgaatagagaacataaagaacgagcataaattaacttggcactatgacgaggacaacccatataagacctgggcttatcatggttcctacgaggtgaaacctagtggcagcgccagctcaatggtaaacggtgtcgtcagattgctaacaaaaccatgggatgtaataccaatggtgacccaaatagcgatgacagatacaaccccatttggacagcagagagtctttaaagaaaaggtggacacaagaacccctagggcaaaacgcggtacaacgcaaataatggaagtaacagcaaaatggctgtggggatttttaagtcgaaacaagaaaccgagaatctgtactagagaagagttcacacgaaaagtaaggtctaatgcagctattggagccgtgtttgtagacgaaaatcaatggaacagtgcaaaggaagctgtcgaggatgaaagattctgggatctcgtacacagagaacgtgaacttcacaagcaaggtaaatgcgccacatgtgtttataacatgatgggcaaacgggagaaaaagctcggagaatttgggaaggcaaaagggagtcgggctatttggtatatgtggctgggcgctaggtttctcgagttcgaagcattgggatttatgaatgaagatcattggtttagcagggaaaacagcctaagtggagtcgaaggagagggtttacataaattgggctatatacttagagacatatcaaaaataccagggggaaacatgtatgcagatgatacagcaggctgggacacacgcattactgaagatgatttacaaaatgaggcaaaaataaccgatattatggaacctgaacacgcactattagcaacttcgattttcaaacttacataccaaaataaggtggtgcgagtacaaaggcccgccaagaatggcacggttatggatgtaataagtagaagagaccagagaggatcaggacaagtgggaacctatggtttgaatacatttacaaatatggaagtccaactaatccgacaaatggaaagtgaaggtatattttcaccatcggaattagaaacaccaaatcttgcagagcgtgtactagattggctagaaaaacatggggctgaaaggcttaaacggatggctatctcaggtgatgactgtgttgtaaagccaattgacgacagatttgcaacggcactcacggcactaaatgatatgggaaaagtgcgaaaagatattccacaatgggagccatcaaaagggtggaacgattggcagcaggtaccattttgttcacatcattttcatcaattaataatgaaagacgggcgagaaatagttgtaccgtgtagaaatcaagacgaacttgtaggtagagctcgcgtgtcccaaggggctggatggtctcttagggagaccgcatgtttaggaaaaagttacgcacagatgtggcaattgatgtattttcacagacgagacctacgactggctgcgaacgcaatatgcagcgcagtcccagtagattgggttcccacgtcacgaacgacatggtcgattcacgcgcatcatcaatggatgacgaccgaagatatgctctcggtgtggaatcgggtgtggattgaagaaaatccgtggatggaagacaaaacacatgtatcctcatgggaggaagtaccatatctcgggaaacgagaagatcaatggtgcggttcattaatagggttgacagcaagggctacatgggctacgaatatacaagtagctatcaaccaggttaggcgactaataggaaatgagaattatctagactacatgacgagcatgaaacgattcaagaatgaatcggatccagaaggagcattgtggtaa

SEQ ID NO: 21414 - RNA, 9879 nt, synthetic construct
  misc_feature 1..9879: note = derived and/or modified CDS sequence (opt6) from DENV-1__FJ639812__SS-prME
  source 1..9879: mol_type = other RNA
agcgttactatgctgttaatgttgttacctaccgcattagctttccacttaacaaccagaggtggagaaccgcacatgattgtgtccaaacaagaaagggggaaatcattactgttcaaaacaagtgctggagtcaatatgtgtactttaatagcaatggatttaggtgaactgtgtgaagatactatgacatataaatgccccaggataaccgaagcagaacctgacgatgtagattgttggtgtaacgcaactgacacatgggttacatacggaacatgcagtcaaaccggtgaacaccgtagagacaaacggtcggtcgctctagcacctcatgtcggattggggctcgaaacaagaacagaaacttggatgtcgagtgaaggagcatggaaacaaattcaaagggtagaaacgtgggcactaagacacccgggattcacagtgatagcactattcttagcacatgccataggtaccagcataacccaaaaaggaataattttcatccttttaatgcttgtaactcctagtatggcaatgaggtgcgtgggaataggcaaccgggatttcgtagaaggcctatccggggcgacttgggtagacgtggtattagaacatggaagttgcgttacgactatggcgaaaaacaaaccaacactggatattgaattattaaaaacagaagttacaaacccagcagtactcagaaaattatgcatagaagctaaaatatctaacacgaccacagattcaagatgtccaacacaaggagaagctacgctagtagaagaacaggatgctaactttgtttgtaggcgaacatttgttgataggggttgggggaacggatgcggcttatttggaaaaggcagtctacttacatgcgcaaaatttaaatgcgtaactaaactggaaggcaaaatagttcaatatgagaatttaaaatattcagttattgtgactgtccacaccggcgatcaacatcaagtaggtaacgaaacgactgagcatggaacaatcgctacgatcacaccacaagctcccacgtcagaaatacaacttacagattatggtgctctcacattggattgtagtccacgcactggtctagactttaacgaaatgatgctgctaacaatgaaagaaaaatcctggctagttcacaagcagtggttccttgacttaccactgccctggacatctggagcttcaacgagccaggaaacttggaataggcaagatttacttgtaactttcaaaacagcgcacgccaagaaacaagaagttgttgtattgggaagtcaagaaggcgcaatgcacactgctcttacaggagctaccgaaattcagactagcggtacaacaactatcttcgcaggccatctaaaatgccgattgaaaatggacaaactcactctgaaagggatgtcttatgtaatgtgcaccggtagctttaagttagaaaaggaagtggccgaaacccagcatggaacggtacttgttcaagtaaaatatgaaggaacggacgcgccatgtaaaatcccgttcagcactcaagacgagaaaggagtcactcagaacggacgattgattactgccaaccctatagtaactgataaagagaaaccagtgaatatagaaaccgaaccaccctttggtgaaagttatatagtagttggagccggtgaaaaagctctcaaattgagttggtttaaaaagggctcctcaataggaaagatgtttgaagcaaccgcgagaggggcgagaagaatggctatattaggtgatactgcatgggacttcggaagcatcggaggggtttttacaagtgtcggaaaactggttcaccaagtgtttgggaccgcatacggagtactcttctccggagtttcttggactatgaaaataggaattggtattttactaacttggctaggccttaacagccgttctacgagtctatcaatgacatgcatagcggtcggaatggtaacattatatcttggtgtaatggtgcaggcagattcaggatgtgtaataaactggaaaggacgagaactaaaatgtggtagtggaattttcgtaacaaatgaggtacatacttggacggagcaatataaattccaagcagattcaccaaaaagactatcggcggcaatagggaaggcttgggaagagggcgtctgcgggatacgaagcgctacaaggttagaaaacataatgtggaaacaaataagcaacgaactaaaccatatactattagaaaacgatatgaaattcacggtcgtagtaggcgacgcgaacggaattttggctcaaggcaagaaaatgataaggccccaacccatggaacataaatattcgtggaaatcctggggaaaagctaagattataggtgcagacatacaaaataccactttcattatcgatggtccggatacaccggagtgtccagatggacagcgcgcgtggaatatttgggaagtggaagattacggttttggaatcttcactacaaatatatggcttaagctccgagattcttatacgcaaatgtgtgatcacagactcatgtcagcagcaattaaagactccaaagcggtacatgccgatatgggttattggatcgaaagtgagaaaaatgaaacttggaaacttgcgcgggcctcgttcatagaagtaaaaacgtgcacatggccaaaaagtcatacactctggtccaatggtgtcttagaatccgaaatgatcattcccaaaatttatggtggacctatctcgcaacataattaccgcccgggatattttacacaaacagctgggccctggcatttgggcaaattggaacttgattttgacttatgcgaagggacaacagtagtagtagacgagcactgtgggaataggggtccatcactaagaactaccacagtaacgggaaagattatacacgaatggtgttgcagatcgtgcacattaccacccttgcggtttaggggcgaggatggatgttggtatggaatggaaataaggccagtgaaagaaaaagaagaaaatctagtccgaagtatggtttcagccggaagcggagaagtggattcatttagtctgggaatcttgtgtgtatcaattatgatagaggaagtaatgagatcacggtggtcacgcaaaatgcttatgacaggaactctggcagttttcctacttctaatcatggggcaacttacgtggaatgatctaatcaggttatgtattatggtaggagcgaatgcaagcgatcgtatggggatgggaacaacgtacttggcattaatggctacatttaaaatgagaccaatgttcgctgttggcctgttatttagaaggctaacatctagagaagtactacttctaacaataggactcagcttagtcgcctctgttgaattacccaactccttagaagaacttggcgatggactagcaatgggcataatgatgttaaaattgttaactgagttccaaccacatcaattatggacgacgttgttatccttaactttcgttaaaaccacacttagtctagattatgcttggaagacgactgccatggtattatcaatagtttcattattccctttatgcttgagtacgactagccagaagactacttggttgcctgtgctgcttgggtccttcggatgtaagccattaacgatgtttttgattacggaaaacaaaatatggggaagaaagtcttggcccctgaatgaaggcataatggcaataggaatagtctcaattctgctaagttcattattaaagaacgatgtacctttagccggaccactaatagcgggaggtatgcttatagcctgttacgttatatctggatcatcggctgacttacttttagaaaaagcagctgaagttagctgggaacaggaggcagaacatagtggagcttcccacaatattctggttgaagtgcaggatgatggaacaatgaaaataaaagatgaggaaagagatgataccctaactatattactaaaagcaacactgctagcagtatcaggagtgtatccaatgtcaatacctgccacgttgtttgtgtggtatttttggcagaagaagaaacaaagatcaggggttttatgggatacaccaagtcccccggaagtagaaagggctgtcttagacgatggcatttaccgaatcctacaacgcggcctattaggtaggagccaagtgggagtgggagtttttcaagacggtgtgtttcacacaatgtggcacgtaacgagaggcgctgtactcatgtaccaaggtaaaagacttgagccaagctgggctagcgtgaaaaaggatcttatatcctacggtggaggctggaggtttcagggcagttggaatacaggagaggaagtacaagtgatcgcagttgagccaggcaaaaaccctaagaatgtacaaactacacccgggacattcaaaacaccagaaggagaagttggagctatagccctggattttaaaccaggtacaagcggcagcccaatagtaaaccgtgaaggtaagattgttggactgtacggtaatggagttgttaccacatccggaacttacgtaagcgctatcgcacaagctaaagcctcccaggaggggccattgccagaaatagaagatgaagtttttaagaaaaggaatctaacgattatggacttacatccaggttcaggaaaaacaagaagatatctgcccgcaatagttcgtgaagccattaagcgaaaactacgtacactcatcctcgcacctaccagagtagtcgcgtcagaaatggcagaggccttgaaaggtatgccaatacgttaccaaactacggctgtaaaatcagaacatactggaagggaaatcgtcgatcttatgtgtcacgccacttttacgatgagattactgagtcctgtcagagtccctaattataacatgataatcatggacgaagctcacttcactgatccagcgtcaattgcagcaaggggttacatatcgactagggtaggtatgggggaagctgcggccatttttatgacagctactccaccaggatctgttgaagcatttccacaaagcaacgctgtcattcaggatgaagaaagggatatacctgagcgaagctggaactccggatatgattggataacggatttcccgggtaaaacagtatggtttgtcccatccataaaaagtggcaacgacatagccaactgtctaaggaagaatggtaagcgagtgatacaattaagtaggaagacattcgacacagaataccagaaaacgaaaaataacgattgggattatgtagttaccactgatatatcagaaatgggggctaactttagggcggatagagttattgatccacgccggtgtcttaagcctgttattctgaaagatggaccagaaagggtaatactagccgggcctatgcctgtgacagttgctagtgctgcacaaagaagagggagaataggacgtaaccaaaataaagaaggagatcagtatgtctatatggggcagcccttaaacaacgatgaagaccacgcacattggacagaagcaaaaatgttacttgacaacatcaatactcccgaaggaatcattccagctctcttcgagccagaaagggagaaatcggcagccatcgacggtgaataccgtttgagaggggaagcacgaaaaacgtttgttgagttgatgaggagaggagatttaccggtatggttatcttacaaagttgcgagtgaaggtttccaatactccgatcgtagatggtgctttgacggagaacggaataatcaagttctagaagaaaatatggacgtggagatatggacaaaagagggagaaagaaagaagttaagaccacgctggctcgacgcacgaacatattcagacccactcgccctgcgagaatttaaagagtttgcggcagggagacgttcagtgtcaggagatttaatactcgagataggaaaactgcctcaacatctgacgttaagagctcaaaatgccttagataatttggtaatgctgcacaactcagagcaaggagggaaggcttaccgacacgcgatggaagaacttccagacacaatagaaaccctaatgctattggctcttattgcagtcttaactggcggtgtcactctatttttcttatcgggaaagggtttaggtaagacctcaataggtctactatgcgtgactgctagctcagcgttactatggatggcatcagtagagccgcattggattgctgcaagcataatcttagagttctttctcatggttttgttaatacctgaaccagatagacaaagaacgcctcaagataatcaactcgcgtatgtcgtcattggactactttttatgatccttacagttgctgctaacgaaatgggtttgctcgagaccaccaagaaagatttaggaataggatatgttgcagcagaaaaccatcaacacgcaacgatgctcgatgttgatttaaggcctgctagtgcctggacattgtatgccgttgcaacaactgtaatcactccaatgatgcgacataccattgagaacacaacagcaaatatctccctaacagccatagctaaccaagcagctatattaatgggactagacaaaggatggccaatatcaaagatggacattggagttccattattagcacttggatgttattctcaagtaaacccacttacgctaaccgctgctgtgcttatgcttgtagcacactatgccataatcggacctggtctacaggcgaaagcaactcgagaagctcaaaagaggacagcggcgggaataatgaaaaatccgaccgtggatggtatagtagccattgacttagatcccgtggtctacgatgcaaaattcgagaagcagctaggacaaattatgctgctcatcctttgcaccagtcaaattttattaatgaggacaacctgggcattatgtgaaagcataacgctcgcaacaggtcccttaacaacgctttgggaaggaagtccaggaaaattctggaacacgacgatagctgtgtcaatggcgaatatatttcgaggcagctatcttgccggagctggcttagcattctcgctcatgaaatcattaggaggaggacgaagggggacgggagcacaaggcgaaacactgggtgaaaaatggaaacgccagcttaatcaattgagtaaatctgaatttaacacgtataagagatcagggattatggaagtagatagatcggaagcgaaggaaggtttgaaaaggggcgagaccacaaaacatgctgttagtcgaggaaccgcaaaattgagatggtttgttgagcgaaatttggtgaaaccggaagggaaggtaatagacttaggttgtggtcgtgggggctggtcatattattgtgcaggtctaaagaaagtcacagaagttaaaggatacacaaaaggcggaccaggacatgaggagccaataccaatggcaacatatgggtggaacttagttaagctgcatagtggtaaagatgtatttttcatgcctccagaaaaatgtgataccctcctatgcgatataggagagagtagccccaatccaacaattgaagaaggaagaaccctaagggtgctgaagatggttgagccctggctaaaaggcaatcaattctgcattaagatattaaatccgtacatgccgtccgtagtagaaactcttgaacaaatgcaacgaaaacacggtgggatgttagtgcgaaatcctttatctagaaactcaactcatgaaatgtattgggtctcttgtggaacaggaaacatagtcagtgcagtaaacatgacttcgagaatgctattaaacaggttcacgatggcacatcgtaaaccaacctacgaaagagacgtggaccttggggctggaactagacacgtggcagttgagccagaggtcgctaatcttgacatcataggacaaaggatagagaatattaaaaatgaacataaaagtacatggcattatgatgaagataatccatataaaacttgggcatatcacggtagttacgaggtcaaacctagtggcagcgcaagctcaatggtaaatggagtagtacgattacttacaaagccttgggatgtgattcctatggtcacacaaatagcgatgactgatacaaccccgttcggtcagcagcgagtttttaaagagaaggtggatactagaaccccaagagccaagagaggaactacacaaataatggaagttacggcaaaatggctctggggtttcctatcgcgcaataagaagccgcggatctgtactagggaagagttcacaagaaaagtaagatctaatgcagccattggtgccgtatttgtagatgagaatcaatggaatagtgcgaaagaagccgtggaagacgaacgattctgggatttagtccaccgagagcgagaacttcacaagcaagggaaatgcgccacatgtgtttacaatatgatgggcaaaagagagaagaaactaggagaatttggtaaagccaagggctcaagggccatatggtatatgtggttgggcgcaagatttttagagttcgaggctcttggatttatgaacgaagaccattggttcagccgggaaaatagtctgagtggtgtagaaggcgaaggcttgcataaattaggatacatactaagagatataagcaagataccaggaggaaatatgtacgcggatgacacagcgggatgggatactagaataacagaagacgatttacaaaacgaagcgaaaataaccgacataatggaacctgagcatgctctattagcaacatctatatttaagctcacttatcagaataaggtagttagagtacagagaccggcgaagaatggtacagtcatggacgtaataagtcgcagggaccagcgaggtagcggccaagttggcacatacggccttaatacgtttacaaacatggaggtgcagcttatacgacaaatggaatccgaaggtatatttttgccgtcagaactggaaaccccaaacttggcagaacgggttttagattggctggaaaaacatggagccgaacgactcaagcgaatggctatatcaggcgacgattgtgtggtaaaacccatagatgacagatttgccacagcgttaaccgcattaaatgacatgggaaaggtacgaaaagatataccacagtgggaaccctcgaaagggtggaacgactggcagcaggttccattttgttctcaccactttcatcaactcataatgaaagatggcagagaaatcgtagtgccatgcagaaaccaagacgaattagtgggtcgcgcacgagttagtcagggcgcggggtggagtttgagggaaaccgcttgtctaggaaaatcttacgcccaaatgtggcaactcatgtattttcatagaagagacttacgtctagcagctaatgcaatttgctcagcggtacctgtagattgggtacctacaagtagaacaacatggagcattcatgcccatcaccaatggatgactaccgaagatatgttaagtgtttggaaccgtgtatggattgaagaaaacccctggatggaagataaaacacatgttagttcgtgggaagaagtcccttatctagggaaacgagaagaccaatggtgcggttccttgattggacttacagcaagagcgacatgggccacaaatatccaagtagcaataaaccaagtaagacgattgattggtaatgagaactacctagactatatgacaagtatgaaacgatttaagaacgaaagtgatccagaaggcgctctgtggtga

SEQ ID NO: 21415 - RNA, 9879 nt, synthetic construct
  misc_feature 1..9879: note = derived and/or modified CDS sequence (opt6) from DENV-1__FJ639813__SS-prME
  source 1..9879: mol_type = other RNA
tcggttactatgcttcttatgctattaccaacagcgttagcgttccacttaaccactcgcggcggtgaaccacacatgatagtcagtaaacaagagaggggtaaatctcttctatttaaaacaagcgctggcgttaacatgtgcaccctaatcgcaatggacctcggtgaactatgcgaagatacaatgacatacaaatgccccagaattacagaagcagaacctgatgatgttgattgttggtgcaatgcgactgacacctgggttacatacggaacctgctcacaaaccggagaacatcgacgggacaaacgttccgtggcacttgcgccacatgtcggtttgggtttggagacaagaaccgaaacctggatgagtagtgaaggcgcctggaaacaaatacaaagagtagaaacatgggcattacgacaccctggatttacggtaatagcattatttttagctcacgcaatcggtacatcaattacccaaaaagggataattttcatccttctaatgctagtcactccatcaatggcaatgagatgcgtaggtatagggaacagagactttgttgaaggtctgtccggagctacatgggttgacgtagtactagaacatggaagttgtgtgaccacaatggccaaaaataaaccaaccctggatatagaattgctaaaaacggaggtcatgaacccggcagtgctgcgcaaattatgtatcgaggcgaaaataagtaatactactacagacagtagatgtccaacgcaaggtgaagcaacgttagtcgaagaacaagatgcaaacttcgtgtgcaggcggacttttgtcgacagaggttgggggaatggctgtggcttgttcggcaaaggcagcctattaacatgcgcaaaatttaaatgcgtaactaaactagaaggcaaaatagtgcagtatgaaaacttaaaatacagcgtcattgttaccgtccacactggcgatcagcatcaagtcggtaacgaaacgacggaacatgggactattgccaccattacgccacaggcgccaacatccgaaatacaattaaccgactacggtgcattaacgttagactgttcacctagaacaggtctggattttaatgaaatggttttgctgacaatgaaagagaaaagttggttggtacataaacaatggtttctcgacctaccattaccatggacatctggggcgtccacttcccaagagacatggaatcgacaggacctcttagtgacattcaaaactgcgcatgccaagaaacaagaagtcgtagtgttaggcagtcaagaaggagcaatgcacaccgctctcaccggagctacggaaatacaaactagcggtacgaccaccatatttgccggtcacttaaaatgtcgactaaaaatggacaaattaacactaaaaggaatgagctacgtcatgtgcacaggatcctttaaattagaaaaagaagtagcagaaactcaacatggcacagtgctagtacaagtaaaatacgaaggaacggatgctccatgtaaaatcccattctcgacacaggatgagaagggggtaactcagaacgggagacttatcaccgcaaatccaatagtaacggataaagaaaaaccagtcaacatagaaactgagccgccatttggagaatcttatatagtcgtaggggccggtgaaaaagcacttaaacttagttggttcaagaaaggaagctcaattggaaaaatgttcgaggcaaccgccagaggggctagacgcatggctatattaggggatactgcgtgggacttcggtagcataggaggagtattcactagcgttggaaaactcgtccaccaagtatttggtacggcgtatggtgtcttattttctggagtctcttggactatgaaaatcggaatcggaatactactcacttggttaggcttgaatagtagatcaacatccttcagcatgacatgtatagcggtgggaatggtaaccttataccttggagtaatggtgcaggcagatagcggatgcgtgataaattggaaaggtcgagagctcaaatgcggatcagggatttttgtaactaatgaagttcatacatggaccgaacagtataagtttcaggctgattcgccaaaacggttatccgctgcaatcgggaaagcgtgggaagagggggtctgcggaatccgatcagccaccagactggaaaatatcatgtggaaacaaatatctaacgagttaaatcatatcttactggaaaatgacatgaaatttacggttgtagtgggagatgcaaatggaatactggcacaaggtaagaaaatgattagaccacagcctatggagcataagtacagttggaaatcatggggaaaagccaaaataataggtgctgatatccaaaatactacatttatcatagatgggcctgatactcccgagtgtccggatggacaaagagcatggaacatttgggaagttgaagattatggcttcggcatctttacaaccaatatatggctaaaattaagagattcatatacccaaatgtgtgatcacagattgatgagcgctgcgatcaaggactctaaagctgtacatgcagatatggggtactggatagagagcgagaaaaatgaaacatggaaattagcgcgggcttctttcatagaagtcaaaacatgtacatggcccaaatcacacacactctggtcaaatggagttctcgaatcggagatgataataccgaaaatatatggcgggcctatcagccaacacaattacaggccaggttattttacgcaaactgcaggtccctggcacctagggaaattagagcttgattttgatctctgcgaaggaacgacagtagttgtagatgaacattgcggtaatagaggccctagcctacggacaacgacggtcaccggcaaaatcattcatgaatggtgttgccgatcctgcacactgcctcctttgcgatttagaggggaagacggatgttggtatggtatggaaattagaccggtgaaagagaaggaagaaaatctggtgagatccatggtaagcgctggttcgggagaagtagacagtttttctttagggatattatgtgtatcaataatgatagaagaagttatgcgatcacgatggtcaagaaagatgcttatgacgggcactttagctgtattcctattgctaattatggggcagttgacttggaatgatcttattcgattatgtatcatggtaggtgcaaatgcgagcgatcgtatggggatgggaaccacctatctggcactgatggcgacgtttaaaatgaggccaatgttcgcagtaggtttactttttcgtagattgacctccagagaagtactccttcttacaataggactatctctagttgcgtccgtggaactacctaacagtctagaagaactgggggacgggttggctatgggaattatgatgctcaaattattaactgagttccagccacatcaattatggactactcttctgtcattaacttttgtaaaaaccacactaagccttgattatgcatggaagactactgcaatggttctatctatcgtcagcttatttcccctctgtctgtctactacctcacagaaaactacatggttacccgtgcttctgggtagcttcggttgtaaaccacttacgatgttcctaatcactgagaacaaaatctggggcagaaagagctggcctctgaacgagggtataatggctattggaatcgtatccatactcttgtcatcactactcaaaaacgatgtaccattggcaggaccattaatcgccggtggaatgctaatagcatgttatgtaatatctgggtcaagcgcagacctatcactcgaaaaggcagccgaagttagttgggaacaagaagcggagcacagtggcgcatctcataacatcctagtagaagtacaagacgacggcactatgaaaatcaaggatgaagaaagggatgacaccctaacaatattattaaaagcaacactactagccgtaagtggcgtgtacccaatgagcatacccgctacgctatttgtttggtatttttggcaaaagaagaaacaacgtagcggtgtcttgtgggacacaccttcaccaccagaggtagagagagcagttctagacgatggaatatatagaatattacaacgtgggttgctgggccgttctcaagtgggcgtcggagtattccaagacggtgtttttcataccatgtggcacgtaaccagaggtgccgtacttatgtatcaaggcaaaagactggaaccttcatgggccagtgtcaaaaaggatttaatctcgtatggaggcggttggcgctttcaggggtcatggaacacaggagaggaagtccaagtaattgctgtggaaccaggcaaaaaccctaaaaatgtacaaacaactccaggaacttttaagactccggaaggagaagtaggggcaatcgcgctagattttaaacccggcacctcaggctccccaattgtgaatagagaaggaaaaatcgtagggttatatggaaatggtgtagttactacatcaggaacatacgtttcagcaattgctcaagcaaaggcttcacaagagggcccactacctgaaatagaagacgaagttttcaagaagaggaatttgacaataatggatttacatcctggatccgggaagactaggcgatatttacctgccattgtgagggaagcaattaaaaggaaattgagaacattaatactagctcctacacgagtagttgcgtctgaaatggctgaagcacttaaaggcatgcccatacgataccagacaacagccgtcaagtcagaacatacagggagagaaatagtagatctaatgtgtcatgctacttttacaatgagacttttgtctccagttcgtgtacctaattacaatatgattattatggatgaagcacactttacagacccagccagtatagccgcacgaggctacataagcacgcgtgtcggaatgggcgaagcagcagcaatatttatgactgcgacaccccctggttctgttgaggcttttccacaatccaatgcagtaattcaagacgaagaaagagacattccggaacgctcgtggaacagtggttatgactggattacagatttcccaggtaaaacagtctggtttgtaccatcgatcaaatccggaaatgacatcgcaaattgtcttagaaagaacggcaagagagtaattcagttaagcaggaaaacattcgacactgaatatcagaaaactaaaaataatgactgggattatgtcgtaacgaccgacataagcgagatgggagcaaattttagagcagacagagtgatagatcctcgcagatgcttaaaaccagtaatactgaaagatggtccagaacgagttatactggcaggaccaatgcctgtcaccgtagcgagcgctgcgcagaggagaggacgcattggacgtaatcaaaacaaggaaggagaccagtatgtttatatgggccaaccactaaataatgatgaagaccacgcccattggacagaagcaaaaatgttactggataatattaatactcctgaaggaataataccagcactgtttgaacctgaaagagagaaaagcgctgccatagatggagaatacagactaagaggggaagccagaaaaacatttgtcgaattaatgcgtcgaggcgaccttcccgtatggttatcatacaaagtcgcatctgagggattccaatactcagacaggagatggtgctttgatggtgaaaggaataatcaagtattagaagagaatatggacgttgaaatctggacgaaagaaggagaaagaaagaaacttcgccccaggtggttagatgcgagaacgtattctgatccattagcactaagagagttcaaggaatttgcagcgggtcgcaggtccgtttctggcgatttaatattagagataggtaagctaccacaacaccttactcttcgcgcccaaaatgctttagataatttggtaatgctacacaactctgagcaagggggaaaggcctatagacacgcgatggaagagttaccagacacaatagagacgttaatgctgctcgctcttatagctgtactaacaggaggtgttactctattctttttatctggcaagggattaggcaagacaagtataggcttattatgcgttacagcatcatcagcattattatggatggcctcagtagaacctcattggatagcagcatcaattatacttgagttctttcttatggtacttctaatcccagaaccggatagacagcgaacccctcaagataaccaattagcttatgtcgttattggtcttctctttatgattctgacagttgctgctaatgagatgggcttgttggaaactaccaagaaagatctagggataggatatgttgcagcagagaatcatcaacacgccacaatgttagatgtagacctgagaccagcctcagcgtggacattatatgcggtagccaccacggttatcacacccatgatgaggcatactatagaaaatactactgcaaatataagcctaacggctattgcaaaccaagcggcgattcttatgggtctagataaaggctggccaataagtaaaatggatatcggtgtgcctcttttggctctaggttgttatagccaggtaaatccactcactcttactgctgccgtattaatgctggtagcgcactatgcaattattggaccgggtcttcaggctaaggcaacacgcgaagctcaaaagcgaacagccgcggggattatgaaaaatccgactgtggatggtatagtagcaatagaccttgatccggtagtatacgatgccaaattcgaaaaacaacttggccaaataatgttactcatattatgcacttcgcagatactgttaatgcgaacaacttgggcattatgtgaaagcattacacttgctacaggacctctgactactttatgggagggatcacctggtaagttttggaatactacaatagcagttagtatggcaaacatcttccgcggatcttatttagcaggagcaggccttgctttctcgttaatgaaaagcctcggagggggaagacgtggtacgggcgcccaaggagaaacattaggtgaaaaatggaaaagacagcttaatcaactgtcaaaatccgaatttaatacgtacaaaagatccggaattatggaagtcgaccgatcagaagcgaaagaaggactaaaacgcggtgagacaacaaaacacgccgttagccgcggaacagcaaaattacgctggtttgtcgagcgcaatttagtcaaacccgaagggaaagttatagatcttggatgtggacgagggggatggagctattactgcgctggtcttaagaaagtaactgaagtaaaaggttatactaaaggtggtcccggacatgaagaaccaatgcctatggcgacgtatggttggaacttagtaaaactgcattctggtaaagatgtcttcttcatgccaccggaaaaatgtgacacgttattatgcgatatcggtgaaagtagtccgaatccgactattgaagaaggtcgtacactgcgagtgcttaagatggtggaaccttggctgaaaggaaaccaattctgcataaaaatactaaatccttatatgccttctgtagtcgaaacactagagcagatgcaacgaaaacatggaggtatgctagtgcgcaatcctctctcaagaaattccacacacgaaatgtattgggtatcttgcggaacgggaaacatagtatccgctgttaatatgacatctagaatgttacttaatcgatttactatggcccataggaagccgacttatgaacgggacgtcgatctaggggccggaacacgacacgttgcagtcgaaccagaagtggcaaatctagatattattggccaaagaatagagaacataaagaatgaacataaatcgacatggcattacgatgaagataatccgtacaaaacctgggcttatcatggttcctatgaagtaaaaccgtccggatcggccagctcgatggtgaacggtgtagttcgactcttgacaaaaccctgggacgtgatccccatggtaacacaaatcgcgatgactgataccacaccctttggtcaacaaagggtatttaaggaaaaggttgacactagaaccccacgagcaaaacggggaacaacacaaataatggaagtaacagcgaaatggttatggggattcttaagtcgtaataagaaacctagaatctgcacaagagaagaatttacgcgaaaagttagatcaaattccgctattggtgctgtgttcgtagatgaaaaccaatggaactcagcaaaagaagccgtagaggacgaaagattctgggacctcgtacatagggaaagggaactgcataaacaaggtaaatgtgcaacatgcgtatacaacatgatgggcaaacgagaaaagaaacttggagagttcggaaaagcaaaaggcagtagagcaatctggtatatgtggcttggggcaaggtttcttgagtttgaagcgttaggctttatgaatgaagaccattggttttcaagagaaaatagcctaagtggagtagaaggtgaaggattacacaaactgggatacattttaagggatatctccaaaataccaggaggaaacatgtatgcggacgatactgcgggctgggacacaagaataacagaagacgatctccaaaacgaagcaaaaataaccgacattatggaacctgaacacgctttattagcaacttcaatctttaagctcacctatcaaaacaaagtcgttcgagtccaaagacccgcaaagaatggaacagttatggatgttatatcaagacgagatcagcgaggttcaggccaggtcgggacatatggcttaaatacatttacgaatatggaagttcaactaattcgtcaaatggaatcagaaggcatttttagcccatccgaactagaaactcctaatttggcagaaagggtgttagattggttggaaaaacatggagccgaacgacttaaacgaatggctataagcggggacgattgcgttgtaaaaccaatagatgaccgtttcgctacagcgctgactgcattgaatgatatgggaaaagttagaaaggatattcctcagtgggagccgagtaaaggatggaacgactggcaacaagtaccgttctgttcgcaccacttccaccagttgataatgaaagacggaagagagatagttgtaccatgtcgtaatcaagacgaattagtagggagagccagggttagtcaaggcgcgggttggtcgctccgtgaaacagcttgtttaggcaaaagctatgcacagatgtggcaacttatgtattttcacagaagagacttacggctagcagcaaatgcaatttgttcagcagtacctgtagactgggttccgacttctagaactacatggtcaattcatgctcatcaccaatggatgacgaccgaagatatgttaagtgtatggaatagggtctggatcgaagagaatccgtggatggaggataagacccatgtaagtagttgggaagaggtaccttatttaggaaaacgggaagatcaatggtgcggatctctaataggcttgaccgcgagagcgacatgggcaactaatatacaggtggcgattaaccaggttagacgtcttattggtaatgaaaattacctagactatatgacatcgatgaagaggtttaaaaatgaatcagatccagaaggcgctttgtggtaa

SEQ ID NO: 21416 - RNA, 9879 nt, synthetic construct
  misc_feature 1..9879: note = derived and/or modified CDS sequence (opt6) from DENV-1__JN819412__SS-prME
  source 1..9879: mol_type = other RNA
tcagtaactatgttacttatgctattgccgacagcattagcgtttcatttaacgacacgagggggagaaccccatatgatagtatcgaaacaagaaagaggcaaaagtcttctattcaaaacgagtgctggggttaacatgtgcacgctaatagcaatggatcttggagaattgtgtgaagacaccatgacctataaatgtcctcgtataactgaagcggaaccggatgatgtagattgttggtgtaacgcaactgatacatgggtaacatatggcacatgcagccaaaccggagaacatcggcgggacaaaagatcagtagcacttgcaccacatgtcggtctaggactcgaaactcgtacagaaacatggatgtcttcagaaggcgcatggaaacaaatacaacgagttgaaacttgggcattacggcatccaggttttacagtcattgcactatttttggcacatgcgataggaacatcaataacccaaaaaggtattattttcatcctattaatgctggttacccctagcatggcaatgaggtgtgtaggaatcggcaatcgtgatttcgtcgaaggcttgagtggcgcaacgtgggtcgacgttgtgctagaacacggatcatgcgttactacaatggcgaaaaacaaaccaacgctagacatagaattgctcaaaactgaagttacaaatccagcagtgttgaggaaattatgcatcgaggcaaaaatcagcaacacgaccactgattctagatgcccaactcagggagaagcaacgctggttgaagaacaagatgctaactttgtctgtcgacgcacgttcgttgatcgaggctggggaaatgggtgtggattatttgggaaaggcagtttgctaacgtgtgccaaatttaaatgtgttacaaaactagaaggaaaaattgtacaatatgaaaatttaaagtattcagtaatagttacagtacatactggagatcaacatcaagtgggaaacgagactactgaacatggtacaatagcaacgataacaccccaagctccaacttctgagatacaactgactgactacggtgcccttacattagattgttcaccacgtacagggcttgattttaatgaaatggttcttttaacgatgaaagagaaaagttggcttgtacataaacaatggtttcttgatttaccattaccgtggacgagtggtgcgtcaacttcacaagagacttggaatcggcaagaccttctagtcactttcaaaacagcacacgcgaagaaacaagaggttgtagtgctaggatcacaagaaggagctatgcacacagctcttacgggggcaactgagattcagacatctggaaccactacgatattcgcgggtcatttgaagtgccgcctaaagatggataagttaactttgaaaggaatgagctacgtaatgtgtacgggatcattcaaattagaaaaagaagttgcagaaacccagcatgggacagtattggttcaagttaaatatgagggaacagacgccccgtgcaaaattcccttttcaacccaggacgaaaagggggtgacgcaaaacggcagactcattacagcaaatccaatagtaacagataaagagaaacctgtaaacatagaaacagaaccaccatttggtgaaagctatatagtcgtaggcgctggagaaaaggccttaaagttaagctggttcaagaaaggaagcagcattggtaagatgttcgaagccactgcccgaggagcaagacgaatggcgatccttggcgatacggcatgggatttcggtagtataggaggagtattcacaagcgttggcaaacttgttcatcaagtatttggaacagcatatggagtgctatttagcggagtgagttggaccatgaaaatcgggatcgggattctcttaacgtggcttggtctaaattcaaggtctacatcattgagtatgacgtgcatcgcggtcggaatggttaccctatatctaggagtcatggttcaagcagattcaggctgtgttattaactggaaagggagagagttaaaatgtgggtcagggatatttgtaacaaacgaagttcacacatggactgaacaatacaaattccaagcagattccccgaagagattatcagcagcaatcggcaaagcctgggaagagggcgtgtgtggtatacggtcagccacccgtttagaaaatataatgtggaagcaaataagtaatgaacttaatcacatcttactagaaaacgacatgaaatttactgtggtagtcggagatgccaatggtattctggctcaagggaagaaaatgataaggccacaaccaatggaacataaatattcttggaaaagctgggggaaggctaaaatcataggggctgatatccaaaacacaacatttattatagacggaccggatactcccgaatgcccagatggacaacgtgcatggaatatttgggaagtagaggattatggctttggaatatttactacaaatatctggcttaaactcagagatagttatacacaaatgtgtgatcatcgactaatgtccgcggcaattaaagatagcaaagctgttcacgcggatatgggctattggatagaatcggagaaaaatgaaacatggaaattagcaagagcatcattcatagaggttaaaacgtgtacatggccaaagagtcataccctttggagcaacggagtcttagaaagcgaaatgataataccaaaaatttatggtggaccaatatcgcaacataactatagaccgggttactttactcaaacggctgggccatggcatcttggtaagctagaattagatttcgatctgtgcgaaggaacgacggtagtagtagacgaacactgtggaaaccgaggtccttctctcagaaccacaaccgttaccggtaagattattcatgagtggtgttgccgctcctgtactctacctccgttacgattccgtggcgaagacggttgctggtatgggatggaaataaggccagtgaaggaaaaggaagaaaacttagtgcgctcgatggtctctgcaggatctggagaagtagactcatttagcctaggtattttatgtgtaagtataatgattgaagaggtcatgaggtcaagatggtcaagaaaaatgcttatgacaggcacattagccgtattcttactgctgataatgggccagttaacctggaatgatttaatccgtctatgtataatggtaggggctaatgctagcgatcggatgggcatgggtactacttatctcgccttaatggcgacattcaagatgagaccgatgtttgcagtagggttgttattccgaagactcacgagtcgcgaagttttgctattgacaatcggactttcattagtagcaagtgtcgaactaccgaatagtcttgaagaactaggtgatggtttagcaatgggtattatgatgctaaaactgcttacagaatttcaacctcatcaattgtggacaactctgttaagcctaactttcgtaaagaccactttatccttagattacgcatggaagactacggcaatggtcctatcaatagtaagcctctttcctctgtgcctaagtacaactagccagaagacgacatggttaccagtcttgctaggttctttcggctgcaagcccctcacaatgttcttaattacggagaataagatttggggaaggaaaagctggccactaaatgagggaataatggctattggcattgtttcaattctgctttcttcgttactaaagaatgatgtacccttggcaggaccactcattgcaggcgggatgttgatagcatgctatgttatctcgggtagctcggccgacctcctattagaaaaggccgccgaagttagctgggaacaagaagccgagcactccggagcatcacataatatcttggtagaagtacaagacgatggaacaatgaagatcaaagacgaagaaagagacgatacattaaccatattgttgaaagctacattattagcagtaagcggagtttacccgatgagtattccggctactttattcgtgtggtacttttggcagaagaagaaacagagatccggagtgttatgggacacgccctccccaccagaggtagagagagccgttttagatgacggaatttacaggatactccaacgcggtttgcttggccggtcccaagttggagtgggcgtttttcaagacggggtttttcacacaatgtggcatgtaacacgaggagctgtattgatgtaccaaggcaaaaggttagaaccttcttgggcaagtgtcaagaaagacttaatatcctacggaggtggttggcgcttccaaggttcttggaacacaggagaagaggtgcaggtaatagcagtagaacctggcaaaaatcctaagaatgtacaaacaacgccaggaacatttaaaacaccggagggcgaggttggagccattgcacttgatttcaagccagggacatcaggatctccgattgttaacagagagggaaagattgtaggattatacggtaacggcgtcgtaaccacatctggcacatacgtatctgcgatagcgcaagcaaaagcctcacaagaagggccattacctgagattgaagacgaagtatttaagaaaaggaatctaaccatcatggatctacatccaggctcaggtaagacacgacggtatttaccagctatagttagggaagcaatcaagagaaaattaaggactttgatcttagcaccaacacgagtggtggccagtgaaatggcagaggcactaaaaggcatgcccattcggtatcagaccactgcagttaaatcggaacatactggtagggaaatcgtagatttaatgtgccatgctacttttacaatgcgactactgagtccagtaagagttcctaattataatatgataattatggatgaggcccactttacggacccagccagtatagcggctcggggatatatatctacgagagtcggtatgggtgaagcagcggccatattcatgactgcaacaccacctggttctgtagaagcattccctcaatctaatgctgtaattcaagatgaagaacgtgatattccagagagatcctggaactcaggttacgattggatcactgacttccctggaaagactgtgtggttcgtacctagtatcaaatctggaaatgatattgcaaattgtttaagaaagaatggtaaaagagtaatacagctcagtagaaaaacatttgatacagagtaccaaaagaccaaaaacaacgattgggattatgtagtcacgaccgatatttctgaaatgggagcaaactttagagctgacagggtaattgatcctagaagatgtcttaaacctgtaatattaaaagatggaccagaaagggtaatactagccggaccaatgccagtaactgttgcatcagctgcacagcgccgcgggcgcataggacggaatcaaaataaagaaggagaccaatatgtctatatgggacaaccgctaaataacgatgaagatcacgcccactggactgaagcaaagatgttgctcgataacatcaatacaccagaaggaataatcccggccttgtttgagccggaaagagaaaaatcagcagcgattgacggcgagtataggttgcgcggtgaagcaagaaagacttttgtagaactaatgagacgaggtgatttgcccgtgtggttaagttataaagtggcgagtgaaggcttccagtattcagataggagatggtgtttcgatggagaacggaataatcaggttcttgaggagaatatggacgttgaaatatggacaaaagaaggcgaaagaaagaaattacgacctagatggttagacgcgaggacttattcagacccactagcattaagagagttcaaagaatttgcagcaggtcgccgctcggtctcaggggatttgattctggaaatcggtaaattaccacaacacttgacacttcgagcacaaaacgctctagacaatctagtaatgttacataacagtgaacaaggtggaaaggcctatagacatgctatggaggaactacctgatacaatagagactttaatgctactggctcttatcgcagtcctgacaggtggagtaacattattctttttgtcaggtaaaggattagggaaaacgtcaattggtttattatgtgtcacagcctcgagtgctttattgtggatggcttcagtagaaccgcattggatagccgcttctataatcttggagttctttttaatggtcttactaataccagaaccagatcgacaaagaacacctcaagataaccaattagcctatgtggtaataggattattatttatgattctaacggtagccgctaacgaaatgggtctcttagaaacgactaagaaagatcttgggataggttatgtagctgccgaaaatcatcaacacgcaacaatgctagatgttgatttgaggccagcttcggcgtggacactatacgctgtagctacaaccgtaatcacaccaatgatgaggcataccattgaaaatacaacagcgaatatcagcttaactgcgatagcaaatcaagctgcaatattaatgggcctagataaaggttggccgatttcaaaaatggacatcggagttccattattggcactaggatgctattcccaggttaacccactaacgctcacggcagcagtacttatgttagttgcgcactacgctatcattggacctggactacaagcaaaggcaactagagaagcgcagaagcgaactgcagctggaataatgaaaaatccgaccgtagatggcatcgtagcaatcgatttagatccggtcgtatacgatgctaaatttgaaaaacaattaggccaaatcatgttattgatcttatgcaccagccagatacttttgatgagaaccacgtgggcattatgcgaaagtataacacttgcaactggaccactaacaactctctgggaaggaagcccaggtaagttttggaatacaacaattgctgtgagtatggccaacatatttaggggtagctatctcgctggcgcaggtttggcgttttctctgatgaaatcattgggaggagggagaagaggtacgggagcacaaggagagactttaggagaaaagtggaagaggcaactcaaccaattaagcaagtctgagttcaacacatataaaagatccggtataatggaagtagataggagcgaggctaaagaggggttgaaaagaggtgaaacgactaaacatgctgtcagcagaggaaccgccaagctccgttggttcgtagagagaaacttagtcaaaccagaaggcaaagtaatcgatttgggatgtgggagaggaggctggagttattactgtgcgggcctcaagaaagtgactgaagttaaaggatatacaaaaggtggacccggacatgaagaacccatcccaatggcgacatatggctggaatcttgtaaaattgcactcaggaaaagatgtctttttcatgccaccagaaaaatgcgacacgttattgtgtgacataggagagtccagtccgaaccctacgattgaagagggtcggaccctccgagtcttaaaaatggttgaaccttggttgaaaggtaaccagttctgcataaaaattttaaatccatatatgccaagtgttgttgagacattagaacaaatgcaaagaaagcacggtggaatgcttgtacgtaatccactgtccaggaatagcactcatgagatgtactgggtaagttgtggaaccggaaatatagtatcagcggtaaacatgacatcacgcatgctattaaacaggtttacgatggctcaccgcaaaccaacctatgagagagatgtagatcttggagctggcacgcgacacgtagccgtagaaccagaggtagccaacctcgatatcattggccaacggatagaaaatatcaaaaatgagcacaaatcaacatggcactatgacgaggataatccctataaaacttgggcatatcatggttcgtacgaagtaaaaccgagcggctcagccagttccatggtaaacggtgttgtacggctgctgacaaaaccatgggatgttataccgatggtcacacaaatcgcaatgactgatactacaccttttgggcagcaaagagtattcaaagaaaaagtagacaccaggacaccaagggcaaaaagaggaactacccagataatggaagtaactgcaaaatggctgtgggggttcctaagcaggaataagaaaccaagaatatgtacacgagaagagttcacacgcaaggttcgaagcaatgccgccataggcgcggtttttgtagatgagaatcaatggaacagtgctaaggaagcagttgaagacgaacgtttctgggacttagtgcatcgagaaagggaattacataaacaaggaaaatgcgccacttgcgtgtacaatatgatgggaaaaagggagaagaaattaggtgagttcggaaaagctaaaggctctcgagcaatctggtatatgtggctgggagcacgtttcttagagtttgaagcactgggatttatgaacgaagatcattggttctcgagagaaaactcattaagcggagtcgagggggaaggattgcataaacttggatatattttaagggatatttcgaagataccaggagggaacatgtacgcggacgataccgctgggtgggatacacgtataacagaagatgaccttcagaatgaggcgaaaataacagatatcatggaacccgaacatgcactactagccacttcaatattcaagttaacataccaaaataaagtagtacgcgttcaacgaccagccaaaaacggtacggtgatggacgttatttcacgacgcgatcagcgtggctcgggtcaagtcggaacttatggattaaatacctttactaacatggaagtgcaattgataaggcaaatggaatcagaaggaatcttcctaccgagcgaactcgaaactcccaaccttgcagagagggtcctagattggcttgagaaacatggagcagagagacttaaaaggatggcgataagtggggacgactgtgtcgttaaaccgatagacgacagatttgcaacggctctaactgcgttaaacgacatgggtaaggtacgaaaagacatacctcagtgggaaccctcaaaaggttggaatgactggcaacaagtaccgttctgcagccatcatttccaccaattaataatgaaagatggacgtgaaattgtagtgccatgtcggaaccaagacgaattagtgggacgagcaagagtaagccagggcgcgggctggtcgctgagagaaactgcttgtttaggaaaatcctatgcacaaatgtggcaattaatgtattttcatcggagagacttaagactcgctgctaatgcaatatgcagtgcggtaccagttgattgggtgccgacaagccgaactacttggtcaatacacgctcatcatcaatggatgacaaccgaagatatgttgtctgtatggaacagagtatggatagaagaaaatccgtggatggaggacaagacacatgtatcgagttgggaagaagtcccctatctagggaaaagagaagatcaatggtgcggttcacttataggcctaaccgcacgagccacatgggctacgaatatacaagtagcgatcaatcaagtacgaagacttatagggaacgagaattacttagactatatgacatcaatgaaaaggtttaaaaacgagtctgacccggaaggagctctgtggtga

SEQ ID NO: 21417 - RNA, 9879 nt, synthetic construct
  misc_feature 1..9879: note = derived and/or modified CDS sequence (opt6) from DENV-1__FJ810415__SS-prME
  source 1..9879: mol_type = other RNA
tcagttactatgttattaatgttactaccgaccgctttagcgttccatttaaccacgcgaggtggggaaccgcacatgattgtatctaaacaagaacgaggaaaaagtctcctattcaaaacaagtgcaggagtcaacatgtgtacattaatagcaatggacctaggtgaattatgtgaagacaccatgacttataaatgcccaagaataaccgaagcagaacctgatgatgtagattgctggtgtaatgcaactgacacttgggtaacatatggtacgtgctcgcaaactggtgaacataggcgagagaaaaggtccgtagccttagcgccccatgtagggctggggctcgaaactaggacggaaacatggatgtccagtgaaggagcttggaaacaaatacaaagggttgagacttgggcacttcgccatccaggtttcacggtaatagctttctttttagctcatgcgattggaacttcaataacacaaaaaggagtcattttcatacttttaatgctagtaacaccgagcatggccatgaggtgcgtaggtatcggtaaccgggactttgtagaaggattatccggagctacatgggtcgatgtagttttggaacatggaagttgcgtaacaacaatggccaaaaataaaccgaccctcgatatcgaattactaaaaacagaagtaacaaatccggcagtgctgagaaaactctgtatagaggcaaaaatttctaacactacgactgacagcagatgtccaactcaaggagaagcaacattagttgaggagcaagacgcaaattttgtttgtagaagaacttttgttgacagagggtggggaaacggttgtggcctattcggtaaaggatcattgttaacatgtgcaaagttcaagtgcgtgacgaaactcgaaggcaaaatcgtccaatatgaaaacttaaagtattccgtcatagtaacagttcatacaggtgaccagcatcaagttggcaacgagacaaccgaacacggtacaatagctacaattactccccaggctccaacatcagagatacaactaacggattatggcgccctaaccttagactgtagtcctcgcactgggctagatttcaacgaaatggtcttgctcacaatgaaagagaaaagttggctagtgcacaaacaatggttcttagatctacccttaccatggacatcaggagcatcgacctctcaagaaacatggaaccgacaggacctattagtgacatttaaaactgcgcatgctaagaaacaggaagttgtggttttagggtcacaggagggagcgatgcacacagctttaaccggtgctacagagattcagacatccgggacaaccaccatttttgcgggacacttgaaatgccgcctaaaaatggataaactcacactaaagggtatgagttatgtgatgtgtacaggatcatttaaacttgaaaaagaagtagctgaaacacaacacggtacagtattagtgcaggttaagtatgagggaaccgatgctccttgtaagatcccgtttagtacgcaagatgaaaaaggagtgacccaaaacggccgactgatcacagctaacccaatagtaacagataaggaaaaaccagtgaatatagaaactgaacctccgttcggggaaagctacattgtagttggagcgggagaaaaggccttgaaattaaactggtttaaaagaggatcatctatagggaaaatgttcgaagcaactgcacgaggagcaagaaggatggcaattttgggtgatacagcatgggattttgggagcataggcggtgtgttcaccagtgtaggaaagttagttcatcaagtttttggaacagcatacggagtactgttttcaggtgtaagttggactatgaaaatcgggataggaatcctactaacatggctaggactaaattctagatcaacatcattgagcatgacctgtatagctgtaggaatggtcacactatacctaggagtgatggtacaagccgattctggctgcgttataaattggaagggaagggaacttaaatgcgggtcgggcatattcgttacaaatgaagtacatacgtggacagaacaatataaatttcaagcggatagtcccaaacgcttgtctgcagcaatcggaaaggcatgggaggaaggagtgtgtggaatacgtagtgcaacacgactagagaatattatgtggaagcaaatatcaaacgagcttaatcatatactcttagaaaatgatatgaaatttaccgtggtcgttggggatgccaacgggatactggcgcaaggtaagaaaatgatacgtcctcaacctatggaacataaatattcgtggaaatcatggggaaaagcaaaaataattggagcggacatccaaaatactactttcattatagacggcccagatactccggaatgtcctgacggccaaagagcatggaatatatgggaagtggaagattacgggtttggagtatttactactaacatctggttaaagttacgagatagttatacacaaatgtgtgatcaccgcttaatgtcggcggcaattaaggattcaaaagcagtacatgctgatatggggtactggattgaatctgagaaaaatgaaacatggaaattggctagagcaagttttatagaagtaaaaacgtgcacttggccaaagagtcatacattatggagcaatggggtactggaatcggaaatgatcatacccaaaatttacggagggccaatatctcagcacaactacagaccggggtattttacacaaacagctggaccttggcatcttggaaagctggaactagacttcgacttatgtgaaggtaccacagtagtggtagatgaacattgtggaaatagaggaccatcattaaggactactaccgtgacgggtaaaataattcacgaatggtgctgcagatcttgtacattgccgcctttacgattcagaggagaagatggatgttggtatggaatggaaattagaccagtaaaggaaaaagaggaaaaccttgtacgatcaatggtctcggcaggtagcggagaagttgacagtttctcactaggtatcttatgtgtgagtattatgattgaagaggtaatgagatcgcgatggtcacgtaaaatgctaatgacaggtactttagctgtgtttttattgctaataatggggcaacttacttggaacgacttaattagattatgtataatggtgggagcgaatgcaagtgacagaatgggtatgggtactacttatcttgccttgatggctacattcaagatgaggcccatgttcgccgtcggtctactattcaggaggcttacttcaagagaggtacttctactaacaataggattaagcctagttgcaagcgtggaattaccaaattcgttggaagaacttggtgatggattagcgatggggattatgatgctaaaattattaaccgagttccagccacatcaactatggacaactctattgagcctaacgtttgtaaagacgacacttagtctagattatgcatggaaaaccaccgccatggttcttagcattgtttcattgtttcctctctgtctctcgacaacttcacagaaaactacatggttgcctgtcttactagggagctttggttgcaagccgctaacgatgttcctaatcaccgaaaacaaaatatggggacggaaaagttggccactgaatgaaggtatcatggcaataggcatagtaagtatcctcctatcgtcattgttaaagaatgacgttccgctagcagggcctttaatagctggtggaatgttaatagcttgctatgttatatcaggatcttcggcagacctcagcctggaaaaagcagccgaggttagttgggagcaagaagcggaacattctggagcttctcataatatcctcgtagaagttcaggacgatggcacgatgaaaatcaaagatgaggaacgtgacgatactttaaccatattacttaaggcaacattattagcagtcagtggggtatatccaatgtcaatacctgctacattatttgtttggtacttttggcagaaaaagaagcagagatcgggggtgttatgggataccccgagcccaccagaagttgaaagagcagtcttagatgacggtatctacagaattttacagcgtgggctgctaggaagatctcaagtcggcgtaggggtattccaggatggggtatttcacacaatgtggcacgtcacaagaggtgcagtgttaatgtaccaaggtaaacgactagagccatcatgggcaagtgttaagaaagacttaatatcgtacggagggggatggcgatttcaaggttcctggaacacaggtgaggaggttcaagttatagcagtcgaaccaggtaaaaaccccaaaaatgtccaaactacgccggggacatttaaaacaccagaaggggaagtgggtgcaatagcacttgacttcaaaccaggaacaagtggatcgccgatagtgaatagagagggtaaaattgtaggtttgtacggtaatggggtggttacgacaagtggaacctatgtttcagccatagcacaggctaaagcctctcaggaaggaccgttgccagaaattgaagatgaagtgtttaagaaaaggaacttaactataatggatttacatcccgggtctggaaaaacccgtcgttacctaccggcaattgtacgtgaagcaataaaacgcaaattacggacgcttattctcgctcccacccgggtcgttgcttccgagatggcggaagccctgaagggaatgcctatacggtatcaaaccacggctgtgaagtccgaacacactggcagggaaatagtagatctaatgtgtcatgcaacttttactatgagattacttagcccggtcagggtacctaattacaatatgataattatggacgaagcacactttaccgatcccgcgtcaatagcggctagaggatacatatcgacgagagtaggaatgggggaagccgcagccatattcatgacagcaacacctccaggttctgttgaggcattcccacaatcgaacgctgtcatacaagacgaggagcgagacatccctgaacggtcctggaatagtggttacgattggataacggactttcccgggaagaccgtatggttcgtcccttcaataaaatccggcaatgacatcgcaaattgcctacgcaagaatgggaagcgagtaatacaactttctagaaaaacatttgacacagagtaccagaaaaccaaaaataatgactgggattacgtagttaccacagacatatcagaaatgggagcaaattttagagcggatcgagtaatagatccccgtcgttgtttaaaaccagtaatccttaaagatggaccagaacgagtcattcttgcaggaccaatgcctgtaacggttgcttcagctgcacagcgacgcggacgtattgggagaaaccaaaacaaagaaggtgaccaatatgtgtacatgggtcaaccacttaacaatgatgaggatcacgcacattggacagaagccaaaatgttacttgataacatcaatacgccagaaggtattattccggcactgtttgaacctgaacgagaaaaatccgctgctatagatggcgaatatcggctacgtggagaagctagaaagacctttgtcgagttaatgcggaggggcgatttgcctgtctggctaagttataaagttgcaagtgaaggttttcaatatagtgacaggagatggtgttttgacggagaaagaaataatcaagtcttagaagaaaatatggatgtggaaatatggaccaaagagggggaaaggaagaaattacgacctagatggttagatgcccgtacatattcagatcctcttgcattacgagaatttaaagaatttgcagcaggaagaagatcagtaagcggagatttgattctagaaatcggcaaacttcctcaacacctaacattacgggcacagaacgcacttgataatctcgttatgctacataatagtgagcagggaggaaaagcatataggcacgcgatggaggaactccctgatacaatagagactctgatgttactagctttaattgcagtattaactggcggcgtaactctcttctttttatcaggaaagggtctgggaaaaacgtcaatcggcttattatgtgttacggcctcttccgcactactatggatggcatcagtcgagccccactggatagcagcctcaattatattagagttctttctaatggtcttacttatcccggaaccagaccgacaaagaaccccgcaggataatcagctagcttatgtcgtcataggattactctttatgattcttacagtagccgctaacgaaatggggctattagagacaacgaagaaagatctcggaataggctacgttgccgctgaaaaccaccagcatgccactatgttagatgtagatcttcacccggctagtgcttggacactttacgccgttgcaacaacagtcattacaccaatgatgaggcacaccatagagaacacaacagcgaacatatctctaaccgctatcgctaaccaggcggcaatattaatgggtcttgacaagggctggcctataagtaaaatggacattggagtgcctctgctggcactaggatgttattcacaagtgaaccctttgactctaacagcggccgttctaatgttggtagcacactatgcaataattggtcccggattgcaggccaaagcaacaagagaagcgcagaaacgaaccgcagcaggtattatgaaaaatccaacagtcgatggcatagtagcaatagacctggacccagttgtgtacgatgccaaattcgaaaaacaactgggacaaataatgcttttaatcttatgtacgtcgcaaattctgttaatgaggactacgtgggcactctgcgaatcaattactttagcgactggtccgctaaccactctatgggaaggttcaccgggaaaattttggaacaccactatagcggtatccatggcaaatatatttagaggttcatatcttgcaggagcaggtttggccttcagtttaatgaaaagtctcggagggggaagaagaggaacaggagcccaaggagaaacattgggagaaaaatggaaaagacaattgaatcagctatcgaaaagtgaatttaatacatataagaggtcgggtatcatggaggtagatcgttcagaagcaaaggaaggtcttaagagaggggaaactactaagcatgcagtatcaagaggcacggcaaaactgagatggttcgtagaaaggaatttggtaaaaccagaaggtaaagtaatcgatttaggttgcggtcgtggcgggtggagttactattgtgcaggcctgaaaaaggtaacagaggtaaaagggtacacaaaagggggtccgggccatgaagaacctatccctatggcaacatacggctggaacttagtaaagttgcattcaggaaaagacgtattctttatgccaccagaaaaatgtgataccctactttgcgatatcggtgaatcctctccaaacccaacaatcgaagagggaaggaccttaagagttttaaagatggtcgaaccgtggttgagaggaaaccaattttgcataaaaatactgaatccttacatgccttctgtagtcgaaacgctcgaacaaatgcaacgaaagcatggcggaatgctagtacgaaacccgttgtctagaaattcaactcatgagatgtattgggtaagttgcggaacgggaaacatagtctctgcggtgaacatgaccagtaggatgttgctaaacaggtttacaatggctcaccgaaaacctacatatgagcgagacgtagatctaggtgctggaacgaggcatgtcgcggtagagccagaagtagcaaatttggacatcattggccaaaggatagaaaatatcaaaaatgagcacaagtcgacttggcactatgacgaagataatccctacaagacatgggcctaccatggaagctacgaggtaaaaccaagtggtagtgcatcctctatggtaaacggtgtagtacgattgttaacaaagccatgggacgtaataccaatggtgactcaaatagctatgactgacaccactcctttcggacaacagcgtgtctttaaggaaaaagtagacacaagaaccccgagagccaaacgcggtacaacgcaaattatggaagtgactgcaaaatggctttggggatttttgagtcgaaacaagaaaccgagaatatgtacacgagaggaatttactagaaaagtacgttccaatgcggctatcggagccgtatttgtggatgaaaaccaatggaactctgcaaaagaggcagttgaagacgaacgcttctgggatctagtacacagagagcgtgaattacataaacaaggcaaatgtgctacatgtgtttataacatgatggggaaaagagagaagaaattaggtgaatttggtaaagcgaaggggtcgcgcgcaatttggtacatgtggctgggagccaggttcttagaatttgaggctctaggattcatgaacgaagaccactggttctccagggagaacagtctatctggcgttgaaggagaaggactgcataagttaggatatatattgagagacatcagtaaaataccgggaggaaacatgtatgcagacgataccgcaggatgggatacgagaataacagaggacgatctacaaaacgaagcgaaaatcaccgatatcatggaaccagaacatgctttgttggccacttctatatttaaattgacataccagaataaagtcgtacgagtacaacgaccagcgaaaaatggaactgttatggatgttatatctagacgcgatcagcgcggatctggtcaagtaggaacctatggtctcaacacgttcacaaatatggaagttcaattaatacgacaaatggaatcggaggggatatttctcccatctgaactagaaacaccgaatctagccgaaagggccttagactggttagagaaacatggtgcggaaagattaaagaggatggcaatatcaggcgacgattgtgtagtgaaaccaatagatgacagatttgcaaccgcattaacagcattgaacgacatgggtaaagttagaaaagacatcccccaatgggaaccatccaaaggttggaacgattggcagcaggtccccttttgtagtcatcacttccaccagctcatcatgaaagacggtcgagaaatagtagttccatgtcgtaatcaagatgaacttgtaggtcgtgccagagttagtcagggtgcggggtggtctttacgagaaactgcatgtcttggaaaatcttacgctcaaatgtggcagctaatgtattttcatcgaagagaccttcggctggcagcaaatgccatatgtagtgcagtgcccgtagactgggtacccacaagtcgaacgacatggtcgatacatgcccaccatcaatggatgacaactgaagacatgctaagtgtttggaacagagtgtggatcgaagagaatccgtggatggaagacaagactcatgtttctagttgggaagaagtaccttacttaggaaagagagaagatcagtggtgcggcagcttaattggtctgactgcgcgggcaacatgggccacaaatatccaggtagctattaaccaggtaagacgcttaattggaaacgagaactacttagattatatgacttccatgaaaagattcaaaaatgaaagtgacccggagggagcattatggtga

SEQ ID NO: 21418 - RNA, 9879 nt, synthetic construct
  misc_feature 1..9879: note = derived and/or modified CDS sequence (opt6) from DENV-1__FJ639814__SS-prME
  source 1..9879: mol_type = other RNA
tctgtgactatgttattaatgttgcttcccacagcgttagcatttcacttgactacacgagggggagaaccccacatgatagtaagcaaacaagaacggggaaaatctttattgtttaaaacttcagcgggagtgaatatgtgcactttaattgctatggacctcggagaactttgtgaagatacaatgacttacaaatgcccaaggattactgaagcagagcccgatgacgttgactgctggtgtaatgccactgatacatgggtgacttacggaacatgctcccaaactggagagcacagacgtgagaaaagatccgtcgcattagctccccatgtaggtttaggtctagaaacccgaacagaaacttggatgtcatcagaaggagcatggaaacaaatacaaagagtcgaaacatgggcgctgagacatccgggttttactgtcatagcattctttctagctcatgctataggaacgagtattacccaaaaaggcataatttttattctattgatgttagtcactccttcaatggcaatgcgatgtgtaggcataggaaaccgtgactttgttgaaggattatctggcgcaacatgggtcgacgtagtcctggaacatggatcttgtgtcacaacaatggccaaaaataagcctactctagatatagaattactaaaaacggaagtaactaacccagctgtgttacggaaactttgtattgaagcaaaaatttcaaatacaactactgacagtaggtgtcctactcaaggcgaagcaacgttggtagaggagcaagatgcaaatttcgtgtgcagaagaacatttgttgacagaggatggggcaatggatgcggtctgttcggaaaaggaagtttattaacatgcgcaaaattcaagtgtgtaactaagctcgaaggaaaaattgtccaatacgagaatttgaaatattcagttattgtgactgtacatacgggagatcaacaccaagttggaaacgaaacaacagagcacggaacgattgccacaataacaccgcaagctcccacaagtgaaattcaattgacagactacggagccttaaccttggattgcagtccgaggacaggtcttgattttaacgaaatggtattgctaacgatgaaagaaaaatcgtggttagttcacaaacaatggtttctagatctgccgctaccttggacaagtggagcaagtacctctcaagaaacatggaatagacaagatctattagtaaccttcaaaactgcacatgccaagaagcaagaagtagtggtattaggatcgcaagaaggcgcgatgcatactgcgttaacgggagctacagaaatacaaactagcggtacaactacaatttttgctggtcatctgaagtgccgtcttaaaatggataaattgactttaaaaggaatgagttacgtgatgtgcaccggatctttcaaattagaaaaagaagttgcagaaactcaacatggaacagttttagtacaagtaaaatatgaagggacagatgcaccttgcaagataccattctctacacaagatgaaaaaggagtcacacaaaatggtcgattaattacagccaatccaatagttacagacaaggaaaaacctgttaatattgaaacggaaccgccatttggagaatcatacattgtagtgggagccggtgaaaaagctcttaagctgtcttggttcaagagaggctctagtatagggaaaatgtttgaggctacagcaagaggagctaggaggatggcgatacttggggatacagcgtgggacttcggctcgattgggggtgtttttactagcgtaggcaaattggtacaccaagtctttggcaccgcttatggtgtattatttagtggtgtcagctggacaatgaaaataggaatcggcatattattaacctggctcggccttaatagtcgatcaacttcgttaagtatgacttgtatagctgtcggaatggtaactctctatttaggagttatggtacaagctgattcggggtgtgtaatcaactggaaaggacgggaacttaaatgcggtagcggaatttttgtgacgaatgaagtacatacgtggacggagcaatataaattccaagctgatagccctaaaagactctcggcggccattggcaaagcgtgggaggaaggcgtatgtggaatcagatcggcgacgagactagaaaatattatgtggaaacaaataagcaacgaattaaatcatattttgctcgagaatgatatgaagttcactgtagtggttggcgacgcgaatggtatactagcacaaggcaagaaaatgataaggccacagcctatggagcacaaatactcctggaagtcttggggaaaagcaaagataataggagctgatatccaaaataccacgtttatcatagacggtccggatacaccggaatgccccgacgggcaaagggcatggaatatatgggaagtggaggactatggtttcggagtgtttaccacaaacatatggctcaaacttagagattcatatacacaaatgtgtgaccatcggctcatgagtgcagctatcaaagattccaaggccgtacacgcagatatgggttactggatcgagtccgagaaaaacgaaacatggaaacttgcacgggctagctttatcgaagtaaaaacgtgtacatggcctaaatcccacacgttatggagtaatggggtgctagaatccgagatgataatacctaaaatatacggaggaccaatttcccaacacaactaccgaccaggatattttacccagacagctggtccatggcatttagggaagttagaattagatttcaatctatgtgaaggaactacagttgttgtcgatgagcattgtggtaatagaggtccttcgcttagaactacaaccgtgactggtaagataattcatgaatggtgttgtcgtagttgcacacttccaccactacgcttcagaggcgaagatggttgttggtacggcatggaaataaggcctgttaaggaaaaagaagaaaaccttgtaagatctatggtatcagccggtagtggagaagttgactcgttctctttaggtatactatgtgtcagcataatgatagaggaagtaatgaggagtcgatggtcgagaaagatgctaatgacaggcacactcgcagtattcttacttttaattatgggacaattaacttggaacgacctaattcgcttatgtattatggttggagcgaatgcatcagacagaatgggcatgggcacaacatatttggcactcatggctacattcaaaatgcgtccaatgtttgccgtcggcctactgtttaggagactaacatccagggaggttttactattgacaatcgggttatcattggttgcttcagtagaactcccaaattctttagaagaattaggagacggattggcaatgggaatcatgatgctaaaattattaacagagtttcagcctcaccaattatggacgactctactaagtctgacttttgtgaagacaacactcagcctcgactacgcttggaaaacgacagcaatggtattatcaatagtatccctatttccactatgcctctcaacgacgtcacagaaaaccacatggctgcctgtattattgggctcttttggatgcaagccgcttaccatgtttctaattacagagaacaaaatctggggaagaaaaagctggccgctcaatgaaggcatcatggcgataggaatcgttagtatattattatctagcttgcttaagaatgacgtacctttagctggacctctgatcgcagggggtatgttaatcgcatgctacgtaatcagcggctcgagtgccgacttatcattagaaaaagcggcggaagtaagttgggaacaagaagctgaacattccggtgcttctcataacatcctagttgaggtccaagatgatggaacaatgaaaataaaggatgaggagcgggatgacacacttactattctactaaaagcgacacttttggctgtaagtggggtatatcctatgagtatcccggcaactctctttgtgtggtacttctggcagaaaaagaaacaaaggtcaggagtcctctgggacacgcccagcccacccgaagtcgaaagagcagtactagacgacggaatttatcgaatattgcaacgagggttactcgggaggtctcaagtcggagtaggagtctttcaagacggagtatttcatacaatgtggcatgtaacaagaggtgccgtcctcatgtatcaagggaaaagattagaaccatcttgggcaagcgtgaagaaagatctgatatcgtatggcggcggatggcgatttcagggctcttggaatacaggagaagaagtacaagtgattgcagttgaacctggcaaaaatcccaaaaatgtacagacgaccccaggtacattcaaaacgcccgaaggcgaggtgggcgccatagccttggattttaaaccagggactagcggatctcccattgtcaacagagaaggtaaaatcgtgggattatatggcaatggcgtagtgacgacgtcagggacatacgtatcggctatagcgcaagcaaaagcaagccaagaaggacctctacctgaaatagaagatgaagtctttaagaaacgaaacttaacaataatggatttgcaccccggcagcggtaaaacaagacgatatctcccggccattgtaagggaagcaataaaacgaaaactccgcacattaattttggcacccactagagtggtagcgagtgagatggctgaggcattgaaaggcatgccaatacgataccagacaaccgctgtgaaatctgaacatactggacgagaaattgtcgacttgatgtgtcacgctacattcactatgcggttattatcaccggtacgcgtaccaaactacaacatgattattatggatgaagctcactttacagatccagcatcaatagcggcacgtggctacataagcactagagtaggaatgggtgaagctgcagcgatatttatgacagcaacgccaccaggatccgtggaagcgttccctcaatcgaacgccgttattcaagatgaagaacgcgatattccggaacggtcatggaatagtgggtatgattggataacagattttcctggtaaaaccgtttggttcgtgccatcaataaaatcaggcaatgacatcgctaattgtttaaggaaaaatggaaaaagggtaattcagttatcaagaaaaacgtttgatactgagtaccagaaaactaaaaataacgactgggattatgttgtaaccacggatatctccgaaatgggtgcgaattttagagctgatagagtcatcgatccgaggcggtgtcttaaacctgtaatccttaaagacgggccagaaagagtaatactagccggccccatgccagttacagtagcgagtgccgcacaaaggcgaggaagaataggaagaaaccagaataaggaaggagatcaatatgtatatatgggacaaccattaaacaatgacgaggaccacgcacactggacagaagcaaaaatgcttcttgataacattaatactccagaaggaataatcccagctctgtttgaaccagaacgtgagaaaagtgcagcaatagatggagaatacagattgagaggtgaagctagaaaaacatttgttgaattaatgaggagaggcgacctccctgtttggttgtcttacaaagtggcaagtgaagggtttcaatatagtgacagaagatggtgctttgacggggagcgcaacaatcaggttttagaagaaaatatggatgttgagatttggacaaaagaaggggaaagaaagaaacttcgaccacgttggttagatgctcgaacgtattccgaccctttagcccttcgcgagttcaaggaatttgcagcgggacgtagaagtgtaagcggtgatttaatactggagattggcaaattaccacagcatctgactctaagggcacaaaacgcactcgataatttagtaatgctacataactcagaacaaggaggaaaagcatatcgtcatgcgatggaagaacttcctgatacaatagaaacccttatgctgcttgcacttattgcagtcctgactgggggtgtgacactattctttcttagtggaaagggtctaggaaaaacaagcataggtcttctctgtgtaacagcatcgtcggcattattgtggatggcttcagtcgaacctcattggatagcagcttctataatcttagagttctttctcatggtactactcatcccagaacccgatagacaaagaacacctcaagataatcaattggcctacgtcgtaattggtttgctattcatgatattaaccgttgcagcaaacgaaatgggtctgctggaaacaacgaagaaagatctcggaattggttacgtcgcggctgagaatcatcagcatgctaccatgctagacgtagatttacatcctgcaagcgcctggaccttatacgccgtagctacaacagtgatcacaccaatgatgagacatacgatagagaataccacagcgaatatttcgcttactgccattgctaatcaagcagctatactcatggggctcgataagggatggcccatttccaaaatggatatcggagttccgctcttagcactagggtgttactctcaggttaatccccttaccctgacggcagctgtactcatgttggtagctcactatgcaatcataggaccaggtttacaagccaaagcaacaagagaggcgcaaaagagaacagccgcgggcattatgaagaatccaacagtcgatgggatagtcgcaatagatcttgatccagtagtatacgatgcgaaatttgaaaagcaattgggacaaataatgcttttgatactatgtacgtcgcaaatattattaatgaggacaacgtgggcgttatgtgaatcgataactctcgcaacaggccccctgacgactctatgggaaggctcacctggtaagttctggaatactacgatagcggtgtccatggcaaacatcttccgaggaagctatttggccggagcaggtctagccttcagtctaatgaagtccttgggagggggacgacgcggcacgggtgctcaaggtgaaacacttggagaaaaatggaaacgacaacttaatcaattatccaaaagcgaatttaatacctataaaagatcaggtatcatggaagtggacagatccgaggctaaagaaggattaaaaagaggggagacaacgaaacacgcggtatcaagaggaactgcaaagttgagatggtttgtggaacggaacttggtaaaaccagagggtaaggtaattgatctagggtgtggtcgcggtggatggtcatactactgtgctggtctaaagaaagttactgaggtaaagggctatactaagggtggcccagggcatgaggaacccatacccatggcaacttatggttggaatttggtgaaattacactcgggaaaagacgtattctttatgccacccgaaaagtgtgacacacttctatgtgatataggcgaatctagcccaaatccaactattgaggaaggacgaacattaagggtccttaagatggtagaaccatggttgcgcggcaaccaattctgtattaaaattctaaatccctatatgccatctgtagtagaaaccctggagcaaatgcagagaaaacatggcggaatgttggtcagaaacccactgtctcgtaacagcactcatgaaatgtattgggtctcgtgcggcacaggcaatatagtttctgcagtaaacatgacgagcaggatgctcctcaatcgctttactatggcccaccgaaaaccaacttatgagagagatgtggacttaggcgcggggacacggcacgtggccgtggagccggaagtagccaatttagacataataggccaacggattgagaatataaagaatgaacataagtcaacgtggcattacgatgaggataatccttacaaaacctgggcataccatggaagttacgaagttaaaccaagcggaagtgcgtcatccatggtaaacggagtagtaagacttctcacgaaaccatgggatgtgatccccatggtcacacaaatagcgatgactgatactactcccttcggacaacaaagggtattcaaagaaaaagtagacaccaggactccacgcgcaaaacgcggaacaacccaaattatggaagtaaccgctaagtggttatgggggtttctttctagaaataagaaacctcgaatctgtacaagagaagaatttacacgcaaagtacggagtaatgctgctataggcgcagtctttgtggacgaaaaccagtggaatagcgccaaagaagctgttgaagatgaaaggttttgggatctagtacaccgcgagcgagagctgcacaagcaagggaaatgtgcaacttgcgtatataatatgatgggcaagagagagaagaaacttggtgaatttggaaaagccaaaggatctagagccatatggtatatgtggctaggagccagatttttagaatttgaagccctagggttcatgaacgaagaccactggttctcaagggaaaatagtcttagcggtgttgagggagagggcttacataaactcggttatatactccgagatatctcaaaaattcccggtggaaacatgtacgctgacgacactgctggctgggatacacgtatcacagaagacgatttacaaaatgaggccaaaattacagacataatggaaccggagcacgcgctacttgcaacgagcatatttaaacttacttatcagaataaagtggtccgagtgcaaagacccgctaaaaatggaacggtcatggatgttatcagtcggcgggaccagaggggttccggccaagttggtacatatggcctaaatacattcactaacatggaagtacagcttatacgccaaatggaatcagaagggatctttctaccttcggaattagagacaccaaatctagcagaaagagcattagattggctcgaaaagcatggggctgagcgtttaaaacgtatggcaatttcaggagacgactgtgtcgttaaaccaatagacgataggttcgcgaccgcattaacggccttaaatgatatgggaaaagtaagaaaagatatcccgcaatgggaaccaagcaaagggtggaatgactggcaacaggtcccgttttgcagccaccactttcatcagttgatcatgaaagatggtcgagaaatcgtagtcccatgtagaaaccaagacgaattagtgggtagagcacgggtgtctcaaggcgccgggtggtcacttagagaaacagcctgccttggaaaatcatacgcccaaatgtggcagttaatgtactttcacagacgtgatttgagattggcggcaaacgctatatgctcagcggttccagttgactgggtacccacctctagaactacctggtcaatacacgcacaccaccaatggatgacaactgaggatatgctatcagtctggaatcgggtgtggatagaagaaaacccatggatggaggacaagacacatgtcagcagctgggaggaagttccgtatttggggaagagggaggatcaatggtgtggatctctaataggattaaccgccagggcaacttgggcaaccaatattcaagtagcaataaaccaagtgcgacgtcttataggtaatgagaactacctggattatatgacatctatgaagagattcaaaaacgaatctgatcctgaaggcgcgttatggtaa

SEQ ID NO: 21419 - RNA, 9879 nt, synthetic construct
  misc_feature 1..9879: note = derived and/or modified CDS sequence (opt6) from DENV-1__FJ639815__SS-prME
  source 1..9879: mol_type = other RNA
tctgtaacgatgctattaatgcttttaccaaccgcgctggcgtttcatttgactacacgtggaggcgaaccgcatatgatcgtaagcaaacaagaaagaggaaaaagcctactatttaaaacctcagcgggagtgaatatgtgtactctaattgcaatggatttaggtgaattatgtgaagatactatgacatacaaatgtccgagaattactgaagctgaaccagatgacgtggattgctggtgcaatgccacagacacgtgggtgacatatggcacatgctcacaaactggagaacatagacgagagaaaagatcagtagcattagcccctcatgtaggactaggcctagaaacacgaacagaaacatggatgtcatcagaaggtgcatggaaacaaatacaaagagtcgaaacttgggccctaagacacccgggatttacagttatagccttctttttggcgcacgcaattggcacgtcaatcacgcaaaaaggcattatctttatattgttaatgcttgtaactccgagtatggctatgcgctgtgttggcattggaaatcgcgatttcgttgaaggattatcaggagctacttgggtagatgtagttcttgaacatggttcttgcgtaactacaatggccaaaaataaacctaccttagatattgaattattaaaaacagaagtcactaacccagcagttctgagaaaactctgcatagaagcaaaaattagcaacacgacaacagactcgcgatgtcctacgcaaggcgaagctactctagtggaagaacaagatgcaaatttcgtatgtcgaagaacttttgtagaccgaggatggggaaatggatgtggattatttggtaaaggctcactacttacatgcgctaaattcaaatgtgtaacgaaactagagggaaaaatcgtacaatacgagaacctcaaatactccgtaattgtaacggtacataccggggaccaacatcaagtaggaaacgaaacgaccgagcacggaacaatcgcaacgataacaccacaagcgccgacctcggagatccagctaactgattatggggctctaacactagactgcagtccaagaactggattagatttcaatgaaatggtcttgttaacaatgaaagaaaaatcatggttagtccataaacaatggtttcttgatttaccgcttccatggacaagtggagcaagtacatcgcaagaaacttggaacagacaggatctcctggttacttttaaaaccgcacatgcgaagaaacaagaggtagtagttttagggagtcaggaaggcgccatgcacaccgcattaacgggtgcaacagaaatacaaacatcgggaacaacaacgatatttgcaggtcatctaaaatgtagattaaaaatggacaaattaacactgaaaggtatgtcgtatgtcatgtgtacgggttcatttaaattagaaaaagaggttgcagaaacacaacatggtacagtcctagtacaggtaaaatatgaaggcaccgatgctccatgtaaaattccattttcaactcaggatgagaaaggagtaactcaaaatggtcggctcataacagctaatccaattgtgactgataaagagaaaccagtaaacatagaaacagagccaccgtttggcgagtcatatatagtagtcggggctggggagaaagcattaaagctatcatggtttaaaagaggtagctctattggtaaaatgtttgaagcgacggcacgtggtgctagacgtatggctatattaggggacactgcttgggattttggaagtattggaggagtatttacaagtgtaggaaaattggtacatcaggtgtttgggacagcatacggagtactatttagcggcgtttcatggacaatgaagataggaatagggatcctattaacgtggctcggactaaactcccgaagtacaagcctatcgatgacatgtatcgctgttgggatggtcacattatatttaggggtgatggtacaggcagattcaggttgcgtgataaactggaaaggaagggaattgaaatgtggaagtggaatatttgttacaaacgaagttcatacttggactgaacaatataaatttcaagccgacagtcctaaaagattatcagcagccattggaaaagcatgggaggagggagtatgcgggattagaagtgccactcgacttgaaaacataatgtggaaacaaatctctaacgagctcaatcatatcctcttggaaaacgatatgaaatttactgttgttgtcggtgacgctaatggaattttggcacaaggaaagaaaatgatacgaccacaaccaatggaacataaatacagttggaaatcctggggtaaagccaaaattatcggcgcggacatccaaaacacaacttttataatagacggcccagacacacccgaatgccccgatggacaaagagcttggaacatatgggaggtggaagattacggattcggtgtgtttactaccaatatctggctaaaacttcgtgattcatacacacaaatgtgtgatcatcgtcttatgagtgcagcaataaaagattcaaaagccgtccatgcggacatgggatattggattgaatccgaaaagaatgaaacatggaaactcgcaagagcctcattcatagaagtaaaaacttgtacttggcccaaatcccatacattatggagtaatggagtactagagagtgagatgattattccaaaaatttatggaggcccaatatcacagcataattatagaccaggctatttcacacaaacagcaggaccttggcatctggggaaattagaattggactttgatttatgcgaaggtactactgtagttgtggatgagcattgtggtaatcgggggcccagcttgcgaacaacaaccgtcacaggaaagattatacacgaatggtgttgtagatcatgcaccctacccccattgcgatttagaggtgaagacggatgttggtatggcatggagatcaggccagttaaagaaaaagaagaaaatctagtaagatcgatggttagcgctgggtccggcgaagtagattcattcagtctgggaatattatgtgtaagtataatgatagaagaagtaatgcgatcgcgatggtcacgcaagatgttaatgactgggacattagctgtattcctcctcctaataatgggtcaactgacatggaatgacttaatccgactgtgcataatggttggagctaatgcatcagacagaatgggaatgggtacaacgtatctagctttaatggctacttttaaaatgcgacctatgtttgctgtagggctactctttcgccgacttactagcagggaagtacttctactcacaatagggctatccttagtggcatcagtagaattgccaaatagtcttgaggaactgggtgatggtttagccatgggaattatgatgctaaaattacttacagaatttcaacctcaccaactctggacaactttattatctttgacgttcgtcaaaactacactatctctagattatgcatggaagacgactgctatgctacttagtatcgtctcactcttccccctatgtttaagcacgacgtcgcagaaaactacgtggttacccgttcttttaggtagctttgggtgcaaaccgttgactatgttcttaataaccgaaaataaaatttggggtaggaagtcctggcctctgaatgaaggtataatggcgattgggatcgttagcatattacttagttccctgctgaaaaatgacgtacctttagccggaccgttaatcgctggaggcatgctcatcgcttgttatgtaatcagtgggagtagcgccgatctatccctcgagaaagctgctgaggtaagttgggaacaagaggccgaacattctggagctagccataacattctcgtagaagtccaagacgacggtacgatgaaaatcaaagatgaagaacgcgatgacacattaacaattctcttaaaagcgaccctattagctgtgagtggagtatatccaatgtcgatacctgcgacgctatttgtgtggtatttttggcaaaagaagaaacaacgatcaggagtattatgggatacaccttcaccacctgaagtagaacgtgctgtcttagacgatggaatttataggattcttcaaaggggattacttgggcgatcacaagtgggagttggagtctttcaagatggagttttccatactatgtggcatgttaccagaggggctgtccttatgtaccaaggcaaaagattagagccaagttgggcatcagtcaagaaagatcttataagttatggaggaggttggagattccaaggcagctggaatactggcgaagaggtgcaagttatcgctgttgaacctgggaagaatcctaaaaatgtccaaacaaccccgggaacttttaaaacgccggagggagaagttggagcgatcgcgttagacttcaaacccggaacatcaggatctcctatagttaatcgagaaggcaagatcgttggactatatgggaacggtgtagttacaacatcaggaacatacgtaagtgcgatcgcgcaagcgaaagctagtcaagaggggccgttacctgaaattgaagacgaagtttttaagaaacgaaacctaactataatggatttgcaccccggatcgggtaaaactaggcgttacctgcctgctatcgtccgtgaagctattaaacggaaactccgcaccctcatcctagccccaacgagggtagtagcaagtgaaatggctgaagcccttaaggggatgcctataagatatcaaacaaccgcggtaaaatctgagcacacgggaagagaaattgtagacttgatgtgtcacgccacttttactatgagactccttagcccggttcgagtgcctaactacaatatgattataatggatgaagcacatttcactgatccagcatcaatcgcagcacgaggctatatatctacacgcgtaggtatgggagaagctgccgccatatttatgaccgctacacctccaggtagcgttgaggcatttcctcaatcaaatgccgtaatccaagacgaagaaagggatatcccagaaagaagttggaatagtgggtacgactggataacggatttcccaggaaaaacagtatggttcgtaccgtctattaaatccgggaatgatatagccaattgtctaaggaaaaacgggaaaagagttattcaactatcaaggaaaacttttgacactgagtatcaaaagactaaaaacaacgactgggactatgttgtaaccacagatatatcagaaatgggagcaaattttagagctgaccgtgttattgacccacgtagatgcttgaagccagttatactaaaagacggccccgaacgggtcattctcgccggacccatgccagttaccgtcgcatccgctgcccaacgacgaggtcgaattggtagaaatcaaaataaagagggagatcagtatgtatacatgggacaacctctaaataatgatgaggatcatgcacactggactgaagctaaaatgctgctagataacataaacacacccgaaggaataattcctgcgctattcgagccagaacgcgagaaaagcgctgctattgacggagagtatagacttcgaggcgaagcacgcaagacatttgtagaattaatgagacgtggcgatcttccagtatggttatcctataaagtagcgtcggaaggatttcaatattctgatcgccgatggtgtttcgacggagaaagaaacaatcaagtgttggaagagaatatggatgttgaaatctggaccaaagaaggggagcgcaagaaattacgccccaggtggctggatgcacgaacctatagcgaccctcttgcattacgggagttcaaagaatttgctgctggccgacggtcggtttctggagatctcatattggaaattggaaaacttccgcaacatctaacactaagggcacagaatgcccttgacaaccttgtcatgttacataattctgaacaaggaggaaaagcctatagacatgcaatggaggaacttcccgatactatagaaaccttgatgctactggctctaatcgcagtactcacaggcggtgtaactctattctttttatctggaaagggtctaggaaaaacatcaattggtttgttatgtgttacagcctcttctgcactattatggatggcatcagtggagccccactggatagctgctagtataattctcgagttcttccttatggtcttattaataccggaaccggatcgccaaagaacaccgcaggataatcagctggcgtatgttgtaatcggattattatttatgatcctaacagtagcagcaaacgaaatgggcctattagaaaccaccaagaaagacttaggtataggatatgtagctgcggaaaatcaccaacacgcaacaatgctcgacgttgatctacatcctgcctcagcatggacattatatgctgttgcaaccacagtcataaccccgatgatgcggcatacaatagaaaatacaacagcgaatatttcgttgacagctattgctaaccaggcagcgatactcatgggtctagataaaggatggcctatatctaaaatggatataggagtaccattattagcattaggctgctactcgcaagtaaatccactaactttaactgcagcagtactcatgctagtagcacattacgccataattggtccaggactacaggcaaaagccaccagggaagctcaaaagcgtacagcagcaggtattatgaaaaaccccacagttgacgggatagtagccatcgacttagatcctgtggtctatgatgccaaatttgagaaacagttaggtcagataatgttactcatcttgtgcacttcacagatattattaatgcgcacaacttgggcgctttgtgaaagcattacgctcgcgacgggaccattaacaaccctatgggaaggtagtcccggtaaattttggaatacaactattgctgtgagcatggccaacattttcaggggctcatacttagcaggggccggtctcgcgttctcgctgatgaaatccttaggcgggggaagaagaggaacgggagcgcaaggagagacattaggcgaaaagtggaagcgacaactaaaccagctatcgaagtctgagttcaacacatataaacgtagtggaatcatggaggtggatagatctgaggcaaaagaagggcttaagagaggagaaaccactaaacatgctgtaagtagaggaacagcaaagttgagatggtttgtagaaaggaatttagtaaaaccggaaggcaaagtcatagatctaggatgtgggagaggtggatggtcatactactgtgctggtctcaagaaagtcaccgaagtgaaaggatacacaaaaggaggtcccggccatgaggaaccaataccaatggcgacttacggatggaaccttgtaaaactgcatagtgggaaggacgtctttttcatgcctccagaaaaatgtgatacacttttatgcgatattggggagtcatctcctaatccaacaatagaggaaggacgtacgttacgagtactaaaaatggtagaaccttggctacgcggcaaccaattctgcatcaaaatattgaacccctacatgccaagcgtagtagaaaccctagagcaaatgcaacggaagcatggaggaatgctagtgcgtaatcccttgagtcgcaactcaactcacgaaatgtactgggtgtcgtgtggtactggcaacatagtatctgctgtcaatatgacaagtcgaatgctattaaatagattcacaatggctcatcgaaagccaacttatgaaagagatgtagatcttggagcaggaactagacatgtagcagttgagccagaagtggcaaacctcgatataataggacaaagaattgagaatattaaaaatgagcataaaagcacttggcactatgacgaagacaacccatacaaaacttgggcataccatggatcatacgaagtgaaaccttcaggctcagcatcttctatggttaatggagtagtaagactcctcacaaagccatgggatgttatacctatggtcacccagattgcaatgacagacacgacaccctttggacaacaacgcgtcttcaaagaaaaagtggatacaagaactccgagagcaaaacggggtactacacaaattatggaggttaccgctaaatggttgtgggggttcctttcaagaaataagaaaccgcgtatttgcactagggaagagtttactaggaaagtacgatcgaatgcagcaatcggggcagttttcgtagacgaaaatcaatggaactctgcaaaagaggcggttgaagatgagcgcttctgggacctagttcaccgtgagagagaactgcataaacagggcaagtgcgccacttgtgtgtacaacatgatggggaaacgtgagaagaaattaggtgaatttggtaaagccaaaggttcccgtgctatttggtatatgtggctcggggcaaggttcctcgagttcgaggcgttaggattcatgaacgaagatcattggttctctagagaaaattctctatccggggtcgaaggagagggtctacataaactaggatatatactcagggacatatcaaagattccaggcggtaatatgtacgcggatgatacagctggatgggacaccaggataactgaagatgacttacaaaatgaagctaaaatcacggacatcatggaaccagaacacgcactcttagcaactagcatatttaaattgacatatcaaaacaaagtcgtaagagtgcaacgtcctgctaaaaatggcaccgtgatggatgtgatatcaagacgagatcaaagagggagtgggcaagtaggaacatatggactaaatacctttactaacatggaagtacaattaatcagacagatggaatccgaaggcatatttctaccatcagaactagaaacaccgaacttagctgaaagagcgctagattggttagaaaaacatggagccgaacgcctaaagaggatggcgatcagcggtgatgactgtgtcgtcaaaccaattgatgacaggtttgcaacagcattgacagcactcaatgatatgggcaaagtaagaaaagatattccgcaatgggaaccatcaaaagggtggaacgattggcagcaagtaccgttttgtagccaccacttccatcaattaatcatgaaagacggtagagaaattgtagtcccctgtcgaaatcaggatgaattagttggtcgcgcacgagtaagccaaggtgcagggtggtcattgagagaaacagcatgccttggaaagtcatacgcacaaatgtggcaattaatgtacttccacagacgagacttacgactcgcagcaaatgctatctgcagtgctgtacctgtagattgggtacccacttcaaggacaacgtggtcaatacacgctcaccaccaatggatgactacggaggatatgctttcagtatggaaccgagtttggattgaagagaatccgtggatggaggataagacacatgttagttcctgggaagaagtaccatacttaggtaaacgagaagatcaatggtgcggatcattgatagggttaactgcacgggcaacatgggccacaaatatccaagtagcgatcaaccaggtccggaggctcataggtaatgagaactacttagactatatgacaagcatgaaacggttcaaaaatgaaagcgatccagagggtgcattgtggtga

SEQ ID NO: 21420 - RNA, 9879 nt, synthetic construct
  misc_feature 1..9879: note = derived and/or modified CDS sequence (opt6) from DENV-1__FJ639818__SS-prME
  source 1..9879: mol_type = other RNA
agtgtgacaatgcttttaatgcttttacccactgctttagcattccatttaactacgcgtggaggggaaccacatatgatagtctctaaacaagaacgtggtaaaagcctcctgtttaaaacaagcgcaggagtgaatatgtgcacattgatagcgatggacctgggagaattatgtgaagatacgatgacctacaaatgcccaaggataactgaggcagaacctgatgacgtagactgctggtgtaatacaaccgatacgtgggttacatatgggacgtgttctcaaacaggagaacatagacgtgacaaaagaagtgtcgcgttagctccgcatgtaggtcttggtttagaaacacgtacagaaacatggatgtcatctgaaggtgcgtggaaacaaatccaacgggttgaaacctgggccctaagacatcctggcttcacagtgattgcgctatttttggctcacgctataggaacctctataacccaaaaaggaataatatttattcttttaatgcttgtgacaccatctatggctatgcgatgtgtaggcattgggaatcgggattttgtcgaaggtctttctggggcaacctgggtagatgttgttttagaacatggctcatgtgtaacaaccatggctaaaaacaaaccaaccttagatatagaactactcaaaacagaagtcacaaatcctgctgtcctgcgcaaattatgtatagaagccaaaataagtaatacaacaactgacagccgatgtccgactcaaggagaagcaacacttgtagaagaacaagatgccaattttgtgtgcagaagaacttttgttgatagaggctgggggaatggatgcggtttgtttggaaaaggttcgcttcttacttgcgccaaattcaaatgcgttactaaacttgaaggaaaaatagttcagtatgaaaatttaaaatactcggtcatagtaactgttcacactggtgaccaacatcaagttggtaatgaaacaacagaacatggaactatagcaactattacgccgcaagcgcccacatcagaaattcagctaactgattatggagcattaactttagactgttccccaaggacaggcttagacttcaatgaaatggtattgttgacaatgaaagagaaaagttggctagtacacaaacaatggtttttggatctaccgttaccgtggacatcgggtgcatcgaccagccaagaaacgtggaatcgacaggacttacttgttacattcaaaacagcacacgccaagaaacaagaagtagttgtcttaggttcacaagagggagccatgcacactgctcttacgggtgcaaccgagattcagacgagcggaaccactaccatttttgctggccacctcaaatgcaggctcaaaatggaaaaattaacattaaaaggtatgtcttatgttatgtgcacagggtcttttaaactagagaaagaagtcgcggaaacacagcacggaacagtactcgtgcaggtaaaatatgagggtacggatgccccctgcaaaattcctttcagtacccaagatgaaaaaggtgtaacgcaaaatggtcggcttataacggctaatcccatcgtcactgataaagaaaaaccagtgaacatagaaacagagcccccatttggcgagagttatatagtagtaggagcaggcgaaaaggccttaaaactgagctggtttaagaaaggtagttcaataggtaaaatgttcgaagcaactgccagaggggctcgacgtatggcgattctgggggatacagcctgggactttgggagtatcggtggcgtatttacatctgttggaaaattagtacatcaagtatttgggacggcctatggagtgttgttctcgggagttagttggaccatgaaaataggcataggcatacttttaacgtggcttggactaaacagtcgaagcaccagcttgtctatgacctgtatagctgttggaatggtcacactatatttaggggtaatggtacaggcagacagcggatgcgtcataaactggaaaggaagagaattaaaatgtgggtctggtatattcgtgactaatgaagtccacacatggacagaacaatacaaattccaggcagatagtccaaaacgtctatcagcagcaattggcaaggcttgggaagagggcgtgtgtggtatcagaagtgccacgcgattagagaatataatgtggaaacaaatctccaacgaactgaatcatatccttctggagaatgatatgaagtttacagtagttgtaggcgacgcgaatggcattttggcgcaaggaaagaaaatgataagaccccaacccatggaacacaaatactcttggaaatcgtggggaaaagcgaaaataatcggggcagatatacagaacacaacgttcattatcgatggaccagatacaccagaatgtcctgatggccaaagggcttggaatatatgggaagttgaagactacggctttggaatttttacaactaacatttggcttaaactcagagattcctacacccaaatgtgcgatcaccgtttgatgagtgctgcaataaaagactccaaagcggtccatgcggatatgggatactggatagaatccgagaaaaatgaaacctggaaacttgcaagagccagttttatagaagtcaagacgtgcacttggccaaaaagtcacacactctggagtaatggagttcttgaatctgaaatgattatacctaaaatctacggaggaccaataagtcagcataactacagaccaggatattttacacaaacagctgggccttggcacttgggaaagctcgaattagattttgacctatgtgaaggcacaacagtagtagtagatgaacattgcggaaatagaggtccgagtttaagaactaccactgtaacaggaaagataatccatgaatggtgctgcaggtcatgcacgcttcctcctctccgatttagaggtgaagatggctgttggtacggtatggaaatacggccagtaaaagaaaaagaagaaaatttagtcaggtccatggtgagtgccggcagcggtgaagttgatagttttagtctggggatattatgtgtatcaatcatgatagaagaagtcatgagatcaagatggagtaggaaaatgctaatgaccggaacactggctgtattcttattactcattatgggtcaattaacttggaacgacttaattagattatgcatcatggtcggagccaacgcttccgatagaatgggaatgggaacgacacatctagctctcatggcaacatttaagatgagaccaatgtttgcggtcggtcttttatttagaagacttacaagtcgtgaagttctcctactaacgatcggattatcactcgtagctagtgtagagttgccaaactcacttgaagaacttggagacggactggcgatggggataatgatgctgaagttattaactgaatttcaaccacaccaactttggaccaccttactctcattaactttcgtcaaaaccacattatctttggattacgcctggaaaactacggcaatggtactatcgatagttagtttatttccattatgtctaagtactacctcacagaagacaacctggttgcccgttttattgggctcattcgggtgcaagccattaactatgttcctaattaccgagaacaaaatatggggacgtaaaagctggcctctaaatgaaggaattatggctatcgggatagtatcaatcttactatcaagtctgcttaaaaacgacgtaccactagcggggccgctgatcgccggcggaatgctcatagcttgttatgttataagtggatcttcagcagacctgagtttagaaaaagcggcagaggtttcatgggagcaagaagcagaacatagcggcgcttcccataatatccttgtcgaagttcaggatgacggaaccatgaaaataaaggatgaagaaagagacgatacacttaccatcttattgaaagccactctgttagcagtatccggtgtctatcccatgtctatccccgcaacgctttttgtctggtatttctggcagaagaagaaacaacgcagcggcgtcttatgggacactccatcaccaccagaagtcgaaagagctgtattagatgatgggatatatagaatactgcagcgtggattattaggcagatcccaagtcggtgtcggcgtatttcaagatggagttttccatacgatgtggcatgtgacccgaggtgcagtacttatgtatcaagggaaaagactagaaccctcatgggccagcgttaaaaaggatctaatttcttatgggggaggatggagatttcaaggaagttggaatacaggggaagaagtacaagtcattgctgtggaaccaggtaaaaaccctaagaatgttcagacgaccccaggaacgtttaaaacaccggaaggtgaagtcggagcaatcgctttggacttcaagccaggaacgtcaggttcaccgatcgttaatagagaaggaaaaattgttggtttatacggaaatggtgtcgtgactacgtccggaacgtatgtttctgccatagcgcaagctaaagcctcacaagagggtcctcttccggaaattgaggatgaggtttttaagaaaaggaacctaacaatcatggatctacatcccggttccggcaaaaccaggagatacttaccagcaatagtcagagaagccataaaaaggaagttaagaacattaatactagcacctacacgagtagtggctagtgaaatggctgaggctctaaaaggaatgcctattcggtatcaaacgaccgcggttaaatcagagcacacaggccgagaaattgttgacctgatgtgccacgcaacattcactatgagattactaagcccagtacgggtaccaaattataacatgatcattatggacgaagcgcactttacggaccctgctagcatagctgcgagagggtacatttccactagagtaggaatgggagaagctgctgcaatattcatgacggctacacctcccggctccgtagaagcctttccacagagcaatgcagtcatacaagatgaagaacgagacatacccgaacgatcgtggaatagtggttatgactggataactgattttccaggcaaaactgtatggttcgttcctagtataaagtctggtaacgacattgccaactgcttacgaaagaatggtaaaagggtaatacaactatccagaaaaacatttgacacagagtaccagaaaaccaaaaataatgactgggactacgttgtaactactgatatctccgaaatgggcgctaattttcgcgctgacagagtgatagatcctcgtcggtgtctgaaaccagtaattttaaaggatgggcctgaaagagtcatattggccgggccaatgccagtcactgtagcaagtgcggcacaaagaagagggagaataggtaggaaccagaataaagaaggagatcaatacgtgtatatgggacaacctctgaataacgatgaagaccatgcacactggactgaagcaaaaatgctccttgacaacataaacacaccagaaggtataatacctgcattatttgaaccagaaagagagaaatctgcggcgatagatggagaatacagacttcgaggcgaagcaaggaaaacattcgtcgagttgatgagacgcggtgatttacctgtatggctatcatacaaagtggctagtgagggctttcaatatagtgatcgcagatggtgttttgacggtgaaagaaataatcaggtccttgaggaaaatatggatgtggagatatggacaaaagaaggcgagaggaagaaacttagaccgagatggctagacgcccgaacgtacagtgacccgctcgctttaagggagtttaaagaatttgctgctggtagaagaagtgtctcaggagacctcatactagagatagggaaattacctcaacatttgacattgcgggcccaaaatgcgttggataatctagtaatgttgcataatagcgagcaaggaggtaaggcttatagacatgcaatggaagaattaccagatacgattgagacgctaatgctgttggcactcatcgcggtacttacagggggcgtaacacttttcttcttatctggcaagggcctaggtaagacatctattggcttgttatgtgtaactgcttcaagtgcattactatggatggcgagcgtggaaccgcactggattgcagcatcaataatattagagttctttctgatggtcttactaattcccgagccagatagacaaaggacgccgcaagacaatcaattagcatacgttgttatcggcctattatttatgatactaactgtggcagccaacgaaatgggcctcctcgaaacaacaaagaaagacttaggtatcggatacgtagcagcagaaaatcatcagcacgcaactatgttggatgttgacttaagacccgcatccgcgtggacactatatgctgttgctactactgtcataacacctatgatgcgacatactatagaaaataccacggctaacatctctttgaccgcaattgcaaatcaggctgctattcttatgggattagataaggggtggcctatatcgaaaatggatataggtgtacccctactagcactagggtgttatagccaggtaaaccctcttacactaacggcggctgttctaatgctagtagcgcattacgctataatcggtccgggacttcaagcaaaggctactagagaagcgcagaaaaggacagctgcaggcataatgaagaacccaacagttgatggaattgttgcgatagacttagacccagttgtatatgatgcaaagttcgaaaagcaattaggtcagataatgctgttaattctatgtacttcacaaattctattaatgaggacaacttgggccctctgtgaatcaattacactggcgacaggaccgttaacaacactatgggaggggagcccaggcaaattctggaacaccactattgcagtttctatggctaatatttttcgaggatcatatctggccggagcaggattggcattttccttaatgaagtctttaggcggaggacgaagagggaccggcgcacagggggaaacgttaggagaaaaatggaagcgacaactaaaccaactaagcaaatcagagtttaatacatataaacggagcgggattatggaggtagatcgttcagaagccaaagaaggactgaaaagaggagaaactactaaacacgcagttagccgtggaacggcaaaattgagatggtttgtagaacgtaatctggtaaaaccagaaggaaaggttatagacttaggatgtggtagaggtggttggtcatattattgcgcaggcctgaaaaaggtaacggaagtaaagggatatactaaagggggtccaggacatgaagaaccaatccctatggccacttacggatggaacctagtaaaacttcatagtggcaaagacgtcttctttatgccaccagaaaagtgtgatactttactttgtgacataggagaaagtagtccgaatccaacgatagaagaaggacgcacgttgagggtattaaagatggtagaaccatggctaaaagggaatcaattttgtatcaaaatacttaatccgtatatgccatcggttgtcgagactttagagcagatgcagcggaaacacggtgggatgctagtacgtaatccactgagtaggaatagtacccatgagatgtactgggtctcgtgtgggacaggtaacattgtcagtgcagtaaacatgacgtctcgaatgctacttaatcgattcacaatggcccacaggaaaccaacttatgaaagagacgtagacttaggagcaggtacccgacacgtagctgtggaaccggaggtagctaacttggatattattggacaaagaattgaaaacattaagaatgaacacaaaagcacatggcattatgatgaagacaatccatataaaacttgggcgtatcatggtagctacgaagtaaaaccttctgggtctgcatcttccatggtaaatggcgtcgttagattactcacaaaaccatgggacgtaataccaatggtaacacaaatagcaatgacagatacaacacctttcggacaacaacgagtgtttaaggaaaaagtcgatactagaacaccacgagcaaaacgaggcacaactcaaattatggaagttacagcaaaatggctctggggttttctttcaagaaacaagaaaccacgaatatgtactagagaagaatttacaaggaaagtacgttccaacgcagctatcggtgccgtttttgtggatgagaatcaatggaatagcgccaaggaagcagtggaggacgaaagattttgggatttagtccatagagagagagagttacataagcaaggcaaatgcgctacctgcgtatataacatgatgggaaagagagagaagaaactgggggaatttggcaaagcaaaaggatctcgggctatttggtacatgtggttaggcgcccgatttttagagttcgaagcacttggatttatgaatgaagaccattggtttagtagagaaaactcactctctggtgtggagggcgaaggattgcataaattggggtacattttgagggacattagcaaaattccaggtggcaatatgtatgccgatgatactgcaggatgggatactagaataacagaggatgatctccaaaacgaggctaaaataacggatattatggagcctgaacatgccttacttgcaacgagcatatttaagttgacatatcagaacaaagtagttagagtacaacgcccagccaaaaacggaacagtaatggatgtgatctctagacgtgatcagcgaggttcaggacaagtcggtacgtatggtttaaataccttcactaacatggaggttcagctcattagacaaatggaaagcgaagggatatttctaccatcagaattagaaaccccaaacttagctgaaagagtcttagactggttggagaagcatggcgctgaaagactaaaaagaatggcaatttctggagatgactgcgtagttaaaccgatagacgatagattcgccactgcgcttactgctttaaatgacatgggtaaagtcaggaaagatattccacaatgggaacccagtaaaggatggaatgattggcagcaagttcctttttgctctcatcattttcatcaactaattatgaaagatggaagagaaatagtagtcccctgccgaaatcaagatgaattagtaggcagagcgagagtaagccaaggagctggctggtctttgagagaaacggcctgtcttgggaaatcctatgcacaaatgtggcaactaatgtacttccacagaagggatttaaggctggcggccaatgcgatatgctccgctgtaccagtggactgggtaccgacttcaaggactacatggtcaatacatgctcatcatcaatggatgactactgaagatatgttgtcagtttggaacagagtttggatagaggaaaacccgtggatggaagataaaactcacgtttcatcttgggaggaagttccctatctagggaagcgggaagatcaatggtgcggaagtctaattggtttgacagccagggcaacgtgggctacaaacattcaggtagcaattaatcaagttagacgtctgataggaaacgagaattatctagattatatgacttcaatgaaaaggtttaagaatgaaagcgatcctgaaggcgccttgtggtga

SEQ ID NO: 21421 - RNA, 9879 nt, synthetic construct
  misc_feature 1..9879: note = derived and/or modified CDS sequence (opt6) from DENV-1__FJ639819__SS-prME
  source 1..9879: mol_type = other RNA
agcgtcaccatgttacttatgttactgccaactgctctcgcgtttcacttaacaaccagagggggcgaaccccatatgatagtgtcaaaacaagaacgagggaaatcgctactctttaaaacaagtgcgggtgtaaacatgtgcaccctaatcgcaatggatctaggagaactctgcgaagatacaatgacctacaagtgccctagaattaccgaagcagaacccgacgacgtagactgttggtgcaacgctactgatacatgggtaacatatggaacctgctcacaaacaggagaacataggcgagaaaagagatccgttgctctagcgccgcacgtaggtttaggccttgaaacccgaactgaaacctggatgtcaagcgaaggagcatggaagcaaattcagcgagtcgaaacgtgggcgctacgacatcctggatttacggtgatagcattctttctagctcatgcgattgggacaagcataacacaaaaaggtataatattcatactcttgatgttagtgacaccatctatggcaatgagatgtgttggcatagggaatcgagatttcgtcgaaggtctgagtggagcgacatgggtagatgttgtgctcgaacatggctcgtgcgtaacaaccatggcgaaaaataagcctacactagatatagaacttctgaaaaccgaagtgacgaaccctgccgtgctaagaaaactatgtatagaagctaaaatatcaaatactacaacggactcaaggtgtcccactcaaggtgaagcaaccttagtcgaagaacaagatgcgaatttcgtgtgtcgtagaacatttgtcgatcggggatggggaaacggatgcggccttttcggaaaaggatctctacttacatgtgccaaattcaagtgcgttaccaaattagaaggtaaaatcgttcaatatgaaaatttaaaatacagcgtgattgtgacagtacataccggtgaccaacatcaagtgggaaacgaaaccacggaacacggcacgattgcaactattacgccacaagctccaacttcagaaattcaactaactgattatggagcgctgacccttgactgtagcccaagaacggggctagatttcaatgaaatggttttacttaccatgaaagaaaaatcatggcttgtacataaacaatggtttcttgatttacctttaccttggacaagcggggcatcaacaagccaagaaacatggaaccgtcaggatcttttggtaacctttaagaccgctcacgccaagaaacaagaagtagtagtcctaggttcacaagagggagcgatgcatactgccctcactggagccacagagatccaaacatcaggcaccactacaatcttcgcaggtcatttaaaatgtcgtctaaaaatggacaaattaacattaaaaggaatgagctacgtcatgtgcactggatcattcaagttagaaaaagaggttgctgagacacaacacggcacagtactcgtacaagtcaaatatgaaggaactgatgcaccttgtaaaataccattctcaacacaagacgagaaaggagtaacgcaaaacggcagacttatcacggctaatcccatagtaacggacaaagaaaaaccagtaaacattgagaccgaaccgccgttcggagaaagctatatagtggttggagcaggagagaaagcgttaaaattatcatggtttaaaagaggatccagcataggtaagatgtttgaggcaacagcacgtggagctagacgtatggctattcttggtgatactgcctgggacttcggcagcattggcggtgtcttcacttcagtgggaaagttggtacaccaagtatttggaacagcgtacggggtcttatttagcggcgtaagttggaccatgaaaataggtattggtattctacttacttggttaggcttaaactcaaggtcaacgagtctaagcatgacctgtattgcagtaggaatggtcacactttatttgggagttatggtacaagcagactcaggttgcgttatcaactggaagggtcgagaattaaaatgtggtagtggaatctttgtcactaatgaagttcatacatggactgaacaatacaagttccaggctgatagccccaaacgattgtccgctgccatcggcaaggcatgggaagaaggcgtgtgtggaatcagaagtgctactcgattggagaatatcatgtggaaacaaatctcaaacgaattgaaccatatattattagagaacgatatgaaatttactgttgtagtaggggatgcaaatggaatattagctcaaggcaagaaaatgatacgaccgcagccaatggaacataaatattcgtggaaatcgtggggtaaggcaaaaataattggagcagacatccaaaacacaacatttatcatagatggccccgacaccccagaatgcccggatggacaaagagcatggaatatttgggaagtcgaagattacggatttggaattttcactacaaacatttggttaaaacttagagactcatacactcagatgtgtgaccaccggctcatgtctgcagcaataaaagatagtaaagcagtacatgcagatatgggctattggattgaatcagagaaaaatgaaacctggaaactcgccagagccagctttattgaagttaaaacatgtacatggccaaaatctcacacgctctggagcaacggagtattggagagcgaaatgatcatcccgaaaatatacggtggtcctatatcacaacataactacagaccaggatacttcacccaaacagccgggccgtggcacttagggaaacttgaactagacttcgacttatgcgaagggactacagttgttgtcgacgagcattgcggaaatagaggtccttccttaagaactacgacggtaacaggcaaaattatacacgaatggtgttgccgtagctgcacactgcctccattaagattccgaggtgaagacggttgctggtacggaatggaaatacggcccgttaaggagaaggaagagaatttagtccgttcaatggtcagcgccggttcaggcgaggttgacaattttagtctaggtatattatgtgtatcgataatgatagaagaggtcatgaggagcagatggtcccgcaagatgcttatgactggtacattagcagtatttctgctgctaataatgggccaattaacttggaacgatttaataagactctgtattatggtaggcgcaaatgcatcagatagaatgggaatgggaacaacatatttagccttgatggctaccttcaaaatgcgaccaatgtttgccgtgggactactatttagaaggctaacatcacgtgaagtcttactacttaccataggtctatccctcgttgcaagtgtcgaattaccgaactccctcgaagaactgggtgacggtttggcaatgggtattatgatgttgaagctactaacagaatttcaaccacatcaattatggacgacattgttgtcactaacatttgtgaagacaacacttagcctagattatgcatggaagactactgctatggtgctctcgattgttagtctgtttccattatgcttatctactacgtcgcagaaaactacatggctgcccgttttactgggatcattcggatgtaaaccattaacaatgtttttgattactgaaaataaaatatggggacgaaagtcctggcctttaaatgaggggataatggccataggtatagtttcaatcctactctcatcgttactaaagaatgatgtcccattagccggaccattgatagcaggaggcatgttaatagcatgttatgtcatatctggcagtagtgccgacttaagtcttgaaaaagccgcagaagtaagctgggaacaagaggctgaacactcaggtgcaagtcataacatattagttgaagtgcaagatgatggtacaatgaaaatcaaagatgaagaaagagacgatactttaacaatactcctgaaagccacgctcttagcagtatcgggagtgtaccctatgtcaataccagcgacgctattcgtgtggtatttttggcaaaagaagaaacaacgtagtggggtgctttgggacacacctagcccgccagaggtcgaacgggccgttctagacgacggtatatatagaatacttcagcgaggattattaggacgatctcaagtaggggttggagtgtttcaagatggtgtttttcatacaatgtggcacgtaactagaggcgcggtcctaatgtatcaaggtaagagactagaacctagttgggcttgtgttaaaaaggatctcataagctatggaggtgggtggcgctttcaggggttatggaacacaggggaagaagtacaagtgattgcagtcgaacccggtaaaaatccgaaaaatgtacaaacaactcctggtacattcaaaacacccgaaggagaagtaggcgcaattgcattggatttcaaaccaggcacaagcggaagtcctatagtgaaccgggaagggaaaatagtagggttatacggtaatggtgttgtgacaacatcgggtacatatgtgtcagcgatcgcacaagctaaagcaagccaagaaggcccgttacccgaaattgaagatgaagtatttaagaaaaggaatctaaccataatggacctacaccctggatcaggaaaaacacgacgctatcttcccgcaatagttagagaggctattaaaagaaaactccgaacattgattttagccccaacaagagttgtggcatcagagatggccgaagcattaaaaggtatgcctatcagatatcagaccacggcggttaaatctgaacatacaggtcgcgaaatagtagatctaatgtgtcatgctacctttacaatgcgattattatcaccagtaagagtgccaaactataatatgatcataatggacgaagcacattttacggaccctgcctccatagcagcaagaggctatatatccacgcgagttggcatgggcgaggctgcggctattttcatgactgcgactcctccagggtcagtagaagcgtttcctcaatctaatgctgtaatacaggatgaggagcgagatatccctgaacgttcgtggaatagtggatatgattggataaccgatttcccaggcaaaactgtctggttcgtcccgagtattaaaagtggaaacgacattgccaactgtcttagaaagaacggtaaaagagttattcaattgagccgcaaaacatttgacacagaataccagaagactaagaataacgattgggattacgtggtaactaccgatataagtgaaatgggtgctaatttccgcgctgatagagttatagatcccagaagatgtttaaaaccggttatattgaaggatggacccgaacgcgtcatactagccggacccatgccagtaaccgtagcgtcggcagcccaaaggcgcggtagaattgggaggaaccaaaataaagaaggagaccaatacgtatatatgggccaaccattaaacaatgatgaggaccacgctcattggactgaggcaaaaatgcttttggataatataaatacaccggaaggaatcatccccgcattgtttgaaccagaaagagagaaatccgccgcaattgatggggaatatagattaagaggtgaagcacgaaaaacattcgtcgaattgatgagacgtggagatttgccagtatggttgagctataaggtcgcgtctgaaggctttcaatatagtgacagacgttggtgtttcgacggcgagagaaacaatcaagtcctagaggaaaacatggatgtggaaatttggacaaaggagggcgaaaggaagaaattgcgaccacgatggctagatgctagaacttattcggatcctctcgccttgagagaatttaaagaatttgcagcaggccgtcgaagcgtttctggtgacttgattttagagataggaaaactaccacaacacctaacattgagagcacaaaatgcacttgacaatttagtaatgctccacaattcggagcaaggcgggaaggcatataggcacgctatggaggaactgcccgacactatagaaacgttaatgctactcgccttaatagcagttctcaccgggggtgttacgctatttttcctatccggcaaaggacttggtaagacgtcgatagggcttctttgtgtgacggcatcttccgctttactatggatggcaagcgttgagccacactggatcgccgcgagtataatattagagttctttcttatggtattattaatacccgaacctgaccgtcaaaggaccccacaagataatcagctcgcatacgtagtaatcggtctcctcttcatgatactcactgtcgctgctaatgaaatgggcttgttagagacaactaagaaagacttagggataggatacgtagccgcggagaaccaccaacacgcaaccatgttagatgtagatctccaccccgcatcagcatggacgctatacgcagtggccacgacagtaattacacctatgatgaggcacacaatagaaaatactacggctaatatatccctaacagcaatagcgaatcaagctgcaatactgatgggcttagataaaggatggccaataagtaagatggacataggcgtaccactactagctctgggctgctactcccaagttaacccgctcaccctaacagcggctgtattgatgttagtagctcactatgcaattataggcccaggactccaagcgaaagccacacgggaagctcagaaaagaactgcagcagggataatgaaaaatcctacagttgatggtatcgtggccattgatctagatccggtagtatatgatgcaaaatttgaaaaacagttaggacaaataatgctactgatactatgcacgtcacaaatactgctaatgagaaccacttgggccctttgtgagagtatcacactcgcaacaggcccgttaactacgctctgggaaggaagtccaggaaagttttggaatacaactatagccgtaagcatggcgaacattttcagaggatcgtacttagcgggagctggtttagcattttctttaatgaaatcgttaggaggcggacgacgaggcaccggagcacaaggtgaaaccttaggtgaaaaatggaaacgtcagttaaatcagcttagcaaaagcgagtttaatacatacaaaagaagtggaataatggaggtcgatagatcagaagctaaagaggggttaaaacgcggtgaaacaaccaagcacgcagtgagtcggggcactgcgaagctacgttggttcgttgaaagaaacttagttaaaccagaaggaaaagttatagatctaggctgcggaaggggaggttggtcatattactgtgctggtttgaagaaagttaccgaggtgaaaggttatactaaaggaggaccgggacacgaagaaccaattccaatggcaacttatggatggaatttagtaaaattacattcaggtaaagatgtatttttcatgcccccagaaaaatgtgacacactactatgcgatattggtgaaagttcccccaatcccacaattgaagaaggtcgaacacttcgggtattaaaaatggtagaaccatggttaagaggaaatcaattctgtattaaaatccttaacccttacatgcccagtgtagtagaaacactcgaacaaatgcaaagaaaacatgggggcatgctagtaaggaatcctttaagtcgaaacagcacacacgaaatgtactgggtgagctgcggaaccggaaatatagtctcggctgtaaacatgacaagtcgaatgctactaaatagatttacaatggctcatcgaaaacctacttatgaacgagatgttgacttaggcgctggaacaagacatgtcgccgtcgaaccagaagtcgccaatttagatattataggtcaaagaatagaaaacataaagaacgaacacaaatccacctggcattacgacgaagataacccttacaagacttgggcgtaccacggatcttatgaagtcaaaccgtctggatcagccagctcaatggtaaacggagtagtcaggctactgacaaaaccctgggatgttataccaatggtaactcagatcgcaatgacagacactaccccattcggccagcaaagagtatttaaagagaaagtcgacacacgcactcctcgagcaaagagagggacgacacaaatcatggaagtaactgcgaaatggttatggggatttttaagccgaaacaagaaaccaaggatctgcacaagagaagaatttacaagaaaagtacgatcaaacgcggcaataggagctgtgtttgtagacgaaaatcaatggaactcggcaaaagaagcagtggaagatgaaaggttctgggacctggtacaccgagaaagagaattacacaaacaaggtaaatgcgccacctgtgtttacaatatgatgggtaaacgagagaagaaacttggtgagttcggaaaagcaaaagggtcgcgggcaatatggtacatgtggcttggagcgcgttttctcgagttcgaagcccttggttttatgaatgaagatcattggttctctcgggaaaattcgttatccggagtagagggagaaggacttcacaaacttggctacatattaagagatatcagtaaaataccaggtggaaatatgtatgctgatgacacggcagggtgggacacacgtataacagaggacgacttacagaacgaagctaaaataacggatattatggaacctgagcatgcactgctcgcaacttcgattttcaaacttacctaccaaaacaaagtggtgagagttcaacgcccagcaaagaacggtacagtaatggacgtaatatcacggcgcgatcagaggggatcagggcaagttggcacctatggtttaaacacgtttacgaatatggaagtccagcttattagacaaatggaaagtgaaggcatttttctccctagtgagctagaaaccccgaatctggctgaaagagtactagattggctggaaaagcatggggcagagagattgaaaagaatggcaatatcaggagatgattgtgtagtaaagcctatagacgaccgatttgcaacagcgctaacagccttaaatgacatgggaaaggtacgaaaggatattcctcaatgggagccctctaaaggctggaatgattggcaacaagtgcctttttgctcacatcattttcaccaacttattatgaaagacggtcgtgaaatagttgtaccgtgtaggaatcaagacgagctagttgggagagccagagtgtctcagggagcggggtggtcattaagagaaactgcttgccttggaaaatcatacgcacaaatgtggcaactgatgtattttcaccgacgtgatttaagattggcggctaatgcaatctgttctgcagtacctgttgattgggtcccgacaagtagaaccacgtggagtattcatgcacatcaccaatggatgacgacagaagatatgttaagcgtctggaaccgggtatggatagaagagaatccttggatggaagacaaaactcacgtgagcagttgggaagaagtaccatacttaggcaaaagagaggatcaatggtgtggatccttaataggcctaacagcccgtgcaacttgggcgacaaatattcaagtcgcaattaaccaagtacggaggttgatagggaatgaaaattatctcgattatatgacatcaatgaaaaggtttaagaatgaatcagacccagagggtgcactgtggtaa

SEQ ID NO: 21422 - RNA, 9879 nt, synthetic construct
  misc_feature 1..9879: note = derived and/or modified CDS sequence (opt6) from DENV-1__FJ639820__SS-prME
  source 1..9879: mol_type = other RNA
tcagtaactatgctacttatgttattgcctacggcgctggcattccatctcactacaagaggcggggaaccccatatgatcgttagcaaacaagaaagaggaaaatcgctcctttttaaaacttcggcaggcgtcaacatgtgtaccctcattgcgatggatttaggtgaattatgcgaagataccatgacatacaaatgtcctcggatcactgaagcagaacctgacgatgtagattgctggtgcaacgctacagatacatgggtaacctatggaacgtgcagtcaaacaggagaacacagacgagacaaacgttcagtagccctagctccacatgtcggcttaggtttagaaaccagaacggagacgtggatgagttcagaaggcgcatggaaacaaatccaaagggtagaaacatgggccctaagacatccaggttttacagtaatcgcgctctttttagcacatgccattggtacttccataactcagaagggaataattttcatactattaatgctcgttactcctagtatggctatgaggtgtgtaggcatcggcaatagagactttgtagaaggtctatctggagcaacgtgggtggatgtagtattggaacacggatcgtgcgtgacaacaatggccaaaaataaaccgactttagatatagaacttttaaagactgaagtgactaatccagcagtgctacggaaactttgcattgaagcaaaaatatcaaacactacaacagacagtagatgcccgacacagggcgaagcaacgctagtagaagaacaagacgctaattttgtttgcagacgaacgttcgtcgataggggttggggcaatggctgtggattgtttggtaaaggatcgctattaacttgtgccaaattcaagtgtgttacaaagctagaaggaaaaattgtacaatatgaaaacctaaaatactcagtcatagtcacagttcacacaggagatcaacaccaagttgggaatgagacaactgaacatggtacaattgcaaccattacgccacaagcgcccacgagtgagattcaattgactgactatggggctcttacccttgattgttctccgagaaccgggttagattttaacgagatggttctactaactatgaaggaaaaatcatggttagttcacaaacagtggttcctcgatttgccattgccatggaccagtggagcgagtacaagtcaagagacttggaacaggcaagatcttctagtaacattcaaaaccgcgcatgcgaagaaacaagaggtggtcgttctgggcagtcaggaaggagcaatgcacactgccttaacaggtgcaacagaaatacaaacatcaggaacaacaacgatatttgcgggacacttaaaatgccgcttgaaaatggacaaactaacactaaaaggaatgagttacgtgatgtgcacaggttcttttaaactagaaaaagaagttgctgagacccaacatggtaccgtgctcgttcaagtgaagtatgagggtacggatgcaccatgcaaaataccgttttctacacaagatgaaaaaggagtcactcagaatggccggctcataaccgccaatccaatagtgacagacaaggaaaagcccgtcaatatcgaaactgaacctccatttggcgagtcatatatcgttgtgggagcaggcgaaaaggctttgaagttatcttggtttaaaaagggaagtagtataggaaaaatgttcgaagctaccgcacgcggagcgaggagaatggctatcttgggtgacacggcgtgggatttcggtagtataggtggtgtctttacctcggtcggaaaattggtacatcaagtctttggaacagcttatggagtactttttagtggcgtaagttggaccatgaaaataggaatcggaatattattaacctggttaggcttaaattcacgtagcacaagtttatcgatgacctgtatagcagtaggaatggtcacgctatatctaggagtaatggtacaggcagattctggctgcgtaattaactggaaaggaagagaattaaaatgcggaagtgggatatttgtcacaaatgaagtacacacctggacggaacaatataaatttcaggcagattcccccaagagattgtctgcagcaattgggaaagcatgggaagagggtgtttgtggtattcgaagtgcaacaagactggaaaacatcatgtggaaacagataagtaacgagcttaatcacatattactggaaaacgatatgaaattcacagtagtagtgggcgatgctaacgggatactagcacaaggtaagaaaatgataaggccacaaccaatggaacacaaatattcatggaagtcatggggaaaagcgaaaataataggagcagacatacaaaacacgacttttataatagatggcccagacacccctgaatgtccggacggacagcgagcatggaacatatgggaggtcgaagattatggttttggaatttttacaactaatatctggctaaaattaagggattcatacacgcaaatgtgcgatcacagattgatgtcagcagcaataaaagactcaaaagccgtacatgctgacatgggatattggatagaatcagagaaaaatgaaacctggaagctagctagagcaagtttcattgaggtaaaaacatgtacatggccaaaatcgcatactttgtggtcaaacggggttctagaaagcgagatgatcattccaaaaatctacgggggaccaatctcgcaacacaactacagacccggatattttactcaaacagcaggaccatggcaccttggcaaattggagttagatttcgatctttgcgaaggaacgacagttgtcgtcgacgaacattgtggcaataggggaccatctcttagaacgacaacagttacaggtaaaatcattcacgaatggtgttgtcgttcatgtacgctaccacctctgagattcagaggcgaagatggctgttggtatggcatggaaattaggccggtaaaggagaaagaagaaaatttggtaaggagtatggtctctgctggatctggagaagttgacagcttttcattaggaatactttgtgtaagtataatgatagaagaggttatgagatcacgatggtctaggaaaatgctaatgacaggcactttagcggtattcttgctactaattatgggacagctgacttggaacgacttgataaggttatgtattatggtcggagctaacgcaagtgacagaatggggatgggcaccacctatttagcgctgatggccacattcaaaatgagacccatgttcgccgtaggactattattcagaagactaacttccagagaagtactgctgttgacaataggcttatcattagtcgcctccgttgaattaccaaatagcttagaagaattaggagatggtttagctatgggaataatgatgttaaaattattaactgaatttcaaccccatcaattatggacaacgttattaagtctaacatttgttaagacaacgctaagtctggactatgcatggaagactaccgctatggtgctatctatagtgtcattatttcctctttgtttgtcaactacatcgcagaaaactacgtggctacccgtactcttaggcagttttggctgtaaaccattaacaatgttcttgattacagaaaacaagatatggggaaggaaatcttggcctcttaatgaaggtatcatggctatcggtatagtctcaattttgctctcttctctccttaaaaatgatgtacccttagcaggtccactaattgcgggtggcatgcttatagcctgctacgtaattagtggcagttcagcagacttaagcctcgagaaagcggcagaagtttcatgggaacaagaagccgagcatagtggagcatcacataacattctagtagaggtacaagatgatgggacgatgaagataaaggatgaagaaagagatgacacattaacgatactactaaaggcaactcttctcgcagtatcaggcgtatacccaatgtctatacccgcgacactatttgtatggtacttttggcagaagaagaaacagagatcaggagtattatgggatacaccgtctccccctgaagttgagagagccgttctggacgatggtatctataggatattacagaggggattattgggtagaagtcaagtcggagtaggagtgtttcaagatggagtattccacacgatgtggcatgtaacacggggtgctgtacttatgtaccagggaaaacgacttgaaccaagctgggctagtgtcaagaaagacttgataagctacggagggggctggagatttcagggatcatggaatacaggcgaagaagtccaagtaatagctgtagaaccgggcaaaaatcccaaaaacgtacagaccactccgggtacatttaagaccccagaaggggaagtaggtgctattgcattagacttcaaaccaggaacgtcgggaagtcccatagtaaatcgagaaggtaagatagtaggcctatatggtaacggagttgtcacaaccagtgggacatacgtctcggccatagcacaagctaaggcctcgcaggaaggtcccctacctgaaatagaagacgaagtatttaagaaacgaaatcttaccataatggatcttcacccaggttctggaaaaacaagaagatatcttccagcgattgtacgcgaagccataaaaagaaaactgcggactttaatacttgcgccgacgagggtagtggcgtcagaaatggcagaagcactcaaagggatgcccatacgatatcagacaaccgcagtgaaatctgaacataccggccgtgagatcgtggatcttatgtgtcacgcaacttttacaatgaggcttcttagtccagtccgagttcctaattacaacatgattataatggacgaagcacattttacagaccctgcatcaattgcggcaagaggttatattagcactcgcgttggaatgggcgaagccgctgcaatttttatgacggctacaccaccaggttcagtggaggcttttccacaatcgaatgcagtaatccaggatgaagaaagagatatccccgaaagatcgtggaactccggatatgattggataactgactttcctgggaaaaccgtctggtttgtcccttccattaagtctggtaatgatatagctaactgcctcaggaaaaatggaaaaagagtaatccaactaagtagaaaaacctttgacacggaataccagaaaaccaaaaacaacgattgggattatgtagtaacaactgatatatctgagatgggcgcgaactttcgggcagatagggtaatagatcctcgtaggtgtttaaagccagttatcctaaaagatggaccagaacgagtaatactagcgggaccaatgccagtaacggtagcatccgcagcgcaaagacgaggaagaataggaagaaatcaaaataaagaaggggaccaatatgtgtatatgggacagccactgaacaacgatgaagaccatgcacactggactgaggccaaaatgttgttagataatattaacactccggaaggaatcatcccagcgttgtttgaaccagaacgtgaaaaatccgccgccatagatggagaatataggttacgaggagaagcgagaaaaaccttcgtcgagttaatgcggaggggagatctgccagtgtggctgtcatacaaagtcgcttctgaaggtttccaatattcagaccgaagatggtgttttgacggggaacgcaacaatcaagtattagaagaaaacatggacgttgaaatctggactaaggaaggagaacggaagaaactaagacctcgctggttagacgccagaacatatagcgatcctttagcactgcgagaatttaaagagttcgctgctggccgacgaagcgtgtctggagatctaatattggaaattggcaaattaccgcaacatctaacattaagggcccaaaacgcactggacaatctagcaatgttgcacaattcagagcaaggaggcaaagcataccgccatgctatggaagaattgcccgataccattgagacgcttatgctactagccctcatagctgtgttaaccggaggcgtaacactattctttctgagtgggaaaggcttgggaaagactagcataggactgctttgtgttacagcaagttctgctttattatggatggcaagcgttgaaccgcattggattgctgcatctattatattagagttctttctaatggttctcttaattccggaacctgatagacaacgaacaccacaggacaatcagctagcatatgtcgtgatcggacttctatttatgatactaaccgttgccgccaatgaaatgggcttacttgaaacaacgaagaaagaccttggaataggatatgtagcagcagaaaaccatcaacatgcaacaatgctagatgtcgatttgagacctgcgtcagcatggactctctacgctgtcgcgactacagtaataacaccgatgatgcggcacactatagagaacacaaccgctaatattagtctgactgcgatagcaaaccaagccgcgatattgatgggacttgataaaggatggcccataagcaaaatggacataggagtacctttactagccctagggtgttattcccaagtaaatccattgacactaactgccgcagtcctcatgttggtagcacattatgccataataggcccgggattacaagcaaaagctacgagggaggcacagaaaagaactgctgccgggatcatgaaaaatccgacagttgacggtatcgtggctatagatttagatccggtggtatatgatgccaaattcgagaaacagctcggccagatcatgctcttaattttatgcacaagtcaaatattactcatgagaactacgtgggctctgtgcgaaagcatcacccttgctactggacccttaactacattatgggaaggaagtccaggaaaattttggaacacaacgatcgccgtttccatggcaaatatctttcgaggatcatatcttgcaggcgccggactggctttctcactcatgaaatcgttaggcggtggacgaagagggaccggtgcccaaggagaaacgctcggtgaaaaatggaaaagacagctaaaccagttgagcaaaagcgaatttaatacttataaacgcagcggtatcatggaggtagataggagtgaagcaaaagagggattgaaaagaggagaaacaacaaaacatgctgtttcgcggggtactgcaaaactgagatggtttgtagaaagaaatttagtaaagcccgaaggaaaagtcatcgaccttggatgtgggagaggaggctggtcatattattgtgcaggactcaagaaagttacagaagtcaaaggttatactaaaggaggtcctggacacgaagaaccgattcccatggcgacatatggctggaatttagtcaaactacacagtggcaaggatgtattctttatgcctcctgaaaaatgtgatacactgctatgtgatataggagaaagctcacctaatcccactatagaagagggtcgaacactcagagtacttaaaatggtagagccttggttgaaagggaatcagttttgcataaaaattctaaatccatacatgccatccgtcgtagagaccttagaacagatgcaacgcaaacacgggggtatgctcgttcgaaatcctttatctcgcaactcgactcacgaaatgtattgggtttcttgcggaactggtaatatagttagcgcggtaaatatgacaagtagaatgcttctaaatagatttactatggctcacagaaaacctacatacgaaagggacgtcgacctaggagctggtacaagacacgtagcagtggaaccagaggtcgctaatctcgatataataggacagaggattgaaaacattaaaaacgaacataaatcgacatggcactatgacgaggataacccgtataaaacttgggcctatcatggctcgtatgaagttaagccttcaggttcagcatcttccatggtaaacggagtcgtacgactgttaaccaaaccatgggacgttatacccatggtaacgcagatcgccatgacagatactacgccatttgggcagcaacgtgtctttaaagagaaggtagacactaggacacccagggctaaaaggggtacgacccaaataatggaagtcacggctaaatggctgtgggggttcttatcccggaacaagaaaccaaggatatgcacccgtgaggaatttacacgtaaagtacgctctaatgcagcaattggggcagtctttgtcgacgaaaatcaatggaacagcgcaaaagaagcggtcgaagatgaacgtttctgggacctcgtacatcgagaaagggagctgcacaaacaaggaaaatgtgccacatgtgtttataacatgatgggcaaacgcgaaaagaaactcggagaatttgggaaagctaaaggaagcagagccatctggtatatgtggttgggagcccgtttcttggaatttgaagcattgggcttcatgaatgaagaccattggttttcgagagagaatagcctatccggggttgaaggagaaggactacataaattagggtacatactgcgagacatctcaaaaatccctggaggtaacatgtatgctgacgatacagccggctgggacactagaattaccgaagacgacttacaaaacgaagctaaaataacggatataatggaacctgagcacgcactattggcaacatctatattcaaactaacatatcaaaacaaagttgtaagggtacaaagacccgccaaaaacggtactgtgatggatgttatttcccggagagatcagcgcggctcaggacaagtggggacttatggacttaatacattcacgaacatggaagttcagcttatcagacaaatggagtcagaaggaatttttctaccgtccgaattggagacgcccaatttggctgaaagggtactggattggttagagaaacacggagcagaaaggttaaagaggatggctatatctggtgatgactgcgtcgttaaacccattgatgatcggttcgccacagcattaactgctcttaatgacatgggtaaagtaaggaaagatattccacagtgggaaccgagtaagggatggaatgattggcaacaagtaccattttgctctcaccactttcatcaactaattatgaaagatggtagagaaatcgttgttccttgcaggaatcaagatgagctagtaggtcgagcaagagtatcccaaggagcaggatggagtctacgtgaaacggcttgtcttggaaaatcgtatgctcagatgtggcaacttatgtatttccaccgacgcgacttacgtttagccgcaaacgctatatgtagtgctgtgcccgtagattgggtaccaacaagtcggactacatggtcaatccatgcacatcatcaatggatgacaacagaggacatgttatctgtatggaatcgagtttggattgaagaaaatccatggatggaagataaaacgcacgtcagctcctgggaagaagttccctatttagggaaacgcgaggaccaatggtgtggttcccttataggactcactgctagagccacttgggcgactaacatacaggttgcaattaatcaagtgcgaagactaataggaaatgaaaattacctagattacatgacctcgatgaaacgatttaaaaacgagagcgaccccgaaggtgcgttatggtag

SEQ ID NO: 21423 - RNA, 9879 nt, synthetic construct
  misc_feature 1..9879: note = derived and/or modified CDS sequence (opt6) from DENV-1__FJ639821__SS-prME
  source 1..9879: mol_type = other RNA
tcggcgacaatgttactaatgcttttgccaacagcactagcttttcatttaactacacgcggaggggaaccacacatgatagtctcaaaacaagaacggggaaaatcactacttttcaaaacttcagctggagtaaatatgtgcacattaatagcgatggatctaggtgaattgtgcgaagatactatgacttacaaatgtccaaggataactgaagcagaaccagatgacgtggattgctggtgtaacgcaacagacacttgggtaacatatggaacatgtagtcaaacaggagagcaccgtcgcgagaaacgtagtgtagcattggcccctcatgtgggattaggactagaaacgcgaactgaaacttggatgtcttcagaaggtgcttggaaacaaatacaacgtgttgaaacatgggcattgaggcatcctgggtttactgttatagcatttttcttagctcatgcaataggaacttcgattacacaaaaaggtatcatcttcattcttttaatgctggtcacaccttccatggcaatgaggtgtgttgggatcggcaatagggattttgtagaaggacttagtggagctacttgggtcgatgttgttctagaacatggatcatgcgtaaccacaatggccaaaaacaaaccaacattggatattgaattactaaaaactgaagtcactaacccggctgtactcaggaaactttgtattgaggcaaaaatttcaaatacaacaacagattcccgttgcccgacacaaggggaagcgaccttagtagaagaacaagacgccaattttgtttgccgacgaacatttgtcgataggggctggggcaatggatgtgggttatttgggaaaggtagcctgctgacgtgtgcgaaatttaaatgcgttacgaaactcgagggaaaaattgttcaatacgagaatttgaaatactcagtgatagtgactgtacacaccggtgatcaacaccaagttggaaacgaaaccacggagcatggcacaattgccactattacaccacaagcgcctacaagcgagatacaactaacagattatggagctttaacactcgattgctcacctagaacaggattggatttcaacgaaatggtcttactaacaatgaaagagaaaagctggctagtacacaaacaatggttcttggacctacctttgccgtggacttccggagcatcgacatcgcaagaaacttggaatcgccaggacctgttggttacatttaaaacggctcacgccaagaaacaagaagtcgtagtcttaggttcccaagaaggtgcaatgcacacagcgttaacaggagcgacggaaatacaaacgtccggaacaaccacaatcttcgccggccatctaaaatgtcgattgaaaatggacaaactaactctaaaaggaatgtcatatgtaatgtgtaccggttcatttaaattagaaaaagaagttgccgagacacagcatggtacggtgttggttcaagtaagatacgaaggaacagatgcaccgtgtaaaataccattttctacgcaagatgaaaaaggagtgacgcagaacggaagactaataacagcaaaccccattgtcactgataaggagaaaccagtaaacatagaaactgagccacccttcggcgaaagctatatagtggtcggcgctggcgaaaaagctctaaaactaagctggttcaagaggggcagttcaatagggaaaatgtttgaagcgacagcacgaggcgcaaggagaatggcaattctgggtgatacagcgtgggatttcggcagtatcggtggggtattcacctctgttggaaaattagttcatcaagtatttggtactgcatacggggtgttattctcgggtgttagttggacgatgaaaatagggatcgggattttactgacctggctaggacttaactcacgatctacgagtctaagtatgacatgtattgcggttggaatggttacattatacctgggcgtaatggtgcaggcagacagtgggtgcgtgattaattggaaaggacgagagttgaaatgcggtagcggaatatttgtaacaaatgaagtccatacatggacagagcagtacaaatttcaagcggactcaccaaaacgattgtcagctgcaataggcaaggcttgggaggagggtgtgtgtgggatacgttccgctacaagactggaaaatattatgtggaaacaaattagtaatgaattgaaccacatcttgttagaaaatgatatgaagttcactgtagtagtaggagacgcaaatggaatattagctcaaggaaagaaaatgataaggccacaaccgatggaacataaatacagctggaaatcttggggtaaagccaaaataattggcgccgatatacaaaatacgaccttcatcattgatggacccgacacacccgaatgtccagacggacaaagagcgtggaatatatgggaagttgaagactatggatttgggatatttacaacaaacatttggctaaaattaagggactcttatacacaaatgtgtgatcataggctgatgagtgcggcaataaaagatagtaaagcggttcatgcggatatgggttattggattgaatctgagaaaaacgaaacatggaaattagcacgtgcgtctttcatcgaggtcaaaacgtgtacctggcctaaaagccacacactttggagtaacggtgtcttagaaagtgaaatgatcattcccaaaatatatggaggtccaatctcacaacacaactacagacctggttattatacacaaacagcaggaccttggcacttgggtaagctggaactagattttgatttatgtgaaggaacaacagttgtagtagatgagcattgcggcaatagaggaccttcattaagaacaacaacagttaccggaaaaataattcatgaatggtgttgtcgctcctgtactttaccgccgctccgattccggggcgaagatggatgctggtatggtatggaaataaggccagtaaaggaaaaagaggagaatcttgtgcgatctatggtatctgcgggatctggagaagttgataatttttccttagggatcctctgtgttagcatcatgattgaggaagtaatgcgtagcagatggtcacggaagatgctaatgacaggcacgctcgcggtatttttacttttaatcatgggacaattaacttggaacgatctaataagactatgtataatggtaggtgctaatgcttcggacggtatgggaatgggaacaacgtatttggcattaatggccacgtttaaaatgcgtccaatgttcgccgtaggactgttattccgtagactaacttcacgggaagtcttactgttaacgattgggctgagcctagtggcgtcagttgaactaccaaactctttggaggaactaggagacggtttagcgatgggaataatgatgttaaaattacttaccgagttccaaccgcatcaattatggaccacattgctctcacttacgtttgttaaaaccacattaagtcttgactatgcttggaaaaccacagctatggtcttatccatagtttccttgttcccattgtgcttatcaaccacatctcagaaaacgacatggctgcccgttcttctaggttcctttggttgtaaacccctaaccatgtttttaatcaccgaaaataaaatttggggtagaaaatcttggcccttgaatgaaggaattatggctattgggattgtaagtatcctcttaagttcattgttgaaaaacgatgtgcccttagcaggaccgttaatcgctgggggaatgctaattgcatgttatgtgatatcaggtagtagtgctgatctatcactcgataaggcggcagaagtctcctgggaacaagaagcagaacatagcggagcaagtcacaatataagcgtagaagtacaagatgatggcacaatgaaaattaaagacgaagaacgagatgatacattaaccatcctactaaaggctacattgttagcagtatcaggtgtgtatcccatgtccatcccggcaacactgtttgtctggtatttctggcagaagaagaaacaaagatcaggtgtattgtgggatactccatctcccccagaggtcgaaagagctgttttggacgatggtatataccgcattctccaacgcggtttactgggacgctcacaggtaggagtaggtgttttccaagacggtgtattccatacaatgtggcacgtcactcggggagcagtattaatgtaccagggaaaacgcctcgaaccctcctgggcctgtgttaagaaagatttgatatcttatggtggagggtggaggtttcaaggatcgtggaacactggcgaagaggtacaagtaattgcagtggagcctggcaaaaatcctaagaatgtacagactacaccgggcacattcaagactccggaaggggaagtaggcgcaatcgcattagattttaaaccaggaacatcaggtagtcccatagttaatcgtgaaggaaaaatagttggattatatggtaacggagtagttactaccagtggaacatatgtttcggctattgctcaggctaaagcaagtcaagaaggaccgctgccggaaatagaagacgaagtttttaagaaacggaacttaacaataatggatttacacccaggttcgggaaaaactcgccgatatctccctgcgatagtaagagaagcaatcaaacgtaaattaaggacgttgatactagcaccaactcgtgtagttgcaagtgagatggcagaggctttgaagggaatgcctatccgctaccaaacgacagcagtaaaatcagaacatacagggagggagattgtagacctgatgtgccatgcgacatttacgatgagactattatcgccagttcgtgtacccaactacaacatgataataatggatgaggcccattttacagacccggcgagtatagctgctagaggatatatatctactagggttggtatgggtgaggctgcagctatttttatgacagctacgcctcctgggagcgtcgaagcgtttccccaaagcaacgcagtgatacaggatgaggaacgtgacatacccgaaaggagttggaactcgggatacgattggatcaccgacttccccggtaaaaccgtatggtttgttccatctataaaaagcggcaacgacattgcgaattgtttaaggaagaacgggaaaagagtaattcaattaagcaggaaaactttcgacacagaataccagaaaactaaaaacaatgattgggattatgttgtgacgactgatatcagcgaaatgggcgcgaattttcgagccgatcgagtcatagaccccagacgttgtctaaaacctgttattcttaaagacggacccgaacgagttatcctagccggtccaatgccggttacagtcgcttctgcggcccaaagaagagggcgaattggaagaaatcaaaacaaagaaggcgatcagtacgtttatatgggacagccgcttaataacgatgaggatcatgcacactggacagaagcaaaaatgttgctagataacattaacactccggaaggtatcatccctgcattatttgaacctgaaagggaaaagagcgctgcgatagatggagagtataggctacgcggcgaagccaggaagacttttgtcgaattgatgcgacgcggagatctccctgtttggttatcatacaaggtggcttctgagggcttccaatattcagacaggcgctggtgttttgatggagaaagaaataatcaagtattagaggaaaacatggacgtagagatttggaccaaagaaggcgaaaggaagaaactaaggccacgatggttagatgcgaggacctactccgaccctctagccctaagagaatttaaagagtttgcggcaggaagaagatctgtctctggtgatttgattctagaaataggaaagctcccgcagcatttgacattaagagcccagaacgcgcttgataacttagtaatgctccacaactcggaacagggaggaaaggcatatcgccatgcgatggaagaactcccagataccatagaaacgttaatgttactcgccttgattgcagtgttgaccgggggagttaccttatttttcctttctggcaagggtttaggaaaaacctctataggattactctgcgtcactgctagttctgcattattatggatggcatcagtagaaccacattggatagcagcgtcaatcatattagagtttttcttgatggtactgctgatacctgaacctgataggcagagaacaccacaagataaccagctggcgtatgtagtcatcggattattgttcatgatcctaacagtggctgcaaatgaaatgggcctacttgaaacaaccaagaaagacctcggcattggatatgttgcggctgaaaatcatcaacatgcaaccatgttagacgtagatctccaccctgctagcgcctggacactttacgccgtagccactacggtcatcactcccatgatgcgacacacgattgaaaatacaacagctaatatatctttaacggcaattgcaaatcaggcagcaatactcatggggttagataaaggctggccgattagtaaaatggacataggcgtccctctgcttgccttaggatgctatagtcaagttaatcctcttacactaacagcagcagtactgatgttagtagctcattacgcaataataggaccgggtctacaggcaaaagcgacacgagaggcacaaaaacgaactgcagcgggtattatgaaaaatccgacagtagacggtatagtcgcaattgaccttgacccagtagtgtatgacgtaaaatttgaaaaacagcttggtcaaattatgttactaatactatgcacatctcaaatactgctcatgcgaaccacttgggctttgtgcgaaagcataacccttgctaccggtccgttaactacactatgggaaggtagtccgggtaaattctggaacactacaatagccgtttctatggcaaacatattcagaggtagttatctagctggtgcaggattagcattcagcttgatgaaaagcctcggtggaggtagacgaggcacgggagctcaaggagagaccttgggtgagaaatggaaacgtcagcttaaccaactttctaaatcagagtttaatacatataaacgaagtggaataatggaggtcgatcgatccgaggcaaaagagggcttaaaacggggagaaactacgaaccacgcagtcagcaggggaacagcaaagttacgatggtttgtggaaagaaatttagtcaaaccagaaggcaaggttatagaccttggctgcgggagaggtgggtggtcatattactgtgccgggctaaagaaagttacggaagtcaagggctacacaaaaggcggacctggacacgaagaacctataccaatggcaacgtacggatggaatttggtcaagctccatagcggcaaggatgttttctttatgccaccagaaaaatgcgatacattgctatgcgatataggagaaagcagtcccaatccaacaattgaggaaggtcgtacattgagagttctaaaaatggttgaaccctggttaagaggaaaccagttctgtattaaaatcttaaatccgtatatgccgtcggtcgttgaaacgcttgaacaaatgcaacgtaaacatggtggaatgcttgttcgaaatccattgagcagaaattcaactcacgagatgtactgggtgtcttgtggaacgggaaatatagtatctgccgtaaacatgacatctagaatgctcctaaaccggtttactatggctcacagaaagcctacatacgaaagggatgtagacctcggagcaggaacacgacatgtaacagtagagccggaagttgcgaatctggatattatcggacaaagaatagaaaatatcaaaaatgaacacaaatcaacgtggcattatgatgaggataatccatacaagacatgggcttatcatggtagctatgaggtaaaacctagtggttccgcctcctcaatggtaaatggagtagttagattgctaacaaaaccctgggatgttataccgatggtaacccaaatagcgatgacagatacgacaccatttggacaacaacgcgtatttaaagaaaaggtagatacaagaacccccagggcaaaaagaggaactacccaaataatggaagtcacagccaaatggctttggggatttctaagtaggaacaagaaaccaaggatctgtacgagagaagaatttacaagaaaagtaaggtctaatgctgccattggtgcggtatttgtcgacgaaaaccaatggaacagcgctaaagaagcggtagaggacgagagattttgggacctcgtccatagagaaagagaattacataaacagggcaaatgtgcaacctgtgtatataatatgatgggaaaacgtgagaagaaattaggcgagttcggcaaagcaaagggatcgcgagcaatctggtatatgtggctaggagctagattccttgagtttgaagcacttggattcatgaatgaagatcactggttttcacgagaaaacagcttaagtggtgtagaaggggaaggcttgcacaaactcggctatattctaagagatatttcaaaaattccaggagggaacatgtacgccgacgacacagcaggatgggatacacgaattacagaagacgatttacaaaatgaagcaaagattactgacataatggagccagagcatgcacttttagcaacttcaatttttaaactaacataccaaaataaggtggtgcgtgtacaaaggccggccaaaaacggaacagtaatggacgtaatatcgagaagagatcaaaggggtagcggacaagtaggtacatacggcttgaataccttcactaacatggaagtccaactcatacggcaaatggaaagtgaaggtatattccttccatcagaactagagaccccaaatttagcggagagggtactcgactggttggagaaacatggtgcagaacgcctcaagagaatggcaatatcaggagatgattgcgtagtcaaaccaattgacgaccgtttcgcaacggccttaactgcacttaacgacatggggaaagtaagaaaagatatcccccaatgggagcctagcaaaggctggaatgattggcaacaagtgcccttctgtagtcaccattttcaccaattaattatgaaagatgggagagaaatagtagttccgtgcagaaatcaagacgagcttgtaggacgtgcgagagtatcgcaaggagctggatggagtctgcgggaaacagcgtgtctagggaaaagttatgcacaaatgtggcaactcatgtatttccaccgaagagatttacgtctcgcagctaatgcaatttgtagtgcagtccctgtggactgggttccaacatcacgtaccacctggtcaatacatgcacaccatcaatggatgaccaccgaagatatgttatcagtgtggaacagggtctggattgaagagaacccatggatggaggacaaaacacatgtatcctcgtgggaagaagtaccttacttaggtaaaagggaagatcaatggtgtggatccctcatagggctgactgcacgagctacatgggcgactaatattcaagtcgcaataaatcaggtccggagattaatcggtaacgagaattatctagactatatgacatccatgaaaagattcaaaaatgaaagcgacccagaaggcgcactatggtag

SEQ ID NO: 21424 - RNA, 9879 nt, synthetic construct
  misc_feature 1..9879: note = derived and/or modified CDS sequence (opt6) from DENV-1__FJ639824__SS-prME
  source 1..9879: mol_type = other RNA
tcagtaacgatgttacttatgctcctacctactgcacttgcatttcacttaacaacaagagggggtgaaccgcatatgatagtatccaaacaagaaagggggaaatccttattattcaaaacttcggcaggggtaaatatgtgtaccttgatagcaatggatctaggggaactgtgcgaagataccatgacttataaatgccctcgaataacagaagcagaaccggatgatgttgactgttggtgcaatgctaccgatacatgggtgacatatgggacttgtagccaaactggggaacacagacgggataaaagaagcgtagcattggctcctcatgtcggtctgggcttggaaacacgaacggaaacttggatgtcttcagaaggggcatggaaacagattcaaagagtagaaacgtgggcactacgccatccaggattcactgtaatcgcacttttccttgcacatgccattggcacgtcaataacgcaaaaagggatcatattcatcttacttatgttagttactccatcgatggccatgcgttgtgtgggaattggtaatcgtgatttcgtagaaggactttcaggagctacatgggtggacgttgtcttagaacatggatcctgtgttacaacgatggctaaaaacaaaccaacattagacattgaactactaaaaactgaagttactaatccggcggtgttacgaaaattgtgcattgaagctaaaataagtaatactacaaccgattctcgatgtccaacacaaggagaggcaacgctggtagaggaacaagatgcaaacttcgtttgtcggcgtacatttgtagatagaggatggggtaatggatgtggtctttttggaaaaggttcgctcctaacttgtgcaaaattcaaatgtgtaacaaaacttgaaggaaaaatagtacaatatgagaacttaaagtatagcgtaatagtaactgtccacacgggagaccaacatcaagttggaaacgaaacaacggaacacggaacaatcgctacaataactccacaggcaccaacgagtgaaatccaactaaccgactacggagctttaactctggattgcagcccacgtacaggactggacttcaatgaaatggttctactaactatgaaagaaaaatcatggttagtgcacaaacagtggtttttagacctacctctgccctggacatctggtgcgagcacgtctcaagaaacgtggaatagacaagatttattggtaacctttaaaaccgctcacgccaaaaagcaggaggtagtcgttttaggatcgcaggagggcgctatgcatacagccttaaccggagcaacggaaatccagacatcgggaactacaacaattttcgcgggacacttgaaatgcagattaaagatggacaaattaacgttaaagggcatgagttatgtcatgtgtactggttcattcaaattggaaaaagaagtagccgaaacccaacatggcactgtactcgttcaagtaaagtatgagggaaccgacgcgccctgtaagataccattcagtacacaggatgaaaaaggtgtaactcaaaacggaagactcataacagcaaacccgattgtaactgacaaggaaaaaccggttaacattgagactgaaccgccatttggtgaatcttacatagtagtaggagctggagaaaaagcactaaagttaagttggtttaagaaagggtcgtcaataggaaaaatgttcgaagcaaccgcccgaggcgcaagacgtatggcgatcttaggtgacacagcttgggatttcggatcaataggcggagtatttacaagtgttggaaagctagtgcatcaagtattcggcactgcatatggcgtactattttcaggagtctcatggacgatgaaaattggtattggaatactattaacttggcttggactcaattcacgaagtacgagcctaagcatgacctgtatcgcagttggtatggtaactctatatttgggagttatggtccaagccgatagcgggtgcgtcattaattggaaggggcgagagctaaaatgtggttcaggtattttcgtgactaatgaagtacatacttggacagaacagtataaatttcaagccgacagtccaaaacgactctcagctgctattggaaaagcctgggaggaaggcgtatgcgggatacgtagtgcgacaaggctggaaaatataatgtggaaacagatctcaaacgaactcaatcacatacttttagaaaatgacatgaaattcaccgtcgtagtcggcgacgcaaatggaattttggctcaaggcaagaagatgattagaccacaaccaatggaacataaatattcgtggaaaagctgggggaaagcgaaaataataggagcagacatacaaaacactacattcataatagatggaccagatacgccagaatgccctgatggtcaacgtgcatggaacatctgggaagttgaggattacggctttggaatcttcaccacaaatatatggttaaagctccgcgactcgtacacacaaatgtgtgatcacaggttaatgtcagctgccataaaggactctaaagcggtacacgctgatatgggttattggatcgaaagtgaaaagaacgaaacgtggaaattagcgcgggcatctttcatcgaagtaaaaacatgtacctggcccaaaagccatacactctggtcaaatggagtattagaaagtgagatgatcatccccaaaatatatggaggtcccatttctcagcataactatcgtcctggatattttacgcagactgcaggaccatggcatcttgggaaattagagctcgactttgatttatgtgaaggaacaactgtagtggtagatgaacattgtggcaatcgtggaccatcattaaggacaactactgtgacaggaaagataatacacgaatggtgttgtaggagctgcactcttcctcctttgcgattcagaggtgaagatggatgctggtacggaatggagattcgtcccgtaaaagagaaggaggaaaatcttgtaagaagcatggtatcagcaggcagtggcgaagtagattcattctcattgggaattttatgcgtaagcataatgatcgaggaagtaatgagatcacgctggtcaagaaaaatgctaatgaccggtacacttgctgtattcctactcttaatcatgggccaactgacttggaatgacctaataagactatgtataatggttggtgctaacgcatcagatagaatgggcatgggaacgacatatttagcgttaatggccactttcaaaatgagaccgatgtttgcagttgggcttttgtttcgaaggttgacctccagagaagtgctactattaaccataggtctcagcctagttgcttcagtagaattaccaaattcacttgaagaacttggtgatgggctagcaatgggaattatgatgcttaaattactcactgaatttcagcctcatcaattgtggacaactcttctttcactaacatttgtcaaaacaaccttatctttggattatgcgtggaaaactacagctatggtactcagcatagtcagcctctttccgctatgtttaagtacaacctctcaaaagacgacgtggctaccagtgttgttaggttcctttgggtgcaaaccgctaacaatgttcctaattactgaaaataagatttggggacgcaaatcttggcctttaaatgaaggtattatggctatcggcatagtctctatattactatcatcattgctcaaaaacgacgtgccgttagcgggacctttggttgcaggcggtatgttaatagcttgctacgtaatttcggggtctagtgcagatttatctcttgagaaagcggccgaagtatcctgggaacaagaagctgaacatagcggagcatcacacaacatacttgtagaagtacaagacgatggaaccatgaagataaaagatgaagaacgggacgatacattgacaatactattaaaagctacattattagcagtaagcggcgtttaccccatgtcaatacccgccacactcttcgtatggtacttttggcagaagaagaaacagcggtccggtgtgctctgggatacgccaagccctcctgaagtagaacgagcagtattagatgatggaatataccggatactgcaacgcggtttgttgggaagatcccaagtaggagtgggagtattccaagatggcgtcttccatacaatgtggcatgtcaccagaggtgcagtattgatgtatcaaggaaaaaggctcgaaccttcttgggcttctgttaagaaagacttaatatcttacggaggagggtggcggtttcaaggtagttggaatacaggtgaagaggtgcaggttatagcagtagaaccaggcaaaaatcccaaaaatgtccagacgactccaggaacgttcaaaacacctgaaggtgaagtcggggcaatagcccttgactttaaacctggcacgtcaggtagcccaattgtaaaccgagaagggaaaatagtcggactatacggtaatggtgtcgttacaacttcaggaacgtatgtcagcgccattgctcaagctaaggcgtcacaagaaggacccctcccagaaatagaggacgaagtgtttaagaaacgaaacttaacgattatggatttacatcctggaagtggaaaaacaagaaggtatctacctgctatcgtacgagaagccattaaaagaaagttacgtacactaatactagccccaacaagagtcgtggcttctgaaatggcagaagcattaaaaggaatgccaatcagataccagacaacagctgtaaaatcagaacacacgggtagagagatagtagatttaatgtgtcacgcgacattcacaatgcgtttactctctcctgtccgggtgcctaactataatatgatcataatggatgaggcgcatttcacagaccctgctagtatagctgcgagaggatatatatcaacaagagtaggtatgggggaagctgcagccatatttatgacagcaacacctccaggatctgttgaggcttttccgcaatcaaatgcggtcattcaagatgaggaaagagatattcccgagcgatcgtggaactcaggctatgattggatcactgactttccaggaaaaacagtctggtttgtaccgtcgattaaatcagggaacgacatagccaattgcctaagaaagaatggaaaacgagtgattcaattaagtcggaaaacattcgatactgaatatcagaaaactaaaaataatgattgggactacgtagttacaaccgatataagcgaaatgggcgctaattttagggcagatagagtaattgatccgagaaggtgtttaaagccagttatcctgaaagatggtcccgaaagagttatattagccggtccaatgcctgtaacggtagctagtgcagctcagaggcgaggcagaataggcagaaatcaaaacaaagaaggggaccagtatgtatacatgggacagcccttaaacaacgacgaagatcacgcacattggacagaagcaaagatgctcctagataatatcaacaccccagaaggaattatacctgccctattcgaacctgaacgagaaaaatctgcagcaattgatggcgaatacaggcttagaggcgaagcaaggaagacatttgtagaacttatgagacggggagatctccctgtttggctctcatataaagtagcaagtgaaggctttcaatatagcgatagaaggtggtgttttgatggcgaacgcaacaaccaagtgttagaagaaaacatggacgtagaaatttggacaaaagaaggggaaaggaagaaactgcgaccgagatggttagacgctcgtacatattcagatccgcttgctctaagagagtttaaggaatttgcggctggcagaagaagcgtaagcggagatttgatcttagaaattggaaaattacctcagcaccttaccctacgtgcgcaaaacgccttggacaatctggtgatgttacataactcagaacaaggcgggaaggcctaccgacatgcaatggaagagttgcctgacacaattgaaacactgatgctactagcattaattgcggtgttgacgggaggagtgacgctattctttttaagtggtaaaggtttaggcaaaacgtcaataggtctactttgtgtaacagccagcagtgcactactctggatggctagtgtcgaaccgcattggattgcagcgtcaataattctcgagttcttcctaatggttttattgatccccgaacctgatagacagagaactccacaagataatcagctggcgtatgttgtaatcggccttttgttcatgattcttactgtagctgctaacgaaatgggcttactagaaactactaagaaagatcttggaattggatacgtagcagccgagaaccaccaacatgcgacaatgctggacgtcgacctgaggcccgcatcagcctggaccctctacgcagttgccacaactgttatcacaccgatgatgcgtcacaccatagagaataccacagccaacatatctctcacggcaatcgcaaaccaagctgcaatcttaatgggacttgacaaagggtggcctattagcaaaatggacataggcgttccgttactcgctttaggatgttactctcaagttaaccccctaaccttaactgcggcagtattaatgttggttgctcactatgcgatcattggcccgggacttcaggccaaagccacaagagaagcgcagaagaggaccgcggctggaataatgaaaaacccaaccgtcgatggtattgtagccattgatttagatccagttgtctatgatgctaaatttgaaaaacaacttggacaaataatgttgttaattctgtgcacttcccaaatactactaatgcgcacaacttgggctctatgtgaatccataactcttgccacagggcctttaactacgctatgggaagggtccccaggtaaattctggaatacgacaattgcagtgtctatggcaaatattttccggggctcttatctcgccggtgcgggactagccttctcattaatgaagtccctgggaggagggagacgcggaactggtgcgcaaggagagactctgggagaaaaatggaaaaggcaactaaaccaacttagcaagtcagaatttaacacgtataaaagaagcggcataatggaagtcgacagaagcgaagcaaaagaaggattaaagagaggtgaaacaactaaacatgccgttagcagaggaacggccaaacttagatggtttgttgaaagaaacttagtaaagcctgaaggtaaagtaatagacttaggttgcggcaggggaggatggagctattattgtgctggtcttaagaaagtaactgaggtgaaagggtatacaaaaggtgggccaggccatgaagaaccgatccctatggctacatatgggtggaacctagtaaaactacattctgggaaagacgtatttttcatgccgccagaaaaatgtgacacattactatgtgatataggtgaatcttcacctaatcctacaattgaagaaggacgaacattgagagtccttaagatggtagaaccatggctaaagggcaaccaattttgtatcaaaattctcaacccttatatgccatctgttgtagaaacgttagaacaaatgcaaagaaaacacggtggaatgctcgtaagaaacccactgtcccgcaactcaacccatgagatgtactgggtttcttgcggaaccggtaatatcgtgtctgctgtcaacatgacttcaagaatgttactcaacagatttacaatggcacacagaaaacccacctacgagagagacgtcgatctaggggccgggaccagacatgttgctgtagaaccggaggtcgcaaacctcgacataataggtcaaagaatcgagaacatcaaaaatgaacacaagtcaacctggcactacgacgaggataatccttacaagacttgggcgtaccatggttcatacgaagtaaaaccaagcggaagtgcttcaagtatggtcaacggcgtagtacggctacttacgaaaccatgggatgtaatacctatggtgacacaaatcgcaatgactgatacaacacctttcggacaacaaagagtattcaaagaaaaagtagacacaagaaccccacgagccaaacgagggaccactcagataatggaggtaacagcaaagtggctttggggatttctatcaagaaacaagaaaccaaggatatgtacgagagaagagttcacccggaaagtcagatccaatgccgctataggagccgttttcgtagatgaaaaccaatggaactcagcaaaggaggcagttgaagatgaaagattctgggatcttgtacatagagagagagaacttcacaagcaaggaaaatgtgcgacgtgcgtatataatatgatgggcaagagagaaaagaaactaggtgaatttggtaaagccaaagggagcagagctatttggtatatgtggctcggtgcaagatttctagagttcgaggcactaggtttcatgaacgaggatcattggtttagtagggaaaacagcttatctggagtcgaaggtgaaggacttcacaaattaggatacatcttacgagatatctcgaagattccgggaggaaacatgtatgcagacgatacagctggatgggacacgcgcataactgaggatgatctacaaaatgaggctaaaatcactgacatcatggagccagaacatgctctcctagcgacaagtatcttcaaacttacttaccaaaataaagtggttagagtccagagacctgccaaaaacggaacagttatggacgttatttcacgaagagatcaacgtggatctggacaagtaggtacatacggacttaacacatttacgaatatggaagtccaactaatcagacaaatggaatctgaaggtatattcctacccagtgaactagaaactccaaacttagccgaacgagttctagattggctagagaaacatggcgccgaaagactaaagcggatggcgataagtggtgacgactgtgtagtaaaacccattgacgacagatttgccacggcattaactgctcttaacgacatgggtaaagttcgtaaagacataccccagtgggaaccgtctaaaggctggaacgattggcaacaagtgccattttgttcacatcacttccaccagttaataatgaaagatggacgtgaaattgttgtaccatgtagaaatcaagatgagcttgtcggcagagctcgtgttagtcaaggcgcaggatggtccctcagagagacggcttgtcttggtaaatcttatgctcaaatgtggcaattgatgtatttccacagacgagacctaagacttgcggccaacgcaatttgttccgctgtaccagtagattgggtgccaacttcgagaaccacttggtccatacacgcacatcatcaatggatgacaactgaggatatgctatcggtgtggaaccgcgtctggatagaagaaaatccgtggatggaggataagactcatgtaagctcatgggaagaagtaccgtatctcggaaaaagggaagatcaatggtgcgggagcctcatcggtttaacggcacgcgccacatgggcgactaatatccaagtagctatcaaccaagtgcgtcgcctaatcgggaatgaaaactatttagactacatgacttctatgaaacgattcaaaaacgaaagtgaccctgaaggtgcattatggtaa

SEQ ID NO: 21425 - RNA, 9879 nt, synthetic construct
  misc_feature 1..9879: note = derived and/or modified CDS sequence (opt6) from DENV-1__JN819425__SS-prME
  source 1..9879: mol_type = other RNA
agcgttaccatgctcttaatgttgctccccactgctcttgcatttcatttaacaacaagaggaggagaaccccatatgatcgtttctaaacaggaaagaggtaaaagtctcttattcaaaacttccgcgggggtaaatatgtgtacattgatagctatggatttgggagaactgtgtgaagatacgatgacatacaaatgtccccgtataactgaagctgaaccagacgacgttgattgttggtgcaatgcaactgacacttgggtgacctatggtacatgtagtcaaacgggagagcatagaagagagaaaagaagcgtcgcccttgccccacacgttggattaggattggaaactagaacagagacttggatgagttctgagggtgcctggaaacagatccaaagagttgagacttgggcgctacgccacccaggctttaccgtaatagctttctttctggcccatgccataggaacaagtatcactcaaaaaggaattatatttatactattaatgcttgttacgcccagtatggcaatgaggtgcgtaggaattggcaatcgtgatttcgtggaaggattaagtggagctacttgggtagacgtcgtattagagcatggttcctgcgtcactacgatggcgaaaaacaaaccaacacttgacattgaactgcttaaaactgaagtgactaacccggcagtattaagaaaactgtgtattgaggcaaaaatatcgaacactacgactgattccagatgtcccacacagggggaagcaactcttgtcgaagaacaagacgctaattttgtatgtcgaagaaccttcgttgaccgaggatggggtaatggttgtggattgtttgggaaaggctcgttgcttacatgcgcaaaattcaaatgtgtaacaaaactagaagggaaaattgttcaatatgaaaatctaaaatatagtgtaatagtcacagttcataccggagatcaacaccaggttggaaacgaaacaacggagcacggaaccatagcgacaattacacctcaagcgccaacttcagaaatacagttaacagactacggagccctaactctagactgcagccctcgtactggtttagattttaacgaaatggttctactaaccatgaaagaaaaatcatggttggtgcacaaacaatggttcctagatctacccctcccgtggacctccggggcaagtacgtcacaggagacttggaacagacaagatttacttgttacattcaaaacagcccacgccaagaaacaggaggtagtagtccttgggagccaggagggagctatgcacacagcccttacaggggccacagaaatacaaacatcgggtacaacgaccatttttgcgggacatctgaaatgtcgtctcaaaatggacaaattaactctaaaaggaatgagttacgtaatgtgtacaggatcatttaaattggaaaaagaagtggctgaaactcaacacggaacagtattagtacaagtaaaatatgaaggtactgatgccccctgtaaaatcccattttcaactcaagacgaaaaaggggttactcagaatggacgtttgataactgccaatccaattgtaacagataaagaaaaaccagtaaatatagagaccgaacctccattcggagaaagttacatcgtcgtaggcgctggtgaaaaagcacttaaactcagttggtttaaacgtggctcctccatcggaaaaatgtttgaagcgacggccaggggagctcgacgtatggcaatattaggagatactgcttgggacttcggctcaataggtggagttttcacatccgttggtaagttagttcatcaagtatttggaactgcctacggagttctattttcaggtgtaagttggaccatgaaaattgggataggtattctactcacatggctaggtctaaactctagatcaacctcgctatcaatgacatgtatcgctgttggaatggtaacattatatttaggcgtcatggtccaggctgattcgggatgcgtgatcaattggaaaggaagagaactaaaatgtggttcaggaatatttgtcaccaatgaagtacacacatggacagagcagtacaaatttcaagcagacagtcccaaaaggctctcggccgcaataggaaaagcatgggaagaaggtgtctgtggcattcgatcagcaactcgacttgaaaatattatgtggaaacagatcagcaatgagctcaatcacattctattagaaaatgatatgaaattcacagtagtggtaggagatgcaaacggtattttagcgcaagggaagaaaatgatccggccacaaccgatggagcataaatacagctggaaaagttggggcaaggcaaagataataggagcagatattcaaaatacaactttcataattgatgggcctgacacgccagaatgtccggatggccagcgggcctggaatatatgggaagtggaagattatggattcggagtatttactacaaatatctggctgaaactgcgtgattcgtatacccaaatgtgcgatcatagactaatgagcgcagcaatcaaggattcgaaggcagtccatgcagatatggggtactggatagagtcagaaaagaatgaaacatggaaactagcaagagcgagctttatagaggtaaaaacatgtacatggccaaagtcacacactttgtggtcaaacggcgtattagagtctgaaatgataataccaaaaatttatgggggccctatatcacaacataattacaggcccggatatttcacccaaacagctggaccgtggcacctagggaaattggagttggactttgacttgtgcgaaggaaccacagtagttgtagatgaacactgcggcaaccgtggcccttcccttaggacaaccaccgtaaccgggaagattatccacgaatggtgttgtcgaagttgcacactgccacccctacgattcaggggagaagatgggtgttggtatggaatggagattaggccagttaaggaaaaagaagaaaatttagttagatcaatggtaagtgcaggaagcggtgaagtcgacagtttctctctcggtatactatgcgtatccataatgatcgaagaagttatgagaagtagatggtccagaaaaatgctaatgaccggaacccttgccgttttcctattactaatcatgggccaactgacgtggaacgatctaattagactctgcataatggtaggagctaacgcatccgatagaatgggaatgggaactacatatcttgctcttatggccacctttaagatgcgacccatgttcgcggtcggattactttttagacgacttacttcaagagaggtattgttgctcacaattggtctttctcttgtagcttctgttgagctaccaaacagcttagaagaactaggggatgggctcgcgatgggtataatgatgttaaaactattgacagaatttcaaccacatcaactgtggactacgcttttatcactcacattcgtaaagaccacgctcagcttggactacgcatggaaaacaactgcaatggtactcagcattgtttcgctattccccttatgcctctctactacttcacaaaagacaacttggctcccagttctactgggatccttcggttgcaaacccttgacaatgttcttaattacagaaaataaaatctggggaagaaaatcctggcctcttaacgaagggataatggcaattggaatagtatcaatcctgttgtcttcactattgaaaaacgatgtacccttagctggacctttaatagctgggggcatgttgatcgcgtgctacgttataagtggaagcagtgcagatttgtcactagagaaggcggtcaagattagttgggaacaagaagctgaacacagcggtgcctcgcacaacatactggttgaagtacaagatgatggaacgatgaaaataaaagatgaagaacgtgatgacacattaacaattttgctgaaggcaacattattagccgtatcaggagtgtatccgatgagtatacccgccacactttttgtatggtacttttggcaaaagaagaaacaacgctcaggcgtattatgggacacacctagtcctccggaggttgaaagggcagtcttggacgatggcatctacagaatattacaaagaggtctcttagggagaagtcaagtcggagtaggtgtgtttcaagatggagtatttcataccatgtggcatgttactcgcggagcagtactaatgtatcaaggcaagagattagaacctagctgggcatccgtcaagaaagacttgatatcatatggtggaggatggcgttttcaaggatcatggaacacaggcgaagaagtccaggtaattgcagtagaaccgggcaaaaaccccaaaaatgttcagaccacgccgggtacattcaaaactcccgaaggtgaagttggtgcaatcgcgttggatttcaaacctggcacgagcggatcacctatagtcaatagagaaggcaaaatagtgggattatacgggaacggagttgttacaacgtcaggaacatacgtatccgcgatagctcaagcaaaagcatcacaagaagggccgcttccagaaatcgaggacgaagtcttcaagaaacgaaatctaactataatggatcttcatccgggctcggggaaaacaagacgataccttccagcaatcgtaagagaagcaattaaacgcaaactccgtacgctcatattggcgccaactcgagttgtggcctcagaaatggctgaagcattaaaggggatgccaatcagatatcaaactactgcagtgaaaagcgaacacactggaagagaaatagtagacttaatgtgccatgccactttcactatgcgactgttaagtcctgtaagagtacctaactacaacatgatcatcatggacgaggcgcactttacagatccggctagcatcgctgcacggggatacatctcgactcgtgtgggcatgggtgaggcagctgcaatttttatgacagccactccaccaggatccgtcgaggcattcccccaaagtaacgccgtaatacaagatgaagaaagagatataccggaaaggagttggaactctggttatgactggataacagactttccaggtaaaactgtatggtttgttccttcgattaaatccggcaatgacatagctaactgcctcaggaaaaatggaaaacgagtaatacagctatcaagaaaaacattcgacacagaatatcaaaagactaaaaataatgactgggactacgttgtaacaacagacatttcggaaatgggggcaaattttagggcagaccgagttattgatcctcggagatgtttaaagccggtaatcttaaaagacggtccagaacgtgtgatattagctggaccgatgcctgttaccgtagcaagtgcagcccaaagaagaggtaggataggaagaaatcaaaacaaagagggggatcaatatgtttatatgggccagcctttaaacaatgacgaagatcacgcccattggactgaagcaaaaatgctgcttgacaatattaatactccagaaggcattataccggcgttatttgaaccggagagggaaaagagcgcagcaatcgacggagagtacagactcagaggagaagcaaggaagacattcgtagagttaatgaggagaggtgatcttccggtatggctatcttacaaagtagcatctgaaggtttccaatactccgatagacgttggtgcttcgatggagaacgaaataatcaagtactagaagagaatatggacgtagagatatggacgaaagaaggtgaaaggaagaaactaagacctcgatggcttgacgcaaggacgtactccgatccactagccctaagagaatttaaggagtttgcagcaggaagaagatctgtcagtggagatttaattctagaaataggtaaattaccacaacatttaacccttagggcacaaaacgccttggacaacctagtaatgttacacaattcagaacaaggcggtaaggcctatagacatgcaatggaagaactcccggatactatagaaaccctaatgttattggcgctaatagcggtactaactggcggtgtcactcttttctttttaagcgggaagggattgggaaaaacatccattggtttattatgcgtaacggcgtcttcagcacttttatggatggctagtgtagaaccacattggatagcagcttcgatcattttggaatttttcttaatggtactattgattccagaaccggataggcaaaggacgccacaagataatcaattagcatatgttgtcattggattgctattcatgatactaaccgttgctgcgaatgaaatgggattactagaaacaacaaagaaggacctcgggatcggttatgtagctgcggagaaccatcaacatgcaaccatgttagatgttgatcttcatcctgcttcggcatggactttatatgcagtagctacgacagttataacaccaatgatgcgtcatacaatagaaaatacaactgcaaatataagtctaacagcaatagcgaaccaagcggcaatcttaatggggcttgataaaggatggccgatatctaaaatggatattggagtgcctctgctagcactcgggtgctactctcaagttaatccgcttacgctaacagcggcagtacttatgttagtagcacactatgctataattgggcccgggctacaggctaaagctacccgagaagctcaaaagagaactgcagctggaatcatgaaaaatcccacagtggacgggatcgttgctatcgacttagaccctgtagtatatgatgctaaattcgaaaaacaactaggacagatcatgttactcatattatgtacgtcgcaaatattattaatgagaacgacttgggcactttgtgagagtattacgcttgcaacaggtccattaacaaccctgtgggagggcagtcctggaaagttttggaatacaacgatagcggtatccatggctaacatattccgtggatcatatttagccggggccgggctagcattttccctaatgaaatccttaggaggaggtcgccgaggaacaggagcgcaaggagagactttaggagaaaaatggaaaagacagttaaatcaactctccaaatcggaatttaatacttataagagatcaggaataatggaggttgatcgatctgaggcaaaagaaggtttaaagcgtggagagactacaaaacatgcagttagtcgaggcacagcaaagttgagatggtttgtagagagaaatctagtaaaacctgagggcaaggtcatagatctcggctgtggacgcggaggatggtcttattattgcgcaggcttaaagaaggttaccgaagtaaaaggttatactaaaggaggacccggacacgaagaacccattcccatggccacatatggatggaatctggtcaagttacacagtggaaaagacgtattctttatgccgcctgaaaaatgtgatactctcctgtgtgatataggcgagtcatctccgaatccgacgatagaagaaggccgaacgctaagagtactaaaaatggttgaaccgtggctcagaggaaatcaattttgcataaaaattctaaatccgtatatgcccagtgtcgtagagacgctagaacagatgcaacgtaaacatggaggtatgctggtccgtaatccactgtctcgaaatagcactcatgaaatgtactgggtcagctgcggcacaggaaatatagtatcagcggtaaacatgacaagtagaatgctactaaaccgatttaccatggctcatcgtaaaccgacttacgagcgtgacgtggacctcggagccggaacacgccacgtagccgttgaacctgaagtcgcgaatctggatattattggacaaagaattgaaaatattaaaaacgagcacaagagtacatggcactacgatgaagataacccttacaaaacctgggcttatcacgggagctacgaggtgaaaccctcaggttcagcgtcttccatggttaacggagttgtaagactgctaaccaaaccgtgggacgtgatcccaatggtcacacaaattgcaatgaccgacacgacacctttcgggcaacagcgagttttcaaagaaaaagttgatacaagaaccccacgcgctaaacgaggcacaactcaaataatggaagtcaccgcaaaatggctttggggcttcctttctcggaataagaaacctagaatttgtacaagggaagagttcaccaggaaagtgagatcgaacgcggcgattggtgcagtcttcgttgatgaaaaccaatggaatagcgccaaggaagcagtagaagacgaaagattttgggacctggtacatagagaaagagaattgcataaacagggcaagtgtgcaacctgcgtatataacatgatgggaaaacgagagaagaaattaggtgaatttggtaaggctaaaggatctcgtgcaatttggtatatgtggctcggtgcaagatttttagaatttgaagcactcggatttatgaatgaggaccactggtttagccgtgaaaatagtttatctggggtagaaggtgagggcctacataaattagggtatattctacgtgatatatcaaaaattcctggaggaaatatgtacgcggacgatacagcaggatgggatacaagaataactgaggatgacttacaaaacgaggccaaaattacggacataatggagcccgaacacgctctactggcaacaagcattttcaaacttacatatcaaaataaggtagttagggttcaacgaccagcaaagaacggaactgttatggatgttatatccagaagagatcaacgaggaagcggccaggtaggtacatatggcttaaatacttttactaatatggaagtgcaacttattaggcaaatggaaagtgagggaatatttctaccttccgagcttgagacccctaatttagctgaacgtgcgctagattggttagaaaaacacggtgcagaaaggttaaaaagaatggccattagcggtgacgattgtgtcgtgaaaccaatcgacgatagattcgctacagccttgactgcgcttaacgatatgggtaaagttagaaaagatatccctcagtgggaaccaagtaaaggttggaatgattggcaacaggtaccgttttgttcccaccatttccatcaattgataatgaaagacgggcgagaaattgtagtaccttgtcgcaaccaagatgagctagtgggacgagccagggtatcgcaaggagcaggttggtcgctacgtgagactgcctgtctaggcaaatcttatgcacaaatgtggcaattaatgtactttcaccgcagagatctaagacttgccgcaaacgcaatctgtagcgcagtccctgtagattgggtaccgacttcaagaacaacatggtccatccatgcacaccatcaatggatgacaacagaggacatgctttctgtatggaatagagtatggatcgaagaaaacccctggatggaagataaaacacacgtttcatcttgggaagaagtaccatacttagggaaaagagaagatcagtggtgtggtagtctgattggtttgactgccagagcgacgtgggcgacaaacatccaagtagctataaaccaagttcgaagactaattggaaatgaaaactatctagattatatgacttcaatgaaaagattcaaaaacgagagcgaccccgaaggagcactctggtag

SEQ ID NO: 21426 - RNA, 9879 nt, synthetic construct
  misc_feature 1..9879: note = derived and/or modified CDS sequence (opt6) from DENV-1__FJ850099__SS-prME
  source 1..9879: mol_type = other RNA
agtgttactatgttactaatgttgttgcctacggcgttagcatttcatcttactactaggggaggggaaccacatatgattgtaagcaaacaagaaagagggaaatcactcttattcaaaaccagcgctggtgtaaatatgtgcactcttatagcaatggatctaggagaactatgtgaagatacaatgacctataaatgtccacgtataactgaagcagaacctgacgacgtagattgttggtgtaacgcaacagatacatgggttacctacggaacatgctcgcaaactggtgaacacaggagagacaaacgaagcgtcgcattagcaccacacgtgggactaggactagaaacccgtacagaaacctggatgagttctgaaggggcatggaaacaaatacaaagagtagaaacgtgggcactgagacaccccggatttacggtcattgcattatttttggcacatgcgatagggactagcattactcaaaaaggaataatatttatattactgatgctagtaacgccaagtatggcaatgcgctgtgtaggaataggaaacagagatttcgtagagggtctatcaggggctacatgggtagacgtagtattggaacacggctcgtgtgtaaccacaatggctaaaaacaaacctacacttgatattgaactcctaaaaacagaagtaacgaatcctgcagtcctccggaaattatgtatagaagcaaaaatttctaataccacgacagacagccgatgtccaacgcaaggagaagcgaccttagtggaggaacaagacgctaatttcgtatgcagacgtacctttgtcgaccgaggctggggaaacggatgtggtttatttgggaaaggtagcctactcacttgcgctaaatttaaatgcgttacaaaactagaaggcaaaatagtacaatatgaaaatttgaagtatagtgtgatagtgactgtacatacaggagatcaacatcaagtcggtaacgaaaccactgaacatggaactatagctacaattactccacaagcgcctacaagtgaaatccaattaaccgactacggagcactaacattggattgttcaccaagaacaggtctagatttcaacgaaatggtccttttaaccatgaaagagaagagttggctggtccataaacaatggtttttggatttaccacttccttggacaagtggggcttctacaagtcaagagacgtggaatagacaagacctactggtaacatttaaaactgcccacgctaaaaagcaagaggtagtcgtactagggtcacaggaaggggcgatgcatacagctcttaccggagctacagaaatacaaacctctgggacaaccactatattcgcagggcacttgaagtgtagattaaagatggacaaacttactttaaaaggaatgagttacgtcatgtgtacgggatcgtttaaacttgaaaaagaggttgcggaaactcagcatggtactgtcttagtacaagtaaaatatgaaggtacagatgccccatgcaagatacctttttctacacaggatgaaaaaggtgtaactcaaaacggacgcctaataaccgccaaccccatagttaccgataaggaaaaaccagtaaacatagagacggagcccccttttggcgaatcctatatagtcgtaggagcaggagaaaaggcactaaaactatcatggtttaagaaaggctcaagtatcggtaaaatgttcgaagcaacagctaggggagcacgaagaatggccatacttggtgatacagcatgggactttggatcgataggaggagtgttcacatcggtgggcaaattagttcatcaagtctttggaacagcgtacggggttttgttttcaggtgtgagttggacgatgaagataggcattggcattttattaacatggttgggtctcaattctcggtcaaccagtctatcaatgacttgcattgcagtgggcatggtaaccttatacttgggcgtaatggtgcaggccgactccggatgcgttattaactggaaaggacgagaattaaaatgtggaagcgggatctttgttactaatgaggtgcatacatggacagagcagtataaatttcaagctgactcccctaaaagactgtcggctgcaattggaaaggcgtgggaagaaggcgtctgcggcatacgaagtgcgacacgattagaaaatataatgtggaagcaaatttcaaatgagttaaaccacatattacttgaaaacgatatgaaatttacggtagttgtaggcgatgctaatggtattctcgctcaaggcaagaaaatgataaggccacaaccaatggaacataaatatagctggaagtcttgggggaaagctaaaattattggagctgatattcaaaataccacttttattattgatggacctgatacgccagagtgtccagatggccagagagcatggaacatttgggaggtagaagattatgggttcgggatatttactacaaatatctggctaaaattgagggacagttacacacagatgtgtgaccatagacttatgagcgcagctataaaagatagcaaagccgttcacgcggatatgggttactggattgagagcgagaaaaatgaaacttggaaactagcacgagcgtcatttattgaagtcaaaacctgtacctggcctaagtctcatacgttatggtccaatggagttctagagagtgaaatgataattcccaaaatctatggcggaccaataagccagcataattatagaccgggatactttacgcaaaccgcaggtccatggcatctcgggaaactggaactcgactttgatttgtgtgagggtaccactgtcgtggtagatgaacattgcggaaacagaggaccaagccttcgaaccacaacggtgaccggcaaaatcattcatgagtggtgctgccgctcttgcacactccctcccttgcgctttcgaggagaggacggatgttggtatgggatggaaataagacccgtaaaggagaaagaagagaatttagtaagaagtatggtcagtgcaggatcgggtgaagtagatagtttttcattaggtattttatgcgtaagcataatgattgaggaagtcatgcgaagtcgctggagcagaaaaatgctcatgaccggaacactcgccgtttttctacttttgattatgggacaacttacttggaatgatttgatccgcttatgcattatggttggtgctaatgcttctgacaggatggggatggggacaacataccttgcattaatggcaacatttaaaatgcgaccaatgtttgctgtaggtttgctattcaggcgattaacaagcagggaggtattattgttaacgataggtctttccttagtggcaagtgtcgaacttccaaacagcttagaggaattaggggacggcctcgccatgggaataatgatgttaaaactacttacggaatttcaacctcatcaattatggacgacgcttttaagtttgacattcgtcaagacaacgctctctctcgattacgcctggaaaacaacagctatggtgctaagtatagtatcgttatttccactatgtctcagcacaacctcacagaaaactacctggttgcctgtactgctaggcagtttcggttgtaagccattgacgatgttcttgataacagagaataaaatttggggtcgtaaatcgtggcccctaaatgaaggcataatggcaattggtattgtaagtatacttctgtcgtctttactcaaaaacgacgtaccactagcgggtccactaatagcaggcggtatgctgatcgcatgttatgtaataagcggaagttctgcagatctatcattggaaaaggcagcggaagtctcctgggaacaagaagccgagcactcgggagcaagccataatatcttagttgaagtccaagacgatggtacaatgaagattaaagatgaggaacgcgatgacacgctcactatactattgaaagcaaccctgctagcagtcagtggagtttatccaatgtccatcccagctacactattcgtatggtatttttggcagaagaagaaacagaggtccggggtactctgggacactccttccccaccagaggttgaacgtgcagtattggacgatgggatatataggattttacaacgcggattactgggtagaagtcaagttggcgttggagtattccaagacggtgtatttcacaccatgtggcatgttacgaggggagctgttttaatgtatcaaggcaagcgactagaaccaagctgggcatcagtaaagaaagatttaatatcatacggcggagggtggagattccagggatcttggaacaccggggaagaagtacaagttatagcagttgaacccggaaagaatcccaaaaacgtacaaacaacaccagggacttttaaaacgccagagggcgaagtgggtgcaatcgctttagactttaaaccaggaacgagcggatcacctatcgtaaatagagaaggtaaaattgtaggtttatacggaaatggagttgtaaccacctcaggaacgtacgtaagcgcaatcgcccaggcaaaagcatcacaagaaggacctttgcctgaaattgaagatgaagtattcaaaaagagaaatttaacgattatggatttacatcctggttcaggaaagacaagaaggtacttaccggccatagtacgagaagcaataaagagaaaactaagaacgctaatattggcaccgacgagggtagtcgctagtgaaatggctgaagcgctaaaaggaatgccgataagatatcaaactacggctgtaaaatcagagcatacgggcagagagatagtagacctaatgtgtcacgcgacatttactatgagactgctgtcacctgttcgggtaccgaattacaatatgataataatggacgaggctcactttacagatccagcatcaatcgctgctcgaggatatatatcaaccagagtaggaatgggagaggccgccgcaatctttatgacagccacgcctcctggtagcgtagaggcatttccccagtcgaacgcagtgatacaagacgaagaaagagatatcccagaaagatcatggaatagcgggtacgactggataacagatttcccaggtaagacggtatggtttgtgcccagcataaaatctggaaacgatattgcaaattgtttgcggaaaaacggaaagagagtaatacaattgtcccgtaaaacgtttgatacggaatatcagaaaaccaaaaataatgactgggactatgtcgtaacaacagatatatcagaaatgggtgcaaatttcagggcggatagagtcatagatccgagaagatgcctcaaaccagtaatactaaaggatggacccgaacgagtcatacttgcaggcccaatgcccgtaacagtagcttccgcagcccaacggcggggtcgtataggtcgtaatcagaataaagaaggagatcaatatgtgtatatgggtcaacctttaaataacgacgaggaccacgcgcactggaccgaagctaaaatgctattagataatataaacacacccgaaggcattattcccgcactattcgagcctgaaagagagaaaagtgcagcgatagatggagagtatagattaagaggagaagcacggaaaacatttgtagaattaatgaggcgtggcgacttgccagtgtggctctcatacaaagtggcaagtgaaggatttcaatatagcgaccggagatggtgtttcgacggggagcgaaataaccaagtcttagaggagaacatggatgtcgagatttggacgaaggagggagaacggaagaaactccgcccaagatggttagacgctagaacatatagcgatcccttggcactgcgtgaatttaaagaatttgcagccggacgcaggtcagtatcaggagatttgatattagaaattgggaaacttccgcaacacttgactcttagagctcaaaacgcactggacaacctagtaatgttgcataatagtgaacagggtggaaaagcatatagacatgcgatggaagaacttcctgacactatcgagactttgatgttactagcacttattgctgttcttacaggaggggtcacactattctttctcagcggcaagggattaggaaaaacgagcatcgggttgttatgtgtcacagcgtcaagcgccttgctatggatggctagcgtcgaaccgcactggatcgcagcatcaattatattagagttcttcctaatggtacttttgataccggaacctgatagacaaagaacccctcaagataaccaactggcttacgttgtgataggattattatttatgatattaactgtagcagcaaatgaaatgggtctattagaaaccactaagaaagatcttgggatagggtatgtggcggccgaaaatcatcagcatgcaactatgttggatgtagatttgcgacccgccagcgcgtggacattatatgcggtagcgacgactgtaataaccccaatgatgcgtcatactatcgaaaatacgacagcgaacataagtcttacggctatcgccaaccaggcagcaatcttgatgggtttagataaaggctggccaataagtaagatggatatcggagtcccattactcgccttaggatgctatagccaggtaaacccgttaacattgacagcggcagtgttaatgctcgtcgcacactacgcgataataggaccagggcttcaagcaaaggccaccagagaagctcagaaaagaactgcagctggaataatgaaaaatcctactgtcgacgggatagtagccatagatttagatcctgtagtgtacgacgcgaaattcgaaaaacaactaggtcaaattatgttactaattctatgtacctctcagatactactaatgagaacaacttgggctctatgtgagagtattacccttgcgacaggaccgctaacgacattatgggaaggatctccaggaaaattctggaacactacaattgcagtaagtatggccaatatttttaggggaagctatttagctggagcggggctagctttttcgcttatgaaatctctaggaggaggcagaagagggacgggcgcccaaggggagactctaggtgaaaaatggaaaaggcaattaaatcaacttagtaagagtgaatttaatacatataaacgttctggtataatggaagtagataggagcgaggctaaggaaggattaaaaagaggtgaaacgaccaaacatgccgtcagtcgaggtacagctaaacttagatggtttgttgaacgcaatctagttaaaccagaaggaaaagtgatcgatttaggatgcgggagaggcggctggtcttattactgtgcaggactaaagaaagtcacagaagtaaaaggttacacaaaaggtggtcctggtcacgaggaaccaatcccaatggctacctacggatggaacctggtaaaactccattcagggaaagatgtattctttatgcctccagagaaatgtgatacgctactatgcgatattggagagtcctctcccaacccaacaattgaggaaggtcgcacgcttagagtgcttaaaatggtggagccttggctaaaaggtaatcagttttgtattaaaattttgaatccgtatatgccaagtgtagtagaaacactggaacaaatgcaaaggaaacacggaggaatgttggtaaggaatcccttgagccgcaatagtactcacgagatgtattgggtcagttgcgggactggtaacatagtcagcgcagtaaatatgaccagcaggatgctcttaaacagatttacaatggcccatcgaaaacctacttacgaaagagacgtcgatttaggtgcaggaacgagacatgtcgcagtggaacctgaagttgctaatctcgacatcattggacaacggatagaaaatatcaaaaacgaacataaaagtacatggcattacgatgaagataacccctataaaacgtgggcataccatggcagctacgaagtgaaaccgagcggaagtgcctcttctatggttaacggggtcgtaagacttctcactaaaccatgggatgtcatacctatggttactcaaattgctatgacagacacaactccatttgggcaacaacgagtgtttaaagaaaaagttgatacccgcacccctcgagcaaaaagaggaacaacacaaattatggaagtaacagcaaaatggttatgggggttcctaagtaggaataagaaaccacgaatttgtactagggaagaatttactagaaaggtaagatcaaacgcggcaattggagcggtattcgtggatgagaatcagtggaatagcgcaaaagaagccgttgaagatgaacgattttgggatctagttcatcgagaaagagaactgcataaacaagggaagtgtgctacctgtgtttataatatgatgggtaaacgggagaagaaattaggcgaatttggtaaagcgaagggttctcgggccatatggtatatgtggttaggagcacgcttcctagagtttgaggcgttaggtttcatgaacgaagaccattggtttagtcgagaaaatagtttgtcaggagtcgaaggggaaggactacataagttaggttatattttaagagatattagcaaaattccgggaggcaatatgtatgctgatgacaccgccggttgggacacacgaataactgaggacgatctccaaaatgaggctaagattacagatattatggaacctgagcacgcattgttggcaaccagcatctttaaacttacctatcaaaataaagtcgtcagagtacaaaggccagccaaaaacggaacggtgatggatgtaatatccaggagggatcagaggggcagtggccaggtaggaacatatggcttaaatacattcacaaatatggaggttcagttaattagacaaatggaatcagagggtatatttctgagcagcgagttagagacgccgaacttggcggaaagggtactggattggcttgagaagcatggagctgaacgtcttaaacgtatggctatttcaggtgatgattgtgtggtcaagccaatagacgatcggtttgcgaccgctctaacggccctaaacgatatgggtaaagttagaaaagatataccccaatgggaaccaagtaaagggtggaacgattggcaacaagtaccattctgtagccatcattttcaccaacttataatgaaggatggcagagaaattgtagtaccatgtagaaaccaagatgaattagtgggacgagccagagtaagccaaggagcaggctggtcgctgcgagagaccgcatgtttaggtaagtcatatgcccaaatgtggcaactaatgtatttccacagacgtgacttgagactagcagctaatgcaatatgttcagctgtccctgtggattgggtcccaacttcgagaactacgtggtcaatacacgctcaccatcagtggatgacaaccgaggacatgttaagcgtatggaatcgagtctggattgaggagaacccctggatggaggacaaaacgcatgtttcctcttgggaagaagtaccttacttagggaagcgagaagaccagtggtgtggtagccttattgggctcacggcaagagctacatgggcgaccaacatacaagtagccataaatcaggtgcgaagattaattggaaacgaaaattacttagattatatgacttccatgaaacgttttaagaatgaatccgatcctgaaggggctttatggtaa

SEQ ID NO: 21427 - RNA, 9879 nt, synthetic construct
  misc_feature 1..9879: note = derived and/or modified CDS sequence (opt6) from DENV-1__FJ850100__SS-prME
  source 1..9879: mol_type = other RNA
agcgtgactatgttactaatgttactacctaccgcattagcattccatttaaccacaagagggggagaaccgcacatgatcgtctcaaaacaggaacgaggaaaatcattattgtttaaaacgagtgctggagtcaacatgtgtacactgattgcaatggacttaggagaactatgtgaagacacaatgacctataaatgcccaaggataactgaagctgaacccgacgatgtcgactgttggtgtaatgctactgatacatgggttacctacggaacttgttctcaaaccggagaacaccgacgagacaaaaggtctgtagcattagctccacacgtcggactagggctagaaaccagaacagaaacctggatgtcatcggaaggcgcatggaaacagatccaaagggtagaaacttgggcacttagacatccaggattcaccgttatagcattatttctagcacacgcgattggcacctcaatcacgcaaaaaggcatcatattcattctcttaatgctcgtgaccccttcaatggcaatgagatgcgttgggataggaaatcgggattttgtggaaggtcttagtggagccacatgggtagatgtagtattggaacacggaagttgcgtaaccactatggctaagaacaaaccaacactagatatagagttgttaaaaacggaggtaacaaatcccgcggttctaaggaagttatgcatagaggcaaagatatctaatacaacaacggattctaggtgtcctacacaaggggaagccaccctagtagaggaacaagacgccaatttcgtttgtcgtaggacattcgtagaccgcgggtggggaaacggatgtggcttgtttggaaaaggaagtttattaacatgcgctaaatttaagtgtgtcactaaacttgaaggaaagatcgtacaatatgaaaatctaaagtacagtgttattgtaaccgtacatacaggcgatcaacatcaggtaggaaacgagacaaccgaacatggcacaatcgcaacgattacgccacaagccccaacctcagaaattcaactaacggattatggagcattaactctggactgctcccctcgaacaggactggatttcaatgagatggtcctgctaacaatgaaagaaaagagctggttagtacataaacaatggtttttagacctcccgctcccgtggacatcaggagcttcaacatctcaagagacctggaaccgccaagatttgctggttacattcaaaactgcgcacgccaagaaacaagaagtcgtagtattaggatcacaggaaggagccatgcatacagcactaacaggagctactgaaatccaaacatccggtacaacaacaatctttgccggtcatctgaaatgtcgtctaaaaatggataaactaacactaaaaggtatgtcatatgtgatgtgtacagggagcttcaaattagaaaaagaggtagcagaaacgcaacatgggacggttttagtacaggtaaaatatgaaggcacagatgcaccctgtaaaattcctttttccacgcaggatgaaaaaggtgtaactcagaatggccggctaataaccgcaaatcctattgtaacggataaggaaaaaccggtcaatatagaaacggaacccccattcggagagtcgtacatagtagtgggggcaggcgagaaggcacttaaattatcgtggtttaagaaagggagttcaataggtaagatgtttgaggctacagcaagaggagcgagacgaatggcaatactgggtgacactgcttgggattttggatccattggcggtgttttcacttcagtaggaaaattagtacaccaagtgttcggcacagcttacggcgtactttttagtggggtaagttggactatgaaaatcgggataggaatattactaacgtggttgggactgaacagcagatcaacatcactcagcatgacatgtattgcggtaggtatggttacattatatttgggggttatggtacaagcagattcgggctgtgtaatcaattggaaggggagagagcttaagtgtggatccggtatatttgttactaatgaagtacatacttggactgaacaatacaaattccaagcggactcccccaagcgccttagcgccgcaataggaaaagcctgggaagaaggcgtgtgtggcataagatcagcaacaagactagagaatattatgtggaaacaaataagtaatgagttaaaccacatattgctggaaaatgacatgaaattcaccgtagtcgtgggcgatgcaaatggaatcctggcacaaggaaagaaaatgattcgaccacagccaatggaacataaatatagttggaaatcatggggaaaggcaaaaataataggtgcagacatacaaaacacaacctttataattgatggcccagatacacctgaatgcccagatggccaacgagcttggaatatttgggaagtagaggactacggatttggtatatttacaacaaacatatggcttaagctaagagactcatacacacaaatgtgcgaccaccgtctcatgtcagcagcaatcaaggatagtaaagccgtccatgccgacatgggatattggattgaatctgagaaaaatgaaacgtggaaacttgcaagagccagcttcatcgaggtgaaaacctgcacttggcctaagagccatactctgtggtcgaatggtgtattagagagtgagatgataattccaaaaatctatggtggtccaatctcccagcacaactacaggcctggatacttcacgcaaacggcaggaccctggcatctaggaaaactagagttggatttcgatttgtgtgaaggaacaacagtcgtagttgatgaacactgtggaaacagagggccttccctacgaaccacaacagtaactggaaaaatcatacacgaatggtgctgtaggagttgcacattaccacctttacgtttccggggtgaagatggatgctggtacgggatggaaataagaccagtgaaggaaaaggaagaaaacttagttagatcaatggttagtgcaggcagtggggaagttgacagtttttctctaggcatattatgtgtgtcaataatgatagaggaagtaatgcgttcacggtggtcacggaagatgctaatgacgggtactttggcggtatttttgctgttaataatgggacaactcacttggaatgatttgatacgtttatgcattatggtaggagcgaacgcgtcagaccgaatgggaatgggcaccactcatttggctcttatggcgacatttaaaatgaggcctatgtttgccgtgggcttactattcagaagacttacgtctagagaagtcttgctactaacaataggattaagtttgatggcatcaatggaattaccaaatagcctagaggaactcggagatggcctagccatgggcattatgatgctgaaactactaacagagttccagccacatcaactatggacaactctcctcagcttgactttcgtcaagacaaccttgtcattggattatgcttggaagaccacggccatgatattatcaatagtctccctctttccactatgtctttctacaacaagtcagaaaacaacgtggttgccagtactattaggatccttcggttgtaaaccgctaacaatgtttctaattaccgagaataagatatggggtaggaaaagttggcctctaaatgagggaattatggccattggaatagtctccatactcctctcaagtttactgaagaacgatgtcccactagccggtcctctaatagcagggggaatgttaatcgcttgctatgtaataagtggctcatccgctgacctaagtctagaaaaagctgcagaagtatcgtgggaacaagaagctgaacactcgggtgcaagtcataatattttagtcgaagtacaagacgatggtacaatgaaaatcaaggatgaagaaagagatgataccttgacaatactgctcaaagctacactattggcagtatctggagtatatccaatgtcaattcctgctactctgtttgtctggtacttttggcaaaagaaaaagcagagatccggggtgttgtgggatacaccaagcccaccggaagttgaacgagcggtgttggacgatggcatctatcgaatcttacaaagaggactattaggaagatctcaggttggggtcggggtcttccaggacggagtctttcatacaatgtggcatgttacccgaggggcagtgctcatgtaccagggtaaaaggctagaaccatcgtgggcatcagtcaaaaaggacttaattagttacggaggtggatggcggtttcagggttcatggaatacaggtgaggaagtccaggtaatagctgttgaacccggtaaaaatccgaaaaatgtacaaacgacaccaggtacttttaaaacccctgaaggagaagtgggagctatagctttagatttcaaaccaggaacaagtggtagtcccattgtcaaccgcgaaggcaagattgttggtttatatggtaatggtgtagtaacgacctcaggaacatatgtttctgcaattgctcaagcaaaagcgtcccaagagggtccattaccagaaatagaagacgaagtatttaagaagagaaatctgactatcatggatctacatcccggaagtggcaaaacacgacggtatctacccgctatagtcagagaagcgataaaacgcaaattgagaacactaatactagcaccaacacgagttgtagcaagtgagatggctgaagcattgaaaggtatgcctattcggtatcaaaccacagctgtaaaatcagaacatacagggcgcgaaatagttgatcttatgtgtcatgctacatttacaatgagactactgtcaccggtgagggtcccgaactacaatatgattattatggacgaagcacatttcaccgatcccgcatcaatagctgctagagggtacatcagcacacgtgttggaatgggagaagcagccgcgattttcatgaccgcaaccccacctggatcagttgaagcattccctcagtcaaatgccgtaatccaagacgaagaaagagatatcccggaacgatcttggaactctggatatgattggatcaccgacttccccggaaaaactgtctggtttgtcccatcaataaaatcaggcaatgatatagctaattgtctacgcaaaaatggcaagagggtaatacaattgagcagaaaaacattcgatactgaatatcagaaaacgaaaaataatgattgggattatgtagtgacaactgacatatcagagatgggtgcaaacttccgagcagaccgtgtaattgatccacgaagatgtctgaaaccagtgatactaaaagatggacctgagagagttatactagcgggccctatgccagtaacagtcgcatcagcggctcagagacgtggaagaattggtcgtaatcaaaacaaagaaggagatcagtatgtatatatggggcagccattgaataatgacgaggaccatgcccattggacagaagctaagatgttgttagacaatattaatacacctgagggaataattccagcactgtttgaaccagagagagaaaaatcggcagcgatagacggagaataccggttaaggggagaggccaggaagacctttgtggaactcatgagaagaggagatcttcctgtatggctttcatataaagtggcaagtgaaggttttcagtatagtgatagaaggtggtgtttcgacggcgaaagaaataatcaagtcttagaagaaaatatggacgtagaaatatggactaaggaaggagaaaggaagaaactacgcccacgctggttggatgccagaacttatagcgaccctcttgctctaagggagtttaaggaatttgccgctgggcgacgttccgtctctggtgatctaattttagaaatcggtaagttaccacaacacctaactctcagagcgcaaaatgcactcgataatttagttatgttgcataactctgaacaaggaggaaaggcgtatagacatgctatggaagaacttccagatacgatagaaactctgatgctactggcgttaattgcagtgttaacgggtggagtcacgttattctttctttctggcaaaggattaggcaaaacctctattggcctattatgtgtaacagcttcaagtacattgttgtggatggcgtcagttgaaccacactggatagcggcctcaatcatactggaatttttcttaatggtgttactcataccagagcctgaccggcaaagaactccacaggataaccaactcgcttacgttgtaattggcttgctctttatgatattaacagtagctgcaaacgaaatggggctattagagacgactaaaaaggatctgggcatcgggtacgtggcggcagagaaccatcaacatgcaacaatgctcgacgtggacttacgacccgcaagcgcctggactttatatgcagtggcaacaacagtaatcaccccaatgatgcgtcatacaatcgaaaatacaacagctaatatcagtcttactgctatcgcaaatcaagctgctatattaatggggttagacaaagggtggccgatatccaagatggacatcggggtaccgctattggcacttgggtgttattcacaagtgaatccactcacactaaccgctgcggttctaatgctagtcgcccattatgccataatagggccgggcctacaagcaaaagcaacaagagaagcccaaaaacgcaccgccgctgggataatgaagaatccgacagtcgacggaattgtggcaattgatctagatcccgtcgtttacgatgcaaaatttgagaaacaactaggacaaatcatgcttctcatattatgcaccagtcaaatactcctaatgcgaacaacttgggcgctatgcgaatcgattaccctagctacgggtccactaacaacattgtgggagggaagtcctggaaaattctggaatacaactatcgctgtctcgatggccaacatattcagaggttcgtatctcgccggtgctggactggcattttcgttaatgaaaagtttaggaggaggacgacgaggcacaggggctcaaggagagacgctaggagaaaaatggaagagacagttaaaccaactaagtaaatcagaatttaatacatacaaacgaagtggaattatggaggtagatcggtcggaagccaaagaaggactaaaaagaggagaaactacaaaacatgctgtgagcagaggtaccgcaaaactaagatggttcgtagaacgtaatttggttaaacccgaaggcaaggtaatagatctaggatgcggcagagggggctggtcgtattactgtgccggcctgaagaaagtaactgaggtaaagggctatacgaaaggtgggcccggacatgaagaaccaattccgatggcaacctatggttggaatttagtaaaactacacagcggaaaagacgtattctttatgcccccagaaaaatgtgatactcttctgtgtgatattggggaaagctcgccaaacccgaccatagaggaagggagaacattaagagtactaaaaatggtagaaccatggctaaaaggcaatcaattttgtattaaaattctaaatccatatatgcccagcgtagtggaaacactggaacagatgcaaaggaaacacgggggaatgcttgtacgcaatccccttagtcggaatagcacacacgagatgtattgggtatcatgcggaactggtaacattgtttcagcagtcaacatgacatccagaatgttattaaatagatttaccatggcacatcgtaaacctacgtacgagagagacgtggacttaggtgcgggcacacgacatgtcgctgttgagccagaagtcgccaacctcgatattattgggcaaaggatagagaatataaagaatgaacacaagtcaacgtggcattacgacgaagacaatccttacaaaacttgggcataccatggaagttatgaggtgaaaccctctggctctgctagctcaatggtaaatggggtagtccggctattaactaaaccatgggatgtaattcctatggtaacccaaatcgcaatgacagacacaacgccttttggtcaacagagagttttcaaggaaaaagttgatacgagaacacctagggcaaaaaggggaactacacaaatcatggaagttacagccaaatggttatgggggttcttatccagaaacaaaaagcctcggatatgtacaagggaagagttcacccgaaaagtcagaagtaacgctgcgataggagcagtatttgttgacgagaatcagtggaatagtgctaaagaggcagttgaagatgaacggttttgggatcttgtgcacagagaacgagagttacataaacaaggtaaatgcgcgacttgcgtatacaacatgatggggaaacgtgagaagaaattaggcgaatttggaaaggctaaagggtcccgcgcaatctggtacatgtggctaggcgctcggttcctagaatttgaggcactcggttttatgaatgaagatcattggtttagtcgagaaaattctttgtcaggcgtggagggtgaagggttacacaagctaggatatattttaagagatatttccaaaataccgggcggtaatatgtacgcggatgacacagcaggctgggatactcgaattacagaagatgatttacaaaatgaagcaaaaattacagacataatggaaccagaacacgcattgctcgccacctcaatatttaaacttacttaccagaataaagttgttcgagtccagagaccagctaagaatggaacagttatggacgtaattagtaggagagatcagcggggctcaggccaagtaggtacatatggcttaaacacctttactaatatggaggtccaattgatccgacaaatggagagcgaaggaatatttctaccgagcgaactggagactccgaatttggcagaaagagtattggattggttagaaaaacacggcgcagaaagattgaaacgcatggcaatttcaggagacgattgtgtcgtaaaaccaatcgatgacagattcgctacagcattgactgcgctaaatgatatgggtaaagtgcgaaaagatattccacaatgggaaccgtccaaaggctggaatgattggcagcaagttcctttctgcagccaccattttcatcaactcataatgaaagatgggagggaaatagtggtaccttgcagaaatcaagacgaacttgtaggacgagcccgtgtgagtcagggggcagggtggtcacttagagagacggcgtgtctaggaaaatcttatgctcaaatgtggcaactaatgtatttccatcgccgcgatctgcgtcttgccgcgaacgcaatatgtagtgcagttccggtagattgggtaccgacaagtcgtactacctggagcattcatgcacatcatcaatggatgacaacagaagatatgttgtccgtatggaatcgagtatggattgaagaaaacccatggatggaagacaagacacatgtaagctcctgggaagaagttccctatcttggaaaacgggaggatcaatggtgtgggtcacttatagggctaacggcgagagctacgtgggcaactaacatacaggtcgcaataaaccaggtcagacgattaattggcaacgaaaactatcttgattatatgacctcgatgaaaagatttaaaaatgaaagtgacccagaaggagcgctctggtga

SEQ ID NO: 21428 - RNA, 9879 nt, synthetic construct
  misc_feature 1..9879: note = derived and/or modified CDS sequence (opt6) from DENV-1__FJ882579__SS-prME
  source 1..9879: mol_type = other RNA
tcagtgactatgttgcttatgttgttgcctaccgcacttgcatttcatttaactacgcgcggaggagaaccacatatgatagtatctaaacaagaacggggaaaatcattgctgttcaaaacttctgctggggttaacatgtgcactcttattgctatggatctcggcgaactatgtgaagacactatgacctacaaatgtccgcgaattacggaggccgagcccgacgatgtagactgttggtgcaacgcgactgatacctgggtaacatacgggacatgcagccaaacaggagaacacagacgtgataaacgaagtgtggctttggcgcctcatgttggtctaggactagagacaagaacagagacgtggatgtcgagtgagggagcgtggaaacaaatacaaagagtagaaacctgggcactacgacacccaggttttacagttatagcgttcttccttgcgcacgccataggaacaagtataacacaaaaaggaataatatttatcttactaatgcttgttactccgtcaatggcgatgagatgtgttggaattggaaatcgcgactttgtggaaggactctctggagcgacatgggtagacgtggttcttgaacacggatcctgtgttaccactatggcgaaaaataaaccaacgctagatatagaactgctaaaaaccgaggtaaccaatcccgccgtattacgtaaactctgtatagaagcaaaaatctcaaacactacaacagacagtcgatgtccaacacaaggcgaagcaaccttggtcgaagaacaagatgcaaacttcgtttgtagacgaacctttgttgatagaggttggggcaatgggtgtggcttatttgggaaaggctcattattaacgtgcgccaaattcaaatgcgttactaaactagaaggtaaaattgtgcaatatgaaaacttaaaatattccgtgatcgttacagttcacactggtgaccaacatcaagtggggaatgaaaccaccgaacatggtacaatagccacgattacaccacaagcgccgacatctgagatacaactgacagactatggagctttaacactggattgcagtcccaggacaggactggattttaacgaaatggtactgttaacgatgaaagaaaaatcctggttagtgcataaacaatggtttctagacctcccattaccttggacaagcggagcttcgacgtcccaagaaacttggaaccggcaagatctattggttactttcaaaactgcccatgccaagaaacaggaagtggttgttctaggatcgcaagagggcgcaatgcataccgcgctcacaggcgctactgagatacagaccagcggtactacgacgattttcgcaggtcacctcaaatgtcgcttgaaaatggacaaattaacattgaaaggaatgtcatacgtgatgtgtacaggttcttttaaattagaaaaagaagtggctgagacgcaacatggaacagtgctagtacaagttaaatatgaaggaacagatgcaccatgtaaaataccttttagcacacaagacgaaaaaggagtaacacaaaacggaaggctcatcacagctaaccctatcgttacagataaagaaaaaccagtaaacattgaaactgaaccacctttcggagaaagctacatcgtagtcggagctggtgagaaagccctgaaactgagctggtttaagaaaggttcaagcatagggaaaatgtttgaagctaccgccagaggcgcaaggagaatggctatattaggcgacacagcctgggattttggtagcatcggaggagtattcacatccgtaggaaagttagtacaccaagtattcggtactgcctacggcgtattattttctggagtaagttggacaatgaaaattggcataggtatactgctaacatggttagggcttaattctagaagcacttcattatcaatgacttgtatagcagtagggatggtaactctttacttaggggtgatggtacaggccgacagcggctgtgtcattaactggaaaggtagggaactaaaatgtggatctggaatttttgttactaatgaggtacatacgtggacagagcaatacaaatttcaagcagattctcctaaacgactatctgcagccataggcaaggcttgggaggagggggtgtgtggcattagatccgccacgagactggaaaatattatgtggaaacaaataagcaatgaattaaaccatatattacttgagaacgacatgaaatttaccgtggtggtcggggatgcaaatggtattctgacacagggaaagaaaatgattcgcccacaaccgatggaacataaatactcatggaagagttggggaaaagcaaaaatcatcggagcagacattcaaaatactaccttcataatagatggaccagatactccagaatgtccagatggtcagagagcttggaacatttgggaagtagaagattatgggtttggtattttcaccacaaatatatggctaaaactaagagatagttatacacaaatgtgcgaccataggttgatgtctgcagcaatcaaagattctaaagctgtacacgcagatatggggtattggattgagtcggagaaaaatgaaacatggaagttagcacgggcttcttttatagaagtgaaaacatgtacatggccgaagagtcacaccttatggagcaacggtgtcttggaaagtgaaatgataattccaaagatatacgggggtccaatttcacaacacaattatagacctggttactttactcagacggctggaccatggcatctaggaaaattagagctcgattttgatttgtgcgaaggaacgacggtagtagtagatgaacactgcggaaatagaggaccctctcttagaacgaccacagttactgggaaaataattcacgaatggtgttgtcgtagttgtactctaccaccccttagatttcgtggagaagacggttgttggtacggaatggagatccggccggtcaaggaaaaagaagagaacttggtacgctctatggtgtcagctggtagcggagaagtggactcgttttccctcggtatactctgtgtaagtataatgatagaagaagtcatgagaagccgatggtcaagaaaaatgttgatgacaggcacattagcagtatttctacttctaattatgggacagcttacttggaatgatttaataagactgtgcatcatggtcggtgcaaatgccagcgatcgtatgggaatgggaacaacatatttagctctcatggccacatttaagatgagacctatgttcgctgttggactgctctttcgaagacttacttcgcgggaagtattactgttaacgataggcttatcactggtagcgagtgttgagcttccgaactcactggaagaactaggagacggattagctatgggaataatgatgttgaaattgttaacggagttccaacctcatcaactatggacgacactattaagtctcacatttgtaaaaactacgctgtcgcttgactatgcctggaaaaccactgcgatggtacttagtatcgtcagcttattccctttatgtctaagtacaacgtcgcagaaaaccacctggctacccgtacttctcggcagctttggatgcaagcctctaacaatgtttttgataacagaaaacaaaatatggggaagaaagtcatggccgttgaatgaaggaataatggcaatcggaatagtatcaatacttctatcttctcttcttaaaaacgatgtacccctcgcaggtccattaatcgcaggaggaatgctcatagcgtgctacgtaataagtggttcaagcgcagatttattactcgaaaaagcagcggaagtttcatgggaacaagaagcagagcatagcggcgcttcgcataacatattagtagaagttcaagatgatggcacgatgaagattaaagatgaagagagagatgatacccttacgattttactcaaggctaccctactagcagtatcgggtgtatacccaatgtcgattccagctacactatttgtttggtatttttggcagaagaagaaacaaaggagtggagttttatgggacactccctcgcctcctgaagttgagcgggcagttttggatgacggcatatataggatactgcaacggggattattaggccgttctcaagtcggggtgggagttttccaagatggcgtgtttcacacaatgtggcatgtcacgaggggcgcagttttaatgtatcagggaaaaaggcttgagcccagttgggcaagtgtcaagaaagacttaattagctatggtggaggttggagattccaaggatcatggaatactggagaagaagtacaagtaatagcggtggaaccaggtaaaaatcctaaaaatgtacagactacacccggtacctttaaaacgccagaaggggaagtcggagccattgctttagattttaaaccaggcacatcaggttcacctatcgtaaacagagaagggaagattgtaggattatacggtaacggagtggttactacaagcggtacttacgtgtcagcaatagcacaagcaaaagccagccaagaaggtccgcttccagaaattgaggacgaagtattcaagaaacgcaatctcaccataatggacctccacccaggatcaggcaaaacacgaagatatttgccagccattgtacgtgaagcgataaaaagaaaacttaggacgttaatactggcaccgacgagagttgttgcatcggaaatggcagaagccttaaaaggcatgcctatacgatatcaaacaacagccgtgaaatcggaacatacgggtcgagaaatagtagatctcatgtgtcatgccacatttacaatgcggttattaagccctgtcagagtaccaaattataatatgattatcatggacgaggctcattttacagacccagcatcaatagctgctagagggtatatatctacaagagtaggtatgggtgaagcagcagcgatattcatgactgcgacccctccaggttccgtagaagcatttccacaatcgaacgcagtcattcaagacgaagagagagacatacctgaaagatcctggaactcaggttatgattggataacagatttccctggaaaaacagtctggtttgtacccagcattaaaagtggcaatgatattgcaaattgtctaaggaaaaatggaaagagagttattcaattgagtcgaaaaacatttgatacagagtaccagaaaactaaaaataatgattgggattacgttgttacgacggacatatcagaaatgggagcgaatttcagagctgatagagtgatagatccaagaaggtgtctgaaacctgtgattttaaaggatggaccagagcgcgttatattagctggacctatgccagtaactgtagcaagcgccgcacaaagaaggggtagaattggtaggaatcaaaacaaagaaggagatcagtatgtgtatatgggacaaccattaaataatgacgaagatcacgcacattggactgaagccaaaatgctgttggataatataaatacaccagaaggaattattccagctttgtttgagcctgaacgagagaaaagtgccgctattgacggggagtacagacttagaggagaagctagaaaaacatttgtcgaactaatgagaagaggagatctccctgtttggttgtcgtataaagtggcatcagaaggatttcaatactcagatagaagatggtgtttcgacggcgaaagaaataaccaagtcctagaggaaaatatggatgtagaaatttggactaaggaaggcgagaggaagaaattacggcccaggtggctcgatgcccgaacctatagcgaccccttagcactacgcgaatttaaagaatttgccgctgggcggcgaagcgtaagtggtgacctaatcttagaaattggtaaactcccgcaacatcttacattacgtgcacaaaacgcacttgacaatttagttatgttacataacagcgagcaaggaggaaaggcatatagacacgcgatggaagagttaccagatactatagagaccctgatgcttttggccctcatagccgtattaactgggggagtaacactattctttctctcaggaaagggattaggcaaaacaagcatcggattattatgcgtaacggcatcatcagcactattatggatggctagcgtagaacctcactggatagcagcaagtataattttagagttctttctaatggttctgcttattccagaaccagacagacaacgtactccgcaagacaaccagttagcttacgtcgtaatcggattgctatttatgatattaacagtcgcggcaaatgaaatgggacttttagaaacaactaaaaaggatctagggattgggtacgtggcagcggagaatcatcaacacgccaccatgttagatgtagatctacgccccgcgagcgcttggactctgtatgcagtcgctacaacagtgatcacgccaatgatgcgacatacaattgaaaatacaaccgcaaatatcagcttaaccgcaatcgccaaccaagcggcaatactgatggggttagataagggatggcccataagtaaaatggatattggcgtacccctacttgcactaggctgctatagccaagtcaatccattaaccctaacagcggcagtattaatgttagtagcacactatgctatcattggacctgggttgcaggcaaaggcaacacgggaagcacagaagaggactgccgcaggaatcatgaaaaatccgacagtagatgggatagtagccatagatttagacccagtggtatacgacgcaaaatttgaaaaacagctcgggcagattatgttactgatcttgtgtacttcacaaatattattaatgaggacaacctgggcattatgcgaaagcattacactagcaacaggtccactgacgacattatgggaaggctcccccggaaagttctggaatacgaccatcgccgttagcatggcaaacatttttcgtggaagttatctagcaggagctggtctggcattctcattaatgaaaagcctcgggggaggacgaagaggtactggcgctcaaggtgaaacactcggcgagaaatggaaacgacaattaaaccagctatcaaaaagtgaatttaacacatataagagatcaggtatcatggaagtggatcgctctgaggcgaaagagggcttaaaaagaggcgagacgactaaacatgccgtaagtagggggacggcaaagctacgatggttcgtcgaacgaaacttagttaaacccgaaggtaaagttattgacttagggtgtggtcgaggaggctggagctactactgcgcaggactaaagaaagtcaccgaagtgaaaggatatactaaaggtggccctggacacgaggaaccaatccccatggcaacctatggctggaatttagttaaactacactccggaaaagatgtgttctttatgcccccggaaaaatgtgacaccctattgtgcgacataggggaatcttcgcctaatccgactatagaggaaggaaggaccttgagagttttaaaaatggtagaaccatggctaaaaggtaaccaattttgtataaagatcctaaatccatacatgcccagcgttgtcgaaacgcttgagcaaatgcaaaggaagcatggaggaatgttagtacggaacccactaagtcgaaatagtactcatgagatgtactgggtaagttgtggcaccgggaacattgtttcagcagtcaatatgacttcccgtatgttactaaatagatttactatggcacacagaaaaccaacttatgagcgcgacgtggacctaggagctggtacacgacatgttgccgtggagccggaagtcgccaatctagatatcatcggtcagagaatagaaaatatcaaaaacgaacacaagtcaacgtggcactatgacgaagataacccgtataaaacttgggcatatcatggcagctatgaagtaaaaccatctggaagcgcttcgtcaatggtcaatggagtggtacgcctcttgaccaaaccgtgggacgttattcctatggtcactcagatagcaatgaccgatactacaccgtttgggcaacaaagagtctttaaagaaaaagttgacactcgtacgccaagagccaagcgaggtacaacacaaataatggaagtaacggcgaaatggctgtggggctttttaagcagaaacaagaaacctcgtatctgtactagagaagaatttactcgtaaagtacgaagtaacgcagctatcggagcagtatttgtcgacgaaaatcaatggaacagtgcgaaagaagctgtagaggatgaaagattttgggatcttgtacaccgagaaagagaactacacaaacaaggcaagtgtgcaacatgtgtctacaatatgatgggcaaacgtgagaagaaacttggtgaatttggaaaagctaaaggaagcagagcaatatggtatatgtggttgggtgctcgatttctagagttcgaagcattgggatttatgaatgaagatcactggtttagtagagagaactccctatcaggagtcgaaggcgaaggattacataaactagggtacatattacgtgatatttcgaagattcctggcgggaatatgtacgcagatgatacagctggttgggatactaggataacagaagatgacctgcaaaatgaagccaaaatcaccgacattatggaacccgaacatgccctgttagcaacctctatattcaagttgacttatcaaaacaaagtcgtgagagtacaacgacccgccaaaaatgggacggtaatggacgtcatttcaagaagggatcagagaggttccgggcaagtggggacgtatggcctaaatactttcacaaatatggaagttcaacttattcgacaaatggaatctgagggcatatttctaccatcagaattggagacaccaaatctggcagaaagagtactagattggctcgaaaaacacggagctgaaagattaaaaagaatggctatatcaggagatgactgcgtcgtgaaaccaattgacgaccggtttgcaacagctttgacggcgttgaacgacatgggaaaagtaagaaaggatatacctcagtgggaaccatccaaggggtggaacgactggcagcaagtcccgttctgttcacaccacttccatcagttaataatgaaagatggtcgcgagatagtagtcccctgcagaaatcaagacgaattagtaggtcgtgcccgtgtaagccagggtgcaggatggagccttcgagaaacagcttgcttaggcaaatcatacgcgcagatgtggcagcttatgtattttcacagacgagacctacgactcgccgccaatgcaatatgttcagctgttccggttgattgggttcccacaagcagaaccacatggtcaatacatgcacatcatcaatggatgacaacagaagatatgttaagcgtttggaatagggtttggattgaggaaaacccttggatggaagacaaaactcacgtttccagctgggaagaagtaccatatcttgggaaaagagaagaccaatggtgcggatcccttataggactaaccgctagggctacttgggctacgaacatccaagtggccattaatcaggtgagacgtttaattggtaacgagaattacttagattatatgacatccatgaaaagatttaagaacgaatctgatcctgaaggagcactatggtaa

SEQ ID NO: 21429 - RNA, 9879 nt, synthetic construct
  misc_feature 1..9879: note = derived and/or modified CDS sequence (opt6) from DENV-1__JN819414__SS-prME
  source 1..9879: mol_type = other RNA
tcagttactatgttgttgatgttattacccaccgcactagcgttccacctcactactcgtggaggtgaaccacatatgattgtatctaaacaagaacggggtaaatcattattatttaaaacatccgctggggtaaatatgtgcacactaatcgctatggacttaggagaattatgcgaagatactatgacctataaatgtcctcgaatcacggaagctgaaccggacgacgtggattgttggtgtaatgcaactgatacgtgggtaacgtatggaacttgttcgcaaacaggagaacaccggagagataagcgatccgtggcactcgcgccgcacgtgggtctcggattagagacgcgaaccgagacatggatgagttctgaaggtgcgtggaagcaaatacagagagtagaaacgtgggcgcttaggcaccccggtttcacagtgatcgccttgtttctagcttatgccattggcacaagtatcacacaaaaaggaataattttcatattacttatgctcgtaacaccaagcatggcaatgagatgcgtaggaataggtaatagagactttgtcgaaggattaagcggggctacatgggttgatgtagtcctggagcatggcagttgtgtaactacaatggcgaaaaataaacccactttagatatagaactcttaaaaactgaagttacaaaccctgcagtattaagaaaattatgtatagaggcgaaaatatcaaataccaccacagatagcagatgcccgacacaaggagaagcgacattggtagaagaacaagacgccaattttgtctgtcggaggacttttgtagataggggatggggaaacggatgtggactttttggcaagggatctctattaacatgtgcaaaattcaaatgcgtaaccaaattggaaggaaaaattgtacaatacgagaatctaaagtattccgttatagtaactgtgcatacgggagatcaacaccaagtaggtaatgagactacagagcatggaaccattgcgaccattacgcctcaagctcctacatctgagatacaactgacggactatggcgcactaacgttagattgttcaccccgcactggattagactttaatgagatggttttactcactatgaaagagaaaagttggctagtacataaacaatggtttctagatctaccactaccatggaccagcggagcctcaaccagtcaagaaacctggaaccgtcaagacttattagtaacatttaagaccgctcacgccaagaaacaggaagtagtagtactaggcagtcaagaaggtgcgatgcatacggcattaactggtgcaactgaaatacagacaagtggcactaccactatttttgctggacatctaaaatgccgtctcaaaatggacaaattgacattgaaaggaatgtcttacgtaatgtgcaccggtagtttcaaattagaaaaggaagtcgccgaaacgcaacacggtacggtacttgttcaagttaagtatgaagggacagacgccccctgtaaaattccattttcaacacaagatgaaaaaggggttactcaaaatggaagactcattacggctaacccgatagtaacagacaaagagaagccagtcaatatcgaaactgaaccgcctttcggagaatcgtacatcgtagttggcgcgggagaaaaggcattaaaactctcatggtttaagaaaggaagtagtatagggaagatgttcgaggcaacggcaagaggcgcacggcgaatggcaattcttggagacactgcttgggacttcggtagtataggaggtgtgttcacgagcgttggaaagttagtccaccaagtgttcggtactgcatacggagtcctcttttctggggtcagttggacaatgaagataggtattggtatcttattgacctggcttggactcaattcaagatcaacttcattgtcaatgacatgtatagctgtcggaatggtgactttatatttgggggtgatggtacaggctgatagtggatgcgtaataaattggaaaggtagagagcttaaatgcggtagtggaatctttgtcacgaatgaagtacacacatggacagaacagtacaaattccaggctgatagtcctaaaagattatccgctgctatcggcaaggcttgggaggagggtgtatgtggaattagaagtgcaactagattagagaacatcatgtggaaacagatatccaatgaattaaaccatattctactagaaaatgacatgaaatttactgttgtagttggagatgcgaatggaatcctcgctcaaggcaagaaaatgattagacctcaacctatggaacataaatatagttggaagtcttggggcaaagctaagataataggagcagatattcaaaatacaactttcattatcgacggacctgataccccagaatgtccagatggtcaacgagcgtggaatatatgggaagttgaagattatggatttggtatctttacaactaatatctggcttaaactcagagattcatatacacagatgtgtgatcataggttgatgtcagccgcaataaaagatagcaaagcagtacatgccgatatgggctactggatagaaagcgagaaaaacgaaacttggaaattagcacgtgcatccttcattgaagtaaaaacatgcacatggcccaaatcccacacactatggtcgaacggtgtacttgagagcgaaatgataatacccaagatttatggagggccgatatcacaacacaattatcgtccagggtacttcacccaaacggcaggcccatggcatctcggaaaattagaactagacttcgatctctgtgagggaacgaccgtagtagtagacgaacattgtggcaaccggggaccttctctgcgtaccaccacagtgacgggaaaaatcatacatgaatggtgctgccggtcctgtacactcccaccactgcgatttagaggtgaagacggatgctggtatggaatggagattcggccagtaaaagaaaaagaagaaaacctagtgcgctcaatggtcagtgcaggttccggggaagttgattctttttcgcttggaatactgtgtgtatcaataatgatagaagaagtaatgagatcccgttggagccgtaaaatgttaatgaccgggacgttggcggtattcttacttctaataatggggcaattaacttggaatgatttaataagattgtgcataatggtaggagcgaatgcctcggaccgaatgggaatgggaactacgtatttagcattgatggcgacattcaaaatgagaccaatgtttgcggttggtcttttattccgaagactaacctctagagaagtcttattattgactatcgggttatcacttgtggcaagcgtcgaactgcccaattccttagaggaactcggagacggcctagctatggggataatgatgctgaaattgttaacagaatttcagccgcatcaactgtggaccacgttactaagccttactttcgtcaaaactacattatcattagactacgcttggaaaacaacagcaatggtattatctatagtttcgctttttccgctatgcctatcaaccacgagtcagaaaacaacatggctaccggtcctactaggatcatttgggtgtaaacctctcaccatgtttttgataacagagaacaaaatttgggggcgaaagtcttggcctttaaatgaaggtataatggcaataggtatcgtctccatattactgtcatcattactaaagaacgatgttcctctagcgggaccccttatagctggtggtatgttaattgcgtgttatgtcatatcgggaagtagtgccgatctattgttagaaaaggctgccgaggtgagttgggagcaagaagctgaacactctggcgcgtcacataatattttggtagaagtgcaagatgatggtacaatgaaaatcaaagatgaagaacgcgacgacactttaacaatactgcttaaagccacattgttagctgtatctggagtctatcctatgtcaatcccggctactctatttgtgtggtatttttggcagaagaagaaacaaagatcaggggttctatgggatactccgagcccacccgaagtagaaagagctgtattagacgatgggatatacagaatactgcaaagggggttattgggtaggtcacaagtgggagttggggtattccaggacggagtgttccatactatgtggcacgtgacccgtggtgctgtactcatgtaccaggggaagcgactcgaaccaagttgggctagcgtcaaaaaggatttaatatcatatggaggagggtggcggtttcaaggatcttggaatactggggaagaagtgcaggtaattgcagttgaaccgggaaagaacccgaaaaatgtacaaactacacctgggacattcaaaacccccgaaggagaggttggagctatagcactggatttcaaacctggtaccagtggaagtccaatagttaatcgagaaggtaaaatagtcggattatatggaaacggtgttgttactacaggaggaacctatgtatccgccatagcccaggcgaaggcaagccaagaagggccactccccgagatagaagacgaagtcttcaagaaacgtaatctaactataatggacctgcatcctggatcaggtaaaacaagaagatacttgccggcgattgtcagagaagcaataaagcgaaaactccgaacactaatcttggctccaaccagagtggttgctagtgaaatggcggaggcattgaaggggatgcctataagatatcaaacaacagcagtaaaaagcgaacatacgggaagagaaattgttgacttgatgtgccatgctacgttcaccatgagacttttatcgcccgttagagtccccaactacaacatgataattatggatgaagcacacttcaccgaccctgcctctatagctgctcgaggatatatctctaccagagtaggtatgggtgaagccgcagcaatatttatgacagctacccctccaggaagtgtcgaagccttcccacagagtaatgccgtgatccaggatgaagaaagagatataccagaacgaagttggaactcaggatatgactggataacagacttcccgggtaaaacggtttggtttgttccgtccataaaatccggaaacgacattgctaactgtctacgtaaaaacggtaaaagggttattcagctatctcggaaaacttttgacacggaatatcagaaaactaaaaataacgactgggattacgtggtaacgacagacatatctgaaatgggagccaactttcgtgcagacagagttatagacccacgtaggtgtctcaaaccagtaattcttaaggacggtccggaacgagttattcttgccgggcccatgcccgtaacagtagccagtgcagcacaaaggagaggacggatagggcgtaaccaaaataaagaaggagaccaatacgtttacatgggacaacccttgaataatgatgaagatcatgcacattggacagaagcaaagatgttgttagacaatataaacacgccggaaggaattataccagccttgtttgaaccagaacgagaaaaatctgctgccatagacggcgagtacagactaagaggagaagctagaaaaacatttgtagagctgatgcgtcgaggggacctaccagtgtggttatcatacaaggtcgcaagcgaaggatttcaatacagcgatagaagatggtgcttcgatggcgaaagaaataaccaagtattagaagagaacatggatgtcgaaatatggaccaaggaaggagaaaggaagaaattacgcccacggtggttagacgcccgaacgtacagtgatccattagcactaagagaatttaaggaatttgcagccggacgccgatcggtctctggagatcttatacttgagattggtaaattaccacaacaccttacactccgtgcccaaaacgcgttagataacttggtaatgctgcataactcagaacaaggtggaaaagcgtacagacatgcgatggaagaacttcctgatactatagaaacattaatgttacttgcattaatagcggtcctaacaggtggagtcacactgttcttcctcagtggtaagggccttggaaaaaccagtattggcttactttgtgtaacggcaagctctgcacttctgtggatggcaagtgtggagccccattggatagcggcgagcattatattggagttctttcttatggtacttttgataccagagcctgacaggcaaagaactccgcaagacaaccaacttgcttatgttgtaattgggctattatttatgattttaacagtggcagctaacgaaatgggtcttttagaaacgacaaagaaagacctaggaatcggatacgtagcagctgaaaatcatcaacatgcaactatgctcgacgttgatctaagacccgcatcagcatggacactctatgcagttgcaactacagtcattacaccaatgatgcgacacacgatagaaaacacaacagcaaacatctcgcttactgctatagcaaatcaagcagcaatcttaatggggcttgacaaagggtggccaatatctaaaatggatattggtgtacctttattggcactgggatgttatagtcaggtcaacccactaacccttaccgctgccgtcctaatgttagtagcacactatgcaataatagggcctggacttcaagcaaaggcaacccgagaagctcaaaaacgtacagcagccgggattatgaaaaacccaacagttgatggaatagtcgcaatagatctagatccagttgtttatgacgcaaaatttgagaaacagctaggacaaataatgttgcttatcttgtgcaccagccaaatattactaatgagaacgacttgggctttatgcgaatctataacattggctacaggaccactaacaacgctgtgggaaggtagtccgggcaaattctggaataccactatagcagtttctatggcgaatatctttcgcgggtcctatttagcaggcgcaggactggcatttagtctgatgaaatcactaggcggaggcaggaggggcactggagcacaaggagaaactcttggcgaaaagtggaaacgacagctcaatcaacttagcaaaagtgagttcaatacttataaaaggtccggtatcatggaggtagacagaagtgaggcgaaagagggtctaaaacgaggagaaactacaaagcatgcagtatctcgaggcacagccaaattacggtggtttgttgagagaaatttagtgaagcctgaagggaaagtaatagacctggggtgtggaagaggaggctggagttactattgtgcgggattgaagaaggttactgaagtaaaaggatacaccaagggcgggccaggacatgaagaacctataccaatggctacgtacgggtggaatttagtaaaattacattcggggaaagacgtgttctttatgcctcctgaaaagtgtgacaccctattgtgcgacattggagaatcttcaccaaatcctactatcgaggagggaaggacactaagagttctaaaaatggtagagccatggttaaagggaaatcaattctgcattaaaatattaaacccttatatgccaagcgttgtggaaacacttgaacaaatgcaaagaaaacatggcggaatgttagttcgaaaccccctatccagaaattcaactcacgagatgtactgggtgagctgtggtactggtaacattgtaagtgcagtaaatatgacaagtcggatgcttcttaatcgattcactatggcgcatcgcaaaccaacatatgaacgagatgtagacttaggtgcaggtaccagacatgtagctgtagaaccagaagttgcaaatttagatataataggacaaaggatagagaatataaagaatgaacacaaaagtacatggcattatgacgaagacaatccgtataagacctgggcgtatcatggaagttacgaggtaaaaccatccggaagtgcgagctctatggtaaatggggtagtacgactacttacaaaaccttgggatgttattcccatggttacacagatagcgatgacagataccacgccatttggacaacagcgcgtgtttaaagaaaaagtagatactcggaccccaagagcgaaacgtgggaccacccaaattatggaagttactgctaaatggctctggggatttctgtcgaggaataagaaacccagaatttgtacgcgcgaagagttcacaaggaaagtacgaagcaatgcagcaatcggagcagtttttgtagatgagaatcagtggaatactgcgaaagaagcggtagaggatgaaagattctgggacttagtgcatagagaaagagaactacataagcaaggaaaatgcgcaacctgtgtttataatatgatgggtaagcgagagaaaaagttaggagagttcggtaaagcgaaaggaagcagagcgatatggtacatgtggttaggagccagattcctagagtttgaggcgttgggatttatgaacgaagaccattggttctccagagaaaattccttatcaggcgtcgaaggcgagggattgcataaattggggtacattctcagagacatctccaaaattcccggcggtaatatgtatgcggacgatacagcaggatgggacacaagaatcaccgaagacgatttacaaaatgaggctaaaataacagacattatggaacccgagcatgccttattagcaacatcgatcttcaaattaacctaccagaataaggtagtaagagtgcaaagaccagccaaaaacggaaccgtgatggacgtgatatcgagacgagatcagcgcggatctggccaagtaggaacttatggtttaaatacgtttaccaatatggaggtgcagttgatacgacagatggagagcgaaggtatattcctacccagtgaattagagacacctaacttggcggaacgtgccttagattggctcgagaaacacggagcagaaagattgaagcggatggcgataagtggagacgattgcgtcgtaaaaccaatagacgaccgtttcgcgaccgctctcacggcgttaaatgatatgggaaaggttagaaaagacattccccaatgggaaccatctaaaggatggaatgattggcaacaagtgcctttttgctcccaccattttcatcagttaataatgaaggacggacgcgaaatcgtcgtcccgtgcaggaaccaggatgagctagtagggagagctagagtaagccagggagcaggttggtcattaagagaaacagcgtgcctaggaaaatcatacgcacaaatgtggcaactgatgtattttcataggcgagacttacgtctcgcggccaacgctatttgtagtgccgtacccgtggattgggtaccgacaagtaggactacttggagcattcacgcacatcaccaatggatgacgacagaagatatgctatcggtttggaatagagtctggattgaagaaaacccatggatggaagataaaacacacgtctctagctgggaagaggtgccatatttaggaaaaagagaagatcagtggtgtggtagtttaattggattaacagctagagcgacatgggctactaatattcaagtagcaataaaccaggtcagacgactaataggaaatgaaaattacctagactatatgacgtcaatgaagagatttaaaaatgagtccgatccagaaggcgctttgtggtaa

SEQ ID NO: 21430 - RNA, 9879 nt, synthetic construct
  misc_feature 1..9879: note = derived and/or modified CDS sequence (opt6) from DENV-1__FJ873810__SS-prME
  source 1..9879: mol_type = other RNA
tcggtgacaatgctattaatgcttctgccgacggcattggcttttcatttaacgacaagaggtggagaaccgcatatgatagtaagtaaacaagaaagaggaaaaagtctattgtttaaaacatccgttggtgtgaatatgtgtacgttaatagccatggatcttggtgaattatgcgaagacactatgacatataaatgtccaagaataactgaagcagaaccggatgatgttgactgctggtgcaatgctactgacacatgggtcacctatgggacgtgctctcaaacaggtgagcatcgacgagagaaaaggagtgttgctttagctccccacgttggcttgggactagaaacaagaacagaaacatggatgtcttctgaaggcgcatggaaacagatacaaagggtagaaacatgggcattacgtcatccaggatttacggtcattgcattctttttagcgcacgcgataggaacttcgataacacagaaaggaataatctttatactgctcatgctcgtgaccccgagtatggctatgagatgtgttggaattggaaatcgcgattttgtagaaggactaagtggggcgacatgggttgatgtagtattagaacatggtagctgcgtaacaactatggccaaaaataaacccaccttagatatagagttattgaaaaccgaggtaacgaatcccgcagtgctcaggaaactctgtatagaggccaagataagcaacactacgacagatagtcgttgccctactcagggagaagcaactttggtcgaagaacaagatgctaattttgtgtgtaggcgcacttttgtggatcggggttggggtaacggatgtggtttatttggtaaagggtctttactaacatgtgcaaaatttaagtgcgtgacaaaactagagggtaaaatagtgcaatatgaaaacctaaagtatagcgtaatcgtaactgtacacactggagatcagcatcaagttggcaatgaaacgacggagcacgggacaatcgccacaatcacgcctcaagcaccaacttcggaaatacaactgaccgattacggcgccctcacgttagactgcagtcctagaacgggtcttgacttcaatgagatggtactactcactatgaaagagaaaagttggctggttcataaacagtggttcctagatttaccattaccatggacgagcggtgcatcaacaagtcaggaaacctggaaccgtcaagatctattagtaacctttaagacagctcatgcaaagaaacaggaagtcgttgtcctgggctctcaagagggtgcgatgcatactgcgcttaccggtgctacagaaattcaaacatccggaacgacaacaatatttgcaggccacttaaaatgtcgtcttaaaatggataaacttaccttaaagggtatgagttatgtcatgtgtacagggtcgtttaagttagagaaagaagttgcagaaacgcaacacggcacggtccttgtccaagtaaagtatgaagggactgatgctccttgtaaaataccgtttagtacacaggacgagaagggagttactcaaaatggtagattaataacggcaaacccaatagtaaccgataaggaaaaaccagtgaacatcgaaactgagcctccgtttggagaaagttatatagttgttggtgccggcgaaaaagcattaaaattgtcatggttcaaaagaggaagttcaataggaaaaatgttcgaagcaaccgcgagaggtgccagaaggatggctattttgggggacacagcttgggattttggtagcataggaggagtatttacaagtgtcggtaaacttgtacatcaggtctttggaactgcatatggagtattattcagtggagtctcatggacaatgaaaataggaataggaattttactaacatggttaggtttgaatagtagaagtacttcgctgagtatgacatgtatagcggtaggtatggtaacactatacctgggggtaatggtacaagcggatagcggatgcgtaattaactggaaaggcagagaattaaaatgtgggtccggaatctttgtcacaaacgaggtacatacctggactgaacaatataagtttcaagcagattcacctaagaggctgtcagcagcgattgggaaagcatgggaggagggggtatgtggtataagatcagcaacgcgcctcgaaaatatcatgtggaaacagataagtaatgaattaaatcatattctactagagaatgacatgaaatttaccgtggtcgtaggtgacgctaatggcatattggcacagggtaaaaagatgattagaccacaaccaatggaacataaatacagttggaaatcatggggaaaagctaagataataggagcagacatacaaaacaccactttcataatcgacgggcctgatactccagaatgtcctgatggtcaacgtgcctggaatatctgggaagtcgaagactatggctttggagtattcacaacgaatatatggctaaaactacgtgactcatacacacagatgtgcgatcacaggttgatgtcagctgcaataaaagacagtaaagcggtccatgcagacatggggtattggattgaaagcgaaaagaatgagacatggaagttagcaagggccagttttatagaagtaaaaacatgtacctggcccaaatcacacactttgtggagtaatggagtattggagagtgaaatgattattcctaagatatacggaggaccaatatcacaacataattatcgcccgggttatttcacacaaaccgccggaccatggcacctaggaaaattagaactagacttcgatttatgcgaaggtacaaccgtggtagtagatgaacattgtgggaatagaggcccgagccttcgcactacaactgttaccggtaagataatccatgaatggtgctgtcgatcatgtactctgccccctttgagatttaggggtgaggatggatgctggtatggaatggaaatccggccagttaaagaaaaagaagaaaatttagtaagaagtatggtttcggcaggaagcggagaagttgacagtttcagcctaggaatactatgtgtaagtataatgatagaagaggtgatgagatcccgatggtctagaaagatgctaatgactggaacgctcgccgtatttttgctgttaattatgggacaactgacatggaacgatcttataaggttatgcataatggtcggagcgaatgcaagtgataggatgggaatgggtaccacttatcttgcactcatggctactttcaaaatgagaccaatgtttgccgtggggttattgtttagaagactaacgtctcgcgaagtattactgctcaccataggcctctctctagttgccagtgtagaactacctaactctttagaagaactcggagatggattagcaatgggcataatgatgttaaaattactaactgaatttcaaccacaccagttatggacaacattattatcccttactttcgttaagaccacattaagcctagattatgcttggaaaactacggcaatggtattatcaatcgtcagcttgttccctctatgcctatcaacaacttcacagaaaacaacttggttgcctgtactattaggctcattcggttgtaaaccattgacaatgtttctaatcacagagaacaaaatctggggaaggaaatcatggccgcttaatgagggtattatggcaatagggatcgtatctattctattgagttcactcttaaagaatgatgtccccttagcaggaccgctaatagctggtggtatgttaattgcatgctatgtaataagtgggagctcagcagatctatccttagagaaagcggctgaagtctcatgggaacaggaggcagaacatagtggcgctagtcataatatattagtggaagtccaagatgacggtacgatgaaaatcaaggatgaagaacgagacgatacgttaaccattttactcaaggcaaccctattagcagttagtggtgtctacccgatgtcgataccagctaccctatttgtatggtatttttggcagaagaagaaacagagaagcggggtcttatgggatacccccagcccacctgaagtagagcgggcggtactagatgatggtatatatagaatactacagcgtggccttcttggcaggtcacaagtaggtgtaggagtcttccaagacggtgtcttccacacaatgtggcatgtaaccagaggtgctgttctaatgtatcaaggaaaaagactcgaaccttcatgggcgtctgttaagaaagacttaatatcttatggagggggatggagatttcagggaagctggaatacgggagaagaagtgcaagttatagcagtggaaccgggtaaaaatcccaaaaatgtccaaaccaccccaggaacatttaaaacgccagaaggagaagtaggtgcaattgctttggacttcaaacctggaacttctggatcaccaatagtaaatcgtgagggtaagatagtaggtctttatggcaacggtgtggtcacaacgtcagggacctacgtaagtgcaattgcccaagcaaaagcctcacaagagggtcctttacctgaaattgaggatgaggtatttaagaaaagaaatttaacaataatggatttacatcctggatctggaaaaaccagaagatacctacccgcaatagtgagagaggcaattaagagaaaattacgaactttaatccttgctccgacaagagtggttgcatcagaaatggccgaagcattaaagggaatgccgatacgataccaaacaacagccgtgaaatcagagcatacaggtcgagagattgttgacttgatgtgccatgcaacctttacaatgcgactattgagcccagtgagggttccgaactataacatgattattatggacgaagcacactttacagatccagccagtatagcagcgaggggttatataagtactagggttgggatgggcgaagcggctgccattttcatgacagcaacaccgcccggctccgtagaggctttcccacagtcgaacgcagtaattcaagatgaagaaagggatataccagaacgttcctggaactctggatatgattggatcactgatttccctggcaaaaccgtatggtttgtaccatccataaaatctggaaatgacatagctaattgtttgaggaaaaacggaaaaagggtaattcaattatcacgaaaaacgtttgacacagaataccagaaaactaaaaataacgattgggactacgtagtaacaacagatatatccgaaatgggtgcgaatttccgagctgatcgcgttatagatcctaggaggtgcttaaaacctgtcatactaaaagacggtccagagagagtaatactagctggaccaatgcccgtaaccgtggcgtcagcagcccaacggcgaggccgtataggaaggaaccaaaacaaagagggagatcaatacgtttatatgggacaacccttaaataacgatgaagatcacgcccactggacagaggcaaaaatgctactagacaacataaatacacctgaaggaatcatacctgccctatttgaacctgaacgagaaaaatctgctgcaatagatggtgagtacagattacgaggagaagctcgaaaaacgttcgtcgaactaatgaggagaggtgatcttcccgtatggctatcttataaggtggctagcgaaggattccaatattcagatcgtcgatggtgttttgatggagaaaggaacaaccaagtactcgaagaaaatatggatgtcgaaatctggacaaaagaaggagaacggaagaaacttcgcccacgctggctagatgcacgaacatattctgatccattagcacttcgagagttcaaagaatttgcagctggccgaagaagtgtatcgggtgacctaatacttgaaataggaaaactaccgcaacatttgactttacgtgcacaaaacgcattggacaatctcgtgatgctacacaacagtgaacaaggaggtaaagcgtacagacatgcaatggaagaactacccgatacaatagaaacccttatgttacttgcgcttattgccgtactgactggcggggttacactattctttttgtctggtaaaggtctcgggaagaccagcattgggctactatgtgtcaccgcatcatcagctctattatggatggcttccgtggagccacattggattgcggcatcgataattttggagttctttctaatggttttactaatccctgagccagacagacaaagaactccccaagacaatcaattagcatatgtagttataggattattatttatgattttaaccgtggctgccaatgaaatgggcttactagagactacaaagaaagacctaggcattgggtatgtagctgctgagaaccaccagcatgcaactatgttagatgtagacttacaccccgcctcggcctggactctttacgcagtcgcaacgacggtaataacacctatgatgaggcatacaatcgaaaatacgacggctaatataagcctaacagccatcgccaaccaggcagcaatattgatggggttagataaagggtggccaatatctaagatggacataggcgtaccactgttagcattaggatgttattcacaagtgaatccactcactttaactgcagccgtactgatgctcgtggctcattacgcaatcataggaccaggcctacaagcaaaagctaccagagaggctcagaaacgtacggctgcgggcataatgaaaaatcctaccgtagacggtatagtagcaatcgacctagaccctgtagtatatgacgccaaatttgaaaaacaactcggacaaatcatgttattaatcctgtgcacaagccaaatacttttaatgagaacgacttgggccctgtgtgaaagcataactctagctacaggtcctttgacaaccctatgggaaggtagtccaggcaagttttggaataccacaattgcagtctcaatggcaaacatatttcgtggtagttatctagcaggcgcaggactagcatttagtttgatgaaatcccttgggggcggtcgtcgaggtactggagctcaaggcgaaacgctaggagaaaagtggaagagacagcttaatcaactatcgaaaagcgaatttaatacatacaaaaggagtggaataatggaggtagatcgaagtgaggcaaaagaaggattaaaacgcggtgagactacaaaacatgcagtatccagaggaacggccaagttaagatggtttgtagaaaggaacctagtaaagccggaggggaaagttatagacctaggatgcggcagaggtggctggagctattattgcgctggtctgaagaaagtaactgaagttaagggatatacaaaaggtggaccaggacacgaagaacctatacctatggcaacttacggatggaacctagtaaaattgcactcaggaaaagatgtattctttatgcccccggaaaagtgtgatacgctattatgtgatattggagaatcaagtccgaacccgacgatcgaagaaggcagaaccctcagggtgttaaaaatggtagagccttggttacgaggtaatcaattctgtataaaaattttaaatccatatatgccgtcggtcgtcgaaacgttagaacaaatgcaaagaaaacatggtgggatgcttgtaagaaaccctttaagccgtaattctacacatgagatgtactgggtttcctgcggaacgggcaatatagttagtgcagtaaatatgaccagccgaatgctcctcaatagatttacgatggctcaccgaaagcccacatacgagcgggatgttgatctaggtgctggcacacgacatgttgcagtcgagccagaagttgccaacctagatatcatcgggcagagaattgaaaatatcaaaaacgaacataaaagtacttggcactacgatgaggataacccgtataaaacatgggcataccatggatcttatgaagtgaaaccaagtggaagtgcaagtagcatggttaacggtgtggtaagactacttacaaagccttgggatgtaatccccatggtaacgcagattgccatgacagatacgacccctttcggacaacaacgagtctttaaagagaaagttgacactaggactccccgagccaaacgcggcacgacacaaatcatggaggtaacggctaaatggctctggggatttttatcaagaaataagaaaccaagaatctgcacacgtgaggaatttaccagaaaagtgcgatctaacgcggctattggagccgtttttgttgatgaaaatcaatggaactcagctaaagaagcagtagaggatgaaagattctgggatctggtgcatagggaaagggaactacacaagcaaggcaagtgtgcaacatgtgtgtacaatatgatgggaaaaagggaaaagaagctcggagaatttggaaaagcaaaagggagccgggccatatggtacatgtggctcggagccaggtttttagaatttgaggctttaggattcatgaatgaagaccattggttttctagagagaatagtttatcaggagtcgaaggcgaaggtctacataaattaggatacatattgcgtgatatcagtaaaataccaggaggaaatatgtatgccgatgacactgcaggttgggacacccgtatcacggaagatgaccttcagaacgaagcaaaaataacagatattatggagccagaacacgccctgttagccactagcatatttaaacttacttatcaaaataaagtagttagagtacaaagacccgccaaaaacggtacagtaatggacgtgatttccagaagagatcaaagaggctcaggccaagtaggaacctatggtctcaatacatttacaaacatggaagtccagctaatacggcaaatggaatcagaaggtatatttttgccctcagaattagaaacacccaatcttgctgaaagagcattagactggctagaaaagcacggtgctgaaaggttaaagaggatggccatcagtggagacgactgtgttgttaaaccgattgatgataggttcgctacagcgttaacagctttaaacgatatgggtaaagtacggaaagacataccgcaatgggaaccatcgaaggggtggaacgattggcaacaagtacccttttgtagccatcatttccaccagcttataatgaaagacggtcgagaaattgttgtaccttgtcgcaaccaagatgagttagtaggcagagctagggtctcgcaaggagccggatggtctttacgggaaactgcttgcctcggcaaatcatatgcgcaaatgtggcagttgatgtattttcatcgacgggatctccgtctagctgctaatgctatctgttcagccgtcccagtggactgggtccctacatcaagaacaacgtggtcgatccacgcacatcatcagtggatgacgactgaagatatgctatcagtttggaatcgtgtgtggattgaagagaacccttggatggaggacaagacacacgtaagtagttgggaagaggttccatatcttggaaaacgagaagatcaatggtgtggaagcctaattggccttacggcacgagcaacctgggctactaacatacaggtagcaataaatcaagtacgacgattaataggaaatgaaaattacttagattacatgacctccatgaaacgtttcaagaatgagtctgacccagaaggcgcactttggtaa

SEQ ID NO: 21431 - RNA, 9879 nt, synthetic construct
  misc_feature 1..9879: note = derived and/or modified CDS sequence (opt6) from DENV-1__FJ850103__SS-prME
  source 1..9879: mol_type = other RNA
tcggttacgatgctacttatgttattaccgactgctttagcatttcacctaaccactaggggaggtgaaccccacatgattgtaagcaaacaagaacgtggcaaatcattactctttaaaacttctgctggagtaaatatgtgtactttaatagcgatggatctcggcgaattgtgcgaagacacgatgacttataaatgtcctagaataactgaagccgaaccggacgatgtcgattgctggtgtaatgcgactgatacctgggtaacttatggaacatgcagccaaactggagaacaccgtcgagaaaaacgatcagtagcactcgcacctcacgtaggattaggacttgaaactagaactgaaacttggatgagtagcgaaggtgcttggaaacaaatacaaagggtggaaacatgggcacttcgacacccaggcttcacggtaatagcattctttctggcccatgctataggaacaagcataactcaaaaaggtatcatctttatattgctcatgctagtaacaccatctatggctatgagatgcgtaggaataggcaatagagattttgtagagggtttatcgggcgcgacatgggtagacgtcgtactagagcatggaagttgcgtaacaactatggccaaaaacaaaccaactctagatatcgaattattaaaaacagaagtcactaatccggcagtcttacggaaattatgtattgaggcaaaaataagcaacaccacgacggattcaagatgtcccacacaaggagaagctacattggtagaagaacaagacgcaaattttgtctgtagaaggacattcgttgataggggatggggaaacggatgtggactgtttggaaaaggatccctattaacttgcgccaaattcaaatgcgtaactaaattagaggggaaaatagtacagtacgaaaatttaaagtattctgttatagttacagtacacacaggagatcaacaccaggttggaaatgagaccactgaacacggtaccatagccaccattacacctcaagctcctacttcagaaatacaactcacagattatggagcattaactctcgactgttcgccaagaacaggtctcgatttcaatgagatggtccttttaacaatgaaagaaaaatcctggctagtccacaaacagtggttcttagacttgccattaccatggacgagtggcgcaagtacttctcaagagacatggaatagacaagatctcctcgtaacttttaagactgcacacgcgaagaaacaagaagttgtagtactaggttcgcaagagggcgcaatgcatacagcactgacaggagctacagaaatccaaacatccggtaccacaacaatatttgccggacacttaaaatgtagattgaaaatggataaactgacattaaagggtatgtcatatgtcatgtgtactggatcatttaaactggaaaaagaagtggctgaaacacaacatggtacagtattagtgcaggttaagtatgaaggcacagatgcgccctgtaaaattccgttctccacccaggatgagaagggggttacccagaatgggcgtttaattacagctaatccgatagtcaccgataaagaaaaaccagttaatatagaaactgaaccgcccttcggggaatcatacatcgtcgtaggagccggtgaaaaagcgttgaaactttcttggttcaaacgtggaagctcaatagggaagatgtttgaagccaccgcgagaggagctagacgaatggcgatactgggtgatacggcctgggatttcggaagcattggtggcgtgtttactagcgtaggcaagttggtacaccaagtatttggcactgcctacggagtattgttctcaggagtatcctggacaatgaagataggaatcggaatacttctaacgtggctagggttaaattcgagatcaacatcattgtcgatgacttgcattgcagtaggaatggtcacattatacctaggggtcatggtacaagctgactctggatgtgtgatcaattggaaggggagagaactaaagtgcggaagcggtatctttgtcacaaacgaagtgcacacgtggactgaacaatataagttccaagctgatagtcctaagcgactaagcgccgcgatcggcaaggcgtgggaagaaggagtttgcgggattagaagcgctactcgactcgaaaatattatgtggaaacagataagcaatgaattaaaccatatactactcgaaaatgatatgaaatttaccgtcgtagtaggcgatgcaaacggaatcttagcacaaggtaagaaaatgatacgtccgcaaccaatggaacataaatacagctggaaatcgtggggtaaagcaaagataatcggggccgatatccagaacacgacatttataatagatggtccggataccccagaatgtcccgatgggcaacgagcgtggaatatatgggaagtagaagattatggatttggggtctttacaacaaacatatggctcaaattacgtgacagctatacacaaatgtgcgaccacagactgatgtcggcggcgattaaagactcgaaagctgtgcatgctgacatgggctattggattgaaagtgagaaaaatgagacatggaaattagcaagagcaagttttatagaggtgaaaacgtgcatttggcctaaaagccatacgttgtggtcaaacggagttctagaaagtgaaatgattattcccaagatatatggaggaccaatatcacaacataattaccgaccgggctatttcacacaaacagcaggaccatggcatctcggaaaactagaattagacttcgatctatgcgaaggaactacggtggttgtagacgaacactgcggcaacagaggaccctctcttcggacaacgactgtcacgggaaagatcatacacgaatggtgctgtagatcttgtaccctcccgccattacgtttcagaggggaagatgggtgctggtatggtatggaaattagacctgttaaagaaaaggaagagaacttagtcaggtcaatggtcagtgccggaagcggagaggtcgactcattcagtttaggtattttatgtgtaagtataatgatagaagaagtgatgagaagtcgctggtcccgaaaaatgttaatgacaggtacactagccgtgttcttattactaattatgggacaactaacgtggaacgatctgattcgattatgcataatggtgggcgcaaatgcaagcgatagaatgggcatgggtactacatatctggcattaatggcgacatttaaaatgagaccaatgtttgcagtcggcttgttatttcgtcgattaacaagtcgcgaagtgttattactaacaattggattaagccttgtagcatccgtcgaattaccaaattcccttgaagaattaggagatggtttagctatgggtataatgatgttaaagttgttaacagagtttcaacctcaccagttatggacaacattattaagcctcacattcgttaagactacattatcattggattacgcttggaaaacaaccgctatggttttatcgatagtgagtttgtttccactttgtctctcaacgacaagtcagaaaacgacatggctaccagttcttctcggttccttcggatgtaaacctttgactatgtttttgatcactgaaaacaaaatatggggaagaaaatcttggcccctaaacgagggtataatggctataggtatagtaagtatattgttaagttctcttcttaaaaatgatgttcccttagcaggtccgctaatagcagggggaatgttaattgcgtgctacgtaatatcgggatcttcagctgatttatctttggaaaaagctgcggaagtgtcctgggagcaagaagcagagcactcaggagctagccacaatatacttgtagaggttcaagacgatgggaccatgaaaataaaagatgaagaaagggatgacacacttacaatactcctaaaagcaacattattagcagtgtctggggtataccctatgtctatacccgcaacattatttgtatggtacttttggcaaaagaagaaacaacgaagcggggttctgtgggacacgcctagtccaccagaagtagaacgcgcagttctagatgatggtatttatcgtatcctgcaacgtggactcctgggaaggtcacaagttggagtcggagtgtttcaggatggtgtcttccatacgatgtggcatgtaactagaggggctgttctaatgtaccaaggtaaacggctagaaccttcatgggcaagcgtcaagaaagatttaatatcatatggtggagggtggcgattccagggatcttggaacacgggtgaagaagttcaagtgatagcagttgaacctgggaaaaacccaaagaacgttcagacaacacctgggactttcaaaacgccagaaggggaagtaggcgccatagcgcttgatttcaaaccaggtacaagtggctcgccaattgtaaatcgtgaagggaaaattgtaggactatacggcaacggagtggtgactacatccggaacttatgtgagcgcgatagctcaagcaaaggcttcgcaggaaggacctctgcctgaaatagaggatgaagtatttaagaaacgaaatttgacaatcatggatctacatccgggttcgggcaaaacaagaagatacttgccagcaatagtcagggaatcgattaaaaggaaacttaggacattaattctggcaccgaccagagtcgtggcatcagaaatggcggaggcgttgaaaggtatgccgataagatatcagactacggctgtcaaatcagagcatacaggccgcgaaatcgtagatttaatgtgtcatgcaacgtttactatgagattgttatcgcccgtgcgagttccaaactacaatatgataataatggatgaggcacactttactgaccctgcttctatcgcagcccgaggatatattagtacaagagtaggcatgggcgaagcagcagcaatatttatgacagctaccccacccggaagtgtagaagcgttcccacaaagtaacgcagtaatacaggacgaagaaagggatataccagagaggtcatggaactcgggatatgactggataacggacttccctggtaaaacagtttggtttgtcccctctataaaaagtgggaacgatattgcgaactgtttaaggaaaaacggtaagagagtgattcaactgagtagaaaaaccttcgataccgaatatcagaaaaccaagaacaatgattgggactatgtcgttactactgatatcagtgaaatgggtgctaatttcagggcagatagagtcatagatccccgtcggtgtttaaagcctgtcatactaaaggacggcccagaaagagtaatactagccggacctatgccagtaacagttgcatcagctgcccaacgaaggggtcgaatcggaaggaaccaaaacaaggaaggcgatcagtatgtatatatggggcagccacttaataatgatgaggatcatgcacattggaccgaagccaagatgcttttagataatataaatactcctgaaggcataataccggcactctttgagcccgaaagggaaaaatccgctgccatagatggagagtataggcttcggggagaagcacgtaaaacattcgtggaattaatgcgacggggagacttacccgtttggctctcctacaaagtagcaagtgagggctttcaatattcggataggagatggtgcttcgatggagaacgcaataatcaggttttggaagagaacatggacgtagagatttggacaaaggaaggcgaacgaaagaaacttcgaccccgatggttagatgctcgaacgtattcagatccattagcacttagagagttcaaagagtttgcggcaggcagaagaagtgtctcaggagatctaatcttggaaataggaaagctaccacaacatcttactctgagagctcaaaatgcactggacaatcttgttatgcttcataacagcgagcaaggaggtaaagcatatagacatgctatggaggaattgcctgatacaattgaaacattaatgcttttagcactcatagcagtcttaacgggaggtgtaacacttttctttttatcaggaaaaggtctgggaaaaacatccataggcttattatgcgtcacggcttccagtgcactgttatggatggcaagcgtagagccacattggatagcagcatcgataatattagagttctttctgatggtactcctaattccggaaccagataggcaaaggacaccacaggataatcaattagcgtatgtagtaatcggccttctgtttatgatcttgaccgtcgctgcaaacgaaatggggcttttagaaaccactaagaaagacctgggtatcggatatgtagctgcagagaatcatcaacatgcaaccatgcttgacgtcgaccttcacccagcaagtgcctggactttatatgctgtggctacaactgttatcactccaatgatgaggcataccatagagaatactacagcaaatatctcattaaccgccattgcaaatcaagcagcaattctgatgggtctggataaaggttggcccatttctaagatggacattggagtaccattgcttgcgttggggtgctacagccaagttaatcctcttactctcacagcagccgtgttaatgctagttgcacattacgctattatcggcccagggttacaagcgaaggcaacaagagaagcacaaaaacgaaccgcagctggcataatgaaaaacccaacggttgatggtatagtagctatcgatctagatcccgtggtatatgatgcaaaatttgaaaaacaactaggtcaaataatgttattaatattgtgcacatcacagatactgttgatgcgaacaacttgggcgctttgtgaaagtatcactttggccacgggacctctcactactttatgggaaggatcgcccggcaaattttggaatactactattgccgtgtctatggcaaacatcttcagaggatcatacctggctggcgcaggtctggctttttcactgatgaagtcattaggtggtggcaggagaggcactggcgcacaaggagaaacactaggagaaaaatggaaaaggcagctaaaccaattatctaaatctgaatttaacacatataaaagaagcggtataatggaagttgatcgatccgaagcaaaagaaggtctgaaaagaggtgaaacaacaaaacatgcagtatcaagagggacagccaagctccgatggttcgtagaaagaaatctagtaaagcccgaaggtaaagtaatagaccttggctgtggcagaggcggatggtcatattactgcgcaggtttaaagaaagtgaccgaagtaaaaggatacacgaaaggaggaccaggacacgaagaaccgataccgatggctacctatggttggaatctggtcaaactgcatagtgggaaagacgtctttttcatgcccccagagaaatgcgatacgttgctctgtgacattggggaaagctcaccaaatccaactatcgaagagggaaggacgctaagagtattaaaaatggtggagccatggttacggggaaatcaattttgcatcaagattttaaatccctacatgcccagcgttgttgagactctcgaacaaatgcaaagaaaacatggtggaatgctcgtacgaaatcccttaagccgaaacagtactcacgagatgtactgggtcagctgcggaacaggcaatatagtatcagctgtcaatatgactagcagaatgttattgaaccgatttactatggcacatagaaaacccacatacgagagagacgtagacttgggagctggtacccgacacgttgcagtagaaccagaagtggcaaatctggatataattggccaaaggatcgaaaatattaaaaacgagcataaaagcacatggcattatgacgaagataatccttataaaacttgggcctatcacgggtcctacgaagtgaagccatcagggtcagctagttcaatggtaaacggtgtagttaaattactcacaaaaccgtgggatgtgataccaatggttactcaaatcgcaatgactgacacaactccattcggtcagcagcgggtgttcaaagaaaaagtggatacacggacaccgagagcaaagcgtggaacaactcagattatggaggttacagctaaatggttgtgggggtttctaagtcgaaataagaaaccacgaatctgtacacgcgaggagttcaccagaaaggttaggtcaaatgctgcgattggtgcagtctttgtagacgagaatcagtggaactcagctaaagaggctgtggaagacgaacgcttttgggatcttgtgcatagagaaagagaactacataaacagggtaagtgtgcaacgtgtgtttataatatgatgggtaaacgcgagaagaaactcggggagttcggaaaagcgaaaggatctagagcaatttggtatatgtggttgggagcaagattcttagagtttgaagcattaggttttatgaacgaagaccattggttttctagagaaaattcactatctggggtggaaggtgaaggtttacataagctgggatacatcttaagagatataagcaaaataccagggggaaacatgtatgcagatgatacagccgggtgggatactcgaataacagaagacgatttacaaaatgaagctaaaatcaccgatatcatggaaccagaacatgcattattagctaccagtattttcaagctgacatatcagaacaaagtggtacgagtacaacgtccagccaaaaatggaactgtgatggatgtgattagcagacgagatcaaagaggatctggacaagtcggaacatacggcttgaatacgttcacgaacatggaagttcagttaattaggcagatggaatcagaagggatattcttgccctcagagttggaaacacctaatctcgcagagcgtgctttagactggttagaaaagcacggcgcagaacgtctaaaaaggatggcgatatcaggagatgactgtgtagttaaacccatcgacgatagatttgccaccgctctaacagctctcaacgatatgggcaaagtcagaaaggacataccccaatgggaacctagtaagggctggaatgattggcaacaagttccattctgcagccatcattttcatcaattaataatgaaagacgggagagaaatagtggttccttgcagaaatcaagatgagctagtaggacgagcaagagtcagccaaggagcgggttggagtttgagagaaactgcatgtttgggaaaatcatatgcacagatgtggcaactaatgtatttccacagacgagacttacgccttgcagctaacgccatatgctcagctgttccagtggactgggtcccgacgagtaggacaacttggagcatacatgcacatcatcaatggatgacgacagaagatatgctgagtgtgtggaatagagtatggatcgaagaaaatccttggatggaggacaagacccatgtatcatcatgggaagaagtgccttatttaggaaaaagggaggaccaatggtgtgggagtttaataggattaaccgctcgagctacttgggcaacaaatatacaggttgcgatcaaccaagtaagacgattgataggcaacgaaaattatctggattacatgacaagtatgaagaggtttaagaatgagagcgatcccgaaggagccctttggtaa

SEQ ID NO: 21432 - RNA, 9879 nt, synthetic construct
  misc_feature 1..9879: note = derived and/or modified CDS sequence (opt6) from DENV-1__FJ850104__SS-prME
  source 1..9879: mol_type = other RNA
tcagtgactatgttattgatgttactacccacggccctagctttccatttaactacaagaggtggggaaccacatatgatcgtgagtaaacaagaaaggggaaagagcttactttttaaaacgagtgcaggagtaaatatgtgtaccctaatagccatggatcttggtgaattgtgtgaagatacaatgacttacaaatgcccaagaataaccgaagcagaaccagatgatgttgattgctggtgcaatgtcactgatacttgggtaacatacggaacatgttcccaaacaggcgaacataggcgagataaacgatctgtcgccctcgcaccgcatgtaggactagggctagaaacgagaacagaaacttggatgtccagtgaaggtgcatggaaacaaattcaacgcgtagaaacttgggccttacgacacccaggatttacagtaatagcactatttttagcacatgcaatcggaacatcgataacacaaaaagggatcatcttcatactgctcatgctcgttactccgtcgatggcgatgagatgtgtaggaataggaaatagagacttcgtagaaggtctgtctggagcgacctgggttgatgttgtcttagaacatggcagctgcgtcacaacgatggcgaaaaataaaccgacattagatatcgaattgttgaaaacggaagttacgaatcctgctgtactcaggaaactttgtatagaagcgaaaatatcaaacacaacaactgatagtcgatgtcctacacaaggggaggctacgttggtagaggaacaagacgcaaatttcgtgtgccgaaggactttcgttgatcgcggttgggggaacggatgtggactctttggaaaaggatcgttgctaacctgcgctaaatttaagtgtgtaactaaattagaaggtaaaatagttcaatacgagaacctaaaatatagtgttatagtaacggtacacacaggagaccaacaccaagttggaaacgaaactaccgaacacggaacaattgcaacaattactccacaagcgcctacgtctgaaatacaattgactgattatggggctctgacccttgattgctcgccacggaccggactagacttcaacgaaatggtcttacttactatgaaagagaaaagctggctagttcacaaacaatggtttttagacctcccattaccatggacaagtggagcttctacatcacaagaaacatggaatcgacaagacttattagtcacatttaaaacagcacacgcaaagaaacaagaagtagtcgtactgggttcacaagaaggcgcaatgcatacagcattaacgggagccacagaaatacaaacgtcaggaactacaactatatttgcagggcacttaaaatgtcgtctcaagatggataaattaacgttaaagggcatgtcttatgtaatgtgcactggatcgttcaaacttgaaaaagaagttgcggaaacgcaacatgggactgtactcgttcaagtcaaatacgagggtacagatgctccatgtaaaattcccttttccacgcaagatgaaaaaggagtcacacaaaatggacgactcatcacagctaatcctattgtaacagataaagaaaaaccagtaaatattgaaacagagccaccgtttggcgagtcctatatagtagtgggcgccggtgagaaagcgttaaaactctcatggttcaagaaaggtagttcaattgggaaaatgtttgaggcaacagcaagaggagcccgccgaatggctatacttggcgatacagcttgggacttcggttcaatcggaggagtattcacctctgtaggaaaacttgtgcaccaagtattcgggactgcatatggtgtgttattctcaggcgtcagttggacaatgaaaataggtataggaatattactgacgtggcttgggttaaactcgagatccacaagtctttctatgacttgtatagctgtcggaatggttacattatacctcggggtaatggtacaagcagacagtggatgtgttataaactggaaaggccgcgaactaaaatgtggaagcggtatatttgtcacaaacgaggtgcatacatggactgaacaatacaagtttcaagctgacagtccaaaacgattgtcggctgcgatcggcaaggcctgggaagaaggtgtgtgtggaatcagaagcgctacacgtttagagaacataatgtggaaacaaatcagcaatgaactcaatcacatattacttgaaaatgatatgaaattcactgtagtagtcggcgacgctaatggtatacttgcacaaggtaaaaagatgattaggcctcaaccaatggaacataaatattcatggaaaagttggggtaaagccaaaataatcggtgcagatatccaaaacactactttcataatagatggacctgatactcctgaatgtcctgatggacaacgagcttggaacatatgggaggtcgaagattatgggtttggaatattcacaactaacatatggttaaaactcagagattcatacactcaaatgtgcgaccatcgattaatgagcgccgcaattaaagacagtaaagcggtgcacgcagatatgggatattggattgaaagtgagaaaaatgagacatggaagttggcgagagcttcttttatagaagtaaaaacttgtacttggccaaaatcacacacgttgtggtcaaatggcgtcctagaaagtgaaatgattatcccaaaaatctacggaggaccgatctcgcagcacaatcatagaccgggatactttacacagacagcaggtccatggcatctcgggaaattagaactagatttcgacctctgcgagggaaccactgtagtagtagacgaacattgtggaaacagagggccatccttgaggacaactactgtaacaggaaagatcatccacgaatggtgctgcagatcgtgtactctcccaccattaagatttcgtggagaggacggttgctggtatggtatggaaataaggccagtaaaggaaaaggaagaaaaccttgttagatcgatggtatctgcgggctccggcgaagtagattcattcagtcttggtattctgtgtgtgagcataatgattgaagaagtaatgagaagtaggtggagtcgcaaaatgctaatgaccggtactctagcagtatttttacttttgataatggggcaacttacctggaatgacctaatcagactctgcatcatggtaggtgcaaatgcgtctgataggatgggcatgggaacaacttatctagccttaatggcaactttcaaaatgagaccgatgttcgctgttggacttctgttcagaagattaacgagtagggaagtattgttactcacaataggattgagtttagttgcatccgttgaattacctaatagtctagaagaactaggggacggtttagcaatggggattatgatgttaaaacttttaacagagtttcagccgcaccagttatggaccacacttttatcgttgacttttgtgaaaacaactcttagcttagattacgcatggaaaactacagctatggttctaagtattgtatcactattccctttatgtttatcaacaacttcgcagaaaactacttggctgccagtattacttgggtctttcggttgtaagccattgacaatgttcctcataacagaaaacaagatatggggtcggaaatcttggcccctcaacgaggggattatggccataggaattgtatcgatattactaagtagtctactcaaaaatgatgttccattagcaggacctcttattgcagggggcatgttaatcgcctgttacgtgatttcgggctccagcgctgatttatctcttgaaaaagcagcagaggtctcatgggaacaagaagccgagcacagtggagcctcccacaacatcttagttgaagtgcaggatgatggtacgatgaaaatcaaagacgaagaacgagatgatacgctcaccatactactaaaggcgacactattagctgttagtggggtctatcccatgtcaattcctgcaacgctattcgtatggtatttctggcagaagaagaaacaaagaagcggagtattatgggatacaccatcccctcccgaagttgaacgagccgtactcgatgatggaatatatagaatcctccaacgaggacttctgggacgttcacaagtgggcgtcggagtttttcaagacggagtattccatacaatgtggcacgtcacaagaggcgcagtactcatgtatcagggaaaaagattagaacctagctgggcaagcgtcaagaaagatttgatatcgtatggaggtggttggcggttccaaggtagttggaatactggtgaagaagttcaagtaatcgctgttgaaccaggaaagaatcccaaaaatgtccaaacaacaccgggcacattcaagacaccggaaggtgaggttggagcgattgctctcgattttaaacctggaacatctggatctccaattgtaaaccgcgaaggaaaaatagtgggtttgtatggaaacggcgtcgtaaccacgtcagggacttatgtatctgctatagcccaagccaaagcaagccaagaaggaccattgccggaaatagaagatgaagtgtttaagaaaaggaatctgacaatcatggaccttcatccaggaagcggaaaaacgaggagatacctacccgcaatagtaagagaagcaatcaaacggaaacttcgaacattgatactagccccaaccagagtagtcgcaagtgaaatggcggaagcactaaaaggcatgccgataaggtatcaaaccacagctgtaaagtcagaacatactggaagagaaatagtagatctaatgtgccacgcaacgttcacaatgagactgctatcacccgtccgtgtgcccaattataacatgattatcatggatgaagcacactttacagatcctgcctctatagcagcccgtggatatataagtactcgagttgggatgggtgaagcagcggccatatttatgacggctactcctcctggaagtgtggaggcatttcctcaatcaaacgcagtaatacaagacgaagaacgagacattcctgagagaagttggaactctggatatgattggataacagattttccaggtaaaacagtatggttcgtgccatcaatcaaaagtgggaatgacatagccaattgtctcaggaaaaacggaaaacgtgtaattcagttatcacgaaagacattcgatactgaatatcaaaagaccaaaaataatgactgggactacgtagttacaactgacatcagtgaaatgggcgcgaatttccgagctgatcgggtaatagatcctagacgatgtctcaagccagttatcttaaaagacggacctgaaagagttatattagctggaccaatgccggtaacagtagcatcagcggcacagagaagaggtcggattggtagaaaccagaataaagaaggcgaccaatacgtttacatgggacagccccttaataacgacgaagatcatgcacattggactgaggccaaaatgttactcgataatattaatacaccagaaggcattatcccagcattatttgagcccgagagggagaagtctgcagctatcgatggtgaatatcgtttacgtggagaggcaagaaaaacattcgtagagcttatgagacgcggcgatctaccggtatggctcagttataaagtagcatcagaaggattccaatattcggatcggagatggtgtttcgacggcgaacgcaacaaccaagtactcgaagaaaacatggacgttgaaatatggacaaaggaaggcgaaagaaagaagttgagaccaaggtggctggatgccaggacgtatagtgatccattagcactgagagagttcaaagagttcgcggccggtcggcgttcagtttctggggacttaattctggaaattggcaagttgcctcaacacttaacgctaagggcacagaatgcgctggataacctagtaatgcttcacaactcagaacagggtgggaaggcatacagacatgcgatggaagaattaccggacactattgagactctcatgttactggccttaatagctgtcttgacaggtggtgtcacactcttctttctttcaggcaaagggttgggtaagacaagtatcggactgttatgcgtcacagcatcatctgctttactttggatggcaagcgtagaaccccattggatagccgcatcaataatcctggagttctttcttatggtcctgctgattccagaacctgatagacagagaacacctcaagacaatcagctagcttacgttgtcataggactactattcatgatcttgactgtagctgccaatgaaatgggcttactcgagacgactaagaaagatctcggaatcggctacgtagcagcggagaatcaccaacatgcaacgatgctagatgtggacttaagaccggcatcagcctggacattgtacgcagtagcaaccacagtaattactcctatgatgaggcacacaatcgaaaacacgacagccaatataagtttaacggcgattgccaatcaagcagcaatattgatgggcctggataaagggtggcctatatctaagatggatattggagttcccttattagcgttgggctgttacagtcaagtaaatccgctcacccttactgcagcagttctaatgctggttgctcactacgcaattattggccccggactccaggctaaggcaaccagagaagcccagaaaagaacagcggcaggaataatgaagaatccaaccgtagatggtatagtcgccatagacttggatccagtagtctatgatgcaaagttcgaaaaacagctcggccaaattatgttactaatattatgcacatctcaaattctcttaatgaggactacatgggcattatgtgaatcaattacactagcaactggaccactaacgaccctctgggaaggttcccccggaaaattctggaacaccacaatagcagtttccatggcgaacattttccgaggaagctacttagcaggagcgggtctggcattttcattaatgaaaagcctgggaggaggacggagaggcacaggcgcccaaggagaaacattaggcgaaaaatggaaaagacagctcaaccagcttagtaaatcagaatttaatacgtataaaaggtcaggaataatggaggtagataggtcggaagccaaagaaggtctaaaacgaggtgagacgacaaaacatgcagtgagtagaggaacagccaaactaaggtggtttgttgaacgtaatttggtcaaacctgaaggaaaagtgatagacttgggctgtggtaggggtggctggtcatattattgtgcagggctgaagaaagtcactgaagtaaagggatatacaaaaggagggccagggcatgaagaaccaatacccatggctacgtatggctggaatttagtcaaacttcattctggcaaggacgttttcttcatgccacctgaaaaatgcgatacactactgtgtgacattggagaatcatcgcctaaccccacaatagaagaaggtaggaccctcagggtattgaaaatggtagaaccctggttaagagggaatcaattctgtattaagattttaaacccgtacatgccttctgtagtagagaccttggagcaaatgcaaaggaagcatggtggcatgctcgtaagaaatcctctatcgagaaattctacacacgaaatgtattgggtgtcgtgcggaacaggaaatattgtatccgcagtaaatatgacgagccgaatgttactcaatcgttttacaatggcgcaccgcaaacctacgtatgaaagggatgttgatttaggggctggtacacgccacgttgcggtagaaccagaagaagcaaatttagatataatcggacaaagaatagaaaacattaagaacgagcacaaaagcacttggcactacgatgaagacaatccatataagacgtgggcataccatggcagttatgaggttaagcctagcggatctgctagttccatggtcaatggagttgtacggcttttgaccaaaccatgggatgtaatccctatggttacacaaatagcaatgactgatacaactccgtttggccaacagagagtattcaaggagaaagttgatacacgtacaccaagagcaaaacgagggaccacacaaatcatggaagtaacagctaagtggctttggggatttttgtcgagaaacaaaaagccaagaatatgtactagagaagagttcactagaaaagtacgttcaaatgccgcaattggcgcggtcttcgtggatgagaaccaatggaactcggctaaggaggccgttgaagatgagagattttgggatctcgtacatagagagcgggaactacataagcaggggaagtgtgcgacatgcgtttacaacatgatgggtaaaagggaaaagaaattgggtgaatttggaaaagcaaaggggtcaagggcaatatggtacatgtggctgggagcaagatttttggagtttgaagccctgggatttatgaatgaagaccattggttcagcagggaaaactcgctatcaggagtagagggagaaggtttacataaattgggatatatcttacgcgatatctctaagataccaggcggtaacatgtacgcggacgatactgccggatgggatactagaataactgaagacgacctccagaacgaagccaaaataacggatattatggagcccgaacatgcgctgcttgcgacaagtatttttaagttaacgtatcagaataaggtcgtcagagtacagagacccgcgaagaacggcaccgtaatggacgtaataagtcggagagaccaacgtggatcgggacaggtgggcacatacggtctaaatacctttactaatatggaggttcaactcattagacaaatggagagtgaaggaatatttctgccttcggaattagaaacccctaatttagcggaacgcgtcctagattggctggaaaaacatggcgccgaacgtctaaagagaatggccatctcaggcgatgattgcgtcgttaaacccattgatgataggtttgctacggccttgacagcattgaatgacatgggaaaagtaagaaaagatatacctcaatgggaaccgtctaaaggatggaatgattggcagcaagtaccattttgtagtcatcactttcatcaacttataatgaaagatggaagagaaatagtggtcccatgtagaaaccaagacgaattagtcgggcgagcaagggtgtcacagggcgcggggtggtcattacgtgaaacagcatgtttgggcaaatcatacgcacaaatgtggcaactgatgtactttcaccgaagagatcttcgactagcagctaacgcaatttgtagtgccgttccagtcgactgggttcctacaagtcgaacaacttggagcatacatgcacaccatcaatggatgacaactgaggatatgttatcagtgtggaacagagtgtggatcgaagaaaatccatggatggaagataagacccacgtttctagttgggaagaagttccatatttgggaaaacgagaagaccaatggtgtggttcacttatagggttaacagcgcgtgccacatgggcaacaaatatacaagtagcaattaaccaagttcggagattaatcggcaacgagaattaccttgattacatgacttcgatgaaaaggttcaagaatgaaagcgatccagaaggcgcgttatggtaa

SEQ ID NO: 21433 - RNA, 9879 nt, synthetic construct
  misc_feature 1..9879: note = derived and/or modified CDS sequence (opt6) from DENV-1__JN819405__SS-prME
  source 1..9879: mol_type = other RNA
agtgttactatgttattaatgttgttaccaactgctttagcatttcacttaacaacacgtggtggggaaccccacatgatagtgtctaaacaagaaaggggtaaatcacttttgtttaaaacatcagcaggagtcaatatgtgcacgttaattgctatggatctaggtgaattatgcgaagataccatgacatacaaatgcccgagaataacagaagcagaaccagatgatgtagactgctggtgcaacgctacggacacatgggtaacttacggtacctgttcccaaacaggagaacataggcgcgataaaagatcagtagctttagcaccgcatgtaggattagggctagaaacaagaacggaaacctggatgagctcagaaggcgcgtggaaacagatacaacgagtcgagacatgggcattacgccaccctggattcaccgtgatagcattattccttgctcatgccataggtacttccatcactcaaaaaggaataatattcattttgctaatgttagtgactccgtcaatggcaatgagatgcgtaggcataggtaatagagattttgtagaggggctaagcggtgccacctgggtagacgtggtattagaacacggatcctgtgtaactacaatggccaaaaataaaccaaccttagatattgagcttctaaaaactgaggtaacaaatcctgctgtacttcgaaaattatgtatagaagctaaaatcagcaataccacgaccgacagccgatgcccaacacaaggcgaggccaccttagttgaagaacaagatgcaaatttcgtctgtagaaggacctttgtagatagaggatggggcaatgggtgcggtctttttggaaaaggatcattattaacttgcgcgaaatttaaatgtgtaacaaaattggaaggtaaaatcgtacaatacgagaacttgaaatattctgttatcgtgacagtacacacgggagaccaacaccaggtaggaaatgaaactaccgagcatggaacgatagcaactattacgcctcaagcaccgacaagtgaaatacaactcacggactacggcgcattgactttggactgtagccccagaaccggcttggattttaacgaaatggtacttctcacaatgaaagaaaaatcctggttagtccataaacaatggttcctcgatttaccgctaccctggaccagcggcgcgtccacctcacaggaaacatggaataggcaagatctattagttacatttaaaactgcacacgccaagaaacaagaagtagtcgtcctggggagtcaagaaggagcaatgcatactgcattaactggagctacagaaatccaaacttccggaacaactaccatatttgcaggccacctaaaatgccgattaaagatggataagctaacactaaaaggtatgtcttatgtcatgtgtaccggttcatttaagctggaaaaagaagtggctgaaacccaacacggtacggttctagtacaggtgaaatatgaaggcactgatgcaccttgtaagatcccattctcaacgcaagacgagaaaggggtcacacaaaacggaagactcattacagcaaacccaatagttacagacaaagagaaaccagtcaatatagagaccgaacctccattcggtgaaagttacattgttgtaggcgcaggagagaaagctcttaaattgagttggttcaagaaaggatcttcaattggtaaaatgttcgaagctaccgcgcgcggagcaagacgaatggcaatcctcggagacacagcgtgggactttggcagtatcggaggagtatttacttctgtaggcaagctagtgcatcaagtcttcgggacagcttacggtgtattattttcaggcgttagttggaccatgaaaataggtatcggcatcttactaacatggctgggacttaattcaagatcaactagcctgagcatgacatgcatagcggtcggcatggttactttatatttaggtgtaatggtacaggcggacagcggttgcgtaatcaactggaagggacgcgaattaaagtgcggctctggaatattcgttaccaacgaggtacacacgtggacagaacaatataaatttcaagcagatagccctaaacgactttccgcggcaatagggaaggcctgggaagaaggggtatgcggaatacgaagtgcgacgaggttagaaaacataatgtggaaacaaatttcaaatgagttgaaccacatattactggaaaacgatatgaaattcacagtagttgttggtgacgcaaacggcattttagcgcaaggcaagaaaatgattaggccacagcctatggaacataagtattcttggaagtcgtggggcaaggcgaaaatcatcggagcagacattcagaatacaacgtttataatagatgggccagatacgcctgaatgtcccgatgggcaacgggcgtggaatatctgggaggtcgaggattacggtttcggaatattcacaactaacatttggctaaaactcagggattcatacacccaaatgtgtgatcatcgattaatgtccgcagctattaaagattccaaggctgtacacgcagacatgggttattggattgaatcagaaaagaatgaaacatggaagttggcacgcgcaagttttattgaggtcaaaacctgtacatggcccaagtcccatacgctatggagtaatggcgtcctagaatctgaaatgattataccaaaaatttatggcgggccaataagtcaacacaattatagaccaggatatttcacacaaaccgctggaccgtggcatcttggtaaattagagcttgacttcgatttatgtgagggtacaacagttgtagtagacgaacattgtggcaacagaggacctagtctgaggactacaaccgtaacaggtaaaataattcatgaatggtgttgccgtagctgtacgttgccacctctcagatttcgaggagaagatgggtgttggtatggaatggaaatacgaccagttaaagaaaaagaagaaaacctagtaaggtcaatggtctcagcagggtctggtgaggttgactccttctcactaggaatactgtgtgtatcaataatgatcgaagaagttatgagaagccgttggtcacgaaaaatgttgatgacaggaacattggccgtattcctccttttaattatgggacagcttacttggaatgatctaatacgactttgcataatggtgggagctaatgcgagcgatagaatgggcatggggactactcacctagctttgatggcaacttttaaaatgagacccatgttcgcagtgggattgctgttcaggcggttgacatcccgtgaagtacttttactaaccatagggctttcattaatggcgagtatggagcttcctaacagcctagaagaattaggagacgggttagccatgggaataatgatgcttaagctacttaccgagttccaaccacatcagctctggacgacactattatcattaacttttgtaaaaacaactttatcgctagattacgcatggaaaaccacagctatgattttaagtatagtatcactgtttccactttgtctatcaacgacaagtcagaaaacaacatggttgccagttcttcttggtagctttgggtgtaagccccttaccatgtttttaataacggagaataaaatttggggaagaaaaagttggcctttgaacgaagggataatggcaatcggaatagtctccatactattaagcagtttgttgaaaaatgatgttcctttagctggacctctaatagccggcggtatgttaatagcgtgttatgtgataagtggatcctcagccgatctgtctctagagaaagctgcagaggtcagttgggaacaggaagcagaacactcgggagcatcgcataacatactggttgaagtacaagatgatggaacaatgaaaataaaagacgaggaaagagatgacacgctaacaatattactcaaagctacactcttagccgtaagtggtgtgtaccccatgtccattcccgcgacactctttgtttggtacttttggcagaagaagaaacaacgatccggcgtgttgtgggatactccaagccctccagaagttgaaagggcggtgttggatgacggaatatatcggattttacaaaggggcctcttaggacgatcacaagtaggagtgggagtattccaggatggcgtattccacacgatgtggcacgttaccagaggggctgttttaatgtatcaaggaaagaggttggaaccgagttgggcttctgttaagaaagatctaatatcttatggaggtggttggcgttttcaagggtcatggaatacaggtgaagaagtgcaggtcattgccgtcgagcccggtaaaaatcccaaaaacgtccagacaactccaggcacatttaaaacacctgaaggtgaagtaggagcgatcgcgctcgatttcaagcctggcacgtctggatcgcccattgtaaatagagaaggtaaaatagtagggttgtacggaaatggagtagtaacaactagcggaacatatgtatctgcaatagcacaagccaaagcaagtcaagaaggaccactacctgaaatagaagacgaagttttcaagaagagaaacctgacaattatggatttacatcccgggtctggtaagacacgccggtacttgccggcgatagtccgagaagcaattaaaaggaaactaagaacactaatattagctcctacgagagtcgtagcttcagaaatggcagaagcactgaagggaatgccaataagatatcagacaacggcggttaaaagcgaaactacaggacgagagatcgtggacctcatgtgccatgcgacatttacgatgcgtctcctatcgcccgttagggtaccgaattataatatgatcattatggacgaagcccattttaccgatcccgccagcatcgccgctagaggatacatatcaacacgcgttggaatgggagaagcagcagccatatttatgaccgctactcctccaggcagtgtagaagcctttcctcaatctaatgcagtgatacaggatgaagaaagagatataccagagagaagctggaactctggatacgattggataacagattttcctgggaaaactgtttggttcgtaccttcaattaaatctggaaatgacatagccaattgcctccgcaaaaacggtaaaagagtaatacagctatcacgaaaaacatttgacacagaatatcagaaaactaaaaataacgattgggactatgtagttacaacagacatctcagaaatgggtgccaacttccgagcagacagagtaattgacccacgaagatgtcttaagccggttatactaaaagatggtcccgagagagtaatcctcgcaggccctatgccagttaccgtcgcatccgccgcgcaaagaagaggaagaataggtcgcaaccaaaacaaagaaggtgaccaatacgtatatatgggtcaaccattgaataatgatgaggatcatgcacattggacagaagccaaaatgctattagataatataaatacgccggagggaattatcccagcccttttcgagccggagagagaaaaatcggcagccatcgatggggaatatagattgagaggagaagccagaaaaacttttgtagaacttatgagaaggggtgaccttcccgtctggttatcatataaagtagcatcggaaggattccaatatagcgataggagatggtgtttcgacggtgaaagaaacaaccaagtcttagaagaaaatatggacgttgaaatatggacgaaggaaggggaacggaaaaagctaaggccacgatggctagacgcaaggacatattcggatccgttagccctacgcgaatttaaagaatttgcagctggtcggcgctccgtatcgggtgatctaatattggaaattggaaagttgccacaacacctaacattaagagcgcagaatgcgttagataacttagtgatgttacataatagcgaacagggcgggaaagcatatagacacgcgatggaggaactcccagatacgatcgaaacccttatgttattagcactcatagcagttctaactggaggcgtcactctattcttcctttcaggaaaaggcttggggaagacatctataggattattatgcgttactgcaagttcagcgttattatggatggctagtgtagaaccacattggatcgctgcaagtataatattggagtttttcctcatggttcttttaattccagaaccagatcgacagagaactccccaagacaatcaattagcatatgtagttattggtctcttatttatgattctgactgtagcagcaaatgaaatgggtctattagaaacaacgaagaaagatctgggaataggatatgtcgcggcggagaatcatcaacatgcaaccatgttagatgtagatttaagaccggcatcggcatggaccttatatgcagtggctaccacagtaatcacgccgatgatgagacataccatagaaaatacaactgcaaacataagtctaactgctatagcgaatcaagctgctatactaatgggactagacaaaggatggcccatatccaaaatggatataggagtaccattactagcacttggctgctattcacaagtaaaccctttaacgttaactgcggccgtactgatgctagttgcacactatgccataatcggtcctggacttcaagccaaagccacacgggaggcacaaaaacgtaccgccgcaggaataatgaaaaacccaaccgttgacggaatagtagctatagatttagatccagtggtttatgatgccaaattcgagaaacaattgggtcaaattatgctcctgatcctatgtactagccaaatattacttatgagaactacgtgggcattatgtgagtcaataacattagcgacaggaccattaaccactctatgggagggtagcccaggtaaattctggaacactacaattgcggtgtccatggcgaacattttcagaggaagttatcttgcaggagcaggcctagcgttttccttgatgaagtcactaggaggaggaaggagagggacgggcgcacaaggagaaacactgggagagaaatggaaacgtcagcttaaccagctttccaagagtgaatttaatacttacaaaagaagcggtataatggaagtggatcgatcagaagctaaggaaggtctcaaaagaggcgaaaccaccaaacacgcggtctctagaggcacagcaaaactcagatggttcgtagaaagaaacctggtaaagcccgagggaaaggtgatagacttgggatgtggaagaggagggtggtcatattattgcgcaggacttaaaaatttcacagaagttaaagggtatacttcaggtggacctggacacgaagaacctataccaatggcaacgtacggatggaacctcgttaaactacattccgggaaggatgtcttctttatgcctcctgaaaaatgtgacactttattatgtgacatcggagaatcatctccgaatccaacaatagaagagggcaggacattacgggtcctgaaaatggtcgaaccgtggctgaaaggtaatcagttttgtataaagatattaaacccctatatgccatcagttgtagaaacattggaacagatgcaaaggaaacatggaggaatgctcgttcgaaatccactttcaagaaactcaactcatgagatgtattgggtaagctgtggtacaggaaatattgtaagcgcagtgaacatgacgtctaggatgctattaaatcgatttaccatggcccacagaaaacccacatacgaacgtgatgttgatctcggtgctggaacaaggcatgtagcagtggaaccggaagtagcaaacttagatataataggacaacgcatagaaaatatcaaaaacgaacataaaagcacctggcactacgatgaagataacccctacaaaacttgggcgtaccatggtagctacgaggttaagccctcaggcagtgcctcaagtatggtcaatggtgtggttaggctcttaacaaaaccgtgggatgtaatccctatggttactcagatagccatgactgacactaccccgttcggacagcaaagagtattcaaggagaaagtggacactagaacaccacgtgcgaaaagaggtactacacaaatcatggaagtaacggctaaatggttatgggggttcttaagtcggaacaagaaaccacggatctgtacgagggaggagttcacacgaaaagtaagatctaatgctgcgatcggggctgtatttgttgacgaaaaccaatggaactcagcgaaggaagcagttgaagacgagagattctgggatctcgttcatagagaacgagagttacacaagcaggggaagtgcgcaacttgtgtatacaacatgatggggaagcgtgaaaagaagctcggggagttcggaaaagctaaaggatccagagcaatctggtatatgtggttaggcgctagatttttggagttcgaagccctcggcttcatgaacgaggaccactggttctcaagagaaaatagtctaagtggagtcgaaggtgagggactccataaacttggatatatcttaagagacatcagcaaaattccaggtggcaacatgtatgccgacgacacggcaggttgggacactcgaataaccgaagatgatctgcaaaatgaagcgaaaatcaccgatataatggaaccagagcatgcattactggctacaagcatttttaagttaacgtaccaaaataaagtcgtaagagtacaacggcccgcgaaaaacggaaccgtaatggacgttataagtcgcagagaccaacgtggtagcggacaagtgggtacttatggactgaatacctttactaatatggaggtacagttaataagacagatggagtctgaaggaattttcttaccctcagagctagaaactcccaacttagcagaaagagtacttgattggttagagaaacacggggcagaaagattgaaaagaatggcaatatctggagatgattgcgtagtaaagccgattgatgatagatttgccacagcattgacagcgttaaacgatatgggaaaagttagaaaagacataccacaatgggaaccaagtaaaggttggaacgattggcaacaagtaccattctgctctcaccattttcatcagttaataatgaaagatggccgagaaatagtcgtcccttgtagaaatcaggatgaattagttggtagggcgcgtgtaagccaaggagctggttggtctctacgagaaacggcatgtttagggaaaagttatgcgcaaatgtggcaattaatgtactttcatcgtagggacctcaggttggctgctaatgcaatttgctcagccgttccagtagactgggtaccaacctcaagaacaacatggtcaatacacgctcaccatcaatggatgacaactgaggatatgctgtcggtatggaatcgtgtttggatagaagaaaatccgtggatggaagacaaaactcatgttagcagttgggaagaagtaccttatttgggtaagcgagaagaccaatggtgtggctcattaataggactcacagctcgagctacctgggcaacaaacatccaagtggccatcaatcaagtacgaaggttaatcggaaacgaaaactatttagattatatgacatctatgaaaagattcaagaacgaatccgatcctgagggtgccttatggtaa

SEQ ID NO: 21434 - RNA, 9879 nt, synthetic construct
  misc_feature 1..9879: note = derived and/or modified CDS sequence (opt6) from DENV-1__GQ199877__SS-prME
  source 1..9879: mol_type = other RNA
tccgttacgatgctactaatgctattacccacggcgttggcttttcacctaactacgcgaggaggagaaccacacatgattgtttctaaacaagaaagaggtaaatcgctactctttaagacatccgcgggtgttaacatgtgtacactaatagcaatggacctaggggaactatgtgaagacactatgacatataaatgtccacggataacggaagcagaaccagacgatgtagattgctggtgcaacgccacggatacttgggtgacttacggcacttgctctcaaacaggggaacatagaagagaaaaacgaagcgtggcattagctccacatgtcggccttgggttagaaactagaacagaaacatggatgtcaagtgagggggcctggaagcaaatacaacgagtagaaacatgggctttgcggcacccaggtttcacagtcatcgcattctttcttgcccatgcaatcggtacatctataactcaaaaaggaataatattcatactgttaatgctcgtcacaccaagtatggctatgcggtgtgtaggaattggtaaccgagattttgtagaggggctttcaggcgcaacatgggtagatgtggtattagaacatggtagctgtgtcacaactatggctaagaataaacctacgctggacatagaattacttaaaacagaagtcactaacccagccgttttacgaaaattgtgcatagaggctaaaatttcaaacactaccactgactcacggtgtccaacacaaggagaagcaaccttagtcgaagaacaagacgccaatttcgtctgtcgccgaacgtttgtagatagaggatgggggaacggatgtgggctatttggtaaaggaagcctgttaacatgtgcaaaattcaagtgcgttacaaaattagaaggaaaaattgtgcaatacgaaaatttgaagtattctgttattgtgacagtacatacaggagaccaacatcaagtcggtaatgaaacaactgaacatggtaccatagcaactataaccccacaagcaccaacatcagaaatacaactaaccgattacggagcacttacacttgactgctcccctcggacaggattagactttaacgaaatggttttattaacaatgaaggagaaaagttggcttgtacataaacaatggttcctagatttgcctctcccgtggacaagcggagcatcaacgagtcaagagacttggaatagacaggatcttttggtaacatttaaaaccgcgcatgcgaagaagcaagaagtagtagttctaggttcacaagaaggagccatgcatactgctctaacaggagcaactgaaatccaaacatcagggacaacaacaatatttgccgggcatttaaaatgtagacttaagatggataaactcacgttaaagggaatgagctatgtcatgtgcactggttcatttaaattagaaaaggaagttgcggaaactcaacatggaacagtactcgttcaggtaaaatatgagggcactgatgcaccatgtaaaatacctttctcaacgcaagacgaaaaaggagttacacaaaatggaagattaattactgcaaaccctatagttacagataaggagaaaccagtgaacatagaaaccgagcctccctttggtgaaagttacatagtcgtcggagcgggcgaaaaagcgcttaagctaagttggtttaagagaggttccagcattggaaaaatgttcgaagcaaccgctcgcggagcgcggcgtatggcgatattgggtgacactgcttgggatttcggctcaataggaggcgtatttacttcggtaggaaaactggtccatcaagtgtttggaactgcttacggagtattattttcaggtgtctcttggaccatgaagattggtatcggcattctactaacctggttagggctaaacagccgatctacctctttgagtatgacgtgtatcgcagtaggaatggtgacattgtatttaggagtaatggttcaagcggactcaggctgcgtaataaattggaagggtagggaactaaagtgcggaagtggaatattcgtcactaacgaagtacacacatggacagagcaatataaattccaagcagattcacccaaaagattatctgcagcaatcggaaaggcctgggaagaaggggtctgtggaataaggagtgcaacaaggctagagaatattatgtggaagcaaatatcaaatgaattaaaccatatattactagaaaacgacatgaagttcacggtggtagtaggtgatgctaacggcattctcgcacagggcaaaaagatgatacgtccccagccaatggaacataaatactcgtggaagtcgtggggaaaagcaaaaattatcggagcggacattcaaaacactacatttatcatagatggaccggatacccccgaatgtcctgacggacaacgagcgtggaacatatgggaggtcgaggattacggtttcggcgtgtttaccacgaacatttggttaaaactcagagactcatatacacaaatgtgcgatcacaggttaatgagcgccgccataaaggacagtaaagcagtacacgcagatatgggatattggattgaatccgaaaagaatgaaacctggaaactcgccagggcaagtttcatcgaagtaaagacatgcacatggccaaaatcacacacattgtggtccaacggtgtattagagtccgaaatgattataccaaagatctacggcgggccaataagtcaacataattatagaccaggttatttcacacaaacagcaggtccttggcacctagggaaactggaactagattttgatctttgtgagggtactacggtcgttgtcgacgaacactgtggaaatcgggggccatctctcaggacgacgaccgtgacaggtaaaataatacatgagtggtgctgtagaagttgtacacttccgccgctacggttccgtggagaggatggttgttggtacggtatggaaataagacccgtgaaggaaaaagaggaaaacttagttaggagtatggtaagcgcaggttctggtgaagtcgactctttctcattaggcatcctctgcgtgtcaatcatgatagaagaggtcatgagatcgcgatggagccggaaaatgcttatgacaggaacactcgcagtctttctcctattaatcatgggacaattgacgtggaatgaccttatacggctatgcattatggtaggagctaatgcaagtgacagaatgggcatgggtaccacttatcttgctctaatggcaacattcaaaatgcgacctatgtttgcagtggggctgttgtttcgcagactcacgagtcgtgaagtactgctgttaacaatagggttgagtttggtcgccagcgtagaattaccgtcgtctctagaagagttgggcgatgggctggcaatgggcattatgatgcttaaactactcaccgaatttcaaccccatcaactttggacgacgttactatcgctgacgtttgttaaaacgactctgtcacttgattacgcatggaaaacaactgctatggtactatcaatagtttcattatttcctctgtgtctatcaacaacctctcagaaaactacctggttaccagtgctgctcgggagctttggatgtaagcctttaactatgtttttaataacagaaaacaaaatatgggggagaaaatcatggccactcaatgaaggaataatggctatagggattgtaagtatactcttgagtagtttgctcaagaatgatgtcccgctggcgggaccactcatcgccggtggtatgttaattgcatgttatgtcattagtggaagcagtgcggacctcagtttagaaaaagcagcggaagttagctgggagcaagaggccgaacattcaggagcaagtcacaatatacttgtcgaagttcaagatgacggaacaatgaaaattaaagatgaagaacgagatgatacacttactattttattgaaggccacgttactggctgtatccggcgtctatccaatgagtattccggccacactcttcgtctggtacttttggcagaagaagaaacaaaggtccggggtattgtgggatactcctagtcctccagaagtagaaagggcagtactagacgacgggatttaccgtatattgcagagaggcctactaggtcgttctcaagtaggagtaggagtatttcaagacggagtatttcatacgatgtggcatgtcacacgaggtgcggtattgatgtaccaaggtaaacgactagaaccctcttgggcatccgtaaagaaagacttgatatcatacgggggaggctggaggtttcagggctcatggaatacgggtgaagaagtacaagtaatagctgtcgaaccgggcaaaaacccgaaaaacgttcaaacgacacccggaacattcaagacaccagaaggcgaagtgggcgcaatagccctagatttcaagccgggcacctctggctcaccgatagtgaatagagaaggcaagatagttggattatacggaaacggagttgtgacaacatcaggtacatatgtgagtgctattgcacaagctaaagcgagccaagaaggaccgttacctgaaatagaggatgaagtattcaaaaagcgcaacctaacaatcatggacctacatccagggtcgggaaaaacgcgtcgctatcttccagcgatagtaagagaagcaatcaaacgcaaattacggacgttaatcttagcaccaactagagtagttgcctcagagatggcggaagctctaaaaggaatgcctatcagatatcagacaacagcagtaaaaagtgagcatacgggacgagaaatagtggatttaatgtgccatgctacattcacgatgcgactattatccccagtcagagtaccgaactataatatgattattatggatgaggctcacttcacagatccagcatctatagcggctagaggctatatcagtacaagggtaggtatgggtgaagcggctgcaatattcatgactgctaccccaccaggaagtgtagaagccttccctcaatcgaatgcagtaatacaggacgaagaacgcgacatacctgagagaagttggaactctggatatgactggatcacagatttccctggaaaaaccgtatggttcgtgcctagtatcaaatcgggaaatgacatagcaaattgtctaaggaaaaatggcaaaagagtcatacaattaagccgtaaaacgttcgatacagaataccaaaagaccaaaaataacgactgggattatgtcgtgactacagatatatccgaaatgggggcaaattttcgcgcagacagagttattgatccccggcgatgtttgaaacctgtaatactaaaagacgggccagaaagagtcatacttgccggaccgatgcccgtcacagtggcaagtgcggcacaacgtagaggaagaatcggacggaaccaaaataaggaaggcgatcaatatgtatatatgggacagcccctaaacaatgatgaggatcatgctcactggactgaggctaaaatgctgctggacaatatcaatactcctgaaggtataatacccgcactcttcgaaccagaaagagagaaaagcgccgctatagatggtgaatataggttaagaggagaggcgcgaaaaacgttcgttgaattaatgaggaggggtgatctaccggtctggttatcatataaggttgcaagtgaaggatttcaatactcagatagacgttggtgcttcgatggagaacggaataaccaagtattggaggaaaatatggacgtagaaatctggaccaaggaaggagaaaggaagaaattaaggcctagatggctagacgcccggacttattctgaccctttagcccttcgtgagttcaaggaatttgcagcgggacgaagaagcgtctctggagatttgatattagaaatagggaaacttcctcaacacttaacgttaagagcgcaaaacgctctggataaccttgtaatgctgcacaattcagaacagggagggaaagcatatcggcacgctatggaagagttgccagatacaatagaaacattaatgcttttagctttgattgccgttttgaccgggggcgtaacactattcttcttgtcaggcaaaggtctcggtaagacatctatagggttattatgcgttacggcgtcttcagcacttttgtggatggcatcggtagaacctcattggattgcagcatccataatactagagttctttctgatggtacttctaatacctgaacccgatcgacaacgaacaccacaggacaatcaacttgcatatgtagtgatagggcttctctttatgatactcaccgtagcagcaaacgaaatgggtttgttagaaacaactaagaaggatctaggaataggctatgtagcagccgagaatcatcaacacgctacgatgttagatgtcgacctgcaccctgcatcagcatggacactttacgcggtcgcaacaactgtcataacacctatgatgcgtcataccattgaaaatacaactgcaaatattagtttaaccgcaatcgcaaatcaagctgcgatactgatgggtttggacaaagggtggccgatatcaaagatggacattggagtaccgttactcgcacttggatgttactcacaagttaacccattaacattaaccgcggcggttctaatgcttgtagcacattatgcaataatcggtcctggtctacaagccaaggctacacgagaagctcagaaaagaacagcagccggaatcatgaaaaacccaactgtcgatggtattgtcgctatcgacttagaccccgtcgtctatgatgcgaaatttgaaaaacaactaggccaaataatgttacttatcttgtgcacatcgcagatattgttaatgagaacaacgtgggcgctatgtgaatctataactttggccactggcccattgacaacgttgtgggaaggaagtcctggcaagttttggaatactacgattgcagttagcatggcgaacatatttagaggatcatatttggcgggcgcaggattagcatttagtcttatgaaaagtttaggaggaggaagaagaggaacaggcgcgcaaggcgagacgcttggggaaaaatggaaaagacagctcaaccaattatctaaaagtgagttcaacacttataagaaatcaggtataatggaggtagacaggtctgaagctaaagaaggactgaaacgaggcgaaacaacaaaacatgcagtgtcaagaggtacagcaaagctaagatggtttgtagaaaggaatctagtcaagccagaagggaaggtaatagatctaggatgtggcagaggaggatggtcatattactgtgctgggctaaagaaagtgacagaagtcaaaggttacacaaaaggcggaccgggtcacgaagaacccatacctatggcaacatatgggtggaatcttgtcaagctacactcaggaaaagacgtatttttcatgcctccagaaaaatgtgacacactactatgtgatataggagagtcctccccgaatccaacgatagaggaagggcgtactttacgcgttctaaaaatggttgaaccgtggttacgcggtaaccaattctgcattaagatattaaacccttatatgccatcagtagtagagacattggaacagatgcagaggaaacatgggggcatgctcgtgcgaaatcccttatcaaggaatagtacgcatgaaatgtattgggtatcatgcggaacaggaaacatagtaagtgcagtaaatatgacaagcagaatgttactaaacagattcactatggcacatagaaaaccaacgtacgagagagatgtagacttgggagccggaacgaggcacgtggcagtggagcctgaagtcgccaatctagacattattggacaaaggatcgagaatataaagaatgagcataaatcaacttggcactatgatgaagataatccttacaagacatgggcatatcacggctcgtatgaggtgaaaccctcaggcagtgcatcatccatggtaaatggggttgtgcgacttcttacaaaaccatgggatgtaattcctatggttacacaaatagcgatgactgatacaacaccattcggacagcaaagagtttttaaagaaaaggttgatacacgtactccaagagcaaaaagagggacaacacaaataatggaagtgacagcaaagtggctttggggattcctttccagaaacaagaaacctaggatttgcacgcgagaagagtttactagaaaagtacgtagtaatgccgctatcggggctgttttcgtagatgagaaccagtggaacagtgcaaaagaggcagttgaagatgagcgcttctgggacctcgtacatagggaaagagaactccataaacaaggcaagtgcgctacttgcgtctataatatgatggggaagcgtgagaagaaattaggtgaatttgggaaagcaaaagggtcgcgagcaatatggtatatgtggctcggagccagatttttagaatttgaggcattaggtttcatgaatgaggatcactggtttagtcgtgaaaattcattatccggcgtcgagggggaaggactacacaaacttggatacatattaagagatatatcgaaaatccctggaggaaatatgtatgcagatgatactgcgggatgggacacacggataaccgaagatgaccttcagaacgaagctaaaataacagatataatggagcctgaacatgcattgctagctacatcaattttcaaattaacgtatcaaaataaggttgtcagagtgcaacgccctgctaaaaacgggacagtcatggatgttattagtagaagagaccaacgtggatcaggccaagtaggaacttatggactcaataccttcactaatatggaggtacaactaataagacaaatggaatcagaagggatcttcttacctagtgagcttgaaaccccgaacctagcggaaagggccctcgattggctagaaaaacatggcgcagaacgactaaaacgtatggcaatatccggagatgattgtgtcgtaaaaccaatcgatgatagatttgccaccgccctaactgcccttaacgatatgggcaaagtccgcaaagatataccacaatgggagccttcaaaaggatggaacgattggcaacaggtacctttttgttctcaccatttccatcaactcataatgaaagacggaagggaaatcgtagtaccatgccgtaaccaagacgaactggttggcagagcacgtgtgtcacaaggtgcaggatggagtctacgggaaacagcttgtttagggaagtcgtatgctcagatgtggcaactcatgtattttcatcgacgggatttacgtctggctgccaatgcaatttgttctgccgttccagttgattgggtaccgacatccagaacaacttggtctatccacgcacaccaccagtggatgactacagaagacatgttgagcgtatggaatcgagtttggattgaagaaaacccatggatggaagataaaacacacgtaagtagttgggaggaagtaccttacttaggaaaacgagaagatcagtggtgcggttctctaatcggcctaacggctagagcaacctgggcgacaaatatacaagttgctataaatcaagtacggcgactgatcggtaacgaaaattacttagactacatgacaagtatgaaaagattcaagaacgagagtgacccggaaggagcattatggtga

SEQ ID NO: 21435 - RNA, 9879 nt, synthetic construct
  misc_feature 1..9879: note = derived and/or modified CDS sequence (opt6) from DENV-1__GU056029__SS-prME
  source 1..9879: mol_type = other RNA
tcagttactatgttgttaatgttactaccaaccgcactcgcttttcacttaactactcgaggaggagaaccgcacatgatagtttctaaacaagaaagaggtaaatctctcctgtttaaaacaagtgcaggggtaaatatgtgtacattaattgcgatggatctaggagaactgtgcgaagataccatgacatacaaatgcccaagaattaccgaagcggagcctgatgacgtagactgctggtgtaatgcaacagacacatgggttacttacggcacctgttcccaaactggagaacataggagggagaaaaggagcgtggctttagcgccacacgtaggtttgggcctcgaaacaaggacagaaacatggatgtctagtgaaggtgcatggaaacaaatacaaagagttgaaacctgggcactaagacatccaggcttcactgtaattgcattctttttagcccatgcaattggaactagcataactcaaaaagggattatatttatactactaatgttagtaacaccgagtatggcgatgagatgcgtaggaataggtaacagagactttgtggaggggctaagcggagcgacatgggtcgacgtggtgctagaacacggttcctgtgtcacaacgatggccaaaaataaaccgacactagacatagaattgcttaaaacagaagtcaccaatccagcggtcttacggaaattgtgtatagaagccaaaatatcaaatacaaccacagattcgcgatgccctacacaaggagaagcaaccttggtagaagaacaagacgctaattttgtttgtcgtagaacgtttgtagatagaggatggggaaacggatgtggcttatttgggaaagggtctctattaacttgcgccaaatttaaatgtgtgacaaaacttgaaggtaaaatagtacaatacgagaacttgaaatatagcgtcatagtcacagtacacaccggggatcagcaccaagttggaaatgaaactactgaacacggcacgatagccacgatcactccccaggctccgacaagtgaaatacaattaacagattatggagcattaactcttgattgctcaccaaggacagggttagatttcaacgagatggtccttttaacaatgaaagaaaaatcgtggctagtacataaacagtggtttctcgatttgccgttaccgtggacatcaggagcctcgacatcacaagaaacatggaaccgtcaggatctgcttgtaacattcaaaaccgcacatgccaagaaacaggaagttgttgtcttgggttcccaagagggagccatgcatactgctcttactggagctacagagattcagacgtcaggcacaaccacaatttttgcaggacacctaaagtgcaggttaaaaatggataaacttaccttaaaaggcatgagttacgttatgtgtacaggatcctttaaactagaaaaagaggtggcagaaacgcaacatggaacagtcctagttcaagtaaagtatgagggaaccgatgcaccatgtaaaattccattttccacacaggacgaaaaaggggttacgcaaaacggtagactaataactgccaatccgatagtaactgacaaagaaaaacctgtaaatatagaaacagaaccaccttttggggagtcgtatattgttgtaggcgccggagaaaaagcgttaaaattgtcttggtttaaaagaggttcgtccataggaaaaatgtttgaagctacggcgaggggagcgcgaaggatggctattctaggagacaccgcttgggattttggtagcataggaggtgtgtttacaagtgttggaaaattggttcatcaagtcttcggtacagcgtacggtgtattgttctctggtgtatcatggacaatgaaaatagggatcgggattctattgacatggcttggattaaatagtcgtagtacctccttatcaatgacatgtatcgcagtaggtatggtaaccctttacctgggggttatggttcaagccgatagcggctgtgtcattaactggaaaggtagagagttaaagtgtgggtctggaatatttgttacaaatgaggtgcatacgtggactgaacaatataagtttcaggcagacagcccgaaacgcttatctgctgcaatagggaaagcatgggaggaaggtgtgtgtggcataagatccgcgacacgattggagaacataatgtggaaacaaatatctaatgagttaaatcacattttattggagaatgatatgaaattcacagtagtagttggagatgcaaatgggatcttagtacaagggaagaaaatgatccggccacaaccgatggagcacaaatattcttggaaatcgtggggtaaagctaaaataataggtgcagatatccagaacacgacctttattatagatggacctgatactccagaatgccccgatggtcaaagagcatggaatatatgggaggtcgaagattacggcttcggagtgttcacaacaaatatatggctcaagctaagggactcgtatacgcaaatgtgcgatcatcgtcttatgagcgctgcgatcaaagattccaaagcagtgcatgcagacatgggttactggatagaatcagagaaaaatgagacatggaagttggcgcgagcatcatttattgaagtaaaaacttgtacttggccgaaaagtcacactctttggtctaatggagttttagaatccgagatgataatccctaaaatttatgggggacctataagccaacataattatagacctggctacttcacgcagactgcagggccatggcatttaggcaaactagaattagacttcgatctctgcgagggaactactgtagttgttgatgaacactgcggaaatagagggccttctcttagaactacaacggtgactggtaaaatcatacatgaatggtgttgtagaagttgcactctacccccgttgcggttcaggggcgaagacggatgttggtacggaatggaaattcgtccagtcaaggagaaagaagaaaaccttgtgcggtcgatggtaagtgctggctcgggcgaagtagattcattcagtttgggcattctgtgtgtatcgataatgatcgaagaagtaatgagatcacggtggtcgcgtaaaatgctcatgacgggtactctagcagtgttcctattattaataatgggccaacttacatggaacgatctcatcagattatgtataatggtaggagccaacgcgagtgatcggatgggtatgggaacaacgtacttggcgctaatggcgaccttcaaaatgaggcccatgtttgcagtaggactactattccgaagactaacgtcaagagaagtattgctattaaccattggactatcattagtggccagtgtagagcttcccaattcactcgaagaattaggcgacgggttggccatgggtattatgatgttaaaactacttacagaatttcagccacatcaattgtggacaaccctattaagtctaactttcgtaaaaacagccctttcgttagattatgcatggaagacaaccgctatggttttatcgatagtcagcttattcccattgtgcttaagcacaacgtctcagaaaacaacctggttaccagtacttttgggttcatttggctgcaaaccattaacaatgtttttaatcacagagaataagatatggggcagaaaatcgtggcctctaaacgaagggatcatggccataggcatcgtgtccattttactcagcagtctattgaaaaatgacgtcccattggcaggccccctcatagcgggcggaatgctaattgcctgctacgttatcagcggcagtagcgcagacttgagcttagaaaaagcggcggaagtaagttgggagcaagaagctgaacacagcggtgcatcacataacatattagttgaagtgcaagatgacggaacaatgaagataaaggatgaagaaagagatgatacccttaccatattattgaaagctacgttactcgcagtatcaggtgtctatcccatgagtataccagccactttgttcgtatggtacttctggcagaagaagaaacaacgcagtggtgtactttgggatacaccatcaccaccagaagttgaaagggcagtattagataacggtatttacaggatattacagcgaggtttactaggcaggagtcaagtgggcgttggcgtatttcaggatggagtttttcatactatgtggcatgtaacgagaggcgctgttcttatgtatcagggcaagcgtctggaaccctcgtgggcttcagtcaagaaagatttaatttcttatggaggcgggtggagattccagggcagctggaatacaggtgaagaagttcaggtaatagcagttgagccaggcaaaaatcctaaaaatgttcaaacaaccccaggtacatttaaaacacctgaaggagaagtaggggccatagctttagattttaaacctggtacttcaggaagtcctatagtaaatcgagaaggaaaaattgtaggattatacggcaatggtgtcgtaacaacgtcgggtacttacgtgtcggccatagcacaagctaaggcttcccaagagggcccgttacctgaaattgaggacgaggtgttcaaaaagcggaacttaaccataatggacttacatccaggtagcggaaagacgagaaggtatctaccggccattgtccgtgaagcgattaagagaaaattaagaacgttaattttggcgccgacaagagtagtagcttcagagatggctgaagcactgaagggtatgccaataaggtatcaaaccacggctgtaaaaagcgaacataccggtagggagatagtagatcttatgtgtcatgctacatttactatgcgacttctatcacctgttcgcgtaccaaactataacatgataatcatggacgaggcacattttaccgacccggcgagtattgcggcgcgcggatacattagtacaagagtagggatgggtgaagccgcagctatatttatgacagccacgccgcctggtagcgtagaagcattccctcagtctaatgccgtaatccaggatgaagaacgtgatatacccgaaagaagttggaatagcgggtacgactggataaccgatttccctgggaagacagtttggttcgttccatcaataaaaagcggaaatgatattgctaactgtttgaggaaaaacggtaaaagagttatacaattaagcagaaaaacgtttgatactgaatatcagaaaacgaagaataacgactgggattatgtagttacgacggacatcagtgaaatgggtgcaaatttccgagccgatagagtcatcgatcctagaaggtgtttgaaacccgtcatacttaaagacggtcctgaacgagttatactcgcaggtcccatgcccgtaacggtggcttcagctgcacaaagacgtgggagaatagggagaaaccagaataaagaaggagatcaatatgtttatatgggtcagccacttaataacgatgaagatcacgcccattggacagaagcgaaaatgttgctagataacataaacactcccgagggaattataccagcattattcgaacctgaacgagagaaatcagcagcgatcgacggcgaatatcgcctgaggggtgaagcaagaaaaactttcgttgaacttatgagacggggtgaccttccagtatggctctcgtacaaagtggccagcgaaggattccaatatagcgacaggagatggtgttttgacggagaaagaaataatcaagtactcgaagagaatatggacgttgagatctggactaaagaaggtgaacgcaaaaagttacgtccgagatggctcgacgctcgtacatacagtgacccattggccctacgagaatttaaagagtttgctgcaggtcgacgttctgtatcaggtgacttaatacttgagataggaaaattaccccaacatcttacactacgagctcaaaacgccttagataatctagtaatgttgcacaacagcgaacagggaggtaaagcgtataggcatgcaatggaagaattgccggatacaatagagaccctcatgttattagctctaatcgctgtgctcacaggcggagttacactattctttctctccggtaagggtttaggaaagacatcaataggactactctgcgttactgctagttcggctctcttatggatggcatcggtcgaacctcactggattgcggcctctataatcctagagttctttttaatggtactcctaatacccgaacccgaccgtcaacgaacaccccaagataaccaattagcttatgtagttatcggcctattatttatgatcctcacagtcgcagcgaacgaaatggggctattagaaacaactaagaaagatttaggaataggctatgtcgcagcggaaaaccaccaacacgccaccatgttagacgttgatttgcatcccgcgagtgcgtggacactttacgctgtggcaactaccgtaatcactccgatgatgcgtcatacaatagaaaataccactgcaaatatatctttaactgcgatcgctaaccaagctgcaatattaatggggctagataaaggatggccaatctcgaagatggacattggagtaccactgttagcgcttggatgctactcgcaggttaatccactcacactaacagcggctgtacttatgctcgttgcccattatgcaataataggccccggcttacaggctaaagcaacccgtgaagcacagaagagaacagcggcggggattatgaaaaacccgacagttgacggcattgtggctattgacttggatcctgtcgtatatgacgccaaatttgaaaaacaactggggcagataatgttattaatactatgtacttcacaaatactccttatgagaacaacatgggcactttgcgaaagtatcactctagccaccggtccactcacaacattatgggaagggtcacccggtaaattttggaataccactattgctgtatctatggcgaatatattccgaggaagctacctagcgggtgcaggactggcattctcgcttatgaaatcccttgggggaggacgtcggggaacaggcgctcagggcgaaacgctaggtgaaaaatggaaaagacaactaaatcaactaagtaagtctgagttcaatacatacaagaggagtggaataatggaagtagaccgatcagaggccaaagaaggattaaaacgaggcgaaacaacaaaacatgcggtttctagaggaacagcaaagttacggtggtttgtcgagagaaacttggttaagccagaaggtaaagttattgatttagggtgcggacgcggaggctggtcttactactgtgcgggacttaagaaagtaactgaagtaaaaggttacacaaaaggcgggccgggccatgaagaaccaataccaatggcgacgtacggctggaacttggtaaaattacatagcggaaaagacgtattctttatgcctccggaaaaatgcgacacgctactttgtgatataggcgagagtagtcctaatccaaccatagaagagggtcggactttacgagtacttaaaatggtagaaccatggttacgtggaaaccaattctgtattaaaatactcaatccctatatgcccagcgtggttgaaacgttagaacagatgcaacgtaaacacggaggaatgttagtacggaatccgttgagtagaaactcaactcatgagatgtactgggttagctgtggtacaggaaacattgttagtgcagtaaatatgacatctcgaatgttattaaatagatttactatggcacacagaaaacccacatatgaaagggacgtcgatttaggggcaggaacgcgacatgtggcagttgaaccagaggtagcaaatttagacatcattggccagcggatagagaatataaagaatgaacataaatcgacatggcattatgatgaagacaacccttacaaaacctgggcgtaccatggtagctacgaagtgaaaccatcaggaagtgcaagttctatggtgaatggtgtagtaagattgttaaccaaaccatgggatgtgatacctatggtgacacaaatagcaatgacagataccacgccgttcggacaacagcgagtttttaaagaaaaagtcgataccagaacacccagggcgaagcgaggtactacgcaaataatggaagtgaccgctaaatggttatggggatttctgagtagaaacaagaaaccgcgcatatgtacccgggaagagttcactcgtaaagtgagatcaaatgcggccattggagcagtattcgtagacgaaaatcagtggaactcagcgaaagaagcagtggaagacgaaaggttctgggatttagtacatcgagaacgggaactacataaacaaggcaaatgcgcaacatgcgtgtataatatgatgggaaaaagggagaagaaactgggagaatttggtaaagctaaaggttcaagggccatttggtacatgtggttgggcgctcgatttctagaatttgaagcgttgggatttatgaatgaagaccactggttttcacgtgaaaactcattgagcggtgtagagggtgaaggtctgcataaattaggctatattttacgggacattagcaaaataccaggaggcaatatgtatgctgacgacaccgcaggttgggacacaagaattacagaagatgatctccagaacgaagcaaaaattactgacataatggaaccggaacacgctttactagcaacaagcatttttaaactaacctatcaaaacaaggtagtcagagtacaaagaccagccaaaaatggcacggtgatggacgtcatcagccgaagagaccaaagaggatcaggacaagtcggaacttacggcttaaacacatttacgaacatggaggtacaattgatacgacaaatggaaagcgagggtattttccttccgtctgaactggaaactccaaacctcgcggaacgcgcgctagactggttagaaaaacatggagcagaaagattaaaaagaatggcaataagtggtgacgattgcgtcgtaaaacctatagatgatcgttttgctactgctctcactgcactaaatgatatgggcaaagttagaaaagatataccacagtgggagccatccaaagggtggaatgattggcaacaagtacccttttgtagtcatcacttccaccaactgataatgaaagatgggcgtgaaatcgtggtcccctgtcgaaatcaagatgaattagtaggtcgagcacgtgtgagtcaaggagccgggtggagtttacgtgagactgcttgtttaggaaaatcgtacgcccaaatgtggcaactaatgtacttccacagaagggatttacggctcgcagcgaacgcaatttgcagtgctgtaccggttgattgggttcctaccagtagaaccacatggtctatacatgctcatcatcaatggatgacaacagaagacatgttaagtgtctggaatcgggtatggatagaagagaatccatggatggaagataaaacccacgttagtagctgggaagaagtaccatatttaggcaaacgggaagatcaatggtgtggtagcctaattggcttaacagcaagagcgacctgggcaaccaatatacaagtggccattaatcaagtacgaagacttataggtaatgagaattatctggattacatgacatcaatgaaacgattcaaaaacgaatcagattctgaaggagcgctatggtga

SEQ ID NO: 21436 - RNA, 9879 nt, synthetic construct
  misc_feature 1..9879: note = derived and/or modified CDS sequence (opt6) from DENV-1__GU056030__SS-prME
  source 1..9879: mol_type = other RNA
tctgtcacaatgctactgatgctactgcctacagcactagcgttccacctaacaacgagaggtggggaaccccatatgatagtgtcaaaacaggaacgagggaaatcactcctatttaaaacatcagccggtgtcaatatgtgtacattgatcgctatggacttaggagaattatgtgaagataccatgacgtataaatgcccaagaataacagaagcagaaccagacgatgttgactgttggtgtaacgctactgacacgtgggtaacctacggtacatgttcacaaaccggagaacaccggagagaaaaacgttcagttgcattggcaccgcatgtgggactaggacttgaaaccaggactgaaacgtggatgagtagtgaaggagcttggaaacagatacaacgagttgaaacatgggcattacgacacccagggtttaccgtcatcgcatttttcctagcacacgccatagggacgtcgataacacaaaaaggaatcattttcatcttactaatgttggtaactccatctatggctatgagatgcgtaggaataggaaatcgagactttgtagaagggctatccggagcaacgtgggtagatgtagtcctcgaacatggatcatgtgtcaccacaatggccaaaaataaacctacattagatattgaactactgaaaaccgaagtcaccaatccagccgtacttaggaaactatgcattgaagcgaaaatatctaatacgacaactgatagtcgttgtccaacccaaggagaagctacgcttgttgaagaacaagacgcaaatttcgtatgccgccgtacatttgtagatcgcggatggggcaacggttgtgggttatttggaaaaggctcgttattaacatgtgctaaatttaaatgcgttacgaaactcgaaggcaaaatagttcaatacgaaaatcttaaatatagtgtaatagtaacagtacatacaggagaccagcaccaagtcggaaacgaaacaacagaacacggtacgatagccaccattactccccaggcgccaacatcggaaattcaactaacagattatggagcattgaccctagattgttcacccagaactgggcttgatttcaatgaaatggttttgttgacaatgaaagaaaaatcatggctagtgcacaaacagtggtttctagacctgcctctgccctggacaagtggggcctcgacatcacaggaaacctggaacagacaggacctcttagtaacattcaaaaccgcgcacgccaagaaacaagaagtagtagtattaggctcacaagaaggggcgatgcacacagctttaactggggcaacagaaatacagacgtcagggacaacaacaattttcgcaggtcacttaaaatgtagattaaaaatggataaattgacattaaagggaatgagttatgtgatgtgtactggatcattcaaactcgaaaaggaagtagctgaaactcaacatggaactgtattggttcaagtcagatacgaaggaacagatgcaccatgcaaaataccatttagcacccaagacgaaaaaggagtcacgcaaaatggacgacttatcacggcaaatccaatagttacagacaaagaaaagccagtcaacatagaaacagaacccccattcggtgaaagttacattgttgtcggagccggggaaaaagcactcaaacttagctggtttaaaaggggctctagtataggaaagatgtttgaggccaccgcaaggggcgcacgtagaatggccattctgggggatactgcatgggacttcgggagtatagggggagtcttcacgtcggtggggaagctagttcaccaagtcttcggtacagcttacggagtgctattcagtggggttagttggactatgaagatcggtatcggcatcctactgacatggttaggattaaattcaaggtcaactagcctgtccatgacgtgcatcgccgtgggcatggtgaccttatacctaggggtaatggttcaggccgatagcggttgcgttataaattggaaggggcgagaactaaaatgtggttcgggtattttcgtaacaaatgaagtacatacttggactgaacaatataagtttcaagccgatagcccgaagagacttagtgcagcgatcggcaaagcgtgggaagaaggtgtctgcgggatccggtcagcaacacggctggaaaacatcatgtggaaacaaatatcaaatgaattaaatcacatattattagaaaatgacatgaagttcacagtagttgtaggtgacgcaaacggtatattagcccaaggcaagaaaatgatacgaccacaaccaatggaacataaatattcatggaaaagttggggtaaagcgaaaattatcggtgcagacattcaaaatacaacttttataatcgacggcccagatacacccgaatgtcctgacgggcaacgtgcatggaacatatgggaagtggaagattatgggttcgggattttcacaacaaacatttggctaaagctacgtgatagttatacccagatgtgcgatcatagattaatgtctgcagcaataaaagatagtaaggctgttcatgccgacatgggatactggattgagtctgaaaagaatgagacttggaaattagctagagcgtcatttatcgaagtgaaaacgtgtacctggcccaaatcacatactttatggtctaacggagtattggaaagtgaaatgataataccaaaaatatatggtggaccaatttcccagcataactacagaccaggatactatacacaaactgctggcccgtggcatcttggaaaattagagctcgatttcgacttatgcgagggcaccaccgttgttgtagatgaacattgcggtaatcgtggaccctcattaagaactacgaccgtcaccgggaagataatacatgaatggtgttgcagatcgtgtaccttacctcctttacgtttccgaggagaagatggctgttggtatggaatggaaatcagaccagtgaaggaaaaagaagaaaatttagtacggtcaatggtatcagctggaagtggtgaagtagacaactttagtttaggcattctttgcgtttcaataatgatcgaagaggttatgcgtagtcggtggagcagaaagatgctcatgactggaaccctcgcggtcttcctattattaatcatgggacaattaacttggaacgatttaataaggctctgtatcatggttggcgcgaatgcttcagatggaatgggaatgggtaccacttacttagcattaatggccacgttcaagatgagaccaatgtttgctgtcggacttttatttcgacgccttactagccgagaagtactattattaacaatcggactaagcctagtagcatccgtagaattgccaaattccttagaagaactaggagatgggctcgcaatgggtattatgatgcttaaactattaacggagttccagcctcatcaactttggacaacgttgctatctttgacatttgtaaaaactaccctatccctagactatgcatggaagacgacggctatggttttatctattgtatcattatttcccctttgcttgagtacaacaagtcagaaaacaacatggttacctgtgctacttggttccttcggttgtaaaccccttactatgttcctcatcacggaaaataaaatatggggaagaaagtcttggccactaaacgaggggataatggctataggtatcgtgtctattctactttcaagtttattgaaaaatgacgtccctttagctgggcccttaatagcaggcgggatgttaatagcatgctatgtaattagcggtagttcagcggatttatctttggataaagcagcagaggtaagttgggagcaagaagccgaacacagtggtgcttcacacaatataagtgtggaggtacaagacgacggaaccatgaaaataaaagatgaggagagggacgacactcttaccatcttgttaaaagcaacgttactagcagtatctggagtatatccaatgagtataccagcaacattgttcgtatggtatttttggcagaagaagaaacaacgatctggagtcctatgggataccccgagcccacctgaagtcgaacgtgcagtgctcgacgacggaatataccgaatacttcagcgagggttactagggcgctcccaagtaggagtaggagtgtttcaagatggtgtattccatacaatgtggcacgtaacacgaggagctgtgttgatgtaccaaggaaaaaggctagaacccagttgggcttgcgtcaaaaaggatttaatttcttacggcgggggctggagatttcaagggtcctggaatacgggggaggaagtacaagtgatagctgtcgaacctggtaaaaatccaaagaacgtacagactacaccaggaacatttaagacgccagaaggcgaagttggagcaatcgcccttgattttaaaccggggacaagtggatcacccattgtaaatagggaaggtaaaattgttggtctatatggaaacggagttgtaacgactagcgggacttacgtttcggctatcgcccaggctaaagcatcacaagaggggccgttaccggaaatagaagatgaggtgtttaagaaaagaaatttaacaattatggacttacacccgggaagcggaaagacaagaaggtatctgccagcaatagttagagaggcgataaaaagaaaactacgtactttaattttagcgccaacgagagtagtggccagtgaaatggcggaagcactgaagggcatgccaatcagataccaaactacagctgttaaatctgaacacaccggtagggaaattgttgatttaatgtgtcatgcaacctttactatgagactgttaagtccagtaagagtaccaaactataacatgattataatggacgaagcacattttacagaccctgcttcaattgcggcaaggggatatattagcactagggtaggcatgggagaagctgcagctatttttatgaccgctacacctccaggaagtgtagaggcttttccgcaatccaacgctgtaatacaagatgaagaaagagacattcccgaaaggtcatggaactcaggttatgattggattactgacttccccggaaaaacagtgtggtttgtccccagtataaaatctggcaatgatatcgcgaactgtctaaggaaaaatggaaagagagtaatacaactctcaaggaaaacttttgatactgaatatcagaagactaaaaataatgattgggactatgtagttacaacagatatcagtgagatgggagccaacttccgagcggatagagtgattgatcctaggagatgcctaaaaccagtcatcttgaaagacgggcctgaaagagtaatactagcaggacccatgccagtaactgtagcttcagcagcccagagacgcggacgtataggtcgaaatcaaaacaaagagggcgatcaatacgtatacatgggacagcccctaaataatgatgaagaccatgcgcactggacggaagctaaaatgttgctagacaacataaacacccccgaaggaattattccagcactttttgaacctgaacgggaaaaatctgcggctattgatggagaatatagactgagaggggaagcaagaaaaactttcgtggaactaatgagacgcggggacctaccggtttggctatcatataaagtagcaagcgaaggattccagtatagtgatagaaggtggtgctttgatggagaaaggaataatcaggtattagaagaaaatatggatgttgaaatatggaccaaggaaggggaaagaaagaaactcagacctcggtggttagacgcaagaacatactcagaccctctagcgttaagggagttcaaagaatttgccgcagggcgtcgaagtgtgagtggagacttgatactcgaaataggcaaactacctcaacatttgacgttaagagcgcaaaacgcccttgataatttggtgatgctacataattcagaacaaggcggtaaggcttatcgacacgcaatggaagaattaccggataccattgaaactctgatgctactagcgctgatcgctgttttgactggaggagtaacactattcttcctaagtgggaaagggctagggaaaaccagcataggcctattgtgcgtaaccgcaagctccgcgctgttatggatggcatcagtggaacctcactggattgccgcatcaataatcttagagttctttttaatggttttactgattcctgaaccagatcggcaaagaacgccacaagataaccaacttgcatatgtagtgataggcttattgttcatgatattaaccgtagcagctaatgagatgggactactggagaccactaagaaagacctcggcatcggttacgtagctgcagagaatcaccagcatgctacaatgctagacgttgacctgcaccccgcatcagcctggacactctacgcggtagctacgactgtcattactccaatgatgagacacacgatcgagaatacaacggctaacattagtctaacagctattgcgaatcaagctgccatattgatgggtcttgacaaaggttggcctatttccaaaatggacataggagtcccacttttagcactaggctgttattctcaagttaacccattgacactgactgcagccgtcttaatgttagtagctcactacgccataatcggacccggcctccaagcgaaagccacacgagaagcacaaaaacgaacagccgccggtattatgaagaatcccactgtagatggaatagtcgccatagatctagatccagttgtttacgatgtcaaatttgaaaaacagttaggtcaaataatgttattgattctgtgtacgagtcaaatattactaatgagaacaacgtgggctctatgcgaatctataaccttagcaactggacctttaaccactttatgggagggaagtccaggtaaattttggaacacgacaatcgcggtaagcatggctaacatatttagaggcagctatttagctggggcaggattagccttttccctaatgaagtctctaggtggaggaagaagaggcacgggcgctcagggtgaaacactgggagagaaatggaagcgtcaattaaatcaactatcgaaatcagaatttaatacttataagcgaagcgggattatggaggtagatagatctgaagcaaaggagggtctaaaacgtggagaaactacgaatcacgctgtatcacgagggacagcgaaattgaggtggtttgtggaacgtaatttagtgaaacccgagggtaaggtcatagaccttggttgcggccgaggagggtggtcttactattgtgcaggactcaaaaaggtaactgaggttaagggctatacaaaaggaggacccggtcatgaagaacctataccaatggctacgtatggatggaacctcgtaaaattacactctggcaaagacgtattctttatgccgccagaaaagtgtgatacgttattatgtgacataggggaaagctcacccaatcctacgattgaggaaggacgaacactgagagtgttaaaaatggtggagccgtggttaagaggaaaccaattctgcataaaaatattaaacccctacatgccctcagtggttgaaaccctcgaacaaatgcaaagaaaacacggaggtatgctcgtacgaaacccattatcaaggaatagtacccatgagatgtattgggttagctgcggcactgggaacatcgtaagtgcggtgaatatgacaagtcgtatgttattaaacagatttaccatggctcaccgtaaacccacatatgaacgagatgttgacttaggcgcggggacaaggcatgttacagtggaaccagaggttgcaaacttggacattataggtcaacggatagagaacataaagaatgagcataaatcaacttggcactacgatgaagataacccttataaaacatgggcttatcatggaagttacgaagtaaaacccagtggaagtgctagtagtatggtgaacggtgttgtacgattactgacaaaaccctgggacgtaataccaatggtaacacaaattgcgatgacagataccacaccctttgggcaacaaagagtattcaaagaaaaagttgacactcgaacgcccagggctaagagaggaactacacaaattatggaggtaacagctaaatggctttggggatttttgtcccgaaataagaaaccacggatatgtactcgagaagaatttacccgcaaggtgagatctaatgcggctatcggtgcagttttcgttgacgaaaatcaatggaactcggctaaagaagcagtggaagacgaaaggttctgggatctcgtacaccgggaacgagaactgcacaagcaagggaagtgtgctacgtgcgtgtataatatgatgggaaaacgagagaagaaactaggggagttcggaaaagcgaaaggctcacgcgcaatctggtatatgtggctaggtgcaagatttttagaatttgaggcactagggtttatgaatgaagaccactggttctcacgtgaaaacagcctaagtggcgtagaaggtgaaggcctgcataaactcggatacatccttcgagacatctcaaaaatccctggaggaaacatgtacgcggacgacacagcgggatgggatacccgcataacagaagatgatctacaaaacgaagcgaaaataacagatatcatggaaccagagcatgcattattagcaacgtccatctttaaactaacatatcagaataaagtcgtgagagtacagcgccccgccaaaaacggtacggtaatggacgtgataagtagaagggatcaacgaggatccggccaagtagggacttatggattaaacaccttcactaatatggaggtacaactaattagacaaatggaaagcgaagggatatttctcccatctgaactagaaactcccaacctagcagaaagggtattagattggttggaaaaacacggagccgagaggttaaagcgaatggctatttcaggcgatgattgcgtcgttaagcctatcgacgaccgcttcgctacagcactaactgctttgaacgatatgggcaaggtaagaaaagacatcccgcaatgggaaccctccaaaggatggaacgactggcaacaagttccattctgctcacaccacttccaccaattaatcatgaaagacggtcgagagattgtcgtaccttgtaggaatcaagatgagctagtgggaagggcacgagtaagccaaggagccggttggtcactacgggaaaccgcgtgtctaggtaaatcgtatgcacagatgtggcagctaatgtattttcaccgaagggacttgagactcgcagcaaatgcgatatgctcagcagtgcccgttgattgggttccgactagcagaactacttggtcaatacacgcacatcatcagtggatgacaactgaagacatgttaagtgtgtggaacagagtttggattgaggagaacccatggatggaagataagacacacgtttcctcatgggaagaagtaccgtacctgggaaaaagagaagaccaatggtgcggatcacttattgggctcacagccagagcgacatgggcgacgaatatacaagttgcaataaatcaagttcggcgtctaataggcaacgaaaactacttagattatatgacatcaatgaaacgatttaaaaacgaaagcgatccagaaggcgctctttggtag

SEQ ID NO: 21437 - RNA, 9879 nt, synthetic construct
  misc_feature 1..9879: note = derived and/or modified CDS sequence (opt6) from DENV-1__GU056031__SS-prME
  source 1..9879: mol_type = other RNA
tcagtaactatgctgctaatgctcctcccaacagcattagcttttcatctcactactcgaggtggggaaccacatatgatcgtatctaaacaagaaagaggaaaatcgcttctatttaaaacgtcggcaggagtcaatatgtgtaccttgatagctatggatttgggagaattatgtgaagataccatgacatataaatgccccaggataacagaagcagaaccagacgatgtcgactgttggtgtaacgcaacagatacgtgggtaacatacggaacatgctcacaaacgggcgaacacagaagggagaaaagatccgtagcacttgcacctcatgtaggattaggtctagaaacacgcactgaaacttggatgagttcggaaggagcatggaaacaaatccaaagggtagaaacctgggctctacgacatcctggctttactgttatagcattctttttggcacatgctattggtacgtcaattactcaaaaaggtataatctttatactcttaatgctcgttacgccatcgatggcaatgcggtgtgtaggtatcggtaatagggattttgtagaaggactaagcggagccacatgggttgatgtcgtcttagaacacggctcgtgtgtgactacaatggccaaaaacaagcctactctagacatagagctgttaaaaacagaggtcacgaaccccgctgtactacgtaaactgtgtatagaggcgaaaattagcaacacaacaacagatagtagatgtccaacacaaggagaggcgactttagtagaagaacaggatgctaatttcgtctgccggagaacgtttgtcgacagaggatggggcaatggctgtgggttatttggcaaggggtctctcttaacatgtgctaaatttaagtgcgtaacaaagttagaaggaaaaatagtccaatatgaaaatctaaaatacagcgtgattgtaacggtacatacaggagaccaacatcaggtcggaaatgaaactacagaacatgggaccatagcaacaatcacaccgcaagcccctacgtcagaaattcaattgacagattatggggctctaacactagattgtagcccacgtaccggactcgattttaatgagatggtcctactaactatgaaagaaaaatcgtggctagtgcacaaacaatggttccttgacttacctctcccttggacttcaggagcctcaacgagtcaagagacttggaataggcaggatcttcttgttacatttaaaacggctcacgcgaagaaacaagaggtagtagtattagggtcccaagaaggggcaatgcacacagctttaaccggtgcaaccgagatacagacgagtggaactacaacgatcttcgcaggtcaccttaaatgcaggcttaaaatggacaaattaacgttgaaaggtatgagctatgttatgtgcactggatcttttaaattagaaaaagaggtagcggaaacacaacatggaacagtgcttgtgcaggtaaagtatgaaggtaccgatgctccttgcaaaatacccttctcgactcaagacgaaaaaggagttacacaaaatggtaggctaataactgccaacccgatcgtcactgataaagagaagccagtaaatatagagactgagccaccgtttggagagtcctacatagtagtcggtgccggtgaaaaggcgctaaaattaagttggttcaagaggggcagtagtattggtaaaatgttcgaagctacggctaggggcgccagaagaatggcaattttaggcgacacagcctgggacttcggatcgatagggggagtctttaccagtgttggaaagttagttcatcaggtgtttggtaccgcctatggggtactatttagcggagtcagttggaccatgaaaattggaatcgggatattattaacatggttagggctaaactcaagatcaacaagcctttcaatgacctgtattgcagtaggtatggttacattatatttaggagtgatggttcaagcagattcaggttgcgttatcaattggaagggtagagaattgaaatgtggtagtggtatatttgtcaccaatgaagtacatacgtggacggaacagtataaattccaagccgattcccccaaaagactgagtgcagcaataggaaaggcttgggaggagggggtgtgcggcatacgatcagcgacgagactagaaaatataatgtggaaacaaatatcaaatgagttaaaccacatattactagaaaacgatatgaaattcacagtggtggtcggagatgcgaacggaatactcgcacaaggaaagaaaatgatcagaccacagcctatggagcacaaatactcttggaaaagttggggaaaggcgaagattataggagcggacatacaaaacactacatttataattgatggacccgatactccagagtgcccggatggacaaagagcatggaatatttgggaggtggaagactacggttttggagtattcacaacgaacatatggttaaaattaagggactcctatacccaaatgtgtgaccaccggctaatgagcgcagcaatcaaagatagtaaagccgtacacgctgacatgggatactggatcgaatcagagaaaaatgaaacgtggaaactagcaagagcttcctttatcgaagtaaaaacttgtacttggccaaaaagtcatacattgtggtcgaatggagtcctagaatccgagatgattatcccaaaaatatatgggggtcccatatcccaacataactacagacctggatactttacgcagactgctggtccctggcatttaggcaaactcgagttggattttaacctatgcgaagggaccactgtagttgttgatgaacactgtggtaatcgtggtccaagtcttaggacaaccacagtaacgggaaaaataatccacgaatggtgctgtagatcatgtacgttaccgcctttaagattcagaggggaagatgggtgttggtacggaatggaaattcgacccgtaaaagaaaaggaggaaaatctagtgaggtctatggtttcagctgggagtggagaagtagatagctttagtctgggtattctctgtgttagcataatgatcgaagaagtaatgagaagtaggtggtcacgcaagatgctaatgaccggtactttagcagtatttttacttcttataatgggacaactcacatggaacgatctaattagactctgcataatggttggtgcgaatgctagcgaccgtatgggaatgggaacaacatacttggcactgatggcaacttttaagatgagacctatgtttgctgttggtctcctatttcgtcgattgacatcccgcgaagtactgctactaacgattggtctgagtttggttgcatccgtagaattaccaaattcgcttgaagaattaggtgacggattagcaatgggaataatgatgctgaaactccttactgaatttcagccgcatcaactttggacaactctattgtcattaacattcgtaaaaacgacattgtctctagattacgcatggaagacaactgcaatggttttatctatagtaagcctcttcccattatgtttaagtacgacgagccagaaaacgacctggttaccggttttactagggtcgtttggatgtaaaccttcaactatgtttctcataaccgaaaataaaatttggggaagaaaatcctggccgcttaatgaaggaatcatggcgatcggaattgtgagtatactcctaagctctctgcttaaaaacgatgttccattagcgggtcctttaatagccgggggaatgcttattgcttgttatgtcatctcgggcagctcagcagacttgagcctagaaaaagcagctgaagtttcatgggaacaagaagccgaacactcaggagcttctcataacattctagtggaagtacaggacgacggcacaatgaagataaaagatgaagaacgtgatgacacattgacgatacttcttaaagcaacgctgctcgcagtgtcaggggtgtacccaatgtcgatcccggcgacattatttgtctggtatttctggcagaaaaagaagcaaagatcgggagtgctatgggatacaccaagcccaccggaagtcgaacgcgcggttcttgatgacgggatctacagaatactacaaaggggcctattaggaagaagtcaagtcggggttggagtattccaagatggtgtttttcacactatgtggcatgtcaccaggggagctgtgctcatgtaccaagggaaacgactagagcctagttgggcatcagtcaagaaagatctaatcagctacggtggaggttggcggtttcagggaagttggaatacaggcgaagaagtacaagtaattgcggtcgaacccggcaaaaatcccaaaaatgttcaaactacaccgggtacgttcaaaacaccagaaggggaggtaggggccatagctcttgactttaagccgggaacaagtggatcgccaatagtaaaccgagagggaaaaatagtcggcctttacggcaacggtgtagtgacgacgtcagggacgtacgtatcagcgatcgcccaagcgaaagcatcgcaggaaggtccactgccagaaatagaagatgaagtattcaagaaaagaaatctaactataatggacttgcatccgggctcaggtaagactcgccgctacttaccagctatagtacgtgaagctataaaaagaaagttgaggactttgatcttagctccgactcgtgttgtagcgagtgaaatggctgaggctttaaaaggcatgccaattcgatatcagaccactgccgtaaaaagcgaacatacgggaagagaaatagtagacctaatgtgccacgcaactttcacaatgagattactttcgccggtcagggtcccaaattataacatgataataatggacgaagctcacttcactgacccagctagtattgccgcaaggggctacatcagcacaagagtaggtatgggagaagcagcagcgatatttatgacggccacaccaccgggaagcgtagaagcattcccacagagtaatgctgtaattcaagatgaagagagggacattccagagaggtcatggaactcgggatacgactggattactgatttcccaggcaaaacggtttggtttgtgccaagtattaaatctgggaacgacattgcaaactgtttacgcaagaatgggaaacgtgttatacagctctctcgcaaaacatttgatacggaataccagaagactaagaataacgattgggactacgttgtaacaaccgatataagcgaaatgggagcaaacttccgggccgatcgggttatcgatccacgtagatgtttgaaaccagttatactcaaggatggcccggagcgtgtcatcttagcaggcccaatgcctgtgaccgtggcatcagctgcccagagaagaggccgtataggccgcaatcaaaacaaggaaggtgatcaatatgtatacatgggtcaacctctcaataacgacgaggaccatgcacattggacagaggcaaaaatgctactagacaacataaatactccggaaggaataatacctgccctatttgagcctgaacgtgagaagtctgcggcaatagatggtgaatatagactaagaggtgaggcacgaaaaactttcgtagaacttatgagaagaggcgatctgcctgtatggctttcttataaagttgcatctgaaggatttcaatattccgatcgtaggtggtgcttcgacggggagcgcaataaccaagtattagaggaaaatatggacgtagaaatctggacgaaagagggagaacggaagaaactaagaccacggtggttagatgcccgaacgtattcagacccacttgcgctgagagaatttaaagaatttgcagctggtcgtcggagcgtctccggtgatttaattcttgaaataggtaaattaccacaacatctaaccttaagagctcagaatgcattagacaaccttgtgatgctacataattcagaacaaggagggaaagcatacagacacgcaatggaagaactgcccgatacaatagagactcttatgctccttgctctaatcgctgtcttaacgggcggagtcacactatttttcttatcgggaaaaggattaggaaaaacttcgattgggttgctatgtgtcacagcatcatcagcactcctttggatggcgtcagtagaaccacattggattgccgcatcaattatactcgaatttttcttaatggtcctattgataccagaacctgacagacagaggacaccacaggataatcaattagcatatgtggtaattggacttctatttatgatactaaccgtagctgctaacgaaatgggtttattggagacgaccaagaaagacctagggataggctatgtcgccgcggagaaccatcaacacgctaccatgttagatgtggacttacatccagcgagcgcatggacgctctacgcagtcgcaactaccgtaataacccccatgatgagacatacgatcgaaaatactactgcgaatatcagcttaacagcgattgccaatcaagcagccattttgatgggcctcgataaagggtggccaatatcaaaaatggacataggggtacctttacttgctctcggctgttattctcaagttaatccattaacccttacagctgcagtacttatgttagttgcacattacgcaataataggacctggcttacaggcaaaagctaccagagaagctcaaaagaggaccgcagcaggcataatgaaaaatccaaccgtagacgggatagttgcaatagatttggacccggtagtttacgacgcgaaatttgaaaaacaattaggacagattatgctactgatcctgtgtacttctcaaatactattaatgaggacaacttgggcgttatgtgagagcataacgctagctacaggtccacttaccactctttgggaaggaagcccgggaaagttttggaatacgacgatagctgttagtatggcaaacatatttcgcggaagctacctagcaggagctggcttagcattcagtctcatgaaatcgctcgggggcggaagaaggggtacgggggctcaaggggaaacattaggtgaaaaatggaaaagacagctgaaccagttaagtaaatcagaatttaacacatacaaacgctcaggaatcatggaagtagatcgcagcgaagcaaaggaaggtttaaaaagaggggaaacaacgaaacatgcagttagcaggggaactgcaaaattaaggtggttcgtagaaaggaatctagttaaacccgaaggtaaagtaatagatttgggatgtggaaggggtggctggagttattattgtgcaggactcaaaaaggtaacagaagtaaaaggatatacaaaaggaggaccaggacatgaggaaccaatacctatggcaacatatggctggaatttagtcaaactacattcaggcaaagacgtattctttatgccccctgagaaatgtgataccctactttgtgatataggtgaaagctctccaaaccccacgattgaagaagggaggacactaagagttttaaaaatggttgaaccctggttgagaggaaaccaattctgtataaaaatcttaaacccttacatgccatccgttgttgagacgttagaacaaatgcaaaggaaacatggcggaatgcttgtaagaaacccattaagccgaaatagtacacatgagatgtattgggttagttgtggaactggaaacatagttagtgccgtaaatatgacatcgcgtatgttactaaacagattcacaatggcacacaggaaacctacatatgagagagatgtcgatttaggcgcgggtactaggcatgttgcagtcgaaccagaagtcgcaaatttagatattatcggacaacgcatagaaaacattaaaaatgaacataaatcaacctggcattatgatgaagataatccgtataaaacatgggcctatcatggatcctatgaggtaaaaccgagcggaagcgcttccagtatggtaaatggtgttgtaagattattaacaaaaccatgggacgttatccccatggttacgcagatcgcaatgacagacacaacaccattcgggcagcaaagagttttcaaagaaaaagtagatacaagaaccccaagagcgaaaagaggcactacccaaataatggaagtcacagccaaatggctttggggatttctttctcgcaacaagaaaccgcggatctgtactagagaagagtttaccagaaaagtccgatcaaacgcagctatcggtgctgtattcgttgatgaaaaccaatggaactctgctaaagaagctgtagaagatgaaagattctgggatctagtacatcgcgaaagggagttacacaaacaaggcaagtgtgctacttgcgtctataatatgatgggtaagagggagaaaaagttaggggaatttggcaaagcgaagggcagtcgggcgatctggtatatgtggttaggagctaggtttttagagttcgaagctctcggctttatgaacgaagatcactggttctcgcgcgaaaatagtttgtctggcgtggaaggagaaggtttacacaaacttggttacatactacgggatatttcaaagatcccagggggtaacatgtacgcagacgatacagcaggatgggacacacggataactgaggacgatttgcaaaatgaagctaagataacggacattatggaacccgaacatgcgttgttagcgacgagcatatttaaactaacctatcagaacaaagtagtacgtgtacagagacctgccaaaaatggcacagttatggacgtaatctctcgaagggaccaacgtggctcgggtcaagtaggaacatatggtctcaatacttttacaaatatggaagtacaactcattcgtcaaatggagagcgaaggcatattcctaccatcagaattggaaacacccaatctagcagaacgtgcacttgattggctggaaaaacatggggctgaaagacttaaaagaatggctatatcgggagacgattgtgtggtaaaacccatagatgacagattcgcgacggcactgaccgcactcaatgatatgggaaaagttaggaaagatatccctcaatgggaaccaagtaagggttggaatgattggcaacaagttccgttttgctcacatcatttccatcagttaatcatgaaagatggaagggaaatagtcgtcccgtgtaggaaccaagacgaattagttggtcgtgcccgcgtaagtcaaggagctggttggagcttgcgagaaaccgcatgcttaggaaaaagttatgctcaaatgtggcaactcatgtattttcaccgtagggatctgcgcctagctgctaacgcaatatgctctgctgttccagtagattgggtccctacatcgcgtacgacatggagcattcatgcacatcaccaatggatgacaacagaagacatgttgtcagtatggaacagggtatggatcgaagaaaacccttggatggaagataaaacccacgtgagttcatgggaagaagtaccatatctcggaaagcgtgaagaccaatggtgtggtagtctaataggactaacagcaagagcaacctgggcgactaacatccaagttgcaattaaccaagttcgaaggctcataggtaatgaaaactattcagattatatgacatccatgaaacgatttaaaaatgaaagcgatccggaaggtgcattatggtga

SEQ ID NO: 21438 - RNA, 9879 nt, synthetic construct
  misc_feature 1..9879: note = derived and/or modified CDS sequence (opt6) from DENV-1__GU056032__SS-prME
  source 1..9879: mol_type = other RNA
tcagtagcaatgttattaatgttactaccaacagcactggcctttcacttaacgacaagaggaggggaaccgcacatgatagtcagcaaacaagaaagagggaaatcgctactctttaaaaccagcgcgggtgtcaacatgtgcacattaatagcaatggatttaggggaactttgcgaagacactatgacatataaatgcccaagaataacagaagcagaacccgatgatgttgactgctggtgtaacgcaacagatacatgggttacatatggcacatgttcacaaactggagagcacagaagagataaacgtagcgttgctttagcaccacacgtgggtttaggactcgagacgagaacagaaacatggatgtcaagtgagggtgcgtggaaacaaatacaacgtgtagaaacctgggctttaaggcaccctggatttacagtgattgcactctttttggctcatgctatcggtacatcgattacacaaaaaggtattatatttatattattaatgcttgtcacaccaagcatggccatgagatgcgtggggataggaaatcgggactttgtagaagggttaagtggcgcaacgtgggtggatgtagtacttgaacatggctcttgcgtgaccactatggccaaaaataaaccgaccctagatatcgaactattgaaaacagaagtaactaacccagcagtgctacgcaaattgtgtattgaagcgaaaattagtaacaccactacggattcaagatgtccgactcaaggcgaagcgaccctagtggaagaacaggatgcaaattttgtatgccgccgaacattcgtagatagaggctgggggaacggatgtggtctgtttggcaaggggagcttgcttacatgtgcaaagttcaaatgcgtcaccaagttagaagggaaaatagtgcaatatgaaaatctaaaatattcagtcatagtcacagtacacacgggtgatcaacatcaagtcggcaacgagacaacggaacatggcacaattgcgactattactccacaagcaccgacaagtgaaatacagctaaccgattacggggcactaacattagactgctcgcctagaacaggcctagattttaatgagatggtcttattaactatgaaagaaaaatcatggctggtacataaacagtggtttctggatctaccattgccgtggacatcaggagcctcaacaagccaagaaacttggaaccgtcaagatttacttgtgacgtttaagacagcgcatgctaagaagcaagaagtagtagtgttgggtagccaagaaggtgccatgcacactgctttaacgggagctactgaaatccaaacctccggcacaacaactatatttgcaggtcaccttaaatgtagattaaagatggataagttaaccttgaaaggcacgagttatgtaatgtgtactgggtcatttaaactagagaaagaagtagcggaaacacagcacggaacagttttagtacaggttaaatatgaagggacagacgcaccatgcaaaattcccttcagtacccaggatgagaagggtgtgacacagaacggaagattaattactgccaatccgattgtaacagataaagagaagcctgttaatattgaaaccgaaccacccttcggcgaatcgtatatagtggtaggagcaggagaaaaagcgttaaagttatcgtggtttaagaaaggaagctccattggcaaaatgtttgaagcaacggccagaggagctagaagaatggctatcttaggcgataccgcttgggattttggtagtattggaggcgtgtttacatctgtagggaaacttgtccatcaagtatttggaaccgcgtacggtgttctttttagcggtgtgtcatggactatgaagatcggaataggaatacttctaacatggttgggtctaaatagccgtagcactagcctttcaatgacttgcatagcagtaggcatggtaacactctacctgggagtaatggtacaagcagactcaggctgtgtcatcaactggaaaggaagagaattaaaatgcggaagcggtatattcgttacaaacgaagtacacacatggacggaacaatataagtttcaagctgactcaccaaaaaggctatctgcagcaattggaaaggcttgggaagaaggagtttgcggaataagaagtgcaacaaggttggagaatatcatgtggaaacagatttcaaatgaactcaaccatattcttctagaaaacgacatgaaattcacagtagttgtgggagatgctaacggcatcttagcacaagggaaaaagatgataagaccacaaccgatggaacataagtactcttggaaatcttggggcaaagcgaagatcattggcgcagacatacaaaatacaacatttattattgatggtccagatacgccagagtgtcctgacgaccagcgagcttggaatatatgggaggtagaagattatggttttggtatatttacaaccaatatatggttaaaactaagagactcttatactcaaatgtgcgatcataggcttatgtctgctgctataaaggacagcaaagcggtgcatgcagacatgggatactggatagaatcggagaaaaatgaaacctggaaactggcacgtgcaagttttattgaggttaagacttgcacgtggccaaagagtcacactttatggtctaatggagtcctcgaaagtgaaatgataatacctaagatttatggcggaccaatttcgcagcacaattatagaccaggttattttactcaaacggcgggaccgtggcatttagggaaacttgaacttgactttgacctctgcgaaggtacgaccgtcgttgtcgatgaacattgtggaaaccgaggaccgtctctgagaacaacaaccgtcacgggtaaaattatccatgaatggtgttgtcggtcatgcactcttcctccattaagatttcgtggagaagacggatgttggtacgggatggagatccgaccggtaaaggaaaaagaagaaaacttggtgcgttccatggtaagcgcaggtagtggcgaagtagacagctttagtttaggtatattatgtgtcagcatcatgatcgaagaagtaatgagaagccgatggagtagaaaaatgctgatgacaggcacacttgccgtatttttgttgctaattatgggtcagttaacttggaacgacctaataaggctatgcataatggtcggcgccaacgcaagcgatcgtatgggcatggggacgacatatcttgccctaatggcaacgtttaagatgaggccgatgtttgcagtcggacttttgtttcgtagattaacctcgagagaagtattactgctcacaataggacttagcttagttgcgtccgtcgaattacccaactcgttagaggaacttggagatgggcttgcaatgggtataatgatgttgaagctgttgacggaatttcaacctcatcaactatggacaacgctcctgagcctgacatttattaaaacaactctatcattagactatgcatggaaaaccacggctatggtactatcaatagttagcctgtttccactatgtttatctacaacgtcccagaaaacaacatggctccctgtacttttaggaagtttcgggtgtaaacccttaacaatgtttctaattacagaaaataaaatctggggacgtaaatcttggccacttaatgaaggaataatggctgtcggcattgtatctatgttattaagtagtttactaaagaacgacgttcctttagcaggacccttaatagcaggaggaatgcttatagcgtgttacgttataagtggtagtagcgcggacttatctctagaaaaagctgccgaggtctcatgggaacaagaggccgagcattcaggcacaagccacaacatattagttgaagttcaagatgatggaactatgaaaatcaaagacgaagaacgagacgataccttaactattttgttaaaagcaacactgttagcggtatcaggagtatatccaatgtcaatacctgccacgttgttcgtttggtacttttggcagaagaagaaacaaaggtcaggagttctttgggacacgccatcaccaccagaagtcgagcgggcagttttagatgatggtatttatagaatcctgcaacgtggtttgctaggaagatctcaggtgggtgtcggagtattccaagatggagtgtttcatactatgtggcacgtgactagaggtgcagttctaatgtaccagggtaaaaggctggaacccagttgggcttcagtaaagaaagacttaatatcatatggaggcggctggaggtttcagggatcatggaacaccggagaagaagtccaagtaattgccgtggagccgggcaaaaaccctaaaaacgttcaaacaactcctgggacatttaaaacccctgaaggggaggtcggtgcaattgctttggatttcaagcctggtacctctggtagtcccattgtgaatagagaagggaagatagtgggactttatggaaatggagtagttaccacgtcaggtacttatgtatcggctatagcgcaagctaaggcttcacaggaaggacctctgcccgaaatagaagatgaagtctttaagaaaaggaatttaacgattatggatctgcaccccggatcaggaaagacacgtcgatacttacccgctattgtaagggaggctataaagcgaaaactaagaacgctaattctcgcgccgacacgagttgtagcatcggaaatggcggaagccctaaaaggtatgccaattaggtatcaaacaacagcggtaaaatcagaacacacggggagagaaattgttgatttaatgtgtcacgccacatttaccatgcggttattatcacctgttagagttccaaactataacatgatcataatggatgaagcacatttcactgatcctgcatcaattgctgcaagaggatacataagtacacgagtcgggatgggggaggctgcagctatctttatgacagctactccaccaggatcagtcgaggcttttccccaatcaaacgctgtgattcaagacgaagaaagggatataccggaaagaagttggaactccggttatgattggataacagatttcccaggcaagacagtttggttcgtaccgtcaatcaaatcgggaaatgatattgctaattgtttgagaaagaacggtaaacgagtcattcaacttagcaggaaaacttttgacacagagtatcaaaagacgaaaaataatgactgggactatgttgtgactacagacatttctgagatgggagcgaatttcagagcggatagagtaatagatccgagacggtgcttgaaacctgtcattttaaaagacggacctgaaagagttattcttgcaggtccaatgcctgttacagtcgcgtctgcagcgcaaagacgcggaagaattgggagaaatcaaaacaaagagggagatcaatatgtttacatgggacaacctttaaataatgacgaagatcatgctcactggacagaagccaagatgttactagataatataaatacgccagaaggaattatacccgctcttttcgaaccagaaagagagaaaagcgcagcaatcgatggggagtatcggctaaggggagaagctcgaaaaacatttgtagagttaatgcgcaggggagatctaccagtatggctttcatataaggtagcaagcgaaggatttcaatactctgatagaagatggtgctttgacggagaacgcaataaccaggtactagaggaaaacatggatgtagaaatatggacaaaggaaggtgaacgaaagaagttacgtcctaggtggctagatgcgagaacgtactctgatccattagccttgcgagaatttaaagaatttgcagctggaaggcgatccgtctcaggcgatctaatattggaaattggaaagctgccacagcacctaactctaagagcacaaaacgcattagataatctagtcatgcttcataactcggaacaaggcggcaaagcatatagacatgctatggaagaacttcccgacacaatagaaaccttaatgctattagctctaatagcggtgttaaccggcggggttacattgttcttcctgagcggaaaagggcttggtaagacaagtattgggttgctatgtgttacagcatcatctgctttactttggatggcgagtgtagaaccgcactggattgccgcatcaataatattggagttctttttaatggtcttattaattccagaaccagatcgacagagaactccacaagataaccaactcgcctacgttgtaatcggcttactattcatgatactaacggtagcagcaaatgaaatgggactgttggaaaccaccaagaaagatttgggaatcggacatgtggcagcggaaaaccatcaacatgcaacaatgctcgatgtagacttgcgaccagcaagtgcgtggacactatacgcggtggctacaacagtgataactcccatgatgaggcatacgatagaaaatacaacggcaaacattagtcttactgccatcgcaaatcaagcagctattctaatgggcttggataaaggatggccgattagtaagatggatataggagtgccactattggcattaggatgctatagccaagtcaatccattaactctgacggcagctgtgttgatgttagtagcacactatgctattattggtcccggattacaggcaaaagcaaccagggaagcccagaaaagaacagccgcaggaataatgaagaatccaacggtagacggaatcgttgcgatagatttagatcctgtggtatacgacgcaaagtttgaaaaacaacttggacaaatcatgctattaatcctatgtacatcacaaatattattaatgagaacgacctgggcactgtgtgaaagtataacactagcgacagggccattaaccactctttgggagggcagtccaggtaaattttggaatactacgatagcagtaagtatggccaatatctttaggggatcatacctagcaggagccggattagcgttcagcttgatgaaaagcctaggaggcgggcgcaggggcacaggagcgcaaggagaaacattaggggaaaagtggaagcgtcagttgaatcaactgtcgaaaagtgaatttaatacatacaagcggtctggaatcatggaagtagacaggagcgaagcgaaagaaggtctaaaaaggggagaaacaacaaaacacgccgtaagtaggggaacagctaaacttcgttggtttgttgaaagaaacctagtcaaaccggaaggcaaggtaattgacttaggttgtggaaggggaggctggagttattactgtgcgggtctaaagaaagtcacagaggtaaaggggtataccaaaggaggacccggacatgaagaaccgatcccaatggcgacctacgggtggaacttagtaaaactgcacagcggcaaggatgtcttcttcatgcccccagagaagtgtgacacgctactttgtgatatcggagaatcatctccaaatcctacgatagaggaaggaagaacactaagagtactgaaaatggtagaaccctggttaagggggaaccaattctgtataaaaattctaaacccgtatatgccctcagtcgtagaaaccttggaacaaatgcaacggaagcatgggggtatgttagtaagaaatccattatctcgcaatagcacccatgagatgtactgggtatcctgtggcacgggaaacatagtttctgcggtaaatatgacaagtcgaatgttgctaaatagatttactatggcgcaccggaagcccacctatgagcgagatgtagaccttggcgcgggaacaaggcatgtcgcagtagaaccggaggttgcaaatttagacataattggtcaacgtatagaaaatatcaaaaatgaacataaatcaacttggcattatgatgaggacaatccttataagacatgggcatatcacggtagttatgaggtaaaacctagtggatccgcgtcatcaatggtcaacggtgtagtcagactgctaactaaaccttgggatgttataccaatggtcacacaaattgcgatgacggacacaacaccattcggtcaacaaagagtgtttaaagagaaggtagataccagaacgccgagagcaaagcgtggcacgacacagattatggaagtaacagcaaaatggctttggggatttttatcgcgaaacaagaaaccgaggatatgcacacgagaagagttcaccagaaaagtacggtctaatgcagctattggagcagtatttgtagacgaaaatcaatggaactctgctaaagaagcggttgaagatgaacgcttctgggatttagttcatagggaaagagaattacacaaacaaggaaaatgtgctacgtgcgtatacaatatgatggggaaaagggagaagaaactgggagaatttgggaaagcaaaaggctcaagagccatttggtatatgtggttgggtgctaggtttcttgaatttgaagcgcttggttttatgaatgaagatcactggttttcgcgagaaaattctctctccggggttgaaggggaaggtttacataagttaggttatattttaagagatatttcaaaaattccgggaggaaacatgtacgctgatgatactgcggggtgggatacacgaattactgaagacgatcttcaaaatgaagcgaagataacggacataatggagcctgaacatgcactcttagccacaagcatatttaaacttacgtatcaaaacaaggtcgtgagggtccaaaggcctgctaaaaatggtacagttatggatgtaatatcacgacgagaccagcgtggatcaggacaagtgggaacctatggtctaaacacctttacaaatatggaagtacaactcattagacagatggagtccgaaggaatcttcctgccaagcgagctagagacacccaaccttgcagaaagggtgctggactggttagagaaacatggtgcggaacgattaaaaagaatggcgatttcaggcgatgattgtgtagtcaagccgattgatgatcgtttcgctacggctttgactgccttgaacgacatgggcaaaataagaaaagacatcccacaatgggagccgtccaaaggatggaatgattggcagcaggtaccgttttgtagtcatcatttccatcagctaattatgaaagatggtcgtgaaatagttgttccatgtcggaatcaagatgagttagtaggacgagcacgcgtcagccaaggagctggatggtcgttacgagaaacggcatgcctcggtaaatcatatgcacaaatgtggcaattaatgtacttccataggagagatttacgacttgcagcgaacgcgatatgtagtgcggtaccggtagattgggtaccaacaagtaggacaacatggagcatacatgcgcatcatcaatggatgacgacagaggatatgttaagcgtctggaacagggtctggatagaagagaacccctggatggaagacaagactcacgtatcttcgtgggaagaagtgccttacctgggaaaacgagaagatcaatggtgcgggtctttaataggattgaccgcacgtgctacttgggctaccaatatccaggtagcaattaatcaggtgcgcaggcttataggtaacgaaaactacttagattatatgacaagcatgaaaagattcaaaaatgaatctgatactgaaggagcactttggtga

SEQ ID NO: 21439 - RNA, 9879 nt, synthetic construct
  misc_feature 1..9879: note = derived and/or modified CDS sequence (opt6) from DENV-1__GU056033__SS-prME
  source 1..9879: mol_type = other RNA
tctgtgacgatgttgctgatgcttctaccaaccgcactagctttccatctaactaccagaggtggggaaccgcatatgattgtatcgaaacaagaaagagggaaatcgctattgttcaaaacaagtgtaggtgtgaacatgtgtactcttatagcaatggatttaggagaactttgtgaagatacaatgacttacaaatgtcctcggattaccgaagcggaacctgacgatgtcgattgctggtgtaacgcaaccgatacatgggtaacctacggtacatgtagtcaaacgggtgaacacaggcgagacaaaagaagtgttgcgctagcaccgcatgtggggttaggcctagaaacaagaactgaaacatggatgagctctgaaggggcatggaaacagatccaaagggttgagacctgggcacttcgacatccagggttcacagttattgcactattcttagctcatgctataggtacaagtattactcaaaaaggaataatatttattctgctcatgttagtcaccccttctatggcgatgcgttgtgtaggtataggcaaccgggacttcgtcgaaggattaagtggggctacatgggtcgatgtagtgctagaacatggaagctgtgttacgactatggccaaaaacaaaccaactctcgacattgaattgctaaaaactgaagttacgaaccctgcagtactgagaaaactgtgtatagaggcaaaaattagtaatacaactacagactctagatgtcccactcaaggggaggcgacgttggttgaagaacaagacgcaaattttgtatgtagacggacatttgtggatcgtggttggggtaacggatgtggactcttcggtaaaggttctcttctaacctgcgcaaaattcaaatgcgttacaaaactagaaggtaaaattgtacaatatgaaaacctgaaatattcggtcatagtaactgttcatacaggggaccagcaccaagttggcaatgagaccacagaacatggaacaattgcaacaattactcctcaagctcctacatcagaaatacagttgacagactatggggctttgactctagactgcagtccacggaccggactcgactttaacgaaatggtattattaacaatgaaagaaaaatcttggctagtacacaaacaatggtttttagacttaccgttaccatggacatcaggagcatctacatctcaagaaacgtggaatagacaagacctgctagtaactttcaaaacggcacacgccaagaaacaagaagtagtagtactaggtagccaagaaggtgcaatgcatacggcactgactggagcaaccgaaattcaaacttctgggactaccacaatatttgcagggcaccttaaatgtagattgaaaatggacaaattgacgcttaaggggatgtcttatgtcatgtgtacaggttcattcaaattagagaaagaagtagcagaaacgcaacatggtacagtgcttgtacaagtgaaatatgaaggtacggatgctccatgtaaaattccattctctacacaagacgaaaaaggagtgacacagaatggtcgacttataacggcgaatcctatagtaaccgataaagagaaaccagtgaacattgaaacggaacctccctttggagaatcatatattgttgttggtgccggtgaaaaagcccttaaattaagctggtttaagaaaggtagcagtataggcaaaatgtttgaagccaccgctagaggtgcaagacgcatggcaatcttgggagatacagcatgggactttgggtctatcggcggtgttttcaccagcgttgggaagctagtgcatcaagtttttggaacagcgtatggtgtattatttagcggtgtatcatggacaatgaaaataggaataggcatcttattaacatggctgggtttgaatagtagatcaacatctttgagtatgacctgtattgcggtgggaatggtgactctttatctaggagtaatggtgcaagcagactcgggatgcgttataaattggaaagggagagaattaaaatgtggaagtggcatttttgtaactaacgaagtacatacttggactgaacaatacaaattccaagcagattccccaaaaagactttcggctgcaatagggaaggcttgggaagaaggagtttgtggtatcagaagtgcaacaaggcttgagaatatcatgtggaaacagatatctaatgaattaaaccatattctgttagaaaatgacatgaaatttactgtcgtggtaggtgatgttaacggcatattagctcaagggaagaaaatgatacggccacaaccaatggaacataaatattcttggaaaagttgggggaaagcaaaaataataggagcagacatacaaaataccacctttataatagatggtcctgacactccagaatgtccggatgaccaaagagcatggaatatttgggaagttgaagactacggattcggaatattcactaccaacatatggctaaaacttcgggatagttacacacaaatgtgtgaccatagattaatgtctgccgcaattaaagattccaaggctgtccacgccgatatgggatattggattgaaagtgagaaaaacgagacatggaaactggctaaggcctcatttattgaagtaaaaacgtgcatctggccaaagtcacatacattatggagtaacggtgtactagaaagcgaaatgataataccgaagatatacggaggccccatatcacagcataactatagacctggttacttcacacaaacagcaggtccgtggcacttaggtaagttagagttggactttgatctttgtgaagggactactgttgttgtggatgaacattgtgggaacagaggcccctctttgcgcactacgacagttactggtaaaattatacatgaatggtgttgccggagctgtacacttcccccactgcgattcaggggagaagatggttgctggtatggaatggaaatcagacctgtaaaggaaaaggaagaaaatcttgttaggagtatggtatcagcaggatcaggagaagtcgactcattctcactgggtattctatgtgtaagcataatgattgaggaggtgatgagaagcagatggagtaggaaaatgttaatgaccggcacattagctgtattcctactactaattatgggacaattgacttggaacgacttaatacgactttgtatcatggtaggagctaatgctagcgataggatgggaatgggaactacctatttggccctaatggcgacatttaaaatgaggcctatgttcgcagttggactattatttcgtaggttaacttctagggaagtactactactaacgataggattgagtctggttgcaagcgtagagttgcctaacagcctagaagaactgggtgatggactagcaatgggtataatgatgttaaaactactcacagaatttcagccacaccagctctggaccacgttactctcactaacatttataaagacaacgctgagtctagactatgcgtggaaaacaactgcaatggcattaagtatcgtgtccctatttccgttatgtctgtcgacaaccagccagaaaactacatggctccctgtgctcctaggatcgtttggatgcaaaccactcacaatgttcctaataaccgaaaataaaatctgggggcgaaagtcatggccacttaatgaaggtataatggccataggcatagtatctatactattaagtagtctacttaaaaatgacgttcctctagcaggacctttaatagccggcggtatgttgatagcatgctacgtaattagtggctcgtcggctgatttgtccttggaaaaagccgctgaagtatcttgggaacaggaagcagaacactctgggacaagtcacaacatacttgttgaagtacaagacgatggtacgatgaaaataaaagacgaagagagagacgatacccttacaatcttactaaaggccacacttttagctgtgagtggcgtatacccgatgagcataccagcgacgctttttgtttggtatttttggcagaagaagaaacaaaggtcaggggtgttatgggacactccttcacccccagaggttgaaagggccgtgctagacgacggcatttacagaattagtcaaagagggttgttaggacgctcacaagtcggagtgggggtttttcaagatggagttttccacaccatgtggcacgtaacacgtggtgctgtgttaatgtatcaggggaaacgtttagaacccagttgggcgtcagtcaagaaagatttaatatcatacggaggtggatggagatttcagggatcctggaataccggagaggaagtacaagtaattgccgttgaaccgggcaagaatcccaaaaatgtgcagacaacgcctggtactttcaaaaccccagaaggcgaagtgggagcaatagcacttgattttaagccgggtacaagtgggagtcccatagtaaaccgtgagggcaaaattgtaggcctatatgggaatggtgtagttacaaccagcggaacatacgtatccgcaatagcccaagctaaagcatcacaagaaggtcctttacccgaaatagaagacgaagtctttaagaagagaaacctcactataatggaccttcatcctggttcggggaagactaggcggtacttaccagctatagtccgcgaagccatcaaacgtaaacttagaacattaatattagcaccaacccgtgtggtcgcaagtgaaatggcagaagcattaaaaggaatgcctataaggtatcaaactacagcagtgaaatccgaacatactggtcgtgaaattgttgaccttatgtgtcatgccactttcacaatgcgactcttaagtccagtaagagtgcccaattataatatgataatcatggatgaagctcactttacagatccggcttctattgcagcaaggggatatatatcaacacgtgttggaatgggtgaagcggccgcaatatttatgacagcaacacctcccggcagtgtcgaagcatttccacaatcgaatgcggtgattcaggacgaagaaagggatatacctgaaaggtcttggaactcaggctacgattggatcactgactttcccggtaagaccgtttggttcgtgccaagcatcaaaagtggaaatgacattgcaaattgccttaggaagaatggaaaaagagttatacaactgtcaaggaagacatttgacactgaatatcagaaaactaaaaataacgattgggattacgtggtaaccacagacatatctgagatgggagctaactttagagcagatcgagtaatagacccaaggcgttgtctcaaaccagtcattttgaaagatggtccggagcgggttatattagccggaccaatgcctgtaacagtcgctagcgcagcacaacgacgtggaagaatcggaagaaatcaaaataaggaaggggatcaatacgtttacatggggcaacctctaaacaatgatgaagatcatgcacactggacagaagcaaagatgttgctagataatattaatacgcctgaaggaataattccggcattattcgaacctgaaagagagaaaagtgcagcaatcgatggcgagtaccgtttgagaggtgaagctagaaaaacgtttgtagaattaatgagacgaggagacttgcctgtatggctgtcgtataaagtagcaagtgagggtttccagtactcggatagaagatggtgttttgatggggaaagaaataatcaggtactggaagaaaatatggatgtcgaaatttggactaaagagggagagcgtaagaaattacggccacgatggctggatgcgagaacatacagcgatccactggcccttagagaatttaaagagtttgcagctggaagaagatccgtatccggtgacttaatacttgaaatagggaagttgccacaacatcttactctcagggcacaaaacgcactcgacaatctggtaatgctccataactctgaacaaggcggtaaagcatacagacatgccatggaagaattacctgatactatagaaacactaatgctacttgctttaatcgctgtgcttacaggaggggttacactattctttctaagcggaaaagggctaggtaaaacatccataggactattgtgtgttacggcctcttcagcattattatggatggcgtctgtagaaccacactggatagccgcctcgataatattagagttctttcttatggttctcctaattccagaaccagatagacaaagaacacctcaagataatcagttagcatatgttgttataggcttactattcatgatactcactgtcgcggcaaatgaaatgggcctactcgaaactactaagaaagatctcggtattggccacgtcgccgcggaaagtcatcaacatgctacaatgctggatgtggatcttagacccgctagtgcttggacactttatgcagtggctacaacggttatcactccaatgatgaggcatacaattgagaacacgacagccaatataagtctgacagcgattgcaaaccaagcggcaattctaatgggtcttgacaaggggtggcccatatctaagatggatataggcgtacctcttctggcgttaggctgttattcccaagtaaatccgctaacgctcacagctgctgtccttatgttggtagcacactatgcaattataggacccggactacaagcaaaagctacaagagaagcacagaaaaggacggcagccggaattatgaaaaatcccacggtcgatggcattgttgccatagatttggacccagttgtctatgatgcaaaatttgaaaaacagttgggccaaattatgctgttaatactatgcacttcccaaatactgttaatgagaacaacctgggcgttgtgcgaatcgataacgttagcaacaggcccacttactactttatgggagggttccccaggcaaattttggaacacaacaattgctgtgtcaatggcaaatatattcagaggttcctatttagccggagctggtttagcgttttcactaatgaaatctctaggcggaggtaggagaggtaccggagcacaaggcgaaaccttaggagaaaaatggaaaagacaattgaatcagttgtccaagacggagtttaacacctacaagcgaagtggaattatggaagtcgacaggtcagaagcgaaagagggattaaagcgaggcgaaacaacaaaacatgcggtgagtcgcggtaccgcgaaattaagatggttcgttgaacggaatctagtgaagcccgaaggtaaagtaatcgatcttggatgcgggagaggaggatggagctattattgcgctggactcaagaaagttactgaagtgaaaggatatacgaagggtgggctgggtcatgaagaacccatacccatggcaacatacgggtggaatttggtaaagctccactcgggaaaagatgtgtttttcatgccgccagaaaagtgtgacactctactgtgcgatattggcgagtcgagcccgaatccaacaatagaggaagggcgtacattacgagttctaaaaatggtggagccgtggctaagaggcaaccaattttgtattaaaatcttaaatccatacatgccctcagtggtagagacattggaacaaatgcaaagaaaacatggtgggatgctagtgagaaatcccctatcccggaatagtacacatgaaatgtattgggtatcttgtggaactggaaacattgtctcagcggtaaacatgacaagccgaatgcttcttaatcgtttcactatggctcatagaaaaccgacatacgagcgagatgtagacttaggcgcgggtacgagacacgtagctgtagaaccagaagttgcaaacctagatataataggtcaaaggattgaaaatatcaaaaacgagcataaaagcacatggcattatgatgaggataatccttataaaacgtgggcctaccacggatcatatgaggtaaagccatcaggttcggcatcatcgatggttaatggtgtcgtcaaactacttactaaaccgtgggatgtaataccaatggtaacacaaattgcgatgacagataccacaccgtttggccagcaacgagtattcaaagagaaggttgacacacgaacgccgcgagctaaacgaggcaccacgcaaataatggaagtaacggctaaatggttatggggatttttgtctcgaaataagaaacccaggatctgcacacgagaagaatttacaagaaaagtaagatcgaacgctgccataggtgcagtttttgtggacgaaaaccaatggaatagtgctaaagaagctgtcgaagacgaaaggttctggaacttagtgcaccgcgaaagagaactccataagcaaggaaaatgtgccacatgtgtctacaacatgatgggcaaacgtgagaagaaactcggtgagtttggaaaagcgaaaggaagtcgagcgatctggtacatgtggcttggagctcggtttcttgagttcgaagcactaggattcatgaacgaggaccattggttttcgcgtgaaaattctctgtccggtgttgaaggtgaaggcttacataaattaggttatatacttcgagacataagcaaaattcctggaggcaacatgtatgctgatgacacagctggatgggacactcgtattacggaagatgatctacagaacgaggctaaaatcaccgacattatggaaccagaacatgctttgttagccacaagcattttcaaactaacttatcaaaacaaggttgtacgagttcaaagaccagcgaaaaatgggactgttatggatgtaatcagtagaagagaccaaagaggatctggacaggtcggaacgtacgggctaaatacgttcaccaatatggaagtacagctaatcagacaaatggaaagcgaaggcattttcttgccatccgagttagaaacgccaaatttggccgagcgagttcttgattggcttgaaaaacacggggccgaaagactaaaaagaatggcgatatcgggcgatgattgtgttgtaaaacccatagatgatcgattcgcaacagcgctaacggcactaaatgacatgggtaaagtaaggaaagacataccacaatgggaacctagtaaaggatggaacgactggcagcaagtgcctttctgcagtcatcattttcaccagttaattatgaaagacggcagggaaattgttgttccatgtaggaatcaagatgagttagttgggcgagcgagagtatcacaaggagcgggttggagtctaagggagacagcttgcttgggaaaaagctacgctcagatgtggcaactaatgtacttccatcgtcgagatctgaggttggcagccaatgcaatttgtagcgcagtgcctgtggattgggttcccaccagtagaacgacatggagcatccatgctcatcaccaatggatgaccaccgaagacatgctttctgtgtggaatagagtttggatagaggaaaacccatggatggaagataagacgcacgtatcatcgtgggaagaagtaccctatttaggtaaaagagaagatcagtggtgtggttctctaataggattaactgcaagagctacatgggccaccaacattcaagtagctataaaccaagttaggagacttattggtaatgaaaattatttagactatatgacaagcatgaaaaggtttaaaaacgagagcgacccagagggagcactatggtga

SEQ ID NO: 21440 - RNA, 9879 nt, synthetic construct
  misc_feature 1..9879: note = derived and/or modified CDS sequence (opt6) from DENV-1__GU131833__SS-prME
  source 1..9879: mol_type = other RNA
tcagtgactatgttattaatgctactgcctactgcgctggcattccacttgactacaagaggtggagaacctcacatgatagtaagtaaacaagaaaggggaaaaagtctattattcaaaacttcagctggagttaacatgtgtacattaatagcaatggatttaggagagctatgtgaagacacgatgacctataaatgcccacgaataaccgaagcggaaccagatgatgttgactgttggtgtaatgccacagatacttgggtaacttacggaacgtgttcacaaacgggtgaacaccgaagagacaaaaggtctgtcgcattagccccacacgttggtctgggcctggaaacgcgtacggaaacctggatgtcctcagagggagcatggaaacaaatacaaagagtcgaaacgtgggccctgagacacccaggatttacagtcatcgccctatttcttgcacacgctattgggacaagcataacgcaaaaaggtattatctttatcctgttgatgttggttactccatctatggcaatgagatgtgtaggcattggcaaccgagatttcgtagagggtttatccggagcaacatgggttgacgtggtgctagaacatggctcttgcgtcacgactatggccaaaaacaaaccaaccttggatatagaacttttaaaaactgaagtaacaaacccagctgtactacgtaaactgtgcattgaagccaaaataagtaacacgacgacagacagtcgttgtcctacccaaggtgaagcaactctagtagaagaacaagatgctaatttcgtatgtcgacgaacctttgtggacagaggttggggaaatgggtgtggactattcggaaaagggtctctgttgacttgcgcgaaatttaaatgtgtaaccaagttagaagggaaaatagttcaatatgaaaacctaaaatattccgtcattgtgacagtacataccggcgaccaacaccaagtaggaaatgaaacgacggaacacggtactatagctaccattacaccacaagctcctacaagtgaaatacaactaacagactacggtgcattgactctcgattgtagtcctagaacaggtctagatttcaatgagatggtacttctaaccatgaaggaaaagtcctggttagtacacaaacaatggtttcttgatcttccactaccatggacaagtggagcctccacgagccaagaaacgtggaatagacaagatctacttgtgacatttaaaactgcacatgcgaagaaacaggaggtagttgtacttggtagccaagaaggggccatgcatacagctctaactggtgccaccgagatacaaactagcggcacaactacaatattcgccgggcatttaaaatgtagactaaaaatggacaaattaacattaaaagggacaagttatgtaatgtgtactggaagttttaaacttgagaaggaagtggcagaaacacaacacggaacggttttagtgcaagtcaagtacgaaggaacggatgcaccctgtaaaataccctttttaactcaggacgaaaagggcgtaacacagaatggacggcttataacggcaaacccaatcgtaacagacaaagaaaaaccagtaaacattgagacggaaccgccgtttggagaatcctacattgttgttggagcaggagaaaaagctcttaaactatcttggtttaagaaaggatcatctataggtaagatgtttgaagcgactgcaagaggagctagaagaatggcaatactcggagatacagcatgggattttggttctattggaggagtctttacatcagtcggtaaactggtgcaccaggtattcggaaccgcatacggcgttttattctcaggcgtaagctggactatgaaaattggcatagggatcttacttacatggctggggttaaatagtaggagtacatcactgtcgatgacctgtattgctgttggtatggtgaccttgtatctcggcgtaatggtacaggcagactctggatgtgtgattaattggaaaggtcgtgaattaaaatgtggctcgggcatcttcgttacgaatgaggtgcatacatggaccgagcaatataagttccaagcagactcaccaaaaagattaagtgcagcaattggcaaggcatgggaagagggagtatgcggaataagaagtgcgactcgccttgaaaacataatgtggaagcaaattagcaacgaactaaatcacatattactggaaaatgacatgaaattcactgtcgtagtcggagacgctaacggaatcttagcacaaggtaagaaaatgatacgaccacagccgatggagcacaagtattcttggaaaagttggggaaaagccaaaataataggtgccgatattcaaaatacaacatttataatcgacggtccggatactcctgagtgtcccgacgatcagcgcgcttggaatatatgggaggtagaagattacgggtttggaatttttacaacgaacatctggttaaaattgagagactcgtatacacagatgtgtgaccatagattaatgtccgccgcgataaaggactcaaaagccgtccatgcagatatgggctactggatcgaatcagagaaaaacgaaacatggaaattggcgcgcgcatctttcatcgaggtgaaaacgtgcacatggccaaagtcacacacactatggtctaatggagtactagaatcagagatgataataccaaaaatctacggaggtccaatctcacaacacaactataggccagggtattttacacaaactgctgggccctggcatttagggaaactagagttggattttgatctctgtgaggggacaacggttgtcgtagatgagcactgcggaaaccgaggacccagcttaagaacaaccaccgtgacgggcaagattatccacgaatggtgttgcagatcatgtactctaccaccactacgatttagaggcgaagacgggtgttggtatgggatggaaatccgcccagtcaaggagaaagaagagaatctcgtgcgatcaatggttagtgcaggcagcggcgaggtagattctttttcattaggtatattatgtgtctcaattatgatcgaagaggtaatgcgctcaagatggagcagaaaaatgctaatgacaggcacgctggccgtattcttacttttaataatgggccaactcacctggaacgacttaataagactatgtataatggtcggagcgaatgcttcggaccgaatggggatgggaacaacctatttagccttaatggcaacttttaaaatgcggcctatgttcgcagtcggactcttattccgtcggttaacatcgcgtgaagtgttattactcactatagggctgtcactggtagcaagtgtagagctaccgaatagcctagaggaacttggagatggactagcaatgggaataatgatgctaaaattactaacggaatttcaaccacaccaattgtggactacgttactgtccctcaccttcatcaagactacgctatcactagattacgcatggaagaccacagctatggcactttctatagtgtcgcttttccctctctgcctctcgacaacatctcagaaaactacgtggttaccagtccttttaggctcatttggatgtaaaccactgaccatgttcttaataacagagaataaaatctggggaagaaaatcatggcccttgaatgaaggtataatggctataggaatcgtctcaatactgttaagctccctactcaaaaacgatgtccccctagctggaccattaatagcagggggaatgctcatagcgtgttacgtaattagtgggagttctgcagatttatctttagaaaaagctgcagaagtaagctgggaacaagaagcggaacattcaggtacctctcataacatactcgttgaggtacaagatgatggaactatgaaaatcaaagacgaagaaaaggatgacacgctgacgatcttacttaaagctactttattggcggtttcaggggtatacccaatgtctattccagcaacattgttcgtctggtatttttggcagaagaagaaacaaagaagcggggttctatgggacactccgtctcctccagaagtcgaaagggcagtattggatgacggaatatatagaatactacaaagaggtttattaggccgttcccaagtgggagtgggagtctttcaaaacggtgtatttcacaccatgtggcacgttactagaggagctgttctcatgtaccaaggtaaacgacttgaacccagctgggctagtgttaagaaagatctaatttcgtacggtggtggttggagattccaaggttcatggaatacaggcgaagaagttcaagtaatagcagtagaacccgggaaaaatcccaaaaatgtgcagacaacacctggtacttttaaaactccagaaggagaagttggggcaatagcattagacttcaagccaggaacctcagggtcacccatagttaatagagaaggcaaaatagtagggttatatggtaatggcgtcgtcacaacttccggtacgtatgtttcagcgattgcccaagctaaagcatcgcaagaaggacctttacccgaaatagaagacgaagtcttcaagaaacgcaacctaactataatggatttacacccaggtagtgggaagactaggcgatatttaccagcgatagttagggaagctattaaacgcaagctccgcactctaattcttgcacccacccgtgtagttgcatcagaaatggctgaagccttaaaaggcatgcccatcaggtatcaaactaccgctgtaaaatcagaacataccggaagagaaattgtagatctaatgtgtcatgccacttttacaatgagattgctaagtccagtgcgcgtaccaaattacaatatgataataatggacgaagcgcattttaccgatccagcttctatagctgcaagggggtatatctcaaccagggtaggaatgggtgaagctgcagcgatatttatgacagcgacccctcccggatctgttgaagcatttcctcaaagtaatgcggttatacaggacgaggaacgtgatataccggagcgaagctggaactctggatacgattggatcacggattttccaggaaagacagtttggtttgtgccgtcaattaaaagcggaaatgatatagctaattgtttgcgtaaaaatggtaagagagtgatccaactcagtagaaaaacattcgataccgaatatcaaaagaccaaaaataatgattgggattatgttgtaaccactgacataagcgaaatgggcgcaaacttccgagctgatcgggtcatagatccccgcagatgtttaaagcctgtgattctaaaagatgggcccgaacgagtaatactagcaggtcctatgcccgttactgtagcctcagcagctcaacgtagaggccgcatcggaagaaatcagaataaagaaggagatcagtatgtgtatatgggacagccactgaataacgatgaagaccacgctcattggactgaagctaaaatgctattagacaacataaatacgccagaaggaatcattcccgctttattcgaaccagaaagagaaaaatcggcagctattgacggggaatatcgactcagaggggaggctcgaaaaacctttgtagaacttatgagaagaggtgatttacctgtatggctaagctataaggtagcttcagagggattccaatactccgatcgaaggtggtgttttgacggagaaagaaataaccaggtcttggaagagaacatggatgtcgagatctggaccaaggaaggggaacgaaagaaactgcgaccgagatggctcgatgcgagaacgtattctgatccgctcgcactccgggagttcaaagaatttgcagcaggcaggcgatctgtatccggtgatcttatcttagaaataggaaaactaccacaacatcttacattgcgggcacaaaacgcattagacaatttagtaatgctacataactctgaacaaggagggaaggcttaccgtcatgctatggaagaattaccagacacaattgaaacattaatgttgctagcattgattgccgttcttacaggaggggtaactctctttttcctatcaggaaaagggctaggaaaaacttcaataggcttgctttgcgttacagcatctagtgcgttactctggatggcgagtgttgaaccacattggattgcagcaagtattatactagagttctttttgatggtattgttgattccagaaccagaccgtcaacgaacaccacaagacaaccaactcgcttacgtagtaataggattactattcatgatattgacagtagcagcgaacgaaatgggtctattagaaaccactaagaaagatttaggtatcgggcacgtagcagcagaaaatcaccagcatgccacaatgttagatgtggatctaaggccagcatcagcgtggaccctgtatgcagtagcaacaaccgtgataacaccaatgatgcgtcatacaatagaaaacacaactgctaatatttcactgacggcaattgcgaatcaagcagcaatattaatgggactggataaagggtggccaatatcaaaaatggatataggagtacctcttttagcattaggctgctatagccaggtaaatccactgacattgacagcagcagtgttaatgctagtagctcactatgcaataataggaccaggattacaggcgaaagcaacacgagaagcccagaaaagaacagcagcggggatcatgaaaaatcctacagtagatggcatagtagcgatagacttagatcccgtagtctatgatgcaaaattcgaaaaacaattaggccagataatgttattaatactttgcacgagtcaaatcctactaatgcgaacaacctgggcattatgtgaatcaatcacactcgcaacagggccactaactacgttgtgggaagggtcaccaggcaagttttggaacactaccatagcagtatccatggccaatatatttcgcggaagctaccttgcgggtgccggattggccttttctttaatgaaatcacttggaggagggcgaaggggaaccggtgcgcaaggagaaacacttggagagaaatggaaacggcaactcaaccaactaagtaaaagtgaatttaatacctataagagaagcggaataatggaagttgacagatctgaagctaaagaaggcttaaagcgtggagagacaactaaacatgcagtatcacgagggacagccaaattaagatggtttgtagaacgcaacctggtgaagccagaaggaaaagtaatagatctagggtgtggtcgaggaggctggagttattattgtgcaggtttaaagaaagtgacagaagtaaaaggatacactaaagggggaccagggcatgaagaaccgatacctatggccacctacggttggaatttggtaaaactacattcaggtaaagatgtattctttatgccacctgagaaatgcgatacactcctatgcgacatcggagaaagcagtccaaacccaactattgaagagggtcgtaccttacgagtattaaaaatggtagaaccttggttaagaggtaaccaattttgcattaaaatcttaaacccatatatgcctagcgtcgtagaaacacttgagcaaatgcaaagaaagcacggtggaatgttagtgagaaatccattatccagaaatagtactcatgaaatgtattgggtatcctgcggcacgggtaatattgtatccgcggtgaatatgacctcacgtatgttgctcaaccggtttacaatggcccatcgcaaaccgacatatgaacgcgacgttgatttaggcgcgggcaccagacacgtggcagtagagccagaggttgctaatttagatataataggtcaaagaattgaaaatattaaaaacgagcataaaagtacatggcactacgatgaagacaatccatacaagacctgggcttaccatggaagctacgaggtaaagcctagcgggtcagcttcttcaatggttaacggagtcgttagacttcttaccaagccatgggatgtgattccaatggtaacacaaatagcaatgaccgatacaacgcccttcggtcagcaacgcgtttttaaggaaaaggtggatacacgcacacctagggctaaacgtggtaccactcaaattatggaggtaaccgcacggtggctatggggatttctgtcgcgtaataagaaacccagaatttgcacacgtgaggagtttacaaggaaagtacgaagtaatgcggcaataggagcagtatttgtagatgaaaatcaatggaatagcgcaaaagaagcagtggaagatgaaaggttttgggatctagtacatagagaacgagaattacataaacaagggaagtgcgccacatgtgtatataacatgatgggaaaacgagagaagaaattaggagagtttggaaaagctaaaggaagtagagcaatatggtacatgtggctaggggcacggttcctagaatttgaagcattgggatttattaatgaagaccattggttttcaagagaaaatagtctatcaggggtagaaggtgagggcctgcataagctcgggtatatactccgtgacatatccaagatacctggaggcaacatgtacgcagatgatacagcaggctgggatactcgtataacagaagatgatttacaaaacgaggcaaaaatcacagatattatggaacccgaacatgcgctattggcaacttccattttcaaattgacatatcagaacaaagtagttcgcgtccaaaggcccgctaaaaatggcacagtaatggatgtcatctctagaagagatcaaagaggttctggtcaggtaggcacttatggacttaatactttcacgaatatggaagtgcagctaattaggcaaatggaaagtgaaggcatatttctacctagtgagttagagactcccaatctagccgagcgcgtactagactggctggaaaagcacggagcagaacgactaaagagaatggccattagcggagatgattgtgtggttaagcccatcgacgatcgatttgctacagctcttacagcgttaaacgacatgggtaaagtgcgtaaagacattccgcaatgggaaccaagtaaaggatggaacgattggcagcaagtaccattctgtagtcaccattttcaccaattgattatgaaagatggacgtgaaattgttgtgccttgccgtaatcaagatgaattggtcgggagagcaagagttagccaaggagcagggtggtcactacgtgaaacagcatgcctgggaaaatcctatgcccaaatgtggcagttgatgtacttccacagaagggacctacgtctcgccgcaaacgcaatatgctccgcagtgccagtcgactgggtaccaacttctagaactacatggagtatccacgctcaccaccaatggatgactaccgaagatatgctaagtgtatggaatcgcgtatggatcgaagaaaacccatggatggaagataagacacacgtatcgtcatgggaggaggtaccgtacctgggaaaaagggaagatcaatggtgtgggtccctaattggactaaccgcgagagccacctgggcgactaatattcaagtagcaataaatcaagtaagaagattaatagggaatgagaattacttagattacatggctagcatgaaacgattcaaaaatgaaagcgatccggaaggagctctgtggtag

SEQ ID NO: 21441 - RNA, 9879 nt, synthetic construct
  misc_feature 1..9879: note = derived and/or modified CDS sequence (opt6) from DENV-1__GU131834__SS-prME
  source 1..9879: mol_type = other RNA
agtgtgaccatgcttttgatgttgctgcctacggcattagcattccatctaacgacccgaggtggggaacctcatatgatcgtatctaaacaagaacgtggcaagagcttgctatttaaaacgagcgcaggggttaacatgtgcaccttaatagctatggatcttggggagttatgtgaagatacaatgacctacaaatgtcctaggataactgaagctgagccggatgatgtagattgttggtgtaacgctactgatacatgggtaacatatgggacatgctctcaaacgggggaacaccgcagagacaaaagatcagttgcacttgctccacacgtaggtttggggctggagacacgcacggaaacatggatgtcatctgaaggagcttggaaacaaattcagcgagtagaaacttgggcattgagacatccaggttttacagtaattgcgttgtttctcgctcatgcaataggcacgtcaattacccaaaaagggataatcttcatacttcttatgctcgtaacaccatcaatggcaatgcgttgcgtcggaatcggaaatagagattttgtcgaaggactatcaggagcaacgtgggtagatgtcgtactggaacatggaagttgtgtcacgaccatggccaaaaataaaccaacgctagacattgaactactaaaaacagaagtgaccaaccccgccgtgctcaggaaattatgtatagaagcgaaaatatccaatacgacgactgatagccgctgtccaacacaaggcgaggctacattagtagaagaacaagatgcaaactttgtatgtcgacgaaccttcgttgatagaggttggggtaatggttgtggtttatttggcaaaggttcattgttaacatgtgcaaaatttaaatgtgtcacaaaattagaaggaaaaatagttcaatatgaaaatctgaaatattccgtcatagtgactgtacacaccggtgaccaacatcaggttggcaacgaaacgacagaacatggcaccattgcaactatcacaccccaagcaccaacaagtgaaatacaactaacagactacggcgcattgaccctagattgtagcccccgcactggcttagacttcaatgaaatggtgttattaactatgaaagagaaaagctggcttgtacataaacaatggtttctggacttgccgctaccatggacgtccggagctagtactagccaagaaacatggaatagacaagacctcttagtcaccttcaaaactgctcatgcaaagaaacaagaagtcgtcgttctcggatcgcaagaaggggctatgcacaccgcactaacaggagctacggagatacaaacatcaggcacgactaccatatttgccgggcatctgaaatgtcgtctcaaaatggacaaattgacgctcaaaggtatgagttacgtaatgtgtacaggtagttttaaattagaaaaagaagtcgcagagacacaacatggtaccgtattggtgcaagttaaatatgaaggtactgacgcgccgtgtaaaataccctttagtactcaagatgaaaaaggagtaacacaaaacggccggctgataaccgcaaatccgatcgtaaccgataaagaaaaaccagtaaatatagaaacagaaccaccatttggtgagtcttacatagttgtcggagcaggagagaaaacgttgaaactttcttggtttaagaaagggagctccatcggtaaaatgttcgaagcaacagcaaggggagctaggagaatggccatccttggagatactgcctgggactttggatccataggtggggtgtttacgtctgttgggaaattagtgcaccaggtgtttggaacagcatacggtgtcttattcagtggagtatcatggacaatgaaaataggcataggaatcctattaacatggctgggactaaatagccgaagcacatcattatcaatgacttgcatcgcagtagggatggtgacactatatttgggcgtcatggttcaggccgatagcggctgtgtgatcaactggaaaggccgtgagctcaaatgtggtagtggaatttttgtgaccaacgaagttcatacctggaccgagcagtataaatttcaagcagatagtccaaagaggttaagcgccgccatagggaaggcctgggaagaaggagtatgcggaataagatcagctacgcgactcgaaaatattatgtggaagcaaattagtaacgaactaaatcatatccttctagaaaacgacatgaagtttacagtagtagtgggcgatgcaaatggtattctagcccaaggcaagaaaatgatacgccctcaacctatggagcataagtattcatggaaatcatggggaaaagcaaaaatcataggagccgacatacaaaacacaacattcataatagacggacctgacacccccgagtgccccgatggtcaacgggcatggaacatatgggaagttgaagactacggttttggtattttcacaacaaacatttggcttaaactgagagattcctatactcaaatgtgcgaccaccgcctgatgagtgccgcaatcaaggatagtaaagcagtacacgctgatatgggatactggatagaaagtgagaaaaatgaaacctggaaactagcacgggcgagctttatagaagtcaaaacatgtacatggcccaagtcgcacactttatggagtaatggagtcttagaatccgaaatgattatcccaaaaatttatggagggcctatatctcaacataattatcgccctggatatttcacgcaaacagcagggccgtggcatctgggaaaattagagctagacttcgatctttgcgaagggaccaccgtggttgtagacgaacactgtggtaatagaggaccgagtctacgaacgacaacagtcactggaaaaataatacatgaatggtgctgcagatcctgcaccctacctcctttaaggtttcgaggcgaagatgggtgttggtatgggatggagataaggccagtgaaagaaaaagaggaaaatttagtaagatctatggtaagtgcaggatccggagaggtagattctttcagcttaggaatcctttgtgttagtatcatgattgaagaagtaatgcgaagtaggtggtcgaggaaaatgcttatgacaggaaccttagccgtcttccttcttctcattatgggacagttgacatggaatgatctaataaggctatgcatcatggttggcgcaaatgccagtgatagaatgggcatgggcacgacttacctagctctaatggccacattcaagatgcgaccaatgtttgcagttggtttactatttagaagattaacaagtcgcgaagttctcttgcttactatcggattaagtcttgtcgcttctgtagaattaccaaacagtttagaagaactaggagacggactcgctatgggcatcatgatgctgaaactcttaactgaatttcaacctcatcaactttggacaacgttactatccttaacattcgtaaaaacaacgttaagtctcgactacgcttggaaaactacagccatggtactatcaatagtcagtttattccctttgtgtctttcaactacgtctcagaaaacaacatggttacctgtgttattgggaagtttcggatgcaagccactaactatgttctttataactgaaaataaaatatggggaagaaaatcctggccacttaatgaggggattatggcaattggcattgtttccattcttttatccagtctactgaaaaatgatgtacctttggcaggtcctttaattgcaggagggatgctgatcgcttgttatgttatcagtggttcatcggcagacctaagtttagagaaagcagctgaggtttcatgggagcaggaggcagaacactcgggtgcttcgcataatatcctagtagaagttcaggacgatggaacaatgaaaataaaagacgaagaacgtgacgacactttaacaattttactaaaagcgactttattagctgttagcggagtttaccccatgtcaatacccgcaacactgtttgtatggtacttttggcagaagaagaaacaaagatccggggtgctatgggacactccatctccgccagaagtcgaaagagcggttctggatgatggaatttacagaatccttcaacgtggcttgttaggacgctctcaagttggagttggagtgttccaagatggggtctttcataccatgtggcatgtcacaagaggagctgtacttatgtaccaagggaaacgccttgaaccctcctgggcatccgtaaagaaagacctcatctcatacggaggagggtggagattccaaggtagctggaacacgggagaggaggtacaagtaatagcagtggaaccaggtaaaaatccaaagaatgtccagaccaccccaggtacctttaagacacccgagggagaagtgggtgccatagctttggatttcaaaccgggtacatcggggagccctatcgtcaatcgtgaagggaaaatagttggtttatatggtaatggagtagttacaacaagtggaacatatgtaagcgccatagctcaggcgaaggcgagtcaagaaggacctcttccagagattgaagatgaagtatttaagaaaagaaacctcactatcatggatctccacccaggctctggcaaaactcgacgatacctccctgcaatagtccgtgaagctataaagaggaaactcaggaccctaatattggcacctaccagagtagtagctagtgaaatggcagaagcgctaaaaggcatgccgataaggtatcaaactactgctgtaaaatcagaacacacaggcagagaaatagtagatctaatgtgccatgctacatttacaatgagactattgagccctgtaagagtgcccaattacaatatgatcataatggacgaagctcacttcacagatccagcctcaattgcagctcgaggttatatatcaactcgtgtgggcatgggcgaggctgccgctatttttatgacagccacacctccgggatctgtggaagcattccctcagagtaatgcagtaatccaggatgaggaacgagatatacctgaaagatcatggaactcaggatacgattggatcacagatttcccgggtaaaactgtttggtttgtaccttcaataaagagcggaaatgatattgcgaattgcttgaggaaaaatggaaaaagagtaatccaattatccagaaaaactttcgataccgagtatcagaaaactaaaaacaacgattgggactatgtggttacaactgatataagcgaaatgggtgctaatttcagagcagatagggtaatagacccccgtaggtgcctaaaaccggtaatactaaaagacggacccgaaagagtaatattagcaggccccatgccagttaccgttgctagcgcggcacaacggagggggagaatcggacggaaccaaaataaagagggagaccagtatgtatatatgggacaaccgttaaataatgatgaggatcacgctcattggactgaagcaaaaatgctattagataatatcaatacacccgagggaattatcccagcattattcgaaccagaaagggaaaagtcagctgcgatagacggagaataccgcttgcgaggagaagctagaaaaacctttgtagagcttatgagaaggggagatcttccagtctggttaagttataaagtcgctagtgaaggtttccaatactcagaccgtagatggtgtttcgacggagaacgtaacaatcaggtattagaagaaaacatggatgtagaaatatggacgaaggaaggcgagcgaaagaaacttcgaccacgttggctggatgctagaacgtactcagacccactagcactgagagaatttaaagaatttgcagctgggaggcggtcagtaagcggagatctcatattggaaatcggtaaacttccacaacatctcactctgcgcgctcaaaatgcattagataatctagttatgctccacaattctgaacaaggcggaaaggcttacaggcacgcgatggaagaattaccagataccattgagacgcttatgttgttagcattgatagcggttcttacaggaggggtaactctcttctttttatcagggaagggattaggtaaaacatccataggtcttttgtgtgtaaccgctagctctgcactcctgtggatggcttctgttgaaccacattggatcgcggcatccatcatactcgaatttttcttgatggtattattaattcctgaacctgatagacagcggacaccccaagataaccaacttgcctatgtcgtcattggtttattatttatgattctaacggttgcagccaacgaaatgggtctattagaaacaactaagaaagatttaggaattggatacgtagccgcagaaaatcaccaacatgctacaatgctcgatgtagatttacgaccggcctctgcttggacgctttatgctgttgcaaccactgtcataacacctatgatgcggcacacaatagagaatacaacagctaatatatctttaacagcaatagcaaaccaagctgccatcctaatgggtttagacaagggttggccaatttcaaaaatggacataggagtacccctgttagccttaggatgttactcccaagttaatccattaacgttaactgctgcggttctaatgttagtggctcactacgctatcataggtccaggactccaagcaaaggccactcgagaagcccaaaaacgaaccgcagctgggataatgaaaaatcccaccgtagatggaattgtcgccatagatttagatccggtagtctatgacgcgaagtttgaaaaacagctcggtcaaattatgctactaattctatgcacaagccaaatcctattaatgcgaacaacgtgggctttatgcgaatcaatcacactagccactggaccgctcactactctgtgggaaggaagtccaggcaaattttggaacactacaattgcggtaagcatggcgaacatttttcgaggatcttatttagccggtgcagggctagcattcagtcttatgaaatctttaggaggagggcgaaggggtacaggagcacaaggggagaccctaggagagaaatggaagcgacagctcaaccaattatcaaagagtgaatttaatacatacaaaagaagtgggataatggaagtggacagatctgaggcaaaagaaggcctaaagagaggtgaaacaacaaaacatgcggtcagtagaggaactgcaaaattaagatggttcgtagaaagaaacttagtgaagccagaaggtaaagtcatagacctaggttgcggtagagggggatggtcatactattgcgcgggtctaaagaaagttacagaggtgaaaggctataccaagggcggaccgggacatgaagaacctatacctatggcaacatatggctggaatctggtcaagttacactcgggcaaagatgtattcttcatgccaccagaaaaatgtgatacattactatgtgatataggggagtcatcacctaacccaactatagaggagggtagaactttgcgcgtgctaaaaatggtagaaccgtggctaagaggaaatcaattctgcattaaaatattaaacccgtatatgcctagcgtagtagaaactttagaacaaatgcagcgtaagcatggaggcatgttagtacgcaacccactgagtagaaacagcacacatgagatgtactgggtatcatgcggtacaggaaacatcgtatcagccgttaacatgacttcaagaatgctacttaatagattcacaatggcacatagaaaacccacctatgaaagagatgtagatctaggagcaggcacacgccatgttgctgtagaaccagaagtcgccaacttggatatcatcgggcaaagaatagagaacatcaaaaatgaacataaaagtacttggcattacgatgaagacaacccttataaaacgtgggcgtatcatggatcctatgaagttaaaccaagtggtagcgcatcaagcatggtaaatggagttgtacgactcttaacaaagccatgggatgtcatacctatggtaacacaaattgcaatgaccgatactacacccttcggacaacaaagggtatttaaagaaaaagtagacacaagaactccacgtgcgaagagaggtaccacacagattatggaagtgacagccaaatggttatggggatttttatctagaaacaagaaacccaggatatgcactagagaagagtttactcgaaaagtgcgttcgaatgctgcaatcggtgcggtctttgtcgacgaaaaccagtggaactctgcaaaagaagcggtcgaagacgaacgattctgggatcttgtacatagagaaagggaactacacaaacaaggaaagtgtgcgacttgtgtttataacatgatgggaaaaagagagaagaaactaggtgaatttggaaaagctaaaggtagtagggcaatctggtatatgtggctgggagcgagattcttagagttcgaagcactcggcttcatgaacgaggaccactggttctcgagggaaaactcactctccggagtggaaggtgaaggcttgcacaaacttgggtacattctacgcgacataagcaaaataccaggtgggaatatgtacgcggatgacacggcaggttgggatacaaggataactgaagatgatttgcaaaatgaggccaaaattactgatattatggaaccagagcacgcacttttagcgacatcaatttttaaactaacctaccaaaataaggttgtacgcgtacaaaggcccgcaaagaacggaactgttatggatgtcatctcaagacgtgatcaaagaggatcaggacaagtaggaacttatggcttaaatacatttactaatatggaagttcaattaattcgacaaatggaatccgaagggatatttctaccatccgaactggagacaccaaatcttgcagagagagtactagactggttggaaaaacatggcgcagaaaggctaaagagaatggccatctctggagacgattgcgtagtcaaaccgattgacgatcgatttgcaaccgcgctaacagcattaaatgatatgggtaaagtacgaaaagatattccccaatgggaaccgtcaaaaggttggaacgattggcaacaagttcctttttgttcacatcacttccatcaattgattatgaaagatggacgagaaatcgttgttccttgtagaaaccaagatgagctagtgggacgtgcaagagtgtctcaaggtgcagggtggtcactcagagaaacagcgtgtctcggaaaaagctatgcacaaatgtggcaactgatgtatttccatagaagggatcttaggcttgcagccaatgcaatctgcagcgctgtccctgtcgactgggttccaacttcaagaactacatggagcatccacgcacaccaccagtggatgacaacagaagacatgttgagcgtatggaacagggtatggatagaagaaaatccatggatggaagacaaaacacatgtgtctagttgggaggaggtaccatacctaggtaaaagagaagatcagtggtgcggcagtctcattggcctaacagctcgcgctacatgggctacaaacattcaagtcgcaatcaatcaagtccgtcgattgatcggaaatgaaaactaccttgattatatgacctccatgaaaagatttaagaatgaatcagacccagaaggtgctttatggtaa

SEQ ID NO: 21442 - RNA, 9879 nt, synthetic construct
  misc_feature 1..9879: note = derived and/or modified CDS sequence (opt6) from DENV-1__GU131835__SS-prME
  source 1..9879: mol_type = other RNA
tcggtcaccatgctactcatgcttctccctacagcactcgcgttccatttaacgactagaggaggtgaaccacacatgatagtctcaaaacaagaaaggggcaaaagcctgttattcaaaacttcagcaggggtaaacatgtgcactttaatagcaatggacctgggggaattgtgtgaagatactatgacctacaaatgtccgcgaataacggaagcagaaccagatgacgttgactgctggtgtaacgcaacagatacatgggttacctacgggacttgttcccaaactggagaacacagaagggataaacgatccgtcgcactagcaccacatgtgggcctcggactagagacccgaaccgaaacgtggatgagctccgagggcgcatggaaacaaatacaacgtgtagagacatgggtgctcagacacccaggttttacagttattgcattcttcttagcgcacgcaataggtacaagtattacacaaaaaggaataatctttatactactaatgttagttaccccttctatggctatgcgatgcgtaggaattggaaatcgagattttgtggaaggcctatccggggcaacatgggtggacgtcgtgcttgaacatggtagctgcgtaactacaatggccaaaaataaaccaactctagatatagaattgctgaaaacagaggtaactaaccctgccgtgcttagaaaattatgtatagaagcaaaaatctctaacactactactgattcacgatgtcctacgcaaggcgaggcaactttggctgaagaacaagacgctaatttcgtatgtcggaggacgtttgtcgaccgaggttgggggaatggctgcgggttgtttgggaaaggtagcttgttgacgtgtgcgaaatttaaatgtgtaacgaaactggaaggaaaaatcgtgcaatatgaaaacttaaaatactctgttattgttaccgtacacactggagaccaacatcaagttgggaatgaaacaactgaacatggaacaattgctactatcactcctcaagcccccacttcagaaattcaactgaccgattacggagcactgacactagattgtagcccccgaaccggattggacttcaatgaaatggtactattgacaatgaaagaaaaatcgtggctagtccacaaacaatggtttttagacttaccactgccatggaccagtggagcttcaacttcccaagagacatggaaccgacaagatttactcgtaacgttcaaaaccgctcatgccaagaaacaagaggtagtcgttttaggatctcaagaaggtgcaatgcacacagcattaaccggagcgactgaaatccaaaccagcgggacaacaactatattcgcaggccacttaaaatgtagattaaaaatggacaagttaacattaaaaggaacatcttatgtcatgtgtaccggcagctttaaacttgaaaaagaagtagcagaaacacaacatggaacagtacttgttcaggtcaaatatgaaggtacagatgctccctgtaaaataccttttagcacacaagacgaaaaaggggtaactcagaatggaaggttaataacagcaaacccaatagtaactgataaagaaaaaccagtaaacatagaaaccgaacctccgttcggcgaatcatatattgtagtaggcgcgggagaaaaggctttgaagctgagttggtttaagaaaggcagttcgataggaaaaatgtttgaggctacagcacgcggcgctaggagaatggcaatcttgggagatacagcatgggatttcggtagtataggcggggtatttaccagcgtcgggaaacttgtacaccaagtatttggaaccgcttatggcgtactgttttcaggggtatcatggactatgaagattggaataggcattttacttacttggctgggcttaaattctagaagcacgagcctctcaatgacttgtattgcagtgggaatggtcaccttatatttaggagtcatggtccaagcagactctgggtgtgtaatcaactggaagggcagagaactgaaatgcgggtccggcatttttgtaacaaatgaagttcatacatggaccgaacaatacaaattccaagcagactcccctaaacgattatccgcagcaattggtaaggcatgggaagaaggagtttgtggcattcgtagcgcgactcgtttagagaacataatgtggaaacaaatctcaaatgaattaaatcatatactattagaaaatgatatgaaattcacagtagtggtcggtgacgcaaatggtatcctagctcaaggcaagaaaatgataagaccacaaccgatggaacataaatactcatggaaatcttggggtaaggcgaaaataataggtgcagatattcagaacacaactttcataatagatggtcccgatacccctgaatgccctgatgaccaacgagcctggaatatttgggaggtagaagactacggctttggtattttcacaacaaatatctggctaaagttaagagacagctacactcagatgtgtgaccatagattgatgtcagccgcaattaaggatagtaaggcagttcacgccgacatgggatactggatcgaaagtgagaaaaatgaaacctggaaacttgcaagagctagttttatagaagtaaaaacttgtacatggccaaaaagtcatacactttggtcaaatggtgtactcgagagcgaaatgataatacccaaaatctacggaggtcccatctcacaacataattacagaccaggctattttacacagacggcaggcccttggcacttaggcaaactcgaattagattttgacctgtgtgaggggactacagttgttgttgacgaacactgcggcaatagagggccatctctacgcacaacaacagttacgggaaaaataattcatgaatggtgttgccgttcttgtactctaccaccactacgctttaggggagaagacgggtgctggtatggaatggaaatccgaccggtgaaggagaaagaggaaaacttagtgcgtagtatggttagtgccggtagtggggaggtagattctttcagtttgggaatcttatgcgtcagcataatgattgaggaggtgatgagaagtcgatggtcaagaaagatgttgatgacaggcactttagccgtttttctcctgctgataatgggccagctaacctggaatgacttaataagactatgcataatggtaggagcaaacgccagtgacagaatgggaatgggtacaacgtatcttgctttaatggcaacatttaaaatgagaccaatgtttgccgtaggactcttgtttcgaaggctaacatccagagaggtcctgcttctaaccataggactgagcctagtagcaagtgtcgaactaccaaactcattggaagaactaggagacggcctagcaatgggtataatgatgttaaaacttttgacagaatttcaacctcaccagctatggacaactttgttgagtttaacatttattaaaactacattgtcactagactacgcctggaagacaaccgctatggtattatcgattgtgtccttgttcccattatgcttatcaacaacatcacagaaaactacatggttaccagtattacttggatcatttggatgtaaaccattaacaatgttccttattacagagaataaaatatggggaaggaaaagttggcctctaaacgaagggattatggcgataggcattgttagcatattactatcaagtcttttaaagaacgatgtccccttagcaggaccacttatcgccggtggtatgctaatagcatgttacgttatatcaggatcgagtgctgacttgtctcttgagaaagccgcagaggtaagttgggaacaagaagccgagcattcgggtacctcacacaatatcctagtcgaagttcaagatgatggcaccatgaaaataaaagatgaagaacgcgacgatacacttacaatactattgaaagctactttattagcagttagcggagtttatccgatgtcaattccagcgacgcttttcgtatggtatttttggcagaagaagaaacaacgtagtggagtcctatgggataccccctctcctccagaagtggaacgtgcggtactggacgatggcatttatagaatattgcaaagaggattgctaggaagatctcaagtcggtgtaggcgtatttcaagacggagtgttccatactatgtggcacgttactcgaggagcggttttaatgtaccagggaaaaagactggagcccagttgggcttcagtgaagaaagatttaatatcatatggagggggctggcgctttcaaggatcatggaacactggcgaggaagttcaagtaatagctgtagaacctgggaaaaatcccaaaaacgtacaaaccacgccagggacattcaaaactccggaaggcgaagtgggagcgatcgcattagactttaagcccggaacatccggatcaccaattgttaatcgagaagggaaaattgtaggtttatatggaaatggagtagttacaactagcggtacatatgttagcgctattgctcaagcaaaagcatcacaagaaggtccacttccggagatagaggatgaagtctttaagaaacgaaatctgaccatcatggatttacatcccggttcaggcaaaacaaggcgttacttgcccgccatagtacgcgaggcaatgaaacgcaaattaagaacactaatcctagcgcctacgcgcgttgtggcgagcgaaatggcagaagccttaaaaggaatgccaataagataccagaccacagcagtcaaatcagaacacacgggtcgagaaatagtcgacctaatgtgtcatgcgacgtttacaatgcgtctgttgtcacctgtgcgtgtgcccaattacaatatgattataatggacgaagcacattttacagatccagcatctatagcagctaggggatacatatctactagagtggggatgggagaagcagcggccatttttatgacggcaacaccaccaggaagtgtcgaagcctttccacaatcaaacgcggttattcaagacgaagagagggacattcccgaaaggagctggaactctggttatgaatggattactgatttcccaggtaaaactgtttggtttgtcccgagcataaaatctgggaatgatatagcaaattgtctaaggaaaaatggaaaaagagtcatccaattgtcgagaaaaacatttgatacagaatatcagaaaacgaaaaacaatgattgggattacgtggttacaacggacatctccgaaatgggagcaaactttcgggcagaccgggttatcgatccgagacggtgtttaaaaccggttatactaaaagatgggcctgagcgagtaatattagcaggaccgatgcctgtgacagtagcaagcgcagcccaaagaagaggacggatcggcagaaatcaaaacaaggagggagaccagtacgtttatatggggcagcctttgaataacgatgaagatcatgctcactggacggaagcaaaaatgttattagataatataaatacgcctgaaggtattattcctgctttatttgagccggaacgcgaaaaatcagcagcaattgatggcgaataccgattaagaggagaagcgagaaaaacgttcgtggagttaatgcgtcgaggtgaccttcctgtatggctttcatataaagtagcttccgaaggctttcaatacagcgatcgaagatggtgtttcgacggagaaagaaataatcaagtattagaagaaaacatggatgttgagatttggacaaaagagggtgaacgaaagaaattaagaccccgatggctagacgcacgcacctacagtgacccattagccttaagagagttcaaagagttcgctgccgggagacgatcagtctccggagacctcatcctcgaaatagggaaactacctcaacatcttactctgagagctcagaatgcactagacaatctagtaatgctacataatagcgaacagggcggaaaagcatatagacacgcaatggaagaacttccggatactattgaaacattaatgctgttagcactcattgcagtactgacaggaggtgtaatgttgtttttcctctctggcaaaggtttgggaaaaacatcaataggtctgctgtgcgtaaccgcgtcgtctgctctattatggatggcatctgtggagccccactggattgcagcgagtatagtgctggaatttttcctcatggttcttttaataccagaaccggatcgacagcgaactccgcaggataaccagctggcatacgtagtcataggtttgctctttatgatattaacagtagcggctaacgaaatgggattattagaaacaactaagaaagacctcggcatcggtcacgcagcagccgaaaatcaccaacatgcaacaatgcttgatgttgacctcagaccagcgtcagcatggaccctttatgctgtcgcgacaacagtaataacaccgatgatgagacacacaattgaaaacactactgcgaatatttctttaacggccatagccaaccaagcagccatacttatgggtctagataaaggctggccaatcagtaaaatggacataggcgtgccattgctcgcattaggatgttatagccaagttaatcctttaactttaactgctgctgtgctaatgttggtagcgcattacgcaataataggtccgggtctacaagctaaagcgacaagagaagcacagaaaagaaccgctgcaggaataatgaagaacccaacggttgacggtattgttgcgatagacctggatcctgtcgtatatgatgctaagtttgaaaaacaattaggacaaattatgctattaatactttgcacttcacagatattgctaatgagaacaacctgggcgttatgtgaatctataaccctcgctaccgggccacttaccacgctttgggagggctccccgggcaaattttggaataccacaattgcagtctctatggcaaatattttccgaggaagctatctagcaggggcaggattagcgttttccctcatgaagagtctagggggtggcagaagagggaccggagcacaaggtgaaacattaggtgagaaatggaaaagacaattaaaccagttgtcaaaaccagaatttaatacttacaaaagatctggcataatggaagtagacaggtccgaagctaaggaaggtttgaaacgaggagaaacgacaaaacatgctgttagtagaggtactgcaaaacttcgttggtttgttgagagaaacctggtcaaacctgaaggaaaagtaatcgatctagggtgtggaagaggaggttggtcatattactgtgcgggacttaagaaagttaccgaggtcaaagggtacacaaaaggagggcctggacacgaagaaccaatacccatggccacatacggatggaacttagttaagttgcacagtggcaaggatgtattctttatgccccctgaaaaatgcgatacattgttatgcgacattggcgagtcgagtccaaatccaacaatagaagaaggacgcactttgcgtgtgttaaaaatggtggagccgtggcttagaggcaaccaattctgtattaagatactaaacccgtatatgcctacagtggtcgagacactagaacaaatgcagcgcaagcatggagggatgctggtgaggaatccactttctagaaattcgacacatgaaatgtactgggtcagctgtgggactggcaatattgtttcggctgttaacatgacaagtaggatgcttcttaatagattcacaatggctcaccggaaaccaacatacgagcgagatgtagacttgggagctggtaccaggcatgtcgctgtagaaccagaggttgcaaaccttgatattattggccagaggatcgaaaatatcaagaatgaacataagtctacttggcactacgacgaggataatccgtacaaaacttgggcttatcatggttcgtacgaagtaaagccgagtggttcggcaagttccatggtaaatggagttgtaagattattaactaaaccttgggacgtcatccctatggtgactcaaatcgcaatgacagacactacgccctttggccagcagcgtgtttttaaagaaaaagtagatacaagaactcccagagctaagcgagggaccacacaaataatggaggtaaccgctaaatggctttggggctttctcagcagaaacaagaaacccaggatatgtacgagagaagaatttaccagaaaagtgcgttcgaatgcagcaataggagcagtattcgtggatgagaatcagtggaactcggctaaagaggcagttgaggacgaaaggttttgggatcttgttcatcgggaaagagaattacataaacaaggcaaatgcgccacatgcgtatataacatgatgggtaagagggagaagaaactaggagagttcggcaaagccaaagggagcagagcgatatggtatatgtggctaggtgccagattcttagagtttgaggcccttggattcatgaacgaggatcattggttttcacgggagaacagcttaagcggtgtagagggcgaagggttacataaactgggctatatactgcgtgatatctcaaggataccgggtggcaatatgtacgctgatgatactgcaggctgggacacacggatcacagaagacgatttacaaaatgaagcaaaaatcacagatataatggaacccgagcatgccttattagctacaagcatctttaaactcacatatcaaaataaagtggtaagagtacaaagacccgccaaaaatggtactgtaatggacgtgatttctagaagagatcaaagaggttccggacaagtgggaacctacggactgaatacatttacaaatatggaagtacaacttattaggcagatggagtcagaggggatatttctacctagcgaactagaaacacctaatttagccgaaagagttctagattggctagaaaaacatggtgctgaaaggctaaagagaatggcaataagcggggatgactgcgtggtaaagccaattgatgacagatttgcaacatcgctaaccgcgttaaatgacatggggaaagttagaaaggacattccacaatgggaaccaagtaaagggtggaacgactggcagcaggttccattttgttcacatcattttcatcaattgataatgaaagatggacgagagattgtcgtaccgtgcaggaatcaggacgagttagttggacgcgcaagagtcagtcaaggggcaggatggtccttacgtgaaactgcatgtttaggaaaatcctatgcacaaatgtggcagttgatgtactttcatcgtagggaccttcggttggctgctaatgctatatgttcagcagtacctgtagattgggtaccaacaagccgaactacttggtctattcatgcccatcatcaatggatgaccacagaagacatgttgagcgtatggaacagagtttggatcgaagaaaatccatggatggaagataagacccatgtaagctcatgggaagaggtgccatatttaggtaaaagggaagatcaatggtgcggatcattgattggactgactgcacgagcaacatgggcgacaaacattcaagtagctataaatcaagtgagaagattaattgggaatgaaaattatttagactatatgacatcaatgaaacggtttaagaacgaatcagacctcgagggggccctgtggtga

SEQ ID NO: 21443 - RNA, 9879 nt, synthetic construct
  misc_feature 1..9879: note = derived and/or modified CDS sequence (opt6) from DENV-1__GU131836__SS-prME
  source 1..9879: mol_type = other RNA
tccgtaacaatgttattaatgttattgccaactgctttagcatttcatctcacgactcgaggaggagaaccccatatgatagtttccaaacaggaacgcggtaaatccctattgtttaaaacatcggccggagtgaatatgtgtacattaattgcaatggacttaggagaattgtgtgaagacacgatgacatataaatgtccgcggattactgaagcagaacctgatgacgtagattgctggtgtaacgcaacagatacttgggtaacctatggaacgtgctcacaaaccggcgaacaccgtcgtgataaaaggtcagtggcgttggctccacatgtaggtcttggactcgaaacgagaacagaaacttggatgagttcagagggagcgtggaaacaaatacaaagggtagagacatgggcccttagacacccgggttttaccgtaatagcattatttctagcccacgctattggtacgtctataacacaaaaaggtataatattcatattactaatgctcgtaacgccatccatggcaatgcgatgcgtagggattgggaaccgtgatttcgtagaaggattatctggggctacgtgggtggatgtagtattagaacatggatcatgtgttactacaatggcgaaaaacaaaccaacacttgacatagaactacttaaaacagaagtaacgaatcccgcagtcctaaggaaactatgtatagaggctaaaatcagtaatacaaccacagactcgcgatgtccgactcagggagaagcaaccttagttgaagaacaggatgcaaatttcgtatgtcggcgcacgttcgtagaccggggatggggtaatggctgtggtttgttcgggaaaggatcgttattaacgtgcgctaaattcaaatgtgtaacaaaactggaaggaaaaattgtacagtacgaaaaccttaaatattcagttatcgtaacggtacatacgggtgatcaacatcaggtaggaaacgaaaccacagagcatggcacaatagcaactatcaccccgcaagctcccacgtcagaaatacagctcacagattatggtgccttaactcttgactgttcacctagaaccgggttagattttaatgaaatggtattactcaccatgaaagagaaaagttggctagtgcataagcaatggtttttggacctaccactgccttggacttctggagcatctacgagccaggaaacctggaatcgacaagatttattggtcacattcaagacagcgcatgcgaagaaacaagaagttgtggtactaggatcgcaggaaggcgcaatgcatactgctttaaccggtgctacagaaatacaaacatctggcactacaacgatatttgctggtcacctaaagtgcaggttaaaaatggacaaacttacgttaaaaggaacaagctacgtcatgtgtactggtagttttaaactcgagaaagaagtagctgaaacacagcatgggacagtattagtacaggttaaatatgaaggaactgatgcgccatgcaaaatacctttttcaactcaggatgaaaaaggtgtcacacagaacggaagacttataactgcaaatccaattgtaactgataaagagaagccggtaaacatcgagactgaaccaccctttggggaatcctatatcgtagtgggcgcaggggaaaaggcactgaagttgtcatggtttaagaaaggaagcagtataggtaaaatgtttgaagcaaccgcaagaggtgcaagacgaatggctatactaggtgatacagcgtgggattttggaagcatcgggggcgttttcacgtccgtcggtaaactcgtgcatcaagtgtttggcactgcttacggtgtcctattttctggcgtaagctggacaatgaaaatcggaataggaatcttattaacctggttaggactcaatagcaggtcgacatctttaagcatgacgtgtattgcggtgggaatggtcactctgtacctgggagtaatggttcaagcagatagtggttgtgtcattaattggaagggaagagaattgaaatgcggtagtggcatatttgttacaaatgaagttcacacatggacagagcaatataaatttcaggccgacagtccaaaacgactatcagcagcgattggaaaggcgtgggaagagggagtttgtggtatacgtagtgcaacacgcctagaaaacatcatgtggaagcaaatctcaaacgaattaaatcatatattattagaaaacgacatgaaattcaccgtggtagtcggagatgctaacggaatcctagtccaaggaaagaaaatgataagacctcaacctatggaacacaaatatagctggaagtcatggggaaaggcaaaaataatcggtgccgacatacaaaacactacattcatcatagatggccctgacacacccgaatgcccagacgatcaaagggcgtggaatatttgggaagtagaagactatggtttcggaatatttaccactaatatatggcttaagctgagggatagctatactcagatgtgcgatcataggctaatgtcggccgcaattaaggattctaaagcagtccatgcagatatgggctattggatcgaatctgaaaagaatgaaacttggaaactttctagggcttccttcatagaagtaaaaacctgtacgtggccaaagagtcacacgctctggtcgaatggagtgcttgaaagcgaaatgataataccgaaaatatatggaggaccaatatcgcaacataattatcggccagggtacttcacacaaactgcggggccatggcatctgggcaaactagagttagatttcgatttgtgtgaaggaacgactgtagtagtagacgaacattgtggaaatcgtgggccttcgcttagaacaacaacagtaaccggaaagataatacatgaatggtgttgcaggtcttgcacattaccaccccttagatttaggggtgaagatggttgctggtacggtatggaaataagacccgtgaaagaaaaagaggaaaatttagtacggtctatggtaagcgcgggaagcggagaagtagactccttttcattaggaatcctatgcgtatcaataatgattgaagaagttatgaggtcaagatggtcacgaaaaatgcttatgacgggcacactcgcagtatttttactacttataatgggtcaactaacatggaacgacctaatacgactctgcattatggtaggagccaacgcaagtgatagaatgggaatgggcaccacttatttagcattaatggcaacgtttaaaatgagacccatgtttgcagtaggacttttgttcagaagactaacaagtagagaggtcctattgctcacgattgggttgagcctggtggcatcagtagaattaccgaactcgctagaggaactcggagacggtttagccatgggtattatgatgcttaaactattaactgaatttcaaccgcatcaactgtggaccaccctattatcccttacgtttatcaaaaccactttatctcttgattatgcctggaaaacaactgccatggccttgtctattgtttcattatttccactttgtctaagcactacttctcagaaaactacatggctaccagtcctcctaggtagttttggttgtaaacctttaactatgtttctgattaccgaaaataagatttggggcagaaaatcctggccactaaatgaagggatcatggcaattgggatcgtatcaattcttctttcaagtttgctgaagaacgacgtgcccttagcaggacctctaatagcgggaggaatgctcatagcatgctatgtaatcagcggcagctccgcagacttgagcttagagaaagcagcagaagtttcatgggaacaagaagccgaacatagtgggaccagccataacattttagtagaagtacaagacgatggaacaatgaaaatcaaagacgaagaaaaggacgatacactaactattttattgaaagcaacactactcgcagtttcgggtgtgtatccgatgagcatacctgccacactttttgtctggtacttttggcagaagaagaaacagcgatcaggagtgctatgggatactccatcaccgcctgaggtcgagagagccgtattagatgatggtatctatagaatactacaaagaggattattgggcagatcgcaagtaggggtgggagtattccaagacggagtcttccatactatgtggcacgtgactagaggcgctgtactaatgtaccaaggtaagcgcctagagccatcgtgggcatctgtcaagaaagatttaattagttacggtggtggatggcgtttccagggatcatggaatacgggtgaggaagttcaagttatagcggttgaaccaggcaaaaatccgaaaaacgtccaaactacaccaggaactttcaaaacaccagaaggagaagtaggagcgatagccttggacttcaaaccaggaacaagtggcagtccaattgtgaatcgtgaaggcaaaatcgtaggattatacgggaacggtgttgttacgacatcaggtacgtacgtttcagcaattgcccaagctaaagcatctcaagaaggaccactaccggaaattgaagatgaagttttcaaaaagagaaatctcactataatggatttacatcccggcagtggtaagactagacgatatctccctgcaattgttagggaagcaataaaacgaaaattaagaactctaatacttgcgcctactagagtagtcgcaagcgaaatggcagaagctctaaaaggcatgcccattaggtaccaaacaacagctgtgaaatcggaacacaccggtcgtgaaattgtagatttaatgtgccatgcaacctttacaatgcgacttttaagtccagtacgagtacctaattacaacatgattattatggacgaagcccatttcacagacccggcgagcatagcagcgagaggatatatctctactcgcgtaggtatgggggaagccgccgccatctttatgacggcgactccacctggctccgtagaagcgtttcctcaaagcaacgccgttatacaggacgaagagagggatatacctgaaagatcctggaacagtgggtatgattggataacagatttcccgggtaaaacggtatggttcgtgccatccataaaatctggtaatgacattgcaaattgtctacgcaagaacggaaaaagagtaattcagctatccagaaaaacgtttgataccgaataccagaaaaccaaaaataacgattgggactatgtggtgacaacagacataagcgaaatgggtgcaaattttagagcagatagagtaattgatccgcgtcgatgcttaaaaccagtaatccttaaggatggaccagaacgggtgatactggcgggtcccatgccggttacggtagcctctgcggcccaaaggaggggacgcattggtcgcaatcaaaacaaagaaggtgaccaatacgtatacatgggacaacccctgaacaacgatgaggatcacgcccattggaccgaagcgaaaatgctattggacaatataaatacaccagaaggaatcattccggcactcttcgaacctgaacgtgagaagtcagccgcaatagacggagaatatcgtcttcgaggagaagccaggaaaacctttgtagaattaatgagaagaggggatttgccagtatggctttcatacaaagttgcatcggagggattccaatattcagatcgaagatggtgttttgatggagaacgaaataaccaagtcttagaggagaacatggacgtagaaatctggacaaaagaaggggagagaaagaaattacgcccaagatggctagatgctaggacttactcagatcccttggctctgagggagttcaaagaatttgctgccggtcgaaggtcagtttcaggtgatctaatattagaaattggaaaattgcctcaacatctcacactgagagcccagaacgcacttgataatttggtaatgttacataactcagaacaaggtggaaaagcctacaggcatgcaatggaagaactaccagatactatagaaacactaatgttgcttgccttaatcgcagttttaaccggaggagtgactttgttctttctatccggtaagggattgggcaagaccagtatcggacttctgtgcgttatggcatcaagtgcattgctctggatggcatcagtagaaccgcattggattgccgccagcataatacttgagttctttctaatggttctattgatccccgagccagatagacaacgaaccccgcaagataaccagttagcctacgtagtaataggtttattatttatgatcctaacagtagcagcgaacgaaatgggtctattagagacaacaaagaaagatttgggtatagggcatgtagcagctgaaaatcaccaacacgctacaatgttagacgtagatttaaggccagcatcagcatggacattatatgccgtcgccacaacagtgataactcccatgatgcgccatacaattgagaatacaacggcgaatatttctctaacagccatagcaaatcaggcagcaattcttatgggcttggataaaggctggccaatatccaagatggatataggagtcccattactcgctttaggatgctacagccaagtcaatcctctgactctaacagcggccgtgctaatgttagtagctcattatgcaattatcggccctggtcttcaagcaaaagcaactagagaagctcaaaaacggactgcagccggcataatgaaaaatcccactgtcgatggtattgtcgctatagacttagatcctgtagtttacgacgccaaatttgaaaaacagctcggccaaataatgctgctgatcctttgcacctcccagatcctcctgatgagaacgacatgggcgctctgcgagagtattacactcgcaactggacctttaactactctatgggaaggtagtcctggcaagttttggaacaccaccattgctgtatccatggcaaacatttttagaggatcatacctagcaggggcaggattggcttttagtctcatgaaatcattaggaggtggtcggcgtggcacaggagcacaaggtgagacattaggtgaaaaatggaaaagacagttaaaccaactatctaaaagcgaatttaatacatataagcgatcaggtattatggaagtagatagatctgaagcaaaagaaggactgaagcgaggagaaaccactaaacacgctgtaagcaggggaaccgccaaattaagatggttcgtcgagagaaatttggtaaagccagaaggcaaagttatagatctaggatgtggtagaggaggctggtcctactattgtgctggattgaagaaggtaaccgaggtaaagggctacacgaaaggagggcccgggcacgaagaaccaataccaatggcaacctacggatggaacttggttaagctgcattcaggtaaggatgtatttttcatgccacccgagaaatgtgatacactgttatgcgatatcggagaatcctctccaaacccaacaatagaagaaggaagaacactacgagtattgaaaatggtcgaaccatggttacgtgggaatcaattttgcattaaaatcctaaatccttatatgcctagcgtcgtcgaaacactagaacaaatgcagagaaagcatggagggatgctagtacgtaatcctttatcaagaaattccacacacgaaatgtattgggtatcatgcggtactggaaacatcgtaagcgccgtgaatatgacctctagaatgctcctcaatagattcactatggcgcaccgtaaaccaacatatgagcgtgatgtcgatctcggtgcggggactagacatgtagcagtagaaccagaagtgccgaatttggatattataggtcagcgcatagaaaatatcaaaaatgagcataaaagcacatggcactacgatgaggacaatccttataaaacttgggcatatcacggctcctatgaagtcaagccgagtggaagtgcctctagtatggtgaatggagtggtgaggttattaacaaaaccatgggatgttatacctatggtcacccaaatagctatgactgataccaccccgttcggacaacagagggtcttcaaagaaaaagtagacactcgaacgcctcgagccaaacgtggaacaactcaaataatggaagtaacggcaaagtggttatgggggttcttgtcaagaaacaaaaagcctcgaatttgtacacgtgaggaatttactaggaaagttcgatcaaacgctgcaatcggagcggtatttgtagacgaaaaccaatggaactcagctaaggaagccgtcgaagacgaacgattttgggatttagtacatagagaaagggaactccataaacagggaaaatgcgctacttgtgtatataatatgatgggaaagagggaaaagaagctaggtgagtttggaaaagccaaaggttcaagagctatttggtatatgtggctaggtgcaaggtttttagagttcgaagcgttaggatttatgaacgaagaccattggttctccagagaaaacagtttatcgggcgttgaaggtgaaggactacataaattaggttacatcttacgagacattagtaaaatacccggagggaatatgtacgcagatgatacagcaggatgggatactcgaataacagaagatgatctgcagaatgaagctaagattaccgacatcatggaaccgggacacgctttattagcaaccagtatatttaaacttacctatcaaaataaagttgtgcgggtacaaaggcctgcgaagaatggcaccgtcatggacgtcatatcgagaagagaccagagaggttccggacaggttggaacatatggtctcaacacattcactaacatggaggtacaattaatccgacagatggagtcagaaggtatattcttaccttcagaattagaaacacctaacttagcggaaagagttttagattggttagagaagcatggtgcagagagattgaagaggatggcaatctcaggagatgattgcgtagtcaagccaatagatgatcgatttgccacagctctgactgcgttaaatgacatgggaaaagttcgcaaagatataccacaatgggaaccctcaaaaggctggaacgattggcaacaggttcctttttgttcacatcattttcaccagcttataatgaaggatggaagagaaatagttgtcccgtgtagaaaccaggatgagctagttggacgagcccgagtgagtcaaggggcggggtggagcttgagagagaccgcttgtctagggaaatcttatgcccaaatgtggcaactcatgtatttccatcgacgagacctccgtttagccgctaacgctatatgtagtgctgtacctgtggactgggtaccaacatcacgaacaacctggtccatacacgctcatcaccaatggatgacaaccgaagacatgctatcagtttggaacagagtttggatcgaagagaatccctggatggaagacaaaactcacgtatcatcatgggaggaagtgccatatttaggaaaacgagaagatcaatggtgtggatcattgatcggtctcacagcaagagcgacatgggcaacgaatatacaagtcgcaataaatcaagtacgaagactaattggaaatgaaaattatctagactatatgacatccatgaagagattcaaaaatgaatcagatcctgaaggggcgttatggtaa

SEQ ID NO: 21444 - RNA, 9879 nt, synthetic construct
  misc_feature 1..9879: note = derived and/or modified CDS sequence (opt6) from DENV-1__GU131837__SS-prME
  source 1..9879: mol_type = other RNA
agtgtgactatgttgttgatgctattgccgactgcgttagcgtttcatttgactacgcgaggaggggaaccgcatatgatagtgagcaaacaagaacgtggcaaatctcttttattcaaaacttcggcaggagtgaatatgtgtacgttaatagctatggatctaggcgaactctgtgaggatacaatgacgtataaatgcccacggatcacagaagctgaacctgatgacgtagactgctggtgtaatgcaactgatacttgggtaacttacggaacatgttcacaaactggagaacaccgacgagataaacgcagcgtagccttagcaccacatgtaggtctaggactagaaacaagaacagaaacttggatgagtagcgaaggagcatggaaacaaatacaaagagtagaaacgtgggcgctaagacacccaggattcacagttatagccttattcttggcacacgccataggaacatctataacacaaaaaggaattatattcattctactaatgttagttactccttccatggctatgagatgtgttggtatcgggaaccgagattttgtagaaggtctaagtggggcaacatgggtcgacgtagtattagaacatggatcgtgcgttacgactatggctaaaaacaaaccaacattagatattgaactactgaaaactgaagtaactaatccggctgtgttaagaaaactttgcattgaagcgaaaattagtaacacaacgacagattccaggtgtccaacccaaggtgaagccacgctagtagaggaacaagatgcgaacttcgtatgtcgacgcacatttgtagatagagggtggggaaacggatgcggtttatttggaaaaggctcattactaacatgtgcaaaatttaaatgtgtaaccaagttagagggaaaaatcgtacaatatgaaaatctaaaatactccgtcattgtaaccgtacatacaggggaccaacatcaagtcggaaacgaaacaacggaacacggcacaatcgctaccattacgcctcaggctccaacaagtgaaatacaactaacagattacggagccctcactctcgactgctctcctaggacaggacttgattttaacgaaatggttctattaacgatgaaagaaaaatcatggctagtacacaagcaatggtttttggatctaccgcttccttggacaagcggagcctctacaagtcaagaaacgtggaacaggcaagatttattggttacttttaaaacagctcatgccaagaaacaagaagtggtagtattagggtctcaagaaggggcaatgcacacagctctaacaggagcaacggagatacaaacatctgggacaacgactatattcgctgggcatctaaagtgtcgattaaaaatggacaaactcacgttaaaagggatgagctacgttatgtgtaccggtagctttaagttagaaaaagaagttgcggaaacacagcatggtactgtcctagtacaggtcaaatacgaaggaactgatgcaccgtgtaagatccccttctcaacccaagatgaaaaaggagtgacacaaaatggacgtctgatcacagctaatccaatagttacggacaaggaaaaaccagtaaacatagaaacagagccgccattcggggaatcatacattgtagttggcgcaggagaaaaagcattaaaattatcatggttcaagaaaggatcgagtatcggaaagatgtttgaggctacagcacgaggtgcaagacgcatggcaatattaggagatacggcctgggattttggctctataggcggcgtattcacatccgttggtaaattagtgcatcaagtgtttggaacggcatatggcgtcctcttcagtggagtatcttggacaatgaaaataggcatcggaatattgcttacctggttaggtctcaatagtaggagcacaagtctttctatgacgtgtatagcggtcggtatggtcacactttacttgggcgtgatggttcaagctgatagtggatgtgttataaactggaaaggcagggaacttaaatgcgggtcaggaatttttgtaacaaatgaagttcatacatggaccgaacaatataagttccaagctgattcaccaaaacggttaagcgcagctattggcaaagcatgggaagaaggagtatgcggaatacgttctgccaccaggttggaaaatattatgtggaagcaaataagcaatgaactcaatcacatccttttagaaaacgacatgaaattcacggtagtcgttggagatgcaaacgggattcttgcgcaaggaaagaaaatgatacggccacaaccaatggagcacaaatactcatggaaaagctggggaaaagcaaaaatcataggcgccgatattcagaacactacatttataatagacggaccggacacgccagaatgtcccgacgggcaaagagcatggaacatatgggaagttgaagactatggatttggtatatttacgaccaacatttggctgaagttgcgagactcctatacacaaatgtgtgaccatagactaatgtcagctgccataaaagactcaaaggcagtccacgcggatatgggatactggattgaaagtgagaaaaatgaaacgtggaagttagctagagcatcatttatagaggttaaaacatgtacctggcctaaatcacatacattatggagtaacggcgtacttgagtcagagatgataatacccaaaatatatggtggtccaattagccaacataattaccgaccaggctacttcacccaaactgcaggaccctggcatctgggaaaactcgagttagatttcgatttatgtgaaggaacaacagtggtagtagatgaacattgtggcaacagaggcccaagtttaaggaccactacagtgacaggaaagataatacacgaatggtgttgtcgatcttgtactctaccccctttacgattccgaggtgaagacggttgctggtacggaatggaaatccgacccgtgaaagagaaagaagagaaccttgtaagatccatggtatcggcgggttcgggagaagtggactcgtttagtctaggtatattatgcgtaagcataatgatcgaagaggttatgcgttctagatggtcacgaaagatgttaatgacaggaacactcgctgtattcttgctgctcattatgggacaattgacatggaatgacctcataagattatgtattatggttggtgccaacgcatctgatcggatgggcatggggacaacctatttagcactaatggcaacatttaagatgagacctatgttcgcagtgggattactgttcagaaggctcacaagtagagaagttctcttactaacaataggattatctcttgtggcctctgttgagttgccaaattcattagaagaactgggtgacgggcttgccatgggcataatgatgttaaaattattgaccgaatttcaaccacaccaattatggacaacgctactatcacttacctttgtgaagaccactttgtcgctagattatgcctggaaaacaacggctatggtgttaagcattgtaagtctctttccgttgtgtctaagtacaacaagccaaaagactacgtggttacccgtcctactgggatcgtttggttgtaaacctctgacaatgttcttgatcactgaaaacaaaatatgggggaggaaatcatggccactcaacgagggtattatggcaataggaatagtttcaatattactcagctcactactcaaaaacgacgtccctttagcggggcccttgatcgctggcgggatgttaatcgcatgttatgtaataagtgggtcaagtgcagatctatccctagaaaaggccgcagaagtatcatgggaacaagaagctgaacactccggagccagtcataatatcctagtagaagttcaagatgatggtactatgaaaatcaaagacgaagagagagatgatacacttaccatattactaaaagcaacactactagctgtatcaggagtatatcctatgtctataccagccactctatttgtctggtacttctggcagaaaaagaaacaacgttccggggtgctatgggacacaccaagtccccctgaagtagaacgagctgtattggatgacggtatatacagaatattacaacgaggccttctaggacgaagtcaagtaggggttggagtctttcaagatggggtctttcatacgatgtggcacgtaacaagaggagcagttctgatgtaccaaggaaaaagattggaaccttcctgggcatcagttaaaaaggacctaataagttatgggggcggttggaggttccaagggagttggaacaccggtgaagaagtacaagtaatcgccgtagaaccagggaaaaacccgaaaaatgttcagactactccaggaacgtttaaaacacctgagggtgaggtaggagcaattgctttagattttaaaccaggcacatcaggcagtccaatagtaaatagagaggggaagatagtcgggttatatggaaacggcgttgttacaacaagcggcacctatgtttcagctatagcccaggcaaaggcttcccaggaaggaccattacctgagattgaagacgaggtgttcaagaaaagaaatttaactattatggatcttcatccaggttcaggtaaaacacgcagatacttgccagcgattgttagggaggctatcaagcgtaaactcagaacactgatacttgcgccaacaagggttgtagcatcggagatggctgaagcgctaaaaggaatgccaataagatatcaaaccactgccgtgaaatctgaacacacgggtagagaaatcgttgacctaatgtgccacgcaacttttacaatgaggctcctatcacctgtaagggtaccaaattacaacatgataattatggacgaagcacatttcactgaccctgcgtccatcgcggcgcgaggttacataagcacccgtgtgggaatgggagaagcagcggctatatttatgacggccacgcctccaggatcagttgaggcttttccacaatcgaatgcagtcatacaagacgaggaaagggacataccagagaggtcctggaactcaggatatgattggattaccgatttccctggcaagactgtatggtttgttcccagtataaagtcagggaacgatatagccaattgtttgcggaaaaatggaaaacgggttattcaactatctcgcaaaacatttgatacggaatatcagaaaactaagaacaatgactgggactacgtagttactactgacattagtgaaatgggcgcaaacttccgagccgatagagtaatcgatccacgaaggtgtcttaaaccggttatattaaaagatgggccagaaagggtgatacttgcaggtccgatgccggtaacggtggcatcagcagcacaaagaagagggagaattggtagaaatcaaaataaggaaggagatcaatatgtttatatgggacaaccacttaacaatgatgaagatcatgctcactggacggaggcaaagatgttgcttgacaacataaacacacccgaagggataattcccgcgctatttgagccagaaagagagaagtcagcagcaatcgatggagaatatcgattaagaggtgaagctagaaaaacattcgtggaacttatgagacgcggtgacttacctgtatggttgtcttataaagttgcaagtgagggattccaatactcagaccggaggtggtgtttcgatggtgaacggaataatcaagtattagaagaaaatatggacgtcgaaatatggacaaaagaaggggagaggaagaaattaaggccaagatggctagacgcaagaacttatagtgatccacttgccttgcgggaatttaaagagttcgcggctggccggagatctgtgagtggagacttaatattagaaatagggaagctacctcagcatctgacgttgcgtgcacagaacgctttagataatttggttatgttacataatagtgaacaaggaggaaaggcataccggcacgcaatggaagaactcccagacacaatagaaacactaatgctgttggcattaatcgcagtcctaactggtggtgtaactctcttctttttatctggcaaaggtttaggaaaaacttccataggactcctgtgtgtaacagcatcaagtgctttactctggatggcgtcagtggagcctcactggattgccgcgtctatcatattagagttctttcttatggtcctactcattccggaacctgatcgccagcggacccctcaagataatcagttagcgtatgttgtgattggcctattatttatgattctgaccgtagcggccaacgaaatggggctccttgaaacaacgaagaaagacttaggtattggatatgtggcagcagaaaaccaccagcatgcgacaatgctagacgttgacctgagaccagcaagcgcgtggacattatatgctgtagccacgaccgtaattactcctatgatgagacacacaatagagaatactaccgctaatatatccctaaccgctatcgctaaccaagcagcgatcttaatggggcttgataaaggatggccaatcagtaaaatggacattggagtgccattactagcattaggttgttatagtcaggtaaatccactaacattgaccgcagccgtactaatgttagtcgcacattatgcaataataggtcctggtttacaagccaaagccacacgagaagcgcagaaaagaactgcagctggaataatgaagaaccccaccgtcgacggcatagtagcaatcgatcttgacccagtagtttacgatgcgaaatttgaaaaacaactgggacaaattatgctactaattctctgtacaagccaaatacttctcatgaggacaacttgggccttatgtgaaagtataactttagcaacaggacccttaacgacgttatgggaggggtcccctgggaaattttggaatactacgatcgcggtatcaatggcgaatatatttcgaggtagctacctagcaggagcagggctggcgttttcattaatgaaaagtttgggtggtggacggagaggaaccggagcacagggagaaacactaggtgaaaaatggaaacgacaacttaatcaattatcaaagagcgagttcaatacgtataaaaggtcaggaattatggaagtagatcgttcagaagcgaaagagggattaaaacgcggagaaacaactaaacatgcagtatcgcgaggaaccgcaaaactacgatggtttgtggagcgaaatttagtcaaacctgaaggaaaggtaatcgacctgggatgtggaagaggaggctggagttattattgtgcaggtctgaagaaggtcacagaagtaaaagggtacactaaaggtggtcccggacatgaagaacctatacctatggctacgtacggatggaacttagtcaaactacactctggaaaagatgtgttctttatgcccccagaaaaatgcgataccttgctatgtgacataggtgaatccagtcccaatccgacgatagaagaaggtcgtacactaagggtcttaaaaatggttgagccctggcttaggggaaatcaattctgtataaaaattctaaatccctatatgcccagcgtagtagaaacgttggaacaaatgcaaagaaagcacggaggtatgttagtgaggaatccactctcaaggaatagcacgcatgaaatgtactgggtaagttgtggtacgggaaatattgtctcagcagttaacatgacaagtcgaatgttactaaacagatttacaatggcgcatcgaaaaccgacttatgagagagatgttgacctgggagctggaactcgccacgttgcggtggaaccggaggaagctaacctagatattataggtcaacgaattgagaacattaaaaatgagcataaaagtacttggcactatgatgaagacaacccttataaaacttgggcttatcatggatcatatgaagtcaagccgtcgggctctgcttcgagcatggtcaacggcgtcgtacgtttactaaccaaaccatgggacgtaataccaatggttactcaaatagccatgacagacactactccattcggacaacaaagggtctttaaggaaaaagtggatactaggactcctcgcgctaagaggggcacaacgcagataatggaagtaacagctaaatggttatggggatttttatcaaggaacaagaaaccaagaatttgtactagggaagagttcactcgcaaggtccgatcaaacgctgccataggagctgtatttgtcgacgaaaatcaatggaactcagcaaaagaagccgtggaagatgaaagattttgggatttagtacaccgcgaacgagagctgcataaacaaggaaaatgtgcgacgtgtgtatataatatgatgggtaaaagagaaaagaaattgggggagttcggaaaagcaaaagggtccagggccatatggtacatgtggttaggtgccaggttcttagaatttgaagctctcggcttcatgaacgaggatcactggttcagcagggaaaattccctatccggtgtagaaggagaaggattacataaacttggttatatacttcgagatatttccaaaattccgggaggaaatatgtatgcagatgacacagcaggttgggatactagaatcacagaagatgatcttcaaaacgaagcaaaaatcactgacataatggagcctgaacatgcactattggcgacctctatattcaagttaacctatcaaaacaaagtggtaagggtccaacgaccagcaaagaacggtacagtaatggacgttatatcgagaagggaccagcggggaagtggccaagttggcacctatggcttgaacacctttactaatatggaagtacaacttatcagacagatggaaagcgaaggaatatttctcccatcagaattagagactcctaatctggcggaaagggtactagactggctagaaaaacatggcactgaaagactcaaacgaatggctatttccggtgatgactgcgtagtaaaacctattgacgatcggtttgctaccgcgttaaccgcactaaatgatatgggcaaagtcaggaaagacattccgcagtgggaacctagtaaagggtggaacgattggcagcaagtgccattttgcagccatcacttccatcaattaataatgaaggacggacgagagatagtagtaccgtgtagaaatcaagatgaattagtaggccgggcaagagtatctcaaggggcaggttggagtttacgagagacagcgtgtttagggaaatcttatgctcagatgtggcaattaatgtacttccatcgaagagacctgcgactcgcagcaaatgccatttgttctgcagtacccgtagactgggtacctacaagcaggaccacatggtcaatccacgctcatcatcaatggatgacaacagaggatatgttatcagtgtggaacagagtttggattgaagaaaatccatggatggaagataagacgcacgtaagttcctgggaagaagtaccttatcttggcaaacgggaagaccagtggtgtggatcattgataggacttacggctagagccacttgggctactaacattcaagtggcgattaatcaggttagaagattaataggaaatgaaaattatctagattacatgacaagtatgaaaaggttcaaaaatgagagtgatcccgaaggtgcgctatggtga

SEQ ID NO: 21445 - RNA, 9879 nt, synthetic construct
  misc_feature 1..9879: note = derived and/or modified CDS sequence (opt6) from DENV-1__JN819415__SS-prME
  source 1..9879: mol_type = other RNA
tcagtaacaatgctattaatgctgcttcccacggcgctcgcatttcaccttacaacgaggggaggagaaccgcacatgattgtctcaaaacaagaacgaggtaagtcccttctattcaaaacttcagcaggagttaatatgtgcaccttaatcgcaatggatttgggagaactttgcgaagatacaatgacttacaaatgtcccagaataacagaagcagaacctgatgatgttgactgttggtgtaatgctacggacacctgggttacatacggcacttgtagccaaacaggcgaacacagaagagataaaagaagtgtcgcactagcaccgcatgttggactggggctagaaactcggaccgaaacatggatgtcttccgaaggggcatggaaacaaattcaaagagtagagacatgggctctcaggcatccaggatttacggtcaccgcactatttttagctcacgcgattggaacaagcatcacacagaagggaattatatttatattacttatgctagtgacgccgagtatggcgatgcgatgtgttggcattggtaaccgagacttcgtcgagggcctctctggagcaacatgggtcgacgtggtactagaacacggttcgtgtgttacaactatggccaaaaataaaccgactcttgatatagagcttcttaaaacagaagtgacgaacccagctgtgcttcgtaaattatgcatcgaagcaaaaatatctaatacaacgacagacagtcgttgcccaacccaaggtgaggcgaccctagttgaggaacaagatgcaaatttcgtatgcagaaggacttttgtagataggggatggggcaatgggtgcggactcttcggtaaaggaagtcttctaacatgtgctaagtttaaatgcgtgactaagctagaaggtaagatcgtacaatacgagaacttaaaatacagcgtaatagtcacagttcacaccggtgaccaacaccaagttggaaatgaaacaacggaacatggaacgatagccacgataactccgcaagcgccaacctcagaaatccaattgacagactatggagcattgacccttgattgcagtcctcgcacgggtttagattttaatgaaatggtattattaacaatgaaagagaaatcttggctagtccataaacaatggtttcttgatttaccgttaccatggaccagcggtgccagcacatcccaagaaacttggaacaggcaagacttgttggtaacttttaagacagcccacgccaagaaacaagaagtcgtcgttctagggtcccaagaaggggcgatgcatacagcactgacaggtgcaaccgaaatacaaacaagtggtactaccacaattttcgcaggccatctaaaatgtagactaaaaatggacaaattaaccctgaaaggtacgtcatatgttatgtgtacaggtagtttcaaactagaaaaagaagtagctgagacccaacatggtaccgtattagttcaagttaaatacgaaggtactgacgcaccctgtaaaatacccttttcaacacaagacgaaaaaggagttactcaaaatggacggttgataacagctaatcccatagtgacagataaagaaaaacctgtaaatatagaaacggaaccaccttttggggaatcatacattgttgtaggagcgggcgagaaggccctcaaactttcctggtttaagaaaggcagtagtataggcaaaatgtttgaggcaactgctagaggggcaagacgcatggctatcctcggggatacagcttgggattttggttcgatcggtggagtctttacctcagtggggaaattagtacatcaggtgttcggtactgcttacggagttttatttagcggtgtctcttggactatgaagatagggataggaatactcttgacctggctgggcttaaattcccgttccactagcttgagtatgacgtgtattgcagttggtatggtaaccctttatttgggagttatggttcaggcggattcaggttgtgttattaactggaagggaagagagctcaaatgtggaagcggtatattcgtcacaaatgaggttcatacttggacagagcaatataaattccaagctgatagtccaaagagactatctgccgccataggaaaagcctgggaagaaggagtatgcggcattcgatcggccacaaggctagaaaatataatgtggaaacaaataagtaatgaattgaatcacatattactggaaaacgatatgaaattcactgtagttgtaggagatgcaaacggtatccttgcacaagggaagaaaatgattcggccgcaacctatggaacacaagtacagctggaagtcatggggaaaagctaagataataggcgcagatatacaaaacactacatttataatcgatggacctgacactcctgaatgtccagacgaccaacgtgcatggaatatttgggaagtggaagattacgggtttggaatcttcacaactaacatatggctaaaactgagagattcatatacacaaatgtgcgaccatagacttatgagcgcggcaataaaagacagtaaagccgtgcatgccgatatgggttactggattgagtctgagaaaaacgagacttggaaattagcacgagcctcgttcatagaagtaaaaacctgcacatggcccaaaagccatacactttggtccaacggcgtattagaatctgaaatgattataccaaaaatatacggcggccctatatcacaacacaactacagaccaggttacttcacacaaactgcaggtccttggcacttaggaaaactcgagctagattttaacctatgtgaaggaacaaccgttgtcgtcgatgaacattgcggaaacaggggtccgagtctccgtactactacagttactggtaaaataatacacgaatggtgttgtagaagttgtacactacctccgctccgattccgaggagaggacggatgctggtatggcatggaaatccgaccagttaaagaaaaagaagaaaatctcgtccgaagtatggtatcagctggttcaggagaagtagacagttttagtcttggtatattgtgtgtttcaataatgatagaagaggtcatgcgatcgagatggtcaagaaaaatgttaatgacaggaaccctagcggtgtttttattattaattatgggccagttgacatggaatgatttgattagactatgtatcatggtaggcgcaaacgcgagtgacagaatggggatgggaactacgtatctagcactaatggcaacattcaaaatgcggccaatgtttgcagttggtttattattcaggcgcctcacaagccgagaagtgttattattaacgattggactctcacttgttgcttcagttgaacttcctaatagcctcgaagaactgggcgatgggttagcaatgggaataatgatgctgaaactacttaccgaatttcagcctcatcaactgtggactaccttattatctttaacttttattaaaacaacgctgtcattggattatgcttggaaaactaccgctatggcgttgtctattgtttccttatttccactttgtcttagcacaacttcccagaaaaccacatggcttcccgtcctgttgggaagttttggatgtaaacccctaacgatgtttcttattacagaaaataaaatatgggggcgaaaatcttggccactgaatgaaggtataatggccataggcatcgtctcaattttgctatcatccctcctaaagaatgacgtcccattagcgggaccgttaatagccggcggaatgctaatagcatgctatgtaataagtggcagctcggcagatttgtccctagaaaaagcagctgaagttagttgggagcaagaggccgaacattccggcacgtcacacaacattcttgtggaggtgcaggatgacgggacaatgaaaataaaagatgaagaaaaagacgacacactcactatccttcttaaagcaacactactagcagttagcggcgtatatcctatgagcattccagcaacattatttgtttggtatttctggcaaaagaagaaacagagaagtggagtattatgggatactccaagcccacccgaagtcgaacgagcagtgttagacgatggcatttataggatcctacagagaggattgttgggcagatcccaggtaggtgttggtgtgttccaagatggcgtattccatactatgtggcacgtaaccagaggcgcagtccttatgtatcaaggtaagagattggagccttcatgggcctctgtcaagaaagatttaatatcatatggagggggatggcgatttcaaggaagttggaacaccggcgaggaagtgcaggtaattgctgtcgaacctggaaagaaccccaaaaatgttcaaacaacaccggggacatttaaaaccccggagggcgaagtaggggctatagcgctagactttaaacccggaacgtccggatctccaattgtcaacagggagggtaaaatcgttggcttatatggtaacggggtcgttaccacgtcgggaacgtacgtatcggcgatcgcacaggctaaagcaagtcaagagggtccactacccgaaatagaagacgaggttttcaagaaacggaatctaacaattatggatttacacccgggttcgggaaaaacaaggagatacctacctgccatagtacgggaagcaataaaaaggaagctgagaaccctaatactagcaccaacgagggttgtggcgagtgagatggctgaggctttaaaagggatgccaattagatatcaaactacagcggtgaaaagcgaacacacaggacgggaaatagtagatctaatgtgtcatgctacatttacgatgagactgttatcacccgttcgagtaccaaattacaatatgataataatggacgaagcgcacttcacagatcctgcgagtatagctgctagaggatatatctccactagagtcggtatgggcgaggcggcggctatatttatgaccgcgacaccaccaggttcagtcgaggcgtttccacagagtaatgctgttattcaagatgaagaaagagatatacctgaacgatcctggaatagtggatatgattggataacagacttccctggaaagactgtttggtttgttcccagcataaaatccggtaacgatattgccaattgtttaaggaaaaatggcaaacgagtaatacagctaagcagaaaaaccttcgacacagaatatcagaaaactaaaaataatgattgggattatgtcgtcacaacggacatctcagaaatgggtgctaatttccgtgctgacagagttatagatccaagacgctgtttgaagccagtaattcttaaagacggacctgaacgtgtaatcttagcaggacctatgcccgttactgtggccagtgccgcacagaggcgtggtagaattggtcgaaaccaaaacaaagagggagatcaatatgtatacatgggccaaccgttaaacaatgacgaagatcacgcacattggacagaggccaaaatgttgctagacaatataaatactccagaaggaataatcccagcacttttcgaacctgaaagagaaaaatctgctgcaattgacggagaatatagattacgaggagaagctagaaaaactttcgtcgaattaatgcggcgtggagacttaccggtatggttatcctataaagtggcatcagaggggtttcaatatagtgatagacgatggtgcttcgacggtgaacgaaacaatcaagtactggaagaaaacatggacgttgaaatatggacgaaagaaggagaaagaaagaaattaagaccacgttggctggacgcaagaacatatagcgacccgctggcattgagagaatttaaagaatttgcagcaggaaggagaagcgtcagcggggatctaatacttgaaataggaaaacttccgcaacacttaacactacgagctcagaatgcgctagataatttggtaatgctccataattctgaacaaggtggaaaagcataccgccacgcaatggaagagttgccagatactatagaaaccctgatgctgttggctctaatagccgtcttaaccggtggtgtaactttattctttttatccggtaaaggattaggaaaaacgagtatcggattattgtgtgtaacggcctcttcggctttattatggatggcatccgtcgaaccacattggatagctgcatcaataatattagagttcttcctgatggtgctcttaatcccagaaccggacaggcaaaggacacctcaggataaccagctggcttacgtagtaattggtttgttgtttatgatattaacagttgctgctaacgaaatggggttacttgagaccacgaagagagatcttggtataggccacgtcgcagccgaaaaccatcagcacgctacaatgctggacgtggatctaagaccagcaagcgcatggacattatatgcggttgcgactactgttattacacctatgatgcgccacacgatcgaaaataccactgctaacattagcctaacagcaatagctaatcaagctgccattctaatgggactagataaaggatggccgataagtaaaatggatataggagtaccactactagcactgggatgttacagtcaggtgaatcccctaacgcttacggcagccgtacttatgttagtcgctcattacgcaataattggacctggcctgcaagctaaagccacaagggaggcccagaaaagaaccgctgcaggaataatgaaaaacccgactgtagatggtatcgttgctatagatttagaccctgtagtttacgatgctaagttcgagaagcaattaggccaaataatgttattaattttatgcacatctcaaatactactaatgcgtacgacctgggcactctgtgagtcaatcacattagcgactggaccactcacaacactatgggagggcagcccaggaaaattctggaacactactattgcggtatcaatggccaacatatttagagggtcataccttgcaggggcaggattagcatttagtcttatgaagtctttaggcggcggtcgaagaggaacaggagcacaaggtgaaacactcggggaaaagtggaagagacaacttaaccagttatccaaatctgagttcaatacatataaaagatccggtataatggaagtggaccgttctgaagccaaagaaggtttaaaacgaggagaaactacaaaacatgcggtatcaagaggaacggctaagctgcgctggtttgtagaaaggaacctcgtaaagcccgaaggcaaagtcatcgatctcggttgtggaagaggaggatggtcatattactgcgctggtttaaagaaagttaccgaggtcaaaggatatacaaaaggaggtcccggtcacgaagaacctataccaatggctacatacgggtggaacttagtaaaattgcacagtggaaaagacgtattctttatgcccccagaaaaatgtgacacactgttatgtgatatcggggagagtagtcccaatcccaccatagaagaaggtaggactctaagagtacttaagatggttgagccatggcttagagggaaccaattttgtattaaaattcttaatccatacatgcccagcgttgtagagacactcgaacaaatgcaaagaaaacatggtggcatgctggtaaggaatccgctctcccgcaacagtacacatgaaatgtactgggtcagttgtggcactggcaacatagtaagtgctgtaaacatgacaagtcgcatgctattaaatcgttttactatggcacataggaaaccaacctacgaaagggatgtggacctcggggcgggaacgagacacgtagctgtagaacctgaggtagcgaacttggacatcataggccagaggatagaaaatattaagaacgaacataaaagcacatggcattatgatgaagataacccttacaaaacttgggcttatcatggttcctatgaagtaaaaccatcaggaagcgcctcttctatggtaaatggagtagtgagattactcaccaaaccgtgggacgtgataccaatggttacccaaatcgctatgacagatacaactccattcggacaacaaagagtattcaaagaaaaagttgataccagaacacctcgagcgaaaagagggactacacaaattatggaagtcacagctaaatggttatggggattcttgtcgcgaaacaaaaagccgcggatttgtactcgtgaagaatttacccgcaaagtcagaagcaatgcggcaataggagcggtctttgttgatgaaaaccaatggaactccgctaaagaggcagtggaagacgaaagattttgggatctggtgcacagagaaagggagttacataaacagggtaaatgtgctacgtgtgtttataatatgatgggcaaacgtgagaagaaactaggtgaatttggaaaagcaaaagggtcaagggctatatggtatatgtggttaggtgcacgatttctagaatttgaggcacttggattcatgaatgaggatcattggttttcgagagaaaatagcctaagtggggtcgaaggtgaagggctacataaactaggctatattttgcgagatatctcaaaaatccctggtggaaacatgtatgcagatgatacggctggatgggacacgaggattacggaagatgatctgcaaaatgaggcgaaaattacagatatcatggaacctgaacacgcgctattagcaacctccatttttaaacttacctatcaaaacaaagtagttagagttcaacgtccggccaaaaatggtactgtaatggacgtgatttcaagacgcgatcaaagagggtcgggccaagttggcacatacggcctcaacacctttacgaatatggaagttcaactcattcgtcaaatggaatcagaagggatattccttccatctgaactagaaacccctaacttggctgagagagtattggactggttagaaaaacacggagctgaaagactcaaaaggatggcaattagtggtgatgactgtgtagtaaaacctattgatgatcgatttgctacagcacttacagctctgaacgacatgggtaaagttcgtaaggacattccgcagtgggagcctagtaaaggatggaatgattggcaacaggttccattttgcagtcatcattttcaccaattgataatgaaagatggaagagagatcgtggtaccttgtcgaaatcaagatgaattagtgggcagagctagagtaagccaaggtgcggggtggagcttgagagaaacggcttgtttaggaaaatcatatgcacaaatgtggcaattaatgtatttccaccgacgagatttaagattggcggctaacgctatttgtagtgcagtacctgtagactgggtccccacaagtcgtacgacatggagtattcacgcgcatcaccagtggatgactaccgaagatatgctgtcagtatggaatagagtatggatagaggaaaatccctggatggaagataaaacacatgtatcctcttgggaggaagtaccatacttgggtaaacgggaagatcagtggtgcggcagcttgataggcttaacggcaagagcgacctgggctaccaatatacaggtagcaattaatcaagttcgtcgtctaattggtaacgagaattatctcgattacatgacatccatgaaaagatttaaaaatgaaagtgaccctgagggagcgctatggtaa

SEQ ID NO: 21446 - RNA, 9879 nt, synthetic construct
  misc_feature 1..9879: note = derived and/or modified CDS sequence (opt6) from DENV-1__GU131838__SS-prME
  source 1..9879: mol_type = other RNA
agtgtcacgatgctattaatgttattaccaactgcattggcatttcaccttactactcgaggaggagaacctcacatgattgtctcgaaacaagaacgagggaaatctttgctgttcaaaacatctgcaggagtaaacatgtgcactctgatagcaatggacctaggtgaactctgcgaagacactatgacttacaaatgtccgagaattacagaagcggaacctgatgatgtagactgctggtgtaatgctacggacacatgggtaacatatggtacatgcagtcagacaggtgaacatagaagagaaaaacgatctgtagcattagctcctcatgtcggtctaggattagaaactcggacagaaacgtggatgtcaagtgaaggtgcgtggaaacaaatccaacgagtcgaaacttgggcattgagacatccaggtttcacggtaattgcgtttttcttggcacatgcaattggaacatcaatcacgcaaaaaggaataattttcatactcctaatgctagtgacgccatctatggctatgcgttgcgtcggaataggtaatcgcgattttgtagaaggattatcaggagctacatgggttgatgtggtcctagaacacgggtcttgtgtaactacgatggcgaaaaacaaaccaaccctagatatagaattgctcaaaacagaagttacaaaccctgcagtacttagaaaactatgtattgaagctaaaatatcaaatacaaccacagattcaaggtgtcccacgcagggagaagctacattagtagaagaacaagatgctaattttgtatgtagaagaacgttcgtggatagaggatgggggaacggatgcggattattcgggaaaggtagcctgcttacatgtgccaaatttaaatgcgttacaaaattagaaggaaaaatagtccaatacgaaaatttaaaatattccgtgatcgtaacagtgcatacaggtgatcaacatcaagtcggcaatgaaacaactgaacatggaacaatagccaccatcacaccccaagctcctacaagcgaaatccaactcaccgactatggagcattgacattagattgtagcccacgtaccggattggattttaacgaaatggtattacttacaatgaaagagaaaagttggctagtgcacaaacaatggtttctagacttaccattaccatggacaagtggagcctccacttcacaggagacgtggaatagacaagacctcttagtcacgtttaaaacggcgcatgctaagaaacaggaagtagtcgttctcgggagccaagaaggagccatgcatacagctctaacaggggcaacagaaatacaaacatcgggtactactacgatatttgctggtcatctgaaatgtcggctcaaaatggacaaacttactctaaaagggatgtcctatgtaatgtgcacaggcagttttaaactagaaaaagaggtagctgaaactcagcatggcactgtgttagtacaagtaaaatatgaaggcactgatgccccttgcaaaattcccttcagtacacaagatgaaaaaggtgtgacccagaatggacgactaatcacagccaatccgatagtaaccgataaagagaaaccagttaatattgaaacagaacctcctttcggcgaaagttatatagtcgtaggagccggtgaaaaagcattaaaactatcatggttcaaaagagggagctcaatagggaaaatgttcgaagcaactgcaagaggtgccagaaggatggccatacttggtgacactgcgtgggactttggttctattggtggagttttcacttcggttggaaaattggttcatcaagtcttcggcactgcctatggtgtgttattttccggcgtgagttggacaatgaaaataggaatcggcatcctcctaacctggctagggctaaattcacgttcgaccagtctatccatgacatgtatagcagttggtatggtaacattgtacttaggtgtcatggtacaggcagattcagggtgtgtcataaactggaaaggaagggagctaaaatgcggatcagggatcttcgtaactaatgaagtacacacatggacagaacaatataaattccaagcagacagtcctaaacgcttatcagcggctataggaaaagcatgggaagaaggcgtatgtggtataagatcggctactcgattagaaaatataatgtggaaacaaatatccaatgaactgaatcatatattattggaaaacgatatgaaattcaccgtagtcgtgggagacgctaatgggatactcgcacaaggcaagaaaatgataaggccgcagccaatggaacataaatatagctggaagagttggggaaaagcaaaaataataggagctgacatacagaataccacgtttataattgatggtcctgatactccagagtgtcccgacggacaaagagcatggaatatctgggaagtggaagactacgggttcggtgtattcacaacaaacatttggttaaaactccgtgactcctatacacaaatgtgcgatcaccgactgatgtcagcagcaatcaaagatagcaaggcggtacatgcagatatgggttactggattgaatcagagaaaaatgagacatggaaactggcacgggcttcgttcatcgaggtcaaaacatgtacttggccaaaaagccacaccctgtggtccaacggggtcctagaaagtgaaatgataatcccgaaaatatatggcggcccgatctctcaacacaattatcgaccaggttactttacacagacagcggggccttggcatttgggaaaattagagctagactttgatctgtgtgaaggaaccacagtagtagtagacgagcactgcggtaacagaggaccttcacttaggacgacaaccgtgactggcaaaattatccatgaatggtgctgtagaagctgcaccttacctcctctacgattcagaggtgaagatggctgttggtatggtatggaaataagacccgtgaaagagaaagaagaaaatctcgtcagatctatggtatccgcaggaagtggcgaagtcgattcattttctcttggaatactatgtgtatcaataatgattgaggaagtcatgcggtctagatggagtcgtaaaatgttgatgactggcacattagcggtatttctgttgttaatcatgggacaactcacttggaacgacctgattaggctatgtatcatggtcggtgctaatgcatccgaccgaatgggcatgggaacaacatatctcgcacttatggcgacatttaaaatgcgtcctatgtttgccgttggtttgcttttccgtcggctaacttcacgtgaggttctactactgaccataggtctaagtttagtagcaagtgtggagcttccgaatagtttagaagaacttggggacggactagccatgggaattatgatgcttaaattattgacagagttccagccgcaccaactatggacaaccctattgtccctaacgtttgtaaaaactacactatcacttgattacgcttggaagacaaccgccatggtgttaagcatagtttcactttttccattatgtctatccacaacatcccagaaaacaacttggcttccagtgctactaggcagcttcggctgcaagcccttaacaatgtttctaatcacggaaaacaaaatatggggaagaaaatcttggccattaaatgaaggaattatggcaataggcatagtctcaattttactaagctcgctcctgaaaaatgatgtgcccctcgcgggcccattaatagccggcggtatgttaattgcctgttacgttataagtggaagttctgcagatttaagtctagagaaaacggcagaggttagctgggagcaagaagcagaacattctggtgctagtcataacatattagttgaagttcaagatgatggcactatgaagataaaggacgaggaacgtgacgatactctcacgatactcttaaaagccacgctcttagctgttagcggcgtgtatccgatgtctattcccgctactctattcgtatggtatttttggcaaaagaagaaacaacgaagcggggtgctgtgggacaccccttctccgcctgaagttgaacgagcagttcttgatgatggaatataccgaatattacagagagggttattgggaagatcacaagttggagtaggggtattccaggatggtgtttttcatacaatgtggcacgtcacacgcggtgccgtattaatgtaccaaggcaaaagattagagccatcttgggcaagtgtgaagaaagatctgataagttacggaggcggctggaggtttcaagggagttggaatacaggggaagaagtccaagtaatcgctgtcgaaccaggtaagaatcccaagaatgtccaaaccactcctggaacttttaaaacacctgaaggtgaagtcggtgcgatcgcgcttgactttaaaccgggtacatctggatctcctattgttaacagagaaggaaaaatcgtcggtttgtatggaaatggagtggtcactacaagtggcacttatgtgtcggctattgctcaagcaaaagcaagccaagaaggcccgttaccagaaattgaagatgaagtgtttaagaaacgaaacctaactataatggacttgcaccctgggtcaggaaaaactcgtagataccttcccgctatagtgagagaagcgattaaaagaaagttaaggacactaatacttgctcccactcgtgtagtcgcttcggagatggccgaggccctaaaaggtatgccaataagatatcaaactacagcagtaaaaagtgagcatacgggtagagaaattgtagatctgatgtgtcacgcaacattcaccatgaggcttctttctcctgttcgtgtaccgaactataatatgattatcatggacgaagcacactttacggaccctgcaagtatagctgcacgaggttatatctcgacacgggttgggatgggcgaggcggcagcaatattcatgactgcaactccacccggttcagtagaggcattcccgcaatcgaacgctgttatacaagacgaagaaagggacatccccgagagaagttggaactctggatatgattggattacagacttccctggaaaaaccgtctggtttgttccaagtatcaaaagtgggaatgacatagcaaattgcctaaggaaaaatgggaaaagagttatccagttatcaaggaagacatttgatactgaatatcagaaaactaaaaataatgattgggattacgtagtaactaccgatatttcggaaatgggagccaactttagagcagacagagtgatagatccacgacgctgtcttaaacccgtaattctaaaagatggtccagaacgcgtcatattagccggaccaatgccggttactgtggcctctgcggcacaaagaagaggaagaataggtcgaaatcaaaacaaagagggagatcaatatgtttacatggggcaacctctgaacaatgatgaggatcacgctcattggacggaggcaaaaatgttactcgacaatatcaacacaccagaaggtatcatccctgcactttttgaacccgaaagggaaaagtcggctgctattgatggtgaatatagacttcgtggagaagcaagaaaaacattcgttgaacttatgagacggggagatctgccggtctggctctcctataaagtggcatcagaaggatttcaatattccgatcgccgatggtgctttgatggagagagaaataaccaggtattagaagaaaacatggacgtagagatatggaccaaggagggagaaaggaagaaattgagaccgaggtggctagacgcaaggacgtatagtgatcctctcgcactcagggaatttaaagagttcgcggcaggcagaagatctgtaagcggagatctaatcttggagatagggaaactaccgcagcatttgacactaagagcacagaatgccctcgataatttagtaatgttacataattctgaacagggaggtaaggcttatcgccacgcgatggaggaacttcctgataccatagaaaccttgatgcttctggctttaatagctgtcctaacgggtggtgtaactctattcttcctcagcgggaaaggactaggaaaaacttcaattggtctactctgtgtaaccgcttcatcagctttactgtggatggcatcagtagaaccgcattggattgccgcgtctataatacttgagttctttttaatggtactactaattcctgaaccagacagacaacgaacgcctcaagataatcaacttgcatatgtagtaattggtttactattcatgatactgacggtagctgcaaatgagatgggtttattagaaactacgaagaaagatctcggcattggatatgtggctgctgaaaaccatcaacatgccacaatgctcgatgtagacttgcatccagcatccgcttggactttatatgccgtggccacgacagtgataaccccaatgatgagacacaccatcgaaaacaccacggctaacatttcgctaacagcaatcgcaaaccaggcagcgatattaatgggcttggataaaggttggccaatctcgaaaatggatataggggtacctctcttagccttaggatgttattcacaagtaaatcctttgacactaaccgcagcggtcttgatgttagttgcacactacgctatcataggacccgggttacaagcaaaagccacccgagaagcacagaaaagaacagcagctgggattatgaagaaccccacggttgacggcatcgttgcaatagaccttgacccggttgtgtatgacgctaaattcgaaaaacaactaggtcaaataatgctactcatattgtgtacgagtcagattctactgatgaggacgacatgggccttgtgcgaatcgataacattagccacgggcccactcacaactctatgggaaggctcaccaggtaagttttggaacaccactatagcagtatcaatggcaaatatctttaggggctcgtacttagctggcgcgggtctagccttctcactcatgaaatcattaggcggcggcagacgaggaacaggcgcccaaggtgaaaccttaggtgaaaagtggaaacgacagcttaatcaattatctaaaagtgaatttaatacttataaaagaagcggaatcatggaagtagatagatctgaagcgaaggaaggtctcaaaagaggagagacaaccaaacatgcggtatcaagaggaactgcaaagttacgatggtttgtagaaaggaatttggtaaaacctgaaggaaaagtgatagatttggggtgtgggaggggaggatggtcctactactgcgctggtttgaagaaagttactgaagtaaaaggttatacgaaagggggaccaggtcacgaagaaccaatcccaatggcaacttacggctggaaccttgtcaaactacattctggaaaagatgtgttctttatgccacccgaaaaatgtgatacactattatgcgacataggtgaaagttcacctaatccaactatcgaagaaggtaggaccttgagagttttaaaaatggtggaaccatggctgagagggaatcaattttgcatcaaaatattaaatccatacatgccaagtgttgtggaaactcttgaacaaatgcaaagaaaacacggaggcatgctagtacgtaatcctttaagcagaaattctacacacgagatgtattgggtctcatgtggtacagggaatatagtatctgcggtaaacatgacatcaagaatgttgctcaacaggtttacaatggcacatagaaaaccaacgtatgaaagagatgtagacctaggggcaggcactagacatgtagccgtcgagccagaagtcgcaaacttggatattattggacaacgcatagaaaacataaagaatgaacacaagtcaacatggcactacgacgaagataatccatacaaaacatgggcttatcatggctcttacgaagttaagccgtcgggtagcgcaagcagtatggtaaacggtgttgttagacttttaacaaaaccctgggatgtaatcccaatggtaacacaaatagcaatgacagatactacaccgttcggacaacaacgggtttttaaagagaaagtcgataccaggaccccacgagcaaaacgtggcactactcaaatcatggaggtgaccgccaagtggttgtgggggtttttatcaagaaataagaaaccgaggatttgtacaagggaagagttcacaagaaaagtcagatcaaatgcagctataggagcagtatttgtcgacgaaaaccaatggaactcagctaaagaagctgtagaggatgagcgtttttgggatctagtacatcgggagagagaactccataaacaaggaaagtgtgccacatgcgtatataacatgatgggaaaacgagaaaagaaattgggagagtttggaaaagcaaaaggtagtcgtgcaatttggtatatgtggttaggagccagatttcttgaatttgaagcgttaggatttatgaacgaagaccattggttctcaagagagaatagcctatcgggagtggaaggcgagggattgcataaattgggatatattctacgagacatcagtaaaataccgggaggaaatatgtatgctgatgacactgctggctgggacacgcgtattactgaagacgatctacaaaacgaagcgaagataactgatatcatggaaccggaacatgcactattagctactagcatcttcaaactgacctaccagaacaaagttgtaagagtgcagagaccagcaaagaacggaaccgtaatggatgtgataagcaggagagatcaaagaggctctgggcaagtgggtacctacggacttaatacatttacgaatatggaagttcaattaataaggcaaatggaatccgagggaatctttttaccttcagagttagaaacaccaaatttagcagaacgagcgttggactggcttgaaaaacatggtgctgagcgtcttaaaagaatggcgataagtggagatgactgcgtggtcaagccaatagacgacaggtttgccactgcacttactgcattaaatgatatgggcaaggtaaggaaggatataccacaatgggagccgagtaagggctggaatgattggcaacaggtacccttttgtagtcaccactttcaccaactaattatgaaggatggaagagaaatagtcgtaccgtgccgaaatcaggacgagctggtaggcagagcccgtgtcagtcagggggcaggatggtcgttgagggaaacggcttgcctcgggaagagttatgcacaaatgtggcagttaatgtactttcacagaagagatttacgcctagcagcaaacgcgatctgtagtgcagtgcccgtagactgggtacccacaagtaggactacctggagcatacatgcgcatcatcaatggatgaccaccgaagatatgttatcagtgtggaaccgcgtatggattgaagaaaatccatggatggaagacaaaacacatgtgtcgtcatgggaagaggtaccatatttaggaaaaagagaagatcaatggtgtggatcgctaataggactaacagctcgcgcaacctgggcaacgaatatacaagttgcaatcaatcaagtaagacgcctcataggaaacgaaaattacctagactatatgacaagtatgaaacgttttaaaaatgaatctgacccagaaggggccttatggtaa

SEQ ID NO: 21447 - RNA, 9879 nt, synthetic construct
  misc_feature 1..9879: note = derived and/or modified CDS sequence (opt6) from DENV-1__GU131839__SS-prME
  source 1..9879: mol_type = other RNA
tcagtaaccatgctgttgatgctgcttccgactgcacttgcatttcacttaacgactaggggtggggaaccgcacatgatagtcagtaaacaagaaagagggaaatccttgcttttcaaaacgtcagctggagtaaacatgtgtactctaatagctatggatttaggagaattgtgtgaagatactatgacatataaatgtcctcgaataacagaagcagaaccagatgatgtggactgctggtgtaatgctacagatacatgggttacctatggtacatgttcgcaaacaggtgaacacagacgcgagaaaaggtcggtcgcactagccccacacgttggactaggacttgaaacaagaaccgaaacatggatgtcgagtgaaggagcgtggaaacaaatacaacgcgtagaaacatgggccctacggcatccaggatttacggtaatagcgtttttcttagcacatgccattggaacgtctataacccaaaaaggaataatttttattttacttatgttagtgacaccatcaatggcgatgaggtgtgtgggtatcggaaatcgtgattttgtcgaaggactttcaggagccacatgggttgatgtcgtacttgagcatgggtcttgtgtcactacaatggctaaaaacaaaccgacattagatatagaactactaaaaacagaagtcacaaatccagcagtcttgaggaaactttgcatcgaagcaaaaatttcaaatacaacaacagacagtagatgcccaacacaaggggaagcaacccttgtagaagaacaagatgctaatttcgtgtgtagaagaacgtttgttgatcgaggatggggaaatgggtgcggactgtttggaaaaggatcactattaacatgtgccaaatttaagtgtgtcacgaaattagaaggtaagacagtacaatacgaaaatctaaaatattcagttatagttacagtacacacgggggaccaacatcaagtcggaaatgaaactaccgaacatggcacaattgccactattacaccacaagcaccaacaagtgaaatacaacttacagattatggcgcgctaacgttggattgctctccaaggacaggactagattttaatgaaatggtacttcttaccatgaaagaaaaatcatggttagtgcataaacaatggttcctagatttaccgttaccgtggacaagcggcgcatcaacctcgcaggagacttggaatagacaagaccttttggtgacattcaaaactgcacatgctaagaaacaggaagttgtagtactaggatcacaagaaggtgcgatgcataccgcactaactggagcaactgaaatacaaacaagtggtacaacaacgatttttgcaggacatctaaagtgccgtcttaagatggataaattaacattaaaaggcatgagctacgtcatgtgtactggctcgttcaaactcgaaaaagaggtagcagagacccaacacgggacagtactcgtacaagttaaatacgaaggaactgatgcgccttgcaaaattcctttttcaacgcaagatgaaaaaggcgtgacccaaaacgggagacttatcacggctaatcctattgtgaccgataaggagaaaccggtaaacatagaaactgagccgccatttggcgagagttatatagttgtaggagctggagaaaaagcactgaaactttcgtggtttaaaagggggagcagcatcggtaaaatgttcgaagcaactgctcgcggcgcaaggaggatggcgattctcggtgatacggcatgggactttgggtctattggaggtgtattcacatctgtgggaaagttggttcatcaagtttttgggacagcgtacggcgtactattcagcggcgtatcatggactatgaaaataggtataggaatactattgacttggttgggtctaaattctcgtagcacatcattatcaatgacctgcattgcagtgggaatggtaaccttatatctaggggtaatggtgcaagcagatagtggttgcgttattaactggaaaggacgtgaactgaaatgtggatcggggattttcgtaacaaatgaggtgcatacctggaccgagcaatacaagtttcaggcggattcacctaaaagattaagcgcagcaataggcaaggcttgggaagaaggagtatgcggtatccgtagtgcaacaagactagaaaatatcatgtggaaacaaataagcaacgagttaaatcacatattactggagaacgatatgaaatttaccgttgttgtcggtgacgcaaatggtatactcgtacaaggcaagaaaatgatacgaccccaacctatggaacacaaatactcctggaaatcatggggcaaggcaaaaataataggtgccgatacgcaaaacaccacattcattatcgacggaccggacacacctgaatgtccagacgggcagcgagcatggaatatttgggaggtagaagactatgggtttggagtcttcactacaaatatttggctaaaactacgtgatagttacacccaaatgtgtgatcaccggctaatgagcgcagcaataaaagacagcaaagcagtccatgcagatatgggctattggatagaatccgagaaaaatgaaacttggaagctcgcaagggcatcgtttattgaagtcaagacatgtacgtggccgaaatctcatacattgtggtcaaacggagttctcgagagcgaaatgataattcctaaaatctacggtggaccgatctcacaacacaattatcgcccagggtacttcacgcaaacagctggcccatggcatcttggaaaattagagctggatttcgatttgtgtgaaggaactacagtcgtagtggatgagcactgcggaaatcggggcccctcgttaagaacaacaaccgtaacgggaaaaataatacacgagtggtgctgccgaagttgtaccctaccgccgttgagattcagaggtgaagacggctgctggtatgggatggagatacgacccgttaaagaaaaggaagaaaatttagtaaggagtatggtctcagccggctccggcgaagtcgatagcttctctcttggcattctctgtgttagcatcatgattgaggaagttatgagaagtagatggagccgaaaaatgctcatgactggaacgctcgcggttttccttttactgataatgggacaattgacttggaatgatcttatcaggttgtgcattatggtcggagccaacgcatctgaccgcatggggatgggaactacttatttagcccttatggccacttttaaaatgaggcctatgtttgctgtcggcttactttttcgaagactcacttcgagagaagtactattacttactataggactttcactcgtcgcatcagtggagctacctaatagcctcgaagaattaggtgatggactcgctatgggaataatgatgctcaaacttctaacagagtttcaaccgcaccaattatggacgactctgctttcccttacctttgtaaaaacagcactgtcgttggattatgcatggaaaactactgctatggttcttagtatagtaagccttttcccactatgtctttccacaacaagtcagaaaacgacctggttacctgtgctccttggatcattcgggtgcaaaccgctaacaatgttcctgattacggaaaataaaatttggggtcgaaagtcttggcccctaaacgaaggtataatggctattggtattgttagcattcttctttcctcgctactcaaaaatgacgtgcccctagcaggtcctttaatagccggtggaatgttaattgcatgttacgtaattagcgggtctagtgctgacctatcgctcgagaaagcagcagaagtttcgtgggaacaagaggccgagcatagcggtgcctcacacaacatacttgtggaagttcaagacgacggaaccatgaagataaaagatgaagaaagagacgatacacttacgattttgctgaaagctacgttgctcgcagtatcaggagtctatcccatgtcaattcccgctacgctattcgtttggtatttttggcaaaagaagaaacaacgttcaggagtgttatgggatacaccatctcccccggaagtagagagagcagtattagataatgggatctaccggatactacaacgaggacttttaggtcgttcacaagtaggagttggcgtatttcaggatggagtttttcatactatgtggcacgtcactagaggtgcggtattgatgtatcaaggaaaaagactcgaaccttcgtgggcttctgtgaagaaagatttaattagttatggaggcgggtggaggttccaaggctcgtggaacacaggcgaagaagtacaagttatcgccgtggaaccgggcaaaaatcctaaaaatgtacaaacgactccagggactttcaaaactcctgaaggagaagttggtgcgatagcattagacttcaaaccgggaacaagcggatcacctattgttaatagagaagggaagatagtcggactttatggtaatggagttgtaaccacaagtggcacatatgtatctgccattgcccaagccaaggcgagtcaagaaggaccactacctgaaatagaagatgaagtattcaaaaagagaaaccttacaataatggatttacatccaggctctggaaaaacaaggagatacctacccgctatcgtccgcgaagcgataaaaagaaaacttcgaacgttgatcttagccccgactagagtagtagcttctgaaatggcagaggctctaaaagggatgccgataagatatcagacaactgcggttaaaagtgaacacacaggaagagaaatcgtagaccttatgtgtcatgctacttttaccatgagactactgtcaccagtgagagttccaaactataacatgatcattatggacgaagcacactttacggacccagcaagtattgctgcaagaggatacatctcaacaagagtaggaatgggcgaggctgcagccatattcatgacagcaacgccaccaggaagcgtcgaagcattcccgcagtctaacgctgtgattcaagatgaagagagagatatacccgaaaggagctggaactccgggtacgattggatcactgattttcccggaaaaaccgtgtggttcgttccatcaatcaaaagtgggaatgacatagcaaattgcctaaggaaaaacggcaaaagagtaatacagttatcaagaaagaccttcgatacagagtatcagaaaacgaaaaataatgattgggactatgtagttactaccgatataagcgaaatgggggctaattttcgagcagatagagtgatagatcctagaaggtgcttaaaaccagtgatactgaaagatggtcccgaacgagtaatactcgcaggtccaatgcccgtaacagtagcttctgcagcacaaaggagagggcgaataggccgtaatcaaaataaggaaggggaccaatatgtttatatgggtcaacccctcaacaacgatgaagatcacgctcattggaccgaagccaaaatgcttctagacaatataaacacacctgagggtattatccctgcattgtttgaaccagaacgcgagaaaagtgctgccattgatggggaatacagattgcgaggggaggcgagaaaaacattcgttgagttgatgcgaagaggggacttacctgtgtggttatcctataaagtggcatccgaaggtttccaatattcggataggcgttggtgctttgacggagagcgaaacaatcaagtattagaagaaaatatggacgtagagatatggactaaagaaggagagcgtaagaaactgcgaccccgatggttagacgccaggacgtactctgacccacttgctctacgtgaatttaaagaatttgctgcaggacgaagaagcgttagtggggacttaatactggaaataggtaaacttccacaacatcttacattaagagcacaaaacgcgctagacaatttagtaatgttacacaattcagaacagggtggtaaagcatacagacatgctatggaagaattaccggacactatagaaactttgatgcttcttgcgttgatagcagttctgacaggaggcgttactttattctttcttagtggaaagggcctaggtaaaacatcgataggccttctatgcgttactgcgtcatcggcacttctgtggatggcaagcgttgaaccccattggatagctgctagtattatcctagagttctttctaatggtactactaatacctgaaccagatagacaaaggacaccacaagataaccagctagcatatgtcgtaatcggtttattattcatgattctcacagtagcagcaaacgaaatgggactattagaaacgactaagaaggacctaggaataggctatgtggccgccgaaaatcaccaacatgctacgatgctggatgtagacctacatcctgcatctgcatggacactttacgcagtggcgacgacggtaatcactccgatgatgcgccatactatagagaacacaactgctaatattagtttaacagctattgcgaaccaggcagcgattcttatggggctagataaaggttggcccatatcaaagatggacattggcgttccactgttagcattaggttgttatagccaagttaacccattaactttaacgagtgccgtcttaatgctagtagctcactatgcaataattggacctgggctacaagccaaagctacgagagaagcgcaaaagagaactgcagctggaataatgaaaaatcctacagtcgatggtattgttgccattgatttagatccagtagtctatgatgctaaattcgaaaagcagctagggcaaatcatgctactcatcttatgcacttcacagattcttctaatgaggacaacatgggctctatgtgagagcattacattagctacaggaccactcacaactctttgggaaggaagcccaggaaagttctggaatacaacaattgcagtatctatggcaaatatattccgaggtagttatctagccggtgcgggtttagcattttccctgatgaaatcgttaggaggaggaagaaggggcactggcgctcaaggagagacactcggagaaaaatggaaaaggcagctaaaccaattatctaaaagtgaatttaacacgtataagcgatcaggaataatggaggtagatagatccgaagcaaaagaaggtctaaagagaggtgaaacgacgaaacacgcagtttcacgagggaccgcgaaacttcgttggttcgtggaaaggaatctagttaaacctgagggcaaagtaatcgacttgggatgcggacgtggtggttggagctattactgtgcaggtctaaagaaagttactgaagtcaaaggatatacaaagggaggtccagggcacgaagaacctattccaatggctacgtatggttggaatttagtaaaactacactcaggaaaggatgtattctttatgccaccagaaaaatgcgatacattactatgtgatataggcgaatcttcacctaatccgacaatagaggaaggacgtacgttgagggtactaaagatggttgaaccttggttgaggggtaaccaattctgtattaaaatattgaatccgtatatgccatcagtggtggaaacgttggaacaaatgcagcgaaagcacggaggcatgttagtacgaaaccccctaagtagaaatagcactcatgagatgtattgggtatcttgtggcacaggaaacattgtaagtgcggtaaacatgaccagtagaatgttgttaaaccgtttcaccatggcccaccgcaaaccaacatacgaaagagatgtagacctcggcgcaggcacccgtcacgtagccgtagaaccagaggtcgcgaatttagatataattgggcagagaatcgaaaatatcaaaaacgaacacaagagcacgtggcattacgacgaagataacccgtacaaaacttgggcatatcacgggtcatacgaagtaaagccctccggatcagcgtcgtctatggttaatggggtggtacggctactgacaaaaccgtgggatgtaataccaatggtaacacaaatagcaatgacagatacaaccccatttggccaacaacgagtctttcgagaaaaagtagacacacgaacaccgagagctaagagaggaacaactcagataatggaagtgacggcaaaatggctttggggatttttaagccgtaataagaaacctagaatttgtactcgggaagaatttacacgcaaagtacgatctaacgcggctattggagctgtattcgtagatgaaaatcaatggaatagcgcaaaggaagcagtcgaggatgaacggttttgggaccttgtccacagagagagggaattacataagcaggggaaatgcgctacttgtgtctataacatgatgggaaagagggagaagaaactaggagagttcggcaaggccaaaggatcgagagctatctggtacatgtggttaggagctaggtttctagaatttgaagcattgggttttatgaatgaagatcattggttcagccgtgaaaatagcctaagtggcgtagaaggagaaggtttacataagctaggatatatcctaagagatatatctaaaataccaggagggaatgtctacgcagatgatacagcgggatgggatactcggattacagaggacgatttacaaaatgaagcgaaaataacagatataatggaaccagaacatgcattactcgcaacctcaatttttaagttaacatatcaaaataaagtagtacgtgtccaaaggcctgctaaaaatggcacagtaatggatgtgataagtaggagagaccaacgcggtagcggacaagttggaacgtacgggctcaacacttttacaaacatggaggtccaattgataagacaaatggaaagcgaaggaatattcctaccttcggaattagaaactccaaaccttgccgagagggcactcgattggcttgaaaaacatggtgtcgaacgtcttaaaaggatggcgatttcaggcgacgattgtgtcgtaaagcctatcgatgataggttcgctacagcactcacagctctgaatgacatgggaaaagtaaggaaagacattccacaatgggagccatctaaaggatggaacgactggcaacaagtaccattttgtagccaccattttcaccaacttataatgaaagacggaagggaaatagtggtcccttgtaggaatcaagatgagctagttggtcgagcgagggtcagtcaaggcgcgggatggagtttaagagaaactgcatgtctaggaaaatcatatgcacaaatgtggcaacttatgtatttccatagaagagatttgcgtttagccgcaaatgctatctgtagcgctgtaccagtagattgggttcctacaagccgaactacatggagcatacacgcacaccaccagtggatgacaacagaagacatgctttctgtgtggaacagggtctggattgaagaaaatccttggatggaagacaagacgcacgtctcgagctgggaagaggtaccatacttaggaaagagagaagatcaatggtgcggttctctaattggattgacagctcgagcaacatgggctacgaacattcaggtcgctataaatcaagtacgtagactgattggtaacgaaaactatctagactatatgacatcaatgaaacggttcaaaaatgaaagtgatagcgaaggagctttatggtaa

SEQ ID NO: 21448 - RNA, 9879 nt, synthetic construct
  misc_feature 1..9879: note = derived and/or modified CDS sequence (opt6) from DENV-1__GU131841__SS-prME
  source 1..9879: mol_type = other RNA
tcagttacgatgcttttaatgctgttgcccaccgctttagcctttcacttaactacacgtggaggagaaccacatatgatcgtttccaaacaagaaagagggaaatcgctattgttcaaaacaagtgttggcgtaaatatgtgtacgttaatagcaatggatctgggagaattatgcgaagatacaatgacttataaatgtccacgaataaccgaagccgaacctgacgacgttgattgttggtgcaatgcaaccgatacatgggtcacttacggtacttgttcacaaacaggagaacacagaagagaaaagcgaagtgttgccttagcgccacacgtaggactagggttagaaacaagaactgaaacatggatgtcgtcagaaggcgcctggaagcagatccagagagttgaaacttgggctctccgtcatcctgggttcacagttattgcatttttcttagcttacgcaatcggaacatcaataactcaaaaaggaattatttttatactgttaatgcttgttactccaagcatggcaatgaggtgtgttggcatcggtaatagagattttgtggaaggattgagtggagctacttgggtggatgtcgtactagaacatggctcatgcgttactaccatggctaagaataaaccaacactggacatcgaactgttaaaaactgaagttacaaatcctgcagtactaagaaaactatgcatagaggctaaaataagcaatacaactacagattctcgctgtccaacacaaggtgaggctacattagtagaagaacaagatgcaaatttcgtgtgccgacgcacattcgtagatcgaggttggggaaatggatgcggtttatttggtaaggggtcgctattaacatgcgcaaaattcaaatgcgtaacgaaattggaaggtaaaatcgtgcaatacgaaaaccttaaatatagtgtaatagtaaccgtgcatacaggcgatcagcatcaagtaggtaatgaaacaacagaacacggtacaattgctacaattacaccgcaagcacccacaagtgagatacaactgacggattatggagcactgactttagattgcagcccacggacgggcttggattttaatgaaatggtgctacttactatgaaagaaaaatcctggctagtacataaacaatggttcctagatttaccattgccttggacctcaggtgcatccacctcacaagaaacctggaaccgccaagatctgctagtcacatttaagaccgcacatgcgaaaaaacaagaggtggtcgtgttaggtagtcaagagggcgcaatgcatacagcgttaactggagccactgagatccaaacctcgggcacgacgacaatatttgcaggccacctgaagtgtaggttaaaaatggataaattgacgttgaaaggcatgtcttatgtaatgtgtacaggatcatttaaattagaaaaggaagtagcggaaacacaacatggcactgtgttggtgcaagttaagtatgaaggaactgatgcaccgtgcaaaataccgtttagtacccaagacgaaaaaggagtcacgcaaaatggcagactaatcactgcaaatccaattgttacggataaggagaaaccagtaaatatagagacggaaccacctttcggcgaatcgtatatcgtagttggagcaggagaaaaggcacttaagctatcatggtttaaacggggatccagcattggtaagatgttcgaagcaaccgcacgaggcgcgagacgaatggcaatacttggcgataccgcatgggacttcggttctattggaggggtattcacgtcagtcggaaaacttgtgcaccaagtttttgggacagcgtacggagtattattttctggggttagctggaccatgaagattggtattggcatcctattaacctggctaggccttaactctaggagcacttcattatcgatgacctgcattgctgttggaatggtcacactgtacttgggtgtgatggttcaggccgacagtggatgtgttataaattggaaaggtagagaattgaagtgcggaagcgggatatttgtaacaaacgaagtgcacacatggactgagcaatataaattccaagctgactccccaaagcggcttagtgcagctattggaaaagcctgggaggagggagtatgcggaatcagatctgcgacaagactagaaaacatcatgtggaaacaaatctccaatgaattaaaccatatcctcctcgaaaatgacatgaagttcactgtggttgtgggcgacgcaaacgggatactagcccaaggcaaaaaaatgatacgacctcagccaatggagcacaaatacagttggaaaagctggggcaaagcgaaaataattggtgccgatatacaaaatacaacatttattattgatggtccggacacaccagaatgcccggatggacagcgtgcgtggaatatatgggaagtcgaagactacggctttggcgtttttacaaccaacatctggttaaaactcagggattcatatacacagatgtgcgaccaccgattaatgagcgctgcaattaaagactcaaaagcggtccatgcagatatgggatattggattgaaagtgaaaaaaacgaaacttggaaactcgcacgtgcgtcatttatagaggttaaaacttgtacatggcctaagtctcacacactttggagcaatggtgtcttagaaagtgaaatgataataccaaaaatttatggcggaccaataagtcaacacaattaccgaccaggatactttacccaaactgccggtccatggcacttaggcaaattagaattggactttgatctgtgcgaagggacaactgtagttgttgatgagcattgtggaaatcgaggaccttccctaagaacgaccacagtcactggtaaaatcatacatgaatggtgttgtagatcctgtacgttgcctccgctcagattccgaggcgaagacggatgttggtatgggatggaaatacgaccggtaaaagaaaaggaagaaaacctagttagatctatggtaagtgcaggatcaggagaagtagattcattcagcttaggcatcctttgtgttagcattatgattgaagaagtaatgagatctagatggtctagaaaaatgcttatgactggaacattggccgtctttttattgcttattatgggccaactaacgtggaatgacttgattcgattatgtataatggtaggagctaatgcgagcgacaggatgggaatgggcactacgtatttagcattgatggcaacgttcaaaatgagaccgatgtttgccgtgggattactgttccgtagattgacttcgagggaggttttattgttaaccatagggctatcgttagtggcgagcgtagagcttccaaatagcttagaagaactcggcgacggtttagccatgggaataatgatgcttaagctgctgacagaatttcaacctcaccaactatggacaacattactatctctaacttttgtgaaaaccacactatctttggattatgcatggaagacaacagcaatggtcctctctatcgtctcactttttcctttatgcttgagtactacatctcagaaaacaacatggttgccagttttacttgggtcatttgggtgtaagccactcactatgtttctcatcaccgaaaacaaaatatggggacgcaagtcctggccactaaatgaaggtataatggcgattgggattgtatccatccttctatcttccttgctgaaaaatgatgtaccattggcaggcccgttaattgcagggggaatgctaattgcatgttatgtaatctcaggtagctcagcggatctttcactggaaaaagcagctgaggtttcttgggagcaggaagccgaacattccggagctagtcacaatatattggttgaagtacaggatgatgggacgatgaaaataaaagatgaagagagagatgatacacttacaatccttctaaaggccactttactagcagtatctggagtataccctatgagtataccagcgacgctattcgtatggtacttttggcaaaaaaaaaaacaaagatcaggcgtactatgggataccccttcacctccagaagtcgaaagagcggtattggatgatggcatttacagaatattacaaagagggctacttggacgctcgcaagttggagttggtgtattccaagatggggtgttccatacaatgtggcacgttacaaggggagcggtcttaatgtaccagggaaaacgattagagccctcgtgggcgtcagttaaaaaagatttaatttcatatgggggcggctggcgattccaggggtcatggaatactggagaagaagttcaggtaattgcagtagagccaggaaaaaatccaaagaatgttcaaacaactccaggaacattcaaaaccccagagggagaagtaggtgcaattgcgctcgatttcaaaccaggaacatcaggatctccgattgtaaatcgggaaggcaaaatagtagggctttacggcaatggcgtagtaacaacttctggcacatatgtctcagccatagcgcaagcaaaagcctcgcaagaagggccactacctgaaatagaagacgaagtattcaagaagagaaacctgactatcatggatctccatcctggatcagggaagaccaggcggtatcttccggccatagttcgggaagctataaagagaaaactaagaactctaattttagcaccaacaagggtagtagcttctgaaatggcggaggctttgaaggggatgccaatcagataccagactactgctgttaaaagcgaacatacaggacgcgaaatagtcgaccttatgtgccatgcgacatttacgatgagattattatcgccagtccgagtaccgaactataatatgataatcatggatgaagcccactttacggatcctgcatctatagcggcacgaggatatatatccactagagtcggcatgggagaagctgctgcaatttttatgacagccactcctcccggaagcgtagaagcctttccacaaagcaatgccgtaatccaggatgaagagcgcgatataccagaaagaagctggaatagtgggtatgactggatcacagactttccaggtaaaacagtatggttcgtacccagtataaagagtggtaatgacatagctaattgtttgcgtaaaaatggcaaaagagtgattcaactgtcgagaaaaacgtttgatacagaatatcaaaaaacgaaaaataacgactgggactatgtagtaacgactgacattagtgagatgggtgccaatttcagggcagatagggttattgatcccaggagatgcttaaaacctgtgattttaaaggacggcccagagagagtcatactagcaggccctatgccagtcactgttgcaagcgctgcacaacgacgcggaagaataggtagaaatcaaaacaaagaaggtgatcaatacgtatatatgggtcaaccattaaacaatgatgaggaccacgctcattggacagaggcaaaaatgctactagataatataaatactcctgaaggtataataccggcactatttgagcctgagagggaaaaatccgctgcaatagacggagaataccgactgagaggggaggctcgaaaaacatttgtagaactgatgcgaaggggagacttgccagtttggttaagctataaagtagcaagcgaaggatttcagtattcagataggagatggtgctttgatggcgaacgaaacaatcaagtcttagaggagaatatggatgtggaaatatggacaaaagagggagaaaggaaaaaattaagaccaaggtggttggatgcacgcacatacagtgatccactagccttgagagaatttaaggaattcgcagcgggtcgtcgatcggtttcaggagatctaattttggaaataggaaagttaccccaacacctcacgcttagagctcaaaacgccttggataacttagtgatgcttcataactccgagcaaggaggtaaggcgtatcgacatgcaatggaggaacttcctgataccatagaaacattaatgttattggcattaatagcagtacttactggaggagtaacattatttttcctcagcgggaaaggtttgggaaagacatcgattggcctgctttgtgtcacagcgtcatctgcgctgttgtggatggcatcggtagaaccccattggattgcggcctccataatattagaattctttcttatggtcttacttatcccagagccagatcggcaaagaactccacaggacaaccaactagcatatgtggtaatagggcttttattcatgattcttactgtggctgcaaacgagatgggacttctcgagactacaaaaaaagacttgggaatagggtatgtcgcggcagagaaccaccaacacgcaacaatgttagacgtagatctacacccagcatcagcatggacactatatgcagttgcaaccacagtaataaccccaatgatgaggcatacaatagaaaacacaacagccaatataagcctgactgctattgcaaaccaagcagcaatactgatgggattagacaaaggatggccaatttctaaaatggatatcggcgtcccactattggcgttaggatgctatagtcaagtaaacccactgactttgaccgcagcggttcttatgttagtagcacattatgccataatcggacctgggttacaggccaaagcgacaagggaggcacaaaaaagaactgctgctggtattatgaaaaatccgacagttgacggtattgtcgcaatcgatttggacccagttgtttatgacgccaaatttgagaaacagttggggcagattatgcttcttatactatgcacatctcaaatattgctaatgcgtaccacctgggccttgtgtgaatcaattacattagctactggtcctttgacaaccctatgggagggttcaccgggaaagttttggaacaccactatagcagtttctatggcgaacatattcagaggatcatatttagccggggcagggctggccttttccctaatgaaatccttgggaggtggtagacgaggcacaggtgcacagggtgaaacgcttggggaaaaatggaaacgacagttaaaccaactatctaaatcagaatttaatacttataaaaggtccggaataatggaagtagatcgatcagaagcaaaagagggacttaaaaggggagagaccaccaagcatgccgtgtcgagaggaacagctaaactgagatggttcgtagaaagaaacttagtaaaaccagagggtaaagttattgacctagggtgtggaaggggaggctggtcgtattactgtgccggattgaaaaaagttactgaggtaaaagggtatacgaaagggggaccgggacatgaagagccgataccaatggctacctacggttggaatttagttaaactacattcaggaaaagacgtatttttcatgcctccggagaaatgcgacacgttattgtgcgacattggtgagtcatctccaaacccgacaatagaggagggacgtactttacgagttttgaaaatggtggaaccttggctaaggggtaatcaattttgtattaaaatattaaacccttatatgcccagcgttgtagagactttagaacaaatgcaacgaaaacacggcggaatgttagtacgtaaccccttatcccgaaattctacccatgagatgtattgggtgagctgtggaactggtaacatcgtatccgcagtaaatatgacatcccgaatgcttttgaataggtttaccatggcacacaggaaaccaacatacgagagagacgtagatttaggagcgggcacgagacatgttgctgtagaacctgaagtagccaatctagacataataggtcaaaggattgaaaatattaaaaatgaacataaaagcacgtggcattatgacgaagataatccatataaaacgtgggcataccacggaagttatgaagtcaagccgagtggttcagcatcatccatggtaaatggtgtggtacgattacttacaaaaccatgggatgttataccaatggtaacacaaattgcaatgaccgataccacgccttttggtcaacaaagggtatttaaggaaaaagttgatacgcgaacccccagggcgaaaaggggaacaactcaaataatggaagttacagctaaatggctgtggggtttcttatctcgtaacaagaaacctagaatatgtacaagggaagaatttactcggaaagtgagaagtaacgctgctataggagcagtattcgtggatgaaaaccaatggaacagtgcgaaagaagccgtagaagatgaaagattttgggatttggttcatcgcgaaagagaattacataaacagggtaagtgcgctacatgcgtatataacatgatggggaaacgagaaaaaaaattaggtgaatttgggaaggcaaaaggcagtcgggctatatggtatatgtggcttggtgcaagattccttgaattcgaagcactaggatttatgaatgaagatcattggttttcgagagagaactccctcagcggtgtcgagggcgaagggctacataagctaggatatatactgcgcgacattagtaaaattccgggcgggaatatgtatgcagacgacactgccggatgggatacaagaattactgaagatgacttacagaatgaggcgaagataacagatataatggaaccagagcacgcactactcgcaacatctatatttaaattgacataccaaaacaaggttgttcgtgtccaaagaccggcaaaaaatggtacagtcatggacgtaatatcgcgacgagaccaacgtggctcgggccaagtaggaacttacgggctgaacacattcaccaatatggaagtacaattaattagacaaatggaatctgaagggatattcctaccgtcggaattagaaacacctaatttggcagagagagcactagattggcttgagaaacacggcgcagaaagactaaaacgtatggctatatctggagatgactgcgtagtaaaacctatagacgatcggtttgcaactgccttaacagcattgaacgatatgggaaaagtccgcaaagacataccccaatgggagccatcaaagggttggaatgactggcaacaagtgccgttttgctcacatcattttcatcaactaattatgaaagatggaagggagatcgtggtaccgtgcaggaaccaagatgaactggtaggccgggcaagagtatctcagggagcgggttggagtttacgtgaaacagcttgtttaggaaagtcttacgcacaaatgtggcaactgatgtatttccatcggcgagatcttaggctggcagcaaatgcgatctgcagtgctgtgcctgtagattgggtaccaactagcagaacaacttggagcatccacgcgcaccatcaatggatgacaacggaagacatgctatcagtatggaaccgagtgtggatcgaggagaatccttggatggaagataaaacccatgtttcatcttgggaagaagtaccctatttaggtaaaagggaggatcaatggtgtggctcattaattggtctaacagcacgagctacatgggcgacgaatatacaagtcgccattaaccaggtacgcagactcattggtaatgaaaattacttagactacatgacatcaatgaaaagattcaagaacgaatccgaccctgaaggagctttgtggtaa

SEQ ID NO: 21449 - RNA, 9879 nt, synthetic construct
  misc_feature 1..9879: note = derived and/or modified CDS sequence (opt6) from DENV-1__GQ868601__SS-prME
  source 1..9879: mol_type = other RNA
agcgtaaccatgctactaatgttattacccactgcattagcgtttcatctaactactcgtggaggagaaccacatatgatagtatcaaaacaagaacgtggaaaaagcctattatttaagaccagtgtaggcgtaaacatgtgcactctaatagcaatggaccttggcgaactatgcgaagacactatgacttataaatgccctcgtattacggaagcagaaccagatgacgtcgattgctggtgcaacgccaccgatacatgggtaacgtacggcacatgctcccaaactggagaacaccgcagggataaaagatcagtagctttggccccacacgtaggtttaggcctagaaactcgaactgaaacatggatgagctcagaaggcgcctggaagcaaatccaaaaagtagagacctgggcattacgccatccaggcttcaccgtaatagcattattcctagcgcatgcgatagggacctccattacacaaaaaggaattattttcatcttgttaatgttagttacgccctctatggccatgagatgtgtgggaataggtaaccgagactttgtagaaggattatccggggcaacttgggtcgacgtagttcttgaacacgggtcctgtgttaccaccatggccaaaaacaaaccaacattagatatagaattactaaaaaccgaggtaacaaacccagccgtgttaagaaagctatgcatagaagcaaaaatttcaaataccacaacggatagcagatgcccgacacagggagaagccacattagtagaagaacaagatgctaactttgtatgtcgtcgaacattcgtggacaggggctggggtaatggatgcgggctattcggaaaaggttcacttttaacatgcgcgaaatttaaatgtgtcacaagattagaggggaaaatagtgcaatacgaaaacctcaaatatagtgtaatcgtaaccgtacatacgggggatcagcatcaagtaggcaacgagacaaccgaacacggaaccatagccacaattactcctcaagccccgacgtctgaaatacaactgacggactacggtgctttaactctggattgctccccgcgtacaggactcgactttaacgaaatggttctattaacaatgaaagagaaaagctggcttgtacacaagcaatggttcctagacctaccgttaccatggacaagtggagcatcaacctctcaagaaacttggaacagacaagacctattggtgacattcaaaactgcccatgctaaaaagcaagaggtagtagtattaggatcacaagaaggtgccatgcacactgcattaacaggggccacggaaatacaaacttcgggaacaaccacaattttcgccggtcacctaaaatgtaggttaaaaatggacaaattaacactgaaaggcatgagttacgtcatgtgcacgggaagttttaaattggaaaaggaagtggctgagacacaacacggaactgtcctagtgcaagtaaagtatgaaggcacagatgctccatgtaagataccttttctgacacaagacgagaaaggtgttactcagaacggccgattaattactgcgaacccgatagttacagataaagaaaaaccagtaaatatagaaacagaaccacccttcggcgaatcttacatagttgtaggagctggtgagaaagcacttaaattaagttggtttaagaaaggatcaagtataggaaaaatgttcgaggcgacggcaaggggagcgaggaggatggctatattgggagatacagcatgggacttcggtagtatagggggtttattcacatcagttggaaagttaattcatcaggttttcggtactgcatacggcgtactattttcaggtgtgtcatggacaatgaaaatcgggataggaatcctactaacttggttggggcttaacagcagaagtacaagtctatctatgacgtgtatagcagttggaatggttaccctataccttggtgtgatggtgcaagcagattctggatgtgttataaattggaaaggccgtgaactaaagtgtggcagtgggatttttgtaacaaatgaggtgcatacttggacggaacaatacaaatttcaggcagactctccaaaaagactatcagccgccattggaaaggcgtgggaagaaggagtctgcggtattcgttcagctacacgactagaaaacatcatgtggaaacagattagcaatgaactcaattacatactactagaaaacgatatgaaattcacagtagtagttggagacgcaaacgggatcctagcacagggcaagaaaatgataagaccgcaaccgatggagcacaagtattcatggaagagttggggcaaagcaaaaataattggtgctgatattcaaaataccactttcataattgatggaccggacacacctgagtgtccggatgatcaaagagcatggaacatatgggaggttgaggactacggttttggaatattcactacgaatatttggctaaaattgcgagactcatatacacaaatgtgtgaccataggttaatgagtgctgcaataaaagatagcaaagctgttcatgcggacatggggtactggatcgagtcagagaaaaatgaaacatggaaactagcgagagcctcattcattgaagtcaagacgtgcatttggccaaagtctcacaccctgtggagtaacggtgtgttagagtctgagatgattataccaaaaatatacggaggtccgatttcacaacacaattacagacctggttacttcacacaaaccgcaggaccttggcatctcggaaaacttgagctagatttcgacttatgcgaagggacgactgtagtcgtagatgaacattgtggctatagagggcccagcttaagaaccaccacagtcacaggaaaaataatacatgagtggtgctgcagatcatgtactctcccgcctttgcggtttagaggcgaagacgggtgctggtatggtatggaaatacgcccagtgaaggaaaaggaagaaaaccttgtacgctcgatggtatctgcgggatcaggtgaagtagattccttctccctggggattctatgtgtctcaatactaattgaagaagtaatgaggtctcgatggtcaagaagaatgctaatgacaggtacactagcagttttcttactattaataatgggacagttgacatggaatgatttaatcaggttatgcataatggtaggtgccaacgcttcagacagaatgggcatgggaactacctatctagctctaatggcgacctttaaaatgcgtcctatgtttgcagtaggcttacttttcaggcgattaacctcaagagaagtacttctgttaaccataggactatcacttgtagcatcagttgaattgccaaacagtctagaagaactcggagatggactagctatgggaatcatgatgttaaaactcctaacagattttcagccacaccagctctggacaacccttctcagcttaacgtttattcgtaccactctttcactcgactacgcctggaaaaccatggcaatggctttgtcaatcgtgtcattatttccattatgcctgagtactacaagtcagaaaacaacatggttgccagtcttgctgggatcattcggctgtaaacctctaaccatgttcttaataacagagaacaaaatatggggtcgcaaaagttggcctataaatgaggggattatggcagttggtattgtatctatactcttatcaagtctcctcaaaaacgacgttcctctcgcaggaccactcatagcaggaggaatgttgatcgcatgttacgtgatttctggatcatcagctgacttatcactggagaaggctgctgaggtaagctgggaggaagaagccgaacattccggaacctcacataatatcctagttgaagtgcaggatgatggcacaatgaaaatcaaagacgaagaacgagacgatacgctcacaatcttgctaaaagctacgctacttgcagttagtggtgtataccctatgagcattcctgccactcttttcgtatggtacttctggcagaagaagaaacagcgaagtggtgttctgtgggacactccttcgcccccagaggtggaacgggcggtacttgacgatggaatatacagaatcttacaacgagggttacttggcagatcgcaggttggtgtgggcgtgtttcaagatggagtttttcatacaatgtggcacgtaacacgaggcgccgttcttatgtaccaagggaagagacttgagccatcgtgggcaagcgtcaagaaagacttaatttcgtacggtggaggatggcgtttccagggatcgtggaacaccggggaagaagtacaggtcatcgctgtagagccggggaaaaatcccaaaaacgtccaaaccacgcctggtacctttaaaacaccagaaggagaagtaggagccatagctctagattttaagccgggtacgtctgggtctcccatagttaatcgagaaggaaaaatagtgggtctttatggtaatggtgtcgtaacaacttcaggaacttacgtcagtgcaatagcccaagcaaaggcatcacaagaaggaccactcccagaaatcgaagacgaagtatttaagaaacggaatctcacaataatggatttgcacccaggttccggcaagacgagacggtatctcccagcgatcgttagggaagcaataaaaagaaagttaaggaccctcatccttgctcccactagggtagtagcatctgaaatggcggaggcactaaaaggaatgccaataagataccaaacaactgcagttaaatctgaacatactggaagagaaatcgtcgacttaatgtgtcatgcaacgtttaccatgcgtctcctatcgccggttcgagtgcccaattataatatgataattatggacgaagcccattttacagaccctgccagcatagcagcccgaggatacatttcgacaagagttggcatgggagaagcagctgcgatattcatgacagcaacgcctcccggttccgtagaggcattcccacagtctaatgcagtaattcaggacgaggaaagggacatcccagaaaggtcatggaacagtggttatgattggattacagattttccaggtaagactgtatggttcgtaccatcaataaaaagcggtaatgacattgctaattgtcttaggaaaaatggcaaaagagtgatacagctaagccgaaaaacattcgatactgagtatcagaaaacgaagaataatgattgggattatgttgtaacgactgatatatcagaaatgggagcaaattttagagcagaccgagtaatagatcctaggcgatgtctaaaaccggtaattttaaaggacggccctgaaagggtaattttagcggggccgatgccagtaactgttgcaagtgcagctcaacggagagggcgtattgggagaaaccaaaataaggaaggtgaccaatacatttatatgggacaaccactaaataacgacgaggatcacgctcattggacagaagcaaaaatgttattagacaatataaatacccccgagggtattatccctgcgctctttgaaccagaaagggagaaaagcgcagcaatcgatggtgaatatagactaaggggagaggctagaaaaacttttgtggaattaatgcgaagaggggatctccccgtctggctgagttataaagtcgctagtgaagggtttcaatatagcgataggaggtggtgttttgatggtgaaagaaacaatcaagtgctcgaagagaacatggacgtagagatatggacaaaagaaggtgaaagaaagaaattaagaccaaggtggctcgacgccagaacctattccgaccctttagcattaagagaatttaaagaatttgctgcaggtagaagaagcgtatcgggagatctaatattagaaattggtaaacttccgcaacacctaacattaagagctcaaaacgccttagataaccttgtaatgttgcataattctgaacaaggagggaaggcctacagacatgctatggaagaattaccagacaccatcgagacactgatgttgcttgcgttgatagcagttttgacaggaggggtaactctcttctttctatcaggcaaaggattgggaaagacaagtattggtctactatgtgttatggcttcaagtgcactcttgtggatggcatcggtcgaaccacattggatagctgcatctatcattctagagttctttttgatggtccttttaataccggaaccagatagacaaagaacaccacaagacaatcaactggcatatgttgtcataggattgctctttatgatactaacggtagccgcaaatgaaatgggtctcttagaaacaactaagaaagacctcggtatagggcacgtagcagcagaaaatcatcatcatgcaacaatgttagacgttgatcttcgccccgcctccgcttggacattgtacgcggttgctaccaccgtcatcacaccaatgatgagacataccattgagaacacgacagcaaacattagcttaacggcgatcgcgaaccaagccgccattctaatgggactagataaagggtggccgatctcaaagatggacataggagttcctttacttgcattagggtgctactctcaggtaaacccattgactttaactgcagccgtgttaatgctggtggcacattacgccataatcgggccaggacttcaagctaaggctacacgagaagcacaaaagagaactgctgccggtattatgaaaaatcccacagtggatggaattgttacaatagatctagatccagttgtgtatgacgcaaaatttgaaaagcaattaggacaaataatgttactaatactatgtacaagccaaattctcctcatgagaacaacttgggccctatgtgaatcaatcacactagcaacgggacctttaacaacactctgggaagggtcacctggaaagttctggaacacaactattgccgtttctatggcaaatatttttagaggttcctacctagcaggagcaggcttagcattctcccttatgaaatcactcgggggaggccgccgtggtacaggagcacaaggcgaaactctcggagaaaaatggaaaagacaactaaatcaattatcgaagtcagaatttaatacgtataagcgttcggggattatggaagtcgatcggtcagaggcaaaagaaggattaaagcgcggtgaaactacaaaacacgcggtaagtcgaggtactgctaagttaagatggtttgttgaacgaaacctggtgaaacccgaaggaaaagtgatcgaccttggttgcggtagaggcggttggagttattattgcgccggattgaagaaagttactgaggtaaaaggatatactaaaggagggccaggacacgaagaaccaatcccaatggctacttatgggtggaatttggtcaagctacatagcggaaaagacgtattctttactccacccgaaaagtgcgatacgttactttgcgatattggagaaagttcacctaatcctacgattgaggaaggtaggacgcttagagtattaaagatggttgaaccatggcttcgaggcaatcaattttgcataaaaatactcaacccatacatgccatcagtcgtagaaacgttagaacaaatgcaacgaaagcatggtggaatgctcgtacgaaatccactttcgcggaatagcacgcacgagatgtactgggttagctgtggcacaggaaacatcgtcagcgctgtaaacatgacaagtagaatgctactaaatcgatttactatggcacatcgaaagccaacatatgagcgtgatgtagacctcggggctgggacaagacacgtagcggtcgaaccggaagtcgcgaatttagatattattggccaaagaatagaaaatattaaaaacgagcacaaatccacatggcattatgatgaagacaatccatataagacgtgggcgtatcacggatcgtatgaagtcaaacccagcggctcagcatctagtatggttaatggagtagtacgactgctcacgaaaccatgggacgtgataccgatggtcacgcaaatagcaatgactgatacaacacccttcggacaacagcgggtatttaaagagaaagtggatacaagaaccccacgagctaagagaggtaccgcacaaataatggaggtaacagccaaatggctttgggggtttctgtctcgaaacaagaaaccgcgcatatgtacaagagaggagttcacacgtaaagtacggagtaacgctgcaataggagcagtttttgtggatgaaaaccaatggaactcagcgaaggaagcagtggaagatgaacgattctgggacttagttcatcgcgaacgcgaactacataagcaaggcaaatgcgcaacatgtgtatataatatgatgggcaaacgagagaagaaactaggagagttcggtaaagcaaaagggagccgggccatatggtacatgtggttgggagcgcgttttctagagttcgaggctctaggtttcatgaatgaagatcattggttttcacgtgaaaattctctatctggcgtggaaggagaaggattgcacaaattgggatatatattaagagacatatcaaaaattcctggtggaaatatgtatgcagacgacacagctggatgggacacaagaataactgaggatgatctacaaaatgaagccaaaatcacggacataatggagcctgagcacgcccttcttgccacatccatattcaagctgacatatcaaaacaaagtagtacgggtacaaagacccgctaaaagtggtacggtaatggatgtcatatctagaagagatcagagaggtagtggtcaagtagggacatacggcttgaacacttttactaatatggaagtgcagctaataagacaaatggagagtgagggtatatttagtccatctgaactagaaaccccaaacttagcaaaaagagtattggattggctagaaaagcaaggagcagagagactaaaaagaatggctataagcggtgacgattgtgtagttaagcctatcgatgacagattcgccaccgctttgactgctttgaatgacatgggaaaagtaagaaaagatataccgcaatgggagccatctaaaggatggaacgattggcaacaggttccattttgttcccaccactttcaccaactaattatgaaagacggtagagaaattgtagtgccttgcaggaaccaagatgagctagttggaagggcaagagtgagtcagggagcaggctggtcgttgagagagaccgcatgtctaggtaaatcatatgctcaaatgtggcaactgatgtatttccatagaagagacctccgtctcgcagcaaatgcaatttgtagtgccgtacctgtggactgggtaccaacctctcgcacgacatggtctatacatgcacaccatcaatggatgactactgaggatatgttaagtgtatggaatcgagtttggatcgaggaaaatccttggatggaagacaagacacatgtttcatcctgggaagaagttccctatctaggtaaaagggaagaccaatggtgtggatcattaatcggactaacggctcgcgccacatgggcaacaaatatccaagtcgctattaatcaggtaagacgacttatagggaacgaaaattatcttgactacatgacatcaatgaaaaggtttaaaaatgaatccgacccagagggagcgctatggtga

SEQ ID NO: 21450 - RNA, 9879 nt, synthetic construct
  misc_feature 1..9879: note = derived and/or modified CDS sequence (opt6) from DENV-1__EU660390__SS-prME
  source 1..9879: mol_type = other RNA
tcagtgaccatgctattaatgttgatgccaaccgcactagcattccatctcacgactcgcggaggagaacctcatatgatagtatcaaaacaagaaagaggaaaaagtctgttatttaaaacaagtgcaggagttaatatgtgtacactcattgctatggatttaggtgaattgtgtgaagatacaatgacgtataaatgcccaagaatcacagaagcagaaccagacgatgtcgactgttggtgtaacgcaacagacacttgggtaacgtacgggacatgttcacaaacgggagaacatcgcagggacaaacgatccgtcgctttagcaccgcatgtagggcttggtctagaaactagaacagaaacatggatgagttccgaaggcgcatggaaacaaatacaaagggtcgaaacatgggctctgcggcatccaggattcacggttatagcgctattccttgcacatgcaataggtacaagtattacacaaaaaggcataatttttatactacttatgttagtaacacctagtatggcaatgagatgcgtcggaataggttcaagagactttgtagagggtttgtcaggtgcgacatgggtcgacgtcgttctagagcacggtagttgtgttactaccatggcaaaagacaaaccgacgttagatatagagctacttaaaactgaagtaactaacccagcagtactacggaaattatgcattgaagctaaaattagtaatacgacaacagatagtaggtgcccaacacaaggagaggccacgttagttgaagaacaagatgcaaactttgtttgccgtagaacttttgtagatcgagggtggggcaatggctgcgggctattcggaaaaggtagtctcattacatgtgcaaaatttaaatgtgtaactaaattagaagggaaaatcgtccaatacgagaatttgaaatattccgttatagtaacagtacacaccggcgaccaacaccaggtaggaaacgaatcgacggaacatggcacaacagcgacaattactccacaagctccaacgacggaaatccagctcacggactacggagcgctgacgctcgattgttcaccacggactgggctagactttaacgagatggtgttattaaccatgaaagaaaaatcctggttagtacataaacaatggtttctggatctaccactaccatggacttcaggagctagcaccagccaagagacctggaaccgacaagacctgctagttacgttcaaaaccgcacacgccaagaaacaagaagttgtcgtgttaggtagtcaagagggtgctatgcacacagctttgaccggcgctaccgagattcaaacttcaggaacaacgactatattcgcaggacatttaaaatgcagattgaaaatggacaaactgaccctcaaaggtatgagttatgttatgtgtactggatcattcaaattagaaaaagaagtggcagaaacgcaacatggaactgtattagttcagattaagtacgaaggaactgatgccccatgtaaaattccgttctcgacacaagatgagaaaggagttacccaaaacggcaggcttataacagcaaatccgatagttacggataaagaaaagccggtaaacatagaagctgagcccccattcggagaaagttacatagtaatcggagcaggcgagaaagcactaaagctctcatggtttaagaaaggttcgtcaattggcaaaatgtttgaagcgacggcaagaggtgcgagacgaatggcaatactgggtgatacagcgtgggattttggatcaattggaggtgtctttacctcagttggaaaattagtgcaccaaattttcggaacagcttacggagtgttattcagtggcgtttcttggacaatgaaaattggcatcggggtcttgttgacctggctcgggttgaactcgcgatctacaagcctatctatgacttgcattgcagtaggcttagtaacgttgtacctcggggttatggtacaggccgactcaggttgcgtcattaactggaagggcagagaattgaaatgtggttcgggcatatttgttacaaacgaagtccatacctggacggagcaatacaaatttcaagctgatagcccaaaaaggctgtctgccgctataggaaaggcttgggaagaaggggtatgtggtatacgctcagcaaccaggctcgaaaatataatgtggaaacaaattagtaatgaactcaatcatattttattagaaaatgatatgaaattaacagtcatagtcggagacgtagctggtatactaggacagggaagaaaaatgattaggccacagcctatggaatataagtattcttggaaatcgtggggaaaagctaagatcattggagcagatgcccaaaatactacttttataatagacggccccaatacacccgaatgtccggatgatcaaagagcttggaacatatgggaagtagaagattatggttttggaattttcacaacaaacatttggttgaaattgagagattcatatacccaagtatgtgaccatagactcatgtcggctgcgataaaggatagcaaagcagttcatgccgatatgggttattggatagaaagtgagaaaaatgaaacatggaaactcgcaagggccagctttatagaagtgaaaacctgtatatggcctaagtcccataccttgtggtctaacggagtcctcgaatctgagatgataattcccaagatctatggcggaccaatatcccaacataactatagacctgggtattttactcaaacagcagggccttggcatttgggaaagttagagttagattttgatctatgtgaaggcacaactgtagtagtggatgaacactgcggcaatcgaggacccagcttgaggacaacaactgtaacagggaagatcattcatgaatggtgttgcagatcatgtacattacccccacttcgattcagaggcgaagatggttgttggtatggcatggaaattagaccagtaaaggagaaagaagaaaaccttgttaagagcatggtatctgctggatcaggagaagtagactcattctcgctaggcctcttgtgtatatcaataatgatagaggaggtaatgagaagtcgttggtcccgcaaaatgctaatgacaggcacattagcagtatttttcctactcataatgggtcaactcacatggaacgatctgatcagattatgcattatggttggagccaatgcgtctgacaggatgggcatgggaactacatatcttgctctaatggcaacatttaaaatgagaccaatgtttgcagtaggcttgttgtttaggagattgacatccagagaggttctgttattaactatcggtctctcgctagtagctagtgtcgagctacctaattctcttgaagaattaggagacggcttggcgatggggatcatgatactcaaacttttaaccgatttccagtcacaccaactgtgggcaacacttctgagcttaaccttcataaaaacaactttctcactacattatgcctggaaaacaatggcaatggtactctcaatagtttcattgtttcccctctgtttgtcaacgacttctcagaaaactacatggttacctgttctattaggttcattaggttgtaagccgttgactatgtttttaatagcggagaacaagatttggggacgtaaatcatggccattgaacgaaggaatcatggctgtgggtatagtgtccatattgttatcatcgttacttaaaaatgatgttccactagctgggcccttggttgccggaggaatgttaatcgcatgttacgtaatatccgggtcttccgctgatctctcccttgaaaaggccgctgaagtaagctgggaagaagaagccgagcatagcggagccagtcacaatatattagtcgaagttcaagacgatggaacgatgaaaataaaagatgaagaaagagacgataccttaacgattttattaaaggcgacacttttggcagttagtggggtttatccgttgtcaatccctgctaccctattcgtttggtacttttggcagaagaagaaacaacgatctggcgtactctgggacactccgtcgccaccggaagtagaacgagcagttctagatgatggaatatatagaataatgcaacgtggattacttggaaggagtcaagtaggagtaggggtttttcaagagaatgtatttcataccatgtggcatgttacacggggagcagtattgatgtaccagggaaagcgattagaaccgtcttgggcatcggttaagaaggatctaatatcatacggaggaggttggcgtttacgagggagttggaacacaggagaagaagttcaggtaatagctgtcgaaccaggcaaaaatccgaagaatgtccagacggcgcccggtaccttcaaaactcctgaaggagaagtcggcgccatagcattggattttaaacccggaacttctggctctcccatagtcaatagagaaggaaaaatagtcggcttatatggaaacggggtcgtaaccacatctggcacttatgtatcagcgatcgcacaagctaaggcttctcaagaagggccgttaccagagatagaagatgaggtattcagaaaaaggaacttgacaataatggatcttcatccaggatctggaaagactcggaggtacttgcccgctattgtaagagaagcgatcaaacgtaagctgagaaccctgatattagctcctacgagggtagtagctagcgaaatggcggaagccttgaaaggaatgccaattaggtaccaaactactgcagtcaagagtgagcatacaggtaaagagatagtagatttaatgtgtcatgctacattcactatgagactacttagtccggtcagagtaccaaattacaatatgatcatcatggacgaagcacactttacagatccaagtagtattgcggcgcgcggctacatcagtactagagttggaatgggagaagcagctgccatttttatgaccgctactcctccgggctctgtcgaagcgttcccgcaaagtaacgctgttattcaagatgaggaacgcgatatccctgaaagatcgtggaatagtggttacgaatggatcactgactttccaggaaagacagtatggttcgtaccaagtattaaatcaggcaatgatatcgctaattgtttgaggaaaaacggcaaacgtgtgatacagctaagcagaaaaaccttcgatactgaataccagaaaaccaagaataatgattgggactatgtcgtaacaacggacatatccgagatgggagccaattttcgagcagacagagtaatagatccgcgaagatgtttgaaaccggttatactgaaagatggaccagagagagtcattcttgctggacccatgcctgtgactgtagcttctgctgcgcagagacgagggagaataggtagaaaccataacaaagagggagaccaatatatttatatgggccaacctttaaataatgatgaggatcatgctcattggaccgaagcaaaaatgttattagataacattaacactccagaaggaattatcccggccttatttgagccggagagggaaaagtctgctgcagtagatggcgaatataggctacgtggtgaagcaagaaaaacattcgtggagctcatgagacgtggagatttgccagtgtggttaagttataaagtcgcttccgagggattccagtatagcgatagacgttggtgttttgatggtgagagaaacaatcaagtactagaagaaaatatggacgtagaaatttggaccaaagagggagaacggaagaaattacggcctagatggttggacgcaagaacatatagtgatccgttagcattgagggagttcaaagaatttgctgcgggacgcagatctgtgagtggtgacctaatattagaaataggtaaactcccccaacacctaacacaacgagctcagaacgcattagacaatctggttatgttacacaattctgagcaaggtggcagagcttaccgccatgctatggaagaattaccagatacaattgaaactctaatgttacttgcccttattgcagtactaactggtggtgtcacattatttttcctgtctgggagagggctaggcaaaacttccataggtctattgtgcgttatggcttccagtgtattgctatggatggcttcagttgaaccacactggattgccgccagtataatcctcgaatttttcttgatggtattattaataccagaacctgatcgacaacgtacaccacaggacaaccagcttgcttacgtagtcattggcctccttttcatgatactaacagtggcggcaaatgagatgggactattagaaactaccaagaaagatcttggtatagggcatgtcgcagtcgaaaatcatcatcatgcagcgatgctggacgtagatttacatcccgcaagtgcatggacattatacgctgttgctacaaccataataacgcctatgatgaggcatacaatagagaacactactgccaacattagtctgaccgcaattgcaaatcaagccgcaattctaatgggactcgataaaggatggcctatctcaaaaatggacataggtgtaccgcttcttgcattaggctgctacagtcaagtcaatccactaactttaaccgcagcagttttaatgttagtagcacattatgctatcataggaccgggattacaagcgaaagctacaagggaagcccagaaacgaacagccgcaggaataatgaagaatcccactgtggatggtattgtggctattgatttggacccagtggtttatgacgccaagttcgaaaaacaactgggacaaattatgcttctgatattgtgtaccagtcaaattcttctgatgcgaacaacatgggcattatgtgaaagtatcaccctagcgacaggtccactaaccacattgtgggaaggtagtccaggtaaattttggaacactactattgccgtgtctatggcaaacatatttagaggaagctatctcgccggtgcaggtctagccttttcattaatgaaatcattaggaggtggacgtcgaggaacaggcgcacaaggggaaactttaggagagaaatggaaaaggcaactgaaccaactctctaaatctgagtttaacacctataagagaagcggcatcatggaggtagacagatccgaggcaaaggagggactaaaacggggagaaactacaaaacacgcggtaagtagaggtactgccaaattaaggtggtttgtagagaggaatctagtcaaacccgaaggtaaggtcatagatttaggatgcggacggggtggatggtcctactattgcgcgggtctaaagaaagtcactgaggtaaaaggttatactaaaggtggtcctggacacgaggaacctattccgatggccacgtatggttggaacttagtgaagctacactcaggtaaagacgtattcttcataccaccagaaaagtgcgataccctattatgtgacatcggagaatcttctcccaatccaacaatagaagaaggacgaactctacgagtactaaaaatggtagaaccatggttaagaggtaatcagttctgcataaaaatacttaatccctatatgccatcagtagtggaaactttggaacaaatgcaaagaaaacatgggggtatgttggttcgaaacccgttatcacgcaactctacccacgaaatgtattgggttagttgcggaactggcaatatagtttcggccgttaatatgacaagtcgaatgttactcaatcgatttacaatggctcatagaaaaccaacatacgagcgcgatgtagacttaggaactggaacaagacacgtagctgttgaaccagaagtagctaatctagatataattggccaacgaatagaaaatattaaacatgaacataaatcgacatggcattacgatgaggataatccatacaaaacttgggcttatcatggatcgtatgaagtaaaaccatcaggttcagcaagctcaatggtaaacggcgtcgtgaaactgcttactaaaccatgggacgtaatccctatggttacccaaatagctatgacagacaccacgcctttcggacaacagcgagtttttaaagaaaaagtcgataccagaaccccaaaagctaagaggggcactgcgcaaataatggaggtgacagcgcgctggttgtggggctttttatcgcgaaacaaaaagccacgaatttgcactagagaagagtttacacgaaaagtacgctctaatgctgcgattggagcagtcttcgtagatgaaaatcagtggaacagtgccaaagaagcagttgaagatgaacggttctgggatttggttcatcgggaaagagaattgcacaaacagggaaagtgtgcaacttgtgtatacaatatgatgggcaagagagaaaagaagttaggagaatttggaaaagctaaaggctccagggcaatatggtacatgtggttaggtgcacgattccttgaatttgaggcactaggcttcatgaacgaagatcattggtttagtcgagaaaatagtttgtctggggtagaaggggaaggtctacataaactcggatatatattacgagacatatcaaagattcccggcggtaacatgtatgcagatgatacggcagggtgggatactagaataacagaagacgaccttcaaaatgaggctaaaattacggacatcatggagccggaacacgcacttcttgctaaagccatatttaaattaacctaccaaaataaagttgtaagagtacagagaccagctaaaaacgggactgtaatggatgtgatctctagacgggatcaaaggggatcgggacaagttggaacatacggacttaacacttttacgaatatggaggcacagttaatccggcaaatggaatctgaaggaattttcagtccatctgaattagagactcctaacctagccgaaagagcattggactggttagaaaaatatggagtagaacgactcaagcgcatggcaatatcgggagatgactgtgtagtaaaaccaatagatgacagatttgccaccgcacttaccgctctcaatgatatgggcaaggtccgaaaagatataccacagtgggaaccatccaaaggttggaatgactggcaacaagttccattctgctctcaccattttcatcaattgataatgaaggatggacgagaaatagtcgtaccatgtagaaatcaagatgagttagtaggaagggctcgtgtttcccagggagcaggttggtccctgagggaaaccgcatgcttaggtaagagttatgctcagatgtggcagttaatgtactttcatagacgggatttacgcttggcagcaaatgctatatgttccgccgtacctgtagactgggttccaacgtctcgtactacgtggtctatacatgcacatcaccaatggatgacaaccgaagatatgctctcggtatggaacagagtttggattgaagaaaatccttggatggaggataaaactcacataagctcgtgggaagatgtaccctacctgggcaaaagagaagaccaatggtgcggcagcctaatagggctgacagcgagggctacatgggcaactaatatacaagtcgctattaaccaggtaagacggctaattggaaatgaaaattatcttgactatatgacgagcatgaaaagatttaaaaatgagagtgatccagagggagcgctatggtaa

SEQ ID NO: 21451 - RNA, 9879 nt, synthetic construct
  misc_feature 1..9879: note = derived and/or modified CDS sequence (opt6) from DENV-1__EU660391__SS-prME
  source 1..9879: mol_type = other RNA
tcagtcactatgttattaatgctcatgccgacggcacttgctttccatttaactaccagagggggagaaccccatatgattgttagcaaacaagaacgaggaaaatcgttattatttaaaacgagcgcaggggtaaatatgtgcactttaatagctatggatcttggtgaattttgcgaagatacaatgacctacaaatgcccaagaatcacagaagcggaaccggacgacgtagactgctggtgtaacgcaacagatacgtgggtaacatatgggacatgttcccaaacgggtgaacaccgacgagataaaaggtcggtagcacttgcacctcatgtagggcttgggctagaaactagaacagaaacatggatgtcgtcggaaggagcatggaaacagatacaacgtgttgaaacatgggcattaagacaccctggattcactgtaatagcactttttcttgcacatgcgattggtacatccattacacaaaagggaataatctttatactactaatgctagtaacaccgagcatggcgatgcgatgcgtaggtataggatctagagattttgtggaaggcttaagcggtgcgacatgggtagatgtagtgttggagcacggttcatgcgtaacaactatggccaaagacaaaccaacattagacattgaattactcaaaactgaagtcacaaaccccgcagttcttcggaaattatgcatagaagcaaaaataagcaacacgacgacagactcacggtgtccaacacaaggcgaggcaactcttgtcgaagaacaagacgccaatttcgtttgtaggcgaacttttgtcgatcgaggatggggaaacggttgcggactgttcggaaaaggaagcctgataacttgcgcaaaatttaaatgcgtaacgaaattagaaggtaaaattgtccagtatgaaaatcttaaatactcagtgattgtaactgtacatactggtgatcaacatcaggtaggtaatgagtctaccgaacatggtacaaccgcgacgataacaccacaagcaccgtccacagagatacagctaactgattatggagcattaacgctggattgttccccacgcacgggacttgacttcaatgaaatggtactactaacaatgaaagaaaaatcctggttagtacacaaacaatggttcctggaccttccactgccctggacctccggggcaagtacttcgcaagagacctggaatcgcaaagacctcctagtaaccttcaaaactgcacatgcgaagaaacaagaagtagtcgtactaggttcacaagagggggctatgcatacggctctgacaggagcaacagaaatacaaacctccggaacaactacaatctttgccggtcacctaaaatgcaggctaaaaatggataaactcactttgaaagggatgtcctacgttatgtgtactggcagctttaaactagaaaaagaggtcgctgaaacccaacatgggacagtattagtccagatcaaatacgaaggaacagacgcaccatgtaaaataccattttctacgcaagacgaaaaaggcgtaacccagaatggaaggttaataacggctaatccgatagtcacggataaagagaaaccagttaatattgaggcggaacccccgttcggcgaatcgtacattgtcatcggggccggcgaaaaagcacttaaactgagttggttcaagaaaggtagttctatcggcaaaatgtttgaagcaaccgcgagaggagctagacgaatggcaatacttggtgatacggcttgggattttggctcgataggaggtgtatttacaagcgttggtaaattagtacatcaaattttcggaacagcgtacggagtactgtttagtggcgtatcgtggacgatgaaaataggtataggtgttctgttaacatggttgggcttaaactcaagatccacaagtttatcgatgacttgtatagccgttgggcttgtaaccctgtacctgggagttatggtacaagcggattctggatgcgtgattaactggaaaggtagagagcttaaatgcggatctggaatttttgttactaatgaagtacatacatggacagaacaatacaaatttcaggcagattccccaaaaaggctaagcgcggcaatcggcaaagcatgggaagaaggagtttgcggaatacgatcagcaacaaggctagaaaacataatgtggaaacaaatctcaaatgaattaaatcacatattgttagaaaatgatatgaaatttacagtcgtagtaggagatgtagcaggtatattagcacaaggcaagaaaatgatacgtccgcagccaatggaatataaatattcttggaaatcatggggtaaagctaaaataataggtgcagatgtccagaatacaaccttcattattgatggacctaacacaccagaatgtccggacgatcaaagggcatggaacatatgggaggttgaagactatggttttggcatatttacaacaaatatatggctaaaacttcgagattcttacactcaagtctgtgatcaccggcttatgtccgcggcgatcaaagactcaaaagcagtacatgcagatatgggttactggatagagtctgaaaagaatgaaacctggaaactagccagagcctcctttattgaagttaaaacttgtatatggccaaaatcgcatacattatggagcaatggggtcctagagtctgaaatgataatcccaaaaatttatggcggaccgatatcgcaacacaattaccggcctggctactttactcaaacagcaggcccgtggcatttggggaaactcgaactcgatttcgacttgtgtgaagggacgacagtggtagtggacgaacactgcggaaaccgcggtccaagccttagaacgacaacagttacgggtaagatcattcatgaatggtgttgccgatcttgtaccttaccccctttgcggtttaaaggggaagatggttgctggtacggaatggaaatacgaccagtaaaagagaaggaagaaaaccttgtgaaatcgatggtgtcagcaggatcaggtgaagtcgattcattttccttgggcttattatgtattagtattatgattgaagaagtgatgagatcgcgatggtccagaaagatgttaatgaccgggacattggcagtattctttctgttgattatggggcagttaacctggaacgacttaattcgattgtgtatcatggttggggccaacgcatcggacagaatgggaatgggtacaacatatcttgctttaatggcaacctttaaaatgcgaccaatgttcgcagttggtttactctttagaaggttaacaagtcgagaggtattattactgaccattggattatccctagtcgcgagcgttgaactaccaaattcgctcgaagaattaggggatgggctggcaatgggcataatgattctaaagttacttacagattttcaatcccaccaactgtgggctacattgctatccttaacgtttataaaaactacttttagtctacattatgcatggaaaaccatggcaatggtattatccatagtcagtctcttccctttatgtttgagtaccacttcgcagaaaacaacttggctacctgtcttattaggatcgctaggttgcaagcctcttacaatgtttcttatagcagaaaataagatatggggccgaaaatcttggccgcttaatgaaggaatcatggcagttggaatagtctccatattactctcaagtttacttaaaaacgacgtgcctttagctggtccgctaatcgctgggggaatgttaatagcttgttacgttatatcaggtagctctgctgacctaagtctcgaaaaggccgcggaggtatcatgggaagaagaggcagagcactctggggcctctcacaacatcttagtagaggtgcaagatgacggcaccatgaaaataaaagacgaagaacgcgatgataccctgacaatattgctgaaagcaacactcctcgcagtctcaggggtatatccattgtccattcctgcaacgttattcgtatggtatttttggcagaagaaaaagcaacgatctggggttttatgggacaccccctctccacccgaggtagagcgagccgtcctagacgatggcatttatagaatcatgcagaggggccttctcggtcgaagtcaagtgggtgttggcgtctttcaagagaacgtgtttcacaccatgtggcacgttacaaggggtgctgtgttaatgtatcagggaaaacgattggaaccaagttgggcatcagtaaagaaagatttaatttcatatggtggtggttggaggctacaaggcagttggaacacaggtgaggaggtacaggtcatagccgtagaaccaggcaaaaaccctaaaaatgtacaaacggcacccggtacatttaaaaccagtgaaggggaagttggagctatagcattggattttaaacccgggacgagtggatcacctattgttaaccgagaaggaaaaattgtaggcttatatggcaatggagtggtaacaacctctggtacatatgtgtcagccatagcacaagccaaagcatcacaagacggaccgttaccagaaatcgaggatgaagtatttcgaaaaagaaatttaactatcatggatctacatcccggaagcggaaaaacacggagatacttaccggcaatcgtgcgagaagcgataaaaagaaaattacgtaccctgatcctagcaccaaccagggtagtagcttcggaaatggccgaggctctcaaaggtatgccaattagatatcaaactacagcagtaaaatcagaacatacaggaaaggagatagtagatctaatgtgtcatgccacatttacaatgcgattgctctcacctgtccgcgttccaaattacaacatgataataatggatgaggcccattttactgatcccagcagtatagccgcaagaggatatatttcaacaagggtaggcatgggtgaagcggctgctatttttatgactgccactccaccgggatcggtcgaagcctttcctcaatccaatgcggtaatacaagatgaagagagagatatacctgaacgctcctggaatagtggatatgaatggataaccgatttcccagggaagacggtatggtttgttccaagcatcaaaagcggtaatgatatagctaactgtcttcgcaaaaacggaaagagggtcattcaactatctaggaaaacatttgacaccgagtatcagaaaacgaaaaataacgactgggattatgttgttactacggatatctcagaaatgggcgctaacttcagggcagatcgtgtcattgacccgaggaggtgcttaaagccagtcattcttaaggacggcccggagcgagtcatactagcaggtccaatgcctgtgacagtagcttcagcagcacaacgccgtggaagaataggcaggaaccacaacaaggaaggagatcaatacatttatatgggccagcctttgaataatgacgaggaccacgcacattggaccgaagcaaaaatgctgctcgacaatattaatactccagaaggaattatcccggcgctttttgagccagagcgagaaaaatcagcggcgatagatggagaataccgcctacgaggcgaagcgcgtaaaacatttgtggaactgatgagacgcggagacttaccagtttggctatcttataaagtcgcatctgagggatttcagtacagtgatcgtagatggtgcttcgacggcgaacgcaataatcaagtgcttgaggagaacatggacgtagaaatctggacgaaagagggagagcgtaagaaactgcgacctagatggttggacgctagaacttattccgaccccctagcactacgagagttcaaggagttcgcggctggtcgaagatcggtatcgggcgacctcatactagagataggcaaattgccacagcacctaacccaaagagctcagaatgcattagataatctggttatgcttcataatagtgaacaaggaggcagagcatatcgacatgctatggaagaactccccgatacaatagaaaccttaatgctcttagcattaatagccgttttgacaggtggggtaactctattctttttaagcgggcgcggcttaggtaaaacaagtattggcctactttgtgtcatggcgagcagtgtactattatggatggcctcagtagaaccccactggatagcagcatccatcatactagagttctttctaatggtactgttaatcccggagcccgatagacagagaacacctcaagataaccaactagcctatgtagtaataggactgctatttatgattctaaccgttgcagcgaacgaaatgggcctacttgagacaacaaagaaagatctaggtattggacatgtcgcagtagaaaaccatcaccatgccgccatgttagatgttgacctacatccagctagtgcatggaccttatatgcagttgcaacaactatcataacgcctatgatgcggcacaccatagaaaacacaacggctaatataagtttgaccgcgattgcaaatcaagctgccatattaatgggtcttgacaaaggttggcctatatcgaaaatggatatcggcgtcccactcctagcactcggctgttatagccaagtaaatccgctaacactgaccgctgctgttctaatgcttgtcgcacattatgcaattatagggccggggctacaagcaaaggccacaagagaagcccaaaaacgtactgctgcaggaataatgaaaaaccccaccgtagatgggatagtagcaatagacttggacccagtggtctatgatgcaaagttcgaaaaacaactaggccaaataatgttattaattttatgcacaagtcaaatactgttaatgcgtacaacttgggcactctgtgaatcaataacactcgcaacaggacccctaaccaccctctgggaaggctctccaggaaaattctggaatacgacgatagcggttagtatggcgaacatcttcaggggatcgtatctggctggagccggtttggcattctcgcttatgaaatcattaggcggagggcgacggggcaccggagctcaaggcgagacactaggggaaaaatggaaacgccaattaaatcaactaagtaaatcagaatttaacacatataaacgctccggtataatggaggtggatcgatcggaagcaaaagaaggtttaaaacgaggagagacaacaaaacacgcagtatcccgcggtacagctaaactgagatggtttgtggaaagaaatctagtcaaaccagaggggaaagtcatagatctaggatgcgggagaggtgggtggagctactactgtgcgggactaaagaaagtaaccgaagtcaagggctatactaaaggaggaccaggacatgaggagccaatacctatggcaacatatggttggaatctagttaaattacacagcggtaaagacgttttctttattccacccgaaaagtgtgatacactattatgtgatataggcgaaagttctcccaacccgacaatagaagaaggacggaccctacgcgtactaaaaatggtagaaccatggctgcgaggaaatcaattctgtattaagatcctgaatccttacatgccgagcgtggtagaaaccctagaacagatgcaacgtaaacatggcgggatgttagtccgtaacccgctatcaagaaattcaacgcatgaaatgtactgggtctcttgtggtaccgggaatatagttagtgcagtaaacatgacgtcacgaatgctccttaacagattcactatggcgcatcgaaaacccacgtacgaacgagacgtagaccttggggccggaaccagacatgttgcagtggagcctgaagtagcaaatcttgatattataggacaaaggattgaaaatataaaatatgaacataaatcaacttggcattatgatgaagacaacccatataaaacctgggcgtatcacggttcttatgaagttaaaccaagtgggtctgcgagtagcatggtaaacggagtagtgaaacttctcactaaaccttgggatgtgataccgatggtcacccagatagctatgacagatactacaccctttgggcaacagcgcgtcttcaaagaaaaagtagacacacgaacacccaaagcaaaacgcggaacagctcaaatcatggaagtaacagctaaatggctatggggattcctaagtagaaataaaaagcccagaatatgcacaagagaagaatttactagaaaagtacgatctaatgccgctataggagctgtgtttgttgatgaaaatcaatggaactcagctaaggaagctgtcgaggacgagagattttgggatctggttcaccgagaaagggagctacacaagcagggcaaatgcgctacgtgtgtatataacatgatgggaaaacgtgagaagaaactaggagaatttggtaaagcgaaagggagtagggcaatctggtacatgtggcttggtgcgagatttttagaatttgaagctctagggtttatgaatgaagatcactggttctctagggaaaactcactttctggagttgaaggggagggattgcacaaactaggttatatcttgagggatattagcaaaatccccggaggcaatatgtatgccgatgacacagctggatgggacacaagaattaccgaagatgaccttcaaaatgaggctaaaataacagatattatggaaccagaacatgctttgcttgcgaaatctatctttaagttgacttaccaaaacaaggttgtcagagttcagagaccagccaaaaacggtacggtcatggatgttatctcgaggcgagatcaacggggcagcggacaggtcggaacttacggcctcaacacatttacaaacatggaagcccaactaatcaggcaaatggaatcagaaggaatattttccccatcagaattagaaacaccaaatttggcaggaagagtgttagattggctagaaaagcacggtgtcgaacggttgaaaagaatggcaattagtggggatgattgcgtagtgaagcctatcgatgatagatttgcaaccgctttaaccgcactaaacgacatgggaaaagtccgcaaggatatacctcaatgggaaccttccaaaggttggaacgactggcaacaggttccattttgtagccaccactttcaccaactcattatgaaagatgggagggagattgttgtcccatgtaggaaccaagacgaattagtcggcagggctagagtctctcaaggagcaggttggagtttacgcgaaaccgcctgcctgggaaaatcttatgcgcaaatgtggcaattgatgtattttcacagacgtgacctcagattagcagccaacgctatctgtagtgcagtaccggtagattgggttccgacaagcaggactacatggtcaatacatgcgcatcatcaatggatgaccactgaagacatgttaagtgtgtggaatcgtgtgtggatcgaagagaatccatggatggaagataaaacacacatttcttcttgggaagacgtaccataccttggtaaaagagaagaccaatggtgtggatctctgattggtttaactgctagagctacatgggcaacgaatatacaagtagcaataaaccaggtccgaagattaataggaaacgaaaactatttagattatatgacaagtatgaaacgtttcaagaatgaatctgaccctgaaggagcattatggtaa

SEQ ID NO: 21452 - RNA, 9879 nt, synthetic construct
  misc_feature 1..9879: note = derived and/or modified CDS sequence (opt6) from DENV-1__EU660393__SS-prME
  source 1..9879: mol_type = other RNA
tcagtcacaatgttattaatgttaatgcctacagcactagcatttcatttaactacgcgaggaggggaaccacatatgatagtatcaaaacaagaaagaggtaaaagtctactattcaaaacttcggctggagtgaatatgtgcacacttattgcaatggatttaggagaattgtgtgaagatacaatgacatacaaatgtccgcggattaccgaaacagaaccggatgacgtcgattgttggtgcaatgccacagacacatgggtcacgtatggtacttgttcgcaaactggagaacatagaagagataagaggtcagtagcccttgcaccacatgtgggattaggcttagaaacaaggactgaaacatggatgagttcagaaggggcatggaagcaaattcaacgtgttgaaacatgggcattaagacatcctggttttactgttatagctctattcctagcccatgccattggcaccagtataacacaaaaaggcataatttttattcttctcatgcttgtcaccccctcaatggcgatgagatgtgttggaattgggtcaagagatttcgtcgaaggactgtctggagcaacatgggtggatgtcgtcctcgaacacggctcgtgtgtaaccaccatggccaaagacaaacctacgttagacattgaattacttaaaacagaagttactaatccagctgtattgagaaaactatgtatagaagcaaaaatttccaatacgactacagattccagatgccccacccaaggagaagctacgctagtagaagaacaagatgctaacttcgtctgtcgtaggacctttgttgatcgaggttgggggaatggatgtgggctgtttggaaagggttccctaattacttgtgcgaaattcaaatgtgtaacaaaattagagggtaaaatagtgcaatatgaaaatttaaaatattctgtaatagtgacagtacatacaggtgatcaacaccaagtagggaacgaatcgacggaacatggaacgacagcaacaatcacgccccaagcaccgaccactgaaattcaactaacagactatggagcgttgacactcgattgctcaccacgaacaggattggattttaatgaaatggttttattgactatgaaagaaaaatcatggttggttcataaacaatggtttctagatttgcctttaccttggacaagcggtgcttcaacctcacaggagacctggaacaggcaggacttattagtaacatttaagactgcacacgcgaagaaacaagaagtcgtggtattaggctcacaggaaggagcaatgcatacagcgctcacaggcgcgacagaaatacaaactagcggtacaactacaatatttgctggccatctcaaatgtcggctaaaaatggataagctaacgcttaagggaatgtcgtacgttatgtgcaccggatcatttaaacttgaaaaagaggttgcagaaacacaacacggaaccgtgctagtccaaataaaatacgaaggaacggacgcgccatgcaaaattccattttccacacaagacgaaaagggcataacacaatcaggaagattgatcactgcaaacccgatagttacagacaaagagaaacctgtcaatattgaagcagagcctcctttcggcgaatcgtacatcattataggcgctggcgaaaaagcccttaaactttcatggtttaagaaaggctctagcatcggaaaaatgttcgaagcaacagccagaggtgcgcggaggatggcaatactaggggatactgcatgggatttcggctcgatcggtggtgtatttacctcagtagggaaattggttcatcaaattttcggtaccgcttatggggttttattttcaggggtgagctggactatgaaaataggtataggcgttctgttaacttggcttgggctaaatagtcgcagtacatcactttctatgacgtgcattgcggtaggtttggtaacgctatacttaggagtgatggtacaggcagatagcggatgtgttatcaactggaaaggtagggaattaaaatgtggtagtggaatattcgtaacaaatgaggtacatacctggacagaacagtataaatttcaagctgattcaccaaaacggttatcagcggctatcggaaaggcttgggaagagggggtatgtgggatccgaagtgctacacgacttgaaaacatcatgtggaagcaaatcagtaatgaattgaatcacatactattggaaaacgacatgaaatttacggtagtagttggggacgtagctgggatattagctcagggaaagaaaatgataagaccacaaccgatggaatataaatactcatggaaaagttgggggaaggcaaaaattattggagcagacgttcagaatacgactttcataattgatggtcctaacactccagaatgtccagacgatcagcgagcatggaatatatgggaagtagaggactatggattcggaatttttacaactaatatatggctcaagctaagggatagctatacccaggtttgcgaccataggctgatgagtgctgcaatcaaagattctaaggcagtacatgccgatatgggctactggattgaatcagagaaaaatgagacgtggaaactagctcgtgcatcttttattgaagtgaaaacttgcatatggccaaagagtcatacactgtggtcgaatggggtattagaatcagagatgattatccccaaaatctatggaggtccaatcagccaacacaactacagaccgggatacttcacacaaaccgccggtccatggcatttaggaaaacttgaattagatttcgatttgtgtgaaggcacaacagtagtagtggatgaacactgcggaaaccggggccccagcttacggacgacaacagtgactgggaaaatcatacatgagtggtgctgccgctcatgtacactcccgccactaagattccggggagaagacgggtgctggtatgggatggaaattcggccggtcaaggaaaaagaagaaaatctcgtaaaatctatggtatctgcagggtcaggtgaggttgactcgttctcgctcggtttactatgcatctcgataatgatagaagaagttatgcgatctcgatggtccagaaagatgttaatgacaggaacattagcggttttctttttattaataatggggcaattaacatggaatgatctcatcagattatgtataatggtgggggcaaatgcttctgaccggatgggaatgggaaccacatacctagctttaatggcaacatttaagatgaggccaatgtttgcagttggtcttctatttagacggcttacaagccgagaagtcctattactaaccataggtctatctctcgtcgcatcggtggaactgcccaactctctagaggaactaggggacggattagcgatggggataatgatcctgaaacttctaacggacttccaaagccatcaactgtgggcgacgttattatcactaacgttcataaaaacaacttttagtttacattatgcatggaaaacgatggcaatggtactaagtattgtgagtttatttccactatgtttgtccacaaccagccagaaaactacatggctccccgtcttactcggctctttaggttgcaagccattaacaatgttcctcattgctgaaaacaaaatatggggtagacgaagctggcctttaaatgaaggcataatggcagtaggcattgtatccatacttttaagtagcttgctaaagaacgatgttccgttagctggaccactcatagccgggggaatgctgatagcttgctatgttatatcaggctccagcgcggatctttccttagaaaaagcggcggaagtatcgtgggaagaagaagctgaacatagcggtgcctctcacaacatactcgtagaagtacaagacgatggcacaatgaagataaaggacgaagaacgagatgatacgctgacaattttgcttaaagcgacattgttagcagtttcaggagtttacccgttatcaataccggctacactattcgtgtggtacttctggcagaagaagaaacagcgatcgggtgtcttatgggataccccttcgcctcctgaggtagaacgagctgtcttggatgatggaatataccggatcatgcaacgcggtttactagggagatcacaggttggtgtaggagtatttcaagaaaatgtttttcacacaatgtggcatgtcacacgaggagcagtactaatgtatcaaggcaaaagactcgaacctagttgggcatcggtcaagaaagacctaataagctacggtggcggttggaggttacagggttcatggaacaccggtgaagaagttcaggttatagctgttgaaccaggcaaaaatcctaaaaatgtacaaacagcaccaggaacatttaaaactccagaaggcgaagtaggagcaatcgcgctggattttaaaccagggacaagcggttcaccaatcgtgaacagagaaggcaaaatcgtcggactatatggaaatggtgtagtcactacaagtggtacatacgtgtctgcgatcgctcaagcaaaggcgtcacaggagggaccattaccagagatagaagacgaggtttttagaaaacgcaatttaaccattatggaccttcacccagggagtgggaaaacacgtaggtacctacccgctattgtacgcgaagcaataaaaagaaaactcagaacgcttatattagctccgacaagggtcgtggcatctgaaatggcggaagctctgaaaggtatgccaataaggtaccaaaccacagccgtcaagtccgaacatacgggaaaggaaattgttgatcttatgtgccatgcaactttcacgatgcgactattatcgccggttcgggttcccaactacaacatgatcataatggacgaagcacatttcacggatcccagtagcattgccgcgcgaggatacatatcaacacgtgtcggaatgggtgaagctgccgcaatctttatgacagcaacaccgccaggaagtgtagaggcatttccccagagcaatgccgtaatacaagacgaagagagagacattcctgaaagatcatggaacagtgggtatgaatggataacagacttcccggggaagacggtctggttcgtgccgtcgattaagagcggaaacgacatcgctaactgtttaaggaaaaatggaaaaagagtcattcaactatcacgtaaaacttttgacacagagtatcaaaagactaaaaataatgattgggactatgttgtcaccacagatatatcagaaatgggagcaaattttcgcgcagacagagttattgacccacgaagatgtttaaaacccgttatactcaaagatgggcctgaaagagtaatcctagcaggccctatgcctgttacagtggcaagcgcagctcaaagaaggggacgcataggacgaaaccataacaaagagggcgatcagtatatatacatgggacaacctctaaacaacgatgaagatcatgctcattggactgaggcaaagatgttgttggacaacattaacactccagagggtattattcccgctctatttgaaccagaaagagaaaagtcagccgctattgatggagagtaccgattaaggggagaagcgagaaagacattcgtcgagttaatgagaagaggggacctcccagtatggctctcgtataaagtcgcatcagaaggattccaatattcagaccgacgatggtgctttgacggagaacgaaataatcaagtattggaagaaaacatggacgtagagatttggacaaaggagggcgaaagaaagaaattgcgtccacgatggttagatgctcgcacttattcggatcccttagcgctaagagaatttaaggaatttgcagctgggaggcgttcggttagtggggatttaattctagaaatcggaaagttaccacaacatttgactcagcgagcgcaaaatgctttggataatttggtgatgttacacaatagtgaacaaggaggtagagcctaccgacatgcaatggaagaattgccagacacaattgaaacattgatgctattagctctaatagctgtactaacaggcggtgttacattgttcttcctcagtggacgaggattaggaaagacatctattggattactatgcgttatggcatcatcggtactattatggatggcatcggttgaacctcactggatagcggcctctatcatcttagagttctttctgatggttttgctcattcccgagccggatagacagcgaactccccaggataatcaacttgcatatgttgtaattggattattgtttatgatacttactgtcgccgctaatgagatggggctacttgaaacaactaagaaagatttaggaattgggcatgtagcagttgaaaatcaccatcatgccgcaatgcttgacgttgatctccatccagcaagtgcatggacattatatgcagttgcaacaactatcatcacgccgatgatgaggcatacgattgaaaacactactgctaatatatctttgactgcaatagcaaatcaggcagctatcttgatgggcttggacaaaggctggcctataagcaaaatggacataggggttccattattagcactaggatgctactcccaagtaaatcccctaacccttactgctgcggtactaatgctagtggctcactacgccatcataggtccagggctacaagcgaaggcaactagagaagcccaaaaacggaccgccgcaggcataatgaagaacccaacagttgatggaattgttgctattgatttagatccagttgtatatgacgccaaattcgagaaacaactagggcaaatcatgctgttaattctttgcacttcacaaatactattgatgagaactacatgggcattgtgtgaaagcatcaccttagcaaccggacctctaacaacgttatgggagggctcgccagggaaattttggaatacaacaatagctgtaagtatggctaatatatttcgtggaagttatttggccggggccgggctcgctttctcactcatgaaatctctcggcggaggcagaagaggtacgggagctcagggagaaaccttaggagaaaagtggaagagacaactaaatcaactcagcaagtccgaatttaatacctatagaagaagcgggataatggaggtagatagatcagaggcaaaagaaggattaaaaagaggtgagacgacgaaacacgctgtatcgagagggacagcgaaacttcgttggtttgtagagcgcaatctagtcaaacctgagggaaaggtcatcgatcttggatgcggtcgtgggggttggtcatactactgtgcaggattgaagaaagtcacagaagtgaaagggtataccaaaggaggacctgggcatgaagaacctatacccatggcaacatatggttggaatttagtaaaactccacagtggcaaagacgtattctttataccacccgagaaatgcgacacattactttgcgacataggcgaaagttcgccaaacccaaccatagaggaaggccgaactttaagagtacttaaaatggtagaaccgtggctaagaggtaatcaattctgtattaaaattctaaacccctatatgccaagtgtagtcgaaactttagaacagatgcaacgaaagcatggaggaatgttagtacgaaacccgctgtcaagaaacagcacacatgagatgtactgggtatcatgtggaactgggaatattgtatccgccgtaaatatgacttcgaggatgttgcttaatagattcacaatggctcatagaaagccaacatatgaaagagacgtagatctgggcgcagggactagacatgtcgcggtagaaccagaagtagcaaatctagatataattggtcaacgtatagagaatattaaacacgaacataagagtacatggcattatgacgaagacaatccttataaaacgtgggcctaccacgggagctacgaagtaaaacctagtgggagcgcatcctctatggttaatggagttgttaaacttttaactaaaccttgggacgtcattcctatggtaactcaaatagcgatgaccgataccacaccctttggtcaacaaagagtgttcaaggaaaaggttgacactagaacacctaaggctaaacgtggcacagctcaaattatggaggttacagccaaatggctatggggttttctatctagaaataagaaaccacgaatatgtacacgcgaagagttcacacgaaaagtaagaagtaacgctgctataggggcagtattcgtagacgaaaatcaatggaactctgctaaagaagcggtagaagatgaaaggttttgggatcttgtacatcgagagagggagttacataaacaaggaaaatgtgccacttgtgtttacaacatgatggggaaaagagagaagaaactcggggagttcgggaaggcaaaggggagccgagctatatggtatatgtggcttggagctcggtttctagagtttgaagccttaggttttatgaatgaagatcactggtttagtagagaaaattctctttcaggtgtagagggggagggacttcacaaactgggttatatactgcgtgatatctctaaaatacccggaggtaacatgtatgcagacgatacggcaggatgggatactagaattactgaagacgacctacagaatgaagctagaattacagatataatggagccagaacacgcactcctagccaaatctatctttaaattaacgtatcaaaataaagttgtacgcgtgcagaggccggccaaaaacggcaccgttatggatgtgatatcaagacgcgatcaacgtggttccgggcaagtcggtacatacggattgaacacattcacaaatatggaagcacaactcataagacagatggaaagcgaaggtatattcagtccatctgaattagagacacctaatctagctgaacgagttctagattggttagaaaaatacggggtcgaacggttaaaaagaatggcaatttccggagatgactgtgttgtcaaaccaatagatgaccgtttcgcgactgctttgactgcattgaatgacatgggcaaagtgaggaaggatataccccaatgggagccctccaagggatggaatgactggcaacaagtgccattctgctctcatcattttcatcagcttataatgaaagacggcagagagattgtcgtaccatgccgcaatcaggatgagttagtcggaagggccagagtatcacaaggagctggatggtctctacgggaaacggcttgtcttggtaagtcatatgcacaaatgtggcagttaatgtattttcatagacgagatctacggttagcagcgaatgcaatttgttcagcggtacctgtagattggatacccacttccaggactacctggtcaattcatgctcaccatcaatggatgaccaccgaggatatgttatcggtgtggaatagagtatggatagaagaaaatccatggatggaagacaaaacacatatcagttcatggggagacgttccgtatttgggtaaacgtgaagaccagtggtgcggctccctaataggcttaactgctagagccacatgggcgacaaacatacaagttgcgataaaccaagtcaggcgacttattggaaacgaaaattacctagactacatgacatcaatgaaaagatttaaaaatgagagcgatcctgaaggtgctttatggtaa

SEQ ID NO: 21453 - RNA, 9879 nt, synthetic construct
  misc_feature 1..9879: note = derived and/or modified CDS sequence (opt6) from DENV-1__EU660401__SS-prME
  source 1..9879: mol_type = other RNA
tcagtgacaatgctgcttatgttgatgcctactgcacttgcatttcacttgacaactcgtgggggtgaaccacatatgattgtatcaaaacaagaacgagggaaatcattgctatttaaaacttcagcaggagtgaatatgtgtacgttaatcgcaatggacttaggggaactatgcgaagacaccatgacttataaatgccccaggataacggaaactgaacccgatgatgtcgactgctggtgtaacgcaaccgatacatgggttacttatggaacatgttcacaaacaggtgagcaccgccgagataaacgttcggtcgcgttagcacctcatgtcggtctgggtttggagacaaggaccgaaacttggatgtcgtccgaaggtgcatggaaacaaatccaacgtgttgaaacctgggcactaagacatccgggtttcacagttatagcgctctttctagctcacgcaataggaacgtctattacacaaaaaggaattatatttattttgttaatgttagtaactccatccatggcaatgcgctgtgtcggaataggaagcagggactttgtagaaggattatcaggagcaacatgggtagatgtagttctagagcacggtagctgcgtcactacgatggcaaaagacaaaccgactcttgatatagagttactaaagacggaagtgacaaacccggcagtgctacgcaaactatgcattgaagctaagatatctaatacaactaccgacagccgatgccccactcaaggagaagcaacgttagtcgaggaacaagatgctaattttgtatgtaggagaacatttgtcgatcgtggatggggtaacggctgcggcctttttggaaagggatcgttaatcacttgtgctaagtttaaatgtgttacaaaactagagggaaaaattgtgcaatatgagaatctcaaatattctgtcattgtcacagttcacacaggtgaccaacaccaagtagggaatgagtcaacagaacatggaacaactgcaacgataactccgcaagcccctactaccgaaatacaactaactgactatggggcactcacattagactgtagcccgcgtacaggtttagattttaatgagatggtattattaacaatgaaagaaaaatcctggctcgttcacaaacaatggtttctggatttaccgctaccttggacttcaggagcatcaaccagtcaagagacttggaatcggcaagacttattagtaacgtttaagacggctcatgctaagaaacaggaagtagtagttctaggatcacaagaaggagcaatgcatacagcactaacgggagctacggaaattcaaacctctggtacaactactatctttgcgggccatctaaaatgtagactcaagatggataagctcacgctcaagggtatgtcttatgtaatgtgcactggatctttcaaattagaaaaggaggtagcagaaacgcagcatggtacggtcttagttcaaataaaatacgaaggtacagatgcgccatgtaagataccattttctactcaggacgaaaaaggtgttacacaaaacggacgtttaataacagcaaacccaatagtgacggataaagagaaaccagtaaatatcgaagccgaaccacccttcggtgaaagctatattattatcggagccggtgaaaaagccttaaaattgtcatggtttaaaaagggatctagtatcggtaaaatgtttgaagccacagctcgaggagcaagacgcatggctattttgggagatacagcatgggatttcggcagcataggaggggttttcacaagtgtaggaaagctagttcaccaaatctttggtacagcttacggtgtactatttagtggtgtatcatggacaatgaagataggaataggagtattattaacctggctaggtctaaattcaagaagtacgagcttgtcaatgacttgtattgcagtaggtctagtcactttatacctaggagtcatggttcaggccgactcagggtgcgtaattaattggaaaggacgtgaactgaagtgtgggagcggaatattcgttactaacgaggtacatacatggaccgaacaatacaagtttcaggcagattcgccgaaacgattgtcagcagctattggtaaagcgtgggaagaaggcgtatgtggaataagatccgctactcgactcgaaaacataatgtggaaacaaatatcaaatgagcttaaccatatccttctagaaaatgacatgaagttcaccgttgtcgtcggcgatgtagcaggtatcctagctcagggcaagaaaatgatacggccgcaaccaatggagtacaaatattcctggaaatcatggggaaaggcaaaaattatcggtgcagatgtacagaacacaacttttataatagatggaccaaatacaccggaatgtccagacgatcaaagagcgtggaatatatgggaagtagaagactatggcttcggaatatttactacgaatatttggctaaagctcagagactcacacactcaagtttgtgatcacagacttatgagcgctgccataaaagacagcaaagctgtacatgccgatatgggttattggatagaaagtgaaaagaacgaaacctggaaacttgctcgtgctagctttatagaagtaaagacgtgcatttggcccaagagtcacacgctatggagtaatggggtcttagagtcagaaatgattattcccaaaatatatggaggacctatatcacaacataactacagacctggttatttcacgcaaacagcagggccttggcatttagggaaacttgagttagattttgacttatgcgaaggcactaccgtggtggtcgacgaacactgcggaaacagaggcccttctttacgaacaacaacagttacgggcaaaataatacatgagtggtgctgtcgaagttgtacgttgcccccactcagatttagaggggaggatggttgttggtacggcatggagattaggccagtaaaggaaaaagaggaaaatttagttaagagcatggtatcagcagggagcggtgaagttgactcattctcactcggattgctctgtatttccataatgattgaagaggtaatgcgttccagatggtcgcgtaaaatgctaatgactggcacattagccgtattctttctactaataatgggacaactaacatggaatgatttgatacgcttatgtattatggtgggtgcaaatgcttctgatcgaatgggcatggggacaacatatctagccttaatggcaacattcaaaatgaggccaatgttcgctgtcgggttactatttcgacgtttgacgagccgtgaagtgttgctacttacaattggactatcactcgtagcgtctgtcgagctaccaaattctctcgaagaactgggcgacggcctagcaatgggtataatgatattgaaactcctaacagattttcaaagtcaccagctatgggcgacgttattatcattgactttcataaaaaccaccttttcattacattatgcctggaagacaatggcgatggttctatcaatcgtatcactatttcctttatgtctatctactacatcacagaaaacaacgtggctcccggtactgttgggcagcttgggatgtaaacctctaactatgtttctaatagcggaaaacaaaatctgggggcgacgaagttggccattaaatgaaggtataatggccgttggtatagtctccatccttcttagttcattactcaaaaacgatgtacctctagcagggcctctaattgccggcggaatgctcatagcatgttatgtgatatcaggtagctcggctgatttaagcctagaaaaggcggcagaagtatcttgggaagaagaagccgaacattcaggcgcgtctcacaacatacttgtagaagtacaagatgacggtaccatgaaaatcaaagatgaggaacgggatgatacacttacaatcttattaaaagctactttgcttgcggttagtggagtttatccactttcaattcctgcaactttgtttgtatggtatttttggcagaagaagaaacagagatcaggggtactttgggatacaccatcacctccagaggtcgaacgtgcggtattagatgatggaatatataggattatgcagagaggtcttttaggacgatcccaagtaggtgtaggcgtctttcaagaaaacgtatttcataccatgtggcacgtaaccaggggagcagtacttatgtaccaaggcaaaagattggaaccctcttgggcttctgtaaagaaagatctgatctcttatggaggaggttggagacttcaaggatcatggaatacaggagaagaagttcaagtaatagcagtcgaacctggcaaaaaccccaaaaacgtacagacagcgccaggaacatttaaaactcctgagggagaagttggagccatcgccctcgattttaaacctggaacgtcgggatcgcctattgttaaccgagaaggaaaaattgtagggctatatggaaatggagtcgtgacaacgtcaggaacatatgttagtgcgattgcgcaagcaaaggcttcccaagaaggaccgttaccagaaattgaagatgaggtatttagaaaaagaaatcttacaatcatggacttacatccaggaagcggcaaaactcgaaggtatttaccagcgatcgttcgtgaggcgatcaaacgaaaactacgaactctaatattagcgcctactagagttgttgcttccgaaatggcagaggcattaaaagggatgcccataagatatcagaccacggcagtcaaatcggaacatactggtaaagaaatcgttgatttaatgtgccatgctacttttacaatgcgcctattaagtcccgtcagagttccaaattataacatgatcataatggatgaagcacatttcactgatccaagttctatagcagcgagaggatatatctcgacaagggttggaatgggtgaagccgctgctatttttatgactgccacacctcccggatccgtagaggccttcccccaatccaatgcagttattcaagacgaagaaagagatattccagaaagatcctggaacagtgggtatgaatggataaccgatttccccggcaaaaccgtatggtttgtaccttcaataaaatctggtaatgatatagcgaactgcttgcgtaaaaatggaaaaagagtcattcaactctcgagaaaaacttttgacacggaataccagaaaacgaaaaacaatgattgggattatgtagtgacaaccgatattagtgaaatgggcgccaattttcgagcggacagagtaatagacccacgacgatgcttgaaacccgttatactaaaagatggtcctgaacgggtcatcctagcaggacctatgccagtaacggttgcaagtgccgctcaaagacgtggccgaataggacgaaaccacaacaaagaaggagatcaatatatatatatgggacaaccactcaataatgacgaggatcatgcgcactggacagaagccaaaatgctactagataatataaacacacctgagggcataattcctgcattatttgaaccggaacgtgagaagtctgcagcaatcgatggcgaatacagattaaggggtgaggctcgcaaaacctttgtcgagttaatgagacgtggcgatctgccagtatggttatcctataaagtcgcaagtgaagggttccaatacagcgaccgaagatggtgctttgacggtgaaagaaacaaccaagtattagaggaaaatatggatgtagaaatctggacaaaagagggagaacggaagaaattaagaccccgttggcttgatgcaagaacgtattcagatccattagcattgcgtgaatttaaagaatttgctgcaggcaggagatctgtgagtggcgatttaatactggaaattggaaagttaccgcaacacttaacacaacgagcacagaatgcgcttgataatttggtaatgcttcacaatagtgagcaagggggccgagcctatcggcatgccatggaagaacttccagacacgattgaaacattaatgttgttagcgctaatagctgtactcactggtggagttactctgttctttttatcgggtagaggattagggaagacatcaattggattactatgtgtaatggctagcagtgttctgctatggatggcttcagttgaacctcactggatcgccgcaagtatcatcctcgagtttttcttaatggtattactcataccagaacctgacagacaaaggacccctcaagataatcagctggcgtatgtagttattggtctgctgtttatgattttgacagtggccgcaaatgaaatgggtttgctcgaaacaaccaagaaagatttaggtattggacacgttgcagttgagaatcaccatcatgctgctatgctagacgtcgatctgcatccagcatcagcatggactctatatgcagttgcaacgacgatcattactccaatgatgcgtcacacaatagaaaacacgacagcgaatataagtttgactgcgatcgcaaaccaagccgcaattctaatgggactagataaaggatggccgatctcaaaaatggacataggtgttcccctgttagccttgggatgctattcccaggtaaacccattaacattgacagcagctgtcttaatgcttgtggcgcactatgcaattatcgggccaggacttcaggctaaagcaacaagagaggcacagaaacgaactgccgcaggaataatgaagaacccaaccgtcgatggaatagtcgcgatagatttggatccagtggtctacgacgctaaatttgaaaagcaacttggacaaataatgctactcatactctgtacaagtcagatccttctaatgaggacaacttgggcattatgcgagagtattactctcgctacaggcccactaacaacgttatgggaaggtagtccgggtaaattctggaacaccacaatagcggtgtccatggctaacatctttaggggctcgtatctcgctggagctggactcgcattctccctgatgaaaagtttgggcggtgggagacgtggcacaggcgcgcagggggaaactctgggcgaaaaatggaaacgacagctaaatcaactctctaaaagtgagttcaacacttataagcggtcaggtatcatggaagtcgatagatccgaagcaaaagaaggtctgaagcgaggcgaaacaacaaagcacgccgtctccagaggaacagccaaactgagatggttcgtagaacgcaacttagttaaacctgagggaaaagtaattgacctcgggtgcggtagaggaggctggagctattactgtgcagggcttaagaaagtcacagaggtgaaaggctataccaagggtgggcccggacacgaggaaccaattccaatggcaacatatggatggaatcttgtaaaattacattccggaaaagatgtgttctttataccaccagaaaaatgcgataccttactatgcgatattggagagagctctcctaatcccacgatagaagaaggtagaactttaagagtcctcaaaatggttgaaccgtggctacgaggtaaccaattctgtataaaaattctcaacccatatatgccaagcgttgttgaaacactggaacaaatgcaaaggaagcatggaggtatgctcgttcgaaaccccctttctaggaacagtacacatgagatgtactgggtgtcttgcggcactggtaatattgtaagtgctgtaaatatgacctcacgaatgctattaaataggttcacgatggcacaccgcaaacctacttacgaaagagatgtagacctaggggcaggaaccagacatgtagcggtggagccggaagtagcaaatttagatatcattggacaacgaatagaaaacattaagcacgaacataaaagtacatggcattatgatgaagacaacccatataaaacctgggcgtaccatggatcatatgaagttaagccttccggaagcgcttcaagtatggtaaatggcgtcgtgaaactactaacaaaaccgtgggacgtaataccgatggttacacaaatagccatgacggatactacaccgtttggccaacaaagggtctttaaggaaaaggtggatacgaggacgccaaaagctaaaagaggcacagcccaaattatggaagtaacagcgaaatggttatggggattcttaagtagaaataagaaaccccgcatatgtacaagggaagaatttacgcgaaaggttcgaagcaatgctgcaattggagccgtctttgtcgatgaaaatcagtggaacagtgcaaaagaagccgttgaagatgagcgtttctgggatctggttcacagagaaagagaactacataaacagggtaaatgtgcaacatgtgtgtataacatgatgggcaagcgagagaagaaactaggcgaatttgggaaagcaaaggggagtagagccatttggtatatgtggttgggcgcaagattcctggagtttgaggcgttgggatttatgaacgaagatcattggttttcaagagaaaactcgctatcaggggttgaaggtgaaggcctacataaactagggtatatccttcgagacattagcaaaatacctggcggaaacatgtatgccgatgatacagcaggatgggatactagaattacagaagatgatttacagaatgaggcacggataaccgacatcatggaaccagagcatgcattgcttgcaaaaagcatatttaaacttacctatcagaacaaagtggttagagtacaaaggccggccaaaaatggaactgtcatggatgtaatatcaagaagagaccaaaggggatcagggcaagtaggtacatacgggttgaacacattcacaaatatggaagctcaattgatacgacaaatggagtcagaaggcatttttagccccagcgaactagagacaccgaacctagcagaacgcgtattagattggttggaaaaatatggagtcgaaagactcaaacggatggccataagcggtgatgattgtgtggtcaaacctatcgacgaccgattcgcgacagctttaaccgcacttaatgatatgggtaaagttagaaaggacatcccccaatgggaaccatcaaagggctggaacgattggcagcaagtacctttttgttcacatcacttccaccaattaataatgaaagatggaagagaaatcgtcgttccttgtagaaatcaggatgaattagtagggagagctagggtcagccagggagcaggatggtcattacgggaaacagcatgcttaggtaagtcttacgcccagatgtggcaactaatgtattttcataggcgagatttacgtctcgcggccaatgcaatatgtagcgccgttccagtagactggattcctacttctaggacaacctggagcatacacgcccatcatcaatggatgacaacggaagatatgttgagcgtatggaacagagtatggatagaagagaacccatggatggaggataagacacatatcagcagttggggagatgtaccatatctaggaaaaagggaagatcagtggtgtgggtcactcataggcttaacagccagggcaacatgggctacaaatattcaagtagcaataaatcaggtcagaagactgataggtaatgaaaactacttagactatatgacaagtatgaagcgatttaaaaatgagggcgatccagaaggagcattatggtaa

SEQ ID NO: 21454 - RNA, 9879 nt, synthetic construct
  misc_feature 1..9879: note = derived and/or modified CDS sequence (opt6) from DENV-1__FJ373305__SS-prME
  source 1..9879: mol_type = other RNA
tccgttaccatgctactgatgttaatgccgacggcattagcgtttcatctcactactagaggaggcgaaccccatatgatagtaagtaaacaagaacgtggtaagagcttactcttcaaaacttccgctggggtcaatatgtgcacgttaatcgctatggacttaggggaactttgcgaagatactatgacctataaatgcccacggattaccgaaactgaaccagacgatgtagactgctggtgcaatgcaactgatacatgggttacttatggaacgtgctcacaaacgggagaacaccggagagacaagcgcagcgtagctcttgcaccacatgtgggactgggtcttgaaacccgtacagaaacctggatgtctagcgaaggcgcttggaaacaaattcagagagtcgaaacttgggcattgagacatccgggcttcactgtaatagctttgttcctggctcatgcaattgggacttcgatcacacaaaaaggtattatcttcatactactgatgcttgtaactcccagcatggcgatgagatgtgtaggcataggcagtagggatttcgttgaaggactttcaggcgccacctgggtagatgtagtactagaacacggatcttgcgtaactacaatggccaaagataaacccacccttgacatagaactacttaaaacagaagttaccaacccagctgtactgcgaaaattatgcatagaagcaaaaattagcaatacaaccacagattcgagatgtccaacacaaggtgaagcaactctcgtcgaagaacaagacgcgaattttgtttgccgacgtacctttgtggatcggggctggggaaacggatgtggacttttcgggaaaggttctttgataacttgcgcgaaattcaaatgtgtaacgaaattagaagggaaaatagttcagtatgaaaacttgaaatattccgtcattgtaaccgtccacaccggtgatcagcatcaggtcggaaacgaatctacagaacatggaacaacagctactatcactcctcaagcaccgacaacggaaatacagcttactgattacggagctttaactctagactgtagtccccgcacaggattagattttaatgaaatggtattactaacaatgaaagaaaaatcatggttggttcataaacaatggtttttagacctacctcttccatggacttcaggcgcctccactagccaagaaacctggaataggcaggatctgttagttacttttaagactgcacacgcgaagaaacaagaagtcgttgtcttaggctcacaagagggagcgatgcacactgccttaacaggagccactgaaatccaaaccagcggtactactacaattttcgcagggcatttaaaatgtaggttaaaaatggacaaacttacgctaaagggcatgtcttatgtgatgtgcaccggatcattcaagctagaaaaggaagtggcagaaacacaacatggcacggtactcgttcagatcaagtatgaaggaacagacgcgccatgtaaaattccatttttgactcaagatgaaaagggcgtgactcaaaatggaagattgataacagcgaaccctatagtaacggataaagaaaaaccagtcaatatagaagcagaacctccatttggcgagagttatataataataggagccggtgaaaaggcacttaaactatcatggttcaaaaagggatcaagtattggaaaaatgttcgaagccactgcgagaggagcacgtcgaatggctatcctcggagatacagcttgggatttcggtagcataggcggtgtgtttacaagcgtcggtaaactcgtacatcagatttttggaacagcatatggtgttctctttagtggcgtcagctggacgatgaaaataggaataggagtattattaacctggcttggactaaacagtcggtcaacaagtctttcaatgacttgcatagctgttggactcgtaactctatacttaggtgtaatggtccaagcagactcaggatgcgtgattaattggaaaggaagagaactaaaatgtggttcaggaatattcgtaacgaatgaagtacatacatggacagaacaatacaaattccaagcagatagtcccaagcgactttcagcagcaatagggaaggcttgggaagaaggagtatgtggaataagatccgcgacccgtctcgaaaatatcatgtggaaacaaatatcaaatgaactaaaccatatattactagagaatgatatgaaattcaccgtagtcgttggggacgtagctggcatactggcacaaggaaagaagatgattcgtccccaacctatggaatataaatattcatggaaatcgtggggaaaagccaaaatcataggagcggatgttcaaaatacaacgttcataatcgacgggcctaatactccagaatgtcccgacgaccagcgagcctggaatatttgggaggtcgaagattatgggtttggaatatttacgaccaatatctggcttaaacttagagatagttatacacaagtatgtgaccatcggttaatgtcggcagcaattaaggactcaaaagccgttcatgcagacatgggttattggattgaaagtgaaaagaacgaaacatggaaacttgcaagagctagttttatcgaagttaaaacttgtatatggcccaaaagtcacacattatggtcaaacggagtccttgaatcggaaatgataatacctaaaatctacggaggacctattagccagcacaactacagacctgggtattttacccaaacagcaggaccttggcatttaggaaaactagaattagattttgatctctgtgaaggaactacagtggtagtagatgaacattgcggtaataggggaccaagtttaagaacgacaacagtcacaggaaagattattcatgagtggtgctgccggagctgcactctacctccattgagattcagaggggaagatggttgctggtatgggatggagataagacctgtaaaagaaaaagaagaaaacctggtgaaatcgatggtttctgcgggaagtggagaagtagacagctttagtttaggactactatgtatttccataataattgaggaggtaatgagaagtaggtggtctaggaagatgcttatgactggcactttagccgtatttttcttactaataatgggacaattaacatggaatgatctaatacgcttgtgtataatggtaggagcgaatgcatcagaccgaatgggaatgggaactacgtatttagctttaatggcgacgttcaaaatgaggcccatgtttgctgtaggcctactctttagaagattgacaagtagagaagtacttttgctaaccattggcctaagtctagtagcgagcgtcgagcttcctaactcgctggaagaattgggtgatggattagctatggggatcatgatattaaaattgctaaccgatttccaaagccatcagttatgggctactctgttgagcttgacttttataaagaccacagtttcccttcactatgcttggaaaaccatggctatggtgctgagtatagtctcactatttcctctatgcttgtcaactacatctcagaaaaccacatggctacctgtgctcttaggcagccttggctgtaaaccacttaccatgttcctgatcgctgaaaataaaatatgggggcgtagatcctggccattaaatgaaggtataatggcggtgggaatagtatcaatacttttaagcagcttgcttaaaaacgatgtaccactcgcaggcccccttatagcagggggcatgctcattgcgtgttatgtaatctctggcagctcagctgatctatcactagaaaaagcagcagaggtatcctgggaagaagaggcagaacacagtggtgcttctcataacatattagtcgaagtacaagatgatggaacaatgaagataaaggacgaggagagagacgacacgttaactatactactcaaagctaccttgctggccgtaagtggagtttaccccttaagtattccagcgacgttgttcgtttggtacttttggcagaaaaagaagcagaggtcaggagtactgtgggacacaccgagcccacctgaagtagaacgtgccgtacttgacgatggaatataccggataatgcaaaggggattacttggcagaagtcaagtcggagtaggggtgtttcaagagaatgtattccatacaatgtggcatgtgaccagaggagcagtcctcatgtaccaggggaaaagattggagccatcttgggcatctgtgaagaaggatctaatcagttacggcggcggatggcgtcttcaaggatcatggaatactggggaggaggttcaagtaattgcagtggagccgggtaaaaatcctaaaaatgtgcagaccgcaccgggaacgttcaagacgcctgaaggggaagttggggcaatagccttggactttaaaccaggaacaagcggaagtcccatagtaaatagagaaggaaagatagtgggactttacggaaatggggtggtaactacaagtggaacatatgtaagcgcaatagcacaagcgaaagcaagccaagaaggaccccttcctgagatagaggatgaagttttccgaaaacgcaacctcacaattatggatttacaccctggctcgggcaagacgagacgctacctgccagctatagtaagagaagcaattaaacgaaaactgagaacgctgatactggcgcctaccagagttgtagcaagcgaaatggcggaagctctaaaaggaatgcccatacgataccaaacgacagctgtgaaatccgaacacacaggtaaagaaatcgtagacctaatgtgtcatgccacatttacgatgcgattgttgagcccggttcgagtgccaaactataatatgattattatggacgaagcacatttcactgacccgtcaagtatcgcggctaggggttacatatccactcgcgttggaatgggggaagcagctgccatttttatgactgctactccacctgggtcagtagaggcttttccgcaatcaaacgcagtcattcaagatgaggaaagagatataccagaaagaagttggaactcaggctatgagtggatcacagatttcccaggaaaaacagtatggttcgttcccagtataaaatctggtaacgacattgccaattgcttgaggaaaaatggcaaaagagtaatccaactttctaggaaaacattcgacacagaataccaaaagacgaagaataacgactgggattacgtagtaactaccgatatttcagagatgggagctaattttcgagcagatcgggtgatagatcctcggagatgtctaaaaccagtcatattaaaagacggtccagagcgagtaatattagcgggtccaatgccagtgactgtagcatcagcagcacagaggcgaggcagaataggacggaatcacaacaaagaaggggatcaatatatatatatgggccaaccactcaataacgacgaagatcacgcacactggactgaagctaagatgctattagacaacataaatacccctgaggggatcataccagcattgtttgaaccagagagagaaaagtcggccgcaatagatggggaatatcggcttagaggagaggcacggaaaacatttgtggagttgatgcgaagaggcgatctacctgtttggctaagttacaaggtcgcatcagaaggcttccaatactcggaccgacgttggtgttttgatggagagcgcaacaatcaagtattagaagagaacatggacgtagaaatttggaccaaagaaggagagagaaagaaattacggccccgatggttagatgcacgaacttatagcgatccattagccttgagagagttcaaagaatttgccgcaggccgcagaagtgtatctggtgacctgatattagagatcggcaaacttccacagcacttaacacaacgcgcccaaaacgcacttgataacctagtaatgttgcacaattctgaacaaggcggtcgtgcttataggcacgctatggaagaattgccggatacaatcgagacactcatgctactcgccctaattgctgtacttacaggtggagtgactttattcttccttagtggacgtggacttggaaaaacttcgatcggtctattgtgtgttatggcttcttcagtattattgtggatggcctctgtagaaccgcattggatcgcagcaagtattattcttgagttctttttaatggttttactaatacctgagccagatagacaacgaacgccccaagacaatcaattagcctacgtagtgataggattgctgtttatgatcctgacagtggcagcgaacgaaatgggcctccttgaaacaacgaagaaagacttgggcattggccatgtagcagtagagaaccaccatcatgctgctatgcttgatgtagatttacatccagctagtgcatggaccttatatgcggtagctacgacgattatcactccaatgatgagacatacaattgaaaatacgacagcaaacataagcctaacggcaatcgcaaatcaagcagctatattaatgggattggataaaggatggccaatatccaaaatggatataggagtacctctattggcattaggttgctattcccaagtaaatcctctgacactgaccgcagccgtcctaatgttagtagcacattatgctataatcggaccgggactacaggcaaaagctacgagagaggcgcagaaacggacagctgccggaatcatgaaaaaccccacggtagacggcatagttgcaatagatttagaccccgtagtttatgatgcaaaatttgagaaacaactaggtcagataatgctcttaatattatgtacctcccaaattcttttgatgagaactacatgggcattatgtgaatcaattacattagcaactggccctttaaccacattatgggagggttcaccaggcaagttttggaatactacaatagcagtatcaatggcgaatatattccgaggatcctatttagcgggcgcgggcctggctttctcactaatgaagtcactaggtggaggcaggagaggcaccggagcccagggcgaaactttaggagaaaaatggaaaagacaacttaatcaattatctaaatccgagttcaatacatacaaaagatctggtataatggaagtagatcgttctgaagctaaagaaggtctaaagcgaggagaaacaacgaaacatgctgtttcgagagggaccgccaaattaaggtggtttgtagaaagaaatcttgttaaacctgaaggaaaagtaatcgatctcggatgtggtagaggtggttggagctattattgtgcaggactaaagaaagtgacggaagtaaaaggatatacaaaaggaggcccaggccatgaggaacccattcccatggcaacatatggatggaacctagttaaactacattcgggcaaggacgtattctttataccacctgagaaatgcgacactctcctatgcgatattggagaaagtagcccgaatccaaccatagaagagggacgaactttacgcgtgctaaaaatggtagaaccatggttacggggcaatcaattctgtataaaaatcttaaatccttatatgccaagcgtcgtcgagacgttagaacagatgcagaggaaacatggtgggatgcttgtacgaaatcccctaagtagaaactcaactcacgagatgtactgggtaagttgcgggaccggaaatatagtatcggccgtaaatatgacaagtaggatgttattaaatagatttactatggcccacagaaaacccacctatgaaagggatgtagatcttggcgccggtacacgacatgtcgcggtggagcctgaagtcgctaatcttgacataataggtcaacgaatagagaatattaaacatgagcataaaagcacatggcactatgatgaggacaacccatataaaacatgggcttaccatggtagctatgaagtaaagcccagtgggtctgcaagttcaatggtcaacggtgtggttaaactcttaacaaaaccctgggacgttatacccatggtcacacaaatagctatgaccgatacaactccattcggacaacaaagagtttttaaagagaaagtcgacaccaggacgcccaaagcgaaacgaggtaccgcacaaatcatggaggtgactgcaaagtggctatggggcttcctttctcgtaataagaaaccacgaatctgtacaagggaagaatttactcgaaaagtccgatctaatgccgcaataggagctgtattcgtagatgagaatcagtggaatagtgctaaagaagcagtggaggacgaacgattctgggatctagttcatagggaacgtgagctgcacaaacaagggaaatgtgcgacatgcgtttacaacatgatgggtaaaagagagaagaaactgggagagttcggcaaggctaaaggcagcagggccatttggtacatgtggttaggcgctcgcttcctggagttcgaggctttggggttcatgaatgaagatcactggttttcaagggaaaattcgttgtcgggtgtagaaggagagggtctccacaagctgggttatatacttcgagacatctcaaagattcctgggggcaatatgtatgcagatgatacggctgggtgggatactaggataacggaagacgacttacaaaacgaggcccggattaccgatattatggaaccagagcatgcattgctagctaaatcaatatttaagctaacatatcaaaataaagttgttagggtacaaaggcccgctaagaatggaacagttatggacgtcatcagtagacgggaccaaagaggatccggacaagttggaacgtatggactaaacactttcacgaacatggaagcgcaactaataagacaaatggaatcagaggggatatttagcccatcagaactcgaaacgccaaacttagcggaacgtgttttagattggctagagaagtacggcgtggagagacttaaaagaatggctataagtggagacgactgtgttgtgaaacccatagacgatcgcttcgcaacagctttaacagccttgaatgacatgggaaaggttaggaaggacataccccaatgggaaccatcaaaaggatggaacgactggcaacaagttccattttgtagccatcactttcatcagttaataatgaaagatggtcgagaaattgtagttccttgtaggaatcaagatgagttagtgggtcgagcgagagttagccaaggagccgggtggagcctacgagagacagcctgcttgggcaagtcatacgcacagatgtggcaactaatgtacttccatcggcgtgacttgagattagcagcaaacgcgatctgttcagctgtacctgtagattggataccaacaagtagaacgacttggtcaatccacgcacatcatcagtggatgacaacagaagatatgttgtcggtttggaatcgagtttggatcgaagaaaacccgtggatggaagataaaacacatatttcaagctggggagacgtaccttatttgggcaaaagagaggatcaatggtgtggaagtcttattggactaacggcgagagccacatgggcaactaatatacaagttgcgatcaatcaggtcagacgactcattggtaacgagaactatcttgattacatgacaagtatgaaacgatttaaaaacgaaggagacccagaaggggccttgtggtaa

SEQ ID NO: 21455 - RNA, 9879 nt, synthetic construct
  misc_feature 1..9879: note = derived and/or modified CDS sequence (opt6) from DENV-1__EU660402__SS-prME
  source 1..9879: mol_type = other RNA
tcagtaacaatgttactgatgctgatgccaacagctctagcgtttcatctgactacacgaggaggagaacctcacatgatcgtatccaaacaagaacgaggaaaaagtttgctttttaaaacttccgcaggcgtcaatatgtgtactctaattgcaatggacctgggcgaattttgtgaagatacaatgacatataaatgtccacgaataactgaagcagaacctgatgatgtagattgctggtgcaacgcaaccgatacatgggttacatacggcacatgttcacaaacgggcgaacacaggcgtgacaaacgctcagtagccctagccccacatgtcggcttaggtcttgaaactcgtacagaaacctggatgagtagtgagggcgcttggaaacaaatacaaagagtagaaacctgggcactaagacatccaggatttacagtaatcgcactttttcttgcacacgcaattggcacatctatcacccaaaaaggaatcatattcattctacttatgttagtcaccccttcaatggccatgcgttgcgtaggtatcggaagtagagacttcgttgaggggttaagcggagctacttgggtagatgttgtcttagaacacgggtcttgtgttacaactatggccaaagacaaacctacacttgatatcgaactcctgaaaaccgaggtgaccaacccagcagttctgcgcaaattatgcattgaagctaaaatttccaatacgacaacagacagcagatgccctacacaaggtgaagcaaccttagtagaagaacaagatgccaatttcgtgtgtcgcagaacattcgttgatcgtggctggggtaatggttgtgggctatttggaaaaggcagcttgataacgtgcgcaaaatttaaatgtgttactaaattagaaggaaaaattgtccaatacgagaatctcaaatattctgtaatagtaacagtccacacaggagaccaacaccaagtcggtaatgagtctacggaacacggaacaacggcgacaatcacgcctcaggccccatcaacagaaatccagctaaccgattacggagcattaacactagattgttcaccacgcacaggcttggacttcaatgaaatggtattgttaacgatgaaagagaaatcgtggcttgtacataaacagtggtttctagatttgcctttgccctggacttctggggcttcaacatcgcaggaaacatggaatagacaagatcttttagtcacatttaaaacggctcatgcaaagaaacaagaagtggtagtacttggatcccaagaaggagcaatgcacaccgcactaactggagccacagaaattcaaacatctggaacaacgacgatatttgcaggacatctcaaatgtcgtctcaaaatggataaactaacgttaaaagggatgtcatacgtaatgtgtacaggttcttttaaattagaaaaggaggtagcggaaacgcaacacggaacagttctcgtacaaataaaatatgagggaatcgacgctccttgtaaaataccattttcaacacaggatgaaaaaggtgtaacacagaatggaagattaattacagctaatccgattgtaacagataaagaaaaaccagtaaacatagaggcggaaccaccctttggcgaatcatacatagtgatcggagcgggagaaaaggctttaaaattaagctggtttaagaaaggatcatccattgggaaaatgttcgaagcgacagctcgaggagcgcgacgtatggctatactcggagataccgcctgggatttcgggtcaattggcggggtgtttacatcagtagggaaacttgtccatcagatatttggaaccgcctacggggtactttttagtggcgtgtcatggaccatgaaaatcggcattggagtgttacttacgtggctaggattaaacagcaggagcacttcacttagcatgacatgtatagcagtgggtttggtaacattatacttaggggtcatggtgcaggcagattccggatgtgtcattaattggaagggaagggaattaaagtgcggcagcggaatatttgtgacaaatgaagtgcacacttggaccgagcagtataaatttcaagcagactcaccaaaaagacttagtgctgctatcgggaaggcatgggaagagggtgtatgtggaatcaggtcggccacaagattggagaatatcatgtggaagcagatcagtaatgaactaaatcatatattattagaaaatgacatgaaactaactgttgtagtaggggacgtagcaggtatattagcccaaggaaagaaaatgattagaccacaacctatggagtacaaatacagctggaaaatatggggaaaagcgaaaatcattggtgcagatgtgcaaaacactacctttatcatcgacggaccaaacactccagaatgtccggacgaccaaagagcgtggaatatatgggaagtagaagactatggatttggaatttttacgacaaacatatggcttaaactacgcgactcatatactcaagtatgcgaccataggctcatgtcggcggcgattaaggatagcaaggcagttcacgcggatatggggtattggatcgaaagcgagaaaaatgagacgtggaaactggccagagccagtttcatagaggtaaagacatgtatctggccgaaatcacacactttatggtctaatggagtattagaaagcgaaatgataataccaaagatctacggtggacccatatctcaacacaattacagaccagggtactttacacagactgctggaccttggcatcttgggaaactggagttagattttgatctctgcgaaggcacgacagtagtggttgatgaacactgcggcaatagaggcccctcattacgcacaaccacagtgaccggaaaaatcatacacgaatggtgttgccgttcatgcaccctgccaccgcttaggtttaaaggtgaggatggatgttggtatgggatggaaattaggcctgtaaaagaaaaagaagagaatttggttaaaagtatggtttcagctggctcaggagaggtagattcgttctctttgggtttattgtgcatttcgataatgatcgaagaagtaatgcgtagcagatggtcgcgtaaaatgcttatgaccggtacactagcggtctttttcttactaatcatgggtcaactaacatggaatgacttaataagattgtgcataatggtaggagcaaatgcatacgatcgaatgggcatgggcacgacgtacttagcccttatggctacctttaaaatgaggccgatgttcgccgtaggtttactgtttagacggctcacgtcgagagaggttctactattaactataggactcagcttagtagcctctgtagaactacctaacagtttggaagaactgggagacggattggcgatgggtatcatgatactgaaactattaactgattttcaatctcaccaattatgggctacacttttatcactaaccttcatacgaactacattttctctacattatgcttggaaaacaatggctatggtgttatcgatagtcagcttattccctttatgtttaagtacaactagccagaaaactacgtggcttccagtcctactaggatcgctaggatgtaaaccattaacgatgttcttgatagcggaaaataaaatttgggggaggaaatcatggcctctgaatgagggtatcatggccgtaggtatagtatcgattctactatcatcactactcaaaaacgacgttccattggcaggtcctttaattgctggcggaatgctaattgcatgctacgtaatatcaggcagcagcgccgatttgtcattggaaaaagccgcggaggtttcatgggaagaggaggcagagcatagtggggcgagtcataatattttagtagaagttcaggacgacggaacaatgaaaatcaaggacgaagaacgggatgatacactgaccatactattaaaagcgacgctactagctgtaagcggtgtatacccattatcgattccggccaccctttttgtctggtatttttggcagaagaagaaacaacgatcgggagtgttatgggatactcctagtccaccggaagtcgaaagggcagtattagatgacggcatctaccgcataatgcagcgtggattgctggggagaagtcaagttggtgtaggtgtatttcaagaaaatgtatttcacacaatgtggcacgtgacaagaggcgctgtactaatgtaccagggtaaaaggttagagccaagctgggcctcagttaagaaagacctaatctcttatggtggaggatggaggctacagggttcatggaacacaggtgaagaagttcaagtgatagctgttgaacctgggaaaaatcccaaaaatgtgcaaactgctcctggcactttcaaaacatcagaaggagaggttggagctatagcactagactttaaacctggcactagcggaagtcccatagtcaacagagaaggaaaaatcgtgggcttatacggcaatggcgtggtgaccacctcaggaacatatgtaagcgcaatagcacaagcgaaagctagccaagagggaccgctccccgaaatcgaagacgaagttttccgaaaacgcaatttaactataatggatttacacccaggcagcgggaagacaagacgatatctacccgcaatagtcagggaggctatcaaacgcaggctaagaacactaatattagcaccaacaagagtagttgccagtgaaatggccgaagcattgaaaggaatgccaatacgctatcaaacgacggcagtgaaaagcgaacacaccggtaaagaaatagtagatctaatgtgccatgctacttttactatgagattactcagccccgtaagggtgcccaattacaacatgattatcatggatgaagcacactttacggatccatcctcaatcgcagctagaggctatatctcaactagagtagggatgggagaagccgcggcgatatttatgacggcaacaccccctggtagcgtcgaagcattcccgcagtcgaacgctgtaatacaagatgaagaaagggacatccctgagcgctcctggaatagtggttatgaatggataaccgattttccaggaaaaactgtatggtttgttccttcaataaaaagtggaaacgacattgcaaattgtttaaggaaaaatggtaaaagagttatacagttaagtagaaagacatttgacacagaatatcagaaaacgaaaaacaatgactgggactatgtagtaactacagatatttcagaaatgggcgctaactttagagccgacagagtaattgacccacgcagatgtctaaaacctgtcatcctaaaagatggcccagaaagagtaattttagcgggtccaatgcctgtaacagttgcatcagcagcacaacgccgagggcgtataggcagaaaccataacaaggaaggcgaccaatatatatatatgggacaaccactaaataatgacgaagaccacgcacattggacagaggccaaaatgctgttagataatattaacacaccagaaggaattattccggcactgttcgaaccagaacgtgaaaaatcagcagcgatagacggagaatataggctaagaggggaggctcgaaaaacctttgtagaactaatgagaagaggagacttgcctgtctggctatctcacaaggttgccagcgaaggattccagtacagtgaccgaagatggtgtttcgatggagagagaaacaaccaagtacttgaagaaaacatggatgtagaaatatggactaaagagggagaacggaagaaattacgtccacgatggctagacgcgcgaacttacagtgatccattggcacttcgagaatttaaagaatttgcagcaggacgaagaagcgtgtcgggcgacttaatcttagaaataggaaagctaccacaacatttaacacagagggcacaaaatgcgttagacaatcttgtgatgttgcataactcagaacaagggggtcgtgcatatcgacatgcaatggaagaattgcctgatacaatagaaacacttatgttgttagccttaatcgcagtactgaccggcggggtaatgttgttctttttaagtggtagaggattagggaaaacatctataggactattatgtgttatggcttcgtcagtattattatggatggcgagtgtcgagccacactggatagctgcttctataattttggagttctttctaatggtgctgctaattccagaacctgacagacaaagaacaccacaggacaaccaattagcctatgtagtgattggactattattcatgatattgacggtagctgcaaacgaaatgggattactagaaactaccaagaaagaccttggaataggacacgtggcagttgagaatcatcatcacgcagcgatgctcgatgtagacttacatccagcttcagcatggactttatatgccgtagccacgacgattatcacaccaatgatgagacatacgatagaaaacacaactgcaaatataagccttacagcaatagctaatcaagcggcaatattaatggggctcgataaaggatggcccatctcaaagatggacataggagtcccattactggctctagggtgttactcacaagttaacccgcttacactaacagccgcagttttaatgttagtcgcacattatgcaataatagggcccggcttacaagctaaagcgacaagagaagctcaaaagagaaccgcggctggaattatgaagaacccaaccgtagatgggatcgtcgcaattgacctggaccccgtggtatacgatgctaaatttgagaaacaactgggacaaattatgctccttatcctatgcacaagtcaaatattattaatgcgcactacatgggccttatgtgaatccattacccttgccactggaccactcacaacactatgggagggttctccgggaaagttctggaacaccacaattgctgtgtctatggcaaatatcttccgtggatcttatttagctggagcgggattagcattctctttaatgaagtcactaggcggaggacggagaggtactggtgcccagggtgaaacactaggagaaaaatggaaacgacaattaaatcagttatcaaaaagtgagttcaacacgtataaaagaagtggaatcatggaagtagaccgaagcgaggcaaaggaaggcttgaaacgtggagagactaccaagcatgccgtgtcccgcgggacggctaagctacggtggtttgtggaaagaaatttggtgaaacccgaaggcaaggtaatagatttaggttgcggaagaggaggttggagctactattgtgcaggactaaagaaagtgacagaagtcaaaggttacaccaagggtggtccaggacacgaagaaccaatacctatggcaacttatgggtggaatttggtcaaacttcactcgggaaaagatgtattctttatacctcctgaaaaatgtgatacactactatgtgatataggtgagtcatcaccaaatccaacgatcgaagagggaagaactcttcgggtcctcaaaatggtcgagccatggttaagagggaaccaattttgtataaaaattttaaatccgtatatgcccagtgtagtcgaaacattagagcagatgcaacgtaaacatggtggaatgctcgttagaaaccctttaagcagaaactcaacccacgaaatgtattgggtatcttgtggaacagggaatattgtttcagccgttaacatgacgtcaagaatgttgttgaatcgatttactatggcacatagaaaacccacgtatgaacgtgatgtggatctgggtgcgggcacacgtcatgttgctgtagaaccagaggtagcaaatctcgacatcatagggcaacgtatagaaaatatcaaacacgagcataagagcacatggcattatgacgaggacaatccttacaagacctgggcttaccatggatcatatgaagtaaaaccaagcggcagcgcctctagtatggtaaatggagtagttaagttactaacaaaaccatgggatgttatcccaatggtcactcaaatagcaatgacggatacaacaccatttgggcagcaaagagtatttaaggaaaaggtagatacaaggacaccgaaagcaaaaaggggcacggctcaaattatggaggtcactgcgaaatggctatgggggtttctatcaagaaataagaaaccacgcatatgcacacgagaagagttcacgcgaaaagtaaggtccaatgcagcaattggagcggtctttgtcgatgaaaatcagtggaactcagcgaaagaagcagtcgaagatgaaagattttgggatctcgtgcatcgagaacgagagttgcataaacagggaaagtgcgcaacctgtgtttataacatgatgggcaagagagagaagaaactgggggagtttggcaaagcaaaagggtctagggcgatatggtatatgtggttgggagccagattcctagagtttgaagcgttaggctttatgaatgaggatcattggttcagcagagagaactccctatccggagtagaaggcgagggattgcataaactaggatatatactacgagacatatccaaaattcccggtgggaatatgtacgcagacgatactgctgggtgggatacgcgtataaccgaagatgatctgcaaaatgaagcaaaaattaccgatataatggaacccgaacatgcactattggcaaaatcgatctttaaactgacatatcaaaataaagtggtcagggttcaacgaccagctaaaaatggaaccgtgatggatgtaatctcaagaagggaccagcgtggtagtggtcaagttggaacgtacggattaaatacattcacaaacatggaagctcaactaatcagacagatggaatcagaagggatattttcgccatcagaattagaaacaccgaacctcgctggcagagtattagactggctagagaaacacggcgttgagagactgaaaaggatggcaatatccggcgatgattgcgtggtgaaacctatagatgaccgatttgctacagcactaacagcgctaaacgatatgggtaaagtaagaaaggatatcccccaatgggaaccaagcaaaggatggaatgattggcaacaggtgccgttttgtagccaccatttccatcagttaatcatgaaagatggcagagagatagttgtaccgtgtagaaaccaagacgaattggtaggtagagctagagttagccaaggtgcgggttggagtctcagggaaactgcttgtttaggaaagagctatgcgcaaatgtggcaattaatgtactttcaccgaagggacttgcgactcgccgcaaatgctatatgcagtgcggttccggtggattgggtacctacgagcaggacaacttggagtatacatgcccatcatcaatggatgacgaccgaagacatgctttctgtatggaatagagtatggatagaagaaaacccatggatggaagataaaacacatgtcagttcatggggtgatgtaccctaccttggtaagcgggaagatcagtggtgtgggtcacttatagggttaacagcgagagctacatgggcgactaatattcaggttgctataaaccaggttcggcgtttactaggaaatgaaaattatttagattacatgacgtcaatgaaaagattcaagaacgagtcggatcccgagggggcgctatggtag

SEQ ID NO: 21456 - RNA, 9879 nt, synthetic construct
  misc_feature 1..9879: note = derived and/or modified CDS sequence (opt6) from DENV-1__EU660403__SS-prME
  source 1..9879: mol_type = other RNA
agtgtgaccatgcttctaatgcttatgccgactgcacttgcatttcatctaactacacgaggtggggaaccacacatgatcgtatcaaaacaagagagagggaaatctctattatttaaaacaagtgcgggcgttaatatgtgtacgttgatcgcaatggacctaggggaactatgtgaagatactatgacctataaatgcccaagaatcacagaaacggaacccgatgacgtagattgctggtgtaatgctaccgacacatgggttacctatggaacctgctctcaaaccggggaacataggcgtgacaaaaggtctgttgccctcgcccctcatgttggtttggggctagaaacccgaaccgagacgtggatgtcttccgagggcgcatggaaacaaatacaacgtgtggaaacatgggccctacgacacccaggtttcacggtaatcgcattgtttcttgcgcacgcgataggaacatctattacacaaaaaggaattatatttattcttctcatgttagtcacgcctagtatggctatgagatgtgtcgggattgggtctagggattttgttgaagggttaagtggagcgacttgggttgacgtggtcttggagcatgggtcatgtgtaacaactatggctaaagataaaccaacactggacattgaacttcttaaaacagaggtaactaaccctgcagtacttcgaaaactatgcatagaggctaaaatttccaacacgactacggattcacgatgtccgacacaaggtgaagcgacccttgtagaagaacaagatgctaacttcgtatgccgcagaacatttgtcgacaggggatggggtaacggatgtgggctctttgggaaaggatcactaataacctgcgctaaattcaaatgtgtcacaaaactagaagggaaaatagtacaatacgagaacctaaaatactcggtaatagtgacggtacatacaggtgaccaacatcaagtgggaaatgaaagtacggaacatggaacgacagctacaattactccacaagcaccaacaacagagatacaattaacggattatggtgcgttaacgctcgactgtagtcccagaaccggtctagactttaatgagatggttctactaactatgaaagagaaaagttggttagtccacaaacagtggttcttagatctgccgctaccttggacctctggggcatcaacaagtcaggaaacttggaatcgacaagatctcctagtaacatttaaaactgcacatgcaaagaaacaagaagtcgtggtattaggctctcaggaaggggccatgcacactgctctgactggagcaaccgaaatacaaacgtcaggtacaactactatttttgctggacaccttaagtgtcgtttaaaaatggacaaacttacactcaaggggatgagttacgtaatgtgcaccggcagttttaagctagaaaaagaagtagcagaaacccagcatggaactgtactggtacaaattaaatatgaagggacggatgcaccctgcaaaatccccttcctaacgcaagatgagaagggagtaacgcagaatggtaggttgataacagctaatccgatagtcactgataaagaaaaacctgttaatatagaagcagaaccaccatttggagaatcatatattattatcggggctggcgaaaaggcattaaaattatcttggtttaagaaaggaagctcaattggcaaaatgttcgaagctactgctagaggtgctaggcgaatggcaatattgggagacacagcttgggacttcggatctataggaggagtttttacaagtgttggaaagttggtacatcaaatatttggtacggcatacggtgtactattcagtggggtgagttggactatgaaaatagggattggagtactgcttacttggctgggattaaattctaggtcaacctccctttcaatgacatgcatagcagtaggcttagttacattatacttaggagttatggttcaagccgatagcgggtgtgtcataaattggaaaggtagggaattgaagtgcggaagtggtatcttcgtcaccaacgaggtacacacatggacagaacaatacaaatttcaagccgacagcccaaaacgtctatcggcggcaattggaaaggcttgggaagaaggggtatgcgggatacgatctgctacacgattagaaaatatcatgtggaaacagatcagtaatgaactgaatcatattttactagagaatgatatgaagtttacagttgtggtgggtgatgttgcaggtatactagcacaaggtaaaaagatgatcagaccccaaccgatggaatataaatactcgtggaaaagttggggtaaagcgaaaataataggggctgatgttcaaaatacaacgttcatcatagatggtccgaataccccagaatgcccagatgatcaacgtgcatggaatatttgggaagtcgaagattacggttttggtattttcacgactaatatctggcttaaacttagggattcgtacacacaagtatgcgatcacagattaatgtccgccgcaataaaggattccaaagctgtacacgcagacatggggtactggatcgagagcgaaaagaatgaaacatggaagttagcaagggcatcctttatagaggtaaagacctgtatatggccgaaatcgcacactttatggagtaacggggttttggaatcagaaatgataatcccaaagatatatggcgggcctatatcacaacataattaccgtccaggctacttcacccagacagccggcccatggcacttaggtaaacttgagctggacttcgacctatgtgaaggcacgaccgtggtagtagatgaacattgtggcaatcgaggaccgagtttaaggactacaactgttacaggtaaaattatacatgaatggtgttgtagatcctgcaccttaccaccattaagatttagaggggaagatggatgctggtatggaatggaaatccgtccagtaaaggaaaaagaagaaaacttagtcaagagtatggtttccgcaggtagcggtgaagtagatagtttttcattggggttactatgtatatctataatcatagaagaagttatgagatcccgatggtctcgtaagatgttaatgacagggacattagcagtattctttttattaatcatgggccaacttacttggaatgacctaatcagattatgcataatggtaggggcaaatgctagtgacagaatgggaatgggcacgacatatctagctctaatggccacctttaaaatgagacccatgttcgccgtaggtctcctatttagaagactgacgagtagggaagtcctattactcaccattggactatcactcgttgcgtcggttgaactacccaatagtttggaagaattgggcgatgggttagcgatgggaataatgatattaaaactcttaaccgatttccaaagtcatcaattatgggctacacttttatcgctgacttttattaagaccacgttctcactacattatgcctggaaaactatggccatggtattatccattgtatcgttatttcccttatgtttgagcacaacttcccaaaagacaacctggctcccagtattactaggctcactaggttgtaaaccacttactatgttcttaatcgcggagaataaaatatgggggagacgatcatggcccttaaatgaagggatcatggctgtcggtatagtaagcattttactatccagtcttttaaagaatgacgtccctctggcaggaccgctaatagcagggggtatgttaattgcatgctacgtaataagcgggtcctcggcggacttatcgttagagaaagctgctgaagtctcatgggaagaagaggcggaacatagcggagcatcacacaacatattagtagaggtccaagatgatggaacaatgaaaataaaagacgaagaaagagacgacaccttaacaatattattgaaagccacattattagccgtatccggtgtatatcctttaagtattcccgcaacattatttgtgtggtacttctggcagaagaagaaacaaaggagtggcgtcctttgggacacacccagtcctccagaggtggagcgggcagtcctagacgatggtatttataggattatgcaacgaggtctacttggaaggtcacaagttggagttggtgtgtttcaggagaatgtattccatacaatgtggcatgtgacgaggggagcagtgttgatgtaccagggtaaaagattagagccaagttgggctagcgttaagaaagatctcatctcttacgggggaggatggcgactccaaggttcatggaatactggtgaagaggtacaagtcatagcagtagaaccaggcaaaaatcctaaaaatgtgcaaacagccccgggaacattcaagacaccggagggagaggtgggagcaatcgcattggacttcaaacctggaacttctggcagccctatagtaaatagagaaggcaaaattgttggactatatggcaacggagttgtcacaacctcaggaacttacgtatcagcaatagcacaagcaaaagcctcccaagaaggcccactcccagaaatagaggatgaagtgtttcggaaaagaaatttaacaatcatggacctacatccaggaagcggaaaaacaagacgatatttaccggcaatagttcgggaagctattaaacgaaagctcaggacattaatattagccccaacgagagtggtagcatcagaaatggccgaggcgttaaaaggcatgccgatccgatatcagacaacggcggttaaatcggagcatacaggtaaagaaattgtagatttaatgtgtcatgccacgtttacgatgagattgttaagtcctgtcagggttccaaattacaatatgataatcatggatgaagctcattttacagatcccagttccattgcagcaaggggatacatatccaccagagtaggtatgggagaggccgcggcaatattcatgaccgcaacgccacccggaagcgtagaggcatttccgcaatccaacgcagtcattcaagatgaagaaagggatattccagaacggagctggaactctggttatgaatggattacagacttccccggtaaaactgtttggttcgtgccgagtatcaaaagcggcaatgatattgctaattgcttaaggaaaaatggaaaaagagtaattcaactatctagaaaaacattcgacaccgagtatcagaaaactaaaaataacgattgggactatgtcgtaactacggacatatccgagatgggcgcgaatttcagagccgatagagttattgatccacggagatgtttaaagccagttatacttaaagatggacctgagagagtgatcctcgcaggtcctatgccagtaactgtagcctctgcggcgcaaagacgaggaaggatcggcagaaatcataataaagagggtgaccaatatatttatatgggtcaaccgctcaataatgacgaagaccacgcacattggacagaagcaaaaatgctattagacaacattaacacaccagaaggaattataccagcactctttgagccggaaagagaaaaatctgccgcaatagacggggaatacagactacgcggtgaagcaagaaagacgttcgtagaattgatgagaaggggtgatttgccagtatggttatcatataaggttgcgagtgaaggatttcaatattcagacagaagatggtgtttcgatggagagcggaataatcaagtactggaagaaaacatggacgtcgagatatggacaaaggagggtgagaggaagaaactgagaccacggtggttggacgcccgaacatattcagatcccttagcacttcgtgaatttaaagagttcgctgctggaaggagaagcgtctcaggagatttaatcttagaaataggaaaactcccacaacacttaacacaaagagcgcaaaatgctttagataacctcgtcatgctgcataactctgaacaaggagggcgtgcgtacagacatgcaatggaggagcttcctgacacaatagaaaccttgatgttactggctttaattgcagtattaacaggtggagttacacttttcttcttatcagggagaggtcttggaaagacaagcatcggattattatgtgttatggcatcatcggtactattgtggatggcttcagtagaaccccactggatagccgcaagtataatattggagttctttctgatggtcctactaataccggaaccagacagacagcgaaccccacaagataaccaattggcttatgtcgtaattggacttctttttatgatattaacagtggccgcgaatgagatgggactactagagaccacgaagaaagatctaggcattggtcacgtagccgtagagaaccatcatcacgctgctatgttagacgttgatttacatcctgcctccgcctggacactatatgctgttgcgaccactattataacaccaatgatgagacatacaatagaaaacacaacggcaaacatatcactgaccgccatagcaaatcaagcagcaatcctaatgggcttggacaaaggctggcctatatcaaaaatggatataggtgttccgttgcttgctttaggctgctatagccaagtcaatcctctaacactaaccgcggcagttttaatgttagtagctcattatgcgattatcggaccaggtctacaagctaaagccacaagagaagctcagaaacggacagcagcgggaataatgaaaaatcctaccgtggacggaatagttgccattgacttggatcctgttgtgtatgatgccaagtttgaaaagcaattaggtcaaatcatgttactaatcttatgtacatcacagatacttttaatgaggacaacatgggctctgtgcgaaagtataaccttagcaacaggaccattaaccactttatgggaaggaagtcccggtaaattttggaacacgacaatcgcggtatcaatggctaacatttttcgcggatcgtatctagcgggcgcaggactagcattttcactaatgaaaagtcttggaggtggcagacgtggaacaggagcacaaggcgaaaccctaggagaaaaatggaaacgccaactaaaccaattgtcaaagtcagaatttaacacatataaacgatcaggtattatggaggttgacagaagtgaggctaaagaaggcctaaaaagaggtgaaactacgaagcatgccgtatcaaggggtactgcaaaattaagatggtttgtggagcgcaatcttgtaaaaccagaagggaaagtaattgatttaggttgcggacgaggaggatggagttactattgtgctggacttaagaaagtgacagaagtaaaaggatacactaaaggcggtccaggtcatgaggaacctattcccatggcaacttatggatggaatttggtcaaacttcactccggcaaagatgtattctttatacctcccgagaagtgtgatacattgttatgtgatataggcgagtcatcccctaatcccactatagaagaaggtaggaccttgcgggtcttaaaaatggtcgaaccttggttaagaggtaaccaattctgtatcaaaatattaaatccatatatgccatctgtagtagagactttagaacaaatgcaacgaaagcatggtggcatgttagttaggaatcctctaagcaggaacagtacccatgaaatgtactgggtatcatgcggtactgggaacattgtatccgccgtcaatatgacatcaagaatgttactaaatcgttttacaatggcacataggaagccaacttatgagagagatgtagacttaggcgctggaacacggcatgtagcggttgaacccgaagtagcaaatttagatattatagggcaaagaattgaaaatattaaacacgagcacaaaagtacatggcattatgatgaagataatccttacaaaacatgggcataccatggatcttatgaagtaaaaccatcgggatcagcttcatcaatggttaatggtgtagttaagttgttaactaaaccgtgggacgtaatccctatggttacccaaatagccatgactgatactaccccgtttggccaacaacgtgtatttaaagaaaaggtagacacacggacaccaaaggcgaaacgaggaacagctcaaataatggaagttaccgctaaatggctctgggggttcctttcgcgtaataagaaaccaagaatttgtactagagaagaatttacaaggaaagtacgatcaaatgccgctatcggagcagtgttcgtagacgaaaaccaatggaactcagctaaggaggcagtagaagatgagcggttttgggacttagtacacagggagagagagctccacaaacaaggcaaatgtgccacatgtgtatacaacatgatgggcaaacgagagaagaaactcggtgaatttgggaaagctaaggggtcccgagcgatatggtatatgtggcttggagcccggttccttgagttcgaagcattaggttttatgaacgaagatcattggtttagcagagaaaattccttaagtggagtggaaggtgaaggcttacataaattaggatacatattaagagacatttctaaaattccaggaggtaatatgtatgcagacgatacggcaggatgggacacacgtattactgaagatgacctgcaaaatgaagcccgcatcacagacataatggaacctgagcatgcgttactggcaaaaagtattttcaaactaacataccagaataaagtagttcgagtacaacgaccggccaaaaatggtactgttatggatgtgatctctcgtcgcgatcagagaggcagcggtcaggtcgggacgtacgggctaaatacatttaccaacatggaggcccagttgatacgacaaatggagagtgaagggatattttcaccttccgaactggaaacaccgaatttagccgaacgcgtccttgattggcttgaaaaatatggcgttgagcgactgaagcgcatggcaatttccggcgacgattgtgtagtaaaaccaattgatgatcgatttgctacggcactcaccgccctaaatgatatgggaaaggtaagaaaagatataccgcaatgggaaccatcaaaaggatggaatgactggcagcaagtgccattctgtagtcaccattttcatcaactgataatgaaggacggtcgcgaaattgtagtaccatgtcgaaaccaagatgagctagtaggtcgtgcaagagtgagccagggagcgggctggagcctcagagaaactgcatgcctgggaaaatcatacgcacaaatgtggcaattaatgtactttcaccggcgagatttacgacttgctgcaaacgccatttgtagcgctgtccctgttgactggatcccaacgagcagaactacatggtcaatacacgcccatcaccaatggatgacgacagaagacatgttatctgtatggaaccgtgtatggatagaagagaatccttggatggaagataagacacacatctcgtcatggggagatgtgccctacctaggtaaaagggaggatcagtggtgcggatccctcataggtttaacagcacgggcaacttgggcaacaaacatacaagtagcaataaaccaagttaggagactaattggcaacgaaaactatctggactatatgacttcaatgaaacgattcaagaatgaaggtgacccagaaggggccctttggtag

SEQ ID NO: 21457 - RNA, 9879 nt, synthetic construct
  misc_feature 1..9879: note = derived and/or modified CDS sequence (opt6) from DENV-1__EU660397__SS-prME
  source 1..9879: mol_type = other RNA
tccgtaacaatgctattaatgctaatgccaacagcactagctttccacctaactactaggggtggggaacctcacatgatagtctcaaaacaagaacggggaaaaagccttttatttaaaacatctgcaggagtaaatatgtgtactttaatcgcaatggacctcggcgagctatgcgaagacacaatgacgtataaatgtccacgaatcacggaaacagaaccggacgacgtagactgctggtgtaacgccactgacacatgggtaacgtatggtacttgctcgcaaacaggcgaacaccggagagacaaacgatccgttgctctagctccacacgtgggactagggttagagacacgaacagaaacttggatgtcatctgaaggagcatggaaacaaatccaaagagttgaaacatgggccttgcgccatccaggttttaccgtaattgcattgtttttggcacacgcaatagggacaagtatcacacaaaaaggtataattttcatattattaatgttagtaactccttcaatggctatgaggtgtgtaggtataggttcacgcgattttgtagaagggctatcgggtgctacatgggtagatgtagtcttagaacatggatcctgcgtcacaactatggcgaaagacaaaccaacgctcgatattgaactgctgaaaacggaggtaaccaaccccgcagttctaagaaaactctgcatagaggctaaaataagcaacactactactgattcacggtgtcctacacaaggcgaggcgaccttagtagaagaacaagatgctaatttcgtatgtcgtagaactttcgttgaccgaggttggggcaatggctgcggccttttcggaaaaggaagtttaatcacatgcgcaaaatttaaatgtgttacaaaactcgaaggaaagatagtacaatatgaaaatttgaaatactcggtcatcgtaactgtacacactggagatcaacatcaagtcggtaacgaatcaaccgaacacggcactactgcaacgataacaccacaagcccctacaacagagatacaactcacggactacggagcattgacgcttgattgtagtcctagaactggtcttgattttaacgaaatggtattactaacaatgaaggagaagtcatggttagttcataagcaatggtttttagatctaccgttaccgtggaccagcggagcatcaacatcccaagaaacttggaaccgccaggatttacttgtaacatttaaaacagcacatgcgaagaaacaggaggttgtcgtactcggttcacaagaaggggccatgcacactgctttaactggagcgacagaaatccaaacaagtgggacgactactatatttgccgggcatcttaaatgtcgtctgaaaatggacaagttaacactccgaggaatgtcatatgtaatgtgtacagggtcatttaagttagagaaggaagtcgcagaaactcaacatggcacagtcctcgtacaaataaaatacgaaggaacggacgcgccatgcaaaattcctttttctactcaagatgaaaaaggggtgactcaaaatggtcgtctaatcacagctaaccctatagtgacagataaggaaaaaccagtaaatattgaagcagaacctccttttggagagagttacatagttattggggcaggggaaaaagccttgaaactctcctggtttaagaaaggttcttcgattggaaaaatgtttgaagcaaccgctagaggagcaagaagaatggcaatcttaggagacacggcatgggacttcgggtcaataggtggcgtgttcactagcgtaggtaaacttgtacaccaaatatttggaaccgcgtatggcgtactgtttagtggagtatcttggaccatgaaaattggaattggagtattacttacatggttaggactaaattcaaggtccacatcactatcaatgacgtgtatagcggtaggtctcgtcactctttatttgggagttatggtccaagcagattctggttgtgtcataaactggaaaggaagggaattaaaatgtggctctggtatttttgtaacaaatgaagtacatacatggactgagcaatataaatttcaagcggattcacctaaaagactaagtgccgcaattgggaaagcatgggaagaaggcgtatgcgggatacgttcagccacgaggctagagaatataatgtggaaacagataagtaacgaacttaaccacatacttcttgaaaatgacatgaaatttaccgtagttgtgggagacgttgcaggtattctcgcacaaggtaagaaaatgataagaccccaacctatggaatataaatattcatggaaatcatggggaaaagctaaaattattggagccgacgtccaaaacacaacattcataatagacggaccaaatacaccagaatgtcctgatgatcagagagcttggaatatttgggaggtagaagattacggctttgggatattcaccacaaatatatggctaaaacttagggatagttatacacaagtctgtgatcataggcttatgtccgcagcgattaaagattcaaaagccgttcatgccgatatgggttattggatagaatcagaaaagaacgaaacgtggaaattggcaagagcttcattcattgaagtaaaaacatgcatatggcctaaaagtcacactctatggagcaacggagtacttgaatctgaaatgattattccgaaaatatatggcggacctatctcccaacacaattacagaccgggttacttcacacaaacagcgggtccttggcatttagggaaactagaactggatttcgacttatgcgaaggaactactgtagtagttgacgagcattgtggaaataggggccccagccttagaactacgaccgtcactggcaagattatacacgaatggtgctgtcgttcgtgcactttaccccctctaaggttccgaggagaggacggatgttggtatgggatggagattaggccagtaaaggagaaagaagaaaatctggtaaaatcaatggtttccgccggctcaggagaagtagatagtttttcacttgggttattatgtataagtataatgatcgaagaggtgatgagatcacgctggtcaaggaaaatgctaatgacagggacgttagctgttttcttcctactaattatgggccaactaacgtggaatgatcttatacgattatgtataatggtaggagccaatgccagcgaccgaatgggtatgggaactacatacttagcactaatggcgactttcaaaatgcgaccgatgttcgctgtcggactgttattcaggagattaactagccgagaagtattgctactaacgatcgggttgagcttggttgccagtgtcgaattacctaattctttagaagaactaggagatggcctagcaatgggtatcatgatattaaaattattgacagactttcagagtcaccaattgtgggctacactgctgtcattaacattcattaaaacgactttcagtctacactatgcatggaaaacgatggctatggtcctttcaattgtatcattatttcctctttgtctttccacaacgtctcagaaaactacatggttgccagtattactaggaagccttggttgtaaaccactaacaatgttcttgatagctgaaaacaaaatatggggaagaagaagttggcccttaaacgaaggaataatggcagtgggaatagttagcatactgttgagctcattacttaaaaacgatgttcctctagctggacccctaattgccggtggaatgctaatagcgtgttatgtaatatcggggtctagcgccgacctatcgctagaaaaagcagctgaagtaagttgggaagaagaagctgaacatagcggggcttcacataatatattggtggaagtacaagatgacggaaccatgaaaataaaagacgaagaacgtgatgatactcttacgatattgcttaaggcaactctacttgccgtctctggggtatacccactctcaataccagctactttatttgtgtggtatttctggcagaagaagaaacaacgtagtggagtattatgggatacccccagcccaccagaagtcgaaagagctgttctcgacgacgggatatatagaataatgcaaagaggccttttggggagatcgcaagtaggagttggtgttttccaagagaacgtgtttcacacaatgtggcatgtaactagaggagctgtattaatgtaccagggaaaaaggttagagccttcatgggcctctgttaagaaagatttgatatcttatggaggcggttggcgacttcaagggagttggaatactggggaggaagtgcaagttattgcagtagagcccggaaagaatcccaaaaatgtacaaacagcgccaggaacatttaaaaccccagaaggagaagtaggagccatcgcattagatttcaagcctggtacaagcgggagccctatagtaaacagagaaggaaaaatagttggattatacgggaatggagtagtaacaacatcaggaacctatgtttctgctatagcccaagcaaaggcatcacaagagggaccattaccagaaattgaggacgaagtgtttagaaagagaaacctaaccattatggatttacatcccggatcgggcaaaacccgaagatacctaccagcgatagtaagagaagcgatcaaaaggaaactacgaaccctaattttagcgcccacacgtgtagtggcttctgaaatggccgaagctctaaaaggcatgccgataagataccaaactaccgctgttaaaagcgaacacaccggtaaggagattgtagatttaatgtgtcatgcaaccttcacaatgaggttattgagtcctgtaagagttcccaattataacatgatcataatggacgaagcgcattttaccgatccgagttcaattgcggctcgtggttacataagtacgcgagtcggaatgggtgaagcagccgcgatattcatgacagccaccccaccgggttccgtagaagcatttccacaatctaacgcggtgattcaggatgaagaaagagatataccagaaaggagctggaatagtggatatgaatggataactgactttccaggaaaaacagtttggttcgtcccttccataaaatctggaaatgatattgcaaactgcttacgaaagaatgggaagcgagtcatccagttgtcccgcaagacgtttgatacagaataccagaaaacgaaaaataatgactgggattatgttgttaccacagatatatccgaaatgggcgctaattttagagctgacagggtaatcgacccccgaaggtgtttgaaacccgttatattaaaagatggccctgaacgtgtcatcttagctggacccatgccagtcactgttgcatcagctgctcaacgtcgcggacgcattggccgaaatcacaacaaggaaggagaccaatatatctatatgggacagcctttaaataacgatgaagatcatgcacattggaccgaagcgaaaatgctactggacaacataaataccccagagggtatcattccagcgcttttcgagccggaaagggaaaaatcggcagcaatagatggagaatatagactaaggggcgaagcaagaaagaccttcgtcgagctaatgcgaagaggagatcttcccgtatggcttagttataaagtagcctctgagggctttcagtattctgatcgaagatggtgcttcgacggcgaaagaaacaatcaagtgcttgaggaaaacatggatgttgaaatatggacgaaggagggcgaaagaaagaaactacgacctcggtggctcgatgcaagaacctacagtgacccgctagccttacgcgaatttaaagaatttgcagctgggagacgatctgtttcgggagatttgatactagaaataggtaaacttcctcaacacttaacacaaagagcgcaaaacgcactagataatctagttatgctccataactcagaacaaggtggcagagcttacagacacgctatggaagaactaccggatactatagaaacgttaatgttattggctctaatagcagtcctgactggaggtgtgacactattctttctcagcggtcgcgggctcgggaagacctcaataggcttgctatgcgtaatggcctcatccgtactactatggatggcaagtgtagaaccacattggatcgcagcttcaataattctagagttctttctcatggtgctcttaatacctgaaccagatcgacaacgcactccacaggataatcaattagcttatgttgtcataggactgctatttatgatattaacagttgcggctaatgagatggggttgctggaaacaaccaagaaagatcttgggataggtcacgtagcggtagaaaatcatcatcatgccgcaatgctagatgtagaccttcatcctgcgagcgcgtggacgttatatgcagtggcaaccaccattataacacctatgatgagacatacaatagagaacaccacagcgaacattagtttaacagcgattgcaaatcaagcagcaatcttaatgggcctagataaagggtggccgatatcaaaaatggacattggagtacccttgttagcgctgggttgttattcacaagtaaatccactgactctaacggcagccgttctaatgctagtggctcactacgcaatcattggaccgggattacaggcaaaagcaacacgagaagcgcaaaaacgaacagctgcaggaataatgaaaaatccgactgtagatggaatagtagctattgacctcgatccagtcgtttatgatgccaaatttgaaaaacaattagggcaaattatgctcttaatattatgtacgtctcaaattttgttgatgcgaacaacatgggctttatgcgagtcaatcacactcgctacagggcccctgaccacgttatgggaaggaagcccgggtaaattctggaacacgactattgctgtatccatggcaaacatctttcgaggctcgtatttggcaggagcaggtttagccttttctttaatgaaatcccttgggggaggacgacgtggcaccggtgctcagggagagaccctgggagaaaaatggaagagacagcttaatcaattaagtaagtccgagttcaacacgtataagcgttcgggcattatggaggtggaccgatctgaggcaaaagaaggcttaaaacgaggagaaactacgaaacacgccgtgagtcgaggaacagccaaattacgttggtttgttgaacgcaatctagtaaaacccgaaggtaaagtcatcgacttaggatgcgggcgtggtggttggagttattattgtgctgggctcaagaaagtcacagaagtgaaaggatatacaaaaggaggtccaggacacgaagaacctatccctatggctacatatggatggaacttagttaaactacattctggtaaagatgtattctttattccccctgaaaaatgtgatacactcctctgtgacataggtgagtcgagcccaaatccaacgattgaagagggaagaacactaagagtacttaagatggtagagccttggcttcgaggcaatcaattttgtatcaaaattctaaacccatacatgccctcagtggtagaaactctagaacaaatgcagaggaagcacggaggcatgttagtgaggaacccgttatctagaaactccacgcacgagatgtattgggtaagttgcggaacgggtaatatcgtcagtgcggtaaacatgacaagtcgaatgcttttaaatcgatttactatggcccacagaaaaccaacatatgaaagagatgtcgatttaggcgctggtacccggcacgtcgcagtggagcctgaagtagcaaatctcgacataattggacaacgaatagaaaacataaaacacgaacacaaatcgacttggcattatgatgaagataacccgtataaaacatgggcatatcatggtagttatgaagtcaaaccctccggttctgcatcatctatggtaaatggggttgtaaagctactaactaaaccatgggacgttatccccatggttacacaaatagcgatgactgatacaaccccttttggacaacagcgagtttttaaagaaaaagtagacacaagaacccctaaagcaaaaagaggaacggctcaaataatggaggtaacagcaaagtggttatggggatttttatctagaaataagaaaccacgaatatgtacacgtgaggaatttacacgtaaggtaaggtcgaatgccgcaatcggagcggtttttgttgacgaaaaccaatggaactcagcaaaagaggccgtcgaggatgaacgattttgggacttagttcatagagaacgggagttacataaacaaggaaagtgcgcaacatgtgtctataatatgatgggtaagcgggagaagaaacttggagagttcggaaaagcaaaaggatcaagagctatatggtacatgtggttaggtgccagatttcttgagtttgaggctctaggatttatgaatgaagatcactggttctcccgcgaaaattcactaagcggggtggaaggagaagggctccacaaactaggctacattttaagggacatttcgaagattcccggaggaaacatgtatgccgatgacacagccggttgggatactagaataacagaagatgatctccaaaatgaagctaggataactgacataatggaaccggaacatgcactattagccaaaagtatttttaaactaacatatcaaaataaagtggtacgcgttcaaagacccgccaaaaatggaacagtcatggacgtaatttcaagaagagatcaacgaggtagcggacaagttggtacgtatggtttaaataccttcacaaacatggaagcacaattaatcagacaaatggaaagtgagggtatcttttcaccatcagaattagaaacacctaacctagcagaacgtgtattggactggttggaaaaatacggagttgaaagactaaaacgaatggccattagcggcgacgattgcgtggttaaaccaattgatgaccgtttcgccactgcattaactgctttgaatgatatgggaaaagtgagaaaagacataccacagtgggagccgtcaaagggctggaatgattggcaacaagtaccattttgcagtcaccattttcaccaattaattatgaaggacggaagggaaatcgtagtcccatgcagaaaccaggacgagctagttggtcgagctagagtatcacagggtgccggatggtcattgcgagagactgcatgtttaggaaaaagctatgcccaaatgtggcaactaatgtacttccatcgaagggatttacgacttgcagcaaatgcaatatgtagtgctgttcctgttgattggatacctacaagccgcacaacctggagtatccatgcacatcatcagtggatgacaaccgaagacatgttatcagtgtggaatagagtctggattgaggaaaacccatggatggaggacaaaacccatataagctcttggggagacgtcccttacctaggaaaaagggaagatcaatggtgcgggtctttaattggacttacagcccgagcgacttgggcaacgaatatacaggtagctattaatcaggtgaggaggttaataggtaatgaaaactaccttgactatatgacttcaatgaaacgttttaaaaatgaatcagatccagaaggtgccttgtggtaa

SEQ ID NO: 21458 - RNA, 9879 nt, synthetic construct
  misc_feature 1..9879: note = derived and/or modified CDS sequence (opt6) from DENV-1__EU687247__SS-prME
  source 1..9879: mol_type = other RNA
agtgtaacaatgttactaatgttaatgccgacagcccttgcattccatttgaccacaaggggtggagaaccccacatgatcgtatccaaacaagaacggggaaaaagtctattgttcaaaacatctgctggagtaaatatgtgcacattgatagcaatggacttaggggaattttgcgaagatactatgacttataaatgtccgaggataacagaagccgagccagatgacgtagattgctggtgtaatgcaaccgatacatgggtaacctatggaacatgtagtcaaacaggagagcatcgtagagataaacgttctgttgctttagctccacacgtcggactgggactagaaactcgaactgagacatggatgagtagtgaaggagcttggaaacagatacaacgagtagaaacgtgggccctacgacaccccggattcacggtaatagcgctgtttttggcccatgctataggtacaagcataactcaaaaagggattatttttatactactaatgctggttacacctagtatggcgatgcgttgtgttggaataggctccagggattttgttgagggcctaagcggcgcaacttgggtggacgtggtattagaacatggatcatgcgttactactatggcaaaagataaaccaacgttagatatagaactattaaaaaccgaggtgaccaatccagcagttttaagaaaattatgcatcgaagcgaaaatatctaacacaacaacagacagtagatgtcctacgcaaggcgaagctactctcgtagaagaacaagacgctaatttcgtctgtagaagaacttttgtagatagaggctggggaaatgggtgcgggcttttcggaaaaggcagcttaattacgtgcgcaaaattcaaatgtgtaactaaactcgaaggaaaaattgttcaatatgagaatctaaagtattccgttatagttactgtgcataccggagaccaacaccaagtgggtaacgagtcgaccgaacatggaacaacggctactataacaccacaagcgccctcaacggagatacaactgactgattatggagcacttactcttgactgttcccctagaacgggcctagacttcaatgaaatggtgttactaacaatgaaagaaaaatcctggttagtccataaacagtggtttttagacctcccattgccttggacatcaggtgcttcaacaagccaagagacctggaatcgacaagacctattagtaacttttaaaacagcccatgccaagaaacaggaagtcgttgtcctaggaagtcaagaaggtgcaatgcacactgcactgacaggagcaacggagatacagacaagcggaactacaacgatatttgcaggacatcttaaatgcagactaaaaatggacaagttgaccttgaaaggtatgtcatatgtaatgtgtactggcagctttaaattagaaaaagaagtagccgaaacacaacatggcactgttctcgtccaaataaagtacgaaggaacagacgcgccatgtaagataccattctcaacgcaggatgagaagggggtgactcaaaacggacgcctaataactgcgaatcccattgttacagataaggaaaagccagttaacattgaagcagaaccacctttcggggaaagttatattgtcatcggagctggggagaaagcattgaaattatcctggttcaagaaaggaagttcgatcggtaaaatgttcgaggcgacagcacgaggagcaaggaggatggcaatcttaggagacacagcttgggatttcggctcaattggaggagtatttacttctgtcggaaaattagtacatcaaatttttggcactgcatacggcgttctgttctcaggggttagctggacaatgaagattggcatcggagtcctattaacatggctagggctaaactcaagaagcacaagtttaagtatgacctgtatagctgtggggcttgtaacattatacctgggtgttatggttcaggcagattcaggctgcgttatcaattggaaaggtcgcgaactcaaatgcggatctggaatctttgtgactaatgaagttcacacatggacagagcaatataaatttcaagctgactctcccaaacgtttatcagcagcaattggaaaggcttgggaagaaggcgtatgcggaataaggtcagctaccagattagagaacataatgtggaaacaaatctcgaacgaattaaatcacatactattagaaaatgatatgaaactaactgtcgtagttggagacgtagctggcattctggcacaaggcaagaaaatgataaggcctcaacccatggaatataaatatagctggaaaatatggggtaaagcgaaaataattggtgccgatgtgcagaacactactttcataattgacggaccaaatacaccagaatgccctgacgaccaaagggcatggaacatttgggaagtagaagattacggattcgggatttttacgacgaatatatggttaaaacttagggacagctacacacaagtatgtgatcatagactgatgtcagcagctataaaagatagtaaagcagttcacgcggacatgggctactggatagagtctgaaaagaatgaaacttggaagctagccagagccagttttatagaagttaaaacatgtatttggcctaaaagccatactctctggtcaaatggagtattagaatcagaaatgataataccgaaaatctacggaggaccgataagccagcacaattacaggcctggctacttcacccaaaccgcaggtccttggcatcttggtaagttagaactagattttgatctatgtgaaggaacgaccgtagttgtagacgaacattgcggaaatcgtggacctagtctaaggactacaacggtcactggtaagataatacacgaatggtgttgccgatcatgtacactaccgcccttacggtttaaaggggaagatggttgttggtatggaatggaaataaggccagtgaaagaaaaggaggaaaatttggtcaagagcatggtatcagctggaagtggcgaagtagacagttttagcctgggtctgctttgtatttcaataatgatagaagaagtaatgcggagtcgatggagtcgcaaaatgttgatgacaggaacattagcagtgtttttcttactaatcatgggacaactcacctggaatgacctaataagattatgcataatggtaggcgctaacgctagtgatcgaatgggcatgggaacgacctacttagcacttatggctacatttaagatgaggccaatgttcgcggtcggcttgttgtttcgaaggttaacatcaagggaggtccttcttcttacaattggactcagcttggtagcgagtgtagagttaccaaattctttagaagaactcggcgatggtttagcgatgggcattatgatacttaaattgttaacggactttcaatcacaccaactctgggcgactctactctcactgacttttatccgcacgacattcagcctacattatgcatggaagactatggcaatggtactgtccatcgtgtctttgtttccactttgtcttagtaccaccagtcagaagacgacatggttacccgtgctacttggttcattaggatgtaagccgcttaccatgtttttaatagctgagaacaaaatatggggaaggaaaagctggccgttgaacgagggaataatggctgtcggaatcgtcagtatactattgtccagtttattgaaaaatgacgtcccactagcaggtcccttaattgccggtggaatgctaatagcctgttacgttataagcggcagttccgcggatctgagcttagagaaggccgccgaggtatcttgggaggaagaagctgaacatagtggtgcatcacataatatactcgtagaagtacaggacgacggtactatgaaaatcaaggatgaagaacgtgatgatacactaacgatattattaaaggcaacactgttagcagtaagtggtgtttatcccctctctatacctgcaacattatttgtttggtatttctggcaaaagaagaaacaaagatcaggagtcttgtgggataccccaagtccaccggaggttgaacgagcagtactcgacgacggtatctaccgtattatgcaacgaggtttgctaggcagatcacaagtgggcgtaggtgtctttcaagaaaatgtttttcacactatgtggcatgttacaagaggtgcagtgttaatgtatcaaggcaagagattagagccttcatgggcttccgtcaagaaagatctaatcagctacggagggggttggaggctacaaggatcctggaatacgggagaggaggtacaagtaatagccgtagaacctggcaagaatccgaaaaatgtacaaaccgctccagggaccttcaaaacgagtgagggagaagttggagcaattgcattggatttcaaaccaggcacttctggatctcccatcgtaaatcgagaaggcaaaatcgtagggttatacggtaacggtgtagtaactacatccggcacatatgtatctgcaattgcacaggctaaagcatcacaggaaggtccacttccagaaatagaagatgaagtttttagaaaaagaaatcttacgattatggatttacatcctggatcaggtaaaacaaggaggtatttaccggctattgttagggaagcaataaaacgtagacttcgaactctaatactagccccgactagggttgtagcatcagaaatggctgaagcccttaaaggcatgcccatacgttatcaaaccacagctgtcaagtcagaacatactggaaaggaaattgtggatttgatgtgccatgctacgtttacaatgcgattattgagcccagtcagagtacctaactacaatatgataattatggatgaggctcatttcacagatccgagcagcatagccgcaaggggttacatatccacgcgagttggtatgggcgaagccgccgcaatattcatgacagcgacaccaccgggcagcgttgaagcattcccccaatcaaatgcagtgatacaagatgaggagcgagacatacctgagaggagttggaactcaggttatgagtggattacagactttccgggcaaaacagtatggttcgtaccatctattaaatcagggaatgatattgctaattgtctaaggaaaaatggaaaacgcgttatccaactatcacgcaaaacatttgataccgagtatcagaaaactaaaaataatgattgggattacgtagtaactactgacatctcggaaatgggggccaacttcagagcagaccgtgttatagacccaagaaggtgtttaaagcccgtgatcttaaaagacgggccggagagagtaattttggcaggcccaatgccagtcacagtggcatccgcggcccaaagaagaggaagaataggaagaaatcataacaaagaaggagatcaatatatttatatgggccaaccactaaacaatgatgaagatcatgcccattggaccgaagccaagatgctactcgataacatcaatactcccgaaggaattataccagctttattcgaaccagagcgtgagaaatccgcagcgatagatggtgaatacagattaagaggagaagccagaaagacctttgtggaactgatgcggagaggggatctaccagtatggttatcatacaaagtagcatcagagggatttcagtactcagatagacgctggtgttttgatggagaaagaaataatcaagtccttgaagaaaatatggacgttgaaatatggacaaaagaaggcgaaaggaagaaactgagacctcgatggttggatgctagaacatactccgatccacttgcactgcgggaatttaaagaatttgccgctgggcgacgttccgttagtggtgatttaatactagaaattgggaaactaccacaacacttaacccagcgtgcccagaatgctttggacaaccttgtcatgttgcacaattccgaacaaggaggtcgcgcatatcgtcatgcaatggaagaattacctgacacgatcgagaccttgatgctcctagctctcatcgcagtactaactgggggtgtcaccttatttttcttatctggacgaggactagggaaaacaagtataggtttactatgcgtcatggcgagttcagtattgttgtggatggcctcagtagaacctcactggatagcggcctctataatactcgagttctttttaatggtacttttaatccctgaaccagataggcaaagaaccccacaagacaaccagttagcttatgtagtaattggtttattgttcatgattctaactgtagctgcaaatgaaatggggctactagaaacgactaagaaagatctggggataggacatgtagcagtagaaaatcaccatcacgcagccatgctggatgtggacctacacccagcttcggcttggacactttatgcggttgcaacaacgattataaccccgatgatgcgccacactattgaaaataccacggcaaacatatcacttacagctatagcgaaccaagctgctatcttaatgggcttagataaaggatggcctatatccaaaatggatattggggtaccactactggcgttgggatgctattcccaagtaaacccactcacactcactgctgcagttctaatgttggtggctcactacgctatcattgggcctgggctccaggcaaaagcaacgcgggaagcacagaaaagaacagccgcaggtataatgaaaaatcccactgttgatgggattgtcgctattgatcttgaccccgttgtctatgacgcaaaatttgaaaaacaactaggccaaattatgttgttgattctatgtacatcccagatacttttaatgcgaactacatgggccctatgtgaatccataactcttgcaaccggacctttaacaacattgtgggaagggtcaccaggaaaattctggaacacgacaatagctgtttctatggcgaatatttttagaggaagttatttagccggagcaggtctagcattttctttaatgaaatcattaggcggtggaagacgggggacaggagcgcaaggcgaaactctaggagaaaaatggaaacgtcaacttaatcaactgagtaagtccgaatttaacacttacaaaagatcaggaataatggaagttgacagatcagaagcgaaagaaggacttaaacgaggggaaacgactaaacacgctgtgtccagaggtaccgctaagctgcgatggttcgtagaaagaaatttggtaaaacccgaagggaaggtaatagatttaggatgcgggcgcggaggatggtcatattactgtgcaggcttaaagaaagtaacggaagtgaaagggtacactaaagggggtcccgggcacgaagaaccgataccaatggccacatatggatggaacttagttaaattacactccggaaaagacgtattctttataccgccagagaagtgtgacactttgctgtgcgatattggagagtcatctcctaacccgactattgaagagggaagaacactgagagtacttaaaatggtggagccatggctgcgcggaaatcaattctgcatcaaaatactaaatccctacatgccatcagtggtagaaactcttgagcaaatgcaaagaaaacatggcggaatgcttgttcggaatccattgtccagaaattcgacacacgaaatgtattgggtatcatgtggcacgggaaatatagtatcagcagtaaacatgaccagtagaatgttactaaaccgcttcactatggcacataggaagcccacatacgaaagagatgtcgacttaggggcaggtacgagacatgtagcggtagaaccagaagtcgctaacttagacataattggacaacgaattgaaaacattaaacacgaacataagagtacatggcattatgacgaagacaatccctataaaacttgggcatatcacggttcatatgaagttaagccatcaggtagtgcatcaagtatggtaaatggtgtggttaaattacttacaaaaccttgggacgtcataccaatggtaactcaaatagccatgacggacactacaccgtttggacaacaacgtgttttcaaagaaaaggttgatactaggaccccaaaggccaaaaggggtacagcccagatcatggaagtgaccgcaaagtggctttggggatttttatctcgaaataagaaaccaagaatttgtacaagagaggagtttaccaggaaagtccgcagtaacgctgcgataggtgcagtattcgtagacgaaaatcaatggaactcagcaaaggaagcagtagaggacgaacgtttttgggacttagtacatagagaaagagaactccataagcaagggaaatgcgcaacctgtgtgtataatatgatgggtaaaagagagaagaaacttggtgagttcggaaaagctaagggctcacgcgccatctggtatatgtggttgggcgcaagatttctagaatttgaagcactaggatttatgaacgaagaccactggttcagtagagaaaattctctttcgggagttgagggcgaagggttgcataaacttggatatattttgcgagacatatcaaaaattccaggaggtaatatgtatgccgacgatacagcgggttgggataccagaatcacagaagatgatctgcaaaacgaggctaaaataaccgatataatggaaccagaacatgcactattagccaaaagtatcttcaaactaacttatcaaaacaaggttgtcagagttcaaagacccgcgaaaaacggtactgttatggatgttatttcaagacgagatcaaaggggctcaggacaggtggggacgtacggtttaaacactttcactaatatggaagcccaattaattcgacaaatggaatccgaagggattttctccccatcagaacttgaaacacctaatttggcaggaagggtattaaactggctggagaagcatggagtagaaagacttaaaaggatggcaatcagtggtgacgattgcgtggttaaaccaattgatgacagatttgcaactgcgcttacagcgctaaacgacatgggtaaagttagaaaggacatcccccaatgggaaccatcaaagggatggaatgattggcaacaggtcccattctgctcccatcacttccaccaactaattatgaaagacgggcgggaaattgtagtaccatgtaggaatcaggacgagctagtaggtagagcacgagttagccaaggagcaggctggagtttgagagaaacagcatgcctaggtaaatcctatgcacaaatgtggcagctaatgtactttcatagacgagacttacgactagcagcaaatgctatttgttctgctgtccccgtagattgggtaccaacaagcagaacaacatggtcaatacatgcccaccaccaatggatgacaacggaagacatgttatcagtgtggaatagagtctggatagaagaaaacccgtggatggaagacaaaacacatgtttcatcttggggtgatgtaccatatttaggtaaacgagaagatcagtggtgtggaagcctcataggactaaccgccagagcaacatgggccactaacatacaggttgccatcaatcaagtgagaagacttttgggcaacgaaaattaccttgactatatgacttctatgaaacgtttcaagaacgagtctgacccagagggagcgttgtggtag

SEQ ID NO: 21459 - RNA, 9879 nt, synthetic construct
  misc_feature 1..9879: note = derived and/or modified CDS sequence (opt6) from DENV-1__EU660412__SS-prME
  source 1..9879: mol_type = other RNA
agtgtgactatgctattaatgctcatgccgacagcccttgcatttcacctaacaactaggggcggtgaaccacacatgatagttagcaaacaagaaagaggtaaatccctgctgtttaaaacaagtgctggggtcaacatgtgtacgttgattgcgatggatttaggtgaattatgcgaagataccatgacttataaatgcccgaggatcacagaagccgaacctgatgacgtcgattgttggtgcaacgctaccgacacttgggtcacatacggcacgtgtagccaaacgggagaacatcgaagggataaacgtagtgtagcattagcacctcacgtaggactgggattagaaacacgaacggaaacgtggatgtcatcggaaggggcatggaaacaaatccagagggtggaaacatgggcactgcgacacccaggctttacagtaatagcactctttttagcacacgccattggaacaagcattactcagaaaggaataatatttatactattgatgctagtgacgccatccatggcgatgaggtgtgtggggattgggtcgagggactttgtggaaggactttcgggagccacatgggtagatgtagtcctagaacatggatcatgtgtaacaacaatggctaaagacaaaccaacacttgatattgaactactaaaaactgaagtgacaaatcctgcagtcctacgaaaactctgtattgaagcgaaaatcagcaatactacgaccgactcaagatgcccgactcagggagaagcaactctagtggaagaacaggacgctaacttcgtttgtagacgtacatttgtcgatagagggtggggaaatggatgcggacttttcggtaaaggatcactaattacatgtgcaaaatttaaatgtgtaacaaaactggaaggtaaaatagtacaatacgaaaatttgaaatatagcgttattgtcacggtccacacaggagaccagcatcaagtaggaaacgaaagtaccgaacatggaactacagctacaatcacaccacaagctccaaccacggaaatacaactcactgactacggagccttgaccttagactgtagtccacggacgggcctggactttaatgaaatggtcttattaactatgaaagaaaaatcatggttggttcataaacagtggtttcttgatctaccattaccttggacgtcaggtgcttctacttcgcaagaaacttggaaccgacaagaccttctagtaacgtttaaaacagcacacgcaaagaaacaagaagtggttgttctaggatctcaggagggagccatgcatactgcattaactggcgctacagaaatacaaactagcggcacaacaactatatttgcggggcacctaaagtgccgattaaagatggataaacttaccttaaaagggatgtcctacgttatgtgcacaggatcattcaaactagaaaaagaagttgccgaaacccaacacggtacagtattagttcagataaaatatgaaggaacagacgcaccttgcaaaattccctttagtactcaagatgaaaagggagttacacaaaatggacgtttaataactgcaaatccaattgtgactgataaagagaaacccgtgaacattgaagctgaacctccttttggagagagttatattgtgatcggggctggagagaaagctctgaagttaagttggtttaagaaaggatcttcaataggaaagatgttcgaagcgactgcaagaggagcgcgtaggatggcaatcttaggagatactgcctgggacttcggatcaattggaggagttttcacttcagtgggtaagttagttcaccagatattcggaacagcatacggtgtcttgttttctggcgtaagttggacaatgaagataggtataggtgtactgttaacatggctagggttgaatagtagaagcactagcttgtcgatgacatgtatagctgtcgggttggtcactctctatttgggtgtcatggttcaagcagacagtggttgtgtcataaattggaaaggaagagaattaaagtgtggaagtgggattttcgttacaaacgaagttcatacctggacagaacaatataagttccaagcggatagtcccaaaaggctttccgcggcaattggtaaggcatgggaagaaggagtatgtgggatccgatctgcaacccggttagaaaatataatgtggaaacaaatcagtaatgaactcaaccacatccttttggagaatgacatgaaactaacagtagtggttggcgatgtagctggaatactgggacagggtaaaaagatgatcaggccgcaacctatggaatataaatactcatggaaatcttggggcaaagctaaaatcattggagcagatgcccaaaatacaacttttataatagacggaccgaacacaccagaatgtcctgacgaccagagagcatggaatatttgggaagtagaggactatggttttggcatctttacaacaaatatatggctaaaattaagagattcgtatacacaagtttgtgatcatcgactcatgtcagcggccatcaaagattctaaagccgtccacgctgatatggggtattggatagaatcagagaaaaatgagacctggaaactagctagggctagttttatcgaggtaaagacatgtatatggcccaaatcccatactctctggagtaatggtgttttagaaagcgaaatgatcattccaaagatttatggcggacccatatcacaacataactaccgtcctggatacttcacacagacagctgggccatggcacttaggaaaacttgaattagatttcgatttatgtgagggaacaactgtcgtagttgatgagcattgtggtaatagaggcccaagtctaaggacaactactgtcactggcaagataatacatgaatggtgctgtcgatcatgtacattaccaccactaagatttcgaggagaagatggatgttggtatggaatggaaataagaccagtaaaagagaaagaagaaaatttggtaaagagtatggtatcggcggggtcgggggaagtagactctttcagccttggattattatgtatctccattatgatagaggaagtaatgcggtctagatggagccggaaaatgctgatgactgggactcttgcggtatttttcctattaattatgggccagctcacatggaacgatttaatccgactctgcatcatggtaggagcgaatgcaagcgaccgcatggggatgggtacaacctacttagcgcttatggctacttttaaaatgaggcctatgtttgcagtaggactccttttcaggcggctaactagccgggaagttctattattgacaattggtttaagcctggtcgcttcagtggaacttccaaatagtctggaggagttgggtgacgggttggcaatgggtataatgatattgaaactgttaactgattttcaatcccaccaactatgggcgaccttattatcattaacattcatcaaaaccacattttcacttcactatgcatggaaaactatggcaatggtactgtcaatcgtaagtcttttccctttgtgtttaagcacaacctcccagaaaacaacatggctacctgtattgttagggagtctagggtgcaaacctcttacaatgtttctgattgcggaaaacaaaatttggggtagaaaaagttggcctttaaatgaaggtataatggctgttggaattgtatcaatactactcagctcgctactgaaaaacgatgtaccactggcaggtcctctgatcgcagggggtatgctaattgcttgctatgtaatatcaggaagtagcgccgatttgtcattagaaaaggcagcagaggtcagttgggaggaagaagctgaacattctggagcaagccacaatattttggtagaagtacaagatgatggcacaatgaagatcaaagatgaggaacgtgatgatacactcacaatattgttaaaagcgactttgctagcggtatccggagtttatcccctaagcattccagccactttgtttgtatggtatttttggcagaaaaagaaacaaagatcgggggtcttgtgggataccccttccccacccgaggttgaacgcgcggtattagatgacggtatataccgaattatgcagaggggtctgctgggtcgaagccaagtaggagtgggagttttccaagaaaacgtatttcacaccatgtggcatgtaacaagaggtgcggtattaatgtatcaaggaaaaagactagaaccctcttgggctagcgtcaagaaagatttgatcagctatggaggtggctggcgactaagaggcagctggaacactggcgaagaagtccaagtaattgccgtagaaccaggtaaaaaccctaaaaatgtacagacagcgccaggaacattcaaaactccggagggagaagttggtgcaatcgctttagactttaaaccaggaacttcaggatcaccgattgttaacagagaaggaaaaatagtaggcctgtacggaaacggcgttgtaacaacgtcaggcacatatgtttcagctattgctcaagcaaaagcatcacaggaaggaccgctaccggagatagaagatgaagtttttcgaaaaagaaacctaaccatcatggatctacatccaggatcaggcaagacaagacggtatttgcctgctattgtaagggaagctataaaaagaaaactaagaactttaatattagcacctaccagagtagtagcaagtgaaatggcagaggctttgaaaggtatgcccatacgatatcagacaacggcggtgaaaagtgaacatacgggtaaagaaatagtagatcttatgtgccatgcaacttttacaatgagattactaagcccggtgagggtaccgaattataatatgattataatggatgaagctcattttactgatccaagttcaatagcggccagaggttacatatcaacacgggtaggaatgggcgaagccgcagccatcttcatgacagctaccccaccaggtagtgtagaggcgtttccacaaagcaacgcagtaatccaagatgaggagcgagatattcctgaacgaagttggaacagtggttatgaatggatcaccgactttcccggaaagacagtttggtttgttcctagcataaagagtggaaacgatattgcaaattgtttaaggaaaaatggaaaacgggttatacaactgtcaagaaaaacatttgatactgaataccagaagacgaaaaataatgactgggactacgtagttacaaccgatatatctgagatgggcgcaaatttccgcgcggacagagtaatagaccctagaagatgcttgaaaccagtaatattaaaagacggaccagaaagggtaatattggcgggaccgatgcctgttaccgtagcgagtgcagcgcagcggagggggagaattggacgaaaccataataaagaaggggatcaatatatatatatgggacaacccttaaataacgacgaagatcatgcacactggacagaagcaaagatgcttttagataatataaacacaccggaaggtatcataccggcactcttcgagcctgaacgtgagaaatcggcagccgtcgacggtgaatataggttgaggggtgaggcaagaaaaacatttgtagaactaatgcgacgaggggacttacccgtatggctttcttacaaagttgcatctgagggcttccaatactcggatagaaggtggtgtttcgatggagaaagaaataatcaagtgttagaagaaaatatggacgttgaaatttggaccaaagaaggagaacgcaagaaattacgcccacgatggcttgatgcccgaacatatagtgatcccttggctctccgcgagttcaaagagtttgcagcagggcgcaggtccgtctctggagatctcattctagaaataggtaaactcccccaacacttaacacagagagctcaaaacgcgctagataatcttgtaatgctgcacaatagtgaacaaggaggaagggcttaccgtcatgcaatggaggaattaccggacacgatcgagacgctgatgctgttagcattaatagcggtgctcactgggggagtcacattgtttttcctcagtggaaggggcttaggtaagaccagtattgggctattatgtgttatggcatcaagcgtgcttttgtggatggcaagcgtagaaccacattggattgccgcgtccataatattagaatttttccttatggtattactcatcccagaaccagacaggcaaaggacacctcaggataatcaactcgcgtacgtagtcataggattgttgtttatgatacttactgtagcagcaaacgaaatgggactgctagagacgaccaagaaagacttgggaataggtcatgttgcagtcgagaatcaccatcatgcagctatgttagacgtggatttacacccggcctcagcatggacactttatgccgttgctaccactatcattacacccatgatgagacacacgattgagaacacaacagcgaacatttcgttaaccgctattgcaaaccaagcagctatattaatgggactagacaaaggctggccaatatctaagatggacataggcgtgcctctccttgcattgggatgttattcccaggttaacccactgactctaacagctgcggtacttatgctagtagcacattatgcaattattggaccgggactacaggcgaaagcaaccagagaagcccaaaaacgcacagctgctggtattatgaaaaatccgacagtagacggaattgtagcaatagatcttgacccagttgtgtatgatgcaaaatttgaaaaacaattgggacaaataatgcttttgattttatgtacgtcacaaattctattaatgcgtacgacttgggccctttgcgaaagtattacactagctaccggaccacttacaaccctatgggaaggaagtccaggtaaattttggaataccaccatagcggtatcaatggcaaacatctttagagggtcttacttagccggtgcaggcctagcatttagtttaatgaagtcgttaggtggaggaagaagagggacgggagcgcaaggggaaacactgggggagaaatggaaacggcaacttaaccaactaagcaaaagtgagttcaatacatataaacgaagcggtatcatggaggtagatcgaagcgaagcaaaggagggtctcaaaaggggagaaacgaccaaacacgcagtgtcgagaggaacagcaaaattaaggtggttcgtagagagaaatctggtgaagcccgaaggaaaagtcatcgatcttggttgcggtagagggggttggtcttattactgtgccggactaaagaaagtcacagaagttaaaggatacaccaaaggcggacctggacatgaagaaccaatccccatggcaacatacgggtggaatttagttaaattacattccggtaaagatgttttctttattccacctgaaaaatgtgatactctattgtgtgatataggagaaagttctccgaacccaaccatcgaagaggggagaacactaagagtcttaaaaatggtagaaccctggctacggggaaaccaattctgcataaagatattaaacccgtatatgcccagtgtagtcgaggctttagagcaaatgcagcgaaagcatggaggaatgttagtgcgaaatccgctatcaagaaacagtacacacgaaatgtactgggtttcatgtggaacagggaatatagtaagcgcggtaaatatgaccagcagaatgctgttaaatcgctttacaatggcgcatcggaaaccaacatacgaaagagacgtagatttagggacaggcacaagacatgttgccgttgaacctgaagtagcaaacctcgatattataggacaacgaatagaaaatataaaacatgaacataaaagtacttggcactatgatgaagataacccatataaaacctgggcctatcatggtagttatgaggtaaaaccttctggttctgcgtcgagtatggtgaatggagtggtgaaattgttgactaagccttgggatgttatccctatggtgacgcagattgcaatgactgatacgacaccgtttggacagcaaagagtattcaaagaaaaagtggatacacgtacaccgaaggcgaaaagaggcacagcccagattatggaagttaccgctaggtggttatgggggttcttaagcaggaataagaaaccacgaatctgtactagggaagagttcacaagaaaagtaagatctaacgcggcaataggcgcagtctttgtcgatgaaaatcagtggaacagcgccaaagaggcggtcgaagacgagcgattttgggacctcgtacatagagaaagagaactacacaaacaaggtaagtgtgcgacatgcgtatacaatatgatgggcaagagggagaagaaattgggggaatttggaaaagcaaagggatcgagggcaatttggtacatgtggctaggagccagatttttagaatttgaagcattaggattcatgaacgaggatcattggttttccagggaaaactctttgtctggcgttgaaggggaaggcctacataaactcggctacatactgagggatataagtaaaatccccggcggaaatatgtatgcagatgataccgcaggttgggatactcgaataactgaggacgatcttcaaaacgaagcaaaaataacagatataatggaacctgaacatgcattgttagcgaaagcaattttcaaattgacttatcaaaataaagtagttcgtgtacagagaccagcgaagaatggcacagttatggacgtcatatctcgcagagaccaaagaggcagcgggcaagtcggaacatacggcctaaatactttcacgaatatggaagctcaactcattcgacaaatggagagcgagggtatatttagtccatcggagttagagacacctaatctggctgaacgggcgctcgactggttagaaaaatatggcgtcgaaagattaaagaggatggccatatcgggcgatgattgtgttgtgaaaccaatcgatgatagatttgcaaccgcgctcacagcactaaatgatatgggaaaagttcgaaaggatataccacaatgggaaccatcaaagggatggaacgactggcaacaagtgccattctgctcacatcactttcaccaactcataatgaaggatggaagggagattgtagtcccttgtcgaaaccaagatgagctagtaggccgtgcccgagttagtcaaggagcaggatggtcgctacgggaaacagcttgtttggggaagtcctacgcacaaatgtggcagttaatgtactttcaccgtcgagatctgcgtcttgctgctaatgctatctgtagtgcggtgccagtagattgggtacccacatcacgaacgacatggtcaatccatgcacatcatcaatggatgactacagaagacatgttaagcgtatggaaccgggtatggatcgaagaaaatccttggatggaagacaaaacacatatatcaagttgggaagatgttccctatttggggaaacgtgaggatcagtggtgtggatcactaatagggttaactgcacgtgcaacatgggccaccaatatacaagtagcgataaatcaagtaaggcgcctgattggcaacgaaaactacttagattacatgatctctatgaaaagattcaaaaatgagagtgacccagaaggcgcactttggtaa

SEQ ID NO: 21460 - RNA, 9879 nt, synthetic construct
  misc_feature 1..9879: note = derived and/or modified CDS sequence (opt6) from DENV-1__EU660418__SS-prME
  source 1..9879: mol_type = other RNA
agtgtcaccatgcttctaatgttaatgcccactgctcttgcattccacctaacgactagaggtggggaaccacatatgatagtaagcaaacaagaaagagggaaatctttactattcaaaacgagcgcaggagtcaacatgtgcactctaatcgcaatggacttaggagaactatgtgaagacactatgacctataaatgtcccagaataactgaaacagaacctgatgatgtcgactgttggtgtaatgcgacagatacgtgggtaacctacggaacgtgttctcaaacaggtgagcatagaagagataaacgatcagtggcattagccccgcatgttggattagggctcgaaacaagaaccgaaacatggatgtcctccgaaggagcgtggaaacaaatacaacgtgtagaaacctgggcactgagacatcccggatttactgtaatagcgttatttttagcccacgcaataggaacttcaatcacgcagaaaggaataatattcattctacttatgttagtaacaccatcgatggcaatgagatgcgtagggataggatccagagactttgtagaagggttatctggtgccacatgggttgacgtagtcctcgaacatggtagctgcgtgacgactatggctaaagacaaaccaacactagacatcgaactattgaaaactgaagtgactaacccagccgttttacgaaaattatgtatagaagcaaaaatatcaaatacaacaacagacagcagatgtccaacacaaggggaagcaaccctggtcgaagaacaagatgctaactttgtttgtcgaagaacattcgtggaccgaggatggggtaatggatgcggactctttgggaaaggatcacttataacatgtgcaaaattcaagtgcgttacaaaacttgaaggcaagatagtacaatatgaaaatttaaaatattcggtaatcgttaccgttcatactggtgatcaacatcaagtcgggaatgaatcaacagaacatggcaccacagctacgataacgcctcaagcacccaccacagaaatccagttaaccgattatggagcactcactcttgactgttcgccacgaactggattggatttcaacgaaatggttttattgacaatgaaggagaaaagctggttggtacataaacaatggtttttggacttgccattaccctggacgtcaggagcgtctacatcacaagaaacttggaataggcaagatctattagtaacttttaagacagcacatgccaagaaacaagaagtcgtcgtattaggttctcaagaaggcgccatgcacacagcattgactggagcaacggaaatacaaacgagtggaacaacaacgattttcgctgggcacttaaagtgtagacttaagatggacaaactgacattgaaaggaatgtcctacgtaatgtgtaccggttcatttaaactagaaaaagaggtagcagaaacacaacatggtactgtcctagtgcaaattaaatatgaaggtacagacgcaccatgcaaaatcccattttcgactcaagacgagaaaggagtaacacaaaacggaaggttaataacagcgaatccgatcgtcacagataaggaaaaacccgtgaatatagaagctgaacccccatttggagaaagttatatagttattggggcgggcgaaaaggctttaaaactctcttggttcaaaaagggatccagcataggaaaaatgtttgaagcaactgcccgaggcgcaagacgaatggcaattctgggtgacaccgcttgggatttcggcagtataggaggtgtattcacatcagtcggaaaattggttcaccaaatatttggaaccgcatatggtgttttattcagcggagtaagttggacgatgaagataggaataggagtattactgacctggctgggtctaaattcaaggtctacttctctttctatgacatgtattgcagtgggattggttactctttacctcggggtaatggtacaagcggatagcggttgtgttataaattggaaaggcagagaattaaaatgcggatcgggaatattcgtcacaaacgaagtacatacttggacagaacagtacaaatttcaagctgacagtcctaaaagattgagtgcagcaattggaaaagcctgggaagaaggtgtttgtgggattagaagcgctacgcgcctagaaaacatcatgtggaaacaaataagtaatgaattaaaccatatactattagagaatgacatgaaattcactgtagtagtaggagatgtggctggcattttggcccaaggcaagaaaatgatccgacctcaaccgatggaatataaatacagctggaaatcgtggggtaaagccaagataataggggcagacgtgcaaaatacaacatttattatagatggtccaaacactccagaatgtccggacgaccagagagcttggaatatatgggaagtagaagactacggattcggaatctttacaaccaacatatggttaaaacttagagactcatatacacaagtatgcgatcacagacttatgtctgcggctattaaagattcaaaagcagttcacgctgatatgggatattggatagaatctgaaaagaacgaaacctggaaattagctcgtgccagctttatagaagtaaaaacatgtatctggcctaaaagtcatacattatggagtaatggcgtattagaaagtgagatgataatcccaaaaatttacgggggacccatttcgcaacacaattacaggcctggatacttcacccaaaccgcaggtccgtggcacttaggaaagttagaattagatttcgatctatgtgaggggacaacagtagtagtagatgaacattgtggaaacaggggaccatcattaaggacaacaacggttaccggtaaaataatacatgagtggtgttgtcgatcttgtacactaccacctctccggtttcgaggagaggatggatgctggtacgggatggaaattagacctgtaaaggagaaagaagaaaacttagtgaaatccatggtaagtgcagggagtggagaagttgatagtttttcattaggcctcctctgcatatccataatgatcgaagaagtgatgcgctcaagatggtctcggaagatgcttatgaccggaacgctggccgtatttttcctccttatcatggggcagctaacctggaatgacttgataagactatgtattatggtaggggcgaatgccagtgatagaatgggaatgggcacgacctatttagccttaatggcaacttttaaaatgcgaccaatgttcgccgtaggacttttattccggagattaacaagtcgcgaggtcctcctgttgactattggactttcacttgtagctagtgttgaactacctaacagcttagaagaattgggagacggattagccatgggcattatgatacttaaattactaactgattttcagtcacaccaattatgggcaacattgttgtccttaacttttattaaaactacattttcattacactatgcatggaagaccatggcgatggtcctcagcatagtgagtcttttcccactctgcctatcgacaacaagccaaaagactacgtggctacccgtattactagggagtctaggctgcaaaccactaacgatgtttctaattgcggaaaacaaaatttgggggcgcagaagctggccgctgaacgaaggcataatggcagtaggtattgtatctatactactgagctcactacttaagaatgatgtgccgttagctggtccactaatagcgggaggtatgttgattgcttgctatgtaattagcggttccagcgcagacctatcactcgaaaaagccgctgaagtttcatgggaggaagaggcagaacatagcggagcttcacataatatcttagtggaagttcaggacgatggaacgatgaaaataaaagatgaggagagagatgatacactaacaatattactgaaagcgactttattagctgtgtctggtgtatatcctttgagcatacctgctactctcttcgtctggcacttttggcaaaagaaaaagcaacgttctggtgttttgtgggacactcccagcccacctgaagtcggtagagcggtgttagatgacggtatataccgaataatgcaaagaggactcctaggtagaagccaagtaggcgttggagtctttcaagaaaatgtcttccacactatgtggcatgtgacccggggagcagtactaatgtatcagggtaaacgattagaaccaagttgggcatcagttaagaaagacttaatatcatatggtggtggatggagactacaagggagctggaacaccggcgaagaagttcaagtaatagccgttgaacccggaaagaatcctaagaacgttcagacggcccccgggacatttaaaacacctgaaggtgaagtcggcgcaatagcattagatttcaaacccggaacaagtggctcaccaatagtcaatagagagggcaaaattgtgggactatacgggaacggagtggtcacaacctccggtacgtatgtcagcgcaattgcccaagccaaagcatctcaagagggaccattaccggagatagaagacgaagttttcaggaagagaaacttgactataatggatttacatccaggaagcggaaaaacaaggagatatctcccggctatcgtccgcgaggcaataaagagaaagttgaggactttaatacttgcaccaacaagagttgttgcgtcggagatggccgaggctttaaaaggtatgcctattagatatcagactacagcggtgaaatctgagcacacggggaaggaaattgtagatttaatgtgtcatgctacatttacgatgagattattatctccggttagagtaccaaattataacatgattatcatggatgaagctcatttcacggatccttcttcgattgcagccagaggttatataagcacacgcgtcggaatgggcgaagcggccgcaatatttatgacagcgacaccgcccgggtcagtcgaagcatttccacagtcgaacgcagtaattcaagatgaggaacgagatataccagaaagaagctggaactctgggtacgagtggataacagatttccccggaaaaacggtttggttcgtcccgtccatcaagtccgggaacgatatagcaaattgcttaaggaaaaatggaaaacgcgtaatacagctatctagaaaaacattcgatacagaataccagaaaactaaaaacaacgattgggattatgttgtaaccacagacatcagtgagatgggagcaaattttcgtgcagatagagttatcgatccaaggcggtgcttaaaacccgtaattttaaaagatggtcccgaaagagttatattagcaggacctatgccagttacggtcgcttcagcggcacaaaggcggggacgtataggtcgaaatcacaataaggaaggtgatcaatatatctatatgggtcagccattaaataatgatgaggaccacgcacactggactgaagctaaaatgttattagacaacatcaacactcctgaaggtattataccagcactgttcgagcccgagcgtgagaaaagcgcagcaatagatggagaatacagattacgaggagaggcacgcaaaacattcgtagaactcatgcggaggggcgaccttccagtttggttatcatataaagtagcaagtgagggtttccaatattcagaccgtaggtggtgctttgacggcgagaggaataaccaagtacttgaagaaaatatggacgtcgagatatggacaaaggaaggagaaagaaagaaactaagaccaagatggttagacgcgaggacttattcagatccattagcgttgcgtgaatttaaagagttcgctgctggtcgaaggtcagtatcgggagatctaatacttgaaataggaaaactaccacaacacctaactcagcgggcacagaatgcactcgacaatctggtcatgctgcataactcggaacaaggaggtagagcgtacaggcatgccatggaagaattacccgatactatagaaactttaatgcttttagcactaatcgccgtcctgaccggaggagtcacgttgtttttcctgtctggccggggactcggtaaaacatcaataggactactctgtgtaatggcaagttctgttttgttgtggatggctagtgtggaaccacattggatagcggcctcaattattttggaatttttcctcatggtcctcctaatacctgagccggatcgccagagaactccacaggataatcagttagcatacgtagtaattggattattatttatgattcttactgttgccgccaacgaaatggggctattggaaactaccaagaaagatctcgggataggacatgtggcggttgaaaaccaccaccatgcagctatgctagatgtagacctccatccggcatctgcttggacgttatacgcagtggctacgacaattatcacgcctatgatgcgtcacacaattgaaaacaccacggcgaatatttctcttactgcaattgcgaatcaagctgctatattgatgggacttgataagggatggcctatttcaaaaatggatattggtgtgcctttactagctctagggtgctatagtcaagttaacccacttacgttaactgcagcggtactgatgttagtagcacattacgccataataggaccaggcctacaagcaaaggcaacacgagaggctcaaaaacggacggcagcaggtataatgaaaaatccaaccgtcgacggtatcgtcgctattgatttagacccagtagtttatgacgctaaatttgaaaaacaactggggcaaataatgttgttaatattatgtacatcacagatattactcatgaggaccacatgggcactatgtgaatcaataacgttagcaacaggacccttgaccacgttgtgggaaggcagccctggcaagttttggaatactacaatagcagtaagtatggctaatatttttagaggtagttatctcgccggagctggactcgcctttagcttgatgaaatcactgggaggaggacgtcgtggaactggagctcaaggcgaaactttaggggaaaaatggaaacgccaattaaatcaactttccaagtcagaatttaatacgtataagagaagcggtattatggaggttgatagaagcgaagctaaagaaggacttaagagaggagaaactacaaaacacgcggtgtctcgcgggacggctaaattacgctggttcgttgaaagaaatttagtaaaaccggagggaaaagttatcgatctaggatgcggaaggggaggttggagttactactgtgctggtttaaagaaagtaacagaggtaaaaggttacactaaaggaggccccggtcacgaagaacccatcccaatggccacatacgggtggaatctagtcaagttacactcaggaaaggacgtgttctttattccgcccgagaaatgtgatacgctcttatgtgatattggggagtcctcaccaaatcctacaattgaagaaggtagaacgttacgggtacttaaaatggtcgaaccatggctaaggggaaatcagttctgtattaaaatattaaatccatacatgccaagcgtcgtggaaacactagaacaaatgcaaaggaagcacggtggtatgttggtgcgtaacccactatcacgaaacagcactcatgaaatgtattgggtgagttgtgggaccggtaatatagtaagcgctgttaatatgacgtcacgtatgctactaaatcgttttactatggcacatcggaaacctacatacgaaagagatgtagatctgggtgctggtacacgccatgtggccgttgaacccgaagtggcaaacctagacataataggccaaagaattgaaaacataaagcatgaacataaatccacatggcattatgatgaagacaatccatataagacgtgggcatatcatggatcgtatgaggtgaaaccaagcggttcagcctccagcatggtcaatggagtggtgaaactactcaccaaaccgtgggatgtaatcccgatggtaacacagatcgctatgactgacaccaccccatttggtcaacaacgcgtttttaaggaaaaagtagacacacgaactcctaaagccaaaagaggaacagcacaaataatggaagtaactgcaaaatggttatggggatttttatctaggaacaagaaacctagaatttgtacacgcgaagaatttacacggaaagttagatcgaatgctgcgatcggagcagttttcgtggacgagaaccaatggaacagtgctaaggaagcggtagaagatgagagattctgggacctagttcacagagaacgcgaattacataaacaaggaaagtgtgcaacatgcgtatataacatgatgggtaaacgtgagaagaaactgggtgagttcggcaaagctaaaggaagcagagccatatggtatatgtggttaggcgccagatttctagagttcgaagcgttaggattcatgaacgaggatcactggttttctcgagaaaatagtttatcgggggtcgaaggtgaagggttacataagctaggctatatattaagagacatctcaaatataccaggcggcaatatgtatgcagatgataccgctggttgggacactagaatcacggaagacgacttacaaaacgaggcgaggataacagacatcatggagccagaacatgcactacttgccaagtcaatatttaaactaacctatcaaaataaggtagtcagggtacaacggccagccaaaaatggtacagttatggatgtcatttctcgtagagaccaaagaggatcaggacaagtagggacttacggcttaaatacttttaccaacatggaagcacaattgataagacaaatggaaagcgaaggcatatttagccccagtgaactggaaaccccaaatctagccgaaagggttttagactggttagagaaatatggtgtagaacgtttaaaacgaatggccatatcaggagacgactgtgtcgtgaaaccaatcgatgatagattcgcaactgctttgactgctcttaatgatatgggaaaagtacgaaaagatataccccaatgggaaccgtcaaaaggatggaacgattggcaacaggtgcctttttgcagccatcattttcatcaacttattatgaaagacggcagggaaatcgtagtaccatgcagaaatcaagatgagctcgtgggaagggcaagagtaagccagggagcaggatggagtctgcgagaaactgcgtgccttggtaagagctacgcacaaatgtggcaattaatgtatttccataggagagatctaagactcgcagccaatgccatctgttcagcagttccggtagactggattccaacaagtcgaactacatggagcattcatgcgcatcaccaatggatgacaacggaggatatgttatcagtctggaacagggtttggatcgaagagaacccgtggatggaagataagacacatataagcagctggggagacgtaccataccttggaaagcgtgaagatcaatggtgtggttctttaattggactaacagcacgagcaacttgggcaacgaacatacaagtggctataaaccaagtaagaagactcatcgggaacgaaaattatttagactacatgacatccatgaaaaggtttaagaatgaatctgaccctgaaggagctctatggtga

SEQ ID NO: 21461 - RNA, 9879 nt, synthetic construct
  misc_feature 1..9879: note = derived and/or modified CDS sequence (opt6) from DENV-1__EU677151__SS-prME
  source 1..9879: mol_type = other RNA
tcggtaacgatgctattgatgctaatccctacggcattagcatttcatctgacaacccgcggtggggaaccgcacatgattgtatcaaaacaggaacgaggaaaatcgttactattcaaaaccagtgccggagtgaatatgtgtacattgatagctatggacttaggagaattatgtgaagatactatgacatacaaatgtccaagaataactgaggtggaacctgatgacgttgattgctggtgtaatacaacagatacttgggtaacatatggtacatgttcgcagacaggggagcaccgaagggataaaagaagtgtcgcgctcgccccacatgttggactgggactagagaccagagcagaaacatggatgagcagcgaaggtgcatggaaacagatccagaaagtcgaaacttgggcattaagacatcccggatttactgtaatagccttgtttctagcgcacgcgataggcaccagcatcactcaaaaagggataatctttatcctactaatgctagtcactccctcaatggcaatgagatgcgtcgggattggaagccgtgattttgtggaaggtcttagcggggcaacatgggtagatgtagttttagaacatggcagctgcgtaactacaatggcaaaagataaaccgaccctggacatagaattgttaaaaacagaagtgacgaatccagcggtattaagaaaattatgtatcgaagcgaagatttccaatacaactacagactcgagatgtccaacacaaggagaagctaccctagttgaagaacaggacgcaaatttcgtgtgccgcaggaccttcgtagatcgaggttggggaaacgggtgcggattgttcggtaaaggctctctaataacatgtgcgaaattcaaatgtgtaacgaaattggaggggaaaatagtgcagtatgaaaacttaaaatattcagttattgtgactgtacatacaggcgatcagcatcaagtcggtaatgaatcaaccgaacatggaacaacagcaacgatcacaccccaagcacctacatcagaaatacagctcactgattacggcgctctcacccttgattgttctccgcgaacaggattagactttaacgagatggtgttgttaactatgaaggaaaaatcgtggttggtccataaacagtggtttttggatttacctcttccgtggacttcaggcgctagcacctcccaagaaacctggaaccgacaagatctccttgtcacattcaaaactgcccacgccaagaaacaggaggtagtcgtactaggaagtcaagaaggagcaatgcatacagcattaactggagcgacagagatccaaacgtcaggaacaacaaccatttttgctggccacttgaaatgcagacttaaaatggataaactcactctaaaaggaatgtcctacgtgatgtgtaccggcagttttaaactcgaaaaggaagtcgcggaaacacaacacgggacagtacttgtacaaataaaatatgaaggaacagatgccccttgtaaaattcctttttccacacaagacgagaaaggagtcactcaaaatggtagactaatcacagcaaatccgattgtaactgacaaagaaaaacctgtcaacatagaagcggaacctccgttcggagaatcatatatagttatcggcgctggagaaaaagcactaaaactaagttggtttaagaagggatcaagcatcgggaaaatgttcgaggctactgcaaggggagcgcgacgcatggctatattaggggatactgcttgggacttcggtagcatcggtggagttttcacgtcagtgggaaaattagttcatcagatattcggtactgcttatggtgtactttttagtggagtatcttggacaatgaaaatcggtataggtgtacttttgacatggctcggactaaatagtcgatcaacttcattaagcatgacctgtattgcagtaggactggtaacgctatacctaggtgttatggtacaggccgattcaggatgcgtaataaactggaagggtagagaactcaaatgtggaagtgggattttcgtgacaaatgaggtccacacatggacggaacaatataagtttcaagcagacagtccaaaacgtctatcggcagcgataggaaaagcgtgggaagaaggggtttgtgggataagatcggcaaccagattagagaatatcatgtggcgacaaattagtaatgaattgaatcacatactcctggagaacgatatgaagttcactgtcgtggtaggggacgtagttggaatcctagctcaaggtaagaaaatgatccgacctcaacctatggaacataaatactcatggaaaagttgggggaaggctaaaataatcggtgccgacgttcagaatactacctttatcattgacggtcccaacacacctgaatgccctgacgatcaaagagcctggaatatctgggaggtggaagattatggattcggaatctttacgactaacatttggctcaaactaagggattcatatacacaggtgtgcgaccatagattaatgtcagcagctataaaagactcgaaagctgttcatgcagacatgggatattggatagaatctgagaaaaatgaaacatggaaattggcaagagcatcgtttattgaagtaaagacatgtatctggccgaaaagtcatacactatggagcaatggagtattggaaagcgagatgattattcccaaaatttacggaggaccaattagtcaacacaactatcggccaggttatttcacgcaaactgcaggtccttggcacttgggtaaattggaactcgatttcgacctctgtgaaggaactactgtagtcgtggacgaacattgcggaaatcgaggagcatcattaagaaccacgacagtgactggtaagataattcatgagtggtgctgtagaagttgtactttgccacctttacgcttcaaaggagaagacggctgttggtatggaatggaaattaggccggtaaaagaaaaagaagaaaacctagtaaaaagtatggttagtgctggatctggtgaagtagattctttttcattgggcttactttgtatcagtataatgatcgaggaggttatgcgtagtaggtggagtagaaaaatgctaatgactggtaccttggcagtgttcttcctcctgattatgggacagttaacatggaatgatctcattagaagttgcataatggtcggagcgaacgcttccgacaggatgggtatgggaacaacatacttagcattgatggccactttcaaaatgcgacctatggttgcagtaggattactctttagacgattaacgtcgagggaagttctactcttaactataggtctttccttagtagcatcggtagaattacctaactcgttagaggaacttggtgacggcctagcgatgggcatcatgattttgaaactattaactgattttcaatcttaccaactttgggctacattattatcgttaacctttataaaaactaccttttcgctccattatgcttggaagacaatggccatggtactatcaatagtaagtctactacctctctgtcttagtacaactagccaaaagaccacttggttacctgtattgctaggaagcctgggttgtaaaccactaacgatgtttctgatagcggaaaataagatctggggaagaaaatcctggccacttaatgaaggaatcatggcagtcggaatcgtatcaatccttcttagtagtttgttgaaaaacgacgtcccactggcggggcccctaatagctggaggtatgctgatagcatgttacgtgattagcggtagttcagctgacctatcactagagaaagctgcagaagtaagttgggaagaggaggcagaacacagtggcgcaagtcataatatcttagtagaagtccaagacgatggcacaatgaaaataaaagatgaggaacgagatgataccctaacaattctgttaaaagcaactctacttgcagtatcaggcgtttatcctttaagcattccagcgaccctgttcgtttggtacttttggcagaaaaagaaacaaaggagcggggtgctttgggatactccatctccaccagaagtagaacgagcggtcctagacgatggtatctatagaatcatgcaacggggtttattaggcagatcccaggtaggagtcggagttttccaagagaacgtttttcatactatgtggcatgtgacaagaggtgctgtactaatgtatcaaggcaaacggctagagccgagttgggcatctgtgaagaaagacttaatttcatacggcgggggttggagactacaaggaagctggaacactggagaagaagttcaagtaattgcggtagaacccggcaaaaatccaaagaatgtgcagacagccccgggcaccttcaagactccagaaggagaagtcggtgcaatcgcattggactttaaaccagggactagcggatcacctattgttaatagagaagggaaaatagtgggattatatggcaatggagttgtaacaacttccgggacatatgtaagtgcaattgctcaagcaaaggcttctcaagaaggacctctgcctgaaattgaggatgaagtgtttcgaaaaaggaatttaactataatggatctacatcccgggtcaggaaaaacacgtagatacttaccggctatagtgcgagaagcaataaaacgtaaactacgtacgttaattcttgcaccgactcgagtcgtggcatccgaaatggctgaggcgttaaaagggatgccaatcagataccaaaccactgcagtaaaatcggaacacacaggtagagaaatagtagacttgatgtgccacgcaacgtttactatgagactattgtctcccgttagagtgccaaactataatatgatcattatggatgaggcgcacttcacagatccttctagcatagcagccagaggttacataagtaccagagtagggatgggcgaggcagcagccatcttcatgactgccacacctccgggtagtgtggaggcttttcctcaatcgaatgctgttattcaagatgaagaacgagatataccagaacgctcatggaacagcggctatgaatggataactgatttccccgggaaaactgtatggttcgtaccatcaataaagtcaggaaacgacattgcaaactgtctcagaaagaatggcaagcgtgtaattcaattatcaagaaagacttttgacacagaatatcagaaaacgaaaaataatgactgggactacgttgtcacaacagacataagtgaaatgggtgcgaattttagagcagatcgtgttattgaccctagacgctgcttaaaacccgtaatactaaaagatggaccagaaagggtaatactagcaggccccatgcctgttacagtagcttctgctgcacaaagaagaggtagaatagggcgaaaccacaataaagagggcgatcaatatatatatatgggtcagccattaaacaacgacgaggaccacgcacattggacagaagctaaaatgctacttgacaacataaatacaccggaaggtataattccggcactcttcgagccagaacgagagaagtctgcagcaattgacggtgaatatagactaagaggcgaagcgcgtaaaactttcgtcgaattgatgagaaggggtgaccttcctgtttggctcagttacaaagtcgcctcagaaggatttcaatattcggacagacgatggtgtttcgacggtgaaagaaataatcaagtcttagaagagaacatggatgtagagatatggactaaagaaggagaaaggaagaaacttagaccgaggtggttagatgcgagaacatattctgatccactagctttacgtgaatttaaagagttcgctgctggtcggcgctccgtctctggcgatctcatattagaaattggcaagttaccccagcacttgacacaaagagcccagaacgcgttagataatctcgtgatgctacacaatagcgaacaaggaggaagggcttatagacatgcaatggaagaactaccggatacaatagaaactctaatgttactggcattaattgcagtactaacaggaggagtaacattgtttttcttgtccgggagaggactaggcaaaaccagtatcgggctattatgtgttatggctagttcggcccttttatggatggcatcagtagaacctcattggattgcagcatcgataattttagagttctttttaatggtcttgttaatacctgaaccggatcgccaaagaactccgcaagacaaccaactagcctacgtcgtcatcggtttactgttcatgatattgacggttgctgcgaacgaaatgggtttacttgaaacgacgaagaaagacttaggaatcggtcatgtagcggtagaaaatcatcaccacgctacaatgttagatgtagatttacaccccgcaagcgcatggacactatacgcagtagcaactacgataataacgcctatgatgagacacaccattgagaacacgacagctaatatttcgttaacagcaatagcaaatcaagctgccatattaatggggctggacaaaggatggccaataagtaaaatggacattggggtaccccttttagcacttggttgttactcacaggtaaatcccctaaccttaactgctgccgtattaatgctggtagctcactacgcgataattggtccaggactgcaagcaaaagcaactagagaggctcagaagcgaacggcagccggaataatgaaaaatcccacagtagacggcatagtagcaattgacctcgatccagtagtgtacgatgcaaaatttgaaaaacagcttgggcaaatcatgttactcatcttatgtacgtctcaaatactattaatgagaactacatgggcactctgtgaatctataacactggctacagggccactaactactttatgggaaggatcgcctggaaaattctggaatactacgatcgccgtgtcaatggcgaatatttttagaggcagctatttagctggtgccggattagcttttagcctcatgaaatcattaggcggtgggagaagaggtacaggcgcacagggcgaaactctaggcgagaaatggaaaagacaactgaaccagttaagtaaaagcgaatttaatacctacaaacggtcgggtataatggaagtagatcgatctgaagccaaagaaggattaaggagaggagaaacaacaaagcatgccgtttcacgaggcacggctaaactgaggtggtttgtggaacgaaacctagttaaacctgaagggaaagtcatagacttaggctgcggtagaggaggatggtcttactattgcgcagggttgaaaaaggtgacagaagtcaaaggttacactaaaggcggcccgggacacgaagaaccaattcccatggcaacatatggatggaatttagtgaaactgcatagtggaaaggatgttttcttcataccacccgagaaatgtgatactctcctttgtgacataggcgaatccagccccaatccaactatagaagaaggaagaaccctacgtgtattgaaaatggtagagccgtggttaaggggcaatcaattctgcataaaaatcttgaatccttacatgccatccgtagtcgaaacattagaacagatgcaaagaaaacacgggggaatgctagtaaggaaccccctttcccggaactcaactcatgaaatgtattgggtttcatgcggaacaggtaatatagtctctgcagtaaatatgacatctaggatgctactaaatcgtttcactatggcacatagaaaacccacatacgaaagagatgtagatttgggtgcaggtactagacatgtcgctgtggaacctgaagttgctaacttggatattataggacaaaggatagaaaatattaaacatgaacacaaatcaacgtggcattacgatgaggataatccatataaaacttgggcttaccacggatcttatgaggtcaaaccatctggatcagcgagcagtatggtcaatggtgtagtaaaattacttactaaaccatgggatgtgataccaatggttacacaaatagctatgacagacactactccatttggacagcaaagggtttttaaggaaaaggttgatacaaggacgccaaaagctaagagaggaacagctcaaatcatggaagttacggcaagatggctttggggattccttagcagaaacaagaagccgaggatctgtacacgagaagaatttactcgtaaggtacgatcgaacgctgcgattggagctgtatttgttgatgaaaaccaatggaactcagcgaaagaagccgtagaggacgagcgtttttgggatttggttcaccgagaaagagaactccataaacagggaaaatgtgctacatgcgtatataacatgatgggtaaaagggagaagaaattaggcgagttcggaaaggcaaagggctccagagcaatatggtatatgtggttaggagctaggtttttagaatttgaagcattaggctttatgaacgaagatcattggttctcacgagaaaacagtctttctggagtagaaggcgaaggattgcacaaattggggtatatattaagagatatttccaaaattccaggaggtaatatgtatgctgacgatacagctggctgggacacacggataacagaagatgatcttcaaaatgaggccaagataacagatataatggaacccgaacacgcgcttctggcaacatccatattcaagttgacttatcaaaacaaggttgtaagagtacaaagaccagcccggaatggcactgtaatggatgttatcagtagacgggatcaacgagggagcggtcaagttgggacatacggccttaatacgttcacaaacatggaagcccaattaatacgccaaatggaatcagaaggtatctttagtccttccgagctagaaacaccgaaccttgctgaaagagtgttagattggttagaaaaacacggggtagaaagacttaagagaatggcgatatcaggcgatgactgcgtggtcaaacctatcgatgacagatttgccacagcattgagtgctcttaatgacatgggtaaggtgcggaaggacatacctcaatgggaaccatcaaaaggatggaatgactggcaacaggtacctttctgcagccaccatttccatcagctaataatgaaggatggtagggagatcgtagtcccgtgtagaaatcaagacgaattggtagggcgagctcgtgtatcacaaggagcaggatggagccttcgagaaactgcgtgtctgggaaaatcctatgcgcagatgtggcagcttatgtattttcacagaagagatttgaggttggcagctaacgctatatgctcagcagtacctgtggattgggtgcctacaagtaggacaacctggagcatacacgctcaccaccaatggatgactacggaagatatgctgagtgtatggaaccgggtatggattgaggagaatccgtggatggaggataaaacacacattagtagttggggagatgttccgtacctaggtaaaagagaggaccaatggtgcggttcattgatcggcttaaccgcaagagctacgtgggcaacaaacatccaagtagccattaatcaggttcgaaggctaatcggaaacgaaaattatttagattacatgacaagtatgaaaagattcaaaaacgagtcggatcctgagggcgcgttgtggtga

SEQ ID NO: 21462 - RNA, 9879 nt, synthetic construct
  misc_feature 1..9879: note = derived and/or modified CDS sequence (opt6) from DENV-1__EU677152__SS-prME
  source 1..9879: mol_type = other RNA
tccgtaacgatgctactaatgctgatgccaacggctctagcgtttcatttaactacgcgtgggggtgaaccccatatgatcgtcagtaaacaagaacgaggaaagtctctcttatttaaaacttcggctggggtaaacatgtgtactttgattgccatggacttaggcgaattttgcgaagatacaatgacttacaagtgcccaaggataactgaagctgaaccagacgatgtggattgttggtgtaatgcaacagatacatgggtaacttatgggacgtgcagccaaacaggagagcatcgtagggataaacgaagtgtagctcttgcacctcatgtcggcttgggtcttgaaactagaactgagacttggatgagttcggaaggcgcctggaaacaaatccagcgagtggagacctgggcattgaggcatccaggatttacagtgattgccttgtttttagcacatgcgatagggacatcaataacacaaaaaggaataatatttatattactaatgctcgtgacaccttccatggcaatgaggtgcgtaggaattggttcacgagattttgtagaaggtctgtcaggagccacatgggttgacgtagttttagaacatgggagctgcgtgacaactatggcaaaggataaaccgactctggatatagaactacttaaaacagaagtaacaaatccagccgtccttagaaaactgtgtatcgaagctaaaatttctaatacgactacagattcaagatgtccaacacaaggagaagccaccctagtggaagaacaagatgctaactttgtatgcagacgtactttcgttgatcgtggttggggcaacgggtgcggtctatttggtaaaggctcgttgataacttgcgctaaattcaaatgtgttaccaagttagaagggaaaacggtacaatatgaaaacttaaaatactccgtaattgttaccgtgcatacaggagatcaacatcaagtgggaaatgaatcaacagaacacggtaccactgcgacaattacacctcaagccccgagtacagaaatccaattaaccgattacggagcgctaacgctcgactgcagccctagaactggtttagacttcaacgaaatggtcctactaactatgaaagaaaaatcctggcttgttcacaaacaatggtttctcgatcttccgcttccatggactagcggtgcttctacatcacaagagacgtggaatagaaaagatttattagtaactttcaagaccgcgcacgccaaaaagcaagaagtcgtcgtactaggaagccaggagggagcaatgcacaccgccttgacaggggccactgaaattcaaacgtccggaacaaccacaatatttgcaggtcatttgaaatgtcgccttaagatggataaactaacactaaaggggatgagttacgtcatgtgcacaggtagcttcaagttagaaaaagaggtcgcagagacccaacacggaactgtccttgtgcaaataaaatatgagggtacagatgccccctgcaaaataccattttcaactcaagacgagaaaggagtcacgcaaaatgggaggcttattacagcgaacccgatagtaactgacaaagagaaaccagtcaatatagaagctgaaccgccatttggagaaagctatatagtcataggcgccggtgaaaaagcattaaaactctcatggttcaagaaaggatcaagtattggtaagatgttcgaagctacagcaagaggggccagaagaatggctattttaggtgatacggcttgggattttggttccattggtggcgtatttacaagtgtaggtaagctagtacaccagatatttggaacagcttacggtgtactgttttctggtgttagctggaccatgaagataggaataggagtactattaacttggttaggtcttaacagtaggagtacatcactaagtatgacatgtatagctgtagggttagtcactttatacctgggagtaatggttcaggccgacagcggctgtgtgatcaattggaagggtagagaattaaagtgtggaagcggtatttttgtgacaaacgaagtgcacacctggactgaacaatataaattccaggcagactcgccaaaacgattatccgcagccataggaaaagcatgggaggaaggtgtatgtggtatacgatctgccactagattagaaaacattatgtggaaacaaattagtaatgaattgaaccatatccttttggaaaatgacatgaagtttactgtagttgtcggagacgtggcaggcatcttagcacagggcaagaaaatgatcaggccacaaccgatggagtacaaatactcgtggaaatcttggggtaaagcaaaaatcataggcgcagatgtacaaaacacaacctttatcatagacggccctaacacaccggaatgtcccgatgaccaacgagcctggaacatatgggaggtagaagattatgggttcggcattttcactaccaatatttggctaaaactcagagactcatacacccaggtctgcgatcacagattgatgtccgcggcaattaaagattcgaaagctgttcatgcagatatgggctattggatagaatcggagaaaaatgaaacctggaaactggcaagagcctcttttatcgaagtcaaaacgtgcatatggcccaaaagtcacactctctggagtaacggtgtactcgaaagtgaaatgataattcccaaaatttatggaggacctataagccaacacaactaccgacccggatattttacgcaaacagcgggaccctggcatctggggaaacttgaactagattttgacttatgtgaaggaacgactgtagtagtagacgaacattgcgggaatagaggcccatctctgcgaaccacgacagtcacaggcaaaattatacatgaatggtgttgccgttcttgtacattaccaccgttacgctttaaaggcgaagatggctgttggtacggaatggaaatacgccccgtaaaagaaaaagaagagaatctagtcaagtcgatggttagtgcagggtccggagaagtagattctttcagtttaggtctgctgtgcataagcataatgattgaagaagtaatgcggtctaggtggtctcgaaaaatgctaatgactggaaccttagcagtgttctttctattgattatgggtcagctcacgtggaacgatttaatacgattgtgcattatggttggtgcaaacgccagcgacagaatgggcatgggtactacttatttggcattaatggctactttcaaaatgagaccaatgtttgctgtgggattgctatttcgcagattgacctctcgtgaagtcctactcctaaccattggtttaagtctggtagcgagtgtcgagctacccaacagcctggaggaactaggagatggtcttgcaatgggcattatgatattgaagttactcacagattttcaatcccatcaattgtgggcgacccttctaagtctaacattcataaaaacaacattcagcttgcattatgcgtggaaaactatggctatggtgttatcaatagtatctctgttccccctttgcttatcaacaacatcccagaaaacaacctggctacctgtattgcttggaagtttaggatgtaaaccactgacaatgtttctcatagcggagaacaagatttggggaagaaaatcgtggcctcttaatgagggaatcatggctgtaggcatcgtttcaatcctcctttcatcacttctgaagaatgatgtaccattagcaggacctctcatcgcagggggtatgctgatagcatgctatgtgatttcagggtcaagcgcagatttatctctggaaaaagctgctgaagtaagttgggaagaggaggcagaacactcaggggctagtcacaacattttagtggaagttcaagatgatggaacgatgaagattaaagatgaagaaagggatgacacacttacaatactattaaaagcaaccttattggcagtatcaggagtataccccttgtccatccccgctacacttttcgtttggtacttctggcagaagaagaagcaaaggtctggagtactatgggacacaccatcgcccccagaagtagagagggccgttttggatgatggtatatatcgtataatgcaaagagggttactaggccggagccaggtcggagttggtgttttccaagagaatgtattccacaccatgtggcatgtaactagaggcgctgtacttatgtatcagggaaaaagattagagccatcttgggcaagtgttaagaaagatctaattagttatggaggagggtggcgattacaaggatcttggaacactggtgaagaagtacaggtgattgctgtagagccagggaaaaatcccaaaaacgttcaaacagcacctggaacctttaaaacatctgaaggtgaagtaggagccattgcgttagattttaagccaggtacgtcaggctctccaatagtaaacagagaaggaaaaatagttggattgtacggaaacggagtggtaacgacaagtggtacatacgtaagtgcaatagctcaagctaaagcaagtcaggaaggaccactacctgagatagaggatgaagtttttagaaagaggaatctaactataatggacctgcatcctggctcaggtaaaacgcgtcgatatctccctgctatcgtacgtgaagccatcaaacgaaagctaagaactttgatcttagcaccgacccgagttgttgccagtgaaatggccgaagctctaaaaggcatgccaatacgatatcaaactacagcggtaaagtcagaacacaccggaaaggaaatcgtcgatctgatgtgtcatgcaacctttaccatgagattattatctcctgtgagagtacctaattataacatgattataatggatgaagcacatttcacagatccgagttcaatcgcagcaagaggatacattagcacgagagtcggaatgggagaagctgccgcaatcttcatgacagcgacaccaccgggttcagtcgaagcatttcctcagtctaatgctgttattcaagatgaagaaagagatatcccagagcgatcttggaacagcggttatgagtggattactgattttccgggaaaaactgtgtggttcgtcccaagcataaagtccggaaacgatattgcgaactgtttaaggaaaaatgggaaaagagtaattcaattgagtagaaaaactttcgatacggaatatcaaaagactaaaaacaatgactgggactacgtagtcacaacggatatttcagaaatgggagccaactttagagcagatagagttatagacccaagacgatgccttaagccagtcatacttaaagatggaccagaacgagtcatattagccggaccaatgccggttacggttgctagcgcagcacaaaggcgcggacgtataggacgaaaccacaataaagaaggagatcaatatatctatatgggtcaaccattaaataatgacgaagatcatgcacactggacggaagcgaaaatgttacttgataatatcaacactcccgagggaatcattcctgcattattcgaaccagaaagagagaaaagcgcagcaattgacggcgaatatcgactcagaggagaggctaggaaaacatttgtggaacttatgagacgtggtgacctaccagtttggctctcatacaaggtagcttctgaaggcttccaatatagtgatcgtcgttggtgcttcgacggagaaagaaacaatcaagtactcgaggaaaacatggacgtagaaatttggactaaagagggcgaaaggaagaagctaaggccgcgatggttagacgcaagaacatacagcgacccactagcactgagagagttcaaagagtttgctgctgggcgtcgaagtgtgtcaggagatctaattttggaaataggcaaattaccccaacacttaacccagcgagcccaaaacgctctagacaacttagtgatgctgcacaactcagagcagggaggcagagcgtataggcatgcaatggaagaactacctgatactatcgagacgcttatgctattggcgttgatagctgtattaactggtggggtaactttattctttctttctggtagaggattaggcaaaacctctataggattgctatgtgtcatggctagtagcgtcttactatggatggcttcagttgaaccccactggattgcggccagtataatacttgagttctttctaatggtacttttaataccggaaccagacagacagcgaaccccacaggataatcaattagcgtatgtggtaataggtctgctttttatgatattaaccgttgcggcgaatgaaatgggacttctggaaactactaagaaagatctaggtattggacacgcggcagtagaaaatcaccatcatgcggcaatgttagacgttgaccttcatcctgcaagcgcttggaccttatatgcagtggctactacgatcattactcctatgatgcggcacacaattgaaaatacaacggctaacataagtttgacagctattgcaaatcaggctgcaatcttaatgggtttagataagggttggcccatttcaaaaatggatattggcgttcctttgttagctctaggctgctactcccaagtaaacccgctaaccctcacggctgccgtgttaatgctagtggcacattatgcgataataggtcctggtctacaagctaaagcgacacgagaagcgcagaaaaggactgcagcaggaataatgaaaaatcctacggtagatggaattgttgcaattgatttagatccggtagtttatgatgccaaatttgaaaaacaattgggtcagataatgctattgatcttatgtacctcacaaattttgctgatgaggactacttgggcattgtgcgaaagcatcaccctagcaactggaccactaacaacattgtgggagggatcgccaggtaagttttggaacacaacgatagcagtcagtatggcgaatatattccggggatcatatttggcgggggctggactcgctttttcactaatgaaatccttaggagggggaagacgaggtactggcgcacagggagaaaccttgggtgaaaaatggaagagacagttgaaccaattaagtaaaagtgaatttaatacctataagcgatcaggaataatggaagtagataggtcagaagctaaagaaggtttaaagaggggagaaactacaaagcatgctgtaagtagagggacagcaaaattgcgttggtttgtcgaacgcaatttagttaagccagaagggaaagtgatagatctaggatgtggaagaggaggttggtcttactattgtgcagggctcaagaaagtcacagaagtaaaaggatatactaaaggcggaccaggccacgaagaacccataccgatggcgacatatggatggaatcttgttaaacttcattcagggaaagatgtattctttataccacctgaaaaatgcgatacgctactatgcgatattggcgagtcatccccaaaccccacaatagaagaaggtagaacattacgggtactaaagatggtagaaccatggctaagaggaaaccaattctgtattaaaatattaaatccatacatgccatctgtagtagaaacattggaacagatgcaaagaaaacacggaggtatgcttgtccgtaaccccctatcacgtaattccacacatgaaatgtattgggtgtcctgtggaacgggaaacattgtaagtgctgtaaatatgacgagccgaatgttattaaatagattcacaatggcacatagaaagccaacatacgaaagagatgtggacctaggtgctggtacaagacatgtggcggttgagccggaagttgcgaatctggacattatcgggcaaagaatcgaaaatatcaaacacgaacacaagagtacctggcattatgacgaagataacccttataaaacgtgggcgtatcatggaagctatgaagtaaaaccttcaggatcagctagcagcatggtaaatggtgtggtgaagttgttaactaagccctgggatgtaatcccgatggtcacccaaatagcaatgacagataccacaccttttggtcaacagcgcgttttcaaagaaaaagtcgacaccagaactccaaaagccaaacgagggacagcacaaataatggaggtcacggctaaatggctctggggcttcttatcacgaaataagaaaccaaggatatgtacaagagaagaatttacacgtaaagtacgttctaacgcagcgataggagccgttttcgttgacgagaatcagtggaatagtgctaaagaagcagtagaagacgaacgattttgggatctagtccaccgagaaagagaactgcataagcaaggaaaatgcgcgacgtgcgtctataatatgatggggaaacgagagaagaaattgggagagtttggtaaagcaaaaggatccagagcaatatggtatatgtggctaggagcacgatttcttgagtttgaagcattaggcttcatgaatgaagatcattggtttagcagagagaatagtttgagcggtgtagagggtgaaggtttacataaattgggatacatacttagagatataagcaaaataccaggaggaaatatgtatgctgatgatacagctggatgggatacgagaattacagaagacgatttacaaaacgaagcaaaaataaccgatatcatggaaccagaacacgctttgctagcaaaatcaatattcaaattgacttatcagaataaagtagttagagtccaaaggccagctaaaaatgggactgtaatggatgttatttcacgaagagatcaaagaggtagtggacaggttggtacctacggtctaaatacatttacgaatatggaagcacaattaataagacaaatggaatcagaaggcatattttccccgagcgaattggaaactcctaatttagctggtagggtgctagattggttagagaaacacggtgtagaaagattaaaaagaatggccatatcaggagacgactgcgtcgtcaaacccatagacgacagattcgccacggcattaacagcactaaatgacatggggaaggtaagaaaagatatcccccaatgggaaccatcaaaaggctggaacgactggcaacaagtacctttctgcagccaccatttccatcagcttataatgaaggacgggagggaaatagtagtgccatgtaggaatcaagacgaattggttggccgtgcaagagtctcccaaggggcgggatggagcctaagagaaacagcatgtttgggtaagtcttatgctcaaatgtggcaattgatgtattttcatagacgagatctaagactcgctgctaatgcaatatgttcagccgtaccagtggattgggtaccgacaagcagaaccacttggtccattcatgctcatcaccaatggatgacaactgaagacatgttatccgtgtggaatcgagtctggatagaagaaaacccatggatggaagataaaacacatatatcaagctggggagatgttccatatttaggtaagcgtgaagatcaatggtgtggaagcctgatagggctcacggcgagagctacttgggctacaaacatacaagttgctataaaccaggtaagacgcctaatcggtaatgaaaattacctagactacatgacttctatgaaaaggtttaaaaacgaaagcgaccctgaaggcgcactctggtaa

SEQ ID NO: 21463 - RNA, 9879 nt, synthetic construct
  misc_feature 1..9879: note = derived and/or modified CDS sequence (opt6) from DENV-1__EU677155__SS-prME
  source 1..9879: mol_type = other RNA
tcggtaactatgctgttaatgttgatgcccactgcactcgcttttcatttaactacacggggtggagaacctcatatgatcgtaagtaaacaagaaaggggaaaatccttattgttcaaaacatcagcaggagtaaacatgtgtacccttatcgcaatggacttaggagaactgtgtgaagatactatgacctacaaatgtccacgaattaccgaaaccgaaccggacgatgtggactgctggtgtaacgcgaccgacacgtgggtaacctacgggacatgctcccagactggcgaacatcggcgtgataaacgaagtgtagcattagcacctcatgtgggattaggcctagaaacgcgtacagaaacctggatgtcttcagaaggagcatggaaacaaatacaacgtgtagaaacgtgggcattgcggcatccagggtttacagtgatagctctgtttttagctcatgctataggtacaagtataacgcaaaaaggaattatctttatactgctaatgcttgtaaccccttcgatggcaatgagatgtgtgggcattggatcgagggactttgtagaaggacttagcggtgcaacatgggtagacgtagtgttagaacatggaagttgtgtaacgactatggcaaaagacaaaccaacattggatatagaattgttaaaaaccgaggtaacaaatcccgcggttctacgcaaactgtgcatcgaagccaaaattagtaacaccacgactgattcgagatgtccaactcaaggtgaagccaccttagtcgaagaacaggatgcaaactttgtctgtcgtagaacatttgtcgatagaggctggggaaatggatgtggtttatttggtaaagggagtttaataacctgcgcaaaatttaaatgcgtaacaaaactagaaggtaaaatagttcaatatgaaaacctaaaatattcagtaatagtaaccgtacatacaggcgaccaacaccaagtcggcaacgagtcgacagagcacgggacaactgccacaattacccctcaagcaccaacaacagaaatacaattaactgactacggtgctctcactttagactgcagtccacgcacgggactggatttcaatgagatggtcctgcttacaatgaaagaaaaatcttggttggtacataaacaatggtttctagacttaccacttccatggacaagtggagcgtcaacaagtcaggaaacctggaatcgtcaggatctattagtgacttttaaaacggcacatgccaagaaacaggaagtagttgttctaggatcacaggaaggagccatgcacaccgcactgacgggggctacggaaatacaaacttctggcactaccacaatttttgctggacacttgaaatgtaggctgaaaatggataaactcactctaaagggaatgagctatgtaatgtgtacaggatcctttaaactcgaaaaagaagtagcggagacccaacacggaacagttctggtccagataaaatatgagggtactgacgctccatgcaagatccctttttcaactcaagacgaaaagggggttactcaaaacggaaggcttatcacggcgaaccctattgttactgacaaagaaaaacccgtgaacatagaagcagaacctccgtttggtgaatcgtacatagtaatcggagcaggggaaaaagccctaaaactgtcatggtttaagaaaggtagtagcataggcaaaatgttcgaggctactgcaagaggggccagacgaatggcgatattgggagatactgcctgggacttcggaagtatagggggagtttttacctcggtgggtaagctggtgcatcaaattttcggtaccgcctatggagtcctctttagtggggtttcttggacaatgaaaattggtataggagtgttattaacgtggttgggtctaaattcacgaagtacttcccttagtatgacatgtatcgcagttggcctagtaactctatatttaggagtaatggtgcaagcagatagcgggtgcgtaataaactggaaagggagagaattgaaatgtggatcaggcatttttgtcacaaatgaagtacatacgtggacagaacagtacaaatttcaagcggactcccctaaacggctttcggctgcaataggaaaagcatgggaggaaggtgtctgtggtattagaagtgcgacaagattagagaatattatgtggaaacagatctctaatgaactgaatcacattttactagaaaatgatatgaaatttactgttgtagtaggtgacgtggcaggtatacttgctcaaggaaagaagatgatccgacctcaaccaatggaatacaaatacagttggaaatcctggggtaaagccaagataattggagcagatgtccagaatactacatttataattgatggaccgaacacacccgaatgtccggatgatcaacgagcatggaatatatgggaagtcgaagattacggatttgggattttcacgactaatatttggctaaaattaagggattcatatacccaagtttgcgatcatcgactaatgagtgcagcaattaaagattccaaagcagttcacgcagacatgggatattggattgaaagtgagaagaacgaaacatggaaattagctagggctagttttatcgaagtcaagacatgtatatggccaaaatctcatactttatggagtaacggagtactggaatctgaaatgataattccaaaaatttatgggggacccatatcacaacacaattaccgccctggatacttcacccaaactgcaggtccatggcacttgggaaaattagaattagatttcgacttatgcgaaggaacaactgtagtagtggatgaacactgcggaaacagagggccatcattaaggacaacaaccgtaactggtaaaataatacatgaatggtgctgtcgatcatgtaccctacccccgctccgcttccgaggagaagacggatgctggtacggtatggagataaggccagtaaaagaaaaggaagagaatttggttaaatctatggtcagtgccgggtcaggagaagttgactccttttcactgggcctgctgtgcatctccattatgatagaggaagtaatgcgatctcgatggagccgcaaaatgttaatgaccggtactctggccgtattcttcctattaatcatgggacaactgacctggaacgatcttatcagattgtgcatcatggtaggggcgaacgcgtctgatcgaatgggaatgggaaccacatatttagctcttatggcaacgtttaaaatgcgacctatgtttgcggtcggattactttttaggagactgacctcccgtgaagtccttctgttgacaataggtttaagtttagtagcatcagtagaattaccaaatagtttagaagaacttggagatggattggctatggggatcatgattctcaaattattgacagacttccaatcgcatcaattatgggcaacccttctaagtctaacttttataaaaactacattcagtttacactacgcctggaaaacaatggccatggtcctatcaattgtttccctgtttccactatgtctatccacaaccagccagaaaactacttggttaccagtacttcttggatcattagggtgcaaacccctaactatgtttttaatcgcagagaataaaatttgggggcgaagaagttggccattgaacgaaggaatcatggcagtaggaatcgtaagtatattactatcttcattacttaaaaatgacgtgccattagcgggaccactaattgccggtggaatgctgatcgcatgttatgtaatttcagggtcctccgcagacttatcacttgagaaagccgctgaagtatcttgggaggaagaagccgaacatagtgggacctcacacaatatcttagtcgaagtacaggatgatggaacaatgaaaataaaagatgaagaaagagacgatacgttgacgattttgttgaaggccacattattagcagtatccggagtctatccgctttctatacccgcaaccttatttgtttggtacttttggcagaagaagaaacagcgaagcggtgtgttatgggatacgccaagtccccctgaggtcgaacgagcagttctagatgacggtatttatcgtattatgcaaaggggtttactaggacgttcacaagtaggagtaggtgtatttcaagaaaatgttttccacacgatgtggcacgtgacaaggggagccgtactaatgtatcaaggaaaaaggttagagcctagttgggcgagtgtcaagaaagatttaatatcatatggaggcgggtggagattacaaggaagctggaatacaggagaagaagtacaagtcatagcagttgagccgggcaagaaccctaaaaatgtccaaaccgcaccaggaaccttcaaaacacctgagggagaggtaggtgctattgcattagactttaaaccgggtacatccggaagccctatagtgaaccgagaggggaaaattgttggactatacggtaatggagtagtaaccacaagtggaacgtacgtatcggcgattgcgcaagccaaagcatcacaagagggacccctacccgagatagaagacgaggtatttaggaaaagaaacttgacaattatggacttacatccgggttcaggtaagactcgaagatacctacccgctatagtgcgagaagcaataaaaagaaaactcaggaccctcatattagctcccactagagtcgtagctagcgaaatggccgaggcactaaaaggcatgccgataaggtaccagactactgcagtcaaatccgaacacacaggaaaagaaattgtagatctcatgtgtcacgcaactttcaccatgcggcttttatcaccggttagagtccctaattacaacatgattataatggatgaagctcattttaccgatccatcaagtatcgcggctaggggatatattagtacaagagtaggaatgggtgaagctgcagccatctttatgacagcaacaccacctgggtcggtggaggcgtttcctcaaagtaacgcggttatccaagatgaagagagagatatacctgaacgctcatggaacagtggatatgaatggattacagattttccaggtaagaccgtatggttcgtaccgtcaattaaatcaggaaatgatatagcgaattgtctacgtaaaaatggtaaaagggtgattcaacttagtagaaaaaccttcgacactgagtatcagaaaactaaaaacaacgactgggattacgtcgtaacaactgacatctcagaaatgggagcgaattttagagctgatcgggtcatcgatccgagaagatgtttaaagcctgtgattttaaaagacggacctgaacgggtcatactagcagggcccatgccggtaacagtggcgagtgcggcacaaaggagagggcgcatcggtagaaatcacaataaggagggagatcaatacatatatatggggcaaccgctaaataatgacgaagatcatgcgcactggacggaggccaaaatgctactagataatatcaacactccagaaggcattatacctgccctgtttgagccagaacgtgaaaaatcagcagcaatcgatggagagtacagattgcgtggggaagcacgcaaaacttttgtcgaactaatgcgtagaggtgatctcccagtctggctgtcttataaagtagcaagtgaaggtttccaatactcagatagaagatggtgtttcgacggtgagagaaataatcaggtgctagaagaaaatatggatgtcgaaatatggacaaaagaaggagagagaaagaaattgagaccacgatggctagacgcacgcacatacagtgaccctctagcactgcgtgagttcaaagaatttgcagcaggtaggagatctgtttcaggagatctcattttagaaatcgggaagttaccccaacatttaacacagagagcacaaaatgccttagacaatctcgtcatgttacataattctgagcaaggtggcagggcttaccgccatgcgatggaagaacttcccgacacaattgaaacattgatgcttctagcactaatcgcagtgcttacaggcggcgttactctgttctttttaagtggaaggggcctaggaaaaacatccataggtctcctgtgcgtaatggcaagtagcgtattgttatggatggccagtgttgagcctcactggatagccgcgtcgatcatcttggagttcttcttaatggttctgctgataccagaaccagacagacaaagaactcctcaagataatcagctagcatatgtagtaataggacttttatttatgatacttacagtagctgctaacgaaatgggactcctggaaacaaccaagaaagacttaggaataggccatgtagcggtagaaaatcatcaccacgccgcaatgttagacgttgacttacaccctgcctctgcgtggactttatacgcagtggctactacaataattacacctatgatgagacatacgatagaaaataccacagccaatatttcgctaacggctatcgcaaatcaagctgctatattaatgggtctagacaaaggttggccgatttctaaaatggacatcggagtccctttattagctctcgggtgttattcacaggtaaatccactgactcttacagctgcagtactaatgttggtagcgcattatgctattataggtccaggtttacaagccaaagcaacacgtgaagctcaaaagcgaacagctgcaggcattatgaaaaaccctacagtagatggaatcgtagcaatagatctcgatcctgtagtctatgacgcaaaattcgagaaacagttgggacaaataatgcttctaatattatgtacctcacaaatacttttgatgaggactacatgggctttatgcgagagtattaccctagcaactggacctttaactaccctctgggaggggtcgccgggaaagttttggaatacaacgatagccgtaagtatggcaaacatcttcagaggctcatatctagcgggtgcagggctagcattttctctgatgaaatccctaggcggagggcgacgaggaactggagcacaaggagaaacgttaggagaaaaatggaaacgtcaattaaaccaactttcaaaaagcgagttcaacacatacaaaagaagtggaataatggaagtcgacagatcggaggcgaaggagggactaaaaagaggtgagacgacaaaacacgcggtatctagagggacagcaaagttaaggtggtttgtagaacgtaaccttgttaagcccgaaggcaaagtaattgacttgggttgtggaagaggtggatggtcatattattgcgcaggactgaagaaagtaaccgaggttaaaggatacactaaaggagggccaggtcatgaagaaccaattccgatggccacctatggatggaacttagttaaactacatagtggcaaagacgtgttctttatcccgccagaaaaatgtgacacattattatgtgatattggtgaatcaagtccgaatccaactattgaagaaggacgtacactaagagtattaaaaatggttgagccgtggctgaggggaaatcaattctgtataaagatactgaacccatacatgccctcggtcgttgaaaccctagaacaaatgcaacgcaaacacggagggatgctggtgagaaacccattaagtaggaacagtacgcatgaaatgtactgggtgtcatgtggtactggtaacattgtatcagcagttaacatgactagccgaatgttgttgaatagatttactatggcacatagaaaaccgacttatgaaagagatgttgatctaggagctggaacacgccacgttgcagtagaaccggaagtagcgaatttagacataatcggtcaaagaatagaaaatataaaacacgaacataaatccacttggcactacgatgaagataatccctataaaacgtgggcttatcacgggagttatgaagtaaaaccatcggggtcagccagttcaatggtaaacggagtagtaaagttattaactaaaccatgggatgtaattcctatggtaacgcaaatagctatgaccgacacaactccttttggacagcaaagagtttttaaagagaaagtggatacgcggacgccaaaagctaagcgaggcacagcccagataatggaagttaccgctaaatggctatggggatttttaagtaggaacaaaaagcctcggatttgcacaagagaagagttcactcggaaagttcgatctaatgcagctattggagcagtcttcgtagacgaaaaccaatggaatagcgcaaaagaagctgtagaagatgaaagattttgggatttggtacacagggaaagagaactacataaacaaggaaaatgcgcgacgtgcgtatataatatgatggggaaaagagagaagaaattgggtgaatttggcaaagcaaaaggtagccgggcaatatggtatatgtggcttggagcacgattcttagagtttgaggcattgggatttatgaatgaagatcactggttttcgagggaaaacagcttaagcggcgtggagggcgaggggttacataaactggggtacattctaagagatatctctaaaatacccggaggaaacatgtatgcagatgatacggctggttgggatacccgaataacagaagatgaccttcagaatgaagctcggattaccgacataatggagccagaacacgcacttctcgccggtagtattttcaaactaacataccagaataaagttgttcgtgtacaaaggcccgccaaaaatggcacagttatggatgtaatcagcaggcgagatcaaagaggtagcggtcaggttggcacatatggacttaacactttcactaacatggaagcacaactaattcgacaaatggaatccgaaggtatttttagcccgagcgaactagaaacaccaaatctagccgagagggtcctcgactggctggaaaaatatggggtagagcgattaaaacgaatggccatatcaggggatgactgtgttgttaagccaatagatgatcgctttgcgacagccttaacagcattaaacgatatgggaaaagttagaaaagatataccccaatgggagccctcaaaaggttggaatgattggcaacaagtaccattttgttctcatcactttcaccaattgataatgaaggatggacgcgaaatagtagttccctgtagaaaccaggatgaactcgtcggaagggcaagggtttctcagggcgctggatggagtctaagggaaacagcgtgcttaggtaagtcatacgctcagatgtggcaattaatgtattttcatcgaagggacctaaggttggccgcgaacgcaatctgttcagcagtaccagtagactggataccgacctcacgaactacgtggagcattcatgctcatcatcagtggatgacgacggaagacatgctatcagtttggaacagggtatggatagaagaaaatccttggatggaagacaaaacgcatatttcttcctggggcgatgtgccttatctcggaaaacgtgaagaccagtggtgcgggagcttaataggacttactgctagagccacttgggcaacaaacattcaagtcgccattaaccaagtacgaagacttataggcaatgaaaactatctagattatatgaccagcatgaaaaggtttaagaatgaatccgacccggagggagcgctctggtag

SEQ ID NO: 21464 - RNA, 9879 nt, synthetic construct
  misc_feature 1..9879: note = derived and/or modified CDS sequence (opt6) from DENV-1__EU677157__SS-prME
  source 1..9879: mol_type = other RNA
tcagtaaccatgctattgatgctaatgccaactgcattagcgtttcatctaaccacaagaggaggagaacctcatatgattgtaagtaaacaagaaagaggaaaatctctcttgttcaaaacctcagctggcgttaatatgtgtacgttaattgctatggacttaggagaactctgtgaagatactatgacatataaatgcccaagaataacagaaacagaaccggacgacgttgattgttggtgcaatgctactgatacatgggtaacatatggaacttgttcccaaactggtgaacaccgacgggataaaaggtcagtagcgcttgctccacatgtggggttgggactagaaacacgaacagaaacgtggatgagtagtgaaggggcctggaaacaaattcaaagagtcgaaacttgggccctgcgacatccaggcttcaccgttatagctctttttctcgctcatgcaataggaacgagcataacacaaaaagggattatctttatactactgatgcttgtaacaccatctatggcaatgagatgcgttggcataggttctagagacttcgtggaaggactttcaggagcaacttgggtcgatgtggtactggagcacggcagttgcgtaacaactatggctaaagataaaccaacacttgacatagaactcttaaaaacagaagttacaaacccagcggtactacgaaaactgtgcatagaggctaaaataagtaacacaacaactgattcacgttgcccaacacaaggtgaggccacattagtggaagaacaagacgcgaactttgtgtgcaggaggactttggttgataggggttggggtaacggatgcggtttattcggcaaaggatcattgatcacatgcgcaaagtttaaatgtgtcaccaagctggagggtaaaattgtacaatacgagaatcttaaatatagtgtgatagtcaccgttcacacaggtgatcaacatcaagtaggaaatgaaagtacagaacatggcacaacggcaacaatcacaccccaagctccaaccactgaaatacaattaacggactatggagcccttaccttggactgtagcccacgtaccggactcgatttcaacgaaatggtgcttttaacaatgaaggaaaagagttggctagtacacaagcaatggttcttagacctacctctaccctggacttctggagcaagtacgtcccaagaaacatggaatagacaagacctcctagtaactttcaaaacagctcatgcgaagaaacaagaagtagttgtccttggcagccaagaaggagctatgcacaccgccctaaccggagcaacagaaatccaaacgagtggaaccacgacaatcttcgcgggacatttaaaatgcagactaaaaatggataaacttactttgaaaggtatgtcttacgttatgtgtaccggcagcttcaaacttgagaaagaattggcagagacacaacacgggactgttctagttcaaattaaatatgagggaacagatgctccatgcaaaattccgttttcaacgcaagacgaaaaaggagtaacccaaaatgggagattgatcactgcgaatccaattgtgaccgataaagaaaaaccagtaaatatagaggctgaaccaccttttggcgagtcttacatcgtcataggagctggagaaaaagctcttaaactgagttggtttaaaaagggatcatccataggaaagatgttcgaagcaacagcccgtggagctcgacgaatggccattctgggagataccgcatgggactttggttcaatcggcggagtctttacatctgtaggaaaattggttcatcaaatctttggcacagcatacggtgtactattctcgggcgttagctggacaatgaagattgggattggtgtattgttaacgtggctcggtcttaatagccggtcaacatcactaagtatgacatgcatcgcggtcggattagttacattgtatttaggggtaatggtgcaagcggattcaggatgcgttatcaactggaagggtcgtgagcttaagtgtggaagcggtatctttgtcaccaacgaagtccacacatggaccgaacaatacaaatttcaggccgatagcccaaaacgtctctctgctgcaattggaaaagcatgggaagaaggtgtctgtggcattcgctcagccacaagattagaaaatattatgtggaagcaaatttcgaatgagctcaaccacattcttctagaaaatgacatgaaatttacggtggtagtcggagacgttgctggaatattagcacagggtaagaaaatgatacgcccccaaccaatggaatataagtattcatggaaaagttggggtaaggctaaaattattggagccgatgttcagaataccaccttcataatcgatggaccaaacacacctgagtgccctgatgatcaacgggcttggaacatttgggaggttgaagactatggatttgggatttttacaactaatatctggctaaagctccgagatagttatacccaagtttgcgatcatcgactaatgtctgcagccattaaggattcaaaagcggtacatgcagatatggggtactggatagaatccgagaaaaatgaaacatggaaactagctagagctagtttcatagaagtaaaaacttgtatatggcctaaaagccacacattgtggtccaacggagttctcgaaagtgaaatgattatacctaaaatatacggaggaccgatctctcaacacaactacaggccaggttattttacacaaaccgctggcccgtggcaccttgggaaacttgaactggattttgacttatgtgagggcacaaccgtagttgtcgacgaacactgtgggaatcgtggtccgtctctcagaacaactactgtaacaggcaaaataatccatgaatggtgttgtagatcgtgtacacttccacccttgagatttagaggagaggacggatgctggtatggaatggagatacgaccagtgaaggagaaagaagaaaatttagtaaagtccatggtctcagcaggaagcggagaagtagacagtttcagtttaggacttctctgcatatccattatgatagaagaggtaatgagaagtagatggtcaagaaagatgttaatgacaggtactttagcagtgttctttctactaattatgggccaactcacctggaacgaccttattaggttatgcatcatggtcggtgctaatgcaagtgatagaatgggtatgggcaccacttacttagcattaatggcaacgtttaaaatgagacccatgttcgcagtgggactgctctttagaagactcacatcgcgcgaggtactactccttacaataggcttgtcattagtagcctccgtagaattaccaaattccttagaggagcttggcgacggtctagctatgggaatcatgattttaaaactgctaacagacttccaatctcatcaattatgggcgactctattatctctaacatttatcaaaacaactttttcactccactacgcatggaaaactatggcgatggtacttagtatcgtgagtttgtttccattatgtttgtcaaccacatctcagaaaactacatggctgccggtattgctagggtcgcttggttgcaaaccattgacgatgtttctaatagcagaaaataaaatctgggggagaagaagttggccattaaatgaggggataatggctgtcggcatagtcagcattcttttaagctcgctattaaagaatgatgttccactagcaggcccgctaatagcaggaggaatgttaatagcgtgctatgttattagtggtagttcagcagacctgagcttggaaaaagccgccgaggtgtcttgggaagaagaagcagaacattcaggcgcaagtcataatattttggtagaagtacaagatgatgggactatgaagatcaaggatgaagaacgtgatgacacacttacaattctattaaaagctacattgttagcagttagcggtgtttatccgttaagtataccagcaacactgtttgtatggtatttttggcagaagaagaaacaaagatctggggtactatgggatacgccatcacccccagaagtagagagagccgttctagacgacgggatctatagaattatgcaaagaggactccttgggagaagccaagtcggagtcggagttttccaagaaaatgtttttcatacaatgtggcatgtcactagaggagcagttcttatgtatcaagggaaacgccttgaaccatcatgggcttcagtcaagaaagatttgatctcctacggtggtgggtggagattacaaggatcttggaacacgggtgaagaggtgcaagtcattgctgttgaacctggtaaaaatccgaaaaatgtacaaaccgccccaggtacattcaaaactcctgaaggagaggtcggtgcaattgcacttgattttaaacctggaaccagtgggagcccgatagtcaatcgagaaggaaaaatagttggactgtatggaaatggggttgtcaccacctcaggtacgtatgtttcagcaatcgcacaagcaaaagcgagtcaagaaggtccgctcccagagatagaggacgaagtttttcgtaaaagaaacttaaccataatggacctacacccaggctcgggtaaaactaggagatatctaccagcaattgttagagaagcgattaaacgcaaattacgaactttaatactagcacccactcgagtcgtggcaagtgaaatggccgaggcactaaaaggcatgccaataagataccagactacggcagtcaaatccgagcacacagggaaagaaatagtagatttgatgtgccatgctaccttcacgatgcggctcctttcaccggtaagagtaccaaattacaatatgataatcatggatgaagcacatttcaccgatcccagttcaatcgcagcccgagggtacattagtacgcgtgttggaatgggcgaggctgctgcaatttttatgactgcgacacctccagggagtgtagaagcgttcccgcaatcgaacgccgttattcaagatgaggagcgagatattccagaaaggtcttggaactctggatatgaatggataactgacttcccaggcaaaacagtgtggttcgtgccttcaattaaatcgggtaacgacatagcaaattgtctaaggaaaaatggcaagagagtgatacaactatcaagaaagacgtttgatacagaataccagaaaaccaagaataatgactgggattatgtggttacaaccgacatctcagagatgggcgcaaattttagagcagatagagtaattgatcctaggcgctgtcttaaaccggttatattaaaggacggaccagaacgcgtcatccttgcgggcccaatgccggttacggttgcatctgcagcacagcgccgaggacgaattggcagaaatcacaataaagaaggtgatcagtatatctacatggggcaaccacttaataatgatgaggatcatgcgcattggaccgaagctaagatgttgctcgacaacattaatacccctgaaggaataatacctgcattatttgaaccagaaagagaaaagtcggctgcaatagatggggaatatcgattacgaggggaagcgagaaaaacctttgtcgagctaatgaggagaggagatttacctgtatggctatcatataaagtggctagcgagggcttccaatactcagatagacgttggtgtttcgacggcgaacgaaataaccaagtattagaagaaaatatggatgtagaaatttggaccaaagaaggtgaacgtaagaaactaaggccaagatggctagatgcgcgaacatattccgatccattggctttaagagaatttaaagagttcgctgccggccggaggtcagtgagtggggatctaatactagaaatcggtaaattgccacaacatctaacgcaaagggctcagaatgcattagataatttagttatgctacataactccgaacagggaggcagggcttatagacatgcaatggaagaacttcctgatactatcgaaacacttatgttactcgcccttatcgctgtactgactggcggggttacgttatttttcttgagcggaagggggcttggaaaaacttctatcggtcttttatgcgtaatggcatcctcagttctactatggatggcatccgttgaaccacactggatagccgcatctataattttagagttctttctgatggtactactcatacctgaacccgatagacaaagaacaccacaagacaaccaattggcatacgtagttatcggattgttattcatgattctgactgttgcggcaaatgaaatgggactattagagactacgaagaaagatctaggaattggacatgtcgctgtcgaaaaccaccaccatgctgcaatgttggacgtggatctgcatccagcttctgcttggaccttatacgcagtggcgactactataataactccgatgatgagacacacaatagaaaatacgacagcaaacatatccctaacagcaatcgccaatcaggcagccatccttatgggattagataaaggatggccaatttcaaaaatggacatcggtgtaccactcttagctttgggatgttattcacaggtgaacccactaacattgacggccgccgtacttatgcttgttgcacactacgcgattatagggccgggtttacaagctaaagcaacccgtgaagcacaaaaacgaacagcagcaggaattatgaaaaatccaactgtagacgggatagtcgcaatagatttggatccagtagtgtacgatgcaaagtttgagaaacaactcggtcaaatcatgttactaatactatgtacatctcaaatactacttatgagaacgacttgggccttatgtgaaagcataactctcgcaacaggacccctaactaccctatgggagggaagtccaggcaagttttggaatactacaatagcagtatctatggcaaacatattcagagggagttacttagccggagctggattggcgttttcactaatgaagagtttgggaggtggccgacgtggtaccggagcacaaggagaaactttaggagaaaagtggaaacggcaactaaaccagcttagcaaatctgagtttaatacctacaagcgctctggtataatggaagtggatcgttcggaggccaaagaaggattgaaaagaggtgaaaccacaaaacatgcggtctctaggggaacggcaaaattgagatggttcgtagaaaggaatctggttaaacccgaaggaaaagtaatagatctaggatgcggaagaggaggctggagttattactgcgcaggcctgaagaaagtgacagaagtgaaggggtacactaaaggtggtcctggccacgaggaacctataccgatggctacatatggatggaacttagtaaaactacacagtggaaaagatgttttctttatacctccagagaagtgtgacaccttattatgtgacatcggtgaaagctcaccaaatcctactatagaagaaggacgtacacttagagtgttgaaaatggtagagccatggctaagaggtaatcaattctgcataaaaatattaaatccttacatgcctagtgttgtcgagactctagaacaaatgcaaaggaaacatggcgggatgctggtaagaaacccattgtcaagaaattcaactcacgagatgtactgggtaagttgtgggaccggtaatatagtgtcagccgttaatatgacaagcagaatgttgttaaatcggtttacaatggcacatagaaaacctacatatgaacgtgatgttgatttgggcgccggaacgagacacgttgcagtagaacccgaggttgcgaaccttgatatcataggtcagaggatagaaaatataaaacatgaacataaatcgacctggcattatgacgaagataacccttataaaacatgggcataccatggcagctatgaggttaagccttccggttccgcttcgagcatggtaaatggcgttgtaaaactactgacaaaaccttgggacgtaatacccatggtaacccagatagcaatgacagacaccacaccctttggtcagcaaagggtcttcaaagaaaaggtagacacccgaactccaaaagccaaaaggggtacagcacagatcatggaagtaacggcgaagtggttatgggggttcctttcaaggaataaaaagccacgcatttgtaccagagaagagtttacacgaaaagtcagaagtaatgcagcgatcggagcagtatttgtggacgaaaaccagtggaactctgctaaagaagcagtagaagatgaacgattttgggaccttgtacatcgcgaacgagaattacataaacaaggtaaatgcgcgacatgcgtatataatatgatgggtaagagagagaagaaactgggggagttcggcaaggcaaaaggtagccgagccatctggtacatgtggttaggagctagattccttgaatttgaggcactaggattcatgaatgaggatcactggtttagcagagaaaattccttatccggtgtagaaggcgaaggactacataagctcggatacatattaagggacattagcaagatccctggtggtaacatgtatgctgatgatacagctggttgggatacccggataacagaagacgatttgcaaaacgaagctcggataacagatatcatggaaccagaacatgcactattggcaaaaagtatattcaagttgacttatcagaacaaagtagttcgggtacagcggcccgccaagaatggtacggtaatggacgtgatttcacggcgagaccagagaggaagcggtcaagttggcacttacggtttgaatacgtttactaacatggaggcacagctgatacgacaaatggagagcgagggcatattttcaccgtccgaattagaaacaccgaatttagcaaaaagagtattggattggttggaaaagtatggagttgaaagattaaaaagaatggcgatatcgggagatgattgtgtggttaagccaatagacgataggttcgctacagcgctcacggcgctaaatgatatgggaaaagtgagaaaagatataccccaatgggaacctagtaaaggctggaacgattggcaacaagttcctttttgctcacatcattttcatcaactcatcatgaaagatggaagagagattgtagtgccatgtagaaaccaagacgaattagtaggacgggcacgggttagtcaaggagcaggttggagcctgcgggaaacagcttgtttaggaaaatcatatgcgcaaatgtggcaactaatgtattttcatagaagagacctgcgactagcagcgaacgcgatttgctcggctgtgcccgtagactggatcccaacaagcagaactacatggtcaatacatgcacaccatcaatggatgactaccgaagatatgctgtcggtctggaatagagtatggatagaagaaaacccatggatggaagacaaaactcacattagttcgtggggcgacgtaccttatttaggaaaaagagaagatcaatggtgcgggtctttaataggtttaacagccagggctacatgggcaacaaatatacaggtcgctattaaccaagtgcgaaggcttataggcaatgaaaactatctagactacatgacatctatgaaaagattcaaaaatgaatctgacccggaaggcgcattatggtaa

SEQ ID NO: 21465 - RNA, 9879 nt, synthetic construct
  misc_feature 1..9879: note = derived and/or modified CDS sequence (opt6) from DENV-1__EU677158__SS-prME
  source 1..9879: mol_type = other RNA
tcagtaactatgttattaatgctaatgccaacagcactggcatttcatcttactacacgaggcggagaacctcacatgatagtttctaaacaagaaagagggaaatcattgttattcaaaacttcagcaggagttaatatgtgcacgttgattgcaatggatctaggcgaattatgtgaagacacaatgacatacaaatgtccccgaatcaccgaaacagaacctgacgatgtagattgctggtgcaatgcaactgacacgtgggttacatatggaacatgttcccaaacaggcgaacacagaagagacaaacggagcgtagcacttgcaccccatgtaggattaggattggaaactaggacagaaacatggatgtcctcagaaggtgcatggaaacaaattcaaagagtagaaacatgggcattaagacatccagggttcacggtgattgctttattcctagctcacgcaataggtacatctatcactcaaaaaggtatcatctttatccttcttatgttagtcacgccgtcaatggcaatgagatgcgttggcattggttcaagggatttcgttgaaggtttatccggagctacgtgggttgatgtcgtattagaacatggttcgtgcgtcacaactatggcaaaagacaaaccgacactagatatagaactattaaaaactgaagttaccaatccagcagtattgcgaaaactatgcattgaggcaaaaatatcaaatacgacgactgacagtagatgcccaactcaaggggaagcaacccttgtggaagaacaagatgcaaatttcgtttgtcggagaactttcgttgacagaggttggggaaatgggtgtggactttttggaaaaggatcattaataacgtgtgctaaatttaaatgtgtcacaaaactagaaggtaaaatcgtacaatatgagaacctaaaatacagcgtaatagtaactgtccacactggtgatcaacaccaggtcggaaacgaaagcacggaacacggaactacagcaaccatcactccacaggcacctaccactgaaatacaactgacagactacggagcactcacactagattgtagcccaagaacgggacttgacttcaatgaaatggttttacttacgatgaaagagaaatcatggctggtacataaacaatggttcctcgatcttcctctaccttggacgtcaggtgcgtccacatctcaggagacttggaaccggcaagatctattagttacttttaaaacagcacatgccaagaaacaggaagtagtagtactcggctcacaagaaggagcaatgcacacagcgctaacaggagcgaccgaaatacagacgagtggcacaacaactatttttgcaggacacctgaaatgtagattgaaaatggataaattaactttgaaagggatgtcatatgtaatgtgcactggatcatttaaactagaaaaagaagtggcagaaacccaacacggaacggttttagtccaaattaaatacgaaggaaccgacgcaccctgtaaaatacctttccttactcaagacgagaaaggggtaacacagaatgggaggttgatcacggcgaatccgatagtaactgacaaagaaaaaccggttaatatagaagctgagcccccatttggtgaatcttatatcataataggcgcaggggagaaagctctaaaactatcctggttcaagaaaggatcttctataggcaaaatgttcgaagcaaccgcacgaggtgcgagaaggatggctattctaggagacaccgcatgggactttggatccataggcggtgtatttacttccgttgggaaattagttcaccaaatcttcgggacagcatatggggttctattttccggagtaagttggacaatgaaaatcgggattggagtattgttaacatggcttggattgaatagtcgtagcacatctctttccatgacatgcattgcggtcggattagtaaccttataccttggagtcatggtacaggcagactcaggttgtgtgattaattggaaaggaagagaacttaaatgcggaagcggaatatttgtgacaaacgaagttcatacgtggacagaacaatataaattccaggcagactcacctaaacggctgagtgcagctattggaaaggcttgggaagaaggagtgtgcggaatcagatctgccacacgtctagagaatattatgtggaaacaaattagtaatgaattaaaccatatacttttagagaatgatatgaaattcaccgtggtagtaggtgatgtagcagggatcctagctcaagggaagaaaatgatcagaccacaaccgatggaatataaatacagttggaaatcgtggggtaaagcgaaaataataggtgcagacgtgcaaaatacaacattcattatagacggtcctaatactccagagtgccctgatgaccaacgcgcatggaatatatgggaagtagaggattatggttttggaatatttacgactaatatttggttgaaattaagggattcgtatacacaggtctgtgaccacagactgatgtcggcggcaattaaagactctaaagcagtgcacgcagacatgggatattggatagaaagtgagaaaaatgaaacttggaaactggcccgcgcatctttcatcgaagtaaaaacatgcatctggccaaagtcgcacactctatggtccaatggtgtattagaatctgaaatgataatcccaaaaatttacgggggacctatatctcaacataattatcgaccgggatatttcactcagacagctggtccttggcatttaggtaaattggaattagattttgacttatgcgaaggcacaacggtggtagttgacgaacactgtggaaacagaggaccatcacttaggaccacaacggtcacaggcaagataatccatgaatggtgctgccgtagctgtacactcccacctctacggtttcggggcgaagacggttgctggtatggtatggaaataagacctgtaaaggaaaaagaagaaaatctcgtaaagtcaatggtaagtgctggatctggagaagtcgacagcttctctctaggtcttctctgtatatctatcataattgaagaagtaatgcgatcaaggtggagcagaaagatgttgatgactggaacccttgccgtatttgtcctgctgataatgggacagctaacatggaacgacctaatacgcttatgcataatggtgggtgcgaacgcaagtgatcgcatgggaatgggtacaacgtatttggccctaatggctacgtttaaaatgcgaccaatgtttgcagtaggtctattattcaggcgattaacatccagggaggtcttactgttgactattgggttatcgctggtcgcatcggtagaattaccgaatagtcttgaagaattaggcgatggactagctatgggcataatgatattgaagttgctaacagacttccaatctcaccagctttgggctacacttctctctttaaccttcattaaaacaactttctcactgcattacgcttggaagacgatggccatggtattgagcatagtttcattgttcccgttatgtttgagtacgacctcccaaaagactacctggttaccggtgttattaggttctcttggatgtaaaccactgacgatgttccttatagcagaaaacaaaatatggggaagaagaagttggcccttaaatgaaggcataatggctgtgggaatcgttagcatcttattgtccagcctactaaagaatgatgtgcccctggccggaccactaatcgctggcggtatgttgatcgcttgttatgtaatatcaggcagttctgcggacttaagtctcgagaaggccgcagaggtctcttgggaagaagaagccgagcatagtggagcaagtcataatatactcgtagaagttcaagatgacggtacaatgaaaataaaagatgaggaaagagacgatacgctgacaatcctacttaaagctacactacttgccgtgtcaggagtataccctctatctattccggctactttatttgtttggtatttctggcagaaaaagaaacaacgcagtggagtcttgtgggataccccgtctccaccagaagtagaacgagctgttctggacgacggtatttatagaatcatgcaaagaggccttctcgggcgttcacaagtgggggttggcgttttccaagagaacgtctttcacactatgtggcacgtaacaagaggcgcagtcttaatgtatcaggggaaacgcctagaaccttcctgggcaagcgttaagaaagacttaatctcatacgggggcggttggagacttcagggctcttggaatactggtgaagaagtacaagtgatcgccgtagaaccaggtaagaatccgaagaatgtgcagacagctccaggaacttttaaaacaccagaaggagaggtcggcgctatagcattagactttaaaccaggtacaagtgggagtcctatagttaatcgtgagggtaaaatcgttggactatatggaaacggagtcgtaacgacaagtggaacttacgtaagtgccatagcacaagccaaggcctcgcaagagggccctctcccagaaatagaagacgaagtatttcgaaaacgaaatttgacaataatggacttgcacccaggcagcgggaaaacaagacggtacctcccggctatagttagggaggccataaaacgaaaactgagaactctgattttagcgccgacaagagtagtggcatccgaaatggccgaggcgctcaaaggaatgcccataaggtaccagacaactgctgtaaagagtgaacacacaggcaaagaaattgttgatctaatgtgtcacgcaacctttacaatgcgtctcctatcaccagtaagagtccccaattataatatgataataatggatgaggcccattttacagatccttcaagtatagccgctaggggttatatcagtacaagagtgggaatgggtgaagcagcggccattttcatgacggccacgcctccaggctcggtagaagcctttccacagtcaaatgccgtaatacaagatgaggaaagggatattccggagagatcgtggaactcgggatatgaatggataaccgatttcccgggcaagactgtgtggtttgtacccagcataaaatcaggtaatgatatcgcgaactgtttaaggaaaaatggtaaaagggttatccaattatcacggaaaacttttgatacagaatatcaaaagactaaaaataacgattgggactatgttgttaccactgatatatccgaaatgggggcaaactttagagcagatagagttatagatccaaggaggtgtttaaaaccagtgatccttaaagatggaccggaaagagttatcctcgcaggaccgatgccagtaacagtagcgtccgcagcgcagagaagaggtagaatcgggagaaatcataataaagaaggagaccaatacatttacatgggccaacctttaaataatgatgaggaccatgctcattggacagaggccaaaatgcttttagataatattaacactccagaaggtataattccagccctatttgaacccgaaagagaaaaatcagctgcaatagatggagaatatcggcttagaggagaggcaagaaaaacatttgtcgagttgatgcgtagaggtgacttgcccgtatggttgtcatacaaagttgcctcagaaggttttcaatacagtgaccggcggtggtgttttgatggtgaaagaaataaccaagtcttagaagagaacatggatgtagaaatttggacaaaagaaggcgaacgaaagaaattacgaccacggtggttagacgctcgcacctacagcgatcccttagcattgagagaatttaaagagtttgcagcaggaagaaggtctgtttcgggtgaccttatcttggaaatcggaaaattgccacaacatttaacacaaagggcacaaaacgcgttagataatttagtaatgctacacaactcggaacaagggggtagggcgtatagacatgcaatggaggaattaccagacaccatagagactttaatgcttctcgcactaattgcagtcttaacaggaggagtcactttatttttcttaagcggtagggggctcggcaaaacgtctatcgggttactgtgtgtaatggcgtcatcagtcttactgtggatggcaagtgtggaacctcactggatagcagctagcattatcctggaatttttcctaatggtactattaataccggaaccagacaggcagcgcactccacaggataatcaactagcatatgtagtaataggactcctttttatgatcctcacagtagctgcaaacgaaatgggacttctagaaaccaccaagaaagatttaggcatcggtcatgtagccgtagagaaccaccatcatgccgcaatgctagacgtcgacttacaccccgcgtctgcatggacactttatgcagtagctacaacgattataactcccatgatgagacacacaattgaaaatacaaccgccaacattagcctaacagccattgcaaaccaagccgccattttaatgggattagataaagggtggcctatatcaaaaatggatattggggttccattgcttgcattaggatgctacagccaggttaacccactaactctgacagcagctgtgcttatgttagttgcacactatgcaataataggtccaggattacaagctaaagcgactagagaagcgcagaaaagaaccgctgcaggtattatgaaaaatccgacagttgacggaatcgttgctatcgacttagacccggtggtctatgacgcaaaatttgaaaaacaactcggtcaaataatgttactcatcctatgtacatctcaaatattgctcatgcgtaccacatgggcgctctgtgaatctataactctcgcaaccggcccactgacgaccctatgggagggatcaccaggtaagttttggaacactacaatcgccgtgtccatggctaatatatttcgtggttcttacttggccggggcaggtctagcattctcactcatgaaaagcctagggggtggaagaagaggtaccggagcccagggagaaacgcttggagaaaagtggaaacgtcaattaaatcagctttcaaaatcagaatttaacacttataaacgatctgggataatggaagttgatagatcagaagccaaagaaggattaaaaaggggagagacaaccaaacacgcagtatcacgcgggactgcaaagttgagatggttcgtagaacgaaacctagtaaagccagaaggaaaggtaattgatcttggttgtgggagaggcggttggtcatattattgtgccgggctcaagaaagtaacggaagtcaaaggatacactaaaggtggacctggtcatgaagaaccgatcccaatggcaacatacggttggaatttggtgaaactccacagcggaaaagacgtattctttataccgcccgagaaatgtgatacactattatgcgatataggggaatcctcaccaaacccaaccattgaagaaggacgtaccctaagggtactaaaaatggttgagccatggcttcgaggcaaccaattttgtataaaaatattaaatccatatatgcctagcgttgtcgaaactctagaacagatgcagcgtaaacatggtgggatgcttgtcaggaatccactatcacgcaactccactcacgaaatgtactgggtatcatgcggcacaggcaatatagtatcggcggtcaacatgacgtcaaggatgctattgaatagatttaccatggcccataggaaaccaacatatgaaagagatgttgacctaggagcaggtacacgacacgtagcagtagaaccggaggttgcaaacctcgacataataggccaaaggatagaaaatataaagcacgagcacaaaagtacgtggcactatgacgaagataacccatacaaaacctgggcctaccacggaagctatgaagtgaaacctagtggatcagcttcatctatggttaacggagtagttaaactattaaccaaaccgtgggacgtcatacctatggttacacaaattgccatgactgacacgaccccttttgggcaacagcgggtctttaaagaaaaagtggatactaggactccgaaagccaaaagaggaactgcacaaattatggaagtcacagccaagtggctctggggatttttaagtagaaacaagaaacccaggatatgcaccagagaagagttcacaaggaaagttagaagtaacgcagcaattggagccgtattcgtggacgaaaatcaatggaacagtgcaaaagaagctgtagaggatgaaagattttgggatttagttcaccgagagcgagagttgcacaagcaaggtaagtgcgcgacgtgcgtatataatatgatgggcaagagagagaagaaactgggtgaatttggaaaagccaagggttcgagagcaatttggtatatgtggttaggcgcccgattccttgagttcgaagcattaggatttatgaacgaagatcattggttttcgcgagaaaattcgctgagtggggtagaaggagaaggtttacataaattaggatacatcttaagagacataagtaaaataccgggcggaaacatgtacgctgatgatacagcaggatgggatacgagaataacagaagatgacttgcagaatgaggccagaattacggatataatggaaccagagcatgcactgctagccaagagcatcttcaagttaacctatcaaaataaagttgtgagagtgcaacgacccgccaaaaatggcactgttatggatgtaataagtaggcgagatcaaagaggctcgggacaagtaggaacctacggtctaaacacattcactaatatggaggcacagttaatcagacaaatggagtcggaaggaatattctccccaagcgaactagagactccaaaccttgctgaaagggtcctagactggcttgaaaaatatggagttgaacgcctgaaacgaatggctataagcggagacgattgtgtagtcaagccaatagacgataggtttgctacagcactaaccgcgcttaacgacatggggaaagtgagaaaggatatcccacaatgggaacctagtaaaggttggaacgattggcaacaagtaccattctgctcacaccattttcaccaactcataatgaaagatggacgcgagatagtagtcccgtgtaggaatcaagatgaattagtggggagagctagagtatcacaaggagcaggctggtcccttagagaaacagcctgtttaggtaagtcgtatgcgcagatgtggcaattaatgtatttccatagaagagatttaagattggctgcaaacgcaatatgttctgcagtcccagttgactggattcccacatcaagaactacgtggtcaattcacgcccaccaccaatggatgacaacagaagacatgttgtcagtgtggaatagagtctggatagaagagaacccttggatggaggataagacccatatatcttcatggggtgacgtaccttacttaggaaaaagagaggatcaatggtgtggatccctaatcgggctgacagcgcgagcaacctgggcaacgaatatccaagtagcaattaatcaagtgagacgtctcataggaaacgagaactatttagactacatgacatccatgaagcgatttaaaaatgaaggcgaccctgaaggcgcactatggtga

SEQ ID NO: 21466 - RNA, 9879 nt, synthetic construct
  misc_feature 1..9879: note = derived and/or modified CDS sequence (opt6) from DENV-1__EU677159__SS-prME
  source 1..9879: mol_type = other RNA
agtgttactatgctactaatgctgatgccgaccgcactagcatttcaccttacaactcgtggaggggaaccacacatgatagtatccaaacaagaaagaggtaaatcgttattattcaaaacttcagctggcgtaaacatgtgcacgctcattgctatggatctcggggaactatgcgaagacacaatgacatacaaatgtccgaggataaccgaagcagaaccagatgatgtggattgctggtgtaatgcaacagatacatgggtaacgtacggaacttgtagtcaaacgggtgaacatagaagggataaacgttctgtagctttggcaccccatgtaggattagggctagaaacgcgaactgaaacgtggatgtcatcggaaggagcgtggaaacaaatccaacgagtagaaacctgggctcttaggcatccaggattcacagtaatagcactgttcttagcacacgcaataggtacaagtataacccaaaaaggtataatatttatcctactaatgttagttaccccgtctatggcaatgaggtgcgtaggaataggtagtagagatttcgtagaaggattaagcggggcaacctgggtagatgtagtcctagaacacggatcgtgtgtaacaacgatggcaaaagacaaacccactctagatattgaactgctaaaaacagaggtcacaaatccagccgtattaagaaaattgtgtattgaagcaaaaataagcaacactacaactgattcccgctgcccaactcaaggggaagccacactcgtcgaagaacaagatgcaaatttcgtgtgtagaagaacattcgtagataggggttggggaaatggatgcggtctattcgggaaaggaagtttgattacgtgtgcgaaatttaaatgcgtaacaaaattagaaggaaaaatcgttcaatatgaaaatttaaaatacagtgttatagtgactgttcacactggtgatcaacaccaagttggtaacgaaagtacggaacacggcacaaccgccacgataacacctcaagcccctacaacggaaattcaactaactgattatggagcgttaacattggactgttccccaagaacaggactagattttaatgagatggtcttactcacaatgaaagaaaaatcatggcttgtacataaacaatggttccttgaccttccactgccttggacaagtggtgcaagcacatcccaagagacatggaacagacaagatctgttagtaacattcaaaaccgcacatgccaagaaacaagaagtggtcgtccttggttcgcaagaaggcgcgatgcacacggccttgacaggtgcaaccgaaattcaaacttcaggaactacaacaatcttcgctggtcatttaaaatgtagacttaaaatggataaattaacactaaaaggaatgtcctacgtgatgtgtacaggtagctttaaattggaaaaagaggtggccgaaacacaacatggtacagtacttgtgcaaattaaatatgaaggaacagatgctccatgcaaaataccattctcaacacaagatgaaaagggtgttacccaaaatggaagattaataacagcaaatcctattgtgactgataaagagaagccagtgaacattgaagctgagccaccctttggtgaatcgtacatagtgatcggtgcaggcgaaaaggctttaaaactgtcatggtttaagaaaggatcaagtataggaaaaatgtttgaagcaacagctcggggagcaaggcgcatggcgatattaggcgatacagcatgggacttcggctctataggtggagtattcacgagcgtgggcaagttagttcatcaaattttcggtacggcatatggcgtattgttctccggtgtaagttggactatgaaaattggaattggcgtcctcctaacctggcttggacttaatagtagaagtacaagtctgagcatgacttgcatcgcggttggcctagtgacgttatacttaggcgttatggttcaagctgatagtgggtgtgtaataaactggaagggcagagaactcaaatgtgggtcggggatctttgtcactaacgaagtacacacgtggacagaacaatataaatttcaagccgactcccctaagaggctatcggccgcaatagggaaggcttgggaagaaggagtttgtggtataagatccgcaaccagattagaaaacattatgtggaaacagatcagcaatgagctcaaccacatactactagagaatgatatgaagttaacggtagtagtaggcgatgtcgctggtatcctaggtcaaggcaagaaaatgattagacctcaaccaatggaatataaatacagttggaaatcatggggaaaagctaagatcattggagcagatgcacaaaacactacatttatcattgacggaccgaacacacccgaatgtccagacgatcagagagcatggaatatatgggaggtagaagattatggattcggaatctttacgacaaacatctggttgaaattaagagattcctacactcaagtttgtgaccacagattaatgagtgccgcaataaaagacagtaaagctgttcacgctgacatggggtactggatagaatcagagaaaaatgaaacttggaaattagcaagagcaagttttattgaggtaaaaacctgcatttggcccaaatctcatacgttatggtcgaacggcgtgttagaatcagaaatgatcataccaaaaatatatggtggaccaataagtcaacataactacagaccgggttacttcacgcaaactgcgggaccatggcacctcggaaagttagaactggactttgatctatgtgaaggtacaacggtagtcgtcgatgaacattgcggtaatagaggacccagtcttcgaacgacgacggttactggcaagataattcacgaatggtgctgcaggagttgcacattaccaccactgagattccgtggagaagatggatgctggtacgggatggaaatccgacccgtaaaagaaaaagaagaaaatcttgtaaagtctatggtaagcgccggaagcggtgaagtcgatagctttagtcttggtcttctctgtatttcaataatgatagaggaggttatgaggtcacgttggtctaggaaaatgctgatgactggtactctagcagtattctttttattaataatgggacaattaacatggaatgacctcattcgtctctgtataatggtcggagcgaatgcatcagaccgtatgggtatgggaaccacatatttagcactcatggcaacatttaaaatgaggcccatgttcgccgtaggactactatttcgtaggttaacgagtagggaagtacttttactaacaattgggttgtccttagttgcttccgtagagctaccaaacagtttagaggaactgggagacggcttagctatgggtataatgattcttaaattgcttacagattttcaatcacaccaactgtgggctactctactatcgctcacttttatcaaaactacctttagccttcactacgcctggaagactatggccatggttttatccatcgtttcgcttttccctctttgcctcagtaccacatctcaaaagacgacatggcttcccgtcttgctaggatcgctagggtgtaaacctcttaccatgtttctgatagctgaaaataaaatttggggacgaaaaagctggcctttgaatgagggaattatggcagtaggcatagtgtccattttgctttcaagtctcttgaaaaatgacgtcccactcgcggggccgttaattgccggcggcatgttaatagcatgttatgtcatatctggttcctcggcagacctttcactagagaaggcagccgaggtaagttgggaagaagaggcggaacactctggtgctagccataatatacttgtcgaagtacaggatgatggaacgatgaaaataaaggacgaagaacgagatgataccttaacaatactattaaaggccacattactggcagtatcaggagtgtaccccatatcaatacctgcaactctttttgtctggtatttttggcagaagaagaaacagagaagcggagtattatgggacacgcccagtcctcctgaggttgaacgagccgtgttagacgacggtatatataggataatgcaaaggggactactaggtcgcagtcaagtcggcgtaggagtattccaagagaatgtattccatacaatgtggcatgtaacccgaggggctgtgttaatgtatcaaggtaaaagacttgaaccctcatgggcttccgtaaagaaagacctcataagctacgggggagggtggaggctacgaggttcatggaacacaggagaagaggtacaagtaatagctgtagaaccagggaaaaacccgaagaacgtccagacagcaccaggaacctttaaaactccagaaggcgaggtaggggctatcgcattagatttcaaaccaggaacaagtggttctccaattgtcaatagggaaggtaagatagtaggcttatacggtaacggcgtggttacaacttctggaacttatgtgtccgctatcgcacaagcaaaggccagtcaggaaggaccacttccagagatagaagatgaagtttttcgaaaacgtaaccttacgattatggacctacatccgggatctggcaaaacgagacgatacttgcctgcgatagtgcgagaagcgattaaacgaaaactaagaacacttattctagcccccactcgcgtggtggcatctgagatggcggaggcattaaaaggaatgccaatccgataccaaactacagcagtaaaatctgaacatactggaaaagaaattgtggatcttatgtgtcatgcaacatttacaatgcgtttgttgagcccagtcagagtacccaattacaacatgataataatggatgaagctcacttcacggatccatcgagcatagcggctagaggctacattagtaccagagtggggatgggtgaagccgcagctatttttatgacagccacgcctccaggttctgtagaagccttccctcaaagtaatgcagtaattcaagacgaggaacgagatattcctgaaagaagctggaactccggatacgagtggataacagatttcccaggcaagaccgtgtggtttgtccctagcataaaaagtggcaatgatattgcaaattgcttaaggaagaatggcaaacgcgtaatacagctgtcaaggaaaacgtttgacaccgaataccagaaaacgaaaaacaatgattgggattatgttgtaaccactgatatttctgagatgggagctaattttagagctgacagggttatcgatcctcgtagatgcttgaagcctgtcatactcaaggacggcccagaaagggttattctagccggcccaatgccggttactgtagcttctgcagctcaacggcgtgggcgcatcggaaggaatcacaataaagaaggggatcaatacatatacatgggacaaccgttgaataatgatgaagatcatgctcattggaccgaagccaaaatgttattggataacattaatacacccgaaggaataattccagcacttttcgaacctgaaagagagaaaagcgctgctgtcgatggtgaatatcgtttaagaggtgaagcacgcaaaacattcgtcgagttaatgcgaagaggggatttgccagtttggctttcctataaagtagcttcagaaggttttcaatatagcgatcgaagatggtgctttgacggggagcgtaacaatcaagttttagaagaaaatatggacgttgaaatctggacaaaggaaggagaacgaaagaaattaaggccaagatggttagacgcaaggacatacagtgatcccctggcgcttcgtgagttcaaagagttcgcagcaggtaggcgatcggtatcgggcgatctaatattagaaataggaaaattacctcaacacttaactcaaagagcacagaatgcactagataatctagtaatgctacataatagtgaacaaggtggacgtgcttatcggcatgctatggaagaactacccgataccatcgagacacttatgttgttggctctaatcgcggtcttaacaggaggcgtgactttattctttttgagtgggagagggttaggaaaaacaagtattggattactttgcgtcatggcgtcaagtgtattactctggatggcgagcgtagagcctcattggatagcagcatccataatacttgagttctttctgatggtgttactaatccccgaacctgaccgtcaaagaacgcctcaagacaatcaattagcatatgtagttattggtctgcttttcatgatccttacagttgcagcaaacgaaatgggactgttagaaactaccaagaaagatttaggaataggacatgtagccgtggaaaaccaccaccacgctgccatgctggatgttgacttacacccagcctccgcatggacactttatgcagttgcaacaactataattacgccaatgatgcgacatacaatcgaaaacacaacagctaacatcagcttaacagctatagcaaatcaagcagcaatacttatgggtctagacaaaggttggcctattagtaaaatggatattggagtaccactacttgcgttgggctgttatagtcaggtcaaccctctcacactaacagctgcagtactaatgctcgtggcacactatgcgattatagggccaggattacaagctaaagccaccagagaggcacagaaacgtaccgccgcagggattatgaaaaaccccactgtggatggaatagttgctatagacttagaccccgtcgtttatgatgcaaagtttgaaaagcaattaggacaaatcatgttgctaatattgtgcacctcacaaatactattaatgagaaccacttgggcactatgtgagtcgatcaccttagccacagggccattgactacattatgggaaggtagtccgggcaaattttggaatacaacgattgccgtcagcatggcaaatatttttaggggtagttatcttgccggtgcaggattagcatttagccttatgaaaagtctcggtggtggtcgcagaggaaccggtgcacaaggtgaaacgttgggagaaaaatggaagaggcaattaaaccaactcagcaagtccgaatttaacacttacaaacgatcagggattatggaagttgaccgtagtgaagcaaaagaaggactaaaacgaggagaaaccacgaaacacgctgtctcacgaggcacggcaaagttaagatggtttgtcgaacgaaacctagtaaagccagaggggaaggtcatagatttaggttgcggaagagggggatggtcttactattgtgccggtctaaagaaagtaacggaagtaaagggttatactaaaggaggtcccggtcatgaagaaccaattccaatggcgacctacggctggaatctagtgaaattacattctgggaaggacgtattctttattcctccggaaaagtgcgataccttgctttgtgatataggagaaagcagtcctaatccaacaatagaagaaggacgaaccctgcgagtcctcaagatggttgaaccatggttacgcggcaatcaattttgtataaaaattcttaacccttacatgccttcggtcgtcgaggccctagagcagatgcaacggaagcatggaggaatgctggtacgtaacccattatcacgtaacagcactcatgagatgtattgggtttcctgcggaactgggaatatagtttctgccgtaaatatgaccagcagaatgctattaaatcgtttcacaatggcccatcgcaaacccacatatgagcgcgacgtagacttaggaacaggtaccagacacgtggctgtagaacccgaggtagcaaatttagatattatcggtcagaggattgaaaatatcaaacatgagcataaatcaacatggcactacgacgaagataacccttacaaaacttgggcctatcatggatcctacgaagtaaagccaagcggcagtgcatcctcgatggttaatggtgtagtaaaactcctaacaaaaccgtgggatgttatacccatggtaacacaaattgcgatgacagacactacaccgttcgggcaacaaagagtttttaaggagaaggtggatacgcgcacgccaaaagcgaaacggggaacagctcagataatggaagttacggcacgctggctatgggggtttctatctagaaataagaaacctcgcatatgtacgcgagaagaatttacaagaaaggttagatcaaacgcagcaataggtgcagtgttcgtcgatgaaaatcagtggaacagtgctaaagaagcagtagaggatgaacggttctgggacctggttcatagagaacgtgaactacataaacagggcaaatgcgcaacttgcgtctacaacatgatgggtaaaagagagaagaaacttggcgaatttggaaaggccaaaggatccagagcaatttggtatatgtggctcggtgcacgattcttagagtttgaggccttgggttttatgaatgaagaccactggttcagtcgagaaaatagtctgagcggtgttgagggagaagggctacataaattaggatatatactacgtgatatttctaagatccccggaggcaatatgtacgcggatgataccgccggttgggatacgagaatcactgaagatgacttacaaaacgaggctaagataacggatataatggaaccagaacatgccctactggcaaaggcgattttcaaactcacatatcagaacaaagtcgtgcgagtacaacgaccagccaaaaacggaaccgttatggacgttataagcagacgagaccaaaggggaagtggccaagtcggtacatacggcctcaatactttcactaacatggaagcacaactcattagacaaatggaaagcgaagggatattctctccttcagaacttgagacaccaaacctagcagagagagcactagattggttaggtaaatacggtgtagaaaggctcaaaagaatggccatctctggagatgactgtgtagtaaaacccatagacgacagatttgcaactgctttaacagcattgaatgatatggggaaagtaagaaaagatatcccccaatgggagcctagtaagggatggaatgattggcaacaagtccctttttgtagtcatcatttccatcagctaataatgaaggacggaagagagatagttgtgccctgtagaaatcaggacgaacttgtgggaagggcacgtgtgtctcaaggtgccggatggagtctgcgggaaactgcttgcctcggaaagagttatgctcaaatgtggcaattgatgtatttccatcgacgtgatctaagactagccgcaaacgcaatctgctccgccgtaccagtagattgggttccaacatcaagaacaacatggagtatacacgctcatcaccaatggatgacaaccgaagacatgttgtcagtttggaatcgcgtgtggatagaagaaaatccgtggatggaagataaaacccacatatcaagttgggaggatgtcccgtatctaggaaagcgagaagaccaatggtgtggatcactaataggtcttacagcaagagcgacttgggcaactaacattcaagttgcgattaaccaagtccgtagattaataggcaatgaaaactacttagattatatgatctcaatgaaaagatttaagaacgaatctgacccggaaggtgcactttggtaa

SEQ ID NO: 21467 - RNA, 9879 nt, synthetic construct
  misc_feature 1..9879: note = derived and/or modified CDS sequence (opt6) from DENV-1__EU677160__SS-prME
  source 1..9879: mol_type = other RNA
tctgtaactatgctcctaatgttaatgcctaccgccctagcattccatttaactacccgcggaggagaaccgcatatgattgtatccaagcaagaaagaggaaaatctctcttatttaagacgtctgccggtgtcaatatgtgcaccctaattgctatggatctaggggaattttgtgaagacacaatgacgtacaaatgtccaagaataaccgaggcggaaccagatgatgtagattgctggtgcaacgctactgacacctgggtgacctacggaacttgttcgcagactggggaacatagaagggataagcgatccgtggctctcgcaccacatgtaggtttaggtttagaaaccagaactgaaacgtggatgagctccgaaggtgcttggaaacaaattcaacgtgtcgaaacgtgggcccttcggcatcctggattcacagtcatagccttatttttggcccatgctataggaacatcgattacacaaaaaggaataatatttatattgttggttttggttacgccaagtatggcaatgaggtgtgtagggatagggtcgagagattttgttgaaggactaagcggagccacgtgggtagacgtagtattggaacatggctcatgcgttacgacaatggctaaagataagccaacattggatatagaactcctaaagacggaagttactaatccagcagtattaagaaagttgtgcattgaagcaaaaatatccaatactacaactgactcaagatgtccaactcaaggagaggctaccttagttgaggagcaagacgctaattttgtgtgtaggcggacatttgtagatagaggctggggaaacggttgcggactatttggtaaaggatctctgataacctgtgctaaatttaaatgcgtcaccaaactcgagggcaagaccgttcaatacgaaaatttaaaatatagtgtcatagtgacagtgcatacgggagaccaacatcaagtaggaaacgagtccaccgaacacggaacgactgccactataaccccacaagcgccaagtactgagatacaattgaccgattacggtgcacttacattagattgtagtcctaggaccggacttgactttaatgaaatggtattactcacgatgaaagagaagtcgtggcttgttcataaacaatggttcttagatttaccattaccatggacttcgggagcaagcacaagtcaagaaacatggaatagaaaagatcttttggtgactttcaaaacagctcatgccaagaaacaagaagtggtagtgttgggatcgcaagagggtgccatgcacacggccttaacaggtgcaactgagatccaaaccagcggaacaactacaatattcgccggacatttaaaatgcagactcaaaatggataaattgacgctaaaaggaatgagttacgtaatgtgcaccgggagttttaagttagaaaaagaggttgccgaaacccaacatggaacagtcctagtccaaataaagtatgaaggaacagatgcgccgtgtaagataccattctctacacaagatgaaaaaggagtaacacaaaatggtcgactaatcacggccaacccgatagtcacggataaagagaaaccagtcaatatagaagcagaaccaccatttggcgaaagttacatcgttataggagctggggagaaagctctaaaattgtcctggttcaagaagggaagttcaattggtaagatgtttgaagcgacagctcgtggggcacggagaatggctattctaggtgataccgcatgggactttggaagcataggtggtgtattcacttcagtcggaaaacttgttcatcaaatctttggcacagcatacggtgtattgttttcgggagtgtcatggacaatgaagataggaataggggttttgcttacatggctagggctcaattcgagaagtacctctctaagtatgacatgtatagcagtaggcttggtaactctctatttaggtgtaatggttcaagcggattcaggatgtgtcattaattggaaaggaagagagttgaagtgcgggagtggaatatttgttactaacgaagtgcatacatggactgaacaatataaattccaagcagattcaccaaaaaggctatcagcagccattggtaaggcatgggaggagggtgtttgtggtattcgtagtgctacacgactagaaaatataatgtggaaacagatatccaacgaactgaaccacattcttctagaaaacgacatgaaattcacagtagtagtgggagatgttgccggtattctagcacagggtaaaaagatgataagacctcaaccaatggaatacaaatattcgtggaaaagctggggaaaagctaaaattatcggagctgatgtacaaaacacaacattcattatagacggacctaatacccctgaatgcccagatgaccaaagagcatggaacatatgggaagtcgaagattatgggtttggtatatttacgacaaatatctggttaaaacttagggatagctatacacaggtatgtgaccacaggttaatgtcagcagcaataaaggactcaaaggcggtacacgcagatatgggttattggatagaaagcgagaaaaatgaaacttggaaattggcaagggctagctttattgaagttaaaacttgtatatggcctaaatcgcatacactatggtcaaacggtgttttggaatcagagatgattatccccaaaatatacgggggacctataagtcaacataattaccgtccaggatactttacacagaccgcaggaccatggcatttgggaaaattagaacttgatttcgacttgtgcgaaggaaccacagtggtcgtcgacgaacattgcggtaatagaggcccaagcctacgcactacaactgttacgggtaagataatccatgaatggtgctgccgttcatgcaccctaccaccattacgattcaaaggagaggatggttgttggtatgggatggaaataaggcctgtaaaggaaaaagaagagaacctagtaaaaagtctagtgtcagccggttctggagaagtagactcgtttagcctaggcttgttatgcatcagcataatgatagaagaagtaatgcggagccgatggagtagaaagatgcttatgactggcactctagcggtgttcttccttttaataatgggacaacttacttggaacgacctaattcggctatgtataatggtcggtgccaatgctagcgacagaatgggcatgggaacaacttacctagctttgatggcgacattcaaaatgcgaccaatgttcgcggttggactgttgtttcgacgacttacgtccagagaggtgttactcttgactataggactttctttagtggcttcggttgagttaccaaatagtttagaagaattaggagacggtctggctatgggaattatgatcttgaagctcctaacggacttccaatcccatcaactatgggcaacattgttatcgctaacattcatcaaaaccaccttcagtctacattacgcttggaagacgatggcaatggttttgtcaattgtttctttatttcccttatgtttatcaacaacatcgcagaaaactacgtggctaccggtattactcgggtcgttgggttgtaaaccactaacaatgtttctgattgccgaaaacaaaatctgggggcgaaaatcttggcctctaaatgagggtattatggcggttggtatcgtgtcgatactattaagtagcttactgaaaaacgatgtgcctcttgctggaccacttatagcgggtggtatgctgatagcatgttatgttattagtggctcaagtgcagatctatcattggaaaaggcagcagaagtatcatgggaggaagaagccgaacatagtggtgcttcgcacaatatattagtggaagtacaagacgacgggacaatgaagattaaagacgaggaaagggacgatactcttactatattactcaaggcaaccctactagctgtaagtggcgtctatccattaagcatacctgcaacactttttgtttggtacttttggcagaaaaagaaacaacgttccggggtattatgggatactccttcaccgccagaagttgaaagagcagttttagatgacggaatttacagaattatgcaaaggggactgcttggaaggtcacaagtaggagtgggagtgtttcaggaaaatgttttccatacaatgtggcacgttactcgtggtgccgttttgatgtatcaaggtaaacgattagagccgtcttgggcaagcgtgaagaaagatttaattagctacggcggaggatggagactacagggatcttggaataccggtgaagaagtacaagttatagcggtagaaccaggtaaaaatcccaaaaatgttcagactgcaccaggaacttttaaaacaagtgaaggagaggtcggagccatagcattagactttaaacccggaactagcggctctcccatcgtgaatagggaagggaaaatagttggcctttacggtaacggtgtagtaacgacgtctggtacctacgtctccgctatcgcgcaagcgaaagccagtcaagaaggcccgctaccagaaattgaagacgaggtgttccgaaaacgaaatcttactattatggatttacaccccggatccggtaaaaccagacgctatttaccggctattgtaagagaggcgattaaaagaaaattaagaactctcattttagcgccaacgagagttgtcgcatcggagatggcagaggcccttaaaggaatgccaatccgataccaaactacagctgtgaagtccgagcatactggcaaagaaatagtcgaccttatgtgtcacgccacgtttactatgagattgttatctccagtccgagttccaaattataatatgattattatggatgaagcccattttaccgatccaagttcaatagcggcgcgaggatatatatcaacaagagtaggaatgggtgaagctgctgctatctttatgacagctacgccaccgggatctgtagaggcttttccccagagtaacgctgtaatccaagacgaagaacgagacatacctgaaaggtcttggaacagcggatatgagtggattactgattttcccgggaagaccgtgtggttcgtaccatccattaaaagtggtaatgatatagctaactgtcttagaaagaacgggaagagagtaatccaattaagtcgaaaaacattcgatacagaatatcagaagacgaagaataacgattgggactatgtcgtcacgaccgacatatcggaaatgggtgcaaatttccgagcagacagagttatagacccaagaagatgtctgaagccagtaatcctgaaagatggtcctgaacgtgtcatactggccggtcctatgccagtcacagttgcctcggcagcgcaacgaagaggacgaatcggtagaaatcataataaggaaggtgatcaatatatatatatgggacaacctctaaataacgacgaagaccatgcacattggacagaagcgaaaatgttattggacaacattaacactccagaaggtataatacctgcgctgttcgaaccagaaagagaaaaatctgcggccattgatggcgaataccgactgcgtggtgaggctcgaaaaacgtttgttgaattgatgcgtagaggagacttaccagtgtggctatcgtataaagtggcgtcagaagggtttcaatatagtgacagaagatggtgttttgatggagaaagaaataaccaagtattagaagaaaatatggatgtcgagatatggacaaaagagggagaaaggaagaagttacgaccccgatggctagatgctcgaacatactctgacccgttagctctacgtgaatttaaggaatttgctgcaggtcggaggtcagtgtcaggggacctaatactagagatcggaaaattacctcaacatttaactcaaagagcacaaaacgctttggacaacctagttatgttacataacagtgagcagggtgggagagcataccgacacgctatggaagaacttcctgacacaatagagacgcttatgttgctggcgcttatagccgtactcactggtggagtaacactgttctttctttcagggcgagggctagggaaaacaagtataggtttattatgtgtaatggcatcttcagttttgctttggatggcaagcgtggaaccacactggatagccgcctcgataatcctcgagttctttctaatggttctcctgatccccgaaccagacaggcaaagaactccacaagataatcaactcgcatacgtagtgattggattactttttatgatactaacagtcgccgccaatgaaatgggactcctggaaaccacgaagaaagatttagggataggtcatgtggcagttgagaatcatcatcatgcagcgatgctcgacgtcgatctgcatccagcatcggcgtggacactgtatgccgtcgcaacaacaattattacacccatgatgagacacacaatagaaaatactacagctaatatcagcttaaccgcaatcgctaatcaagctgcgatactcatgggattagacaaagggtggcctatttctaaaatggatataggcgtgcctttattggcattaggctgctactcacaagtaaatcctttgactttaacagctgctgttttaatgttagtggcgcactatgcgataataggtcccggactacaagccaaagccacaagagaggcgcagaaaaggacggcagctggcataatgaaaaatcctacagtagatggtatagtagctattgacttggatcctgttgtctacgacgccaaatttgagaaacaactaggacaaattatgctactgatactatgtacatcccaaatcctactcatgcgtacaacgtgggcactatgtgaatctattacattagctaccggtccactaacaaccctatgggagggtagtccaggaaaattctggaatacaacgattgcagttagtatggcaaacatatttcgcggaagttaccttgcaggagcaggtttagccttttcattaatgaaatcgctaggagggggaagacgtgggaccggtgcgcaaggggaaacacttggagaaaagtggaaaaggcaattaaaccaattgtcgaaaagtgagttcaatacatacaaaaggagcggtataatggaagtcgatcgatccgaagcaaaggaaggactaaaacgtggagaaacaacaaagcatgctgtatccagaggtacggccaaattaagatggtttgtcgaaagaaatttagtaaagcctgagggtaaagtaatcgatcttggatgcgggagagggggatggtcatattactgtgcaggtcttaaaaaggtaactgaggtaaagggttacacaaaaggcggaccaggccatgaagaaccaattccaatggcaacttatggatggaacttggtaaaattgcacagtggaaaggacgtattctttattcccccagaaaaatgtgatacgcttttgtgtgatattggtgagagtagccctaaccctacaattgaggagggacgcaccttacgagtcctgaaaatggtagaaccttggttgcgaggtaatcaattctgtataaaaatactaaatccgtatatgccaagcgttgttgaaactctagaacaaatgcagaggaaacatggtggtatgctagtaagaaaccccttaagtcgcaatagtactcatgaaatgtattgggtatcttgcggtacaggaaacattgttagtgccgtcaatatgacatcacgaatgctactaaatcgatttactatggcacatcgcaaacctacctatgagagagacgtcgatttaggcgcaggaacaagacatgtcgcggtcgaacctgaggtcgcaaatttagatataattggacaaagaatagaaaacataaagcatgaacacaaaagcacatggcattacgacgaggataatccatacaaaacctgggcgtatcacggaagctacgaagtaaagccaagtggatcggcctcaagtatggtaaatggtgtagtgaaattacttaccaaaccgtgggatgtaattccaatggtgacgcaaatagcaatgacggatacaacgccttttggacaacagcgcgtattcaaggaaaaagtagatactagaacacctaaagctaaacggggaactgctcagataatggaagtaacagctaagtggttatggggctttctttctagaaacaagaagccacggatatgcacgagggaagagttcacgcgtaaagtcaggtccaacgctgcaataggagctgtattcgtcgatgaaaatcagtggaactctgcaaaagaagctgtagaagacgaaagattctgggatttggtgcacagagaacgggaactacataaacagggtaaatgcgcaacctgcgtatacaacatgatgggaaagcgagagaaaaagttaggggaatttggaaaagcaaaaggatctcgagccatttggtacatgtggctaggtgccagattcttagaatttgaagcgctgggatttatgaatgaagatcactggtttagtagagagaactcattaagtggtgttgaaggagaaggacttcacaaactcggctatatccttcgagacatatctaaaatccccggcgggaacatgtacgctgacgatacagcaggatgggacacgagaattacagaagatgatttacaaaacgaagccaaaataacagacatcatggagccagaacatgcgctattagccaaaagtatttttaaattaacgtaccaaaacaaggtggtaagagtacaaaggcccgctaagaacggtaccgttatggatgttataagccgacgcgaccaaaggggaagtggccaggtaggtacatacggacttaatacctttacaaatatggaagctcaattaataagacaaatggagtcggaaggaatattttcgccgagtgagctggaaacaccaaatctcgcaagaagagtattagattggctagagaaacacggagtcgaacgattaaagcgaatggcgatttccggtgacgattgtgtcgtaaaacccattgatgatagattcgcaacagcacttacggcacttaatgacatgggaaaagtaagaaaagatataccccaatgggaaccctcaaaaggatggaatgactggcagcaagttcctttttgctctcaccatttccatcaattaataatgaaggacggacgagaaatagttgtaccatgtcgcaatcaggacgaactcgtaggccgcgctagggtcagtcagggggctggatggtccttaagagagacggcctgcttaggtaagtcgtatgcacagatgtggcaattgatgtatttccatagaagagatcttaggctcgccgcgaacgccatatgtagcgctgttccggtggattgggtgcccacttcaaggactacatggtcaatacacgcgcatcatcaatggatgaccacagaagatatgcttagcgtctggaatcgcgtctggatagaggaaaatccctggatggaagacaaaactcacatttcttcttggggcgatgtaccatatttgggaaaacgagaagatcaatggtgtggatccttgatcggactaacagctcgggctacttgggcgacaaacatacaagtcgccattaaccaggtgaggagattgataggaaatgagaattatctggattatatgacatcgatgaaacgttttaaaaatgagtcagatcctgaaggagcactttggtag

SEQ ID NO: 21468 - RNA, 9879 nt, synthetic construct
  misc_feature 1..9879: note = derived and/or modified CDS sequence (opt6) from DENV-1__EU677162__SS-prME
  source 1..9879: mol_type = other RNA
agtgtaacaatgttattaatgttaatgccaacagcattggcgttccatcttaccactagaggtggagaaccgcatatgattgtttcaaaacaagaacgaggaaaaagccttttgtttaaaacatcggctggagtcaacatgtgtactctaatagccatggatctaggagaattttgcgaagatactatgacatataaatgtccgagaataacagaagcggagccagatgatgtggattgttggtgcaatgccactgacacttgggtaacatatggtacgtgtagtcaaactggcgaacataggcgtgataaaagaagtgtagccctagcgccacacgttggactgggtttggaaactagaacagagacatggatgagctctgaaggagcctggaaacaaatacaaagagttgagacttgggcactccgacatccagggttcacagtaatagcgctatttcttgctcatgcgatcggaacatctatcactcaaaaaggcattattttcattttacttatgttagtgacgccttcgatggcaatgcgatgcgttggtataggttcccgggattttgtagaaggactttccggggcaacatgggtagacgtagtcctagagcacggttcttgtgttacaacaatggcaaaagataaaccaactttagatatagaactattaaaaacagaagtcactaatccagctgtactaagaaaattatgtatagaagctaaaataagcaatactacgacggattctagatgccccacacaaggtgaagcaaccctggtcgaagaacaagacgccaatttcgtctgtcgacgaacctttgttgatagaggatgggggaacggttgtggtttgtttggaaaaggatcattaataacatgtgcaaaattcaaatgtgttaccaagttggagggaaagattgttcaatacgagaatctaaagtattcagtaatagttacagttcatacaggcgaccaacatcaagtcggaaatgaatctacagaacatggtacaactgctacaataactccccaagcgcctagtacagaaatccagttaacggactatggagcactgacgttagactgttcacctcgaacggggttggatttcaatgaaatggtactcttaaccatgaaagagaagtcgtggttggtgcacaagcaatggtttttagaccttcctttaccttggacttcgggggcatcgactagccaagagacatggaatagaaaagatctattagtaaccttcaagacggctcacgcgaaaaagcaagaggtcgttgtattagggagtcaagaaggtgcaatgcacacagccttgacgggagccacggaaatacaaacatctggtacaaccactatcttcgcgggtcacctaaagtgtagattgaaaatggataaattaacactgaagggaatgtcgtatgtaatgtgtacgggatcgttcaaacttgaaaaagaagtagcggagacccaacacggcacggtattagttcaaataaaatatgaaggaacagatgcaccgtgtaagatacccttttcaactcaagacgagaaaggagtgactcaaaacggacgcctaataaccgctaatcctatagttacagataaagagaaaccagtgaacattgaagcagagcctcccttcggagagtcgtatatagtaataggcgcaggcgaaaaagccttaaagctgtcgtggtttaagaaaggctcatcaataggacgtatgttcgaagccacggcgagaggagcaagacggatggcaatattgggagatacagcatgggactttggttccattggcggtgtatttacgtccgtgggcaaattagtacatcagatatttgggactgcatatggtgtattatttagtggcgttagttggactatgaaaataggtataggtgttttacttacctggttagggctaaattcacgatctacctcattatcaatgacatgcatcgctgtaggcttggttactttatatttaggggtgatggttcaagctgactcgggctgtgttataaactggaaaggcagagagctaaaatgcgggagcggaatcttcgttacgaacgaagtacacacttggacagagcaatataagtttcaagccgattcgcctaaacgactttcagcagcaataggtaaggcctgggaagaaggagtttgcgggattcgcagtgccactcgattagagaacatcatgtggaaacaaataagcaacgagctcaatcatatactccttgaaaatgatatgaaattcactgtcgtagtgggggatgttgcgggaatattggcacaaggcaagaaaatgataagaccgcagcctatggaatataaatatagttggaaatcgtggggcaaggcaaaaattataggagccgacgttcaaaatacaactttcataatagacggaccaaacacaccagaatgcccagacgatcaacgggcatggaatatatgggaagtggaagattacggttttggaatttttacaacaaacatctggcttaaactccgcgatagttatactcaagtttgcgatcacagattaatgtcagcggcgattaaagacagcaaagccgtacacgcagacatggggtattggattgaaagtgagaaaaatgaaacttggaaattagcccgcgcatccttcattgaagttaaaacatgcatatggccaaagtcgcatacattatggtcaaacggagtattagagtctgaaatgataatacccaaaatatacggagggccgatatcacaacacaactataggccagggtactttactcagactgccggaccttggcacctaggaaaattagaattagattttgacctctgcgaaggaacgacggtagttgtagatgagcattgcggcaatcggggaccgtcgcttagaaccacaacagtgaccgggaaaataattcacgaatggtgctgtcgcagctgtacacttcctccactaagattcaaaggagaagatggatgttggtacggcatggaaataagacctgtaaaagaaaaggaagaaaaccttgtaaaaagcatggtatctgcggggtcaggagaagtcgactcatttagtttaggcctgttgtgtataagcattatgatagaggaggtaatgcgcagtagatggtcaagaaagatgttaatgactgggacactagcagtattctttcttttaataatgggacagttaacatggaacgacctaattcgtctctgcattatggtaggagcaaatgcttctgataggatgggtatggggacaacatatcttgctttaatggcaactttcaagatgaggccaatgttcgcagtcggtctactctttagacggttaacatctcgagaagttcttcttctcaccataggactcagcttagtcgcttcagttgagctaccaaattcgctcgaagaattaggagatgggttagcgatgggtataatgatattaaaattattgacggatttccaatcacatcaattatgggctactctcctttcacttacatttataaagaccaccttcagcctgcattatgcatggaaaaccatggcaatggttctatcgatagtaagtctatttccattatgtctgagcactaccagccagaaaacgacgtggctgccagttctattgggttccttaggatgtaaacccttaacgatgtttctaatagcagagaacaagatatggggcagaaagagctggccgttgaacgaaggcatcatggcagttggcatcgtaagtatactgttgagttcactactgaaaaatgatgttccattagctggaccattgatagcaggagggatgctgatagcgtgctacgtgatcagtgggtcatctgcggacttatcattagaaaaagcagctgaagtatcatgggaagaagaggcggaacattccggggcatcacataatattttagtcgaagtacaagatgatggtacaatgaaaataaaagatgaggaacgagacgatacattaacgattttgttaaaagcaactcttcttgcagtttcaggagtgtatcccctctcaatcccagcaacgttattcgtttggtatttctggcagaaaaagaaacaaagaagcggagtattgtgggatacgcccagcccaccagaagttgaaagagcagtgcttgacgatggtatatatagaatcatgcaacgaggactgttaggtcgaagccaggtaggtgtaggagtgtttcaagaaaacgtctttcatactatgtggcatgtaactagaggtgcagtgttaatgtaccaaggaaaaagacttgaacctagctgggctagcgtcaagaaagatcttatcagctacggaggaggatggcgtctacagggatcatggaatacaggcgaagaagttcaagtgatagcagttgaacctggtaaaaaccccaaaaacgtacaaaccgcgcccggcacgttcaaaacctctgagggtgaagttggggcaattgctttagactttaaacctggcacttctggaagtccaatcgttaatcgggaggggaaaatagtaggcctatacggtaatggagtcgtgactacttctggaacatacgtaagtgctattgcacaggcgaaagcgagtcaagagggcccgcttccggagattgaagatgaagttttccgtaagagaaatctaaccataatggaccttcatccaggatcaggcaaaaccagacgttacttaccggctatagtaagagaagccatcaagagaaaattacggactcttatattagcgcctacaagagttgttgcttccgagatggcggaagcattaaaaggtatgccaataagataccaaactactgccgtcaaatcggaacatacagggaaagaaatagtagacctaatgtgccatgcaacatttactatgcggctattatctcccgtacgcgtaccaaactataatatgattataatggatgaagcacactttacagacccttctagtattgcagcacgaggatacataagcacccgtgtagggatgggcgaggcggcggcgatatttatgaccgcaaccccgccaggatcggtcgaggcatttccccaaagtaatgcagttatccaagacgaagaaagagatattccagaacgtagctggaactcgggatatgaatggataacggattttcccggtaaaacagtgtggtttgtaccttctataaaatccggaaacgacatcgcaaattgtttgaggaaaaatggaaaacgtgtaatacagctttccagaaaaacatttgacacagaatatcagaaaaccaaaaataacgattgggattatgttgttacaactgacataagtgagatgggagcgaatttcagggcagaccgcgtcatcgatccacgcagatgtctaaaacctgtaatactgaaagatggacctgaaagggtcatactagcagggccaatgcccgtaacagtcgccagcgcagcacaacgaaggggaagaatcggtagaaatcataataaagaaggggatcaatatatatatatgggacaaccgttgaataacgacgaggatcacgcgcattggactgaagcgaagatgttactggacaatattaatacacctgaaggaataataccagcactctttgaaccagaacgagaaaaatccgccgctatagatggagaatatcggctaaggggagaagcacgtaagacatttgtggaattaatgagacgtggtgatttacctgtatggttatcatacaaggtagcttctgagggctttcagtattcagacagaagatggtgttttgatggagaaaggaataatcaggtcttagaagagaatatggatgtcgaaatatggacaaaggagggcgaaaggaagaaacttcgtcctaggtggctcgatgccagaacttacagcgatcctttggcgttacgagaatttaaagaatttgcagctggaagaagaagtgtaagcggagatctcatattggagatagggaaattacctcaacatttaactcaaagagctcaaaacgcgttggataatttagtcatgttacacaattctgaacagggcggccgtgcatatcgtcatgctatggaggaacttccagatacgattgaaacgttgatgcttcttgcactcatcgcggtactaacgggtggcgtcaccttatttttcctgtcaggacgcgggcttgggaaaacaagtataggcttactttgtgtaatggcatccagtgtacttttatggatggcctctgttgaaccacattggattgcagcaagcataattctcgagttctttttaatggtacttctgataccagaaccagatcgacagaggaccccacaagacaatcaactggcatatgtcgtcatcggactactttttatgattcttactgttgcggcaaatgaaatgggacttttggaaaccaccaagaaagacttagggatcggacatgtagcagttgaaaaccaccatcatgcagcaatgctagatgttgatcttcaccctgcgtcagcatggacgctgtatgcggtagcaactactattattaccccaatgatgaggcatacaatagagaatactacggcaaatatatcattaactgcaattgcaaatcaagcagcaatattgatgggcctagataagggatggccaatttctaagatggacattggagtcccattattagcgcttggatgttattcgcaggtaaatcctctaactctaactgctgcagtcctaatgttagtggcacactacgcgattatcggtcctgggctacaagcaaaagctacgagagaggcacagaaaagaaccgcggcagggatcatgaaaaatcccacagtagatggtattgtagctattgacctagatccggtagtatacgatgccaaattcgagaagcaacttggacaaataatgttactaatcttgtgcacgagtcaaatattattaatgagaactacgtgggcactttgtgagtcaataactctagccacaggacctcttacaacactttgggaaggaagtccgggcaaattttggaatacaacaatagctgttagtatggcgaacatcttcagaggcagctacttagcgggagccggacttgccttttcacttatgaaaagcctcgggggcggccgcaggggaactggagcgcaaggagaaaccctaggtgaaaaatggaagcgtcaattgaatcaacttagtaaatctgagtttaacacatataaaagaagtggaattatggaggtcgacagatccgaggctaaagaggggctcaaaagaggagaaacaacgaaacatgcagttagcagaggcacagcaaaattacgatggttcgtcgaacgaaaccttgttaaacctgaaggaaaagtcatagatcttggttgtggtagaggtgggtggtcttattactgcgccggattaaagaaggttactgaagttaaaggatacacaaagggtggacctggacatgaggaacctatacctatggctacgtacggatggaatttggttaagttgcattcgggaaaagatgtcttctttataccacccgaaaaatgtgatacccttctatgtgacataggagaaagcagcccaaatccaaccatagaggaagggagaacgctaagagtcctgaaaatggtggaaccatggcttcgaggaaatcaattttgtattaaaatactgaacccatacatgcctagcgtagttgaaacactagaacaaatgcaacgaaaacacggcggaatgttagtcagaaatccattgagtagaaattcaacacatgaaatgtattgggtatcatgtggcaccggtaacatcgtcagcgccgttaatatgacaagccgcatgctgttaaatagatttactatggctcatagaaagccaacgtatgaaagagatgtagatttgggggcaggtacaagacacgttgctgtggagccagaagtagcgaacttggatattattgggcaacggatcgaaaatataaaacatgaacacaaatcaacgtggcactatgacgaagacaatccatataagacctgggcataccatgggagttatgaagtaaaaccatcaggatcagcctcgagtatggtaaatggagttgtcaagttattaacaaaaccttgggatgtaattcccatggtgacccagatagctatgacagatactacccccttcggacaacaaagagtattcaaagaaaaggtagatacccgaacaccgaaggctaaaagaggcacagcacaaatcatggaagtaacagcaaaatggttgtggggtttcttatcaagaaacaagaagccgcgaatttgtacaagggaagagtttacgagaaaagttcgaagtaatgcagcaatcggagcagtctttgtagacgaaaatcaatggaactcagccaaggaagccgtcgaagacgaacgtttttgggacttggttcatagagagagagagttacacaaacaagggaaatgcgcaacgtgcgtatataatatgatgggtaaaagagagaagaaacttggtgaatttgggaaagcaaaaggctcgcgtgcaatatggtatatgtggcttggagcgcgcttcttagaatttgaggctttgggttttatgaacgaagaccattggtttagtagagaaaactccttgtctggagttgaaggagaaggattacataaactaggatatatactgagagacatctccaagatacccgggggaaacatgtatgcagatgacactgccggttgggatacacgtattacagaagatgatttgcaaaacgaggcaaagattacagatataatggagccagaacatgccctcctcgcgaaatcgatctttaaattaacctatcaaaataaagtggtccgagtacaacgaccagctaaaaatgggactgtgatggatgtaatatccagaagagaccaacgtggatcaggacaggtggggacctacggtctaaatacttttacgaatatggaggcccaattaataagacagatggagagtgaaggaatattctctccttccgaattagaaacgcctaacctagctggtagagttttggattggctagagaaacatggggtcgaaaggctgaaaagaatggcaatcagcggagacgattgcgtcgttaaaccgatagatgatcggtttgctactgcactgacagcactgaacgatatggggaaagtaaggaaagacatcccgcaatgggaacccagcaaagggtggaatgattggcaacaagtcccgttttgctcacatcatttccatcagctaataatgaaagatggccgcgaaatcgttgtaccctgcaggaatcaagatgaacttgttggcagagcacgggtcagccagggagctggttggtctctacgagaaacagcttgcctaggaaaatcttatgctcaaatgtggcaattgatgtactttcatcgtcgagatctacggctcgcggcaaatgccatctgttctgcggttccagttgattgggttccaacctcaagaacgacgtggagtattcatgcccatcaccagtggatgacgacagaagatatgctaagtgtatggaacagggtatggattgaagaaaacccttggatggaggacaagacccatatatcatcgtggggtgacgtcccttacctggggaaacgagaagatcaatggtgtggatccctaataggtcttacagctcgtgctacgtgggctacaaacatccaagttgccattaatcaagtgcgtagattaatcgggaacgagaactacttagactatatgacttcaatgaagagatttaaaaatgaatccgatccagagggcgcactttggtaa

SEQ ID NO: 21469 - RNA, 9879 nt, synthetic construct
  misc_feature 1..9879: note = derived and/or modified CDS sequence (opt6) from DENV-1__EU677164__SS-prME
  source 1..9879: mol_type = other RNA
agtgttacgatgctattaatgttaatgccaacagctttagcatttcacctcacaaccagaggaggagaaccacatatgatcgtgagcaaacaagagcgcggaaaaagccttttatttaaaacgtcagcaggagtgaatatgtgcactctcattgcaatggacttaggagaattttgtgaagacacgatgacatacaaatgtccaagaataacagaagcagagccagacgacgttgactgttggtgcaatgcaacagacacatgggtaacttacgggacatgttcacagacgggagaacatcgccgtgacaaacgaagtgtagctttagcaccacacgtgggacttggtctcgaaacacgtacggagacctggatgagctcggaaggtgcttggaaacaaatacaacgggtagaaacctgggcgttaagacatcctggatttactgtaatagctctatttctggctcacgccattggaacttctattacacaaaaaggaatcattttcatactgttgatgctggtgactccatcaatggcaatgagatgtgttggaataggatctcgagacttcgtagaaggactttccggagcgacatgggtcgacgttgtactcgagcatggatcttgtgttacgacgatggcaaaagacaaacctactcttgatatagaacttttgaaaactgaagtcactaatccggctgtactacgtaaattatgcatagaggccaaaatatccaatactactaccgatagtagatgtcccacacagggtgaagcaacgttagtggaagaacaggacgcaaattttgtttgtcgaagaaccttcgttgatagaggttgggggaatggatgtggcctatttggcaaaggatctctaataacttgtgcaaaattcaaatgtgtaacaaaattagaaggtaaaactgtacaatatgaaaatctgaaatacagtgtaatagtaacagttcatacaggcgatcagcaccaagtgggaaacgagtccacagaacatggaacaacagcaacaataactccgcaagcaccatcgacggaaatacaactaacagactatggcgctttgactttagactgctcgccaagaacaggactcgatttcaatgaaatggttttgctaaccatgaaggaaaagagctggctcgtgcataagcaatggttcctagacttacctttaccatggacatccggcgcctcgactagccaagagacttggaatagaaaagatctcctagtaactttcaaaacggcacacgctaagaaacaggaagtagtggtcctaggcagtcaagaaggagcaatgcacacagcattaactggagccacggaaattcaaacttccggtacaactactatatttgctggccaccttaaatgtaggctaaagatggacaaactaactttaaaaggcatgagttacgtaatgtgtactggtagttttaaattggagaaggaagtagccgagactcagcatggtaccgtcttggtacaaatcaaatacgaaggcaccgatgccccttgcaagatcccattttcaacacaagatgaaaaaggagttactcagaatggacgtctaattactgccaaccccatcgtcaccgataaggaaaaaccagtaaatatagaagctgagcctccatttggagaaagttatatcgtaataggagcgggggaaaaggcactaaagctgtcctggtttaagaaaggtagtagcattggtaagatgttcgaagctacagcaagaggggcccgacgtatagcaatattaggagatacagcttgggacttcggaagcataggaggagtttttacctctgttggaaaacttgtgcatcagatcttcggaaccgcctacggtgtactattttcgggagtgtcatggacaatgaaaattggcattggcgtactacttacatggctaggcttaaactcaagaagtactagcttatcaatgacgtgtatagccgtaggcttggtgaccctatatctcggggttatggtacaagctgattccggatgtgttatcaactggaaaggaagggaattgaagtgtggatcaggtatatttgtgacaaatgaggtacatacctggaccgaacagtataagtttcaagccgacagtcccaaaagattatcagcggctataggtaaggcttgggaagaaggagtatgtggaatacgttccgcgacaagattagaaaatatcatgtggaaacaaatcagtaatgaattaaaccacatcttattggaaaatgatatgaaatttacagttgttgtaggtgatgtagctggaattttagcgcaaggaaagaaaatgataaggccccaaccaatggaatataaatatagttggaagtcgtgggggaaagctaaaatcataggagcagacgtacagaataccaccttcatcatagatggccccaatactccagaatgtccagatgatcagagggcttggaatatctgggaagttgaggactatgggttcggaatttttactacaaacatctggttaaaactaagggacagttatacgcaagtttgtgatcatagactaatgtcggcagctataaaagactctaaggcagtacatgctgatatgggatactggattgagagtgagaaaaatgaaacgtggaagttagcccgagcatctttcatagaagttaaaacttgtatatggccaaaatcccatacactttggtcaaacggtgtcctcgaaagcgaaatgataatacccaaaaattatggagggcctatatctcaacacaattatagaccaggatatttcacccagacagctggaccctggcatttaggaaaattagaactagacttcgatttgtgcgaaggtacaaccgtagttgttgatgaacattgtggaaatcgaggacccagcctgagaactacgacagtaacaggaaagattattcatgagtggtgttgtagatcctgtacattaccacctctaagattcaaaggagaggatgggtgttggtacggaatggaaataagaccagttaaggaaaaggaagaaaatttagtcaaatcgatggtttctgctggtagtggagaagttgatagctttagtctgggtctcctttgtatatcaataatgatcgaggaagtgatgaggtcaaggtggtctagaaagatgctcatgacaggcacactggcggtattatttctactaatcatgggtcaactaacatggaatgatttaatccgactttgtataatggtaggcgctaacgcttctgaccgcatgggaatggggacgacctacttagctctaatggcaacctttaaaatgagacctatgttcgctgtaggtctcctatttagaagacttacttccagagaagtactcttgttgacaataggtctgtctctagtagcatcagtcgaattgcccaattcgctcgaagaactaggtgatggattggctatgggcatcatgattttaaaactattaaccgactttcaaagccatcaactatgggcaactttactctcactgacgttcataaaaaccacattcagtcttcactatgcatggaagacaatggcgatggtactgagcatcgtaagtctatttccgttatgtctatccacaacgtctcagaagacaacatggttaccagtcctcctagggagtctaggttgtaaaccattaaccatgttcttaatcgcggaaaataaaatatggggacggaaaagttggcctctaaatgaagggatcatggcagtcgggattgtcagtattttactatctagtctgctgaagaatgatgtgcctctagcaggcccactaattgctggaggtatgcttatagcatgctacgtaatatccggctcgtcagcagatctgtccctagaaaaagctgcagaggtatcttgggaggaagaagctgaacacagtggagcatctcataatatacttgttgaggtacaagatgacggcacaatgaaaatcaaagatgaagaacgagatgacacactaactaccttactaaaagcgacgcttttagcggtgagcggagtatacccactttcaatacctgccacacttttcgtatggtacttctggcagaagaagaaacaaagatctggagttctatgggatacaccctcccctcccgaagtagagagagcagtgttagacgatggcatttatcgaataatgcagcggggactcttaggaaggtcgcaagtaggtgttggagtgtttcaagagaacgtatttcatacaatgtggcacgttacaaggggtgcagttctaatgtatcaaggaaaaagactagaaccctcatgggctagtgttaaaaaggatttgattagttacgggggaggatggagattgcaagggtcttggaacactggtgaagaagtacaagttatcgcagtcgagccaggcaaaaatccaaagaatgtccagacagcgccaggaaccttcaaaacgagtgaaggagaagttggtgctatcgccttggattttaaaccgggtacaagtggatcaccgattgttaatcgagagggcaaaattgttggattatacggcaatggggtcgttacaactagcggtacttacgtaagtgcaatagcacaagcaaaagcgtcacaggaaggacctttaccagaaatagaagatgaagtctttaggaaacgaaacctaacaataatggatttacaccccggtagtggaaaaacacgaaggtaccttccagcaattgtacgtgaagcgataaaaagaaaattgcggacactaatactagcccccactcgagtggtagcgtcagaaatggcagaagcgttgaaaggtatgcctattagatatcaaactactgcagtgaaaagtgagcacactggaaaagaaatagtcgatctcatgtgtcatgctacatttacgatgaggctcctatcacctgtcagagtaccaaactacaatatgataattatggacgaagctcatttcaccgacccttctagtattgcagcccgtggttatatatccacgcgtgtaggaatgggtgaggcagcagctatttttatgactgctacaccgccaggaagcgtcgaggcttttccccaatcgaatgccgttattcaagatgaagaaagagatatacccgaacgaagttggaacagcggttacgagtggatcactgactttcccggcaaaacagtatggtttgtgcccagcataaagtctggtaacgacatagcaaattgcctgaggaaaaacggaaaaagggtaatacaattaagtcgaaaaacattcgataccgagtatcagaaaaccaaaaataacgattgggactatgtagtaacaaccgatatatccgaaatgggtgcaaatttccgagccgatcgagtcattgatccaaggcgatgcctcaaacctgtcatcctgaaagacggtcctgaacgtgtcatcctagcaggtcctatgccagtgactgttgcaagcgcagcgcagagacgtggcagaataggccgaaatcataacaaagaaggagatcaatacatatatatgggtcaaccattaaataatgacgaagaccatgctcactggactgaggcgaaaatgctgctagataacataaacacgccggaaggtattatcccagcactatttgaaccagagagggagaaatcagccgccattgacggagagtatcggctcagaggagaagcaagaaaaacctttgtggagctaatgcgcaggggtgacctgccagtgtggctaagttataaggtagcttctgaagggtttcaatactctgatagacgatggtgcttcgatggggagcgcaacaaccaagtcctggaagagaatatggacgtagaaatttggactaaggaaggagaacggaagaaactacgcccaagatggctggatgctagaacatatagcgatcctttggcccttagagaatttaaagagttcgctgcggggcgaaggtcagtatcaggtgatttaatacttgaaatcggaaaactgccacaacacttaacgcaaagagcacaaaatgcgctggataatttagttatgttgcataactccgaacaaggagggcgagcatacagacatgcgatggaggagctgcctgacacgatagaaacactcatgctactagcactaatcgctgtacttactggtggtgtcacactattctttttaagcggaaggggtttaggtaaaacctctatcggtctactttgcgtgatggcctcatccgtcttattatggatggcttcagttgaaccacactggatagctgcaagtattattctagaatttttcctaatggtattgttaatacctgagccggatagacaaagaacacctcaagacaaccaattagcctacgttgtaataggtttactcttcatgattttaacagtcgctgctaatgagatggggctgctggaaacaacgaagaaagatctaggtataggacacgttgcggtcgaaaatcaccaccatgccgcaatgctagatgttgacctacaccctgcatcagcgtggactttgtatgctgtagcaacgaccatcattacaccaatgatgcgacatacaattgaaaataccacagctaatataagtctcaccgcgatcgcaaaccaggcggccattttaatgggactggataaagggtggcctattagtaaaatggacataggcgttccgctattagctctcggatgttactcacaggtgaatccgttaacccttacagccgctgtgttaatgttagtagcacattacgccatcattggccctggtctacaagccaaagccactagagaagcacaaaaacgtacagcagcaggcataatgaaaaaccctacagtagacggaattgttgccatcgacttagatcccgtagtatatgacgctaagtttgaaaaacaactcgggcaaattatgctactcattctatgtacttcgcaaatattgttaatgagaacaacgtgggctctttgtgaaagcataactctcgccacaggaccactaaccacgctatgggaaggctctccagggaaattctggaatactactatagctgtatcaatggccaacatcttcaggggctcttacctcgcaggagccggtctagctttttcgcttatgaagagtctaggagggggccgacgggggacaggagcacaaggcgaaacactaggggaaaagtggaaaagacaacttaaccagttaagtaaatcggagttcaatacttataaaagaagcggtatcatggaagtagatagatctgaggctaaggagggactaaagagaggcgaaaccactaaacatgcagtttcccgtggaacagcaaaattgagatggttcgtcgaacgtaatttagtaaaacctgaaggcaaagtaatagacttaggatgcggaagaggcggatggagctattactgcgccggattaaagaaagtcacagaagtaaaaggttatacaaagggaggcccaggccatgaagaaccgatacccatggctacttacggatggaacttagtaaagttgcacagcggaaaggacgtcttctttatcccaccggaaaaatgcgacaccctactatgtgacataggagaatcatcacctaatccgacaatcgaagaaggtcgaacactacgcgtactgaaaatggtcgagccatggctacgtggaaatcaattttgcataaaaatattgaatccttacatgccttcggtagtcgagactttggaacaaatgcagcgaaaacatggaggcatgttggtccgtaaccctttatctagaaacagtacgcatgagatgtactgggtaagttgcggtacaggaaacattgtatcagcagtaaatatgacctcgcgaatgttgttaaatcgatttaccatggctcatcgcaaacctacgtacgagcgcgatgttgacttaggtgctggcactcgtcatgtcgctgttgaaccagaagttgcaaacttagacataattgggcaacgaattgagaacattaaacatgaacacaagtcgacgtggcactatgatgaggacaatccgtataaaacttgggcctatcacggatcatacgaagttaaaccgtcaggatcagcttcgagcatggttaatggcgtagtaaagttactaacaaaaccctgggatgtcatacctatggtaacccaaatagcaatgacagataccacacccttcgggcagcaaagagtattcaaagaaaaagtcgatacacgaactcctaaagcaaaacgtggtactgcgcaaattatggaagtaaccgccaaatggctgtggggatttttatcacgtaataagaaaccgcgaatatgtaccagagaagaatttacgcgtaaggtacgtagcaacgccgcaattggagcagtattcgtagacgaaaatcagtggaactctgctaaggaagcggtagaagatgaacggttttgggatctcgtgcaccgtgagagagaactgcacaaacagggtaaatgcgcgacatgtgtctacaatatgatggggaaaagggagaagaaactaggagaatttggcaaagccaaaggaagtcgtgcaatttggtatatgtggttaggtgcacgattcctagaatttgaagccctaggattcatgaatgaagatcactggttctcaagagaaaattcgcttagcggtgtggaaggtgaaggtttacataaactcggctacatactgagagatataagcaaaattcccggtggcaatatgtatgccgatgatacagcaggttgggatacccgaatcaccgaagatgatttacaaaatgaagccaagattacagatataatggaacctgaacacgcactactcgcaaaatccatttttaaactaacctatcagaataaagttgtcagagttcaaagaccagcaaagaatggaacagtaatggatgtaatatccaggagagatcaaagaggatcgggccaagtaggcacctacggacttaatacattcactaacatggaagcacaactcataaggcagatggaatctgagggcatctttagtccaagtgaattagagactcccaacctagccggacgagtacttgattggttagaaaaacatggggtagaacgattaaaaagaatggcaatttcgggagatgactgcgtcgtcaagccaattgacgataggttcgctacagccctaacagcgcttaatgacatgggtaaggtaagaaaggacattcctcagtgggaaccaagtaagggttggaatgactggcaacaagtcccgttctgctcccatcactttcaccaactgattatgaaggatggaagagagattgtcgtaccttgcagaaatcaggacgaacttgttggcagagctcgagtaagtcaaggtgcgggttggtccttacgtgaaacagcgtgcttgggaaaatcgtatgctcaaatgtggcaactaatgtatttccaccggagagacttacgattagcagccaacgccatctgtagtgcagttcctgtcgattgggtacccacgtcaagaaccacgtggtcaatacacgcacatcatcaatggatgaccacagaagacatgttaagtgtctggaacagagtttggattgaagaaaatccatggatggaagataagactcatataagctcatggggagatgtaccttatctcggcaagcgagaagatcaatggtgtggctcgcttatcgggttaactgcacgagctacttgggctacgaacattcaagtcgctattaaccaagtgagacgactaattggcaacgaaaattacttagattatatgacatctatgaaaaggtttaaaaacgaaagcgacccagagggagcactatggtaa

SEQ ID NO: 21470 - RNA, 9879 nt, synthetic construct
  misc_feature 1..9879: note = derived and/or modified CDS sequence (opt6) from DENV-1__EU677165__SS-prME
  source 1..9879: mol_type = other RNA
tcggtcactatgttattaatgctcatgcctactgcactcgcattccatttaacaacacgtggaggagaaccgcacatgatagttagcaaacaagaacgaggcaagtcattactattcaagacatcagcgggtgtaaatatgtgtactttaattgcaatggatctaggcgagctatgcgaagacacgatcacatataagtgtccgcgtataacagagactgaaccagatgatgtagactgttggtgtaatgcaaccgatacgtgggtcacttacggaacatgctcccaaacaggagaacacaggagagacaagagaagcgtagcacttgcaccacatgtaggattgggtctagaaacacgcaccgagacctggatgtctagtgaaggagcatggaaacaaatacagcgtgtcgagacatgggcactgaggcacccagggtttacagttatagccctattcctagctcatgccatagggacaagtattactcaaaaaggaattatctttattcttttaatgctagccacaccttctatggcaatgaggtgtgtcggaatcggcagtagagacttcgtagagggtttaagtggcgctacgtgggttgatgtagttttagaacatggcagctgtgtcacaaccatggcgaaagataagccgacactagatatagagttactgaagacagaagttacgaaccccgcagttcttcgaaaactatgtatagaagccaaaatctcaaacactaccacagatagtaggtgtccgactcagggagaggcaacgcttgtagaagaacaagacgcgaattttgtatgcagacgaacctttgtcgacagaggttggggaaacggatgcggcctttttggaaaaggaagtctaataacatgtgcaaaatttaaatgcgtgactaagctagagggaaagatagtacaatatgaaaacctaaaatattcagtgatcgtgaccgtacacacaggcgatcagcaccaggttggtaatgaatctaccgaacatggtacaacagcaacgattacacctcaagcacctactactgaaatacaattaacagactatggagcgttgacgctcgattgtagtccccggacaggtctggatttcaatgaaatggtactattgacaatgaaagagaagtcgtggctcgttcataaacagtggtttctggatttgccgcttccatggacgtcaggggcgagtacaagccaagaaacttggaatcggcaagatttacttgtaacttttaaaaccgcgcatgcgaagaaacaggaagtagtagtgctaggctctcaagagggtgcaatgcatacagctttaaccggagcgacagaaatacaaacatcaggtactactactatctttgcaggtcatttgaagtgccggttaaagatggataaactaacacttagaggaatgtcttacgtaatgtgtacaggcagttttaagttagaaaaagaagttgccgaaactcaacacggtacagtcttggtccagattaaatatgaaggtacagacgctccatgtaaaatacctttctccacgcaggatgaaaaaggagttacccagaatggacgcctcataaccgctaatccgatagttactgataaagaaaaacctgttaacatagaggcagaacctccctttggagaaagttatatcgtaatcggagctggtgagaaagcactaaaacttagctggttcaagaaaggctcaagtataggtaagatgtttgaagcaacagcgagaggggcaaggcgaatggccattcttggagataccgcttgggattttggatctataggcggagtttttacgtcggttgggaaattggtccatcaaatcttcggcacagcatacggagtcctgttctctggtgtttcttggacaatgaagataggaataggggtgctgttaacttggctgggtctaaacagccggtccacttctctttcaatgacttgtatcgcagttggtctggtcaccctatacttgggagtaatggtacaagcggattcaggatgcgttatcaactggaagggaagggaattaaaatgtggatcgggtatattcgtaacaaatgaagtacatacttggacagaacaatataaatttcaagcggattcaccaaagaggttaagcgcagctataggtaaggcatgggaagagggagtatgcggtatcagatcggcaactcgactagaaaacattatgtggaagcaaatatcaaacgagcttaatcacattttgctagaaaacgatatgaagttcaccgtcgtcgttggggacgtagctggtatactcgcacaagggaagaaaatgataaggccacaaccaatggaacacaagtacagttggaaaagctggggcaaggcaaaaataataggagcagatgtccaaaacaccacttttattatagacggaccaaacaccccagagtgtccggatgatcaaagagcctggaacatttgggaggtcgaagattacggatttgggatttttacaaccaatatttggttgaaattacgagactcgtatacacaagtttgcgaccacagattaatgtctgctgcgatcaaagactcaaaggccgtccacgcagatatgggctattggatcgaatcagaaaagaatgagacctggaagctagccagagcttcttttattgaggttaaaacttgcatatggccaaaatcgcatactctttggagcaatggtgtattggaatcagagatgataataccaaaaatatacggcggtcccatatcacaacacaactaccgcccaggctacttcactcaaactgcgggcccttggcatctcggaaaacttgaactggacttcgatttatgcgaaggtacaactgttgttgtagacgagcattgcgggaatagaggcccatcattgaggacaacaacagtaacgggaaaaatcatacatgagtggtgttgcagatcatgcacacttccgccgctaaggtttaggggtgaggacggatgttggtacgggatggaaattcgaccggtcaaggaaaaagaggaaaatctcgttaaatcaatggttagcgcaggcagcggcgaggtagacagttttagcctcgggcttctctgtattagtataatgatagaggaagttatgcgatcacgttggtcaagaaaaatgttaatgacaggaacgttagctgtattctttttactaataatgggacaattaacttggaatgatttaataagattatgtattatggtaggcgctaacgcaagtgatagaatgggtatggggaccacgtacctggcccttatggcaacgtttaaaatgagaccaatgtttgcagtaggactattattccgtagattaacttcacgcgaagttctcttgctgacaatcggtttatcactcgtagcctctgttgagcttccaaatagtttagaagaattgggtgacggtcttgcgatggggataatgatattgaaactcttaacagattttcagtcccatcaattatgggcaacgctacttagtctcacattcatcaaaacaacatttagtctccattatgcctggaagacgatggcgatggtgcttagcattgtgagtctgtttccactatgtttatcgaccacatcccagaaaacgacgtggttaccagtattgctaggtagcctaggttgtaaaccgttgactatgttcctcatagccgagaataaaatctggggcagacgatcttggcctttaaatgaaggcatcatggcggtggggattgtatcaatcctgttgtcctccctattgaaaaacgatgtccctctagctggaccattaatagccggcggaatgcttatcgcgtgttacgtgattagtggtagttctgcggacctatcactcgagaaggccgcagaagtaagctgggaagaggaagcggaacattccggagcctcccacaatattctagtagaggtccaggatgacgggactatgaagatcaaagatgaagaacgggacgatacactcacaattcttctcaaagctacattacttgctgtatcaggggtttatcctctgtccataccggcgactttatttgtatggtatttttggcagaagaagaaacagcgatcgggagttttatgggatacaccatcacccccagaagtggaaagagcagttcttgatgacgggatatacagaattatgcaacgtggattattaggcagatcccaagtaggcgtaggagtctttcaagaaaacgtatttcatacgatgtggcatgttacaagaggtgcagtattaatgtatcaaggaaaacggctggaaccgtcctgggcatcggtcaagaaagaccttatatcgtatgggggtggatggcgtttacaaggatcgtggaacacgggtgaggaagtacaagttatagcggtcgaacctggcaaaaatcccaaaaatgtacagactgcacctggcacattcaaaactccggaaggagaagtaggtgctatagcattagactttaaaccgggcacatccggtagtcctatagtaaatcgtgaaggaaaaatagtaggattatacggcaacggagtagtcactacttcaggcacatacgtatcagcgatcgcccaagctaaagcatcacaggaaggtcctctgccggaaatagaagatgaggtgtttcggaaacgaaacttgacaataatggacttacatccagggtctgggaaaacgcgtaggtacttgccagctatagtcagagaagccatcaaaagaaagttgcggacattgatacttgcaccgacacgagtagttgcgtcggaaatggctgaagcactcaaaggcatgcctatccgttatcaaactacggcagtaaaatcagaacatacaggcaaagaaatcgtcgatttaatgtgtcatgctacatttacaatgcgtttgctatcaccagttcgggttccaaattataatatgataataatggatgaggctcacttcacggacccgtcttcaatcgctgcaagaggctatataagtacaagggttggaatgggagaagctgctgctatttttatgaccgctacacccccaggaagtgtggaagcattcccacaatcgaacgccgtgatacaagatgaagaacgtgatatacctgaaagaagttggaatagtggttacgagtggatcacagactttcctggtaagactgtatggtttgttccatctataaaaagtggaaatgatattgctaattgccttcgcaaaaatggaaaacgtgtaatccagctctcgagaaagacgtttgacacggagtatcagaaaacgaaaaacaacgattgggattacgttgtcactacagacatatcagaaatgggtgccaactttagagcggatagagtaatcgatccaagacgttgcctcaaacctgttattttgaaggatgggcctgaaagggtaattctggctggccctatgccggtgacggtagcaagtgcggcccagaggagaggacgaattggtcgcaatcacaataaagaaggtgatcaatatatatatatgggacaacctctcaacaacgatgaagaccacgctcattggacagaagctaaaatgttacttgacaacatcaacactcctgaaggaataatacctgccctatttgaaccggaaagggaaaagagtgcagctatagatggtgagtatagactacgaggagaagcaagaaagacatttgtggaattaatgagaaggggcgacttaccggtttggctttcttacaaagtagcatctgagggtttccaatactcagatcgcagatggtgctttgatggcgaaagaaacaatcaagttctagaagaaaacatggatgtcgagatttggacaaaagaaggtgaaagaaagaaattaagacctcgatggttagatgcgcggacatactcagatccacttgccctccgagaatttaaagaatttgctgccggaagacgctctgttagcggagatcttatccttgagattggtaaacttcctcaacacctgacccaacgagcccaaaacgccctagataacttggttatgctccataattctgaacaaggtggcagagcttataggcatgcgatggaagaattgcctgatacaatcgaaacgctaatgcttttagcattaatagccgttttgacagggggcgtaacattattctttctcagcggcaggggactgggtaaaacaagtatcgggttactctgtgtaatggcgtcgtcagttcttctatggatggcaagcgtggagccccactggattgccgcaagtataatcctagaatttttcttgatggtacttttgatacccgaaccagatagacaaaggactcctcaagataatcaacttgcatatgttgttattggacttttgttcatgatccttaccgttgctgccaatgaaatgggactactagagacgaccaagaaagacctgggcattggacatgtggcagtggagaatcatcaccatgctgcaatgttagacgtagatttacaccccgctagtgcatggaccctatatgcagttgccactacaatcatcactccaatgatgagacacactatagaaaatactacagcaaacatatcattaactgcaatcgccaatcaggctgcgatattaatgggcttagataaaggatggccaatcagtaaaatggatataggtgtaccattgctagcactaggttgctattcgcaagtgaacccattaaccttgaccgccgccgttctaatgcttgtagcacattacgctataatagggccaggactccaagcaaaagcaacaagagaggcacagaaaagaaccgccgcgggtattatgaaaaaccccaccgttgatggtatcgtcgcaatagacctcgatcccgtcgtgtatgatgctaaatttgaaaagcaactagggcaaattatgctattaatcttgtgtacaagccaaattctgcttatgaggacaacttgggccctttgtgagtcaataactttagcaaccggcccgctaactactttatgggaagggtcgcctgggaaattttggaacacaacaattgctgttagtatggcaaatattttccgtggaagctatttagcaggagcaggcttagcattctccctaatgaaatccttaggtggagggagacgcggaacgggagcccaaggagagactttgggagaaaaatggaaaagacaattaaaccaattaagtaagtcggaatttaatacctataaacgttcgggtattatggaagttgataggtccgaggcaaaagaaggcttgaaaagaggggagacaacaaaacatgcagtaagccgggggacagcaaaactgaggtggtttgtagaaagaaatttagtcaaaccagagggaaaggtcatagaccttggatgcggccgtgggggatggtcatattattgcgctggcctaaagaaagttacagaagtaaaaggttatactaaaggcggcccaggtcacgaagaaccaattccgatggcaacctatgggtggaatctagttaaattgcattcaggaaaagatgtgttctttataccaccagaaaaatgcgacaccctattatgcgacataggagagagttcaccaaacccaacaatagaagaaggccgtacattgcgagttttgaaaatggtagagccctggttaagaggaaatcaattttgtattaaaatacttaatccatacatgccatctgtagtagagacgcttgaacaaatgcaaagaaaacacgggggaatgttggtaagaaaccctcttagcagaaacagtactcatgaaatgtattgggttagctgtggcactggtaatatagttagtgcagtaaatatgaccagtcgcatgctacttaacagattcacaatggcccatagaaagccaacgtacgagagagatgtcgatctcggtgcggggactcgtcatgtagccgttgaacctgaagttgccaatctagatataatcggtcaacgaatagaaaatatcaaacacgaacataaaagtacatggcattacgatgaagataacccctacaaaacatgggcatatcatggatcttacgaggtaaagcccagtgggagtgccagctctatggtaaacggagtggttaaactgttaactaaaccctgggatgtaataccaatggtcactcaaattgctatgaccgacactactccattcggacagcaaagagttttcaaagaaaaagtagacacacgtacccctaaagcaaaaaggggtacagctcaaattatggaagtaacagccaaatggttgtggggcttcctagcaagaaataagaaaccaaggatatgtacacgagaggaatttaccagaaaagtcagatccaacgctgcaataggcgcagtctttgtcgatgaaaatcaatggaactccgcaaaggaagccgtagaagacgaaagattttgggatctagtacatagagaaagggaattacataagcaaggtaaatgtgcaacctgcgtatacaatatgatgggtaaacgggagaagaaactaggagagtttggtaaagcaaaaggctctcgggcaatatggtacatgtggctcggagcaagatttcttgaatttgaagcactaggttttatgaacgaagatcattggttttctcgagaaaattcactctccggtgttgaaggtgaagggctacacaaacttggatacatcttgcgtgacataagtaaaatccccggcggaaacatgtatgcggatgatacagcaggctgggataccaggataacagaagatgatctacagaatgaagcacgcataacagacattatggaacctgagcatgcactattagccaaaagtatctttaaacttacatatcaaaacaaagttgtgcgggtacaaagacctgccaaaaatggtacagtgatggacgtcataagcagaagagatcaacgaggatcgggccaggtaggtacgtacggattaaatacgttcacaaatatggaagcccaactaatccgacaaatggagtctgaaggcattttctcaccaagcgaattagagacccctaaccttgcagaacgtgtattagattggctggaaaaatacggcgttgagcgtttaaaaagaatggcaataagtggagatgactgcgtagtaaagcctatagacgatcggtttgctacggcacttaccgcgctaaatgatatgggaaaggtacgcaaggatataccccaatgggaaccatcaaaaggctggaatgactggcaacaagtaccattttgttcgcatcattttcaccaattaattatgaaggatgggagagaaatagtcgtaccttgtcgtaatcaggatgagctagtcgggagagcaagagtttcacagggcgcaggttggagcctaagagaaacagcatgtcttggaaaaagttatgcacaaatgtggcaattaatgtactttcaccgcagagatctcagactcgccgcaaatgcgatttgtagtgctgttccagtcgattggatacctacgtcgagaacgacatggagtattcacgctcatcaccaatggatgacaactgaggatatgctatcagtatggaatcgcgtctggatagaggaaaatccttggatggaagacaaaacgcacatcagctcttggggcgatgtgccatatttaggaaaacgcgaagaccagtggtgtggttctttaattggacttaccgcaagggccacatgggcaactaacattcaagtggccataaatcaagtaagacgtctcataggaaatgaaaactatcttgattatatgacatcaatgaaacgctttaaaaacgaatcagatcctgaaggtgcactatggtaa

SEQ ID NO: 21471 - RNA, 9879 nt, synthetic construct
  misc_feature 1..9879: note = derived and/or modified CDS sequence (opt6) from DENV-1__EU677140__SS-prME
  source 1..9879: mol_type = other RNA
tcggtaactatgcttcttatgttaatgcctactgctttggcattccatttgaccacgagaggtggagaaccgcatatgatagtttctaaacaagaaaggggaaaaagcctactctttaaaacttctgcaggggtaaatatgtgcacactaatagcaatggacttgggtgaactttgtgaagatactatgacctataaatgcccaagaataacagaaaccgaacccgacgatgttgactgctggtgtaatgcaacagacacctgggttacatatggcacttgttcacaaaccggtgaacatcgaagagacaaaaggagcgttgcactagccccgcatgtaggattaggtcttgaaactagaacggaaacatggatgtcaagtgaaggagcatggaaacaaattcaaagggtagaaacgtgggcattaagacacccaggctttacagtgatagctctatttttggcccacgcaataggtacttccataactcaaaaaggcattatatttatattattaatgcttgtgaccccatcaatggctatgagatgcgtaggaataggaagcagagattttgtagaaggactctctggggcaacttgggtggacgttgttttagagcatggtagttgcgtaaccactatggcaaaagataaacctaccttagacatagagctattaaaaaccgaagttaccaaccctgcagtacttcgcaaactttgcattgaggcgaaaatctctaatacaactactgattcaagatgtccaacacaaggagaagcaaccttagtggaggaacaagatgcaaactttgtttgtcgacggactttcgtagacaggggttgggggaatggatgtggcctatttggaaaaggttcattaataacgtgcgcgaaatttaaatgcgtcacaaaactcgaggggaaaattgttcaatatgaaaatttaaaatactcagtgatagttacggtacatactggagaccaacatcaagttggtaatgaatcaacagagcatgggaccactgcgactataactccccaagctcccacaactgagatacagctaacagattacggggctttgacattagattgctctccaagaaccggtctggatttcaacgagatggtcctactaactatgaaagagaaaagctggttagtgcataaacaatggtttttagacttgccactcccctggacaagtggcgcaagtacctcacaggaaacttggaaccgacaagatcttctagtaacatttaaaacagcgcatgcgaagaaacaagaagtcgtggtactaggctcccaagagggagcaatgcacactgcactcactggagcgactgaaatacaaacctctggcaccacaacaatatttgctggtcatttgaaatgcaggctaaaaatggacaagttaacactaaaaggtatgtcgtacgtgatgtgcactggttcttttaaactcgagaaggaagttgcggaaactcagcatggaaccgtccttgtacaaataaaatatgaggggactgacgcaccatgtaaaatcccattcagtactcaagatgaaaaaggggtaacacaaaacggaagactgataactgcaaatcccatagtaacagataaagaaaaaccagtgaacattgaagcagaaccaccatttggggagagttatattattataggggcgggcgagaaagctctaaaacttagttggttcaagaaaggtagttcaatagggaaaatgttcgaagccactgcgagaggtgcacgtcgaatggcaatccttggtgacacagcctgggattttggaagcattgggggagtgttcacctcagttggcaaacttgttcaccagatattcgggaccgcctacggtgtattattcagtggagtaagttggacaatgaaaataggcatcggagtattgttaacatggctaggcctaaatagtaggagtaccagcttatctatgacctgtattgcagtgggtctcgttacattatatttaggagtaatggtacaggctgattccggctgtgttataaattggaagggacgtgaacttaaatgtggctcaggtatatttgttactaacgaggtacacacatggacggaacagtacaaatttcaagcagacagtcctaaaagattatctgcggctataggcaaagcatgggaagagggtgtttgtggaattaggtcagcgacgagactcgagaatataatgtggaaacaaatctctaacgagttgaatcacatactgctagaaaacgatatgaaatttacagtggtagtgggtgacgttgctggtatattggcacagggtaagaaaatgatcagacctcagcctatggaatataaatacagctggaaaagctggggcaaagcaaagattattggcgctgacgtacaaaatactacctttataattgacggtccaaacacacccgaatgccctgatgatcagagagcgtggaatatttgggaagtcgaagactacgggtttggcatctttacaacgaacatttggcttaagctaagagactcgcatactcaagtatgtgatcaccggttaatgtctgccgcgataaaagattcaaaagctgttcacgcagatatgggttattggatagaatcggaaaagaacgaaacatggaaattagctcgagccagttttatagaagtaaagacttgtatttggcccaaatcacatactctatggagcaatggtgtattagaatccgaaatgatcattccaaaaatttacgggggtcctatatcacagcacaattacaggccggggtacttcacgcaaacagctgggccatggcacttaggcaagttggaactcgactttgatttatgtgaaggtaccacagtagtcgtagacgaacattgcggaaatagagggccttcattaaggacgactaccgtaactgggaagataattcatgagtggtgttgccgaagctgcacacttccgccattgcgtttcaggggagaggatggctgttggtacggaatggaaattaggcccgtgaaggagaaagaggaaaatctggtaaaatctatggtgtccgcggggagtggcgaagtagatagtttttctctcggattactgtgtataagtataatgatcgaggaagtaatgcgatcgcgttggagccgaaaaatgctgatgactggaactcttgcagtattcttccttttaattatgggtcaattaacgtggaatgaccttattcgattatgcataatggtaggggcaaatgcatccgataggatgggaatgggaacaacataccttgccctgatggcaacattcaaaatgagaccgatgttcgctgtaggtttactattcagaagattaacaagtcgtgaagtcttactgctaacaatcggattatcactcgtagcatcggtagaattgccaaattcactcgaggagctcggcgacggactagcaatgggcataatgatattaaaactgctcacagattttcaaagtcaccaattatgggcaacattgttatcgctgaccttcataaagacgacattttcattacactatgcttggaaaactatggcaatggtcctaagcatcgtttccttgttccctctatgtttaagcaccacttcacaaaagacaacttggttgccagtattattaggaagtctcgggtgtaaacctttaactatgttcttaattgcagaaaataagatatggggccggagatcgtggcctcttaatgaaggcatcatggcagtggggattgtctccatacttctcagcagtctgcttaaaaacgatgttccgcttgcaggacccctaatagccggaggaatgctaatcgcatgctatgtaatttcgggatcaagtgctgatttatcactagaaaaagccgcagaagtaagttgggaagaggaggcagagcatagcggtgcgagccacaacatactggtggaagtacaagacgacggcaccatgaaaattaaagatgaagaaagagacgatacgttaacgatattgttaaaagcgacccttctagctgtttccggcgtgtacccactaagtataccagcaacactgtttgtttggtatttttggcaaaagaagaaacagagaagtggcgtcttgtgggacacaccaagccctcccgaagtagaacgagcagttctagacgatggaatttatagaataatgcagcggggattgcttggaagatctcaagtaggagtaggagtgtttcaagagaatgtctttcacaccatgtggcatgtcacgagaggtgcagtgctaatgtatcagggaaaacgactagaaccaagctgggcaagcgttaaaaaggatttaataagttatggaggtggatggagactacaaggatcatggaataccggcgaagaagtccaggtgatcgctgtcgaacctggcaaaaaccctaagaacgtacaaacggctcctggaacatttaaaacgccagaaggagaagtgggagcaatcgcattagactttaaaccaggtacaagcggaagcccaatcgttaatcgcgaaggtaaaatagtcggattatatgggaacggggtcgtaacaacatctgggacttatgtttctgcgattgctcaagcaaaagcctcacaagaaggcccgttacctgagatcgaagatgaggtatttcgcaaaagaaaccttacaatcatggatttgcatccaggctcaggaaaaactagacgttatcttcctgcaattgtcagagaagctattaaaaggaaacttagaactctaatactcgcacctacacgagtggttgcaagtgaaatggcagaagcgcttaaaggaatgcccataagataccagacaacagctgtaaaatctgaacatacgggtaaagaaattgttgatctaatgtgtcatgccactttcacaatgcgtttactttctccggtcagagttccaaactacaatatgataattatggacgaagcccattttacggatcccagctcaattgcggcaagagggtatatatctacgcgggtgggtatgggggaagcagcagcaatttttatgactgcaacaccaccgggcagcgttgaagcatttccacaatccaatgctgttatacaagatgaagaaagggacataccagagcgcagctggaatagtgggtatgaatggatcacagatttcccaggaaagacagtctggttcgtcccaagtataaaatcaggaaatgatattgcgaattgtctcaggaaaaacggcaaaagagtaattcaattgagtagaaagacatttgataccgaatatcagaaaacaaagaataatgattgggattacgtagttacgacagacatatctgaaatgggagcaaactttagggctgatagagtaattgaccctcgccgatgtctaaaaccagttattttaaaagacggcccagaacgtgtaattctagcgggaccgatgccagttaccgtcgcctcagcagcacaaagaaggggtcgtatcggtagaaatcataacaaggaaggggaccaatatatatatatgggacaacctctgaataatgatgaagatcatgcccattggacggaagctaaaatgttactagacaatataaatacaccagaaggaataataccagctctctttgaacccgaaagggaaaaatcagctgcaattgatggcgaatatcggttacgaggcgaggctagaaaaacgttcgtagaattaatgaggagaggagatttgccagtatggttaagctacaaagttgctagcgaagggttccaatactctgataggagatggtgctttgacggcgagagaaacaaccaagtactagaagaaaacatggacgtagagatttggacgaaagagggtgaaagaaagaagttgagacctcgctggctagacgcacgtacttattcagaccctcttgcgcttagggaatttaaggagttcgcagctggcagacgcagtgtatcgggggatctgatcttagaaatagggaagttgcctcaacacttgactcaaagagcgcaaaacgcactcgataaccttgttatgttacataatagtgagcaaggcggacgagcatatagacacgcaatggaagagttgccggacacaattgaaacattaatgttgttagctcttattgcggtattaactggtggtgtaacgttattctttttatccggaagaggacttgggaaaacgagtataggactattatgcgttatggcgtcgagtgtgttgttgtggatggcaagtgtagaaccacattggattgctgcttctattatcttagagttctttttaatggtattgctaatacccgaacccgataggcaacgcacaccacaggataaccagttagcatacgttgtaatagggttactgttcatgatattaacagttgcagctaatgaaatgggactattagaaaccactaagaaagacctggggattggtcatgtggctgtagagaatcatcaccacgcagccatgttagatgttgatttgcaccccgcttcagcatggaccctatacgctgtagctactacgataatcactccaatgatgaggcatacaatagaaaacacaactgccaatatctcactaacggctatagcaaaccaagcagcaatattaatgggtttggacaagggatggccaatttcgaagatggacataggggtaccattgttagccctagggtgttattcgcaagttaatccattaacactgactgctgcagttttaatgctagtcgcacattacgcaataataggaccgggcttgcaagccaaagcaacgagggaggctcagaaaaggaccgccgctggcatcatgaaaaatcccacagttgatggtatagttgcaattgatctagacccggtcgtttatgatgctaaattcgaaaaacaactggggcaaattatgttattgatactttgtacctctcagatattattaatgaggacgacatgggccctttgcgaatcaataactcttgcgactggcccgctaacgacgctatgggaagggagtccaggaaaattttggaatacgacaattgctgtatcaatggccaacatattcagaggtagttatctagcgggggcaggacttgccttctcactcatgaaatcactagggggaggtaggagaggtactggggcgcaaggagaaacgttaggggaaaaatggaaacgacaactaaaccaactaagcaaatcagagttcaacacatataaaagatcgggtataatggaagtggatcgctcagaagcaaaagaaggcctaaaaaggggagaaactacgaaacatgcagtcagccgagggacagcaaaacttagatggttcgtagaaagaaatcttgtcaaacccgaaggtaaggtcattgatttaggatgtgggcgcggagggtggtcatactattgcgccggattgaagaaagttacggaggtcaaaggttatactaaaggtggcccagggcacgaagaaccaatacccatggctacatatggttggaacttggtaaaactgcattcgggcaaggacgtgtttttcattccacctgaaaaatgtgatactctactctgtgatattggggagagtagtcctaatccaacaatagaggaaggtagaaccttaagagtactcaaaatggtagaaccttggttgcgaggaaatcaattctgtatcaaaatcctaaatccctacatgcctagcgttgtagaaactctagaacaaatgcaaaggaagcacgggggaatgttagttaggaaccctttgagtcgtaacagtactcatgagatgtattgggtgtcatgtggaaccggaaatattgtctctgccgtgaacatgacaagcagaatgctattaaatagattcacaatggcacaccgtaaaccaacatacgaacgagacgtggacttgggtgcgggcactcgacatgtcgcagtggaaccagaagtagccaacctagacataattggacaaagaatcgaaaacataaaacatgaacacaagtctacgtggcactacgatgaagataatccatataagacttgggcatatcatggatcatatgaggtaaaaccttctggttcggctagttccatggttaatggcgtagtcaaacttttaacaaagccatgggacgtaataccaatggtcacacaaattgctatgactgacacaacaccttttggccagcaacgtgtattcaaggagaaagtagatacaaggacaccaaaggcaaaacgagggacagctcaaattatggaggtcacagctaaatggctatggggatttctttcgcggaacaagaaaccacgtatttgtacacgagaagagttcacgagaaaggtaaggagtaatgctgcaattggtgcggtgttcgtggatgaaaatcaatggaactctgcaaaagaagcagtagaagatgaaagattctgggatttggttcatagagaacgtgaacttcacaagcaaggaaagtgcgccacttgtgtatataatatgatgggaaaacgcgagaagaaactgggtgagttcggtaaagctaaagggagccgagcaatctggtacatgtggcttggggcccgctttcttgagtttgaggcattaggattcatgaatgaagatcattggttttcgagagaaaactctttatcaggggttgaaggagaaggtttacacaaactaggatacatactcagggatatatctaaaattcccgggggaaacatgtatgctgatgataccgcagggtgggatacccgaattacggaagacgatttacagaatgaggctagaataacagacatcatggaaccagagcatgctttactggcgaaatcaatattcaaactcacttatcaaaataaagtagtaagagtccagcgtcccgccaaaaacggcaccgtgatggacgtcatcagtaggagggatcaacgtggcagtggccaggtaggaacttatggtttgaatacctttactaatatggaagctcaattaatcagacaaatggaatcagaggggatatttagtccatctgagctagaaacaccaaacttagccgaacgagtcctcgattggttaaagaagtacggagtggaacgcctaaaacgtatggccatatctggggatgactgcgtggtaaagcccatcgatgacagatttgcaacagctctaacggcactaaacgatatggggaaggtaaggaaggatatacctcaatgggagccaagcaagggctggaatgactggcaacaagttccattctgcagtcatcactttcaccaactgattatgaaagatggaagagaaatagtggtaccctgccgaaaccaagatgagctagtaggtcgagcgcgcgtttctcaaggggcaggatggtcactgagagagaccgcttgcctcggtaaaagttatgcgcagatgtggcaactaatgtactttcatagacgtgatttgagattggctgccaacgccatatgtagtgccgttccagtggactggataccaacgtcacgaactacttggtcgattcacgctcaccatcagtggatgactacagaagatatgctgtcagtatggaatagagtttggatagaagaaaatccttggatggaagacaaaactcatattagtagttggggtgacgtcccatacctaggaaagcgagaagatcagtggtgtggttcgctaataggactcactgcaagagcgacatgggccacaaacatccaagtagcaataaatcaagtaagaaggttaataggaaatgaaaattatcttgattacatgacatctatgaaaagatttaagaatgaaggcgaccctgagggggcattatggtaa

SEQ ID NO: 21472 - RNA, 9879 nt, synthetic construct
  misc_feature 1..9879: note = derived and/or modified CDS sequence (opt6) from DENV-1__EU677166__SS-prME
  source 1..9879: mol_type = other RNA
agcgtgactatgctactaatgttaatgccgactgcacttgcatttcaccttaccactcgaggtggagaaccacatatgattgttagcaaacaagaaagaggaaaatcacttttatttaagacatctgctggagtaaacatgtgtacccttattgccatggaccttggggaactatgtgaagacacaatgacctataaatgtcctcggattacggaaaccgaaccggacgatgttgattgctggtgtaatgcaacggacacttgggtgacctatggaacatgtagtcaaactggagaacaccggagggacaaacgttcggtagcgctagctccccacgttggactgggacttgaaactagaacagaaacgtggatgtcatccgaaggagcttggaaacaaatccaacgggttgaaacttgggcgctccgacatccaggatttacagtaatcgcactctttctagcacatgccattggcacaagtatcactcaaaaaggtataatctttatattactcatgctggttacaccgtcaatggcaatgagatgcgtgggcatcggttcaagagattttgtagaaggtttatccggagcaacgtgggtggatgtggtacttgaacacggttcctgcgtcacaacaatggcaaaagataaaccgactctggatattgaattgttaaagacagaagtaacaaatccggctgtattaagaaaactatgcatagaagcgaaaataagtaacactacaactgactccagatgcccaacccaaggcgaagccactctagttgaagaacaagacgctaactttgtttgcagaagaacttttgtagaccgtggatggggtaatggctgtgggctatttggtaaaggttctttaataacctgtgcgaaattcaaatgcgtcacaaaacttgaaggaaagatagtgcaatatgaaaacctgaaatatagtgtcatcgtaacagtccacacgggcgatcaacatcaagtaggaaatgagtcaacagagcatgggaccacagcaactatcacacctcaagcaccaactacagaaatacaattaaccgattacggagccttgactttagactgtagcccacggacggggctagatttcaatgaaatggttcttttaactatgaaagaaaagtcatggttagttcataaacaatggtttttagacctgccattgccttggaccagtggggctagtacatcacaagaaacatggaataggcaagatttattggtaaccttcaaaacggcacatgcgaagaaacaagaagttgttgtgttaggatcgcaagagggtgcgatgcacacagcactaactggggcaactgaaatacaaacttcgggcactacaacaatctttgcaggacacttaaaatgtagactgaaaatggataaattaaccttgaaaggaatgtcatatgtaatgtgtacaggaagttttaaactagagaaagaagtcgcagaaactcaacacggcaccgtgttggtacaaatcaaatacgaaggcacagatgcaccctgtaagatacctttttcgacacaggatgaaaaaggcgtcacacaaaatggtagattgataacagctaatccgattgttaccgacaaagagaagcctgttaacatcgaggctgaacccccattcggagaaagttacattgtcataggggctggagaaaaagcattgaaactcagttggttcaagaaagggtcatcgatagggaaaatgtttgaggcgaccgctaggggagcacggcggatggctatattaggcgacacggcttgggatttcggttcaattgggggagtatttacatcagtcggaaagttagtccatcaaatatttggtacagcatacggagtactttttagtggggtgtcgtggactatgaaaataggaattggcgtacttctcacatggttaggacttaattcgcggtcaacgagcctatcaatgacatgcatagctgttggattagtaacactctatcttggcgtaatggttcaggcagacagcggctgcgtcataaactggaaaggccgagaactgaagtgcggcagtggtatatttgtaacaaatgaagttcatacttggacagaacaatataaatttcaagctgacagtccgaagagacttagtgctgcaatcggaaaagcctgggaggaaggtgtctgtggcattcggagtgcaacacgactagagaatataatgtggaaacagatatcaaacgaactgaatcacatattattagagaatgacatgaaatttacagtagtagttggtgacgttgcgggtatacttgcacaaggcaagaaaatgattcgtccacaaccaatggagtacaagtattcctggaaatcttggggcaaagccaaaattatcggggcagacgtacaaaacactacctttattatagatggtcctaacacgcctgaatgcccagatgatcaacgcgcatggaatatttgggaagtagaagactacgggttcggaatatttactacaaacatctggctaaaactccgggatagttacacacaagtatgcgatcatcggttaatgtcggctgcaattaaagattcaaaagccgtacacgcggatatgggctattggatagagagcgagaaaaatgaaacatggaaattggcgagggcttcctttatcgaagtaaaaacatgtatctggccaaaaagtcacacattatggtccaatggagttctagagtccgaaatgataataccaaaaatatatggtgggccaataagtcaacataattatagaccaggatattttacacaaacagcgggaccatggcacctagggaaattagagttagactttgacctgtgtgaaggtaccacggttgtagtagatgagcattgtggtaatcgaggtcccagtttaagaacgacgacagtcaccggcaaaataatacacgaatggtgctgccgctcatgtacactgcctccccttagattccgaggtgaagatgggtgttggtatgggatggaaatacgcccagtgaaggaaaaagaagaaaatttggtcaaaagcatggtaagtgccggttcgggagaggtagactcattctcattaggactgttgtgcatttctattatgatcgaagaggtcatgcggtcacgatggagccgcaagatgttaatgacaggaaccttggcagtgttcttcttattgataatgggccaactaacctggaacgatcttattagattatgtataatggtgggtgccaatgcatctgaccgtatgggcatggggacgacgtacttagccttaatggccacttttaaaatgcgacctatgtttgctgtaggactgttattccgaaggttaacctctcgtgaagtactattgctcacgattggtttatccctggttgcatctgtagaacttccaaattcccttgaagaacttggagatggactcgctatggggataatgattttaaaattactgaccgatttccagtcgcatcaactttgggcaactctcttatctttaacctttattaaaacgacattttcattgcactatgcctggaaaacgatggcaatggttctctctatcgtctcgcttttcccactgtgtttgtcgacaacatcccaaaagactacatggcttccagttctattgggaagtctgggatgtaaaccattaacgatgtttctaatcgctgaaaataagatatggggaagaaggagctggccgctaaacgaagggattatggccgtaggtatagtttcaatacttctaagtagtcttttgaaaaacgacgtaccactagccggcccactgattgcaggaggaatgctaatagcatgttatgtcatatctggttcatcggcagacctatcattggagaaggcagcggaagtaagttgggaagaagaagcagaacatagtggtgcatcacacaacattttggtagaagtgcaagatgacggaacgatgaaaataaaggacgaagaaagagacgatacattaacaattctacttaaagcaacattattagccgtaagtggggtataccccctatccatacccgcaacattatttgtgtggtatttttggcagaaaaagaaacaaagaagtggggtgctatgggacacccccagtccacctgaagtagaacgggcagttttagacgatggtatttatcgcataatgcaaaggggactactcggaagatctcaagtgggggttggtgtatttcaagaaaacgtttttcatactatgtggcacgttacacgaggtgcagttttaatgtatcagggaaagagattagagccgtcgtgggcaagtgtgaagaaggatctaatatcttatggcggcggatggcgactgcaagggagttggaacacgggagaagaagttcaagtaatagcagtagaacctgggaagaacccaaagaacgttcaaacagcgcctggaacatttaaaacacctgaaggagaagtaggagcaatcgcgcttgattttaagcctggaacttccgggtcacccattgtcaatagagaaggaaagattgtgggcctttacggaaatggcgtagttacaacaagtggaacatatgtctcggcaatcgctcaagcaaaagcatctcaagagggaccacttcctgagatagaagatgaggtgtttcgtaaaaggaatctgaccattatggacttacatccaggtagcggcaagactcgaagatatctaccagcaatcgttagggaagcaattaagagaaaactacgtacattaatacttgcaccaacccgggtagtagcatctgaaatggcggaggccttaaaggggatgccaataaggtatcagacaacagctgtgaaatcggaacataccggaaaagaaatagtcgatttaatgtgtcatgcaactttcacaatgcgactactatcgccagttcgtgttcctaattataatatgataataatggatgaagcgcattttacagatccgagcagcatagcagcacgaggatatattagtacgagggtcggaatgggcgaagcagcagcaatattcatgactgcaactccaccgggaagtgttgaagcatttccacaatccaacgcagttattcaggatgaagaacgcgacataccagaacgatcgtggaactcaggatatgaatggatcacagatttccctggtaaaacagtttggttcgtaccctccataaaatcaggtaatgacatagcaaattgtctaaggaaaaacggaaaaagagtcattcaactgagtagaaagacattcgataccgaataccagaaaacgaaaaacaatgactgggattatgtggtaaccactgacatatcggaaatgggagcaaatttcagagcagatcgagtgattgatccgagaagatgcttaaagccggtaattttaaaagatggcccagagcgagtgatcttagcgggtcctatgccagttacggtggctagtgctgcgcaacggcgtggacgtataggacgtaatcacaataaggaaggagatcaatatatttatatgggacagccattaaataacgacgaggatcatgctcattggactgaagctaaaatgttgctcgataatataaatactccagagggaattattcctgcactatttgaaccagaaagagagaaaagcgcagcgatagacggggaatatcgcttgagaggtgaagcacgaaaaacttttgttgaactgatgaggcgtggcgaccttccagtctggctaagttacaaagttgcaagtgaaggcttccaatatagtgacagacgttggtgctttgacggggaacgtaataatcaggtgcttgaagaaaatatggacgtggaaatttggaccaaggaaggagaacgaaagaaattgagacctaggtggttagatgcccgtacctattcagacccattggctctacgagagttcaaagagtttgcagcgggtagacgcagcgtgtctggagacctgatccttgagatcgggaaacttccccaacatttaacgcagcgtgcgcaaaatgctttagacaacctagtaatgttgcacaatagcgagcaaggagggcgtgcgtacagacatgcaatggaagaactaccagacacaatcgagacactaatgttactggcgttaatcgctgtgctaacagggggtgtaaccctattcttcttatcaggcagaggtttggggaaaacaagtataggactgctatgtgtcatggctagcagcgtactgctgtggatggctagtgtagaaccacattggattgccgcatcaattatactggagttctttttaatggtcttgctcataccagagccagatcgccaaagaacacctcaagataaccaactcgcatatgttgtaattggactattgtttatgatactaaccgttgccgctaatgaaatgggactattagagacaactaaaaaggatctcggtattggccacgtagccgttgaaaaccatcatcacgcagcaatgttagacgttgacttacatcctgcatcagcgtggacactttatgcggtcgcaaccaccataataacacccatgatgagacatacaatagaaaatacaacagccaatatctcacttacagcaatagctaaccaagctgcaattcttatgggattggataaggggtggccaatcagcaaaatggacatcggagttcccttactggcgttaggctgctacagtcaagtcaacccattaacacttacagccgcagtactaatgctagtagcacattatgctattataggaccagggttacaggccaaagccacgcgtgaagcgcagaagagaacagctgcaggaatcatgaaaaaccctaccgttgatgggattgtcgccatagacttagacccagtagtgtacgacgcgaaattcgaaaaacagctaggacaaataatgcttcttatattatgtacttctcaaatacttctaatgaggacaacatgggccctctgtgaatccattactcttgcaaccgggccgcttacaacattatgggaaggatctcccgggaaattctggaatacgacaattgcagtaagtatggcgaatattttcagaggtagttatcttgctggtgcaggattagctttcagtctaatgaaatcattaggaggaggacgtcgaggaactggagcacagggagaaacgttaggcgagaaatggaaaaggcagctaaatcaactaagcaaaagcgaatttaatacatataaacgctcaggtataatggaagtggatcgaagcgaagctaaagaaggcttaaaaagaggcgaaacaaccaagcacgcagtaagccgtggaacagccaaacttcgatggtttgtcgaaagaaatttagttaagcccgaaggaaaggttatcgacttaggatgtggacggggcggttggagttattattgtgctggtcttaagaaagttaccgaagtcaaaggatacacgaaaggcggaccgggacatgaagaaccaattccaatggccacgtatggatggaacctcgttaagctacattccggaaaagatgtcttctttatacctcctgaaaaatgtgacacattgctttgcgatattggcgaaagttcccccaaccctactattgaggaaggacgaactctacgagttttaaaaatggttgaaccgtggctaagaggaaaccaattttgtattaagatcctaaacccctacatgccatctgtcgttgagaccttggagcaaatgcaacgtaaacacggaggtatgttagtacgtaatccactatctagaaattcaacacatgaaatgtattgggttagttgcggcacaggaaatatcgtgtcggcagttaatatgacatccaggatgttactaaataggtttaccatggctcataggaaacctacgtatgaaagagatgtagatttaggggcaggcacaagacatgtagcagtagaaccagaagtggctaatttagatatcattggccaaaggattgaaaatataaagcatgaacataaaagtacttggcattacgacgaagataacccctataaaacatgggcctatcatggttcatatgaagtgaagccgtccggtagcgcgagttccatggtaaacggagtagtgaaacttttaacaaagccatgggatgtgattcctatggtaacgcaaattgccatgacagacactacaccatttggacaacaacgagttttcaaagaaaaagtagataccagaacaccaaaagcaaagcgcggaacagcccaaattatggaagtcaccgcaaagtggttgtggggatttttatcaaggaacaaaaagcccaggatctgcactcgagaagagttcacacggaaggttaggagtaacgcagcgataggagcagtatttgtggacgaaaatcaatggaactcagcaaaagaggccgtagaagatgagaggttctgggacttagtacatcgtgaacgagaattacacaaacaaggaaagtgtgcaacttgtgtgtacaatatgatgggcaaaagggagaagaaattaggagaatttgggaaagccaaaggttctcgagcaatctggtacatgtggttaggggcacgttttctagagtttgaggctctggggttcatgaacgaggaccactggtttagtcgtgaaaacagcctttcaggagtagaaggtgaaggattacacaaattaggatacatactacgagacattagcaaaataccaggtggaaatatgtatgctgatgacactgcagggtgggacaccagaattactgaagacgacttacaaaatgaagcgcgaatcactgatataatggaaccagaacatgcactattagcaagatctatctttaagttgacttatcaaaataaagtagtgagagtccagcggccggccaaaaatggaacagttatggacgttatcagcagaagagatcaacgaggtagtggacaagtcggaacgtatggtttaaacaccttcacgaacatggaagcacaattaattcgtcaaatggaaagtgaaggcattttctcacctagtgagctagaaaccccaaacctagcggaacgtgtacttgactggctcgaaaagtatggcgtcgaaagattaaagaggatggcaataagtggagatgattgtgtcgttaaaccaatcgatgacagatttgcaacagctcttacagcgcttaatgatatgggtaaagttcgtaaagatataccacaatgggagccaagtaaaggatggaatgattggcaacaagttcctttttgtagtcaccactttcaccagctaataatgaaagacggccgtgaaatagtagtaccgtgtcggaaccaagatgagctagtcggacgggcaagggtttcacagggtgctggatggtctctaagagaaactgcttgtcttggtaaatcatacgcacaaatgtggcagcttatgtactttcaccgccgcgatttaagattagcagctaatgctatatgcagtgcggttccagtaaattggataccgacatccagaacaacgtggtctatccatgctcatcatcaatggatgacgacagaagacatgctaagcgtatggaatagagtatggatagaagagaatccctggatggaggataaaacccatatatcgtcctggggtgacgtgccatatttaggaaaaagagaagaccaatggtgtggttcattaattggcctcacagctagagcaacgtgggccacgaatattcaagttgctataaaccaagtccgaagacttataggtaacgagaactatctagactatatgacttcaatgaaacgatttaaaaacgaatcagatcccgaaggcgctctgtggtga

SEQ ID NO: 21473 - RNA, 9879 nt, synthetic construct
  misc_feature 1..9879: note = derived and/or modified CDS sequence (opt6) from DENV-1__EU677170__SS-prME
  source 1..9879: mol_type = other RNA
agcgtgacaatgttattaatgctaatgccaactgctctcgcattccaccttaccacacgaggtggggaaccgcatatgatcgtatcaaaacaggaacgaggaaaatctcttctctttaaaacatctgctggagtcaatatgtgtactctcattgctatggatctgggggagttatgcgaggacacaatgacatataaatgccccaggattacagagacagaacccgacgatgtagactgttggtgtaatgccacggatacctgggtcacatatggaacatgtagccagacaggcgaacatagacgagataaacgatcggtagcattagctcctcatgtaggtctcggtcttgaaacccgaacggaaacttggatgagtagtgaaggggcctggaaacaaatacaacgtgttgaaacatgggccctgcggcatccgggctttactgtaatagccttgtttctagctcatgctatcggaacttccataactcaaaaagggatcatatttattttactaatgctggtaaccccgagtatggctatgagatgtgtaggcataggttcgagagactttgttgaagggctatccggcgcaacctgggtagatgtcgtgctagagcatggttcatgtgtaacaacaatggccaaagacaaacccacgcttgacatagaactgctaaaaactgaagtaactaatcctgctgtgttaagaaaattatgtattgaagcaaaaattagcaacacgacaacagacagtcggtgcccaactcaaggtgaggcgacattagtagaagaacaggatgccaattttgtctgtagaagaacgtttgtagaccgaggctggggcaacggatgtggattgttcggaaagggaagcttgatcacttgtgcgaaatttaagtgtgttaccaaactagaaggtaaaatagtacaatatgaaaacttaaagtactccgtgatagtaactgtacatactggagatcaacatcaagtagggaatgaaagcacagaacatggcaccacggctacgataacgccacaggcccctactaccgagattcaattaaccgactatggtgcattaactctggactgtagtccccggacggggctagatttcaatgaaatggtcctactaacaatgaaggaaaagtcctggttagtccataaacaatggtttttagatttaccacttccatggacaagtggtgcgtcaacttcgcaagagacatggaatcgacaagacttactagtaacgttcaagacagctcatgcgaaaaaacaagaagttgtagttttagggagtcaggaaggcgccatgcacacagcactgacgggcgccacagagatacaaacgtcagggacaactactatttttgctggacacctcaaatgcagactaaaaatggataagctgacgttaaaagggatgtcatatgttatgtgtactggaagcttcaagctcgaaaaagaggtagccgaaactcaacatggtactgttctggtccaaataaaatatgagggaaccgatgcgccctgcaaaatacccttcagcacacaagatgaaaaaggtgtaactcagaatgggcgtctaattactgccaacccaatcgttacagataaagagaaaccggtcaacatagaagcagaaccacctttcggtgagagttatattgtgattggtgcaggggaaaaagctttaaaactatcttggtttaaaaaaggttcaagcataggcaaaatgtttgaagccacagctaggggtgcaagaagaatggctatacttggtgatacagcgtgggactttggatcgataggcggagttttcacatcagtgggaaaactagtgcaccaaatatttggaacggcctatggagtgttattctctggagtaagttggactatgaaaataggtattggtgtattacttacatggctgggcctgaattcaagaagtacctctttaagtatgacctgtattgctgtgggcctagtcacgctttacctgggggtaatggtacaagcagactctgggtgtgtaataaactggaaaggacgagaacttaaatgcggcagtggaatttttgtaacgaacgaggtccatacatggactgagcaatacaaatttcaagcggattcacctaaaagactatcggctgccattggaaaagcatgggaagaaggggtttgtggaattaggtctgcaactaggcttgagaatataatgtggaagcaaatctccaatgaactaaaccatatactattggaaaatgacatgaaattcactgtggtagtgggggacgtcgctggcatattagcccagggaaaaaaaatgataagaccacaacccatggaatataaatattcttggaaatcatggggaaaggctaaaataataggagcagatgtacaaaatacaacctttataatcgacggacctaacacacccgaatgcccggacgaccagcgcgcctggaacatatgggaggtagaagactacggatttggaatatttaccactaatatatggatgaagcttagggattcatacactcaagtatgtgaccatagattgatgtcagcagcaattaaagactctaaagctgtacacgcagacatgggttattggattgaatcagaaaaaaacgagacgtggaagctagcgcgagccagttttatagaagtaaagacgtgcatatggcccaaatctcacactttatggagcaatggtgtcttagagtctgaaatgattataccaaaaatttatggaggtccgatttctcagcacaattatagacccggatattttactcagactgccggtccctggcatctaggaaaattagaattagatttcgacttatgcgaaggcaccacagtagttgtagacgaacattgtgggaatcgaggacctagtctgagaacaacaacagtcactggcaaaataatccatgaatggtgttgtaggtcgtgtacattaccccctttaagattcaggggcgaagatggttgttggtatgggatggaaatacggccagttaaggagaaagaagaaaatctggtgaaaagtatggtatcggcgggtagtggggaggtggactcatttagtttaggtttgctttgcatatctataatgatagaagaggtcatgcgaagtagatggagtcgaaaaatgcttatgactggaacgctagcggtgttctttctactaattatgggtcaattaacatggaatgatttaataagattatgcattatggtaggagcaaacgcaagcgatagaatgggtatgggtacgacctaccttgccttaatggccacgtttaaaatgagaccaatgttcgcggtgggtttgctatttcggagattgaccagtagagaagttttgttgctgacgataggattaagcctagttgcttctgtggaactaccaaatagtttagaagagctaggcgatggtctagcgatgggaataatgatattaaagctcttaaccgattttcaaagtcatcaattatgggcaacattgctgagtcttacatttattaaaaccactttctcattacattatgcatggaaaactatggcaatggttttaagcattgtaagcttattccccttgtgcttatctacaactagccagaagactacgtggcttcccgtattactaggttcattaggatgcaagccattaacgatgttccttatcgcggaaaataaaatttgggggcgaaggagctggcctctaaacgaaggaataatggccgtaggaatagtttcaatcctactatcaagtcttttaaaaaatgatgtcccattagcgggtccactaatagctggtgggatgttaatagcttgttatgtaatatccggatcttctgcggatctcagcttagaaaaagcggctgaggtaagttgggaagaagaagctgaacattctggtgcatcccacaatatccttgtcgaggtccaagacgatggaacaatgaaaattaaagatgaagaacgtgatgacacacttacaatacttttaaaagcaacattattagcggtctcgggagtttatcccttgtctattcctgctacattattcgtgtggtatttctggcagaaaaagaagcagcgtagtggggtgttatgggacacgccatctccacctgaagtagaaagagcagttctcgacgacggcatatacagaatcatgcaacgtggcttacttgggcgatcacaggtcggagttggtgtattccaggagaatgtgtttcatacgatgtggcacgtaacgagaggcgcagtcctgatgtatcaaggaaaacggttagaaccctcctgggcctcagtgaaaaaggatctgatttcatacggcggaggttggcgccttcagggaagctggaacacaggtgaggaagtccaagtcatagctgtcgaaccggggaagaacccaaagaatgttcaaactgcgcccggaacatttaagactccggaaggagaagtcggagccattgcgttagattttaaaccaggaacctcaggaagcccaattgtaaatagagaaggtaaaattgttggattatacgggaatggggttgttacaacgtcgggaacatacgtatccgcaatcgctcaagcaaaggcctcacaagaaggccctctgccagaaatagaagatgaagtctttagaaaacgaaacttaactattatggatttacaccctggttccggaaaaacgcgcaggtatttaccggctatcgtacgagaagccataaaaaggaaattacggactttaattctggcacccacaagggtagtagcatccgaaatggcagaagccttgaaggggatgccaatacgatatcaaactaccgctgtcaaatcggaacataccggaaaggagattgtagatcttatgtgtcatgctacttttacaatgcgacttctcagtcccgtaagggttccaaattataatatgataattatggatgaagcgcatttcaccgatcctagcagcatagcagcgagaggatacatatctactagagttggtatgggggaagcagcagcaattttcatgacggcgactcctcctgggtctgtagaagcgtttcctcaatccaacgctgtgattcaggacgaagagagagatatccctgaaagatcgtggaactccggatatgaatggataacggatttccctgggaaaactgtatggtttgtgccaagtataaaatccgggaatgatattgctaactgcttaagaaaaaacggaaaacgagtaatacagctatcacgaaagacgtttgatacggaatatcaaaagactaaaaataatgactgggattacgttgttacaactgatatatcagaaatgggagcaaactttagggccgatcgggtgatagaccccagaagatgtctaaaaccggttatattgaaagacggaccagaaagagtgatattagcaggaccaatgcctgtcactgtcgcatcagcagcacaaaggagaggtcgcatcggacgtaatcacaacaaagagggtgaccagtatatctatatgggacaaccgttaaataatgatgaggatcatgctcactggacagaagcaaagatgttacttgataatataaacaccccagaagggataataccggcacttttcgaaccggagcgtgaaaaaagcgcggcgattgatggcgaatatagattacgtggagaggctaggaaaacttttgtggaacttatgagaagaggcgacctaccagtgtggttaagttacaaggtcgcgagtgaaggcttccaatactcggaccggcgatggtgttttgatggggaacgaaataaccaggtacttgaagaaaacatggacgtggagatatggacaaaggaaggagagagaaaaaaactccgtcctcggtggttagacgcacgtacatatagtgaccctctagccctaagagaatttaaagaattcgcagcaggaagacgttctgttagtggggaccttattttggagataggcaaattgcctcaacatctgacacaaagagcccaaaatgcgttggacaatcttgtcatgctacataattcagaacagggaggtagagcttatcgtcatgctatggaagagttaccagataccatcgagaccctaatgctattagctttaattgctgtacttacaggtggagttaccttattttttttgtcgggaagaggcttgggaaagacgagtataggcttactgtgtgttatggcgtcgagcgtccttttatggatggctagtgtggagccacactggatagctgctagtattattctagaattcttcttgatggttttattaattccggaacctgatcgacaacgtacaccccaagataaccagcttgcgtatgtagtaatagggctattgtttatgatccttacggttgcagctaacgaaatggggttattggaaactactaaaaaagatcttgggatagggcatgtcgcagtagagaatcaccatcatgccgcaatgctagatgttgatttacaccctgcttctgcgtggacactttatgctgtggccacaacaattataacgcccatgatgagacatacgatagaaaataccactgccaacatcagtctaactgccattgcaaatcaagcagccatattgatgggactagataaaggctggcctatctcaaagatggacataggagtaccactcctcgcactaggatgctatagccaggtaaatccgctaacacttaccgcagcagtactgatgctagttgctcactatgcaatcataggtccaggattacaagcgaaagctacacgagaagcccagaaaagaacagcggctggaattatgaagaaccctactgttgatggaatcgtggcaatagatttagacccagttgtatatgatgcaaaattcgaaaaacaactgggacaaattatgctacttatattatgtacgtcgcaaattctattaatgagaacaacatgggccttgtgtgaatccattacactagctacaggcccattaaccactttgtgggaaggtagtccaggtaaattttggaacaccacaattgcagtttcgatggcgaacatcttcaggggttcctatttagcaggagcaggactagcatttagcttgatgaaaagtttaggaggagggcgtagggggacgggagcacaaggggaaacattgggagaaaaatggaaacgtcaactaaatcagctcagcaaatctgagtttaatacttacaaacgcagtggtataatggaagtagaccgctcagaagccaaggaaggtttaaaacgtggagaaactacaaaacacgctgtgagtcgcggtacagccaaactgagatggtttgtagaaaggaatcttgtaaaaccagaaggtaaagtcatagacctgggttgtggtcgagggggttggagttattattgtgcagggttgaaaaaggtaacagaagtcaagggctatactaagggaggaccaggtcatgaagagcccatcccaatggcaacttatggatggaatctggtgaaactacattcaggaaaagacgtcttcttcatcccacccgaaaaatgcgatacgctgctctgtgatatcggagaatcaagtccaaatccgacgattgaagaagggagaacactgcgcgttctcaagatggttgagccttggctacgagggaaccaattttgcatcaaaattctaaacccttatatgccgtccgtagtggaaacgcttgagcaaatgcaaaggaaacatggaggaatgctggttaggaatccgctgtctcgaaatagtacgcatgaaatgtattgggtttcatgcggaacaggaaacatagtatctgcagtgaacatgacttcaaggatgctgttaaatagatttacaatggcacataggaaacccacatatgagcgtgatgtagatttgggagctggtaccaggcatgtagcagttgaacccgaagtcgcaaatctggatatcattggacaaagaatagaaaacataaagcacgaacataaatccacatggcactatgatgaagacaacccgtataaaacatgggcctaccacggatcttatgaagtaaaaccatccgggtcagcatcttcgatggtaaatggggttgtcaaattattaacaaagccatgggatgttatacctatggttacacaaattgcaatgactgatacaactccattcggacaacaacgtgtttttaaagagaaagtagatacaagaactcccaaggccaaacgcggcacagcgcaaatcatggaagtaacggctaaatggctatggggatttcttagtcgtaacaaaaaaccaagaatatgcacacgagaagaatttacgcggaaagttcggagtaacgctgcaattggagcggtttttgtggacgaaaatcaatggaacagtgcaaaggaagctgtggaagatgaacgcttctgggacctagttcaccgggagagagagctgcacaagcaaggtaaatgcgcaacttgtgtatacaatatgatgggcaaaagagagaagaagttaggggaattcggaaaggctaaggggtcacgggctatatggtatatgtggttaggcgcacgctttctggagttcgaagcactaggttttatgaatgaagatcattggttcagtcgagaaaatagtctatcaggcgtcgaaggagaaggattgcataaacttggatatatactgcgtgacatttccaaaattccaggtggtaatatgtacgcggatgatacggctgggtgggatacccgaattacagaagatgatttacaaaacgaagcccgtattactgatatcatggaaccagagcatgccctgctcgcgagatcaatttttaaactaacctatcaaaataaagtagttcgggttcaaagaccagctaagaacggcactgttatggatgtaataagccgccgagatcaacgaggcagtggtcaggtaggcacctatggtctaaacacttttacgaatatggaggctcagttaatacgacaaatggagtcagaaggcattttttcgcccagtgaattagaaacaccaatacttgctgaacgcgtcttagattggttagagaagtacggtgttgaaaggttgaagaggatggcaatttcaggcgatgactgcgtagttaagccaatcgatgaccgttttgcaacagcattaacagctcttaatgacatgggaaaagtaagaaaagatattccacaatgggaaccttcaaaaggctggaatgactggcaacaagttccattttgtagtcatcattttcatcaattaatcatgaaagacggccgagaaatagtcgtcccatgccggaatcaggatgaactagttggacgcgccagagtttcacaaggggccggatggtcgctccgagaaacagcatgtttgggtaaatcgtacgcacaaatgtggcagttgatgtattttcatagaagagatttgaggttagcagccaacgccatctgcagcgctgtacctgtagattggatcccaacgtcacgtacaacttggagcattcatgctcatcatcaatggatgacgacagaggacatgcttagcgtatggaacagagtttggatagaggaaaatccctggatggaagataaaactcacatttcgagttggggtgacgtaccatacttaggaaagagagaagatcagtggtgcggttccctaataggtttaaccgcaagggctacctgggcaacaaacattcaagttgcgataaatcaggttagaaggctaattggtaacgaaaactatctagactatatgacgtccatgaaaaggttcaaaaacgagtctgatccagaaggggcattatggtaa

SEQ ID NO: 21474 - RNA, 9879 nt, synthetic construct
  misc_feature 1..9879: note = derived and/or modified CDS sequence (opt6) from DENV-1__EU677171__SS-prME
  source 1..9879: mol_type = other RNA
tcagtgactatgctgttaatgctcatgccgaccgctctagcatttcatctcactacccgtgggggtgaaccacatatgattgtatcaaaacaggaaagaggtaaatccttactatttaaaacaagtgcgggagtaaacatgtgtacactaatagcaatggatttaggagaactgtgtgaggatactatgacgtataaatgtcccagaataacggaaaccgagccagatgacgttgattgctggtgtaacgcaacagatacctgggttacttacggtacatgttcccaaactggagaacatcggcgagacaaacgatcagtagcactcgcaccacatgtaggactaggattggaaacccgcacggagacctggatgtcctcagaaggagcttggaaacaaatacagcgagtagagacgtgggcactcagacatccaggatttacagttatagcactgtttctagcacacgccataggaacatcgattacacaaaaaggcattatatttatactattaatgcttgtgacaccgagtatggcgatgagatgtgtgggaataggatcacgagattttgttgaaggcctgtctggtgctacatgggtagacgtagtattagaacacgggtcatgcgtcacaacaatggccaaagataaaccgacgctggacatagaattacttaagacggaagtaacaaatcccgcagtattaagaaaactctgtatcgaagcaaaaatcagcaataccacaacagattcaagatgtccgactcagggagaggctacactggtagaagaacaagatgcgaattttgtttgtaggaggacattcgtagatagaggttggggtaatggatgtggactattcgggaaagggagtctaataacctgcgcgaagtttaaatgcgttacgaaactagaaggcaaaatcgtacaatacgagaacttaaagtactctgtaatagttacagttcacacaggggatcagcatcaagtggggaatgaatctactgaacatggaaccacagctaccataacgccacaagctcctacaacggaaatacaattaaccgattacggcgctctgactttagattgtagcccacggactggtctcgacttcaatgaaatggtactcctaactatgaaagagaaatcatggctagttcacaaacagtggtttctcgatttaccacttccctggacaagtggagcgtcaacaagtcaagaaacgtggaacagacaagatcttttagtcactttcaagacagcacacgccaagaaacaagaagtcgtagtcctggggtcccaagaaggcgcgatgcataccgccttaactggagcaactgagatacaaacaagtggtaccacaacgatatttgctggacacttgaaatgtcgcctgaaaatggataaattgacattaaaaggcatgtcatacgttatgtgtacggggtcattcaaattagaaaaggaagtcgcagagacccaacatggcacagtattggtacaaattaaatatgagggtacagacgcaccatgcaaaatcccattcagcacacaggacgaaaaaggagtaactcagaacggtcgactgataactgctaaccctatcgttacggataaagaaaaacctgttaatatagaagctgagcctccattcggagagtcatatattgttattggagccggcgaaaaggcattgaaacttagttggtttaaaaaggggagttcaataggtaaaatgttcgaagcaaccgctagaggtgcacgacggatggcaatactcggtgatacagcttgggactttggttcgattggaggcgtatttactagcgtagggaaattagtgcatcaaatcttcggtacagcttatggagttttattcagtggagtttcgtggacgatgaagattgggattggtgtattattaacttggctaggattaaacagtcgatcaacgtcgctctcgatgacatgcattgctgttggattagtaactctatatctgggtgttatggtgcaggccgacagtggctgtgttataaattggaagggacgcgaactaaaatgcggttcaggtatttttgtcactaacgaagtccacacgtggactgaacagtacaagttccaagcagattcacctaaacgtctgtcagctgcgatcggcaaagcatgggaagaaggagtatgtggcataaggtcagctaccaggttagaaaatatcatgtggaagcagataagtaatgaattgaatcatatactgctagagaatgacatgaaatttacagtcgtggtcggtgatgtagcaggaatactagcacaaggaaagaaaatgataagaccacagccgatggagtataaatattcttggaaatcatggggaaaagcaaaaattataggcgcagatgtccaaaatacaacatttattattgatggacctaatacgccagaatgcccagacgatcaaagagcttggaatatttgggaagttgaagactatggattcggcatttttacaacgaacatatggttaaaattgcgcgattcttacacgcaagtttgcgatcaccgtttaatgtccgcggcaataaaagactcgaaggccgtacatgcagatatgggttattggatagaatcagagaaaaatgaaacttggaaacttgctagagcttcattcatagaggttaagacttgcatatggccaaaaagccatacattatggtcgaatggtgttttagagagcgaaatgatcataccaaaaatatacggaggaccgataagtcaacataattatagacctgggtatttcacacaaacagcaggaccatggcaccttggaaaattggaactcgattttgatttatgtgaaggaactacggtagttgtcgacgaacactgtggtaacaggggaccgagcttaagaactaccactgtcacagggaaaataattcatgagtggtgttgtcgatcttgcacattacctccgttgagattcaggggcgaggatggctgttggtatggaatggaaatacggcctgtgaaagagaaagaagagaatctagtgaaatcaatggtctctgcgggatcgggcgaggtcgacagcttttccctaggattgctctgtataagcataatgatagaagaggtcatgagatcacgatggtccagaaaaatgttaatgactggaaccctagctgtattctttctcttaataatgggacaactaacgtggaatgatttaatacgactatgcatcatggtaggtgccaacgcatcagatagaatgggtatgggaaccacgtaccttgcccttatggcaacatttaagatgaggccgatgtttgctgtagggttactatttcgaagactgacaagtagggaagtcttattattaacgatcggcttatccctggtcgccagcgtagaactgccaaatagtcttgaagaactcggcgatggtcttgcgatgggtattatgattctcaaactccttacggatttccaaagccatcaactatgggcaacactcttatcattaacctttattaagacaaccttttccctacactatgcatggaaaacaatggctatggtactatcaattgtcagtttattccctttatgtttgtccacgactagccaaaagacaacatggttacctgtactcctgggatcgttaggatgtaaacctttaacaatgtttttgatagccgaaaataaaatatggggccggcggtcgtggccgcttaatgaaggtattatggcggtagggatcgtgtccatcctattaagttcattattgaaaaatgacgtaccgctagcaggcccactaattgcaggcggaatgcttatcgcatgttatgtgatatcaggcagttcagcagacctgtccttagaaaaagccgcagaagtctcttgggaagaagaggcggagcattctggtgcaagccacaacatcctagtcgaagttcaagatgatggtaccatgaagattaaagatgaagaacgcgatgatacactaaccatactattaaaggctactctcctcgccgtctcaggagtatacccattgtccataccggcaaccttattcgtctggtatttttggcaaaagaagaaacaacgatcaggtgtcttgtgggatacaccaagcccaccagaagtagaacgtgcagtattggacgatggaatataccgcataatgcaaagaggactgttagggcggtctcaagttggtgtcggggtatttcaggagaacgtatttcatactatgtggcacgtaacaagaggcgctgtcttaatgtaccaagggaagaggttagagccgtcttgggcatccgttaagaaagacctaataagttacggtggtggctggaggttacaaggttcctggaacaccggcgaggaagtccaagttattgctgtggaaccaggtaaaaaccccaaaaatgtacagactgcccctggcactttcaaaacaccagaaggagaggtaggagctatagcactggactttaaacccgggacaagcggaagtcccatcgtaaatcgcgaaggtaaaatagttggattatatggaaacggcgttgtcactacatctggtacttatgtatctgcaattgcccaagcaaaggcaagccaagaaggaccattaccggaaatcgaggatgaagtatttagaaagcgaaatctaaccattatggacctccaccctggatcaggtaaaacacgtaggtatctacctgcaattgtaagggaggctataaaacgaaagctcaggaccctaatccttgcaccgacacgcgtagtagcttcagaaatggctgaagcacttaaaggcatgccaataaggtatcaaacaacagcagtgaaaagtgagcacaccggtaaggagattgtggatttaatgtgccacgccaccttcactatgagattactgagccccgtcagagtgcctaattacaatatgatcataatggacgaagcacatttcaccgatccctcttccatcgcagctcgtggatatatttctacaagagtcggtatgggcgaagcagctgcaatattcatgaccgctacacccccgggctcagttgaagcgtttccacaatccaacgcagttatacaagacgaagaaagagatattcccgaaaggagctggaactcgggatacgaatggatcactgattttcccggtaaaaccgtatggttcgttccatccataaagagcggaaatgatatagctaactgtctgagaaagaatggaaaaagagtcatacaacttagccggaaaacttttgacactgaataccaaaagactaaaaataatgattgggattacgtagttactacagacatctcagaaatgggggcaaacttcagagccgatagggtgatcgacccaaggagatgtctcaaacctgtaatactaaaagatggtccggaaagagtaattctagcagggccaatgcctgtaacggtggcaagtgcagcacaacgacgcggtaggattggacgtaatcacaacaaagagggcgaccagtacatatacatgggacaaccgctcaataacgatgaagaccatgcccactggacagaagctaagatgctactggacaacataaatacgcctgagggaataatcccggccttgttcgaacctgagagagaaaaatcagcagctattgacggagagtacagacttcgaggtgaagccaggaaaacgttcgtagaattgatgcgacgaggagatcttcctgtctggttgtcatacaaagtagcctctgaaggattccaatattccgaccgtagatggtgttttgatggtgagaggaataatcaggttttagaggaaaatatggatgtcgaaatatggacaaaggaaggcgagaggaagaaattgagaccaagatggctagatgcacgcacatactcagatccactagcactgagagaatttaaagaatttgcagcgggtagaagatccgtgtcaggggatctaattctagaaataggaaaattaccgcaacacctaacgcagcgagcgcaaaatgctctagataatctagtaatgttacataacagtgaacagggaggcagagcgtatcgacatgcaatggaagaattaccggacacaatagagacattaatgctgttggcactgattgcggttcttacagggggagtcacactattctttttaagcggacgtgggcttggtaaaacgagtatagggctactttgtgttatggctagtagcgtcttactatggatggccagcgtcgaaccacattggattgcagcgtcgattatactagagttctttttaatggtactactcatcccagaacccgatagacaaagaacaccccaagataatcaattggcatatgtcgtaataggtcttttattcatgattctgactgtggcggcaaatgaaatggggctactagaaactacgaagaaagatttaggtataggtcatgttgcagtcgagaaccatcatcacgcggcaatgttagacgtagatctccacccagcctcagcctggactttatacgctgtagcaactactattataactccaatgatgagacatactatcgagaatacaacggcgaacattagcctgaccgcaatagctaatcaagcggcgattctgatggggctagacaaagggtggccaattagcaaaatggacattggagtacctttattggcactagggtgttattcgcaagttaatcctctaactttaacagccgctgtacttatgttagtggcacattatgcaatcatagggccaggactacaagcaaaagctacacgtgaggcgcaaaaacgaaccgcggcaggaataatgaagaatccaaccgtagacggaatagtggctatagacctagatcctgttgtatacgacgcaaaatttgaaaaacaactgggtcaaataatgttactcattttatgtacatcgcagatattactaatgagaaccacgtgggctttgtgtgagagcattactttagcaactggtccactaacaaccctctgggaaggtagcccaggtaaattttggaacactactattgctgtaagtatggcaaatatattcagaggatcctatttagcaggggcagggttggcattttctttaatgaagtcactaggtggtggtcggagaggtacaggagcccaaggagagactcttggggagaagtggaagaggcaactgaatcaacttagtaagtccgaatttaacacttataagcgatccggcataatggaggtagaccgtagcgaagccaaagagggtctcaaacgaggagaaacaacgaaacacgcagtatcccgtggtactgcaaaactccgatggtttgttgaaagaaatctagtgaaaccggagggaaaagtaattgatctcggttgtggtagaggagggtggtcatattattgtgctgggcttaagaaagtaacagaggtaaagggttatacaaaaggaggaccaggtcatgaagaacccattccaatggctacctatgggtggaatcttgtaaagctacatagtggaaaggatgtcttcttcatacccccagagaaatgtgatactttactatgtgatattggtgaaagttctcctaacccaaccattgaggaaggacgaacactacgtgtattgaagatggtagaaccttggttaagagggaatcaattttgtattaagatattgaatccatatatgccctcagtagtcgagacattagaacagatgcaaagaaaacatggtggaatgttagttagaaaccccctatctagaaattccactcatgaaatgtactgggtctcatgtggtactggtaatattgtgtcagcggtgaacatgacttctcgaatgctcctaaaccgctttaccatggcgcatagaaaacccacatatgaacgtgacgttgatctaggggctggaacccgtcacgtagcagtcgagccagaagtagccaacctcgatattattggtcaaagaatcgaaaatattaaacatgagcacaaaagcacatggcattatgacgaagataacccatataagacctgggcgtaccatggaagctatgaggtcaaacctagtgggtccgcctcaagtatggtaaatggcgttgttaaactgctcacgaaaccgtgggatgttataccgatggtcactcaaatcgcgatgaccgacactacaccattcggtcaacagcgtgtctttaaggaaaaagtggatacccggacacctaaagccaaaagaggaacagcccaaataatggaagttactgcaaagtggttgtggggatttttgtctcgcaataaaaagccaagaatctgcactcgtgaagaatttacacgcaaagttagaagtaatgcagcaataggggcagtatttgttgacgaaaatcaatggaactcagctaaagaagccgtagaagacgaacgattttgggatttagtacatagagagagagagctacataagcaagggaaatgtgcaacgtgcgtatataacatgatgggaaaacgagagaaaaagttaggtgagttcggtaaggccaaaggtagtagggcaatttggtacatgtggttaggagctaggttccttgaatttgaggctttaggatttatgaatgaagaccactggttctcgagagagaacagtctttctggagtcgagggtgaaggcctacacaaattaggttatatattaagggatatcagtaaaattccgggaggaaatatgtacgcggatgacacggctggatgggatacaagaattacggaagatgacctacaaaatgaagctagaattactgatataatggaaccagaacacgcgctactcgcccgatctatattcaaattaacttatcaaaacaaagtggtacgagtacagagaccagccaaaaatggcacagtaatggacgtaataagtcgcagagaccagagaggttctggacaagttggtacatacggcctgaatacttttacgaatatggaagcacaacttatacgacaaatggagagtgaagggatattttcgccatccgaattggagacacccaacctggctgagagggttctggactggttagagaaatatggtgtagagcgattaaagcgaatggcaatctcgggtgatgattgtgtggtaaagccaatagatgatcgatttgcaactgctctcaccgcattgaacgacatgggtaaagtacgtaaggacattccgcaatgggagccttcaaaaggctggaacgattggcaacaagtgccattttgctcacaccattttcatcaattgatcatgaaagacggtcgagaaatcgtcgtaccatgcaggaaccaagatgagttggtaggacgagcaagggtgtcccaaggagctgggtggagtttacgagaaaccgcttgtttaggaaaaagttatgcccagatgtggcaattaatgtattttcatagacgcgatttaagactcgccgctaacgcgatatgtagcgctgtaccagtcgactggataccaacgtcccgaaccacatggagtatacatgcgcatcatcaatggatgactacagaagatatgttgtcggtttggaaccgagtatggatagaagaaaatccctggatggaggataaaacgcatatcagttcgtggggagacgtgccttatttaggcaaaagagaagatcaatggtgtggttcgctaattggactgaccgccagagcaacttgggcaacaaacattcaggtagctataaatcaagtacgtcggttgattggcaatgagaactacctagattacatgacaagtatgaagagatttaagaacgaatctgatccagaaggggctttatggtga

SEQ ID NO: 21475 - RNA, 9879 nt, synthetic construct
  misc_feature 1..9879: note = derived and/or modified CDS sequence (opt6) from DENV-1__EU677172__SS-prME
  source 1..9879: mol_type = other RNA
agtgtgacaatgctattaatgctaatgcctacagcgctagcatttcaccttacaacaagaggtggtgaaccgcacatgatcgtaagtaaacaagaaaggggtaagagcttactttttaaaacttcagcaggggttaatatgtgtaccctaatcgcgatggacctaggggaactatgcgaagacaccatgacgtacaaatgccctcgaatcactgaaactgagccagatgacgttgactgctggtgtaatgcaaccgatacatgggtaacatatggtacctgttcacaaacaggagaacacagaagagataaaagatcggtggctttagcaccccatgttggattaggcctagaaacacgaactgagacctggatgagctcagaaggtgcctggaaacaaatacaaagagtagagacttgggccttgcgacatccgggatttactgtgatagctttatttttagcacatgcaataggaacatccatcacacaaaaagggataatctttatactccttatgttagtaacaccttctatggctatgaggtgcgtaggtataggatcgcgtgattttgttgaaggactgagtggcgcaacttgggtagacgttgtcctagaacatggctcatgcgttacgactatggcaaaagataaaccaacactagacatagagctacttaaaactgaagtaacgaacccagctgtactgagaaaattatgcatagaagcgaaaatatcaaacacaacgaccgattctagatgtccgacccagggagaagcaacactggtggaagaacaggacgcgaactttgtctgccgtagaacctttgtggacagaggatggggcaatggatgtggtctgttcggaaaaggcagcttgattacctgtgcaaaattcaaatgtgtaacaaaactagaaggaaaaatagtacaatacgaaaatctaaaatacagcgtaatcgtgacggtacatactggagaccagcaccaggtcggcaatgaatcgacagagcacggtacaacagctacaataacaccacaggcccctacgacggaaatccaattgacggactacggagcattaacacttgactgttccccacgcacgggactggattttaacgagatggtcctgttaaccatgaaagagaaatcatggctagttcataaacagtggtttttggacttgcccctaccctggacttcaggggcaagtacaagccaagaaacatggaacagacaggatctactcgtaacctttaaaactgcacacgccaagaaacaggaagtagtggtgttaggatcacaagaaggtgcgatgcacacagcactaacaggagcgacagaaatacaaacctcaggtactaccactatatttgcgggacatctcaaatgccgacttaaaatggacaaattaacactaaaagggatgtcgtatgttatgtgtacgggttcattcaaactagaaaaagaactggccgagactcaacacggcactgttctggtacagatcaaatacgagggaaccgacgcaccctgcaaaataccgttttctactcaagatgaaaagggtgtcacacaaaacggaagactgatcactgctaacccgatcgtgacagacaaagaaaaacccgttaacattgaagcagaaccaccgtttggcgaaagttacatcgtaataggagcgggtgagaaggctttgaaattgtcatggtttaagaaaggatcctcgataggtaagatgtttgaagctacagcaagaggagcgagacggatggctattcttggagacaccgcatgggacttcggcagtataggtggcgtatttacttccgttggaaaactcgtacatcaaatctttgggactgcatacggtgtattgttctcgggtgtatcatggacgatgaaaataggcattggagtactactaacctggctcgggctaaattcgagaagtacctccctatcaatgacatgtatagcagtcgggctagtcactttatacttaggggtaatggtccaagccgattccggatgtgttattaactggaagggacgggaattaaaatgtgggtcaggaattttcgtaacaaacgaggttcacacatggacagagcaatacaaatttcaagctgattcacctaaacgtctttcggcagcaattgggaaggcttgggaagagggagtctgtggcatacgttccgctacaaggctggaaaatattatgtggaaacagattagcaatgaattaaatcatatacttttagaaaatgacatgaagtttacggtagtcgtcggcgacgtagcaggtatacttgctcaaggaaagaaaatgataaggccacaaccgatggagtataaatactcatggaagagttgggggaaagcaaaaataattggggctgatgcacagaatacaaccttcattatagatggacccaacacaccagaatgccctgatgaccaacgagcatggaacatatgggaagtagaagactatgggttcgggatatttacgactaatatatggctgaaactccgagacagttatactcaagtatgcgatcatcgcttgatgtcggcagcaataaaagatagtaaggcagtgcatgctgacatgggatactggatagaaagtgagaaaaatgaaacatggaaattagcacgtgcatcgtttatagaagtaaagacatgtatatggccaaaatcgcacaccctatggtccaatggagtgctagaaagcgaaatgatcattccgaaaatttacggtgggcctatttcgcaacacaattatcgtcctggatactttacccaaactgcaggtccatggcacttaggaaaactcgaattagacttcgatctatgcgaggggaccacagtggttgtagacgaacattgtggaaatagaggaccatcactgagaacaaccacagttaccggtaaaatcatacatgagtggtgttgcagaagttgcacattacccccattgagatttcgtggtgaagacggctgctggtacggaatggagatacgtccagttaaagaaaaggaagaaaatcttgtgaaaagtatggtgtccgcaggttctggcgaggttgatagcttttcattggggctgttatgtatctcgataatgatagaggaagtcatgagatcacgatggagccgaaaaatgttaatgacggggactcttgccgtcttctttctactaacaatgggacagcttacctggaatgatttgataagattatgcataatggtaggtgctaatgccagtgatagaatgggaatggggaccacatacctagctctaatggcaacctttaaaatgaggccaatgtttgcagtgggattactgttcagacggcttaccagcagagaggtgttactattaacaattggactaagtctcgtggcaagcgtggaacttccaaacagtctagaagaattaggggatgggctagctatgggcataatgatattaaaattgcttacagatttccaatcgcatcagctttgggctacactgttaagtttgacgttcataaaaactacattttccttacattatgcatggaaaaccatggccatggttctaagtatagtcagtcttttcccgctttgtttaagcacaacgtcacagaaaacaacgtggctgcctgttttgctaggcagtctaggatgtaaacccttgactatgttcttaatcgcggagaacaaaatttggggtcgaagatcatggccccttaacgaaggcataatggccgtcggtatagtaagcatactgttatcaagcctacttaaaaatgatgttcctttagctgggccattaatagctggtggaatgttaatcgcttgctacgttattagcggatcatcagcagacctatctttggaaaaagcagctgaagttagttgggaggaagaggcagaacactctggagcaagtcacaatattttagtagaggtccaagacgacggcacgatgaagattaaagacgaagaaagggacgatacactcaccatcttattaaaagccacattattagcagtaagtggagtatacccactatcgattcccgctactctcttcgtatggtacttttggcagaaaaagaaacaaagatcaggcgtattatgggacacacctagtcctccagaagtagaaagggcagtcttggacgacggtatttataggattatgcaaaggggacttcttggaagaagccaggtcggagtcggcgtttttcaagagaacgtctttcacacgatgtggcatgttacaagaggtgctgttctcatgtatcaaggcaagagactagaaccatcatgggcttcagttaagaaggacctaataagctacggagggggctggcgtctgcaaggaagctggaatacaggagaagaagtccaggtaatagcagttgaacctggcaaaaatcccaaaaacgttcaaacagctccaggaacctttaaaacacctgaaggcgaagtcggcgccatcgctctggattttaaaccaggcacatccgggtctcctattgtcaatagagaagggaaaatagtaggactgtatggtaatggagtagtaacgacatcaggtacatatgtgtctgcaatcgctcaggcaaaggcttctcaagaaggacctttaccagaaatagaagacgaagtattcagaaagagaaacctgacgatcatggacctgcacccaggaagcggaaaaactagaagatatttaccagcaatcgtacgagaagcaatcaagagaaaacttcggacgctaatattagccccgactagggtagttgcaagtgaaatggccgaggctttgaaaggcatgccaattagatatcaaacaaccgcagttaaaagcgaacataccggtaaagaaattgttgatttaatgtgtcacgcaacgttcaccatgaggctcctctctccagtgcgagtaccaaattataatatgataattatggatgaagcgcatttcacggacccttcgtcgattgcggcacgtggctatatatctacacgcgttggcatgggagaagcggcagcaatattcatgacagctacacccccaggtagtgttgaagcatttcctcagtcaaatgctgtaatccaagacgaagaacgagacataccagagcgaagctggaactcaggttatgaatggataaccgatttcccaggaaaaactgtttggtttgttccttcgataaaatctggaaatgacatagctaattgtctaaggaagaacggcaagagagtaatccagctaagtcgaaaaacatttgatactgaatatcagaaaaccaaaaataatgattgggactatgtagtcactacggatatcagtgagatgggagcaaactttagggctgatcgagtaattgatcctagaagatgtttgaaacctgtaattctcaaagatggtccggaaagagtcattttagcaggcccgatgcctgttaccgtagcctcggctgctcaaagaagaggcagaataggtagaaaccataacaaagagggagatcaatatatatacatggggcaacccctaaacaatgatgaagatcatgcgcattggacggaagccaaaatgctattagacaacattaacacacctgaaggaatcataccggcattattcgaaccagaaagggagaaaagcgccgcgatagacggcgaatacaggcttcgaggtgaagcaaggaaaacgttcgtcgaactgatgagaagaggggacttacctgtctggctaagctacaaagtcgcgagtgagggttttcagtattccgaccgacgttggtgttttgatggggaaagaaataaccaagttttagaagaaaacatggatgtagaaatttggactaaagaaggcgaaaggaagaaattacgaccaagatggcttgacgcaagaacatactccgatccgctagcactacgggaatttaaagaatttgcagcgggtagacggtctgtcagcggtgatttaattttggagatcggtaaactgccacaacatcttacacaaagggcccaaaacgctttggacaacttagtaatgttacataactcggagcaaggcgggagagcatacagacatgccatggaggagttaccagacactatcgaaacattgatgctcctcgcattaatcgctgtattgacaggaggggttacgctgttctttttaagtggaagaggtctcggaaaaacatccattggattactatgcgtaatggcatcatcagtattgttatggatggcatctgttgaacctcactggatagccgcatctattatattagagttctttcttatggttctattgattcctgaaccagatagacaaagaactccacaagataatcaactagcttatgtcgttatcgggctattatttatgatactcactgttgctgctaatgaaatgggcttattggaaaccacgaagaaagatttgggaatagggcacgtagcagtagaaaaccaccatcacgcggcgatgttagatgttgatttacatcctgcatctgcgtggactttatatgctgtcgctaccacaattattactccaatgatgagacacaccattgagaacacaacagctaacatatcattaactgcgatagcgaatcaagctgcaattctaatgggtttagacaaaggatggccaattagcaagatggatattggcgtgcctctactagctctaggatgctatagtcaggttaacccgctaacacttacagccgccgtcttgatgttggtagctcattatgcaataattggtccaggactccaggctaaagcaacaagagaggctcagaaaaggacagcagcaggtatcatgaaaaatccaaccgtggatggtatagtagctatagacttagatcctgtcgtgtatgatgccaaatttgaaaagcaactagggcaaataatgttattaatattatgcacttcacaaatacttcttatgaggaccacttgggcgctttgtgaatccataacacttgccactggtccactgacaacactgtgggaagggagtcctggtaaattttggaataccaccatagcagtgagtatggctaatatatttagaggatcgtatctggccggagccggccttgcctttagcttaatgaaaagtttaggaggtgggaggcgaggcacgggagcgcaaggtgaaactcttggagaaaaatggaaacgacaacttaatcaattatcaaaatcagaatttaatacctacaaacgaagcggcataatggaagttgataggtcagaagccaaagagggtcttaaaaggggagaaacaacgaaacatgcagtgtccagaggaactgctaaattaagatggttcgtagaaaggaatttggtaaaacctgaggggaaggtgattgatttgggatgtggacgaggcggatggtcctattactgtgctggactgaagaaagtaacagaggttaaaggatatacgaaaggtgggcctggacatgaagaaccaatacctatggctacatatggttggaacttagtcaagctgcattctggtaaagatgtattctttataccgcctgaaaaatgtgacacattattatgcgatatcggcgaaagcagtccgaaccccaccatagaagagggccgaacgctgagagttctcaagatggttgagccatggctaagaggcaatcagttctgtataaagattttgaatccctacatgcctagcgtcgtagaaaccttagaacaaatgcagcgcaagcacggaggaatgttagtacgcaaccctctgtcaagaaacagtacacatgaaatgtattgggtatcatgtggtacagggaatatagtaagcgccgtcaatatgacatcaagaatgctgttaaaccggttcacaatggcacacaggaaaccaacatacgaacgcgatgtggaccttggagcgggaactcggcacgtagcagtggaaccggaagtcgcaaacttggatataattggccaaagaattgaaaatataaaacacgagcacaaaagcacttggcactatgacgaggacaatccatacaaaacttgggcctaccacgggtcatatgaagttaagccttccggaagtgcttcttcaatggttaatggcgtagtgaaactattaacaaaaccttgggacgttatacctatggttacccaaatcgcaatgacagacacaactccctttgggcaacaaagagtttttaaagagaaggttgatacgaggacaccaaaagctaaaagaggaactgcgcagatcatggaagtgacagcaaaatggctttggggattcttgtctcgcaacaagaaaccacgtatctgcacaagagaagaatttacaagaaaagttagatcaaacgcggcaattggggccgtatttgtagacgaaaatcaatggaactcagccaaagaggcagtagaagatgaaagattctgggatctagtacatagggaacgtgaactacataaacaaggtaaatgtgccacgtgtgtttataacatgatgggcaagagagagaagaaattaggagaatttggaaaggctaaaggatcacgtgctatttggtatatgtggctaggagcaaggtttttagaatttgaggctttaggatttatgaatgaagaccattggttctctcgtgaaaattccttgtcaggggttgaaggagaaggcttgcacaaactagggtacatattgagggatattagcaaaattccaggagggaacatgtatgcagacgacacagctggatgggatacccggattacagaagacgacttgcagaatgaggcaagaattactgacataatggagccagaacatgccttgttagcgaaaagtatattcaaacttacatatcaaaacaaggtcgtaagggtccaaaggcccgccaaaaatgggacagtgatggacgttattagtagaagggaccagcgcggatctggacaagttggtacgtatggcttaaatacatttacaaatatggaggcgcaattaatcagacaaatggaaagcgaaggtatattctccccatcggaactagagacccccaatctagcggaacgtgtattggattggctcgaaaaatacggcgtggagcgtttaaaacgcatggccatctctggtgatgattgtgttgtaaaaccaattgatgacagattcgcaacagcactaactgcactaaatgatatgggaaaagtgagaaaagacatccctcagtgggaaccatctaaagggtggaatgactggcaacaggtcccattttgctctcaccacttccatcagttaataatgaaagacggtcgggagatagttgtaccatgcaggaatcaggacgaacttgtaggaagggcccgagtatcgcagggagcaggatggagtctaagagagacggcgtgtctcggtaaatcatatgctcaaatgtggcaattaatgtatttccacagacgtgatttacgtttagcagcaaatgctatatgctccgcggtcccagtagattggatacccacaagccgaacaacctggtcaatccatgcgcatcaccaatggatgaccacagaagacatgttatccgtatggaacagagtatggatagaagaaaatccctggatggaagacaaaacgcatatatcttcatggggagacgttccttacttaggcaaacgggaagaccaatggtgtggttccctcattggactaacagcacgcgcaacctgggcaacaaatatccaggtagctataaatcaagtaagacggctgatcggaaacgaaaattacctagactacatgaccagcatgaaacgctttaaaaatgaaagcgaccccgaaggggcgctctggtag

SEQ ID NO: 21476 - RNA, 9879 nt, synthetic construct
  misc_feature 1..9879: note = derived and/or modified CDS sequence (opt6) from DENV-1__EU677173__SS-prME
  source 1..9879: mol_type = other RNA
agcgtcacaatgttgttgatgctaatgcccacagcattggcgtttcacttaactactagaggaggggaaccacacatgatagtcacgaaacaggaacgtggaaaatctttattatttaaaaccagtgctggagttaacatgtgcaccctgattgcaatggatttaggcgaactttgcgaagatacaatgacttataaatgcccgagaataacggaagcagaacccgacgatgtagattgctggtgtaacgcgacagatacgtgggtaacttacggaacgtgttcccaaaccggagaacacagaagggataaaagatcagtggcattggctccacatgtggggctcggtctggaaacaagaacagaaacgtggatgtcttctgaaggagcatggaaacagattcaacgcgttgaaacttgggcgctaaggcatccaggatttacagttatcgcattatttctagctcatgcaattggaacaagcataactcaaaaaggtataatatttattctgctgatgctggttacaccaagtatggcaatgcgatgtgtgggcattggatcaagagattttgtcgaaggcctaagtggggcgacatgggtagacgtagtcttagaacatgggagttgtgttacaactatggcaaaagacaaacctaccttagatatagaattactaaaaacagaagtgactaatccggccgttttacgaaaactatgtattgaagccaaaatatcgaatacaacgactgattctcgttgcccgacccagggcgaagcgactctcatggaagaacaagacgcgaactttgtgtgcaggcgaacatttgtggatcggggttggggaaatggttgcggtttatttggtaaaggatcgctaattacatgtgcgaaatttaaatgtgtaactaaactagaaggtaaaattgtccaatatgagaatctgaaatatagtgtaatagtaaccgttcacacaggtgatcagcaccaagtgggaaacgagtccacggagcatggaaccaccgcaacaataacaccgcaggcaccaacgagcgaaatacaactaaccgactatggagcgctgactctagactgtagcccccgcacaggtttggattttaacgaaatggtactattaactatgaaagagaaatcgtggttggtccacaaacagtggtttctagacctacccttgccctggacatcaggtgcaacaacgagtcaagaaacatggaaccgtcaagatctcttagtaacatttaaaacagcccacgcgaagaaacaagaagttgtcgtgcttggttcccaagaaggagcgatgcacacagctttaacaggcgccacggaaatccagactagcggaaccaccactatatttgcgggccacttaaaatgcagattaaaaatggacaaactaaccctgaaaggtatgtcatatgtgatgtgcactggatcttttaaacttgaaaaagaagtggctgaaacccaacacggtacagtcctggtgcaaataaaatacgagggcacagacgcaccatgtaaaataccgttctccacacaggacgaaaaaggtgtaacacaaaacgggagactaattactgctaaccctattgtcactgacaaagagaaaccagtcaacatcgaggctgaaccaccatttggtgaaagttatatcgtaattggggctggggaaaaggcactgaaattaagctggtttaagaaaggatcatctatcggtaaaatgtttgaagcgaccgctagaggagcaaggcgaatggcaatactaggtgatacagcttgggatttcggctccataggtggagttttcacatcagtaggaaagctagtgcaccaaatttttggaaccgcatatggcgtcttattttccggggttagctggacaatgaagataggaattggtgttttacttacatggctagggctaaattctagatcgaccagcttaagtatgacgtgtattgcagtaggcctagttacattatacttaggagtcatggtacaagcagattctggctgtgtaattaattggaaaggtagggaattgaaatgcgggagtgggatcttcgttacaaacgaagtacatacatggaccgaacaatataaattccaggcagacagcccgaaaagactctctgctgccataggtaaggcatgggaagagggagtttgtggcattagaagcgcaacaagattggaaaatattatgtggaaacagatcagtaatgaattaaatcatattctgttggaaaatgatatgaaatttacagtggttgtcggcgatgttgtaggtatacttgcccagggaaagaaaatgataagaccacaacctatggaacacaaatattcttggaaatcctggggtaaagctaaaatcataggggctgatgtgcaaaacacgacgttcatcatagatggacctaacactccagaatgccctgatgatcaacgtgcttggaatatttgggaagtagaggattatggatttgggatatttactacaaatatatggctcaagttaagagactcatatacccaaatgtgtgatcataggttaatgagcgcagccatcaaagatagcaaagccgtacatgcagatatgggttattggatagaatcagagaaaaacgagacctggaaattagctagagcgagctttattgaagtcaaaacatgcatatggcctaaaagccatacactctggtctaatggtgtcttggaaagcgaaatgataatacccaagatatacggtggtccgatttcacagcataattatagaccaggatattttacgcaaacggcaggcccctggcatctagggaagctcgagcttgatttcgatctgtgcgagggcacaaccgtcgttgtagatgaacactgtgggaacagaggtccaagtttgcgcacaacaactgtaaccggcaaaataatacatgaatggtgctgtcgttcttgtacattgcctcctttaagatttaaaggagaagacggttgttggtatggaatggaaattagaccggttaaagaaaaagaagaaaatttagtaaaatctatggtaagtgcaggttcaggagaggtggatagcttcagtttagggctactatgcatatccattatgattgaggaggtaatgaggagtagatggagcagaaaaatgttaatgacaggcaccctagcggtgtttcttttactaataatggggcaacttacttggaacgatctaatcagattatgtatcatggttggagctaacgccagtgaccgtatgggaatgggaactacatatctagcattaatggctacttttaagatgagacccatgtttgccgtaggccttctcttccgaaggttaaccagtagagaggtgttactattaaccataggtctttcgttagtagcatctgtcgaattgccaaatagcctagaagagttaggtgacggtctagcaatgggaattatgatcctaaaactacttacggattttcaatctcaccaactttgggcaactcttttatcactgacattcattaagacgacactttcactacactatgcgtggaaaactatggcgatggtattaagtatcgtttcgctattcccactatgtttgagtacgacatcacaaaagacgacttggttaccagtactgttaggaagtcttggttgtaagcctcttactatgtttttgattaccgaaaataagatctggggacggaaaagctggcctctcaacgagggcataatggcggtaggagtagtatcaattttactaagtagtcttctaaagaacgatgtcccattagccggtccactaattgcaggaggtatgttgatagcatgctacgttattagcggttcctcagcagatctatcattggagaaagctgcagaagttagttgggaggaggaggcagagcattcaggcgcgagtcataatatccttgtagaagtccaagacgatgggaccatgaaaataaaggatgaagaacgtgatgatactctaacaatattattaaaagctaccctactggcagttagcggggtttatccattatccattcccgcgacattatttgtttggtatttctggcagaagaagaaacagagatcaggagtactctgggatacacctagtcccccagaagtagaaagagcagttctagacgatggaatatatcgcattatgcaaagaggtttattagggcgatcgcaagtgggagttggtgtttttcaggagaacgtgtttcatacaatgtggcatgtaacacggggtgccgttctgatgtatcaaggaaaaaggctagaaccaagctgggcctcagttaagaaagatttgatcagttatggtggtggctggcggcttcaaggatcatggaatgctggagaagaagtgcaagttatagcggtagagccgggcaaaaaccccaaaaatgtccagacagctcctggaactttcaaaacacccgaaggagaagtaggggctatcgccttggatttcaaaccaggaacttcaggctccccaatagttaacagagagggcaaaatagtaggattatatggcaacggagtagttaccacatctggtacttatgtttccgcgatagcccaagccaaagcaagccaagaaggaccactacccgaaatcgaagatgaagttttcagaaaaagaaatttaacgataatggacttacatcccggaagtggcaaaactcgaagatacttgccagctatagttcgggaggcaataaaacggaaactaagaacactaattcttgcaccgacacgtgtagtggcatcagagatggcggaagcattaaaaggaatgcctattaggtatcaaaccacagccgttaaatctgaacatacaggaaaagaaattgtagatcttatgtgtcatgcaacctttacaatgagattgcttagccctgttagagtcccgaactataatatgataattatggatgaggctcattttacagaccctagttcaatcgcggcgcgtggatacatttcaacgagagtaggcatgggcgaagctgcagcaattttcatgactgctacacctccaggatcagtggaagcatttcctcaatctaacgcagtcatccaagatgaagaacgagatatacctgaacgtagctggaatagcggatatgagtggattacagacttcccaggtaaaacagtctggtttgttccttccataaaatcaggaaatgatattgccaattgtttaaggaaaaacggaaaacgagtaatacaactttcccgaaagaccttcgatacagaatatcaaaagaccaaaaacaatgattgggactatgtagtcacaactgatattagcgaaatgggcgcaaactttcgcgctgacagagtcattgacccaagaagatgtctgaaacctgtaatactgaaggatggtccagagagagtaatattagccggcccaatgccagttacagtggcctctgcagcacaaagacgtggaaggataggccggaatcataacaaagaaggtgaccaatatatttatatgggacaaccattaaataatgatgaagatcacgctcattggactgaagcaaaaatgttgcttgataatataaacactcccgaaggaataatacctgccctctttgaaccagaaagagagaaaagcgcagctattgatggagaatataggctcagaggcgaagcaaggaagacgttcgttgaacttatgagaaggggagaccttcccgtttggttgagctataaggtagcatcagaaggatttcagtattcagatagaaggtggtgtttcgatggggaacgaaacaaccaggtcttagaagaaaatatggatgttgaaatatggacaaaagagggcgaacgcaaaaagttgcgccccagatggctagatgctaggacttatagtgacccattagcgctgcgggaatttaaagagttcgcggcaggtagacggtcagtaagtggggatttgatactagaaattggaaaattacctcaacatctgactcaaagagcacaaaatgccctggacaatctggtaatgctccacaactctgagcaaggtggccgggcctacaggcatgctatggaagaactacctgacacaatagaaaccttaatgttactagcactaatagcggtactaactggcggagtcacgttattcttcttgtcagggcggggattaggaaaaacgagtattggcctactgtgcgtaatggcatcaagcgtcttattatggatggcaagcgttgaacctcattggatcgcagcatcaattatcctcgagttctttttaatggtcttgctaatcccagaacctgatcggcaacgcacaccccaggataatcagttagcatacgttgtaattggactgctatttatgatcttaacagtcgcggcaaatgaaatgggattacttgaaaccaccaagaaggatctaggcataggacacgtggccgtggagaaccatcatcatgcgactatgctggacgtagatctacacccagcaagcgcttggaccttatacgcagtagctacgacaatcataactccaatgatgagacatacaattgagaataccactgcaaacattagcctcacagctatagcgaaccaagccgcaatcctgatgggattagacaaaggttggccaatttcaaaaatggacattggagtccctttactagcactcgggtgttatagccaagtaaaccccctgactctaacggcggccgttttaatgctggtagcccattacgctataatagggcccggcctccaagccaaggccactagagaagcgcagaaaagaactgcggccggtataatgaaaaatcctaccgttgatggcatagttgcaatcgatcttgatcctgttgtgtatgacgctaagtttgaaaaacaattaggccaaataatgctacttatactttgtacatcgcaaattttattgatgagaaccacatgggcactttgtgaaagtataacactggcaactggcccactcactacgctgtgggagggttcaccaggtaaattttggaacacaactatagcagttagcatggcgaatatttttaggggaagttatctggcgggagcaggactggcatttagcttgatgaaatcgctagggggtggacgcagaggtacgggagcacaaggagaaacgttaggtgaaaaatggaaacgccaacttaatcaattaagtaaatcagaatttaacatctacaaacgaagcggaattatggaagtagatcggtctgaggcgaaagaaggattgaagaggggcgagaccacgcgccatgccgtgtcaagaggaacagctaaactccgttggtttgtagagagaaatcttgtcaagcctgaaggaaaagttatcgatttgggatgtggccgaggtgggtggtcttattactgcgccggactaaagaaagtaacggaggttaaagggtatacgaagggaggacccggacatgaagaaccgatacccatggcaacatacggttggaatttagtaaaactacattctgggaaagacgtattctttacacctcctgaaaagtgtgacacactcctgtgcgacataggagaaagttctcctaatccgaccattgaggaaggccggaccttgcgagtactcaagatggtagaaccatggttaagaggcaaccaattttgtataaagatcttaaacccatatatgccaagcgtcgttgaaactttggaacaaatgcaaagaaaatatggcggaatgttagtccgtaacccgttaagtcgtaatagcacacacgaaatgtattgggtttcgtgcggaactggcaacatagtgagtgcagtaaatatgaccagcaggatgcttcttaatagattcactatggcacacaggaaaccaacatacgaaagagatgtcgacttaggggcaggaactcggcatgtcgcagtagaaccagaagtagctaatttagatattatcgggcaaagaatagaaaacataaaacacgaacataaatctacttggcactacgatgaagacaatccgtacaaaacgtgggcttatcacgggtcgtatgaagtcaaaccaagtggtagtgcatcttcaatggtgaatggggtcgttaaactattaacgaaaccatgggacgtgattccaatggtaacacaaattgcaatgactgacacgaccccatttggacagcaaagagtatttaaggagaaagtagatactagaactccgaaagcaaaaagggggaccgcacaaattatggaagttacagcaagatggctgtggggcttcctatcgcgcaacaaaaagccacgaatttgcactcgagaagagttcacacggaaagtacggtcaaatgccgcgataggtgcagtgtttgtcgatgaaaaccaatggaatagcgcaaaagaagcagtagaagacgagagattttgggacttagttcaaaaagaacgtgaacttcataaacaagggaaatgcgctacatgcgtttacaacatgatggggaaaagggagaagaaactaggtgaatttggaaaagctaagggaagccgtgccatctggtatatgtggctaggggcaagatttttggagttcgaggccctcgggttcatgaacgaagatcattggttttcccgcgaaaactccctatccggagttgaaggagaaggactacataaactcggctatatcttacgtgacatttcaaagatccccgggggaaatatgtatgctgatgacacagcaggatgggacacccgaatcacagaagatgatcttcaaaatgaagcgaaaataactgatataatggagccggaacacgcgctgttagcaacatcaatatttaaattaacttaccaaaataaagttgtaagggtacaacgaccagccaaaaacggaacagttatggacgtaatatcaaggcgtgatcagcgtggctccggacaggtaggtacttacggtctaaataccttcacaaatatggaggcccagttaatacgacaaatggaatcggaagggatcttccttccatccgaattagagacgcctaatttagcagaacgtgtgttagactggctagaaaagtacggtgttgagaggttgaagcgcatggccataagtggtgatgactgtgtagtcaaaccaatcgatgatagattcgcaacagcactcactgctttaaatgatatgggaaaggttagaaaagatattccacaatgggaacccagcaaaggatggaatgattggcaacaggttccattctgcagccaccattttcatcagctaattatgaaagatggcagagaaatcgtcgttccatgtcgcaatcaagatgaacttgtaggaagggccagggtcagtcaaggagcgggatggtctctgcgtgaaacagcatgcttaggaaaatcttacgcacaaatgtggcaattaatgtattttcatagacgtgatcttcggctagctgcgaacgccatatgctcagcagttcctgttgattgggttcccacttctagaactacctggtccatccacgcacaccatcaatggatgaccacagaagacatgctttctgtatggaatcgggtatggatagaagagaacccctggatggaggacaaaacacatgtatcaagctggggagatgtaccctatcttgggaaaagagaagaccagtggtgtgggagcttgatcggcctaacagcacgagcgacatgggcctctaacatccaagtggcaatcaaccaggtacgtagactcataggaaatgaaaactatcttgactatatgacatcaatgaagaggtttaaaaatgaaggcgatcctgaaggagccctctggtag

SEQ ID NO: 21477 - RNA, 9879 nt, synthetic construct
  misc_feature 1..9879: note = derived and/or modified CDS sequence (opt6) from DENV-1__EU726779__SS-prME
  source 1..9879: mol_type = other RNA
tccgtaactatgctactaatgttaatgcctacagcactcgcatttcatctaacaactcgaggaggagaacctcacatgatagtttcaaaacaagaaagaggtaaaagcctcctgtttaaaacatctgccggcgtaaatatgtgtactttaatagcaatggatcttggagaactgtgcgaagatacaatgacatacaaatgtccacgaattacggagactgaaccggatgacgtagattgctggtgcaatgcaacggatacttgggttacatatggcacatgttcccaaacaggagaacatagacgggacaaaagatcagtcgccttagctccacatgtaggattaggacttgagacacgtacggagacatggatgtcatccgaaggagcttggaaacaaatacaacgggtggaaacgtgggctctgagacacccggggtttactgtaatcgccctatttctagcgcatgccattggcacttcaatcactcaaaaaggaataatttttatactcctcatgttagtaactccttccatggccatgagatgcgtaggtataggatcacgggattttgtagaggggctcagtggagctacttgggttgacgttgtactggagcatggttcatgtgtaacaacgatggcgaaagataaaccaacattggatatagagctcctaaaaacagaagttactaatccagccgttctacgaaaattgtgcattgaggcaaaaatctcaaatacgacaacagacagcagatgtccaacacagggtgaagcaacgttggttgaggagcaagacgcgaatttcgtatgtagaaggacatttgtagatagaggctggggcaatggctgcggattatttggcaaaggatcactgataacctgcgcaaaattcaaatgcgtgacaaaattagaaggcaaaatcgtgcaatacgaaaatcttaaatattctgtaatcgtaacagtacatacaggtgaccaacatcaagttggcaacgaatccaccgaacacggaacgacagcgacaattacccctcaagcgccaacaactgaaatacaactaacagactacggagctctgacattagattgttctcctcgaacaggactagatttcaatgagatggttttattaactatgaaagagaaatcatggttggtccacaagcaatggtttctggatttaccccttccatggacgtctggtgcaagcacatcacaagaaacatggaatagacaggacttattagtgacattcaagacggcccatgccaagaaacaggaagttgttgtgctaggaagtcaagagggagcaatgcacaccgcactaaccggtgcgaccgaaatacagacgtcgggaactacgacaatatttgccggccatcttaaatgccggttaaaaatggataaacttacacttaaaggtatgagttatgttatgtgcactggctcgtttaaacttgaaaaagaagtagcagagacccaacacggaaccgtacttgtacaaataaaatatgagggaactgatgcgccgtgtaaaataccattttctacacaagatgaaaaaggtgtgactcaaaatggacgtctaataacggctaatccaattgtgacagataaggagaaacccgtcaacattgaagcagagccaccctttggggaatcatacattgtaataggggcgggtgaaaaggcattgaaactatcatggttcaagaaaggatcatcgataggcaaaatgtttgaagctactgcacgaggagcgagaagaatggcgattcttggggacacggcttgggattttggatcaataggaggtgttttcacctcggtaggtaagctagtacaccagatctttggaacggcttatggggtactgtttagcggagtcagttggactatgaaaatcggtatcggagtactattaacttggctcggtttaaactcgcgctccacatcattttcaatgacatgtattgcggtcggacttgtaaccttatatcttggggttatggtgcaagcagattcgggatgtgttataaattggaagggcagagaattgaagtgcgggtcaggaatatttgttaccaatgaagttcatacatggactgaacaatacaaattccaagcagactccccaaaacgtctctctgcggcaatagggaaggcttgggaggagggtgtttgtggcattcgatcggcgacacggcttgagaatataatgtggaaacaaattagcaacgaacttaaccatattttattagaaaatgatatgaaatttacagtagtagtgggtgacgtagctggtattctagcacagggcaagaaaatgattagaccccagccaatggaatataaatattcatggaaatcatggggtaaagcaaaaataataggtgcagacgtgcagaacacaacatttattatagacggaccaaacacccccgaatgtcctgacgaccaacgggcctggaacatatgggaagtggaagattatggatttggaatatttacaactaatatctggttaaaattgagggatagctacacccaagtatgtgatcatagattaatgagtgctgctataaaggattcaaaagctgtacacgctgatatgggatattggattgaaagtgagaaaaatgaaacatggaaattagcgagagctagcttcatagaagtaaaaacctgtatatggccgaaatcacacaccttatggagcaatggagttttagaaagcgaaatgattatccctaagatctacggagggccaatctctcaacacaattaccgtccagggtatttcacccaaacagcaggaccatggcatttaggcaaattagaattggattttgacctttgtgaaggaacaacagtggtagtcgatgaacactgcggcaatcgaggacctagtctcagaacaactaccgtaaccggcaaaatcattcacgaatggtgttgcaggagttgcactctaccacctttaagatttagaggagaagatggatgttggtacggaatggaaatacgacccgtaaaagaaaaagaagaaaatctagttaaatcaatggtttcagcaggtagtggtgaagttgattcatttagtttgggactactttgcataagcatcatgatagaagaggtaatgagatcacgttggtcacgtaaaatgctcatgacaggaacactagccgtatttttcctacttatcatggggcaacttacttggaatgacttaatcagactgtgcataatggtcggtgcaaatgcctcagatagaatgggcatgggaacaacatatcttgccttaatggcaacattcaaaatgagacctatgtttgcagtaggactactatttcgaagattaactagcagagaagttctactattaacaatcggcttaagtcttgttgcgtcggtagaacttccaaactctctggaggagttgggagatggcttggcaatggggataatgatactcaaattattgaccgattttcagagtcatcaattatgggctactttactgtcattaacctttattaaaaccacttttagtcttcactatgcatggaaaactatggcaatggtattatccatagtgagtctatttcccctctgcctgtcaactacatcccagaaaacaacttggttaccagtcttactagggtccctaggatgtaaaccattaactatgtttctaattgccgaaaataagatttggggcagaagatcctggccattaaatgaaggtatcatggctgtgggtattgtatctatactcctaagttcccttctgaaaaatgatgttccattagcaggaccgttaatagcgggaggaatgctaatagcgtgctacgtaatatctggatcatcagcagacctcagcttagaaaaagcggcagaagttagttgggaggaagaagctgagcactccggcgcttcacacaacattttggtggaagtccaagatgatggcacaatgaagattaaggatgaggagagagatgatacactgactatactactcaaggctactttactagctgtgagtggcgtatacccactgtcaattcctgcaaccttatttgtctggtatttttggcagaagaagaaacagagatcgggagtattgtgggacaccccaagtcccccagaagttggccgggccgttttggatgatggaatataccgcatcatgcaaagaggtctgttgggaagaagtcaagtcggggtaggagtatttcaagagaatgtatttcatacaatgtggcacgtaactaggggcgccgtactgatgtatcaaggcaaaaggcttgaaccctcgtgggcttctgtcaagaaagacttaatcagctatggaggaggatggagattgcaaggatcctggaatactggcgaggaagtgcaagtaatagcggtagaaccgggtaaaaatcccaaaaatgtccaaactgcgcctgggacttttaaaacaccagaaggggaggtaggggcaattgcactagattttaaacctggaacctccggatcgccaatagttaaccgggaaggtaaaatagtgggactatatggcaacggtgtagtaacaacatcagggacgtatgtgtccgcaatagcccaagcaaaagccagccaggaagggcctttaccagaaatagaagatgaggtattccgaaagagaaatctgaccataatggatcttcaccctggaagcggaaagactagacgatacttgcccgcgatagtaagggaagcaattaaaagaaaattaaggacactaatattagcacccacgagggtagtcgcgtcagaaatggccgaagcattaaaggggatgcctataagatatcaaacaacagccgtaaaatctgagcacaccggcaaagagatagtagatttaatgtgccatgcaacttttactatgcgattattatctccggtcagagttcccaactacaatatgataattatggatgaagcacattttacggacccatcatcaattgcagcaagagggtatataagtacacgcgtaggaatgggtgaagcagctgcaatattcatgactgccacaccgccaggctcagtagaggcttttccgcagtcaaacgctgtaatacaagatgaagaaagagatatccctgaacgttcctggaactcgggttatgaatggataactgattttcccgggaaaacagtgtggtttgttcctagcataaaatcgggaaatgacattgcaaattgtttgaggaaaaatggtaagagagttatacaacttagtagaaaaacatttgataccgaatatcaaaagaccaaaaataacgattgggattatgttgttacgaccgatataagtgaaatgggcgccaactttagggccgaccgggttatcgatccaagaaggtgcttgaagcccgttatattgaaagatgggcctgaaagggtgatcctagcggggcctatgccagttacagttgcaagtgcggctcaacgaaggggtagaattggacgaaatcacaacaaagaaggagatcaatatatttatatggggcaacctttaaacaatgacgaagatcacgcacattggaccgaagcaaaaatgttacttgacaacatcaatacaccggaaggaataattcccgctctgttcgagcccgagagggagaaaagtgccgcaatagatggggagtacaggttaagaggagaggcacgtaaaacatttgttgagttgatgcggaggggtgacttgccagtttggttatcttataaagtagcatccgaagggttccaatactcggaccgaagatggtgttttgacggcgaaaggaacaaccaagtgcttgaagaaaacatggatgtagaaatttggacgaaggaaggggagaggaagaagttacgaccgcgatggttagatgcaaggacttatagtgatccacttgccctcagggaatttaaagagttcgccgctggcaggcgatcggtcagtggagatctaattttagaaattggcaaactaccccagcatctgacccaaagggcacagaacgcattagacaacctagtaatgctccataatagcgaacagggaggccgtgcatatcgccatgcaatggaggaacttccagataccattgaaactctaatgctattagcacttatagcagtccttacaggcggagttaccttattctttctttcaggacgcgggttaggaaaaacatctataggattactttgtgtgatggcaagtagtgtgctactatggatggcgagcgtcgaaccacattggatagcggctagtataatcttagagttctttctaatggttctactaattccagaacctgatcggcagagaacaccgcaagacaaccaactggcatatgttgtgattggattactctttatgatcctaacagtagcggctaacgaaatgggcttgttagagaccaccaagaaagatcttggaattggccacgtagcagtggaaaatcatcatcatgctgcaatgctggatgtagatttgcatcctgccagcgcctggaccctatatgcagtagcaactaccataattactccaatgatgagacacacaatagaaaacactaccgcgaatattagtctgaccgcgattgctaatcaagctgcgatattgatgggactcgataaaggctggccgataagtaaaatggatattggcgttccactgctggcactcggctgttattctcaggtaaaccccctgaccttgacagccgcagtactgatgctagtagcgcactacgcaataataggtccgggcctccaagcgaaagctacacgagaggcccaaaaacgtaccgcagcaggaattatgaaaaatcccactgttgatggaatagttgctatcgatctagacccagtggtgtatgatgccaaatttgaaaagcagttggggcaaataatgttactcatactttgcacaagccaaattctattgatgaggacaacctgggcgttgtgcgagtccattacattagccacgggacccctaaccacactctgggagggctcgccgggtaagttctggaatacaaccattgcggtgagtatggctaatatatttcggggtagctatcttgcgggagcaggcttggcattttctctaatgaagtctttaggaggaggaagaaggggtacaggtgcccagggcgaaacattgggtgaaaagtggaaacgtcaattgaaccaattgtcaaaaagcgaatttaacacttataaaagaagcggcattatggaagttgatagatccgaagcgaaggaaggattaaagagaggagagacaactaagcatgcagtaagtcgaggtacggccaaactaagatggtttgtggagaggaatctagtaaaaccagaggggaaggtgattgatctcggttgtggaaggggtggatggagctattattgcgctgggctcaagaaagttactgaagtgaagggatacactaagggtggcccaggtcatgaagaacctatccctatggcgacatatggatggaatctcgtaaaactacattcaggaaaagacgtgttctttataccacctgaaaaatgtgatactttactgtgtgatattggcgaatcctcgccaaatcctactatcgaagagggaaggacccttagggttcttaaaatggttgaaccctggctaagaggaaatcaattttgtataaaaatacttaatccatatatgccaagcgttgtagaaacgctcgaacaaatgcaaaggaaacatggaggaatgttggtgaggaacccgctttcccgaaatagcactcatgaaatgtactgggtctcctgcggcacggggaatatcgtctctgcggtaaacatgacgtcgcgtatgttgcttaataggtttacgatggcacatagaaaaccaacatatgaacgagatgttgacctaggagcaggcacaagacacgtagcagtcgaaccagaggtggcaaacttggatataatagggcaaagaatagaaaacataaaacatgaacataaatcgacctggcattatgatgaagacaatccatataagacatgggcttaccacggtagctatgaagtaaaaccatcgggttcagcaagcagcatggtaaacggcgtagtaaaattattaacaaaaccttgggacgtaatcccgatggtcactcagatagctatgacagatacaactcccttcgggcaacaacgagtttttaaagaaaaagtcgatacacgtacccctaaagccaaaaggggaacagcacaaattatggaagtcacggcgaaatggttgtggggctttctaagtcggaataagaaaccacgaatatgtacgcgagaagagtttactagaaaggtaaggagcaacgcagccataggcgcagtatttgtggatgaaaaccaatggaacagtgctaaagaggcggtagaagatgaacgtttttgggaccttgtacacagagaacgtgaattacataaacaaggaaagtgtgcaacttgtgtatataatatgatgggaaagcgagaaaagaaactgggtgaatttggaaaagcgaaaggaagccgagcaatttggtatatgtggctgggtgcacgatttctagagtttgaggctctcggattcatgaatgaagaccattggtttagtcgagaaaatagtttaagcggcgtagagggcgaagggttgcataaactcggatatatattacgtgatatctcaaatataccaggaggtaacatgtatgccgacgacacagcagggtgggatactcgaatcaccgaggatgacctacagaacgaagcacgaataacagacatcatggaacccgaacacgcgttattggcgaagtccatttttaaattaacctatcaaaacaaggtcgttagggttcaacgaccagcgaaaaatggaaccgtcatggatgtgatatctagacgtgaccaacgaggatctgggcaagttggaacttatggtttgaatacatttacgaatatggaggcccaacttatacgacagatggagagtgaaggaatattttctccctcagagttagaaacacccaacttagccgaaagggttttggactggctagaaaaatatggggtagaacgattaaaaagaatggccattagtggcgacgactgtgtagtaaaacccattgacgacaggtttgctactgcactaacagccttaaacgatatgggaaaagtacgaaaagacatacctcaatgggagccgagtaaggggtggaatgattggcaacaggtaccattttgttcacatcattttcaccaactcattatgaaagatgggcgggaaattgttgttccctgtagaaaccaagatgaacttgtaggtagagcgagagtatctcaaggggcgggatggtcacttagggaaaccgcatgtttgggcaaatcatacgcgcaaatgtggcaacttatgtactttcatagacgagatctccgcttagcggcaaatgcaatatgtagcgccgtccctgttgattggatccctacaagtagaactacctggagtatccatgcacaccaccaatggatgaccaccgaagacatgttgtcagtatggaatagagtatggatagaagaaaacccttggatggaggataagacacacatatcaagctggggcgacgtcccgtatctcggaaaacgagaagaccaatggtgcggctcactaattggattaacggctcgtgctacctgggcaactaatatccaagtagcaatcaatcaagtaagaaggctaattggcaatgaaaactacctagattatatgacatccatgaagcgatttaagaacgaaagcgacccagagggtgcattatggtaa

SEQ ID NO: 21478 - RNA, 9879 nt, synthetic construct
  misc_feature 1..9879: note = derived and/or modified CDS sequence (opt6) from DENV-1__EU677176__SS-prME
  source 1..9879: mol_type = other RNA
agcgtgactatgttactgatgttaatgcccacagctcttgcgtttcatcttacgacgagaggaggagagccacatatgatagtaagtaaacaagaaagagggaaaagcctcctgttcaaaactagcgctggggtaaatatgtgcacactcatagctatggatcttggagaattatgtgaagacactatgacatacaaatgcccaagaataacagaagtcgagcctgatgacgtagattgttggtgcaatactacagacacatgggttacatacggaacatgtagccaaaccggagaacaccgacgagacaaaagatcggtggcacttgcccctcatgtaggattaggattagaaactcgtgctgagacctggatgtcttctgaaggagcgtggaaacaaatacaaaaagtcgaaacctgggctctgcgtcatcctggctttacagttattgctttatttttagcacatgctataggtacaagcataacacaaaaagggataatatttatacttttaatgctcgtcacgccaagtatggcaatgcggtgtgtaggaataggaagcagggatttcgtagaagggctctcaggtgcaacatgggtagacgtcgtgctcgaacacggaagttgcgtgaccacaatggcaaaagataaaccaacgttggatattgagttattaaaaacagaagtaaccaatcccgcagttttaagaaaactatgcatagaagcaaaaatatctaacactacaaccgactcaagatgtccaacacaaggcgaagcaaccttagttgaggaacaagatgcgaactttgtatgtagaagaacatttgttgaccgaggctgggggaacggatgcggtctgtttgggaagggcagcttgataacatgtgctaaattcaagtgcgtaactaaactagagggaaaaatagtacaatacgaaaaccttaaatactctgtaatcgtgactgttcatacgggagatcaacaccaagtaggtaatgaatcgacagagcatggaactaccgccaccattacccctcaagcacctacatccgagattcagctcacagactatggcgctctaactttagattgtagcccaagaacagggctggatttcaacgaaatggtcttattgacaatgaaagaaaaatcctggctagtccacaaacagtggtttcttgacctacccctcccgtggacaagtggtgcctccaccagtcaagaaacttggaacagacaagatctacttgtaacgtttaagacagcgcatgctaagaagcaggaagtggtagttctaggttcacaggaaggggcaatgcacacggccctaacaggtgcaacggaaatacaaacaagtgggacaacaaccatatttgcgggacatctgaaatgtagattaaaaatggataagttaaccctaaaaggcatgagttacgttatgtgtactggtttatttaaattggaaaaagaggtagctgagactcaacatggaacagtactggtacagattaaatacgaggggacagatgcaccttgcaaaataccatttagtacacaagacgaaaagggagttacacaaaacggaagacttattactgctaatcctatcgtaactgataaagaaaagccggtcaatatcgaagccgagccacccttcggagaatcctacattgtaattggcgctggtgagaaagcattaaaattatcatggttcaaaaagggcagttccattggcaaaatgttcgaagcgactgcacgcggagccaggagaatggctatccttggagataccgcgtgggactttgggagcataggtggagtgtttacttcagttggaaaattagtacaccaaatcttcggaactgcatatggagtactattttctggtgtcagctggacgatgaaaataggtattggtgtcttgctgacgtggctaggcttaaatagtcgttctacaagtctctctatgacttgcattgccgtaggactcgtgacgttgtacttaggggtcatggtgcaagcagacagcggctgcgtgatcaattggaaagggagggaactgaaatgcggatctggcattttcgtcacaaatgaagtacatacctggaccgaacaatataagtttcaagcggacagtccaaaacgcctttcagctgcaatcggtaaggcttgggaagaaggagtgtgcggcataaggagtgcaacccgtctcgaaaacataatgtggaggcaaataagtaatgaattaaaccatatacttctagaaaacgacatgaagtttacggttgtagtaggagatgtagttgggattttagctcaaggaaagaaaatgatacgaccgcaacctatggagcataaatattcatggaaatcatggggtaaagctaaaattatcggggcagatgtccaaaatactacattcatcatagatggtccaaatacccctgagtgccccgatgatcagagggcttggaatatctgggaagttgaggactatggtttcggtatatttaccacaaatatttggctaaagctgcgtgattcatacactcaagtttgcgatcatagattaatgtcagcagcaattaaggattcgaaggccgtacatgctgacatgggttattggatagaaagtgagaaaaatgagacttggaaattagcacgagcttcatttattgaagttaaaacatgtatttggccaaaaagccatacattatggagtaatggagtcttagagagtgaaatgattataccaaaaatatacggtggtccgatctcacaacataactaccgtcctggatatttcacccaaacagcgggcccgtggcacttgggtaagttagagttagactttgacttatgtgaggggacaacagtggtcgtagatgaacattgtggtaatcggggtccgtctttgagaacaacaaccgttaccggcaaaataatacatgagtggtgttgcagatcatgtactctacctcctctacgatttaaaggagaagacggatgttggtacgggatggaaataagacctgttaaggaaaaagaagaaaatcttgtcaaaagtatggtatccgcaggatctggtgaagtagattctttctctctgggccttttatgtattagtataatgatagaagaggtaatgcgatcgcgatggtcccgtaagatgcttatgacagggaccttagcagtattctttctactcatcatggggcaattgacgtggaatgacttgatcagatcctgtatcatggttggcgctaatgcaagtgaccggatgggcatgggcaccacctatttagctttgatggccacattcaaaatgagaccaatgtttgcggttggactactcttccgaaggctaacttcgcgtgaagtattattattaaccataggattgagtcttgtagctagtgtggagctacctaattctctagaggagttgggtgacgggcttgcgatggggattatgatattaaaattattaacggatttccaaagttatcaactatgggcaacgttgctttccttgacatttataaaaactactttttctttgcactatgcttggaaaactatggcaatggtacttagcatcgtcagtttattaccgttgtgtttatcaaccacttcccagaagacaacctggcttccagttttattaggcagcttagggtgtaaaccgctaacaatgtttctgatcgctgaaaataaaatatggggaaggaagtcttggcctttaaatgagggaattatggccgtcggaatagtcagcatcttgttatcaagtctactcaaaaacgacgtaccactagcaggaccgctaatagcaggaggcatgttaatagcatgctacgtgatttccggtagtagtgcggatttgtcactcgagaaagcagccgaagtttcctgggaagaagaagccgaacattctggtgcatcacacaacatactcgttgaagtacaagacgacggtacaatgaaaatcaaagatgaggagagagatgacacattaacaatattacttaaagccactcttttggcggtttctggagtatacccactttcaatacccgcgacactattcgtatggtatttttggcagaagaagaaacaaaggagtggtgttctttgggatacaccaagtccacccgaggtagaacgagctgttttagacgacggcatataccgaattatgcaacgaggtttattaggtagatcacaagtaggagttggtgtttttcaagaaaatgtatttcatacaatgtggcatgttacccggggcgcagttctaatgtatcaaggtaaaaggttagaaccaagctgggcgtctgtaaagaaagacttgataagctacggcggtggatggcgtcttcagggatcatggaatacgggcgaagaggttcaagtaattgcagtagaaccaggtaaaaaccccaaaaacgtgcaaacagcgcccggtacttttaaaactccagaaggcgaagttggcgcaattgcattagattttaaacctgggacaagtggttcacccattgtaaatagagaggggaaaattgtagggctttatggtaatggtgttgtcacaacctctggcacatacgtatccgcaatcgcgcaagcgaaagccagtcaagaagggcctttaccggagatcgaagacgaagtatttagaaaacgaaacttgactataatggatctacatcctggtagcggaaaaacgaaacgttatttgcctgctattgttcgtgaggcaatcaaacggaaattgaggactcttatactggcacctacgcgtgtagtagccagcgaaatggcggaggcattgaaaggaatgccaattaggtaccaaaccactgcagtaaagtctgagcacacggggagggaaattgtagatctgatgtgtcacgccacattcactatgaggcttctcagcccggttcgagtcccaaactataatatgatcataatggatgaagcgcattttacagacccttccagtatagcggctagagggtatatcagtacgagagtaggcatgggagaagcagccgctatattcatgacagcaacaccgccgggaagtgtagaagcatttccacaatcaaatgcagtaatccaggacgaagaacgagatattccggagaggtcatggaactccggatacgaatggataactgatttccctggaaaaacagtatggttcgtaccatcaatcaaatcaggcaacgacatagctaattgtctaagaaagaatgggaaacgagtcatacaactcagcagaaaaacattcgatactgaatatcaaaagaccaaaaacaatgattgggactatgtagtaacaactgacatatccgaaatgggggcaaacttcagggctgatcgtgtaatagaccctagaagatgcttaaaaccagtaatactcaaagacggacccgaaagggttatattagcaggtcctatgcctgtaactgttgcatcagcggctcaacgtcgaggaagaattgggaggaaccataataaagaaggtgaccaatatatatacatgggacaacctctaaataatgatgaagatcatgctcattggacggaagctaaaatgcttttagataatataaatacgccggaaggtataatacctgcactgttcgaacctgaaagagagaaaagcgcagcaatagatggtgagtatagattaagaggagaggcgcgcaaaacattcgtcgagctcatgagaagaggggatcttcccgtctggttgtcctataaagtcgcttccgaaggattccaatactcagatcgacgatggtgttttgatggcgaaagaaacaatcaagtactagaggagaacatggacgtggaaatatggacaaaagaaggcgaaaggaagaaactccgaccacgctggctggatgctcgaacatattccgaccctttagcccttagagaatttaaagaatttgcagccggtagaaggagtgtgtcaggcgatctaattctcgaaattggaaagttgccacaacaccttacccaacgcgcccaaaacgcattagacaacttagtcatgctccataatagcgaacaaggtggcagagcatatagacatgctatggaagaattgcccgacacaatagagaccctaatgttgctagcgctaattgcagtactcaccggaggagttacactgttctttctatccggacggggtctcggcaagacaagcatcgggttactctgtgtcatggcgagcagtgcattattgtggatggcctctgtagaaccccattggatcgccgcaagtataatcctggaatttttcctaatggttctattaataccagaaccagataggcaaagaacgccgcaggataatcaactagcttatgtcgtaataggtctgctttttatgatattaacggtagcagccaatgagatggggttactcgagacaacgaaaaaggatctcggcatcgggcatgtcgcggtagaaaatcatcatcacgctacaatgttagacgttgatctgcaccctgcatcagcatggaccctatatgccgtagctactacaataataactcccatgatgagacacacgattgagaacacgaccgcgaacatcagcttaactgccatcgcaaatcaagcagctatattaatgggcctagataaaggatggccaatttcaaaaatggatattggtgtccctctattagcactcggatgttactctcaagttaatccacttacattaactgcggctgtactcatgttagtcgcacattacgcaattattggtcctggtcttcaagctaaagcaacgcgagaggcacagaaaagaacagcagccggtattatgaaaaatcctacggtcgacggaattgtagctatcgatttagaccctgtagtttatgacgctaaatttgaaaaacagctaggccagataatgttgctgatcctatgtacatctcagatactactaatgagaactacgtgggctctatgcgaatcaataaccttggcgacaggccctttgactactctttgggaagggagtcctggaaaattttggaatacgaccatagcggtttctatggcaaatatttttagaggctcttatttagcgggagccgggcttgcatttagtctaatgaagagtctagggggtggtagaaggggcacgggagcacaaggcgaaacgttgggagagaagtggaaacgtcagcttaatcaattatcaaaaagtgaatttaatacatataaaagatcgggtataatggaagtagacagaagtgaggctaaagaaggactaaggcgcggagaaactacaaagcatgcggtcagcagaggtacggccaaacttaggtggttcgtagaaagaaacctagttaaaccagaaggtaaagtaattgaccttggttgtgggcgaggaggttggtcctattattgtgcaggactaaagaaagtgactgaagtcaaaggatatacaaaaggaggacctgggcacgaagaaccaattccaatggcgacgtacggatggaacctcgtaaaattacatagcggaaaagacgtgtttttcataccaccagaaaaatgcgatactttattatgtgatattggcgagtcctcgcctaatcctacaatagaggaggggagaacactacgtgtattaaaaatggtcgaaccttggctaagagggaatcagttctgcattaaaatacttaatccatatatgccatcagtagtggaaacattagaacaaatgcagcgaaaacatggaggcatgctcgtgaggaatccgctatcaagaaatagcacacacgaaatgtattgggtaagctgtgggacgggtaatatagtgagcgctgtcaacatgacaagcaggatgctgctgaatcggttcacgatggctcacaggaaacctacgtacgaacgtgatgtcgacctaggtgcaggaacacgacatgttgccgtagagcctgaagtagcaaacttagacataataggtcaaagaattgaaaatataaaacatgaacataaatccacatggcattatgacgaggataatccttataaaacgtgggcctatcatggtagttatgaagtaaagccgtcaggaagcgcttcaagtatggtaaacggagtagtaaaactactcacaaagccatgggacgttataccgatggtcactcaaatagctatgacagacacaactccattcggacaacaaagagttttcaaagagaaagttgatactcgcacccctaaggctaaacgcggtacagcccaaataatggaagtcacagctagatggctatggggctttctctctcgtaataagaaaccgcgaatatgcacacgggaagagtttacaagaaaagtacgtagtaatgcagccataggagccgtttttgttgatgaaaaccaatggaactcagctaaagaagcggtagaagacgaaaggttttgggatctcgtacatagagaacgggaactacacaaacagggaaaatgtgcgacgtgtgtgtataacatgatgggtaagcgagagaagaaacttggtgagtttggaaaagctaaggggtcaagagcaatttggtatatgtggctgggtgcgagattcttagagttcgaggcgttgggtttcatgaacgaagaccactggttttcacgagagaacagcctctcaggagtggagggagaaggccttcacaagttaggatatatattaagagatatctccaaaattcccggaggcaacatgtatgcagatgacacagcaggctgggatacacgtattaccgaggatgatctccaaaacgaagctaaaatcacagacatcatggaaccagagcacgcactcttggcgacaagtatcttcaaactaacctaccaaaacaaagtagttagagttcaacgacccgctcgtaatggaactgtgatggacgtaataagtcgaagagatcaaagaggcagcggtcaagttggcacttacggacttaatacatttacaaatatggaggcacagttgatacgtcaaatggaaagtgagcgtattttctcgccttccgaattagaaacgcccaacttagcagaaagagtcttagactggctagagaaacacggagttgagcgtctgaaaagaatggcaatcagcggagatgactgtgttgttaaaccgatagatgatcggtttgctacagcacttagtgcactaaacgatatgggtaaagtaagaaaagatattccacagtgggaaccttcaaaaggttggaatgattggcaacaagtaccattttgttctcatcattttcaccaactgataatgaaagacggcagggagatagttgttccgtgtcgcaatcaagacgaattggtagggagagctcgagtgtcacaaggagcaggatggagcttgagggagacagcttgcttaggaaaatcatacgcccaaatgtggcaattaatgtacttccacaggagggatcttagattggcagctaatgcaatatgttctgcagtcccagtagactgggttcccacctccagaacaacatggtcaattcatgctcatcatcaatggatgacaactgaagatatgctctctgtttggaacagagtttggattgaggaaaatccttggatggaagacaagactcacatttcctcttggggagatgtcccatacctaggcaaacgtgaagatcaatggtgtggctctctaattggtctgacagctcgagctacctgggcaactaatatccaggttgcaatcaaccaagtacgcagactaatcggcaacgagaattatcttgattatatgacctcaatgaagagatttaagaatgacagcgatcctgaaggagctctttggtaa

SEQ ID NO: 21479 - RNA, 9879 nt, synthetic construct
  misc_feature 1..9879: note = derived and/or modified CDS sequence (opt6) from DENV-1__EU726780__SS-prME
  source 1..9879: mol_type = other RNA
agcgtaacaatgttattaatgctgatgccaaccgctcttgcttttcatcttacgactagaggaggagaaccacacatgatagtttcgaaacaagaacgcgggaaatcattactattcaaaacgtcagctggagtaaatatgtgtacattaattgcgatggacctcggagaattatgtgaagatacaatgacctacaaatgcccacgaattactgaaactgaacctgatgacgttgactgttggtgtaacgcaacagatacttgggtaacatacggaacatgctctcaaacaggtgaacatcgaagagacaaaagaagtgtagcgctggcgccgcatgtgggactcgggcttgaaaccaggaccgaaacatggatgagttcagaaggtgcgtggaaacaaatacaaagagtcgaaacatgggcattaagacatccaggattcaccgtaattgcactttttctggctcatgctataggaacctctataacacaaaaaggaataatattcatactgttaatgttagttacaccctccatggcaatgcgatgtgttggtataggatcaagagatttcgtagaaggtctatctggggccacctgggtagacgtagtactagaacacggctcatgcgtgacgacaatggcaaaagacaaacctaccctagacatagaattattaaaaactgaagttactaatccagctgtactacgaaaactatgcattgaagcaaaaataagtaatacaaccacggactcacggtgcccaacgcaaggcgaagctaccctagtagaagaacaagatgcaaatttcgtttgtaggagaacatttgtagaccgtgggtggggcaatggatgtggtctattcggaaaaggcagtttgatcacgtgcgctaaattcaaatgcgtgaccaaacttgaaggaaaaatcgtacaatatgaaaatctaaaatattctgtaatcgtgacagtacacaccggagaccaacaccaagtgggaaatgaaagtacagaacacggaaccacggctactataacaccacaagcgcctactaccgagatccaattaacagattatggtgcactcactctggattgtagtcctaggacgggcctagatttcaatgaaatggtcttattaacaatgaaagagaaatcctggttagttcataaacaatggtttttggatctaccattgccttggacaagcggggcatcaacatctcaagaaacttggaataggcaagatttgctcgttacatttaaaacagcgcacgctaagaaacaagaggttgtagtattaggcagtcaagaaggtgccatgcacacggcactgacgggagcaacagaaatacaaacatcgggaaccacaacaatctttgctggtcatctgaaatgtagattgaaaatggataaattaacgttaaaaggaatgtcctatgtgatgtgtactggtagttttaaattagagaaagaggttgctgaaacccaacacggcacagtacttgtacaaatcaaatacgaaggaactgatgccccgtgcaaaataccattctcaacacaagatgaaaaaggagttactcaaaatggtagattaataaccgcgaaccccatagtaacagataaagaaaagcccgttaacattgaagcagaaccaccatttggagaatcttatatcgtaataggggcgggcgagaaaacgttaaaactaagttggttcaagaaaggaagcagtataggtaagatgttcgaagcgaccgctcgtggtgccagaagaatggcaatattaggagatactgcttgggattttggcagcataggaggagtctttacatccgttggcaagctagtccatcaaatcttcgggacagcttatggagttttgttcagcggtgtatcgtggacaatgaagattggtataggagttctgttaacatggctgggattaaatagcagaagtacatcattatcaatgacttgtattgcagtaggacttgtaacactatacctgggggtaatggtacaagccgatagtggctgtgtgataaactggaaaggacgtgaactaaaatgtggttcggggatctttgttacgaatgaggtacatacatggacagaacaatataaatttcaagctgatagtccaaaacgactatcagctgctatagggaaagcatgggaggaaggcgtatgtggtatccgatcagcaacacgattagaaaatataatgtggaaacagatatcaaatgaacttaatcacatcttgctagaaaatgatatgaagttcacagtcgtagtgggagacgtagcgggcatcttagctcaaggcaagaaaatgatacgaccacagcctatggaatataaatacagctggaagagttggggaaaggcaaaaataattggagcagatgtacaaaacactacctttataatcgatggtcccaacactcctgaatgcccagatgatcaaagggcatggaatatatgggaagtggaggattatggttttggtatctttacaactaacatctggctcaagctacgagatagctacacacaagtttgcgaccatagactaatgagcgcagcaataaaggattccaaagctgtccatgccgatatgggatattggattgagtcagagaaaaatgaaacgtggaaattggccagagcttcattcatcgaagtcaagacatgtatatggccgaagtcacacactttatggagcaatggtgttctcgaatccgagatgatcattccgaaaatttatgggggacccatctctcagcataactaccgacccgggtactttacacaaacagctggaccatggcatttaggtaagctagaactagattttgatctttgtgaagggacaaccgtggtagttgacgagcattgtggcaaccggggacctagtttgagaacaactacagttaccggaaaaatcatccatgagtggtgttgtcgatcatgtactttacccccattacggtttagaggagaagatggttgttggtatgggatggagattcgacctgtaaaagaaaaagaagaaaatttagtaaaaagcatggtgagcgcgggcagcggtgaggtagattcatttagtttagggttactttgtatatctataatgatcgaagaggtcatgcgatcccgatggtcacgtaaaatgttaatgactgggacactggcagtgttctttctattgataatggggcagttgacctggaatgacctcatacggctgtgcatcatggtcggggcaaatgccagtgacagaatgggaatgggtacaacttatttagcacttatggctacattcaagatgagacctatgttcgcagtaggattattatttaggagactgacatctagggaagtattactactcacaatagggttgagtttagtcgcctccgtggagctgcctaactcacttgaggagttaggggacggactcgccatgggtataatgatcctgaaactcttgactgacttccagagccatcagctgtgggtaaccctattgtcactaacgttcataaaaactaccttctcgctccattacgcttggaaaactatggcaatggtactctctatagttagcctgttcccgttgtgcctgtccactacaagtcagaaaacaacctggcttccagtattgcttggaagtttagggtgtaagcctttgactatgtttctaattgcggagaacaaaatctgggggcgaagatcgtggcccttaaacgaaggtatcatggcagttggcatcgtcagcatccttcttagcagtttattgaaaaatgatgtgccattagctggaccattaatagcaggcggaatgttaatcgcatgttatgtgataagcggatcgagtgcagacttaagcctagagaaagcggctgaagttagttgggaggaagaagcagaacattcaggtgcgagccacaacatacttgtggaagtccaagatgacgggactatgaaaatcaaagatgaagaaagagacgatacattaaccattctcctgaaagcaacactcctcgcggtatcgggggtttaccctttaagtataccagccacattatttgtatggtatttttggcaaaagaaaaagcagagatcaggggtgttatgggatacaccgagcccaccagaagtggaaagagccgtcctggatgatgggatttatcgaataatgcaacgagggcttctaggtagatcccaagttggagttggagtatttcaagagaatgtgtttcatacaatgtggcatgtaaccagaggtgccgtcttgatgtatcaaggaaaacgacttgagccttcatgggcttcggtaaagaaagatctgatatcatacgggggtggttggagactacaaggtagttggaatacaggtgaagaagtgcaagtaatagcagtggaaccaggcaaaaaccccaaaaacgtacaaactgcaccaggaaccttcaagacacccgagggggaagttggagccattgctttagattttaagccaggtacctctggttctcccatagtcaatagggagggtaaaatagtcggcctttatggcaacggggtagttaccacatctggtacgtatgtctcagcgattgctcaggctaaggcttcccaagaaggtcctttaccagaaatcgaagatgaggtgtttcgtaaacgaaacttgacaatcatggatcttcaccctggatcaggaaaaaccagacgatacctaccagcaatagtacgggaggcaataaaacgaaaattgcgaacccttattttggcacctacaagggtcgtcgcttcggagatggccgaggccctaaaggggatgccgatacgatatcaaacgacagcggttaaatcagaacacacaggtaaagagattgtcgacctaatgtgtcatgctactttcacaatgcgacttttatcgccggtaagagttccaaattacaatatgataattatggatgaggcgcattttaccgatccatcaagtattgcggcaagaggatacatatcaacaagagtcggcatgggagaggctgcggccatatttatgacagctacacctccaggttcagttgaggcatttcctcagtcgaacgcagtaatacaagatgaggaaagagatattccagagcgtagttggaactcgggctacgaatggataacagactttccggggaaaacagtctggttcgttccaagtataaaaagcggcaacgacattgctaattgtctgaggaaaaacggaaaaagagtaatacaactatcacgaaagacatttgatacagaatatcagaaaactaagaacaatgattgggactacgtcgtaactacagacatcagcgaaatgggcgcaaactttagagcagaccgagtcattgatccacgtagatgtctaaaacctgtaatactgaaagacggtccggaacgcgtaatactcgccggtcctatgccggtgaccgtggcttctgctgcacaacgacgtggtagaatagggcgaaatcacaataaagaaggtgaccagtacatatatatgggacaaccactcaataacgacgaggatcatgcacattggacagaagctaaaatgttactagataatataaacaccccagaaggcattattcccgccctattcgagccagaaagggagaaaagtgccgctatagatggcgaatatagattaaggggagaggcaagaaaaacatttgtggaattaatgcgcaggggagacctacctgtatggttatcatataaggtcgcaagtgaaggctttcagtattcagacagacgctggtgttttgatggagagcgaaataatcaagtgctagaggaaaatatggacgtagaaatatggactaaagaaggagaacggaagaaactaagacctcgatggctagatgcacgaacgtacagcgacccattagcactgcgtgaatttaaggaatttgctgctggtcgaagatccgtttctggggacttgatatcagaaataggaaaattacctcagcatcttacgcagagagcacaaaacgctctagacaatctagtgatgcttcataatagcgaacaaggcgggcgagcatatcggcacgcaatggaagaacttccagacacaattgaaacgctaatgctcctagcacttatagcggtactaacaggaggtgtgactctattctttttaagtggccgcggattaggaaaaaccagtatagggctcctgtgcgtaatggcaagttcggttttattgtggatggcctcagtagaaccacattggatcgctgcgtcaattatattggagttctttcttatggttctattgatacccgaaccagacagacaaagaacaccacaagataatcagctagcatacgtggtaatcggtctcctttttatgattttgacagtagcagcgaatgaaatgggactattagaaacaactaagaaagatctggggatagggcatgtcgccgtagaaaaccatcaccacgcagctatgctagacgttgatctacaccctgcgtcagcttggactctctatgcagtcgcaaccaccataattacacccatgatgagacatacgattgaaaacacgacggctaacatcagcttaaccgcaatcgcgaatcaagcagcaatcttaatgggtctagataaaggatggcccattagtaaaatggatataggtgtccctctcttggccctgggttgttattctcaagttaatccgttaacgttaacggcggccgtcctcatgttagtggcacactatgcgattataggaccaggtttgcaagctaaggccacaagagaagcacaaaagaggacggctgctggcattatgaaaaatcctaccgtcgacgggattgtcgcaatagatttggatccagtagtatatgatgcaaagtttgaaaaacaacttggacaaataatgctcctgattctatgtacttcccaaatacttctaatgcgcacaacatgggctctatgtgaaagtattacgctagctacaggaccacttacaacgctctgggaaggatcaccgggaaagttttggaatactactatcgctgtaagtatggctaatatattccgtggtagttatctagcgggagcaggactagcattctccttgatgaaatcgttaggaggaggcaggcgtggaaccggggcccaaggtgagacacttggagaaaagtggaaacgccagctaaatcagttgtctaaaagtgaatttaacacctacaaaagatcgggaatcatggaggtcgacagaagcgaagcaaaagaaggtctaaaaagaggagagaccactaaacacgctgtcagtagagggacagcaaaactcagatggtttgtagaaaggaatttggtcaagcccgaaggtaaagtaatagatttaggctgtggaagaggcggttggtcgtattattgtgcaggactcaagaaagtaacagaggtaaaaggatacacaaaaggaggaccaggacatgaagaaccaattcccatggcaacctacggatggaacctggtcaaactgcactcaggaaaagatgttttcttcataccccctgaaaagtgcgataccctattgtgcgatattggagaatcatcaccgaatcctacaatcgaagaaggcagaacgctacgtgtacttaaaatggtagaaccatggttaaggggtaatcaattttgcataaaaatattaaatccttatatgcctagtgttgtggaaacactagaacagatgcaaagaaaacatgggggcatgctggtaagaaatccattatccagaaatagtacccatgaaatgtactgggttagctgcggtacaggtaatattgtttctgcggttaacatgacctcaagaatgcttttaaatcgattcacaatggcccatcgaaaacctacttatgaacgggatgttgacttaggagccggaactcgtcatgtcgcggtcgaaccggaagtagcgaatttggacataattggacaaagaatcgaaaatatcaagcatgaacataaatctacgtggcattatgatgaagacaatccatataagacctgggcttaccacgggtcatatgaggttaagccatcaggctccgcttctagtatggtaaacggggtagtaaaactattgacaaaaccatgggatgtcattccgatggtaactcaaatagcaatgactgacaccacgccattcggacagcaacgagtttttaaggaaaaagtagacacaaggacccccaaagcaaaaagaggtacagcccagataatggaagtgacagcaaaatggctatggggattcctctctagaaacaaaaagccaagaatttgcacacgcgaagaatttacgaggaaagtgcgctcgaacgcagcaataggcgccgtgtttgtggatgaaaaccaatggaactcagcaaaggaagcggttgaagatgagagattttgggatctagtacacagagaaagagaactccacaaacaaggaaaatgcgcgacctgcgtttataatatgatgggtaaaagagagaaaaagttgggagagttcggaaaagcgaagggaagtagagcgatttggtatatgtggctaggagcacgctttctagaatttgaagcgcttggcttcatgaatgaagatcattggttctcacgagaaaactcattaagtggcgttgaaggagagggtctgcacaagttaggttatatcttacgagacataagcaaaattccgggtggaaatatgtatgcagatgatacagcgggatgggacactagaataactgaagacgatctacaaaacgaggcacggataacggatatcatggaacctgaacacgcactacttgctaaaagtatatttaaattaacctatcaaaataaagtagtaagggtacagaggccggccaaaaacggaacagtcatggacgtaatttctagacgagatcagcgggggagtgggcaagttggaacatatggcttaaatacttttaccaatatggaagctcaattaattaggcagatggagagcgagggtatattcagccccagtgaattagaaacacccaatttggcagaacgtgtacttgattggctcgagaaatatgggatcgagagactaaaacgaatggccatctccggagacgactgcgtcgttaaaccgattgatgatcgattcgcgactgccctaacagcccttaacgatatgggaaaagttaggaaggatattccacaatgggaacccagcaagggatggaatgactggcaacaagtgccattttgcagtcatcattttcaccaactcatcatgaaagatggtagagaaatcgtcgtaccgtgcagaaatcaagatgagctagttggccgagccagggtttctcagggagcaggttggagtttaagagaaaccgcctgtctcgggaaatcttatgctcagatgtggcaattgatgtactttcacagaagagatttaaggctcgcagcaaacgctatatgctcagccgtaccagtcgattggattccaacgagtaggaccacatggtcaatacatgcccaccatcagtggatgactaccgaggatatgttatccgtgtggaatagggtatggatcgaggaaaatccgtggatggaggataagacacacattagtagttggggagatgtcccttatctcggaaaaagagaggatcagtggtgtggctcactcataggtttgacagcaagggcaacatgggcaaccaatattcaagttgcaattaatcaagtacggcgattgatagggaacgaaaattatttagattatatgacatcaatgaaaaggttcaaaaatgaatctgacccagagggcgctctttggtaa

SEQ ID NO: 21480 - RNA, 9879 nt, synthetic construct
  misc_feature 1..9879: note = derived and/or modified CDS sequence (opt6) from DENV-1__EU726781__SS-prME
  source 1..9879: mol_type = other RNA
agtgtaactatgctcttaatgctaatgccaactgcgcttgcattccacctaacgaccaggggcggtgaaccacatatgattgtttctaaacaggagagagggaagagtttattatttaaaacatccgcgggagtaaatatgtgtactttaattgcaatggatctcggagaattttgtgaagacacgatgacctacaaatgtccgagaatcaccgaggctgaaccagacgacgttgactgttggtgcaacgcaactgatacttgggtcacatacgggacgtgttcgcaaacaggagaacataggagggataaaagaagcgttgctttggctccacatgtaggcttgggattagagacacgcaccgagacctggatgtcatctgagggagcatggaaacaaattcaaagggtggaaacttgggcccttaggcatccagggttcacagtaatagctttgttcctggcacacgcaataggcacatcaatcacacaaaagggcattatatttattttacttatgctagtaacgccctcaatggctatgagatgcgtaggcataggatcacgagatttcgtagaaggattaagcggcgctacatgggtagatgtagtattagaacacgggtcttgcgtgacaactatggcgaaggataaacctacacttgatattgaactgttaaaaacagaggtcacgaacccggcagtgctacgaaagttgtgcatagaagcaaagatatcaaatacaacgacagattcgcgttgtcccactcaaggtgaagcaacattagtagaggaacaagatgctaactttgtttgccgacgtaccttcgtcgatcgtggatggggcaatggatgtggattattcgggaagggcagtctaataacatgcgccaaatttaaatgtgtgaccaaattagagggaaaaacggtacaatatgaaaatctaaaatacagcgtaattgtaacagtacacacgggggatcagcaccaggtcggcaatgagagcacagaacacggtacaaccgccacaataacaccccaagctccatccaccgaaatacagttaaccgactatggcgcgctgacactagactgttcacctagaactgggttggactttaatgaaatggtcttactcacaatgaaagagaaatcgtggttggtacataaacaatggttcttagatctaccactaccttggacatccggagcaagtacctcacaggagacatggaaccgcaaagatttactcgttactttcaagaccgctcatgcaaaaaagcaagaagtagtggttcttggctctcaagaaggagcaatgcatacagctttaacaggtgctaccgaaatacaaacgtcgggaacaacaacgatcttcgctggacacctcaaatgtagattgaaaatggacaagctaactttaaaaggaatgtcatatgttatgtgcacaggaagtttcaagctggaaaaagaagtagcagagactcagcatggtactgtgttagtacaaataaaatatgaaggaactgatgcaccctgcaaaataccgttttcaacacaagacgagaaaggtgtcacacaaaatggcagattaataacagctaatccaatcgtcacggacaaagaaaaacctgttaatatagaggcagaacctccattcggcgaaagttatatagtaattggagcaggagagaaggccctaaaactctcctggtttaaaaaaggctcgtcaatcggaaagatgttcgaagccacagcccggggcgcacgacgaatggcgatattaggtgataccgcatgggactttggaagcattggaggtgtatttacatcagtaggaaagcttgtacatcaaatttttgggactgcatatggagtattattctctggtgtatcttggaccatgaagatcggcataggagtgctactcacatggctcggcctcaatagtagaagcacctcactttccatgacttgtatagtcgtgggtttagtcacgctttatttaggtgtaatggtccaggcagactcaggttgtgtcattaattggaaaggtcgtgagctaaaatgtggaagcgggattttcgttaccaacgaggtacatacgtggacagagcaatataaatttcaagccgacagcccgaaacgactttcagcagctatagggaaagcatgggaagaaggcgtgtgcggtatccgctcggcaacaagattagaaaatattatgtggaaacaaataagtaatgaattgaatcatatactactagagaatgatatgaagttcacagttgttgtaggagacgtggctggcatcctggctcaaggtaaaaagatgattcgaccacaaccgatggaatacaaatattcttggaaatcatggggtaaagctaaaataatcggggcagatgtacaaaacacgacatttataattgacggaccaaacacaccggaatgccctgatgaccaaagagcatggaatatttgggaagttgaggattatggattcggaattttcactacaaatatatggctaaagctgagggattcctatacacaggtatgtgaccatcgattaatgtcggcggcgattaaagacagcaaagcagtacacgccgatatgggttattggattgaatccgaaaagaacgaaacctggaaattggcaagagcttcctttatagaagtcaaaacatgtatctggccgaagtcccacacactctggtcgaatggtgtattggaatcagaaatgattatacctaaaaattacggagggcctatttcccaacacaactatcggccaggttattttacccaaactgcaggtccgtggcaccttggtaagttagaactagatttcgacttgtgtgaaggaactacagtagtcgtcgacgaacattgcggaaacagagggccatcactaagaacaacaaccgtcacagggaaaatcatacacgaatggtgctgtagatcctgtacgttaccaccacttcgttttaaaggagaagatggatgctggtatggaatggaaattaggccggttaaagaaaaggaagaaaatctggtcaaaagtatggtttccgctggtagcggtgaagtggacagttttagtttgggtctcttatgtattagtataatgatcgaggaagtgatgagaagtcgatggtccagaaaaatgcttatgacaggtacattggcagtattatttttgctaattatgggacagttaacatggaatgacctgattagattatgcataatggtaggcgctaacgcctcggatagaatgggcatgggcacaacgtatctcgctctaatggctacgtttaaaatgcgacccatgtttgcggtaggattactctttagaagacttacatcaagagaagtccttctactaacaataggactaagtttagtggccagtgttgaattaccaaatagtctggaagaattgggcgatggactagcaatggggattatgattctaaagttactaaccgattttcaaagtcaccaactctgggcaacacttctatctttgacatttataaaaacgaccttttctctacactatgcatggaaaactatggctatggtgctgtcaatagtatcccttttcccattatgtctctcgaccacttcacaaaagacaacatggttaccggtcttattaggaagtttgggatgcaaacctttgacaatgttcctcatagccgaaaacaagatttggggacggaaatcatggccactaaatgaaggtattatggcagtagggatcgtgtccatcttactaagttcgttgctgaaaaatgatgtgccactcgcgggacccctaattgctggcggaatgctcatagcctgttatgttattagcggaagttccgcggacctaagcctggaaaaagcagcagaagttagctgggaagaggaagcagagcatagtggggcgagtcataatatattagttgaagtacaagatgacggaactatgaaaatcaaggatgaagaaagagatgacaccctaacaatccttctgaaagcaacattattagcagtatctggggtatatcccctgtcaataccggctacattgttcgtttggtatttctggcaaaaaaaaaaacaaagatcaggagtgttgtgggatactcctagtcctcctgaagttgaaagagcggtactagacgatggaatctatcgcatcatgcagcgcggtctactaggcaggagccaagtgggagtaggagtgtttcaggaaaatgtattccatactatgtggcacgtgactcgcggagctgttctaatgtatcaaggaaagcggttagagccctcatgggcaagcgtgaaaaaggatctaataagttatggaggtggttggaggctacagggatcttggaataccggagaagaagtacaagtaatagcagtagaaccgggcaagaacccaaagaatgtacaaaccgcaccaggtacctttaaaacgagtgaaggcgaggtaggagccatcgcgctagactttaaacctggaacgagcggttcaccaatagtcaatagagagggcaaaatcgtaggattatacggcaacggggtagtcacaacttcgggaacctacgttagtgcaattgctcaagcaaaagcaagtcaagagggaccattgccagaaattgaagatgaagtctttagaaaacgtaatctaaccataatggacttacatccaggtagtggaaaaacaagacgttatttgccggccattgtccgggaagctatcaaaaggaaattgcgaacgctaattcttgctcccacaagggtagtggcatcagagatggcagaggctttgaaagggatgcctataagatatcaaacaacagccgtaaaatcagaacatactggtaaagagattgtagatctaatgtgccacgctactttcactatgcgattactctcacccgttagagtcccaaattacaatatgataataatggatgaggctcatttcacagacccatcatctatcgctgctcgagggtatattagtacgcgcgtaggaatgggagaagcagccgcaatttttatgacagccaccccaccaggatccgtggaagcgttcccgcaaagcaacgctgttatccaagatgaagaaagggacattccagaacgttcatggaactcaggttatgaatggataacggattttccgggaaagacagtttggttcgtcccaagcataaaaagtggaaatgatattgccaattgtctacgaaaaaatggtaaacgagtcatacaacttagtagaaaaactttcgacacagaataccaaaaaacaaagaataacgattgggactacgtagtgacaacagatattagcgaaatgggcgctaattttagggccgatagagtcatcgatccaagaaggtgtcttaaacctgtaatactaaaagacggacctgaaagagtgattctagctggcccaatgcctgttaccgttgcatccgctgcacagcgaagggggagaataggtcgtaatcacaataaagaaggtgatcaatatatttatatgggacagccattaaataacgatgaggatcatgctcactggacagaggcaaaaatgttactggataatattaacacaccagaaggtattattccggctctatttgaaccagaaagggaaaaaagcgcagctattgacggggagtatagactgagaggtgaagcccggaagactttcgttgaactaatgcggagaggagatttaccggtctggctctcgtataaagtagcatctgagggatttcaatactcggatcgccgatggtgtttcgacggcgaaagaaacaatcaagtattagaagaaaatatggatgtcgagatttggactaaggaaggggagcgtaagaaactgcggccgagatggttagatgccagaacctatagtgacccattagcattacgtgaatttaaggagttcgcagcaggtaggagaagtgtcagcggtgacctaatcttggaaattggcaaactaccacaacacctgactcaaagagcacaaaatgcgttagacaatttggtcatgctgcacaacagcgaacaaggaggaagagcatacaggcacgcgatggaagaactgcctgatacaatagaaacactaatgttactcgcactaattgctgttttaaccggaggagtaacactattcttcttatctggaagaggcttaggaaagacgtctattggattgctttgcgttatggcctcgtcagtattattatggatggccagcgtggaaccgcattggatcgcagcaagtattatccttgaattctttctgatggtactcttaattcctgaacccgatagacaacgaactcctcaagacaaccaactcgcatatgtggtaattgggctgttattcatgattttaacagtagcagcgaacgaaatgggcttactcgaaacgactaaaaaagatttgggaataggtcatgtcgcagtagagaatcatcatcatgccgccatgctggatgtagacttacacccagcatcagcctggacattatacgctgtagcgacgacaatcataactccgatgatgcgacatactatcgaaaataccacagctaatatatctctaaccgcaattgcaaatcaagcagctatacttatgggactcgacaaagggtggccaataagtaagatggatatcggagtccctcttctcgcactaggatgttacagtcaagtaaacccattgactcttacggcagcggtacttatgttggttgcgcactacgcgattattggtcccggtctacaagctaaagccacacgagaagctcagaagcgtacagccgcaggaataatgaaaaacccaaccgtggatgggatagttgctatagatttggacccagtggtttacgatgctaaatttgaaaaacagctaggacaaattatgctacttatattgtgtaccagtcaaatactattaatgagaactacatgggctctatgtgaatcaattactctagcgacgggaccactaacaaccctttgggaggggtcgccagggaagttttggaatacaactatagcggtatcgatggctaatatatttagaggatcttatttagcgggcgccggattggctttttcattaatgaaaagtctgggcggagggcgtagagggacgggagctcagggcgaaacattgggtgaaaagtggaaaagacagctgaaccagctaagtaagagcgagttcaatacttacaaacgcagtggaataatggaggtagaccgatcagaagctaaagaaggattgaagcggggagaaaccactaagcacgcagtcagcaggggcacagctaaactgagatggttcgtcgaacgtaacctggtcaagcccgaaggaaaggtcatagatctaggttgtggcagaggaggttggagttattactgcgcaggcttaaaaaaagtcacagaggtaaaaggatacactaaaggcgggccaggacacgaagaacctattccaatggctacgtacggttggaatctcgtgaaactacactctggtaaagacgtcttttttatacctcccgaaaaatgcgacacattgctatgcgacattggtgaatcatcccctaatcctacaattgaagagggaaggaccttgcgtgtacttaaaatggtagagccgtggcttagaggaaatcagttttgtataaaaatacttaatccttatatgccgtcggtggtcgaaacattggaacaaatgcagagaaaacatggggggatgttagtgcgtaatccactcagtagaaactcaacgcatgaaatgtattgggttagctgcgggactggaaatatagtgagcgctgtaaacatgacatctagaatgttattgaaccgttttactatggcccacagaaaacctacctacgagagagatgtagatctcggtgctgggaccaggcatgtcgcagtcgaaccagaagtagccaatcttgacattataggacaaagaatagaaaatatcaaacacgaacataagagcacttggcactatgacgaggacaacccatacaaaacctgggcttatcatggatcatacgaagtcaagccaagcggttcggcgagcagtatggttaatggggttgtcaagttactaactaaaccatgggatgtcatacctatggtcacgcagattgccatgactgacaccactccttttggacaacaaagagtatttaaagaaaaggttgatactaggacaccaaaagctaaacgcggtactgcccaaataatggaagtaaccgcaaaatggctctggggctttcttagtagaaataaaaaacctcgaatttgtaccagagaagaatttacaagaaaagttcgctccaacgctgctatcggggctgttttcgtagacgaaaaccaatggaattcagcgaaggaggcagtggaagatgaaaggttttgggatttagtacatcgagagcgagaattacacaagcaaggaaagtgcgctacgtgcgtatacaatatgatgggaaaaagagaaaaaaagctaggagaattcggaaaagctaagggaagccgtgcaatttggtatatgtggttgggtgcccgattcttagaattcgaagccttgggctttatgaatgaagatcattggtttagccgagagaattcactttcgggtgttgagggggagggcttacataaattaggatatatattgcgtgacataagtaaaatacctggaggtaatatgtatgccgatgacaccgcaggatgggacacacgaatcacagaagatgatttacaaaacgaggcaaaaatcacggacataatggagcctgaacatgctttgttagccaaaagtatatttaaactaacataccaaaacaaggttgtcagggttcaacgcccagccaaaaacggaacagtaatggacgtcatatctcgtcgcgatcaacggggttccggtcaagtgggcacatatgggttaaacacgtttacgaacatggaagcgcaactcattcgacaaatggaaagcgaaggcatattttcaccttcagaattagaaacaccgaacctggcaggaagggttttggattggctagaaaagcatggagttgaacggttaaaaaggatggcaataagtggcgacgactgtgtggtaaagccaattgacgatcgatttgcaacggcactaactgccctgaatgacatgggtaaagtgagaaaggatatccctcaatgggaaccaagtaaaggatggaatgattggcaacaagtgcccttttgcagccaccactttcatcaacttataatgaaagatggacgggagatagttgtaccctgtagaaaccaggacgagttggttggaagagctcgcgtcagccaaggcgcaggctggtcgctcagagaaacagcatgcttggggaagagctacgcacaaatgtggcaacttatgtattttcacaggcgagatctacgactagctgccaatgcaatttgtagtgctgtacctgttgactgggtaccgacttcccgcacaacatggtcaatccatgcacatcatcaatggatgaccacagaagatatgttaagtgtctggaatcgagtatggattgaggagaacccttggatggaagacaaaacacatatctcctcttggggagacgttccttatctaggaaaacgagaagatcaatggtgtgggtccctgatcggattgacagcaagagcgacatgggcaacgaatattcaagtcgctataaaccaagtaagaaggttaattggcaatgaaaattatctcgattatatgacgtcaatgaagagatttaaaaacgagagcgatccagaaggagcattatggtaa

SEQ ID NO: 21481 - RNA, 9879 nt, synthetic construct
  misc_feature 1..9879: note = derived and/or modified CDS sequence (opt6) from DENV-1__EU726782__SS-prME
  source 1..9879: mol_type = other RNA
tctgttactatgctattaatgttaatgcctactgcactagcttttcacctaacgactcgtggtggcgaaccccatatgattgtttccaaacaagaaaggggaaaaagtttattatttaaaacttctgcaggggtaaatatgtgtacgctaatagcaatggatttgggagaactatgtgaagacacaatgacatataaatgccccagaataactgaaacggaacccgacgatgtagactgctggtgtaatgccacagatacatgggtgacttacggtacgtgtagtcaaacgggagaacacaggagagataaaaggtcagttgcattggcaccccatgtaggcttagggttagaaacacgtaccgaaacttggatgtcatcggaaggagcatggaaacagattcaaagagtagaaacatgggctctacgacatcccggatttactgtgatcgcactgttcttagcacacgctataggtacaagtatcacgcaaaaaggtataatattcatcctcctaatgttagtaacaccctcaatggctatgcgctgtgtgggtataggttctcgagatttcgtagagggattgagcggagcaacatgggtagatgtagtgttagaacacggttcatgtgtaaccactatggcgaaagataaacccacgcttgatatagaactactgaaaactgaagtcactaacccagctgtattacggaaactttgtattgaagctaaaattagtaatactaccaccgattctagatgcccaacacaaggagaagcgactctagttgaggaacaagacgctaacttcgtatgtagaagaacatttgtagataggggctggggtaatggatgcgggttatttggcaaaggctccttgatcacatgtgcaaaattcaaatgtgtaaccaagttagaagggaaaatcgtccaatacgaaaacctcaaatactcagtgattgttacagtgcatacgggcgaccaacatcaagttggcaacgaatcaacagaacatggaactacagccacgataaccccacaagctccgacaaccgaaatacaattaaccgattatggagccctaaccctagattgttcaccaaggacaggacttgactttaacgaaatggtactcctcactatgaaagagaagtcatggctcgttcacaaacaatggttcttggatttgcccctaccgtggacctctggagccagtacttcgcaagaaacctggaataggcaagaccttctcgtcactttcaaaacagcccatgctaagaaacaagaagtagtcgtactaggatcgcaagagggtgcaatgcataccgccctcaccggggccaccgaaattcaaacatcaggaacaacgacaatatttgccggtcatctaaaatgtagactaaaaatggataagctaacacttaaagggatgtcatacgtaatgtgcactggctcatttaaacttgagaaagaggtagcggaaacacagcatgggactgtcttggtacaaataaaatatgagggaaccgatgcaccatgcaaaatcccctttttgacccaggatgaaaagggagtaacgcaaaatggtagattaatcacagctaatcccattgtaacagataaggaaaaaccagtcaatattgaagcagagccacccttcggagaaagctatatcataatcggagctggcgagaaagctctaaaacttagctggtttaagaaaggttcatcaataggcaaaatgttcgaagccactgctcggggcgcgcggcgaatggcgatcttaggggatacagcgtgggacttcggcagtattggcggagtattcacaagtgttggtaaattagttcatcaaatctttggaacagcttatggggttctattttcaggggtatcgtggacgatgaaaattggtataggggtcctcctgacttggctaggtttaaattcgcgaagtacttctttatcaatgacctgcatagcagttggtttggttacgttgtacctaggagtaatggtgcaagcggattctggatgtgttattaattggaaaggcagggagctaaaatgtggcagtggtatttttgtaacgaatgaggtgcatacatggaccgaacaatacaagtttcaagccgactcccctaaacgactgtcagcggccatagggaaagcatgggaagaaggagtgtgcggaataagaagtgctactaggctagaaaatattatgtggaagcagatctcaaacgaactaaatcatatactgttagagaacgatatgaagtttacagttgttgtcggagatgtcgctggtatactggcacaaggaaagaagatgattaggcctcaacctatggaatataagtattcctggaaatcttggggtaaagcaaagataatcggagcggatgttcaaaacactacttttataatcgatggcccaaatacacccgaatgtcctgacgaccaacgagcgtggaatatatgggaagtagaagattatgggttcggcatttttacaacaaacatatggcttaaactcagagacagctatacacaagtttgtgaccacagactgatgagtgcagctattaaggattccaaggcagttcacgccgacatgggttattggatagaaagcgagaaaaatgaaacttggaaacttgcgagagccagctttatcgaggtcaaaacgtgtatttggccaaaaagtcacacactttggtctaacggcgttcttgaatcagagatgattatacctaaaatatacggtggtccaatctctcaacataattatcgtcctgggtattttacgcaaacggccggaccttggcatctggggaaattagaacttgatttcgatttatgtgaggggactacagtggtagtagacgaacattgtggcaatcgcgggcctagtctaagaactactaccgtaacaggtaagattatacatgaatggtgctgccgatcgtgtactctaccaccattgcggttcagaggagaagatgggtgttggtatggaatggaaatacggccggtcaaggaaaaggaagaaaatctggtaaaatcaatggtatcagcgggaagcggagaagtggattcattctccctcggtttattgtgtatttctataattatagaagaagtcatgagatcgcggtggagcagaaaaatgttaatgacaggaactttggccgtcttctttcttctaatcatgggacagctgacatggaatgacctaatacgattatgcattatggtgggcgcaaatgcatctgacagaatggggatgggcactacatatttagcactaatggcaacttttaagatgcgaccaatgtttgctgtaggcttattattcaggagactaacaagtcgggaagttttgctgcttacaattggactttctttagtagctagcgtagaattacccaactccttagaggaactaggtgatggcttggcaatgggcataatgatcctaaaattactaacggattttcaaagccatcaactatgggcaacccttttatcattaacattcattaaaacgacattcagcttacattatgcatggaagacaatggcaatggtacttagtattgttagcttgttcccgctctgcctaagtacaaccagtcaaaagacaacgtggctgccagtgcttcttggatctctaggctgtaagcctttgaccatgtttttgatcgctgaaaacaaaatctggggaagacgctcatggcctttaaacgaaggtataatggcggttggaatagtcagcatactgttaagttccctgctcaaaaatgatgtcccccttgctggtcccttaatcgcgggaggaatgttgattgcatgttatgtcataagtggaagctctgcagatttatcgcttgaaaaagctgctgaagtaagttgggaagaagaggcggaacattcgggagcaagccataacatcctggtcgaagtacaagatgatggcacaatgaagataaaagatgaagaaagagatgatacattgacgatactactgaaagcgacattactggctgtaagcggggtctaccccttatctattcctgcgaccttatttgtttggtatttctggcagaaaaagaaacaaagaagcggcgttttatgggatacaccttctccaccagaagtagaaagggcagttctggatgatgggatatatagaataatgcaacgcggtcttctcggtagatcacaggtgggggtaggagtatttcaagaaaatgtttttcacacaatgtggcacgtaacgcgtggcgctgtcttaatgtaccaaggtaaacgactagaaccttcatgggcgtccgttaagaaagatctaatttcttatggtggcggatggagactgcaaggttcttggaacaccggagaagaagttcaagttatagccgttgaaccgggaaagaatccaaagaacgttcagactgctccaggaacatttaaaacgcctgagggagaagtaggagcgatagcgcttgatttcaagcccggtacatcggggtcaccaatagttaatagagaaggtaaaatagttgggctatacggtaatggcgtggtaacgacttcagggacgtacgtaagtgcaattgcacaggcaaaggcttcacaggaaggtccgttgccggagatagaagatgaggtattcaggaaaagaaaccttacaattatggacttacaccccggatcaggcaagaccagaagatatttgccagccatagtacgggaagcaattaaacgaaaactacgaaccttaattctggcacccacaagagtagtagcttcagagatggcggaagctcttaaagggatgcctatccgataccagacaacagcagtgaagagtgagcatacgggcaaagagattgtagacctaatgtgccatgccacttttactatgcgccttctctcacctgtacgagtgcctaattacaatatgattataatggatgaggcacacttcacggatccatcatccatagccgcacgaggctatatatcaaccagagtggggatgggggaggccgccgcaatatttatgaccgctacgccacccgggagcgtcgaggcttttccgcaatctaatgctgtgatacaagacgaagaaagagatataccagaaagaagttggaactcgggctacgaatggatcactgacttccccggaaagacggtgtggttcgtcccaagcataaaaagtggaaatgatatagcaaattgtttacgcaaaaatggaaaaagagtaatacaactatccagaaaaacttttgatacagaatatcagaaaactaagaataatgattgggattatgtcgttactacagacatttctgagatgggtgcgaattttagagctgacagagtgatagatccgcgaagatgtctaaaacctgttatattaaaagatggaccagagcgtgttatacttgcaggaccaatgccagtgacagtggcttcagcagcacaacgacgcggaaggataggaaggaatcacaataaagaaggagaccaatacatttacatgggacaacccctaaataatgacgaagatcacgcacattggacagaagcaaaaatgctattagataacattaatacaccagaaggtatcatacctgcattattcgaaccggaaagagagaaatcagcagcaatagatggggaatatcgcttgaggggtgaagcaagaaaaacgtttgtcgaactaatgagaagaggtgatctcccggtttggttatcttacaaagtcgcttccgaaggattccaatattcagacagaagatggtgctttgacggagaaagaaacaaccaagttctagaagaaaacatggacgttgaaatttggacaaaagaaggtgagcgaaagaaactaaggcctcggtggttagatgctcgtacatattcagatccactagccttgagggagttcaaggaatttgcagctggacgcagaagcgtaagtggagacttgatccttgaaatcggcaaactccctcagcacctaacgcaaagggcgcagaatgcattggacaatctggtcatgttgcataacagtgaacagggaggacgggcatatagacacgcaatggaagagttgcctgatacaatcgaaactctaatgctactggcgctaatagcagtattaacaggaggcgttactctattctttctaagtggtagaggacttggaaaaacctcgatcggacttctttgcgtgatggcttcaagtgtactactatggatggcttcagtcgaaccgcattggattgcagcaagcattatattagagttctttttgatggtattgttgataccagaaccggatcggcagaggacacctcaagataaccaattagcatatgttgtaataggtctcttatttatgatattaacagtcgctgccaacgaaatgggcttgttagaaacaacgaagaaagacctgggaattgggcatgtggctgttgaaaatcatcaccatgctgctatgctagatgtagatcttcatccggcatctgcatggactctatacgcagtagcaaccactataatcactccgatgatgcgacataccatagagaataccacggcgaatataagtttaactgcaatcgccaaccaggcagcaattctcatgggacttgacaaaggctggccaatatccaagatggatataggagtaccattgttagctctaggatgctatagtcaggtaaaccctctaacactaacagccgcggtactcatgcttgtagcacactacgccataattggaccaggacttcaagcaaaggcaacaagagaagcacaaaagagaacagctgcagggatcatgaaaaacccaacagtagacggtatagtagccatagatctggacccggttgtttatgacgcgaaattcgaaaagcaattaggtcaaataatgctgcttattttatgtacaagtcagattcttcttatgaggacaacgtgggctttatgtgagtcaattaccctagccacaggaccactaaccacgctatgggaaggttcaccaggtaaattttggaacacaaccatagctgtatcgatggcaaacatcttccgagggagttatctagcaggggcgggcttagctttttctcttatgaaatctctgggaggaggacgtcgagggacaggcgcacaaggagaaaccttaggtgaaaagtggaaacgacaactaaatcaactaagcaaaagcgagtttaacacatacaaaagaagtggtataatggaagtcgacagatcagaagctaaggagggtttaaaacgtggagaaactacaaaacatgcagtctctcggggtacagctaaacttcggtggtttgtagaacgaaatttggtcaaaccagaaggcaaggtcattgatctaggctgcgggaggggaggatggtcatattattgcgcaggcctaaagaaagtcaccgaagtgaaaggctatactaaaggaggacctggccacgaagaaccaatacccatggctacatatggttggaatttagtaaagctgcactccggaaaagatgtctttttcataccacccgaaaaatgtgatacattactttgcgatataggggaatctagtccaaacccaaccatcgaggaaggtagaacacttagagtactaaaaatggttgagccgtggttaagaggaaatcaattctgcataaaaatactcaatccatacatgcctagtgtggtagaaacattggagcaaatgcagagaaaacatggaggcatgctcgtgcgtaaccctctatctagaaactctactcacgaaatgtactgggtttcgtgtggaacggggaacatagtaagcgcagtaaatatgacctctagaatgcttcttaatagatttaccatggcacatcgaaaacctacatacgagagggacgtagatctcggtgctggcacaaggcacgtcgcagtagaacccgaggtagcaaatttagacataatagggcagcgcattgaaaatattaaacatgaacataaaagtacttggcactatgacgaagataacccatataaaacctgggcataccatggatcctatgaagtcaaaccgtctggaagcgcttccagcatggtaaatggagtagttaaattgttaacgaaaccctgggacgtcatcccgatggttacacaaatcgcaatgacagacaccacgccattcgggcaacaacgcgtatttaaggagaaagttgacacaagaacacctaaagcgaaaagaggaacggcacaaatcatggaggtgacagccaaatggttatggggtttcctctctcgaaacaagaaacccaggatatgcacacgagaggagttcacaaggaaagtccgatcaaacgccgcgatcggcgcagtatttgtcgatgagaaccaatggaactcagctaaagaagcagtagaagacgaaagattttgggatttagtacatagggaacgagaactgcataaacaaggcaaatgtgctacatgtgtttataacatgatgggtaaaagggagaagaaattgggtgaatttggtaaagccaaagggtcgagagctatttggtacatgtggttaggggctagatttttagaatttgaggctctaggatttatgaatgaggaccattggtttagtagggagaacagtctatcaggcgtagagggagaaggcctccataaactgggttacatattacgagacattagcaaaataccaggaggcaacatgtacgctgacgacacagcaggttgggacactaggataacggaagacgatttacaaaatgaagcaagaatcacagacataatggaaccggaacatgcattgttagcaaagagcatctttaaactaacctatcagaataaagtcgtacgggtacagcgaccagcgaaaaacggaactgttatggatgtcattagcagacgcgatcagcgaggcagtggtcaagtaggtacgtacgggctaaacacatttactaatatggaggctcaattaattagacaaatggaatcggaaggaatcttttcacccagtgaattggaaattcccaatttagcagaacgcgtgctggattggcttgaaaaatatggggtcgaaagactaaaaagaatggctatcagcggtgatgattgcgttgtaaaacctatagacgataggtttgcaactgctctaaccgcactgaatgacatggggaaggttcggaaagacattccacagtgggaaccttctaaaggttggaacgactggcaacaagtaccgttctgctctcatcacttccaccagttgattatgaaagatgggagagaaatagtggtcccgtgccgcaaccaagatgaattagtaggacgagccagggtaagtcaaggggcaggatggtccttaagagaaacggcatgtttaggtaaaagttacgcacaaatgtggcaattgatgtactttcaccgtagagacttgcgattagccgccaatgcgatatgttcagccgttcctgtagattggattccaacgtcacgcacaacttggtccattcacgctcaccaccaatggatgactacggaagatatgctaagtgtatggaatagggtatggatagaggagaacccatggatggaagataaaactcatattagttcatggggagatgttccatacttaggaaaaagggaagaccaatggtgtggaagtctaataggacttactgctagagcaacatgggcaacaaacatacaagttgccattaatcaggtgagaagattaattggaaatgagaattatttagattatatgacatcaatgaaaaggtttaaaaatgaaggcgacccggaaggagcactctggtga

SEQ ID NO: 21482 - RNA, 9879 nt, synthetic construct
  misc_feature 1..9879: note = derived and/or modified CDS sequence (opt6) from DENV-1__EU677178__SS-prME
  source 1..9879: mol_type = other RNA
agcgtaactatgctattaatgttaatgccaacggctctagcatttcacctgaccacgcggggaggggaacctcacatgatcgtaagcaaacaagaaagaggaaaaagtctgctatttaaaacgtccgcgggagtgaatatgtgtactttaatcgcaatggatttgggagagctatgtgaagacactatgacttacaaatgtccacggattacggagactgaaccagacgatgtagattgctggtgtaatgctacagatacatgggtgacgtacggaacctgttcccaaaccggagagcacagaagagacaaacgaagcgtggccctagcgccgcacgtcggattaggattagaaacaagaactgagacatggatgtcatcagaaggcgcgtggaaacagattcagagagtagaaacctgggccctacgacacccgggtttcacggtaatagcgttgtttctagcccatgctattgggacctcaataacacagaaaggtataatcttcatactactaatgctagtaacaccttcgatggcaatgcgctgtgtagggatcggaagtcgcgattttgtagagggactatcgggcgccacatgggttgacgtagtactggaacatggatcctgtgtaacaactatggctaaagataaaccaacattggatatcgagttgttaaaaactgaggtcactaatcccgctgtattacgcaaactctgcattgaggcaaaaatatccaatacgacgactgatagtaggtgcccaactcaaggagaggcaaccttagtggaggaacaagatgcgaatttcgtatgtaggagaacatttgtcgatagaggctggggaaatggttgtggattgttcggcaaagggagcctaataacttgtgccaaatttaaatgtgttactaaattagagggaaaaatcgttcagtatgaaaatttgaaatatagcgttatcgtaaccgtacacacaggcgaccaacatcaagtgggcaacgagtcgacggaacatggaacgacagcaacaataacgccgcaagcgccaacgaccgaaatacaattgacagattatggtgcattaacgctagattgcagccctaggacaggtttagactttaatgaaatggtcttgttgaccatgaaagaaaaatcatggttggtacacaaacaatggttcctagacctgccactaccatggacgagcggagcatctacctcacaagaaacatggaacagacaagatttgctagtaacgtttaaaactgcacatgccaagaaacaagaagttgtagttctcggatcgcaagaaggtgccatgcacacggcgttaactggagccactgaaatacagacgtcagggaccactactatttttgcgggccatctcaaatgcagattgaaaatggacaaactaacattgaaagggatgtcttatgtcatgtgcacaggaagttttaaattagaaaaagaagtcgcagaaactcagcatggaacagttttggtacaaataaaatacgaaggaacagacgcaccatgcaaaataccgtttttaacgcaagatgagaaaggggttacccaaaacggacgattaataaccgcaaatccaattgtaactgataaagaaaaaccagtaaacatcgaagcagaaccaccattcggtgaaagttacattatcattggcgcgggcgaaaaagctctaaaactttcctggttcaagaaaggtagcagtataggcaaaatgttcgaagcaactgctcgtggagctcgtcgaatggcgatacttggagatacagcttgggactttggctctataggaggagtattcacatcagtcggtaaactcgttcaccaaatatttgggaccgcatacggtgtattgtttagtggggtaagttggactatgaagataggtattggcgtcttacttacatggcttgggttaaactcacgttcgacgtcattaagcatgacttgcatagccgtaggcttagtaacactatatctaggagtaatggtacaagcggattcgggctgtgtgataaattggaaaggccgagaactgaaatgtggaagtggcatattcgtaaccaatgaggtacatacatggactgagcaatataaattccaagcagactcaccaaagcgccttagcgcagccataggaaaggcttgggaggagggagtgtgtgggataaggtctgcgacacgactcgaaaatataatgtggaaacagattagtaatgaattaaaccatattctacttgagaacgatatgaaattcaccgtggtagtgggcgacgtagcaggtatcctagcacaaggcaagaaaatgataaggcctcagcccatggaatacaaatatagttggaagtcatggggcaaggcgaaaatcataggggccgatgtacaaaacacgacatttatcattgacgggccaaatacacctgagtgtcctgatgatcagagagcatggaacatttgggaagtagaagattatgggttcggaatattcacgacaaacatatggctcaaactacgggatagtcacactcaagtatgtgatcatagattaatgtcagcagccataaaagattcgaaggcagtacacgctgacatgggctactggatagaaagtgagaaaaatgaaacatggaaattggctcgagcgtcatttatcgaagtaaaaacttgcatatggccaaaaagtcatacactctggagtaatggggtcttagaatctgaaatgataatccccaaaatatatggcgggcccattagccaacataattatcgacctggatatttcactcagactgccggaccgtggcatctgggtaaattagaattagattttgacttatgcgaaggaaccactgtagtggtagacgaacactgcgggaatcgtggcccatccctaagaacgacaacagtcaccggaaagatcatacatgagtggtgctgcagatcctgcacgttacccccacttcgtttcagaggtgaggatggatgctggtatggtatggaaatcaggccagttaaagaaaaggaagaaaatttagtaaagtcgatggtttctgcgggttcaggagaagtagacagcttctcattagggttattgtgtatatccataatgattgaagaagtaatgagatcaagatggtcgaggaaaatgttaatgacagggactttagctgtgtttttcttattgataatgggacaattgacatggaacgacttaataagactgtgtattatggttggagcaaacacgtcagatagaatgggtatgggaactacatatttagcacttatggctacgtttaaaatgcggccgatgttcgcggtcggattattattcagacgactaacaagtagagaagttttgcttcttacgataggactcagtctagtcgccagcgtagagctgccaaactctcttgaggaactaggtgatggtttggcaatgggaataatgatccttaagttgcttactgatttccagagtcatcaattatgggcaacattattatctctaacctttataaaaacaacattcagcctccattatgcttggaagacgatggcaatggttttaagtatagtaagcctatttccactctgcctaagcaccacttcgcagaaaacaacatggcttcctgttttattggggagccttggttgcaaacccctgacaatgtttctaatagctgaaaataaaatctgggggagaaggagctggcctctaaatgagggaataatggcagtaggaatagtaagtatcctgctatcaagtctgttgaaaaacgatgtgccattagcgggtcctctaattgcaggaggcatgttgatagcatgctatgttatatcaggaagtagtgcggatctaagcctagagaaagcagcggaggttagttgggaagaagaagccgagcattcaggagccagccataatattttagttgaggtacaagatgatggcacaatgaagataaaagacgaagaacgtgatgacacgctgacaatcttattaaaggctactctactcgcagttagtggggtatacccactaagtatccctgccaccttatttgtatggtatttctggcaaaagaaaaagcaaaggagtggtgtgctgtgggatactccttcacctccggaagtggagagggcggtgttggatgatggtatatatcgcattatgcaaagaggtttattaggtcgttcacaggtgggggtcggagtgtttcaggaaaatgtattccacacaatgtggcacgtaaccagaggcgctgttctaatgtatcaaggtaaacgattagaaccgagctgggcgagtgttaagaaagatttgatttcttacgggggaggttggcggcttcaaggaagttggaataccggcgaagaagttcaggtaatagcggtggaacccggcaaaaatccgaaaaatgttcaaacagcaccgggcactttcaaaacccccgagggggaagtaggagccatcgcactagactttaaacccggaacatcgggctctcctattgtgaatcgagagggcaaaatagtaggattatacggaaacggtgtcgtaaccacgagtggaacgtacgtgtctgctatagcacaagccaaggcgtcgcaagaaggaccgttacctgaaatagaagatgaagtctttcgtaaaaggaatttaactataatggatctacacccagggagtggtaagacaagacgataccttcccgcaatcgttagagaggccattaaacgtaagttaagaacattaatcttagccccaacgcgcgtagttgcttcggaaatggcggaagcattgaaaggaatgcccatacgataccaaactactgcagtgaaaagtgaacatactggtaaggaaattgtggatcttatgtgtcacgcgacattcacgatgcgtttactctcaccagttcgagtgccaaattataatatgattattatggacgaggcacattttacggacccatcttctatagctgcaagaggttatatctccacccgggttggaatgggagaggcagcagcgatatttatgaccgctacgccgcctggaagtgtggaagcattcccacagagtaacgctgtcattcaagacgaagaacgcgatatacctgagagaagttggaactccgggtatgaatggattaccgacttccctggaaagacggtctggttcgtgccttcaataaaaagtggaaatgatatagcaaattgcctacggaaaaatggaaagagggtaatccaactatccaggaaaactttcgacactgaataccagaaaacgaaaaataatgattgggattacgtggtaaccaccgacatctcagagatgggggccaattttcgtgcagatagggttatagatccaagacgctgtttaaaaccagtaatactcaaagacggtccagaacgcgtaattttagctggtccaatgcctgtaaccgtagctagtgcagcacaaagacgtggaagaataggcagaaatcataataaagaaggggatcaatacatatatatgggtcaaccactcaacaatgatgaagaccacgcacattggacagaagcgaaaatgctcttagataatataaataccccggagggcattatccctgcattatttgagccagagagggaaaaatccgcggcgattgacggagagtatagattacgaggggaagctagaaagactttcgtggagttgatgcggcgtggagacttgcctgtttggcttagctacaaggtagcaagcgaagggttccaatattcagatagaagatggtgcttcgatggagaaagaaacaatcaagttctcgaagaaaatatggacgttgaaatatggacaaaagaaggggaaaggaagaaattaagacccaggtggctagacgcacgaacatattcggatccattagccttacgcgaatttaaagaatttgcagcgggcagaagatcggtatcaggcgatctaatcttagaaatagggaaactgccacaacatctaactcaaagagcacaaaacgcacttgacaacctggtaatgctgcataattccgaacaagggggacgcgcatatcgacacgccatggaggaactcccggatacgatagaaaccttaatgcttttggcgttaatagcggtgcttacgggtggagtaaccttatttttcctaagcggtagaggactaggaaagacatcaatcggtttactttgcgtaatggctagtagcgtactattatggatggcctcagtggaaccacactggatagcagctagcataattctcgagttctttctaatggtgttattaatccccgaaccagataggcaaagaacacctcaagataatcagctcgcgtatgtcgtcataggattattatttatgatcctgacagtagccgcaaatgaaatgggattactcgagactacgaagaaagacctgggaatcgggcacgtcgcggtagaaaaccatcatcacgctgcaatgttggatgttgatttacacccggcctcagcatggacgctctatgctgtagcaacgactataataacccccatgatgaggcatactatagaaaatactacggcaaatattagtctgactgcaatcgcaaaccaagccgcaattcttatgggcctagacaaagggtggccaatatcaaagatggacattggagtgccattactcgctctgggttgttacagtcaagtaaacccattgactctaactgctgcagtattgatgcttgtggctcattacgctataatcggtcctggattacaagcaaaagccacaagagaagcacaaaagaggactgcagcggggattatgaagaacccaacggtagacggtattgttgcaatagatttggatcctgtggtttatgatgcgaaatttgaaaagcaactagggcaaataatgctactcatactttgtacgagtcaaattttactaatgagaacaacatgggcgctatgcgagagcatcactttggcaacagggccattaacaaccctatgggaaggctcaccgggaaaattttggaatacaacaatagcagtttcgatggccaatatattcaggggcagttatctggcaggggctggattagctttctcgttaatgaagagtctaggaggcggaagacgaggcaccggagctcaaggtgaaacattaggagaaaaatggaaacgacaattaaatcaactatcaaaaagtgaatttaacacatataagcgatccggaataatggaagttgatagaagtgaagcaaaagagggacttaaacgaggggaaacaacaaagcatgcagtaagtaggggaactgcaaaactacggtggttcgtggagcggaacttagtaaagccagaaggtaaagttatagacctgggatgtggaagagggggttggtcatattattgcgcaggattaaagaaagtgaccgaggttaagggatatacgaaaggaggaccaggacatgaagaacctattcccatggcaacatatggttggaacctagttaagttacactcaggtaaagatgtatttttcattcccccagaaaagtgtgacacattattatgtgatatcggagaaagtagccctaacccaacaattgaagagggtcggacattgagagtcctaaaaatggttgaaccgtggcttcgaggaaaccaattttgtataaaaattctaaacccatatatgccctcagtggttgagacgcttgaacaaatgcaacggaaacacggtggaatgctagtccgtaatccgctgtcaagaaattccacacatgaaatgtattgggtgtcgtgtgggactggaaacatagtgagtgctgttaacatgacctccaggatgttgcttaatcggtttaccatggcacatagaaaaccgacatatgagagggacgtcgatctaggcgcagggaccagacacgtagcagtcgaaccagaaatagcaaatctagatataatagggcaacgaatagaaaatattaaacatgagcataagtcgacttggcattacgatgaagataatccttataagacctgggcttatcacggaagctatgaagtcaaaccgtccggaagtgcgtcttcaatggtaaacggagtagttaaacttctaacaaagccttgggatgtaatcccgatggttacacaaatcgcaatgacagacacaactccatttggacaacagagggtattcaaggaaaaagttgacactcgaacacctaaagcaaaacgggggaccgcgcaaattatggaagtgactgcaaaatggctatggggatttttatcaagaaataagaaacctcgaatttgcacccgagaagagtttacaaggaaagttagaagcaatgcagcaattggtgccgtatttgtcgacgagaaccaatggaatagtgctaaggaggcagtcgaagacgagcgattctgggatttagtacaccgggaaagagagttacataaacaaggaaaatgtgcaacctgtgtgtataatatgatgggcaagcgcgagaagaaacttggggaatttggaaaagccaagggtagtagggctatatggtacatgtggttgggagcaagattcctagagttcgaagcgctcggattcatgaatgaagatcattggttctcacgagaaaattcactatcaggggtagaaggagagggcttacataaattaggatatatactaagagatataagtaaaattcctggcggaaacatgtacgctgacgatactgctggctgggataccaggattacagaagatgatctacagaatgaggcaaggataactgatatcatggagccggaacacgcgttgcttgctaaatcaatatttaagttaacgtatcaaaacaaggtggtgagggtacaaagaccagctaagaacgggacagtaatggatgtcatcagtcgaagggatcaacgtggaagcggtcaagtcgggacatacggattaaacactttcaccaatatggaagctcaactgatacgacaaatggaatcagagggtatatttagcccttcagagttggaaacaccaaatctagcagaaagagttcttgactggttagagaaatatggcgtggagagattaaaacgcatggctatttctggcgacgattgtgtcgtaaaaccaatagatgacagattcgcaacggcattgacggccttgaacgacatgggcaaggttaggaaagatataccgcaatgggaaccctctaagggatggaatgattggcaacaagtccctttctgttcccaccatttccatcaactaatcatgaaagatgggcgagaaattgtagtaccttgcagaaaccaagacgagctagtgggacgagcgagagtgagccaaggagccggctggtctcttagggagactgcgtgtctcggaaaatcatacgctcaaatgtggcaattaatgtattttcaccggagagatctacgtttggcggccaacgctatatgctctgcagttccggtggattggattccgaccagtagaacaacttggtcaatacatgctcatcatcagtggatgacaactgaagacatgctaagcgtatggaaccgggtttggatagaagaaaacccttggatggaagataagacacatatatccagttggggagacgttccttacttagggaaacgggaggatcaatggtgtggatcgcttataggcttgacggctagagctacctgggcaactaatattcaagtggccataaatcaagttcggaggctcataggaaatgaaaattatttagattacatgacatcaatgaaacgatttaaaaacgaaggcgatccggagggggccttatggtag

SEQ ID NO: 21483 - RNA, 9879 nt, synthetic construct
  misc_feature 1..9879: note = derived and/or modified CDS sequence (opt6) from DENV-1__EU687251__SS-prME
  source 1..9879: mol_type = other RNA
tcagttaccatgctacttatgttaatgcccacagcattagcattccatttaacaacaagaggaggtgaacctcatatgatcgtttccaaacaagaaagaggaaaatcattgctattcaaaacatcggccggtgttaatatgtgtacactaatcgctatggatctaggggaactatgcgaagataccatgacatataaatgcccaagaataaccgaaacagaacctgacgatgttgactgctggtgtaatgctaccgacacatgggttacgtatggaacgtgctcacaaacgggagaacatcgaagagacaaacgaagtgtggcattggctcctcacgtgggtttagggttagaaaccagaaccgaaacatggatgtcttctgaaggagcatggaaacaaattcaaagagttgaaacatgggcattacgtcatccgggttttacagtaatcgcattatttcttgctcatgctataggtacatccataactcaaaaagggataatatttatattgctaatgttagtgacaccttctatggctatgcgatgtgtaggaataggtagcagggatttcgttgaaggattatccggggcaacttgggtcgatgttgtactagaacatgggagctgcgtaacaacgatggcaaaagacaaacctactttagatattgaactactaaaaactgaagtgacgaatccggcagtgttacgaaaactttgtatcgaagcgaaaatatcaaatactaccaccgattcaagatgcccaactcaaggagaagcgactcttgttgaagaacaagatgcaaattttgtatgtagacgcaccttcgtggatagaggatggggaaacggttgcggactatttggtaaaggaagtttgataacatgcgctaaatttaaatgtgttacaaaattggaagggaaaatagtgcaatacgaaaacctcaaatactctgtcattgttactgtacatacgggtgatcagcatcaagttggtaacgagagtacagaacatggaacaacggcaaccatcaccccgcaggcaccgaccacagaaattcagctgacagactatggtgctcttaccttagattgtagccccagaacgggattagattttaatgaaatggtactgctaactatgaaggagaaaagttggctagtacacaaacagtggtttctagatctacctctaccatggacctctggagcaagcacgtcccaagaaacctggaatcggcaagatttattagttactttcaaaacggcacatgccaagaaacaagaagtcgtagttttagggtcacaggaaggtgcaatgcatactgcacttaccggagcaacagagattcaaacctcgggaactacaaccatattcgctggacacctcaaatgcaggttaaaaatggacaagttgactctcaaaggtatgagctacgtgatgtgtacgggatcatttaaattagagaaagaagtagcagagacgcaacacgggacggttctcgtacaaattaaatacgaaggtactgacgcaccatgtaagataccctttagcacacaggacgaaaaaggggttacgcagaacggacgattgataactgctaacccaattgtaacagacaaagaaaaaccagtcaacatagaagccgaaccaccatttggagaaagctatataatcataggagcaggagagaaagccttaaaactatcttggtttaagaaagggagtagtataggaaaaatgtttgaggccactgctagaggtgcgcggagaatggctattttaggggatacagcatgggatttcggttctattggtggtgtatttacttccgtaggaaagctagtacatcaaatctttggaaccgcatacggcgttcttttcagtggagtatcttggacaatgaaaattgggattggagtactattaacatggttgggactcaactcaaggagtacgagtcttagtatgacatgtatagctgtagggctggtaactttgtatttaggtgttatggtacaggcagattcgggatgtgtaattaactggaaaggaagagaattaaaatgcggttcaggaatattcgtaacaaatgaggtacacacttggactgaacaatataaatttcaagcagactcacctaaacgattgtcagcagcgataggcaaggcgtgggaagaaggagtgtgcggaatacgtagcgcgacgcgactcgagaacattatgtggaaacagatatctaatgagctgaaccatatactacttgaaaatgatatgaaatttacagtggttgtgggagatgtggcaggtatactcgcacagggcaagaaaatgattcggccccaacctatggaatataaatactcatggaaatcatggggcaaggctaaaataattggcgcagatgtccaaaatacgaccttcatcattgatggtcccaacacccccgagtgccctgacgaccaacgagcttggaatatatgggaagttgaagactatggattcggtatatttacaacaaatatttggttaaaattgcgcgactcacatacccaagtgtgcgaccatcgcttgatgtcagccgcgataaaagatagtaaggccgtgcatgcggatatgggatactggatcgaatcagagaaaaatgagacatggaagttggcacgagccagcttcattgaagtaaagacatgtatttggccgaagtctcacacactatggtcaaacggggtcttagaatcagagatgattattcccaaaatatatggaggaccaatatcccaacacaactatcgccctgggtattttactcaaacagcaggaccatggcacctaggcaaattggaacttgattttgatctttgcgaaggaacaacagtagtcgttgatgaacattgtggaaaccgtggaccaagccttagaacaacgacggtcactggaaaaatcatacatgaatggtgctgccgaagctgcaccctccctccattgagatttcgaggagaagatgggtgttggtatggaatggaaattagacccgtaaaggaaaaagaagaaaatctagtaaaatcaatggtttcggctggaagtggggaggttgattctttctcccttggcctcctatgcatatcaataatgatcgaagaagtaatgagatcaagatggtcaagaaagatgctcatgactggaacattggcagtcttcttcttattaattatgggacaattgacgtggaatgatctcatacgactctgtattatggtcggagcaaacgcttcagatagaatgggtatgggcactacctatcttgcattaatggctacctttaaaatgaggccaatgttcgccgtaggcctgttatttcgacgattaacaagccgagaagtcctactgttaacaataggactgtcattagtagcatccgtagaattaccaaattctctcgaagaactgggtgatggattagccatgggcataatgatcctaaaactgttgacagacttccaatcacatcaactctgggccacattattatccttaacttttattaagacgacctttagtttacactatgcatggaaaacaatggctatggtgctgagcatcgtgtcgctatttcctttgtgcctaagtacaacatcccaaaagacaacatggttaccagttctattaggatcacttggttgtaaaccattaaccatgttcttgattgcagaaaataaaatatggggaagacgatcctggccactaaacgaaggaataatggccgttggcatagttagcattctattaagctcactactaaagaatgacgttcctttagccgggcctttaattgctggaggaatgttaattgcgtgttacgtaataagtggttcatcagcggacttatcattggagaaagcagctgaagtgtcgtgggaagaagaagccgagcattcgggggcctcgcataacatcttggtcgaagttcaagatgacggcacaatgaaaatcaaagatgaagagagggacgacaccttaactatcctactaaaagcaacgctactagcggttagtggtgtataccctttatccattcccgcaaccctttttgtctggtacttctggcaaaagaaaaagcaacggtcgggtgttctatgggacacaccttctccaccggaagtggaaagggcggtccttgatgacggcatatacagaataatgcaaagaggattactaggacgatctcaggtgggggttggagtattccaagaaaacgtctttcataccatgtggcatgtcacaagaggcgctgttctcatgtaccagggtaagcgattagaaccatcgtgggcgagtgtaaagaaggatcttatcagttacggtggaggttggcggctacagggaagctggaatactggtgaagaggtccaagtaattgcagttgaaccagggaaaaacccgaagaatgtacaaacggccccaggtacctttaaaacccctgaaggagaagtaggcgcaatcgcgttggactttaaacctggtaccagtggatctcctatagttaatagagaaggtaaaattgtcggactttatggaaacggcgtggtaaccacttcaggaacgtatgtaagtgcaatcgctcaagctaaggcatcacaagagggtcctctgcctgaaatagaagatgaagtatttagaaaaagaaaccttacaataatggacttacacccgggctcaggcaaaacaaggagatacctcccagcgatcgtacgagaagcaattaagcgaaagttacgaacattaatacttgccccaactcgagtagtcgctagtgaaatggcagaagcgcttaaggggatgcccataagatatcaaacgaccgctgtaaagtcagaacatactggcaaagaaatagtagacctgatgtgccacgcaacattcacaatgcgattacttagtccagtccgcgtaccaaactacaatatgataataatggacgaggcacacttcaccgatccttcaagtatagcagcaagaggttatatatcaacaagagtagggatgggtgaagcagctgcgattttcatgaccgcgacaccacccggctccgtagaggctttccctcagagtaatgctgttattcaagacgaagaaagagacataccagaacgaagctggaactcaggatatgagtggattactgactttcccggaaaaactgtttggttcgtcccaagtataaaatcaggtaatgatatagcgaactgtttgcgtaagaatggtaaacgagtcatacagttgtctcgcaaaacctttgacactgaatatcagaaaactaaaaataacgattgggattacgttgtaactactgacatatctgagatgggagcaaattttagagcggatcgagtaatagatcccagaaggtgcttaaaacctgtgatattgaaggacgggccggaaagagtaatattagccggacccatgccggtaacagttgcatctgccgcacaaagaagaggtagaatcgggaggaatcacaataaagagggtgaccaatatatatatatgggccaacccctaaataacgatgaggatcacgctcattggacagaggccaaaatgctactggataacataaatacaccggagggaattataccagcgttatttgaaccagagagggaaaaatcagctgctatagatggggaatacagactaagaggtgaagccaggaagacatttgtagaattgatgagaagaggtgacctcccagtgtggctctcatataaagtagcttcagaggggtttcaatactcagacaggcgatggtgttttgatggtgagaggaataatcaggtactagaagaaaatatggatgttgaaatctggacgaaagaaggcgaaaggaagaaactgaggccgagatggcttgatgcacggacgtacagtgatccacttgccttgcgagaatttaaagagttcgcggcaggaagaaggtctgtctcaggagacttaatcctcgaaattggaaaactaccccagcatttgactcagagagctcaaaatgccttagataatttggtaatgcttcataatagtgaacaaggaggtagggcttaccgacatgctatggaagaactaccagatacaatagaaaccttgatgttactggcgttgattgccgtattgacaggtggtgttacgttattctttctatccggtcgaggcctaggcaaaacatccattgggctgttatgcgtgatggctagtagtgtattactgtggatggcatctgttgaaccccattggatcgcggcttccataattttagagtttttcttaatggtacttttaataccagagcctgacaggcaaagaacgcctcaagacaatcagcttgcatatgtcgttataggattgttattcatgattctcactgtcgcagcgaatgaaatgggactgttagagactactaagaaagatctaggaattgggcatgtcgccgtcgaaaaccaccaccatgcagctatgcttgatgtagaccttcatccagcatctgcttggacgctctatgcagtcgccactacaatcatcacacctatgatgcgacataccatagagaatacaaccgcgaacatctccctaactgcaatagctaatcaagcagcaattctcatgggattagataaaggatggccgattagcaaaatggatatcggcgttccgctattagcactaggatgctactcacaagtaaacccattgacacttactgcagctgtactaatgttagtcgctcattacgctattataggaccaggactgcaagcgaaagcaacaagggaagcacaaaaacgaacagctgctggaattatgaaaaatccaaccgtagacggaattgtagccattgatttggacccagtagtatatgacgctaaatttgagaaacaactcggccaaataatgttattaatcttgtgtaccagccagatacttttgatgcgtaccacttgggctttgtgtgaaagtataacactagctacaggaccactaacaacgctatgggagggcagcccgggaaaattttggaatacaaccatagctgtctctatggcaaatattttcagagggtcctatttagccggagctggacttgcattctctttaatgaaatcactaggcggtggaagacgtgggacaggagcacagggcgaaacgctaggcgagaaatggaagcgacaattgaatcaacttagtaagagcgaatttaacacatataaaaggtcagggataatggaagtcgatagatcagaggccaaagagggcctcaaaagaggagagaccacaaaacatgcagtgtcaagaggcactgctaaattaagatggtttgtagaaagaaacttggtaaaacctgaaggcaaagtaatagatctggggtgcggccgtggaggatggtcctattattgcgctggtttgaagaaagtaaccgaagtgaaaggttataccaagggaggtccgggtcatgaggagccaataccaatggcaacctacgggtggaatttagtaaagctacattctggaaaggatgtcttctttataccccctgagaaatgtgacacgttactttgcgacattggcgaaagttctcctaatccgaccatagaagaaggacgaacactaagagtcttgaaaatggtagaaccgtggctaaggggaaaccagttttgcattaaaattctcaacccatatatgccaagtgtcgtcgaaaccctcgagcaaatgcagcggaaacacggaggtatgttagttcgcaatcctttaagtcgaaatagtactcatgaaatgtattgggtatcatgcggcactggaaacatagtctcagcagtaaatatgacaagtagaatgctactgaacaggtttactatggctcataggaaaccaacgtatgaacgtgacgttgatttaggcgcaggaacacgacatgtcgctgtagagccagaagttgcgaatctagatatcatcgggcaacgtatagaaaatatcaaacacgagcataagtctacatggcattatgatgaagataatccttacaagacttgggcgtatcatggaagctatgaagttaaaccgtcgggcagtgcatcttcaatggtcaacggtgtagtaaaacttctaacaaaaccttgggatgtaatcccaatggtgacccagatcgcgatgacagacaccacacccttcggacaacaaagagttttcaaggaaaaggtggatacgagaacacctaaggcaaaacgaggtacggcccagatcatggaagtaactgcaaagtggctttggggtttcttgagtcgaaacaagaaacctagaatctgtacacgagaagagtttacaagaaaagtgcgtagtaatgccgcaattggcgcagtgtttgttgacgaaaatcaatggaatagtgctaaggaagctgttgaagatgagcggttttgggatttggtgcaccgtgagagagagttacataagcaagggaaatgtgcaacatgcgtatataatatgatgggaaagagagaaaagaagctaggcgaatttggaaaagcaaaagggtcccgtgctatctggtacatgtggctgggagcaagattccttgagtttgaagctctaggtttcatgaatgaggatcattggttctctcgagaaaacagccttagtggagtagaaggagaaggtttacataaattaggatacattcttcgagacatcagtaaaataccgggtggtaacatgtatgcggatgataccgcgggatgggacacaagaataaccgaagacgatcttcaaaatgaagcaaggatcacggacattatggaacctgaacatgcactattggcgaaaagcatattcaaacttacttatcaaaacaaagttgtgagagtacagaggccggcaaagaatggcactgttatggatgttatttcaaggagagatcagcgtggcagcggccaagtcggcacatacggcttaaacacatttactaacatggaagctcaattaataagacaaatggagtcagaaggcatattcagcccaagcgaattggaaactccaaaccttgcagaaagagtactagactggctcaagaaatatggcgtggaaagattaaaaagaatggcaatatcaggggatgattgtgttgtaaagcccatagacgaccgatttgctacagcgctcacagcactaaatgacatgggtaaagtaagaaaagacataccccagtgggagccaagtaaggggtggaacgactggcagcaagtaccgttttgcagccatcacttccaccaactgatcatgaaagacggaagggaaatagttgtaccatgtcgaaatcaagatgagcttgtaggcagggcaagagtcagccagggtgctggatggagtttacgagaaacagcttgtcttggaaaaagttatgcacagatgtggcaattaatgtattttcatagaagggatctaagattagctgcgaacgcaatttgttcggctgtaccggtggattggatacccaccagccgaacgacttggtccattcatgcacaccaccaatggatgactactgaagatatgttatccgtatggaatagggtgtggatagaagaaaacccatggatggaagacaaaactcatatcagttcctggggtgatgtaccgtacctaggaaagcgggaggatcaatggtgcggtagtctaattgggttaacagcacgggccacgtgggcaaccaacattcaggttgcaattaatcaggtccgtcgacttattgggaacgagaactacttggattacatgacatcaatgaagaggtttaaaaacgagagtgatccggaaggcgcactatggtaa

SEQ ID NO: 21484 - RNA, 9879 nt, synthetic construct
  misc_feature 1..9879: note = derived and/or modified CDS sequence (opt6) from DENV-1__FJ024427__SS-prME
  source 1..9879: mol_type = other RNA
tccgttaccatgttactaatgttaatgccaaccgctcttgcatttcatttaaccacaagaggcggcgaaccacatatgattgtttcgaaacaagaacgcggaaaatcgcttttgtttaaaacgagtgcaggggtgaacatgtgtactctcatagcgatggatttgggtgaactttgcgaagatacgatgacatataaatgtcccagaattaccgaaacagaaccggatgacgtcgattgttggtgtaatgcaactgacacatgggtcacctacggtacctgtagtcaaactggagagcaccgcagagacaaaagatccgtagcattagcaccacatgttggtttaggacttgagacaaggaccgagacctggatgtcgtcagaaggggcttggaaacagatccagcgggttgaaacgtgggcattacgacatcccggatttactgtaattgctctgtttctggcacatgcaatcggaacctcaataacgcagaaaggaataatctttatactgttaatgctagtaacacccagtatggcgatgcgatgcgtaggcattggaagtcgggactttgttgaaggtctatcgggggcgacgtgggtggatgtggtactagaacatggttcatgtgttacaactatggcaaaagacaaaccaactctagatatcgagctcctgaaaactgaagtaacaaatccagcagtgctaagaaaactttgtatagaggcaaaaatatcaaacacaacaaccgattccagatgtccgacacaaggcgaggctaccctggttgaagaacaagatgcaaattttgtgtgtagaagaacatttgttgataggggttggggcaacggatgtggactttttgggaaaggaagtctaattacttgtgcaaaattcaaatgtgtcacaaaactagaaggcaaaatagtacaatacgagaacctaaaatacagcgtaattgtgacagtgcacacaggagaccaacatcaagtgggaaatgaatctactgaacacggtacaacagcgacaataacaccccaagcacccaccacagaaatccaattaacagggtatggggcactaacgttggattgttctccccgtaccggtctggatttcaacgagatggtattgctaaccatgaaagaaaaatcctggttagttcacaaacaatggtttctcgatttaccactcccatggacaagtggcgcaagtacatcacaagaaacttggaatcgacaagacctattagttacctttaaaacagcccacgctaagaaacaagaggtagtagttttagggtctcaggagggagccatgcatacagcacttactggggccacagaaatacaaacatcaggtacaactacaatattcgcagggcacctcaaatgtcggttaaaaatggataaattaactctaaaaggcatgagctacgttatgtgtaccggatcattcaaattagaaaaagaagttgcagaaactcaacacggaaccgttttagtacaaattaagtatgaaggagccgacgctccatgtaaaatacccttcagtacgcaagacgaaaagggaataacacagaacggccgacttataactgccaatcccatcgtaacagacaaagagaagcctgttaacatcgaggccgaacccccgtttggtgaaagttatatagtgataggcgctggagaaaaagcgctaaagctatcatggtttaagaagggaagttctataggaaaaatgtttgaagcgacggcccgaggagccaggcgaatggccatcctaggagataccgcatgggatttcggttcgataggaggagtattcacaagcgtaggtaagttagtgcatcaaatatttggtactgcttatggcgttttattttcaggagtctcatggacaatgaaaattggtataggtgttttgttaacatggttgggactcaatagcagaagcacatctttatcgatgacttgcatcgcggttggattggtaacgctttatcttggtgttatggttcaagccgacagtggctgtgtcattaattggaaaggaagggaactgaaatgtggaagcggaatattcgttaccaacgaagtacacacgtggacagaacaatacaaatttcaagcagattcaccaaaacgactatcagccgccataggtaaggcttgggaagaaggagtctgcggtatcagaagtgcaactagactagaaaatataatgtggaaacaaataagtaacgagttaaatcatattctattagagaacgatatgaagttcactgtggtcgtaggcgatgtcgctggaatattggcccaaggtaaaaagatgatacgcccacaaccaatggaatataagtattcctggaaatcatggggcaaagcgaaaataataggagcggatgttcagaataccacgttcattattgacggaccaaatacccctgaatgcccagacgatcagagagcatggaatatttgggaagttgaagattacggttttggaatatttacgactaacatttggctaaaactaagagatagctatacacaggtttgtgatcatcgattaatgagtgcagctattaaagattctaaagccgtacatgcagatatgggctactggatagaatctgagaaaaacgaaacttggaagttggctagggccagttttatagaagttaaaacatgcatttggccaaaatcacacacattatggagcaacggcgttttggagtctgaaatgataataccaaagatatatggaggtcctatttcacaacataattaccgacccggttatttcacgcaaacggcaggaccgtggcatcttgggaaattggaacttgatttcgacctatgtgagggaacgactgttgttgtggatgagcattgcggaaacagaggaccctcattgaggacgactacggtcacaggaaaaataattcacgaatggtgttgcagatcatgtactctaccaccactacgattcagaggggaagatggttgttggtacggcatggaaatacgacccgttaaagaaaaggaagagaatttagttaagtctatggtctcagcgggaagtggagaagtagacagtttctcattaggattactgtgtatttccattatgatagaagaagtaatgagatcacggtggtcaagaaaaatgttgatgacaggaacattagccgtattctttcttctgataatgggacaactaacatggaacgatctaatccgtctatgtataatggttggagctaatgcgagtgatagaatgggaatgggtaccacgtatctagctttaatggctacatttaaaatgcgacctatgttcgcagtagggctattgtttagaagactcacaagccgagaagtactacttttgacgatagggctctctttggttgctagtgtcgaactgccaaactcattggaagaattaggagacgggctcgctatgggaataatgattctaaaactattaaccgattttcaatcgcatcaactctgggcgactctcttaagcctaacctttattaaaacaacttttagcctacactacgcatggaaaacaatggctatggtccttagtatcgtaagtctatttccactatgtctctctacaacaagtcagaaaactacatggctacctgtgctcttaggtagcttagggtgcaaaccactcacaatgtttttaatcgcagagaataaaatttggggaagaaggagttggccgttaaacgagggaattatggccgttggaattgtaagtatacttctgagctctttactcaaaaatgatgtgcctttagcaggaccattaatagcgggtggaatgttaatagcatgttacgtcatcagcggatcatcagccgatctaagtctagaaaaggctgccgaagtgagttgggaagaagaggcagaacactcgggtgcttcccataatatactcgtggaagttcaagacgacggaacaatgaaaataaaagatgaagagagagatgatacgttaactattttattgaaagctaccctgttagcagtatcaggtgtatatccactctctattccagctacactattcgtttggtatttctggcaaaagaagaagcaaagaagtggagtgctctgggacaccccaagcccaccggaagtagagcgtgcagtcttagacgatggcatctataggataatgcaaaggggcttattaggaaggtctcaggtcggagtcggagtatttcaagagaatgtgtttcatacaatgtggcacgtaacaaggggcgccgtcttaatgtatcaaggaaagaggcttgaaccttcgtgggcttctgtaaagaaggatctgatatcttacggtggtggatggagattacagggctcttggaacactggcgaggaagttcaagttatagcagtcgaacccggcaaaaacccaaagaatgttcagaccgcacctggtacgtttaagacgcctgaaggcgaagttggagctatagcattagattttaagccaggaacttcagggagtccaatagtaaatcgcgagggaaaaatcgtaggcctatacgggaatggtgtagtgactactagcggaacgtatgtaagtgctatagcgcaggctaaggcttctcaggaaggtcctcttccggaaatagaggacgaagtatttagaaagcgaaacctaaccataatggacctacaccctggtagtggaaaaacacgcagatacctccccgcgatcgtacgtgaggcaataaaacgaaaattaagaacccttatattagctcccactagagtagtagctagcgaaatggcagaagctctaaaagggatgccaataagatatcaaactactgcggtgaaatcagaacacacaggtaaggaaatagttgatttaatgtgccacgcgaccttcacgatgcgactactttcaccagtaagagtgccaaactataatatgataattatggatgaagctcactttacagatccatcatcgattgctgcgcggggatatatttcaacaagagtaggtatgggagaagcggcagcgatctttatgaccgcaacgcccccaggaagtgtggaggcgttcccacagtctaatgcggttatacaagacgaagaaagagatattccagagcgtagttggaatagtggctatgaatggataactgactttcctggcaaaacggtatggtttgtcccttccattaaatctggcaatgacatagcaaactgtcttaggaaaaatgggaagcgtgtcattcagctatcacgcaagactttcgacactgagtatcaaaagactaagaataatgattgggactacgttgtcaccacggatatatcagaaatgggcgcaaactttagagccgatagagtaatcgatcctcggagatgccttaaaccagtgatactgaaagacggtcccgaaagggttattttagcgggaccaatgccggtgacagtagcatctgctgcacaaaggagaggacgtataggaagaaaccacaataaagaaggcgaccagtatatttatatgggacaacctctaaacaacgatgaagatcatgcacattggacagaggctaaaatgctattagataatataaatacacccgagggaataatacctgctttgttcgagcccgaacgtgagaaaagtgccgcaattgacggtgagtatcgcctgcgtggagaggcgaggaagacatttgtagaattgatgaggagaggggatttaccagtctggctaagctacaaagtagccagtgagggattccaatattcagacaggcgttggtgttttgatggagaacggaacaatcaagtactagaagaaaatatggatgttgagatctggacaaaagaaggtgaaagaaagaagctacgtcctagatggttagatgctagaacatacagcgatcctctcgcattacgtgaatttaaagaatttgcagcgggaagacgcagtgtctccggagatctcatcttggagatcggcaagctccctcaacacttaactcaacgcgcacaaaatgccttggataacttagtaatgcttcacaacagcgagcaagggggtagagcatataggcatgctatggaggaactacccgacacaattgaaaccctcatgttattagcactaatcgcagtattaaccgggggagttacgttattctttttgtctggacgtggattgggaaagacttccattggactcttgtgtgttatggctagcagtgttcttctgtggatggctagtgttgagccacactggatagctgcaagtataatattggagttcttcttgatggtattgttaataccagaaccagacagacaacgaacgccccaagacaaccaattagcgtatgtggttatcgggttattatttatgatattgacagtcgccgcgaatgaaatgggacttcttgaaactactaagaaagatctcgggattggacacgttgcagtagagaaccaccaccatgccgccatgctagatgtcgatcttcatccagcatccgcctggacactttacgcagtcgctactacaattataacacctatgatgcgacacacaatagaaaatacaacagcgaatatatcactcacagctatagcgaatcaagccgcaatactgatgggactagataaaggttggccaatatctaaaatggacatcggagtaccgttattagctttaggatgctattcccaagtcaacccactaacactgaccgccgcagtattaatgctagttgctcattatgcaattatcggccccgggttgcaagcaaaggcgacgcgtgaagcacagaaacgaacagcagccggaataatgaagaatccgacagtggatggtattgtcgctatagatttagatcctgttgtatatgacgccaaatttgagaaacagttaggtcagataatgctattgatactatgtacgagccagatcctgttaatgcgaacaacatgggcgctttgtgaaagtataacgctagccactggcccattaacaactttgtgggaaggcagccctgggaaattctggaacacaacgatagcagtaagtatggcgaatatatttcgaggatcgtatctcgctggtgctggtctcgcatttagcttaatgaagtctttaggaggaggacggcgcggaacaggagcccaaggtgagacactaggtgaaaagtggaaacgacagcttaatcaactaagcaagtccgaatttaacacttacaaacgctctggaataatggaagtagatcggtcagaggcaaaagaaggtttgaagagaggggagactactaaacacgccgtttctaggggaacagccaagctcaggtggttcgtcgaaagaaatctagtaaaacctgaaggaaaggttattgatctaggatgtggtaggggaggatggtcgtattattgtgcaggtttaaagaaagtcaccgaagtcaaaggttatacaaaaggtggaccaggacatgaagaacctataccaatggcgacctatggttggaatttagtcaaactgcactccggaaaagacgtattctttataccacccgaaaagtgcgatacactgctgtgcgatattggagaaagttctcctaatcctactatagaagaaggaagaacactaagagtactcaagatggttgaaccatggcttagaggtaaccaattttgcataaaaatacttaatccttacatgcctagcgtggttgaaacattagagcagatgcaaaggaagcatggtggtatgcttgttaggaaccccttatctcgaaatagcacacacgagatgtattgggtaagctgcggtaccgggaacatagtaagtgcggtaaatatgacatcacgaatgttactaaataggtttacaatggcacacaggaaaccgacttacgaaagagacgttgatcttggggcaggaactcgtcatgtcgctgttgaaccagaggttgcaaatttggacattatagggcagcgaatcgaaaacatcaaacatgagcataagtcaacatggcattacgacgaagataacccatacaaaacctgggcttaccatggatcgtatgaagttaaaccatcaggtagtgcgtcatctatggtaaatggggttgtaaaactgctcaccaaaccctgggatgtgattcccatggtaacgcaaattgcaatgacggacacaacgccctttgggcagcaacgagtatttaaagagaaggtcgatacccgaactcctaaggcaaaacgagggacagcacaaataatggaagtgacagcgaaatggttgtggggttttctgtcaaggaataagaaacccagaatatgcacaagagaggaatttacgcggaaagtgcggagcaatgccgcaatcggggccgtattcgtagacgaaaatcaatggaactcagcaaaagaagcggtcgaggacgaaagattttgggatcttgtacacagagaaagagaattacacaaacaaggcaaatgtgccacatgtgtgtacaacatgatgggtaaaagagagaagaaactgggtgaatttgggaaagccaagggttcacgagccatttggtatatgtggctaggcgcccgttttctagaatttgaagcgttaggattcatgaatgaagaccactggttcaacagagaaaattctctaagcggagtagaaggggagggacttcacaaattagggtatattttaagagatattagtaaaatacccggcggtaacatgtatgctgacgacaccgcgggttgggacactcgaattacagaagatgaccttcagaacgaagctagaatcactgatataatggagcctgaacacgcattacttgctcgatcgatctttaaactaacctatcaaaacaaagtagtaagagttcaaagacccgccaaaaatggaaccgtcatggatgttattagtcgcagggatcaacggggaagcggacaagtcgggacttatggtttaaacaccttcactaatatggaggctcaactaatccgacagatggagagcgaaggcatattttcaccatccgagttagaaacgccaaatctagcagagagagtgctagattggttggaaaaatatggcgttgaacgactaaaacgcatggcaatcagcggcgacgattgtgtggtaaaacctatagatgacaggtttgcaaccgcattgacggcactaaatgatatgggaaaggtaaggaaagatatcccacaatgggaaccaagcaaaggatggaatgattggcaacaagtcccattctgtagccatcattttcatcagctcataatgaaggatggtagagaaatagtagtaccatgccgaaatcaagatgagttggtaggcagagcaagagtaagtcaaggggctggttggtcactacgagagacagcatgccttggaaagtcatatgcacaaatgtggcaactaatgtattttcacaggcgggacctgcgactagcagcaaacgccatctgctcagcagtacctgtcgactggatcccaactagcaggacaacatggagcatacatgcccaccatcaatggatgacaactgaagatatgctctcggtatggaatcgtgtatggatagaggagaatccttggatggaggataaaacacacataagctcttggggagacgtaccgtatttaggtaaaagagaagaccaatggtgtgggagtttaattggtctcactgcgagagcaacatgggcaacaaatatacaagtagcgatcaatcaagtgagacgacttatcggcaatgaaaattacttagactatatgacaagcatgaaacggtttaaaaacgaatcagaccctgaaggtgcgttatggtaa

SEQ ID NO: 21485 - RNA, 9879 nt, synthetic construct
  misc_feature 1..9879: note = derived and/or modified CDS sequence (opt6) from DENV-1__FJ024428__SS-prME
  source 1..9879: mol_type = other RNA
agtgtaactatgctcctcatgttaatgccaactgctctggcgtttcatttaactacaaggggtggtgaaccacacatgattgtaagtaaacaagaaaggggtaaaagtctattgtttaaaacttccgccggggtaaatatgtgtactctaatagctatggatctgggcgaattatgcgaagatacaatgacctataaatgccctagaatcacggaaacagagccagacgatgtggactgttggtgcaacgcaacagatacatgggttacttatggtacttgttcacagacaggtgaacacagaagggataaaaggagtgttgctctggcaccgcatgtaggtttgggactcgaaacgcgcactgagacttggatgtcatccgagggtgcctggaaacagatccaaagagtagaaacatgggcattaagacatcctggttttacagttactgcactcttcttagcgcacgcgatcggaacatcaatcacacagaaaggaattatatttattctattaatgctcgtaactcccagtatggccatgagatgcgtcggaataggaagtagagacttcgtcgagggactttcgggggcaacctgggtagacgtagtgttagagcatggatcatgtgtgacaactatggcaaaagataaaccgaccctagatatagagttacttaaaactgaagtaacgaatccggctgtgttaagaaaactatgtatagaagcaaaaataagcaacaccactacagatagcagatgcccgactcaaggtgaagctacgttagtagaagaacaagacgcaaattttgtatgcagacgtacttttgtagatcgaggctggggaaatgggtgtggattgttcggtaaaggatctctgataacctgtgctaaattcaaatgtgtgacaaaactagaaggaaaaattgtccaatacgaaaatctgaaatattctgtgatagtgactgtccacacaggcgaccaacatcaagtaggcaacgaatcaacggagcatggaaccacagcaacaataacgccacaggccccgacaacagaaatccaactaacagactacggagcattgaccctcgactgttctccgcgaacaggcctagacttcaatgagatggtcctattgacaatgaaagagaaaagttggttagtacataaacaatggtttttagacctgcctcttccatggacctctggtgcatccacatcccaagaaacatggaaccgccaagacctattagtaacttttaaaacagcccacgcgaagaaacaggaagtcgtagttctaggaagtcaagaaggagcaatgcatacagcattaacgggagccacagaaatacagacaagcggaaccacgacaatatttgcaggacatctaaaatgcagattaaaaatggacaaattaactctaaaaggcatgtcttatgtcatgtgtaccggctcatttaaactagagaaggagctagcagagacgcagcacggaactgttttagtacagataaaatacgaaggaacagatgcaccgtgcaaaatcccattttcaacgcaggatgaaaaaggtgtcacacaaaacggtaggttaataacagctaatcccattgtaactgataaggaaaaacctgttaatatagaagcggaaccgccatttggtgaaagttatatagtcatcggagctggcgagaaggcgctaaaactgagctggtttaagaaaggcagttcaataggcaagatgttcgaagcgacagccagaggagcaagacgtatggccatcttaggagacaccgcctgggacttcggatcaataggtggagtatttacctccgtaggaaaattagtacatcaaattttcggcaccgcatatggagtattgttctcaggagtttcgtggaccatgaaaatagggattggtgtcttactgacttggcttggtttgaactcacgttctactagcctgtcaatgacctgcatagcagtaggattggttaccttatatcttggagtgatggtgcaagctgatagcgggtgcgtaattaactggaagggtcgagaattaaaatgcggaagcggcatatttgtaacaaatgaagttcatacatggacagaacagtataaattccaagcagatagtcccaaaaggctaagtgctgctatcgggaaagcgtgggaagaaggggtttgcggtataagatcagcaacgcgtctagaaaatataatgtggaaacaaatatcaaatgaactaaaccacattttgttggagaatgacatgaaatttacggtagtagttggagacgtagcggggatattagcacagggtaagaaaatgatcagacctcagcctatggaacacaagtactcctggaaatcgtggggaaaagcaaaaattataggagcagatgtgcaaaacaccaccttcatcatagatggccccaacacgccagagtgccctgatgaccagagagcatggaacatttgggaagtagaagactatggttttggtatttttactaccaatatatggctcaagctaagagattcctatacacaggtttgcgatcaccgtctgatgtcagcggctattaaagatagtaaagccgtccatgcagatatgggatattggatcgaatcggagaaaaatgaaacgtggaagctggcacgagcaagttttatagaagtaaaaacatgcatttggccaaaaagtcatacgttatggagcaatggtgtcttggaaagtgaaatgataatacctaagatctacggaggacccatttctcaacataactaccgcccaggatactttacccagacggcgggcccttggcacctaggaaaacttgaacttgacttcgacttatgcgaaggaacgacagtagtagttgatgaacactgcggaaaccgaggtcccagcttacgaacaacaacagtaacaggaaaaatcatacatgagtggtgttgtcgtagctgcaccctaccaccattaaggttcaggggtgaagacggttgttggtatggtatggagataagacctgtcaaagaaaaagaagaaaatttagtaaagagcatggttagcgccggtagcggggaagttgattcattttctttaggcctgctctgtataagtataatgatcgaggaagtgatgaggtcaagatggtcgcgtaaaatgctaatgacgggaacgctagctgtcttcttcttactcatcgtgggacaacttacatggaatgatctcatacgtctatgcataatggtaggcgccaatgcttcagatcgaatgggaatgggaacgacgtatttagcactcatggcaacgttcaaaatgcgacccatgtttgcggtcggattattgtttagaagattaacaagtagagaagtactattactaacaattggattgtcattagtagcatcggtagaattaccgaacagtttagaagagttaggggacggtttagcgatgggcatcatgattttaaaattacttactgattttcagtctcaccagttatgggcaacattactcagtctgactttcattaaaaccacttttagccttcattacgcttggaaaacaatggccatggtactcagtgtagtcagcctatttcccttgtgtctcagcacaacatcccaaaagacaacttggttaccagtcttactaggttcactgggatgcaaaccattaacgatgttcctcatcgccgaaaataaaatttgggggaggagatcctggcccctcaatgaagggattatggcagtaggcatagtatctattttactatcaagtctactgaaaaacgatgtcccactagcaggacctctcatcgcaggcggcatgttaatcgcatgttacgtaattagtggatccagtgcggacttaagtttagagaaggccgccgaagtcagctgggaggaggaagctgagcattcaggtgctagtcacaacatcctagtagaagtacaagatgatggtactatgaagataaaagatgaagaaagagatgataccctaacaatactacttaaagccactcttctagcagtgtctggagtctacccccttagcataccggcgacattatttgtctggtacttttggcagaagaagaaacaaaggtcaggagttttatgggatacaccttcacccccagaagtagaacgagcggtccttgatgacggcatctatcgtataatgcaaagagggctattggggagatcgcaagtgggcgttggtgttttccaagagaatgtatttcatacaatgtggcacgttactcgaggagcagtattaatgtaccaagggaagagacttgagccaagctgggcttcagttaagaaagatctgatttcatacggaggcggatggcgattgcagggaagttggaacactggtgaagaggttcaggtgatagccgtcgaaccaggtaagaatccgaaaaacgttcagaccgcccctggaaccttcaagactcctgaaggcgaggtgggagcaatagcattagatttcaaacctggtacgagtgggtccccaatagtcaatcgagagggcaaaatagtcggattatatggaaatggcgtagtcacgacaagtggcacttatgtaagcgctatagcacaagcaaaggcttcacaggagggtccattacctgagatagaagacgaagtatttcgaaaaagaaatctaaccataatggaccttcatccagggtccggcaaaactagaaggtacttacctgcgattgttcgagaagcaatcaagcgtaaattgagaacactgattttagcaccaactagggttgtagccagtgaaatggcggaagcactcaaaggtatgcctatacgataccaaactacagcggtaaagtcagagcatactggtaaggaaatcgtggatctcatgtgtcatgcaacattcacaatgagactattgtccccagtacgagtaccaaattataatatgataattatggatgaagcccattttacagatccctcaagtatagctgctcgaggatacataagtacaagagtcggcatgggcgaagcagcagctatatttatgacggccacaccaccaggatcagttgaagcctttcctcagtctaatgctgtcatccaggacgaagagagggacatccctgaaagatcatggaactcgggatatgagtggataacagatttccctggaaagacagtatggttcgtgcccagcataaaaagcggaaatgatatagcaaactgtcttagaaagaacggtaaaagagttatccaattatctcggaaaaccttcgacacagaatatcagaaaactaaaaacaacgattgggattatgtagtaactacagatatttcagaaatgggggcgaactttagagcagatcgagtaatagatccaagacgctgtcttaaacctgtaatcctaaaggatggccccgaacgtgttattctagcaggacccatgccagtgacagtagcctctgctgcgcaacgaagagggcgcataggcagaaatcataacaaggaaggggaccagtatatttacatgggacagccactcaataacgacgaagatcacgctcattggaccgaagctaaaatgctactagacaacataaacaccccagaaggaattataccggcacttttcgagcctgaacgagaaaagtcggctgcaatagacggtgaatatagacttagaggagaagctagaaagacttttgttgagctaatgagaagaggtgatctacctgtatggttaagttacaaggtggcatcagaagggttccagtacagcgatagaagatggtgctttgatggagagagaaataatcaggtactagaagaaaatatggatgtagagatatggacgaaagaaggcgaacggaagaagctaagaccccgttggttagatgcaaggacgtactcagacccgttagcgttaagggaatttaaagaatttgctgctggtagaagaagtgtaagtggggacctaattcttgagattgggaaactgccacaacatttaacacaaagagcacaaaatgcattagataatctggtaatgttgcataatagtgaacagggcggtagggcatatagacacgccatggaagaattacctgacacaatcgaaactcttatgttattagcgctgatcgcagtacttactggaggggttactcttttcttcttaagtggtagaggattaggtaaaacatcaattggactcttatgtgtaatggcctcgagtgtactgttgtggatggccagtgtagagcctcactggatagctgcatcaatcatcttggagttctttctgatggtcctcctaataccagaaccagatagacaaagaactccacaggataaccaactagcttatgtggtaataggccttctattcatgatattaacagttgcagcaaacgaaatggggctattagaaacgacaaagaaagatctaggaatagggcatgttgcagtggaaaatcaccatcatgcagcaatgctagatgtggatttgcatccagctagtgcttggaccttatatgctgtagcaacaacaataattacgcctatgatgcgacatacaatagaaaatactacagccaatatatcactcacggcaatagctaatcaagctgcaattcttatggggctagacaaaggatggccgataagtaagatggatatcggcgtgcctctcttagctttggggtgctatagtcaagtcaatccactcactcttacagcagccgtcttaatgttagtagcacattacgcaataattgggccgggattacaagcgaaagctacaagagaggcacaaaagagaacagctgcgggaattatgaaaaatccaacggttgatggcattgtagcgattgacctagacccagttgtttatgacgctaagttcgaaaaacaattaggacaaataatgttactcatactgtgcacttcacaaatactgttgatgagaaccacttgggcactttgcgaatccataacactagcgactgggcccttgacaacattatgggaaggttctccaggtaaattttggaatacaactattgcggtatccatggctaatatctttagggggtcgtatctagcaggagctggacttgcgttctccctaatgaagtcactaggtggcggcagacgcggaaccggcgcgcaaggtgagacactaggtgaaaagtggaaaagacaactgaatcagctaagtaaatctgaatttaacacatacaagcgaagtggaataatggaagtagacagatctgaagcaaaagaagggctaaaaagaggtgaaacaactaaacatgcagtgagcaggggaacagcgaaattgagatggttcgtcgaaaggaacctagttaagcctgaaggtaaagtaattgacttaggatgtggacgaggaggatggtcatattattgcgctggccttaagaaagtgacagaagtaaaaggctatacaaagggtggaccaggacatgaagaaccgatacctatggcaacatacggttggaacctagtaaaattgcactctggaaaagatgtattctttataccgcccgaaaaatgtgacactttactatgtgatattggtgaatccagtccgaatccaacaattgaagagggccgtacacttagagtccttaagatggtcgaaccgtggttgcgaggcaatcaattctgcataaaaatacttaatccatatatgccttctgtcgtggaaactttagagcaaatgcaaagaaaacatggaggtatgttagtaaggaaccctctttccagaaattccacccacgaaatgtactgggtgtcatgcggaacaggaaacatcgtttcagctgttaacatgaccagtcgtatgcttttaaacagattcactatggcacaccgaaaaccgacctatgaaagggacgtagatttgggtgccggaactcgtcacgtggcagttgaaccagaggtggcgaatcttgatataataggacagagaattgagaatatcaagcacgaacacaaaagcacatggcactatgatgaagacaatccatataaaacgtgggcctatcatggatcatacgaagtaaaaccttcaggcagcgcttccagcatggtcaacggggtagtaaagctattaaccaaaccatgggatgtaataccgatggtaactcaaattgctatgacagatacaaccccgttcgggcaacaaagagtatttaaagaaaaagttgatactcgcacccccaaagccaaacgaggtaccgctcaaataatggaagtcacagcgaagtggttatgggggttcctaagtcgaaataaaaagccgagaatatgtacaagggaagagtttacacggaaagtcagatcaaatgccgccatcggagcagtattcgtagacgagaatcaatggaatagcgcaaaggaagccgtagaggacgaaagattctgggatctcgtacatagagaaagagagttacacaaacagggaaagtgcgcaacatgtgtatacaatatgatgggcaaacgcgaaaagaaacttggagagttcggcaaggcaaaaggatcccgtgctatatggtatatgtggttgggagcacgcttcctcgaatttgaagctcttggtttcatgaatgaagatcattggttctccagagaaaattcactttccggagtagaaggagaaggactacataaacttggatacatcctaagggatatcagtaagatacccggaggaaatatgtacgcggacgatacagccggatgggacacacgaataacagaggatgaccttcaaaacgaagctaggattactgatattatggagccagaacatgcattactggctaaatcaattttcaaactgacctatcaaaataaagttgtaagagtgcagcgcccagcaaagaatggaactgtaatggatgtcatctcacgaagagatcaaagaggttcagggcaagtaggcacgtacggtctaaacacctttaccaacatggaggcccaattgatccgacaaatggaatccgaaggcattttctcgcccagtgagttggaaacgccaaatctagcggaacgagtacttgattggctcgagaaatatggtgtcgaaagattaaaaaggatggcaattagtggcgatgattgtgtcgtgaaaccaattgatgataggtttgcgacagctttaacagcgttgaacgacatgggaaaagtcagaaaggatatcccgcaatgggaaccttctaaaggatggaatgattggcagcaagtgccattttgctcgcaccactttcatcaattaattatgaaggacggtagagagatcgtagttccgtgtcgaaatcaagatgaacttgtgggtcgggcaagagtatcacaaggcgcaggctggagccttcgagaaacagcatgtctgggcaaatcatacgcccagatgtggcaactaatgtactttcaccgcagagatctacgattagcagcaaatgcgatatgcagtgccgtgcctgtagactggataccaacttcaaggactacatggagtatacatgctcaccaccagtggatgactactgaagatatgttatctgtttggaacagagtatggatcgaagagaatccttggatggaagataaaacgcatataagttcatggggagatgtaccatatttaggaaaaagggaagatcaatggtgtggtagtttaatcggactcaccgctagagcaacgtgggcaaccaatatccaagtcgctattaatcaagtgagacgtttaattggaaatgaaaactatttagactacatgacatcaatgaaaaggttcaagaatgagtcagatccggaaggagcactatggtag

SEQ ID NO: 21486 - RNA, 9879 nt, synthetic construct
  misc_feature 1..9879: note = derived and/or modified CDS sequence (opt6) from DENV-1__FJ024429__SS-prME
  source 1..9879: mol_type = other RNA
tcagtcaccatgttgcttatgttaatgccaaccgcgctagcctttcatctaaccacacgcgggggagaaccacatatgattgtctccaaacaggaaagaggtaaatcgctattatttaaaacaagtgccggtgttaatatgtgcactcttatcgcaatggatctaggtgagctttgtgaagacaccatgacgtacaaatgcccacgtattactgaaaccgaacctgatgacgtggattgctggtgtaacgcgacagatacgtgggtaacatatggaacatgcagccaaacgggagagcatagaagagataaacggtcagtcgcacttgcgccacatgtcggcctgggtttagaaacacgaaccgaaacttggatgtcgtcagagggcgcatggaaacaaatacaaagggtagagacatgggcattaagacaccccggctttacagtcatcgccttattcttagcacatgcaataggtacatcaataacccaaaaaggtataatcttcattctattaatgttagtaactccttcaatggcaatgagatgtgtgggtatcggcagtagggattttgtagaaggtctatcaggagccacgtgggttgatgtagtgctagagcatgggagttgtgttacaacaatggcaaaagataaaccaaccctagacatagaattgctaaagacagaagtgacgaatcctgcagtgttacgtaaactatgtatagaagcaaaaataagtaatacgactacagacagccgatgtccaacccaaggagaagcaaccctcgtcgaagaacaggatgctaactttgtttgtagaaggacatttgtggaccggggatggggaaatggatgcggactattcggaaaaggaagtctaattacttgtgcaaaattcaagtgtgtcaccaagctggaaggcaaaatagttcaatatgagaacctcaaatattctgtcatagttactgtacacaccggtgaccaacaccaggtaggaaatgaatctacagaacatggaactacggcaacgattactcctcaagccccgacaacagaaatacaattgacagattacggtgcacttacactagactgttctcccagaacaggcttggattttaatgagatggtcttgttaaccatgaaagaaaaatcctggttagttcataagcaatggttcttagacttgcctttaccgtggacatcaggggcttcaacttctcaagaaacatggaatcgtcaagatctcctagtaacattcaaaacagcccacgcgaagaaacaagaggtggtggtattaggaagtcaagagggggcaatgcatacggcgctaacgggggctactgaaatacaaacatccggtacaactaccatctttgcaggccaccttaaatgtaggttgaagatggataaacttactctaaaaggaatgagctatgttatgtgcacaggctcattcaaactcgagaaagagttagctgaaactcaacatgggacagtattggttcagatcaaatacgagggaactgatgccccttgtaagatcccttttagtacccaagacgagaaaggtgtaactcaaaatggtagactaattactgcaaaccctatagttacagacaaggaaaaaccagtaaatattgaagcagaaccaccatttggcgaatcctatatagtaatcggcgctggagaaaaagcattaaaactaagttggttcaaaaagggatccagtataggaaaaatgtttgaagcaactgcacgaggtgcgcgaaggatggcaattttaggagacacagcttgggattttggatctataggaggtgtattcacttcagttggaaaattagtccaccaaatatttggtacggcctatggagtattattttcaggggtctcttggactatgaagattggtataggggtgctcatgacctggctcgggttaaacagccgatcaacgtcactttctatgacgtgcatagcagtcggccttgtaactttatatttaggcgtcatggttcaagcggactccgggtgtgtcataaactggaaaggcagggaattgaagtgtggaagtggaatttttgtaactaatgaagtgcacacctggactgaacaatataagttccaagcagattcccccaaaagattatccgcagcaataggcaaagcctgggaggagggtgtatgtggaatacgaagcgcaactagactagagaacataatgtggaaacaaataagcaacgaactcaatcatatactcctagagaatgatatgaaatttacagttgtcgtgggagacgtagccggaatcttagcgcaaggcaagaaaatgataagaccacagcctatggaacataaatatagttggaaaagttggggaaaagcgaaaatcattggtgctgatgtccagaacaccacatttatcattgacggacctaatacacccgaatgcccagatgatcaacgggcctggaatatatgggaagtagaagattatggatttgggatattcacaacgaatatctggttgaagttgcgtgattcatatacacaagtatgcgatcatcgactaatgagtgctgcaatcaaagattcaaaagcagtgcatgctgatatggggtattggatcgagagcgagaaaaacgaaacatggaagttggcgcgagcttcctttatagaagttaaaacatgcatatggccaaaatcacacactttatggagtaatggggtattagagagcgaaatgataataccaaagatatatggaggtccgatatcgcaacacaactacagacccgggtattttacccaaatagcaggtccttggcatctcggaaagctcgaactagactttgatttatgtgaaggaacaacagtcgtcgtggatgaacattgtggaaatcgaggaccatccttacggacgacgacagtgactgggaaaataatacatgaatggtgttgtagaagttgtacgcttcctccattaagattccgtggagaagatggatgttggtatggaatggaaattagaccagtgaaggagaaggaggaaaatttggtgaaaagcatggttagcgccggctcaggtgaagtagattccttttcactaggtttgctctgtatttctatcatgatagaggaagtaatgaggtcgagatggagtagaaaaatgttaatgacaggtacgcttgctgtatttttcctattaatcgtagggcagctaacatggaacgatctcattagactttgcattatggttggtgcaaacgcaagtgatcggatgggtatgggaaccacatatcttgcactaatggctacgttcaagatgagacctatgtttgcagttggtctactatttcgtcgattaacatctcgcgaagtactactattaacaataggactaagtcttgttgccagtgtagaacttccaaacagtcttgaggaactgggtgatgggctggctatgggaatcatgattttaaaactacttactgattttcaatctcatcaattatgggcgaccttacttagtttgacctttattaagacaactttttcattacattacgcttggaaaacaatggcaatggttttatctgttgtaagtttatttccactatgtttaagcaccacgtcacagaaaaccacctggcttccagtcctgttaggatctcttgggtgtaagccgcttactatgttcttaatagctgaaaataaaatatggggcagacgtagttggccattgaacgaaggtattatggccgtcggaatagtcagcatcttattaagcagtttgcttaaaaatgatgtaccactcgcaggccctttgatcgctggtggtatgctaatcgcgtgttatgtaataagcggatcatctgctgacttaagtcttgagaaagcggcagaagttagctgggaggaagaagctgaacattcaggtgctagtcacaacattctagtagaggtacaagatgacggaacaatgaaaataaaagacgaagaacgagacgatactctaaccatcttactaaaagcgacgctactcgcagtatccggtgtctaccctttaagtatacctgcaactctttttgtttggtatttctggcaaaagaagaaacaaagatcaggagtattatgggacactccaagtccgcctgaggttgaaagagcagtacttgacgatggtatttaccgaataatgcaaaggggtttgctgggaagatcgcaggtaggtgtgggtgtgttccaggaaaatgtttttcatactatgtggcatgtaactcgaggagcggtactgatgtaccagggaaaacgactagaaccctcatgggcaagtgtcaagaaagacctaattagttacggaggtgggtggcggttgcaaggcagctggaatacaggagaagaagtccaagttattgcagttgagcctggcaaaaatccaaagaatgtgcaaacagctcccggtacatttaaaacgccagagggtgaagttggtgcaatagctttagacttcaaaccggggacatctgggtctcccattgtcaacagagagaggaaaatagtaggtttatatgggaacggcgttgtaacaaccagcggtacctacgtgtctgcaattgcacaggcaaaagcatcgcaagaaggcccgttgcccgaaatagaggacgaagtattcagaaaaagaaatctgacgatcatggacttacatccaggatcaggtaaaactcgtaggtatttacccgccattgtgcgtgaggcgattaaacgtaagttaagaactctaatactagccccaactcgggtagttgcgagtgagatggctgaagcactgaaaggaatgcctattcgttaccagaccactgctgtgaagtccgagcacactggcaaggagattgtagacctcatgtgccacgcaacgttcacaatgcgtctactaagtcccgtacgagtgccgaactacaacatgataattatggacgaggcccattttactgatcctagttcaattgcagcgcgcggttacatatcaactagagtgggaatgggagaagcagctgcgatatttatgacagctacacctcctggctcagttgaagccttcccccaatctaacgctgtaatacaagatgaagaacgggacatcccagaacgaagctggaacagtggatatgagtggattactgactttcccgggaaaactgtttggtttgttccatctataaaatccggtaacgatattgctaactgtttgaggaaaaacggcaaacgagtcatacaactatcaagaaagacctttgacactgaatatcaaaagacaaagaataatgattgggattatgttgtaaccaccgatatatctgaaatgggagccaatttccgtgccgatagagtcatagatccgagaaggtgcttgaaaccagtgattttgaaagatgggccagaaagggttattctagcaggcccgatgccggttaccgtcgctagtgcagcacagaggagaggcaggatagggcgtaaccataataaagagggggaccaatatatttatatgggccagcctctgaacaatgacgaggatcatgctcactggacagaagcaaaaatgctactagataatatcaatacaccggagggaatcataccagcattattcgaaccagaaagagaaaagtctgcggcaatagacggagaatacagactaagaggagaggctagaaaaacattcgtagaattaatgcgtagaggtgatctaccagtatggcttagttataaagtagcgagtgaagggttccaatacagtgataggaggtggtgctttgatggcgaacgtaacaaccaggtattagaagaaaacatggatgtagagatttggaccaaggagggagaacgtaagaaacttagaccaagatggttagatgcaaggacatatagcgatcctcttgccttgagagagttcaaagaatttgctgccggccgacgcagtgtttcaggtgacttaattctggaaattggaaaattaccacaacacttgacacaaagagcacaaaacgcattagataacttagtgatgttgcataactcagaacaaggcggcagagcatatagacatgcaatggaagaactgccagataccatagaaacgctgatgcttctggcactaatagcagtactaaccggcggggtaactttattctttctttctggaagaggcctcgggaaaacttcaataggacttttatgcgtcatggcaagtagtgtattattgtggatggcttcagttgaaccacactggatagcagcttcaataatattagagttctttcttatggtattgctcataccagaacctgaccgtcaacgaacacctcaagacaatcagttagcctacgtcgtgataggactcctatttatgatactaactgttgcagcaaatgaaatggggctactagaaacaactaagaaagacctaggcatcggccatgtagcagtagaaaaccatcaccacgctgccatgttagatgttgatttacatccagcatctgcatggacattgtatgctgtagcgactaccatcataacacccatgatgagacacactatcgaaaatacaaccgctaatatctcactaacggccatagccaaccaagcagctatcttaatgggattagataaaggatggcctatttctaaaatggatataggtgtaccgcttttagctctcggctgttactcccaagtaaacccactgactttaacggcggcagtactaatgttagtagcacactacgccatcatagggcctggcctacaagccaaggcaactcgcgaggctcagaaaaggacagctgcgggcattatgaaaaatccaaccgtagatggaattgtagctatagacctggaccctgtcgtctatgatgcgaaatttgaaaagcaattgggacaaataatgctgctaatattatgtacatcacaaatacttcttatgcgaacaacctgggcattatgtgagtcaattacactagctacgggacctctaacaactctctgggaagggtcaccgggaaaattctggaataccacaatcgcagtctctatggcgaatattttcagaggatcttatttagccggtgcaggactcgcttttagccttatgaaatcattaggaggcggccgaagaggtacaggagctcagggagaaactctcggagaaaaatggaaaagacaacttaatcaattaagtaagagcgagtttaatacttataagagatcaggaataatggaagtggatcgcagtgaagcaaaagaagggctaaagcggggcgaaacgacaaaacatgcggtcagccgtggaactgcaaaattgagatggtttgtagaacggaacttagttaaaccagaaggaaaagtgatcgacctaggatgtggaagaggtggatggtcttactattgcgcaggtctgaagaaggtgacagaagtgaaaggatatactaaaggaggtccagggcacgaagaacctataccgatggccacttatggatggaatcttgtaaagttgcatagcggaaaggacgtatttttcatacctccagaaaaatgcgataccctcttatgcgatataggagaaagttctccaaatccaacaatagaggaaggacgcacgctaagggtgctcaaaatggtagaaccctggctaagagggaaccaattctgtattaaaattctgaatccatacatgccttctgttgtagagacacttgaacaaatgcaaagaaagcatggcggaatgctagttagaaatcctctgtccagaaatagcacccacgaaatgtactgggtatcgtgcggtacaggaaatatcgtatctgcagtaaatatgacgtcccgtatgttacttaatagatttactatggcacatagaaaacccacatatgagagagacgtagatttgggagcaggcacgcgccacgtggcagtagaaccagaagttgcaaatctggatataatcggccagaggatagagaacattaaacatgaacataaaagcacgtggcattacgatgaagataatccatataagacttgggcgtaccatgggtcatacgaggtcaagccaagcggaagcgccagcagtatggtaaacggggttgtaaaattgttgaccaaaccatgggatgtgatcccaatggtaacacaaattgctatgactgacaccactcccttcggccaacagagagtttttaaggagaaggtcgatacacgtacccccaaggcaaaaaggggtacagcacaaattatggaggtaacagctaaatggctctggggatttttatcaagaaataagaaaccgcgtatatgtacaagagaggagtttacgagaaaagttcggagtaatgctgctattggtgctgtgttcgtagacgagaatcaatggaactctgctaaagaggcggttgaagacgaaaggttttgggacttagtccaccgagagagagagttacataaacaaggtaaatgtgcgacatgcgtctacaacatgatgggtaaaagggaaaagaagctcggtgagtttggtaaagctaaaggcagcagagccatatggtatatgtggttaggagctcgctttctagagttcgaggcgctaggtttcatgaatgaggatcattggttcagccgtgaaaattcattaagtggtgttgaaggcgaaggcctgcacaaactaggttatattctacgtgatatttctaaaattcctggtggaaacatgtatgcagacgatacagcaggatgggatacaaggataaccgaagacgacctccaaaacgaagcaaggattacagatattatggagcctgagcatgcactgcttgcaaaaagtattttcaaacttacataccagaacaaagtagtcagagtacaaaggcctgcgaaaaatggtacggtcatggatgtgatttcaagaagggaccaaagaggaagtggacaggttggaacgtatggacttaatacatttactaacatggaagcccagctcatcagacagatggaaagtgaaggtatattttcaccatctgagcttgaaacacctaatttggcagaacgcgtcctcgactggctcgaaaagtatggcgtagagcgtctgaaacggatggctatctctggagacgactgcgtagtaaaaccaatagatgatagatttgcaactgcacttacagctcttaatgatatgggaaaagtacgtaaagatataccccaatgggaaccgtcgaaaggatggaatgattggcaacaagtcccattctgttcacaccatttccatcaattaattatgaaagatgggagagaaatagtagttccttgccggaatcaagatgaattggtaggcagagctagggtttcgcaaggggctggctggtctctaagagaaacggcttgcctaggcaagagctacgctcagatgtggcaactaatgtattttcatagacgagaccttagattagctgccaatgctatatgtagcgcagtacccgttgattggataccgacatcccgtacaacctggtctatacatgcgcatcatcaatggatgacaacggaagatatgctaagcgtctggaacagagtatggatagaggagaacccatggatggaagacaaaacacacatcagctcatggggagatgttccatatcttgggaaaagagaagaccaatggtgtggtagtttaattggcctaactgccagagccacgtgggcgactaatattcaggttgcgattaaccaagtgcgacgactaataggcaatgagaattaccttgattacatgacttctatgaaaagatttaagaacgaatctgatccagaaggtgcattatggtga

SEQ ID NO: 21487 - RNA, 9879 nt, synthetic construct
  misc_feature 1..9879: note = derived and/or modified CDS sequence (opt6) from DENV-1__FJ024430__SS-prME
  source 1..9879: mol_type = other RNA
tctgttactatgcttctgatgctaatgccgaccgcccttgcatttcacttgaccactagaggtggggaaccacatatgattgtatctaaacaagaaagaggtaaaagtttattattcaaaacatcagctggtgttaacatgtgtacactaattgcgatggatttgggtgaattgtgcgaagacactatgacatataaatgccctaggatcaccgaaacagaaccagacgatgtcgattgttggtgtaatgccaccgacacgtgggtaacttacggaacatgctcacaaaccggcgaacatagacgagacaaacgttcagttgcactggcaccgcacgtaggtctagggcttgaaactagaacagaaacatggatgtcatccgaaggggcttggaaacaaattcagagggtcgaaacttgggccctaaggcacccaggattcactgtaattgctctttttctggcgcatgctataggtacatcgattacgcaaaaaggcattatatttatactattgatgttagtaacgccaagcatggccatgagatgtgttggaataggtagcagagattttgtcgaaggactgtccggggctacgtgggtagacgtggtactagaacacggttcttgcgtcacaactatggcgaaagacaaaccaactctagatattgagttattgaaaaccgaggtgactaatccagctgtgctcaggaaactgtgtatcgaggcaaaaatcagtaacacaacaaccgactcaagatgcccgactcagggtgaggcgactttagttgaagaacaagacgcgaacttcgtatgtaggagaacatttgtagataggggttggggtaatggttgcggactttttggtaaaggctccttaataacttgcgcaaaatttaaatgtgtaacaaaactggagggcaaaatagtccaatacgaaaacctcaaatattccgtgatagtaacagttcatacaggcgaccagcatcaggtaggaaatgagtccacagaacatgggaccactgcaacgattactccccaagctccaactacagagattcaactcacagattacggagcacttacactcgactgtagtccaaggacagggctggattttaatgaaatggtactcctgaccatgaaagaaaaatcatggcttgtccacaaacaatggttcttagatttaccattgccatggacgagcggtgcatctacaagtcaggagacatggaatagacaggacctcttggtaacgttcaaaacagctcacgctaagaaacaggaagtagtcgttctaggttcacaggaaggtgcaatgcatacagctctaacgggtgcaacagagattcaaactagcgggaccacaaccatattcgcgggacatttaaaatgtagactaaaaatggacaaactgactttaaaaggcatgtcttatgttatgtgcaccggctcttttaaactcgagaaagaagtagctgaaactcaacacggtaccgtactggtacagataaaatatgaaggaacggatgccccttgcaaaatacccttcagtactcaggatgaaaaaggagtgacccaaaacggacgactaataactgctaacccaatagtgacagataaagaaaaaccagttaacattgaagcagaaccaccatttggagagagctatatcgtgattggtgcaggagagaaagcattaaaactaagctggtttaagaaaggaagttccatcggtaagatgtttgaagctacagcaagaggtgcgcgaagaatggccattcttggtgataccgcctgggattttgggtctattggaggcgtttttaccagcgtgggaaagctagtacatcaaatttttggtacggcatatggagtcttattttcgggagtaagctggactatgaagataggcatcggtgttcttctcacatggcttggtctaaattcccgcagtacatcgttaagtatgacatgtatagcggtaggattggttacgttgtatcttggcgtaatggtgcaggcagacagcggctgtgttataaattggaagggaagagaactaaagtgcggatctgggatattcgtgactaacgaggtacatacatggacggagcagtacaaatttcaagcagattcgcccaagcgactgtctgctgcaataggaaaagcgtgggaggaaggagtgtgcggaattaggtcggctacaaggttggagaatataatgtggaaacagattagcaacgaactaaatcatatattgcttgaaaatgacatgaaatttacggtggttgtaggggatgtcgcggggatccttgctcaaggcaagaaaatgatcagaccacaaccaatggaatataagtacagttggaaaagttggggtaaagccaaaatcattggcgctgatgtccaaaacaccacatttataatagacggaccaaatacaccagaatgcccggacgaccagcgtgcctggaacatatgggaagttgaagattatgggttcggaatattcactacaaacatatggctaaagttaagggactcgtacacgcaagtatgtgatcataggctaatgtcagctgcgattaaggatagtaaagcggtacacgcggacatgggctattggatcgaatccgaaaagaacgaaacctggaagttagccagagcgagctttatagaagttaaaacttgtatctggccaaagagccataccctttggagtaatggtgtgctggaatcagaaatgataatacccaaaatttatggaggtcctataagccaacacaactatagaccaggatattttacacagacagcgggaccctggcatctcggtaaactcgaattggactttgatttatgtgagggcacaacagttgtagtagatgaacattgcggcaaccgaggaccatcgttaagaacaacaactgtgacgggtaaaatcattcacgagtggtgttgcagatcttgcacattaccacctttaaggttcagaggagaagatggatgttggtatggaatggaaatccggcccgtaaaagaaaaggaagaaaacctagttaaatcaatggtatccgcgggatccggagaagttgactcgttttcactcggcttactatgcatcagcattatgattgaggaagtgatgcggtcaagatggtcaagaaaaatgttgatgacaggaactctcgcagtattctttctactcattatgggacaactcacgtggaatgatttaataagactctgtataatggttggtgctaatgcgtcggatagaatgggaatgggcacaacttacctagcattgatggccacttttaaaatgcggcccatgtttgcagtagggctactgttccgacgtcttacgtcaagagaggtcctactccttacaattggtttatcattagtagcaagcgttgaattacccaatagcttggaggaactcggagacgggttagcaatgggcattatgatattaaaacttttaacagatttccaaagccatcaactttgggctacattactatctcttacttttattaaaaccacttttagcctacactacgcatggaaaacaatggccatggttttgtctattgtaagtctttttccattatgcctttcgaccacctcacagaaaacgacttggctacctgtattactagggtcactaggatgtaaaccattaacaatgttattaattgcagaaaataaaatatggggaagaaggagttggccactcaacgaagggattatggcagttgggatagtcagcattctattatcatcacttctcaaaaatgacgtaccattagcaggcccgctaatcgccggcggtatgctaattgcatgttacgttatcagtggctctagtgctgcgctgtctttagaaaaggctgcagaagtatcatgggaagaagaagcagaacattcaggagctagtcataacatcttagttgaagtacaagacgacggtaccatgaagataaaagatgaagaacgcgatgataccctaacgattctcctaaaggcaaccctcctcgcagtgagtggtgtctatcctttatctatcccagcaacgctatttgtatggtatttctggcaaaagaagaaacagagaagcggggtgttatgggacacccctagtccaccagaagttggacgagcagtactagatgatggcatttataggataatgcaaaggggcctgctaggcagatcacaagttggcgtgggtgtatttcaagagaatgtctttcacacgatgtggcatgtaacgcgaggtgcggttcttatgtaccagggtaaacgtttagagccatcatgggcttccgttaagaaagaccttatctcctacggtggagggtggcgattgcaaggatcatggaatacgggcgaagaagttcaagtaattgcagtcgaaccaggtaaaaatccgaagaatgttcaaacagccccgggcacattcaaaacacctgaaggcgaggttggagctatcgcattagattttaaaccgggaactagcgggtcccctattgtaaaccgtgaaggaaaaattgttgggttgtacggcaacggcgtagtaacaacatcagggacttatgttagtgcaatcgcacaggcaaaagcatctcaggagggtccgttaccagaaatagaagatgaggtatttcgtaaacgaaatctaactataatggacttacacccaggaagtggaaaaacgcgacgatacctaccagcaatagttagggaagcgattaaacgtaaattaagaaccctaatcctcgccccgactcgagtcgttgcaagtgaaatggccgaagcccttaaaggaatgcccattagataccagaccacagcagttaaaagtgaacatactgggaaggaaattgtagatcttatgtgtcacgctacattcacaatgagattactatctcccgtaagagttcctaactataatatgataataatggatgaagcccactttacagatccatcatcgattgctgcacgaggatatataagcacgcgtgtgggaatgggagaagctgctgccatttttatgacagcaacaccaccaggatccgtggaagcattcccccaaagtaacgccgtaatacaagatgaagagagagatattcctgagcgcagctggaatagcggctacgaatggattaccgattttcccggaaaaacggtttggttcgtcccatcaatcaaatccgggaacgacatcgctaattgtttaaggaaaaatggaaaaagagtgattcaattgtcaagaaaaacatttgatacggagtatcagaaaacaaagaataatgactgggactacgttgtaactactgatatcagtgaaatgggagccaacttcagagctgatagagttatagatccgcggcggtgcttaaaacccgttatcctaaaagatgggcctgaaagggtaatcctagctggtcccatgcctgtaactgtggcctcagccgcacagaggcgaggaagaataggaaggaatcataataaagaaggagaccaatacatatatatgggacagccgctaaacaacgacgaagaccatgcgcactggacggaggctaaaatgctgttagacaatataaataccccggaaggaataattccagcgttattcgaaccggaaagagagaaaagtgcagccatcgacggagaatatagacttagaggggaagcacgaaaaacgttcgtcgaattgatgcgccgaggagatctaccagtttggttaagttataaggttgcgtcagagggatttcaatattccgacaggcgctggtgctttgacggggaacgaaataatcaagtactagaagaaaacatggatgtggaaatatggactaaagaaggtgaaagaaagaaactcagacctaggtggttggacgctcgaacatattcggaccctctagcgttgcgagagtttaaggaatttgcagcgggacgccgctctgtatcgggagatttgatacttgagataggaaagctcccccaacaccttacgcaaagagcacaaaacgccttggacaatttagtaatgttgcacaattctgaacaagggggtcgagcatatagacatgcaatggaggagttacctgatacgatcgagacattaatgttgctggcacttattgctgttctaacaggcggcgtcacactattctttctatcaggcagaggattaggtaaaacgtcaataggtcttctctgtgtaatggcttccagcgttctgctctggatggcttctgttgaaccccattggattgctgcttcgataatattagagttcttcctcatggtactcctaattcccgaacctgacaggcaaaggacaccacaggataaccaattggcatatgttgtcatcggattactattcatgatactaacggttgcagctaacgagatgggattgttagagactactaagaaagacctaggtataggccatgtcgcggtagaaaaccatcatcatgcagccatgctggatgtcgatctacacccagcctcagcatggacattatatgccgtagcaacaactattataacacccatgatgagacacacgattgaaaacacgacggcaaatatttcactgacagcaatagcaaaccaagcggcaatacttatgggcttggataaagggtggccaataagcaaaatggatataggtgtaccgctattagctctcgggtgttattcgcaagtaaatccgttaactctaacagcagccgtcctcatgttagtagcacactatgcaataataggacctggactgcaagctaaggcaacgagggaagcacagaaaagaactgcagcaggcattatgaaaaaccctacggtggatggtatagttgcaatcgacctcgacccagtggtatatgacgctaaatttgaaaaacagttaggacagataatgctcctaatattatgtacatcacaaattttactcatgcgtacgacgtgggcgttatgcgagtcaataacccttgctacgggtccattgactacgttatgggaaggctcaccaggaaaattttggaacaccaccattgcggtctccatggcaaacattttcagaggtagctatttagccggtgcgggactagcattttcacttatgaaatcgttaggcggtgggcgtcgaggaacaggtgctcagggcgagactctaggagaaaaatggaaacgccaattgaaccaactatccaaaagcgagtttaacacatataagagatcagggataatggaagttgatagaagtgaggccaaagaaggcttaaagcgcggagaaacaaccaaacacgcggttagtagaggaacagcaaaactacgatggtttgtagaaagaaatttggtaaagcctgagggtaaagtaatagatttaggatgtggaaggggcggctggtcctattattgtgctggacttaaaaaggttaccgaggtcaaaggatacacgaaaggtgggcccggtcacgaagaaccgataccaatggcgacttatggttggaatctagtgaagctccattctggaaaagacgtatttttcatcccaccagagaaatgcgacacactattatgtgacataggcgaatctagtccgaatccgacaattgaagaagggagaaccttacgagttctaaaaatggttgaaccttggctaagaggtaatcaattctgtattaagatattaaatccatatatgccttcggtagtggagacgctggaacaaatgcaacgaaagcatggcggaatgttagtacgtaatccgcttagtagaaatagtacgcacgaaatgtattgggtatcctgtggtacgggaaatattgttagtgcagtaaatatgacgagtcgaatgctacttaacagatttacaatggcccacaggaaacccacgtacgagagagatgtagatttaggtgcgggaactcgtcatgtagcagttgaaccagaggttgcaaatctggatataattggtcaaagaatcgaaaatattaaacatgagcacaaatcaacttggcattatgacgaagacaacccgtacaaaacttgggcatatcacgggagctacgaagtcaaacccagcggttcagcgtcctcgatggtgaatggcgtggtgaaactattgacaaaaccctgggatgtcataccaatggttacacaaatcgctatgacagataccacgccatttggacaacagagagtttttaaagaaaaggtcgatacaagaacaccaaaagcaaaaagaggaaccgcccagatcatggaggtaaccgcaaaatggttatgggggtttctctcaagaaataagaaaccacgtatatgtaccagagaagagttcactagaaaagtacgctcaaacgcagctataggagcagttttcgtcgacgaaaaccaatggaatagtgctaaagaagcagttgaagatgaacggttctgggatctagtacacagggaacgagaattacataaacaggggaaatgtgcgacatgcgtctacaatatgatgggaaaaagggagaagaaactaggagaatttgggaaggcaaaagggagcagggccatatggtatatgtggctaggtgcacgcttcctcgagttcgaagcacttggcttcatgaatgaggaccattggttcagcagagaaaattctctaagtggcgtagagggagaaggtcttcacaaattaggttatatactgagagatattagtaacatcccaggtggaaatatgtatgctgatgacactgcaggttgggatacaagaattaccgaggatgatttacaaaacgaagcaagaattaccgatataatggaaccagagcatgctctcctcgcaaaaagcattttcaaacttacttatcaaaataaagtcgtaagggtgcaacgccctactaagaatggaaccgttatggatgtaatatctcgccgagatcaaagagggtcaggacaagtaggaacctatggtttaaatacatttacgaatatggaagcacaactaataagacaaatggaaagcgaaggaatattttccccgagtgagcttgaaacaccaaacctagctgaaagagtattagactggctggaaaaatatggtgtagaacggctcaaacgaatggcaatatcgggagatgattgcgtagtgaaacccgtagatgatcgatttgccacagcattgacggcattgaatgatatgggcaaagtgaggaaagacataccacagtgggaaccatccaaaggctggaacgattggcaacaagttccgttttgcagtcatcatttccatcaacttattatgaaagacgggagagaaatagtagtaccttgcagaaatcaagacgaacttgtagggagagctagagtctcccaaggagcgggttggtcactccgcgaaactgcatgccttggaaagtcttatgcacagatgtggcaattgatgtattttcatcgaagagatcttaggttagcagccaacgctatttgtagcgctgtcccagtcgactggatacctacttcaaggacaacttggagtattcacgcgcaccaccaatggatgacgacagaggacatgctaagcgtatggaacagagtatggatagaagaaaatccatggatggaagataaaacacatatatcgtcatggggagatgttccatacctagggaaaagagaagatcagtggtgcggtagcctaattggacttacagcccgagctacctgggccacgaatatccaagtcgcaatcaatcaagtaagaaggctgataggtaacgaaaattacttggactatatgacatcaatgaaaaggtttaagaatgaaagtgacccagaaggagccttatggtag

SEQ ID NO: 21488 - RNA, 9879 nt, synthetic construct
  misc_feature 1..9879: note = derived and/or modified CDS sequence (opt6) from DENV-1__FJ024433__SS-prME
  source 1..9879: mol_type = other RNA
tctgtaacaatgttacttatgttaatgccaacagcattagcgtttcaccttacaacacgcggcggtgaacctcatatgatagtatcaaaacaagaaaggggaaaatctctactcttcaaaacttcagccggtgtaaacatgtgtactttaatagcgatggacctaggcgaattgtgtgaagacacaatgacatacaaatgtcctagaataacggaaactgaaccagatgacgtagattgttggtgtaacgctacagatacgtgggttacatatggtacttgctcgcaaaccggtgaacaccgaagagacaaaaggtcggtagcactggcaccacatgtaggcttgggcttggaaactagaacagaaacttggatgagcagtgagggcgcatggaaacagatccaacgagttgaaacctgggcacttcggcacccaggttttaccgttattgctctgtttttagctcacgcaataggtacaagtataacacaaaaaggaatcatatttatattgctgatgcttgtcactccgagcatggcaatgcggtgcgtaggaattggatcacgagacttcgtcgaagggctcagcggagcaacatgggttgatgtagttctggaacatggatcgtgcgtaacaacaatggcaaaagataaacccacgttagatatagaactattaaaaacagaagttacgaatccagcagtattacgcaaactgtgtattgaagcaaaaattagtaatacaacgacagactccagatgtccaactcaaggtgaagcaactctagtggaggaacaagatgctaatttcgtttgccgaagaaccttcgttgacagaggttgggggaacggatgcggactatttggaaaaggtagccttatcacgtgcgctaaatttaaatgcgtaactaaattagaaggtaagattgtgcaatacgaaaatttaaaatatagcgttatcgtaactgtacacacaggtgatcaacatcaagtaggaaatgagtcaacagaacacggaactactgcgacgataacacctcaagcacctacaacagagattcaacttactgactacggtgctctaacgttagactgtagtcctcgtacagggctagattttaacgaaatggttcttttgactatgaaagaaaagtcttggttggttcataagcaatggttcttagatttacccttaccatggacaagtggtgcttccatatcgcaagaaacatggaacagacaagatttacttgtaacttttaaaactgcacatgccaagaaacaagaagtcgtagttttaggtagccaagaaggagcaatgcacactgcgttgaccggcgcgacggagattcagaccagtggaacaacaacaatttttgcgggtcatcttaagtgtcgattaaaaatggataaactcacattgaggggcatgtcttacgtcatgtgtactgggagtttcaaattggaaaaggaagtggcagaaacccagcatggaacagtcttagtacagataaaatatgagggtaccgatgcgccttgcaaaatacctttctcgactcaagatgaaaaaggagtaactcaaaacggcagattaataaccgctaatcctatagtcaccgataaagaaaaaccggtaaatatagaagcagaaccgcccttcggagaatcttatatcgtaataggtgcaggagaaaaagcactgaaattgtcgtggtttaagaaaggctcatcaataggaaaaatgtttgaggctacagccagaggggcacgtagaatggcgatccttggggacacggcctgggattttggatcgattggaggcgtgtttactagcgtcggtaagctcgtacatcagatattcggtacagcatacggagtcttgttttccggggtttcctggacgatgaaaattggtatcggggtcctattaacatggctcgggctcaacagccggtccactagcctaagcatgacatgtattgcggtagggttagtaacgttataccttggagtaatggtacaagcagatagcggatgtgtcataaactggaaagggcgtgaattgaaatgtggaagcggtatattcgtaactaacgaagtccacacatggacagaacaatataaatttcaagccgatagcccaaagagactaagcgcagctattggtaaagcatgggaggaaggagtttgtggtattagatcggctacaagattagagaatattatgtggaaacaaatttccaatgaactaaatcatatactattagagaatgatatgaaattcacagttgttgttggggacgttgcgggtatccttgcccaagggaagaaaatgattcgcccccagcctatggaacacaaatattcatggaaatcgtggggaaaagctaagattatcggtgcagatgtacagaacactaccttcattatagacggtccgaatacgcctgagtgccctgacgaccaaagagcctggaacatatgggaagtagaagattacggttttggaatttttacaacaaacatatggcttaaacttcgtgattcatacacacaagtatgcgatcatcgactgatgtcagctgcaataaaagacagtaaagctgttcatgcggatatgggctactggatcgagtcggaaaagaatgaaacctggaagttagcgagagcaagttttattgaagttaaaacatgtatttggcctaaaagccacacactatggtcaaatggcgtcctagagagcgaaatgataataccaaaaatctacggaggccccatatcacaacataactaccgacctggctattttactcaaacagctggaccgtggcacctgggaaaactagagctagacttcgacctttgcgaggggacaactgttgttgtagatgagcactgtggaaataggggtccgagtcttagaacaactacagtgacgggcaaaataatacacgaatggtgttgccgatcatgcacgttacctccactaaggtttcgcggggaggatggttgctggtatggtatggaaataaggcctgtcaaggaaaaagaggaaaaccttgttaaatcaatggtaagcgccggaagcggtgaagtagactccttctcattaggccttctatgcataagtataatgattgaagaagttatgagatcaagatggtccagaaagatgctcatgactgggacacttgctgtgtttttcttactcattatgggacaattgacatggaatgacctaataagattatgcattatggtcggggcaaacgcgtctgaccgtatgggaatgggcacaacatatttagcattgatggccacctttaagatgagaccgatgttcgcagtaggcttgctctttcgccgactaacctcgcgtgaggttttgttgttgactataggtttaagcctagtcgccagtgtagaactaccaaactcattggaagagttaggagacggactcgctatgggaattatgatactcaaattacttacggatttccagtcgcaccaactctgggctacactactctcccttacttttattaaaacaaccttcagtcttcattatgcctggaagacgatggcgatggtcttgagcattgtatcactattccctttatgtcttagtacaacctcccagaaaacaacctggttgccagtactacttggatcactaggttgtaaacctttaaccatgtttctgatagcggaaaacaaaatttggggtcgacgctcatggccactgaatgaaggcattatggcagtgggcattgttagcattttattaagtagtttattgaaaaatgacgtgcctctggcaggcccactgatagcagggggaatgttaatcgcatgttatgtgatatccggttcgagtgcagacctatcgcttgaaaaagcagccgaggtaagttgggaagaagaagctgaacatagtggagcatcccacaatattttagtcgaagtgcaagatgatggcacgatgaaaataaaagatgaagagagagatgatacgctgacaatattattgaaggcaacacttttagctgtatctggagtgtaccccctgtcaatacctgcaacattgttcgtgtggtatttctggcaaaagaagaaacaacgctcaggggtattatgggatactcccagtcctccagaagtagaaagagcagtactggatgatggtatatatagaattatgcaaagaggattactaggacgtagccaagttggtgtaggtgtatttcaagaaaatgtgttccatacaatgtggcacgtgaccagaggtgcggttctcatgtatcaaggaaaacgcttagagccatcttgggcaagtgttaagaaagaccttattagctatggaggaggctggcgacttcagggttcttggaacacaggagaagaggtccaagttatagccgtagagccaggtaagaatccgaaaaatgtacagactgcacctggcacgtttaagactcctgaaggcgaagtaggagctatagcactggactttaagccaggaacaagtggtagtcctatcgtaaaccgtgaagggaaaatagttggactctatggaaacggcgtggtcacgacaagtggtacatatgtttccgctatcgcacaggcaaaagcaagccaagagggccctctacccgaaattgaagatgaagtttttcgcaagagaaacctcacgataatggatttacatccaggatcagggaaaacaagaagatacctccccgcaatcgttagggaagcaattaaaagaaagctacgaactctaattctagctcctacaagagttgtagcatcagaaatggctgaggccttaaaaggaatgccgatccgataccagaccacagccgtgaaaagtgagcatacaggcaaagaaattgtggacctcatgtgccatgcaactttcacgatgagattactttcaccagtgagggttccaaattataatatgataattatggacgaagcccacttcaccgacccatcgagcatagcggctagagggtacattagtacaagggtaggaatgggcgaagcggctgcaatcttcatgactgccaccccaccaggcagtgttgaggcctttccacaatcaaatgcagtaattcaagacgaagagagagatatacccgaaagatcttggaactcaggttatgaatggataaccgactttccaggtaaaacagtttggttcgtcccttcaataaaaagtggcaacgatattgcaaattgtctaaggaaaaatggtaagagagtaatacaactaagtcgaaaaaccttcgacacggaataccagaaaacaaagaacaacgactgggactatgtagttactaccgatatatcagaaatgggtgcgaattttagagcagacagagttattgatcctcgacgttgtttgaaaccagtaatactcaaggatggtccagagagagtaatactcgcgggaccaatgcctgtaactgtcgctagtgctgctcaaagacgaggcagaataggaagaaatcataataaagaaggagatcaatacatctatatggggcagccacttaacaatgacgaagaccatgctcattggacagaagctaaaatgcttctagataatatcaatacgccggagggaatcattccggcgctattcgagcctgaaagagagaaatcagcggcaatagacggggaatatcgtttgagaggagaagctcgcaagacattcgtagagctgatgcgcagaggcgacttgccggtttggttaagttataaagtcgcgagcgagggatttcaatacagcgaccgaagatggtgttttgacggagaaaggaataatcaagtactggaagaaaatatggatgtggaaatctggacgaaagagggagaacggaagaaattacgacctcgatggttggatgccagaacgtatagtgacccactagccttaagagaatttaaagaatttgcggcagggcgaaggtcggtaagtggtgacttgatcctggagatcggaaaacttccacaacacttaacacaaagagctcagaatgctctcgataatttagttatgctacacaatagtgaacaaggcggcagagcgtatagacatgctatggaagaattaccagataccatagaaactcttatgctattagcactgatagctgtactaacagggggagtaacattgtttttcttaagtggtagagggctgggaaaaacatctatcggattactatgcgtgatggccagctccgtactactctggatggcatcagtagaacctcattggatagcagcatctattatcttagagtttttcctaatggtgctcttgataccggagcctgacagacaacgcaccccacaggataaccagttagcttatgttgttataggacttttgtttatgatactaaccgtcgccgctaatgagatgggactactagaaacaactaagaaagacctaggaataggccacgtggcagtagaaaatcatcaccatgctgcgatgctcgatgtcgacctacatcccgcatcagcttggacactatatgccgtagcgactactattataacccccatgatgagacatacgatcgaaaatacaaccgcgaacatatccttgacggcaatagctaaccaagccgcaattctgatgggacttgataagggttggccaatctccaaaatggatattggagtgcctctgttagctctgggttgttactcgcaagttaacccactaactctaacggcagctgtattgatgttagtagcccactacgcaataataggccctggactccaagccaaagctacacgggaagctcagaaaagaactgcagctggcattatgaaaaatccgactgtcgatggaattgtcgcgatagacttagatccagtagtctacgatgcaaagttcgagaagcaactcggacaaatcatgttgttaatactttgtactagccaaattctattgatgaggacaacgtgggccctgtgtgaatcgataacattggcaacaggaccgttaacaactctgtgggaaggatcaccaggaaaattctggaatacgacaatcgcagtttcaatggcaaacatttttcgagggtcgtatttagctggagctggattagcattctcactgatgaaatcactcggagggggcaggagaggtaccggagcacaaggagaaaccctaggagaaaaatggaagagacaattaaatcaactttcaaaatcagagttcaatacatataaaagatcgggaatcatggaagttgaccggtccgaagccaaagaagggttgaaacgcggtgaaacaacaaagcatgctgtatcacgtggtaccgcaaaattgaggtggtttgtagaaaggaacttagtcaaaccagagggaaaagtaatagacctgggatgtgggcgcgggggatggagttattactgtgcaggtctcaagaaagttacagaagtaaagggttatactaaaggagggccaggccatgaagaacctataccaatggcaacatatggatggaatttagtaaagctacattctggcaaggacgtcttctttataccaccggaaaaatgtgatacgctactttgcgacattggggaaagtagcccaaatccaactatcgaggaaggtaggacgcttcgcgttctaaaaatggtcgaaccatggcttagaggtaaccagttttgtataaaaatcttgaacccgtatatgccttctgtagtagaaacgttagaacaaatgcagaggaaacatggaggaatgctagtccgtaatccactatcacgtaatagtacccatgaaatgtattgggtatcgtgtgggacgggcaatatagtatcggctgtaaacatgactagccggatgctacttaatagattcactatggcacaccgaaaacctacatatgaaagagacgtagacttaggtgcaggaacgcgacacgtagcagttgaacctgaagtagcgaatctagatataatcggacagaggatcgaaaacataaagcatgagcataaaagcacgtggcattacgacgaggacaatccatataaaacctgggcttaccacggttcttacgaagtcaaaccgtccggatccgcttcatctatggtaaatggagtcgtaaaattgttaacaaaaccttgggatgtaataccgatggttactcaaatagcgatgacagataccacgccctttggccaacaaagggtattcaaagagaaagtagatacaagaactcctaaagctaaaaggggtacagcccaaatcatggaagtcaccgcaaaatggttatggggtttcttgtcccgaaataagaaaccacgaatttgtacacgagaagagttcacaaggaaagtccgatctaacgctgcaataggggcagtatttgtagacgaaaaccagtggaactctgctaaagaggcagtggaggatgaacgcttctgggacttggtccatcgcgaacgtgaattgcataaacaagggaagtgtgcgacctgcgtatataacatgatgggaaagagagagaagaaactcggagaatttggaaaagctaaaggcagccgagcaatctggtatatgtggcttggagcacgattcttggaatttgaggcactaggctttatgaatgaggaccattggttttcacgagagaactcactatcaggggttgagggtgaggggctacataaattaggatacatactgcgagatatatctaaaatccctgggggaaacatgtatgcagatgatactgctgggtgggatacacggattactgaggatgatttacagaatgaggcccgcattacggacataatggaacccgaacatgctctcctagcaaaatcaatattcaaattaacatatcaaaataaagttgttagagtccaaagaccagccaaaaatggtacagtaatggatgtcatatcaagaagagatcaaaggggcagtggccaagtcggcacatacggtctcaacactttcaccaacatggaagctcaactgatacgacaaatggaatctgaaggaatttttagcccttcggagctcgaaacacctaacttggctgaacgggtacttgattggttggaaaaatacggtgtcgagagactcaaaagaatggcaatctcaggcgacgattgtgttgttaaacccatagatgaccggtttgcgacggccctaacagcattgaatgacatgggaaaggtaagaaaggacattcctcaatgggaaccatctaaaggttggaatgactggcaacaggtgccattttgcagtcatcacttccatcaacttatcatgaaggatggcagagaaatagtggttccctgcagaaatcaagatgagctagtaggcagggctcgggtaagtcagggagctggatggaatttacgcgaaacagcttgcctaggaaaatcctacgcacaaatgtggcagcttatgtattttcacagaagagacctcagactagcagctaatgcaatatgttcagctgtacctgttgactggattccaacctcccgaacaacatggtctatccatgctcatcatcaatggatgaccaccgaagacatgctttcagtatggaatagggtatggattgaggaaaacccttggatggaagataaaacacatatctcaagctgggaagatgtcccgtatttaggaaaaagggaagaccaatggtgtggaagtttaataggactaacagcccgggcgacatgggcgacgaacattcaggtcgcgattaatcaggtacgacgtctcataggcaacgaaaactatttagattatatgactagcatgaaacgttttaaaaatgagtcagatcctgaaggcgcgctatggtga

SEQ ID NO: 21489 - RNA, 9879 nt, synthetic construct
  misc_feature 1..9879: note = derived and/or modified CDS sequence (opt6) from DENV-1__FJ024434__SS-prME
  source 1..9879: mol_type = other RNA
tcagtcacaatgcttttaatgttaatgcccacggcgttagcattccacttaactactagaggaggagaaccacacatgatagtgtccaaacaggaaaggggcaagtctctattgtttaagacatcagctggtgtgaacatgtgtacactaatcgccatggacctgggcgagttgtgcgaggataccatgacgtacaaatgtccaagaattaccgaagcggagccagatgacgtagattgttggtgtaatgcgaccgacacgtgggtcacttatggcacctgcagccagacgggagaacatagacgagataaaaggagtgttgcacttgcccctcatgtcggtctcgggctggagacgcgaactgagacttggatgagctcggaaggagcttggaaacagatccaacgcgtagaaacgtgggcgctgagacatccaggattcactgtaattgctctttttttagcacacgcgattggtacgtctataacacagaaaggtataatattcattttactaatgttggtaactccttcaatggccatgcgttgtgtaggcataggatcaagagattttgttgagggtctctcaggggcaacatgggttgatgtagtcttagagcacgggagttgtgtaacgacaatggcaaaagacaagcccacattagatatagagctcctaaaaaccgaagtgacaaatcctgccgttttaagaaagctttgtatagaagcaaaaataagtaataccacaacggactcacgatgtcctacccaaggagaagccacactagtggaggaacaagacgctaactttgtgtgccgaagaaccttcgtggataggggatggggtaacggttgcggtctttttggtaaagggtcccttatcacctgtgcgaaatttaaatgtgtgacaaaactcgagggcaaaattgtccaatatgagaatctcaaatatagcgttatagtcacagttcatacaggagatcaacatcaagtgggtaacgaaagcaccgaacacggaacaacagcaacaataactccacaggcccccaccacagaaattcaattgactgactatggtgctttaacgttagactgtagcccacgcacaggactagactttaatgaaatggttttacttacaatgaaggaaaagtcttggttagtccataagcaatggtttttagacctaccgctgccttggacaagcggcgcatccacatcccaagaaacttggaatagacaagacctattggtaacattcaagacggcacacgccaaaaaacaagaagttgtagtgttaggaagtcaggagggcgcaatgcatacggctttaacaggcgcgaccgaaatccaaactagcggtaccacaaccatttttgccggccacttgaaatgccgactaaagatggataaactaacattaaagggaatgtcttatgttatgtgcactggctcttttaaactggaaaaagaggttgccgaaacacaacacggcaccgtcttagttcaaattaaatatgaaggaactgacgctccctgcaaaatcccctttagtacacaagatgaaaaaggagttacccagaacggccgtcttataacggcaaatccaatcgttacggacaaagagaagccagtgaatattgaagcagaaccgccttttggggaatcgtatatcgtcattggtgcaggagaaaaagctctaaaactatcgtggttcaaaaagggatcttcaattggtaaaatgtttgaagccacagctcgtggggccagacgtatggctatacttggagatacagcctgggattttggtagtataggaggtgtcttcacatctgtggggaaacttgtacatcagatatttggcacagcgtatggagtgctattctctggcgtttcttggacaatgaaaatagggataggagttcttctcacctggctgggattaaattcgagaagcacaagtctaagtatgacatgcatagcggtggggttggttactttgtacttaggagtaatggtacaagcggattctggatgcgtaataaattggaaaggcagagaactgaaatgtggttcaggaatttttgtgactaacgaagtacatacctggactgagcaatacaaatttcaagcagatagtccaaaaaggctctcagcagcaatagggaaggcttgggaagagggagtttgcggtatacgttctgcgacaagactagaaaacatcatgtggaaacaaataagtaacgagctaaaccatattttacttgaaaatgatatgaaactaactgtcgtagttggagatgttgctggaattctaggacaaggaaaaaagatgatccggcctcagccaatggagtataaatatagttggaaatcatggggtaaagcaaaaatcataggagctgatgcacaaaatacgacatttataatagacggtccgaacactccggaatgtcccgacgaccaaagggcttggaacatttgggaagttgaggactatggctttggaatcttcacaactaacatctggttaaaactgcgagacagttatacacaagtatgtgatcacagattaatgtccgcagcgataaaggactcaaaagcagtgcacgcggatatgggatattggatcgagtctgaaaagaacgaaacatggaaattagcccgtgcaagttttatagaagttaagacgtgtatctggcccaaatctcacacactatggagcaatggggtactagaatcagagatgattattccaaaaatatatgggggtccaataagccaacacaactacaggccaggttacttcactcaaactgcaggaccctggcacttggggaaactagaattagattttgacctttgtgaaggtactacagtagtcgttgatgagcattgtggaaaccgcggaccctcattaagaaccaccacagttactggcaaaattatacacgagtggtgttgccggtcttgtactttaccacccctacgttttcgcggcgaggatgggtgttggtatggcatggagatacgtcctgtaaaggaaaaggaagaaaatttagtaaaaagtatggtctctgccggctcaggtgaagttgatagttttagccttggacttttgtgtattagtataatgattgaagaagtaatgaggagcaggtggtccagaaaaatgttaatgacaggtaccttggcagtgttttttcttctcattatgggacaattgacatggaatgacttaatacgattgtgcattatggttggtgctaatgcgtccgatcgaatgggaatgggaacaacttatctcgctctgatggctaccttcaagatgagacctatgtttgcagtaggtttattatttaggcgcttaacgtccagggaagtcctactgttgacgataggcttatccttggtcgccagcgtcgaacttccgaattcattagaagaattaggggacggactagcaatgggcatcatgatattaaaactcttaacagattttcaatctcatcaactatgggcaacattattatcactaacatttatcaaaactacattttcccttcattacgcctggaaaactatggctatggttttatccatagtatcactttttccattatgtttgtctactacttcgcagaagactacctggttgccagttctacttggcagtcttggatgtaaaccactaacaatgtttctaatagccgaaaacaaaatatgggggcgaaagtcatggcctttaaatgaaggaataatggctgtaggaatagtatcaatcttgctttcctccctcttgaaaaacgacgttccactcgctggacctctaattgccggcggaatgctgatagcgtgttatgtgataagcgggtcgtccgctgatttaagcctagagaaagcagccgaagtcagttgggaagaagaggctgagcattctggagcctctcacaacattctagttgaggtacaagacgatggaacgatgaaaataaaagacgaagaaagagacgatactctaaccatactactaaaagcaacactactggcagttagcggagtttacccgttatccataccagcaacacttttcgtttggtatttctggcaaaaaaagaaacagcgatccggggtgttatgggatacaccaagtccccctgaagtagagcgagcagtgctagatgacgggatatatcggataatgcagcgggggttgctcggacgatcccaagtaggcgttggggtctttcaagagaatgtatttcatacaatgtggcatgttacgcgcggcgcggtcctaatgtatcaaggaaaaagactggaaccaagctgggcctccgtaaaaaaagatcttatctcttacggtggcggatggcggctacgagggtcctggaatacgggtgaggaagtacaggtgatagcagtggaacccggaaaaaaccctaaaaatgtacaaacagcacctggaacgtttaaaacccctgagggagaagtcggcgcaatcgcattagactttaaacctggaacttcagggagtcccatagttaatagggaaggaaaaatcgttggtctatacggaaacggagttgtaacaacgtcaggcacttacgtgtccgcaatcgcacaagcaaaagcgtcccaggaaggaccgttgccagaaatagaagatgaggtatttcggaagagaaatctcacaattatggacttacatcctggatcaggtaaaactcggcgctatttaccggccatcgtccgcgaagctatcaagagaaaactacgaaccctaattctagccccaacgagggtagtagcttcggaaatggccgaagcactaaaaggcatgccaattaggtatcagacaaccgctgttaaaagcgaacacaccggaaaagaaatagtagatttaatgtgtcatgctacattcaccatgagacttctctcgcccgtacgtgtaccaaattataatatgattataatggatgaagcacatttcacggaccctagctccatagctgcaagaggatacatatctacacgagtaggcatgggagaagcagctgcgatatttatgacggcgactcccccaggtagtgttgaagcattcccacagagtaatgcagtaatccaagacgaagagcgagacataccggaaagatcatggaattcaggttatgagtggataacagattttcctgggaaaacagtatggtttgtgccatctattaaaagcggaaacgacattgcaaattgtttacgaaaaaacgggaaacgagtgattcaactgagcagaaaaacgtttgataccgagtatcaaaagacaaagaataacgattgggattatgtagtgactacagacatatcagagatgggggcgaattttcgagcggatagagttatagatccacgacgttgcctgaaaccagtaatactaaaggatggtccagaacgtgtgatattagctggaccaatgccagtaactgttgcctctgcggctcaaagacgaggacgcataggtcgaaaccataacaaagaaggcgatcagtatatatatatgggacaaccattaaataatgatgaagatcatgcccattggacagaagcaaaaatgttgctagataacataaacaccccagaaggaattataccagcactattcgaaccagaacgtgaaaaatctgctgcagttgacggagagtacagattaaggggggaagcacgaaaaacctttgttgagctaatgagacggggtgacttacccgtttggttgagctacaaggtggccagtgaagggtttcaatattcagatagacgttggtgcttcgacggggaaagaaacaatcaggtcttagaggagaacatggatgtagaaatatggactaaagaaggagagaggaaaaaactaagaccgaggtggttggacgcacgaacatatagtgatcctcttgcacttagggaatataaagaatttgctgcaggaagaagatccgtcagtggcgacttaatacttgaaataggaaagctacctcaacatcttacccaaagagctcagaatgcacttgataatcttgtaatgctgcataattctgaacaaggcggtagagcatacaggcatgcaatggaggaacttcctgatactatcgaaacattaatgttactggctttaatagctgttttaactggtggagtcaccttgttttttctatcaggaagaggacttgggaagacaagcattggcctcctatgtgtcatggctagcagcgtattactatggatggcaagcgtggaaccacattggatagcagcatctattattttagaatttttcttaatggtactgttaataccagaacccgatcgacaacggacaccacaagataaccaactagcttacgtggtaatcgggttgcttttcatgattcttactgtagcagcgaacgagatgggactgctcgaaacaactaagaaagatttaggaatcggccatgtagcagtagaaaaccaccatcacgcagctatgctagatgtggatctacatcctgcatcagcatggactttatatgcagttgcaactaccataataacgcccatgatgcggcatactatagagaacacgacggcaaatataagcttaacagcaattgcaaaccaagcagcaatcttaatgggattggataaaggatggcccataagtaaaatggacattggcgtaccactacttgctttgggatgctacagccaagtaaatccactgacactgactgccgcagtactaatgctcgtagcccattacgcgataattggaccaggattacaggcgaaagctaccagggaagctcaaaagagaactgcagcggggattatgaaaaatcccactgtcgacggaattgtcgcaattgatttggacccggttgtatacgacgcaaagttcgagaagcagttaggacagatcatgctacttatactgtgtaccagtcagatattactaatgcgtactacttgggcgttgtgcgaatcaataacactcgctgctggtccactcacaacactctgggaaggatctcccggcaagttttggaatacaacgatagcagtaagtatggcaaacatatttaggggatcttatctagcaggcgcaggtctagcgtttagcttaatgaaaagtcttgggggtggcagaagaggcactggcgcgcaaggtgagacattaggagaaaaatggaaacgacaactgaaccaactttcaaaaagcgaattcaatacgtacaaaagatcaggaattatggaagtcgatagatccgaggccaaagaaggcctgaagagaggtgaaactaccaaacacgcggttagtcgaggaactgcaaaactacgttggtttgtcgaaagaaacctagtaaaacctgaaggtaaagtaatagaccttggttgtggaagaggcggatggtcatactattgcgcagggctgaaaaaggtcacggaggttaagggatacacgaaaggtggcccaggacatgaagagcccattccaatggcgacatatggttggaatcttgttaaactccattccggaaaagatgtattctttattccaccagaaaaatgcgatactttactttgtgatataggggagagtagtccaaatccgacaatagaagaaggacgtacattacgagtgttaaaaatggttgaaccctggctaagaggtaaccaattttgtataaaaatactgaatccttacatgccaagcgtcgtagaggctcttgagcaaatgcaaagaaagcacggcggaatgctggttcgaaatcctctaagtagaaattcaactcatgaaatgtattgggtatcctgtggaacggggaacatcgttagcgcggttaacatgaccagtagaatgctgctaaatagattcactatggctcaccggaaacccacctacgagagagacgtcgacctcggaacaggaacgcgtcacgtagctgttgaacctgaagtagccaacctagacatcataggtcaaagaatagaaaatataaaacatgagcacaaatcgacttggcattatgatgaagataacccgtataaaacatgggcctatcatggctcctacgaggtaaaaccatcaggtagtgcgtcgtctatggttaacggtgtcgtgaaactacttaccaaaccttgggatgtcattccaatggtaacacaaattgcgatgaccgataccacaccctttgggcagcaacgagtcttcaaagaaaaagtcgatacgcggacaccgaaagcaaaacgtggtaccgcacaaataatggaggtaacagcaagatggttgtggggctttcttagcagaaataaaaaacctcgaatttgtacgagagaggaattcacccgaaaagttcgctcaaatgccgcaattggcgcagtattcgtggatgaaaatcaatggaattcagccaaagaagcagtcgaagacgaaagattttgggatctagtacacagagaacgagaacttcataaacaaggcaagtgtgcaacttgcgtatacaatatgatgggcaagcgggagaaaaaactaggagagttcggcaaagcaaaaggttcccgagctatttggtatatgtggcttggtgcaaggtttctagaatttgaagcactcggctttatgaacgaagaccactggttttcgcgagaaaactcactgtccggtgtagagggcgagggtttacacaaattaggttatattcttagggatattagcaagatccctggtggtaatatgtatgccgacgatacagccggatgggacacacgtataactgaggacgacttacaaaacgaagccaaaataactgacataatggaacctgaacacgcactattagcaaaagcaattttcaagctcacatatcaaaataaagtcgtcagagtgcaaaggcctgctaaaaatggtactgtcatggatgtaatctcacgcagggaccaacgaggaagcggccaggtcggcacatacggactgaacacttttacaaacatggaagcccaactcatacgacaaatggagtctgaaggtattttcagtccgtcagaacttgaaactcctaatttggccgaacgagctttagattggttagagaagtatggagtggaaagactcaaacgaatggctatatccggtgacgattgtgtagtcaagccgattgacgatagatttgcaacagcactcacagcactaaacgacatgggaaaagtccgtaaagatatacctcaatgggaaccgtcaaaaggctggaatgattggcaacaagtacccttttgctcccatcactttcatcaattgatcatgaaagacggaagggagatagttgtaccctgcaggaatcaagacgaattagtcggcagggcacgtgtaagccagggtgcaggatggagcttaagagaaaccgcttgtctaggaaagagctacgcacaaatgtggcaactgatgtattttcatagaagggacttgaggttagctgcgaatgcaatttgtagtgcagttcctgtggattgggttccaacatcccgtactacgtggtctatacatgcccatcaccaatggatgactacagaggatatgctgtcagtatggaatcgagtctggatagaagagaacccatggatggaagataaaacacatatatcttcatgggaagacgtaccatatttaggaaagcgtgaagatcaatggtgcggctcactaataggattgacagctcgagccacctgggccacaaacattcaggtcgctataaatcaagtcagacgcctcataggaaatgaaaattacttagattatatgataagcatgaaaaggtttaagaacgaaagtgatcccgaaggagcattgtggtaa

SEQ ID NO: 21490 - RNA, 9879 nt, synthetic construct
  misc_feature 1..9879: note = derived and/or modified CDS sequence (opt6) from DENV-1__FJ024435__SS-prME
  source 1..9879: mol_type = other RNA
agtgtcacaatgctcctcatgctaatgccaacagcgttggcattccacttaacaactagaggaggagaaccacacatgattgtcagtaaacaagaacgtggaaagagcttgctttttaaaaccagtgccggtgtaaatatgtgcaccttgatagctatggacttgggagaactatgtgaagatacaatgacgtataaatgtccacgtattacagaaacggaaccggacgatgttgactgctggtgcaatgcgacagacacatgggtgacgtatggaacctgttcgcaaacaggagaacatcggagagacaaacgctctgtcgcacttgcacctcacgttggtctaggactggaaacacgaacggagacgtggatgtccagcgaaggagcttggaaacagattcaacgggtagaaacgtgggcattacgtcatcctggctttacggtaacggcattgtttctagcacacgcaataggaacatcaattactcaaaaaggaataatttttattctactaatgttagtgacaccctcaatggcaatgagatgtgtaggtatcggcagtagagacttcgtcgaagggctatcgggcgcgacctgggtcgacgtcgtattagaacacggatcatgcgttacgactatggctaaagataaaccaacgctagacatcgaattacttaaaacggaggtaacaaatccggctgtactgagaaaactttgtattgaggcaaaaatatctaacactacaacggactcacgttgtccaactcaaggcgaagctacgttagtcgaagaacaagacgcaaatttcgtatgtcgccgcacatttgtggacaggggatggggtaacggatgtggtctatttggtaaaggcagtttaattacttgtgcgaaatttaaatgtgttacaaaattagagggtaaaatagtacaatatgaaaacttaaaatactcagttattgttaccgttcataccggggatcaacatcaagtagggaatgagagcactgaacatggaacaacggctacgattacaccacaagcacctactactgaaatacaactaacagattatggtgccttaactctcgactgtagcccgagaaccggattagattttaatgagatggttttattgacaatgaaagagaaatcttggcttgtacacaaacaatggttcttggatttaccacttccctggacgagcggggctagtacgagtcaagaaacgtggaatagacaagacttgttagtaacatttaaaactgcccacgctaagaaacaagaagtcgtagttttaggatcacaagaaggggcaatgcatacagctctcacaggggcaacggaaattcaaacaagtggaacaaccactatatttgcaggacatttaaaatgtaggcttaaaatggacaagctgacattaaaaggaatgtcttacgtaatgtgtacaggtagttttaaactagaaaaagaacttgccgagacacagcacgggacagtattagtacaaatcaaatacgagggtacagacgctccatgcaaaattccgttttctacccaagacgaaaagggtgtcactcaaaacggtagacttattactgcaaatccaatagttacagacaaggagaaaccggttaacattgaagcggaaccaccatttggagagtcctacattgtcataggagccggtgaaaaagcgttaaaattatcttggtttaagaagggctctagtatcggtaaaatgttcgaagccactgcacgaggagcaaggagaatggccatactcggggatacagcatgggatttcggctcgatcgggggagtgtttacttcggtaggcaaattagtacaccaaatatttggaacagcctacggagttctattttccggagttagctggacaatgaaaataggaataggcgtcctattgacatggttaggtctaaacagcaggtcaacgagtctatcaatgacttgcatagcagtaggccttgtaactttatatttgggggtgatggtacaagcagactctggatgcgtaattaattggaaaggaagagaactaaaatgtggttcaggaattttcgttaccaatgaagtacatacatggactgaacaatataaatttcaagctgattcacctaaacgcttaagtgccgctattggtaaagcctgggaggaaggagtttgtggtatacgatcagccacaagactggaaaatattatgtggaaacaaatatctaacgagttgaaccacattctattggaaaatgatatgaaatttacggttgtagtcggcgacgtcgcaggcatcttggcgcaaggtaagaaaatgatcagaccccaacccatggaacataaatatagttggaaatcttggggtaaagctaaaataataggagccgacgtacaaaataccaccttcattatagacggtccaaacaccccagaatgtccagatgatcaacgagcctggaatatttgggaagttgaggactatggatttggaatatttactacgaatatatggctcaaattaagagactcctacacccaggtttgtgatcatcgtcttatgtcagcagccataaaagacagtaaagcagtacacgccgacatgggttactggatcgaaagcgagaaaaatgagacatggaagttggctcgtgcgtcttttatagaagtaaagacttgtatatggccgaaatcacacacgttatggtcaaatggagttctggagtcagaaatgatcattcctaaaatttatggaggaccaatatcacaacacaactatagaccaggatacttcacacagacggcaggcccatggcacctaggaaaattagagttggatttcgacctttgcgagggtacaaccgtagtagtcgatgagcactgtggaaacagagggccttcacttagaacaacaacagtcacaggaaaaatcatttatgaatggtgttgtcgatcgtgtaccttaccgcccttacgctttaggggcgaagatggatgctggtatggtatggaaatacgacctgtaaaggagaaggaagaaaatctagtcaagtcgatggtgtcggccggaagtggagaagttgatagtttcagtcttggcttattatgcattagtatcatgatagaggaagttatgaggtctcggtggagtcgaaaaatgttaatgacaggtactttagcggtattctttctcctaattgtgggacaactaacatggaatgaccttataagactatgtataatggtcggagcaaacgcatcagatagaatgggaatggggacgacatatttagctctcatggcgactttcaaaatgaggcctatgtttgctgttggacttttgtttcgtcgtcttacctcacgcgaagtccttttacttactataggactgtcacttgtagcatctgtagaactacctaattcgttggaagaactgggcgacggattagctatggggataatgatactgaaactattgaccgacttccaatctcaccagttgtgggctacactactttcactgacatttatcaagacaacattctctctacattatgcgtggaaaaccatggccatggtacttagcgtcgtatcacttttccccttgtgtttatccactacgagtcagaaaactacatggctaccagttttgttaggtagcttaggatgtaagcctctgacaatgtttctcattgccgaaaataagatctggggcaggagatcatggccactcaacgaaggaataatggcagtcggaatagtttcgatactattatcgagcttactaaagaatgatgtaccattggccgggcctttaattgccggtgggatgttaatagcgtgctatgtgatctcgggatcgtcagcagacttgagcttagaaaaagcggctgaagtaagctgggaagaggaagcagaacattcgggcgcctcacataacatattagtagaagtacaagatgacgggacgatgaaaataaaagatgaagaacgagatgatacattaacaatactgcttaaagcgacactattagccgtatctggcgtgtaccctttatcaatcccagctactcttttcgtatggtacttctggcaaaagaagaaacaaagatcaggggttctttgggataccccttccccgccagaagtagagagagctgtgctagatgatggcatttacagaatcatgcaacgcgggttacttggacggtctcaagttggcgttggagtattccaagaaaatgtttttcacacaatgtggcatgtaactagaggagcagtattgatgtaccagggtaagagattggaaccaagttgggcgagcgtgaagaaagatttgattagctatggcggaggttggcgattacaaggcagctggaacacaggggaggaggtccaagtgattgcagtagaacctggcaaaaacccgaagaacgtccaaactgcacccggaactttcaaaacccccgagggtgaagtgggtgcaatagccttagactttaaaccagggacatctggaagtccgattgtcaatcgagaagggaaaatagtaggactttatggcaacggggtagttacaaccagtggtacttacgtatcggccattgcgcaagcaaaggcttcgcaggagggtcccctccccgagatagaagacgaggtattcagaaaaagaaatctgacaattatggacttacatccggggtccgggaaaactagacgatatctaccagcaatagtgagggaagctataaaaagaaagttaagaactttaattttagccccgaccagagttgtagcctccgagatggcagaggcattaaaaggaatgccaataagatatcaaactacagcagtaaaatcggagcacacaggcaaagaaatagtcgatctaatgtgccatgctacattcacaatgagactattaagcccagttagggtgccgaactacaatatgattataatggatgaagctcatttcacggatccgtccagcattgcagcccgaggatatatcagtactagagtgggtatgggggaagcggctgcaatctttatgacagcaaccccaccgggtagtgttgaggcatttccacaaagcaatgcagtgatccaagatgaggagcgtgacattccggaacgaagctggaatagtggatatgaatggattacagatttccccggtaaaacagtatggtttgttccatcaatcaaatcagggaatgacatcgccaattgtctaaggaagaatgggaaaagggtgattcaactttccaggaaaactttcgatacagagtatcagaaaacgaaaaacaatgactgggactatgttgtaactacagatatatcagaaatgggagccaacttcagagctgatagggtaatagacccgagaagatgtttgaaaccagtaattctaaaagacggtccagaacgagtcatcttggctgggcccatgcctgttactgttgcctcagcagcacaaagacggggaagaattggccgaaatcataataaggaaggggatcaatacatatatatgggacaacctttaaataacgacgaagaccacgcgcattggacagaagctaaaatgctgcttgataacataaatacacctgaaggaattataccagcgcttttcgagcccgaacgagagaagagtgccgcaatagatggcgaatacagacttaggggtgaagcacgaaagacgtttgttgagctaatgaggagaggtgatttaccagtttggttgagctataaggttgcatcagaaggttttcaatattcagatagacgatggtgtttcgacggcgaaagaaataaccaagttctagaagagaacatggatgttgaaatttggacaaaggaaggagaacgcaaaaagctgaggcccagatggttagatgctaggacttactccgatcccttagccttacgtgaatttaaagagttcgccgcaggaagacgttctgtaagcggagatttaatccttgaaataggcaaattaccgcaacatcttactcaaagagctcagaacgcactagataatttagtaatgctacataatagcgagcaaggtggcagagcttatagacacgcgatggaggaattaccggatacaatagaaactctgatgctcctagccctgatcgccgtcctaactggaggggtgactctctttttcctatcgggacgtggtttgggcaaaacttctattggcttactctgcgttatggcctcaagtgtactattatggatggcctcagtagaacctcattggatcgcagcatcgattatcttagagttctttctaatggttctgctcatccctgaacccgacagacaaagaacgccccaagacaatcagcttgcgtacgttgtgatagggttgctttttatgatattaacggtagcagccaatgaaatgggtctcctggagaccactaagaaagatctcggcataggacacgtcgctgtcgaaaatcatcatcatgctgccatgctcgatgttgatttacacccagcttctgcatggacactatacgcggtagctacgacaataattaccccaatgatgaggcataccattgaaaacacaacagctaacatatccttgacggcaattgccaatcaagccgctatactaatgggcctcgataaagggtggcctataagcaaaatggacattggagtaccactgttggcccttggatgctattcccaagtaaatccgttaactcttacagcagctgtgctaatgctagtagcacattatgccatcataggaccagggctccaggcaaaagcgactagagaagcacaaaagcgtacagcagcgggcatcatgaaaaaccctacggtagacggaattgtagccatagatttagatccggttgtatatgacgccaagttcgaaaaacaactcgggcaaataatgcttctaatattatgtacatcccaaattctactaatgaggacaacttgggcactatgtgagtcaataacattagctactggacccttaacaacactatgggagggaagtccggggaaattttggaacactactattgcagtatctatggctaatatattccgcgggagttacttagccggtgcagggctagcatttagtttaatgaaaagtttgggagggggtagaagagggacgggcgctcaaggagaaaccctgggtgaaaaatggaaaagacaattaaatcagctatcaaaatctgaatttaacacctacaagcggtctgggatcatggaggtcgatagaagtgaagctaaggaagggcttaaacgaggggaaaccacgaaacatgccgtttccaggggcacagcaaagctacgttggttcgtagaaaggaatctagtgaaaccagaaggaaaagttatagatctaggatgtggaaggggagggtggtcttactactgcgcaggccttaagaaggtgaccgaggtaaaaggttacacgaaaggaggaccaggacatgaggaacctataccaatggccacgtacggatggaatttagttaaacttcactcaggcaaagacgttttcttcatcccgcccgaaaaatgtgatacactgctatgtgatataggtgaatcgagtccaaacccaactattgaagagggtagaacactgagagtactgaaaatggttgaaccttggcttagaggtaaccagttctgtattaaaatactcaacccctatatgccatccgtagttgaaacactagaacagatgcagagaaagcacggaggtatgttggtgcgaaacccattatcaagaaatagtacacacgaaatgtactgggtgtcatgcggaacaggaaacatcgtatctgcagtaaatatgacatcccgaatgttactgaatcgtttcaccatggcccaccgcaaaccaacgtatgaaagagatgtagatctcggagccggaacacgacatgtagcggtagaaccagaagttgctaacttggatataattggtcagagaatcgaaaacattaagcatgaacataaaagtacatggcattacgatgaggacaacccatacaaaacgtgggcatatcacggatcctacgaagtgaaaccaagcggctcagcctcctccatggtaaatggggttgtgaaactattaaccaaaccatgggatgtaatacccatggtaacacagatagcaatgacagatacaacgcctttcggtcaacaaagagtattcaaggaaaaagtggacacaaggactccgaaagcgaaacgaggtacagcccaaatcatggaagttactgccaaatggctctggggttttctaagtagaaacaagaaaccgcgcatatgtactagagaagagttcactcgcaaggttcgtagtaacgcagcaattggcgcggtttttgtagacgaaaaccaatggaactcagcaaaagaagcagtcgaagacgaacgattctgggacctggtacatcgagaacgagaattacacaaacaaggtaaatgtgcaacatgcgtatataatatgatgggaaaaagagaaaagaaattaggagagttcggaaaagcgaaaggaagtcgagctatatggtatatgtggttaggagccaggtttcttgaatttgaagcattaggatttatgaacgaggaccattggttttcccgcgagaactcactttccggggttgaaggcgaaggcctgcacaaattaggctacatactacgagatataagtaagataccaggaggtaatatgtatgcagatgacactgcgggatgggacactcgaataacagaagatgatctccagaatgaagcaaggatcaccgacattatggaaccagaacatgcattgctcgcaaaatcaatttttaagttaacctaccaaaataaggtcgttcgagtgcaacggcccgctaaaaatggtacagtcatggacgttatctcgaggagagaccagagagggtcaggacaagttggaacctatggcttgaatacttttacaaatatggaagcgcaactcattagacaaatggaatccgagggaatattttctccttcagagttagagacgcccaatttggcggaacgcgtactagactggctggagaaatacggcgtagagcgcctaaaaaggatggctatatccggagatgactgtgttgtaaaaccaattgatgaccgttttgccacagcgctgaccgctctgaatgatatggggaaagtaaggaaagatatccctcagtgggaaccctctaaagggtggaacgattggcaacaagtaccgttttgctctcaccactttcatcaactaattatgaaagatggcagggaaatagtagtgccttgccgtaatcaggatgagctagtcgggagagcacgtgtaagccaaggtgcgggatggtcattgcgggaaacggcatgtcttgggaagagttatgctcaaatgtggcaacttatgtattttcacagaagggatttgcgattagcagcaaatgcaatatgtagtgccgtcccagttgattggatacctaccagccgtacaacatggtctatacacgcacatcaccaatggatgactacggaggatatgctatcagtatggaacagagtatggatagaggagaacccttggatggaagataaaacacatataagctcatggggcgacgtgccttaccttggaaaacgcgaagatcaatggtgtggcagcctaataggcctaaccgctcgagcaacttgggcaacaaatatacaagttgctataaatcaagtcagacgacttataggaaatgaaaactatttagattatatgactagcatgaaacgattcaaaaatgagtcagacccagaaggcgcattgtggtaa

SEQ ID NO: 21491 - RNA, 9879 nt, synthetic construct
  misc_feature 1..9879: note = derived and/or modified CDS sequence (opt6) from DENV-1__FJ024436__SS-prME
  source 1..9879: mol_type = other RNA
tcagtaacaatgctccttatgctaatgccgaccgcacttgcttttcatttaacaacaagaggtggagaaccacatatgatagtaagcaaacaagaaaggggaaaatctttactctttaaaacaagtgctggagtaaacatgtgcacccttatagcaatggatttaggagaattatgtgaagacacaatgacttataaatgtccccgtataacggaagcggaacctgatgacgtcgattgttggtgtaatgcaaccgatacatgggtaacatatggaacatgttctcaaaccggtgaacatagacgagataaaaggagtgtagcattggcaccgcatgtcggtctaggtcttgaaacaagaaccgaaacctggatgagtagtgaaggggcatggaaacaaatacaacgggtggaaacatgggctctcagacatcccggatttactgtaattgcactatttttggcacacgcaatcggaacgagtatcacacaaaaaggaatcatattcatattattaatgctagttacaccatcaatggctatgcgatgtgtcggaatcggttcaagggactttgtcgagggtttgtctggtgcaacttgggttgacgttgtcttggagcacggaagttgtgtaacaacaatggccaaagataaaccgactctagatatagaactattaaaaactgaagtcacgaatcctgcagtactaagaaaactatgcatagaagcaaaaatcagtaataccacaacagattcgagatgcccgacacaaggagaagcaacattagtggaagaacaagatgccaatttcgtatgtcgtagaacttttgtggatcggggatggggaaacggttgcggactatttggcaaaggatcattgattacatgtgcaaaattcaaatgcgtgacaaaactagaaggaaaaatagtacaatatgaaaacttaaaatattcagtaattgtgacagtacacactggggaccaacaccaagttgggaacgaaagtacagaatacggaaccacggccacaataacaccacaagccccatcaactgaaatacaattaactgattatggagcactaacactagattgctcacctagaacaggattagatttcaatgaaatggtactcttgacgatgaaggagaaatcttggcttgtacataagcaatggttcttagacttgccgttgccctggacaagtggtgcctcgaccagccaagaaacatggaacagacaagatctgttagtaacatttaaaactgcacatgcaaagaaacaagaagttgtagtcctcggatcgcaagaaggagccatgcatacagctctaaccggtgcgactgaaatacaaacgtcaggaactacgactatttttgccggacatcttaaatgtagattgaaaatggataaattgacattaaaaggtatgtcttacgtcatgtgtacaggctcgttcaaactggaaaaagaggtagctgaaacacagcatggcacagtgctagttcagataaaatacgaaggaactgatgcaccttgtaagatccctttcagtacacaagatgaaaaaggagtaacgcaaaacggaaggttaataacagcaaatccgatagtaactgacaaggaaaaaccagttaacatagaagcggaaccgccctttggcgaatcatacatagtgatcggcgccggggagaaggctttgaaattatcctggtttaagaaaggttctagtattggtaaaatgtttgaagctacagcacgcggagcacgaaggatggctatattaggagacaccgcttgggattttggcagtattgggggtgtttttacgtcagtaggtaagctagtgcaccaaatttttggaaccgcatacggggtgttattttcgggggtttcgtggacaatgaaaatagggataggcgtacttctaacatggttagggctaaatagcaggagtacatcattaagcatgacgtgtattgcggttggcctagttactttatacttaggagtgatggttcaggctgatagtggatgcgtaatcaattggaaaggtcgggagctaaaatgtggatccggaatatttgttaccaatgaagttcatacatggactgaacagtacaaattccaagccgatagccctaaacgtttgagcgctgctattggcaaagcatgggatgagggagtatgtggaataaggtcagctacacgattagagaatataatgtggaaacaaatcagtaacgaattaaatcacatactactggaaaacgatatgaagtttacagttgtcgttggggacgttgctggtattctcgctcaaggcaagaaaatgatacgtccacaaccgatggagtacaaatactcatggaaatcatggggaaaagccaaaattataggagcagacgttcaaaacacaaccttcatcattgatggaccaaacaccccagagtgtccggatgaccaaagggcctggaacatatgggaagttgaagattatggttttggaatttttacaactaatatatggttaaaattaagggatagttacacgcaagtatgcgaccataggctaatgtcggccgctataaaagactctaaagcagtgcacgccgatatgggttattggatagagtcagagaaaaatgaaacatggaaattagcgagagccagctttatagaagttaaaacatgcatatggcccaaatcacacaccctttggagtaatggggtgcttgagagcgaaatgataattccaaaaatatatggaggaccaatttcacaacataactacagacccggctactttactcaaacagcaggaccgtggcacttgggaaaattagagctagattttaacttgtgcgaaggaaccacggtcgtagtggatgaacactgcggcaatcggggtccaagcctcagaacaacgacggttacaggtaaaataattcatgaatggtgttgcaggtcctgcacgttaccaccactgagatttaaaggcgaggacggttgttggtatggaatggagataagacctgtcaaagaaaaagaagaaaatctagtgaagtctatggtgagcgccggatccggtgaagtcgactctttttccctaggactcttatgcatatctattatgattgaagaggtcatgaggtctaggtggagtagaaaaatgttaatgacaggaacattagctgtgtttttcttactcattatgggccaattaacatggaatgacttgatcagactatgcataatggtcggcgcgaatgcctccgacaggatgggtatggggacaacttatctagccctgatggcgacctttaaaatgaggcctatgttagcagtagggctactattcagaagacttacgtccagggaagtgctcttattgacaatagggctctcactcgttgcttccgttgaactccctaatagtcttgaagaattgggcgacggtttagctatgggaatcatgattctcaagttgttgacagactttcaatctcaccaattatgggccacactgctcagtctaaccttcattaaaactacatatagtttgcattacgcttggaaaactatggcaatggtattatcgatagtatcattatttccactctgcctatcgacgacatcccagaaaaccacatggctacccgttctactaggctccctaggttgtaaaccattaactatgtttttaattgcagaaaacaaaatttggggaaggaaatcctggcctctaaacgagggaataatggcagtaggtatagtttctatcctcctttcctcattgctgaaaaacgacgttccattagctggtccattgatagcaggcggtatgctcattgcctgctacgtcatctcaggttcgagtgctgacctaagtttagagaaagcagctgaggtatcttgggaagaagaagctgaacattctggcgcctctcacaacatcctagtcgaggttcaggacgatgggactatgaagataaaggatgaagagagagatgacacgctaaccatattactcaaagcaacgctactggctgtttctggagtatatcctttaagtattcccgctactctcttcgtatggtatttttggcagaagaagaaacaacgtagcggtgtactctgggataccccatcacctccggaagtagagcgcgctgttctagatgacggaatctaccgaatcatgcaaagaggtttactaggccgttcccaagttggagtaggtgttttccaggagaatgtcttccatacgatgtggcacgtaacaaggggtgcggtattaatgtatcaaggcaagcggttggaaccttcctgggcaagtgttaagaaagacttaattagctacggaggcggatggaggctacagggaagttggaatacaggagaagaagtacaggttatagctgttgaacctggaaagaatcccaaaaacgtccaaacagcgccaggaaccttcaaaacctctgaaggagaggttggtgcgatagcattagacttcaagccaggtacgtctggatctccaatcgtcaaccgcgaaggtaaaattgtcggtttgtacggaaacggtgtagttacaaccagcggcacttatgtgtctgctatcgcccaggctaaagcatcacaagagggtccccttccagaaatagaaaatgaagtttttagaaaaagaaatctcacgattatggatttacaccctggaagtggcaagacacgacggtatctaccggctatagtacgtgaagctataaaaagaaaactacgtacgcttatactagcccccactcgagtcgtagcttccgaaatggctgaagctcttaaaggtatgccaataaggtaccagacaacagccgtcaaatcagaacacacaggcaaagagattgttgatttaatgtgccatgccacctttacgatgcgactcttaagcccggttagagttcctaattataatatgatcataatggatgaagcacatttcactgaccctagctcaatagctgcgcgtggttacattagcacaagagttggcatgggagaagcggcggctatttttatgacagcaacacccccaggcagcgtagaagcatttccacaatcgaacgcagtcatacaggacgaggaaagagatattcctgagagaagttggaactcgggttatgaatggattacagactttccaggtaaaacggtctggtttgtacctagcataaagagtgggaacgacatagctaactgtttgaggaaaaatggaaaaagggttatccaacttagtcgaaaaacatttgatactgaatatcagaaaacgaaaaacaatgattgggattatgtggtgacaactgatatttcggagatgggagcgaattttagagcggatagagtcatcgacccacgacggtgtctaaaacctgtgatactcaaagacggcccagaaagagtaatactagctggaccaatgccagtaaccgttgccagtgctgctcaaagaaggggtcgaataggccgaaatcacaataaagaaggtgaccaatacatatatatgggacagccgctaaacaacgatgaagatcacgctcattggaccgaagcaaagatgttactagacaatatcaatacaccagagggaatcatacctgcattgtttgaaccggaaagagagaaatcggcagccattgatggcgaatacaggctacgcggtgaggcgaggaaaacgtttgtcgaactcatgcgacgcggtgatttaccggtatggctttcatataaagtagcctccgaaggctttcaatattcggatcgtagatggtgctttgacggagagcgtaataaccaagtcttggaagaaaatatggacgttgagatatggactaaggagggagaaagaaagaaactaagaccccgatggttagatgcgagaacgtattctgatcctctagcattgagagagttcaaggagttcgcagccggtagaaaatctgtatcaggtgaccttatacttgagataggaaagttgccgcagcacctaacgcagcgtgctcagaacgccctagacaaccttgtaatgctacataactctgaacaaggaggaagggcgtacagacatgccatggaggaacttccagatacaattgagactctaatgctacttgcgttaatagccgtactaacaggaggtgtcaccctcttctttttatcggggcgaggactaggcaaaacctcgataggcttactttgcgtcatggctagctccgtattactctggatggcatcagtagagcctcattggatagcagcctcaataatcctagagttcttcttaatggtattattgataccggagcccgacagacaaagaactccacaggacaatcaacttgcctacgtagtcataggtctgttatttatgatattgacagtcgcggcaaacgaaatggggctcctagaaactactaagaaagatttaggaattggccacgtcgcagtagaaaaccaccatcacgccgcaatgttagatgtagacctacacccggcaagtgcatggacactatatgctgtagcgacgacaattataacaccaatgatgagacacactatagaaaatacaacagcaaatataagccttaccgcaatagcaaaccaagccgctatcttaatgggactagataaaggatggccaattagcaaaatggatattggagttccccttttagcattgggatgttattctcaagtaaatccacttacattgacagcggcagtgctaatgttagtcgcccattacgccattataggacctggtttacaggctaaagctactcgtgaggcgcaaaagagaactgcagcaggcataatgaaaaaccctacggtcgacggaattgtagctattgaccttgaccctgtggtatatgatgcaaaattcgaaaaacaattaggccaaataatgttactaatattatgtacatcgcaaattttgctaatgcgtacaacctgggctttatgcgagtcaattactctggcaaccggacctctaaccacgctatgggaaggcagcccaggaaaattctggaatacaactattgcggtaagtatggctaacatattcaggggttcttatttggccggagccggactcgctttctcgctcatgaaaagtttgggaggcggcagacggggaaccggagcccaaggggaaacactaggcgaaaaatggaaaaggcaactcaatcagttaagtaagtcagagttcaatacatacaaaagatcaggaattatggaagtagatagatcggaagcaaaggaagggttaaaaaggggtgaaacaactaagcacgcagtaagtcgagggactgcaaaattgagatggtttgttgagagaaatttggtcaagccagaaggaaaagtcattgatctcggatgcgggcgtggaggctggtcatattattgtgcaggccttaagaaagtaacagaagttaaaggttatacaaaaggtggcccaggtcacgaagaacccataccaatggcaacttatggttggaatttagttaaacttcattccggaaaggatgtattcttcatccctccagaaaagtgtgatacgttgctgtgcgatattggtgagtcttcgccaaacccgacaatagaggagggacgtaccctcagggtactcaaaatggtagagccatggttaagaggcaatcaattttgtatcaagatattgaatccgtacatgccatcagtagtagaaacccttgaacaaatgcaacgaaaacatggaggaatgctagtcagaaatccattatccagaaactcaactcacgaaatgtactgggtgagttgtggtacaggtaacatagtcagtgcagtgaacatgaccagtagaatgcttttaaacagatttacaatggctcaccgaaagccaacatatgaaagagatgtcgatttgggagccggaacacgtcatgtcgccgtagaacccgaagtcgctaatttagatataattgggcaaaggattgaaaatataaagcacgaacacaagagtacttggcactacgacgaagacaatccatataaaacttgggcataccacgggagttatgaagtaaaaccaagcgggtctgcctcaagtatggtaaatggagtagtcaagctattgacaaaaccctgggacgtaattccaatggtaacccagattgcaatgacggacacaacaccttttggccaacaaagagtgttcaaagaaaaggtcgatacacgtacccctaaggccaagagaggaacagcacaaataatggaagttacggctaaatggctatgggggtttctatctcgtaacaaaaagcctcgaatttgcacacgggaagaatttacacgcaaagtgcggtcaaatgccgcgattggagctgttttcgtagacgaaaaccaatggaactccgcaaaagaagcagttgaggacgaacgattctgggatctagttcacagagaaagagagctccataaacaaggcaagtgtgcaacttgcgtttacaacatgatgggaaaaagagaaaagaaacttggtgagttcggcaaagctaaaggaagccgagcgatttggtatatgtggctaggtgcacgatttttagaatttgaagcgctagggttcatgaacgaagaccattggtttagtagagaaaattccttaagtggggtcgaaggtgaagggctacataaattaggatacatccttagagatatatcgaagatccccggcggtaacatgtatgcggatgacacagccggatgggatacaagaataacagaagatgatttacaaaatgaggcaaaaataaccgacattatggaaccggaacacgctttacttgcaaaaagtatatttaaattaacatatcaaaacaaagtcgtaagagtacaacgccctgccaaaaatggcacagtgatggatgtaataagccgaagagaccaaaggggcagtggccaagtaggtacatatggtctaaacacattcacaaacatggaagcgcaattgattaggcaaatggaatcagaagggatttttagtccttcggaattagagacacccaatttagcaggaagagtgttggactggttagaaaaacatggagttgagagacttaagcgtatggccatatccggtgacgattgtgtggtgaagcccatagatgacaggttcgcaactgctctaacagcattgaacgatatgggaaaggtccgtaaggatataccccaatgggaaccgagtaaaggatggaatgactggcaacaagtgcctttttgttcacatcacttccatcagttaataatgaaggatggacgtgaaatcgttgtaccttgtagaaaccaagacgagttggtcggcagagcacgtgtaagtcaaggagctggatggagcctccgagaaactgcatgtctaggaaagtcctacgctcaaatgtggcaattaatgtatttccaccgaagagatcttcgcctcgctgctaatgctatatgttcagcagtaccagtagactgggtccctacatctagaactacatggtctattcacgcacaccatcaatggatgacgactgaggatatgctctctgtatggaaccgagtatggatagaagaaaatccatggatggaagataaaacacatatatcctcctggggtgatgtaccctatttaggaaaaagagaagaccaatggtgtggctccctaatcggtctaacagcccgggctacatgggcaacgaatatacaagttgcaataaatcaggtaagacgactaatagggaacgaaaattacttagactacatgacctcgatgaaacggttcaagaacgaatcagaccctgaaggtgcgctctggtaa

SEQ ID NO: 21492 - RNA, 9879 nt, synthetic construct
  misc_feature 1..9879: note = derived and/or modified CDS sequence (opt6) from DENV-1__FJ024472__SS-prME
  source 1..9879: mol_type = other RNA
tctgttacaatgcttttgatgttaatgccgacagcattagcgtttcatttaactactcgtggaggtgaaccgcacatgatagtttcaaaacaggaaagaggaaaaagcctgttgtttaaaacaagtgctggagttaacatgtgtacgctcattgcaatggatctgggcgaactttgtgaagacacaatgacgtacaaatgtcctcgaataaccgaaacagaacccgacgacgttgattgttggtgcaatgcgacagatacatgggtaacgtacggaacatgtagccaaacaggagaacatagaagagacaaacgatcagtggctttagccccacatgtaggtctgggcttagaaacaagaacagagacatggatgtcttcagaaggggcatggaaacaaatccagcgcgtcgaaacgtgggctctacggcatccaggctttacagtgatagccttatttttagcacacgctataggaacatccataacacaaaaaggtattatttttatacttctaatgctcgttacaccatctatggcgatgaggtgtgtaggtataggaagtagagattttgttgaaggtcttagcggagcaacctgggttgatgtagtccttgaacatggatcgtgtgtcactaccatggctaaagataaaccaacactggacatagaactgctgaaaacagaagtaactaacccagcagttttacgtaaactatgtattgaagctaagataagcaatactacaacagactctagatgccccacgcagggtgaagcgacgcttgttgaagaacaggacgcaaactttgtatgccggcgtacttttgtggaccgtggttggggcaatggatgcggacttttcggtaaaggatcacttatcacttgtgccaagttcaaatgcgtaacgaaactagaaggaaaaatagttcaatatgagaacctaaaatatagtgtaatagtgactgtccacactggcgatcagcatcaagtaggaaacgagtcaaccgaacatggaacgacagccacaatcacaccacaagcacccactacggaaattcaactaacagattatggtgctcttacattggactgcagtcctaggactgggttagattttaatgagatggtattactcacaatgaaggaaaaatcatggttagtacataaacagtggttcttggatcttcccctaccttggacttcaggggcatcaacaagtcaggagacgtggaaccgccaagatttattagtaacttttaagaccgcacacgccaagaaacaggaagtcgtcgtacttgggtctcaagaaggagcaatgcatactgcgttaaccggtgcgactgagattcagacctcaggcacaacaacaattttcgctggacacttaaaatgcagattaaaaatggataagctaactttaaaaggaatgagctacgtaatgtgtactggatcatttaagttagaaaaagaacttgcggaaacacaacacggcacagtcttagttcaaataaaatatgaaggtactgatgcaccatgcaaaataccctttagcacgcaagacgaaaaaggggttacacagaatggacggctaataacagcgaatcctatcgtaaccgataaagagaagccagttaatatcgaggcggaacctcccttcggagaatcgtacatagtaataggagcaggagaaaaggcattaaaactatcgtggtttaagaaaggaagtagtataggtaaaatgtttgaggcaaccgccagaggagcgagaagaatggcgatattgggtgacactgcctgggattttggcagtatcggaggagtgttcacaagtgttggaaaactcgtacaccaaatatttggtaccgcatatggcgtactattcagcggggttagctggactatgaagattggtattggtgtacttctaacttggttggggctaaacagtcgaagcacaagcctatctatgacctgtatcgctgtcgggcttgtaactctctatctaggagttatggtacaggcagactcaggttgtgttattaattggaaaggtcgagaattgaaatgcggatctggtatatttgtgacgaacgaagtccacacctggacagaacaatacaaatttcaagctgatagtcctaagagactatccgctgcagtaggtaaagcctgggaagagggagtatgcggtataaggtcagccacaagattagaaaacatcatgtggaagcagataagcaacgaactaaatcatattttattagaaaatgatatgaaatttacggttgtagtcggtgacgtagcgggtatcttagcgcaaggaaagaaaatgataagaccacagcctatggaatataaatattcttggaaatcgtggggtaaagcaaagattataggagctgacgtacaaaataccacattcataattgatggacctaatacacctgaatgtccagatgaccagagggcatggaacatctgggaagttgaagactacggctttggaatatttacaacaaacatatggcttaaattgcgcgattcgtatacccaggtgtgcgatcatcggttaatgtcggcggctattaaagactccaaggccgttcacgcagatatgggatattggatcgagtcagagaaaaatgagacatggaaactagctcgtgcgagtttcatagaggtaaaaacttgcatatggcctaagtcccatacattgtggtcaaatggagtactggaaagcgagatgataatccccaagatttatggtggcccgataagtcagcataattacagaccaggatacttcacacaaactgcaggaccatggcatttaggaaaacttgagctcgattttgacctatgcgagggcacaacagttgtggtagacgaacactgtggtaatagaggaccaagtctcaggacaactacagtaaccggtaagattatacatgagtggtgttgtagaagctgtactctaccgcctttaagattcaggggagaagacggatgctggtatggtatggaaataagaccagtgaaagaaaaagaagagaatctagttaagtcaatggtgtctgcagggagcggcgaagtcgattcgttcagtttaggtttactatgtatatcaataatgatagaagaagtaatgcgatcgcgatggagccgaaaaatgttaatgactggcactttggctgtgatatttctactaatcatgggtcaattgacatggaatgatctcataaggctatgtataatggtcggtgctaatgctagtgatcggatgggaatgggaaccacatatctagcattaatggcaacgtttaagatgcgccctatgttcgctgtaggattgttattccgaaggctcacatctagagaagtcctgcttctgacgataggtctgtcactcgtagcatcagtagagttaccaaattcactggaggaattaggtgacgggttagccatgggtataatgatcttgaagctactcactgatttccaatcccatcaactatgggctactttgttaagtttaactttcatcaaaactacatttagtttacactatgcatggaagacaatggcgatggttctttcgattgtgagtctcttcccactatgcttgtcaacaacgtcacagaaaactacatggctacccgtgctattagggtctctgggctgcaaaccacttacaatgtttcttattgctgaaaataagatttggggacgaagatcatggccactaaacgaaggtataatggcggtaggtatagtatctattttgctaagttcccttctcaaaaacgacgtaccactagcgggaccattaatagctgggggaatgctgatagcgtgctatgtgatttcaggatcaagtgcagatttgagtttagagaaagctgctgaagtatcttgggaagaagaggcggaacactcaggtgcatcacacaatatcctagttgaagtgcaagatgatggaacgatgaaaataaaagatgaagaaagagacgacacacttacgattctccttaaagcgacattgttagcagtttcaggcgtttacccactgagtattccagccaccctgttcgtctggtatttttggcaaaagaagaaacaacgatccggagtcctatgggatactcctagcccacctgaagtagaacgtgcggtactagatgacggaatctatagaatcatgcaacgaggactattaggtagatcacaagttggcgtcggtgtgttccaagaaaacgtattccacaccatgtggcatgttaccagaggggctgtactaatgtaccaaggcaaacgtctggagccatcttgggcaagcgttaagaaagacttaatatcttatggtggaggatggcgcttacaaggttcgtggaatacaggtgaagaagtgcaagttatagcagtagaacctggcaaaaatcccaaaaacgttcagacagcgcccggaacatttaaaacaccggaaggcgaggtaggagcaattgcattagattttaaaccggggacatccgggagtccaattgtaaatagagaaggtaaaatcgtaggcttatacggtaatggagtagtcacaacaagtggaacatacgtctcggcaatagcacaagctaaagccagccaagaaggacctttaccggaaattgaggatgaagtgtttaggaaaagaaacctaacaattatggatttacaccctggttcagggaaaacccgtcgataccttcccgcaatcgtgcgagaagcaatcaaacgcaagctaagaactctcatactagcaccaacacgtgtcgtggcttcagaaatggcggaggctctgaaaggtatgcctataagataccaaacaaccgcagtgaaatctgaacataccgggaaagaaattgtagacctaatgtgtcacgcgacattcacaatgagactattaagtcctgtaagagtgccaaattacaacatgataataatggatgaagcacactttacggacccgtctagtatcgcagccagagggtatatttcaacgagggtaggaatgggtgaagcagcagccatttttatgacggctactcctccgggttctgtcgaagcatttccccagtccaatgcagttatacaagatgaggagcgtgacataccagaacgcagttggaacagtggttatgagtggattactgactttccaggtaaaacagtatggtttgtccccagcatcaaatcaggcaacgacattgcaaactgtctgaggaaaaatggcaaacgtgtgattcaactaagtaggaaaacttttgacacagaatatcagaaaaccaaaaacaatgattgggactacgtggtaacaacagatattagcgagatgggtgccaatttccgagcagatagagtcattgatcctagacgatgcctaaagcctgtcatcttgaaagatggaccggaacgtgtcatcttggcaggaccaatgcctgtgacggtagcatccgcggcgcagagacgaggtaggattggccgaaatcataacaaagaaggagaccagtacatatatatgggacaacctcttaacaatgacgaagaccatgcgcattggaccgaagcgaaaatgttactcgacaacataaatactcccgaaggcataatacccgctctatttgaaccagaaagagagaaaagcgctgcaatcgacggagaatatcggctcagaggggaagcacggaaaacattcgtagagctcatgcggaggggtgatctaccggtgtggttgtcatataaagttgcatctgagggtttccagtattcagaccgacgctggtgctttgacggggaacgaaataatcaagtgttagaggagaatatggatgttgaaatttggactaaggaaggtgaacgcaagaaacttaggccgaggtggcttgatgcgcgcacctattccgaccctctggcattgcgggaatttaaagagtttgcggctggacgacgcagcgtttcgggcgacctaatactagaaataggaaaattaccacaacacttaacacaaagggcccaaaatgcactggataacttggttatgcttcacaattcggaacagggaggccgcgcatatcgtcatgccatggaagaattacctgatacaatcgaaactctaatgctactagccctgatagccgtattaaccggtggcgtgacattattctttctgtctggtagaggacttggaaaaacaagtatcgggttactttgtgtaatggcgagcagtgttttgctctggatggcaagcgttgaaccacattggatagctgcgtctataatactagagttctttttgatggtattactgataccagaaccagacagacaaagaacaccgcaagataaccaacttgcatacgttgtaataggtctactatttatgatactaacagtagctgctaacgaaatgggtttactagaaactactaagaaagatctcggaataggacacgtagctgtagagaatcaccatcatgcagcaatgttagatgtagacctacacccggcgagtgcgtggacactctatgccgttgcaaccaccattataacgccgatgatgaggcacacaatagagaatactacagcaaacatcagtctgacagcgatagcaaaccaagccgctatattgatgggattagataaaggttggccgatatctaaaatggatatcggcgtgcctcttttagctttaggatgctattcacaggtcaatcccctaaccttaacagccgccgtgttaatgctggttgcacactatgcaataattggcccaggactacaagccaaagcgacgcgtgaggctcaaaagcggactgcggccgggataatgaagaatccgacagtagacggtatagtggcaatagatctagatccagtagtgtatgatgcgaaatttgagaaacaactaggccagataatgctcctaatcctatgtacaagccaaatactcctgatgaggacaacgtgggcattgtgtgagagtataaccttagccacgggaccattaactactttgtgggagggttctccggggaaattttggaacactacaatcgcagtatccatggcaaatatatttcgaggctcatatttggcaggagcgggactagcattctctctgatgaaatccttgggaggaggcagacgaggtaccggggcgcagggagagaccctaggagagaaatggaagagacagcttaatcaattaagcaaatcagaatttaatacttataaaaggagcgggataatggaagtcgatcgatcagaagccaaagaagggttgaagcggggagaaacaactaaacatgcagtatcaagaggaaccgccaaactccgatggtttgttgaacgaaatctagtcaaacctgaaggaaaagtaatagatcttggatgcggaagaggtggatggagttattactgtgcaggcttgaaaaaggtgacggaagtaaaaggatacacgaaaggagggccaggacatgaggaaccaatcccaatggctacgtacggctggaatctggtaaaacttcacagcggaaaagatgtattctttataccaccagagaaatgcgacacgcttctatgtgatattggtgaatcttcacctaacccgacgattgaagagggtagaactctacgtgtcctaaaaatggttgaaccttggttgaggggcaaccaattctgtataaaaatacttaatccatatatgccttctgtcgtggaaacactagaacaaatgcaacgtaaacatggaggaatgttggtgcgcaacccattgtcgaggaacagcacacatgagatgtattgggtctcttgcggaactggaaatattgtttctgctgttaatatgacctcacgtatgctcctgaatcgattcaccatggcacatagaaaaccaacctacgaacgtgacgttgacttaggtgcaggaacaagacatgttgcagtcgaaccagaggtagcaaatttagacattattggtcagcggatagagaacatcaagcacgagcacaaatcgacttggcattacgatgaagataacccttacaaaacctgggcttaccatggaagttatgaagtaaaaccgagtggatcggctagttcaatggttaatggagtcgtgaaactactgaccaaaccatgggatgtgataccaatggtaactcaaatagcgatgaccgatactaccccttttggtcaacagagagtatttaaagaaaaagttgatactagaacccctaaagctaagcgaggaacggctcaaattatggaagtgactgcaaaatggctatgggggttcctctcaagaaataagaaacctagaatatgtactcgagaagaatttactaggaaagtacgatctaacgccgctataggcgctgtattcgtagatgaaaatcaatggaacagtgctaaagaagctgttgaagacgaaagattctgggatcttgtgcatagggaaagggaattacacaaacaaggaaagtgtgcaacctgcgtttataatatgatgggtaagagagagaaaaagttaggagagtttggaaaagcaaaaggtagcagagcaatctggtatatgtggcttggcgcgcgctttttagaatttgaagcactaggatttatgaatgaagatcattggtttagcagagagaactccctatccggtgtggagggggaaggattacataaattaggctacatactccgagatatcagtaaaataccagggggaaatatgtatgcagatgataccgcaggttgggatacacgcattactgaggatgatttgcaaaacgaggccaggattacagatatcatggaaccagaacacgcgctgttagcaaaaagtatatttaaactgacgtaccaaaataaagtcgtgcgcgtacaacgtccagccaaaaacggaaccgtgatggatgtgatttcaagaagagaccaaaggggaagcggacaagttggtacttatggcctaaacacattcactaacatggaagcacagctgatcagacagatggaaagtgaaggaatcttcagcccaagtgagttagaaacacccaacttagccgaaagagttcttgactggctggagaaatacggtgttgagagacttaaaagaatggcaatatcgggagatgattgcgtggttaaacctatagatgatagatttgcaaccgcattgaccgcgttgaatgacatgggcaaagtaagaaaagatatcccgcaatgggagccatcaaagggatggaatgattggcaacaggtgccattttgctcacatcactttcatcaattaattatgaaagacggacgagaaatcgtggtaccttgcagaaatcaagacgagctcgttggtagagcccgagtctcccagggcgcagggtggagcttaagagaaacagcttgcctgggaaaaagctatgcacaaatgtggcaactcatgtattttcatagaagggatctaaggttggccgcaaacgccatatgttctgccgtcccagtagattggattcctacctccagaacaacatggtcgatccatgcacatcatcagtggatgactaccgaagacatgctatcagtatggaatagagtttggatcgaagaaaatccctggatggaagataaaactcatattagttcgtggggcgacgttccatatttaggtaaacgagaagatcaatggtgcggaagtctaatcggtctcacagcaagagctacatgggctacaaatatacaggtggcaattaatcaggtaagacgcttgattgggaacgagaattacctagattacatgacgagtatgaaaaggttcaagaatgaatctgacccggaaggggccctttggtag

SEQ ID NO: 21493 - RNA, 9879 nt, synthetic construct
  misc_feature 1..9879: note = derived and/or modified CDS sequence (opt6) from DENV-1__FJ024439__SS-prME
  source 1..9879: mol_type = other RNA
agtgttactatgcttttaatgttgatgccgactgctctagcattccatttaacgactcgtgggggagagccgcacatgatcgtctcaaaacaagaaagagggaaatccctattgttcaaaaccagtgctggcgtcaatatgtgcactttaatagctatggacctaggtgaattgtgtgaggatactatgacgtacaaatgtccaagaataaccgaaacagagcctgatgatgtggattgctggtgtaacgcgaccgatacctgggtcacatacggtacttgctcccaaactggagagcatcgaagggataaacgctcggtcgccctagcacctcacgtcggattgggtctggaaaccagaacagaaacctggatgagtagtgagggggcttggaaacaaatacaaagagttgagacctgggccctgcggcatcctggttttaccgttatagcattgttcctagcgcatgcaattggtacaagtataactcagaaaggcataatatttatattactaatgttagtgaccccgtcgatggctatgagatgcgtcggtatcggctctagagactttgtcgaaggattgagcggagctacgtgggttgacgtagtacttgaacatggcagttgcgtaactacaatggcaaaagacaaaccgacccttgacatagaattacttaaaacagaggtaactaatccagcagtactacgaaaattatgtattgaagcgaaaataagcaatacaacaacagatagtcgctgtccgacacaaggtgaagcaacgcttgtagaagaacaagatgcaaacttcgtttgtcgaaggacatttgttgataggggttggggtaatggatgtggcctttttggtaaaggcagcctgattacgtgtgctaaatttaaatgtgtaacgaaattggaagggaaaattgtgcaatacgaaaacttaaaatattccgtaatagtaacagttcataccggtgatcagcaccaagttggcaatgaaagcacagaacacggaacaacagccacgataactccccaagctccgacaactgaaatacagctgacggattacggtgcattaacccttgattgtagtccaagaacaggattagattttaatgaaatggtactattgaccatgaaagaaaaatcttggcttgttcataaacaatggttcttggatttacccctcccctggacaagtggggccagtaccagtcaagaaacttggaatagacaagacttactcgtaacttttaaaacggctcatgccaagaaacaggaggtagtagtcttaggaagccaagaaggagccatgcacaccgcactaacaggagcaacggaaatacaaacatcaggcactaccactatatttgctggacacctcaaatgtaggttaaaaatggataagttaacactaaaaggaatgtcgtacgtaatgtgcacaggctcatttaaattagaaaaagaggtagccgagacccaacatggtactgtattagtacaaatcaaatatgaagggacagatgctccctgcaaaataccattttcaactcaagacgaaaaaggcgttacgcaaaatggacgtctaataactgcaaaccccatagtaacagataaagaaaaaccagtaaacattgaagctgagcctccgtttggagaaagctatataattataggagctggagaaaaagcgctaaaactgagttggtttaagaaaggatcatctattgggaaaatgtttgaggcaactgcaagaggcgcacgtcgaatggctatattgggtgacacagcgtgggactttggatcaatcggaggtgtttttacgtcagttggaaagctagtccatcaaattttcggtaccgcatacggtgtgctgtttagtggggtgtcatggacaatgaaaatagggataggagtgctcctgacatggctgggtttaaattcaagatctacaagttttagtatgacatgtatcgccgtcggactggttacactatacttaggggtcatggttcaagcagatagcggatgcgttattaactggaaaggccgggaacttaaatgcggcagcggaatctttgtgacaaacgaagtgcatacctggactgaacaatataagtttcaagccgactcaccaaaaaggttgagcgcagctattggtaaagcatgggaagaaggtgtttgcggtattagaagcgcaacaaggctcgaaaacataatgtggaaacagatttccaatgagctaaatcatatacttctcgaaaatgatatgaaatttacagttgtagttggagatgtggcgggtattttagctcaaggcaagaaaatgatcagaccacagcctatggagtacaaatattcctggaaaagctggggaaaagccaaaatcattggggcagacgttcaaaataccacttttataatagatggtccaaatacacccgaatgtccagatgaccagagagcttggaatatatgggaagttgaggattatggctttggaatattcacgacaaacatctggctaaaattaagggattcgtatacccaagtttgcgatcaccgattgatgtctgcggctataaaagacagtaaagcagtccacgcagacatgggttactggatcgaaagtgagaagaacgaaacatggaaattagcaagagccagcttcatagaagtaaaaacatgcatatggccaaaatctcataccctttggagtaacggagttttagagtctgaaatgattatcccaaaaatatacggcggaccaatctcgcaacataattatagacccggatatttcacacagacagcaggaccatggcatttaggaaaattagagctggacttcgatctttgcgagggaacaacagttgtcgttgatgaacactgtggaaacagaggaccaagtctacggactactacggtaacagggaagataatacatgagtggtgttgcagatcttgtacgctacctccactgcgcttccgaggagaggatggctgctggtatggaatggaaattaggcctgtaaaggagaaggaagaaaacttggtgaaatcgatggtaagtgcggggtccggagaggttgactccttctctcttggattattatgtatatctatcatgatagaggaagttatgcgttcaagatggtcgagaaaaatgttaatgacaggaacacttgcggtattctttcttctgataatgggccaactgacatggaatgacctaattaggttatgtataatggttggcgctaacgcttccgaccgtatgggaatgggcacaacatacctggcattgatggcaacctttaagatgaggccaatgttcgcggtagggttactattccgaagactaacctccagagaagtattgttactaaccataggtttgtcccttgtcgcctcagtagaactgccaaattcactagaagaattaggcgatggtcttgccatgggaatcatgatacttaaactattaacggacttccaatcacatcaactttgggcaactttactcagcttgacgtttataaagacaacattctctcttcactatgcatggaaaactatggcaatggtgttaagtattgtatctctcttcccgctgtgcttaagtacgactagccagaaaaccacatggctgccagtgttattgggatcccttggttgtaaacccctaacaatgtttttgatagctgaaaataagatctggggccgtcgtagctggcccctaaacgaggggatcatggctgtgggtatagtgtctattctcctatcaagtttgctaaagaatgatgtaccactagccggccccctcattgcaggaggtatgctcatagcatgctatgttattagcggatcttctgccgaccttagtcttgaaaaagctgctgaagtttcgtgggaagaagaagcagaacactccggagccagccacaatatacttgttgaggtccaagacgacggaacaatgaaaataaaagatgaagaaagagatgatacgctgacaattttgttaaaagcgacattactggcggtatctggcgtttaccccttatcgattcccgctactttgtttgtatggtatttctggcagaagaagaaacaacgttcaggagtcttatgggacacaccatctccacccgaagtcggtagagcagtattagatgacggaatttacaggatcatgcaacgggggcttcttggcagatcacaagtgggtgtaggggttttccaagaaaatgtattccacacaatgtggcacgtgactagaggagctgtactcatgtatcaaggaaaacggctcgaaccgtcatgggcgagtgttaagaaagatctgatatcatatggaggaggatggcgactacaaggttcttggaatacaggcgaagaagttcaagtgatagccgtcgagccaggaaagaatcctaaaaacgtacaaacagcgcccggaacattcaagacgcctgaaggggaggtaggagcaattgcattagactttaaaccagggacgtctggtagcccaatagtcaatcgtgaggggaaaatcgtcggactgtatggaaatggagtagttacaacatctggaacgtatgttagtgcgattgcacaagcaaaggcaagtcaagaaggaccgttgcctgaaatcgaagacgaagttttccgaaaaaggaatctgactattatggacttacacccaggtagtggaaagactagaagatacctaccagcaatagttcgtgaagcaatcaaaaggaaattaagaacgctcatactggccccgacaagggtagtggcttccgagatggcagaggcactaaaaggaatgccgattagatatcaaacgacagccgtaaaatccgaacatacagggaaagagatagttgacctaatgtgtcatgcaaccttcacaatgagattgttatctccagtgagagtaccaaattacaatatgatcattatggatgaagctcactttactgatccttccagcatagcggcccgtggctatataagcacacgagttggcatgggtgaagctgcagcaatattcatgactgctacaccaccaggttcagtcgaggctttccctcagagcaatgcagttatacaagatgaagaaagagatattcccgaaaggagttggaatagtggttatgaatggattacggatttccccggtaaaacagtttggtttgttccctctattaaaagtggtaatgatatagcgaactgtttgaggaaaaacggtaaacgtgttattcaactttctagaaagacatttgatacggaatatcagaaaacgaaaaataatgactgggactatgtcgtgaccacagatatcagtgaaatgggagctaatttcagagcagatcgagttattgatccaagacgatgtttgaaaccagtaattctgaaagacggccccgagagagtcattttagcgggtccaatgcccgtgacagtagcatcagcagcacaacgacgcggtagaataggcagaaatcataataaagaaggggaccaatacatatatatgggacaacctctaaacaatgatgaagatcatgcacattggaccgaggcgaaaatgttgttggataatattaatactccagaaggtataataccagcattattcgagccggaacgagaaaagtcagcagcaatagatggagagtacagactaagaggagaggcacgtaaaacatttgtggagctgatgcgtcgaggggacttgccagtgtggctatcttacaaggtcgcaagtgaaggtttccaatattcggataggcgatggtgttttgatggcgagaggaataatcaagtgctagaagagaacatggatgtagaaatatggactaaagagggagaaaggaagaaactaagacctcgttggttagacgcgcggacctattcagatccgcttgcgcttcgagaatttaaagaatttgctgccggaagaagaagtgtatctggggatctaatcttagaaataggaaaactcccacagcatttaacacaacgggcgcaaaacgctttagataatctagtaatgctccataatagtgaacaaggtggtagagcgtatcgccaagcaatggaagagttaccagatacaatagaaactctgatgctacttgcattaattgcagtattgacaggaggagtgacattattctttctcagtggacgagggctaggaaagacttcaattggattattgtgtgtaatggcgtcttctgtcctcttatggatggcttccgtggaaccacactggattgcagcttcaattatcttagagttctttctaatggtcttgttaataccggaaccagacagacagagaacacctcaggataaccaattagcatatgtcgtaataggattactctttatgatactaactgtagcggctaatgaaatgggtttactagaaacaactaagaaagacctagggataggtcacgtagcggtcgaaaatcatcatcacgctgctatgctggatgttgatttacatccggcatctgcatggaccttatatgcagtagcaaccactattatcactcctatgatgagacatacaatagaaaatacaactgctaatataagtttaactgcaattgcaaaccaggccgccatcttaatgggtttagacaaagggtggccaatttcaaaaatggacatcggtgtgccactcttggccttggggtgctactcacaggtgaatccactgactttgacagctgcagtactcatgcttgtagcacattatgcaattataggacccggactacaagcaaaagccacaagagaagcacaaaagagaacagcggcaggcattatgaagaatccgacagtagatggaatcgtagcaatagacctagacccggtggtctatgatgcaaagtttgaaaagcaactcggacaaatcatgctattaatcctgtgtacaagtcaaatcttgttgatgcgaactacctgggcattgtgtgaaagtattacattagcaacaggtccgttgactacattatgggaaggaagtccaggtaaattttggaatactactattgcggttagtatggcgaacatattccgcggcagttacttagcaggagctggtttagcttttagcctcatgaaatcactaggcggaggacgacgtggtacaggtgcccaaggtgaaaccttaggtgaaaaatggaaaaggcaactaaatcagttaagtaaatcagaatttaacacctacaagcgatcaggaataatggaagtagatagatcagaagcaaaagaaggattaaagagaggagaaacaacgaaacacgcagtttcacgaggtacagcgaaactgcgttggttcgttgaaagaaatctcgtcaaacctgaaggtaaggtcatagatttaggctgcggccgtggcggatggtcctactattgtgctgggctcaagaaagtcacggaggttaaaggttacactaaaggaggaccgggccatgaggagccaatacccatggcgacgtatggatggaacttggtcaaactccatagcgggaaagatgtatttttcataccacctgaaaaatgtgatacattgttgtgcgacataggagaaagctcaccaaatccaactattgaagaaggacgaaccctccgagtgttgaagatggtggaaccatggttaaggggtaaccaattttgcataaaaatacttaatccctatatgcctagtgtagttgaaacactagaacaaatgcaacgtaaacatggcgggatgcttgtacggaatcctttatcaagaaattcaacccacgagatgtattgggtgtcttgcggcacaggtaatattgtaagtgcagttaatatgacatctagaatgctactaaaccggttcacaatggcacaccggaaaccaacatatgagagagatgtagacctcggagcaggaacacgtcatgttgccgttgaaccggaagtcgccaatctcgacataatagggcaaaggatcgaaaatatcaaacacgagcataaaagtacatggcattatgacgaagataatccctacaaaacatgggcatatcacggaagctacgaggttaagccaagcggaagcgcctcgtcaatggtaaacggtgtggtaaaacttttaacaaagccatgggacgtaatcccaatggtcactcaaattgccatgacagatacaactccatttggtcaacaaagggtattcaaagaaaaggtggacacgagaactccaaaagccaaacgcggaactgctcaaatcatggaagtaaccgcgaaatggctatggggcttcctcagtaggaataagaaacctcgtatctgtacaagagaagaatttacacgaaaggtcaggtctaacgctgctattggagcggtattcgtagacgagaatcaatggaatagcgcaaaagaggcagtagaagacgaacgattttgggatcttgtccatcgagaaagagaactacataagcaaggaaaatgtgctacttgtgtatataacatgatgggaaagagggagaagaaattgggtgaatttggaaaagctaaaggtagtcgagccatatggtacatgtggctgggggcacgatttttagagtttgaggccttgggtttcatgaacgaagatcactggttcagtcgagaaaactcattatctggagttgaaggggagggattacataagctcggatacatcttacgcgacatttccaacattcctggcggtaatatgtatgctgatgatactgcagggtgggatacaagaataacagaggatgacctgcaaaacgaggccaggatcactgatatcatggaacctgaacatgctcttttggctaaatcaatttttaaattaacatatcaaaacaaagtagtgagagtacaaaggccagccaaaaatggaacggttatggatgtgattagtcgacgcgatcaaagaggtagtgggcaagtaggaacttacggattaaatacatttacgaacatggaagcgcaactgataagacaaatggagtccgagggaatatttagcccatctgaattagaaaccccaaatctagctgaaagagtacttgattggcttgaaaaatacggggtagaaagattgaagaggatggcaataagtggagatgattgtgttgtaaagccaatagatgataggttcgcgacagctcttacagcacttaatgatatgggaaaagtcaggaaagacatccctcaatgggaaccatctaaaggctggaatgattggcagcaagtccctttctgctcacatcacttccaccaactaatcatgaaagacggccgtgaaatagtagtgccttgccgcaaccaggacgagctagtaggacgagcacgggtttctcagggggctggatggtcacttagagaaacagcttgtttgggaaagtcgtatgcacaaatgtggcagctgatgtactttcatagacgtgatttaagactcgccgcaaacgcaatatgtagcgccgttcctgtagattggattccaacttcacggactacctggagtatacatgctcaccatcaatggatgacaactgaagatatgttatcggtttggaatcgggtttggatcgaagagaacccatggatggaggataaaacacatatctcgagttggggcgatgtaccataccttgggaaaagagaagatcaatggtgtgggagtttaattggtctcacggcgcgtgccacatgggcaactaacatacaggttgcaataaatcaagttcgacgcttaataggtaatgaaaattacctagattacatgacctcaatgaaaagatttaaaaacgagagtgatccggaaggtgctttatggtga

SEQ ID NO: 21494 - RNA, 9879 nt, synthetic construct
  misc_feature 1..9879: note = derived and/or modified CDS sequence (opt6) from DENV-1__FJ024441__SS-prME
  source 1..9879: mol_type = other RNA
agtgtaactatgttactgatgcttatgcctacggcgttggcattccacctaacgactcgaggaggggaaccccacatgattgtaagtaaacaagaaagaggtaaatcactattattcaaaacaagcgccggagtcaatatgtgtactctcatagctatggatcttggagaattatgtgaagacactatgacctataaatgtccgcgcataactgaaactgaaccggacgatgtagattgctggtgcaatgctacggatacatgggtgacctacggaacctgttctcaaacgggagaacatcgtagagacaaacgaagtgtagcattagcacctcatgtcggattaggactcgaaacgcggacggaaacatggatgtcaagtgaaggtgcttggaggcaaatacaacgagtagagacatgggcactcagacatcctggatttaccgtaattgcattatttttagctcatgccataggtacatctataacacaaaaaggaatcatctttatactgttaatgcttgtaacaccctcaatggctatgcgatgtgtagggattggctcgcgagatttcgtagagggcctctctggagccacatgggtcgatgtagtactggaacacggttcttgtgtcactacaatggccaaagataaaccaacgctggatatagaactactcaaaaccgaagtgacgaatccagcagtgttaagaaaattatgtatagaagcgaaaatatcaaacactactacagactctagatgtcctacccaaggtgaagctaccctagtagaagaacaggacgcgaatttcgtttgtcgacgaacctttgtagaccgcgggtgggggaacggatgtggtctattcggaaaaggtagtttaataacttgcgcaaaattcaaatgtgtcactaaactagaagggaaaatcgtccagtatgagaatttaaaatacagtgttatagttactgttcacacaggagatcaacatcaagttggaaacgagagtacggaacatggtacaaccgctacgataacacctcaagcaccaactaccgaaatacaattgacagactatggagcactaactcttgattgtagtccaagaacaggactggactttaatgagatggtattattgacaatgaaagaaaaatcatggctcgttcataaacaatggtttttggacttacccctcccatggacgtcaggagcctcgacaagtcaggaaacttggaatcgacaagatctgctggtgacttttaaaactgctcatgcaaagaaacaggaagtagtagtacttgggtctcaagagggcgcaatgcacactgctctaactggcgctacggaaatacaaacaagtggcacaactactatatttgctggacacttaaaatgtagattaaaaatggataaacttacattaaaaggaatgtcttatgtaatgtgtacaggatcctttaaactagaaaaagaagtggctgaaacgcaacatggaactgtattagtacagatcaaatatgaagggacagacgcaccctgcaaaatacctttttccactcaagacgaaaaaggagttacacagaatgggcggttaataacagcaaatcctatagttacagacaaggagaagccagttaatatagaagcagaaccacccttcggagaaagctatataacaataggtgcgggagaaaaggccttgaagctctcgtggttcaagaaaggcagcagcatcggaaaaatgtttgaagcaacggcaagaggagcgagaaggatggctatcctaggtgatacagcctgggatttcggttcgataggaggagttttcacgtcagtaggaaaattagtacatcagatatttggaacggcctacggagtattattttctggagtatcatggacaatgaaaattggaatcggagtattattgacatggctcggtctcaactcaagaagtacaagcctatcaatgacttgcatcgcggtgggacttgtgacattatatcttggggttatggtccaggcagattctggatgcgttattaactggaaaggacgtgagttaaaatgtggttcaggtatattcgtaactaacgaggtacatacatggacagagcaatataaatttcaagccgattcgccgaaaagactgtcagcagctatagggaaagcatgggaagaaggagtgtgtggtatccggtcagcaacacgattggaaaacataatgtggaaacaaattagtaacgaattgaaccatattcttctcgaaaacgatatgaaatttactgtggtagtaggcgacgtagcaggtatactcgctcaaggcaagaaaatgatcaggccgcaaccaatggaatacaaatactcttggaagtcatggggtaaggctaagataataggagcagatgtacaaaatacaaccttcataattgatgggcccaatacgccagagtgcccagatgaccaaagagcctggaatatttgggaagttgaagattatggattcggaatctttacgaccaacatatggctaaaattacgcgattcatacactcaagtatgtgatcaccgtctaatgtcagccgctatcaaggatagtaaagcagtacacgcagacatgggatattggatagaaagtgagaaaaatgaaacctggaagttggctagagccagtttcattgaagtaaagacatgtgtatggcccaaaagccatacactctggtcaaatggagtgctagagtccgaaatgattatacctaaaatatacggtggcccaatctcacaacataattataggccaggctattttactcaaacagccgggccgtggcatttagggaagttggaactagacttcgacttgtgtgaaggaaccactgtcgtagtagatgaacattgtggaaaccgggggccaagtctacgtaccacaacagtcacaggtaagataatacatgaatggtgttgtagaagctgcacactaccacccttaagatttcggggtgaggacggttgctggtacggaatggaaataagacccgtgaaagaaaaagaagagaatttggtaaaaagtatggtaagtgctggatcgggtgaggtcgattcattctctctcggcttattatgtatcagcatcatgatcgaggaagtgatgagatcaaggtggtcaagaaagatgttaatgacaggaacactagcagtattctttttattaataatgggacagcttacatggaatgatctaataagactatgtattatggttggtgcaaacgcaagtgacaggatgggtatgggtacaacatatttagctctaatggcgacattcaagatgcgtccaatgtttgcggttgggctattattcagaagactgacatcaagggaagtgctattactcacaatcggtttatcccttgttgcatcagtcgaactacccaattccctggaagaattaggggatgggctggccatgggtataatgatattaaagctgctcactgactttcaatcacaccaactttgggcaactcttttatcgctcaccttcataaaaacaacatttagtctccattacgcatggaaaacaatggctatggtcctatcaatagtgagtctctttccgttatgtttatcaacaacaagtcaaaagaccacttggttacctgtgttgctaggatcattaggatgtaagccattgactatgttcctaatcgccgaaaataaaatatgggggagaaggagttggcctttgaatgaaggaatcatggctgtcggaatagtttcgatcctacttagctcactgttgaaaaatgacgtacctctagccggtcctcttatagccggagggatgctcatagcttgttatgtaatcagcggttcatctgcggacctgtcactcgaaaaagccgcagaggtaagctgggaggaagaggccgaacatagcggagcatcccataatatcctcgtagaagtgcaagatgatggtacgatgaaaataaaagatgaagaaagagacgacacgctcacaattctactaaaagcaacattactcgcagtaagcggcgtttatccacttagtataccagcgacactttttgtatggtatttttggcagaagaagaaacagcggtcaggagttttatgggacacaccttctcccccggaagttgaacgtgcagtcttagacgatggaatatatcgtattatgcagcggggcttgcttggccgcagccaagtaggagttggagtgtttcaggagaatgtcttccacacaatgtggcatgtaaccagaggagctgtactaatgtaccaaggaaaacgacttgaacctagttgggcgagcgttaagaaagaccttataagttatggtgggggatggaggctccagggcagttggaatacgggtgaggaggtccaagtgatagccgtagagccaggtaagaaccccaaaaacgtgcaaacagcacccggaacatttaaaactccagaaggagaagttggggcaatcgctctcgattttaagcctggtaccagtggatcaccaatcgttaaccgcgaggggaaaatcgttggtttatacggtaatggcgtcgtaacgacgtcaggaacatatgtgagtgcaatagcgcaagctaaagctagccaagagggacctttacctgaaattgaggatgaggtattcagaaaaaggaacttgactattatggacttacatccaggtagtgggaaaaccagaagatatcttcctgccatagtcagggaggcaataaaaagaaaattaagaactcttatactagcgccgacaagagttgttgcaagcgaaatggcagaggctttaaagggcatgccaatacgttaccaaactactgcggtaaaaagcgaacataccgggaaggaaattgtagacttaatgtgtcacgctacatttactatgagattattaagcccggtcagagtaccgaattataacatgattataatggatgaagcccatttcacagatccatcttctattgccgccagggggtatatctctacgagagtaggaatgggtgaagccgcagccatttttatgacagcaacaccgccaggctcggtggaggcttttccgcaatccaacgcagtaattcaagatgaagaaagagacataccagaacgttcatggaacagcgggtacgaatggattaccgacttcccgggtaaaacagtttggtttgtaccatccataaaatctggaaatgatattgccaattgcttaaggaaaaatggtaaaagagtgatacaattatctaggaaaacgtttgatactgaataccagaaaactaaaaacaatgattgggactacgtggttaccacagacatatccgaaatgggggccaattttagagcggatagggtcattgacccccgcagatgcttaaagccagtaatactcaaggatgggccagaaagggtgatattagctggcccgatgcctgttacagtagcatccgcggcccaaagacgaggtagaattggccgaaaccataataaagaaggggatcaatatatatatatgggacaaccattaaataatgacgaagatcatgcccactggaccgaagcgaagatgcttttagataatatcaatacaccagaaggaataatacccgcattgttcgaaccggaaagggaaaagtcagctgccatagatggagaatataggctcaggggagaagccagaaagacgttcgtagaattgatgagaagaggagatctaccagtgtggttatcatataaagttgcatctgaagggttccaatatagtgacagacgatggtgttttgatggtgaacgcaacaatcaagtgttagaagaaaacatggatgtagagatttggactaaagaaggggagcgaaagaaattacgtcctaggtggctcgatgcaagaacctattctgatcctctagctttaagagaatttaaagagttcgctgcaggtaggcgttccgtcagtggtgatctaatattggaaataggaaaactacctcaacacttgacacaaagggctcaaaacgctttagataatctcgtaatgctccacaatagcgagcaaggaggcagagcgtatcgccatgcaatggaagagttaccagatacaatagaaacattaatgctgttggcactgattgcggtgctcactggaggagttacgttattctttttatcaggacgtgggttaggaaagacaagtataggactcctttgtgtaatggcaagctcggttcttctatggatggcaagtgtcgagccacattggattgcagcaagtataatccttgaatttttcttgatggtcctcctgatccctgaaccggatcgacaacgaacgccacaagataatcagctagcatacgtagtaataggccttctctttatgatattaacggtagcagcaaacgaaatggggctactggaaacaactaagaaagatctgggtattggccatgtcgccgtagagaatcaccatcacgcggctatgttagacgtcgatctacaccccgcttctgcctggacgttatacgcagtagctacaacgataataacaccaatgatgagacacaccatagaaaatactacggcaaatatatccttaacagctattgcaaaccaagcagcaattttaatggggttggataaagggtggcccatatctaaaatggatataggcgtccccttactagcattgggctgttattcccaagtaaatcctctaacattaacagctgctgtgctaatgctagtagcccactatgcaataataggacctggcttacaagcgaaggctacccgtgaggcacaaaaacgaacggcagcaggaattatgaaaaatccaacagtggatggaatagtagcaatcgatctagacccggtcgtatatgacgctaagtttgagaaacaattaggacagataatgttattaatactatgtacaagccaaatacttctgatgaggacaacatgggcgctatgtgaatcaataactttagcgactggccctttaactactctgtgggaaggtagtccaggaaaattttggaatacgactatagcagtgtcaatggctaatatttttagagggtcatatttagcaggagcaggccttgcattttctttaatgaagtcacttggtggaggtagacgcgggacaggcgcacaaggtgaaactttaggagagaaatggaaaaggcagctaaatcaattaagtaaaagcgaatttaacacttacaagcgaagcggcataatggaggtagaccgaagtgaagcgaaagaaggacttaaacggggagagacgaccaaacatgccgtatcacgaggcactgcaaaattgcggtggtttgtagaacgtaaccttgtaaagcctgaaggaaaagtaatagatctcggatgtggaagaggaggatggtcgtattactgtgccggcctcaagaaagttactgaagtaaaggggtacacaaaaggtggacctggacatgaagaaccaataccgatggctacctacggatggaacttggtgaaattacactccggaaaagacgtattctttataccacctgagaaatgcgatacattactatgtgacataggagagtctagtcccaatccgacgattgaagagggacggacgcttagagtcctaaaaatggtagaaccctggctcagagggaatcaattctgtattaagatattaaatccatatatgcctagtgtggtggaaactctagagcaaatgcagcgtaaacatggaggcatgctagtgagaaatccgttaagtcggaactcaacacatgaaatgtattgggtttcctgtggtacaggaaatatcgtatctgctgtaaatatgacatcaagaatgctgttaaatcgattcacaatggcccacagaaaaccaacatacgagagagacgtagacctgggagcggggacaagacatgtagcggttgagccagaggttgccaacttggatataatcgggcaaagaatagagaacataaagcatgagcataaatctacatggcactatgatgaagataatccctataagacctgggcataccatggcagttatgaagtaaaaccgagtgggtcagcctcaagtatggtaaatggtgtggtgaaattactgacaaaaccttgggacgtgattccgatggttacgcaaatagcgatgacagatacaacaccttttggccaacagagagtattcaaagaaaaagtcgatacgcggactccgaaagccaaaagaggaacagctcaaattatggaagtcaccgctaaatggctttggggatttctctcccgcaataaaaagccgcgtatttgcactagagaagaatttacaagaaaagttaggagtaatgcggcaataggagcagtttttgtagatgaaaatcaatggaacagtgccaaagaggccgtagaagacgaaagattctgggatttagtacacagagaaagagagttgcataaacaagggaaatgtgctacatgcgtctataacatgatgggcaaaagggaaaagaagttaggtgagttcggtaaagctaagggttcaagagctatatggtacatgtggttaggtgcaagatttctagagttcgaagccttaggcttcatgaatgaagatcattggttctccagagaaaacagcctctcgggagtcgaaggagagggattacataaattaggctatatactccgggatatttcaaaaattcctgggggaaacatgtacgccgatgacacggccggttgggatacaaggatcacagaagatgatctacagaatgaagcaagaataactgatatcatggaacctgaacatgcactgcttgcgaagtcaatctttaaattaacatatcaaaataaagtggtccgggtacaaaggcctgcaaagaatgggacagtgatggacgtaatatcaagaagagaccagcgcggttcaggccaagtcggaacatatggactcaacacctttacaaatatggaagcacaattaattagacaaatggaaagcgaaggtatcttcagtccgtccgagttagaaactccaaacctagcggaacgagtattagattggcttgaaaaatatggcgtcgaaagattaaagagaatggccatatctggagacgattgtgttgtgaagccgattgatgataggttcgcaacagctcttacggcactgaatgacatgggtaaagtgcgtaaggatatcccccaatgggaaccaagtaagggatggaatgactggcaacaagtacccttttgctcgcatcatttccatcaactaataatgaaagacggtagagaaattgtggttccttgcaggaaccaagatgagctagttgggcgcgcacgcgtatcccaaggagctggctggagtttacgagagacagcatgtttaggtaaaagttatgcccaaatgtggcaactaatgtactttcatagaagggatctacgactggctgcgaacgccatatgttcagccgtgccagtagattggatacctacctcaagaacgacgtggagcattcatgcacatcaccaatggatgacaacagaagatatgctatctgtatggaatcgagtctggatagaagaaaatccgtggatggaagacaaaacccacatatcatcgtggggagatgtaccctatctaggtaaaagagaggatcaatggtgcggaagcctgattggactaacggctagagccacatgggctactaatatccaagttgccatcaaccaagtaagaagactaatcggaaatgaaaactatttagactatatgacctccatgaaacgattcaaaaacgagtcagatccagaaggagcgttatggtaa

SEQ ID NO: 21495 - RNA, 9879 nt, synthetic construct
  misc_feature 1..9879: note = derived and/or modified CDS sequence (opt6) from DENV-1__FJ024442__SS-prME
  source 1..9879: mol_type = other RNA
agcgtaactatgctactaatgctaatgccaactgctctcgcattccatttaacaacgcgcggcggagaacctcatatgatagtctcaaaacaagaacgaggcaaaagtttgctatttaaaacatccgctggtgtaaatatgtgcacactaattgcaatggacttgggtgaactttgtgaagatacaatgacgtacaaatgtccaagaataacggaaacggaacctgacgatgtagactgctggtgcaatgctacagacacatgggtaacgtatggaacctgtagtcaaaccggtgaacatagaagggataaacgctcagtagcactagcgccccacgtaggcctgggtttggaaacccggaccgaaacatggatgtcaagtgaaggagcatggaagcaaatacaaagggttgaaacatgggcattacgtcatcctggtttcacagtgatagcactcttcttagcacacgcaataggaacatcaatcactcaaaaaggaataatattcatcctactgatgctcgttacaccaagtatggctatgagatgcgtaggtatcggctctcgggatttcgtagaagggctatcaggcgcaacatgggtagacgtggtcctcgaacacgggagctgtgtaacgacaatggcaaaagataaaccgacattagacatagaattattaaaaacagaagtcacaaaccccgcagtactccggaaactatgtattgaagccaaaataagcaacaccactaccgactcacgatgcccaacacaaggagaagccactctcgtagaagaacaagacgcaaactttgtatgtcgaagaaccttcgtagacagaggatgggggaacggttgtggactgtttgggaaagggagtttaataacatgcgcaaaatttaaatgcgttactaaactagaagggaaaatagtacaatatgaaaatttaaaatattctgtgattgtcacagtacacaccggagatcaacatcaggtaggtaacgaatccacagaacatggtacaaccgcgactataacgccgcaagcaccaacgaccgaaatacaacttactgattatggagcattaacccttgactgctccccacgtaccggtctagatttcaatgaaatggtactactaacaatgaaagaaaaatcatggttagtacacaaacaatggttcctagatttaccattaccatggactagcggcgcctcaacgagccaagaaacatggaatcgacaggatctattagtaacgttcaaaacggcgcatgcaaagaaacaagaagtagtagtcttaggcagtcaagaaggggctatgcatacagcccttaccggagctacggaaatacaaacaagtggaacaacgacaatattcgccggacatttaaaatgcagactgaaaatggataaattaacgttaaaaggaatgagctacgtaatgtgcactgggtctttcaaactagaaaaggaagtcgcggaaacacagcacggaacagtcctagtccaaataaaatacgaaggtaccgatgctccatgtaagatcccgttttccacacaagatgaaaaaggagttacacaaaatgggcgtttgattactgcaaatccaatagtcacggacaaagagaaaccagttaacattgaggctgaaccaccattcggtgagtcctacataataataggtgcgggagaaaaggctctcaaactctcatggtttaagaaaggatccagtattggtaaaatgtttgaagccactgcgcgaggagctagaagaatggcgattttgggtgatacagcctgggattttggcagtattggaggagtctttacgtctgttggaaaattagtccaccagatatttggcaccgcttatggggtattattctcgggggttagctggaccatgaaaattggaattggagtattgctaacatggttaggattaaattcacgctcaacaagtctaagcatgacatgtattgctgttgggttggtaactttatatttgggagttatggtgcaagctgactcaggctgtgtaataaactggaaaggtcgagaacttaagtgcggttctggcatatttgtaactaatgaagtacacacgtggacagaacaatataaattccaagcagactcaccaaaaagattaagtgccgcaatcggtaaggcgtgggaagaaggagtctgtggcatacgctccgctacaagattagaaaacataatgtggaaacaaatatcaaatgaacttaatcatatattgctagaaaatgatatgaaattcactgtggtcgtaggcgacgtggctgggatactagcacagggcaagaaaatgatcagaccgcaaccaatggaatacaaatacagctggaaatcctggggaaaagcaaagatcatcggcgcggatgtacaaaacaccacttttattatagatggccctaacacaccagagtgtcccgacgatcaacgtgcctggaacatttgggaagtagaagattacggattcggaatattcacaactaacatatggttaaagctacgtgattcatacactcaagtgtgcgatcaccgccttatgagtgccgccatcaaagatagtaaagccgttcacgccgacatgggatactggatagaatcagagaaaaatgagacatggaaattagcccgagccagttttattgaggtaaaaacttgtatttggccaaaatctcatactttatggtccaacggggtattagagagtgaaatgataataccaaaaatttacggagggcccataagccagcataattatagacctggatactttactcaaaccgcagggccttggcatctaggcaaattagagttagatttcaatctatgcgaaggtaccaccgtggttgtagacgagcactgcggaaaccgaggtccaagtctaagaactaccacagtaacgggcaaaataatacacgaatggtgctgccggagctgcacgttaccacctttacgctttcgtggagaagacggttgttggtatggaatggaaataagaccagtaaaagagaaagaagaaaacttagtgaaatcaatggtttctgcaggatccggagaagttgatagcttcagtttgggcctactatgcattagtattatgattgaagaagttatgcggagtagatggagtcgaaaaatgcttatgactggtacactggcagtattctttctattaataatgggacaactaacctggaacgacctcataagactttgtattatggtcggggcaaatgcttctgacagaatgggtatgggaacgacatacctagccttaatggctacattcaaaatgcgcccaatgtttgcagttggacttttgtttcggaggctaactagcagagaagttttattactaacgatagggttatcgcttgtagctagcgtcgaactccctaatagcttagaagaattaggtgatggtttagcaatgggcatcatgatattaaaactgttaacagacttccaaagtcatcagctatgggcaaccctattatctctaacatttattaaaacaactttctctttacactatgcatggaaaacaatggcaatggttctatcaattgttagcttgttcccattatgcctttctacaacaagccagaagactacctggttacctgtactgctaggctcgctcgggtgcaaacccctaacaatgttcctaatcgctgagaataagatttggggaagacgtagttggccgctaaatgaaggcattatggcggtaggaatagtttcaatacttcttagcagcctactcaaaaatgacgtacccttagcaggtcctttaattgccggtgggatgctcatcgcatgctacgttatcagcggttcaagtgcagatctatcattagagaaagcagcagaggtttcctgggaagaagaggctgaacatagtggagcgtcccataacatattagttgaggtccaagacgacggcaccatgaaaatcaaagacgaagaaagagatgacacgctaactattttactgaaagccacgctactcgctgtcagtggggtttatccactctcaatacctgcaaccctcttcgtctggtacttctggcagaagaagaaacagcgatctggagtgctatgggatacaccatctcctccagaagtggaaagagccgtattagatgatgggatatacaggataatgcaaaggggacttttaggccgaagtcaggtaggggtgggcgtctttcaagagaacgtttttcatacaatgtggcatgttactcgtggtgcagttctgatgtaccaaggaaaacgtcttgagccaagttgggcatctgtaaagaaagatttaattagctatggtggtggttggagactccagggctcatggaatactggagaagaagtccaagtcatcgcagtagaacccggtaaaaatcctaaaaatgtacaaactgcacccggtactttcaagacaccggaaggcgaagttggggcaatcgcgctcgacttcaaaccaggtacttctggcagtccgatcgttaatagagaaggcaggatagtaggtctatacggtaacggtgtcgttaccacaagtggaacatatgtatcagcaatagcacaggctaaagctagccaagagggcccactccccgaaattgaagacgaagtttttcgaaagagaaatctaaccataatggacctgcacccagggtcaggcaaaacgcggagatacctaccagctatcgttagagaagcgattaaaagaaagttacgaaccctaatacttgctccaactcgtgttgtagcaagcgaaatggccgaagcattaaaggggatgccgatccgttatcagaccacagcagttaaatcggaacacactggaaaagaaatagtcgatttaatgtgccatgcaactttcacgatgagattactaagtcccgtacgtgttccaaattataacatgattataatggatgaagctcatttcacggatccttcgtcaatagcagccaggggctacatttcaactagagtgggtatgggggaagctgcggcgatatttatgaccgctacgccacccgggtccgtagaagcatttccacaaagcaacgccgtcatccaagacgaggaacgtgacataccagaaagaagctggaacctgggttatgaatggattactgacttcccgggtaaaactgtatggtttgttccttcgataaaaagcggcaatgatatagccaattgtctccgaaagaacggaaaaagagtgattcaattaagtcggaaaacatttgacacagaataccagaaaactaaaaataacgattgggattatgtagtaacgacagacataagtgaaatgggagcaaattttcgagctgatagagtcatcgatcctcgacgttgccttaaaccagtcatactgaaggacgggcctgaacgagtcatcttagcgggtcccatgcccgttacggtcgcgtctgccgcacaacgccgcggacgaattggaagaaaccataataaagaaggcgaccaatatatatacatgggacagcctctaaataacgatgaagatcatgcccactggacagaagcaaaaatgctattagataacataaacacccccgaagggataatacctgcgctattcgaaccagagagggaaaaatccgcagctatagacggggaatacagattacggggagaagctaggaagacttttgttgaattaatgagaaggggtgatcttccggtgtggctatcctacaaggtcgcatcagaaggttttcagtattcggatcgacgttggtgttttgatggagaacgaaacaatcaagttttagaggaaaatatggatgttgaaatatggacaaaagagggcgaacgaaagaaacttcgtcctagatggttagacgcgagaacctactcagacccacttgctttacgagaatttaaagaatttgcagccgggcgccggtcagtatcaggtgatttaatactagaaataggaaaacttcctcagcatctcacgcaaagagcgcagaatgcactggacaatctcgtaatgttacataactctgaacaaggtggaagggcatacaggcacgcaatggaggaattgcccgatacaattgaaacattaatgcttctagcactcattgctgtgcttactggaggcgttacgctattcttcttgtcaggtcgcggtttaggaaaaacatcgatagggctcctatgtgtgatggcctcttcagtactgttatggatggcttccgtcgagccacattggatagccgcttccatcatcttagagttctttttgatggttctcctgatacctgagccagaccgacaaagaacccctcaagataatcaacttgcgtatgtcgtaatcggacttcttttcatgatactaacggtagcggccaacgaaatgggacttttagaaacaacaaagaaagacctaggtatagggcatgtagcggtagaaaatcatcaccatgcagccatgttagacgtagatttacatcctgcgtccgcttggacattatacgcagttgccacaaccataattacaccgatgatgcgacataccatagaaaatacgactgctaacatcagcttgaccgccatagctaatcaagcagccatactaatgggtctcgataagggctggcctatttctaagatggacataggcgtaccactactagcgttaggatgctactcacaggtaaatccacttacattaactgcagccgtattgatgctcgtagcgcattatgcaataataggaccgggacttcaggctaaggccacgcgtgaagcacaaaagagaacagcagctggtattatgaagaatccaactgttgacggtatagttgctatagatttagacccggtggtttacgatgcgaaattcgaaaaacaattaggccagataatgttattaatactctgtaccagccaaatactattaatgcgaacgacgtgggcgctttgtgaatcgataactttagcaacaggcccgttgacaacgctttgggaagggtcgccaggtaaattctggaacacaactattgcggtttcgatggccaatatattccgagggagttacttagcgggcgcaggcctagcattcagtctgatgaaaagtttaggtggtggcagacgtggaactggcgcgcaaggcgaaactctaggggaaaagtggaagagacaactaaatcaactaagcaagagtgagttcaacacatataaaagaagtggaattatggaagttgatcgttctgaagcgaaggaaggtttgaaacgaggagagaccactaaacatgccgtttccagaggaaccgcaaaattaagatggttcgtagaaagaaacttggtcaaacccgaaggtaaagtaatagatttaggttgcggaaggggtggatggagttactattgcgcaggtctcaagaaagttactgaagtcaaagggtacactaagggaggtcccgggcacgaagaacctataccaatggcaacctatggctggaatctagtaaaactgcactccgggaaagatgtgttcttcataccgcccgaaaaatgcgacacactcctatgtgacataggagaatcctcgcctaatcctacgattgaagaaggccgcacattacgggtattaaaaatggtagaaccatggttgcgtggaaatcagttttgcatcaagatactaaacccttatatgcctagtgtcgttgagactctcgaacaaatgcagcgaaaacacggaggtatgctggtcagaaacccactctcaagaaattccactcacgaaatgtattgggtaagttgtggtacgggtaacattgtatccgctgtgaatatgacatcaagaatgctcctgaataggtttacaatggctcatagaaaaccaacatatgaaagggacgtggatctgggtgctggaactagacacgtggcagtagaaccagaagtagccaatttagacattataggacaacgtattgaaaatatcaaacatgagcataaaagcacatggcactatgacgaggataatccttacaagacttgggcataccacggcagctacgaagtcaaaccatcagggtcagcatcaagtatggtgaatggagtcgttaaacttttgacaaaaccttgggatgtaataccaatggtaacacagattgcaatgacagacactacaccatttggtcagcaaagggtatttaaagaaaaggtggatacacgtacgccgaaggctaaacgaggaacagctcaaataatggaagtcactgccaagtggttatggggatttttatctagaaataagaagcctagaatctgcacaagagaagagttcacacgaaaggttcgatctaatgccgcgatcggtgccgtattcgttgatgagaatcaatggaacagtgcaaaagaagccgtggaggacgaaagattctgggacttagtacatagggaaagagaactgcacaaacagggaaaatgcgcaacatgtgtatataatatgatgggtaaaagagagaagaaacttggtgagtttggtaaagcaaaaggttcacgggcaatctggtatatgtggctaggggcacggttccttgagtttgaagcgcttggttttatgaatgaagaccattggttttctagagaaaattccttaagtggagttgaaggggaaggtctgcacaagttaggatatatactaagagacatatcaaaaataccaggaggaaacatgtatgctgatgacacagctggctgggatacgagaatcacagaagatgacttgcaaaacgaagcacgaattacggatataatggagcccgaacatgcattattagctaaatccatctttaaactaacataccaaaacaaagtcgtacgagttcaaagaccagccaaaaatggcacagtaatggacgttataagtcggcgtgatcaacgagggagtggtcaggtaggcacatacggattaaatacatttacaaatatggaagctcaactgataagacaaatggagtcagaaggcatattctccccgagtgaactagagaccccaaacctagcagaaagagtgctggattggttggagaagtacggtgttgaacggctcaaacgaatggctataagtggtgatgactgtgtagtgaagcccattgacgatagatttgcaacagctctcacagcccttaatgatatgggtaaggtaagaaaagatattcctcaatgggaaccatctaaaggatggaacgattggcagcaagttcctttctgcagtcatcacttccatcaacttattatgaaagacggaagagaaattgtggtaccatgtcgtaatcaagatgagctagtcgggcgggcacgtgtatcccaaggggcaggatggtcactgcgtgaaactgcatgtcttgggaagagttacgcacagatgtggcaactaatgtatttccatcggcgagatttgagattagccgctaacgcaatttgttcggcggtaccggtcgattggatacccacctctaggacgacgtggtctattcacgcgcatcatcaatggatgacaacagaagatatgttatctgtatggaatagagtttggattgaggaaaacccgtggatggaagataagacccacatttcgtcatggggtgatgtgccatatctcggcaaaagagaggaccaatggtgcggaagtttgataggactaacagcaagagccacttgggcaactaacatccaagtcgcgatcaatcaagtaagaagactcattggaaatgagaactatctagattacatgacatcaatgaaaaggtttaagaatgaaggtgatccagagggggcactttggtga

SEQ ID NO: 21496 - RNA, 9879 nt, synthetic construct
  misc_feature 1..9879: note = derived and/or modified CDS sequence (opt6) from DENV-1__FJ373296__SS-prME
  source 1..9879: mol_type = other RNA
tcagttacaatgttattgatgctcatgccaatagctcttgcatttcatctaacaactcgaggaggagaaccacacatgatagtaagtaaacaagaaagaggaaaatcattattatttaaaacatcagctggtgtaaatatgtgcacattgatagcaatggatttaggtgaattatgcgaggatacaatgacttataaatgcccaagaataacagaagcggaaccggatgacgtggattgctggtgtaacgcaacagacacttgggtgacttatggaacgtgctcgcaaacgggcgagcatagacgtgataaaagatcagtagcgcttgcccctcacgttggcttaggactagaaacacgtacagagacttggatgtcaagtgaaggtgcctggaaacaaatccaaagagtagaaacctgggcgttaagacatcccggattcactgtaatagcactctttttagctcacgcgattggaactagcataacacaaaaaggcattatctttatcttgcttatgttagtaacgccgtctatggcgatgagatgcgtcggcataggttcaagagactttgtcgaaggactttccggcgcgacctgggttgacgtggtattagaacatggtagctgtgtcaccaccatggcaaaagacaaacctacactagatatagaattactaaaaaccgaagtaaccaatccagcagtcctcagaaaactgtgcatagaagcaaaaataagtaataccactactgactcacgatgccctactcaaggagaagccacacttgtagaagaacaagacgccaactttgtatgtaggagaacatttgtagatagaggttgggggaacggttgcggtttatttggaaagggaagtttaataacatgcgcaaaattcaaatgtgtaacaaaattggaaggaaagattgttcaatacgaaaacttaaagtatagcgtcatagtaactgttcataccggagatcaacaccaagttggaaatgaatcgacggagcatggtacgaccgccacaattacaccacaagcccctaccaccgagatacaattaactgattatggagcacttacacttgattgcagcccgaggacgggattagattttaatgaaatggtacttttaaccatgaaagagaaaagttggttggtacacaaacaatggtttctagatctaccactgccttggacaagcggggcttctacatctcaagagacttggaataggcaggatctattggtaactttcaaaactgcacatgcgaagaaacaagaagtagtagtcctaggatcccaagaaggagcaatgcatactgcccttactggggctaccgaaattcaaacatctggaacaacaacgatcttcgctggtcatttaaaatgtcgtcttaaaatggataagctaactttaaagggaatgagttacgtaatgtgcacgggttctttcaaactggagaaagaggtcgcagagacccagcacggaacagtcctggtacaaataaaatacgaagggacagatgcaccgtgcaaaatacccttctcgacgcaagacgagaaaggggccacacagaacggtagattgatcactgctaacccaatcgtaacagataaggaaaagcctgtgaacattgaagctgagccaccatttggtgaaagttacatagtaataggcgcgggtgagaaagcgctcaagttgtcttggttcaagaaaggaagtagtatagggaagatgtttgaggccacagcacggggagcacgaagaatggctatactaggtgatactgcatgggactttggaagtattggtggggtattcacttcagtcggcaagttagtacaccaaatttttggaacggcatatggcgtcctgttctcaggagtatcctggacaatgaaaataggcataggagtattattgacgtggttgggattaaattcgagatcaaccagcttaagtatgacatgtatagccgtaggacttgtgactttgtatctaggagtcatggttcaggcagactccggatgcgtaataaattggaagggacgagagttgaaatgcgggtcggggattttcgtcacgaatgaggtacacacatggacagaacagtacaagttccaagcggattcaccaaaacgattatccgcagcgataggtaaagcatgggaggaaggggtgtgcggaataaggtccgcaacaagattagaaaacataatgtggaaacagatatcaaacgagttaaatcatattctgttagaaaatgacatgaaactcacagtcgtcgtgggagatgtcgctggtatcctgggacaaggcaagaaaatgatacgtccacagccgatggaatacaagtatagttggaagtcttggggaaaagctaaaattataggtgcagacgcacaaaatactactttcatcattgatggccctaataccccggaatgtccagatgaccagagagcctggaacatctgggaagtagaggactatgggttcggtatattcaccacgaacatttggctaaaactcagagacagttacacccaagtctgtgatcatagactgatgtctgcagctattaaagactcgaaagctgtacatgcggacatgggatactggatagagagcgagaaaaatgagacttggaaactcgctagagcgtcattcatagaggtcaagacgtgtatatggcctaaaagtcatacactgtggtcaaacggagtcttggagtctgaaatgatcattcctaagatttacggtggcccgataagtcaacataactatagaccgggctattttacacaaaccgccggaccatggcacctagggaaactagaacttgattttgatctgtgcgaaggtaccacagtagtagtggacgagcattgcggaaatagagggccctcattacgcacaacaacagtaacgggcaaaataatacacgaatggtgctgccgttcttgtacccttccgccgcttagattcagaggtgaagatggttgttggtatggtatggagatacgaccagtaaaagaaaaagaagaaaacctggtcaagagcatggtgagcgcaggatctggagaggttgactcgttcagtctaggcctactatgtatatcgataatgatagaggaagtcatgcgatcacgatggtcaagaaagatgctcatgaccggtaccctagcagtattctttttattaataatgggacaactaacgtggaatgaccttatcagactatgcattatggtcggtgcgaacgcaagcgatagaatgggtatgggtactacatatctagctctcatggccacgttcaaaatgagaccaatgttcgcagtgggactcctctttagaagattaacaagtcgagaagtccttctcctcaccattggcctatctctagtagcatcagttgaactaccaaactctttggaggaattgggtgatggacttgcgatgggaattatgattctaaaacttcttactgacttccagagtcatcaactatgggcaacactattaagtttaacttttatcaagacgacattcagtctacattatgcatggaaaactatggctatggtgttgtcaatagtcagcctcttcccattatgtttgagtactacaagtcagaaaacaacgtggctaccggtattattaggatcccttggttgcaaacctcttactatgttcttgattgcggaaaacaaaatatggggaagaaaaagttggcccctcaacgaaggaataatggctgtagggatagtttccatactgctatcaagcctgctgaaaaatgacgttcccctagctggacccttaattgcagggggaatgcttatagcctgctatgtaatatctgggtcatcagctgatctttcattagaaaaagcggccgaagttagttgggaagaggaggcggaacactctggagcaagtcacaatatcctagtagaagtacaagatgatggcacaatgaaaataaaagatgaggaacgagatgatacattaacaattttattaaaagcgacactactggcagttagcggagtttacccattgtcaataccggctaccttatttgtatggtatttttggcagaagaagaaacaacgttcgggcgtactatgggacactccttcccctcccgaagtagaaagggcagtattagacgacggcatatacaggattatgcaacgcgggttattaggccgttcccaagttggagtgggtgtatttcaagagaacgttttccataccatgtggcacgtaactcgcggagcggtattaatgtatcaaggtaaaagattggaaccctcttgggcgtcggtcaaaaaggacctgattagttatggagggggctggagactaagaggtagttggaacacaggagaagaagttcaagttatagcggtggaacccggcaaaaatccgaaaaatgtacagactgcccctggcacatttaagacacccgagggggaagtaggagcaatagcattggattttaaacccgggacaagtggatctcccattgttaaccgagaaggtaaaattgtaggattgtatggaaacggggtcgtaacaacaagtggaacctatgtgtcagccatagctcaagcaaaagcaagccaagaagggccattaccagaaatagaagacgaagtatttagaaaacgaaaccttacaataatggatctccatccaggttcagggaagacgaggcggtatttgccggcgatagtaagagaagctatcaaaagaaaacttcgaacactaattctagcacctacacgagtcgttgcttctgagatggccgaagcactaaaaggaatgccaattagataccaaacaaccgcagttaaatcagaacacaccgggaaagaaatagtggatcttatgtgtcatgcgacattcacaatgcggttactatccccagtgcgagtacctaattataacatgataattatggacgaagcacattttacggacccttcctcaatagcagccagagggtacattagcacccgagttggaatgggagaagcagctgcaatctttatgacagctacgcccccaggatcggtagaagcctttcctcagagcaatgctgtaattcaggatgaagagagagatatccctgaacgaagttggaactcaggatacgaatggattacagatttcccgggcaaaacagtatggtttgtacctagcattaaaagtggaaatgatatagcaaactgcctcaggaaaaatggaaaaagagtgatacagctgagtaggaaaaccttcgacaccgaatatcagaaaaccaaaaataatgattgggactatgtagtcacaaccgatatatccgaaatgggagcaaattttagagctgacagagtgattgacccgaggaggtgtctgaagccagtaatactaaaggacggaccagaacgagtaatactggcagggccgatgccagtaacagtggcgtcagccgcacaaagaagaggaagaatcggaagaaaccacaataaagagggtgaccaatacatatacatgggtcagccactcaacaacgatgaagatcatgcacattggacagaagctaaaatgctcttagataatattaacacgcccgaaggcattatacctgcattatttgaaccagagcgagaaaaatcggctgccgtcgatggggaatatcgtttacgaggcgaagcgcggaaaacattcgtcgaattaatgcgaagaggagacctcccagtttggttaagttacaaagtagcaagtgaaggctttcaatattctgaccggagatggtgttttgatggagaaagaaataatcaagttctggaagaaaatatggatgttgaaatatggacaaaggaaggtgagcgaaagaaattgcgcccccgttggttagatgccagaacgtattcggaccctttagctctcagggaatttaaagagttcgcagcaggtcggcggagcgttagcggagacctaattttagaaatcggtaaattaccccaacatctgactcaacgagcgcaaaacgcactcgataacttagtaatgttgcacaatagcgaacagggaggtcgggcctatagacatgcaatggaggaactacccgataccatcgaaacactcatgcttttagcattgatagccgtacttacaggaggtgtaaccctattcttcctaagtgggagaggattaggaaaaacaagtataggtcttttatgcgtcatggccagtagtgtgctactttggatggcatctgtggagccgcattggatcgcggcctctataatattagaatttttcctaatggttcttctgatcccagaaccggatcgtcaaagaacaccccaagataatcaattggcgtatgtagtgatagggctattattcatgattctaacagttgcagcaaacgaaatggggctgctcgaaacgactaaaaaggatttaggaatagggcatgtagcagtagaaaatcaccatcacgctgcaatgttggatgtcgacttacatccggcaagcgcatggactctctatgctgtcgcaacaacgatcataactcccatgatgagacacaccattgagaacacgacggctaatatatctttaaccgctatagcaaatcaagcagccattttaatggggctagataagggttggccgatctccaaaatggacatcggagtgccactactcgcattaggatgctactctcaagtaaatcctttaacattgactgctgctgtgctcatgcttgttgctcattatgcgattataggccctggtttacaggcaaaagccactagagaagctcagaaaagaacagcagcgggaatcatgaagaaccccacggtagatggtattgtggcaatcgatttagatcccgtggtatatgacgcaaaatttgaaaaacaacttggtcaaatcatgctattgatcctgtgcacctcacaaatattattaatgcgtacaacgtgggcgctgtgcgaatcgataaccctggcgaccggacctttaactacactctgggagggctcccccggcaaattctggaataccacaatagcggttagcatggcaaatatatttagaggatcgtacctagcgggtgctggtctagcatttagtttgatgaagagtctcggcggaggacgacgaggcacaggcgcccaaggcgagactctaggagaaaaatggaagagacaattaaaccaattgtcaaaatcagaatttaacacatacaagaggagcggtataatggaggtagaccgatcggaagcaaaagaaggccttaaacggggcgaaaccacgaaacatgctgtatctagaggcaccgcaaagttacgatggttcgtagaacgaaatctagttaaaccagaaggaaaggtcatcgatcttggttgtgggagaggagggtggagctactactgtgcgggtctaaagaaagtaacagaagtcaaaggatacaccaaaggaggaccgggacacgaagaaccgataccaatggcaacctatggatggaacttagttaaacttcatagcggcaaagatgtatttttcataccaccagaaaaatgcgataccttattatgtgatattggagaatctagtcccaatccaactatagaagaaggccgcacattaagagtactaaaaatggttgaaccatggttacgcggaaaccaattctgtatcaaaattttaaacccatacatgcccagcgtcgtagaaacactagaacaaatgcaacggaagcatggaggaatgctagtacgaaacccattgagcagaaatagcactcatgaaatgtactgggtatcatgcggcacaggaaacatcgttagcgctgtaaacatgacaagtagaatgctccttaaccgttttacaatggctcatagaaaaccaacctacgaaagagacgtcgacctgggaaccggaacaagacacgtggcggttgaacccgaggtagccaatcttgacataatcggccaaaggatagaaaatattaagcacgaacacaaatcaacatggcattatgatgaggacaatccatataaaacttgggcataccatggaagttatgaagtaaaaccctccggctctgcgagcagtatggtaaatggggttgttaagctacttacaaaaccttgggatgttataccgatggttacgcaaatcgcaatgacagatacaacaccttttggtcaacagcgagtattcaaggaaaaggtcgacacccgtacccccaaagcaaaaaggggtacagcacaaatcatggaagtgacagcaagatggctatggggatttctgagtcgcaacaagaagcctagaatttgtacacgagaagagttcaccagaaaagttaggtctaacgcagcaatcggagcagtgtttgttgatgaaaaccaatggaactcggcaaaggaagctgtcgaagacgaaagattctgggatctcgtacatagagaacgagaattacacaaacaaggtaaatgtgcaacatgtgtgtataatatgatgggtaagagagagaagaaattaggggagtttggcaaagcaaagggctcacgagctatatggtacatgtggttaggagcacgttttcttgagttcgaggcgttaggatttatgaatgaagatcattggttttcaagagagaatagcctttctggcgttgaaggtgaaggactccacaaactcggatacatactgcgtgacatctcgaaaatcccaggagggaatatgtacgccgacgataccgccggatgggacacacgaattacggaagacgatttacaaaatgaggctaaaataaccgacattatggaaccagaacatgcactactcgccaaagccatattcaaactcacctatcaaaacaaagtagtacgcgtacaacgaccggccaaaaatggcacagttatggatgtgataagcagaagagatcaacgtggaagcggccaagtcggaacttatggactaaatactttcactaacatggaagcacagttaatcagacaaatggaatcagaaggtattttcagcccctccgaattggaaacgcccaatctagcagaacgcgctttggactggcttgaaaaatacggagttgagaggctcaaacgcatggcgatttcaggagatgactgtgttgtcaaaccaattgacgaccgatttgcgacggcattaactgctcttaatgatatgggtaaagtcaggaaagacattccacagtgggagcctagcaaaggatggaacgattggcaacaggtgccattctgttcccatcattttcatcaattaatcatgaaagatggtagagagatagttgtcccttgtagaaaccaggatgaattagttgggagagctagagtatcacaaggcgccgggtggtcgcttcgagaaaccgcatgcttagggaagagttatgcacaaatgtggcaactaatgtatttccatcgaagagatctccgcttagcagcaaacgccatatgctctgcagtaccagttgactgggtaccaactagcagaactacctggtcaatacatgctcaccatcaatggatgaccacagaggacatgttatccgtgtggaacagggtctggatagaagaaaacccatggatggaagataaaacacatattagcagctgggaggatgttccttacctaggaaagcgcgaggatcaatggtgtggaagtcttattgggctgacagcaagagcaacgtgggccactaatatacaagtcgcaattaaccaggtgcgacgactcattggcaacgaaaactatttggattatatgacctcgatgaagcgctttaaaaatgaaagcgacccagaaggtgcactctggtag

SEQ ID NO: 21497 - RNA, 9879 nt, synthetic construct
  misc_feature 1..9879: note = derived and/or modified CDS sequence (opt6) from DENV-1__FJ182018__SS-prME
  source 1..9879: mol_type = other RNA
agtgtcacaatgctattaatgttaatgcctacagcactagcatttcatttaactacacggggaggcgaacctcacatgatcgtatctaaacaagaacgaggcaaatctttattatttaaaacgagtgctggtgttaatatgtgtactttaattgcaatggacctaggtgaactatgcgaagatactatgacatataaatgtccaagaattacggaaacggaacctgatgatgttgattgctggtgtaacgcgacagatacatgggtaacatatggcacgtgctcacaaaccggcgaacaccgtcgtgataaaagatcagtcgcactagcacctcatgtaggcctaggtttagaaaccagaacagaaacttggatgtccagcgaaggggcgtggaaacagattcaacgggtagaaacatgggctctacgtcatccagggtttaccgtaatagcactatttttagcccacgccataggaacatctattacacaaaaaggaataatattcatacttttgatgttagttaccccatcaatggctatgcgatgtgtgggaatcggctcacgtgacttcgtagagggtctttcaggtgcaacatgggttgatgtagtgctagaacacggctcatgcgttactactatggcaaaagataaacctactctcgatatcgagctgcttaaaaccgaagtcactaatcctgctgttttgcgaaaactatgtattgaggcaaaaattagtaacacaacaaccgatagtagatgtcctacgcagggcgaagctaccttagtagaagaacaagatgcaaacttcgtatgtagaaggacatttgtagacagaggatggggaaatgggtgcggactctttggtaaaggatctttaataacttgtgcgaaattcaaatgcgtcacaaaactcgagggaaaaatagtccagtacgagaatctaaaatatagtgtaattgtgactgtgcacactggagaccagcaccaggtaggcaatgaaagtaccgagcatgggacaaccgccacgatcacgccacaggcgccaaccactgaaattcaactcaccgactatggtgccctcacgcttgattgctccccacggacagggctggattttaacgaaatggttctcttaactatgaaagaaaaatcatggctagtacataaacagtggttcttggacctaccattgccttggacatcgggtgcgtcaacctcacaggagacctggaaccggcaagaccttctagtaaccttcaaaacggctcacgccaagaaacaagaggtggtagtgctaggtagccaagagggcgcaatgcatacggcactaacaggtgcaacagaaatccaaaccagcggaacgactactatattcgctggacaccttaaatgtcgtctaaaaatggacaaactcacgctgaaaggaatgtcctatgttatgtgcactggtagctttaaactcgaaaaagaagtcgccgaaactcaacacgggacagttctagtacaaatcaagtacgaaggaacggacgctccttgtaaaatccctttcagtactcaagacgaaaaaggtgtaactcagaacggtcgtctaattactgccaacccaatagtgacagacaaggaaaaacccgtcaacatcgaggcggagcctccgtttggcgaatcatacattattataggggctggtgaaaaagcccttaagttaagttggtttaagaaaggcagtagtattggtaaaatgttcgaagcaactgcacgtggtgctcggaggatggcaatactgggagacacagcatgggactttggctctatcggaggcgtgttcaccagcgtcggaaagctcgtacatcaaatatttggtactgcctatggggttctattttccggagtcagttggaccatgaaaatcggaataggagttctcctcacttggctaggattaaatagtcgctccacgtcactgtcaatgacatgtatagctgttggtttagttacactatatttaggagtaatggtacaagcagattcgggatgtgtcataaattggaaaggtcgggaactaaagtgcggtagtgggatattcgtaacaaacgaggtgcatacatggacagaacagtacaaattccaggcggacagtccaaaacgactttcagcagcaataggaaaagcctgggaagaaggagtctgtggaataagatcagccactagactggagaacatcatgtggaaacaaatttcaaatgaactgaatcatatactactagagaacgacatgaaattcacggtcgttgtaggagatgtcgctggaattttggcacaaggaaagaaaatgatacgaccacaaccaatggaatataaatatagttggaaatcatggggaaaagcaaagattataggtgcagatgtacaaaacaccacctttattattgatggccctaatacacctgaatgtcccgacgaccaaagggcttggaatatatgggaagtcgaagactatggctttggaatatttacgactaacatatggctaaagttaagagactcccatacgcaagtttgtgatcacagacttatgtcagcagcgattaaggattccaaagcggtccacgctgatatgggatactggatagaatctgagaaaaacgaaacatggaaacttgcacgtgcatcattcatagaagtaaaaacatgtatctggccaaagtctcatactttatggtctaatggcgtcttagaaagtgaaatgattataccaaagatttacggtggaccaatctcacaacacaactaccgaccaggctatttcacccaaactgctggtccatggcatctagggaagttagaactagactttgatttgtgcgaggggaccacagtcgttgtcgacgaacattgcggtaatcgtggtccgagtttacgaacaactaccgtaacagggaaaatcatacatgaatggtgttgtcgctcctgtacacttccgccattaagattcagaggggaagacggttgctggtacggcatggaaataagacccgtaaaagaaaaagaagaaaacttagtaaaatctatggtttcagcaggcagtggcgaagttgattctttttcgttaggattattgtgtatatcaattatgatagaagaggtgatgaggagcagatggtcaagaaaaatgttaatgaccgggacactagcagtatttttccttttaataatggggcaacttacatggaacgacctaatcagactatgcattatggtaggagccaacgcatcagacaggatgggcatgggaacaacatatctggccctaatggcaacttttaaaatgcgacccatgttcgcagtaggtctactttttcgaagactaactagcagagaggtattattgttaacaattgggctttctctagtggcttcagttgaattaccaaattccttagaggaattaggagacggacttgctatgggaataatgatcctaaagttactgaccgatttccaaagccatcaattatgggcgactctattgagcttgacctttattaagacaacgttcagccttcattatgcatggaaaacaatggccatggtgctatctatagtatcactattcccattatgcttgtctacgacgagtcagaaaacaacgtggcttcccgtcttgttaggatctctaggttgtaagcctctcacaatgtttcttatagccgaaaacaaaatttggggaagacggtcatggcctctcaacgaagggatcatggccgtagggatcgtaagcattctactcagctccctactcaaaaatgacgtgccgttagcaggtcccctaattgcaggaggaatgcttatagcgtgctatgtcatctccggttcctccgcggatttgtcactagaaaaggctgctgaagtcagttgggaagaggaagctgagcattctggggcatcacataacatccttgtggaggttcaggacgacggaactatgaaaataaaagatgaagaacgggacgacactttaacaatactcctgaaggcaaccttacttgcagtctcaggggtttatccattatcgatacccgccactttatttgtttggtatttttggcagaagaagaaacaaagaagtggtgtactatgggatacgccctccccacctgaagtagaaagagcggttctagacgatggaatatataggattatgcagagaggactattagggcgatcacaagtcggcgttggcgtttttcaggagaacgtctttcacaccatgtggcacgtaacacgaggtgccgtacttatgtatcagggaaagagactcgaaccttcgtgggctagtgtcaagaaagatttaatctcttatggtgggggttggaggttacaaggttcatggaataccggagaagaagttcaagtaatagccgttgagcccggcaaaaacccgaaaaacgttcaaacggcgccaggtacatttaaaacgccggagggggaggttggcgctatagcactagattttaaaccaggtacgagtggatccccgatagttaatcgtgaaggaaaaatagtcggactgtatggaaacggtgtggtaacaacgtcgggaacctatgtcagcgccatcgcacaagctaaagcatcgcaagaagggccgttaccagaaatagaggacgaggttttcagaaaaagaaacctcactataatggatttacaccctggaagtgggaagactcggcgttatctgcccgcaattgtcagagaagctatcaaacgaaaattacgtacactgattctcgcaccaacgagagttgtcgcttcagaaatggccgaggctttaaaaggcatgccgataagatatcaaaccactgccgttaaatctgaacacactggaaaagaaatagtagatttgatgtgtcatgctacattcacgatgaggctcttgtcacctgtacgggtccctaactataatatgataataatggatgaagcacatttcactgatccctcatcaatagccgctcgtggctacatctctacgcgagtcggtatgggagaagcagcagctatatttatgacagctactccacctggatcagtggaggcatttccacaatctaatgctatcatccaagatgaagaacgagatatccccgagcgctcatggaatagtgggtatgaatggataacagattttcctggtaaaacagtatggtttgttccaagtatcaagagtgggaacgacatagccaactgtcttagaaagaacggaaagcgagtgatccagctatctaggaaaacattcgatacagaataccagaagaccaaaaataatgattgggattacgtcgtaaccacagatatcagtgagatgggagcaaactttagagctgatagagttatagatcctagaagatgtctaaaaccagtaatattgaaagatggtccggaaagagtcatactagcaggacccatgccggtaacggtagcttcagcagcacaaaggcgcggaagaataggtcgtaaccataataaagaaggcgaccaatatatatatatggggcaaccgctaaataacgatgaagatcatgcccactggacagaagctaagatgttgctagacaatataaataccccagagggaataatacccgctttatttgaacctgaaagagaaaaatcggcggcgatagacggtgaatacagactgagaggcgaggctcgtaaaacgttcgttgaattaatgcgcagaggggatctgcccgtttggttaagctataaagttgcgtccgaaggcttccaatattcagatcgaagatggtgcttcgatggtgaaagaaataaccaagttctggaagaaaatatggatgtcgaaatatggacaaaagaaggtgaaagaaagaaacttaggcctcgatggttagatgcacgcacctattcagatccactagcactcagggaatttaaagaatttgcagctgggcgacgctcagtctcgggagacttgatattagaaatagggaaattaccccaacatttaacccaacgcgctcagaacgcattagataatcttgtcatgcttcataatagtgagcagggaggtagggcgtataggcacgcgatggaagaattacctgatactatcgaaacacttatgttgcttgcgctgatagctgtcttaacaggaggagtcacattattcttcctatcaggtcgtgggctaggcaaaaccagtattgggcttctgtgtgttatggccagcagtgttctcctatggatggctagtgtcgaaccccattggatcgcagcgtctattatattggagttctttttaatggttttacttataccagaaccagataggcaaaggacaccccaagataatcaacttgcttatgtagttattgggttactgttcatgattcttacagttgcagccaacgaaatgggtttactggaaacgaccaagaaagatctcggtataggacatgtggccgtagaaaatcaccatcatgcagccatgcttgatgttgatttgcatccggcaagcgcatggactttatatgcagtcgccacaactataattactccaatgatgagacacactattgaaaatacgactgctaacatttccctcaccgcaattgcaaatcaagcagctatactaatggggctagataaaggatggccaatttccaaaatggacattggagttccattgcttgccttaggatgttatagccaagtaaatccacttaccctaactgcagcagttttaatgctagtagcgcattacgctataataggtccgggcctacaagccaaggccacccgagaagcgcagaaaagaacggcagcgggtattatgaaaaatccgaccgtagacggaatagtggcaatcgatttagatcctgtagtttacgacgctaaattcgaaaagcagttagggcagataatgttattaatcttatgcaccagccaaatcctattgatgagaacaacttgggctttgtgcgaatccatcacgctggccaccggaccactaactacactatgggaaggtagtcctggtaaattttggaacactacaatcgcagtatccatggctaatatttttagaggatcatacttagctggtgctgggctagccttttcgctaatgaagtcactgggcggaggtagaagaggaactggcgcccaaggagaaacacttggagaaaaatggaaaagacaattaaaccaactttcaaaatcggaatttaacacctacaaaagatctgggataatggaagtagatagatcagaagctaaggaaggactaaaaagaggggaaacaaccaaacatgccgtaagccggggaactgcaaaactaagatggttcgttgaaagaaaccttgtgaaaccagaaggaaaggtcatagacttaggatgcggccgcggtggctggtcctactattgcgcgggattaaagaaagtcacagaagtaaagggttatacaaaaggaggtcccggccatgaagaaccgattccaatggctacatatggatggaatctagtcaagttacatagcggcaaagatgtattcttcataccacctgaaaaatgcgacacactcttatgtgacataggcgagagtagtcctaatcccacaatagaggaaggtcgtacattaagagtacttaaaatggttgaaccctggcttaggggaaatcaattctgtataaaaatactaaacccctatatgccgtccgttgtagaaactttggaacaaatgcaaagaaaacacggaggaatgttggtaagaaacccactatcaagaaatagtacacatgagatgtattgggtatcgtgcggaacagggaatattgtatcagcagtgaatatgacatctcgcatgctattaaatcgattcacaatggctcatagaaaaccaacatatgaacgggatgtagacctaggagcaggtactagacacgtggccgtggaacctgaagttgcaaacttagacattataggccaaagaattgaaaacattaaacacgaacacaaatccacgtggcactatgacgaagacaacccatataaaacctgggcctatcatggttcatacgaagtgaagccgagtggctctgcctcgagtatggtgaacggagttgttaaacttttgactaaaccgtgggatgttatccccatggtcacacagatagccatgacagatacaacaccctttggacaacaacgagtatttaaagaaaaagtggacacaaggacgcctaaagcaaaacgaggcaccgcccaaataatggaggtgacggcaaaatggctttggggtttcctttctaggaataagaaaccaagaatatgcacgcgagaggaatttacacgtaaagtacgttcgaatgcggcgatcggagctgtattcgtggacgaaaatcagtggaactcagccaaagaagctgtagaggacgaaaggttttgggatctagtacatagagaaagagaactacacaaacaaggaaaatgtgctacctgcgtatacaacatgatgggaaaaagagagaagaaattaggggagttcgggaaagcaaaaggaagtcgtgccatctggtacatgtggctaggcgcgaggttcctagaatttgaagctctgggatttatgaacgaagatcactggttttcgcgggaaaattctttgtcaggtgtagagggggagggactacacaagctaggatatatactgagggatatatcaaaaattccaggtggcaacatgtatgcagacgatacagccggatgggacacacgtattactgaagatgacttacagaatgaggcgcgcattactgacatcatggaacccgaacacgcacttctagcaaagtctatatttaaactaacatatcaaaataaagtcgtacgtgtccaaagacctgccaaaaatggaacagttatggacgtaatatctcgtcgcgaccaacgtggtagtggccaggtaggtacttatggacttaacacgtttacaaacatggaggcgcagttaataagacagatggaaagtgaaggaatattctccccttcagaacttgaaacgcccaatttagctgagagggttctcgactggctcgaaaagtatggagtagaaaggctaaaaagaatggccatttcaggagacgattgtgtggtgaaacctatcgatgataggttcgctactgcgctcactgcattaaatgacatggggaaggtgagaaaagacataccgcaatgggaaccatctaaaggatggaacgattggcaacaagttccattttgtagccaccattttcatcaattgattatgaaggacggtagagagatagtagtaccttgtcgaaatcaagacgagctagtaggacgagcaagagtgtctcaaggagcaggctggtcactaagagaaacggcctgtttaggtaaaagctatgcgcaaatgtggcaacttatgtactttcacagacgggacctaaggcttgcggctaacgctatttgttcagcggtacctgtggactggattcccacaagcagaactacatggtcaatacatgcccatcaccaatggatgactaccgaagatatgttatctgtctggaatagggtgtggattgaagagaatccatggatggaagataagactcacataagtagctggggtgatgtaccttatttaggcaaaagggaagatcaatggtgcggcagtctgataggtttgactgctagggcaacttgggcaactaatatacaagttgcaataaatcaggtgaggaggcttataggaaatgaaaattatcttgactatatgacatcaatgaaaagattcaaaaatgagggagatccagagggagcattgtggtaa

SEQ ID NO: 21498 - RNA, 9879 nt, synthetic construct
  misc_feature 1..9879: note = derived and/or modified CDS sequence (opt6) from DENV-1__FJ410287__SS-prME
  source 1..9879: mol_type = other RNA
agcgttaccatgttactaatgttgatgcccacggcactagcctttcatcttacaaccagaggaggtgaaccgcatatgatagtttcgaaacaggaacgtggtaaaagccttctcttcaagacgagcgctggagtaaatatgtgcactctcatagccatggatctaggagaactatgcgaagatacgatgacatataaatgccccaggataacagaaactgagccagacgatgttgactgttggtgcaacgccacagacacttgggttacgtatgggacttgcagccagacaggggaacatcgccgagataaacgtagtgttgcactagcaccgcacgtaggactaggattggagacccgaactgagacatggatgagttctgaaggagcgtggaaacaaattcaaagagtagagacatgggctttaagacaccctggattcacagtgattgcactcttccttgcacatgccattggaacaagcataacacaaaagggaattattttcatacttcttatgttagtaacgccaagtatggcaatgagatgcgtagggataggatctcgcgactttgtagagggactatcaggcgcaacgtgggttgacgttgtcctcgaacacggttcatgtgtcacaaccatggcaaaagataaacctactctcgacatagaactgttaaaaacggaagtcaccaatccagcagtattgcgaaaattatgtatcgaagccaagatctccaatactacgactgatagtcgatgtcccacccaaggggaagctacactagttgaggaacaggacgcaaactttgtctgtagaagaacctttgtggatagaggatggggaaacggatgtggtctcttcggaaaggggagtctgatcacatgtgctaaatttaaatgtgtaacaaaattggaaggtaaaatagtacaatacgagaaccttaaatattcagtcatagttaccgtacacacgggagaccaacatcaggtcggaaatgaatctacagaacatggaactactgcaactattacgagtcaggctccgacaacagaaatacagctaacagactacggagcattaacattggattgcagtccgcgtacaggtttggactttaacgaaatggtactcctaaccatgaaagaaaaatcttggcttgttcataaacagtggttcctggatttaccgttgccatggacttctggagccagtacgtcgcaggagacatggaatcgacaggaccttcttgtaacattcaaaacggcacatgcaaagaaacaggaagtcgttgtgttgggttcacaggaaggtgcaatgcacacagcccttactggcgctaccgaaatacaaacctcaggaaccacaacaatatttgccggtcatctaaaatgcagactgaaaatggataagcttacgctaaagggaatgagttatgtaatgtgtactggtagttttaaactagagaaggaagtagcagaaactcaacatggtacagtattggtccaaattaaatacgaaggaactgatgccccttgtaaaattccctttttaacacaagatgaaaaaggagtcactcaaaacggtaggttaatcactgcgaatcctatagtcacggataaagaaaagccagtcaatatcgaggcagaaccaccttttggagagtcatatattattataggcgctggtgaaaaagccctaaaattatcatggtttaaaaaaggatcgagcataggaaagatgtttgaagcaactgcaagaggtgcaagacggatggcaattttgggagatacggcatgggatttcggtagcatagggggagtctttacatctgtgggtaaactcgttcatcagattttcggaactgcatacggtgtcttattctcaggtgtgagttggactatgaaaataggtataggggtcctattaacgtggctgggactcaattcgagaagtacatccttgagcatgacatgcattgcagtgggcttagtcacgttgtatctgggagttatggttcaggctgatagcgggtgcgtgattaactggaaaggaagagagcttaaatgcggctctggtatatttgtaaccaatgaagttcacacttggactgaacaatataaatttcaggctgactcgccaaagcgtctgagcgccgcaataggaaaagcatgggaagaaggtgtatgcggaatacgaagtgccaccagactagaaaatatcatgtggaaacaaatatcaaacgaactcaaccatattttgttagaaaacgacatgaaattcacggtcgttgttggggacgttgccggtattttagcacaggggaaaaaaatgataagaccccaacccatggagtacaaatactcctggaaatcatggggcaaagctaagataataggggcagacgtacagaacacaacctttatcattgatggacctaataccccagaatgtcccgacgatcaaagagcatggaacatctgggaggtggaagattacggatttggaatatttacgaccaatatatggttgaaacttcgggatagttatactcaggtgtgcgatcacagactcatgtcggcagcaattaaagactctaaggctgttcatgctgatatgggttactggatagaaagtgagaaaaacgagacctggaaattggcgagggcgtcgtttatcgaggtcaaaacatgtatttggcctaaatcacataccttgtggtccaatggagttctagaatccgaaatgatcattcctaagatctatggaggcccaatatctcaacataactaccgtccaggttatttcacacagaccgcggggccatggcacttaggtaaattagaattagattttgatctatgtgaagggaccacagtagtagttgatgaacactgtggcaatagaggaccgagtttgaggactacaacagtaacaggaaaaatcatacatgaatggtgttgtcgatcttgtaccttgcctccccttagattcagaggtgaagatgggtgttggtacggaatggaaatacggcccgtaaaagagaaggaagagaatcttgtgaaatcaatggttagcgcaggttccggcgaagttgattcattcagcttaggcttattgtgtatcagtataatcatagaggaggtaatgcgttccagatggtctagaaaaatgttaatgacgggaacattggctgtgttctttttactcattatgggccaactcacatggaacgatttaataagactgtgcattatggttggagcaaatgcctctgaccgcatgggtatgggaactacatatctagccttaatggctacatttaaaatgaggccgatgtttgccgtaggccttttgttcagaagattgacgtcacgtgaagttctgcttctaacgataggattaagtctagttgcatccgttgaattgccaaattctcttgaggagttaggcgacggattagcaatgggtataatgatcctaaaactattaaccgactttcagagtcatcaactctgggcaacactactgagtcttacgtttataaagacaacttttagcttacactatgcatggaaaacaatggcaatggtgttatcaatagtttcgctattcccattatgtctgtcgactactagtcaaaagaccacctggcttcctgttttactaggaagtttaggatgcaaacctctcacaatgtttttaatcgcagaaaacaaaatatggggtcgtaggagttggcctctaaatgaagggataatggctgttggtattgtgagcattctattaagtagcttactaaaaaacgatgttccacttgccggccctttgatcgcaggcggtatgctaattgcatgttacgtaatttcaggctcttcagccgatttgtcactagaaaaagctgctgaagtgagttgggaagaggaagctgaacacagtggtgcatcacacaacatattagtagaagtgcaagatgacggcactatgaaaataaaagatgaagaaagagatgacactttaacaatactgctgaaagctacgctcttagctgtgtcaggagtatacccactttcgataccagctaccctgttcgtttggtatttctggcaaaaaaaaaaacagaggtcgggtgtcctttgggataccccatcgcctccggaggttgagagagctgtattagacgatgggatatatagaataatgcagcgtggattgctgggccgtagtcaggtaggggtgggggtctttcaagaaaatgtatttcacacaatgtggcacgtaacgagaggcgctgttctaatgtatcaaggtaagagattagaaccatcctgggcgagcgtaaaaaaggatctaatctcatatggcggagggtggcgacttcaggggagctggaacacgggcgaggaagtccaagtcatagctgtagaaccgggtaaaaaccccaaaaacgtccagactgctcccggaacattcaaaacaccagagggtgaagtcggagctatagctctcgactttaaaccaggaacatctggtagtcccatagtaaatagagagggtaaaatagtgggattgtacggaaatggagtcgtaacaacgagtggaacatatgtaagcgcaatagcacaagcaaaggcatcacaggaagggccactacctgaaatagaagatgaagtatttagaaaacggaatttgaccataatggatttacatcctggttccggaaaaactcggcgctatttaccagctattgttagagaggctataaaacgcaaacttaggacgctaattttggctcctactcgtgtagtagcatcggagatggcagaagcgttaaaaggtatgcctatcagataccagactacagctgtaaaatctgaacataccggtaaagaaatagtcgatctgatgtgccacgcgacatttacaatgagattattaagtccagttcgagtcccaaactacaacatgattattatggatgaggcgcattttacggacccatcatccatagcagccagaggatatatatcaacaagggtaggaatgggcgaagcagcggcaatcttcatgacagcaacgcctccaggttccgtggaagcctttccacaatccaatgccgtaattcaagatgaggaaagggatataccggaacgatcgtggaattcgggatatgaatggataaccgattttccaggaaaaacggtttggtttgtaccaagtataaaatccggaaatgatatcgcaaattgcctacgaaaaaacggtaaacgagtaatacaactctcacggaaaaccttcgacacagaatatcaaaagactaaaaacaatgactgggattatgtggtgacaaccgatatatcggaaatgggagcaaatttcagagcggatcgtgttatcgacccgagaagatgtcttaaaccagttatattaaaggacggaccagaacgcgttatattagcgggtccgatgcctgttaccgttgcatcagcggcacaaagaaggggacgaataggaagaaatcacaacaaagaaggagaccagtatatatacatgggacaacccttgaacaacgatgaagatcatgcccactggactgaagcaaaaatgcttttagacaatattaacactccggagggtattatccccgcgctatttgaacctgaaagagagaaatcagctgccattgacggagaatatcgactgaggggcgaagcgcgaaagacatttgtagaattgatgagaagaggagatttaccagtatggctgtcttacaaagtagccagtgagggctttcaatactcagatagaaggtggtgttttgatggtgagaggaataaccaggtactcgaggagaacatggatgtagagatttggactaaggagggcgaacgaaaaaagctgagacccagatggttggacgcgagaacttatagcgatccacttgcactaagagagtttaaagaattcgcagcgggacgtcgaagtgtttcgggagacttaatattagagatcggtaaactcccccaacatctaacacagagagcgcaaaatgcgttagacaatctggttatgttacataatagtgaacaaggaggacgcgcttatagacatgcaatggaagaactaccggacactatcgagacgctaatgcttttagctttaatagccgttttgacgggcggagttacactattcttcctatctggtagagggttaggaaaaacgagcataggattactttgtgttatggcttcaagtgtattgttatggatggcgtctgtagaaccacactggattgctgcaagtattatcttagagtttttcctaatggtcctattaattccggaaccagacagacaacgtacccctcaagataatcaacttgcatatgtagtcatagggctattattcatgatactcacagtcgctgcaaacgagatgggattgcttgaaacaacaaagaaggatctaggcatcggccatgtagcagtagagaatcatcatcacgcagcgatgcttgatgtagacttgcatcccgccagtgcgtggaccttatacgcagtagctactacaattataactccaatgatgaggcatacaattgagaatactacagcgaatataagtttgacagcaattgcaaatcaagctgcaatattgatgggcttggataaaggatggccaatatcaaaaatggacataggtgtaccactactagcactaggttgctactcacaggtgaaccctctcacactaacagccgccgttttaatgttagtagcacactacgctattataggacctggattacaagccaaagcaactcgtgaagctcaaaaacgaacagctgcaggtataatgaaaaacccaacagttgatggcatagtagctattgatcttgacccggtagtgtacgacgctaagttcgagaaacaattaggccaaataatgttgttaatattgtgcacatcgcaaatactcttaatgagaactacttgggctttatgcgaaagcattacattagcgacaggcccactgaccacattatgggaggggagtccaggtaaattttggaataccacaatcgcggtatcaatggcaaatatttttcgcggttcgtacttagcgggcgcgggactggcctttagtttgatgaagagtttgggtggtggaagacgtggcacaggtgctcaaggagaaacactgggtgagaaatggaagaggcaactaaatcaactatcaaaaagtgaatttaacacatataagagaagtgggattatggaagttgaccggtccgaagcaaaggagggactaaaacgcggagaaaccacgaaacatgcagtttcacgcggaactgcaaaactacggtggttcgtagaacgtaatcttgtaaaaccagagggaaaagtgattgatcttgggtgtggtagaggagggtggtcatattactgtgctgggctgaaaaaagtgacagaggtaaaaggttatacaaaaggtggacctggtcatgaagagccaatacccatggcgacatatggctggaacttagtaaagttgcattcaggcaaagatgtttttttcataccacctgaaaagtgtgatactttactgtgtgacattggtgaatcaagtcctaacccaacgatcgaagaaggtcgaacattgagagtgttgaaaatggtagaaccatggctgcgaggaaaccaattttgcatcaaaatattgaatccgtatatgccttcagtcgtagagaccttagaacagatgcaaagaaagcatggaggaatgcttgtacgcaatcccctaagccgaaacagtacacacgaaatgtattgggtaagttgtggtacaggaaacatagttagtgcagtaaatatgacttctagaatgttactaaaccgttttacaatggcacataggaagccaacctatgagagggacgtagacttaggcgcaggaactcgtcacgtcgctgtcgagccggaagtagcaaacctagatattatcggccaaagaatagaaaacattaagcatgagcataaaagtacttggcattatgatgaagataatccatataaaacatgggcctatcacggatcttacgaggttaaaccatctggctcagctagttcaatggtaaatggagtagtcaaactactaactaagccatgggacgttatccctatggtcactcaaatagctatgacagacactactcccttcggacaacagcgggtcttcaaagaaaaagttgacacacgaactccgaaagctaaaaggggtacagcacaaataatggaagtaacagctaaatggctatggggattcctatctcggaacaaaaagccgcgaatctgcactagagaagaatttactagaaaagttaggagcaacgcagctattggcgcggtttttgtggacgaaaatcagtggaattccgcaaaggaggctgtagaggatgagcgtttctgggatttagtacatcgtgagcgtgaactccacaaacaaggtaaatgtgctacatgtgtttataatatgatgggaaagcgggaaaagaagctaggcgagtttggaaaggcaaagggatctcgtgcaatctggtacatgtggttaggagcaagattcctagaattcgaggccctaggatttatgaacgaagatcactggttcagccgagagaactctcttagtggagtagaaggtgaaggtttgcataagctagggtatatactacgcgatatatcaaaaatacccggcggtaacatgtatgctgatgatactgccggttgggacacaagaataacagaagacgatttacaaaacgaagctaggataacagacataatggaacccgaacatgcactactagctaaatccattttcaaattaacttatcaaaataaagtggtcagagtccagagacctgcaaaaaatggaactgtaatggatgtaatctctagacgagaccaacgcggatccggacaggtgggaacatatgggctaaacacatttacaaatatggaagcccagttaattcgacaaatggagtctgaaggaattttctctcctagtgaattagaaacgccaaacctcgcagaaagagtactggactggttggaaaaatatggtgtcgagagattaaaacgcatggctatttcgggtgatgattgtgttgtgaaaccaatcgacgaccgatttgctacggcattgacagcgttaaatgatatggggaaagtaagaaaagatataccacaatgggaaccttccaaaggttggaacgactggcagcaagtaccgttctgtagccatcacttccaccaattaataatgaaagatggaagagagattgttgtaccatgtagaaaccaagacgaactcgttggtagagctagggtcagccagggagcaggatggagtctgagggaaactgcgtgcttaggaaagagctacgcacagatgtggcagttgatgtatttccatagacgtgacctgcgattagctgctaatgcaatctgcagcgcagtaccggtagactggattcccacatcccgaacgacttggagcatccatgcacatcaccaatggatgacgaccgaggatatgctatctgtatggaatcgtgtatggatagaagaaaatccatggatggaggataaaacacacatcagtagctggggtgacgtcccctatcttgggaaaagagaagatcaatggtgcggaagcttaattggcctaactgcgagagctacgtgggctactaatatacaggtggcaataaatcaagtgagacgacttatagggaatgaaaactacttagactatatgacctctatgaaaagatttaaaaatgaaggtgatcctgaaggagctctatggtga

SEQ ID NO: 21499 - RNA, 9879 nt, synthetic construct
  misc_feature 1..9879: note = derived and/or modified CDS sequence (opt6) from DENV-1__FJ432719__SS-prME
  source 1..9879: mol_type = other RNA
agtgtaacgatgttactgatgttaatgccgacggcactagctttccatctcactacgcgaggaggagaacctcacatgattgtatccaaacaagaacgtggtaagagcttgctgtttaaaactagcgctggggtaaatatgtgcacgttaattgcaatggacttaggggaactatgtgaagatactatgacatacaaatgtccgagaattactgaaaccgaaccagatgatgtggactgctggtgtaacgcgactgatacttgggtgacatacggcacatgtagtcaaaccggtgaacatagacgcgataaaaggagtgtagctttggccccgcacgtagggttgggactggaaaccagaaccgaaacatggatgtcaagcgagggtgcatggaaacaaatacaacgagtagaaacttgggcattaagacacccgggatttacagtaatagctctatttttggcacacgctattggcacatctattacacaaaaaggtattattttcattttactaatgttagttacaccatcaatggcaatgcgttgtgtgggaataggaagtagggattttgttgaaggccttagtggagccacctgggttgatgtagtactagaacatggcagctgtgttaccacgatggcgaaagacaaacctactttggacatagagctattgaaaaccgaagttacaaaccccgcagttttgcgcaaactatgtattgaagctaaaataagtaatacgacaacggacagccgatgtcctacacaaggcgaggctacacttgtagaagaacaagatgcaaattttgtctgtagaaggacattcgtcgatcgagggtgggggaatggttgcggattatttggtaaagggagcttaattacatgcgcaaaatttaagtgcgtaacaaagctcgaaggaaaaatagtacaatatgagaacttgaaatactcagtgattgtaactgtgcataccggagatcaacatcaagtcggaaacgaaagcacagaacatggaacaaccgctaccataactccacaagctccaactgccgaaatacaattaacggattacggcgcactaactctcgattgctcaccccgcacaggattagatttcaacgaaatggtgctattaactatgaaggagaaatcatggctagttcataaacaatggttcctagacctgcctcttccctggacctctggggccagtacaagtcaagaaacttggaacagacaagatttactcgtgacattcaaaacggcccacgcgaagaagcaagaagtggtggtattaggctcgcaagaaggcgctatgcataccgcattaacgggggctacagagattcaaacatcgggtacaacgacgatatttgctggccacctcaaatgcagactaaaaatggataaacttacattaaaaggtatgagctacgtcatgtgcacagggtcctttaagctagaaaaagaactagcagagacacaacatggaaccgtattggtacaaattaaatatgaaggtaccgacgcaccatgcaagataccgttctctactcaagatgagaagggggttacacaaaatggaagactaatcactgcaaatcctatagtaacagataaagaaaaacccgtgaacattgaagctgagccaccattcggggaatcctacatagtaattggggctggagaaaaagccttaaaattatcatggttcaagaaaggctccagtataggcaaaatgtttgaagcaacagctagaggagctaggcgtatggcaattctaggtgatacagcctgggatttcggtagcataggaggagtctttacatccgttggtaaattagttcatcaaatattcggcaccgcttatggggtactattcagcggagtttcttggaccatgaaaattggaattggagtcttgttaacatggctaggactgaatagcagaagcactagcttatcaatgacgtgtatagctgtcggacttgtaacactttatcttggagtaatggtacaagcagattctggatgcgtgattaactggaagggacgtgaattaaaatgtggctcgggtatttttgtgacaaacgaagtacatacctggactgagcaatacaaatttcaagcggattcgcccaaaagattaagtgcagctattggaaaagcatgggaagaaggagtttgtggtatcaggtcagcgacacgactagagaacataatgtggaagcaaatttcaaacgaactgaatcacattctattagagaatgacatgaaatttactgttgtagttggagatgttgcgggtatcttagcgcaaggcaagaaaatgattcgaccacagccaatggaatataaatattcatggaaaagctggggtaaagcaaaaataattggagcagacgtacagaacaccacattcataattgatgggccaaacacacctgaatgccctgatgatcaaagagcatggaatatttgggaagttgaagactatggtttcgggatcttcacaacgaatatttggctaaaactacgtgatagctatacgcaggtttgcgatcataggctcatgtcagcagccatcaaagatagcaaagccgtccacgcagatatggggtactggattgagtccgagaaaaatgaaacatggaaacttgcaagagcctcttttatagaggtgaaaacttgtatatggccaaaaagtcacacattgtggtcaaacggagttcttgaaagcgaaatgataattcccaaaatttacggcgggccaataagccaacacaattatcgaccgggctactttacacagacagcaggtccgtggcaccttggaaagctcgagctagattttgacttatgtgaaggtacaacagtagttgtcgacgaacactgtggaaaccgaggaccgagtttaagaacaacaacagtaaccggaaaaataatacatgaatggtgctgtcggagttgtacattaccacctttaagatttcgaggtgaagatggatgctggtatggaatggagataaggcctgtgaaggaaaaagaagaaaacttggtgaagtcgatggtaagcgcaggctcaggggaggtcgattcttttagcctcggtctattgtgtatatcgattatgattgaagaggtaatgcggtcaagatggagtcgcaagatgctaatgacgggaacattagctgtatttttcttattaattatgggacaactcacgtggaatgatttgataagactatgtatcatggtcggtgccaatgcatcagatcgtatgggaatgggaacaacttatttggcgctaatggcaacattcaagatgagacctatgttcgcggtcggattattgtttcgaagattgaccagtagggaagtattactactaacaattggcctttccttagtagcgagtgtggaactacctaatagccttgaggaattaggagatggattggctatgggaataatgatattaaaactgttaactgattttcagagtcatcaattatgggcaacactgctgagtctaaccttcataaaaactaccttctccttacactacgcttggaaaactatggcaatggttttgtctattgtaagtctgtttcctctgtgcttatcaacaacttcacagaaaacgacatggctcccagtactgctagggagcctaggatgtaaacccttgaccatgtttttgatcgctgaaaataaaatttggggtagaagaagttggccactcaacgaaggcataatggccgtgggaatagttagcatacttctaagttcgctcttgaaaaatgatgtccccctagccggaccgttaatagctggtgggatgttaatagcatgttatgtgatttcaggttcgtccgccgatttaagcctcgaaaaggcagcggaagtatcatgggaggaagaagcagagcacagcggtgctagccataacatcctagtagaagtgcaggacgatggcacaatgaaaataaaagacgaagagagagatgacacactgacaatattattaaaggccacgttactagctgtaagcggagtttatcccttaagtatcccggcaacattatttgtatggtatttctggcagaagaagaaacaaagatcaggagtgttatgggatacgccatcgcctccagaagtggaacgcgcggttctagacgacggcatctatcgaataatgcagagaggactattaggaagatcacaagtcggagttggtgtatttcaagaaaacgtattccacactatgtggcacgttactagaggtgccgtattaatgtatcaagggaagcgactcgagccatcctgggcaagcgtcaagaaagacctcatatcgtatgggggtggctggagactacaaggttcatggaatacaggcgaggaggtacaagttattgccgtagaaccgggcaaaaatccgaagaatgttcagacagcccccggtacctttaaaacacctgaaggggaagtaggcgcaatagcgctagatttcaaaccaggaacctcaggttctccaatagtaaacagagaaggaaaaattgtagggttatatggtaatggagtagtaacgactagcggtacgtatgtaagcgcaattgctcaggcaaaagccagccaagagggtccattacctgaaatagaagatgaggtcttcagaaagagaaatttaacaataatggacctacatcccggaagtggcaagaccagaagatatctgccggccatagtaagagaagcgataaaacggaagttgcgcacactaatactagccccaactagagttgttgcctcggaaatggcagaggccttaaaaggcatgcctattagatatcaaacaactgcagtaaaatcagaacatactggtaaagagatagttgatctaatgtgtcacgctactttcactatgagactattaagccccgtacgagttccgaattacaatatgataataatggatgaggctcatttcaccgacccatcaagtatagcagcacggggttatataagtacgagagttggaatgggagaggctgccgctatatttatgactgcgacaccgccaggatcagttgaagcatttccacaaagcaacgccgtgatccaagatgaagaaagagacattcctgaaagatcgtggaatagcggttatgagtggattactgattttcctggtaagacagtctggtttgtaccaagcataaagtcaggaaatgacatagcaaactgcctgagaaagaatggaaaaagagtaattcaactttcacgaaaaacctttgatacagaataccagaaaactaaaaataatgactgggactatgtggtaacaactgatatatcagaaatgggcgcaaatttccgagctgatagagtaatcgacccacgaagatgcttaaaacctgtaatcttaaaagatggtccagaacgtgtgatcctggctggtccaatgccagtaacggtagcctcagcagcgcaaagacgaggacgaataggacgtaatcacaataaagaaggggaccaatatatttacatgggacaaccacttaacaacgacgaagaccatgcacattggaccgaagctaagatgctcttagataacatcaacaccccggaggggatcattcctgcacttttcgagcctgagcgagaaaagagcgccgcaattgacggagagtacagattacggggagaggcacgcaaaactttcgttgagctaatgagacgtggggatctgcctgtctggttaagttataaggtagcttcagaagggttccaatactcggatcggcgatggtgctttgacggtgaaagaaacaaccaagtgcttgaagaaaacatggacgtggaaatatggaccaaagaaggggagcgaaagaaattgagaccaaggtggctggatgccagaacgtactccgatcctttggctttaagggaatttaaagagttcgctgctggtagaaggtcagtctcaggcgatcttattctagagattggaaagttaccacaacatttgacgcaacgagctcaaaatgctttggacaatctagtcatgttgcacaactcagaacaagggggtcgcgcctatcgacatgcgatggaagaactacccgatactatcgaaacattgatgctactggctctaatagctgttcttaccggaggggtaaccctattctttctttcaggtagagggctaggaaaaacgtcaattggccttctctgcgtgatggcaagtagtgtattactatggatggctagtgtagaaccgcactggatagccgcaagtattatcttggagtttttcttaatggtgttattaattccagagcccgatagacagaggacacctcaagacaaccagttagcatacgttgtaatcggtcttctatttatgattttaacagttgcggcaaacgagatgggattacttgagactacgaagaaagaccttggaataggccatgtagcagttgagaatcaccatcatgcagctatgcttgatgtagatttacatccggcatctgcttggaccctatacgccgttgctaccactataataacaccaatgatgagacatacaatagagaacacgacagctaacatcagcttaactgcaattgcaaaccaagcagcaatcttgatgggcctggacaaaggctggccaatatctaaaatggatataggtgtacccctcctcgcactaggatgttattcacaagtcaatcctctaacgctcaccgcagcagtccttatgttagtagctcactatgccataatcggtccaggtttacaagccaaagctacaagagaagcacaaaagagaacagcggcgggaataatgaaaaatccaactgttgacggaattgttgctatagatctagacccagtggtatatgatgccaaatttgaaaaacaattaggacagattatgttattgatactatgcacaagtcaaatattattaatgagaacaacatgggctctgtgtgagtcaattacattagcgacaggtcccctaacaacgctttgggaagggtcacctggcaagttctggaacaccacaatagcagtatcgatggccaatatttttcggggctcttatcttgcaggggcgggactagcattttcattaatgaagagtttaggtggaggcagacgaggcacgggcgcgcagggcgaaacacttggggaaaagtggaagaggcagttgaatcaattaagtaaatctgaatttaatacgtataagcgaagtgggataatggaagttgatagatcagaagcgaaagaaggtcttaaaagaggcgaaacaaccaagcatgcggtttcaagaggaacggctaaacttcgatggttcgtagagcgtaacctagtcaagccagaagggaaagttatagatttaggttgtggaagaggaggatggagctactactgcgcgggtttgaaaaaggtcaccgaggtaaaaggatatacaaaagggggacctgggcacgaggaaccgatcccaatggcaacgtatggatggaatcttgtcaaattacattcaggaaaggatgtgttcttcataccacccgagaaatgcgacacactcctgtgcgacattggtgaatcatcccccaatccaaccatagaagaaggtcgtaccctacgggttctcaaaatggtcgaaccctggctgcgaggtaatcagttctgcataaagatacttaacccctatatgccctctgtcgtcgagacattggaacaaatgcaaagaaaacatggcggaatgcttgttaggaatccgttatcaagaaactccacgcatgaaatgtattgggtaagttgtggtaccggcaatatagtatccgcagtaaatatgacatccagaatgcttcttaatcgatttaccatggcacatcgtaagccgacttacgaaagagatgttgatttaggcgccggaactcgccatgtagcagtggaaccagaagttgcaaacctagatataatagggcaaagaatagagaacatcaaacacgaacacaaatcaacctggcattatgacgaagataacccatacaagacatgggcatatcacggctcttatgaagttaaaccaagtggaagcgcctcttctatggtaaacggagtagttaaactacttacaaagccctgggacgttataccgatggtgacccaaattgcaatgacagataccacacctttcggtcaacaaagggttttcaaagaaaaagttgacacaagaacaccgaaagcaaaaagaggtaccgcacagatcatggaagttactgctaaatggttatgggggttcctaagtcggaataaaaagccacgaatttgtacacgagaagaatttaccagaaaagtaagatctaacgctgccataggggccgtttttgtggacgagaatcaatggaactcagcgaaagaggcagttgaagatgagagattttgggatttggttcatcgtgaaagagaattacataagcaaggcaagtgtgcaacatgtgtatataatatgatgggtaagagggagaagaaactcggcgagttcgggaaagcgaaaggatcgcgggccatatggtacatgtggctaggcgcaaggttcctcgagttcgaagctcttggatttatgaatgaagatcactggttcagtagagaaaactccctcagcggggtcgagggggaaggattgcacaaacttggttacatactaagagacataagcaaaattccgggaggaaatatgtatgccgacgacactgcaggatgggatacaaggataacagaggatgacctacagaacgaagctcgtattacggatatcatggagcctgaacatgcattattggctaaatcaattttcaaactaacttatcagaataaagtcgtacgtgtacaaagaccggccaaaaacggaactgtcatggatgtaatctcacgtcgagatcaaaggggtagcggccaagttggaacttatggactaaatacatttacaaatatggaagctcaactaatcagacagatggaaagcgaaggtatcttcagtcctagtgaattagagacaccgaacttagcagaacgcgttcttgactggctcgaaaagtacggagtcgagaggctgaagagaatggcaatttcaggagatgattgcgtagtaaagcctattgacgacagattcgcaaccgcactaacagctttgaatgatatgggaaaggtaaggaaggatatccctcaatgggaaccaagcaaaggatggaacgattggcaacaggtaccattttgttcccatcacttccatcaattgattatgaaggatgggcgagaaatagttgtgccatgtagaaaccaggacgaattggtcggccgagctcgagttagtcaaggtgcaggctggagtttgcgtgaaacagcttgcctaggcaaaagctatgcacaaatgtggcaactaatgtactttcataggagggatctaagactagcagcaaacgcaatttgttcagcagtaccggtagactggataccaacatccagaactacgtggtctattcatgcgcatcatcaatggatgactactgaagatatgctctcggtttggaatcgtgtatggatagaagaaaatccgtggatggaagataaaacgcacattagtagctggggtgatgtaccctatttaggaaaacgcgaagaccaatggtgtggcagcttaattggattaactgctcgggcaacatgggcaactaacatacaggtcgcaataaaccaggttcgaagactaatcggcaatgaaaattacctcgactatatgacaagtatgaaacgctttaaaaatgaaagtgacccagaaggggcactctggtaa

SEQ ID NO: 21500 - RNA, 9879 nt, synthetic construct
  misc_feature 1..9879: note = derived and/or modified CDS sequence (opt6) from DENV-1__FJ182020__SS-prME
  source 1..9879: mol_type = other RNA
tctgttaccatgctacttatgttaatgccaactgccttggctttccatttaaccactagaggcggtgaacctcatatgatagtgtcaaaacaggaacgaggtaaatcactactttttaaaacatcagcgggagtgaacatgtgtacactcatagctatggacttaggagagttctgtgaagataccatgacatataagtgtccaaggataacagaagcagaaccggacgacgtagactgctggtgcaacgcaaccgacacatgggttacttacggaacctgttcccaaactggagaacatagacgagataagagaagcgttgcattagcaccacatgtggggcttggactagaaacgagaactgaaacatggatgagctcagaaggagcttggaaacaaatacaaagagtagaaacttgggctctcagacatccagggttcactgtgatcgcattattcctagcccatgcgataggaacaagcataactcagaaaggcataatctttatcctgttaatgttagtgacgcctagtatggcaatgaggtgcgtaggtattggaagcagagactttgtggaaggtttgtcaggagctacttgggtagacgttgtgttagagcatgggtcttgcgtcactactatggccaaagataaaccaacacttgatatcgaactattgaagacggaagttacaaatccggccgtactgcggaaattatgcattgaagctaaaatatccaatactaccacagactcaagatgtccaacacaaggcgaagcaacgttagtcgaagaacaagacgcgaattttgtttgtagacgtacattcgtagacagaggttggggaaacgggtgtggtcttttcggaaagggatctcttataacgtgtgcgaagttcaaatgtgtaactaaactagaggggaaaatagtccaatatgaaaacctgaaatattcagttatagtcaccgttcatacaggtgaccagcatcaagttggtaatgaatcgacagagcatggaaccacagcgaccattacaccacaagcaccaagcacagaaatacaactcacggattacggtgcattaaccttagactgttcaccgcgcaccggtcttgacttcaatgaaatggtacttttgacaatgaaagaaaaatcctggttggtacataaacaatggtttctcgatttacctcttccgtggacaagtggggcctcaacctcacaagaaacttggaacagaaaagacttattggttacatttaaaactgctcatgctaaaaagcaagaagtagttgttctcggttctcaagaaggggcaatgcatacggctctaacgggggcaacagaaatacaaacaagcggtactacaactatctttgccggtcatctaaaatgtagacttaaaatggacaagctaactctcaagggaatgtcatatgtgatgtgcactggctcatttaaactagaaaaagaggttgcagaaactcaacacggtactgtattagtccaaataaagtatgaaggaactgacgctccatgcaagatccccttctcgacacaggacgaaaaaggagtgactcaaaatggacgactgataacagctaacccgattgtaacagataaggagaaacccgtaaatatagaggcagaacctccttttggagaatcgtatattgtcatcggcgcaggggagaaggcgttaaaactaagttggtttaagaaaggatcgagcataggaaaaatgtttgaagcaactgcccgaggtgcacggagaatggcaattctcggagacacagcttgggatttcggaagtattggtggcgtgtttaccagcgttggaaaactcgtgcatcagatctttggtactgcttacggtgtgctattttcaggcgtctcgtggacaatgaagattggaataggtgtgctactaacatggcttggtttaaatagtagatctacatctcttagtatgacgtgtatagcagtaggtctggtgacactatacctaggagtcatggtacaagcagactcgggatgtgtcataaactggaagggccgagagcttaagtgtgggtcaggcatatttgttactaatgaagtacatacttggacagaacagtataaattccaagcagattcgccaaagaggctgtcagcagctatagggaaagcatgggaagaaggagtatgcggtatacgatcggccactagactagaaaacataatgtggaaacaaatctcaaatgaacttaaccatattttgctagaaaacgacatgaaattcacagttgtggtaggtgacgtcgcaggtatattggctcagggtaagaaaatgatcaggcctcagcctatggaatataaatatagctggaagagttggggaaaagcaaaaattatcggggcggatgtacaaaatacaactttcatcattgatggaccaaatacaccggagtgtccagatgatcagcgcgcgtggaatatatgggaagtcgaagactatggatttggaatttttactacaaatatatggctaaaattgagagattcgtacacccaagtgtgtgaccaccgacttatgtctgccgcaataaaagattctaaagccgtacatgctgacatgggatattggattgaatcagagaaaaacgaaacatggaagctagctcgagctagttttatagaagtcaaaacctgtatatggccaaaaagccatacattatggtccaacggagtactcgaatcagaaatgatcattcccaagatttatgggggtccaatatcacaacataactacagacccggttacttcacgcaaacagcaggaccttggcacctaggaaaattagaactagacttcgacttatgcgagggtactaccgttgtcgtggatgaacactgtggtaaccgaggaccttctttgagaacaacaacagtcactggaaaaataatacatgaatggtgctgtaggagttgcactctcccaccattgaggtttaaaggtgaagacggttgttggtatggaatggaaatacgaccagtgaaggaaaaggaagaaaatcttgttaaatcgatggtgtcagcaggttccggggaagtagattcgttctcattaggtcttttatgcataagtataatgatcgaagaagttatgagatcccggtggtcacgaaaaatgttaatgacgggcacgcttgcagtattctttttgcttattatggggcaattaacatggaatgatctaattcgactgtgcattatggtgggggcaaacgcgtcagatcgcatgggcatgggcacgacgtatctcgcattaatggctacttttaaaatgcgccctatgtttgcagttggacttttattccgtcgcctgacgagtcgcgaagtacttctactgacgattggtttaagtcttgtagcatcagtagaactacctaattccttggaggaattaggagacggattagcaatgggtattatgatactgaaattgctgactgattttcagtcccatcaattatgggctacgttacttagcttaacgtttataaaaaccacgttttcattacactatgcatggaaaacgatggcaatggtgctatctatcgttagtctcttcccactgtgtttaagtaccacatctcaaaagacaacttggcttcctgtattacttggatcgttagggtgtaaacctctaacaatgtttcttatagcagagaacaaaatatggggtagaaaaagctggcctttgaacgaagggataatggctgtcggcatagtatcaattctcttgtcctccttactcaagaatgatgttcctttagctggccctttaattgcaggaggtatgctgatagcttgttacgtcatttcaggatcatctgcagatctttctctagaaaaagcggcagaggtttcatgggaggaggaagctgaacactcgggtgcgtcccataatattcttgttgaagtacaagatgatggaacaatgaagataaaagacgaagaacgtgacgataccttgacaatattactcaaggccactttactagctgtaagcggagtatatcctcttagtatacccgctacactatttgtgtggtacttctggcaaaagaagaaacagcgatcgggagtcctatgggatactccgtcacccccggaggtagagagagcagtgttagacgacggtatttaccgaataatgcaaagagggttgcttggaagatcacaagttggagtcggtgtgttccaagaaaacgtgttccatactatgtggcatgtaacaagaggagcagtgttaatgtatcaaggtaaaagactcgaaccaagctgggcaagcgtcaaaaaggatctaatatcatacggtggtggatggcggctgcaaggtagctggaacacaggagaggaagttcaggtcatcgccgtcgaaccaggtaaaaatcccaaaaatgtgcaaacagctccaggaacatttaaaacatcagaaggggaagtcggggctatcgcactcgattttaagccaggcacctcgggatcaccgatagtaaatagagaaggcaaaatcgttggactatatggaaacggagttgttacaacttccggtacttacgtatcagctatagcacaggcaaaagcatcacaagaaggtccactgcccgagatagaggacgaggtgtttcgaaaaagaaacctaactattatggatctgcatcctgggagtggaaaaaccaggagatacttgccagcgattgtgagggaagcgattaaaagaaaattaagaactttgattctagcaccaacgagagttgttgcaagtgaaatggctgaagcattgaaaggaatgccaataagatatcaaactaccgcagtaaaaagtgaacatacaggaaaagagatagtagacttaatgtgtcatgcgacgttcaccatgcggttattaagcccggtaagagtccctaattataatatgataattatggatgaagcccacttcactgatcctagctccatagcagcacgtggctatattagcacacgagttggtatgggcgaagcggcggcaatattcatgacagcgacgccaccaggctccgtggaagcatttccacaatctaatgctgtaatccaagacgaagaacgagatataccagaaaggtcttggaatagtgggtatgagtggataaccgacttcccagggaaaacagtttggtttgtaccctcaataaaaagtggaaacgatatagctaactgcctaaggaaaaatggtaagagagtaatacaactatcaagaaaaacatttgacacggagtatcagaaaactaaaaacaatgattgggactatgtcgttacaacggacatttcggagatgggtgccaatttcagagctgaccgagtaatcgatccaaggagatgtttaaagccggtgatcttgaaagacggacccgaaagagtgattctagccggccctatgcccgtaaccgtcgctagcgctgcccaaagaagagggagaatcggacgcaatcataataaggaaggcgatcagtacatatatatgggtcagccgctaaacaacgatgaggatcatgcgcactggaccgaggcgaagatgttacttgacaacataaacacaccggaaggtatcatacctgcattattcgaacctgagagagagaaatcagcagcgattgatggagaatatagactacgtggcgaagcacgaaagacatttgtcgaattaatgcggagaggggatctcccagtttggttaagttataaagtcgcaagtgagggatttcagtattcagatcgtagatggtgtttcgacggagagcgaaacaatcaggttttggaagagaacatggacgttgaaatctggactaaagagggagaacggaaaaagttaaggccacgttggttagatgcccgcacatacagtgacccattagcattaagggaatttaaggaatttgcagcaggccgaagaagtgtaagtggtgatctaattcttgaaatcggtaagctaccgcaacacctaacgcagagagcacaaaatgctcttgacaacctggtaatgctccacaatagtgaacaaggagggagagcataccgtcacgcaatggaagaactaccagatacaattgaaactttgatgcttctagcactaattgcagtcctaactggaggtgtaacactattctttctctctggtcgaggactaggaaagacatctattggactattatgcgttatggcatcttcagtactcctctggatggcttccgttgaaccgcactggatagcagcgtcaataatattagagttcttccttatggtactactaatcccagaaccagacagacaaaggactccccaggataaccaactcgcatatgttgtaataggactgctctttatgatattaacagtcgcggccaacgaaatgggattgctagaaacgacaaagaaagatctcggaatagggcatgttgcagtcgagaatcaccatcatgcggccatgcttgatgtagatctccatccggcaagcgcatggacattatatgcggtagccacaactattataacgcccatgatgagacacactatagagaatactactgcaaatatctctctaacggcgatagcaaatcaggcagctatcttaatgggcctggataaaggatggccaataagtaaaatggatatcggggtaccattgttggctctaggatgctatagtcaagttaatccattgactctcacagctgccgtcctaatgctagtagctcattacgcaataataggacctggactacaggccaaggcaactagggaagcccaaaaacgaacagctgccgggatcatgaagaatcccacggttgacgggatcgttgcgatcgacctagacccagtggtatacgatgcaaaattcgagaaacagctgggacagattatgttactgattttatgtacatctcaaattctactaatgcgaaccacttgggcattgtgcgagtccatcacgttagcaacaggaccattaactacgctatgggaaggttctccgggcaaattctggaacacaaccattgcagtatccatggcgaacatatttagaggaagttacttggcgggagctggacttgctttcagtctcatgaaatcactcggaggaggacgtagaggaacaggtgcacaaggagagacacttggtgaaaaatggaaacggcaattaaaccaactatcaaagtctgaatttaacacatataaaagaagtggaataatggaggtagaccgaagtgaagccaaagaaggactaaagagaggagagactaccaagcatgcggtaagtaggggtacggcaaagctaagatggttcgtagaacgaaatctagtaaaaccggaaggaaaagtgatagatttggggtgtggcaggggtggttggagctactattgcgcgggcttaaagaaggtaaccgaagttaaaggttatactaaaggtggacccggtcacgaagaacccatacctatggcgacatatgggtggaatttagtaaaattacactctggcaaggacgtatttttcataccgccagaaaagtgtgatacgttattatgtgatataggtgagagctctcccaacccaacaatagaagaagggcgaactcttagagtgctaaaaatggtagaaccatggctacgcggcaatcagttttgtatcaaaatacttaatccctatatgccatccgttgttgaaacattagaacagatgcaacggaaacatggtggaatgttagttcgaaacccgttatcgcgaaacagtacacacgagatgtattgggtatcatgcggaacaggaaatatagtatcagcagtgaatatgacctctagaatgctgctaaatcgttttacaatggctcatagaaaaccaacttacgaacgagatgttgacctaggggcagggaccaggcacgttgctgtagaacctgaggttgctaacctagatataataggacaaagaattgaaaatatcaagcacgaacataaaagtacgtggcactatgatgaggataacccatacaaaacctgggcgtaccacggaagttatgaagtaaagccctcgggcagtgctagctcaatggtgaatggggttgtcaagttattaacaaaaccatgggatgtgattccaatggtaacacagatcgcgatgacagataccactccttttggtcagcaacgagtcttcaaagaaaaagttgatacaagaactccaaaagcaaagagagggactgcccaaatcatggaagttactgcaaaatggttatggggtttcctaagtcgtaacaagaagccccgcatttgcacacgggaagaatttacccgaaaggttagatccaatgctgcaattggcgcagtattcgtagatgagaatcaatggaacagcgctaaagaagcagtagaagatgaaagattttgggatttagtgcaccgagaacgagagctacataaacagggcaaatgcgcaacctgtgtatacaacatgatggggaaaagagagaagaaacttggagagttcggtaaagcgaaaggctcaagagcgatttggtatatgtggttgggcgcccggtttttagaatttgaagccctgggatttatgaacgaagatcattggttttctagagaaaactcattaagtggagttgagggagaaggattgcacaaacttggttacatactcagggacatctccaagatacctggagggaacatgtatgctgacgatacagcaggatgggacacacgtattacggaagacgacttacaaaatgaagcaaagataacagacataatggaaccggaacatgctttactcgcaaaatcaatctttaaattaacttatcagaataaggttgttagagtccaacgacctgctaaaaatggaacagttatggacgtaataagtagacgagatcagagaggatcaggacaagtaggcacgtacggattaaatacatttacaaatatggaggcccagttgattaggcaaatggaaagcgaaggaatattttctccatcagaacttgaaacgccaaatctagctggacgtgtgctggattggctcgaaaaacatggagtcgaaagactaaagaggatggccataagcggggacgattgcgtcgtaaaaccaatcgacgatagatttgctacggcgctcacagccttaaacgacatgggcaaggtacgtaaagatattccgcaatgggaaccttcaaaagggtggaatgactggcaacaagttcccttttgtagtcaccattttcaccagttaattatgaaggatggacgggaaatagtagttccttgccgtaatcaggacgagctagtaggacgggcaagagtaagccagggggctgggtggtcccttagagaaaccgcatgtttaggtaagtcttatgcccaaatgtggcaacttatgtattttcatcgcagggatctccgactagcagcaaacgcgatatgcagtgcagttcctgttgattgggtacccacgagtagaacaacctggagtatacatgctcatcatcaatggatgacgacagaagacatgctaagcgtatggaatcgcgtatggatagaggaaaatccgtggatggaagataagacacacatatcgagttggggagacgtgccatacttaggtaagcgtgaagatcaatggtgtggatctctaatagggctaaccgcaagagcaacctgggcgaccaacatacaggtcgctataaatcaagtgcgtcgtctaattggaaacgaaaattaccttgattatatgacatccatgaagcgatttaaaaacgagtcagatccagaaggagcgttgtggtag

SEQ ID NO: 21501 - RNA, 9879 nt, synthetic construct
  misc_feature 1..9879: note = derived and/or modified CDS sequence (opt6) from DENV-1__FJ182022__SS-prME
  source 1..9879: mol_type = other RNA
tcagtaacaatgttactaatgttaatgcctactgcattagcttttcatttgacaactaggggcggtgaaccccatatgattgtgtcaaaacaagaacgagggaaatcacttctttttaaaacatcagcgggagtaaatatgtgtacgttaattgctatggatttaggagaattatgtgaagacacaatgacttataaatgtccgcgaattacagaaacagaacctgacgacgtagattgctggtgtaatgctacggacacttgggtgacctatggtacatgtagccaaactggcgagcatagaagagataaaagaagcgtagctttagcgccacacgtaggactaggactcgaaactcgaacggagacttggatgtcaagcgaaggagcctggaaacaaatacaaagagtggagacatgggccctcagacacccgggctttaccgtgatcgcgttgtttttagcgcatgcaataggcacttctattactcaaaaaggcataatctttatcctcctgatgttggtcactccgtcaatggctatgagatgtgttggaataggtagcagagatttcgtcgaagggttaagtggtgccacttgggttgacgtcgtgctcgaacacggtagctgtgtaactacaatggccaaagataaacccaccttggatatagaattactaaaaactgaggtgacgaatccagccgtactacgaaaactctgcatagaagcaaaaatttcaaatacaactacggatagccgctgccccactcaaggtgaagccactctagttgaagaacaagatgcaaatttcgtatgtcgcaggacattcgtagatagaggatggggtaatgggtgtgggttgttcggcaaaggaagtcttataacgtgtgcaaaatttaaatgtgtaacaaaactcgagggtaagattgtacaatatgaaaatctcaaatattcggtaattgtaactgtacacacaggagatcaacatcaagtcgggaacgaaagtaccgagcacggaacaacagcaacgattacaccacaagcacctaccaccgaaatacaactaacagactatggggcactaacactggactgcagccctagaaccgggttagattttaatgaaatggtcctactgacaatgaaagagaaaagttggcttgttcataaacaatggttcttagatctacctctcccctggacaagcggggcaagtaccagtcaagaaacatggaacaggcaagacttattggtaacgttcaaaaccgcacatgcaaagaagcaagaggtagtggtattaggaagtcaagaaggagcgatgcatactgctctaactggagccaccgaaatacaaacttcgggtacgacaaccatctttgccgggcatctgaaatgtcgcctaaaaatggataaattgactctacgcggaatgagctatgtcatgtgtactggaagtttcaaattagaaaaagaagtcgctgaaacccaacatgggacagttttggtacaaattaaatacgaaggtactgacgcgccttgcaagataccgttttcgacacaagacgaaaaaggtgttacacagaatggccgattgatcactgcaaatccaattgtcacagataaggagaaacctgtcaatatagaagctgaaccaccgtttggagaatcgtacatagttattggagcgggagaaaaagcactgaaactaagctggtttaagaaaggcagcagtatagggaagatgtttgaagccaccgcgagaggggcgagacgaatggcaattcttggtgacacggcatgggacttcgggagcataggcggtgtcttcacttcagttggaaagttggtacaccaaatctttggtacagcctatggagtacttttctcaggcgtttcgtggaccatgaaaataggtataggcgtcctattaacatggctcggattaaactcccgatcaacgtccctttcaatgacctgtatagcagtaggtctagtcaccctttatcttggcgttatggtacaggctgatagcggctgcgtaataaactggaaaggaagagaattaaaatgcggtagcggcattttcgtaacaaatgaagttcatacatggacggagcaatataaatttcaagccgatagccctaaacgattatctgcagcaataggaaaagcctgggaagaaggagtatgcggtattcgtagtgcaactcgtttagaaaatataatgtggaagcaaatcagtaatgaactcaatcatatcttgctcgagaacgacatgaaattcactgttgtagtaggcgatgttgccgggatattagcccaaggcaagaaaatgatcaggccacaaccgatggagcacaaatacagctggaaaagttggggtaaagcgaagattataggggcagacgtccaaaacactacctttatcatcgatggtccgaacactcccgaatgcccagatgaccagcgagcatggaatatttgggaagtagaggattacggattcggcattttcacgactaacatctggctcaagttgagggattcttacacacaggtatgtgaccatagactcatgtccgctgccattaaggattctaaagctgttcacgcagatatgggatattggatcgagagtgagaagaacgagacctggaaactagcaagagccagctttatagaggtgaaaacctgtatctggccaaaaagtcatacgctgtggtcgaatggggtactcgaaagcgaaatgattatcccaaaaatatatggtggacctatatctcaacacaattacagacccggatatttcacacaaacagcgggaccttggcatctcggaaaactcgaacttgattttgatctgtgcgagggtactacagtggtagtcgatgaacattgcggtaacagaggtccgtctctaagaacgacaacagtcacgggaaaaattatacatgaatggtgttgtagatcctgcaccttaccacccctcagattccgaggagaagacggttgttggtacggaatggaaataagaccagtaaaagaaaaagaggaaaacttagtcaagagtatggtaagtgcaggatcaggagaagtagatagtttcagcttgggattactatgtattagtatcatgattgaagaggtaatgcggtcccgatggtcacgtaagatgctaatgacagggactctcgcggtgttctttttacttattatggggcaattgacttggaacgacttaataagactatgtataatggtaggcgcaaacgcgagtgaccgtatgggcatgggcactacctacctggctttaatggcaacatttaaaatgcgtccaatgtttgcagtaggattattattcagacgactaacgagtcgagaagttttattgttaacgatcggcttatccctagtagcgagtgtggagttacctaattctcttgaagaactaggcgatggcttagcaatgggaataatgatactgaaactactcacggattttcagagccatcagctttgggccacgttattatccctgaccttcataaaaaccacctttagtttacattacgcttggaaaacaatggctatggtactgtcaattgtatctctctttcctctatgtttaagtacaacctctcagaaaacaacatggctcccagtcctcttaggctcactaggatgtaaacctcttactatgttcctcattgctgaaaataagatatggggtagaaggtcctggccactaaacgaaggcattatggctgtaggtatagtatccattttactatcttctttacttaaaaacgatgtaccgctcgccggtccactcatcgcaggcggtatgttaattgcttgttatgtaatatctggtagctctgcggatctgtcactagagaaagcagccgaagtaagttgggaagaggaagcggagcactcgggagcgtcacataatattctggtagaagtacaggatgacggaacaatgaaaataaaggatgaagaacgtgacgatacactaactatcttactaaaagcgacgttactagctgtatcaggcgtatatcccttaagtatacctgcaaccctatttgtctggtacttctggcagaagaagaaacagcgatctggagtgttatgggatacgcctagtccacctgaagtagagagagcagtattagacgatggaatatacagaatcatgcagcgcggactgctgggtcgtagccaagtaggtgtaggtgtatttcaggaaaatgtgttccacacaatgtggcatgttacgcggggagcagtattaatgtatcagggcaaaaggttagagccttcatgggcgagtgtcaagaaagacttaataagttatggcggtggatggagattacaaggctcttggaatacgggtgaagaggtacaagtcatagccgtagaaccaggcaaaaatccaaagaacgtgcaaacagcgccaggaacatttaaaactccagaaggtgaagtaggtgctatagcattagatttcaagcccggaacaagcggatcacctatagtcaatcgagagggcaagattgttgggttatacggcaatggagtagtgacaaccagtggaacgtatgtttccgcaatcgcgcaagcgaaggcttcgcaggaaggtccgttacctgaaattgaggacgaagtgtttagaaagagaaatctaactattatggacttgcaccccggctccggtaaaacgaggagatacttacccgcgatagtgcgagaagctataaaacggaaactgaggacattaatcctggctccaactcgagtcgtagcttcagaaatggcagaagcacttaaaggcatgcctatcagataccagacaacagcagtcaagtcggagcataccgggaaagaaatcgttgaccttatgtgtcatgctacttttacaatgcgtttgctatcacccgtgcgagtaccgaactacaatatgataattatggatgaagctcatttcactgatccttcatcaattgcggctagaggctatatctctacacgagtaggcatgggagaagcagcggctatattcatgacggccacgccacccggaagtgtcgaggctttccctcaatcaaatgctgttattcaagacgaggaaagagacataccagaaagatcttggaactccggatatgaatggataactgactttcctggtaagaccgtgtggttcgttccttcaattaaatcgggtaatgacatcgccaactgcttacgaaagaatggaaaaagagttatacaactctcaagaaagacgtttgatactgaataccagaaaacgaaaaataatgactgggactacgtagtcacgacggacatatcagaaatgggagcaaatttccgggccgatagagtaattgacccaagacgatgtctcaagccagtgattttaaaagacgggcccgaaagggtaatattagcgggtccgatgcccgtgacggttgcaagtgcagcacagcgacgtggaaggataggcagaaatcataacaaagaaggggatcaatatatttacatgggtcagcccctaaataacgacgaagatcatgcacattggactgaagcaaaaatgctactggacaatatcaatacacccgaaggtataataccggcgctgtttgagccagaaagagagaaaagtgctgcgattgatggtgaatatcgcttaaggggtgaagcaagaaaaactttcgttgaattaatgcggcggggcgacttaccagtttggcttagttataaagtggctagcgaaggttttcagtattcagatagacgatggtgttttgacggagaacgaaataatcaagttttggaagaaaatatggatgtagaaatctggacaaaagaaggtgaaagaaagaaactaaggcctcgatggttggatgctaggacttacagtgatccattggctctgcgggaatttaaagaatttgctgcgggaagaaggtcagtttccggagacctgatactggaaattgggaaactcccacaacatttgacccaacgagcgcaaaatgcactagataatctagttatgttacataattcggagcaaggaggacgagcatatcgacatgcaatggaagagttaccagacaccatagagacactaatgcttttagcattgattgccgtattaacgggaggagtaacattatttttcctcagcggtagggggttaggtaaaacgtcaatcggtctgctatgtgtgatggctagttccgtattgctatggatggccagcgtagaaccacattggattgcagcttcaattatattagagttctttctaatggtacttctaatccctgaaccagatagacaacgcacaccacaggataaccaattagcatatgtggtaataggactattattcatgattcttacagttgcagcgaacgaaatggggctactagaaacgaccaagaaagatttgggtatagggcacgtagctgtagagaatcaccatcatgcagcaatgttagacgtggatttacatcccgcgagtgcatggacactctatgctgtggccacaaccattataacaccaatgatgagacacacaattgaaaataccacggcaaatatatcactgaccgctattgcaaatcaagcagcaatattaatgggattagacaagggctggcccataagcaaaatggacataggagtaccgctgttggcattgggttgttattcccaagttaacccattaacattaacagctgcggtactaatgctggtagcacattatgctattataggtccagggttacaggccaaagctacacgtgaagcacagaaaaggacagccgctggcataatgaaaaatcccacagtggatggaatagttgcaatagatctcgatccagttgtatacgatgccaagttcgaaaaacaactaggtcagataatgctcttaatcctatgtacaagtcaaatattgctaatgagaacaacatgggctctatgtgaaagtataactctggcaacaggaccgttgaccacattatgggaagggtcgccaggaaagttttggaatacaactattgcagtatcaatggctaatatattcagaggctcttatcttgcgggtgcaggactagcattcagcttaatgaaaagtcttggaggtggacgcaggggaactggtgcacaaggagaaactttaggcgaaaaatggaaacgccaattaaatcagttaagtaaaagcgaatttaatacatacaaaagatcgggcataatggaagtagatagatcagaagcaaaagaggggttaaagcgtggtgaaacaacgaaacatgcagtaagtagaggtacagcaaaacttcgttggttcgtggaacgcaatctcgtgaagcccgagggcaaagtgatagatctaggttgtggacggggaggctggtcatactactgcgcaggactcaagaaagttacagaagtgaaaggatatacaaaaggcgggccgggtcacgaagaacctattccaatggcaacatatggatggaacctagttaaattgcatagtggcaaagacgtattctttattccacctgaaaaatgcgatacacttctgtgcgacattggcgaaagttctccaaacccaactatagaagaaggtcgaacattaagggtattaaagatggtagaaccatggctgcgaggaaatcaattttgcataaaaattcttaacccttacatgccgtctgttgtagagacgttagagcaaatgcaaagaaagcacggtggaatgttggttagaaatccgttgtcacgcaactcaactcacgagatgtattgggtttcctgtggaacaggtaacatagtttcagcagttaatatgacctcacggatgctcctgaacaggttcaccatggctcaccgaaaacccacctatgaacgagatgtagatctcggagctggtacacgacatgtagcggttgaaccggaagtcgcaaatttagatataattggacaaagaatagaaaatatcaaacacgaacataaatctacatggcattacgatgaagacaatccatacaagacgtgggcttaccatggcagttatgaagtaaagccaagcggttccgccagttctatggtcaatggggtcgtaaaacttctaacaaagccgtgggatgttataccaatggtcacacaaatagcaatgacagatacaactccattcgggcagcaaagggtttttaaggaaaaggttgataccaggactcccaaggcaaaaagagggaccgcgcaaataatggaggttactgctaaatggttatggggattcctcagcaggaataagaaaccgagaatttgtacgagagaagaatttacgaggaaagtacgtagtaatgctgcgataggtgcagtttttgtagatgaaaatcaatggaactcagcgaaagaagcagttgaggatgaaagattctgggaccttgtacaccgtgaaagagaactacataagcaaggtaaatgtgcaacttgtgtgtataatatgatggggaaacgggaaaagaaactaggagaatttgggaaagccaaaggaagcagagccatatggtatatgtggctaggagctcgatttttagaatttgaagctctgggtttcatgaatgaagatcactggttttcacgagagaactcgctatccggagttgagggcgaggggttacataaactcggatacatacttcgagatatcagtaaaatcccaggaggaaacatgtacgccgatgacaccgcaggttgggacacaagaataacagaggatgatttacaaaacgaagcgcgaataacagatatcatggaacctgaacacgcattacttgcaaaaagtatcttcaaattaacttatcaaaataaggtagttagagtccagcgacctgcgaaaaacgggacagtaatggacgtaatctcgagacgagatcagagggggagtgggcaggtagggacctacgggctgaatacatttactaatatggaagcccaactcatacgtcaaatggaatctgaaggaatattcagtccttctgagttagaaacaccaaatttggcagaaagagtactcgactggctagaaaaatatggagttgaacgactcaagaggatggctatttcaggagacgattgtgtcgtgaagccaatagatgaccgttttgcaacagccttgactgcattaaatgatatggggaaagttaggaaagatattccacaatgggaaccgagtaaaggatggaatgattggcaacaggtaccattttgcagtcatcacttccatcaactcattatgaaggatggaagagaaatagtagtaccatgtagaaatcaggatgagttagtaggtagagcccgtgtgagtcagggagcggggtggagtttgagagaaacagcctgcctgggtaaatcctacgcacaaatgtggcaacttatgtattttcataggagggatttgagactggcggcaaacgcaatttgttcagcagtgcccgttgattggatccccacctcaagaacaacctggtcaatccacgcacatcaccagtggatgaccacagaagatatgctatcagtctggaatcgggtttggattgaagaaaatccttggatggaagacaaaacacacatctcctcttggggagacgtaccctatctaggaaaaagagaggaccaatggtgcggatctttaatcggccttactgctagagcaacttgggcaacgaatatacaagtcgccataaatcaagtgagacgacttattggcaatgaaaactacttagattatatgacgtcgatgaaacggtttaaaaatgaaagcgatccggaaggtgcgctttggtag

SEQ ID NO: 21502 - RNA, 9879 nt, synthetic construct
  misc_feature 1..9879: note = derived and/or modified CDS sequence (opt6) from DENV-1__FJ024447__SS-prME
  source 1..9879: mol_type = other RNA
tccgtcactatgcttctaatgttaatgccgacagcattggcatttcatcttacgacgagaggaggtgagcctcatatgatagtctccaaacaagaaagaggaaaatctttactattcaaaacaagtgctggcgtaaatatgtgcactctcatagcaatggacctaggagaattatgtgaggacacaatgacttacaagtgcccaagaatcacagaaactgagcccgacgatgtagactgctggtgtaacgctacagatacctgggtcacatacggtacttgctcacagacaggggagcatagaagagataaacgtagtgtagctctagcaccccatgtaggattaggtcttgaaacgagaacagaaacttggatgagctcggaaggagcgtggaagcaaatacaaagagtagaaacctgggccctacgtcatccagggttcacggtcatcgcattgtttttagcacatgccataggaacaagtatcacacaaaagggcataatttttatcttattaatgctagttactccctcaatggcaatgagatgcgttggcattggatcaagggattttgtcgaaggcctgtccggagccacctgggtggatgtagtcttagagcacgggagctgtgtaactaccatggccaaagataaacctactttagacatcgaacttttaaagactgaggtaacaaatccagcagttttaaggaaactttgcatagaagcaaaaatttcgaatactactacggatagtaggtgtcctacccaaggtgaagccacacttgttgaggagcaagatgccaattttgtttgtagaagaacattcgtagaccgtggctggggtaatgggtgtggattgtttgggaaaggctctctgattacctgtgccaagttcaaatgtgtgaccaagttagaggggaaaatagtccaatacgaaaatctaaaatacagtgtaatcgtgacggttcacactggggatcaacatcaagttgggaacgagtcgacggagcatgggacgacggcaactataacaccgcaagctcctaccaccgaaattcaattaactgattacggagcgctcacactagactgcagtccccgtacaggtttggatttcaatgaaatggtacttttaaccatgaaagaaaaatcatggctggtacacaaacaatggttcctagaccttccgttgccgtggacaagcggtgctagcactagtcaagaaacatggaaccggcaagatcttctggttacatttaagaccgcacatgcaaagaaacaggaggttgtcgtgctcggatctcaagaaggtgcgatgcatacagcattaacaggtgctactgagattcaaactagtggtaccacaacaattttcgcagggcacttaaaatgtcgcttgaagatggataaactaacgctgaaaggaatgtcatatgtaatgtgcacagggagtttcaaactggagaaagaagtagcagagacacagcatggaactgtgctcgtacaaataaagtacgaaggaacagatgcaccctgtaaaatacctttcagcacacaggacgaaaaaggtgtaacgcagaatggcaggctcatcactgcaaacccaatcgtaacagacaaagaaaagccagtcaatatcgaagcggaaccaccgtttggagaaagctatatagtcataggcgcgggagaaaaagcgttaaaattaagctggttcaaaaaagggagcagcattggaaagatgttcgaagcaacagcgaggggggcgagacgaatggctatactaggagatacagcgtgggacttcggctctataggtggagtttttacatcagtcgggaaggtagtacatcaaatttttggaacagcctacggagttctgttctcaggtgtaagctggacaatgaaaattggaattggcgtccttttgacatggctaggattaaattcacgatctacttccctaagtatgacgtgcattgcagtaggtttggtaactttatacttgggagtaatggtgcaagcagatagtgggtgtgtcatcaactggaagggaagagagttaaaatgtggtagtggaatttttgtaaccaatgaagtacacacttggacagagcaatacaaatttcaggcagactcaccaaaacgattatcagctgcaataggcaaagcctgggaagaaggtgtatgcgggataagatctgcaacgagattagaaaacattatgtggaaacaaatctccaatgagttaaaccatattcttcttgagaacgacatgaagttcactgttgttgttggcgatgtggcgggcatattagctcaaggcaaaaaaatgatcagacctcaaccaatggaatataaatatagctggaaaagctggggtaaagcaaaaattataggcgcagacgttcaaaatactacttttataatagacggaccaaatacaccagagtgtcccgacgaccagcgagcgtggaacatctgggaggtagaagattacggattcggaatttttacaaccaacatttggcttaagttacgtgatagttacactcaagtttgtgatcatagactaatgtcagcagcaataaaagatagtaaagcggtacacgcagacatgggatattggatcgaaagcgagaagaatgagacatggaagttggctcgcgcgtccttcattgaagttaaaacgtgcatatggcccaaatctcatactctatggtcaaatggagtgctggaatctgagatgatcattccaaaaatatatgggggccctatatctcaacacaattataggcctggttattttacacaaacagccggaccgtggcacttaggaaaattagaattggacttcgatctatgtgaaggtacaacagtggttgttgatgaacattgcggaaaccgaggaccaagccttcgtacaactactgtcactggaaaaataattcatgaatggtgttgtcgctcctgtacactaccgcccctgagatttagaggagaggatggatgctggtatggtatggaaattagaccagttaaggaaaaagaggaaaatcttgtaaaatcgatggtcagtgccggtagcggtgaagtagattcattcagtttgggattgttgtgtatatcaataatgatagaagaggttatgcgaagccggtggtccagaaagatgttaatgacaggcacgctggcagtattttttctattgattatgggtcaacttacatggaatgacctaatccgactatgcattatggtaggtgcaaacgctagcgatagaatgggaatgggcaccacatatcttgcattaatggctacatttaagatgcgaccaatgttcgctgttggactgctattccgacgactcacgagccgagaagtactcctcttaactattggtctaagtttagtagcgtctgtagaattaccgaatagtttggaagaactcggtgatggattagctatgggaataatgatactcaaactactaacggactttcaatcacatcaactatgggcaacgctcttaagcctaaccttcataaaaaccacatttagtttacactatgcatggaaaactatggcgatggtactaagtatagttagcctttttccattatgcctgagcactacatcccaaaaaactacctggttgcccgtactattaggatcactaggatgtaaaccccttacaatgtttcttatagcggaaaacaaaatatgggggcgacgtagctggccattaaacgaaggtataatggcagttggaattgtatccatattattatcatcattgttaaaaaatgacgtacccctggctgggcccctaattgctggtggtatgttgattgcatgttatgtaatctctggctcgtctgccgatctaagcctggaaaaggcggctgaggtttcatgggaagaagaagcagagcactccggagcatcccacaacattttggtagaagtccaggacgacgggaccatgaagattaaggacgaggaacgagatgacaccttgaccattctgttgaaggctacacttctagcagtatcaggcgtataccctctatcaatacctgcaacactattcgtctggtatttctggcagaagaagaagcagagaagtggtgtgctatgggacacaccatctccccccgaagttggcagagctgtattagatgacggcatatacagaataatgcagagaggcttacttgggaggagccaggtgggagtaggagtgtttcaagaaaacgtattccatactatgtggcatgttacgcgaggggcagttcttatgtatcaaggaaaaagattagaaccatcatgggctagcgtcaaaaaagacctcatctcctacggaggagggtggagattgcaaggttcttggaacactggagaagaagtccaagtgattgcggtcgagccaggcaaaaacccgaaaaatgtgcaaactgccccgggaacctttaaaaccccagaaggagaggttggagccatcgcactagactttaaacccggtacttctggtagtcccattgtgaatagagagggaaaaatagtagggctctacggtaacggcgtagtaacaacatctggaacatatgtatcagcaattgcacaagctaaagcatcccaagagggtccgctaccggaaatagaagatgaggtattccgtaaaagaaatctaacaatcatggacttacacccaggctcaggtaagacacgacgttatttacctgcaatagttcgggaagctataaaaagaaagcttagaactttaattctagcacctacacgtgtggtagcgtcggagatggcagaagccttaaaaggaatgccaattagatatcaaactaccgcagtgaaaagcgaacacacaggaaaagagattgtggatttaatgtgccatgcgaccttcactatgaggcttttgagtccagttagagttccaaattacaatatgattataatggatgaagcgcactttactgatccaagttcaattgcagcgcgcggatatattagtactcgtgtcggcatgggcgaagcagccgctattttcatgactgcgactccgcctggaagtgttgaagctttcccacagtcaaatgctgtaatccaggacgaggaacgagatattccagaaaggtcatggaactctggttacgagtggataacagactttccaggaaagacagtttggttcgtaccaagcattaaatcaggaaatgatatagctaattgccttagaaaaaatggtaaacgagtaatccaactatctcgaaaaacctttgacacagagtatcaaaagacaaaaaacaatgattgggactatgtagtaacaaccgacataagtgagatgggcgccaactttcgggcggatagggtaattgatccaagacgatgtcttaaaccggttattttaaaagatggaccagaacgcgtcatactagcagggccgatgcccgtaaccgtcgcgtcggctgcccaacggagaggtagaataggaaggaaccacaataaggaaggggaccagtacatatatatgggacaaccattgaataacgatgaggaccatgcacactggacagaggcaaaaatgttattggataatataaataccccggaaggaataatccccgcgctgtttgaacccgagagagaaaagtcagcagctatagacggtgaatatcgattgcgcggagaggccaggaaaacattcgtggagttaatgagaagaggagatctaccagtgtggctttcttacaaagttgcttcagaaggctttcaatacagtgatcgtcgctggtgcttcgacggcgaacgaaataatcaagtgctagaggaaaacatggacgttgagatttggactaaagagggagagcgaaaaaaattacgcccacgttggctcgatgctaggacatattcagacccgttggcactaagagaatttaaagaattcgctgccggcagacgttcagtatcaggtgatttaatcttagaaataggaaagttgccgcaacacctgacacagagagcccaaaacgcattagataatttagtaatgttacacaatagtgaacagggaggaagagcctatagacatgcaatggaagaattgccggatactatcgaaacactaatgttgctcgcccttattgcggtgttaaccggaggagtaacgctgttttttttgagtggaagaggattgggaaaaacttcaataggcttattatgtgtgatggcgtcaagcgttttgctctggatggcttcggtggagccacattggatagccgcaagcattatattagaattttttcttatggtactattaataccagaaccagacagacaacgtacaccacaagacaaccaactagcgtatgttgtgataggactgctctttatgatactaacggtagcagctaatgagatgggactgctagaaactacgaaaaaagacctaggcatagggcacgtcgcagtcgaaaaccatcatcacgcagctatgttagacgttgatctacaccccgcaagcgcatggaccttatacgccgtcgcaacgactatcatcacccctatgatgcgtcatactattgagaacactacagcaaatatctcccttaccgccatagccaatcaagccgcgattcttatgggcctcgacaagggttggccaatctcaaaaatggatattggcgtacctctattagcactaggttgttattctcaagtcaatcctttaacactaaccgcagcagttttgatgcttgttgcacattatgcgattataggacccggactgcaagctaaggcgactagagaagcacaaaagcgcacggcagctggaattatgaagaatccaactgtagatgggatagtggcaattgaccttgatcccgttgtatatgatgcaaaatttgaaaagcaactaggacaaataatgcttttaattctgtgtacttcacaaatattgctaatgcgcacaacatgggcactgtgcgagtctataacactggctaccggcccattaacgacactatgggagggttctccaggcaaattctggaacacaacaatagccgtatcaatggcaaacatctttcgtggcagctatttagctggcgcgggtctagccttcagtttaatgaagagtttaggtgggggtagacgaggcaccggtgctcagggggaaaccctaggagaaaaatggaaacgtcaactgaatcaattatcaaagtcagaattcaacacatataaaaggtcgggaataatggaagtggatagatcagaggcaaaagaggggctaaaaagaggagaaacgacaaaacatgctgtaagtagaggaacagcaaaactcagatggtttgtagaaagaaacttggtcaaaccagaaggtaaggtaattgacctgggatgcggcagaggaggttggagttattactgcgcgggcttaaaaaaggtaacagaagttaaaggatatacaaagggcggaccagggcatgaggagcctatcccaatggctacatacggttggaatttggtaaaattacactctggcaaagacgtattcttcatccccccggagaaatgcgacactctgctatgtgacattggagagagctcgccaaacccaactatagaagaaggtagaacacttcgggttctcaaaatggtggaaccctggttacgaggaaaccaattttgtattaaaatattaaacccttatatgccttcggtggttgaaacattagaacaaatgcaaagaaaacacggaggcatgctcgtaagaaaccctttaagtcgcaattcaacacatgagatgtactgggtaagttgcggtaccggaaatattgtatctgctgtaaacatgacaagtagaatgctccttaacaggttcacaatggctcaccgtaagcccacttatgaaagagatgtagacttaggcgcaggaacacgtcacgttgcagtagaacccgaagtggctaatctggatataatcggacagcgtatagagaatataaaacatgaacataaaagtacatggcactatgacgaagacaatccttataagacttgggcgtaccatggatcttatgaagtaaagccatcagggagcgcatcctctatggtgaatggtgtagtaaaacttttaacaaaaccatgggatgtgatcccgatggttactcagatagcgatgacagacaccacgccattcggtcagcaacgagttttcaaagaaaaagtagataccagaaccccaaaagcaaaacgaggaacggcccagataatggaagtaaccgcaaaatggctatggggttttctatcacgaaataaaaaaccaagaatatgcactcgtgaagaattcacacgcaaggtacgtagtaacgcagcgattggagcagttttcgttgacgaaaatcaatggaatagcgcaaaggaagcggtagaagatgaacgcttctgggatttagttcacagagaaagagaattacataagcaagggaaatgtgccacttgtgtttacaatatgatgggaaaacgtgaaaaaaaattaggagagtttggaaaagcaaaaggaagccgggctatttggtatatgtggttaggtgcccgctttttggaatttgaagctcttggattcatgaatgaagatcactggttcagccgagaaaatagtttaagtggcgtggagggtgagggacttcataaattagggtacatactcagggacatatctaatattccgggaggtaatatgtatgccgatgatacagccggatgggatacacggatcactgaagatgacttacaaaacgaagcgagaatcactgatataatggaaccggaacatgctctgctagcaaaaagtatattcaaactaacataccaaaataaagttgtacgtgtacaacggccagccaagaatggaactgttatggatgttatatccagaagagatcagaggggttcgggccaagtaggaacatatgggttaaacaccttcactaatatggaagcacagctgattagacaaatggagtcagagggcattttctcaccaagtgagctggagacaccaaatttggcagagcgggtccttgactggttggaaaaatatggcgttgaaaggctgaaacgaatggcgatttcaggagatgactgtgttgtaaagcctattgacgaccggtttgctactgcactaacagcactaaatgatatggggaaagttagaaaggatattccacaatgggaaccctccaaaggctggaacgattggcagcaagtcccattttgctctcatcacttccatcaacttataatgaaagacggtagagagattgtcgtaccgtgcagaaatcaagatgaattggttggtcgggcaagggtcagtcaaggtgctgggtggagtctaagagaaacagcatgtttaggcaaaagctacgctcagatgtggcaactaatgtactttcataggagagacctaagattggccgcgaatgctatttgtagcgcagtaccagtggactggatacctacatcacgtactacttggagtattcatgcacaccaccaatggatgaccactgaggatatgttatcagtgtggaacagagtttggatagaagaaaatccttggatggaagataaaactcatatttcgagctggggtgacgtaccatatcttggcaagagagaggatcaatggtgtgggagtttaataggcttaactgcgcgagcaacttgggcaaccaatatacaagtcgctattaaccaagtgagacggttaattggcaatgaaaattacctggactacatgacctcgatgaaaagattcaaaaatgaatcggatccagagggggctctttggtag

SEQ ID NO: 21503 - RNA, 9879 nt, synthetic construct
  misc_feature 1..9879: note = derived and/or modified CDS sequence (opt6) from DENV-1__FJ182025__SS-prME
  source 1..9879: mol_type = other RNA
tccgtgactatgttgttgatgctaatgcccacagccctagcgttccatttgaccacacggggaggcgaaccacacatgatcgttagtaaacaagaacggggcaaatcccttctattcaaaacatcggctggtgtaaatatgtgcacactaattgccatggacctgggcgaattatgcgaagatactatgacatacaaatgtcctagaataaccgagaccgaacctgacgatgtggactgttggtgtaatgccactgatacatgggtcacttatggtacatgtagtcaaaccggcgaacaccgaagagataaaagatctgtcgccttagcgccacacgtgggacttggattagaaacaagaaccgaaacatggatgtcatcagaaggagcatggaaacaaattcaaagagttgaaacttgggcgctacgacatccaggattcacagttatcgcattgtttctcgcacatgctattggtacttcgataacgcaaaaaggtataatctttatattacttatgttggttactccaagtatggctatgcgttgcgtcggcataggatccagagatttcgttgaagggctttcaggtgccacttgggtagatgttgtcctagaacacggaagctgcgttactactatggctaaagataaaccaactctagacatagagttgttaaaaacggaagtaactaacccagccgtcctacgaaaactctgtatagaagccaaaattagtaatacaacaaccgactcaagatgccccactcaaggagaagctacattagtcgaagaacaagatgcaaactttgtctgtagacgtacttttgtagataggggctgggggaacggatgcggacttttcggcaaaggaagcctaattacgtgtgccaaattcaaatgcgtgactaaactggaaggaaaaatcgttcaatatgaaaatttgaaatacagtgtcattgtaaccgttcatacaggagatcaacatcaagttggtaacgaatcaactgaacacggtactacagctaccattactccacaagcacccacgactgaaatacaattaacggactatggagcactcacgttagactgtagccctagaacaggactagattttaatgaaatggtcctcttaaccatgaaagagaaatcatggttagtccataaacaatggtttctggatttacctttaccctggacaagcggtgcgagcacatcacaagagacttggaatagacaagatttattagttacttttaaaaccgctcacgctaaaaagcaagaggtcgttgtattaggtagccaagaaggcgcaatgcatacggcactgacaggtgctacagaaatccaaacctctgggactactacgatatttgcaggtcatctcaaatgtcgactgaagatggacaaacttaccttaaaaggtatgtcgtatgtaatgtgtacgggcagctttaaacttgagaaagaggtcgctgaaacacaacatgggactgttttggtacagataaaatacgaaggaactgacgcaccttgtaaaataccattttcaactcaggatgaaaagggggtgactcaaaacggtcgactaataactgcgaatccaatagttacggataaagaaaaacctgtcaatattgaagccgagccacccttcggtgaatcatacatagtaattggggctggagagaaagccttgaaattatcatggtttaagaaaggatcttctataggaaagatgtttgaagcgacagcacgtggagcgcgtagaatggcaatattaggagacactgcttgggatttcgggtctataggcggtgtatttacaagtgtaggtaagttagtccaccagatttttgggacagcttacggtgtattgtttagcggtgtaagttggacaatgaagatcggaattggtgtactactcacatggcttggtctcaattccagatccaccagcttatccatgacttgtatagcggtgggtcttgttacactgtacctaggtgtaatggtgcaagccgattctggctgcgtaatcaattggaaaggtagagaattaaaatgtggtagcggcatctttgttacaaatgaagtacatacctggacagaacaatataaattccaggctgacagtccaaagagattgtctgcggccataggaaaagcgtgggaagaaggtgtatgcggcattcgcagtgcaactaggctagaaaacataatgtggaaacagatttcgaacgagctgaatcacatattgcttgagaatgacatgaaattcacggttgtagtaggtgatgtagctggtatattagcgcagggcaagaaaatgatccggccacagcctatggaatacaaatattcttggaaatcatggggtaaagctaaaataataggcgcggatgtacaaaatacaacttttataattgatggacctaatacaccagaatgcccagacgaccaaagggcatggaatatctgggaagtggaggattatggattcggaatattcactaccaacatatggctaaaactgagggattcttacacgcaggtatgtgatcacagactgatgtccgccgcaataaaggattctaaggcagtccatgcggatatgggatattggatagaaagcgagaaaaatgaaacatggaaacttgccagagcatcatttattgaagttaaaacctgtatttggccaaaaagtcacacgttatggtcaaatggggttttggagtcagaaatgataataccaaaaatatacggcggtcccatatcacaacataactatagaccgggttatttcacacaaactgctggtccatggcatctaggaaaactagaattggacttcgacctatgcgaaggaacgacggttgttgtagatgaacactgcggtaatcgaggccccagtctaagaacaacgacagttacaggtaaaataatacacgaatggtgctgcagatcatgtacattaccaccattgcggtttagaggtgaagatggatgttggtatggtatggaaattcgccccgttaaagagaaagaagaaaacctagtaaaaagcatggtatccgccgggtcaggagaagttgactcattttcccttggtctattatgtataagtataatgattgaagaggttatgcggtctcgctggagtcgtaaaatgttaatgacaggaacattggctgtcttcttcctcttgatcatgggtcaattaacatggaatgatttaatcaggctttgcatcatggtcggagctaatgcaagtgatagaatggggatgggaacaacatatttagccctaatggctacctttaaaatgagacctatgttcgcagttggacttcttttcagaaggttaacctctcgagaagtcctattgttaaccatcggactttcattggtagcctcggttgaattacccaattctttagaagaactaggagatgggctcgcaatggggatcatgatccttaagctgttgacagacttccaaagtcatcaattatgggccacacttctatcccttacatttatcaaaactactttttcattacactacgcatggaaaacaatggcaatggtactaagcatcgtatccctatttcctctatgtcttagtacaacgagccagaaaaccacctggctgccagttctattaggaagtctcggttgcaaaccgcttacaatgttcctcattgcagagaataaaatctggggacggaggtcgtggccattaaatgaaggaatcatggcagttggaatcgtttcaatcttacttagctccttactaaagaacgatgtacctttagcgggacccctgatcgcaggaggaatgttaattgcatgctatgttatcagcggcagttctgccgacctgtccctagaaaaagcagccgaagtatcatgggaagaagaagcagagcatagtggtgcctctcataacatattggtggaggtacaagacgatggaactatgaaaattaaggatgaagaacgagacgatacactaactatcctattgaaagcaaccctcttggcagtatcaggcgtctacccgctgtcaatccctgcaacattatttgtttggtatttttggcagaagaagaaacaacggtcaggggtgttatgggatacaccttctccaccggaagtaggacgcgcggtattagacgacggtatctaccgaataatgcaaagaggcctactaggacggtctcaagtgggagtcggagtgtttcaagaaaatgtattccacactatgtggcacgtaacccgaggagcggtattaatgtaccaaggaaaaagacttgaaccctcatgggcaagcgtaaagaaagatttaatatcatacggagggggatggcggttacaagggagttggaacactggcgaagaagtacaagtgatcgcagtagaaccaggtaaaaatcctaaaaatgtacaaacagcccccggtacatttaaaacaccagaaggagaagttggtgctatagcactagattttaaacctggtacaagtgggagtccgattgtcaacagagaaggcaaaattgtgggactatacggtaatggggtggttaccacgtctggaacttatgtaagcgcaatagcacaagctaaggcctctcaagagggacccttgccagaaatagaagacgaggtttttcgcaaacgcaacctaactatcatggacctgcatcccggcagtggtaaaacccgccggtatctgcctgccatagtgagagaagcaataaaaagaaaattaaggactcttatattagctccaacccgcgtagtagctagcgagatggctgaagcattaaaaggaatgcccattcgatatcaaacgactgcagttaaaagtgaacacacggggaaggagattgtggacttgatgtgtcatgcaacatttacaatgcggcttttgagcccagtcagggttcctaattacaatatgataataatggacgaagcacattttaccgacccttcatcaattgcagctcgtgggtacatatccacaagagttggtatgggagaagcagccgccatattcatgacagctacgccacccggaagcgtcgaggctttcccgcaaagcaatgctgtaattcaggacgaagaaagagatattccggaacgaagctggaatagcggatacgaatggataactgattttcccggcaaaacagtgtggtttgttccctcgattaagtcaggaaatgatatagcaaattgcttgaggaaaaacgggaaaagggtaattcaattatctagaaaaacttttgatacagaatatcagaaaactaaaaacaacgattgggattatgtcgtaacgacagacatatcagaaatgggtgcaaactttcgggcggatagagtaatagacccgagacggtgtttgaaaccagtcattttaaaagacggaccggagcgtgtaattctggctggaccaatgccggtgacagtagcgagcgccgctcaaagaagaggtaggataggccgtaatcacaataaggaaggcgaccaatacatttatatgggccaacccctgaataatgatgaagaccatgcacattggactgaggccaaaatgttattagataatataaatactccagaagggataattccagcattatttgaacctgagagagaaaaatcagccgctatagacggtgaatataggttaagaggtgaagccagaaaaacttttgtggagttgatgagacgaggagatctgccagtgtggctttcatataaagtagcatctgagggctttcagtattcagataggcgatggtgtttcgacggagaaagaaataatcaagtattggaagaaaatatggacgtagagatatggacaaaggaaggagaaaggaagaaattaagaccaaggtggctcgacgctaggacatactcagatcctctagcattacgagaatttaaagaatttgcggcagggcgtcggtcagtttccggtgacttaatcctagaaattggtaaattaccgcaacacctaactcaacgagcccagaatgcattagacaacttagttatgctgcataatagcgaacaaggaggacgggcctataggcatgctatggaagaactaccagacactatcgagacactcatgctgctagcactcatagcggtgcttaccggaggggtcactcttttcttcctaagcggtcgagggctaggaaaaacatcaattggattactatgtgtcattgcttcatcagtactgttgtggatggcctcagtggaaccgcactggatagccgcatctatcatattagagttctttctcatggttcttctaattccagaacccgacagacaaagaacaccacaagacaatcaacttgcttacgttgttatcggtttacttttcatgattcttacagtcgcggcaaacgagatggggttgttagaaaccactaagaaagatcttggtataggacatgtagcagtcgaaaaccaccatcacgctgcaatgctggatgttgacttgcaccccgcatctgcatggacattatatgccgtcgccactacgatcatcactccgatgatgcgtcatacaattgaaaataccacggctaatatctcattaacagcaatcgctaatcaagcagctatattaatgggattagataaagggtggccgatctcaaaaatggacatcggggttccattactagcactggggtgttattcacaagtgaatcctcttacactaacagcagcggtattgatgttagttgctcattacgcaattattggacctggactacaggctaaagcgacgcgagaagcacagaaacgtactgccgctgggataatgaaaaaccccacagtcgatggtatagttgcaatagaccttgatccagttgtttacgatgcaaaatttgaaaaacaattaggtcaaataatgcttctcatactttgtacatctcagatacttttgatgcgcaccacttgggcgctgtgcgaatcgattaccttggccactggaccactaacaacactctgggaaggctcgcctggaaaattctggaacactacaatcgcagtatccatggcaaatatctttaggggctcatacctcgcaggagcgggactcgcattcagcttaatgaaatcgctcggtggaggaaggcgaggtactggagctcaaggagaaacattaggtgaaaaatggaagcggcaacttaaccaactaagcaagtcagaatttaacacctacaagcgatcaggaatcatggaagtcgatcgatccgaagctaaggagggtttgaaaaggggcgaaacgactaaacacgccgtaagccgtggaactgcgaaattaaggtggtttgtagagcgcaacttggtcaaacctgaaggtaaagttatagaccttgggtgtggtaggggaggatggagctattattgtgcaggtctaaagaaagtcacagaggttaagggttacacgaaaggcgggcccggccatgaagaacctatccctatggcgacatacggatggaatttagttaaactgcactcaggtaaagatgtattctttattcctcccgaaaagtgcgatactttactgtgcgacataggtgaaagtagcccaaatccgacgatagaagaaggtagaacactacgtgtcctaaagatggtggaaccttggctccgcgggaatcaattttgtataaagattctaaatccttatatgccctcggtcgttgaaacactagaacagatgcaaagaaaacatggagggatgctagttagaaacccactcagtagaaactcaactcacgaaatgtattgggtctcatgcggtactggaaatatagtatctgcagttaatatgactagccgcatgctacttaacagatttacaatggcacacagaaagcctacatatgaaagagatgtggacttgggggcaggtactagacatgtagcggtagagccagaagtcgcaaacttggacattattggacaaaggatagaaaatattaaacatgaacataagagtacttggcactatgatgaagataacccatataaaacatgggcataccatgggagttacgaagtcaagccatcagggtctgcaagctcaatggtaaacggagtcgtcaaattattaacgaaaccatgggacgtcatacccatggtgacacaaatagcaatgaccgataccacccctttcggtcaacaacgcgtatttaaggaaaaagttgatacgcgcacaccaaaggcgaagcgaggaacagcccagataatggaagtcactgccaaatggctttggggctttctatccaggaataagaaaccaagaatatgtacgagagaggagttcaccagaaaagtaagatcgaatgcggcaatcggggctgtattcgttgacgaaaatcaatggaacagcgcaaaagaagctgtagaagatgaaagattctgggatctagtccatagggaacgtgaactgcacaaacaagggaagtgtgcaacatgcgtatacaatatgatgggaaaaagggagaagaaactaggtgaatttggtaaagcaaaaggttcgagagccatatggtatatgtggcttggtgcccgttttctagagtttgaagccttagggtttatgaatgaagatcattggttctcgcgtgaaaattcactctcaggtgttgaaggtgagggattgcataaattaggctatatactgagggacatcagtaatataccagggggcaacatgtacgctgatgacactgccggttgggatacaaggataactgaagacgatcttcaaaatgaggctagaatcacggatataatggagccagaacatgcattattggctaaaagtatattcaaattaacatatcagaacaaagtcgttagagtccaaagaccaactaaaaatggtactgttatggacgtaataagtaggcgagatcaaagaggaagtggtcaagttgggacatatggacttaacacctttacgaatatggaagcgcaattgatacgtcaaatggaaagcgaaggaatattcagtccgtcggagctagagactccaaacctagcggaacgggttttggattggctagaaaaatacggtgtagaaagattaaagaggatggcaatttccggtgacgattgtgtagtgaagccggttgatgatcgattcgcgacggctctaacagcgttaaacgatatgggaaaagtaagaaaagatattcctcaatgggaaccttcaaaaggatggaacgattggcagcaagtcccattttgtagccaccatttccatcagttaattatgaaggacggaagagaaattgtcgtcccctgccgtaatcaagacgagctagtcggtcgcgcccgggtctcccaaggagctggctggagtttgcgtgaaaccgcttgccttggcaaatcatatgcgcagatgtggcaactaatgtattttcatagacgggacctacgtttagccgcaaatgctatatgttctgctgttccggtcgactggatacctaccagtcgaacaacctggtcaatacacgctcatcaccaatggatgacaactgaagatatgttatcagtgtggaaccgcgtatggattgaggagaatccatggatggaagataaaacacatatctcatcctggggagacgttccatatttaggtaaaagggaagaccaatggtgcgggagtctgattggtttaaccgcgagggcaacttgggctacaaatatacaggtcgcaataaatcaggtcagaagattaattggaaacgagaactacctagattacatgacaagcatgaaacgtttcaagaacgaatcggatccagaaggagccctgtggtag

SEQ ID NO: 21504 - RNA, 9879 nt, synthetic construct
  misc_feature 1..9879: note = derived and/or modified CDS sequence (opt6) from DENV-1__FJ373297__SS-prME
  source 1..9879: mol_type = other RNA
agcgtaacgatgctactgatgctaatgcccacggcattagcatttcatttaactacgagaggtggggaaccccatatgatcgtttctaaacaagagcgggggaaatcgctattatttaaaacctcagcaggggtcaatatgtgtactttaattgcaatggacctaggggaactatgtgaagatacaatgacctataaatgccctagaataactgaagtcgaaccagatgacgtagactgttggtgtaatacaactgacacatgggtaacatatggaacctgttcacaaaccggggaacatagacgtgataaacgaagcgtggctctggcacctcatgttgggttggggttagaaacgagagccgaaacttggatgtcatctgaaggagcttggaaacaaatccaaaaagtcgaaacttgggctttaagacacccgggatttacggtgatcgctctatttctagcgcatgccatcggaacaagcatcacacaaaaaggtataatctttatactcctaatgttggttactccctcaatggcaatgagatgtgtaggcatcggaagtagggactttgtagaagggttaagcggggcaacttgggtcgatgtagtactcgaacacggatcatgtgtgacaacaatggccaaagacaaaccaacacttgacattgaattattaaaaaccgaagtaactaatcctgcagtattaagaaaattatgtatcgaggcaaaaatatccaacaccaccactgactcccgctgccccacccaaggcgaagcaactcttgtagaagaacaagatgcaaattttgtatgtagaaggacatttgtagatcgaggatggggcaacgggtgtggcttatttggtaaaggtagtctgataacgtgcgccaaatttaaatgtgtcacgaaactagaaggcaaaatcgtgcaatacgagaatctcaaatatagtgtaatcgtaactgtacatactggtgatcaacaccaggttggaaatgaaagtaccgaacatggaactacggctaccatcacacctcaagcccctacaagcgagattcaattgacggattatggtgctctcactttagattgtagcccaagaactggactcgatttcaatgaaatggtccttttaacaatgaaagagaaatcttggctggtgcacaaacaatggtttctcgacttacccctgccctggacatcgggagcttcgacctcacaagaaacatggaatagacaagatctacttgttactttcaaaactgcacatgcaaagaaacaggaagtagttgtattaggatcgcaagagggggctatgcataccgcactaacaggagctaccgaaattcaaacttctggaacaactaccatttttgcaggtcatctgaaatgcagattaaaaatggacaaactaacgttaaaaggtatgtcgtatgtaatgtgcactgggttgtttaaactagaaaaagaggtcgcagagactcaacacggaacagttctggtacaaataaaatacgaagggacagatgccccttgtaagattccctttagtacacaagacgagaaaggtgtaactcaaaatgggagactcataaccgcaaaccctattgtaacagataaagaaaagcctgtgaatatagaagcggaaccacccttcggagaaagttatatcgttataggagccggcgaaaaggccttaaaattgagttggtttaagaaagggtcaagcattggaaagatgtttgaagcaacagcgcggggtgcaaggcggatggcaatattaggagacacggcgtgggactttggcagcataggaggggtctttacctcagtaggcaaattagtacatcaaatcttcggaacggcatatggcgtattattttctggagtaagctggactatgaaaattggtataggcgttctgcttacttggttagggttaaacagtcgctcaacatcgctaagcatgacttgtatcgcagttggattagtcaccttatatttgggagtcatggttcaagcagactcgggttgcgtgatcaattggaaaggaagagagctaaaatgcggaagcggtatatttgtcaccaatgaagttcacacttggacagagcaatacaaatttcaggctgattcgccgaaaagattatcggcagctatagggaaggcttgggaggagggagtatgcggaatccgaagcgcgacccgattagaaaatattatgtggagacaaatatctaatgaattgaaccatatactcttagaaaacgatatgaaattcactgttgttgttggcgatgttgtaggcattttagcccagggcaagaaaatgattaggccacagccgatggagcataagtactcgtggaaatcctggggtaaagctaaaataatcggagccgacgtacaaaatacgacctttatcatcgatggacctaatacccctgaatgtcccgacgatcaaagagcctggaacatttgggaagttgaagattacggatttggaatctttaccacgaatatatggctaaagttgcgtgatagttacacacaagtgtgtgatcacaggcttatgtctgcagcaattaaagatagcaaggctgtacacgcagacatggggtattggatagaaagcgagaaaaatgaaacatggaagttagctagagcttcattcatagaggtcaaaacgtgcatctggcccaaatcacacacattgtggtctaatggggtattagagtctgaaatgataataccaaaaatatatggaggaccaatatcacaacataattacagaccgggatacttcacccaaacggccggtccatggcacttgggtaagttagaactagactttgacctatgcgaaggtactaccgtagtggtagatgaacattgcggcaatcgaggaccatcgttaagaacaacgaccgttacgggaaaaataattcacgaatggtgttgtaggtcttgcactttaccaccccttcgttttaaaggtgaggatggatgttggtacggaatggaaatacgccccgtaaaagagaaagaagaaaatctagtaaaatctatggtgagtgcagggtcaggtgaggtagatagtttttcattggggctgttatgtatatcgattatgatagaagaggtaatgagatcaagatggagcagaaaaatgctcatgactggaacactagctgtattctttttactgattatggggcaactgacgtggaacgacttaataagatcgtgtatcatggtaggtgctaatgctagtgatagaatggggatggggactacttacttagccctaatggccacttttaaaatgaggcctatgtttgctgtaggattattatttcgacgcctaacgtcacgtgaagtactattgctaacgataggtttaagcctagttgcgagcgtggagttaccaaatagtctggaagaactgggggacggcctagcgatgggcataatgattcttaaactgctaaccgattttcaatcctatcaattatgggcaacactattatcattaacattcattaaaacaacattttcgcttcattatgcgtggaagacaatggctatggtactaagtatagtctcactattaccactatgtctgtctacgacatcgcagaaaacgacttggctcccagtgctactaggaagtctcggatgtaaacccttaacgatgttcttgattgcggaaaacaaaatatggggacggaagtcatggcctctgaatgaaggaataatggcagtgggaatagtatctatattattatcatctctcctcaaaaatgatgttcctctagcaggacctctcattgcgggaggcatgttgatagcatgttatgttatatcaggctcaagcgcggatttgtctttagagaaagcagcagaagtctcatgggaggaagaggcagagcattcgggagcaagtcataacattttagtagaagtacaagatgatggcactatgaaaataaaagacgaagaaagagatgatacccttactattttattgaaagcgaccctcttggcggtaagtggcgtttacccgttgtcaattccggccacactgtttgtgtggtacttttggcagaagaagaaacaaaggtctggcgtcctgtgggatactccgagtccaccagaagtagagcgagcagttttagatgatggcatttatagaattatgcaaaggggcttattaggacgctctcaagtaggagtgggcgtgtttcaagaaaatgtatttcatacaatgtggcacgtaactagaggagcagtactcatgtatcaaggtaaacgattagagccgagttgggcttcagttaagaaagatttaatttcttacggcggaggctggaggctacaaggtagttggaacacaggagaagaagttcaggttatagcagtggaaccgggcaaaaatccgaagaacgtacaaactgctccaggtacattcaaaacaccagagggggaagttggagcaatagcgctagatttcaaaccagggacaagtggatcacctattgtgaatagggagggtaaaattgtgggtctgtacgggaatggcgttgttacaacatccggtacttatgtctctgcaatcgcacaggcgaaagcaagccaagaaggcccgttgcctgaaattgaagatgaagtatttagaaaacgtaatttaactataatggacctacatccaggatcgggcaagaccagaagatacctaccagctatagtgcgagaagcaattaaaagaaaacttcggaccttgatattggccccaacgagagtagtagcaagtgaaatggcagaagcattaaaaggaatgccaatccgatatcaaacaaccgctgtaaaatctgaacatacaggtagagagatagtggatttgatgtgccatgctactttcacaatgcgactgttaagtccggtgagggttccaaactacaatatgataataatggatgaagcacattttactgatcccagttctatcgcggcgaggggttatatttccacgcgggtaggcatgggggaggccgctgcgatttttatgactgctacaccacccgggtcagtcgaagcattcccacagagcaatgcagtaattcaggacgaagaaagagatatcccagaacgtagctggaactccggatatgagtggatcactgacttcccaggaaaaacagtctggtttgtgccgagtattaaaagtgggaatgatatagctaattgtttaaggaaaaacggtaagcgagttattcaactgagccgtaaaacatttgataccgaataccagaaaacgaagaataacgactgggactacgtcgtgactacagacataagcgaaatgggggcaaactttcgggccgaccgggtaatagacccaaggcgatgccttaaaccagtgattctcaaggacgggcctgaacgcgttattcttgctggacctatgccggtaacggtagcatcagccgctcagcgacgaggacggatcgggagaaatcacaataaagaaggtgatcaatatatctatatgggacaaccattaaataatgacgaagaccatgctcattggaccgaggccaaaatgctgctagataacattaacacaccggagggaataataccagcattattcgaacctgaacgagagaaatctgctgccatagacggcgaatacagattacgaggagaagccaggaagacatttgttgaattaatgaggcgaggcgatttgccggtctggttgtcctataaagtcgcctcagagggcttccaatattccgatcgaagatggtgtttcgatggtgaacgaaacaaccaagttttagaagaaaacatggacgtagagatatggactaaggaaggtgagaggaagaaattgagaccccgatggctggacgctagaacgtatagtgatccgctagctttgagagagttcaaagaatttgctgcgggaagacgaagtgtgagcggggacttaattcttgaaataggcaagttgccacaacacttaacacaaagagcacagaacgcattagacaatcttgtcatgttacataatagcgagcaaggcggccgagcatatagacatgcaatggaagaactaccagatacaatagaaacactaatgttactagccctaatagcggtactaactggtggagttaccttattctttttatcaggcagggggctaggtaagacttctataggtttactctgtgtaatggcgtcgtctgccctgttgtggatggcatctgtagaacctcactggatagcggcttcaatcatattagagtttttcttaatggtgttgttgatacccgaaccagaccggcaaaggactccacaggataatcagctcgcctatgtagttattggacttttattcatgatattaacagtggcagccaatgaaatggggcttttagaaacaaccaagaaagacttggggattggacatgtcgcggtcgaaaaccatcatcacgcgactatgttagacgtcgacttgcatccagcgagtgcatggacgctatatgctgtggctacaacaataataacaccaatgatgagacacacgatcgaaaacactactgctaatataagcctaacagccattgcaaatcaagccgccatattaatgggacttgacaaaggatggcccatatccaaaatggacattggagtaccacttctggcgttaggatgttattcgcaagtaaacccactcactttaaccgccgcggtccttatgctcgtcgcacactatgcgataataggaccggggttacaagcgaaggctacacgtgaagcacagaaaagaacggctgcgggcataatgaaaaatccgacagtagacggaatagttgcgatagacttagacccagtggtatatgatgcaaaatttgaaaagcaacttggacaaataatgttattaatcctatgtactagccagatactgctgatgcgaactacatgggccctttgtgaatctataaccttagcaacaggacctttaacaacattatgggaaggaagtccgggaaaattttggaacacaacaattgcagtaagcatggctaacatttttcgaggatcatatttagctggagcagggttagcattttcactaatgaaatcactaggaggagggagacgaggaactggtgcccaaggggaaactctgggggaaaagtggaaaagacaactcaaccaactctcaaaaagcgaatttaacacatacaaaagaagtggtattatggaggtagatagatcagaagcgaaagagggtttgagacgcggggaaaccactaaacatgcagttagcagaggtacagcaaaactacgctggtttgtagaaagaaacttagtcaaaccggaagggaaagtaattgatttaggctgtggtcgaggtggatggagttactattgtgcgggattaaagaaagtaacggaagttaaaggttacacaaagggaggacctgggcatgaggagcccattccgatggcgacatatggttggaatctagtaaaattgcattcaggtaaggacgtattctttataccgccagaaaaatgcgatacactcctgtgtgacatcggtgagtcttccccaaatccaacgatagaagagggacgaactttaagagtattaaaaatggttgaaccatggctaaggggaaatcaattttgcataaaaatactcaatccttacatgccaagtgtcgtagaaactctcgaacaaatgcaaagaaaacacggagggatgctcgttagaaacccattatctcgaaattctacacacgaaatgtattgggtaagttgtggcacaggaaatatagtatctgcggtaaatatgacatcacgtatgctactaaaccgttttactatggctcataggaaaccgacgtatgaaagggacgtggacctaggagcgggaaccagacatgttgcagtagaaccagaagtcgcaaatctggatataatcggacaacgtattgaaaatattaagcatgaacataagagcacttggcattatgatgaagacaacccatataaaacctgggcatatcacggcagttatgaagtaaaaccaagtgggtcagcttcatctatggtaaatggggttgttaagctacttaccaagccctgggatgttatacctatggtaactcaaattgcgatgacagatacgactcccttcggacaacaaagagtttttaaagaaaaggtcgacaccagaacacccaaggcaaaaagggggacagcacaaatcatggaggtgactgctagatggttatggggattcttatcaagaaacaagaaaccaagaatctgtacaagggaagaatttacccgcaaggtacggagtaatgcagcaattggagccgtttttgtggatgaaaaccaatggaactctgcaaaagaagctgtggaagatgagagattttgggacttagttcatagagaacgagaattacataagcaaggtaaatgtgcgacctgcgtatacaacatgatgggcaagagagagaagaaactaggtgaatttgggaaggccaaaggtagccgagcaatatggtatatgtggttgggagctcgtttcctagaatttgaggcactaggatttatgaacgaagaccattggtttagtagggaaaatagccttagtggagtagaaggtgaagggttgcacaaactcggatatatactccgtgatatatccaaaataccaggcggtaacatgtacgcagatgataccgcaggatgggatacacgtataaccgaggacgatctgcaaaatgaggcaaaaattacggatattatggaaccagaacacgctctgttggcaaccagcatattcaaactaacataccaaaataaagtcgtaagggtccaacgaccagcaaggaacggtacggttatggatgtgataagccgacgagaccaacgaggcagtggacaagtaggaacatatggattaaatactttcactaacatggaggctcaactgatccgacaaatggaatcagaaggaatattttcgccatctgagctagagactccaaacctagcggagagagttttggattggctcgagaaacatggtgtggaacgactaaaaagaatggctatatcaggggatgattgtgtcgtcaaaccaatcgatgacaggtttgcaacggccttatcggccttaaacgacatgggaaaagtccggaaagatataccccagtgggaaccatccaaaggttggaatgattggcaacaagtgccgttctgttcccaccattttcaccaacttatcatgaaagatggccgggaaattgttgtcccatgtagaaaccaagacgagctagttggtagagcacgagtgagccaaggagcaggatggtctttacgcgaaactgcatgcttgggcaaaagctacgcgcaaatgtggcagctcatgtactttcacagaagggatttgcgcttggctgctaatgctatatgctccgccgtgccagtcgattgggtgccaacaaatcgaactacatggtccattcatgcacatcatcagtggatgaccacggaggatatgctaagcgtatggaaccgtgtttggatagaggaaaatccttggatggaagacaaaacgcatataagctcatggggagatgtgccatatttgggtaagcgcgaagatcagtggtgcggctcactcatcggactcacagcaagagcgacatgggctaccaatatacaagtcgctatcaatcaagtacgcagattaatagggaacgaaaattacctagattacatgacatccatgaaacgctttaagaatgactcagaccccgaaggagccttatggtaa

SEQ ID NO: 21505 - RNA, 9879 nt, synthetic construct
  misc_feature 1..9879: note = derived and/or modified CDS sequence (opt6) from DENV-1__FJ024448__SS-prME
  source 1..9879: mol_type = other RNA
tcagtgactatgctcctaatgttaatgcctactgcactggcttttcatctcactacccgaggaggagaaccacatatgatcgtatctaaacaagaacggggaaaatcactattatttaaaacaagtgcgggagtaaacatgtgcaccctaattgcaatggacttaggggaattatgcgaagacactatcacatacaaatgcccaaggataaccgaaaccgaaccagacgatgtagattgttggtgtaatgcaacagatacctgggtgacatatgggacttgtagtcaaactggagaacatagaagagacaaaaggtcagtggctctagcaccacatgttgggcttggattagaaacaaggacagaaacctggatgtcatcggaaggagcatggaaacaaatacaaagagtagaaacatgggcactccgacatccaggattcaccgtcatagctttatttcttgcacacgctatagggacttccatcacccaaaaaggaattatatttatactcttaatgttagtaacaccttcaatggctatgagatgcgtgggtatcggtagtcgagattttgtcgaagggttgtccggtgcaacatgggtcgatgttgttcttgaacatggatcttgtgtaacgaccatggcaaaagataaacctactttagacatagaattattgaaaacagaagtaacaaatcctgcggtcctcaggaaactatgtatagaggcgaaaatttccaacactacaacagatagcagatgccctacacaaggggaggctaccttggtagaagaacaagacgcgaattttgtgtgtagacgaacgttcgttgacagagggtggggtaatggttgcggactctttggtaagggatcattgatcacatgcgctaagttcaagtgcgtaaccaaattagaaggaaaaatagtacaatacgaaaatttaaagtacagtgtcatagtcacagttcacactggagatcagcaccaagtcggaaatgaaagtacagaacacggaacgactgccacgataacgccacaagcgccaaccacagaaatacaactaacagactatggagcactcaccctagattgttcacctagaacaggattagatttcaatgaaatggttcttttaacaatgaaagaaaaatcttggttagtacataagcagtggttcttggaccttcccctaccatggacaagtggtgcatcgacatcacaagaaacatggaatcgccaagatctgttagttacatttaaaaccgcccatgccaagaaacaagaagtagtggtattaggtagtcaggaaggagctatgcacacagcattgaccggggcaacagagattcaaacatccggaactacaacaatattcgcgggacatctgaagtgtagattgaagatggataagctgacattaagaggtatgtcatatgtcatgtgtactggcagttttaagctggaaaaggaagttgcagagacccagcatgggactgtactggtacaaataaaatatgaaggtactgatgccccatgtaagatcccattcagcacccaagacgaaaagggcgtcacacaaaatggcaggttaatcacggccaatccaatcgtaacagataaagagaaacccgtgaatattgaggctgagcccccattcggagaaagctacattgtgatcggggccggggaaaaagcgttgaagttgtcatggtttaagaaaggatcatcgatagggaaaatgtttgaagctacggcaagaggtgcgagacgtatggccattcttggcgacacagcatgggacttcggttcaatcggtggtgtgtttacaagtgtgggaaagttagtacaccaaatctttggcactgcgtatggtgtcttatttagtggtgtatcatggacaatgaaaatcggtataggtgtattgttgacttggctaggtctaaactcaagatcaacaagcctttcaatgacatgtattgctgttggcctagtaacactatacttaggagtaatggtccaggctgactcaggatgtgtcataaactggaaagggcgcgaattaaaatgtgggagtggaattttcgtaacaaatgaggtacatacctggactgaacagtataaattccaagctgacagtccaaaaaggctaagtgccgcaatagggaaagcgtgggaggaaggagtgtgtggaataagatcagcaacacgactagaaaatattatgtggaagcagataagtaacgagttaaatcatatactattggaaaatgacatgaaatttacagtcgttgtaggggatgttgcaggcattcttgctcaagggaagaaaatgataagaccccaacccatggaacacaaatactcatggaaatcatggggaaaggccaaaataataggggctgatgtacaaaatacaacgtttataattgacggccccaatacacctgaatgccctgatgaccaaagagcatggaacatatgggaggtggaagattatggctttgggatttttaccacaaatatatggctcaaattaagagattcatatactcaagtatgtgaccataggcttatgagtgctgctattaaagattcaaaagcagtacacgctgatatgggttactggatcgaatctgagaaaaatgaaacttggaaattagccagagctagtttcatcgaggtgaaaacatgcatatggccaaaaagtcatacactatggagtaatggtgtgttagagagtgaaatgatcatacctaaaatatatggtggccctatatcgcagcacaattatcggcctggatattttacccaaactgcgggaccgtggcacctagggaagctcgagttagattttgacttgtgcgaaggaactactgtggtggtagatgaacactgtggtaaccgtgggccatccctacgaacaactactgtgacaggtaagatcatacacgaatggtgttgtcgaagctgtacactcccgccacttagatttcgcggtgaagacgggtgttggtatgggatggaaataaggcccgtaaaggaaaaggaggaaaacttggttaagtcaatggttagcgctggcagcggggaagtggatagctttagtttgggattactgtgtatttcgattatgatagaagaagtaatgcgctcccgctggagtcgaaaaatgctaatgacggggacactagccgtcttctttttattgataatggggcagttaacctggaacgacttaatccgactgtgcataatggtaggagctaacgcgtccgatcgcatggggatgggtactacttatttagcgctaatggcgactttcaagatgagaccaatgtttgcagtcgggctactgtttcgtagactcacatccagagaggttttactactgaccattggattaagtttagtcgcatcggtagaattgcccaacagcctggaagaactcggagacgggctagcaatgggaattatgatactaaaattactaacagattttcaatcgcatcagttatgggccactctgttatcactaacgtttataaagacgacatttagtctacattatgcctggaagacaatggctatggtcttgagtatagtctctttgttccctctctgcttatcaacaacatcgcagaaaacgacatggctgcctgtgttactcggaagtttagggtgcaaaccacttacaatgttcttaatagctgaaaataagatttggggacggagaagctggccgctcaatgagggaataatggcagtcggcatcgtatctattctattgtcatcgctcttgaaaaatgatgttccattagccggacccttaatagcagggggtatgcttattgcatgttacgtgattagtggctcatctgccgacctctcacttgaaaaagcagcagaggttagttgggaagaggaagctgaacacagcggcgcctctcataacatattagtggaagtccaagatgacggcacaatgaaaataaaagacgaggagcgagacgatacgctcacaatattactaaaagcaacactcttagctgcttctggtgtctatccattgtccatcccggccactctatttgtttggtatttttggcaaaagaagaaacaaagatctggggttctatgggatacgccgtcaccacccgaagttgagcgtgcggttttagacgatggaatttatcgaataatgcaaagaggtttattaggaagatcgcaagtgggcgtaggggtgttccaagagaatgtatttcatacaatgtggcatgtcacacgaggagcagttctaatgtaccaaggcaagaggttagagccatcctgggcgtcagtgaagaaagatcttatctcgtatggaggcggttggcgcttacaaggtagctggaacactggcgaagaagtgcaggtcattgcagtggaaccagggaaaaatcccaaaaatgtccagacagcaccaggcaccttcaaaactcctgagggagaagttggagctatcgccctggatttcaaacctggaacatcaggcagtccaattgttaatagggaaggaaagattgtagggttatacggcaacggagtagtcactacttctggaacatatgtaagcgctatagcacaagccaaagcgtcacaagagggcccattaccggaaattgaagacgaagtattccggaaacgtaatctaacaatcatggatttacatccaggaagtggcaaaactaggagatatttaccggctatagttcgcgaagcaataaaacgcaagctaaggacattaattctagcccctactagagtggttgcatcagaaatggccgaagcactaaagggcatgcctataaggtatcaaacaactgccgttaaatccgaacacacggggaaagaaatagttgatttaatgtgccatgcaaccttcactatgcgacttctttcgcccgttagggttcctaattacaatatgataataatggatgaagcgcactttacagatccgtcttcaatagctgctagaggctacatatccacccgagtaggaatgggagaagctgcagcaattttcatgacagctactccccctggcagcgtcgaggcttttccacaaagcaatgcggtgattcaagacgaagaaagggatataccagagagatcttggaatagtggatatgaatggataacagatttccctggtaagacagtatggttcgttccatcgatcaagtcaggaaacgatattgccaattgcttacgaaagaacggcaaacgagtgatacagctatcaagaaagacgttcgatacagagtatcagaaaactaaaaacaatgactgggactacgttgtaacaaccgacatttcagaaatgggcgctaattttagagccgaccgagtaatagatcccagaagatgcctaaagcccgtaatccttaaagatggcccagagcgcgttattcttgccggacctatgcccgtgacagtcgcctccgcagcacagagacgaggacggataggaaggaatcataataaagagggggatcagtacatatatatgggacaaccattgaacaacgatgaagaccatgcgcactggactgaagcaaaaatgcttttagataatataaatacaccagaaggtattatacctgcgctatttgaaccggagagggaaaaatcagcagctattgacggcgaatatcgactacgaggtgaagcgcgaaaaacattcgttgaactaatgcgacgcggtgatttacctgtatggttatcatataaagtagcatcggaaggttttcaatactcagatcggagatggtgcttcgacggggagaggaataaccaagttctagaagagaatatggatgtggaaatttggaccaaagaaggtgaaaggaagaaactaagacctcgttggcttgatgctagaacttactcagatcccctcgccctaagggaatttaaggagttcgcagctggccgaagaagcgttagtggtgatttaatccttgaaattggtaaattgccacaacatctgactcagcgtgcccagaatgcactagataatcttgtgatgttacataacagcgaacaaggtgggagagcgtatcgtcatgcaatggaagaattaccggacacaattgaaaccctcatgctgttagcgttgatagctgttcttacagggggagttacattattcttccttagcggaagagggttagggaaaacatccataggcttgctgtgtgtaatggcttcgagtgttcttttatggatggcttctgtagaaccacactggatcgctgcaagtattatcttagaatttttcttaatggtccttcttataccagaacctgatagacagagaacaccccaagataatcagttggcatatgtcgtaatcggacttctttttatgattctaacagtggccgcgaacgaaatgggacttttagaaactaccaagaaagatctgggtattggacacgtcgcagtggaaaaccatcatcacgccgcaatgttggacgtagatcttcacccggcctctgcgtggacactctacgcagtcgcgacaacgataataactcccatgatgagacacactatagaaaacactactgcaaacatttctttaacagctatcgctaatcaggcagctatattaatgggactagacaaaggatggccgataagtaaaatggacattggagtaccgttgctagcattgggatgttattctcaagtcaatcccttaacactcactgcagctgttctaatgttagtagcgcattacgccattatcggaccggggttacaagcgaaagcaacaagagaagcgcagaaacgaacagctgcggggataatgaagaatccaacagtagacggaatagtagctatcgacttagacccagtagtatatgatgcaaagttcgaaaaacaactaggccaaatcatgctacttattttatgcacttctcagatactcttaatgagaaccacctgggcgttatgcgaatctatcaccttagccacaggaccactgacaacgctttgggaaggatcacccgggaagttttggaacacgacaattgctgtgtcaatggctaatatatttagaggatcgtacttagccggtgcgggtctcgcattttcattaatgaagtcattaggcggtggtcggagaggtacaggtgcgcaaggcgagactcttggagaaaaatggaaaagacaattaaaccagctttcaaaatcggagttcaatacttacaaaagatcaggcattatggaagtagatcgcagtgaagcaaaagaaggattaaaaagaggcgaaacaaccaaacacgcagttagcagaggaaccgctaaacttcgctggttcgtcgaaagaaatttagtaaaacctgaagggaaggttatagatttaggatgtgggcgtgggggttggtcgtactattgtgccggattgaaaaaggtaactgaagttaagggatacacaaaaggtgggccagggcacgaggaaccaataccaatggcaacatatggctggaacctggtgaaacttcattctggaaaggatgtcttcttcataccacctgagaagtgtgatactctgttatgtgatataggagaatcgtcaccaaacccaacgatagaggaaggtcgaacacttagagtgttaaaaatggtagaaccgtggttacgaggtaatcaattctgtattaagatattaaatccttatatgccgtcagtagtcgaaacattagaacaaatgcagaggaaacacggaggtatgttagtaaggaaccctctctctagaaattcaacgcatgaaatgtactgggtctcatgtgggacgggaaacatagtgtcggctgtaaatatgacatctagaatgcttttaaacaggtttacgatggcacataggaagcccacgtacgaaagggatgtagacctaggagctggcactagacatgtggcagtcgaaccggaagttgcaaatttagatatcataggtcaacgaattgagaacatcaaacacgaacataagagtacgtggcattacgatgaagataatccttacaaaacttgggcttatcatggatcttatgaggtgaaaccgagtggttcggcctcatccatggtaaatggagtggtgaagctcctcacaaaaccatgggatgttattcccatggtaacacaaatcgcaatgaccgatacaactccttttggacaacagcgggtctttaaagaaaaagtagatacacggactcccaaggcgaaaagaggaacggctcaaataatggaggtaactgctaaatggctatggggtttcctatcgcgtaataaaaagccccgaatatgtactagggaggagtttacgaggaaagtccgaagtaacgccgctataggagcagtatttgtggatgagaaccagtggaatagtgccaaagaagcagttgaagacgagagattttgggatttggtacacagggaacgagaattacacaaacaaggtaagtgtgcgacttgcgtctataatatgatggggaagagggagaagaaactaggagagttcggaaaagctaaaggtagtagggcaatatggtatatgtggttaggcgcaaggtttttagagtttgaagccttagggtttatgaatgaagaccactggtttagccgggagaatagtctcagtggagtagaaggagaaggcttacacaagctcggttacatcctacgagacattagcaaaattcccggaggtaatatgtatgctgatgacacagcagggtgggatactaggattacagaagacgatcttcaaaatgaggcgaggattacagatataatggaacctgaacatgcactactagccaagtcgatatttaaactaacgtatcagaataaggtagttagagtgcaacgaccagccaaaaatggcactgtgatggatgtgattagtagacgtgatcaaaggggttcaggacaagttggaacttatgggttaaatactttcacaaacatggaagcccaactgatacgacaaatggaatcggaaggtatattctctccatccgagctggagactcccaatctagctgaacgtgtactagattggctcgaaaaatatggagttgagcgtttgaagcgaatggcgatatcgggagatgactgcgttgtgaaaccaatagatgataggttcgcgacggccctgaccgcgctaaacgatatgggaaaggtcagaaaagacataccacaatgggaaccatccaaagggtggaatgattggcaacaagttcccttctgttcacatcactttcaccaactaataatgaaggatggaagagagatagttgtaccctgcagaaaccaagatgaacttgtcggtcgagcaagggtaagtcaaggagcgggttggtcattacgggaaaccgcatgtctaggcaaatcttacgcccagatgtggcagctaatgtattttcaccgaagggatcttcgactagcagcaaatgccatttgcagtgcagttccagtagactggatcccaacgagtcgcacaacctggagtatccatgcacaccatcaatggatgacaactgaggatatgttgtccgtatggaatagagtttggatagaagaaaacccgtggatggaggacaaaacacacatcagtagctggggagatgttccatatttaggaaaaagagaagatcaatggtgtggcagcttaataggcctgacggcccgggctacgtgggcgacgaatattcaagtcgcgataaaccaggttagaagattgataggaaatgagaattatctagattatatgacttccatgaagagatttaaaaatgagagtgatccagaaggcgctctgtggtag

SEQ ID NO: 21506 - RNA, 9879 nt, synthetic construct
  misc_feature 1..9879: note = derived and/or modified CDS sequence (opt6) from DENV-1__FJ182026__SS-prME
  source 1..9879: mol_type = other RNA
tctgttactatgttattaatgttgatgcctaccgcattggcatttcatttaacgactagaggtggagaaccacacatgattgtatcaaaacaagaacggggaaaaagtcttttatttaaaacctccgccggtgtaaatatgtgcactttaatagctatggaccttggggaactatgtgaagacacaatgacctataaatgccctagaataaccgaaacagaacccgatgacgtcgattgctggtgtaatgctaccgacacatgggtaacatacgggacgtgcagtcaaacaggggaacatcgaagagataaaagatcggtagcattggctccgcatgtgggattaggcttagaaactcgtaccgaaacttggatgagctctgaaggagcatggaagcaaatacaaagagtcgagacctgggctttgagacaccctggatttaccgtcattgcattattcctggctcacgctattggtacatcaataacacagaaaggtataatctttatactgctcatgctcgtgacacctagtatggctatgcgctgtgtgggcattgggtctcgagactttgtagaagggctaagtggagcaacctgggtcgacgttgtattggagcacgggtcgtgtgttactaccatggctaaagataaaccgacgttagacatagaactccttaaaactgaggtcacaaaccctgcagttctacggaagctatgtattgaagcgaaaatatctaacaccacaacagacagtcgatgcccaacccaaggagaagcaacacttgtagaagaacaagatgctaactttgtttgtagacgcacattcgtagatcgcggttgggggaatggctgtggtctatttggaaaaggaagtttaatcacatgtgcgaagtttaaatgtgtaactaaattagaaggtaagatagtccagtatgagaacttgaaatactcagttattgtgacagttcatacaggggatcagcatcaagtgggtaacgaatcgacagagcatggcacaactgcaacaataacacctcaagcacctacaactgaaattcaattaacagattacggtgcattaacactagattgttcacccagaactggcttggacttcaacgagatggtattacttaccatgaaagaaaaatcatggcttgtacataaacaatggtttctggatcttccattaccatggacgagcggggcatcaacatcacaagaaacttggaacagacaagatttattggtaacattcaaaaccgcacacgccaagaaacaagaggtagtcgtattaggatcacaggaaggtgcaatgcatacggcactgacaggagcaacagagatacaaacttcgggaactacaacaatatttgcgggacatttaaaatgccgattaaaaatggacaagttgactttaaagggaatgagttacgtgatgtgcacaggatcttttaaactagaaaaggagcttgcagaaactcagcatggtaccgtgcttgtacaaattaaatatgagggcactgacgcaccttgcaagatccccttttccacacaaaatgaaaaaggagtcacacagaatggacgcttgataactgcgaatcctatagtaacagataaagaaaaaccagtgaacatagaggcagaaccgcctttcggggaaagctacatagttatcggtgctggagaaaaagcacttaaattatcctggtttaagaaaggtagtagcatcggaaagatgtttgaagcgaccgcacgtggtgcccgacgaatggcaatcctaggagacacagcctgggatttcggctccatcggaggggtctttacctccgtcggaaaacttgttcatcaaatttttggaactgcatatggagtactcttcagtggagtatcatggactatgaagatcggaattggagtcttactaacttggttagggttgaactcaagatctacaagtttgagcatgacctgtattgctgtaggtctagtcactctatatcttggggttatggttcaagcagattcaggatgtgtaatcaattggaagggacgagaattgaaatgtggctctggcatttttgttacaaatgaagtgcacacatggactgaacaatataagtttcaagcagatagccctaagagactgtccgcggcgataggtaaggcatgggaggaaggcgtatgtggcataaggtcagcgacgagattagagaatatcatgtggaaacaaatatcaaatgaactcaaccatatacttctagaaaacgatatgaaattcacagtagttgtaggagacgtggcaggaatcttagcgcaaggtaaaaagatgattagaccacaacctatggaatataagtatagttggaaaagctgggggaaagctaaaattattggcgctgatgtccaaaacacaaccttcataatcgacggaccaaacacacctgagtgtccagatgatcaaagggcatggaatatttgggaggtcgaggactatgggtttggaattttcactactaatatatggctgaaacttagggattcatacacacaagtctgcgatcaccgccttatgtcagccgcaattaaagattcaaaggcggttcatgctgatatgggatattggatcgaaagtgagaaaaatgagacatggaaactcgcgcgggcttcctttattgaagttaaaacttgtatatggccgaaatcacatacattatggtccaacggtgttttagagtctgagatgatcataccaaaaatctatggaggaccgatatcccaacataattacagacctggatactttacccagacagcaggtccctggcatttgggtaagttggagctagattttgatctctgcgaaggtacgaccgtagtcgtggacgaacactgcgggaatcgaggaccatcgctacggacaactacagtgacaggtaaaataatacacgagtggtgttgtcgatcatgcactctcccgcctcttcgatttaggggcgaagatggctgctggtacggcatggaaattcgaccagtaaaagaaaaagaggaaaatttggtcaaaagcatggttagtgcgggatcaggcgaagtagattcattctcgcttggcctattgtgtatatctataatgatagaagaggtgatgagatcgaggtggagtcgaaagatgttaatgacaggcacacttgctgtctttttcttacttattatgggccaactcacgtggaatgacctcatccggttatgcattatggtgggcgctaatgcttcagataggatgggtatgggtacgacctatctcgcgctaatggctactttcaaaatgagaccaatgttcgcggtggggttattgttccgaagattaacttccagggaggttctactactaacgataggattatcgttggtagccagtgttgaattaccaaatagccttgaagaattgggtgacggactagcaatgggaattatgatactgaaactattaactgactttcaaagtcatcagttgtgggccacactattgtcactaacgtttataaaaactacattttctttacattatgcttggaagactatggcaatggttttgagtatagtctctttattccctctgtgcttatcgacgacatcacagaaaaccacatggttaccggttttattagggagtctaggctgtaaacccctcactatgttcctaatagcagagaacaaaatatggggacgccgaagttggccacttaatgaaggtatcatggcagttgggattgtgtctatactgctaagtagtcttttaaagaacgatgtgccactagcgggaccattaatagcaggaggaatgctgatagcttgttatgttatttcaggttcgtctgctgacctatcattagaaaaagcagcagaagtcagttgggaagaagaggcagaacacagtggggcctctcataacatattagttgaggtccaagatgatggaactatgaaaattaaagatgaagaaagagacgacacacttacgattttgctaaaagcaaccttactggctgtaagtggagtttatccgctcagcatacctgcgacactattcgtatggtatttttggcaaaagaagaaacagcgtagcggtgtattgtgggacaccccatccccaccagaggtagagagggcagtattagatgacggtatatataggataatgcaaagaggattacttggaagatctcaagtcggcgtgggggtgtttcaagaaaatgtttttcatacaatgtggcacgttacaagaggagccgtattaatgtatcaaggcaaaagattggaaccaagttgggcaagcgttaagaaagacttaatctcatacggaggaggatggcgcctccagggatcttggaatgctggtgaagaagtccaggtcatagctgtagaaccaggcaaaaatcccaaaaatgtacaaactgccccaggtacatttaaaacgcctgaaggagaagtaggtgcaatagctttagactttaaaccaggaacgtctggttccccaatagttaaccgcgagggaaaaatcgttggactgtacgggaatggagtagtgacgacgagcggtacatacgttagcgccatagcacaagcgaaggcatcacaagagggcccacttcctgaaatagaagacgaagtttttagaaaacgaaaccttacgattatggatctccacccagggtccggaaaaacaagacgttacttacccgcaatcgtacgagaagctataaaacgtaagttacggaccttaatcttagcccccacaagagtcgttgctagtgagatggctgaagcgttaaaaggcatgccaatacggtaccaaacaacagcagtcaaatcagagcacaccggaaaggagattgtagatttaatgtgccatgcaacattcactatgcggttattgtccccagtaagagtaccaaattataatatgattattatggatgaggcacattttacagatccaagttcgatagcggccagggggtacatctcaacaagggttgggatgggagaagcagcagcaatctttatgacagctactccgccgggttcggtagaagcatttccccaaagtaatgccgtaatccaggatgaggagagagacataccggaacgatcatggaactcaggatacgagtggattacagatttccctggcaaaactgtatggtttgtaccctcaataaaatcaggtaatgacattgctaattgtttgaggaaaaatggcaagcgcgtgatacagctatcacgcaaaacttttgacaccgaataccagaaaaccaaaaacaatgactgggattacgtagtgacaactgacatttcggaaatgggcgcaaattttagagctgaccgcgtgatcgatccacgtcgatgcttaaagccagtgatactaaaagatggtcctgaaagagtcattttagcaggacctatgcctgttacagtagctagtgcggcccaaagacgggggagaatagggaggaatcataacaaagaaggcgatcaatatatatatatggggcagccactaaacaatgacgaagatcacgctcactggactgaagccaagatgttattagacaatatcaacactccggaaggaatcataccagcattatttgaaccggaaagggagaagtcagcagcaattgacggtgaataccgactaaggggcgaagctcgtaaaacttttgtggaactgatgcggcgaggtgatttacccgtctggttaagttataaggtagcgagtgaaggtttccagtattctgatcgacgatggtgttttgatggagaaagaaacaaccaagtactagaagagaacatggacgtggaaatttggacaaaagaaggagaacgaaagaaattacgcccgagatggttagatgctcgtacatattcagatcctttagcacttcgtgagttcaaagaatttgctgcaggaaggcgttctgtgtccggagatctaatactagagatcggcaaacttccacaacacttgactcaaagagcacaaaatgccctagacaaccttgtaatgttacacaactctgaacagggtggcagagcttataggcatgcaatggaagaacttcccgatacaatcgaaaccttaatgctgctagcccttattgcggtacttaccggaggggtaaccttattctttcttagcggtcgaggcctaggaaaaacttctataggattattgtgtgtcatggcctcctcggtacttttatggatggcttcagtagaacctcattggatagcagctagcattattcttgagttcttccttatggtactattaatcccggagccagatagacaaaggactcctcaagataatcaattagcttatgttgtgatcggattactattcatgatattaactgtagcggcgaacgaaatgggcctacttgagacgaccaagaaagatctaggtataggacacgtagcagtagagaaccaccatcatgcggcaatgttagacgtagaccttcatcccgcatctgcctggactctatacgcagtggctacaacaataatcacacctatgatgagacacactatagagaatacgacggccaacatcagtcttacagcgatagcaaatcaagcagcgatactaatgggcttagacaaaggatggccaattagcaaaatggacataggtgtcccattacttgctttagggtgttactcacaagtcaatccgcttacgcttacagcggcagttctcatgcttgtagctcactatgcaataataggccccggtcttcaggcaaaagcgactagagaagctcagaaaagaacagcagccggaattatgaaaaacccaacggtagacggtatcgtggcaattgacttagatcccgtagtttatgatgcaaaattcgaaaaacaactaggacaaatcatgttgctaattttgtgcacgtcccaaatattattgatgcgaactacgtgggcactgtgtgaaagcataactcttgctaccggtccgctaaccactttgtgggaaggaagcccaggaaagttttggaatactacaattgcggtttcgatggctaacatttttcgtggaagctacctagccggcgcaggtttagcattttccttaatgaaaagtctcggtggaggacgtcgagggacaggcgctcaaggagaaactctgggggagaaatggaagcggcaattaaaccagctatcaaaatcggagtttaatacgtataaacgatcaggaataatggaagtcgacaggtccgaagcgaaggaaggactgaaaagaggagagactacaaaacatgcagtttctagaggcactgctaaactgcggtggttcgttgaacgaaatttagttaaaccagaaggcaaagtgatagacctaggttgtggtaggggtggatggtcttactattgtgcagggctaaagaaagtgacagaggtcaaaggttatactaaaggaggaccaggtcatgaagaaccgataccaatggcaacgtatggatggaatttagtaaaactacactcaggaaaggacgttttctttatacctcccgaaaagtgtgatacgttgttatgcgatataggagagagcagtcctaatcctacaatagaggaaggaagaacattgagagttctaaaaatggtggaaccttggttaagaggcaatcaattttgcataaaaattttaaacccttacatgccctcagttgtggagactttagaacagatgcaacgaaaacatggcggaatgttagtacgaaaccccctcagcagaaactcgacccatgaaatgtattgggtctcatgtggaacaggtaacatagtgtctgctgtaaatatgacatcgcggatgttgctaaataggtttacgatggctcacagaaaacccacgtacgaaagagacgtcgacctaggtgcaggtacgcgtcatgtagccgtagaacccgaagtagcaaacctagacatcataggtcagagaattgaaaacataaaacatgaacacaagtccacatggcactatgatgaggacaacccgtataaaacatgggcctaccacggatcatacgaggtcaaaccgagtggatccgcttcaagtatggtcaatggcgtagtaaaacttttaacaaaaccttgggacgtcattcctatggtcactcaaatagcaatgactgatacaacgccctttggtcaacaaagggtgttcaaagaaaaggttgacacgcgaacacctaaagcaaagagaggaactgcacaaattatggaggtcactgccaaatggctatggggctttttgagccggaacaagaaaccaagaatatgtacaagagaagagttcactagaaaagtaagaagtaatgccgctatcggagcagtctttgtagacgaaaatcaatggaatagcgctaaagaggcggtagaagacgaaagattttgggatctagtgcacagagaacgagaattacacaaacagggcaaatgcgcaacctgtgtttacaacatgatggggaagcgcgagaagaaattgggtgagtttggaaaagcaaaaggctcacgagctatatggtatatgtggcttggcgcccgatttctcgagtttgaagcattgggtttcatgaatgaggaccattggttcagcagagaaaatagtttatcaggagtagaaggtgagggtctacacaaattaggatacatactccgtgatatctcaaaaatccccggcggaaacatgtacgccgacgacacggctggatgggatacgaggattactgaagatgacctccagaatgaggccagaatcacagatatcatggaaccagagcacgctttactagcaaaatcaatttttaaactgacatatcagaataaagttgtacgtgtccaacgaccagccaaaaatggcacagtcatggacgtcatatctaggcgagatcagagaggatcaggccaggtaggcacatacggtttgaacacattcactaacatggaggcccaattgataaggcaaatggaatcagaaggaatattttctccatccgaattggagactcctaatctggcagaaagggttcttgattggctggagaaatatggcgttgaaagattaaaacgaatggcgataagcggtgatgattgcgttgtaaaaccaattgatgacaggttcgcaacagctcttacggcactgaatgatatgggaaaagtaagaaaagatattccacaatgggagccaagtaaaggttggaatgattggcaacaagtacctttctgcagtcatcatttccaccagttaataatgaaagacggcagagagattgtagttccatgtaggaaccaagacgagttagtcgggagagcaagagtcagtcagggagcgggatggtcgctgagagaaacggcgtgcttaggaaaatcatacgcgcaaatgtggcaactaatgtacttccaccgaagagatctccggctcgcggcaaatgcaatttgttccgctgttccggtagactggatcccaacaagccggactacatggtcaattcatgcacaccaccaatggatgacgactgaggacatgctcagtgtctggaaccgggtgtggattgaagagaatccatggatggaggataaaacgcatatatcgtcctggggagacgttccgtatctaggaaaacgggaagaccagtggtgtggcagcttaattggactaaccgcacgcgccacctgggctactaatattcaggtagcaataaatcaagtaagaaggctaatcggtaatgagaattatttggactatatgacaagtatgaaaagattcaaaaacgaaagtgaccccgagggagcattatggtga

SEQ ID NO: 21507 - RNA, 9879 nt, synthetic construct
  misc_feature 1..9879: note = derived and/or modified CDS sequence (opt6) from DENV-1__FJ182027__SS-prME
  source 1..9879: mol_type = other RNA
tctgttactatgcttttaatgttaatgcctacagctttagccttccatttaacaactaggggaggagaacctcatatgattgtaagcaaacaagaaagggggaaatctttactattcaaaacatccgcaggagttaatatgtgcacactaattgccatggacttgggtgaactttgtgaggacactataacgtacaaatgtccaaggataacagaaacggagcctgatgacgtcgactgctggtgtaatgccacggacacctgggttacctacgggacgtgttcgcaaacaggagagcatagacgagacaaaagatctgttgcattagcaccacacgtcgggttgggcctcgaaaccagaacggagacttggatgtcatcagaaggagcatggaaacaaatacaacgagtagaaacctgggcactaagacacccaggttttacggttattgcactattcctagcacatgctatcggcacaagcataactcagaaaggaataatttttatactactaatgctagtaacacccagtatggcgatgcgctgtgtcggtattggttccagagacttcgtggaggggttgtcaggagcaacttgggtagatgttgtattggaacatggtagctgtgtgacaacaatggcaaaagacaaacctacgctagacattgaattactcaaaacagaagtaacaaaccctgcagttttacggaaactttgcattgaagcaaaaatcagcaataccacgactgactcccgctgtccaacccaaggtgaagctactctcgttgaagaacaagacgccaatttcgtatgcagacgaacattcgtcgacagggggtgggggaatggatgtggattattcggaaaaggcagcttgataacgtgtgcaaaattcaaatgcgtaaccaaattagaaggaaaaatcgtacagtatgaaaatttgaaatattcagtcatagttacggtacacaccggagaccaacatcaagtgggaaatgaaagtacagaacacggaacaacagcgactatcacccctcaggcacccacgaccgaaatacagcttacagactacggagcattaactttagattgctcaccgagaacgggtctcgattttaatgagatggtcttactgacaatgaaagaaaaatcgtggctcgttcacaaacaatggttcttagatttgccactaccttggacatctggtgcgtcaacaagccaagaaacgtggaacagacaggacctcttagtcacattcaaaacagcccatgctaagaaacaagaagtcgttgtcctaggtagtcaagaaggagctatgcatacggcgttaacaggagcaacagaaatacagacgtcaggtacaacgacaatatttgcaggacacttaaaatgtagactaaaaatggataaattaacacttagaggaatgagttatgtcatgtgtacaggcagcttcaaattggaaaaagaagtggccgaaacccaacatggaaccgtactcgttcagatcaaatatgagggaactgatgcaccctgtaaaattccgttctctacacaggatgaaaaaggagtaactcaaaacggccgcctcatcacagcgaacccaatcgtaactgataaggaaaaaccagtcaatatcgaagctgaaccaccgttcggggaatcgtatatagtgattggagccggagaaaaggcactaaaattgtcgtggtttaagaaaggaagtagcattggtaaaatgttcgaagcaacagcaagaggtgcgagacggatggcgattttaggcgatacagcttgggacttcggatcaattggaggtgtgttcacctccgtaggtaagttagttcatcaaattttcggcactgcctacggagtattattttcaggcgtgtcatggaccatgaaaattggaataggcgtattactaacctggttaggactaaactccaggagtactagcttatccatgacctgtatcgcagttggcctagtgaccctatatcttggagttatggttcaagcagattctggatgtgtcattaattggaaaggccgtgaactaaagtgtggctcaggaatcttcgttacaaacgaagtacatacttggacggaacaatacaaatttcaagctgatagccccaaacgcctatcagcagcaataggtaaagcctgggaagaaggggtttgcggaataagatcagccacaagattagaaaacattatgtggaagcaaatcagcaacgaattaaatcacatacttctggagaatgatatgaaattcaccgtagtggtcggagatgtcgcaggtatcctagctcaaggcaagaaaatgattcggccacaacctatggagcataagtattcatggaaaagttggggaaaagctaaaattattggtgcagacgtgcaaaatactacttttattattgacggaccaaacacccccgagtgtccggacgaccagcgcgcgtggaacatatgggaagtggaagactacggctttggcatatttacaacaaatatatggcttaaactgagagatagttacacacaggtttgcgatcataggttgatgagcgctgcgatcaaagactcgaaagctgtacacgctgacatgggatactggattgagagtgagaaaaatgaaacatggaaattggcacgggcttcgttcatagaagttaagacgtgcatatggccaaaatcccataccctttggtctaatggcgtgctcgaatcagaaatgattataccgaaaatatacggaggtccgattagccaacataactatcgacctggatactttacacaaactgccggcccttggcatttaggcaaactagaattagactttgatttgtgtgaaggcacaacggttgtagtagatgagcactgtggaaaccgcggcccctctcttcgaactactacagtaactggtaaaataatccacgaatggtgctgcagatcgtgtacattaccacctctaaggtttcgcggcgaagatggatgctggtacggtatggaaattcgaccagtaaaagaaaaggaagaaaatttagtgaaaagcatggtttcagccggaagcggagaagttgactctttcagtttaggacttttatgtatctcaataatgattgaagaggtaatgaggtccagatggagtagaaaaatgttaatgacgggtacattggcagttttctttctactaataatgggacaactaacttggaatgaccttatccgactctgtattatggtaggagccaatgcttcggatcgtatgggtatgggaacaacatatcttgcgttgatggcaacatttaaaatgagaccaatgtttgctgttggcttactatttaggcggctgaccagcagagaggttttattactaactatcggattatcccttgtcgcgtcagtcgaactcccaaattctttagaagaactgggagacggtctagccatgggaataatgatactcaaactgcttactgactttcagtctcaccaattgtgggcaactctattatctttaacatttataaaaacaacatttagtctccattatgcgtggaaaactatggcaatggtcctttcaatcgtttcactattccccctttgtctctcaacaacgtcccagaaaacgacatggctacctgtattgcttgggtccctgggatgtaaaccattaactatgtttctgattgcagaaaataagatttggggtcgacgatcttggccactaaacgaaggaataatggctgttgggattgtatccatccttctctccagcttgctaaagaatgatgttccgttagctggaccgcttatcgctggcggaatgttgatcgcttgttatgtaatcagcggttctagtgctgacttgagtcttgagaaagcagctgaagtaagttgggaagaagaagcggaacacagtggagcatcacacaatatattagtagaagtccaagacgacggaaccatgaaaataaaagacgaagaacgtgacgacactctgactatcctactaaaagctactttattagccgtatcgggagtctaccccttaagtattccggccacactgttcgtatggtatttttggcaaaagaagaaacagcgtagcggtgttttatgggatactccatcaccaccggaagtggaacgagcggttttggatgatggaatctataggatcatgcaacgtggtctcctaggacgctcacaagtcggcgtaggggtatttcaggagaatgtctttcacaccatgtggcacgtaacgagaggcgcagtcctaatgtatcaagggaaaagattagaaccatcatgggccagtgttaagaaagatctaatcagttacggcggaggctggcgattgcaaggatcctggaacacgggggaggaagttcaagtcatagcagtagaaccggggaaaaaccctaaaaacgtacaaactgcaccaggtacgtttaaaactccagaaggtgaagttggagctattgcccttgactttaaaccaggcacctctggatctccgatcgtaaatagagaaggaaaaatcgtcggattatatggaaatggcgtcgtaacaacctctggcacatatgtttcagcaatcgcgcaagcaaaagctagccaagaaggacctctacctgaaatagaggatgaagtgttcaggaaacgtaatcttacaataatggatcttcatccaggtagcgggaaaaccagaaggtacttgccggccattgtacgcgaagcaatcaaacgaaagctccgtactttgattctcgcaccaactagagtggtcgcgtccgaaatggccgaagcgctcaaaggcatgcctatacgatatcagacaacagcagttaaaagcgaacatactggtaaggaaattgtagacttaatgtgccacgccacgttcacaatgagactcctcagcccagtgcgagtaccaaattataacatgattataatggacgaagctcatttcacggatccatcatcaatagcagcaagagggtatatatctacgagggtaggcatgggagaggcagcagcaatcttcatgaccgccacaccacccggaagtgttgaagccttccctcaatcaaatgccgttatacaagatgaagaaagagacatcccagaaagaagctggaactcaggatatgaatggatcacagatttccctggaaagaccgtctggttcgtacctagcataaaaagcgggaatgacattgcaaattgtctacgaaagaatggtaaacgagtaatacaactatcacgcaaaactttcgatacagagtaccagaagacgaagaataatgattgggactatgtagtaacaaccgacatttcagagatgggagcaaacttccgagcggatagagtaatcgatccaagacgttgcctaaaaccggtcatattaaaggatggtccggaacgtgttatattagcagggcctatgccagttacagtagcttctgcggcgcaacggcgcggtcgaattggacgtaatcataataaagagggtgaccaatatatttatatgggacaaccgcttaataacgacgaagaccatgcccactggactgaagccaagatgctattagataacataaacactccggaaggaatcatacccgctcttttcgaaccggaacgcgaaaagagtgcggcaatagatggtgagtacagactccgtggggaagcaagaaaaacattcgttgaactaatgcgtagaggggatttacctgtttggttgagctataaggtggccagtgaaggttttcaatacagtgatagaaggtggtgctttgatggggaaagaaataaccaagttctagaagaaaatatggatgtcgagatctggaccaaggaaggagaacgtaaaaagttaagaccacgttggctagacgcaagaacttattccgatcctttagctctcagagagttcaaggaatttgcagccggtagaagatctgtaagcggcgatttaatacttgaaataggcaaacttccacaacatcttacgcaaagagcacagaatgcattagacaacctcgtcatgttacataattcggagcaagggggacgcgcatatcgacatgcaatggaggaattaccggatacaatagaaaccttaatgctactcgccctcatagcagttttgacaggaggagtcacactattctttctatctggcagaggcttgggcaaaacaagtatcgggctgctatgtgtaatggcatctagcgtgttgctctggatggctagtgtcgaaccgcattggatagctgcgtcaatcatattagagttctttctaatggtactcttaatacccgagcctgacagacagcggacaccacaagacaatcaattagcctacgtagtaattggtttgttgttcatgatcctaactgttgcagcgaatgaaatgggactactcgaaacaaccaagaaagatcttggtataggacacgttgcggtcgaaaatcaccaccatgcagcaatgctagatgtggacctccatccagcatcggcctggacattgtatgcagtagccacaactataatcactcctatgatgcggcacacgatagagaacacaaccgcaaatatatcgctaacagccatcgcaaatcaggccgcaatcctgatgggtttggataaggggtggccgataagtaaaatggatattggcgttcccctcttagcattgggttgttattctcaagtaaatccattgacactaactgcggcagttctaatgctggttgcacactatgcaattatcggtccaggtcttcaagctaaggccacaagggaagcccaaaaacgaacggctgcaggaatcatgaaaaaccctacagttgatggcatagtcgccatagacctggatccagttgtatatgacgcaaaattcgagaaacaattaggtcaaatcatgttattaatactgtgcacgtcgcaaatactacttatgcgaaccacatgggctctatgtgagtcaataacgttagccacaggtccattaaccactctatgggaaggatcaccaggaaagttctggaatactacgatagcagtttctatggcaaacatattccgaggaagttacctggcaggcgctggtcttgccttcagtcttatgaagagtttaggtggaggaaggagaggcaccggagcgcaaggagagaccctaggcgaaaaatggaaacggcaactaaatcaactaagcaaaagcgagttcaatacgtacaaaagatcaggcataatggaagttgacaggagtgaagcaaaagaaggacttaaaagaggagaaactactaagcacgcagtttccagaggcacggcaaagttgcggtggtttgtagaacgaaaccttgtcaagcctgaggggaaagttattgatctcggatgtggacgtggcggttggtcttattattgcgcaggtctaaagaaagtcaccgaagtcaaaggctataccaaaggtggaccaggacacgaagaaccaattccaatggctacttacggatggaatttggttaaattacactccggaaaagatgtattctttataccaccagaaaaatgcgataccttgctatgcgatataggggaaagctcacctaatcctactatagaagaaggtcgaactctaagagttctgaagatggttgaaccttggttgagagggaaccaattttgtataaaaatactaaatccatatatgccctccgtagtagaaacattagagcaaatgcagcgaaaacacggaggtatgctagttcgcaaccctttgtcgcgcaattctacacatgaaatgtactgggtaagttgcggtaccggaaacatcgtttcagccgtaaatatgaccagtcgtatgcttttaaaccgattcacgatggctcaccgcaaacctacgtatgaacgggatgtcgatctaggagctggtacaaggcatgtagccgtagaaccagaggtagcaaacttagatataataggacaaagaattgaaaacataaaacatgagcacaagtcaacttggcactacgacgaagacaatccttataaaacgtgggcctatcatggatcctatgaagtaaaaccctcaggcagcgcatccagcatggttaatggggttgtcaaattgctaacaaagccatgggacgtaatacccatggttacacaaatagcaatgaccgatacgacgccatttggacagcagagagtatttaaggaaaaagttgacacccgcacacctaaagcaaagagagggacagctcaaataatggaagttacagctaaatggctttgggggtttctatctaggaataagaaaccaagaatttgtactcgtgaagaatttacgagaaaagttagatcaaacgcagccataggagccgtatttgtagacgaaaatcaatggaactctgccaaagaggcagtcgaagacgaaagattttgggatctggtgcatagagagcgagaactccataaacaaggcaaatgcgcaacatgcgtttataatatgatgggcaaacgtgagaagaaattgggagaatttggaaaagcaaaaggatccagggcaatttggtatatgtggcttggagcgcgatttctggaatttgaggcattaggtttcatgaatgaagatcattggtttagtagagaaaacagtttaagcggagtcgaaggcgagggattgcacaaactcggctatatcttaagagatatttctaaaattccaggtggtaacatgtacgcggatgatacggccggatgggatactcgtattactgaagatgatctacaaaacgaagctcggattacagacattatggagcctgagcatgcattgcttgcaaagtccatatttaaattaacatatcaaaacaaagtggttcgagttcagagaccagccaaaaacggtacagtaatggatgtcatcagtagaagggatcagagaggctcgggacaggtaggcacgtatggtttaaacacattcacaaatatggaagcacaactcataaggcaaatggaaagcgaaggcatattcagtccatcggagctagaaaccccaaacctagctgaacgtgtgcttgactggctagaaaaatacggcgtcgaaagactaaaacgcatggcaatcagtggtgatgattgtgtggtaaagccgatagatgacagatttgcaactgcccttactgccctaaatgatatggggaaagttaggaaagacataccacaatgggagccgagtaagggttggaatgactggcaacaggtaccattctgtagtcaccactttcatcaattaataatgaaggatggccgcgaaatcgtagttccttgccgcaaccaagacgaactggttggccgtgcacgagtatctcaaggagcaggttggtctctacgggaaacggcgtgtcttggaaaatcctatgcccagatgtggcagttaatgtactttcacagaagagatttaaggctagccgcgaacgcaatatgtagcgccgtaccggtggattggataccaacgagcagaaccacttggtcaattcatgcacatcaccaatggatgacaactgaggatatgttaagtgtatggaatagagtttggatagaagagaacccatggatggaggataaaacacacatatcaagctggggagatgtcccatacctaggaaaaagagaagatcaatggtgcggatccctaataggactcacggcaagagcaacatgggctacaaatatccaagtggccataaaccaagtgcgaagattaattggcaatgaaaattatcttgattacatgacttctatgaaaaggttcaagaacgaatcggatcctgaaggagccctatggtaa

SEQ ID NO: 21508 - RNA, 9879 nt, synthetic construct
  misc_feature 1..9879: note = derived and/or modified CDS sequence (opt6) from DENV-1__FJ024449__SS-prME
  source 1..9879: mol_type = other RNA
agcgtaacaatgctgttaatgctaatgccaaccgccttagcattccatctcacgacaaggggcggggaaccccatatgatagtatctaaacaagagcgaggtaaatccctgctttttaaaacatcagcaggagtgaacatgtgcactttaatcgcaatggatcttggggaactgtgtgaagacacaatgacttacaaatgtcccagaataacagaaacggaacccgatgacgttgattgttggtgtaatgctaccgatacctgggttacatatggcacatgtagtcaaactggtgaacaccgaagagacaaaaggagtgttgccctggctccacacgtcggattaggtttggaaaccagaactgaaacttggatgtcatccgagggggcatggaaacaaatccagcgtgtagaaacatgggcccttagacacccaggcttcactgtgatagcattgttcttagcacatgctatcggaacctctattacacaaaaagggattattttcatacttttaatgctagtcacgccttcaatggcgatgagatgtgttggaattggctcaagagactttgtcgaggggttgagtggagcgacatgggtcgacgttgtattagagcatggaagctgtgtaacaacaatggctaaagacaaaccgacgcttgatatcgaattgttaaaaacagaagtaacaaacccagcagtacttagaaaactttgtattgaagcaaaaataagcaacacaacgactgattctaggtgtccgactcaaggagaagcaactctagttgaagaacaagatgccaatttcgtatgtagaaggacattcgttgatagagggtggggtaacggatgcggtttatttggtaaaggatcactaataacatgtgcaaaatttaaatgtgttactaaattagaaggaaaaatagttcaatatgaaaacctaaaatactcagtcatcgtgacagtacatactggagatcagcatcaagtaggtaatgaatcaacagagcatggtacaacagcaaccataacacctcaggcaccaaccacagaaatacaacttaccgactacggagcacttactctggactgtagtccaaggacaggtttagattttaatgaaatggtattactaacaatgaaagagaaaagttggctggtccataaacaatggttcttggatttaccgctcccttggacttctggagctagcacgtctcaagagacctggaacagacaagatcttttagttaccttcaaaactgcacacgccaagaaacaagaagtagttgttctgggatctcaagaaggtgcaatgcacacggctctcacgggtgctacagaaattcaaacgtcgggcactacgacaatatttgctggtcacttaaaatgccgtttgaaaatggataaactaacattaaaaggaatgtcttacgtcatgtgcactggaagtttcaaattagaaaaagaagttgccgagactcaacacggaactgttttagtacaaataaaatatgaaggaactgatgcaccttgtaaaatacctttttctacacaggatgaaaaaggcgtaacacaaaatggtcgactcataactgcaaatccaatagttactgataaagaaaagcctgtcaatatcgaagcagaaccgccttttggggagagctacatcataataggagctggtgaaaaagccttaaaattgagctggtttaaaaagggctcaagcataggtaaaatgtttgaagcaacagcgagaggggcccggcgcatggcaatactaggagatacggcttgggatttcggtagtattggtggggtatttacgtctgtcggtaagctggtacaccaaatatttggtacggcctatggagtactattttccggtgtatcatggacaatgaaaataggaataggagtgttgttaacgtggctagggctaaattctcgaagcacctcattatctatgacttgtatcgccgtaggtttagttacactatatttaggggtcatggtacaagcagattccggatgtgttataaattggaaaggtagggaactgaaatgtggcagtggaattttcgtaacaaatgaggtacatacttggactgaacaatataaatttcaggcggactcaccaaaacgtctttcagctgccataggaaaagcctgggaagaaggtgtatgtggaataaggtcggctacccgacttgaaaacattatgtggaaacaaatttccaatgaattaaatcatatcctcctagaaaacgatatgaagtttacagttgttgtaggcgatgtggcaggcatactcgcccaaggcaagaaaatgataagaccgcagcctatggaatacaaatacagctggaagtcctggggaaaagctaaaatcattggtgcagacgtacaaaacacaacttttataatagacgggccaaatactccagagtgcccagatgaccagcgagcatggaacatatgggaagttgaagactatggattcggtatttttacgacgaacatatggttaaaacttcgagatagccacacacaagtgtgtgatcatagacttatgtcagcagccatcaaagactctaaggcagtacatgcggacatggggtactggattgaaagcgagaaaaatgaaacctggaaactagcaagagcctcctttatagaagtgaaaacttgcatatggccaaagtcgcacacgctgtggtcaaacggagtcctagaatcagagatgatcataccaaaaatatatggtggcccaattagccaacacaactataggcccgggtattttacacaaactgcaggaccgtggcatttaggtaaacttgagttggactttgatttatgtgaaggtacaacagtagtagtggacgaacattgtgggaataggggacccagcttgcgtacgacaactgttaccggaaaaataatccatgaatggtgctgcagaagttgcactttacctcccctacgatttagaggagaagatggatgttggtatggaatggaaatccgaccagtaaaagaaaaggaagagaatttagtaaaatctatggtcagcgcaggctctggcgaggttgacagcttctccctcggtctcctgtgtatcagcataatgattgaggaggtaatgagatcgcgatggagtagaaagatgctaatgacaggcacactcgcagtattctttttgctgataatgggtcagcttacgtggaacgatctaattcggctatgcataatggtcggagcgaatgcatctgacaggatgggcatgggtactacatatctggcactaatggcgacgtttaaaatgcgaccaatgttcgcagtgggattactatttcgaagacttacctccagagaagttctactactgactataggactaagtctcgtagcatcagttgaacttcctaacagcctggaagagttgggagatggcttagctatgggaataatgatactcaaattgcttaccgattttcaatcacaccagctgtgggcgactttactttctttgacatttataaaaacaacgtttagtcttcattacgcttggaaaacaatggctatggtgttaagcatagtgagtttatttccactttgcttatcaaccacgtcacagaaaaccacatggttaccggttcttctgggatccttgggatgtaagccactcacaatgttcttaatagcagaaaacaaaatatggggtcgaaggtcttggccactcaatgaaggaattatggcagtcggaattgtaagcatcctattgtcatcattattgaaaaatgatgtaccattagcaggtcctttgatcgctgggggaatgctaatcgcgtgctatgttattagcggctcatccgcggacttaagtctagaaaaagcagctgaggtaagttgggaggaggaagcggaacatagtggggcgtctcataatatactggtagaagttcaagacgacggaaccatgaaaataaaagatgaagaaagggacgacactctaactattcttctaaaagcgaccctgttagcagttagtggagtataccctctgtcaattccagccacccttttcgtatggtatttttggcagaaaaagaaacaaagaagcggagtgttgtgggacacgccttcgccgcctgaagtggaaagagcagtcttagatgatggcatttacagaataatgcaacggggacttttaggaagatcccaagtaggagttggagtatttcaagaaaatgtttttcatactatgtggcatgttaccagaggagccgttcttatgtatcagggaaaaagactagaaccctcctgggcctctgtcaagaaagatttaataagctatggaggcggatggcggctgcaaggatcatggaatacaggggaagaagtacaagttatcgcggttgagcccgggaaaaatcctaaaaacgttcagactgcgccaggcaccttcaagactccggaaggtgaagttggggcaatagcactagattttaaacccggaacatcgggctctccgatagtgaacagagagggtaagatcgtaggactctatggtaacggtgtagtaaccacaagtggaacttacgtatcggcaatagcacaagccaaggcttcccaagaaggaccattaccggaaattgaagacgaagtgtttcgaaaaaggaacttgactatcatggatttacacccaggttctggaaaaacgcgacgttacctgcctgccatagttagggaggcgataaaaagaaagctcagaacactaatattggcccctaccagggttgtcgcatcagaaatggctgaagcattaaagggtatgcctattagataccaaaccacagcagtgaagtcagaacatacgggaaaagagatagtagacctcatgtgccatgcaacattcacaatgagactcctgagcccagtgcgagtaccaaattataatatgataataatggacgaagctcactttacagacccatctagcatcgcagctagagggtacatatctactagagtggggatgggtgaagcagcagcaatttttatgaccgcaacaccaccagggtcagtagaagcatttccacaatctaatgccgtcattcaggacgaagaacgggatatcccagaacgctcgtggaatagtggatatgaatggatcaccgactttccgggtaaaaccgtatggttcgttcctagtataaagtctggtaatgatatcgctaattgtctccgcaaaaatggaaaaagagttattcaactatcacgcaaaacttttgatacagaatatcagaaaaccaaaaacaatgattgggactacgtagtcaccacagacatatctgagatgggtgctaattttcgggcggaccgagtcatagatcccaggcgttgtctaaagccagtcatactgaaagacggaccagaacgagttatcttagcaggaccgatgcctgtcacagtagcaagcgcagcacaaagaaggggaagaataggtcgaaaccataacaaagaaggtgatcaatatatctatatgggccaaccattaaataacgacgaagatcatgcacattggactgaagcaaaaatgctcctagataacataaatactccagaaggaataatccctgccttattcgaaccggaacgcgaaaaatcagctgccatcgatggcgaataccgtctacgaggggaggctcggaaaacctttgtcgagttaatgcgtagaggcgatttacccgtatggttaagctacaaagtagcgtctgaaggttttcagtacagcgataggagatggtgcttcgacggagaaagaaataaccaggtactagaagaaaacatggatgtcgaaatatggacaaaggagggagagaggaagaaactccgcccacgatggcttgacgctaggacgtatagtgacccattagcattgcgcgaatttaaagagtttgccgctgggagaaggagcgtttcaggcgatttaatattggaaattggtaaacttccacagcatttgacacaacgagcacagaacgcattagacaacctagttatgcttcataactcagaacagggaggacgtgcatatcgtcacgctatggaggaactaccagacacaattgagaccctaatgctacttgctcttatagcggtactaacaggtggggtaacattgttctttttatctggaaggggcctcggcaaaaccagtatcggcttactatgtgtaatggccagtagtgtactgctttggatggcaagtgtagaaccacactggatagccgcaagtataattctggaatttttcctaatggtgttactcatcccagaaccagatcgacaacgtacgccgcaagacaaccaactggcttacgtcgtcattggtcttttatttatgatcctcacagttgctgctaatgagatgggattactcgaaactacaaagaaagatttagggataggacacgtagcagtagaaaaccatcatcacgcagctatgttagatgtggatctgcaccctgctagtgcttggaccctgtatgcagtcgctacgacaatcataactccgatgatgaggcatacgatcgagaacacgacagcaaatatcagcctaacagcaattgcaaaccaggcagcaattctgatggggctcgacaagggttggccaattagtaagatggatataggagtaccgctgctggcactaggatgttacagccaagtaaatcctctaactctgacagctgcagtactgatgctagtggcacactacgctattataggacccggtttgcaagctaaggcaacaagggaagctcagaaaagaactgcagctggcattatgaaaaatcctaccgtagatggaatagtagccattgacctagatccggtagtatatgacgcgaagttcgaaaagcaattaggccaaattatgctgcttattttatgcacttcgcaaattctacttatgcgaacaacttgggcattatgtgaaagcataacacttgctactggaccattaactacactatgggaaggtagcccaggaaagttttggaacacgacgatagcggttagcatggccaacatatttcgaggatcatatctagctggggccggtttggcattcagtttaatgaaatccttaggaggtgggaggagggggactggagcacaaggtgaaactctgggtgaaaaatggaaaagacaattaaatcaactatcaaaatccgaatttaatacatataaacgttcaggtataatggaagtagaccgatcggaagctaaagaaggacttaaaaggggcgaaacgacaaagcatgctgtatctcgcggcaccgcgaaacttcgctggttcgttgaaagaaatctcgtcaaaccggaaggaaaggtcattgatttgggatgtgggcgtggaggatggagctactactgtgctggactcaagaaagtaacggaggtaaaaggatatacgaaaggcgggccgggccacgaagaaccaataccaatggcgacttacggatggaatttagtgaagctgcattcgggcaaagacgtattctttatacccccagagaaatgtgacacattgttatgtgacataggggagtcgagtccgaatccaactatagaggaaggaagaacgctccgcgtgctgaaaatggtggagccatggctacgagggaatcaattttgtataaaaatcttgaacccatatatgcctagtgtagttgaaacattagaacaaatgcaaaggaagcatggaggcatgctagtacgtaacccgttaagtagaaatagtactcatgaaatgtattgggtaagttgtggaactggaaatatcgtatcagcagtcaatatgacgtccagaatgctattaaacagatttacaatggctcatcgtaaaccaacttatgaaagggatgtggacttgggtgcggggacacgtcacgtagcagtagaaccagaagtggcaaacctcgacattataggtcaacgtattgaaaatataaagcatgaacataagagcacttggcattatgacgaggacaacccgtataaaacatgggcctatcatggatcatatgatgtgaaaccaagtggttcagcatctagcatggttaacggtgtagtaaaattgctgacaaaaccatgggatgttatacctatggttacgcaaattgcaatgacagatactactccatttggacaacagcgtgtgtttaaagaaaaagtggacacaagaacaccaaaagcaaaaaggggaacagcccagattatggaagtaactgctaaatggctatggggatttttaagcagaaacaagaaaccccgaatttgtacgagagaagaatttacgaggaaagtgagatctaacgcagcgattggggcagtattcgtcgatgagaatcagtggaacagtgcgaaagaagcagtcgaagacgagagattttgggacctagtacatagagaaagggaattacataagcaaggtaaatgtgctacatgcgtttataacatgatgggaaaacgtgagaagaaacttggtgagtttggtaaagcaaaaggatcaagagccatttggtatatgtggctgggtgcgagatttcttgaatttgaagcacttggatttatgaatgaggaccactggtttagtcgtgagaatagtctatctggtgtagaaggagaaggactacataagctggggtatatcctcagggacatatctaaaataccaggaggaaacatgtatgcagatgatacagctggatgggacacaagaatcaccgaagatgacctccagaatgaagctaggataactgacataatggaaccagaacacgcacttctggcgaaatctatattcaaactaacatatcaaaataaagtcgttagagtacaaagaccggcgaagaacggaacagtaatggacgtaatttcccgacgcgatcagagaggtagcgggcaggtcggaacgtacggattaaataccttcactaacatggaggcccaattgatcagacaaatggaatcagaaggaatcttctctccatcagaactggagacaccgaacctagcggaaagagttttggattggctaaagaaatatggagtcgaaagactcaaaaggatggccatttcgggagacgattgtgtggttaaaccaatcgatgacaggttcgctaccgctctaactgcattaaacgatatgggaaaagtcagaaaggatataccgcaatgggaacccagcaagggctggaacgactggcagcaggttccgttttgctcccatcactttcatcaactaataatgaaagacggtcgtgaaattgttgtaccttgcagaaaccaagacgagctggttggtcgggcaagagtgtcacagggagccggatggtcattacgagaaactgcttgcctcggaaagtcctacgctcaaatgtggcaattgatgtactttcacagaagggacctacgacttgctgcaaacgctatttgtagtgccgtacctgtagattggatacccaccagtcgcacaacgtggtcaatccatgcacaccatcaatggatgacgactgaagatatgctatcggtgtggaatagagtatggatagaagaaaatccatggatggaagataagactcatattagtagttggggagatgtaccttatctgggaaaaagagaggatcaatggtgcggcagtctcattgggctaacagcccgtgctacatgggcaactaacatccaagtggctattaatcaagtacgaagactgattggtaatgagaactatttagattacatgacatcaatgaaacggttcaagaatgaaggtgatccagaaggtgctctttggtaa

SEQ ID NO: 21509 - RNA, 9879 nt, synthetic construct
  misc_feature 1..9879: note = derived and/or modified CDS sequence (opt6) from DENV-1__FJ390383__SS-prME
  source 1..9879: mol_type = other RNA
tcagttaccatgttgttaatgctcatgcctacggcactagcatttcatctaactacaaggggtggggaaccacatatgatagtgtcaaaacaagaacggggaaaatctctattatttaaaacttcagctggtgtgaacatgtgcacgttaatagcaatggatcttggagaattatgtgaggataccatgacctataaatgccccaggattacagaaacagagcctgatgacgtcgactgctggtgtaacgcaacagatacgtgggtgacatatggcacatgttcccaaactggagaacatcgacgagacaaaaggtcagttgctctagcaccgcatgttggattagggctggagactcgtaccgaaacatggatgagttcagaaggagcgtggaaacaaatccaaagggtggagacgtgggcactccgacatcctggatttactgtaatagcactattcctggctcacgcaataggaacttcaattacccaaaaaggtatcattttcatcttactgatgctagtaacaccgagtatggcaatgagatgtgttggaattggatctcgtgatttcgttgagggactatcaggagcgacgtgggttgatgttgtattggaacacggctcgtgtgtaaccacaatggccaaagacaaacctacattagacatagaacttttaaaaaccgaagtcacaaatccggcagtcctgcgtaaactatgcatagaggctaaaattagcaacacaactacagatagcagatgtccaacacaaggcgaggcgaccctggtagaagaacaagatgccaactttgtttgtcgaagaacatttgtcgatcgcggttggggaaatggttgtggcctattcggaaaaggcagcttaataacttgtgcgaaatttaaatgcgttacgaaactggagggaaagattgtacagtatgaaaatctaaaatactccgtaatcgtaaccgtacatacaggagaccaacatcaagtaggcaatgaatcgacggagcatggtacgactgccactattactccccaggccccaacaacagaaatacaacttacagattatggggccctcacattagattgtagtcctagaacaggactcgatttcaacgagatggtactactaaccatgaaagagaaatcatggctagttcataaacagtggttcttagacttaccactcccctggacgagcggagcaagtacttcacaagaaacatggaacaggcaggatcttttagttacgttcaaaaccgcacatgccaagaaacaagaagttgtagtcctggggtcgcaagagggcgctatgcataccgctttaactggagcaacagagattcaaacttctggaacgactaccatctttgctggtcatttaaaatgcagactaaaaatggacaaactaacgcttaaaggaatgagttacgttatgtgcacaggttcctttaaattagaaaaagaagtcgctgaaacgcaacatggaacagttttagtacaaataaaatatgaaggaactgatgcaccatgcaagataccatttcttacgcaagacgaaaaaggagtaactcagaacggcaggttgataaccgcaaatccaatcgttacggataaagaaaaaccggtgaatatagaagccgagccgccctttggcgaatcatatatcataataggcgcaggagaaaaggcgttaaagttaagttggtttaagaaaggtagttccataggcaaaatgttcgaagcaacagccagaggggctagaagaatggcgatacttggtgatacggcttgggactttggatctataggtggagtcttcacaagtgtaggaaagttggtccaccagatatttggaacagcatacggtgtattgttttcgggcgttagttggacaatgaaaataggtattggtgtactcttaacctggctgggtctaaacagtcgttcaacatcactgtctatgacgtgtattgccgtaggtctagtaacattgtatctcggagtgatggttcaagccgactccgggtgtgttataaattggaaaggtcgagaacttaaatgtggttcgggaatctttgtaacaaacgaagtacacacctggacagagcagtataaattccaagcagattctccgaagcgtttatctgccgctatcggaaaagcgtgggaagagggcgtttgtggtatcagatctgcaacacgacttgagaatattatgtggaagcagatcagcaatgaactaaatcacatactattagaaaacgacatgaaatttacagttgtagttggtgatgtagctggtatattggctcagggcaagaaaatgatcagaccgcaacctatggagtacaagtatagttggaaatcctggggtaaagcaaaaattattggtgctgatgtacaaaatacgactttcataatcgatggaccaaatactccagaatgtccagatgatcaacgcgcatggaacatatgggaagtagaagattatggatttggcatattcaccaccaacatttggttaaaactgagagatagctatacacaagtgtgcgaccatagacttatgtcagctgctattaaagactctaaagctgtacatgccgatatgggttattggattgaaagtgagaagaatgaaacttggaaattagcgcgcgccagctttatcgaagtgaagacttgcatctggccaaaatcccatacgttatggtctaatggagtcttggaatcagagatgattattcctaaaatatatggcggtcccatttcacaacataattatagaccaggatattttactcaaacagcaggcccttggcacctaggtaaattagaactagacttcgacctatgcgagggaaccacagtagtcgtcgacgaacattgcggaaatagaggtcctagccttcgaacgaccaccgtcactggaaaaatcattcatgagtggtgctgcagatcttgtacattgccgcctttacgattcagaggggaggatggatgttggtacgggatggaaataagaccagtaaaagaaaaggaagaaaatctggtaaaatctatggtatcagctggctcgggagaagtagactcgtttagccttgggctattgtgcatttctattataatcgaggaagtaatgaggagtcgatggagtcgcaagatgctaatgactggcactttggctgtattctttttattaataatgggtcagcttacttggaatgacttaattcgactatgtattatggtcggagcgaatgctagtgaccgtatgggaatgggcaccacatatctagcgctaatggcgacatttaaaatgcgtccaatgtttgctgtgggtttattatttaggagattaacaagtcgggaggttttgttgcttactatcggattaagtttagtcgctagtgtagagcttccgaacagccttgaggagctcggtgatgggcttgcaatgggtataatgatactaaaattactgactgatttccaatcacaccaattgtgggcgacactgcttagtttaacttttataaaaactacattcagtttgcattatgcttggaaaacaatggctatggtcttaagtattgtaagtttatttcctttgtgcttatcaaccacaagtcagaaaaccacatggctccccgttttgcttggatccctaggatgcaagcccttaacaatgtttttgatagcagaaaataaaatatggggtcgaagatcatggcctctaaatgaagggattatggccgtaggaatcgtctcaattttattatcatccctattgaagaatgatgagccattagcagggcctttaatcgcaggcggtatgttaatcgcgtgctatgtgatcagcggtagcagcgcagatctatctttggaaaaggccgcagaagtatcatgggaagaggaagcagaacactcaggagcgtcacacaatatcctagtagaagtccaagacgatggtactatgaaaattaaagatgaggaacgcgacgatacgcttacgattttattaaaagcaaccctactagccgtttccggcgtttacccgctatcaattccagctactctattcgtatggtatttttggcagaaaaagaaacagagaagcggtgtactttgggatactccatcaccaccagaagtagaaagagcagttttagacgatggtatatatcgaattatgcaaagaggacttctcgggagaagccaagtaggagttggagtattccaagaaaatgtattccatacaatgtggcacgtcaccagaggagccgttttgatgtatcaaggtaaacgactggagcctagttgggctagtgtaaagaaagatctaatcagttacgggggaggctggcgtttacaagggtcttggaacactggagaggaggtgcaagtgattgcagttgagccaggcaaaaatcctaaaaatgtacaaactgctccaggaacattcaaaacacctgagggtgaagtaggagcaattgccctcgatttcaaacctggaacatccggctctccaatcgtcaatcgcgaaggaaaaatcgtaggtttgtatggtaatggagttgtgacgacatccggtacttacgtatcagccattgctcaagctaaagcaagtcaagaggggccattgccagaaatagaagatgaggtattccgcaaaaggaatctcacaattatggatctccatccaggcagcggaaaaacgagacgatatttacctgcaatagtaagagaagcaataaaaagaaagctacgaacacttattcttgctccgactagagtagtagctagcgagatggcagaggctttgaaaggaatgcctatcagatatcagacaactgccgtcaagtccgaacacacaggaaaagaaatagtagaccttatgtgtcacgctactttcactatgcgtttattatctccagtaagagttcccaactacaatatgattataatggacgaagctcactttacagacccaagttcgatagcggcaagaggatatattagtacgagagtgggtatgggagaagctgcggctatatttatgacggcaactcctccagggtcagtggaggcattcccacaaagtaatgccgtaatacaagacgaagaacgagatataccggagaggtcttggaacagcggatacgagtggataacagattttccaggaaagacagtctggttcgtgccatcgatcaaaagtggcaatgacatagcaaactgtttgaggaaaaacggaaaaagggttattcaactgtctcgaaaaacttttgatacagaatatcaaaagaccaaaaataacgactgggattatgtggtaaccaccgacatatctgaaatgggagcaaattttcgagctgatcgagtgatagaccctcgcagatgcttaaaaccagttatcttaaaagatggcccagaaagggtaatattggcaggaccgatgccagttactgtagcgtctgcagcccaacggagggggagaatcggaaggaaccataacaaagagggagaccagtacatttatatgggtcaacccttaaataacgatgaagatcacgcacactggacagaggcaaaaatgctgttagataatattaacacgccggagggaatcatacctgcgttatttgagccagaacgtgaaaaatctgctgcaattgatggtgaatacagattgagaggagaagctagaaaaacatttgttgaactgatgaggagaggggatttaccagtttggttgtcgtataaagtagcatccgagggatttcagtattcggacagaagatggtgttttgatggagaaaggaataaccaggtactagaagagaacatggacgtcgaaatatggacaaaggagggagaacgaaagaaactgcgacctcgttggttagacgcacgtacttactctgacccgttagctcttagagaatttaaagaatttgcagcgggacgccgttccgttagtggagatttaattcttgaaatcggaaaattgccacaacacttaacgcaacgcgcccagaatgctttagataatttagtaatgctacataactcagaacaaggagggagggcttatagacatgcaatggaagaattacctgacacgattgaaaccttaatgttactagccttaatagcggttttaacaggaggagtaactttgttctttttaagtggacgtggattaggaaagacaagtatcggtctgctctgtgtaatggcaagtagtgttctgttatggatggccagcgttgagcctcactggattgcggcgtcaataatacttgagttcttcctgatggttttacttattcctgaaccagacaggcaacgaaccccacaagacaatcaacttgcatatgtagtaataggcctactattcatgatattaaccgtcgcagctaacgaaatggggttattagaaaccacaaagaaagatctaggcattggccatgttgcggtggaaaatcatcatcacgcagctatgttggatgtagatttacacccagcaagcgcgtggactttatacgcagtggcgacaaccattattactccaatgatgagacacacgatagagaatacaacagctaacataagtttaacagccatagctaatcaggccgctatattgatggggctagataaaggctggccaatctcaaaaatggacatcggtgtccctttactagcgttaggatgttattctcaggtgaatccattaactcttacagcagctgtgctaatgctcgtagcgcattacgctataattggtccgggattacaagctaaagcgaccagagaagctcaaaaacgcaccgcagcagggatcatgaaaaatccgactgtcgatggaatagtggcaatagacttagacccagtagtgtacgatgcaaaatttgaaaaacagctagggcagattatgttattaatcttatgcacgagtcaaatattgttaatgagaactacttgggcgctatgtgaatctataacactagccacaggcccgttaaccactttgtgggaagggtcaccgggaaaattttggaatacgacaatagctgtttcaatggccaatatatttcggggaagctacttagccggggcaggactcgcatttagcctaatgaaatcattaggcggtggtcgtagaggaacaggcgctcagggtgagacattaggtgaaaagtggaaaagacaattaaatcaattatcaaaatcagagttcaatacgtataaacgcagtgggattatggaagtggaccgatctgaagcaaaagaagggttgaagagaggtgaaactacaaaacatgctgttagcaggggcactgcgaaattacgatggtttgtcgaaagaaatctagtcaaaccagaaggtaaagtcatcgacttgggttgcggcagaggaggatggagttattactgtgcaggactgaagaaagtcacggaagttaaaggttatacaaaagggggcccgggacatgaagaaccaattccaatggctacctacggatggaatttagtgaaacttcattccgggaaagatgtcttctttatacccccagaaaaatgcgacaccttattatgtgatataggtgaatccagcccaaacccaacgatagaagaaggacgaacgctacgtgttcttaaaatggtggaaccgtggttaagaggcaatcaattttgcataaaaatattgaacccatatatgccatctgtagtggaaacgcttgagcaaatgcaaagaaagcatggaggaatgcttgtacgcaacccattatcacgtaactcgactcatgagatgtattgggtatcgtgtggaaccggaaatatcgtatcggctgtcaacatgaccagtagaatgttacttaatagatttaccatggcacatagaaaaccgacttatgaaagggacgtcgacttaggagctggaacgagacatgtagcagtagaacctgaagtagcgaacttagacataataggacaacgaatcgaaaacattaaacacgaacataaatccacatggcattatgatgaggacaatccgtataagacatgggcatatcacgggagttacgaagtaaaacctagcggctccgcttcatctatggtgaacggagtagttaaattgttaactaaaccctgggacgtcatcccaatggtaacccaaatagcgatgacagataccacgcccttcggacaacaaagagttttcaaagaaaaagtggatactcgaaccccaaaggccaaacgtggcacagctcaaatcatggaagtaacagcaaagtggctatggggatttttgtcccgcaataagaaaccaagaatctgtacccgtgaggaatttacaagaaaagtacgctctaatgccgctataggagctgttttcgttgatgaaaatcaatggaatagcgcaaaggaggctgtcgaagatgaaagattctgggatcttgttcatagagagcgggaactacataagcagggtaagtgtgcaacttgtgtatacaatatgatgggtaaaagagagaagaaattgggagagttcggcaaagcaaaagggagcagagcaatatggtacatgtggttaggtgcaagattccttgagttcgaagcattaggctttatgaacgaagatcactggttcagtagagaaaattctctgagtggagtggaaggtgaaggtcttcacaaattgggatatatcctaagagatataagtaagattcccgggggaaacatgtacgccgatgacaccgcgggatgggatactcgaattacagaagacgatttgcagaacgaggcaagaataaccgatattatggaaccggagcacgccttacttgcaaaaagcatatttaaactaacttatcagaacaaagtagttagggtgcaaagaccagccaagaacgggacggtaatggacgtgatatcacgacgagaccaaagaggatcaggacaggtaggaacatacggattaaatacttttacgaatatggaagcccaattaatacgtcaaatggaatcagaagggatcttctcgcctagtgaattagaaataccaaacttagctgaaagagtgctagattggctcgaaaaatatggggtcgagcgcttaaaacgtatggcaatttcgggggatgattgcgtagtcaaacctatagatgatagattcgcaactgctctaacggctctaaatgatatgggtaaggttagaaaagacattccgcagtgggaaccgagcaaaggatggaatgattggcaacaagtgccgttctgctcacaccattttcaccaattgatcatgaaagacgggagggagattgtggtaccatgccgcaatcaagatgaattggtaggacgcgctagagtctctcaaggtgctggctggagcttgcgggaaacggcatgtctcggcaagtcctatgctcaaatgtggcagctcatgtattttcatagacgagatctgcgactagcggcgaacgccatctgtagtgcggttccagtagattggataccaacatcccgaaccacatggagcatacatgcccatcatcaatggatgactacagaagacatgttgtctgtctggaacagggtatggatagaggagaacccttggatggaagataaaacgcatatttcatcatggggcgacgttccatatcttggaaagcgggaagaccaatggtgtggaagtttgattggattaacggctcgggccacgtgggcaaccaacatacaggtcgcaataaatcaagtgaggcgattaattggtaacgaaaactatctcgattatatgacttctatgaaaaggttcaaaaatgaaggtgaccctgaaggagcattatggtaa

SEQ ID NO: 21510 - RNA, 9879 nt, synthetic construct
  misc_feature 1..9879: note = derived and/or modified CDS sequence (opt6) from DENV-1__FJ182033__SS-prME
  source 1..9879: mol_type = other RNA
agtgtaaccatgctattaatgttgatgccaaccgccttggctttccacttaacgactagagggggtgaaccccatatgatagtaagcaaacaagaacgaggtaaatcattactttttaaaactagcgcaggggtaaatatgtgcaccttaatagctatggatttaggagaactgtgtgaggatacaatgacttataaatgtccaaggataactgaagttgaaccagatgatgtagattgttggtgtaacactacggatacctgggttacgtatggcacatgttctcaaacaggggaacaccgccgagacaaacgtagtgtagcattagctccccatgtagggttgggattggaaactcgagcagaaacttggatgtcctcagaaggggcctggaaacaaattcaaaaagtggaaacatgggcattacgacaccccggcttcacagtaatagcactattcttagcgcacgcgattgggacgagtatcacacaaaaaggcataattttcatattgttaatgctagtgaccccatcgatggctatgaggtgtgtagggattggcagccgagattttgtggaggggctctcgggtgctacctgggtagatgtggtcttggagcacggtagttgtgttacaactatggcgaaagacaaacctactcttgatatcgaattactaaaaacagaagtaacaaatcctgcagtgctacgtaaactatgcattgaagccaaaatatccaatacaacaaccgacagcagatgccctactcaaggagaggccacattagtggaggagcaagatgctaactttgtatgccgaaggactttcgtagatcgaggatgggggaacggatgtggtcttttcggaaaagggagtctgataacgtgtgccaaatttaaatgtgtaacgaaactagaagggaaaatagtccaatacgaaaacttaaaatactctgtaatagttacagtgcatacaggcgatcaacatcaagttgggaatgagtcaacggaacatgggacaaccgcaacaatcacaccgcaagctccaacaagcgaaattcaactgaccgactacggagcactaacgttagattgctcgccaaggacgggcttagatttcaatgaaatggttctgctaacaatgaaagagaaaagttggttagtccacaaacagtggtttttagacctgcctttaccatggacaagcggtgcaagcacatcacaagaaacctggaataggcaagacctattggtaacgttcaaaactgctcatgccaagaaacaagaagttgtcgtattaggctcgcaagaaggtgccatgcatacagcacttacgggggctaccgagatacaaacaagtgggacaaccacaatatttgctggtcacctgaaatgcagactgaaaatggacaagctaactctaaagggaatgtcatatgtcatgtgtacaggctcctttaaactagaaaaagaagtagcagaaacacagcatggaactgttctagtccagatcaaatatgagggtacagacgctccatgcaagattccattttcgacgcaagatgagaaaggagttactcaaaacggaagattaataacggctaatcccattgtaactgataaagaaaaacctgtaaacattgaggctgaaccaccctttggagaatcatatattgtaataggtgcaggcgaaaaggctttgaaattatcctggtttaagaaaggtagttcaatcggtaaaatgtttgaagctacggcaaggggcgcacgtcgcatggcgattctaggtgataccgcatgggactttggttcgatcggaggggtatttacaagtataggaaaattggtccatcaaatttttggtacagcttatggtgttttgtttagcggtgttagctggacgatgaaaattggaataggtgtactcctaacatggttagggctaaacagccggagcacaagtctgagtatgacttgcatagccgtgggattagtcacactgtaccttggagtgatggtacaggccgacagcgggtgtgtaattaattggaaaggcagagagttgaaatgtggatcagggatctttgtaacaaatgaagtgcacacatggacagagcaatataaattccaagctgattccccaaaaaggctgtcggctgcaataggaaaagcatgggaagaaggcgtttgtggcattcgttcagcgacgcgtttagaaaacataatgtggagacaaattagcaacgaactcaatcatatattactagagaatgatatgaaatttaccgtcgttgttggagatgtagtgggaatactagctcaaggtaagaagatgattcgaccgcaacctatggagcataaatattcgtggaagtcatggggtaaggcgaaaattataggagcggatgttcagaatacaacttttataatagatggtccaaatacaccagaatgtccagatgaccaaagagcgtggaatatatgggaagtggaggattatggctttggaatattcaccacgaatatctggcttaaattacgtgatagttacacacaagtatgtgaccacagattgatgtccgcagcaataaaggacagtaaggccgtacatgctgacatgggttactggatagaaagtgaaaagaacgaaacatggaaattagcgcgcgcttcgtttatagaagttaaaacttgtatttggccaaagagccatacactatggtcaaatggggttttagaatcagaaatgattattccgaaaatatacggtggaccaatttcacaacataactaccgcccaggttattttacacaaactgcagggccatggcatttaggaaaattagaattagactttgatttatgcgaagggacaactgtcgtcgtagacgagcattgtggaaaccgaggaccatcattgcggactactacagtaacaggcaaaataatacatgaatggtgctgtcgcagttgtaccttaccaccattaaggtttaaaggtgaggatggctgttggtatggaatggaaattagaccagttaaagagaaggaggaaaatctggtgaagtctatggtctctgctggatcaggtgaagttgattcgttttcattgggtttgttatgtatatcaataatgatagaagaagtgatgagatctagatggagccgtaagatgcttatgactggaactttggccgtatttttcctacttataatgggtcagttaacctggaatgatttgatacggtcatgtattatggtcggcgcaaacgcaagtgacagaatgggtatggggacgacctatttagctttgatggcaactttcaaaatgaggcccatgttcgcagtcggtctactattcaggcgtctaacaagtcgagaagttttattactaacaatcggactatcactcgtagcgtccgtggaactacctaattcactagaggaattaggcgacggtctagcgatgggtataatgatattaaaactattaacggattttcagagctatcaattatgggcaaccctattatcgttaacatttataaaaacaacattcagcttacattacgcgtggaagacgatggcaatggtattatcgatagtatcgcttctaccgctgtgcctctcaacgacaagtcagaaaacgacatggctacctgtcttacttggaagtttagggtgtaagccattaactatgtttcttatagccgaaaataaaatctggggaagaaaatcatggcctttgaacgaaggcatcatggcagtcggaatagtcagtatcttattgtctagtttgttgaaaaacgacgtgcctctagctggacctttgatagccggtgggatgctgatagcatgctatgttataagtggcagtagtgcggatctgtcacttgaaaaagctgccgaggtttcttgggaagaagaagcagaacatagtggcgcatcgcataatatcttagtggaggttcaagacgatggtacgatgaagattaaggatgaggagagagatgatacacttacaatattgttaaaagcaacgctattagctgtctcaggtgtctatccactgtcaatacctgcgaccctcttcgtgtggtacttttggcagaagaagaaacaaagatccggtgtcctatgggataccccaagcccaccggaggttgaaagagcggtacttgacgacggaatatatcgaataatgcagaggggcttgctaggccgaagtcaagtcggggtaggcgtattccaagagaatgtattccatactatgtggcacgtgacgcgtggagcagtactaatgtaccaaggtaaacgtttagagccctcttgggcatccgtcaagaaggatttaatcagttacggtgggggatggcgtctacaaggctcgtggaacaccggagaagaagtacaggtaatagctgttgaaccaggcaagaaccctaagaatgtacaaactgctcctggtacctttaaaaccccagaaggtgaagttggtgccatagcattggattttaaaccgggtacatcgggaagcccaatcgtaaatagagagggtaaaatagtaggactctatggaaatggagtcgtcacgacttctggtacgtatgttagcgccattgcacaagctaaagcgtcacaagaaggtccattacccgaaatagaagatgaagtatttcgaaagaggaacctgaccataatggacttgcacccaggaagcggaaaaacgagaagatatctaccagccatagtacgagaagcaataaaaagaaaattacgcacgctaattctcgcacctactcgagtagtagccagcgaaatggctgaagctctcaaaggtatgcctattagataccagacaacagcagttaaatcagaacatacaggtagggaaatcgtagacctcatgtgccatgcaacttttacgatgaggctacttagtcctgtaagggtacccaattataacatgattataatggacgaagcccattttacggatcctagctcgatagcagctcgcgggtacatttctacgcgcgtgggcatgggcgaagcagcggcaatttttatgaccgctactcccccaggatctgtcgaagcattccctcaaagcaatgcggtaattcaagatgaggaacgagacatcccggaacgttcgtggaatagcggatatgaatggataacagatttcccaggcaagactgtctggttcgtgccgtcgataaaatcaggaaatgatatagcaaattgcctaaggaaaaatggtaaaagagttatccaattgtcgagaaagacttttgatacagaatatcagaaaactaaaaataatgattgggattacgtggttacaactgacataagtgagatgggagcaaattttcgcgcagacagagtaatagacccaagaaggtgtctaaaacctgtaatcttaaaggatgggcctgaaagagtaatactcgcagggccgatgcctgtaacagttgcaagtgcagcccaacgtagaggaagaataggaagaaaccacaacaaagaaggagaccaatacatatacatgggccaaccactgaacaacgatgaagatcacgctcattggactgaagcgaaaatgttattagataatattaacacacccgagggaatcatcccagcactgtttgaacctgaacgggaaaaatctgctgctattgatggagaatatcgacttagaggggaagctaggaagacctttgtcgagctaatgagaagaggtgatctgcctgtttggttaagttacaaagtcgcatccgaaggattccaatatagcgatagacgatggtgcttcgacggagaaagaaacaaccaggtactagaagaaaatatggatgttgaaatctggaccaaagagggtgagaggaagaaactgaggccaagatggctagatgcccgcacgtattcggaccctctagcactacgagaatttaaggaatttgcagcaggaagacggagtgtctcaggcgaccttattctggagattggaaaactgccacagcatttaactcaaagagcacaaaatgccctggataatctagtaatgttacacaatagtgaacaaggaggcagagcgtataggcacgcaatggaggaattacctgatacaatagaaaccttgatgttgttagcccttatagcagtgttaacgggtggggtaacacttttctttctaagcggtagaggtctaggtaaaacatcaattgggttgctttgcgtaatggcttcaagcgccctgctatggatggcctctgtagaaccacattggatagcagcaagtataatcttagagttcttcctaatggtccttttaatcccagagccagacaggcaacgaacaccccaggacaatcaacttgcatatgtggtgataggtttgttatttatgatcttaactgtcgctgcaaacgaaatgggacttctagaaactactaagaaagatttaggtatagggcatgtggcagtcgaaaaccatcatcacgcaacaatgttagacgtcgacttgcatccagcatctgcgtggacattatatgcagttgcgacaacaataattacacctatgatgcgacatacaattgaaaatacaacagccaatattagcctaacagcgatagcaaatcaggcagcgatcctcatgggtcttgacaaagggtggcccataagtaaaatggacattggtgtcccactattggcactaggctgctacagtcaagttaacccactgactttaacagcagcggttctgatgctcgtagcgcattatgcaattataggtcccggtctacaagcaaaagctactcgagaagcacaaaagagaacagcggcaggaattatgaaaaatcctacagttgatggtattgttgcaattgacttggatccggtagtgtatgatgctaaattcgaaaagcaattaggacaaattatgctattaattttatgcacaagccagatactattaatgcgaacgacctgggctttatgcgagagtataacgctggctacaggccctctaaccactctctgggaaggctccccggggaaattctggaatactaccattgcagtaagtatggcaaatatcttccgaggaagttatttggctggagcgggattggcattcagtttaatgaaaagtttgggaggaggtagacgaggaaccggagcccagggagagaccctcggcgaaaaatggaaacgtcagttaaaccaattaagtaaatccgagttcaatacttataaacgatcaggaataatggaagtagatcggagtgaagcaaaagaaggcttacgtcgcggagaaacaacaaaacacgctgtttcgaggggaacagccaaacttaggtggtttgtagaacgaaatttagtaaagcctgaaggtaaagttattgaccttggttgcggaagaggtggctggtcgtactattgcgcaggcctcaagaaagtaacggaagtcaaagggtacacaaaaggaggtttaggtcatgaagaaccaattccaatggctacatacggatggaatctagtcaaacttcacagtggtaaggacgtcttctttattcctccagaaaaatgcgataccttattatgtgatataggagaatcatctccaaaccccactatagaagaaggtaggacgcttagagtactaaagatggtagaaccatggttgcgtggtaaccaattctgtatcaaaatactcaatccatatatgccttcagtagtagaaacgttagaacaaatgcaaaggaaacatgggggaatgctggttcgtaatcccttaagccgcaattccacacacgaaatgtattgggtaagttgtggaacaggtaacattgtaagtgcagtaaacatgacttccagaatgttactgaataggtttactatggctcaccgtaaacctacatatgaaagagatgtggatctaggtgcaggtacgaggcatgtcgccgttgagcccgaagttgccaatctagatataatcggacaaagaatcgaaaatattaaacatgagcataaaagcacctggcattatgatgaggacaatccatacaaaacttgggcgtatcatgggagttacgaagtcaaaccaagtggttccgcatccagcatggtaaatggggtcgttaaactacttacaaagccttgggatgttattccaatggttactcagatagcaatgactgatacgacacctttcggacaacaacgagtatttaaagaaaaagttgacaccaggacgcctaaggcaaaaagagggacagctcaaataatggaagtaaccgcaaggtggctctggggattcttatcgcggaacaagaaacccaggatctgcaccagggaagagttcacacgaaaagtgagatctaatgcagctatcggagcggtatttgtcgatgaaaaccaatggaatagcgcgaaagaggctgtcgaagatgagagattttgggatctagttcatcgagaacgcgagcttcataaacaaggaaagtgtgcgacttgtgtttacaacatgatgggtaaacgtgagaagaaattaggcgagtttggaaaagcaaagggttcgcgtgcaatttggtatatgtggctcggtgcgcgattcttggagttcgaagcattaggatttatgaacgaagatcattggttttcccgtgaaaatagtttatcaggggtggaaggcgagggccttcacaaactcggatatatcttgcgagatatttctaaaattcctggcggaaacatgtatgccgatgacaccgctggttgggacacgcgtataactgaagacgatctacaaaatgaagcaaaaatcacggacatcatggagcccgaacatgcattactagcgacatccatcttcaaactgacgtaccaaaacaaagtagtgagggtacaaagacctgcgcgaaatggaacagtaatggatgtgatatcgagaagagatcaaagaggtagtggtcaagtaggtacatatggcttgaatacctttacaaatatggaggctcaattaattagacaaatggaatcagaagggatatttttaccttcagaattagagacgccgaatctagcagaaagggtattagactggctcgagaaacatggagtcgaacgactgaaacgtatggctatcagtggagatgattgcgtagtaaagccaatcgatgatcggtttgctaccgcgttaacagcactaaacgatatgggaaaagtcagaaaggatattcctcaatgggaaccgtccaaaggttggaatgactggcaacaagtgccattctgtagccaccattttcatcaattaataatgaaggatggtagagaaatcgtagtgccatgtcgaaatcaggatgagctagttggcagggcccgggttagtcaaggtgccggatggtccctgagggaaacagcttgtttgggcaaatcgtatgctcaaatgtggcagcttatgtatttccacagaagggatctacgattagcagctaatgctatttgctcagcagtgccagtagattgggttccgacaagtagaacgacctggtccattcatgctcatcaccaatggatgactacagaagacatgctttcagtatggaaccgggtgtggatagaggaaaacccatggatggaagataaaacacacatttcaagttggggtgacgtgccttacctgggaaaaagagaagatcaatggtgtggttcattgataggtctaaccgcacgagcgacatgggcaaccaacatacaggttgctataaaccaagtgcggagactcataggcaacgaaaactacctcgattatatgacttcaatgaagcgattcaagaatgagtcggatcctgaaggtgcactttggtaa

SEQ ID NO: 21511 - RNA, 9879 nt, synthetic construct
  misc_feature 1..9879: note = derived and/or modified CDS sequence (opt6) from DENV-1__FJ182034__SS-prME
  source 1..9879: mol_type = other RNA
tccgtaacaatgttacttatgctaatgccaacggcactagcattccatttaacaactcgcgggggagaaccccatatgatcgtaagtaaacaagaaagaggaaaatcattactttttaaaactagcgcgggtgtgaacatgtgtacattaattgcaatggacctaggtgaattatgcgaagatacaatgacatataaatgcccaaggattactgaagctgaaccggacgacgtagattgttggtgtaatgctacagatacttgggtaacctatggtacttgtagccaaactggagaacaccgacgagacaaacgtagtgttgcattagcgccacatgtaggactaggtcttgaaactagaacggaaacatggatgtccagtgagggagcatggaaacaaatacagagagtagaaacatgggcacttcgtcatcctgggttcacagtcatagctcttttcctcgcacatgcgattggtacctcgatcacacagaaaggaataatttttattctcttaatgctcgtaacgccgagtatggcgatgcggtgcgtcggaattggtagccgtgatttcgtggagggcctatctggcgccacatgggtagacgttgtgttagaacatggttcgtgcgtaacaacaatggccaaagacaaaccgacacttgacattgaattactaaaaaccgaagttacgaatcctgcagtgttacgtaaactttgcattgaagctaaaatttcaaacacgacaacagatagtagatgcccaactcagggtgaagctacgcttgtagaagaacaagatgcaaatttcgtatgccgtcgtacattcgttgacaggggttggggtaatggctgtggtttgtttggaaaaggatcattaataacatgcgctaaattcaaatgtgtaaccaaattagaaggcaaaatagttcaatatgaaaacctcaaatattcggtaatagtaacagtgcatactggagatcagcatcaagtgggaaatgagtcaacggaacacggaacgacagcaactataacaccacaagcaccttcgacggaaattcaattgaccgattatggcgcgctgacattagactgctctccacggactgggctagactttaacgaaatggtcttacttaccatgaaagagaaatcctggctagtccataaacagtggtttctagatcttcctctaccttggaccagtggggcgagtaccagtcaggaaacatggaacagacaagacctcttagtaacttttaaaacagcgcatgctaagaaacaagaagtggttgtattgggcagtcaagagggcgccatgcatacggcgttaactggggcaacggaaatccaaacatccggtactacgacaatatttgccggacatcttaaatgtagactaaaaatggacaaactgacattaaaagggatgagctatgtaatgtgcacaggttcatttaaactagaaaaagaagtcgctgaaacacaacacggcactgttcttgtacaaataaagtatgaaggaaccgatgcgccatgtaaaataccgttctcgactcaggacgagaaaggagtaacccagaatggacggctaatcactgcaaaccctattgtcactgataaagaaaagccagtcaacatcgaagcggaacccccattcggtgaaagctatatcgtaatcggcgctggggagaaagcattaaaacttagttggtttaaaaagggcagttctattggtaaaatgtttgaagctacagctcgaggggctaggcgaatggccatactgggtgataccgcgtgggattttggatcaataggcggggtctttacatctgttggaaaattagttcatcaaatcttcggaactgcctatggggtgctttttagcggagtctcgtggacaatgaaaataggcataggcgtcttattgacctggttgggccttaactcaaggagcacttcactgtcaatgacctgcattgcagtaggtttggttacgttgtatttaggcgtcatggtccaagctgatagtggctgtgtgatcaattggaaaggacgtgaattgaaatgtggttcaggaatatttgtaaccaatgaggttcacacttggactgaacaatataaatttcaagcggattcgcccaaaagactttctgccgctattggcaaagcatgggaagaaggggtatgtggtattagatcagcaaccaggttggaaaatatcatgtggaaacaaataagcaatgaactgaatcacattttattagaaaacgacatgaagtttacagttgtagtaggtgatgtcgcaggaatattagctcagggtaagaaaatgataagaccgcagcccatggaatataagtattcatggaagagttgggggaaggcgaagatcataggcgcagatgtacagaacacaacatttattattgacggaccaaatacaccagaatgtcctgatgatcaaagagcatggaatatctgggaggtagaggattatggctttggaatatttacaacaaatatttggcttaaactgagagatagttacacacaagtatgtgatcataggttgatgagtgccgcaattaaagattcaaaagcagtacacgctgacatggggtattggattgagtccgagaaaaacgaaacgtggaagctcgctcgagctagttttattgaggtaaagacttgcatatggccaaaaagccatacactctggtctaacggcgtattagaatccgaaatgataatccctaaaatatatggaggccctatatctcagcacaattatcgacctggttactttacacagacagcaggcccatggcacttaggaaaactcgaattggatttcaatttatgcgaaggtactaccgtggtggttgatgaacattgcggaaaccgtggaccatcattgaggacaacgactgtcaccggaaagataatccatgagtggtgctgccgatcatgcacactccctccgctaagatttaaaggcgaagatggttgctggtatggcatggaaatacggcctgtaaaagagaaagaagaaaatctagttaaaagtatggtcagcgctggctctggagaagttgattccttctcacttggtctactatgtattagtataatgattgaagaagtaatgagatcacgttggtctagaaaaatgctaatgacaggcaccctagcggtcttctttctacttataatggggcaattaacatggaacgatctcattcgtctatgtataatggttggtgctaatgctagtgaccgaatgggaatgggtatgacatatctcgccttaatggcaacgtttaaaatgcgacctatgctagcagtaggcttactattcaggcgtttaactagccgagaagttttacttctaacaataggactaagcctagtggcgtccgtagaactcccgaatagcttagaggaattaggtgacgggctcgcaatgggcataatgattctaaaactgcttacagacttccaatcacatcaactatgggcaactttgttatccctaacctttataaagacaacttattctttgcattatgcctggaagacaatggcaatggtgctttctatagtctctttatttcccttatgtctctccacaaccagtcagaaaacgacttggttaccagttttattaggatcattaggatgtaaaccattaacaatgtttctgatagcagaaaacaaaatatggggacgtaagtcatggcccctaaacgaagggataatggcagtgggaatcgtaagtatcctgttgtccagccttctcaaaaatgacgttccactagcaggcccattaattgctggtggaatgttaatagcatgttatgtaatttctggttcctcggcagatttatctcttgagaaagctgctgaggtatcttgggaagaggaagctgaacacagtggcgcatcgcataacatattggtagaagtacaagatgacggtacgatgaaaataaaagatgaagaacgtgacgacaccctaacaattttactaaaagcgacattactagctgtgtcgggggtctatccccttagcataccagctacgttatttgtttggtacttttggcagaagaagaaacaaaggagtggtgtactgtgggataccccaagcccgccggaagttgaacgtgcagtgctggacgatggaatttatagaataatgcagagaggtctcttgggccgaagccaagtaggagttggtgtatttcaggaaaatgtttttcacacgatgtggcacgtaacacgaggtgctgtgttaatgtaccaagggaaaaggcttgaaccatcttgggcctcggtcaagaaagacttaatttcttacgggggtggttggagactacaaggttcatggaatacaggagaggaggtacaggtaatagcagtagagccaggcaaaaatcccaaaaatgtacagacggcgccgggaactttcaaaaccagcgaaggcgaagttggagccatcgcactagattttaagccaggaacctccgggtcccccattgtaaatagggaaggaaaaatagttggactctatggtaatggcgtcgttactacttcaggtacatatgttagtgctattgcacaagctaaggcttctcaagaagggcctcttcctgaaatagaaaatgaagtttttaggaaacgcaacctaactataatggatttgcatcctggtagtggaaaaactaggagatacctccccgcaatagtgcgagaagccataaagcgtaaattacggactcttattctcgcaccaacaagagtagttgccagcgaaatggcggaggcattaaaaggtatgccgattagatatcagactaccgcagtcaaaagtgaacacactggcaaggaaatagtggatctaatgtgtcatgctacttttacaatgcggcttcttagtcctgtgcgtgtgccaaattacaatatgataataatggacgaggcacactttacagacccgtcttcgatagcggcccggggatacattagcacaagagttggcatgggggaggcggcagctatatttatgacggccactcccccgggatctgttgaagcctttccacaaagcaacgctgttattcaagatgaggagcgagacatcccagaacggtcctggaatagtggctatgaatggatcactgattttcccggtaagactgtatggtttgttccatcaatcaaatctgggaatgatatcgctaattgtctaagaaagaatggtaaacgagtaatacaactatcacgcaagactttcgacacagaataccagaaaaccaaaaacaacgattgggactacgtagtgaccactgatatcagcgaaatgggagctaatttcagggcggatcgcgtcatagacccccggagatgccttaaacccgttatactaaaggatggaccggaacgcgtaatactagctggaccaatgcccgtcacagtcgcctcggctgcacaacgaaggggtagaataggaagaaaccacaataaagagggcgatcaatacatatatatgggccagccacttaataacgacgaagatcatgcacactggactgaagctaaaatgctgctggacaacataaatacacccgagggaataatccccgctctgtttgaacctgagagggaaaaatcagccgcaatcgatggtgaatatcgattgcgtggagaagccagaaaaacattcgttgaattaatgcgacgcggtgatttaccggtgtggttatcttataaagttgcatcagaaggtttccaatattcggacagacgttggtgtttcgatggcgaaagaaacaatcaagtacttgaggaaaacatggacgtagagatttggacaaaggaaggagaacgtaagaaactacgaccacggtggttagacgcaagaacgtactctgatccattagctttaagagaatttaaggaatttgcagccggaagacgctcagtatcgggggatttaatattagaaattggcaaattgcctcaacatttgacacagagagcacagaatgcgttggataacttggtaatgttacataactcagagcaaggtgggcgagcttatcgtcacgccatggaagaactaccggatactattgaaaccctgatgttattagcgctaatcgcagtcttgacaggaggggtaacactgtttttcttatcaggaagaggcttaggcaaaacttctattggacttttatgtgtaatggcaagcagcgtactgttgtggatggcgagtgttgaaccacattggatcgccgcttcaattatattagagttctttctgatggtactattaattcctgagccagacagacagcgtacgccgcaggataaccaactcgcttatgttgtaataggcctactattcatgatactaacagtcgctgcgaacgagatgggtctgctagaaacaactaagaaagatttaggaataggtcacgttgctgtagaaaaccatcatcacgctgcaatgctagatgtcgacttgcatcctgcatctgcctggacactttatgctgtagccactacaataataacaccaatgatgagacacacaattgaaaatacaactgctaacatcagtctaactgcaatcgcgaatcaagccgcaatattaatgggtttggataaaggctggccgatatctaaaatggacataggtgttccattgctggcgctaggatgttattcacaggttaacccgttgacactcacagcagctgtcttaatgttagtggctcactatgcaataatcggcccaggacttcaagcaaaagctactcgggaggctcagaaaaggacagctgccggcataatgaaaaatccaacggttgacggtatagtagcaatagatttagatcccgtagtttacgacgcaaaatttgaaaaacaattaggacaaattatgttactgatactatgcacatcccagatactactaatgcgaaccacatgggcactttgtgaatccattacattagccaccggtccacttacaactctgtgggaaggtagtccgggtaaattttggaatactacaattgctgtaagcatggctaatatattcagaggttcctacttagcaggagcaggtttggcattttccctaatgaaatcacttggtggtggacgacgtggaacaggagcgcaaggagagaccctgggagaaaaatggaaaaggcaactgaaccaattaagtaaaagtgagttcaacacctataagagatcaggaataatggaagtagatagatcggaagctaaagaaggattaaagagaggggaaacgaccaagcatgctgtcagtagaggtactgcaaagctccgatggtttgtagagcgcaacttagtcaagcccgagggaaaagtaatagatcttggttgcggcagaggagggtggtcatattactgtgctggcttgaagaaagtcacagaagtaaagggatatactaaaggaggtcccggacatgaagaaccgatacccatggccacttatggatggaacttagtcaaattacattcaggaaaagatgttttctttataccaccagaaaaatgtgacacacttctttgtgatataggggagagctctccgaacccaaccatagaggaaggaaggacattacgtgttttaaagatggtcgaaccatggttaagaggaaaccaattttgtataaaaattttgaatccctacatgccaagtgttgtagagacattggaacagatgcaacgaaaacacggcggaatgctagtaaggaacccattgtccaggaactcaactcatgaaatgtactgggtaagttgtggaaccggtaatatagtctcggcagtaaacatgacgtcaagaatgcttcttaaccgctttacgatggcacaccgcaaaccaacttatgaaagggatgtagatttaggcgctggtactcgtcatgtagcggtcgagccagaagtagctaacctggacataattggccagcgtatagaaaacataaaacacgaacataaatcaacctggcattacgatgaggacaatccctacaaaacatgggcttaccatggttcttatgaggtgaagccctccggtagtgcctcatcgatggtgaacggtgttgtaaaattactaacaaagccttgggatgtaataccaatggtaactcaaatagccatgacggacacaacaccgtttggacagcaaagagtattcaaagaaaaagttgatacaaggaccccgaaagctaaaagaggaacagctcagataatggaagtgacagcaaagtggttatggggattcttaagtcggaacaagaagccgagaatttgcacaagagaagaatttaccaggaaagtaaggtcaaacgccgcgattggcgcagtctttgttgacgaaaaccaatggaacagtgcgaaagaagctgttgaggatgaaagattttgggatcttgtacatcgagaaagagaattacataaacagggaaaatgcgctacgtgcgtatacaatatgatgggaaaaagggagaagaaattaggagagttcggaaaagctaaaggatctagggcgatatggtacatgtggttaggggcacggtttttagagttcgaggcgcttgggtttatgaacgaagaccattggttctctcgtgaaaattcactctcaggagtggaaggagaaggtcttcacaagctaggatacatcctaagagacatttcaaaaataccaggcggaaacatgtatgccgatgatacagctgggtgggacaccagaataaccgaggacgatttacaaaatgaagcaaaaattaccgatataatggaaccagaacatgcgctcctagctaaaagcatttttaaattaacatatcaaaataaagtagttagagttcagagacccgctaaaaacggaaccgtgatggatgtcatctcccgccgcgatcaacggggtagcggtcaggttgggacttatggattgaacacttttactaatatggaagcccaactaataagacaaatggaaagtgagggtatattcagccctagtgaattggaaactccaaacctagcgggtagagttctagactggttggagaagcatggggtcgaaaggttaaaacgaatggctattagtggtgatgactgtgtggtaaaaccgatcgacgacagatttgccacagctttgacagcattgaatgacatgggaaaagtacgcaaagatatacctcaatgggaaccttcaaaaggatggaatgattggcagcaagtgccgttttgttcacaccactttcaccagttaatcatgaaagacggaagagagatagttgttccatgtcgcaatcaagacgaacttgtagggagagcacgggtttcacagggcgccggttggagccttagggaaacagcttgtctaggaaaaagctatgctcaaatgtggcaactaatgtatttccataggagggacttgcgattagcggctaatgcaatttgctcggcagttccagttgactgggttccaacaagtcgaacgacatggtccatccatgcgcatcaccaatggatgacaacggaggatatgctctcagtttggaatagggtttggatagaagaaaacccctggatggaagataaaacacacataagtagctggggagatgtaccatacttgggaaaacgcgaagaccagtggtgcggatcattaatcggactgaccgcaagagcaacgtgggctacaaacatacaagttgcaataaatcaagtgagacgtctaattggtaacgaaaactatttagactatatgacatctatgaaaagatttaaaaatgagtctgatccggaaggggctctatggtga

SEQ ID NO: 21512 - RNA, 9879 nt, synthetic construct
  misc_feature 1..9879: note = derived and/or modified CDS sequence (opt6) from DENV-1__FJ182036__SS-prME
  source 1..9879: mol_type = other RNA
tctgtaactatgttacttatgttaatgccaaccgcactagcattccatttaactactagaggaggggaacctcacatgatagtaagtaaacaagaaagaggtaaatcactactatttaaaacttccgcgggtgtaaatatgtgtactttaatagcaatggatctcggagaattatgtgaagatactatgacatataaatgccctagaataacagaaactgaaccggatgatgttgattgttggtgcaacgcaacagatacctgggttacctacgggacgtgtagccaaactggtgaacatagaagagacaaacgttcagttgcattggctccacatgtaggattaggtctcgaaacacgaactgaaacttggatgtcgtcagaaggagcatggaaacaaatacaaagagttgaaacatgggcccttcgacatccagggtttactgtaatcgccctctttttggcgcatgcaataggtacatcaataacacagaaagggatcatattcattctattaatgctagccacaccatcaatggccatgagatgcgtcggcattggctcaagggactttgtagaaggactgtctggtgctacttgggtagacgtcgtattggaacatgggtcttgtgtaacgacgatggctaaagataaaccaacgctcgacattgaactattgaaaacagaagtgaccaacccggcggttcttcgaaaattatgcatagaagcgaaaataagtaatacaacgaccgacagtcgttgtccaacccaaggtgaagctacgttggtagaagaacaagatgcaaacttcgtttgtaggagaacatttgtagacagggggtggggtaacggttgcggattattcggtaaagggagcttaataacttgcgctaaattcaaatgcgttaccaaactagaaggaaagatcgtccaatacgagaacctcaaatattcagtcattgtaactgtacacactggtgaccaacatcaagtaggaaacgaatctacagagcatggaacaacagcaaccataacaccacaagctcctacgacagagatacaattgacagattatggagcactaacactagattgctcgccacgtactggtttagattttaacgagatggtactattgacaatgaaagagaaaagttggttagtgcacaaacaatggtttcttgatttaccattaccatggacctctggagcaagtacgtcgcaagaaacatggaataggcaagacctgttagtcacttttaaaactgcgcatgccaagaaacaagaagtcgttgtactcgggtcacaagaaggggctatgcatacagcgctcaccggagcaactgagatacaaacgagtggtacaactactatcttcgctggtcatcttaaatgtagacttaaaatggacaaactaaccttaaaaggaatgagctacgttatgtgtactggatcgtttaaacttgaaaaagaattagctgaaacgcaacacggaacagttcttgtacaaatcaaatatgaagggacggacgccccatgcaaaatcccatttagtacccaggacgagaaaggcgttacacaaaatggacgtctgattactgcaaaccctatagtaacagacaaagaaaaacccgtgaatatcgaagcagaaccaccctttggggagtcctacatagtgataggagcgggggagaaggctctgaaattaagctggtttaaaaaggggtcatcaattgggaaaatgtttgaagcaacggcacgaggagcacgacgaatggcgatcttaggagacacagcgtgggactttggttcaatcggaggcgtttttacgtcggtgggtaagctagtgcatcagatatttgggaccgcttacggcgtgctattctcaggagtcagttggactatgaagattggaataggagtcctcttaacatggttgggtctaaatagtagatccacatccttaagcatgacatgcatagcggttggtttagtaacgttatacctaggagtgatggtccaagcagatagtggttgcgtgatcaactggaaagggcgtgagctcaagtgtggatcgggcatttttgtaaccaacgaggtacacacgtggactgagcaatacaaattccaagctgatagtccaaaaagattaagtgccgctattggaaaggcttgggaggaaggagtctgtggtatacgaagcgcgacgagattagaaaatattatgtggaaacaaatatcaaacgaactaaatcatatcttgctagaaaatgacatgaaatttactgtggtcgtaggcgacgtagcaggtatcctagcacaaggcaagaaaatgatacgtccgcaacctatggaatataaatactcttggaaaagttggggaaaagcgaagatcattggtgcagatgtgcagaatacaacatttataatagatggcccaaatacgccagagtgtcctgatgatcaacgagcatggaacatatgggaagtagaagattatggattcggaattttcactacaaacatatggcttaaattacgggactcctatacacaggtttgtgatcatagactaatgagcgctgcaataaaagactcaaaagcagtacacgctgatatgggatactggatagaaagcgagaaaaacgaaacgtggaagttggcgcgggcgagttttatagaagtaaaaacatgtatttggccaaagtcacacaccttatggtcgaatggcgtactggaatccgaaatgattatacctaaaatttatggaggtccaatgtcccagcataattacagaccaggttattttacacaaacagctggaccatggcatctaggaaaattggaactagattttgacttatgtgaaggcacgacggttgtagttgatgaacattgtggaaatagaggtcctagtttaagaaccactacggtcacgggaaaaattatccacgaatggtgttgtaggagctgcacgcttcctcctctaaggttccgcggcgaggacggttgttggtacggaatggagattagacctgtaaaagaaaaggaggaaaatctagtaaagagcatggtttctgcagggtccggagaagtagattcgttttcgcttgggctcttatgtataagcataatgattgaagaggtcatgaggtctaggtggagtcgaaaaatgctaatgacaggaacgttggcggtcttctttctattaataatgggtcagctaacttggaacgatctaatacgattgtgtataatggtaggggcgaatgcgtccgatagaatgggaatgggtactacgtacttagctttaatggcaacctttaaaatgagaccaatgttcgctgttggtctactgtttcgacgcttaacgagtagggaagtactgttacttacaatcggattatccctagtggcttcagtggagctaccaaatagtctcgaagaattgggagatggactagctatgggaatcatgatattgaaattgctaacggactttcaatcacatcaactatgggcaaccttattatctttaacatttattaaaaccaccttttcacttcattatgcttggaaaacaatggccatggtcttatccattgtaagccttttcccactttgcttatctacaacctcacagaagactacttggcttccagtcctactagggtcattaggttgtaaacccctcactatgttcctcattgcagaaaacaagatatggggacgacgatcttggccgctcaacgaaggaataatggcagtgggaatcgtaagcatactactatcttcgttattgaaaaatgacgtaccattggctggaccattgatagctggagggatgctgattgcatgttatgtaatttcaggctcaagcgctgatttatctttggagaaagcagctgaggtaagttgggaagaagaagccgaacactctggagcgtctcataatatcttagttgaggttcaagatgatggtactatgaaaatcaaagacgaagaaagagatgatacattaacaatactacttaaagccacgctcttggcagttagtggcgtatatcccttaagcattcctgcaacattatttgtatggtacttctggcagaaaaagaaacaaagatcaggagtattgtgggacactccgtctccacctgaagttgaacgggctgtattagacgacggaatctatagaataatgcaacgcggactattaggaagatcacaagtaggagtgggtgtatttcaagagaatgttttccataccatgtggcatgtaacaagaggcgcagttttaatgtatcaaggtaaacgcctcgaaccttcatgggcatctgtcaagaaagacttaataagttacggaggcggttggagactccaaggttcctggaacacaggagaagaggtacaggtaatagcggtggagccggggaaaaaccctaaaaatgtgcagacagcaccaggaacatttaagactccagaaggagaagttggagccatagccctggactttaaaccgggaacttctggttcaccaatcgtaaacagagaagggaaaattgtaggcttatatggaaatggcgtagtgacgacttcaggtacttacgtctccgctatcgcacaagccaaagcctctcaagaaggaccactacctgaaattgaagatgaagtatttaggaaacgtaatcttacaataatggacctacacccagggtcaggcaaaacgagacgatatctacccgcaatagtacgtgaagcaataaaaaggaaacttagaacattaatattagcaccaacccgggtagtagctagtgaaatggcagaagcgcttaaaggtatgcccattagataccagactacagcagtcaaaagtgaacatactgggaaggaaatagtcgatcttatgtgtcacgctactttcacaatgaggctactgtcgcccgtaagagtaccaaactacaacatgattataatggacgaagcacatttcacagacccatcgtcaattgcagcacgcggctatattagtacaagagtgggtatgggcgaagcggcggcaatatttatgactgcgacaccacctgggtccgtcgaagcatttcctcaatctaatgcagttatacaagatgaagaacgggacataccagaaaggagctggaacagtggttatgaatggattacagactttcctggcaagacagtgtggtttgtcccgtcaattaaatcaggaaacgatatagccaattgtcttaggaaaaatggaaaacgagtaatacaattatcaagaaaaaccttcgatactgagtatcagaagactaaaaacaatgattgggattacgtagtaacaacagatatttcggaaatgggcgctaactttagggctgatagagtaatcgatccgcggagatgtcttaaaccagtcatcctaaaggatggtcccgagcgcgtaatattagcaggtcctatgccagtcacagttgcgagtgcagcgcaaagacgaggcaggataggcagaaatcataacaaggaaggggatcaatatatctatatggggcaaccactcaataatgatgaagatcacgcgcactggacagaagcaaaaatgctattggataatattaatacgcctgaagggatcattccggcattatttgagccagagagggaaaaatctgcagctatagacggggagtacaggctacgaggtgaggcacggaagacctttgtagagcttatgagaaggggcgatctacctgtctggctatcatataaagtggctagcgaaggatttcaatacagtgacagaagatggtgcttcgatggcgagcggaataatcaagtattagaagaaaatatggatgtagagatatggactaaagaaggtgaaagaaagaagctaagaccaagatggctagatgcgcgaacttattctgatcctttggcgttaagagaatttaaagagttcgccgcgggaagaagaagtgtctcaggagacctcattctcgagatagggaaacttccccaacaccttacccaaagagcacaaaacgcactagataacctcgttatgctgcacaactccgaacaaggcggtagagcgtatagacatgctatggaagaactaccagatactattgagaccctaatgttattagcacttatagcagttctgacgggaggtgtaactctatttttcctatctggtagaggtctcggtaagacgtcgataggtttactgtgtgtaatggcgtcatcagttttactatggatggccagcgtcgaaccacattggatagcagcaagtatcattctagaatttttccttatggttttattaatcccagaaccagatcgccaaagaactccgcaagacaaccaactagcatatgtagtaatcggccttctttttatgatcctaacagttgcagctaatgaaatggggcttttagagacaaccaagaaagatttaggtatagggcacgtcgcagtagagaatcatcaccatgctgctatgctcgatgtggacctgcacccagcaagcgcatggacattatatgcggtcgccaccactataataacaccaatgatgaggcataccatagagaatacaacggcgaatatatccttaacagcaatagcaaaccaagcagctattttaatgggactagacaagggatggcctatatccaaaatggatataggtgtgccacttctcgccttagggtgttatagccaagtaaatccccttactttaaccgcagcggttctaatgctagtcgcacactacgctataataggaccgggactccaagctaaggcaacaagagaggcacagaagagaacagctgcaggtataatgaaaaatccaaccgtcgatggcatagtggccattgacctagatcctgtagtgtacgatgcgaagtttgaaaaacaattgggacaaataatgcttcttatattatgtacatcccaaattctattaatgcgcactacgtgggcattatgcgaatcaataaccttagctacggggcctctaacaacactttgggaaggaagtccgggtaagttctggaacaccactattgcagtttctatggcgaatatcttccgcggaagctatcttgccggtgcaggtctagcattttcacttatgaaaagcctaggaggcggacgccgaggtactggagcccaaggagaaacactcggcgaaaagtggaagagacaactcaatcagttgagtaagagtgaatttaatacttacaagcggagcggaataatggaggtagatagatcagaagctaaagaagggcttaaacgaggagaaacaacaaaacatgctgtttcccgtggcaccgcgaaacttagatggttcgtggaacgaaacttggtaaaaccggagggcaaagtaattgacttagggtgtggtaggggcggctggtcttattactgcgcaggtctaaagaaagtgacagaggttaaaggatacacaaaaggaggcccgggacacgaggaaccaattcccatggcaacatacggttggaatttagtaaaattacactcaggtaaggacgtgttctttatccctcctgagaagtgtgatacgctactctgcgacataggcgagtcatcccctaatcctactatagaagaagggcgtaccttaagagtactaaaaatggtagaaccgtggctgaggggaaatcaattttgcatcaaaatcttaaatccatacatgcccagcgttgtcgaaacgttggaacaaatgcaaagaaaacatgggggaatgctggtcagaaatccattatcaagaaactcgacgcatgaaatgtactgggtcagttgtggaacaggaaacatagttagtgccgttaacatgacgagtcgtatgttacttaatagattcactatggcacaccgaaaaccaacatacgaacgagacgttgatctaggggcaggaacacgacatgtagcagttgaaccagaagtagccaatctcgacataattgggcaaagaattgaaaatatcaaacatgaacacaagtctacatggcactatgacgaagacaacccgtacaaaacttgggcttatcacggcagctatgaagtaaaaccatctggttccgcctcaagcatggtgaatggggttgttaaactactgactaagccctgggacgtaattccgatggtaacccaaattgccatgacagacaccacaccctttggtcaacaacgcgtattcaaggagaaagtggacacacgcacaccaaaagccaagaggggtacggctcagatcatggaggtgaccgcaaaatggctatggggatttttatcgaggaataagaaaccacgtatctgcacccgggaggagttcacgaggaaggttcgatccaatgcagcaataggcgcagttttcgtagacgaaaatcaatggaatagtgcaaaggaggcggttgaagatgaaagattctgggacctagtacacagggagagagaactgcataaacaaggtaagtgtgcgacttgtgtttacaatatgatgggaaaacgagagaagaaactgggagagttcggtaaagcgaaggggtcaagggctatttggtatatgtggcttggtgccagatttttggaatttgaggctttaggttttatgaatgaggatcattggttctccagagaaaactctttgtcaggtgttgaaggtgaaggtttacataaattaggatatatactccgggacatcagtaaaataccgggaggaaacatgtacgcggacgacactgcaggatgggacacaagaataacagaagatgatttgcagaatgaagcaagaattacagatataatggagccggaacatgccctactggcgaaatctatattcaaacttacctaccagaataaggtagtgagagtacaaagaccggccaaaaacggcactgtaatggacgttatatcgagaagggatcagagaggcagtggacaggtaggaacgtacggtttaaatacattcactaatatggaagcgcaattaatccggcaaatggaatctgaaggaatattcagtccgtccgaactagagaccccaaatctcgctaaaagagtattagattggctggaaaaatacggagtagaacgactcaaacgaatggcaattagtggtgatgattgtgtagtaaaacccatcgatgatcgattcgctacagctctaacagcccttaatgacatgggcaaagttcgcaaagatattcctcaatgggaaccaagtaaaggatggaacgactggcaacaggtcccattttgtagtcatcattttcatcagctaataatgaaagatggaagagagattgtagtaccttgtcgcaaccaagatgaactcgttggtagagctcgtgtatctcaaggtgccggttggtcgttgagagaaacggcctgtctaggcaaatcgtatgcgcaaatgtggcagttaatgtatttccatagacgagatcttcgactagcagctaatgcaatttgtagcgcggtcccagtagactggattccgacgtcaagaaccacatggtcaatacatgcccatcaccagtggatgacaaccgaagatatgctaagtgtatggaacagagtctggattgaagaaaatccctggatggaagataagacacatatttctagttggggagatgtgccgtatctaggaaaaagggaggaccaatggtgtggttcattaattggcctaaccgcccgtgctacatgggcaacgaatattcaagtagcgataaaccaggtaagaagattaataggaaacgaaaactatcttgattatatgacatctatgaagaggttcaaaaatgaatctgacccagaaggcgcattatggtaa

SEQ ID NO: 21513 - RNA, 9879 nt, synthetic construct
  misc_feature 1..9879: note = derived and/or modified CDS sequence (opt6) from DENV-1__FJ205876__SS-prME
  source 1..9879: mol_type = other RNA
tcagtaactatgctacttatgctgatgcctacagcacttgcattccatttaacaacacgagggggtgaaccacatatgatcgtttcaaaacaagaacgtggaaaatcactactgttcaaaacttccgctggagtgaacatgtgtacgttaatagcgatggacttaggtgaattatgtgaagacacaatgacttacaaatgcccaagaattacggaaactgaacctgacgacgtggattgttggtgtaatgcaacagatacatgggtcacatacggaacatgctcgcaaacgggcgaacacagaagggataaacgaagcgttgctctagcaccacacgttggattaggactcgaaaccagaactgaaacttggatgtcgagcgaaggtgcttggaaacaaatacagcgagttgaaacatgggcactaagacatcctggttttacagtaattgcattgtttctagcccatgccataggaacatcaataactcaaaaaggaatcatattcatactactaatgctggtaactccaagtatggctatgagatgtgtcgggataggaagtcgggattttgttgaaggtttgtccggcgcaacttgggtagatgttgttctagaacacgggagctgcgtaacaacaatggctaaagataaaccaacgttagatatagagctcctaaaaacagaagtcacaaacccagctgttttaaggaaactatgtatcgaagctaaaataagtaacactactacggatagcagatgtcctacgcagggagaagctacacttgtagaagaacaagatgcaaactttgtttgtagaagaacgtttgtcgacaggggatggggtaatggttgcggtctgtttggaaaaggaagtctcattacgtgtgctaaattcaaatgcgtaacaaaattagaaggtaaaatcgtgcaatacgagaatttgaaatattcggttattgtcacggttcacacaggtgatcaacatcaggtcggtaatgagagtaccgagcatggtaccaccgcgacaataacaccgcaagcacctaccacagaaatccagttaacagactatggcgctttaacgcttgattgttcacccaggaccgggctcgattttaatgaaatggtgctactcacaatgaaagaaaaatcatggttagttcataaacagtggtttttggacttgccactaccatggacatcaggcgcatcaacaagccaggaaacttggaacaggcaagatctcttagtgacctttaaaacggcacacgcaaagaaacaagaggtagttgtactcggaagccaggaaggagcgatgcacactgcactgacaggggctaccgaaatacagacttcaggcacaacaacaatatttgcgggtcacctcaaatgtcgtcttaaaatggacaaacttaccttaaaaggtatgagttacgtaatgtgtacggggagctttaaactggaaaaagaagtagctgaaacacaacacggaacagtcttagtacaaataaaatacgaaggaactgatgctccctgcaaaataccgttcagtacacaagatgagaaaggggtgacgcaaaacggtaggttaataaccgcaaaccctatcgtcaccgataaagagaagcctgttaatatagaagcggaaccaccattcggggaaagctatattgtaatcggcgctggggagaaagcgctaaaactgtcctggttcaagaaaggaagctccataggtaaaatgtttgaggctaccgcacgcggtgctagaagaatggcaatattgggtgatacagcgtgggattttggatcaataggcggtgtctttacaagtgtaggaaaattagttcaccaaatattcggcacagcatatggtgttttatttagtggcgtttcgtggacgatgaagatcgggataggcgtattattaacatggttgggattaaatagtagatcaaccagcttatcaatgacgtgtattgcggtagggttggtaactctttacttaggagtgatggtccaagctgatagcggttgcgtaataaattggaaaggaagggaactaaaatgcggttccgggatattcgtgacgaatgaagtacacacatggaccgaacagtataagttccaagcagattctccaaaacggttaagtgctgctataggcaaggcttgggaggaaggcgtttgtggcataagatcagcaacacgactagaaaacataatgtggaaacaaataagtaatgagctgaatcacatactgttagaaaatgatatgaagtttactgtagtggtcggagatgtagcgggaatattagcacaaggcaagaaaatgattagaccacaaccaatggaatataagtatagttggaaaagttggggaaaagctaaaataataggagcggatgtccaaaatacaacgttcataatagacgggcccaatactccagaatgcccagatgaccaaagagcatggaacatctgggaagtagaagactatggattcggcatatttactactaacatttggctaaagctcagagactcttatacacaggtatgcgaccacagattaatgtcagctgcgataaaagactcaaaagcagtacatgcagatatgggatattggattgaatctgagaaaaatgaaacctggaaattagctagagcttcattcattgaggtcaaaacatgtatttggcccaaatcacatacgctatggtcaaacggtgtcttggaaagcgagatgataatacccaaaatctacggcggccctatctcacagcacaactataggccgggatactttactcaaacggcaggcccatggcatttaggaaaactcgaattagattttgacttgtgtgagggcactaccgtcgttgtcgatgagcactgtggaaaccgtggcccctctttaagaacaacgacagtaactggcaaaataatccatgagtggtgttgtagatcttgcaccttacctccacttagatttcgcggagaagatggctgctggtacgggatggaaataaggcctgtaaaagaaaaagaggagaaccttgtgaaatcgatggtatcggcgggatccggcgaagttgactccttttctctcggattattatgtatttccattatgatagaagaggtaatgcgctcgagatggtcaaggaaaatgctaatgacaggaacattagcagtcttcttcctcctaataatgggccagctcacgtggaacgacttaatacgcttatgtataatggttggggctaatgcttctgatcgcatgggtatgggaactacatacctagctttaatggccacgtttaaaatgcgacccatgtttgcagtaggccttctctttcgccgactaacgagcagagaggtcctactcttaacgataggattatctttggttgcttcagtagagttaccaaactcactagaagaattaggcgatggcctagctatgggaataatgattctaaaactgttaactgattttcaatcacatcaattatgggctactttactatctctcacatttataaaaacaacattttcattgcactatgcttggaaaacaatggcgatggttctaagcattgtatctctattccctctatgcctatccacgacatcgcagaaaacgacgtggctaccagtcttactagggagcctcgggtgtaaaccactcacaatgttcctcattgccgaaaacaaaatttgggggagaagaagttggcccttaaatgaaggaataatggcagtagggattgtcagtatattattatcgtctcttctcaaaaatgacgtccccttagcagggccattaatagctggaggaatgctcatagcttgttatgttattagtggaagtagtgcggacctatccctagaaaaagcggccgaggtctcttgggaggaggaagcagaacactccggtgccagtcacaacatattggtagaggttcaagacgacggtactatgaaaataaaagatgaagaacgtgacgacactcttacaattcttttgaaggctacactactagctgtaagtggagtatatccactgagtataccagcaaccttatttgtatggtatttttggcagaaaaagaagcaacgatccggagtcctgtgggataccccatcacccccggaggtcgaaagggcggtcctagacgatgggatatatagaatcatgcagcgtggactactaggcagatcacaagtcggggttggtgtatttcaagaaaatgtattccatacaatgtggcatgttactcggggcgccgtactaatgtaccaaggtaagcggctggaaccaagttgggcttcagtgaaaaaggatctgatatcatatggaggaggctggagactgcaaggatcttggaatacgggcgaagaagtacaagtaattgcagtagaaccagggaaaaaccccaaaaatgtacagacagcccctggtacctttaaaaccccggaaggagaggtgggtgcaattgcactagactttaaacctgggacctcagggtcaccaatagtaaatcgagaaggcaaaattgtgggtctttacgggaatggagtagtaacgacaagtggaacttacgtttcagcgatagcccaagccaaagcatcacaggaagggccgttaccagagatcgaagatgaagtatttaggaaacgaaacttaacaatcatggatttgcacccagggtcaggaaaaacgagaagatatcttcctgccattgtcagagaagcaataaagagaaaacttcgcacattgatcctcgcacctacacgtgtggtcgcatccgaaatggcagaagcgctaaagggtatgcctatacgatatcaaacaacggctgttaagagtgagcatactggtaaggagattgtagaccttatgtgtcatgcaacatttactatgcgactcttatccccggtcagagttccaaattataatatgataataatggatgaagctcatttcactgacccgtcgtcgattgcggcaagaggatacatatcaacaagagtaggaatgggagaagcagcagcaatattcatgactgcaaccccaccaggcagtgtagaagcatttccccaaagtaatgcagttatacaggacgaagaaagagacatcccggaacgatcatggaatagcggatacgagtggatcacggatttccctgggaaaacagtttggtttgtcccaagtataaaaagcggaaacgatatagcgaattgcctaaggaaaaacggaaaacgggtcattcaactgagccgtaagacctttgatacagaatatcaaaagacaaagaataacgactgggactatgtagttacgacagacatatccgaaatgggagcgaatttccgagccgacagagttattgatccccgaaggtgtttaaaaccagtgatattaaaggatggacccgaaagagtaatattagcaggacctatgcccgttactgtggcctctgctgcacagagacgcggacgaataggcaggaaccacaataaagagggagaccaatatatttatatggggcaaccattaaataatgatgaagatcatgctcattggacagaagcgaagatgttgttagacaatattaatacaccagaaggaatcatacctgctttatttgaacccgaaagagaaaagtccgcagctattgacggtgagtaccgattaagaggagaggccaggaagactttcgttgaattaatgaggaggggcgatctacctgtgtggcttagttacaaagtagcctcggaaggattccaatactctgataggcgttggtgttttgatggggaacgcaataatcaagtacttgaggaaaatatggatgtagaaatttggactaaagaaggagaacgcaaaaagttaagaccacgttggcttgatgctcgaacctattctgatcctctagccttaagagaatttaaagaatttgctgccggacgcaggtcagtatctggcgatcttattcttgagattgggaaattaccacaacatctgacccaacgtgcacaaaatgctttggacaatttggtgatgcttcataattcggaacaaggtggacgagcatatcgacatgctatggaagaactacccgacaccatcgaaacacttatgctcctagcactaattgctgttcttactgggggagtaacattgtttttcctttctggaagagggcttggtaagacttcaatcggactcttatgtgtaatggcttcatcagtgctgttatggatggctagtgttgaacctcactggatagcggcaagcattatattagagttctttctaatggtccttctaatacctgaaccggataggcaaaggacaccacaggataatcaactcgcatatgtagtgataggcctactgtttatgatacttacagtagcagccaacgaaatgggcctcctcgaaaccactaagaaagatctcggaatagggcacgttgcagttgaaaatcatcaccacgcagctatgctcgatgttgatttgcatcctgcgtctgcatggacgttatatgccgtggcaacgacaataataacaccgatgatgcgtcataccatcgagaataccacagcgaatatttcactgacagctatagcaaatcaagctgcaattttaatgggactagataaaggctggccaatatctaaaatggacataggagtacctttattagcattgggatgctattcacaagtaaatccattaaccctgacagctgcggtactaatgctcgtagcacattatgcaattataggcccaggtttacaggctaaagcaaccagggaagcacagaaaagaactgcagcgggcataatgaagaacccaacggtcgatggtatagttgcgatcgaccttgaccctgttgtatacgatgccaagtttgagaaacaattgggtcaaattatgcttctaatactatgtacgagccaaattcttcttatgcgcacgacttgggcattatgtgaatcgataacattagccacgggcccccttacaactctctgggagggatccccaggaaaattctggaatactactattgcagtatccatggccaatattttccgtggctcttatttagccggtgcaggtttggcatttagcttaatgaaatcattaggcggaggtaggagagggacgggggcccaaggtgaaacactcggtgagaaatggaaacgacaactaaatcaattatctaagagtgagtttaatacctataaaagatctgggattatggaagtagatagaagcgaagctaaggaagggctaaaacgtggggaaacaaccaaacacgccgttagtcggggtacagcaaaacttagatggttcgtagaaagaaacctagtaaaacctgaaggcaaagtcatcgacttaggatgcggtcgcggagggtggtcttactattgtgccggcctaaagaaagtcaccgaggtaaaaggttatacgaagggtggtccaggacacgaagaacccatccccatggcaacatacggatggaacttagtaaaactacattcagggaaagacgtattctttataccgcccgagaagtgcgataccctgctatgtgatataggagagtcctcgcccaatcctacaatcgaagaaggccggactttacgagtacttaagatggtcgagccttggctccgaggaaatcaattttgcatcaagatactcaatccatacatgcctagcgtagttgagacattagaacaaatgcaacggaaacatggtggaatgttagtgagaaatccgttatctaggaactctacccatgaaatgtattgggttagttgcggaactggcaatatagtctcggcagtaaatatgacttctcgaatgttactaaacagattcacaatggcacataggaagccaacgtatgagcgggatgtagacttaggagcgggaacgcggcacgtcgctgtagaaccagaagtggcgaacttagacataataggacaacggatcgagaacataaaacatgaacataaatcgacttggcactatgatgaagacaatccatataaaacatgggcttaccacggctcatatgaggtaaagccttctggatcagcaagctctatggtcaatggggtggtgaaattactaacgaaaccttgggatgtgataccaatggtaacacaaattgctatgacagatactactccgtttggtcaacaacgagtatttaaagaaaaagtcgacactagaacaccaaaagcaaaacgaggtaccgcccaaataatggaggtaaccgcaaaatggttgtgggggtttttgtcgcgaaacaagaagccaagaatatgcaccagagaagagttcacccgaaaagttagatctaatgccgctataggagcagtatttgtggacgaaaatcaatggaactcagcaaaagaagcagttgaagatgaaagattctgggatctagtgcatagagagcgtgaattgcacaagcagggaaaatgcgcgacatgtgtctataacatgatgggtaagcgtgagaagaaattaggagaatttggcaaagcaaaaggaagccgagctatctggtacatgtggctaggcgccagatttctggagttcgaagctctaggatttatgaatgaggaccattggttcaatagagaaaactccttaagtggagtagaaggagaaggtttacacaaattgggttacatattaagagacatatccaaaataccaggagggaacatgtacgcggatgatacagccggttgggacaccagaataactgaagatgatctacaaaatgaggcaaggatcaccgatattatggagcctgaacatgcgttattggcaagatcaatcttcaaactcacttatcaaaataaagtagtgcgtgtccagaggccagctaaaaatgggaccgttatggacgtaatatcccggcgtgatcaaagaggatcagggcaggtaggaacttatggcttaaatactttcacgaacatggaagcacaactgataagacaaatggaatcagagggaatattctcacctagtgaattagaaaccccaaatctagcggaaagagtactagattggttagaaaaatacggggtagaaagactcaaacgtatggcgatctctggagatgattgtgttgtgaaacctatagatgaccgatttgcaacagcactaacagcattaaacgatatgggtaaggtacgaaaagacattccgcagtgggaaccatcgaagggatggaatgattggcaacaagtaccattttgctcacaccacttccatcagttaattatgaaagatggacgggaaatagtcgtaccttgcaggaatcaggacgaattagtagggcgagcacgagtaagccaaggagcaggttggagtttgagagaaaccgcatgtctaggcaaatcttacgcacaaatgtggcaactcatgtactttcaccgtagagatttgcgcttagctgcgaacgccatatgctcagcagttccagtagactggataccaacatcccgcacaacttggtcaatacatgcgcatcatcaatggatgacaactgaagacatgcttagtgtatggaaccgcgtgtggatcgaggaaaatccatggatggaggacaaaacccacatctcgtcttggggagatgttccatacttaggaaaacgtgaagatcaatggtgcggatcccttataggtttaaccgcaagggcgacatgggctacaaacatccaagttgccattaaccaggtaaggaggttaatcggcaatgagaactatctagattatatgacgagtatgaaacgattcaaaaacgaaagtgaccccgaaggagctctctggtag

SEQ ID NO: 21514 - RNA, 9879 nt, synthetic construct
  misc_feature 1..9879: note = derived and/or modified CDS sequence (opt6) from DENV-1__FJ024455__SS-prME
  source 1..9879: mol_type = other RNA
agtgttactatgttactaatgctaatgccaaccgccttagcgttccatttaactacaagaggaggagaacctcacatgattgtgtctaaacaagaacgggggaaaagtctgctgttcaaaacttctgtaggtgtgaatatgtgtacgcttatcgcaatggaccttggtgagctctgtgaagacaccatgacatacaaatgtcctcgcattacagaaaccgaacctgatgacgttgattgctggtgtaatgctacagatacttgggtaacgtatgggacatgctcccaaacaggagaacatagacgagacaaaagatcggtagcgctagcccctcatgtcggactgggactggaaactagaacagagacatggatgtcaagtgaaggagcgtggaaacaaatccaaagggtcgaaacctgggcgctacgacatccggggttcacagtgattgcactgtttctggcgcatgctatcggaacgtcaataacacaaaaagggataatatttatactgttaatgttagttactccgtcaatggctatgcgatgtgtaggaatcggaagtagagacttcgttgaaggattaagtggagccacctgggtagatgtagttctggaacatggatcttgtgttacgacaatggccaaagacaaacctactttggacatcgaacttttaaaaacagaagtaaccaaccctgcagttctcagaaaactatgcatagaagcaaaaatcagcaatacaaccacggattcacgatgcccaacacaaggggaagcgactttagtagaagaacaggatgctaactttgtgtgccgacggaccttcgttgatagaggctggggaaatggatgcggtttatttggaaaaggaagcctgataacatgcgccaaattcaaatgtgtaacgaaacttgaaggcaaaatagttcaatacgaaaacctgaaatattccgtaattgtcactgttcatacaggagatcaacaccaagttggaaacgagagcactgaacacggtacaacagctacaatcacaccacaagccccaacaaccgaaattcaattaacagattatggcgctctaacccttgactgcagtccaaggactgggctcgattttaacgagatggtattgctcacaatgaaagaaaaatcatggttagtgcacaaacaatggtttttagacttacctctaccatggacatccggggcttcaacgagccaggagacctggaatcgacaagatttactcgtgaccttcaaaacagcccatgccaagaaacaggaggtcgtcgtactggggagccaggaaggggccatgcataccgcattaacgggagcgacagaaatacaaactagcggtacaactacaatcttcgctggacatctaaaatgcagactcaaaatggataaactaaccctgaaaggaatgagctatgttatgtgcacaggatccttcaaattagaaaaagaattggcagaaacgcaacacgggactgtattagtacaaatcaagtatgaaggaacagatgcaccatgcaaaattcccttttcaactcaagacgaaaaaggagtgacgcaaaatggccgacttataacggctaacccaattgtgacagacaaagagaaacccgtaaatatagaagccgagcccccatttggtgaatcttacatagttataggagccggagaaaaagcgttaaaactctcatggtttaagaaaggtagcagcataggcaagatgttcgaggcaacagccagaggggctcgtcggatggccatactaggcgatactgcatgggattttggttctataggaggagtgtttacatcagtaggcaaattagttcaccaaatctttggaacagcgtatggtgtattgttttcaggtgtctcatggactatgaagatagggataggtgtattattaacatggttaggtcttaactcaaggagtacgagcctatccatgacttgtatagccgtcggcctagtaacactttatctaggggtgatggttcaggcagacagtgggtgtgtgatcaactggaaaggaagagaattgaagtgtggttcggggatattcgtaaccaatgaggtccatacatggacagaacagtacaaatttcaggcagatagtcctaaacggctaagcgcagcaatcggcaaggcttgggaagagggtgtttgtggcatcagatcagcaaccaggctagaaaatattatgtggaaacaaataagtaatgaattaaatcacattttgctagaaaacgatatgaaattcaccgtagttgtcggagatgtagctggtatacttgcacaaggcaagaaaatgatcaggccacaaccaatggaatacaaatattcatggaaatcctggggaaaggccaagataattggagcagatgtacaaaacactacatttataattgatggcccgaatacaccggaatgtcctgacgatcaacgcgcttggaatatttgggaagtagaagattacggttttggcatcttcactacgaatatatggttaaagttgagagattcttacacccaagtatgcgaccatcgactaatgtctgctgcaatcaaagattccaaagcagtacatgcagatatgggttattggattgaaagcgagaaaaatgaaacatggaagttagcacgcgctagctttatagaagtaaaaacttgcatatggccaaaatcccacacattatggtccaatggagtgctagaatcagaaatgattattcctaagatttacggcggtccaataagccaacataattaccgaccaggctactttacacaaactgctgggccttggcacttaggaaagttagagctagacttcgatttatgcgaaggaacaacagttgtggtcgatgaacattgcggaaaccgaggtccatctttaagaaccacaaccgtaacaggaaaaataatacatgaatggtgctgtagatcttgcacactgccacctctcagatttcgcggggaagatggttgctggtatggtatggaaatacgtccagtaaaggagaaagaagaaaatttagtaaaatctatggtaagtgccggaagtggcgaagtcgattcatttagtctgggattgctatgcatttcgattatgattgaagaggtcatgcggtcaaggtggagcagaaaaatgctgatgactggaacactcgctgtattcttcctattaataatggggcagctaacctggaacgatttgataaggctctgtataatggttggtgctaacgccagtgacagaatggggatgggaactacgtatttagcattgatggccacatttaaaatgagaccaatgttcgcagtcggtctgttatttcgccgactcacatcacgagaagtactacttcttaccatcggtctgagtttagttgcttcggttgaattgccaaattcactagaagaattgggggacggattagccatgggaataatgatccttaaactattaacagatttccaaagtcaccaactgtgggctacacttctctcgcttacattcataaagacaacgttttcactccactatgcttggaaaactatggcgatggtacttagcattgtgagtttatttccactatgtctaagcactacatcacagaaaacaacgtggcttccagtattattaggttcgctagggtgcaaaccactaacgatgttcttgatagcagaaaataagatatggggccgccgatcctggccattaaatgaaggaattatggcggtcggcatagtttcaatacttctgagctcacttctgaaaaatgatgtcccattagcaggaccacttatagcagggggtatgttaatagcatgctacgtcataagtggctcctccgcggacttgagtctcgagaaagcagctgaagttagttgggaggaggaagcggaacattccggcgcttctcataatattctggtggaagtccaggatgatggcaccatgaagattaaagacgaagaaagggatgacacattgaccatacttctaaaagcaacattactagcagttagtggtgtttacccattatcaataccagcaaccctgtttgtttggtatttttggcagaagaagaaacaaagatctggagtgctctgggatacgcctagtccaccagaggtcgaaagggcagtattagatgacggaatttatagaatcatgcagagggggctactggggagatcacaagtaggagtaggtgtattccaggaaaacgtattccatacaatgtggcacgtaacaagaggggcagttctaatgtatcaaggcaagcgactagagccctcatgggcgtcagtcaagaaagacttaataagctacggaggtggctggcgtctacaaggaagttggaatacaggagaggaagttcaagtcatagcagtagagcctggcaaaaatcccaaaaatgtacaaactgccccgggaacgtttaaaacaccagaaggggaggttggagcgatcgctttggattttaaacccggtacctctgggtcaccaatagtaaatagagaaggcaaaatagttggtttatatggcaatggtgttgtaaccacaagtggaacatatgtgtcggcgattgcccaggcgaaggcttcgcaagagggacccccaccagaaatagaggatgaggtttttcgaaagagaaatttaactatcatggacctacaccctgggtcaggaaaaactagacgctatcttccagcaatcgttcgcgaagctataaaaaggaaacttcgcacgttaattcttgccccaactagagtagtggcatcagaaatggcagaagccttaaaaggtatgcccattcgatatcaaacaacagcggtaaaatctgaacataccgggaaagagatagtagatttaatgtgccatgcgacgttcacgatgcgtctactatccccagttagggtaccaaattataatatgataataatggatgaagcacacttcacagatccgagttccattgctgcaaggggttatatatcaacacgtgtaggaatgggagaagcggctgccatctttatgacagcgacccctccagggtctgtcgaggcattccctcaatcaaatgctgtaattcaagatgaagaaagggatatacccgagcggagttggaatagtgggtatgaatggattaccgattttccgggcaagacggtatggtttgtaccaagcataaaaagcggcaacgatatagctaactgcctaaggaaaaatggaaaacgggtaatccaattatcccgcaaaacctttgacaccgagtatcaaaagaccaaaaacaacgactgggactatgtagttacaacagatatctctgaaatgggggcaaattttcgcgcagatcgtgttatcgaccctagacggtgtttaaaaccagtgattttaaaagacggaccagagcgtgtgatcttggcgggaccaatgccagttacagtagcttcagcagctcaacgtcgcggcaggattgggagaaatcataacaaagaaggagaccaatatatttacatgggacaaccattaaacaacgatgaagaccatgcccattggacagaagccaagatgttattagacaatataaacacaccagaagggattattccagctttattcgaaccagagagagaaaaatcagcagcaatagacggagagtataggttacgaggagaagcaagaaagacatttgtcgagctaatgcgaagaggcgacctaccagtctggctaagctacaaagtcgcatccgaaggtttccaatatagcgatagaagatggtgtttcgatggggagcgcaataatcaagtactagaagaaaacatggatgtagaaatttggactaaagaaggtgagaggaagaaattacgtcctcgctggcttgacgcaagaacatactcggatccattagctctcagagaatttaaagaatttgctgcaggaaggaggagcgtatctggggatctgattctagaaatcgggaaacttccgcaacatctaacacaaagagctcaaaacgcgttggacaacctggtcatgctacacaacagcgaacaaggtggtcgggcatatagacatgctatggaagagttgccagatacaatagaaaccctaatgctactagcgttaattgcagtactcacgggcggagtcactttgttctttctatcaggaagaggcctcggaaaaacatctataggacttttatgtgtcatggcatcttctgtactactatggatggccagcgtggaacctcattggatcgccgcttctattatattggaatttttcttaatggtcttacttataccagagccggaccggcagcgaacacctcaagataaccagttagcctatgtagtcattggactattatttatgatattaacggttgctgcaaatgaaatgggattattggaaaccacaaagaaagacttaggaattggacatgttgcagtcgagaaccaccaccatgcagcgatgctagatgtagatttacacccggcgtccgcttggacgttatacgcagttgccacgactataattactcctatgatgagacacacgatagagaataccactgcaaacatatcactaacagcaattgccaatcaggctgccatattaatgggtctagataaaggctggccaatcagtaaaatggatataggagttccgttactggcactagggtgctattctcaggttaaccctttaaccttaactgcagccgtactaatgctcgtagcccattatgccatcatcgggccagggctacaagcaaaagcgacccgtgaagctcaaaagagaacggccgcgggaataatgaaaaatcctacagttgatggtatagtagccatagatctcgatcctgtggtttatgacgcaaagtttgaaaaacagttagggcaaatcatgcttttaatcttatgtacttcccaaatcctattaatgcgcactacttgggcgctatgcgagtcaataacactcgcaacagggcctttgacaacgttgtgggagggttcgccgggaaaattttggaatacaacgatagccgtctcaatggcaaatatctttagagggagctacttagccggtgcaggacttgcattttcgctgatgaaatcattgggtggtgggcgaagagggacaggggcgcaaggcgagactttaggtgagaaatggaaaagacaattaaatcaattatcaaagtccgaatttaatacttacaaacggtctggtataatggaggtagaccgatcagaggctaaggaaggtctaaagagaggtgaaacaacaaagcatgcagtaagtagaggcacagcaaaattaagatggtttgttgaaagaaatttggtaaaaccagagggaaaggtaatagatctaggatgcggaagaggcgggtggtcctattattgtgctggcttaaagaaggtaacagaggtcaaaggttatacaaagggagggcctggacacgaagaaccgattccaatggcaacttatggttggaacttagtgaaattacacagtggtaaagacgtgttctttattccacccgaaaaatgcgataccttgttatgcgacataggagaaagttcgccgaatccaacaattgaagaaggaaggaccttgagagttttgaaaatggtggagccatggttaagaggaaatcaattctgtatcaaaatactgaacccatacatgcctagtgtcgtagagactttggagcaaatgcaaagaaaacacgggggaatgcttgtcaggaatccactcagccgaaactcaacccatgaaatgtattgggtatcctgcggtacgggaaatattgtaagcgctgtaaatatgacctctcggatgctattgaataggttcacaatggcacaccgtaaaccgacctatgaacgcgacgttgatctaggcgcaggcacgagacacgttgctgtcgaaccagaagtagcgaatttagacataatcggccagcgaatcgagaatataaaacatgaacataaatcaacctggcattatgacgaggataatccttacaagacatgggcatatcatgggagctacgaagtaaaaccaagtggctcggcatcaagtatggtaaatggggttgtgaaacttctgacgaaaccgtgggatgttatacccatggtcactcaaattgcaatgactgatactacaccattcggacagcaaagagtatttaaagaaaaggtagatacacggacgccaaaggcaaaacggggaacggcacaaatcatggaggtgacagcgaaatggctttggggattcttatccaggaacaagaagccaaggatttgtacccgcgaagaatttactcgaaaagtaagaagtaatgccgcaatcggtgcagttttcgtggatgagaatcaatggaatagtgcaaaagaagctgttgaagacgaaagattctgggatctagtgcatagagaacgggaactccacaagcagggaaagtgtgcgacctgcgtttacaacatgatgggaaagagagagaagaaactaggtgagttcggaaaagctaaaggatcaagagcaatatggtacatgtggctaggagcaagattcttagagtttgaggcactggggtttatgaacgaagatcactggttttctcgagaaaattcgttgtctggtgtagaaggagaagggttacataaactaggctatatacttagagacatctcaaaaataccaggtggcaacatgtatgctgacgataccgctggttgggatacccgcattacagaagatgatctgcaaaacgaagcacgtataacagatatcatggagcccgagcatgcactgttagcgaaaagcatatttaagttaacgtaccagaataaagtcgtaagagtacaaaggccagcaaagaatggtaccgtcatggacgtcatttcaagacgcgatcaaagaggaagcggtcaggttggaacgtatggactaaacacattcactaatatggaagctcaactaattcgacagatggagtccgagggtatattctcaccctctgaactcgaaacacctaatctggccgaacgagttctggattggttggagaaatatggtgttgaacgcctaaaacgaatggcaataagtggagatgattgtgtagtcaaacctatcgatgatcgatttgcaactgcactaacggccttaaatgatatggggaaagtgaggaaagatataccccagtgggaaccaagtaaaggctggaatgattggcaacaagtccctttctgttcccatcattttcatcaactgatcatgaaagacggacgagaaatagtagtaccgtgtaggaaccaagatgaacttgtcggaagggcacgcgttagtcaaggagcaggatggtctctacgtgagacggcgtgtctaggaaaatcatacgctcaaatgtggcaattaatgtattttcataggcgtgatttacgattagctgcaaatgccatatgctccgcagtgcctgtagattggatacctacttcgcggacaacttggagtatacacgcccaccaccaatggatgactacagaagatatgttaagtgtttggaatagagtctggatagaagaaaatccctggatggaagacaaaacgcacatatctagttggggtgacgttccatacctgggaaaacgagaagatcaatggtgtggttcattaattggattaactgcgcgtgctacctgggcgacaaatattcaagtagcgattaatcaagtaagaaggcttattgggaacgaaaactacctggattacatgacatcgatgaagagattcaaaaatgaaagcgatcccgaaggagccttgtggtag

SEQ ID NO: 21515 - RNA, 9879 nt, synthetic construct
  misc_feature 1..9879: note = derived and/or modified CDS sequence (opt6) from DENV-1__FJ024456__SS-prME
  source 1..9879: mol_type = other RNA
tcagtaacaatgttgctgatgttgatgcctacggctcttgcatttcatttaactactcggggtggggaaccccatatgatcgttacaaaacaagaacgcggtaaatcacttttatttaaaacttcggctggtgttaatatgtgcatattaatagccatggacctaggagaactttgcgaagacactatgacgtataaatgtcccaggatcaccgaagcggaacctgatgacgtagactgctggtgtaatgctacagatacatgggttacatatggaacatgcagtcaaactggtgaacatcgaagagataaacgatcagtagccttggctccacacgtcggcttagggcttgaaaccaggacggaaacatggatgtcaagtgaaggggcctggaaacaaatacaacgtgttgaaacatgggcattaagacaccccggtttcactgtgatagctttatttttagcacatgcgattggaacttctatcacccaaaaaggaattatattcatattactaatgctagttaccccaagcatggccatgagatgcgtaggaataggaagtagggactttgtagaaggactctcaggcgcgacgtgggttgacgtagtcctagaacacggcagttgcgttacaacaatggctaaagataaaccgacattggacatagaacttcttaaaaccgaagtgacgaacccagcagtgctcaggaaactctgcatagaagctaaaattagtaacacaactaccgattcacgatgcccaacgcaaggtgaagctacactaatggaagaacaagatgccaattttgtatgccgcagaacctttgtcgacaggggctggggtaatggttgcggtttattcggtaaaggatcactaataacatgtgccaaatttaaatgtgtgaccaaactagaaggaaaaatcgtacaatacgaaaacttaaagtactctgtaatcgtaactgtccatacgggtgatcaacatcaagtaggaaatgagagcaccgaacatgggaccaccgccacaattacaccacaagcacctactagcgagatccaacttacagactacggagcgttgacgctagattgttcgcctagaacaggccttgatttcaatgaaatggtattattgacgatgaaagagaaaagttggctggtacacaaacaatggtttcttgatctgcccttgccatggacttctggcgcatcaactagccaagaaacgtggaatagacaagacctcttagttacatttaaaacagcacacgcgaagaaacaagaggtagtggttctcggatcacaagaaggtgcaatgcacactgccttaacaggtgcaacagaaatacaaaccagcgggaccactactatatttgcaggacatctcaaatgcagactaaaaatggataaactgacattaaagggaatgtcctacgtgatgtgtaccggctcctttaaattagaaaaagaagtagcggaaacgcaacatggaactgtgctcgtgcagattaaatatgaaggaactgacgcgccatgcaagatcccattctcgacccaagatgaaaaaggagtaattcaaaatggacgtctgattactgcaaaccccatagtgacagataaggaaaagcctgttaatatagaagcggaaccacctttcggagaaagttacatagttattggagtaggagagaaggctttaaagttaagttggtttaagaaaggaagtagtataggaaagatgtttgaagccacagcgagaggggctaggcgaatggcaattttaggtgatactgcttgggactttggcagtatcggtggagttttcacatcggtaggcaaacttgtacaccaaatattcgggacggcatatggagtcttattttcaggtgtcagttggactatgaaaataggaattggtgttcttttaacgtggcttggactcaatagtcgatctacctctctatctatgacatgtattgcagtcggacttgtcaccttataccttggggtgatggtgcaggcggattctgggtgcgtaataaattggaaaggtcgtgaactaaagtgtggctctgggatttttgtaacgaatgaggtgcacacatggaccgaacaatataaatttcaggctgattccccaaaacggctatcagcagcgatcggtaaggcatgggaagagggtgtatgcggtatacgttccgcaacccgtttagaaaatattatgtggaaacaaatatcaaacgaacttaaccacatactgttagaaaatgatatgaaatttaccgtggttgtgggtgatgttgtaggtattttagctcaaggtaagaaaatgattcgtcctcagccaatggagcacaaatattcgtggaaatcttgggggaaagctaaaattataggtgcagatgtgcaaaacacgaccttcataatcgatggaccaaacaccccagaatgcccggatgatcaaagagcatggaatatatgggaagtagaagactatggttttggtatatttactacgaatatctggcttaaattacgtgacagctatacccaggcgtgtgatcatcgactaatgagcgcagcaatcaaagacagcaaagcagttcacgctgatatggggtactggatagaatccgagaaaaacgagacatggaaattggcaagagcttcatttatagaagttaaaacatgtatatggccgaaaagtcacacgctctggtcaaacggagtactagaatctgaaatggtaatacctaaaatttatggaggaccaatatcacaacataattataggccaggttactttacccaaacagcaggcccatggcatctaggtaagttagaattagacttcgacttatgcgagggcacaaccgtagttgtcgacgaacactgtggcaacagagggccgagcttacgtacaaccacagtaaccggtaaaataatccatgaatggtgctgcagaagttgcactttaccgccattaagattcaaaggcgaagatggatgttggtatgggatggagatacgcccagttaaagaaaaagaagaaaaccttgtcaaaagcatggtctccgcaggttctggtgaagtagactctttcagtctagggcttctatgtatcagcattatgatagaggaggtcatgcggtcacgttggagcagaaaaatgctaatgaccggaacacttgctgtatttctactactaataatgggccaattaacttggaatgatttaataagactctgtatcatggtgggcgctaatgcaagcgacaggatgggcatgggaactacctatcttgcgttgatggcaacctttaaaatgcgtccaatgtttgcagttggcctactgtttagaagactaacgtccagagaagtattactattaaccatcggcctaagtttagtagcttcagtagaacttccaaattctttagaggagttaggtgatggactagcaatgggaataatgatactgaaactattaacggactttcaatctcatcaattgtgggcaaccctattatcgcttacgttcattaagacaactttgagcctacactacgcatggaaaactatggcgatggttttaagtatagtgtctttgtttccgttgtgtttgagcacaacgtcacagaaaacaacctggctaccggttttactcggttctctaggatgtaaaccgttaactatgtttctaattgctgagaataagatatgggggcgaaaatcttggccgcttaacgaaggtataatggcagtaggcgtagtttccatccttctgagctctcttctcaaaaatgatgtgccacttgcgggaccacttatagccggagggatgttaatcgcttgttacgtaataagcggttcaagcgcggatctttcattagaaaaggccgcagaagtgagttgggaagaggaagcagagcatagtggagcgtcgcataatatactggtcgaagtccaagatgacggaactatgaaaatcaaggatgaagaaagagacgatacattaacaattttactaaaagcaacattgctggctgtttctggagtctatcctttatcaatacccgcaacattatttgtttggtacttctggcagaagaagaaacaaagatcaggtgtcctttgggatacaccttcgcctccagaggtagaaagagcagttctggacgatggaatctacagaattatgcaacgcggcctattggggaggagccaggtaggtgtaggagtatttcaggagaacgtgttccatacgatgtggcatgtaacaaggggtgccgtcctcatgtatcaaggtaaacgcctggaacctagctgggcaagtgtcaagaaagatttaatcagctacggcggcggttggagactacagggtagctggaacaccggagaagaggttcaagtaatagccgttgaaccgggcaaaaatccgaaaaacgtgcagacagccccggggacatttaaaacaccggaaggagaagtgggggcaatcgctctagattttaaaccaggtacctctggctcacccattgtcaatagagaaggaaaaatcgtaggactttatggcaatggcgtagtaactacaagcggaacttatgtgtctgcaatagctcaagctaaagcctcccaagaaggcccgctgcccgaaatagaagacgaagtatttcgtaagagaaacttaacaatcatggatctacacccaggtagcggcaaaacgaggagatacctacccgctatagtgagagaagcgataaaaagaaaactaagaacgttaattctagcaccaactagagtagtcgcaagcgaaatggcagaagcactgaaagggatgcctataagatatcaaaccacagctgtcaaaagcgaacacaccggaaaagaaattgtcgatctgatgtgccatgcaacatttacaatgcgtcttttgtcacctgttagggtacctaactataatatgataattatggatgaggcgcacttcacagatccttcttcgattgccgcacgaggatatataagtacaagggttggaatgggggaagctgcggcaatctttatgacagcaacccctccaggatcggtagaagcgtttcctcagtcgaacgcagtaatacaggatgaggagagagacattccggaacgaagttggaacagtggttacgaatggattacagactttccaggaaaaacggtatggttcgttccaagcattaaaagtgggaatgatatagccaattgtcttaggaaaaatggtaaaagagtgatccaattaagcagaaagacattcgacacagaataccagaaaaccaaaaataacgactgggattatgtagtgacgaccgacattagcgaaatgggggccaactttagagctgatagagtaatagacccaagaagatgtctaaagcccgtaatcttaaaagatgggccagaaagggtcatattagcaggcccgatgcctgtcacagtggctagtgcagcccaaagacgtggtagaatcggacgcaaccataacaaggagggagatcaatatatatacatgggccagcctttaaataacgatgaagaccatgcacactggacagaggcaaaaatgctgttagacaatattaatacacctgaaggtataattcctgcattattcgagccagaaagagagaaatcagcggcaatagatggtgagtatcgactacgtggtgaagccagaaaaacttttgtcgaattaatgcgaagaggagacctccctgtctggcttagctataaggtagcaagcgaagggttccaatacagtgatagaagatggtgcttcgacggtgaacgtaacaaccaagtgctagaagaaaatatggatgtagagatttggacaaaggaaggtgaaagaaagaaacttaggccacgctggttagacgctaggacgtatagcgatccgctcgcacttcgagagttcaaagagttcgcagcagggagaagatctgtgagcggcgacctaattctagaaatcggaaaacttccacaacatctaacacagcgggctcaaaatgccctcgataatctagttatgcttcacaacagtgaacaaggaggcagagcatacaggcatgctatggaagaactcccggatacaattgaaacattgatgctattggcattgattgcggttttaactgggggcgtaacattattctttttgagtggacgcggactgggtaaaacatccatcggattattgtgcgtaatggcttcctctgtcttgctttggatggcaagcgttgaacctcactggatagccgcctctattatacttgaatttttcctcatggtccttttaattcccgagcccgaccgtcaaaggactccacaagataaccagttagcttacgtagtgatagggttattatttatgatccttacagtggcagccaatgagatgggacttctagaaacaaccaagaaagatctcggaataggacatgtcgccgtcgaaaaccaccatcatgcaaccatgttagatgttgatctacatccagcatcggcatggactttatatgcagtagcaactacgataataaccccaatgatgaggcacacaatcgaaaataccacggcaaatatatcgctaaccgcaatagcaaaccaagcagctattttaatgggcttagataagggatggccgataagtaaaatggatatcggagtccctctattagcgttaggatgctacagccaagtaaatccacttaccttaacagctgcagtactgatgttagtcgcacactatgctataataggtcctggtttacaagcgaaagctaccagggaggcgcagaaacggaccgcggcagggataatgaagaatcccaccgttgatggtattgttgcaatagatctagacccagtagtatatgatgcaaaattcgagaaacaactaggacaaataatgttattaatattatgtacatcacaaattcttttaatgaggacgacctgggcactctgtgaatccattactcttgctacagggcctctaactactttgtgggaaggatctcccggcaaattttggaacacaactatagcagtcagtatggcaaatattttccgaggatcatatcttgcgggtgctggtttagcattctcgctaatgaaatccttagggggcggaagacggggaacgggcgcccaaggagagaccctaggcgagaaatggaaacgacaactgaaccagctaagcaagagcgaatttaacatctataagagatcaggtattatggaagtagatagatcggaagcgaaagaaggcctaaagagaggcgaaacgacccgtcatgccgtttctcgcggtacagcaaaactcaggtggttcgtcgaacgaaatctagtcaaaccagagggcaaggtaattgacctagggtgcggaagagggggctggtcatactattgtgctggtctcaagaaagtaacagaagtcaagggatatactaaaggtggccctgggatggaagaacctatccccatggcgacaaacggctggaatctcgtaaaattacattccggaaaggatgttttcttcactccacctgagaaatgcgatactctcttgtgcgatataggagaaagtagcccaaaccccacaatagaagaaggtaggactttgcgagtgttaaaaatggtggagccctggctacgtggcaatcaattttgtattaagatactgaacccatatatgccatccgtcgtagaaacgcttgagcaaatgcaaagaaaacatggaggtatgttagtgagaaatccactgtctagaaactcaacacacgagatgtattgggtatcatgcgggaccgggaacatagtgagtgccgtgaatatgacttctcgaatgctacttaatcgatttactatggcgcacaggaaaccgacttacgaacgagatgtagatttaggagctggaacgcgacacgttgccgtcgagccagaagtagcaaacctagatatcatcggacagcgcattgagaatatcaaacatgaacacaagtcgacatggcactatgatgaagataacccttacaagacatgggcataccatggaagctatgaggtaaagccctcgggtagtgcgtcttcaatggttaacggtgtcgtaaaacttctaacaaaaccctgggatgtaattccgatggtaacacagatcgcaatgaccgacaccacgccatttggacaacagcgtgtttttaaagaaaaagtagacacacgaacaccaaaagcaaaacgcggcacagcacagataatggaagtaaccgctagatggttatggggatttttgtccagaaacaaaaagcccagaatatgtaccagagaagaatttacgcggaaggtaagatccaatgccgccataggggcagtgtttgtagatgagaatcaatggaacagcgctaaagaagccgttgaggacgaaagattttgggatcttgtacagaaagaacgagaacttcacaaacagggtaagtgcgctacatgtgtgtacaacatgatgggtaaaagagagaagaaattaggtgagttcggcaaagctaaaggtagcagggcaatttggtatatgtggttaggtgcgcgtttcttagagtttgaggctttaggattcatgaatgaagaccattggttttctcgtgagaactcactaagtggcgtggaaggagaaggattacataaattgggatatatactacgagatataagtaaaataccaggaggaaacatgtatgcggacgacactgcgggctgggacacacggatcactgaagatgacctacaaaatgaagctaaaattactgatataatggagcctgaacatgcattactagcaacgtcaattttcaaacttacatatcagaataaggtcgtccgtgttcaacgaccagcaaagaatgggacggtcatggacgtaatctcgcgacgggaccaacgaggttcaggacaggtaggcacttatggactcaatacttttactaatatggaagcccagcttataaggcaaatggagtccgagggcatatttttaccatcagaactggaaacgcccaatttagcggaacgggttctcgactggctagagaaacacggagtcgagaggctgaaaagaatggcaatatcgggagacgattgtgtagtcaagcctatagacgatcgatttgcaacagctctgacagccctgaatgacatgggcaaggtcaggaaagatatacctcaatgggaaccatcaaaagggtggaatgactggcaacaagtacctttttgttctcaccattttcaccagttgataatgaaagatggccgtgagattgtagtaccgtgcaggaaccaagacgaactcgtagggagggcgcgcgtctctcaaggagcggggtggtcgctccgagagactgcttgtttggggaaaagctatgcacaaatgtggcaactcatgtacttccataggcgagacctaaggcttgccgcaaatgctatttgttcggcggtaccagtggattgggtaccaacctcaagaacaacctggtctatacacgcacatcaccaatggatgacaacggaagatatgttgtcagtatggaatcgagtctggattgaagagaacccctggatggaagataaaacccacgtgtcgtcgtggggtgacgtaccttacttaggtaagagagaagatcaatggtgtggctctttaataggactaactgcacgggctacctgggccagtaatattcaggtcgcaataaatcaggtaaggagacttataggaaatgagaactatttagattacatgacatcaatgaaacgttttaaaaatgaaggagatccggaaggagcattgtggtga

SEQ ID NO: 21516 - RNA, 9879 nt, synthetic construct
  misc_feature 1..9879: note = derived and/or modified CDS sequence (opt6) from DENV-1__FJ024457__SS-prME
  source 1..9879: mol_type = other RNA
tcggtaactatgttattgatgcttatgccgacagcactagccttccatctgacaacgagaggaggggaaccacatatgattgtaagtaaacaagaaaggggcaaaagtttattatttaaaacttccgcgggggtcaatatgtgcaccttaatagccatggacttaggagaactatgtgaagatactatgacttataaatgtccccggatcactgaaacggaaccagatgatgttgattgctggtgtaatgcaacagatacctgggtaacctatggaacttgctctcaaacaggagaacataggcgggataaacgaagcgtagctctagccccacatgtcggcttagggttggaaacaagaacagaaacgtggatgagttcggaaggagcatggaaacaaatacaaagggtagaaacatgggccctaaggcatcccggatttaccgttattgctttgtttttggctcatgcaataggtacttcaataacacaaaaaggtattatctttatattactaatgttagtcacacccagcatggcaatgcggtgtgtaggtattggttcacgagactttgtagaaggcttatcaggggcaacatgggttgatgtagtgcttgaacatggcagctgcgtgacaaccatggcaaaagataaaccgactctggacattgaacttttaaaaacggaggtcacgaatccagccgtacttagaaaattatgtattgaagcaaaaataagtaacactacaacagactctcgatgtccgacacaaggcgaagctactctagtagaagaacaagatgcaaactttgtttgcagaagaacctttgttgacagaggttggggaaacggatgtggactgtttgggaaaggcagcttaattacatgcgcgaaatttaaatgtgtaaccaaactggaaggaaaaattgtgcaatacgaaaacttaaaatacagcgtaatcgtcacggtacatactggtgatcaacaccaagtagggaatgagagcaccgagcacggaactactgccacaattacaccacaagccccaacaaccgagattcaattaacagattacggagctttaacgctagattgcagtccacgtacgggtctagattttaatgagatggtattgctcacaatgaaagaaaaatcatggctcgtgcacaaacaatggtttcttgacttacccttgccttggacctccggagctagtacaagtcaagaaacctggaatagacaagatttgttagttacattcaaaaccgcacacgctaagaaacaagaagttgttgtcctaggcagccaagaaggagcaatgcatacagcattgacgggcgccacagaaattcaaacttcaggtaccactacaatattcgcaggccaccttaaatgtcgattgaaaatggataagttgactctaaaggggatgagctacgtgatgtgcacaggatcatttaaacttgagaaggaagtagcagagacccaacacgggacagtcctggtacaaattaaatacgaaggcacggatgctccatgcaaaattccgttcagcacacaagacgagaaaggagtcacccaaaatggacggttaataactgccaacccaattgttacggacaaagaaaaacccgttaatatagaagcggaaccgcccttcggagaaagctatattgtaatcggcgctggtgagaaggctttaaaactatcatggtttaagaagggaagcagcataggtaagatgtttgaagccacggccagaggcgccagacgaatggccatacttggggataccgcttgggattttgggtccataggaggcgtcttcacaagtgtgggtaaactggtacaccaaatctttggaacggcgtatggagtactgttctcaggggtaagttggactatgaaaataggtattggagtcttattaacatggttgggattaaacagtagatctacgtccctctcaatgacgtgtatcgcagttggattagtcacactatatctcggtgttatggtccaggcagactctggttgtgtcataaactggaaagggagagaattgaaatgtggatctggtatctttgttactaatgaggtacatacttggacggaacaatacaaatttcaggcggattctccaaaaagattaagtgcggccattgggaaagcatgggaagaaggtgtgtgcggtattagatcagctacacgacttgaaaatataatgtggaaacaaatttcaaatgagttaaaccatatcctgcttgaaaatgatatgaaatttacggtcgtggttggggatgtcgcggggatccttgctcaagggaagaaaatgatacgaccccaacctatggagtacaagtacagttggaaaagctggggtaaggctaaaattataggcgcagacgtacaaaacacaacttttattatagatggtcctaatactccagaatgccccgatgatcaacgagcttggaatatatgggaggtggaagattacggatttggaatattcacaaccaatatatggttaaaattacgtgattcatatacacaagtctgtgaccatcgattaatgagcgctgcgataaaagacagtaaggcagtgcatgcggacatgggctactggattgaaagcgaaaagaacgaaacctggaaacttgcacgcgcatcctttattgaagttaaaacatgtatatggcccaagtcacacactctatggagtaacggagttttagaatcagaaatgatcataccgaaaatatacgggggtccaatttctcagcacaattacagaccgggttattttacacaaactgccgggccctggcatctcggaaaactagaacttgattttgacttatgcgagggaactactgtagtagttgacgaacattgtggaaaccgaggaccaagcctacgaaccactacagtaaccggcaaaataattcacgaatggtgttgtagaagttgtacgttaccgccactaagatttcgtggagaagatggttgctggtatggcatggaaataaggcctgtaaaagaaaaagaagaaaatctagtaaaaagcatggtttctgcaggatcgggtgaggtagatagtttctctttgggccttctatgtatatcaataatgatcgaggaagtaatgaggtcaagatggtctaggaaaatgttaatgacaggaactttagcagtatttttcctactaataatgggtcaactgacgtggaacgatttaataagactctgtattatggtcggtgcgaacgcctcagaccgcatgggaatgggtacaacttacctagcactaatggcaacttttaaaatgagaccaatgttcgcagtgggattacttttcaggcgattgacatcacgtgaggtactattactaacgatagggttatctttggttgctagtgtggagttaccgaacagtttagaagaacttggggacggccttgccatggggataatgatactcaaattattaaccgatttccaatcccatcagctatgggcaacactattgtcgttaactttcataaagactacttttagtttacactacgcgtggaaaacgatggctatggttttatccatagtatcactattccccttatgtctatccacaacctcgcaaaagacaacgtggctccctgtcctacttggtagtctcggttgcaaacctttaacaatgttcttaatagcagagaacaagatctggggtcgacgaagctggcccctaaatgaaggtataatggccgtaggtattgtatcaatattattgagttcccttttaaagaatgacgtaccactagcaggaccactaatcgcgggtggtatgttaatagcctgctacgtcatatccggatcgtcagctgacctctcacttgaaaaagcagcagaagtgtcatgggaggaggaggcggagcattcaggtgcttcacacaacattctagtcgaggtacaagatgacggaaccatgaaaattaaggatgaagaaagagatgataccttaactatactattaaaagccacccttctagctgtatccggtgtatacccgttatctatacccgcaaccttatttgtgtggtatttctggcagaaaaagaaacaaagatcaggagtactttgggacacacccagtccgccagaggttgagagagcagttctagacgacggaatttaccgtatcatgcagagaggcttactcggtcgaagccaagtaggagttggtgtattccaagaaaatgtattccatactatgtggcatgttacaagaggggcagtattaatgtatcaagggaaacgacttgaaccatcctgggcgtcagtgaagaaagatttaatatcatatggtggagggtggagattacaggggtcttggaatactggggaagaagtccaagtcatagctgtagagccaggcaaaaatccaaagaatgtacaaactgcaccaggcacatttaagacacccgaaggggaagtcggtgctattgctttagattttaaaccaggaacatcaggatcacctatagtgaatagagaagggaaaatagtagggctgtatggaaacggagtggtaactacctcagggacttacgtgagtgcaatcgcgcaagcgaaagcaagtcaagagggtcctttgcctgaaatcgaggatgaagtttttagaaaaagaaatctcacaataatggacttacatccgggttctggcaaaacccgcagatacctcccagctatagtacgcgaagcaattaaacggaagctcaggaccttaatattggcaccgacccgagtagtggcgtctgaaatggctgaagctcttaaaggaatgcctatcagataccaaactactgcggttaaatcagagcacacaggaaaagaaatagtagatctaatgtgtcacgcaacgttcacaatgaggctattgagcccagttagggtacctaactataatatgataattatggacgaggctcacttcactgatccctctagcatagcagcgcgcggatatatctctacccgtgtggggatgggtgaagcggctgctatttttatgacagctacaccaccaggttccgttgaggcttttccccaaagtaatgcagtgatacaagatgaagaaagagatattcctgagcgctcttggaacagtggttacgaatggataacagatttcccaggaaaaacggtatggtttgttcctagcattaagtcaggcaatgacattgcgaactgtttaaggaaaaatggaaaacgggtcatacaattaagtaggaaaacatttgacacagaataccagaaaacaaagaataatgattgggactatgttgtaacgaccgacatctcagagatgggagccaattttagagctgatagggtcatcgatccaagaagatgtcttaagccagtaattttgaaagacggaccagaacgcgttattttggccggccctatgccggtcacagtagcctcagcggctcagcggagagggagaataggacgtaatcacaataaagaaggtgatcaatacatatatatgggccagcctttgaataatgatgaagatcacgcacattggaccgaagcaaaaatgctgctagacaacataaatacccctgaaggaattatcccagcattatttgaacctgaaagggaaaaatcagcagctattgatggtgaatataggctaagaggtgaagcacgtaagacatttgttgaattaatgagaagaggagatttaccggtctggcttagttacaaagttgcatcagaaggtttccaatatagtgataggcggtggtgttttgatggagagaggaataatcaagtgttagaagagaatatggatgtcgagatttggactaaggaaggagaaaggaagaaattacgtccaaggtggctcgacgcacgaacttatagtgatccattagcccttcgagaatttaaagagtttgcggcaggtcgacgaagtgtatcaggagatctaatactcgagataggaaagctgccacaacacttgacgcagagggcacaaaatgctcttgacaatttggtaatgctgcacaattctgaacagggtggtcgagcttacaggcatgcaatggaagaattaccagatacaattgaaacgcttatgcttctcgcccttattgcagtattgacgggtggagtcactttattctttttaagcggaagaggtttaggcaaaacctcgatcggcctattgtgcgtaatggcgtcttcggtactgctttggatggctagcgtagaacctcattggatagcagcttcaattattttggagttcttccttatggtcttattaatacctgaaccagatagacagcgtacgcctcaagacaatcagctcgcatacgtagtaataggtctgttgtttatgattctaaccgtagcggcaaatgaaatgggattactcgaaaccaccaagaaagaccttggtattggacacgttgccgttgaaaatcatcaccatgcggcaatgttagacgtagatttacacccggctagtgcatggacgctatatgccgtcgcaacgactataataacaccaatgatgcgacacacaattgaaaatacaaccgcaaatataagcctaaccgcaattgccaatcaagctgcaatactaatgggtctagataagggatggccaatatcgaagatggacatcggagtaccacttctagcactgggatgttacagccaagtaaatccactaacacttacagcagccgttttaatgttagtggcccattacgctataattggtccgggacttcaagctaaggcaacaagagaagctcagaaaagaactgcagctggtataatgaaaaaccccaccgtcgacggaatagttgctatcgacttagacccagtagtatatgacgcaaagtttgaaaaacaattaggtcagataatgttactcatattgtgcacaagccaaatccttttaatgagaactacatgggcattgtgtgaaagcatcacacttgctacgggaccccttactaccctgtgggaaggatcgccaggaaaattttggaacacaacaatagcagtgtcaatggcgaatattttcagaggttcttatctagcaggagccgggcttgccttttcactaatgaaatcactaggtgggggaaggcgtggcacgggcgcccaaggagaaaccctaggtgagaagtggaaaagacaactgaaccaattatcgaaatcagagtttaacacatataaacgaagcggtattatggaggtagatcgatccgaagcaaaggaaggtctaaagcgaggagagacaacaaagcatgcagtcagccgaggaactgcgaaactgcggtggtttgtcgagcgaaatttagtaaaaccagaaggaaaagttattgacctcggttgtggacgaggcggctggagctattactgtgcaggcttgaaaaaggtaaccgaagtaaaaggatacactaaaggcggtccagggcatgaagaaccgatacctatggctacttacggttggaacttagttaaactacattctggaaaagatgtattctttatacctcctgagaaatgtgatacgctgctatgtgatataggggagtcaagccctaatccaactatagaagaaggcaggacccttagggtacttaaaatggtagaaccgtggttaagagggaatcaattctgcatcaaaatattaaatccctacatgcctagtgtagttgagacccttgaacaaatgcaacggaagcacggcggcatgctagtgcgtaaccctttgagcagaaacagtacacatgaaatgtattgggtaagttgcggtacaggtaacatcgtatcagcagtgaacatgaccagtagaatgttacttaatagatttaccatggcgcaccgaaagccaacctacgagcgcgatgtggatctaggagcaggcacacgacatgttgcggtcgaaccggaggtagcaaatttagatataattggacaacgtattgagaacattaaacacgaacacaaaagtacctggcattacgatgaagataacccatacaaaacatgggcctaccatggttcatatgaagtgaaaccatcagggagcgcatcctctatggtaaacggggtagtgaaactattgacgaagccatgggacgtgatacctatggttacccaaatagccatgaccgatactactcctttcgggcaacaaagagtttttaaagaaaaagtcgatactcggaccccaaaagccaaaagagggaccgcccaaataatggaggttactgctaaatggctatggggttttctttctcgaaataagaaacctagaatatgtacccgtgaggagttcacacgaaaagttcgcagtaatgctgctattggagcagtgttcgtagatgaaaatcaatggaactcagcaaaagaagcagtggaagatgaaaggttttgggatctagtccatagggagagagaacttcataaacagggtaagtgtgcaacctgcgtatataatatgatgggaaaacgcgagaagaaattaggggaatttggcaaggcaaaaggaagcagggccatttggtatatgtggctgggtgcccggttcctagagttcgaagcgctaggctttatgaatgaagaccattggttctcccgagaaaattctctctcgggcgtagaaggtgagggcttgcataagctgggttacattcttagagacatatcaaaaatacccggcggtaacatgtatgctgatgataccgctggatgggacacgcgaatcacagaggacgacttgcaaaacgaagccaggattaccgatattatggaacccgaacacgcgttactagctcgatcgatattcaagttaacctatcagaataaagtagtgagagttcagcggcctgccaaaaacggaacggtaatggacgttatcagtcgaagagatcaacggggttcaggtcaagtcggaacttatggtcttaatacattcactaatatggaggcacaattaatacgtcagatggagagtgaaggcatatttagcccttcagaactagaaacgccgatattagccgaacgagtacttgattggttagaaaagtatggggtggaaagattaaaacgaatggctatatctggtgatgactgcgtcgtaaagccgatagatgacagattcgcaacagcgttaaccgctttaaatgacatgggtaaggtacggaaagatatacctcaatgggaaccaagtaaggggtggaatgattggcaacaggtaccgttctgcagccatcactttcatcaactcataatgaaagacggaagagaaatagtagtcccgtgtcgaaatcaagatgagttagttggtcgagccagagtatctcaaggagcaggatggagtctcagggagacagcttgtctaggcaagtcttatgctcaaatgtggcaacttatgtattttcacagacgagatttgcgattagcagccaacgctatatgttccgcagtacccgttgactggattccaacatcgagaacgacgtggtctattcacgcacaccatcaatggatgacaacagaggacatgctcagtgtatggaacagagtttggattgaagaaaatccgtggatggaagacaaaacacacattagttcctggggcgatgtaccttacttaggtaaacgcgaagatcaatggtgtggctcattaatcggattaacggcccgagcaacttgggcaacaaatatccaagtggcgatcaatcaggttagaaggttaattggaaacgagaattatttagattatatgacaagtatgaaacgtttcaaaaatgagagcgatcctgaaggagcattatggtag

SEQ ID NO: 21517 - RNA, 9879 nt, synthetic construct
  misc_feature 1..9879: note = derived and/or modified CDS sequence (opt6) from DENV-1__FJ205881__SS-prME
  source 1..9879: mol_type = other RNA
tcagtgacgatgttactactattaatgcccaccgcattagcatttcatctgactacgagagggggtgaaccccatatgatagtttcaaaacaagaacgcggtaaaagtctccttttcaaaacttcagcgggtgtgaatatgtgcacactcatagcaatggatttaggagaactatgcgaagatactatgacctacaaatgcccaagaataactgaaaccgaaccagatgatgtagattgctggtgtaatgctacagatacatgggtcacatacggtacatgcagtcaaacgggagaacaccgcagagataaaaggtccgtagccctcgcccctcacgttggcttgggtttggaaacaagaactgaaacttggatgagctcagagggggcttggaaacaaatacaaagagtagaaacttgggctctccggcatcctggttttacagtaatcgccctatttttagctcatgcaataggtacaagtatcactcaaaaaggaatcatttttatattactaatgctcgtaacaccttcaatggcgatgagatgcgtaggcataggaagtagagattttgtcgaaggactttctggagccacgtgggtagatgtagtcttggaacatggctcttgtgtaacaactatggctaaagataaaccaacgttagatatagagctactcaaaactgaagttaccaatcctgctgttctcagaaaactttgcatagaagcaaaaatcagtaatacaactactgactcgaggtgccctactcaaggagaggccaccctagtagaggaacaagacgccaacttcgtttgcagacgcacatttgttgatagaggttggggtaacggatgcggactatttggaaaaggatctctaatcacttgtgcaaaatttaaatgtgtaacaaaattagaaggcaaaatagtgcaatacgagaatttaaaatattcggtaatagtcacagtacacacaggagaccaacaccaagtgggaaacgaaagtacagagcatggaacaacagcaacaattacaccgcaggctccaacgacagaaatacaattgacagactatggtgcactcacattagattgcagtccccgtacaggtctcgattttaacgaaatggtattattaacgatgaaagagaaatcatggttagtacacaaacaatggtttctagaccttccattaccatggactagcggtgcgtctacttcccaagaaacctggaatagacaggaccttttggtaacgtttaaaacggcacacgccaagaaacaggaagttgttgttctaggaagtcaagagggcgctatgcataccgcattaactggggccaccgaaatccaaacaagtggaaccacaactattttcgcgggacacttaaaatgcagattgaaaatggacaaactcacgttaaaagggatgtcctacgttatgtgtactggatcttttaaattagaaaaagaattagctgaaacacaacatggaacggtgcttgttcagattaaatacgaaggaaccgacgcaccgtgtaaaataccattcagtacccaagacgaaaaaggagtgactcaaaatggacgcttaatcactgctaacccgatcgttacggataaagaaaagcctgtgaacatcgaagctgagccaccgttcggtgaaagttatatcgtaattggggcgggcgaaaaagcgttgaaattgtcatggttcaagaaagggtcaagcataggaaagatgtttgaagcaactgcaaggggtgctagaagaatggcaattttaggggacacagcttgggatttcggttccatcggaggagtatttacctctgtaggtaaacttgttcaccagatatttggaaccgcttacggagtactttttagtggtgtatcatggacgatgaaaattggcataggtgtgttactaacatggttaggcctgaactctagatctacaagtctttcaatgacatgcattgcagtagggcttgtcacgttgtacctaggagtaatggttcaagcagattcgggctgcgtaataaactggaaaggtcgggaacttaaatgtggaagtggaatatttgtgacaaatgaagtccatacctggactgaacagtacaaatttcaagcggactcgccaaaaagattaagcgccgctatagggaaagcatgggaagaaggggtatgtgggatcagaagcgcaacaaggctcgaaaacatcatgtggaagcaaatttcaaacgagcttaatcatatacttctggaaaacgatatgaaattcaccgtcgtcgtaggagacgttgcgggaatattagcccaaggcaagaaaatgatacgcccacagccgatggaatataagtacagctggaaaagctgggggaaagcgaaaattatcggggcagatgtacaaaacactacctttataattgatggacctaacacgcccgaatgccctgatgaccagcgagcctggaacatttgggaagtcgaggactatggttttggtatatttactactaacatttggttaaaattaagagactcctatacacaagtgtgcgatcatcgtttaatgagcgcggctataaaagactcaaaagccgtacacgctgatatgggttattggattgaatctgagaaaaatgaaacgtggaaacttgcgagagcgagctttatagaggtaaaaacctgcatatggccaaagagtcatacattatggagtaacggtgtccttgaatcagaaatgatcattcccaagatatatggcggtcccatttcacaacataactatcgtccaggatatttcacacaaactgcgggaccttggcacttagggaaattagaactagactttgacctatgtgaaggaaccactgtagtagttgatgaacattgcgggaatcgtggtcccagcttaagaacaacaacggtcacaggaaaaatcatacacgaatggtgctgccgtagctgtacattacccccacttaggtttcgtggtgaagacggttgctggtatgggatggaaatcaggcccgttaaagagaaagaagagaatctggtaaaaagcatggtctccgctggcagcggggaagtggattcattcagcttggggttgctttgtattagcattatgatagaagaggtcatgcgttcccgctggtcaagaaaaatgctcatgacaggtactcttgcagtgttctttttattaattatgggccaactcacgtggaacgacttgattaggctctgcattatggttggggcaaatgctagcgaccgaatgggtatgggaacaacatatttagctttgatggcaacgtttaaaatgcgaccaatgttcgcggtaggtttattgttccgtagactgacgagtagagaagtgttgttgctgacaataggattaagcctagtcgcgtcagttgagctacctaacagccttgaggaattaggcgacggtctagcaatgggaatcatgatcctaaaattattaacagatttccagtcccaccagctatgggcaacattattaagcctaacatttataaaaacaacgttctctttacattatgcttggaaaaccatggccatggtcttgagcatagtcagcctatttccattatgcttaagtaccaccagccagaaaacgacgtggcttcccgtgctcctaggaagtctaggatgcaaaccgttgactatgtttttaattgctgaaaacaaaatttggggcagacgctcatggcctctgaacgaggggataatggctgtgggaattgtatcgattctcctcagttcacttttgaaaaacgatgtccccttggccggacctttaatagctggaggcatgttgatcgcatgttacgtaatttccgggagcagtgcagatctgtctttagaaaaagcagcagaggtaagttgggaggaagaggccgaacactctggtgcttcccataatatattagtcgaggtacaagatgatggcacaatgaaaattaaagacgaagaaagagatgacacactcactattctactcaaagcaaccttattagcagtaagtggtgtctatccattatccataccagcaaccctgtttgtatggtacttctggcagaagaagaaacaaagatcaggagtactttgggatacccctagccctccagaagtggaacgcgctgtcctagatgacggaatttacagaatcatgcaaagaggactattagggcgaagtcaagttggagtaggagtttttcaagaaaacgtattccatactatgtggcacgttacacgtggagcagttctgatgtatcaagggaagagacttgaaccatcttgggcatcagtgaagaaagacctaatatcgtacggaggaggatggagactacaagggtcgtggaacactggagaggaggttcaagtaatagctgtggaacccggtaaaaatccgaaaaatgttcaaacagcaccggggacgtttaagacaccggaaggagaagtaggtgcgatagcgttagattttaaacctggaacaagcggctcgccaattgtcaacagagaggggaagatagtagggctatatggaaatggggtagtaacaacatcgggcacctatgtatcagccatagcacaagctaaaacaagtcaagaaggaccattgccagagatcgaagatgaggtgtttcgcaaaagaaacctaacaataatggatctacatccgggaagtggtaagactaggagatatttaccggcaatagtacgggaggcaatcaaaagaaaattacgaactttaatcttagctcctacgcgagtagtagcaagcgagatggcagaggctttaaaaggaatgccaattagataccagactaccgcggtcaaatctgaacatacaggaaaagaaatagtggacctcatgtgtcacgcaacgttcactatgcgattattatctccagttcgtgtccctaactataatatgataattatggacgaagcacattttaccgatccatcatcaatcgcagcaagaggatacatatctactagggtaggtatgggcgaggctgcagcgatctttatgacggcaacaccaccaggatcagtagaggcattcccacaaagcaatgctgtaattcaagacgaagagagagacataccagagagaagttggaatagtggttatgaatggataactgactttcctggaaagacagtatggtttgtccctagcataaaatccggaaatgacattgcaaattgtttacgcaaaaacggtaaaagggtaattcaacttagcagaaaaacgttcgacactgaataccaaaagaccaaaaacaacgattgggattatgtagttacaaccgatatatcggaaatgggtgccaacttcagagctgatagagtaattgatcctcgccggtgtctaaagcccgtaattcttaaggatgggcctgaaagagtaatattagccggaccaatgcccgtcactgtagccagcgcagcacaaagaagaggaagaattgggcgtaaccataataaagagggtgatcaatatatttacatgggacaaccattgaataacgacgaggaccatgcgcattggacggaagctaaaatgctattggacaatatcaatactcctgagggtattataccggcattgttcgaacccgaacgagaaaagtcagcagcgatcgacggtgaatatagactcaggggtgaagcaaggaagacgttcgttgagcttatgagacggggtgaccttccagtttggctctcatacaaagtagcgtctgaagggtttcagtattctgacagaagatggtgtttcgacggggaaagaaataatcaggttttagaagaaaacatggatgttgaaatttggacgaaagagggtgagcgaaagaaattgagaccgagatggcttgacgcgcgcacatactccgatcccttagcactacgcgaatttaaggaatttgctgcaggacggagatcggtatcgggagacctaattctagagataggaaaattgccccagcatttaacgcaaagagcacaaaatgcactggataacctggtcatgctacacaatagtgaacaagggggtcgggcatacagacacgctatggaagaactacctgacaccattgaaacactaatgcttctagctttaatagctgtgctcaccggaggtgtcacattatttttcctaagtggaagaggtctcggtaaaacaagtataggtttactatgcgtcatggcttcttcagtgctattatggatggcctcagtagaaccgcattggattgcagcctcgattatactcgaatttttcttaatggtgttattgatcccagaaccggataggcaaagaacccctcaggataaccagctagcatacgtcgttattggcttgctgtttatgatcttaacggtagctgctaatgaaatggggttactagagacaactaagaaagatttgggtataggacatgtcgccgtcgaaaatcaccatcacgcagcaatgttagatgttgatctgcatcctgcttcagcatggaccctgtacgctgtagcaactacaattattacacctatgatgcgtcacacaattgagaatacaaccgcaaatatatcacttaccgcgattgctaatcaagcagcaatactaatgggactagataaaggttggcctatatcaaaaatggacataggagtccccctactagcattagggtgctacagccaagtcaacccactaacactaaccgcagctgttttaatgctagttgctcattacgcaataataggtccggggctgcaagctaaggctactagggaagcacaaaaacgtacagcagccggaatcatgaaaaacccgaccgtagatggtatcgtggccattgatctagatccagtggtttatgatgcaaaatttgagaaacaattagggcaaataatgctattgattctgtgcacaagtcaaatattgctcatgcgaactacttgggcattatgtgaatccatcactcttgcaacagggccgcttacaacgttgtgggagggatcaccaggtaaattctggaatacaacgattgcagttagtatggcaaatattttcaggggcagctatcttgctggtgcgggcttagcatttagcttgatgaaaagtcttggaggaggacgtagagggacaggggcgcaaggggaaactctaggagaaaaatggaaaaggcagttaaaccagctatccaaatcagagtttaatacatataaaagatcaggaataatggaggtagacaggtcagaggccaaagaaggtctgaaacggggcgaaacaacaaagcacgcggtgtctagaggaaccgctaaattaagatggtttgttgaaagaaacttagtcaagccagaaggaaaagtgatagatttgggatgtggacggggtggttggtcgtattactgcgctggactcaaaaaggtaaccgaagttaagggatacactaaagggggtcctggacatgaggagccaatacctatggcaacatatggatggaacctagttaaactgcattcgggtaaagatgtcttctttataccaccagaaaaatgcgatactttattgtgtgacataggagaatcatccccaaacccgactatagaggagggacgaacgctacgcgtgttaaaaatggtagaaccttggctaaggggaaatcagttttgcataaagattctgaatccgtatatgccctcagttgtggagactttagagcagatgcaacgaaagcacggtggtatgttagttagaaatccactgtcccgaaatagtactcacgaaatgtactgggtatcatgcggtacagggaacattgtatcagcagtaaacatgacaagtagaatgcttctgaaccgattcactatggcccataggaagcctacttacgagagagatgtagacttaggagctggcacacgacacgtggcggtggagcctgaagtcgcgaatttagatattattggacaaagaattgagaatataaaacacgagcataaaagcacgtggcattatgatgaagataacccatataaaacttgggcgtaccatggttcatacgaggttaaacctagcggatctgcatcaagtatggtcaacggagtcgtaaaattgctaacaaaaccctgggatgtaatccctatggtaacgcaaatcgccatgacagatactacgccgtttggacagcaacgagtattcaaagaaaaagttgacactaggaccccaaaagctaagagagggacagcgcaaatcatggaggtcactgctaaatggctttggggatttttatctagaaacaagaaacccagaatttgtacccgagaggagtttactcgaaaggtccggagcaatgctgcaatcggtgcagtatttgtcgatgaaaatcaatggaactccgccaaagaggcggtagaagacgaacgattttgggatcttgtccatagagaaagggagttacataagcaggggaagtgtgctacttgcgtatataatatgatgggaaagagagagaagaaattaggtgaatttggaaaagccaaaggcagcagggcaatctggtatatgtggttgggggcaagattcctagaatttgaggcccttggatttatgaacgaagaccattggttcagtagagaaaattcacttagcggcgtagaaggggaagggttgcataaactaggctatatcctgcgagatatatcaaagatacccggtggtaacatgtatgctgacgacaccgcgggatgggatacaagaataacagaagatgatttacaaaatgaagccaggataaccgatattatggaaccagaacacgctcttttagcaaaaagtatttttaagttaacatatcaaaataaagtcgtacgagtacaaaggccagctaagaatggtacagtgatggatgtcattagcagaagagatcaaagaggatcaggccaagtaggaacttatggcttaaatacatttaccaacatggaagcgcaattaatccgtcaaatggaatcagagggaatattcagtccatccgaactggagaccccaaacttggcagaacgagttctcgattggctcgaaaagtatggtgtcgaacgtcttaaaaggatggcaatatcaggagacgattgtgtggtgaaacctatcgatgaccgttttgctacggcactaactgccttgaatgatatgggaaaggttagaaaggacataccccagtgggaaccttccaagggttggaatgattggcaacaagtgccattttgttcccatcatttccatcaactaataatgaaagatggacgagaaatcgttgtaccatgtagaaatcaagatgaattagtaggtcgagcgcgagtgtcacaaggggcaggatggtctctgagagagacagcttgcttggggaagtcttatgcacaaatgtggcaattaatgtatttccaccgaagggacctgcgacttgcagcaaacgcgatatgctcggctgtaccggtagactggatacctacatccagaacaacatggtccatacatgcacaccatcaatggatgactacggaagacatgttatcagtatggaaccgagtctggatagaagaaaacccttggatggaagataaaactcatatatcaagttggggagatgtaccatatctaggcaagagagaggaccaatggtgtggctcactaatagggctcactgcaagagcgacttgggcaaccaacatacaagtggcaataaatcaggtcagacggctgattggtaacgaaaactacctagattacatgacgagtatgaaaagattcaaaaacgagagtgatcccgagggagctctatggtga

SEQ ID NO: 21518 - RNA, 9879 nt, synthetic construct
  misc_feature 1..9879: note = derived and/or modified CDS sequence (opt6) from DENV-1__FJ205882__SS-prME
  source 1..9879: mol_type = other RNA
agtgtaactatgcttctaatgcttatgccaacagcgctggcatttcatctaacaacaaggggaggtgaaccccacatgatagtttctaagcaagaacgaggtaaatcgcttctttttaaaactagtgcaggtgtaaacatgtgtaccttaatagcaatggacctaggagaattgtgtgaggatacaatgacatataaatgcccgagaataacagaagcagaacctgatgatgtggactgctggtgtaatgcaacagatacttgggttacgtatggaacatgctcgcaaacaggtgagcaccgaagggataaacgcagtgtggcacttgcgcctcacgttggtctgggtttagagacgagaactgagacatggatgtcatctgaaggagcttggaagcaaatacagagagtagaaacttgggccctgagacatcccggattcacagtgatagcactattcttggcccatgctattggaacttcaataactcaaaaaggaatcatatttatattgttgatgttagttacaccttcaatggcaatgagatgcgtcgggataggcagtagagactttgtggagggcctatcaggggccacatgggttgatgttgttttggaacacggcagttgtgtaactactatggctaaagacaaaccgacgcttgatatagaattacttaagacggaggtgactaacccagctgtacttcggaaactatgcattgaagctaaaatttcgaatactactaccgattcgcggtgtccaacccaaggtgaggcaaccctggtagaagagcaggatgctaattttgtatgcaggcggacttttgttgaccgaggttggggtaatggatgtggcctgttcggaaaaggatctttaattacttgcgcgaaattcaaatgcgtaactaaactggaaggaaaaatagtacaatatgaaaacctaaaatatagtgtaatagtaacagttcacacaggagatcaacatcaggtaggaaatgagtcaaccgaacacggaactacagctacaattacaccgcaagcaccgtctacagaaatccaattaacagattacggagccctcacgttggattgttcaccaaggactggactcgatttcaatgaaatggtacttttgactatgaaagagaagtcatggctggtacacaaacaatggttcttagatctaccacttccgtggacctcaggcgcttcgacttcacaagaaacatggaaccgacaagacttactagtaactttcaaaacagcacatgctaagaaacaggaagtagtcgtactaggctctcaagagggagcgatgcacactgctttaacgggtgctaccgagatacaaacatcggggacaaccaccatatttgccggtcatctaaaatgtcgtctgaagatggataaattaacattgaaaggaatgagttatgttatgtgcactggtagtttcaagttggagaaagaagttgcagaaacgcagcatgggacggtattggtccagattaaatatgaaggaacagatgcaccgtgcaagattccttttagtacgcaagatgaaaagggggttacacaaaacggacgtctcatcacagcaaatcccattgtaactgataaagaaaaaccagttaatatcgaagcggagccaccttttggagaatcttacatcgtgataggcgcaggtgaaaaagccctaaaattaagctggtttaagaaagggtcatcgattggaaaaatgttcgaggctactgcacgaggagcacgcagaatggcaatacttggggacaccgcctgggatttcggttcaataggaggagtatttacctctgtaggaaaacttgtacaccaaatcttcggaactgcttatggtgtgctttttagcggggtttcttggacgatgaaaattggaataggtgtactactaacttggttaggactaaatagccgttccacaagcttaagtatgacgtgcatagcagtaggtctcgtgacgttatatctcggagttatggttcaagcagactctgggtgtgttattaattggaagggacgagaattaaagtgcggatcgggtatcttcgttacaaatgaggtccatacgtggacagaacaatacaaattccaagccgacagcccaaaaagactgagtgctgcgataggaaaagcttgggacgaaggtgtatgtggtatacgatctgctacaaggctagagaatattatgtggaagcaaatttctaacgagcttaatcacatattgctagagaatgatatgaaatttactgtagttgtaggcgatgtagcaggcattcttgcgcaaggcaaaaagatgattcgtccacaacctatggaatataagtattcatggaagtcgtggggaaaagctaaaataataggtgccgacgtccagaatacaacgtttataatagacggaccaaacactcctgaatgcccggacgaccaaagggcttggaatatatggaaagtggaagaccatggatttggaattttcccgacaaatatatggttgaagctaagagattcatatacacaagtctgcgatcaccgactcatgtcagcggcaattaaggactcaaaggccgtacacgcagatatgggatactggattgagagtgaaaaaaacgaaacatggaaactcgccagagccagttttattgaagttaaaacatgtatttggccaaaaagtcataccttatggagcaacggagttcttgaatcagaaatgatcatcccaaaaatttatggaggcccaataagtcaacataactaccgacccggctatttcactcagactgccggtccatggcatctcggaaaattagagctagactttaacctctgtgagggaacaacggtagtagtagacgaacattgcggcaatagaggcccgtctttacgaacgactactgtaacaggaaaaatcatacatgaatggtgttgtaggtcgtgcactttgccacctttgaggttcaaaggagaagatggatgttggtacggtatggagattcgacccgtaaaagaaaaggaggagaacctagtaaaatcaatggtgagtgcgggctctggcgaagtcgactcgtttagtctgggattattatgcataagtataatgatagaggaggtgatgagatctagatggtcgcgaaagatgctaatgacgggtacacttgcagtattctttttgctaataatggggcaattaacatggaatgacttgattcgattatgcatcatggtaggcgccaatgcatctgatcgaatgggaatgggcacgacctatctagcactgatggcaacctttaaaatgcgaccaatgctagccgtcggattattatttagacgattaacctcgcgtgaagttttattattaaccataggactctctttagtagcgtcagtagaattaccaaacagtctggaagaactaggagatggactagcaatggggataatgatactaaaattactgaccgatttccaaagtcatcaactatgggcaacactattatccttgacttttattaaaactacctattctttgcattatgcttggaaaaccatggctatggtcttatcaatcgtaagtctatttcctttgtgtctatcaactacatcacaaaagaccacatggcttcctgttctattgggatctttgggctgcaagccattaaccatgttcttgatagcagaaaacaaaatctgggggaggaaatcgtggccactaaatgaaggaataatggcagttggaatagtctccatactattatcttcgctattaaaaaacgatgtcccattggctggaccgttaatagccggtggtatgttaattgcgtgctacgtaatatcaggatcatcggccgacttaagcttagagaaagctgcggaagtttcatgggaagaagaagcggaacacagcggtgcatcacacaatatcttagttgaggtacaagatgacggtaccatgaagataaaagatgaagaacgtgacgatacgcttacaatactgttgaaagctacactgttagccgtaagcggagtatatcccttatctattcctgctacgctctttgtctggtacttttggcagaaaaaaaaacagcgatcgggtgttctctgggatacaccaagtcccccagaggttgagagggcggtattagatgatggaatctaccggataatgcaaagagggctactaggtagatcacaggtaggagttggagtttttcaagaaaatgtatttcacactatgtggcacgtgacacgcggagccgtattgatgtaccaaggaaaaagattagaacctagctgggcttcagtaaaaaaagacttaattagctatggaggagggtggagattacagggaagttggaacacaggtgaagaggtgcaagtcatagcagtagaaccagggaagaacccaaaaaatgtgcaaacggctccagggacattcaagaccagcgaaggggaagtaggagctatagcactcgacttcaagcctggtacttcgggatcgcccatagtaaatagagaaggaaagatagtgggtttatatggtaatggagtagtaactacctcaggaacatatgtaagtgcaatcgctcaagcaaaggcatcacaagagggaccactaccagaaatagaaaacgaagtatttagaaaaaggaatttaactataatggatctacatcctggtagtggtaagactagacgatatctcccagcgatagtgcgtgaagcaataaagaggaaattaagaacattaatcttggctccaacacgagtagtggcctcagagatggctgaagcgttgaagggcatgccgatacgctatcaaaccaccgcagtaaaaagcgaacacacaggtaaagaaattgttgacctcatgtgtcacgctacttttacaatgaggctattaagtcctgtgcgcgttccaaactacaacatgattattatggacgaggcacatttcacagatccatcatcaattgcagcgagaggttatataagtactcgagttgggatgggagaagctgcagcaatatttatgacagctactcccccagggtcagttgaagcttttccacaatcgaacgcagtaatacaagatgaagaacgtgatatccctgaacgatcgtggaactccgggtatgaatggataacggactttcccggaaagacagtatggttcgtacccagtattaaaagcggaaatgacattgcgaattgcttacgaaaaaatggtaaacgagttatacaactgtcaagaaaaactttcgataccgaataccaaaagacaaaaaacaatgattgggactatgttgtaacaacggatatcagtgaaatgggtgcaaactttagagcggaccgtgtaatcgatcctcgtagatgtttaaaaccagtaatattaaaagatggaccagaaagagttatattagcgggtccaatgcctgtcacggtagcaagtgctgcacaaaggcgaggaagaataggtagaaatcataacaaggaaggggatcaatacatctatatgggacagccacttaacaatgatgaggatcatgcccattggactgaagccaaaatgttattagataatatcaacaccccagaaggaatcataccagctctgtttgaaccggaaagggagaaatccgcggcgattgatggagagtatcgtcttagaggcgaagcgagaaaaactttcgtagaattaatgcgacgcggagacttaccggtatggttatcctataaggttgcttccgaaggttttcaatattccgatcgcaggtggtgttttgatggagaaaggaataatcaggtattggaagaaaatatggatgttgaaatctggacgaaagaaggtgagaggaaaaaacttagaccacgctggttagatgcacgtacttattcagatcctctggccctcagagagttcaaagagtttgcagcaggtcggaaaagcgtaagcggtgatttaatactcgaaataggaaaattacctcagcatctaacacaaagagcacaaaatgcattagacaacctcgttatgttacacaacagcgagcaaggtggaagagcctataggcatgcgatggaagaattaccagatacaatagaaacattaatgcttttggctctaatagcagttttgaccggtggggtgaccctattctttttatcgggaaggggtttgggtaagacgtccataggtctactgtgtgtcatggcgtcttcggtgcttctatggatggcaagtgtagaaccacattggatagcagcgagcattatattagaattctttttaatggttctgctgataccagaaccggatagacaaagaactccgcaagacaatcaactcgcgtatgtggtcattgggttgctgtttatgattcttactgtggcagccaatgaaatgggattattagaaactacgaagaaagacttagggatagggcatgtagcagtggaaaaccatcatcatgctgcaatgctagacgtagatttacatcctgcgtctgcatggaccctgtatgccgttgcaaccaccataataacaccaatgatgagacataccatagaaaacacaacagcaaatatatctttaactgcaatagcaaatcaggcagccatcttaatggggcttgataaaggatggccgataagcaaaatggatataggtgtacctttattggcactgggatgttatagccaagttaaccctctcacgttaactgccgcggtcttaatgctagtagcccattatgctataatcggacccggacttcaagctaaagcaacacgtgaggcacaaaagcgcaccgctgcaggtataatgaaaaaccctactgtggatggaattgtagcgatagatttagatccagtcgtttatgacgcaaaatttgagaaacagctgggacaaataatgttattaatactctgcactagtcagattttgttaatgaggacaacgtgggcactttgtgagagtattacgctggccacgggaccgttaaccacactatgggaaggatctccagggaaattttggaatacgacaatagcagtttcgatggcgaacatattcaggggaagctatctcgcgggagctgggttagctttttctttgatgaaaagcttgggagggggtaggcgaggtactggagcgcaaggagaaacattgggtgaaaagtggaagcgtcagctaaatcaattgagcaaaagtgaatttaacacgtataaacgaagcggaatcatggaagtcgaccgatcagaagcaaaagaaggtttgaaaagaggcgaaactacgaaacatgctgtctcaagaggaacagctaagctcaggtggttcgtagaaagaaacctagttaaacccgaaggcaaagttatagacctcggatgtggacgaggcggatggtcttactattgtgcaggcctgaaaaaagtaacagaagtcaaaggttatacgaaaggtggtccgggacacgaagaacctattccgatggccacatatggttggaatttggtgaaattacactcaggaaaagatgtattttttatacctccagaaaaatgcgacacacttctatgcgacattggcgaatctagcccgaaccctactattgaagaaggtcgaacactgagggtcctaaagatggttgaaccttggcttagaggtaaccaattctgtattaaaatcttaaacccctacatgccttctgtggtagaaacgctagaacaaatgcaacgtaagcatgggggtatgctcgtaagaaatccattatcccgtaactccacacatgaaatgtactgggtctcttgcggaaccgggaatattgtctcagcagtaaatatgacgagcagaatgcttttaaatcggttcactatggcacataggaagccaacttatgaacgcgatgttgacctaggcgcggggacacgtcatgtagcagttgagccagaagtagcaaacctcgatattataggtcaaagaatcgaaaacattaagcatgaacacaaatctacatggcactacgacgaagacaatccctacaagacgtgggcttatcacggaagctacgaggtcaaaccaagtggaagcgcatcgtcgatggtcaatggtgttgtcaaattactcacaaaaccttgggacgtaataccaatggttacgcaaatagctatgacagatactacaccttttggacaacagcgggtatttaaagaaaaggttgacacgaggacacccaaggcaaaacggggaactgcacagataatggaagtaactgctaagtggttatggggatttcttagcagaaataagaaacctcggatttgcacaagagaagaatttacaagaaaagtcagatcaaacgctgctataggtgcagtatttgttgacgaaaatcagtggaattctgcaaaagaagcggtagaagacgaaaggttctgggacctagtacatagggaaagggaactgcataaacaaggtaaatgtgcaacctgtgtttacaatatgatgggtaagcgagaaaagaagctaggggaattcggaaaagccaagggtagtcgggcgatatggtatatgtggctgggtgccagattcctagaattcgaggcactaggcttcatgaacgaagatcattggttttctagagaaaactcgctcagtggagtggagggtgaagggttgcacaaattaggatacattctcagagatatctctaaaataccgggagggaatatgtatgctgacgacaccgctggatgggacactcgtataacagaagacgatctccagaacgaggcaaagatcactgacataatggaacctgaacacgcccttctggctaagagtatattcaaactaacctatcaaaacaaagtcgtacgagtacaaagaccggctaagaatggtaccgtgatggatgtaatatccagaagagaccaaagagggtcgggtcaggtgggtacgtatgggctgaatacattcaccaatatggaagctcaactcataaggcaaatggagtcagaaggtattttctcaccaagcgaattagagactcctaatttggctggaagagtattagattggttagagaaacatggagtagagaggttaaaaagaatggccataagtggagacgattgtgtcgtaaaacccatagatgacagattcgcaaccgcactaactgcattaaatgacatgggcaaggttagaaaagatatccctcaatgggaaccttcgaaaggttggaatgattggcaacaagttcctttctgcagccaccacttccatcaattgataatgaaagacggacgggaaatagtagtaccttgccggaatcaggatgaacttgtaggacgcgcacgagtttcgcaaggcgcaggctggagtttaagggagacggcatgtctcggtaaaagttacgctcaaatgtggcaattaatgtattttcaccgtagggatttacgtcttgcagcaaatgcaatctgctcggctgttccagtagactgggtaccgacatcaagaacgacatggagtatacatgcgcatcatcaatggatgaccactgaagatatgttgtcggtttggaatcgggtttggattgaagaaaatccgtggatggaagataaaactcacatatcaagttggggagacgtcccatacctaggtaaacgcgaagatcaatggtgtggatcccttataggcctaacagcacgagcaacatgggctactaatatacaagtagctataaaccaagtaagacgattgattggaaacgagaattatttagactacatgaccagtatgaaaagatttaagaacgaaagtgatcccgagggcgcgctgtggtga

SEQ ID NO: 21519 - RNA, 9879 nt, synthetic construct
  misc_feature 1..9879: note = derived and/or modified CDS sequence (opt6) from DENV-1__FJ390388__SS-prME
  source 1..9879: mol_type = other RNA
tctgttacaatgctccttatgttaatgccgaccgctcttgcatttcacttaacgaccaggggaggtgaaccacatatgatcgtatcaaaacaagaacgtggtaaatctttattattcaaaacatcagcaggagttaacatgtgtacactcattgcgatggacctaggtgaattatgtgaagacaccatgacgtataaatgtcctcgaataacagaaaccgaaccagacgatgtagactgctggtgcaacgcaacagatacttgggtcacatatggtacgtgctcacaaacgggagaacataggcgagacaaacgtagcgtagcactcgctccacacgtaggccttggtcttgaaacaagaaccgaaacatggatgagctcagaaggtgcatggaaacaaatacaaagggttgaaacatgggccctaagacatccaggattcacagtcatagctttattcctcgcacacgcaattggcacatctattacacaaaagggaattatattcatactcctcatgttggtcacaccctctatggcaatgaggtgcgtaggtataggatccagggacttcgtagaaggactttcgggcgctacctgggtcgatgtagttctagaacacggatcctgcgtaacaacaatggctaaagacaagcctacccttgatattgaattgctaaaaacagaagtaacaaatcctgctgtattaagaaaactatgtatagaagctaagataagcaatacaactacggacagtaggtgtccaacacaaggcgaagctacgctggtcgaagaacaagatgctaactttgtatgtaggcgaacttttgtggatagaggatggggtaatggttgcggattatttggtaaaggatccctcattacatgtgctaaatttaaatgcgtaacaaaattagaagggaagatagttcaatatgaaaacttgaaatattcggtcattgttactgtacatacgggggaccaacaccaagtggggaatgaatcaaccgaacatggcacaactgcaacaataactcctcaagcgcccacaaccgagatacaattaacagactacggggccctgactctcgattgttccccacgaacgggcttagactttaacgaaatggtcttactaacgatgaaagagaaaagttggttggttcacaagcaatggttccttgatttaccactaccctggacatctggggcttcaacgagtcaagaaacctggaatcgccaagacttattagtcaccttcaaaaccgcacatgcaaagaagcaggaggtggtagtgcttggcagccaagaaggagccatgcacactgccctcacaggtgcaactgagatacaaactagcgggacaacaactattttcgcaggccatctaaaatgcagattgaagatggacaaacttactttaaaaggcatgtcatacgttatgtgtacaggaagttttaagttagaaaaagaattggctgaaactcagcacggaactgtattagtacagataaagtatgaaggaaccgacgcaccatgcaaaattccctttagtacacaagacgaaaaaggtgtaacacaaaacggacgactaattaccgcgaatcccatagtaactgataaggaaaaaccagttaatatagaagccgaacccccgtttggtgaatcctatatagtaattggagcaggcgaaaaggcactcaaactatcatggtttaagaaaggctcctcgataggtaaaatgttcgaggctacggcaaggggagcgcgacgaatggcgatactaggggatactgcttgggactttgggagtataggcggagtatttactagcgtaggtaaacttgttcaccaaatctttgggactgcttatggggtattgttttcaggtgtaagttggaccatgaagataggaataggtgttctaatgacgtggctagggctcaactctaggtctacgtccctttcgatgacgtgtatagcggttgggctagtaactttgtatcttggggtaatggtccaagctgactcaggctgcgtaataaactggaagggaagagaactaaaatgcgggtcagggattttcgtaacgaacgaagtacatacttggacagagcagtataaattccaagcggattcacctaagcgcttgtcagcagcaataggaaaagcgtgggaagaaggagtatgcggaattagatctgcaactcgacttgaaaatattatgtggaaacaaatatcaaatgagttaaatcatatattattagaaaatgatatgaaattcacagtcgttgttggagacgtcgctggtattctcgcacaaggcaagaaaatgatacgaccacaaccaatggagcataaatactcttggaaatcatgggggaaagctaaaataataggagcagatgtccaaaataccacgttcataatagatggcccgaacacgcccgaatgtccagatgatcaaagagcatggaacatatgggaagttgaggactatggatttggtattttcacaacaaacatatggctaaaacttcgagactcatacacacaagtatgtgatcacagactaatgtctgctgcaataaaagactctaaagcggtacacgctgacatgggatactggatagagagtgagaaaaacgaaacatggaaattagccagggcttcattcattgaagtaaaaacttgtatttggcccaaatcgcacacgttatggagtaatggagtgttagagagcgaaatgattattccaaaaatatacggcggaccgatcagtcagcacaactatcgtcccggttatttcacccaaacagccggtccatggcatcttggcaaactagagctcgattttgacttatgcgaaggcacaactgtagtagtagatgaacactgtggaaatcgaggcccgagtctccggacgaccacagttaccggaaaaatcatacatgagtggtgctgcagatcgtgcacattaccacctttgagatttagaggggaagacggctgttggtatgggatggaaatccgcccagtaaaggaaaaggaagagaatttagttaaatccatggtctcagccggcagtggcgaagtagattctttttcattaggtctactttgtatttcgattatgatcgaagaggtaatgcgatcaagatggtcacgcaaaatgttaatgacagggactctagcggtattctttcttctcatagtaggacaactaacttggaacgacttgatacgcttgtgtatcatggtaggtgccaacgccagtgatcgcatgggtatgggtaccacatacttggctctcatggcgacattcaagatgcggccaatgttcgcagtaggactgctctttagaagactaacaagcagagaagtcttactgctaactataggcttaagtctagtagcaagtgttgaattgccaaactccctagaagaattaggagatggtttagccatgggcataatgattttgaagctattaactgactttcaatcccaccaactgtgggccactctgctatccttgacctttattaaaacaacgtttagtttacattacgcatggaagactatggcgatggtacttagtgtcgtcagcctattcccgctatgcttgtcaacaacctcgcaaaagacgacgtggttaccagttttgctaggaagtcttggatgtaaacctttaactatgtttctaattgcagaaaataagatatggggccggcggtcatggccactaaacgaaggtataatggccgttggaattgtaagtatactcctaagttctctgctcaaaaatgatgttcctctagcaggaccattaatagctggagggatgttaatcgcatgttatgtgatatctggaagctcagcagacttatcattggagaaagccgctgaagtgtcgtgggaagaagaagctgaacactcaggtgcaagccacaatatactcgttgaagttcaagatgacggtacaatgaagattaaagatgaggagagagatgatacactcaccatactcctaaaggcaacccttctagcagttagtggagtatatccgctctccataccagcgacactattcgtttggtacttttggcagaagaagaaacaacgatctggtgtactatgggataccccctcccctccagaagtggagagggcagtactagatgatggaatatatcggatcatgcaaagagggctattggggcgtagtcaagtaggagtcggagtattccaagagaacgtgtttcacactatgtggcacgttacaagaggggctgtgttaatgtatcagggtaaaagacttgaaccgagctgggcttcagtcaaaaaggatctaatatcgtatggcggtgggtggcgcctacagggatcatggaataccggcgaagaagtccaagtaatagccgtagaaccaggtaagaatcctaaaaacgtccaaaccgcccccggtacattcaagacaccagagggtgaggtaggggcaatagccctagatttcaaaccaggaacttcagggagcccaatagtcaaccgagaaagaaaaattgtcggcctgtatggtaatggcgtagtcacgactagcggaacctacgtttcagctatagcgcaagccaaagctagtcaagaagggcccttacctgaaatagaagatgaggtatttaggaaaaggaatttaactataatggatttacaccccgggtcaggaaaaacgagaagatatctcccagcgattgtacgtgaagccataaaaagaaaacttagaactttaatattagccccaactcgagtggtagcatcagagatggcagaagccctgaaaggaatgcccatccgatatcaaaccacagctgtcaaaagcgaacatactgggaaagagatagtcgatttaatgtgtcacgctacattcacgatgcgtctacttagtccagttcgggtaccaaactacaacatgataataatggatgaagcacacttcactgacccgtcgagcatagcggcacgggggtatataagcacaagagtaggtatgggcgaggcagcggcaatatttatgactgccacacctccaggaagtgttgaggcttttccccaatccaacgcggtaatacaggatgaagagagagatatacctgaacgatcatggaactcaggctatgaatggataactgacttcccaggtaagacagtatggttcgtccccagtatcaagtcggggaatgacattgccaattgtctacgtaagaacgggaaaagagtaatacagctaagtcgaaaaacctttgatacagaataccagaaaaccaaaaataatgactgggattacgtagtcactacagatatttctgaaatgggtgccaacttcagagccgaccgggttatagacccacgcagatgcttaaaaccggttattcttaaggatggtcccgaaagagtgatactagctggcccaatgcccgttaccgttgcttcggcggcgcaaagacgaggaaggatcggacgaaatcataacaaagaaggagaccaatacatatatatggggcaaccattaaataacgatgaagaccacgctcattggactgaagcaaaaatgctattagacaatattaatacgccagaggggattataccagctttattcgaaccagagagagaaaaatcagccgctatagacggcgaatatcgcctcagaggtgaagcaagaaaaacattcgtagaactaatgagaagaggagatttgcctgtttggctctcatacaaggtcgcctcagaaggtttccagtactcagaccggcggtggtgttttgatggagaaaggaataaccaagtcttagaagaaaatatggacgttgaaatatggactaaggaaggagaacgtaaaaagctccgtccgagatggcttgatgctagaacctatagtgatccgcttgccctaagggaatttaaggagttcgccgccgggagacgatccgttagtggagacttgatccttgagataggcaagctaccacagcatcttactcaaagggctcaaaatgctcttgacaacctggttatgttacataactcggaacaaggagggagggcatacagacatgcaatggaggagcttcctgatacaatagagacgcttatgcttttagccttaattgcagttcttacgggaggcgtaacgttattcttcctaagtggacgaggattaggtaaaaccagtattggactactctgcgtgatggcctcaagtgttctcctctggatggcgtctgtcgaaccacactggatagctgcctctattatattagagttctttctcatggtcttacttattccagaaccagacagacaacgaacacctcaagataaccaactggcttatgttgttatcggtctattgtttatgatcttaactgtagcggcaaatgaaatgggattattagagactacaaagaaagatctcggaatcggacatgttgctgtggagaatcaccatcacgctgcaatgttggacgttgatctacacccggcttctgcctggactctctatgcagtagcaacaacaataataacaccaatgatgaggcatacaattgagaatacaacagcgaacatatccttaacagccattgcgaaccaagcagcgatcttaatgggactagataaaggatggcctataagtaaaatggacatcggtgttcctctactggcactaggttgctactcacaagtaaatcctcttactcttaccgcggcggttttaatgttagtggcgcactacgctataatcggcccaggattacaagcaaaggcaacccgtgaagcacagaaaagaacagcggcaggtataatgaaaaaccccacggtcgatggtattgtagctatcgatctagatcctgtcgtatatgacgcaaagttcgaaaaacaattgggtcaaatcatgctcttgattttgtgtacaagccaaatcctattaatgagaactacctgggcgttgtgcgaatctataacattagcaacaggccctttaacaacactttgggagggtagtccaggcaagttctggaatacaacgatcgcagtatcaatggcaaatatttttaggggtagttacttagcaggagctggattagcgttttccttaatgaagtctttaggcggcggacgtcgaggaactggggcacaaggcgaaacgttaggagaaaagtggaagagacagcttaatcagctatcaaaaagtgaatttaacacatacaagagaagcggaatcatggaagtagatcgatcagaagctaaagaaggattgaagagaggggaaactaccaagcatgccgtaagtagaggcacggccaaactcaggtggtttgtagaaaggaacttagtcaagccagaaggaaaagtaatagacttaggatgtgggcgtggtggatggtcatattattgtgccggtctaaagaaagtaactgaagtcaagggttacaccaaagggggaccaggtcatgaagaacccatacctatggcgacttacggttggaatctagtaaaactccatagtggaaaagacgtgttctttatacccccagagaaatgtgatacgctactttgtgacattggtgaaagttcaccgaatcctacaatcgaagaagggaggactctaagagtactaaagatggtagagccgtggctcaggggaaatcaattctgtattaagatattaaacccatatatgccttcagtagtagagacacttgagcaaatgcagcgtaaacatggaggtatgcttgtgcgtaaccctttgtctcgtaattcaacacacgaaatgtattgggtctcatgcggtacagggaacattgtctctgctgtaaatatgacatctagaatgttattaaacagatttactatggcgcaccgaaaaccgacgtatgaaagggatgttgacctcggtgcaggcacaagacatgtggccgtggaacctgaagttgctaatttagacattataggacaaagaattgaaaacattaagcatgagcataaatctacctggcactatgacgaggataacccgtacaaaacgtgggcgtatcacggatcgtacgaggtgaagccctccggatctgcatcaagcatggtaaacggtgtagtaaaacttttaacaaaaccatgggatgttatccccatggtaacccaaatcgccatgaccgataccacacctttcggtcaacaaagagtatttaaagaaaaggtagacacgaggactccaaaggcaaaacgaggcacagcccagattatggaggtaactgcgaaatggttatggggattcctatcacgaaataagaagccaagaatatgtacccgagaagaatttactagaaaggtccgttccaacgctgcaatcggggcagtattcgttgatgaaaaccaatggaatagtgccaaggaagctgtagaagatgaaagattttgggacttagttcatagggaaagggaacttcataaacaaggaaagtgcgcgacatgcgtatataacatgatgggaaagcgtgaaaagaaattaggagagttcggtaaggctaaaggatcacgagctatatggtacatgtggctcggagcaagattcctagagttcgaagctctaggttttatgaacgaagaccactggttctctcgagaaaattcgttgtcgggagtggaaggggaaggattacataaattagggtatatactgcgagatatttccaaaatacctgggggtaatatgtatgcagatgacacagcaggttgggatacacgaataaccgaagatgacctacaaaatgaggcgcgcataactgacataatggaaccagaacacgccttgctagcaaaaagcatattcaaactaacatatcaaaataaggtcgtacgtgttcaacgacccgcgaaaaatggtacggtgatggatgttatatcaaggcgagaccaacgtggttcaggacaagttggcacctatgggttaaatacgttcactaacatggaagctcaattaatcagacagatggaatctgaaggcatattttcaccatctgagcttgagacgccaaacctcgcggagcgtgtattggattggttagaaaaatatggcgtagagagattaaaacggatggcaatttctggtgatgattgcgtcgtgaaaccaatcgacgatcgatttgcaacagcattgacagcgttaaacgacatgggtaaagtaagaaaggacattccacaatgggaacccagcaaaggctggaatgactggcaacaggtccctttctgttcacaccacttccaccagcttataatgaaagatggaagagaaatcgtagtaccctgtaggaatcaagatgaattggtagggagagcccgtgtaagtcaaggagctgggtggtcattacgtgagacagcttgtctagggaaatcatacgcacagatgtggcaattaatgtactttcatagaagagacttacgactcgctgccaatgcgatatgttcggccgtaccagtagattggatccctacgtccagaacgacctggtcaatacatgctcatcatcaatggatgacaaccgaggatatgctttctgtatggaatagggtgtggattgaagaaaatccctggatggaagacaaaacacatattagtagttggggagacgtaccatacttagggaaaagagaggatcaatggtgtggtagccttataggtcttactgcgcgggcgacctgggcaaccaatatacaagttgcaattaaccaagtaagaagattaataggtaacgaaaattatttggactacatgacatcaatgaaacgattcaaaaatgaaagcgacccagaaggagcgctttggtaa

SEQ ID NO: 21520 - RNA, 9879 nt, synthetic construct
  misc_feature 1..9879: note = derived and/or modified CDS sequence (opt6) from DENV-1__FJ024464__SS-prME
  source 1..9879: mol_type = other RNA
agcgtgactatgttgttaatgttaatgccaacagcgctagccttccatcttacgacacggggtggtgaaccccacatgattgtgagcaaacaagaacgaggaaaatctttactctttaaaacatcagcaggagttaatatgtgtactttaatagcgatggatctaggagaactctgcgaggatacaatgacatacaaatgtccgagaattacggagacagaacctgacgacgtggactgctggtgcaatgcaacagatacatgggtcacttatggaacttgttcccaaacaggcgagcatagaagggacaaacggagtgtagcacttgccccacacgtcggactagggcttgagacgagaaccgaaacatggatgagcagtgaaggtgcttggaaacaaattcaaagggttgaaacatgggctttaaggcaccctggatttaccgtaatcgctctctttcttgcgcatgccataggaacttcaataacacaaaaaggcataatattcatactattaatgttagttacaccgtccatggcaatgagatgcgtcggaataggaagtagagactttgtagagggactaagtggggcaacatgggtcgatgtcgtgctagaacatggatcatgtgttacaactatggccaaagacaaacccacattggatattgagttgctcaaaacagaagtaacaaatcccgcagtacttaggaaactatgcatagaagcgaaaatatctaacaccacgaccgactcaaggtgtcctacgcaaggagaagccactttagtagaagaacaagatgcaaattttgtgtgtagaagaacttttgtcgacagaggatggggaaacgggtgtggattatttggaaaaggaagtttaattacctgcgcaaaatttaaatgtgtgacaaaattagaaggtaaaatagtacaatacgagaacttaaaatatagtgttatagtaacagtacatactggtgatcaacaccaagttgggaacgaatctactgaacacggaaccacagcaactataactccacaagcaccaacaacagagatacaattgaccgattatggagccttaaccttagactgctcccctagaacaggactagactttaatgaaatggttctattaaccatgaaagagaaaagttggctagttcacaaacaatggtttttagatttacctctaccatggacatcaggtgcatcaacaagtcaagagacttggaatagacaagacttactggtaacctttaaaacggcgcatgccaagaaacaagaagtagtagtgctgggaagtcaagaaggcgccatgcatacggcacttacaggtgcaaccgaaatacaaacctcgggcaccacaacaatatttgctggccacctaaaatgcagacttaaaatggataaactcacccttaaaggtatgtcgtacgtgatgtgtacaggatcatttaaactagaaaaagaattagcagaaactcaacacggaactgtattagtacaaattaaatacgagggtacagatgcaccttgcaaaatacctttctcgacccaagacgaaaaaggagtcacgcaaaatggaagactgattactgcaaatcctatagtgacggacaaagaaaaacctgtcaacattgaagctgaaccaccgtttggagaatcttatatagttataggtgccggtgaaaaagcattgaaattatcttggttcaagaaagggtctagcatagggaaaatgttcgaagctacggcaagaggtgttagaagaatggcaatactgggagatacagcttgggactttggatcaatcggcggagtatttacatctgtaggaaaattagttcaccaaatcttcggaacagcctatggggtattattttcaggcgtttcctggacaatgaaaatagggataggggtgcttttaacctggttgggactaaatagtaggagtacatctctaagcatgacatgtatagcggtagggcttgtaacactatatctaggcgtgatggtacaagcagatagcggttgcgtcatcaattggaaagggagagaactaaaatgcggaagtggaatattcgtcaccaatgaagtccatacttggacagaacaatacaaatttcaagccgacagtccgaaaaggctttcggcagccatagggaaggcttgggaggagggggtatgtggcatccgttccgccacgcgcttagagaatattatgtggaaacaaattagtaatgaattgaatcacatcttgttagagaatgatatgaaatttactgtagttgtaggtgatgtagccggaatactcgcacaaggtaagaaaatgatacgcccacaaccaatggaatacaaatatagctggaagtcatggggcaaggcgaaaattattggagcggatgttcaaaatactacgttcattatcgacggtccaaatacccctgaatgtccagatgaccaaagggcatggaacatatgggaagtcgaagactatggttttgggatttttacaacaaatatttggttaaaattacgagattcctatacgcaagtatgtgatcatcgactaatgagtgccgctattaaagactcgaaggctgtccatgctgatatgggatactggatcgaaagtgagaaaaatgagacttggaaactagcgcgagcttctttcattgaggttaaaacctgcatttggcccaaaagccataccctatggagcaatggtgtcctagaaagtgaaatgataatacctaaaatatacggtggacctatgtcgcagcacaattatagacccggttactttacacaaacagcgggaccgtggcatttaggcaaactcgaactcgattttgacctttgtgaaggaactaccgtcgtagtagatgaacactgtggcaatcgtgggccctctctaaggacaactactgtcacaggaaaaattattcatgaatggtgttgtcgatcctgtaccctcccaccgttaaggtttagaggagaagatggctgctggtacggcatggaaatacgacccgttaaggaaaaagaagaaaacctggtaaagtcaatggtatccgcgggctcaggggaggtagattcgttttcattaggactattgtgtatatctataatgatagaagaggtaatgcgatccagatggagtaggaaaatgctaatgactgggacacttgctgtattctttctgttaataatgggacaactaacgtggaatgatttaatcagattatgtatcatggtaggagcaaacgcatctgatagaatgggcatgggaactacgtatctcgccctgatggctactttcaagatgcggcccatgttcgcagttgggctactatttaggcgactgacaagtcgcgaagtacttttattgacaattggactatctctagtcgcttccgtggaactacccaattctttagaagaattgggagatgggttagctatgggaataatgatactaaagttattaactgattttcaaagtcaccagttgtgggccacgttgttgtcactcacatttattaaaaccactttttcactacattatgcgtggaaaactatggcaatggtattaagcatagtgagcttattccccttatgtcttagtacaacatcacagaaaacgacatggttaccagttctattaggatccctcggatgtaaacccttaacaatgttcttaattgctgaaaataaaatctggggtcgtagaagctggcccttgaatgaaggaataatggctgtaggtatcgtatcaatcttactgagttctctcctgaaaaacgatgtgccgctggcgggaccattgatagcgggaggaatgcttatagcatgttatgtaatcagtggttcaagtgcagacttatcacttgaaaaagctgccgaagttagttgggaggaagaagcagaacattcaggtgcatcacataacattcttgtagaagttcaagatgatggtaccatgaagattaaagatgaggaacgtgatgacactcttaccatacttttgaaagccacattactagctgttagtggtgtttaccctctatcgattccggccactttattcgtatggtacttttggcagaagaagaaacaacgaagtggggttctgtgggacacacccagtcccccagaggtcgaaagagcagtgcttgacgacggtatttacagaataatgcaacggggtttgttgggacggtcacaggtaggggtaggggtatttcaagaaaatgtatttcacacaatgtggcacgtgacgcgtggagccgtactcatgtaccaagggaaaaggttggaaccaagttgggcttccgtcaagaaagatttaataagttatggaggcggatggcgattgcagggaagttggaatactggagaagaagttcaggttatagcggtagaacctggcaagaaccccaaaaacgttcaaaccgcgccaggtacatttaagacgcccgaaggagaagttggagccattgctttagattttaagccaggtacttcgggttcacctatcgtaaacagggaagggaaaatcgtaggactttacggcaatggtgttgtcacaacgtcaggtacttatgtatcagctatagcacaagccaaagcatcacaagaaggacctttacctgaaattgaagacgaagtttttagaaaaaggaacttaacaataatggatttgcacccaggaagtgggaagaccaggaggtatcttcctgcaatagtaagagaagcgatcaaaagaaagctccgaaccttaatattggctccaacgcgtgtagtagctagtgagatggcagaggctcttaaaggtatgccgattcggtatcaaacgacagccgtcaagtctgagcacactggaaaggaaatagtggacttaatgtgccatgccacatttacaatgcgacttctaagtccagtcagagtcccaaattataacatgatcattatggacgaagcgcatttcactgacccgagctcaatagcggcaagagggtatatatcgacaagagtcggaatgggtgaagctgcggccattttcatgacagcaacacctccaggcagcgtggaagcatttccacaatcgaatgctgtcattcaagatgaagaacgtgatattcctgaaagatcctggaactcgggctatgaatggattaccgactttcctggtaaaacggtgtggtttgttccaagcatcaaatcaggtaacgatatagcaaattgtctgagaaagaatggaaaaagagtgattcagctttcacgaaagacttttgacaccgaatatcagaaaaccaaaaataacgattgggactacgtagttacaacagatataagtgaaatgggtgctaattttcgtgccgatcgagtgatagacccaaggagatgtcttaagcccgttatattaaaagatggtcctgagagagttattctggccgggcctatgccagtgactgtagcaagcgctgcccaaaggagaggtcgtataggtagaaatcataacaaagagggagaccagtacatctacatggggcaacccttaaataatgacgaagatcatgctcactggaccgaagccaagatgctactagataatatcaatacaccggaaggaataattccggccttatttgagccagagcgggaaaagtcagctgcaatagacggggagtaccggttacgcggggaggctagaaaaaccttcgtagagttaatgcggaggggagatctaccagtatggctcagttataaggttgcgtccgaaggcttccagtattcagatcgaagatggtgttttgacggagaacgtaataaccaagtattagaagaaaatatggatgtagagatatggactaaagaaggagagaggaagaaactacggccaagatggttagatgcacgtacctactctgaccccttagcactgagggaatttaaagagtttgcagcaggacgacgaagcgtgagtggtgatctaatccttgaaatcgggaaactaccgcaacatttaactcagcgggcacaaaacgcacttgataacttagtcatgttacataattccgaacaaggaggccgagcctacagacacgcaatggaagaactcccagataccattgaaacgctgatgcttcttgcgttaattgccgtgttaactggaggagtcactctgtttttcctgagcggtaggggattaggaaaaacctcaatcggattattatgtgtgatggcatcatctgttctgctttggatggcatcagttgaaccacattggatcgcagcgtccatcattctcgagttctttttgatggtccttcttataccagaaccagatagacaacggactcctcaggataaccaactagcttacgttgtaatcggattactgtttatgatactaacagttgctgcgaatgaaatgggtttgcttgaaacaaccaagaaagacctaggtatagggcatgtcgcagttgagaatcatcaccatgcagcgatgcttgatgttgatttgcatccagccagcgcttggactttgtatgctgttgccactacaataattaccccaatgatgagacatacgatcgagaatacaacagccaacatatcattgactgcaatagcaaaccaagctgcaatcctgatgggccttgataaaggatggcctataagcaaaatggatataggtgtacctctattagcgctgggttgctattcgcaagtaaatccattaacacttacggctgcagttctaatgttggtagcacactacgcaataataggacccgggctgcaggcaaaagcaacaagggaggcccagaaacgtactgcagccggcatcatgaaaaacccaacagtagatggcatagtcgccatagaccttgaccccgttgtatatgatgcgaaatttgagaaacagttaggacagattatgcttttaattctatgtaccagtcagatactactaatgagaacgacatgggcattatgtgaaagcatcacacttgctacagggccattaacaactctgtgggaaggatcgccaggaaaattctggaacactacgattgcagtatcaatggcaaatatctttagaggctcttatctagcaggcgccggacttgcatttagcctgatgaaatctctagggggcggacgtagggggacaggagctcagggcgaaacactaggcgaaaaatggaaaagacaattaaaccaactttcaaaatcggagttcaatacttacaaacgtagtggcataatggaagtcgaccgaagtgaagcgaaggaaggtttgaagagaggtgaaactactaaacacgcagtgagtagaggaaccgcaaaattaagatggtttgtagaaagaaatctagtgaaacccgaagggaaagtcatagacttaggatgtggaaggggaggatggtcatattattgtgctggtcttaagaaagtaacagaagttaaaggatacacaaagggtggacctggacacgaagaaccgatacctatggcaacgtatgggtggaacctcgtgaaactgcattcgggtaaggatgtatttttcattccacctgaaaagtgtgatacattgctatgcgacatcggagaaagttctcctaacccaactatcgaagaggggagaacactccgagtgttaaaaatggtggaaccgtggctacgagggaaccaattttgcataaaaatcttaaatccctatatgccaagcgtagtagagacactggaacagatgcaaagaaagcatggaggaatgttagttagaaatcctctttctcgtaattcaacacatgagatgtattgggtatcttgcggaactggaaatatcgtttcggcagttaatatgacttctagaatgcttttaaatagatttacgatggcccataggaagccgacctacgaaagagatgttgatttgggcgctggtactaggcatgtagcagtagaaccagaagttgccaacctagacataataggccaaagaatagagaacattaagcatgaacacaaaagcacatggcattatgatgaagataacccctacaagacatgggcttaccacggatcatacgaagttaaaccaagtggctctgcttctagtatggtaaatggcgttgttaaactattaacgaaaccttgggatgtcatacctatggtcacccaaatcgccatgacggacaccactccattcgggcagcagagagtcttcaaagaaaaggtcgatacacggacccctaaagcaaaaagagggacagcgcaaataatggaggttacagcgaaatggctttggggatttctatcccgtaacaagaaaccacgaatttgtacacgggaagagttcacacgaaaagtgagatcaaacgcagccataggcgcagtgttcgtggacgagaatcaatggaacagtgcaaaagaagcagtagaagatgaaaggttctgggatttagtacatagagaacgcgagctccacaaacagggtaaatgtgcaacctgcgtctacaatatgatggggaaacgagagaagaaattaggagaatttgggaaggcaaaaggttctcgagcaatttggtatatgtggctcggagctagatttttagaatttgaagcattgggatttatgaatgaggaccactggttttcacgagaaaattcattatcaggtgtcgaaggtgaaggcttacacaaattaggatacatactaagggatattagtaaaataccaggcggtaacatgtatgctgacgatacagctggatgggatactcgcataacagaggacgatctgcaaaacgaagctcggataaccgacatcatggaaccagaacatgccttactagctaaatcgatatttaaactaacatatcaaaacaaggtagtaagagtacagcgtcccgctaagaatggcactgtaatggacgtgatatcacgcagggaccagcgaggcagtggacaagttggaacttatggactgaatactttcactaatatggaagcccaactcattcggcagatggaatccgaagggatattttctccgtcagaactagaaacaccaaatctcgccaaacgggtacttgattggttagaaaaatatggtgttgaaagattaaaaagaatggcaatatctggtgacgattgcgtagtaaaacccatagatgatagatttgcaacagcattaactgccttaaatgatatgggcaaagtaagaaaagatatcccccagtgggaaccttcaaagggctggaacgattggcaacaagttccattttgtagccaccactttcatcaactgataatgaaagatgggcgcgaaattgtagtaccttgtaggaatcaagacgaattagttggcagagccagagtgagccaaggtgcgggatggagcttgagagaaacagcttgcctaggaaaatcatacgcgcaaatgtggcaactgatgtactttcacagaagggaccttcgattagcggctaacgcaatatgttcggctgtccctgtcgattggataccaacatcaagaacaacctggagcattcatgcacatcaccaatggatgacaaccgaagacatgctgagtgtctggaatcgcgtgtggatcgaagaaaatccctggatggaagataaaacgcacattagttcctggggtgatgttccttatttaggaaagcgtgaggatcaatggtgtggttccttaataggtcttacagctagagcaacctgggcgacaaacattcaagtggcgataaatcaagtgcgtcgactaattggaaatgaaaattacttagattatatgacaagcatgaaacgttttaaaaatgaatcggaccccgaaggcgccctatggtga

SEQ ID NO: 21521 - RNA, 9879 nt, synthetic construct
  misc_feature 1..9879: note = derived and/or modified CDS sequence (opt6) from DENV-1__FJ410191__SS-prME
  source 1..9879: mol_type = other RNA
agtgtaactatgttattaatgttgatgccaactgcccttgcctttcatctaacgacgagaggaggggaaccccatatgattgtctctaaacaggaaagagggaaatcactactattcaaaacttctgcaggagttaatatgtgcactttaatagcaatggacctaggagagttctgcgaagataccatgacctataaatgtccaagaatcaccgaagcagaaccagacgatgtagattgctggtgcaacgccacagacacctgggtaacatatggaacatgttcgcagacaggtgaacaccgtagagacaaaagaagtgttgctctagctccacacgttggattgggactagaaacccgtactgaaacatggatgagttcagaaggtgcatggaaacagatccagaaagtcgaaacatgggccttacggcatccaggattcacggtaattgcgttatttcttgcacacgcaatcggtactagcataacccagaaggggataattttcatactccttatgttggttactccaagtatggcaatgagatgcgtgggtatcggaagtcgtgacttcgtagaaggtttgagcggtgcgacctgggtggatgttgtgctagaacatggaagttgtgtcactactatggcaaaagataaaccgactttagatatagaattacttaaaactgaagtaacaaatccagcggtactccggaaactatgcattgaagcaaaaatcagcaacaccacgaccgactctcgatgccctactcaaggggaagcgactctagtagaagaacaagatgctaattttgtgtgtcgtcgcaccttcgttgatagagggtggggaaatggttgtggactattcggaaaaggatcgcttataacatgtgccaaattcaaatgtgtaaccaaattggaaggaaaaacagttcaacatgaaaatctaaaatattctgtaatagttacggtgcataccggagatcaacatcaagtcggcaatgagtcaactgaacacggaactacagcaacgataacaccccaggcaccatccacggaaatacaactgacggactacggagccctaactctggactgcagtccccggacaggattagattttaatgaaatggtactattaacaatgaaagagaaaagttggttagtacataaacaatggttcttagatttaccactcccatggacctctggagcgtcgacaagtcaggaaacctggaatagaaaagatttgctagtaacatttaaaactgcacatgctaagaaacaggaagtagtcgtcttaggcagccaagaaggtgcaatgcatactgcattaactggagcaacagagattcagacaagtggcacaacgacaatatttgcaggtcatttaaaatgtcggctgaaaatggataaattaaccctcaaaggaacgtcatatgttatgtgtactggaagtttcaaattagaaaaagaagtggccgagactcaacatgggactgtattagtacaaattaaatatgagggaacggacgcaccatgcaaaattcctttctcaactcaggatgaaaaaggtgtaactcaaaacggtcgtctgattacagcaaaccccatagtaactgataaagaaaaacccgttaatatcgaagcagaaccgccttttggagaatcatacattgtaataggagccggcgaaaaggctttaaaactatcctggtttaagaaaggaagttcgataggaaaaatgttcgaagcaacggctagaggtgcacgtcgcatggcgatcctaggtgatactgcttgggattttggatcaataggcggagtttttacctcagtaggaaagctagttcatcaaatttttgggaccgcttacggtgtgttgttcagtggagtttcttggaccatgaaaatcggtattggggttttattaacttggctaggactaaattcaagatcaacgtccctgtcgatgacgtgtatagcagtgggactcgtaacattgtatctaggagtaatggtgcaagctgatagcggttgtgttataaactggaaagggagagaacttaaatgcgggagcggaattttcgtcaccaatgaagtacatacatggacggaacagtataaattccaggcagacagccctaagcggttgagtgcagcaataggtaaggcttgggaagaaggagtgtgcggcattcgatctgctaccagacttgaaaacataatgtggaaacagatatctaacgaactgaaccatatattattggaaaacgacatgaaatttacagtagtcgtaggggacgtcgccggcatccttgcgcaaggcaagaaaatgattaggcctcaacctatggaatataaatatagctggaaaagttgggggaaggcaaaaatcatcggagccgacgtgcaaaatacaacgtttattattgacggaccaaatactccggaatgccctgatgaccaaagagcctggaacatctgggaggtagaggattatggattcggtatctttaccacaaatatatggttaaagctaagagactcatatacccaggtgtgtgatcatcgcctaatgtcagctgcaataaaggacagtaaggcagttcatgcagacatgggatactggatcgagtccgagaaaaatgaaacatggaagctagctagagcctcgtttatagaagttaaaacatgtatttggcctaaatcacatacgttatggagcaacggtgtattagaatctgaaatgataattccaaaaatatatggagggccaacctctcaacacaattataggccagggtactttacgcagactgcaggtccttggcatctcggtaaacttgaacttgatttcgatttatgtgaaggcacaacagttgttgttgacgaacattgtggaaatagagggccgtcgttacgtacaaccacagttacaggtaaaataatacacgaatggtgttgcagatcgtgtacattacctccgttaaggttcaaaggcgaagatggatgttggtacggaatggaaataaggcctgttaaagaaaaagaggaaaatttagtaaagtcaatggtaagtgcaggtagcggtgaagtcgacagtttttcactcggattactttgtataagcataatgattgaagaagtgatgcgatcaaggtggagtaggaaaatgttaatgacgggtacgctagctgtcttctttctacttatcatggggcaattaacgtggaatgacctaatacgtctatgtatcatggttggagctaatgcaagtgatagaatgggaatgggtacgacctatctagctctaatggccacgtttaaaatgagaccaatgtttgcagttggattattattccgtcgattaactagcagagaagttctattattaacaattggactatcacttgtagcatcagtggagcttcccaattcgttggaggaactaggggatggtctagcaatggggattatgatccttaaattgttaacagactttcaatcgcatcaactatgggcaacgttgttatcactgacgtttataaagacgactttcagtttacattatgcgtggaagacaatggctatggtacttagcatagtgtcactctttcccttgtgcctatcaacgacgagtcaaaagacgacctggttaccggtattattaggtagtctcgggtgtaaaccactaacaatgtttttgatcgctgaaaataagatctgggggcgaaaatcatggcctttgaacgaagggataatggctgttggtattgtctcaatactccttagcagtttattgaagaatgatgtaccactggccggacctttgatagcgggtggaatgttaatagcatgttacgtaatttctggatcgtctgcagatttaagtctggaaaaagctgcggaggtaagctgggaagaagaagctgaacattcaggtgcctctcataatatactggtcgaggtgcaagacgatggcactatgaagattaaagatgaggaaagagatgatacattgactatactcttgaaagctacattattagccgtcagcggagtatacccattaagtatcccagcaacattgttcgtttggtatttctggcaaaagaaaaagcaacgatcaggtgttttatgggacaccccttctccgcctgaagttgaaagagcagtcctagacgacggcatttatcggatcatgcaacgtggcctccttggaagatctcaagttggcgtaggagtcttccaagagaatgtctttcatactatgtggcacgtaactagaggagcagtattaatgtatcaaggtaaacggttggagccatcttgggctagcgttaagaaagatctcatctcgtacggtggaggatggagattacaaggaagctggaatacgggagaagaagtgcaagtgatagccgttgaaccaggtaaaaatcctaaaaatgtgcaaacggctcctggaacatttaaaacctctgagggggaagtcggggcaatagcattggactttaaacctggtacctccgggtcgcctattgttaacagagaaggcaaaatagtaggattatacggaaatggagtagtaactacatcgggtacttatgtatccgcaatagcacaagcaaaggcttcccaagaaggtcctctacccgaaatcgaagacgaagtattcagaaaaaggaatttaaccattatggatcttcatccaggtagcggaaaaacaaggcgttacttaccagcaatagttagagaagcgattaaacgaaaactccgaacactcattttggcacctacgcgtgtcgtagcatctgaaatggcagaagcacttaagggaatgccgattagatatcaaacaaccgccgtgaaaggtgaacacaccggaaaagaaatcgttgatttaatgtgccatgccacgttcacaatgagacttttaagtccggtaagagtaccgaactataacatgataatcatggatgaggcacacttcacagatccttcttctatagcagcacgtggttacataagtacacgtgtaggtatgggcgaagcagcagcaatattcatgactgcgacacccccaggatcagttgaagcatttccacaatcaaatgcagttatacaagatgaagagagggacattcctgaacgatcatggaactcaggatacgagtggataaccgacttcccgggaaaaacagtatggtttgtaccctcaataaagagtgggaacgacatagcaaactgcttgaggaaaaacggcaaacgtgttatacaactatcacgaaaaacgtttgatacagaatatcagaaaactaaaaataatgattgggattatgtagtaacgactgacataagcgaaatgggtgcaaactttagagcggaccgggtcattgatccacgtcgatgtctaaaaccggtcatcttaaaagatggtccagaaagagtaatattagctgggcctatgcctgttactgtagccagcgccgcacaacgtaggggaagaataggtagaaaccacaataaggagggtgaccaatatatatatatgggacaaccattaaacaacgatgaggaccatgcccactggaccgaagctaaaatgttgttagataacattaacacgccagaaggaataatcccagctctatttgaaccagaaagggagaaaagcgcagctatcgatggcgagtatagattaagaggagaggccaggaaaactttcgtagaactaatgagacgaggagacctaccggtctggctatcttataaagttgcaagcgaaggattccaatactctgaccgtcgctggtgctttgacggcgaacgaaacaatcaagttttagaagaaaacatggacgttgagatttggactaaagagggggaaagaaagaaactaagacccaggtggctggatgcaagaacttatagcgacccgttggcactcagggagttcaaggaatttgcggcaggaagaaggtcagttagcggtgacttaatcctcgagatcgggaagttgcctcaacatctaacccaaagagctcaaaatgcattggacaaccttgtaatgcttcataactcagaacagggtggtcgagcttatagacatgctatggaagagttaccggatacaatagaaactctcatgctcttagccttaatcgctgtcttaaccggaggtgtaactttatttttcctaagtggccgcgggctaggaaaaacaagtattggattattatgtgtcatggcttcttcagcactgttatggatggcttcggttgaacctcactggatagctgcgtctatcatcttggagttctttctaatggtccttctaataccagaaccagataggcaaagaaccccacaagacaatcaactggcttacgttgttattggactgctgttcatgattcttaccgtcgcggcgaatgaaatgggtctcttagaaacaacaaaaagagatcttggcataggccatgttgcggtcgagaaccaccaccatgcagcgatgctagatgtcgatttgcacccagcatctgcatggactttatacgctgtcgctactactatcataacccctatgatgcgacacactatagaaaatacgacagccaatatttcgttgacagccatagctaaccaagctgcaatactcatgggacttgataaaggatggccaatcagcaaaatggatatcggcgttccgttactagcgttaggttgctattcgcaagtcaacccacttacattaaccgcagcagttttgatgctagtcgctcattatgctatcattggacctggtttgcaggcaaaggcaactagagaagctcaaaaacggactgcagcaggaataatgaagaacccaacagtagacggcattgtagctatagatttggacccagtagtttatgatgctaaattcgaaaagcaattaggacaaataatgctattggtattatgtacgtcgcaaatattactgatgcgcactacatgggcgctatgcgaatcaattacactagcaacaggaccgcttacgactttatgggagggatcacctggaaaattttggaatacaacaatagctgtatctatggcgaatatttttcggggaagttatttagctggcgcggggctcgcgttttccttaatgaagtcattgggcggtggacgaaggggcactggtgctcaaggagaaacattaggggaaaaatggaaacgacaacttaaccaactgtcaaagtcagagttcaatacatataaaaggagtggaatcatggaggtcgatagaagcgaggccaaagagggtttaaaaagaggggaaactacgaagcatgctgttagtagagggacggcaaaattaagatggttcgttgaacgaaatctcgtcaaaccagagggcaaagttatagatctaggctgtggcaggggaggttggtcgtactattgcgccggactcaagaaagtgactgaagtgaaaggatatacaaaaggtggtccaggacatgaggaaccaatcccaatggctacatatggctggaatctagtcaaactacactccggtaaagacgtctttttcataccgcccgaaaagtgtgatacgctgttgtgtgatattggtgaatcatctccaaacccaactatagaagagggacgaactctgcgcgtattaaaaatggtagaaccatggctaaggggtaatcaattctgcatcaagatactaaatccatatatgcctagcgtagttgaaacactcgaacagatgcaaagaaagcatggagggatgcttgtcagaaaccccttatcccgcaattcgactcacgaaatgtactgggtaagctgtggaaccgggaatatagtttcggcggtaaatatgacaagtcgaatgttactaaatcgatttaccatggcgcacagaaaaccaacttacgagagggatgtcgacttaggtgctggtactagacacgtggctgtagaacctgaagttgctaacctggatataattggccaacgaatagagaacataaaacacgaacacaaaagcacatggcattatgatgaagataatccatataaaacctgggcctaccatggctcctacgaagtgaaaccgtcagggtcggcaagcagtatggtaaatggagtcgtaaagctactgactaagccctgggatgtcatcccgatggtaacacagatagcgatgacagacacaacaccatttgggcagcagagagtgtttaaggaaaaggtagacacgcgaaccccaaaagctaagcgaggaacggcgcaaataatggaagtgaccgcgaagtggttatggggattcctttctagaaacaaaaagcctcgaatctgcactagagaagaatttaccaggaaggttagatcaaatgcagctataggggcagtatttgtagacgaaaaccaatggaactctgcaaaggaagctgtagaagatgagagattctgggaccttgtccacagagaacgagaattacataagcaagggaaatgcgccacctgtgtatacaatatgatggggaaacgtgaaaagaaactcggggagttcggaaaggcaaaaggctcaagggcaatctggtacatgtggctaggagctcgatttcttgagttcgaggcattaggctttatgaatgaggatcattggttttccagagagaactcgcttagtggagtagaaggagagggattacacaaattaggatatatactaagagacataagtaaaatacctgggggaaatatgtatgccgacgacacagctggatgggatactcgtatcactgaagacgacctacaaaatgaagcgaaaataacagatattatggaacctgaacatgcacttttagcaaaatccatcttcaaattgacatatcaaaataaagttgttcgagtacaaagaccagctaagaacggtacagtgatggatgtcatatccaggagagaccaacgcggaagcggccaggtaggcacgtatggtctcaacacatttacaaatatagaagcacaactaataagacaaatggagagtgaggagatctttagtccgtcagagttagaaacaccaaacttagcgggaagggttctagactggttagagaagcatggagtggagagactcaagagaatggctatatcaggcgacgactgtgtggtgaaaccaatagacgaccgtttcgcaaccgcactgaccgccctaaacgatatggggaaagtcagaaaagacattccgcaatgggagccaagtaaagggtggaatgattggcaacaagtacccttttgcagtcatcactttcaccaattaataatgaaagatgggagagaaatagtagtaccttgtaggaatcaggatgaattagttggacgagcgcgggtctcacaaggggctgggtggtcattacgggagacagcctgcctcggtaaatcgtacgcgcaaatgtggcaattgatgtattttcacaggagagatctcagattagccgctaatgcgatatgctctgcagtacccgtggattgggtccctacatcgcgtacaacttggtcaattcatgctcaccatcagtggatgacaactgaggatatgctatctgtatggaacagagtctggatcgaggaaaatccatggatggaagacaaaacgcatatctcatcatggggtgatgtgccttatctagggaaacgcgaagatcaatggtgcggatctcttatcggacttaccgcaagagcaacttgggcaactaacatacaagtagcaataaatcaagttcggagattaattggaaacgaaaactatctggactacatgacttctatgaaaagattcaaaaatgaatcagatcccgaaggagctctctggtag

SEQ ID NO: 21522 - RNA, 9879 nt, synthetic construct
  misc_feature 1..9879: note = derived and/or modified CDS sequence (opt6) from DENV-1__FJ432723__SS-prME
  source 1..9879: mol_type = other RNA
tcagttactatgctactaatgttaatgcccactgccctagctttccatttaactacgagaggaggtgaaccacacatgatagtaacgaaacaagaaaggggtaaatctctattatttaaaacttcagctggcgtaaacatgtgtacacttatagcaatggatctaggagaactatgtgaagacacaatgacatataaatgtccacgcataactgaagcagaacccgacgatgtcgattgttggtgcaatgctacggatacctgggtgacctacggaacatgctcacaaacaggggaacatagacgtgataagagatcggttgctctagcaccacatgtagggcttggcctcgaaacaagaacagaaacttggatgtcttctgaaggagcttggaaacaaatacaacgtgttgaaacgtgggcattacgccatcccggatttacggtcatagcactattcttagcacatgcaataggaacctccatcacgcaaaaaggaataatatttatcttattaatgctagtaactccatcaatggcaatgcgatgtgtagggataggttccagggattttgttgaagggttgtccggcgccacttgggtagacgtcgtcctagaacatgggagttgtgtcacaacaatggcgaaagacaaacccacacttgatattgaattacttaaaacagaagtgactaatccagcagtgctgcgaaagttatgcatagaagcgaaaatatccaatactacaacagacagtcgatgtcctacgcaaggtgaagcaacattaatggaagaacaggatgctaactttgtttgtcgacgaacatttgtggatcgcggatggggtaatggatgcggattatttgggaaaggatctctaattacatgcgcaaaattcaagtgcgtaaccaagctcgaaggaaagatcgtacaatatgagaacctaaaatattcagttatagtaacagtacacacaggagatcaacaccaggtagggaatgaaagtacagaacacggaacaacagcaaccataacgccgcaggctcctacttctgaaattcaacttacagactacggagcattgacactggactgttcaccccgcacgggtctggattttaacgaaatggttctattgaccatgaaagagaaatcctggctcgtacacaagcagtggtttctcgacctgccactaccatggacttcaggagcctcaacatcacaggaaacttggaatcgtcaggatctcctagtcacgtttaagactgctcacgctaagaaacaagaagttgttgttttgggttcacaagaaggtgcaatgcatacggcattgacaggagctactgaaatacaaaccagcggcacgaccacgatcttcgctggacatttaaaatgcagactcaaaatggacaaattaacccttaaaggaatgtcatatgtaatgtgcactggctcatttaagctagaaaaagaagtagcagaaacgcaacatggcacagttttggtgcaaatcaaatacgaaggaactgatgctccatgcaaaataccatttagcacacaagatgagaaaggggtcactcaaaatggacgcctcataacggctaatccaattgttaccgataaggaaaagcccgttaatattgaggcggaacctccatttggtgaaagctacatagttataggggcgggtgaaaaagcactaaaattaagttggttcaaaaagggttctagcataggtaagatgttcgaagctacagctcgaggtgcacgtcgaatggcaatccttggagatactgcgtgggacttcgggagtatcgggggtgtatttacttcagtaggaaagctggtacaccaaatattcggaacagcatatggtgtgttattttcgggtgtgagctggacaatgaaaataggaattggtgtcttgttaacttggctcggattaaactccagaagtacaagtttgagtatgacttgtattgctgtcggcctagtaaccctatatttaggagtcatggtccaagcagacagtggttgtgtcattaactggaaaggtcgcgaactaaaatgcggatcaggaatttttgttacgaacgaggtccatacttggacagaacaatataaatttcaagctgactcaccaaagcgactaagcgcagcgatcggcaaagcgtgggaagagggggtatgtggcattcggtcagcaacgcgtttggaaaatataatgtggaaacaaatatctaacgagttaaaccatattttactagaaaatgatatgaagttcaccgtcgtcgttggggatgtcgttgggatattagcccaggggaaaaagatgatccgtccacaaccaatggaacacaaatatagctggaagtcttggggtaaagcgaaaattataggagcagacgtacaaaacacgacattcataatagatggcccaaacactccagaatgtcctgatgatcaaagagcttggaacatatgggaggtggaggactatggatttggcattttcacgaccaatatatggttgaaattaagagactcatacacgcaggtttgcgaccatcgactcatgagcgcagctatcaaagacagcaaagcagtacacgccgatatgggatattggatcgaatctgaaaagaatgaaacatggaaattggctcgagcatcatttatcgaagtgaaaacttgcatttggcctaaaagtcatacattatggtcaaatggcgtactggaatctgagatgattatacctaaaatatatggcggtccgatatcgcagcataactaccgccctgggtactttacccaaacagctggtccctggcatctcggcaaattagaacttgatttcgacctttgcgagggtacaacagtagtggtagacgaacactgcgggaacagaggaccaagtttacgcacgacaacagtgacagggaaaataatacacgagtggtgctgtagatcgtgtacactaccgccattaaggttcaaaggggaggatggatgttggtatggaatggaaataagaccagtcaaagaaaaagaagaaaacctagtgaaatccatggtctcagcagggtcaggtgaagtagatagtttttcattaggacttttatgcataagtataatgatcgaagaagtaatgagaagtagatggagcagaaaaatgttgatgacagggacattggctgtattcttgttgctaataatgggtcaactaacctggaatgatctaattcggttatgtatcatggtcggtgcaaacgcaagcgatcgtatgggaatgggaacaacttatcttgctttgattgcaaccttcaaaatgcgtccaatgtttgcggtaggcttactattccgacgtcttacaagtagagaagtgctattattaaccataggattatctcttgtggctagcgttgaacttcctaatagtttggaagaattaggcgatggtctagctatgggtattatgatactgaagctcttaactgatttccaatctcatcaactgtgggcaacactactctcgttcacgttcataaaaaccacactgtctttacattatgcatggaaaacaatggcgatggttttaagcatcgtaagtttattcccattgtgtctatcgacaacctcacagaaaacgacgtggctgcctgtccttctaggaagcctaggttgtaaaccattgaccatgtttctaatcgcggaaaataaaatctgggggcggaagagttggcccctcaacgagggaataatggcagtaggggtagtatccatattgctcagttcgcttctcaaaaatgacgtaccattggcaggacccctcattgccgggggaatgctaatcgcgtgctacgtaatatcaggatcttctgcagatttgtcattagaaaaagcggcggaagtctcatgggaagaagaagccgagcatagtggtgcctcacataatatcctagtggaagtacaggatgacggcacaatgaagattaaagacgaagaacgagacgacacgctcacaatcctcttaaaggcaacattgcttgccgtatctggggtgtaccccctcagcattcctgccacactattcgtttggtatttctggcagaaaaagaaacaaagaagcggtgtcctctgggataccccatcaccacccgaagttgaacgcgcagtccttgacgatggaatttatagaattatgcaaagaggactacttgggagatcacaggtaggtgttggagtatttcaagaaaacgtattccatactatgtggcacgttactcggggcgctgtattaatgtaccaaggaaaacgattagaaccctcatgggcaagcgtaaagaaagatttaatatcctacggaggaggatggaggttacaaggatcttggaataccggcgaagaagttcaagtgatagccgtcgaaccgggtaaaaaccctaaaaatgtccaaacagcaccaggaacattcaagactccagaaggagaagtgggggcaatagctttggactttaaacctgggacatcaggatcacctattgttaatagagagggaaaaattgtagggttatatggtaatggagtagtgactacatctggaacatacgtcagtgcaattgcgcaagccaaagcaagccaggaaggccctcttcccgaaatagaggatgaagtatttcgtaagagaaatcttacaataatggatctacatcctggatctggtaaaactcgaagatacctacccgcaatcgttcgtgaagcaatcaagcgcaagctgagaactctaatactagctcctacacgtgtagtagcgagcgaaatggcggaggccttaaagggcatgccgattcgttaccaaacaacagctgttaaaagtgaacatacaggaaaagaaattgtagaccttatgtgccacgcgacctttaccatgcgcttattatcacctgtacgagttccaaattataatatgattataatggatgaagcacactttactgatccatcatctattgcagcaagaggatacattagtacccgggttggcatgggagaagcagcagcgattttcatgacagccacccctcctggtagcgtagaggctttccctcaatctaatgccgtgatacaagatgaggaacgagatataccggaaaggtcctggaactccggttacgaatggattacggatttcccaggtaaaactgtgtggtttgtaccctcgattaagtccgggaacgatatagcaaattgcttgcgtaagaatggaaaacgcgtgatacaattatctagaaaaactttcgatacagagtatcaaaagactaagaacaatgattgggactacgtagtaactacggacatttctgaaatgggagcgaacttccgagccgatagagtgattgatcctcgtagatgcttaaaaccagttatccttaaggacggtccagagagagtcattcttgcaggaccaatgccagtcactgtagcttcagcagcccaaaggcggggacgtattggtagaaaccataacaaagaaggagaccagtatatatatatgggccagcccttgaataacgatgaagatcatgcacattggacggaagcaaaaatgttactagacaatattaatactccggaaggaataataccagcattgtttgagccagaacgtgaaaagtctgccgccatagacggggaataccgactcagaggtgaagctagaaaaacgttcgttgaactaatgagaagaggcgatttacctgtatggctctcctataaagtagcaagtgaaggttttcaatactcagaccggcgctggtgctttgacggtgagcgaaacaaccaagtcctagaggaaaacatggatgtggaaatatggacgaaagaaggtgaaagaaagaaattaaggccacgttggcttgatgcaagaacatattcggatccactagcactaagagaatttaaagaatttgcagcaggcaggaggagtgtaagtggagaccttattttagaaatcggcaagctgcctcaacatcttacgcagcgagctcaaaatgctttggacaatctagtgatgttacacaatagtgaacagggcggacgtgcttatagacatgcgatggaggaacttcctgacacaatagagacactaatgttgcttgcattaatagcagttctcacaggaggagtaacacttttcttcctaagtgggagaggactaggaaagacaagtatcggattgttatgtgtaatggcatcatcagttcttttatggatggcatctgtagagccgcattggatagctgcgagtattatcctcgagttctttctaatggtcctacttataccggagccagatcgacaacgaactccacaagacaaccaactcgcgtacgttgtaatcgggcttctatttatgatcttaacagttgcagccaacgaaatggggttattggaaacaaccaaaaaggacttgggtatcggtcatgtggctgtcgaaaatcaccatcacgcgacgatgctagacgtcgatcttcatccggcttcagcttggactctatacgctgtggcaactacaataattacaccaatgatgagacatacaatagaaaacacaacggccaatatttcactgaccgcgattgccaaccaagctgcaatattaatgggactggacaaaggctggccaatcagtaaaatggacataggagttcctttacttgcattgggatgctattcccaagtcaacccactaactttgactgctgcagtacttatgttagtggcgcactatgctattataggtccaggactacaagcaaaagctactagagaagcacagaaaagaacggcagcaggtataatgaaaaatcctacagttgatggaatagtggcaatagaccttgaccctgtagtttatgacgcaaaattcgagaagcagcttggacagatcatgttattaatattgtgtacttctcagatactattaatgaggacgacttgggcattatgcgagtccataacactcgccacaggaccactcacaaccttatgggagggatcacccggtaaattctggaacactactatagctgttagcatggcaaacattttccgaggaagttatcttgcgggggcaggacttgccttctcattaatgaagtcactgggagggggaaggagaggtactggagcgcagggagaaaccttaggagagaaatggaaacgccaactcaatcaattgagcaaatccgagttcaacacctacaaaagaagtggaataatggaagttgatcgttccgaagccaaagaaggacttaagagaggcgagaccacccgacacgcagtttccagaggaactgcaaagttgaggtggtttgtggaaagaaatttagtcaagcccgaaggtaaagtcattgaccttgggtgtggtcgaggaggctggagctattattgtgcaggactcaagaaagttaccgaagttaaaggttacacaaaaggtggccccggacatgaagaaccaattccaatggcaacgtacgggtggaacttagtgaaactacactcgggtaaagacgtcttctttacacctcctgaaaaatgcgatacactactatgtgacattggagaaagtagtcctaatcctacgatagaagaaggaagaacattaagggtcttaaaaatggttgaaccctggttgcggggtaaccaattttgtataaagatactcaatccttatatgccatcagtggtagaaaccctggagcagatgcagagaaaacacggcgggatgttagtaagaaatccgctttcacgaaattcaactcacgaaatgtactgggtcagctgtggaacaggcaatattgtaagtgccgtgaatatgacttccagaatgttactaaatagattcacaatggcacacaggaaaccaacatacgagagagatgtagatttgggggccgggacacgacacgttgcggtcgaaccagaggtcgcaaacttagacatcattgggcaaaggatagagaatatcaaacatgaacacaaatctacatggcattatgacgaggacaatccatataaaacttgggcataccacggcagttacgaagtaaaaccgtctggatcagcaagctcaatggttaacggcgtggtaaagttattaaccaaaccgtgggacgtcataccaatggtaactcaaatagcaatgacagatactacgcccttcggacaacagagagtattcaaggaaaaagttgacaccagaacaccaaaagcgaagagaggaacagcccaaatcatggaagtaactgccaaatggctttggggatttctttcacgcaataagaagcccagaatttgcacaagagaagaatttacaaggaaggttcgaagcaatgcagctatcggggcggttttcgtagatgaaaatcaatggaactctgccaaagaggctgtagaagatgaacgtttttgggatttagtccaaaaagaaagagaacttcataaacaaggaaaatgtgcaacttgcgtatacaatatgatgggcaaaagggagaagaaactaggcgaatttggaaaggctaaagggagcagagctatctggtacatgtggttaggcgcaagatttttggagtttgaagcgttagggtttatgaacgaagaccattggttctcgcgagaaaacagtttgtcaggtgttgaaggcgagggactacataaactgggttatatactccgcgatataagcaagattccagggggaaacatgtacgcagacgatactgcgggatgggatactagaattaccgaagatgatttacaaaatgaagctaaaataacagatataatggagcccgaacatgcactactagcaacgagtatatttaagctaacatatcaaaataaagtggttagagtacaaagaccagctaaaaatggaactgttatggatgtaatttcaaggcgagaccagcggggaagcggtcaagttggaacttatggccttaataccttcacaaatatggaagcacaactgatacgtcaaatggaaagcgaaggaatattcctccccggagaacttgaaacacccaacttagcagaacgtgttttagattggctagagaaatatggcgttgaacgtctaaaacgtatggctatctcaggggacgactgcgtagttaaacccatagacgaccgtttcgcaacagctctaacagccttaaatgacatggggaaggtaagaaaagatataccacaatgggaacccagtaaagggtggaacgactggcaacaagttcctttttgctctcaccatttccatcagttaatcatgaaggatggacgtgaaatagtagtgccgtgtcgaaatcaagatgagctagttggaagggccagagtttcacagggagcaggatggtcactaagggaaacggcatgcttgggcaagagctatgctcaaatgtggcagttaatgtactttcatcggcgtgacttacgcttagctgctaatgctatttgttctgccgtacccgttgattgggttcctacgtcgagaactacatggtctatccacgcgcatcatcaatggatgactacagaggatatgttgagtgtttggaatcgtgtatggatagaggaaaatccttggatggaggataaaacccacgtttcctcatggggtgatgtaccatacttaggaaaaagagaagaccagtggtgtggatcgctaatcggcctcactgcacgagcaacatgggcctcaaatattcaagtcgcaatcaatcaagttagaagactcatcggaaatgagaactatctcgattatatgacttcgatgaaaaggtttaaaaatgagggtgatccagagggggccctgtggtga

SEQ ID NO: 21523 - RNA, 9879 nt, synthetic construct
  misc_feature 1..9879: note = derived and/or modified CDS sequence (opt6) from DENV-1__FJ410192__SS-prME
  source 1..9879: mol_type = other RNA
tcggtcaccatgctattaatgctaatgccaacagcattggcttttcatttaaccactcgcggaggggaaccccatatgatcgttagtaaacaagaaagaggtaaaagcctgttattcaaaacatcagcaggggttaatatgtgcacactaattgcaatggatttaggagagctgtgcgaagatacgatgacatataaatgtcctcgaatcactgaaacagaaccagatgatgtagattgttggtgtaatgctacggacacatgggtgacatatggaacatgctcgcaaacaggtgaacatagaagagataaaagaagtgtggcactcgccccacatgtaggtctcggtttagaaactcggacggaaacttggatgagcagcgaaggggcatggaaacagattcaaagagtggaaacatgggcacttagacaccccggctttactgttattgcgttgtttttggcacacgcgatcggaacaagtataacacaaaaagggattatattcatcctattaatgctcgtaaccccaagcatggcgatgcggtgtgtaggaattggatcgcgagatttcgttgaaggtctatcaggcgcaacatgggttgatgtagtattagagcacggatcgtgtgttaccactatggcgaaagataaaccaactttagatatagaattactaaaaaccgaggttacaaatccagcagtcctcagaaaactatgcattgaggctaaaataagtaatacgactacagactctagatgcccaacccaaggtgaagcgactttagttgaagaacaagatgctaattttgtatgcagaagaaccttcgtggatagaggttggggcaatggctgcggcctattcggcaaaggcagtttaattacctgtgcaaaatttaaatgtgtgacaaaacttgagggaaaaatagtacaatatgagaatctaaaatactctgttattgtgacagtccatactggcgatcaacatcaggttggaaacgaatcaacagaacacggcactactgctacaataaccccacaagcaccgactactgaaattcaactaacagattatggtgcgctgaccctagattgcagtccccgtacgggtctagattttaatgaaatggtcttattaacaatgaaagagaaatcttggcttgtacataagcagtggtttttggatttaccgctcccatggacatcaggagcctcgacgtcccaagagacatggaaccgacaagatttattagtcacattcaaaaccgcacacgccaagaaacaggaagtagtggtactgggtagccaagagggagcgatgcatactgcacttacaggtgcgacagaaatacagacatcaggaactaccactatatttgcaggacatcttaaatgtagactaaaaatggacaaactgacgttgaagggcatgagttatgtaatgtgcacaggcagctttaaattggagaaagagttagcagaaacccaacacggaaccgttctggttcaaattaagtatgaaggtacagatgcgccttgtaagatacctttttcaacacaggatgagaagggggttacacaaaacggacgattgattacagcgaaccccatagtaacagacaaagaaaaaccagtcaacattgaagcagaaccgccatttggagagtcatacattgtcatcggagctggagaaaaagcactaaagttgtcgtggtttaagaaaggaagctcaataggtaaaatgtttgaagcaaccgctcggggagcaagacgaatggcaatattgggtgataccgcttgggattttgggtcaatcggaggagtttttacttctgtgggtaagctagtacatcaaatttttggaacagcatacggggtccttttcagcggagtgagttggacaatgaaaataggaataggggtattattaacatggctcggcctaaacagtcgttccacgtctttaagtatgacatgtatagctgtgggcttggtgacattatacttaggagtaatggtgcaagctgacagcggatgtgtcatcaattggaagggaagggaactcaaatgtgggtcaggcatattcgtaacaaatgaagtacacacatggacagaacaatataaatttcaggctgattctcccaaacgcttaagcgcagctataggaaaagcgtgggaagaaggagtgtgtggaatacgttcagcaacaagactggaaaacatcatgtggaaacaaattagtaacgagcttaaccacatactattggaaaatgacatgaagttcacagtagtggtgggagatgtagcagggattctcgcacaagggaaaaagatgatccgtccacagccaatggaatataaatattcttggaaatcttggggaaaagccaaaataattggtgctgatgtacaaaatacgacgtttattatagatgggcctaatacgcctgaatgccccgatgatcagcgtgcctggaatatttgggaggtagaggactacggatttggaatttttactactaatatctggcttaaattaagagacagctatacacaagtctgcgaccatcggcttatgagtgctgcaataaaagacagtaaggctgttcacgcagacatgggatattggatcgaatcagagaagaacgaaacatggaaattagcccgtgcttcatttatagaagttaaaacatgtatatggcctaaatcgcatacattatggtctaacggagtacttgaaagtgaaatgataatcccaaagatatatgggggtccaatatcgcaacacaattaccgccctggctactttactcaaaccgccggaccctggcacctaggaaaactagaacttgacttcgatctatgcgaaggcacgacggtggtagttgacgaacattgcggtaatcgtgggcctagtttaaggaccacaacggtaacaggaaagattatccacgaatggtgctgcagatcttgcacattaccgcctctacgatttaggggagaggatgggtgttggtatggtatggaaatccgaccagtgaaagagaaagaagagaatctggtaaaaagcatggtctcagcaggctctggggaagttgattctttctccttaggattactatgcatatccataatgatagaggaagttatgcgctcccgctggtcgaggaagatgttaatgactggcacactggcagtattctttctcttaataatggggcagctgacctggaatgacttaatcagattatgtattatggtgggagccaacgcatctgatcgaatgggaatgggcactacctacctagcgttaatggcaacgtttaagatgagaccgatgttcgccgttggcctactttttaggagattaacatcgagagaagttctgttactgactatcggattgtccttagtagctagcgtagagctacctaatagtttagaagaattgggtgatgggctggcgatgggcattatgatcctaaaactactaacagacttccaaagccaccaattgtgggcaacccttctaagcctaacatttataaaaacgactttttctctacattacgcgtggaaaactatggcgatgatcctctctatcgtgtctttatttccactatgcttatcaactacttcacagaaaacaacttggctccccgtactcttgggaagcctgggttgtaaaccattaacaatgtttctaatagctgaaaacaaaatctggggccgacgaagctggccgctgaacgaaggcataatggctgtaggcattgtatcgatactactctctagtttgttgaaaaatgatgtgccacttgcaggaccgttaattgctggtgggatgcttattgcttgttacgtaatttctgggtcaagtgccgatctaagtctagaaaaagcagctgaagtgagttgggaagaagaagcggaacacagcggcgcgtcacataatatattggtcgaagtacaagacgacggtacgatgaaaattaaggatgaggaaagagacgatacattgacaatactactgaaagcaacacttttggctgtaagtggagtatacccactatcaatacccgcaacattatttgtatggtatttctggcagaagaagaaacaacgatctggggtcctctgggatactccgagtcctccggaagtagaaagagccgtattggacgatggcatttataggattatgcaaagaggactattaggtagaagtcaagtgggagttggtgttttccaagagaacgtttttcatacaatgtggcatgtcaccaggggtgcagtcctgatgtaccaagggaaacgcttggaaccatcatgggcaagcgtcaaaaaggacttgatatcgtacggcggaggttggagattacaaggatcatggaatacgggagaggaggttcaggtaattgctgtggagccaggcaaaaatcctaagaatgtacaaacagcaccaggaacgtttaaaacaccagaaggtgaagtgggcgcaatagcactcgatttcaaacctggaacttcaggctcaccaatagttaatagagaaggcaagatagtaggactatatggcaatggagtcgtaactacttccggaacatatgtgtccgcgatagcacaggccaaggcctcgcaagaagggcctttgccagaaatcgaagatgaagtttttcgtaaaaggaatctaaccataatggatctccatccaggatccggtaaaactcgtagatatttacctgcaattgtccgagaggctataaaaagaaaactgcgaacactaattctagccccaacccgagtagtagcttccgaaatggcagaggctttaaaaggaatgccgatacgctatcaaactacagcagtaaaatcagaacacacgggaaaagaaattgtagacctcatgtgccacgctacttttactatgcgattattatcgccggtacgagtgcctaattacaatatgatcataatggacgaagcacactttacagaccctagctcgattgcggcacgtggttacataagcactcgtgttggaatgggtgaagcagctgcgatttttatgacagctactccccctggctccgttgaagcgttcccgcagtccaatgcggtaatccaggatgaagaaagagatattccagagcggtcctggaactcgggatacgagtggatcacggatttcccgggtaaaacagtatggtttgttccatcgataaaaagtggcaacgatatagcaaactgtctaagaaagaatggaaaaagggtaattcaattatcacgaaaaacgtttgatactgaatatcagaagaccaagaataatgattgggactacgtagtaaccactgacatatcagaaatgggtgctaatttccgggcagatcgggtcatagacccccgcagatgcttaaaacctgtaatactaaaagatggaccagaacgagtcattctagctgggccgatgccagtcaccgtagcatcagcagctcaaagacgaggccgaataggacgaaaccacaataaggagggagatcaatacatatatatgggtcaaccgctaaataacgatgaggatcatgctcactggacagaagctaaaatgttacttgacaatatcaacacaccagaaggaatcatacccgccctgttcgaaccagaaagagaaaagtcagcagcaatagacggggaatatagattgaggggagaagccaggaaaacatttgtagagcttatgcggagaggcgacctacctgtctggctatcttataaagtagcatcagaagggtttcaatacagtgatagaaggtggtgtttcgacggcgaacgaaataatcaggtactggaggaaaatatggacgttgaaatctggacgaaagagggagaaaggaagaaacttagaccacgatggctggacgcacgaacatatagtgacccgttagcacttagagaatttaaggaatttgcggccggacgtcgcagtgtaagcggcgatttaatactggaaataggtaaattacctcaacatttaacgcaaagagctcaaaacgcattagataatctagtaatgctacataattctgagcaaggtggcagagcgtaccgtcacgcgatggaggaactaccagatacaatagaaacccttatgctactagcattaattgccgtcctaacgggtggagtaacactattctttcttagcggtcggggtctcggcaaaacctcaatcggtttattatgtgtaatggcgagttcagtattactttggatggcttccgtagaaccacattggatagctgccagtattatactggagttcttcctgatggttttgttaatacctgaacccgatcgacagcggaccccacaagataatcaattagcatatgtagtcatcggactactattcatgatattgacagtggcggcaaatgaaatggggcttctagaaacgacaaagaaggatttggggataggccacgtagctgttgaaaatcatcatcacgctgcgatgcttgacgtagatttacacccagcttctgcatggacactatacgcggtagcgactacaatcataaccccgatgatgcgacatacgatcgaaaacacaacggcgaatatatctttaacagcaatcgcaaaccaagccgcaatcttgatgggattagataaaggttggccaatctccaaaatggatattggagttccacttctagctttgggttgttactctcaagtcaacccactaacattaacagcagcagtcctgatgttagtagcacattatgcaattatcggccccggcctacaggctaaagctactcgtgaagcacaaaaacgcaccgctgccggcatcatgaaaaatccgaccgtcgatggcatagtggcgatagacttggatccagtagtctacgatgcaaaatttgaaaaacaactaggccaaataatgctgcttatattatgcacgtcacaaatcttattaatgaggactacttgggctttatgcgagtcaataactctcgcaactgggccactaaccacattgtgggaggggagccctggaaaattttggaataccacaattgcagtatcaatggcaaatatttttcggggatcataccttgctggtgcaggtttggcgttttcgttaatgaaaagtttagggggaggcaggaggggcacaggcgcccaaggcgaaaccttaggggagaaatggaaaaggcaattaaatcagttgtcaaagagcgaatttaatacgtataaaagatcgggcatcatggaagtggatcgatcagaggctaaagaagggcttaaacgaggggagacgacgaaacatgcggtctcacgagggacagctaaactaagatggtttgtagagagaaacttagtaaaacctgaaggcaaagtgatagacttgggttgcgggagaggagggtggtcatattattgcgctgggctaaagaaagtcacggaagtaaaaggctacacgaaaggaggtcccggccacgaggaaccaatacctatggccacttacggatggaacttagtaaagctgcactcgggaaaagatgtattctttatccctccggaaaagtgcgacactcttttatgcgatataggagaatccagtccaaatcctactatagaagaaggacgtacgcttcgtgtactaaaaatggtagaaccatggctccggggtaatcaattttgtatcaaaatactcaatccttatatgccatctgtggtagaaacacttgaacaaatgcaaagaaaacatggaggaatgcttgtgagaaatccactaagcagaaatagtacccatgagatgtattgggtatcatgtgggacaggaaatatagtttcggccgtaaatatgactagcagaatgttacttaatagatttacaatggcacatcgtaaacctacttatgaaagagatgtggacctcggagctggtactagacatgtggcagtagaacccgaggtcgcgaacttagatataataggccagaggattgaaaacataaagcacgaacataaatctacgtggcattacgatgaggataatccttataagacttgggcatatcacgggagttatgaagtaaaaccctctgggtcagcaagttctatggtcaacggagtagtgaaactcctaaccaaaccatgggatgtgatacctatggtaacacagatagcaatgacagacactacaccttttggacagcaaagagtgttcaaggaaaaagtagacactagaaccccgaaagctaagagagggacagctcagattatggaagttactgctaaatggttatggggattcctgtctagaaataagaaaccaagaatttgtacaagagaggaatttacgcgaaaggtacgaagtaacgcggcaataggagcggtcttcgtcgatgaaaatcagtggaactcagccaaagaagcagtggaagacgaacgattctgggaccttgtgcacagagaaagggaactccataaacagggaaaatgcgcaacctgcgtatacaatatgatgggaaaacgtgaaaagaaacttggcgaatttggcaaagccaaagggtcgagagctatatggtatatgtggttaggggcaagattcctcgaatttgaagcgctcggctttatgaatgaagatcactggtttagtcgagaaaattcgttaagtggtgtagaaggagagggcttacataaactaggatatatattacgagacatatccaaaattccaggaggtaatatgtacgcagatgacaccgccggatgggatacacgaataaccgaagatgacttgcaaaatgaagctagaataactgacatcatggaaccagaacatgctttgttagctaagtctattttcaaattaacgtaccaaaataaagtagtccgagtacaatctcctgccaaaaatgggacagtaatggatgttatcagtagacgggatcaacgaggttcgggacaagtcgggacatatggattaaacacttttacaaatatggaagcccagctcatacgtcaaatggagagcgaaggaatattctctccatctgagctagaaacacccaacttagccgagagagttctagattggcttgagaagtatggggtcgaacgactaaagagaatggcaatttcaggcgatgactgtgttgttaaaccgattgacgatagatttgctactgctttaactgctttaaatgacatggggaaagtgagaaaagatatacctcaatgggaaccatcgaagggttggaacgattggcaacaagtccccttctgcagtcatcactttcatcaactaatcatgaaggatgggagagagatcgttgtaccatgccgtaaccaagacgaattagtagggcgagcgagggtaagccagggagctggctggagtttacgcgagacagcatgcttaggcaaatcttatgcacaaatgtggcagttaatgtatttccatagacgcgatttaagactggctgcaaatgcaatctgctcagctgtaccggtcgattggattcctacttcaagaactacctggagtatccatgcccaccatcaatggatgactacggaagacatgttgtctgtatggaacagagtatggattgaagaaaacccttggatggaagacaagactcatatatcaagttggggtgacgtaccttatttaggtaaacgagaagaccaatggtgcggttcgcttatcggcctgacagccagagcaacatgggcaacaaatattcaggtggcaattaaccaagttcgaaggttaataggaaatgagaattatcttgattacatgacatcaatgaagcgcttcaaaaatgaatctgatccagagggtgcattgtggtag

SEQ ID NO: 21524 - RNA, 9879 nt, synthetic construct
  misc_feature 1..9879: note = derived and/or modified CDS sequence (opt6) from DENV-1__FJ410194__SS-prME
  source 1..9879: mol_type = other RNA
tcggtaactatgttattaatgctcatgcctacggcgctagccttccatctaacgactcgtggaggggaaccacacatgatagttagcaaacaagaacgaggaaaatcactgttatttaaaacttctgctggtgtcaatatgtgtacattaattgcaatggatctcggagaattgtgtgaagacacgatgacatataaatgtccaagaataaccgaaacagaacccgatgatgtagattgctggtgcaacgcgacagatacctgggttacttatggaacatgttcccaaactggggaacataggcgtgacaagcggagtgtggctctagctcctcacgtgggattggggttagagaccaggaccgagacatggatgtcatcggaaggtgcctggaaacaaatacagagagtcgaaacatgggcactaagacacccgggctttacagtcatagccctcttcctggcacacgcgatagggacatcaataactcaaaaaggaataatttttatactcctaatgctcgtaaccccaagtatggcaatgagatgtgttggcatcgggagtagagatttcgtagaaggtttaagtggagcaacttgggtcgatgtcgtgctagaacacggctcctgtgtaactaccatggctaaggataaaccaactctagatattgaacttctcaaaacagaagtaaccaatccagcggtattaagaaaactatgtattgaagctaagatatctaacacaacaacggattctcgttgtccaacccaaggtgaggctacacttgtagaagaacaagatgccaactttgtttgtagacggacatttgtagataggggatggggcaacggatgcggtcttttcggcaaaggatccttaattacatgcgcgaaatttaaatgcgtaacaaagctagaaggcaaaatcgtacaatatgaaaatctcaaatactcggttatagtcacagtccacaccggagatcagcaccaagtgggcaatgaaagtacggaacacggaacgacggctactataactccacaagccccaacaactgaaatacaattaacagactatggtgccctaaccttagattgtagccctagaactggtcttgacttcaacgaaatggtcttacttacgatgaaagagaagagttggcttgttcacaaacaatggtttttggatctaccactgccatggacaagtggagcaagtacaagtcaggaaacttggaatcggcaagacctgctagtgacctttaaaacagcccacgcaaagaaacaggaggtcgttgttctgggcagtcaggaaggagcaatgcatactgccctaacgggtgcgactgaaatacaaacgagcggaaccacaacaatattcgctggacatctaaagtgtcgacttaaaatggataaattaacattaaaaggaatgtcttacgtaatgtgtaccggatcgttcaaactagaaaaagaggtcgctgaaacccagcacgggacagtactggtccagattaaatatgagggaacggatgcaccatgcaaaatccctttcagtacccaggacgagaaaggagtaacgcagaatggacggttaatcactgctaacccgatagtaactgataaagaaaaacctgttaatattgaagcagaaccaccatttggtgaatcatatatagtgattggagcgggagaaaaagcactaaaattaagctggtttaagaaaggaagctccatcggcaaaatgttcgaagctactgcccgtggtgcaaggagaatggctatcttgggagataccgcgtgggacttcggtagcatcgggggtgtatttacaagcgtaggaaagctagtccatcagatatttggcactgcctacggtgtattatttagtggagtgagctggacgatgaaaattggaattggagtattgttaacttggttaggtcttaacagtagatcaacttccctgtcaatgacatgcatagctgtagggctagtcaccttgtacctcggagttatggtacaagcagactcgggatgcgttattaattggaaagggagggaactgaaatgcgggtcaggaatttttgtaaccaatgaggtgcacacctggacagaacaatataaatttcaagctgacagtccaaaaagattatcggcggctataggtaaagcctgggaagaaggggtttgtggaattagaagcgccacacgtcttgaaaacattatgtggaaacaaatatcgaatgaactgaatcatatactattggagaacgatatgaaattcactgtggtggtaggagatgttgcaggaatcctagcacaggggaagaaaatgataagaccacagcctatggaatataaatacagttggaagtcatggggaaaagcaaagattataggtgctgatgttcaaaataccaccttcatcattgatgggcccaatacaccagaatgcccagacgatcaaagagcttggaatatatgggaggtagaggactacggatttggcatttttacaaccaacatatggttaaagttacgcgacagttatacccaagtatgcgaccacagactaatgtcagcagcgataaaggattcgaaagcagtacacgctgatatgggttactggattgagagcgagaaaaatgaaacatggaaactagctcgtgccagctttatagaagtcaaaacatgtatatggccaaagagccatacgctatggtcaaatggcgtcctagaatctgaaatgattatcccgaagatatatggagggcctatatcacaacataattatcggccaggatactttactcaagcggcagggccatggcacttgggcaagttagaactagattttgacttatgcgaaggcactaccgtcgtcgttgatgagcactgtggaaataggggacctagcctacgtactacaacagtaacaggcaagatcatacacgaatggtgctgtaggtcttgcaccttacctcctcttcggtttcggggtgaagatggatgttggtatggcatggaaataaggccggtaaaagaaaaagaagaaaatttagtcaaatctatggtgagtgcaggtagtggagaagttgactccttcagcctaggcttactctgcataagcataatgatagaagaagtgatgagaagccgctggtcacgacgaatgttgatgactgggaccctggccgtattcttcttattaataatgggacaacttacctggaacgatttaattcgcctatgtattatggtaggcgccaatgcatctgatcgtatgggtatgggcacaacttatttagctttgatggcgactttcaaaatgcggcccatgttcgccgtcggattattattcaggagacttaccagccgtgaggtattattgttgacaattggattatcattagttgcgagtgtagaactcccaaatagcttagaagaactgggagatggcctcgcgatgggtatcatgattctaaaacttttgactgactttcagagtcatcaattatgggctaccctcctcagtctcaccttcataaaaacaacgttctcgctgcattacgcatggaagaccatggctatggttctaagcatagtctcacttttcccattatgtttaagtaccacatctcagaagacaacatggttgcccgtacttttaggctcattaggatgtaagccccttactatgtttttaatagccgagaacaaaatctggggacgaagaagttggcctttaaatgaaggtattatggcggtaggtatagtttcaatactattatccagtttacttaaaaatgatgtacccctagctggtccacttatagccgggggcatgctaatagcttgttatgtaatatcaggtagcagcgcagatttatcacttgaaaaagcagctgaagtttcctgggaagaagaggccgaacacagtggagcatcacataatattcttgtagaagttcaagatgatggtacaatgaaaataaaggacgaagaacgagacgatacactaacaatcttactaaaggctacattattagcggtaagcggcgtttaccccctcagtataccagcaaccctattcgtatggtatttttggcaaaagaagaaacagaggagtggagtcttgtgggatactccgtccccaccagaggtagaacgtgctgttctcgatgacggaatttaccgtataatgcaaaggggactgctcggacggagtcaagtaggcgtaggagttttccaggagaatgtctttcatactatgtggcatgttactcgcggtgcagtattaatgtatcaaggcaaaagactagagccctcctgggcgagcgttaaaaaggatttaatttcgtacggaggaggctggaggttacaaggctcatggaatacaggtgaagaagtccaagtaatcgctgtcgaaccaggcaagaatcctaagaacgttcaaacagcaccaggaacattcaagacaccggaaggggaagtaggtgctattgctttggactttaaaccaggaacatcgggctcgccaatcgtaaacagggaaggaaaaatagtaggactttatgggaatggtgttgtaacaacttcaggtacatatgtaagcgctatagctcaagctaaagcctcccaggaaggacctttacccgaaatagaagacgaagttttccgaaaaagaaatcttaccataatggaccttcatccaggaagcggaaagactagaagatatctaccagcaatagttcgagaagccattaagagaaaactaagaacattaatactcgcacctacaagggttgtagccagtgagatggccgaggcattaaaagggatgcccatacggtatcaaacaacggctgttaaatcagaacacacaggaaaggaaattgtagatttaatgtgccatgctactttcacgatgcgtttactttctcctgttcgtgtaccgaactataacatgataatcatggatgaagcacactttacagatccctcttcaatcgccgccaggggttatattagcaccagggtcggaatgggtgaagcagctgcgatttttatgacagctaccccgccgggctctgtagaagcgtttccacaatctaacgccgtaatacaagatgaagaacgcgacatccctgaaaggtcgtggaactctggctatgaatggataactgactttcctggcaaaaccgtatggtttgtaccgagtataaagtccgggaacgatatagcaaattgtttgaggaaaaatggaaaaagagtaatacagctaagtcgtaaaacatttgacacagaatatcagaaaactaaaaataacgattgggattatgttgtcactacagatatatctgaaatgggggcaaattttcgtgccgatagggtgatcgacccacgaagatgcttaaaaccggtcatcctaaaagacgggccggaacgtgtaatactcgcgggaccaatgccagtaacggtagcatcagccgcacaacgaagaggcagaatcggtcggaatcataataaagaaggtgaccaatatatatatatgggacaacctcttaataacgatgaggaccacgcacattggactgaggcgaaaatgctactggataacatcaatacacctgagggaattattccggcactctttgagcctgaaagggaaaagagtgcagctattgatggtgaatacaggttaagaggcgaagcccgaaaaacctttgtggaattaatgcgaagaggtgacctaccagtatggcttagttacaaagtagcctcggaaggattccaatattccgacagaaggtggtgctttgatggagaacgaaataaccaggtacttgaggagaatatggacgtagaaatttggacaaaagaaggcgaacgcaaaaagttgagacctaggtggttggacgctagaacctatagcgacccattagcattgagagaatttaaggagttcgctgcgggccgtcgatcagtatcaggagatctaatattagaaataggtaaattaccgcagcatttgacccaaagagcacagaatgctctagataacttagtaatgttacataacagtgagcaagggggcagagcctatcgccacgctatggaagaactccctgatactattgaaaccttaatgttactcgcacttattgcagttttaacgggaggagtaactttattctttttaagcgggagaggacttgggaagacgtcgatcggattattatgtgtgatggcttcctcagtactattatggatggcttctgttgaaccacattggatagcggctagcattatcttagaatttttcttaatggtacttttgatccctgaacccgataggcaaaggacaccccaagacaatcagttagcctatgtcgtcataggtcttctatttatgattctgacagtcgcagccaatgaaatgggattattagaaacaactaaaaaggacctagggatcggacatgtagccgtggaaaaccatcatcatgcagctatgttggatgtagacttgcacccagcttcagcatggacactttacgccgtggcaacgacaataataacaccgatgatgcgtcatacaatagaaaacacaacagcgaatatttccctaaccgctattgcaaatcaggcagcaatattgatggggctggacaaaggatggccaatatcaaaaatggacatcggggtacccctcctagcgctaggctgctattcacaagtaaatcctctaactcttacggccgcagttctcatgctagtagcacactatgcaattataggaccaggacttcaagcaaaagcaaccagagaagcgcaaaagagaacagcagcgggcattatgaaaaatccaacagttgatggcattgtcgccatcgatttagaccctgtcgtttatgacgccaaatttgaaaaacaattaggccagataatgcttctcattctctgcacctcacaaatattattgatgagaaccacctgggccttatgtgaatcaatcacgttagcaactggaccattgacaacactttgggaaggctctcccggcaaattttggaacaccacaatagccgtgtcaatggcaaacatattccgtggttcgtacttagctggagcaggcttagcattctcactcatgaaatccttaggaggcggaagaagaggaaccggtgcgcagggcgaaacgctaggggaaaaatggaaacgccaactcaatcaactgtcaaaaagtgaatttaatacatataagagatcaggtataatggaagtagaccgtagcgaagcaaaagaaggcttgaagcgtggtgaaactaccaaacatgctgtatctcggggtactgcgaaacttagatggttcgtcgagcgcaatttggtcaaacccgaaggaaaggtaattgatctaggctgtggaaggggaggatggagctactattgtgcgggtctcaagaaagttaccgaagtaaaaggatacactaaaggaggacccggccatgaagaacccatacctatggctacatatggttggaatctagtaaaactaccctctggaaaagacgtctttttcataccaccagaaaaatgtgatacactactttgtgacataggtgaatcaagccctaaccctactatagaagaaggaagaaccctaagagtattaaaaatggtagagccgtggctaagaggaaatcagttttgcatcaagatattgaatccatacatgccttctgttgttgaaacactggaacagatgcaacgaaaacacgggggtatgttggtaagaaatccattatctcgaaactctacccacgaaatgtactgggtctcttgtggtactggtaacattgtttcagcagtcaacatgacaagcagaatgctattaaaccgttttacgatggcacatcgaaaacctacttacgaacgggacgtcgatctcggagccggtacgagacacgtagcagttgaacctgaagttgctaatttagatatcatcggtcaaagaatagaaaatatcaaacatgaacacaaatcaacatggcactatgatgaagacaacccgtataaaacatgggcataccatggcagttatgaagttaaacccagcgggtctgcaagcagcatggtcaatggcgttgtaaaattactcacaaaaccctgggatgtaatccctatggttactcagatcgcaatgaccgatacgaccccctttggacagcagcgcgtatttaaggaaaaagtagacaccagaactccgaaagcaaaaagaggaacagcccaaataatggaagttacagccaaatggttgtggggcttcttatcaagaaataaaaagcctcggatatgtacccgcgaggaatttacccgaaaagtgcgctcaaacgctgctattggagcagtttttgtcgatgaaaaccagtggaatagtgcgaaggaggcagtagaagatgaacgtttctgggatttagtacatagagaaagggaattacataaacaaggaaaatgcgctacgtgtgtctacaatatgatgggaaaaagagagaagaagttgggagaatttggaaaagctaaaggttcaagggccatttggtacatgtggctaggtgcccgatttttggagttcgaggctttgggatttatgaacgaagatcactggttttccagggaaaattctctttcaggcgtagaaggagaaggtttacacaaactaggttacatcctccgagatatatcaaaaatacctggaggaaatatgtacgcagatgatactgcagggtgggacactaggatcactgaagatgacttgcaaaacgagccacgtataacagatataatggaaccagaacatgcacttctagcaaagagcatattcaaactgacataccaaaataaagttgttagagtacagagccccgctaaaaatgggactgtgatggacgttatcagtcgacgcgatcagagggggtcgggccaggtaggtacatatggactgaacacttttacgaatatggaagcacagttgataaggcagatggaatctgaaggaatcttcagtccaagcgaactagagactccaaatttagcggagagagtactcgattggttagaaaaatatggcgtagaaagattaaaacgtatggccataagcggggatgattgcgtcgttaaaccaatagatgatagatttgcaactgcgttaacagcattaaatgatatgggtaaagttcgaaaagatataccgcagtgggaaccctcgaaggggtggaacgattggcaacaagttccattttggtcacatcatttccatcaattgatcatgaaagatggaagagaaatagtagtaccgtgtcgcaatcaagacgaactcgtaggaagggcaagggtcagccaaggtgcagggtggtccttaagagaaaccgcgtgtctggcaaaatcttatgcacagatgtggcagttaatgtacttccatcgaagagatctcagactagcagctaacgccatatgttcagcagtaccagtagattggattcccacatctagaacaacatggtcgattcacgctcatcaccagtggatgacgactgaagatatgcttagtgtatggaacagggtttggattgaagaaaatccttggatggaggacaaaacacacatatcctcatggggagatgtaccatatctaggcaaaagagaggatcaatggtgcggatcattaatcggactcacggcccgagcaacatgggccacaaacatacaggtggcaataaatcaagtaaggcggctaattggaaatgagaactaccttgattatatgacaagtatgaaacgattcaaaaacgaatctgatcccgagggtgcgttgtggtaa

SEQ ID NO: 21525 - RNA, 9879 nt, synthetic construct
  misc_feature 1..9879: note = derived and/or modified CDS sequence (opt6) from DENV-1__FJ432725__SS-prME
  source 1..9879: mol_type = other RNA
agcgtaactatgttacttatgcttatgcctacagcactcgcatttcatcttactacacgaggaggagaacctcatatgatagtttctaaacaagaacgtggaaaatctctgttgttcaaaacatcagcaggggtaaatatgtgcacactaatagcgatggaccttggagaactttgtgaagatacaatgacatacaaatgtccaagaataactgagactgagcctgatgacgttgattgttggtgtaatgcgactgatacatgggtcacttatgggacatgtagccaaacaggtgaacatcgtcgagataaaagatctgtcgccttagcgccacatgtgggattaggattggaaacaagaacagagacctggatgagttccgaaggtgcatggaaacaaattcaaagagtagaaacctgggcactaaggcatccgggattcaccgtaatagccttatttttggctcatgccataggaaccagtattactcaaaaaggaataattttcattttattaatgttagtaactccgtcaatggctatgcgatgcgtaggcataggctcacgagattttgtagaaggtttatcaggggccacctgggtagatgtagtactagagcacggctcttgcgttacaactatggctaaagacaaacccacattagacatcgagttgttgaaaacagaagtcacaaatcccgcagtcttacgaaaactttgcatcgaagctaaaatctccaatacaacaacagattcccgctgtccaactcaaggagaagcaactttagtagaagaacaagatgctaactttgtttgccgtagaacttttgttgatcgtggttggggaaatggttgcggcttattcggaaaaggatcccttataacatgcgcgaaatttaaatgtgttactaaactagaaggaaaaatagtacaatacgaaaatcttaaatactcggtgatagtcactgttcataccggtgaccaacatcaggtaggaaatgaatcaactgaacatggcactactgcaacgattacgccacaagctccgacaactgaaatccagctaactgactacggggcattaacacttgattgcagtcctaggacaggattagattttaacgaaatggtacttttgactatgaaagagaaaagctggcttgttcacaaacagtggtttttagatcttcccttgccgtggacaagcggtgcatcaacctctcaagaaacatggaacagacaagatctattagtgacttttaaaacagcacacgcaaagaaacaggaggttgtggtattaggcagccaagaaggagcaatgcacaccgcactgaccggagccactgaaattcagacatcaggcactactactatattcgctgggcacttaaaatgtcgccttaaaatggataaactaacgttaaaaggaatgagttatgtcatgtgcacaggatctttcaaacttgaaaaagaagtagcagaaacacagcatggaacggttttggtccaaattaaatatgaaggtacagacgctccctgtaaaataccgttttccacacaagacgagaaaggggtcacacaaaacggtcgattaattacggctaatcccattgttactgataaagagaaacccgttaatatagaagctgaacccccatttggagaatcatatatagtaataggggcaggggaaaaagcactgaaactatcttggtttaagaaaggttcgtccataggtaaaatgtttgaggccacagcacgaggggcacgaagaatggcaatattaggggatacagcctgggactttggtagtattggaggtgtgttcacttccgtcggtaaattggtacatcaaatctttgggacagcgtacggtgtattattctcaggtgtgtcttggacaatgaaaataggcatcggcgttttactgacatggttaggtttaaattctcgttctacttccctttcaatgacttgcatagccgtgggacttgtgaccctatatctcggggtaatggttcaagcggattctggatgtgtaataaattggaaaggtagagaactaaagtgcggatccggaatatttgttactaatgaagtacatacgtggactgaacaatacaaattccaagctgatagtccaaaaaggttatcagcagcgataggcaaagcctgggaagaaggagtgtgcgggatcagaagcgcgactcgactcgaaaacataatgtggaaacaaatatcgaacgagttaaaccacattttattagaaaacgatatgaaatttacagtagtagtgggggacgtcgccggaatattagcacaaggcaagaaaatgattagaccacaaccgatggagtataaatattcatggaaaagctggggaaaagcaaaaattattggcgcagatgtacagaacacaaccttcataattgatggacctaacacacctgaatgtccagacgatcaacgagcttggaacatatgggaagttgaggactacgggtttggaatattcacaacaaacatttggctgaaacttagggactcatacacacaagtatgcgatcatcgcctcatgagtgcggccattaaagactcaaaagctgtacatgcggatatgggttattggatagaatcagagaaaaatgaaacatggaaacttgcccgagctagcttcatagaagtgaagacctgtatatggccaaagtctcatacattatggtcaaatggtgtattggagtcagagatgataattccaaaaatttatggaggaccaatcagtcaacataactatagaccaggttatttcacacaagccgcgggaccttggcacttagggaagctcgaactagattttgacctatgcgaaggtaccactgtagtagttgatgaacattgtggtaatcgcggacctagcctaagaacaactacagtcacaggcaagataatacatgagtggtgttgtaggagctgcacgttaccaccccttaggttccgcggggaagacggatgctggtacggaatggagatcagaccagttaaggaaaaagaagaaaacctagttaaaagcatggtctccgccggttcaggagaggttgactctttctcattgggtttgctatgcatctctataatgattgaagaagtaatgaggagtaggtggagcagaagaatgctgatgactggaacattggcagtattctttttattaattatgggacaacttacatggaatgacttaatacgattatgtatcatggttggagcaaacgcctcggatagaatggggatgggtaccacttacctggcattaatggcaacattcaaaatgagacccatgtttgccgtcggattactgttccggagactaactagcagggaagtattacttctaacaataggtttatccttagtagcttcagttgaactcccaaatagtttagaagaactaggagacggtcttgctatgggcatcatgatattaaaactcctgacagattttcaaagtcatcaattatgggctacactcttaagccttacgtttattaaaacaaccttcagcctacattacgcatggaaaacaatggcgatggttctatctatagtaagcctatttcccttgtgcttgagtacgacgtctcagaaaacgacctggctcccagtacttttaggaagtctagggtgcaaaccacttaccatgttcttaattgcagaaaataaaatttggggaagaagatcttggccattaaatgaagggataatggccgtgggaatagtttcaatactactttcatcattattgaaaaatgacgtaccacttgccggaccactgatagcaggcggtatgcttatagcatgctatgtaatatctggttctagcgccgatttatccttagaaaaagcggccgaagttagttgggaagaagaggcagaacactctggagcatcccacaacatactcgtggaggtccaagatgatgggaccatgaagatcaaggatgaagaacgagatgacactctaacgatcctactaaaggctacgctactcgcggtcagtggcgtctatcctctgagtattccggcaacattatttgtatggtacttttggcagaagaagaaacaaaggtcaggagttctctgggatacgccttctccacctgaagtagaaagagctgtactcgacgatggaatataccgaattatgcaacggggactactagggcggtcacaagtcggcgtaggcgtgttccaagaaaatgtgtttcataccatgtggcatgttactagaggagctgttctgatgtaccaaggtaaacgccttgaaccgagctgggcttccgtaaagaaggatctaattagctacgggggaggatggaggctgcaaggaagctggaacacaggcgaggaggttcaagtcatagcagttgaaccaggaaagaatcccaaaaatgttcaaacagcacctggtacttttaagacaccagagggagaagtaggagcaattgcactagactttaaaccaggtacaagcggatctccgatagtgaacagagaaggaaaaatcgtcggactctacgggaacggagtcgttacgacttcaggaacatacgtatcagcgatagctcaagcaaaggcttctcaggaaggtcctttacctgaaatagaagacgaagtgttccgcaaacgaaatttgacaattatggatctgcatccaggctcaggaaaaactagaaggtatttacctgcaatagtaagagaagccataaaaagaaaattaagaactctaatactcgcaccaactcgagtggtagcaagcgagatggctgaggctttgaaaggaatgcctataagatatcagacaaccgctgtaaaatcggaacatacaggaaaagaaatcgtggatctaatgtgccacgccacatttactatgcgattgttaagtccagtgagagtcccgaactacaatatgattattatggacgaagcacactttacagatcccagttctatagctgctagaggatacatttcaacccgcgtaggaatgggagaggcggctgcaatctttatgacagcaactccaccaggatcagttgaggcttttccacaaagcaatgcagtaattcaagacgaagaacgtgatattccagaacgaagttggaacagtggatatgagtggataactgactttccaggtaagaccgtatggttcgtcccttctataaagtctggaaatgacattgccaactgtttgaggaaaaatggtaagcgcgtaattcaattatcacgaaagacatttgacacagaatatcagaagaccaaaaacaacgattgggattacgttgtcaccacagatatatcagaaatgggcgcaaatttcagagctgatcgcgtaatcgacccccggcgctgcctgaaaccagtcatattaaaggacggaccggaacgagtaatacttgcaggtcccatgccggtgactgtcgcaagcgccgcccaaagaagaggacgcataggtagaaatcataacaaagaaggagatcaatacatttacatgggtcaaccgctaaacaatgacgaagaccatgcacactggaccgaggccaaaatgctactagataacataaatacaccagaaggaataataccggccctatttgaacctgaacgagaaaaatcagcagcaattgacggagaatataggctaagaggggaggcaagaaagacttttgttgaactgatgcgaagaggcgacctaccagtatggctaagttataaggtggcgtcagaaggcttccaatactctgaccgacgctggtgtttcgatggagaacgcaataatcaagtgttagaagaaaatatggatgtagaaatttggacaaaagaaggagaacgtaagaagttacgaccgaggtggctcgacgcgcgcacctacagcgatccactggcccttcgagaatttaaagagtttgccgcaggccgtcgatcagttagcggcgatttaatcctcgaaattgggaagttaccccaacacctaacacaaagagctcaaaatgcactagacaatttagttatgttacacaattcagaacaaggaggacgcgcttataggcatgctatggaggagctacccgataccatagaaacacttatgctattagcgttgatagctggggtgacaggtggagtgactctcgtgtttctaagtggtaggggattaggtaaaacaagtatagggctactatgcgtcatggcgagttcagtcttgttatggatggcgagtgttgagccacactggatagctgcaagtataatattagagttctttttgatggtgctactaatacctgaacctgaccgccagcgaactccacaagataatcaattggcctacgttgtaataggattattatttatgatactcactgttgccgctaacgagatgggccttttggaaaccaccaagaaagacttggggataggacatgtcgcagtggaaaatcatcatcacgcagctatgcttgatgttgatctacatcctgcgagtgcatggacgctctacgctgtggcgaccacaataataacacccatgatgagacatacaatcgagaatacaactgctaatattagtttaacggctatcgccaaccaggcagcgatactaatgggactcgcgaaaggttggccaatctctaaaatggacattggtgtaccactgttagcactcggttgttattcacaagtcaaccctttaacgctgaccgctccagttctaatgttagtagctcattacgcaataataggtcccgggttacaagcaaaggcaacacgagaggcacagaaacgaacggcagcaggtatcatgaaaaatccgactgtggatggaattgtagcaattgacctagatcctgtagtatatgacgcgaaattcgaaaaacaactcggccaaataatgttactaatattatgtacatcgcaaatactactaatgagaactacttgggccttatgcgagtctataactcttgctacaggaccactaacgaccttgtgggagggttccccggggaagttctggaatacgacgattgctgtgagtatggcgaacatattcagaggaagttatctcgcgggagcagggttagcattctccctcatgaaaagtctaggtggaggtagacgaggaacaggcgcccaaggtgagaccctaggtgaaaaatggaagcgacaacttaatcaactctccaaatccgagttcaacacttacaagcggtccgggataatggaagtagatcgatctgaagccaaggaggggctaaaacgtggtgaaacgacaaaacatgcagtatctagaggcacagctaaactccgatggtttgtcgaacgaaatttagtcaaacccgaaggaaaagtaatcgatttaggatgtggacgtgggggctggtcctattattgtgcgggcttgaagaaagtaactgaggtaaaaggatacaccaaaggaggcccgggacatgaggaacctattccaatggccacttacggttggaatttagtaaaactccattctggaaaagacgttttctttataccaccagaaaaatgcgatactctcttgtgcgatattggagaaagctcacctaatccaactatagaagaaggacggactctacgagtgttaaaaatggtggaaccgtggctaagaggtaatcagttctgtataaaaattttaaatccgtatatgcccagtgtagtggaaactttagaacagatgcaacggaaacatggtggtatgctagtacgaaacccgctatctagaaattccacgcatgaaatgtattgggtatcctgcggtacagggaatatagtatcggcagtaaatatgacaagtagaatgcttctgaacagatttacaatggcacatagaaagccaacctacgagagagatgtagacctgggagccggaccaagacatgttgccgtggaaccagaagtagctaacctagatatcattggccaaaggatagaaaatataaaacatgagcacaagtccacgtggcattacgacgaagataacccgtataagacgtgggcgtaccatggatcgtacgaagtaaaaccttcaggatcggcttcttccatggtaaatggagtagttaagttactgacgaagccgtgggatgttattcctatggttacccaaattgccatgacggacaccacaccgttcggacaacaacgtgtatttaaggagaaggtagatactagaacacccaaagcaaaacgtgggacagcacagatcatggaagttaccgcaaaatggttatgggggttcttatcccgaaataagaaaccaagaatatgcacaagagaagaatttacgaggaaagttagatcaaatgcagctataggagcggtatttgtcgatgaaaatcaatggaactcggcgaaagaagccgttgaagacgagcgcttttgggacttaggccatcgagagcgtgaactccataaacaaggaaaatgcgcaacgtgcgtcagcaatatgatgggaaaacgtgagaagaaattaggtgaatttggaaaaccaaaaggaagcagaccaatatggtacatgtggctaggcgctaggttcctcgaatttgaagcgctcgggttcatgaacgaagatcactggtttagtcgcgaaaattcattatcgggcgtcgagggcgagggtttgcataaactaggatatatcttacgagatataagtaaaataccgggaggtaatatgtatgccgatgatacagcaggatgggatacaagaataacggaagatgatctccagaacgaagctcgaatcaccgatataatggagcctgagcacgccttattggcaaaaagcatcttcaagttaacatatcaaaataaagtagtacgtgtacagagacctgccaaaaatggcacagtgatggacgtaatatcaagtagggatcaaagaggatcgggacaagtgggaacatatgggctaaatacgtttacaaacatggaggcgcagctcatacgtcagatggaaagcgaaggaatcttttcaccatcagaattagagacaccaaacttagcggaaagggttctagactggctcgaaaagtacggcgtggaacgcttaaaacgaatggcaattagtggcgatgattgtgtagttaagccgatagatgacagatttgctacagctctgactgctttaaacgatatgggaaaagtacgaaaggacatcccgcaatgggaaccttcaaaagggtggaacgattggcaacaagtgccgttctgctcacatcacttccatcaattaattatgaaagacggacgagaaatcgtcgtcccctgtcgaaatcaagatgaattagtcggacgagcacgtgtgtctcaaggggcaggttggtcccttagggaaactgcatgtctcggtaaaagttatgctcagatgtggcaattaatgtatttccaccgacgggatctgagattggccgcaaacgccatatgtagtgccgtacctgttgattggatacccacatcacgtactacatggagtatccacgcccaccaccaatggatgaccactgaagatatgttgtcagtttggaaccgggtctggatagaagaaaacccctggatggaggataaaacacacataagtagttggggagatgtgccatatctgggtaagcgagaggaccaatggtgcggaagcctaattggtctcacggcaagagccacatgggccaccaacatccaagtagcaataaatcaagttagacgtttaataggaaatgagaactatctagattatatgacaagtatgaaaaggtttaaaaatgagtcagatccggaaggcgcgctatggtaa

SEQ ID NO: 21526 - RNA, 9879 nt, synthetic construct
  misc_feature 1..9879: note = derived and/or modified CDS sequence (opt6) from DENV-1__FJ432729__SS-prME
  source 1..9879: mol_type = other RNA
tctgttaccatgttacttatgttaatgccaacagcactggcattccatcttacaactagagggggagaaccacatatgatcgtaactaaacaagaaagaggaaaatctttattatttaaaacaagcgcaggggtgaacatgtgtacattaattgcaatggacttaggtgaactgtgcgaagatactatgacgtataaatgtcccagaataactgaagcagaacctgatgatgttgactgttggtgcaatgcaacggatacctgggtaacctatggaacatgcagccagacaggagaacatcgccgcgataaaaggagcgtagcactagctccccacgtgggacttggactagagacaaggacggaaacatggatgtcgtcagagggagcctggaaacaaatacaacgtgttgaaacctgggcactacgtcatccaggctttacagtaatagctctatttttagctcacgtaataggtacaagtattactcaaaaaggtatcatctttattctattaatgttagtaacacctagcatggctatgagatgcgtaggtataggctcaagagatttcgtagaaggactgtcaggtgcaacttgggttgatgtagtattagagcacggatcatgtgtaacaacaatggcgaaagataaaccaactctcgatatagagttattgaaaacagaggttacaaacccagctgttttgaggaaattgtgcatagaagccaaaatatctaatacgactacagactctcgatgcccaacccagggggaagcaaccctgatggaagaacaggacgcgaatttcgtttgcagaagaacctttgtggacagaggttggggaaacggatgcgggttatttggaaaaggaagtctgataacttgcgctaaatttaaatgtgttacaaaactagaaggaaaaatagtacaatatgagaacctaaaatattcagtaatagtcactgttcacacgggagaccaacaccaagtaggaaatgaatcaactgagcatggaacaattgctaccattactccccaagcaccaacaagtgaaattcagttaaccgattatggtgccctaactctcgattgttcgccaaggacaggactagatttcaacgaaatggtgctgttaaccatgaaggagaaaagttggcttgttcacaagcaatggtttcttgatctacctttgccttggacatcaggagcatcaacgagtcaagagacgtggaacaggcaagatttgttagtcacattcaaaacagcgcacgccaagaaacaagaagtcgttgttctaggatctcaagaaggtgccatgcacacagccctgacgggtgctacggaaatacaaacatctggaacaacaaccatctttgcaggtcacctaaaatgtaggctaaaaatggataaattgactttaaaaggtatgagctacgtaatgtgtacgggatcgtttaaattagaaaaagaagttgcggaaacgcaacatggtacggtgctggttcagattaaatatgagggaaccgatgccccctgtaagataccgttctcaacgcaagatgagaaaggagtgacccaaaacggacgccttataacagccaatcccattgttacagacaaagagaaaccagttaatatcgaagcagaaccaccatttggcgaaagttacatagtaatcggcgctggtgagaaagcattaaaactcagttggtttaagaaagggtcatctattggtaagatgttcgaagcgacagcaagaggggcacgaagaatggctattcttggggacactgcgtgggactttgggagtattggaggtgtatttaccagtgtcggtaaacttgttcaccaaattttcggaacggcatatggagttttgttcagtggggtcagttggacgatgaaaatcggaatcggcgtcttacttacatggttaggtttaaacagtagatcaacgtctttatctatgacgtgtatagcagtgggactcgttactctatatttgggcgtcatggttcaagctgactcaggctgcgttataaattggaaaggacgcgaactaaaatgtggaagcggtatattcgtaacgaacgaagtacacacgtggactgaacaatataaattccaggcagattcgccaaagagactatcagctgccatcggaaaggcttgggaagaaggcgtttgtggtataagatcagcaactaggctcgaaaatataatgtggaagcaaatatcaaacgaattaaatcatatattacttgaaaatgatatgaagttcaccgtggtagtaggtgacgtagtgggaatcctagcacaaggcaagaaaatgattagaccacaacctatggaacacaagtacagctggaagtcatgggggaaagctaaaataataggagccgacgtacaaaatacaacttttataattgatggtcctaatacccccgagtgtccagatgaccaaagagcatggaatatatgggaagttgaagactacgggttcggtatttttactaccaatatctggctaaaacttcgagactctcatacgcaggtttgtgatcaccgactcatgtcagcggccataaaggattcaaaagcagtgcacgcagatatgggatactggatcgaaagtgagaaaaatgaaacctggaaattagccagagctagcttcatagaagtgaaaacgtgtatctggcctaaatctcataccctatggtcaaacggagttttggaatcagaaatgattatcccaaaaatatacggaggaccaataagtcaacataattatagaccgggctattttacccagacggctgggccgtggcacttaggaaagttagaattagattttgatctatgtgaaggcaccacagttgtggtcgacgagcattgcggaaatagggggcccagccttaggacaacgaccgtaaccggaaaaattattcatgaatggtgttgtcgaagttgtacgctgcctccgcttaggtttaaaggagaggatgggtgttggtacgggatggaaataagaccagtgaaggaaaaggaagagaacttagtaaaatccatggtgtcagccggtagtggagaagtggacagtttcagcttaggtcttctatgtatatctataatgattgaggaagtaatgagaagtagatggagccgtaagatgttaatgacaggtacgttagcggtatttctattgttgataatgggtcagctcacgtggaacgatttaatacgattatgcataatggttggtgccaatgcttcagatcgcatgggtatgggtacgacatacctagccctcatggctacctttaagatgagaccaatgttcgcagttggattactattcagaaggcttacttcacgtgaagtattactattaacaataggtttaagtttggtcgcgtcagtagaactacctaactccctagaagaacttggtgacggactagctatgggaatcatgatacttaaattactaaccgatttccaatcacatcaactatgggccaccttgctctctctcacatttataaaaacgacccttagtctacattatgcatggaagactatggctatggttctatcaatagtctcattgtttcctttatgcttatcaacaacctcacagaaaactacctggttaccagttctattaggcagtctaggatgtaaaccactagccatgcttttaatagccgaaaataagatatggggcagaaaaagctggccacttaacgaagggatcatggcagttggagttgtttcaatcctgttgtcctctctgcttaaaaatgacgtaccacttgcgggacctctgatcgcaggaggaatgttaatagcctgctatgtcatatccggatcatcagctgatttgagtttagagaaagctgctgaagtgtcatgggaggaagaagcagaacacagcggagccagtcataatatattagtggaggtacaagatgatggtacaatgaagataaaagacgaagaacgagacgacactttaaccattctccttaaagctacacttttagccgtaagtggtgtctaccctttgtctattccggcgactctttttgtatggtatttctggcaaaagaagaaacaaagaagcggagtattatgggacacaccttcgccacccgaagtagaaagagcagtattagacgacgggatctacagaattatgcaaagaggtctattaggtagaagtcaagtgggtgttggcgtatttcaagaaaatgtcttccatacaatgtggcatgtaacaagaggagcagtcctcatgtatcaaggtaagaggctagagccaagctgggcatccgtcaagaaagacctgatctcctacgggggaggatggagattacaaggctcgtggaacacaggagaagaagtacaagttatcgctgtggagcctggcaaaaaccccaaaaatgttcagaccgcaccagggacatttaaaacaccagagggggaagttggcgctatcgcccttgatttcaaaccaggaacaagtggaagtccgattgtaaacagagaaggcaaaattgttggactttatgggaatggggtagtaacaacgagtggtacgtacgtgagtgctatagctcaggcgaaggcttcgcaggaaggtccactcccagagatcgaagatgaagtgtttcggaaaagaaacctgactataatggatttacaccccggttcaggaaagaccagaaggtatcttcctgccatagttcgagaagccattaaacggaaattaagaacgttaatactggccccaacacgggtagtagcctccgaaatggcagaggctttaaagggaatgcccattagataccagactacagcagttaagtccgaacatacgggaaaagaaattgtagatctgatgtgccacgcaacttttaccatgaggttgttgtctcctgtgagggttccaaactataacatgataatcatggacgaagcacatttcactgatccatcatcaatagcagcaagagggtatatatctactcgggtaggtatgggcgaagcagctgcaatatttatgacagctactccacctggcagtgtggaggcttttccgcaatcaaatgccgttatacaagacgaagagagggatatcccagagagatcatggaactctggttatgaatggattacagactttccgggaaaaacagtttggtttgttccaagcatcaaatccggaaacgatatagcaaattgtctaaggaaaaatggtaaaagagtaatacagttatctcgtaaaacattcgatacagaataccagaaaactaaaaataatgattgggattatgtggttacgaccgacatatcagaaatgggagctaactttagggcagatagagttatagaccccaggcgttgcttgaagccagtcattcttaaggatggacctgagcgcgtgatactagcgggacctatgccggttacagtcgccagcgcggctcagcgtaggggaagaatcggacgaaatcataacaaagaaggggaccaatacatatacatgggacaaccattaaataacgacgaagatcatgcacattggaccgaggcgaaaatgttattagataatataaacacgccggaaggtataatacccgcattattcgagccagaacgtgaaaaatcagcggcgatcgatggggaatatcgattacgtggagaagcaaggaaaaccttcgttgaattgatgcgtagaggagatttgccagtttggctatcttacaaggtcgcgagtgagggctttcaatatagtgacagacgatggtgctttgatggagaaagaaataatcaagttttggaggaaaatatggatgtggagatatggacaaaagagggtgaacgaaagaagttgcgtccaagatggttagatgctaggacctactcagacccattagcactaagagaatttaaggaatttgcggcaggccggcgttcggtctcaggcgatttaatacttgaaatcggtaagctaccacagcatctgactcagagggcacaaaacgctctcgataacctcgtgatgttacataattcggaacaaggaggcagagcatacagacatgcaatggaagaattaccagacaccatagaaacgttaatgctgttagcattaatcgcggtccttaccggtggcgttacactgttctttttgagtggaagaggtttagggaagacgtctattggccttctgtgtgtcatggcgagctcagtactactctggatggcctcagtggagccccactggattgcggcgtctattatcttagaatttttcctaatggtattattaataccggaaccggatcgtcaaaggactccacaagacaatcagctagcctatgtagtaataggcctactattcatgattttaacggtagccgccaacgaaatgggtttacttgaaactacaaagaaggatttaggtataggccacgtcgccgttgaaaatcatcaccatgcaactatgttagatgtggatttgcacccggcttcggcttggaccttgtatgccgttgcgacaacaataataacacccatgatgaggcacacaatagaaaatactacagcaaatatcagcttaacagcaatagctaatcaagctgcgatattaatggggctagacaaaggatggcctataagcaaaatggatataggagtccccttgttagctttgggttgctatagtcaagtcaatccgttgacattaacagcagcagtgttgatgctcgtggctcattacgcaatcataggtcccgggctgcaagcaaaagcgacacgagaagctcaaaagcggaccgccgccgggatcatgaaaaacccaacggtggacggaatcgtcgcgatagacctagatcctgttgtctacgacgccaaattcgaaaaacagttaggacaaataatgttacttatattgtgcacaagccagatattactaatgaggaccacatgggcgctatgcgagtccataactctagcgacaggtcctctcaccaccctgtgggagggatctcctggaaaattttggaacaccacgatcgcagtatcaatggctaatatatttagaggctcatacctggccggtgctggattagcttttagtctgatgaaatcactaggcggagggcggagaggaactggggcacagggagaaacgcttggagagaagtggaaaagacaattaaaccaattaagtaaatctgagttcaatatttataagagatcgggaataatggaagtagacagatccgaggctaaggaagggctgaaaagaggagaaacaaccagacacgcggtaagcaggggcacggcaaaattaaggtggttcgttgaaagaaatctcgtcaaacctgaaggaaaagtgatagatctgggatgtggaagagggggatggagttactattgtgccggactcaagaaagtaacagaggttaaaggatacacaaaaggtggcccgggacatgaagaaccgataccaatggcaacatatggatggaatcttgtaaaactacattctggtaaagatgtattctttacaccgccagagaaatgtgatacactgctatgtgatatcggagaatcaagtcctaatcctaccatagaggaggggaggactttaagagtattaaaaatggtcgaaccatggctgcgaggaaaccaattttgtattaaaatattaaatccttatatgccaagcgtcgttgagacacttgagcaaatgcaacgtaaacatggtggcatgcttgtaaggaacccactgtcaagaaatagtacacatgaaatgtattgggtatcttgtggaacaggcaatatagttagcgcggttaacatgacttctcggatgttgttgaaccgctttactatggctcatagaaaacccacgtatgagagagacgtagacttaggggctgggacgaggcacgttgcagttgaaccagaagttgctaacttagatataataggacagagaatcgaaaatattaaacatgaacataaatcaacttggcattatgatgaggacaacccttataaaacatgggcttaccatgggagttatgaagttaaaccaagcggatctgcatcaagtatggtaaacggcgtagttaaactgctcactaaaccttgggacgtaatccccatggttactcaaatagcaatgacagacacaacgcccttcggacagcaaagagtctttaaagaaaaggtcgatacaagaacacctaaagccaaaagaggcacagctcaaataatggaggtgactgcgagatggttatggggttttctttcgcggaataagaaacctagaatatgtacacgtgaagagtttactagaaaagttcgatcaaatgcagcaattggggcagtttttgttgatgagaatcaatggaatagcgctaaagaagcagttgaggatgaacggttttgggatttagtacaaaaagaaagagaattgcacaaacaggggaaatgtgcaacatgtgtttataacatgatgggaaaacgtgaaaagaaattaggagaatttggaaaagcaaaagggagtagagctatctggtacatgtggcttggagcaaggttccttgagttcgaggccttaggattcatgaatgaagatcactggttttcccgggagaacagcttaagtggagttgaaggagaaggtctgcataaactaggctacatactaagagatattagcaaaataccaggtgggaacatgtatgccgatgatacagctggatgggacacacgtataacagaagatgatctccaaaatgaagcaagaataactgacatcatggagcctgagcatgcattgctagcaacgagtatttttaaattaacatatcaaaataaggtagtacgtgtacaacgccccgccaaaaacgggacagtgatggatgtaatatcacgacgtgaccagagaggcagtggccaagttggaacctacggattaaacacatttactaacatggaggctcaactgatccgacaaatggaatcggaaggtatatttttaccatcagagctggagacccaaaatttagctgagagagtactagactggctagagaaatacggagtcgaaaggctcaaaaggatggcgatttccggggacgactgcgtagtaaagcccatagacgacaggtttgcaacagccctgacagcgttaaatgacatgggcaaagtaagaaaggatatccctcaatgggagccctctaagggatggaatgactggcagcaagtgccattttgttctcaccacttccatcagcttatcatgaaggacggaagggaaatcgtagttccatgccgtaaccaggatgaattagtagggagggcaagagtctctcaaggagcaggatggtccttacgagaaacggcatgtttgggtaaatcttacgctcaaatgtggcaactaatgtactttcatagaagagacttaaggttagcagcaaacgcaatatgctcagcagtaccagttgattgggtaccaacctctagaacaacttggagtatacatgcccaccatcaatggatgactacagaagacatgttgtccgtatggaaccgggtatggatcgaagaaaatccttggatggaagacaagactcatgtatcaagctggggtgacgtcccatatctaggaaaaagagaggaccaatggtgtggatctttaataggactaacagcaagggctacttgggctagtaacatacaagttgcaataaatcaagtccgaaggttgataggcaatgaaaactacctagactacatgacaagcatgaaaaggttcaaaaacgaaggtgatccagagggagccttatggtga

SEQ ID NO: 21527 - RNA, 9879 nt, synthetic construct
  misc_feature 1..9879: note = derived and/or modified CDS sequence (opt6) from DENV-1__FJ432730__SS-prME
  source 1..9879: mol_type = other RNA
tcggtcactatgttgctgatgttaatgcctactgcactagcttttcatttaacgacacgaggaggggaacctcatatgattgtatcaaaacaagaaaggggtaaaagtttattattcaaaactagcgcaggagtaaatatgtgtacactgattgcaatggacttgggtgagttctgtgaagataccatgacttataaatgtccgcgaatcacagaggcggaaccagatgacgtagactgctggtgcaatgctacagacacttgggtcacttatggaacgtgcagtcaaactggagagcacagacgagacaaacgtagcgtcgctttggcgccgcatgtcgggctgggcttagaaacacgtacggagacatggatgagcagcgaaggtgcatggaaacaaatacaacgtgtggaaacttgggctcttagacatccaggatttacagtgatagcactatttttagcgcacgccatagggacttctatcacacaaaaaggtatcatattcatactattgatgttggtaacacccagtatggctatgagatgtgtgggaatagggtcccgcgacttcgtcgaaggattatcaggagcgacctgggtagatgttgtactggagcacggaagttgtgtcactacaatggcaaaagataaacctactttagatatagaacttttgaaaactgaagttactaatccagcagtcctacgcaaattatgtatagaagctaaaatatccaacacaacgacagattcccgttgccccactcaaggagaagcgactctagtagaggaacaagacgcaaacttcgtctgtcgtcgaacatttgtagataggggatgggggaatgggtgcggattatttggaaaaggatccttaattacatgcgcaaaatttaaatgtgtaactaaactcgaaggtaaaacggttcaatatgagaatttaaaatattcggtaatagtaacggtacacacaggcgaccagcaccaagtaggcaatgaaagtaccgagcacggtactaccgcgacaattacgcctcaagcaccctccacagaaatccaactaacggactacggcgctctaactctcgattgctccccaagaactggattagacttcaatgaaatggttttattaacaatgaaagaaaaatcgtggcttgtacataaacaatggtttttggacctaccgttaccttggacaagtggagcttctacatcacaagaaacgtggaaccgaaaggatctgcttgtgacgttcaaaactgcccatgcgaagaaacaagaagtggtagtgttggggtcgcaagaaggagcgatgcatacagcactaacaggagcaaccgaaatacagacatctggtatgacaactatctttgcaggtcacttaaaatgtcggcttaaaatggataagttgactttaaaaggaatgtcttacgtgatgtgcacaggctctttcaaattagaaaaggaggtagccgaaacgcaacacggcactgttcttgtgcaaataaagtacgagggcaccgacgcaccttgtaaaatcccctttagtacacaagacgaaaaaggcgttacccaaaatggaagactaataaccgctaacccaatagtaaccgataaggaaaaacccgtaaacattgaagccgaacctccatttggagaaagctacatcgtcataggagcgggagaaaaggctcttaaattatcatggttcaagaaaggaagtagcataggtaaaatgtttgaggcaacggcaagaggcgcaagaaggatggccatattaggcgatacagcatgggactttgggtccattggcggtgtattcacttcagtaggtaaactggtacatcagatatttggaaccgcatacggcgtactgttctcgggagttagctggactatgaaaataggaataggagtattattaacgtggttgggtctcaattctagaagcacttcgttaagcatgacgtgtattgctgtcgggttagttacattatatctcggcgttatggtgcaggcagactccggttgtgtgataaattggaaaggacgagaattgaagtgtggcagcgggatttttgtaaccaatgaagtgcatacctggacggagcaatataaattccaagcagatagcccaaaaagactatcagcagcaatagggaaggcatgggaagagggagtttgtgggattcgcagtgcaacaagattagaaaacattatgtggaagcaaatatctaacgaacttaaccacatcttgctggaaaacgacatgaaatttacagttgtcgtaggtgatgtggcgggaatcttagcgcaaggcaagaaaatgatcagaccccagccaatggaatataaatactcatggaaaagctggggcaaagctaaaataataggtgccgatgtacaaaacacaacttttataatagatggtcccaacactccggaatgccccgacgaccaaagagcgtggaacatatgggaagttgaagactatggattcggtatttttaccacgaatatttggttgaaattaagagatagttatacccaagtctgcgatcatcgactaatgtcagcagcgataaaagattcgaaagcagtacatgccgacatgggttattggatagagtcagagaaaaatgaaacgtggaaattagcgagagccagctttatagaagtgaagacctgtatttggccaaaatcacataccttatggtctaacggggtgttggagtcagaaatgattatacctaaaatatatggtggcccaatttcacaacataactatagaccaggttactttacgcaaacagcaggtccctggcatctaggtaaactcgagcttgacttcgatttgtgcgaaggaacaacggttgtggtagacgagcattgcggaaatagggggccttcgttaagaacaacaactgtaacggggaaaatcatacatgaatggtgttgcagaagctgtactcttccccctttgaggttcaagggtgaagacggctgctggtatggaatggaaatacgtccagtaaaagaaaaagaagaaaatcttgtcaagtcaatggtcagtgctgggagtggggaggttgattccttttctctgggacttctttgtattagcataatgatagaggaagttatgagaagtagatggtctaggaaaatgcttatgacagggaccctggccgtgttctttctgctaataatgggtcaattaacctggaatgacctaataagattatgtataatggtaggagcaaatgcgagcgataggatgggaatgggcacaacttatttggcgttaatggcaacatttaagatgagacctatgttcgctgttggactgctatttagacgacttacatcgcgtgaagttctactcttaactattggattgagtcttgtcgcgtccgtagagttaccaaactctctagaggaacttggcgatggtttagctatgggaataatgattttgaagttgttgacggacttccaatcacatcaactttgggcaactttattaagtttaacctttataaaaacaacgtttagcttacactacgcttggaaaacgatggctatggtattaagtatagtatctctttttccgctctgtttatcaactacctcacagaagacaacgtggttacccgtcctattagggagtctaggctgcaaaccattgactatgtttttaatagctgagaacaagatttggggtcgaaagagttggccattgaatgagggcataatggctgtaggtatagtttcaatcctactcagtagtctgctcaaaaacgacgtaccgttggcaggccccttaatagctggaggcatgctaattgcctgctatgtcatatctgggtcaagcgcagatctttctttagaaaaggctgccgaagtttcatgggaggaagaagctgagcattccggagcgagccataatattttggttgaagtacaggacgatggaaccatgaaaatcaaagacgaagaacgggacgatacacttacaattttgcttaaagctactctgctcgctgtgtcaggcgtatacccattatccataccagcaacacttttcgtttggtatttttggcagaagaagaaacaaaggtctggtgtattatgggatactccatcaccaccagaagttgaacgagctgtcttagatgacggtatatatagaattatgcaaaggggattattaggccggagtcaggtaggagtgggagtcttccaggaaaatgtgttccatactatgtggcacgtgacaaggggcgccgtcctaatgtatcaaggcaaaaggcttgaaccctcgtgggcttcagttaagaaagatttaatcagctacggagggggttggcgtttacagggaagttggaatacaggcgaagaggtacaagtaatagcagtagagccaggtaaaaacccgaaaaatgtacaaactgcccctggcacttttaaaacctcagaaggagaagttggagcgatagcgctcgatttcaaaccaggaacatcaggaagccctattgtgaaccgtgagggcaaaatagtcggtttatatggaaacggtgtagttacaacgagtgggacatatgtatccgctatcgctcaagctaaagcgagccaggagggtcctctaccagaaatagaggatgaagtctttagaaaacgtaatttgacaataatggaccttcacccaggatcgggaaagaccagacggtacttacctgcgatagtccgagaagctataaaaagaaaactaaggacattaattttagcgccaaccagagtagtcgcaagtgaaatggctgaagcacttaaaggtatgcccataaggtatcaaacaaccgcggtaaaatcagagcatacagggaaagagatagtcgatttgatgtgccatgcaacattcacaatgaggctactgtcaccggtaagagtgccaaactataacatgataattatggatgaagcgcactttaccgatccttcatccatagccgcaagaggatacatcagtactagggtaggtatgggcgaagctgcagcaatttttatgacagcaacaccaccaggttctgtagaggcctttccacaatcaaatgctgtaatacaagatgaagaacgggacatcccagaacgatcgtggaacagtggctacgaatggattacggatttccctggtaagaccgtttggttcgtaccatctataaaaagtggaaatgatatagcaaattgtcttaggaaaaacggaaagcgagttatacaattatctaggaaaacctttgacacagagtatcagaaaactaaaaataacgattgggattatgtagttacgacagatatcagcgaaatgggagcaaattttagagcagatcgagtaattgatccacgcagatgccttaaaccggttatattaaaagatggtccagaaagggtgatactcgctgggccaatgcccgttactgttgctagcgccgcacaaagacgagggagaattggacgcaaccataacaaagaaggtgatcaatacatatacatgggtcaacctttaaacaatgacgaagatcatgcacattggacggaagctaaaatgctattggacaacatcaacactcctgaaggaattattccagcgctattcgagccagaaagagagaaatcagcagcgattgacggagaatatcgtctcagaggtgaggcacgtaaaacttttgtggagctaatgagaagaggcgatttgcccgtgtggctttcatacaaagttgccagcgagggattccaatattcggaccgtagatggtgttttgatggtgaacgcaataaccaggtcctagaggagaacatggatgtagaaatttggacgaaagaaggagagcgtaagaaattacgccctcggtggctagatgctagaacatactccgatccacttgcattaagagaatttaaggaatttgcagcaggtaggcgtagtgtatcaggagatttaatattggaaataggcaaactaccacaacatttaacacaaagggcacaaaatgcgttagataatttggtaatgttacataactctgaacaaggcggacgcgcttaccgacatgctatggaagaattaccagatactatagaaacactgatgctactggcactcatagccgtattaacaggtggggtaacgttgttctttctgagtggaaggggactcgggaagacaagcattggtctcttatgcgttatggcatcctccgttttattatggatggcatcggttgaaccgcattggattgcagccagcattatattagaatttttcctcatggtcttactaatcccggaaccagatcgacagaggacaccgcaagacaaccagctggcgtatgtagtaatcggtctcctatttatgattttaactgtggcagctaatgaaatgggtctactagaaacaacgaagaaggatctaggaatcggacatgtagcggttgaaaaccatcaccacgcagcaatgctagacgtcgacctacatcccgcctcggcatggactctatacgcagtggcgacaacaattataacacctatgatgagacacactattgagaacacgacagctaatattagcttaacagcgatcgcaaatcaagccgctatactgatggggctcgataaaggttggccaataagtaaaatggatatcggtgtccctttgttagctctaggatgctactcgcaagttaatcctcttaccttaacagcagctgtccttatgttggtcgcacattatgcgataataggacccggattacaagccaaagcaacacgagaagcacaaaaacggaccgctgctgggataatgaaaaatcctaccgtagacggaatagtcgcgatagaccttgacccagtcgtttatgatgccaaattcgaaaagcaacttgggcaaatcatgctattaattctatgtacctcacaaatattgttaatgaggacaacatgggccttatgcgaatcgatcactctcgcaacaggaccactgacaactctatgggagggtagtcccgggaaattttggaatactaccatagcagtctcaatggcgaatatatttcgtgggagttatctggcgggcgcaggattagcattctctctaatgaaatcactcgggggcggacggcggggtacaggcgcacaaggggagaccctaggagaaaaatggaaaaggcaattgaatcaactaagcaaaagtgaatttaatacatacaaaaggagtggaataatggaagtggacagatccgaagctaaggaaggtctaaaaaggggtgagaccaccaaacacgccgtaagtcggggaacagcgaaactaagatggttcgtagagaggaacctggtaaaaccagagggcaaagtcatagacctagggtgtgggagaggaggatggtcatactattgtgccggcttaaagaaagttacagaagtgaaaggatacactaaaggagggcccggccatgaagaaccgatacccatggctacttacggatggaatttagtaaaacttcatagcggcaaagacgtcttctttataccacctgaaaagtgtgatacacttctgtgtgatataggggaatccagtcctaatccaactattgaagagggaagaacactaagggttcttaaaatggtagagccatggttacgaggaaatcagttctgtataaaaatcttgaacccgtatatgccatcagtggtagagactttagaacaaatgcaaagaaaacatggaggtatgcttgtcagaaatccgctaagtcgcaactcaacgcatgaaatgtactgggtctcctgcggaactggtaatatcgttagtgcagtaaatatgacaagtaggatgctactgaaccgatttacaatggcccatcgtaaaccgacctacgaacgagacgtagatttgggagctggtacaagacacgtagctgtcgaaccagaagtagccaatctagacataataggtcaaagaatagaaaatataaaacatgagcacaaatcaacttggcattacgatgaggataacccttataaaacatgggcgtatcatggctcttacgaggttaagccgtctggatctgcttcgtctatggtaaatggagttgtgaagttattaaccaagccgtgggatgtgataccaatggtgacacaaattgcgatgacagacacaaccccgtttggacaacaaagagtttttaaagaaaaggtcgacacaagaacgccgaaagcgaaaagaggtacagcccaaatcatggaagtaactgctaaatggctttggggatttttatcgcgcaataagaaaccaagaatatgcaccagagaggaatttactagaaaagtaagatcgaacgctgcaattggagcagtttttgtagatgaaaaccaatggaacagtgcgaaagaagcggtagaagacgaaagattttgggatttggtccatcgagagcgcgagctacacaagcagggaaaatgtgccacgtgtgtgtacaatatgatgggtaaaagagagaaaaagttaggtgaatttggcaaagctaaggggagcagagctatatggtatatgtggttgggagcacggttcttagagtttgaagcacttggttttatgaatgaagatcactggttttctagggaaaacagtttaagtggtgtcgagggcgagggtctacataaattgggatacatattaagggacatatccaaaatacctggtggaaacatgtatgctgacgacacggccggatgggacactagaattacagaggacgacttgcagaatgaagcaaaaatcacagacataatggaacctgagcacgccttattagccaagtctatattcaaactgacatatcaaaataaggtggtacgtgtacaaagaccagccaaaaatggcacagtgatggacgtaatctcaagacgtgatcaaagaggcagcgggcaagttggtacttacggactaaatacatttactaatatggaagctcagctaattagacagatggaatcagaaggaatcttttcgccctctgaactagagacacctaatctagcaaggagagtactggactggttggaaaagcacggagtcgagagactaaaacgaatggctataagcggagacgactgtgtagtaaaacctatagacgatagatttgcaactgcactaaccgcgcttaatgatatgggtaaagtcagaaaggacattcctcaatgggaaccctctaaagggtggaatgactggcagcaggtaccattctgtagccaccattttcatcaattgattatgaaagatggtagagaaatagtggtcccatgtcgcaatcaagacgaattagtaggtcgcgcgagagtatctcaaggtgcgggttggagcctaagggaaaccgcatgtctcggtaagtcttatgcgcagatgtggcaactcatgtactttcatcggagagatctaagacttgctgcaaacgcaatttgctcagcagttccagtggattgggtgcctacaagtcgaactacatggtcaattcacgcacatcatcaatggatgactacagaagatatgttatcggtatggaatagagtctggattgaagaaaacccttggatggaagataaaacccacatctcctcgtggggtgatgtaccatatctaggcaaaagagaagaccaatggtgtgggagtctgataggcttaaccgcacgggctacttgggctaccaatatccaggttgctatcaatcaggtacgaagactcattggaaatgagaattacttagattatatgacatcaatgaaaaggttcaaaaacgagtcagacccagaaggtgctttatggtaa

SEQ ID NO: 21528 - RNA, 9879 nt, synthetic construct
  misc_feature 1..9879: note = derived and/or modified CDS sequence (opt6) from DENV-1__FJ432732__SS-prME
  source 1..9879: mol_type = other RNA
tcggtaacgatgttattaatgcttatgccgaccgcactggcttttcatctaaccaccagaggtggagaaccacacatgatagtatcgaaacaagaaaggggtaaatccctactttttaaaacctcagcaggagtaaacatgtgtaccttaattgcaatggatttaggagaattgtgtgaagatactatgacttacaaatgcccgcgaattactgaaaccgaacctgatgatgtggattgctggtgtaatgcgacggacacctgggtaacctatggtacatgtagtcaaacaggagaacaccgccgagataaaagatctgttgccctggcaccacatgtagggctcggattagaaacaagaactgaaacttggatgagttccgaaggtgcatggaaacaaatacaacgggtagaaacctgggcactacgacatccaggtttcacagttatagcactctttttagcacacgtaattggaacaagtattacacaaaaaggtataatttttatactattaatgcttgtaactcccagcatggcaatgcgttgtgttgggataggatcaagggatttcgttgaaggtttaagtggggctacttgggtagatgtggttttggaacacggctcatgtgttacaactatggcaaaagataaacctacgctggacattgaactcttaaaaacagaagtcacaaatcctgctgtattacgtaagttgtgtatagaagccaagatttcgaatacaaccactgatagccgttgtcctactcaaggggaagccacacttgtagaagaacaagatgctaactttgtatgtaggcgcacttttgtagatagaggttgggggaatgggtgcggattattcggaaagggatctttaataacatgcgctaaatttaaatgtgtaaccaaacttgaaggcaaaatagtccaatacgaaaatctaaaatattcagtcatcgtcaccgtccataccggagaccagcaccaagtgggtaatgagtccacagaacatggaacaacagcaacgattacacctcaggcgcctacaacagaaatccaactcacggattatggagctttaacactcgactgttcaccaagaacgggactagacttcaatgaaatggtgttattaacaatgaaagaaaagtcctggctcgtccacaagcaatggtttctagaccttccattaccctggaccagtggtgcatcaacgtctcaagaaacttggaacagacaagacctcttagtaacctttaaaacggcacacgccaagaaacaagaagttgtggtactcggatcacaggaaggagccatgcatactgctctaaccggggccacagaaatccaaacttccggaacaacgactatcttcgctgggcatttaaaatgcagactcaaaatggataaacttacattaaaaggaatgtcatatgtaatgtgcacagggtcctttaaactcgaaaaagaagtggctgaaacccaacacgggacagtattagtacagataaaatacgaaggaacagatgctccttgtaaaatccctttttctacacaagatgaaaaaggagttacccaaaacggaagattgattacggccaacccaatagtaactgataaggaaaaaccagttaacatcgaagctgaaccacccttcggagaatcttatataacaataggcgccggtgaaaaggctttaaaacttagttggttcaagaaaggttcgtctatcggcaaaatgtttgaagccacagccaggggagccagacgtatggcaatactcggagacacagcctgggactttggctcaataggtggtgtgttcaccagtgtaggtaagttggttcatcagatatttggtacagcatatggtgttctgtttagtggggttagctggacaatgaaaataggcataggagtcctcctaacgtggttgggactaaattcccggagcacaagtctctcaatgacatgcatcgccgttggcttagtaacgctttatcttggagtaatggtacaagctgatagcggttgtgtgattaactggaagggtcgagaactcaaatgtggtagtggcatatttgttacaaacgaagtccatacgtggacggaacaatataagtttcaggcagatagtccaaagcgattgtcagctgccatcggcaaggcctgggaggaaggagtttgcggaataaggtcagcaaccagactagaaaatataatgtggaagcaaattagtaatgagttgaatcacattcttctggaaaatgacatgaagtttactgtcgtcgttggtgacgtcgctggcatttttgcgcaaggtaagaaaatgatcagaccgcaacctatggagtataagtactcatggaagagttggggaaaagctaaaataattggtgctgacgtccaaaacacaacattcataattgacggaccaaacacccccgagtgccccgacgatcagagagcatggaacatctgggaggtggaggactatggttttggcatattcactacaaatatttggttaaaattaagagattcatatacgcaggtttgtgaccacaggttaatgtctgcagcaataaaagatagtaaggcagtccatgctgacatgggctattggattgagagtgagaaaaatgaaacatggaagttggcaagggctagttttatcgaagtaaaaacatgcatctggccaaagtcacatacattatggagtaatggcgtcttagagagtgaaatgatcatcccgaagatatacggaggacccatcagccaacacaactaccgccctggatatttcacacaaactgctggaccttggcatttaggcaaactcgagctggatttcgatttatgtgaagggacaacagtagtagttgacgaacattgtggaaacagaggcccatcattgcgcacgaccacagttactggaaaaattatacacgaatggtgttgtcgatcctgtactttaccccctttaaggttcagaggtgaagacggttgttggtatggaatggagatcagaccggttaaagaaaaggaagagaatcttgtaaaatccatggtaagtgcaggtagcggagaagttgacagcttcagtctgggcttattatgcattagcattatgatcgaggaagtaatgcggtcgcgttggtcacgtaaaatgctaatgacaggaacactcgctgtattctttttattaattatgggtcaattgacatggaacgacttaatccgtctttgtatcatggtaggagccaatgcatcagatcggatggggatgggtacaacatatttagctctgatggcaacctttaagatgagacctatgtttgcagtcggcctgttattccgtcgtctcacgagtagagaagttttgcttttgaccatcggactaagcctagtggcgtcggtggaattaccaaattctttggaagaactaggtgatgggctagcaatggggataatgatactaaaattactgaccgatttccagtcacatcaattatgggctacattattaagtttaactttcattaaaactacgtttagtttacattacgcgtggaaaactatggctatggtccttagcatcgtaagtctctttcctctttgtttaagtacaacatcacagaaaactacatggctaccggtactcttggggtcattagggtgcaaaccactaacgatgtttttaatagctgagaataaaatttggggtcggcgatcctggccactgaatgaaggaattatggcagttggaatagtaagtatcctgctatcatcattattgaaaaatgatgtacccctagctgggccattaattgctggtggaatgctaattgcgtgttatgtcatatctggttctagtgctgatttatcactagaaaaagccgcagaagtatcgtgggaagaagaagcggaacactcaggcgcaagccataatattctagtagaagtccaagatgatggaaccatgaaaattaaagatgaagaacgggacgatacattaacaatattactcaaggccactttattggccgtatccggggtgtatcccttaagtattccagcgacattattcgtatggtatttctggcagaagaaaaagcagcgaagtggagttttgtgggacacgccttctcctccagaggtcgaaagagcagtactagacgacgggatatatagaattatgcaaaggggtttactcggtcgttcccaggttggagtaggtgtgtttcaagaaaatgtattccacacaatgtggcacgttactagaggggccgtactgatgtatcaaggaaaaaggctagaaccaagctgggcatctgtcaagaaagacctgataagctatggcggtggttggcgactccaggggtcatggaacaccggagaggaggtccaagttattgccgtagagcctggcaaaaatcccaaaaatgtacaaacagctcccggtacattcaaaacgccggagggagaagttggagccattgcattagactttaaaccaggtacatctggttctccaatagttaaccgagaaggaaaaatagtcgggctttatggcaatggagttgtaacaacatcagggacatacgtgagcgcaatagcacaagcaaaggcgtcacaagaaggacccctaccagagatagaggatgaagtttttagaaagagaaatttaacaattatggatttacatcctggtagtggcaaaacacgacgatatcttcctgcaatagttagagaggcaataaaacgtaaattaagaactctcatactcgcacctacaagagttgtagcatcagaaatggcagaggctcttaaaggaatgccaatccgatatcagaccacagctgtgaaatcagagcacacagggaaagaaatagtcgacttgatgtgccacgcaacattcacaatgagacttttgtcacccgtccgagtacctaactataatatgataattatggatgaagcacattttacagacccgtcaagcattgctgcacgtggatatataagtactcgggtagggatgggggaagcagcagcaatatttatgactgctacacccccaggttcagtagaagcgttcccacaatcaaatgccgtcatacaagatgaagaacgtgatatccccgagcggtcttggaactctggatacgaatggataactgactttcctggaaagaccgtttggtttgtcccgagcataaagagtggaaacgacatagcaaattgccttcggaaaaatggtaaaagagtaatacaactctctaggaaaactttcgatacagaataccagaaaaccaaaaataacgattgggattacgtagtcacgacagacatatcggaaatgggggcaaattttagagcggatagggtgatagatccacgtagatgtctcaaaccagtcatcttaaaagacggacctgaaagggtcatattggccggccctatgccagtgacggtagcgtccgctgcacaaaggagagggcgtataggacgaaaccacaataaagaaggagaccaatacatttatatgggacaaccgttgaataacgatgaggatcatgcacattggacagaggcaaaaatgctcttagataatatcaatacccctgaaggaattatacctgccttgtttgagccagaacgagagaaaagcgccgcgatagacggcgaatatagattaaggggagaggcccggaagacctttgtagaactcatgcgaagaggggatttaccagtttggctatcctataaggttgcatccgagggcttccaatatagcgacagaagatggtgtttcgacggagaaagaaacaaccaagtgttagaagaaaatatggatgttgagatatggaccaaggaaggggaaagaaagaaactaaggcctcgatggctagacgctagaacgtactccgatccattggcgctacgagaatttaaagagttcgcagcgggaagacggagcgtgtcaggagatctaatattagaaatcggtaaactaccacagcacctcacgcaacgtgcccaaaatgctttagataacttagtgatgttacacaacagtgagcagggtggccgcgcctatagacatgccatggaagaactaccagatacaatagagacattaatgctactggcattaatcgcagtccttaccggaggtgtaactttatttttcctatctggacggggtttaggaaaaacatcaattggcttactatgtgtaatggcatcgtcggtactactgtggatggcatctgttgaacctcattggattgctgcatctataatactggagttctttcttatggtactcttaatacccgagccagatcgacaaaggacaccccaagataaccaattagcatatgtagtgattggacttttatttatgattctaaccgtagccgcaaatgaaatgggtctactagaaacaactaagaaagacttaggaattggccacgtcgccgtagaaaatcatcatcacgcagccatgctggacgtagacctacaccccgcgtcagcatggacattgtatgctgtagcaactactattattacacccatgatgcgacatactatcgagaataccacagcaaatataagtctaacagcaatagctaaccaagcggcgatattaatgggcctcgacaaaggctggccgatctcaaaaatggacataggggtaccgttacttgccttgggatgttatagccaagtaaatcctttaacactaacggctgcagtgttaatgttagttgcccactatgccatcatagggcctggactacaagcgaaagcaaccagagaagcacagaaaagaacggcagcaggaataatgaaaaatcccacagttgatgggattgtagctatcgatttggaccctgtggtttatgatgccaagtttgaaaaacaattgggacaaattatgttgttaatattatgtaccagccaaatactacttatgagaacgacatgggccttatgtgaaagtattacattagccactggacccttgactacactgtgggaaggcagcccagggaaattttggaacacaacaatcgcagtcagtatggcaaacattttccgaggatcatatttagctggtgcgggacttgccttctcattaatgaaatcattagggggaggaagaagaggcacaggtgcgcaaggagagacgttgggggaaaaatggaagcgacaattaaatcaactaagcaaaagcgagttcaacacctataaacgaagcggtatcatggaagttgatcggagtgaggcaaaggaaggtctgaagagaggtgaaacaactaagcatgctgtaagccgaggtacagctaaacttagatggttcgttgaaagaaatttagtgaagccggagggcaaggtaatcgatctcggctgcgggaggggcggatggtcctattattgtgcaggactgaagaaagtaacggaagttaagggatacactaagggtgggcctggccatgaggaacccattcctatggcgacatatggttggaatctcgtaaaactacattcgggtaaagacgttttcttcatacctcccgaaaaatgtgatacattactttgtgacataggcgaaagtagtcctaatcctactatagaggaaggtcggactttgcgtgtactcaaaatggtggaaccgtggttgagaggtaaccaattctgcattaagattctcaacccatacatgccatcagttgtagaaaccctggaacaaatgcaacgtaaacatggcggtatgctagtcagaaatccccttagtaggaactcaacacacgaaatgtattgggtgagctgtggcacgggcaacattgtatctgcggtaaatatgacatctcgtatgttgcttaatagatttacgatggcgcatcggaaaccaacttatgagagggatgttgacctaggagcaggcactagacatgttgctgtagaaccagaggtagcgaatcttgatataattgggcaacgaatagaaaatataaagcacgagcataagtcaacttggcactatgatgaagataatccttacaaaacatgggcctatcatggatcttatgaagtgaaaccctctggttcagcttcatcgatggtaaatggagtcgttaaattattaacaaaaccttgggatgtcatacctatggttactcagatagcaatgaccgatacaactccatttggacaacagagagtttttaaagaaaaagtagacacgagaactccgaaggctaagcgcggtacagctcagatcatggaagtaacggcgaaatggctttggggctttctgtctaggaataagaaaccaagaatctgtacaagggaagaatttacccgaaaagttcgtagcaacgcggcaataggcgcagtatttgtcgacgaaaaccaatggaatagcgctaaggaagctgtagaggatgaacgattttgggacttggtacatcgagaacgagaacttcataaacaagggaaatgtgctacatgtgtttataatatgatgggaaagcgagagaagaaacttggagagttcggcaaagctaaaggcagcagagcgatttggtatatgtggctaggtgctagattcctcgagtttgaagcactaggtttcatgaatgaagaccactggtttagccgtgagaatagtcttagtggtgtggagggtgaagggttacacaaactaggatatatattaagagacatctcgaaaattccaggtggaaatatgtatgcagatgatacagctggctgggatactagaattaccgaagatgacttacaaaacgaagcacgaatcactgatattatggagccggaacacgcacttcttgctaaatcaatctttaaattgacttatcaaaataaagtagtacgagtccagcgccccgccaaaaacggcactgtaatggatgtgatatccaggagagaccagcgcggctcggggcaagtaggtacatacggattaaacacgtttacaaacatggaagctcaattaataagacagatggaaagcgaaggaatattctcaccttcagagttggaaaccccaaatttagcagaaagagtactcgactggttagaaaaatatggagtagagcgattaaaacgtatggccatcagcggagatgattgtgtggtaaagcccatagacgacagatttgccacagcactcactgctctaaatgatatgggaaaagtcagaaaagatatccctcaatgggaacccagtaaaggatggaatgactggcagcaggttcctttttgctcgcatcacttccatcaacttattatgaaagatgggcgagaaattgttgtaccgtgcagaaatcaagacgagttagtagggagagcaagagtctcccaaggcgcagggtggtccctgcgggaaactgcatgtctcggtaagtcttacgcacaaatgtggcaacttatgtactttcacagacgagatctgaggcttgccgcaaacgccatatgtagcgcagttccggtagattggattccgacaagcagaacgacctggagcatacatgctcaccatcaatggatgaccaccgaagacatgttgtcagtttggaacagggtatggatagaagaaaacccatggatggaggacaaaacacatatatcctcatggggtgacgtcccctatttaggtaaaagagaggatcagtggtgtgggagtttaataggtcttactgctagagctacatgggcgactaatatacaagtagcaattaatcaggtacggaggttaatagggaatgaaaactatcttgattatatgacaagtatgaaacgtttcaaaaacgagtcagaccccgagggcgctttatggtaa

SEQ ID NO: 21529 - RNA, 9879 nt, synthetic construct
  misc_feature 1..9879: note = derived and/or modified CDS sequence (opt6) from DENV-1__FJ432733__SS-prME
  source 1..9879: mol_type = other RNA
tctgtaactatgctgctaatgctaatgccgactgcattagcatttcatctgacgacaagagggggagaaccgcacatgatagttacgaaacaagaaagaggcaaaagcctacttttcaaaacctcagcaggcgtgaacatgtgcactctaatagcaatggatttaggagaattatgcgaagatacaatgacttacaaatgccctagaatcacagaagttgaacctgacgatgtggactgttggtgtaatgcaacggacacgtgggtaacttacggaacctgtagccaaacaggagaacatcgtagagataaacgaagcgtagcactagctccacacgtgggattagggctggaaactcgaactgaaacgtggatgagctccgaaggagcttggaaacaaatacaacgcgtagaaacatgggcattaagacatcccggttttacagttatagctcttttcttagcccatgtcatcgggacaagtattacacaaaaaggcatcatattcatcctccttatgttagtgactcctagtatggctatgcgttgtgttggaataggatcacgtgattttgtagaaggactatccggagctacatgggtcgacgtggtactagaacatggctcctgtgtcacaactatggccaaagacaaaccaacgctggacatcgaattactgaaaaccgaagtaaccaatccagctgtattgagaaaactatgtattgaagcgaaaatcagtaatacgacaactgactctaggtgtcccacacaaggggaagctacattaatggaagaacaagatgctaacttcgtatgtcgccgcacatttgtagatcgtggttggggaaacggttgcggtctatttggtaaagggtcattaattacatgtgctaaatttaaatgcgtgacaaaattggaaggtaaaattgtacagtacgaaaatcttaaatatagcgttatagtgacagtacataccggagatcagcatcaagtaggaaacgaaagcacggaacatggaaccattgcaacgataacaccgcaagcgcccacttcggaaatccagcttacggactatggagcattgacactcgattgtagccctcgcaccggtctagatttcaatgaaatggttctattaacgatgaaagaaaaatcttggttagtacacaaacaatggttcttggatttaccattaccttggacaagcggagcgtcaacatctcaggagacatggaataggcaagacctcttagttacatttaagacagcccatgcgaagaaacaagaagttgttgttttaggttctcaagaaggtgccatgcacactgcattaacgggagccacggaaatccaaacttcaggaacaacgaccatcttcgctggccacctcaaatgccgtcttaaaatggataaattgacacttaagggcatgagctatgttatgtgcaccggatcgtttaaactagagaaagaagttgcggaaactcagcatggcacagtattggttcagataaaatacgaaggtacagacgccccatgcaagatacccttcagtacacaggatgaaaagggcgtaacgcagaacggcaggttaattacagcaaatccgatagtgacggacaaagaaaaaccagttaatattgaagcagaacccccatttggcgaaagttatatagtgataggcgccggtgaaaaggcactgaaacttagctggtttaaaaagggttcatcgatagggaaaatgttcgaggctacggcacgaggagcacggaggatggcaatactgggggatacagcttgggattttggtagcatcgggggcgttttcacaagcgtaggtaaactcgtacatcaaatattcggaaccgcctatggagtgttattctccggtgtctcatggacaatgaaaataggtataggcgtcttactgacgtggctcggattaaactctaggagcacatcgctgagtatgacgtgtatagcggtaggcttggttacgctatatcttggagtgatggtacaagctgattctggatgtgttattaactggaaaggtagagaattaaaatgtggcagcggaattttcgtgacgaacgaagtacatacatggactgaacaatataaattccaagcagattcacctaaacgtctctctgcagcaatcggcaaagcatgggaagaaggcgtctgcggtataagatccgcaaccagattggaaaatatcatgtggaaacaaatatctaatgagttgaatcatattttattagaaaacgatatgaagttcacagtagtagttggtgatgtcgtgggcattcttgcccaagggaaaaagatgataagaccacaaccgatggaacacaaatactcctggaaaagttgggggaaggcaaaaattataggtgctgacgttcaaaatacaacttttatcatagacggacccaatactcccgaatgcccagatgaccaaagagcttggaacatttgggaggttgaagattatggattcggaatattcacgacgaatatctggcttaaattacgagacagtcatactcaggtatgcgatcaccgtttaatgtcagctgctataaaagattcaaaggcagttcatgctgacatggggtattggattgaatcagagaaaaacgagacatggaaattagcccgtgcatcattcatcgaagtgaagacctgtatatggcccaagtcccacaccttgtggagcaacggtgtattggaatctgaaatgattataccaaagatctatggaggaccaataagtcaacataattatcggcctggatatttcacccaaacagcaggtccgtggcatctaggaaagttagaacttgactttgacttatgtgaaggcacaacagtagtagttgacgaacattgtggtaatcgaggcccaagtctaagaacaaccactgtgacaggaaaaataatacacgaatggtgttgtagaagttgtactcttccaccactgcgatttaagggagaggacggttgttggtatggcatggaaataaggccagtaaaagaaaaagaagaaaatttggtaaaaagtatggttagcgccggatcaggcgaagttgactcttttagtttaggcctcctgtgcattagtattatgatagaggaagtaatgagatcgagatggagcagaaagatgttgatgaccggaactctcgcagtattcctcttattaataatgggacaattaacgtggaacgatttaatcagactttgtataatggttggagctaatgcatcagacagaatgggtatgggtactacgtatttggcactcatggcaactttcaaaatgaggccaatgtttgctgtcggccttctatttcggaggctaaccagtagggaagtattgttattgacaataggactaagtctcgtcgcttctgtagagttaccaaactccttagaagaactaggtgatggtttggctatgggtattatgatattaaagttactgactgattttcaatcacaccaactttgggcaactctactttctcttacattcattaaaacaacattgagcctacactacgcttggaaaaccatggcaatggtcttatcaatcgtcagtttgttccctctatgtctttctactacatcgcagaaaaccacatggttacctgtactactaggatctcttggctgtaaaccactagcgatgctattaatagctgaaaacaaaatatggggtcgaaagtcatggccgttaaatgaaggaataatggcagtaggagttgtatcaattttattatcatcactgctcaaaaatgatgttcccttggcaggacccctaattgccgggggtatgttaattgcgtgttacgttatctcgggtagttcagctgacttatctctcgaaaaggctgcagaggtaagctgggaggaagaagccgaacatagtggagcgtctcataacatattagtagaagttcaggatgatggtacgatgaagataaaagatgaggaacgagatgataccttgactattttgctcaaagcaactttacttgcagtctctggggtctatcctttatcgatacccgcgacactatttgtgtggtacttctggcagaagaagaaacagagatcaggcgtactttgggatacgcctagtcctccagaagtagaaagagccgttcttgacgatggaatatacagaatcatgcaacgtggtttgctaggtagatcacaagtaggggttggggtattccaagaaaatgttttccatacgatgtggcatgtcacacgcggagccgtactaatgtaccaaggtaaaaggcttgaaccttcgtgggcttccgtcaaaaaggatttaatttcgtatggaggtgggtggcggctacaaggatcttggaatactggagaggaagtgcaagtcattgctgtcgagccgggtaaaaaccctaagaacgtccaaactgcccctggaacttttaaaacaccagaaggcgaggtcggtgcaatagctctagatttcaaaccagggacttcgggttccccaatagtaaatcgtgaaggaaaaattgttgggctttacgggaatggcgtagtaaccactagcggaacttacgtatcggcaattgcacaagccaaggcttcccaagaaggtcctctcccggaaatagaagatgaggtgttccggaaacgaaacctgacaatcatggatttacacccaggaagtggaaaaacacgaaggtatttgcctgccatagtaagagaagccataaagcgcaagttacgtacgttaatcttagcacccactagggttgttgcaagtgaaatggctgaagcgctaaagggcatgccaatcaggtatcaaactacagctgtcaagtcagaacatacaggtaaagaaattgttgatctaatgtgccacgcaacattcacaatgcgactgctttcgcctgtacgagtaccaaattacaatatgatcatcatggatgaagcgcattttacagatccctcatcaattgcagcgcgcggttacatatcaaccagagtaggaatgggtgaagcggcagcaatatttatgaccgccacgccacctggctctgttgaagcatttcctcaaagtaatgctgtgattcaagatgaagaacgagacatacccgagcgaagttggaactccggatacgagtggatcacagactttccaggtaagacagtttggttcgtaccttcaatcaaaagcggtaatgacatagcgaattgtctacgcaaaaatggtaagcgggttattcaactgtcacggaagacattcgatactgaataccagaaaaccaagaacaatgattgggactatgtagtaacgactgacatatcagagatgggggcaaattttcgtgcagacagagtcatagacccgcgtcgctgtttaaagcctgtcattctcaaagacggaccagagcgagtaatcctagccggacccatgccagttacagtcgcatcggcagctcaacgccgaggtaggatcggaagaaaccataataaagaaggcgaccaatacatatacatggggcaacccctaaataacgatgaagatcacgcacactggacagaggcaaaaatgctcctagataatataaataccccggaaggaataatcccggctctattcgaacctgaaagagagaaaagtgcagccattgacggggaatatcgactacgaggagaagcgcgaaaaaccttcgttgaacttatgaggagaggagatctacctgtctggttaagttacaaagtggcgtccgagggatttcagtactcagaccgcagatggtgttttgacggagaaagaaataatcaggtattagaagaaaacatggacgtagaaatctggacaaaagagggagaacggaagaaattgaggccacgatggcttgatgcaagaacatatagcgaccccttggcgttacgagaatttaaagagttcgctgcaggaagacgtagcgtgtcgggagacctaatactagaaatcggtaaactacctcaacatctaacacagagggcacaaaatgctctagacaatcttgtaatgctccacaactctgaacaaggtggtagggcctaccggcatgctatggaagaattaccagatacgatagaaacgttaatgctgttagctttaatagccgtactaacaggcggagttactctattcttcctctcaggcagggggttgggcaaaacgagtattggactactgtgcgtgatggcttccagcgtcctactatggatggccagcgtagaaccgcactggatagcagcctccataattcttgagttcttcttaatggtattgttaatcccggaaccggataggcaaagaacaccccaagataaccaactcgcctacgtagttataggattattattcatgatactgacagtagcagcaaacgaaatgggactgctcgaaactactaagaaagacctgggtataggacatgttgccgttgaaaatcatcatcatgctactatgttagacgtggatcttcatccagccagtgcgtggacattatatgctgtagccaccacaataataacacccatgatgcgtcatacgatagaaaatactacagctaatatctcacttacagcgattgctaaccaggcggcgatcctgatgggtcttgacaaaggatggccaatctcaaagatggatataggagttccactactggctttaggttgctattctcaggtaaatccattaacgttaacggcagccgtcctcatgttagtcgcccactatgcaattatcggtcctggtttacaagctaaggctacacgggaggcccaaaaacggacggctgcaggaataatgaagaacccaaccgttgacggaattgtagccatcgatctcgatccggtagtatacgacgcaaaattcgaaaagcaactcggacaaataatgcttctaattctttgtacatcacaaattcttttaatgagaacgacctgggcattatgtgaatcaattacattagctacagggcctttgaccacactatgggagggttcccctgggaaattttggaatacaacgatcgcagtgagcatggctaatatttttcgtggatcctatctagccggtgccggactagcatttagtttgatgaaaagcctagggggcggccgccgaggaacgggtgcccaaggagaaacactcggagaaaagtggaaacgtcaactaaatcaactcagtaaatcggagttcaacatatacaaacgtagtgggataatggaagttgacagatctgaggcaaaagagggactaaaaagaggggaaacgacaagacatgcagtaagtagaggcaccgcaaaactaaggtggttcgtcgaacgtaaccttgtaaagcctgagggcaaagtaatagaccttggctgcggtaggggaggatggtcctactactgcgcaggtctcaagaaagttacagaagtcaaaggatacacaaagggaggtccagggcacgaggaacctataccaatggccacgtatgggtggaatctagtaaaactccatagtggcaaagatgtatttttcactccacctgaaaaatgtgatacgctattatgcgatataggagagtcaagtcctaatcctactattgaggaaggaagaacattacgggtactaaaaatggtggaaccatggttaagaggcaaccaattttgtataaagattctaaatccatatatgccatctgtagtcgaaacgttagagcagatgcaaagaaaacacggtggtatgctcgtcagaaatcctctgagtagaaacagtacacatgaaatgtactgggtcagttgtgggacagggaatatagtctcggctgtaaatatgacatcgcgaatgttactaaaccgctttacaatggcacatagaaaaccaacatacgaaagggatgtggacttaggagcaggtacacggcacgtggcagtcgagccggaagtagcgaatttagatatcataggtcaaagaatagagaatatcaaacatgagcacaaatcaacatggcactatgacgaggataacccatacaaaacatgggcctaccacggaagttatgaagtaaagccatcgggatccgcgtcttcgatggttaatggcgtagtaaagctactcaccaaaccatgggacgtgataccaatggtaacccagatcgcaatgacagacacgacaccttttgggcaacaaagggtgtttaaagaaaaagtagatacaagaacacccaaagcaaaacgaggtacggcgcagatcatggaagtcacggcccgatggttatggggattcctaagtagaaacaagaaaccaagaatctgtacaagagaagaatttacacgcaaagtgaggtcaaacgctgcgattggcgcggtatttgttgacgagaatcaatggaatagcgctaaagaagctgtggaagatgaacgattttgggatttagttcaaaaagaacgagaacttcataagcaggggaagtgtgcaacatgtgtatataacatgatgggtaaaagagaaaagaaattgggcgagttcgggaaagcaaaaggctctagagcaatttggtatatgtggctgggggctcgctttctcgaatttgaggctttaggttttatgaatgaagatcactggttttcacgtgaaaactcgttaagtggcgttgagggagaaggtctccataaattaggatacatattaagagatataagcaaaattccaggaggaaatatgtatgcagacgatacagcaggatgggatactaggataacagaagacgatctacaaaatgaagcaaggataacagatataatggaaccagaacacgcgctattggcgacatcaatatttaaattaacataccaaaacaaagtcgtgagagttcagagacctgccaaaaacggcactgtaatggacgtcataagccggagagaccaacgaggatcaggacaagtcggcacatatggccttaatacgttcacgaatatggaagcacaattaataagacagatggaaagcgaaggcatatttttacccagcgaacttgagacacagaacctagccgaaagagttctcgattggttggaaaagtatggtgttgagcgtcttaaaagaatggcaattagcggagatgactgtgtagtcaaaccaatagatgaccgatttgctacggcactcacagcactaaacgatatgggaaaggttaggaaggatataccccaatgggaaccaagtaaaggatggaacgattggcagcaagttccattctgttcgcaccacttccatcaattaataatgaaagatggtcgagaaatagttgtcccatgtagaaatcaggacgagctagtagggagagcgagagtgagtcagggcgctggatggtcactgagagaaactgcttgtttaggaaaatcatacgctcagatgtggcaattaatgtacttccaccgacgcgacctgaggctagcagctaatgcaatatgctcggcggttcctgtcgactgggtacccacaagccgaaccacctggagtattcacgcacaccatcaatggatgactacagaagatatgttaagtgtttggaacagagtttggattgaagagaacccctggatggaagataaaactcacgtatcaagttggggtgacgtcccatacttgggtaaaagagaagaccagtggtgtggcagcttgataggtctaactgctagagcaacctgggcaagcaatatacaagttgcgattaatcaagttcgtagacttattggtaatgaaaattatctcgattatatgacttcaatgaaacgttttaaaaatgagggagatccagagggagcgttgtggtaa

SEQ ID NO: 21530 - RNA, 9879 nt, synthetic construct
  misc_feature 1..9879: note = derived and/or modified CDS sequence (opt6) from DENV-1__FJ410196__SS-prME
  source 1..9879: mol_type = other RNA
agcgtcacgatgctattaatgctgatgcctactgctcttgcgttccatctgactacgcggggtggagaaccccacatgatagtgtcaaagcaggaaagaggaaaatcactgttatttaaaactagcgctggcgtaaacatgtgcacactcattgcaatggatttaggtgaattgtgtgaagatacaatgacgtataaatgcccgagaatcacggaaacagaacctgatgacgtcgattgttggtgtaacgctacagacacgtgggttacttatggaacatgttctcaaactggggaacacagacgcgacaaacgaagcgtagcattggctcctcacgtaggattaggattggaaacacgtacagaaacatggatgtcttcagaaggagcatggaagcagatacaacgtgtcgaaacttgggcattaaggcatccaggatttaccgtaattgcgctatttttggcacacgctataggcacatcaatcacgcagaaaggcataatatttattcttttaatgcttgtaacgccaagcatggctatgagatgtgtcggaattggatcaagagattttgtcgaaggattaagcggagcaacttgggtggatgttgtcctagaacatggatcctgtgtgaccaccatggctaaagataaacctacgctagatattgaactactaaaaacagaagtaacaaacccagccgtactgagaaaactatgcatcgaagcaaaaatctcaaatacaacgacagattcaagatgcccaacccaaggggaagccaccctagtagaagaacaggatgcaaatttcgtctgcagaagaacattcgtcgacaggggatggggaaacggatgtggtctcttcggaaaaggaagtttaattacatgtgcaaaatttaagtgtgtcacaaaactagagggtaaaattgtccaatatgagaatcttaagtatagcgtcatagtcaccgtacacactggggaccaacatcaggtgggaaacgaatcaactgaacacggtaccactgctactatcacgccacaggccccgacaactgagattcagcttactgattatggcgctttaacactagattgcagcccaagaacgggtctggattttaacgagatggtactcttgacgatgaaagagaaatcatggttggttcataaacaatggttcttggatttacctttaccatggacatccggcgcaagcacgtctcaagaaacttggaatagacaagacctattagtgacgttcaaaaccgcgcatgctaagaaacaagaagtagttgtattgggctcacaggaaggggcgatgcatactgctcttacaggagctacagagattcaaacgagcggtacaacaacaatctttgcaggccacttgaagtgccggcttaaaatggataaactcaccttaaaaggaatgagttatgttatgtgcaccggatctttcaagttagaaaaggaagttgctgaaactcaacatggaacggtacttgttcaaatcaaatatgaagggactgatgctccgtgcaaaattccattttctactcaagatgaaaagggtgttactcagaatggtagacttattacagccaatcctattgtaactgataaagagaaaccagttaatatagaagcagagccgccatttggggaatcatatatcgtcataggtgcgggtgaaaaagcactaaaactttcctggttcaagaaaggatcttccatagggaagatgtttgaagccactgccagaggagcgcgcagaatggcaatattgggtgacactgcttgggatttcggcagcatcggtggagtattcacaagtgtagggaaattggtacaccaaattttcggtacggcctatggtgtattattcagcggagtgtcgtggacaatgaagattgggattggagtgctcttgacatggcttgggttaaattcaaggagtacaagcctgagtatgacgtgcattgcagtaggattagtcacactctatttaggagttatggttcaggcggattcgggatgtgtcatcaactggaaaggaagagaactaaaatgtggatctgggatattcgtaacaaatgaagttcacacatggactgaacagtacaaatttcaagcagactcaccaaaacgactaagcgcggctattggaaaggcttgggaagaaggagtttgtggtatacggagtgcaacacggttagaaaatataatgtggaagcagatatcaaatgaattaaaccacatactcctagaaaacgatatgaaattcaccgttgtagtcggagatgtggcaggaatattagcgcagggaaagaaaatgatccgaccacaaccaatggaatataaatactcatggaaatcttggggtaaagcaaaaattataggggccgatgtccagaacactacatttatcatagatggacctaacaccccagagtgtcctgatgatcaaagggcgtggaatatatgggaggtcgaggattacggatttggaattttcacaacaaatatatggttaaaattgagagactcgtatacccaagtatgtgaccaccgactcatgagcgctgcaataaaagattctaaagcagttcatgcggatatgggctattggatcgagtcagagaaaaatgaaacttggaaacttgctcgcgcttctttcattgaagtaaaaacttgtatctggccaaagagtcatacattatggagtaacggggtactggaatcagaaatgataataccgaaaatatatggtggacccattagccaacacaattacagaccaggatatttcacacaagcagccggaccatggcacttaggaaagttggaattagattttgatttatgtgagggaacaaccgtcgtcgtagatgaacattgcgggaataggggaccctcattaagaactactacggtcacaggtaaaatcatacatgaatggtgctgccgaagctgcaccctacctccattaagatttaggggagaagacggctgctggtacggtatggaaatcagacctgtgaaagaaaaggaagaaaatcttgtaaaatcaatggtatcagcaggatcaggcgaagtagattcgttctccttgggtctactctgcataagtattatgatagaagaggttatgcgaagcagatggagcaggcgaatgctaatgactggaaccctggccgttttctttttattaataatgggccaattgacatggaatgatcttatcagactgtgtataatggtcggagcaaacgcaagcgaccgaatgggaatgggcacaacctatctggcattaatggcaacttttaagatgagaccaatgtttgcagttgggctactatttagaagactgacctctagagaagtgttattattgacaattggtctgtcactggtagctagcgtcgaattacccaatagtctggaagaactcggagatggactagcaatggggattatgattttaaaacttttgaccgatttccaatcacaccaattatgggctactttattgagcctaaccttcattaaaacaacatttagcctccattatgcctggaagaccatggcaatggtgctgagcattgtatcgctttttccgctctgcttatcgaccacaagtcagaaaacaacttggttgcccgttttattggggtcattaggatgtaaacccttaaccatgtttcttattgctgaaaacaaaatatggggtaggcgatcgtggccccttaatgaaggtattatggcagtaggaatagtttcaatacttctaagctcccttttgaaaaacgatgtacctctagctggaccactgattgcgggtgggatgctaatagcgtgctatgttatatcaggatcatcagcagatctttctttggaaaaagccgcagaagtgagctgggaggaagaagccgagcattctggcgcatcacacaacatactcgttgaagtccaagacgacggcaccatgaaaataaaagatgaagaaagagacgatacgcttacaatactacttaaagcgacactgttggcagtgtcgggcgtgtatccattaagcatcccggccacactttttgtttggtacttttggcagaagaagaaacaaagaagcggggtattgtgggacaccccgagcccgcctgaagtagaaagagctgtcctagatgacggtatatatcgaattatgcaacgaggactgctaggaagatcacaagtaggagttggtgtattccaggaaaacgttttccacactatgtggcatgtaacaagaggcgcggtacttatgtaccaaggaaaaaggttagaaccctcatgggcgtccgttaagaaagatttaatatcttacggaggaggatggagacttcaaggttcgtggaacaccggagaagaagttcaagtcatagccgtagaaccaggtaaaaaccctaaaaatgtccaaacagcgccgggaaccttcaaaacaccagaaggcgaggtgggagcaatcgcgctagatttcaaacctggcacaagtggatctccaatagttaacagagaaggtaaaattgtaggtttatatggtaatggggtcgttactacctcgggcacatatgtcagtgccattgcgcaggcaaaagcatcgcaagaagggccattgccagaaattgaagacgaagtatttaggaaaagaaatttaacgataatggatttgcatcccggttcaggaaaaacgagacgatacttacccgcaatagtcagggaagccataaaaagaaagttacgaacactgattctagctcccacgagggtagtagcctcagagatggcagaagccttaaaggggatgccaattagatatcaaacaaccgcagttaaatcagagcacactggtaaggaaatagtagacttgatgtgtcacgctacgttcacaatgcgtctactctcgcctgtacgagttcctaattacaatatgataatcatggatgaagcacattttacggatcctttctcaatcgcggcccgcggatatattagtaccagggtgggaatgggtgaagccgccgctatatttatgacagccaccccacctggctcagtggaggcattcccacaaagtaatgccgtcatacaggatgaagaaagggacataccggaacgctcatggaactcgggttacgaatggatcacagactttcccggaaagaccgtgtggtttgtacctagcataaaatcgggaaacgatatagctaattgcctgaggaaaaacgggaaaagagtcattcaactcagcagaaaaactttcgacacagaatatcagaaaaccaaaaataacgactgggattatgttgttactacagacataagcgaaatgggcgctaacttccgagcggatcgagtcattgatccgaggcgatgccttaaaccagtcattttgaaagacggcccggaacgtgtaatcctggccggcccgatgccagttactgtagcaagtgcggcgcaaaggcgcgggagaataggaaggaatcataataaagagggtgatcaatacatttatatggggcagccattaaataatgatgaagatcacgcacattggactgaagcaaaaatgcttcttgacaacatcaacacacctgagggtataataccagcattatttgaaccagagagggaaaagagcgctgcgattgatggtgagtacagacttaggggagaagcaagaaaaacttttgtagaactaatgaggcgaggagaccttcctgtatggctttcgtataaagttgctagcgaaggctttcaatatagtgatcgaagatggtgcttcgatggtgagagaaacaatcaggtcctagaggaaaatatggacgtagaaatatggactaaggaaggcgagaggaagaaactgcgacctcgctggttagacgctcgaacatattccgacccattagctctgcgagaatttaaagagttcgcggcaggtagacgatccgtaagctcagacttaatactagaaataggcaagttaccacagcatctgacacagagagctcaaaacgctttagacaatttggttatgttgcataatagtgaacaaggtgggagagcttacagacacgcaatggaagagttacccgatacaattgaaacattaatgttactcgcgctcatagcagttcttactggtggagtaacattattcttcctgtcagggcgtggtctgggaaaaacctccattggactactttgtgtaatggcaagttccgtattattatggatggcttccgtagaacctcactggattgctgcatctataatattagagttctttttaatggttctgcttatacctgaaccagacagacagcggacaccacaggacaatcagctcgcgtacgtggtcataggtttattattcatgatcctaactgttgctgccaacgaaatgggtctactagaaacgacaaagaaagacttgggcataggtcacgttgccgtagaaaatcatcatcatgcagccatgctagatgtggatttacaccctgcgtctgcctggaccctttacgcagtggctacaactattataacgcccatgatgagacataccatagagaatacaacagcgaatatatcattaactgctattgcaaaccaagcagccatcctaatggggcttgacaaaggatggcctatcagtaagatggatataggcgtaccattattagccttaggttgctatagtcaagttaatcctttaacattgacagctgctgttctcatgttagtggcacattatgcaatcataggtccgggtttgcaggccaaagccactcgcgaggcacagaaacgtaccgcagcaggaattatgaaaaatcctacggttgacggtatcgttgcaattgatctagatccggtcgtatatgacgcaaaattcgagaaacaattaggtcagataatgttactaattctctgtacatcgcagattcttctaatgagaacgacatgggccttatgtgaaagtatcacactagcaaccgggccactgacaacactgtgggaaggatctccgggcaaattttggaacacaacaatagctgtaagcatggctaatatattcaggggctcctatctcgctggcgcgggtctagcgtttagtcttatgaaatcactgggcggaggtagacgtggtacgggagcacagggagagaccttaggcgaaaaatggaagagacaactaaatcaactatcgaaatctgaatttaacacttacaaacgaagtgggataatggaggtagatagaagcgaggcaaaagaaggcttaaaaagaggagaaaccaccaaacatgcagtaagtcgcgggacagccaaattgcgttggttcgttgagagaaatcttgttaaaccagaagggaaagtcatcgatctcggatgcgggagagggggttggagttattactgcgctggactcaagaaagttacagaggtaaaaggatacacgaaaggagggccggggcacgaagaaccgattccaatggctacgtacggatggaatttggtgaaacttcatagtggtaaagacgtcttctttatcccacctgaaaaatgtgatacactactttgtgacattggagaatcgtcaccaaaccccacaatagaggaaggaagaactctccgagttctcaaaatggtcgaaccgtggctaagaggtaatcagttttgtattaaaatcttaaacccttatatgccatcagttgtagaaaccttggaacaaatgcagcggaaacatggcgggatgcttgtcagaaatccactttcgagaaactccactcacgaaatgtattgggtatcatgtggaacaggtaatattgtcagtgcagtaaacatgacatcgaggatgttgttgaaccgctttactatggcacacaggaaaccaacatatgagagagatgtggacttaggcgctggtactcgacatgttgcagtcgagccagaggtagctaacctagacatcataggtcaaaggatagagaacatcaaacatgagcacaaatcgacttggcattatgatgaggataatccctataaaacatgggcataccacggaagctacgaggtaaaacccagtggtagtgcatctagtatggttaatggtgtagtcaagttactaacgaaaccatgggatgttataccaatggttacccaaatcgctatgacggatacaacaccttttggacaacagagagtattcaaagaaaaagttgatacacgaacgcctaaagcgaagaggggcaccgcacagataatggaagtaacagctaaatggttgtggggatttttaagtcgaaataagaaaccgcgaatatgcaccagggaagagttcacaagaaaagtacgatcaaatgcggccataggggccgtattcgtagatgaaaatcaatggaactctgccaaagaagctgtcgaggatgaacgcttttgggaccttgtacacagagaacgagagcttcacaaacaaggtaaatgtgctacatgcgtttacaatatgatgggaaaaagggagaagaaattaggggagttcggaaaagcaaaaggttcaagggctatatggtacatgtggcttggagctcgtttcttggaatttgaagccttaggctttatgaacgaagaccattggttttcgagagagaatagtttatcaggagtggaaggcgaaggactccataaattgggttatatcctccgaggaatttctaaaatcccaggaggaaatatgtatgcagatgacactgcaggatgggacaccagaataacagaagatgatttacaaaatgaggcaagaataacagacatcatggaacctgaacatgctttactggcaaaaagtatattcaaattaacttatcaaaacaaagtagtaagagtacaaagaccggctaaaaacgggactgtaatggacgtaataagtaggagagaccaacggggatcgggacaagtgggcacttacggattgaatacgtttacaaatatggaggcccaactaataaggcaaatggaaagcgaaggaatcttcagcccgagtgaacttgaaaccccaaatctagccgaaagagtacttgactggctagaaaaatatggtgttgaacgattaaaacgaatggccatatcaggtgacgattgcgtagtcaaacccatcgatgaccgctttgcaactgcgttaactgctttaaatgatatgggtaaggttaggaaagacataccacagtgggaaccaagcaaaggatggaacgattggcaacaagtaccattttgtagccaccattttcaccagcttatcatgaaagacggcagagaaatagttgtaccatgtaggaaccaagatgagcttgtgggcagagctcgagtatcacaaggggccggttggagtttaagagaaacagcgtgtctcggaaaaagttatgctcaaatgtggcaactaatgtattttcacagaagagatctcagacttgccgcaaacgctatttgttcagccgttccagttgactggattccgacatctagaacgacgtggtcaatacacgcccaccaccagtggatgacaactgaagacatgctatctgtttggaatagagtatggatagaagaaaatccatggatggaagacaaaacccatataagttcttggggtgatgtaccatacttaggcaagagagaggaccaatggtgtggaagtcttattggactgacggctagagcaacctgggccacgaatatacaagtagcaattaaccaagtaaggcggttgattggtaatgaaaattatcttgattacatgaccagtatgaagaggttcaaaaacgaaagtgatccagaaggagccctgtggtga

SEQ ID NO: 21531 - RNA, 9879 nt, synthetic construct
  misc_feature 1..9879: note = derived and/or modified CDS sequence (opt6) from DENV-1__FJ432734__SS-prME
  source 1..9879: mol_type = other RNA
agtgtgacaatgctattaatgcttatgccaaccgctctagcatttcacttaaccaccagagggggtgaaccgcatatgatagtctcaaaacaagaacgcggtaaatccttgctctttaaaacaagtgctggtgttaatatgtgtacactaatcgccatggatttaggagaactatgcgaagacactatgacatacaaatgcccccgaataacagaagccgaaccggatgacgtagattgttggtgtaacgccactgacacgtgggtaacttatggaacttgctcgcaaacaggagagcaccgaagagataaaaggtcagtcgctctcgcaccgcatgttggtctcggactcgaaacacgtacagaaacttggatgtcttcagaaggggcatggaaacaaattcaacgtgtagaaacgtgggttttaagacatcctgggttcacagtaatcgctctctttctagctcacgccattggtacaagcatcacacaaaaaggaataatatttatcctgctaatgttagtaacaccaagtatggctatgcgatgtgttggtataggcagtagagatttcgtggaaggactatccggtgctacctgggttgacgtagttctggaacatggatcgtgcgtaaccacaatggccaaggataaaccaactctggatatagaacttttaaaaacagaagttacaaatcctgccgtactaagaaagctatgtattgaggctaagataagtaatacaactactgactcccgctgtcccacccaaggggaagcaacgctggtagaggaacaagatgcaaactttgtctgtcgaagaacttttgtagatagaggatgggggaatggctgtggattattcggaaaggggagtcttattacgtgtgcaaaattcaagtgtgtaaccaaactagaaggaaaaatagtacaatatgaaaatttaaaatactccgtcatagtaacggttcatacaggtgaccagcaccaagtaggtaatgaaagcacagaacacggaacgaccgccacgatcacacctcaggctccaactacagagattcaattaacagattatggggccctaactctggattgtagtccgcgcactggcttagacttcaatgagatggtgcttcttacaatgaaagagaaaagttggttagttcataaacagtggtttttggatttaccacttccatggacatccggtgcttcaaccagccaagaaacttggaaccgtcaagatttgctagttacgttcaaaacggcacatgctaagaaacaagaggtcgtagtactaggatcacaagaaggtgcaatgcataccgcgttgacgggcgcgacagaaatccaaacgtccggtactacaacgatcttcgctgggcatctcaaatgtaggttaaaaatggataagttaacattaaagggtatgtcatacgtcatgtgcactggctctttcaaattagaaaaagaagtagcagagacacaacacggaactgttttagttcagataaagtatgagggaaccgacgctccctgtaagataccctttagcacgcaagacgaaaaaggtgtaacgcagaatggaagattaatcacagcaaatcctattgtgactgataaagaaaaaccagttaatatagaagccgagccaccgtttggagaaagctacatagtgatcggcgcaggagagaaagcgctgaaacttagttggttcaagaaaggatcaagtataggaaaaatgtttgaagcaacagctaggggtgcgagaagaatggctattctaggcgacactgcttgggactttggttccattggaggcgtcttcacttcggtgggtaaattggtacatcaaatttttggaaccgcttatggagttctattttctggcgtaagctggacaatgaaaattggcataggtgtattattgacctggcttggactaaatagccgaagtacttctctaagtatgacttgtatcgcagtaggccttgtaactctctatcttggagtaatggtacaagctgattctggttgtgtaattaactggaaaggtcgtgagctaaaatgcggtagcggaatatttgtgaccaacgaagtacacacctggaccgagcaatataaattccaggccgactctccaaaaagactatcagccgctattggtaaagcctgggaagaaggcgtatgcggtataaggtcagccactagacttgagaatatcatgtggaagcaaatttcgaatgagctcaatcacattctactagaaaatgacatgaaattaactgtggtggtcggtgatgtcgcaggaatattaggtcagggtaagaaaatgatacggccacagccaatggaatataagtattcgtggaaatcatggggaaaagcgaaaattatcggagccgacgcacaaaataccacatttatcattgatgggccaaatacgccagaatgcccagacgaccagagagcttggaatatttgggaagtagaagattacggattcggaatgtttactaccaacatatggctaaaactacgggattcatatacgcaagtctgtgatcaccgtctaatgtcagcagccatcaaagattctaaagccgtgcatgcagatatgggatactggatagagtctgagaaaaacgagacatggaaattagcccgtgcttcgtttatagaagttaaaacatgcatctggcctaaaagtcacacgctatggagcaacggtgttctggaatcggagatgattattccaaagatctacggaggaccaatatcacaacataactatcgtcctggttactttacccagacagcaggtccgtggcatttaggaaagttagaacttgattttgacttatgcgaggggaccaccgtggtggttgatgaacactgtggtaataggggacccagccttagaacgacgacagtcacgggtaagataatccatgaatggtgttgtagaagctgcacactaccacctctacggttccgtggagaggacgggtgctggtatggaatggaaattaggccagtaaaagaaaaagaagaaaatctagtcaaatcaatggtaagtgcgggatcaggcgaagtcgattcgtttagtctgggtctactgtgcatatcaataatgattgaagaggtgatgaggagtagatggtctagaaagatgttaatgactggaacactagccgtcttctttctactaatcatgggacaattaacatggaatgacttaatccgattatgcataatggtaggtgcaaatgctagcgatagaatgggtatgggaacaacatatctagccctaatggctacatttaaaatgcgccccatgttcgctgtcgggctcctgtttaggagattaaccagtcgagaagttttacttctgacaatcggactaagcctagttgcaagtgtagaactacccaattctttagaggaattgggggacggtttagcaatgggtattatgatactcaagttactgactgacttccaatcacaccaattatgggcaactctattatccttgactttcatcaagacgacattctcactgcattatgcctggaaaacgatggcaatggtcttgagtatagttagtttgtttcccttgtgtttgtctactacatcacagaaaacgacatggttacccgttctcttgggtagtctgggttgtaaacctttgacaatgtttctaatagcagaaaataaaatttgggggaggaagtcttggccattaaatgagggaattatggccgttggaatagtatccatattgctatccagtttgttaaagaatgatgtgccgttggcgggacccctaatagcgggaggtatgttaatagcatgttatgtcatatcaggaagttcggcggatttgtctttagagaaagccgctgaagtctcttgggaagaggaagcagagcattcaggagcaagccataacatcttagtagaagtacaagatgacggtacgatgaagatcaaagatgaagaacgtgacgatacattaacaatcctactgaaagctactttattggccgttagcggagtatatcccctttctattcctgcaacactatttgtatggtatttttggcaaaagaagaaacaacgatctggagttttatgggataccccatcaccacctgaagtagagagagcagtattagatgacgggatatataggataatgcaacgaggactgctagggaggtctcaagtaggtgtcggagtatttcaagagaacgtatttcacacaatgtggcacgttactaggggagctgtccttatgtatcaaggcaagaggctagagccctcttgggctagtgtaaagaaagatttaattagctacggcggtggttggcgattacgagggtcatggaatacgggagaggaagtacaagttatagcagttgaacccggcaaaaatcccaaaaatgttcagaccgctccaggaacgtttaaaaccccagaaggcgaagtaggtgctatcgctttagatttcaaacccggaacgtcagggtccccaattgtcaacagagaaggaaaaatagtaggtctatatgggaacggagtagttactacaagcggaacatacgtcagtgccatagctcaagcaaaagcaagtcaggaaggaccattaccagaaatagaagacgaagtcttccgaaaacgtaacttaacgataatggatcttcacccgggtagcggtaagacaaggcgatatctcccggccatagttcgagaagctatcaaacgaaaattacgtacattaattcttgcgccaacccgagtagttgcctcagaaatggcagaggcactaaaaggtatgcctataagatatcaaactacggccgtaaaatcagagcataccggcaaagaaatcgtagacctaatgtgtcatgcaacgtttacgatgaggcttttgtcaccggtaagagttccaaattataatatgataatcatggacgaagcacatttcactgatccatcatcgatagccgcaagaggatacataagcacgagagtaggaatgggggaggctgcggccatcttcatgacagcaacgccaccaggttctgtagaggcatttcctcagagtaatgcagtaatacaggatgaagagagagatatacctgagcgatcgtggaatagtggctacgaatggataacagatttccccggcaaaacggtgtggttcgttccctcaatcaaatcaggcaatgatatagcaaattgcctaaggaaaaacggcaaaagggtaatacaattatcgagaaaaacttttgataccgaataccagaaaaccaaaaacaatgattgggactatgtggtaacaacagacataagtgaaatgggagcaaactttcgtgcagatagagttattgacccaagaagatgcttaaaacctgtcatattgaaggacggaccagaaagagtaattctagcaggtcctatgccagtaacggttgcgagcgctgcacaaagacgaggtcggattggacgcaatcataacaaagaaggagaccagtacatatacatgggacaacctttgaataacgatgaagaccatgcacattggaccgaggcaaaaatgcttttagataacattaatacgccagagggaataatccccgcattattcgagccagagcgagaaaaatcagcggctgtagatggagagtaccgactgcgtggtgaagcaaggaagactttcgtggaacttatgagaagaggagatttacctgtatggttatcatataaagttgcatcagaaggctttcaatattcagacagaagatggtgtttcgatggcgagaggaacaaccaagtattagaagaaaatatggacgtagagatatggacaaaggagggagaaaggaagaaattaaggccaagatggctagatgccagaacatactcagacccgctagcgctacgagaatttaaggaatttgcagctggaagaagaagtgtgagcggagacttaatactcgagataggaaaattgcctcaacatttgacccagagggcgcaaaatgccttagacaatctagtgatgcttcataatagtgaacaaggagggagagcatatagacatgcaatggaagaactcccggatacaattgagaccttaatgctgctagctctcatagctgttttaacaggaggcgtaacactattctttttaagtgggcggggtctaggaaagacttcaataggactcctctgcgtaatggcaagctcagttctactgtggatggcatcggttgaaccgcattggatcgctgctagcataatattagagttctttttaatggtactattgatccctgaacctgacaggcaaagaacaccacaagataaccaactcgcctatgtagtaattggcctgttattcatgattttgactgtagcggcaaatgaaatgggattgctggaaacaactaaaaaggatctaggaatagggcacgtagctgtagagaatcaccatcacgctgcaatgctagacgtcgacctacatcccgcaagtgcatggaccttatacgccgttgccacaacaatcatcacaccaatgatgcggcacacaatagagaatactactgctaacatcagcctgacggcgatcgccaaccaggcagcaattctgatgggacttgacaaaggatggccaattagtaaaatggatatcggcgtcccattactagcattaggctgctatagccaggttaatccgttaacattaacggcagcagtgcttatgctggtcgcccactacgccataattggtcccggcctgcaagcgaaggcaacacgagaagcgcaaaagagaactgctgctggaattatgaaaaatcctactgtggatgggattgtcgcaatcgatttagatccagttgtatatgacgcaaaatttgaaaaacaattgggccaaattatgctactaattctgtgtacatcgcagatattgcttatgaggacgacctgggcgctatgtgaatcaataacccttgctactggcccattaactaccttatgggaaggttcacccggtaagttttggaatacaacaatagcggttagtatggcgaacatatttcgagggagttacctagctggagctggattggcattctccttgatgaaatcccttggaggtgggagaagaggcactggtgcacaaggggaaaccttaggggaaaagtggaagcggcaattgaaccaactatcaaagtctgagttcaatacctacaagagaagcggcattatggaagtggataggagtgaagccaaagaaggattaaaaaggggcgagacaacaaagcacgcagtgtcgcgaggaacagcaaagttgcggtggtttgtagaaaggaatttagtaaaaccagaagggaaagtgatagacttaggctgcggtagagggggctggagttattattgtgctggtctcaagaaagtaaccgaggtcaaaggatatacaaaagggggtccaggacatgaagaaccgatcccgatggcaacttacggttggaacttagtgaaattgcactcaggaaaagacgtattctttatacctccagaaaagtgcgacacattactatgtgacataggagagtcaagtccaaatcctacaattgaagagggaaggaccttaagagtactaaaaatggtagaaccttggctgcgaggaaatcagttttgtattaaaattctcaacccatatatgccgtcggtagtggaaacactagaacaaatgcaacgaaaacatggcggtatgctcgtacgaaacccactatcacgaaatagtacccatgaaatgtactgggttagttgtggtactggcaatatagttagtgcagtaaacatgacttcaaggatgttactcaataggtttacaatggcgcaccgtaaaccaacatatgaaagagatgtggatcttggaacgggtacaagacacgtcgctgtcgagccggaagtagctaatctagatattatcggtcaacgcattgagaatataaagcacgaacataaatcaacctggcattatgacgaggataatccatacaaaacatgggcttatcatggtagttatgaggtaaagccatcaggttcagcatcgagtatggtaaatggtgtggtaaaattacttacaaaaccctgggatgtaataccaatggtgacccaaattgcaatgactgacacaacgccgtttggccagcaacgagtatttaaagagaaagtcgacactcggacaccaaaagcaaaacggggaaccgcccaaataatggaagttactgcgagatggctatgggggttcctcagtaggaataagaaaccacgaatctgtacgcgtgaagagttcactcggaaggttaggtcaaacgcagcaattggtgctgtttttgtagatgaaaatcagtggaatagcgccaaggaagcagttgaggatgagcggttttgggacctagtacatcgagaaagagaacttcataaacaagggaaatgtgctacctgtgtttacaatatgatgggtaaaagagagaagaaactaggagagttcggtaaagcgaagggttcacgagcaatatggtacatgtggctaggtgcacggtttcttgagtttgaagcactgggctttatgaatgaagaccattggtttagcagggaaaattctctgtcgggagtagagggtgaagggttacacaaattaggttatatattgagggatatttccaaaatccccggaggcaatatgtacgcagacgatacggccggttgggacactcgcatcacagaggacgatttgcagaatgaagcaaaaataactgacataatggaacctgaacacgctctgttggcaaaagcaatatttaaacttacatatcaaaataaagtcgtgcgcgttcaaagaccagccaaaaatggtacagttatggacgtaattagtagacgtgatcaaagaggatccggccaagtcggtacatatggattgaatacatttactaatatggaggctcaattgattagacaaatggaaagtgaaggtatatttagtcccagcgaactagagaccccaaacctggctgaacgggcacttgactggttggagaaatatggagttgaacgattaaaaagaatggctattagcggagacgactgtgtagtcaaacccatagatgatcgcttcgcaaccgcattgacggcactcaacgacatgggtaaggtaaggaaagatattccacaatgggaaccatctaaaggatggaatgattggcagcaggtccctttctgctcacatcattttcatcaactaatcatgaaggatggaagggaaatcgttgtgccgtgccgtaaccaggatgagttagtcggccgagccagggtatcccaaggagccggatggtctttacgtgaaacagcgtgccttggcaaatcgtatgcacaaatgtggcaattgatgtattttcataggagagatctaagattagcagcgaacgctatttgttcggcagtgccagtggattgggtaccgacttcacgtactacgtggtcaatacacgcgcatcatcaatggatgacgacggaagatatgttatcggtttggaatcgggtatggatcgaagaaaatccttggatggaggacaaaacacatatttcatcctgggaagacgtaccatatctcggaaaaagagaagatcaatggtgtggatcactcataggattaacagcgcgagcgacttgggctactaacattcaagtagccataaatcaagtgagacgacttatcggcaacgagaattacctagactatatgacaagcatgaaacgattcaaaaatgaaactgatcccgaaggagcattgtggtaa

SEQ ID NO: 21532 - RNA, 9879 nt, synthetic construct
  misc_feature 1..9879: note = derived and/or modified CDS sequence (opt6) from DENV-1__FJ432735__SS-prME
  source 1..9879: mol_type = other RNA
tcagtaacaatgttactgatgttaatgccaacggcactagcattccacctcacgactaggggaggtgaaccacacatgatagtatctaaacaagaaagaggaaaatcactcttgtttaaaacaagtgctggcgtaaatatgtgcacattaatagcgatggacctgggagaattttgcgaagatacaatgacatacaaatgcccgcgaataaccgaagcggaacctgacgacgtcgattgctggtgcaacgcaaccgatacttgggtaacctacgggacttgtagccaaaccggtgaacatcgcagggataaacgaagcgtcgcccttgcacctcacgttggcttggggttagaaacaagaaccgaaacatggatgtcatcggaaggcgcttggaaacaaatacaaagggtagaaacatgggctttacgtcatccgggatttacagttatagccctgtttctcgcacatgcaatagggacaagtatcacgcagaaaggtattattttcattctattgatgctggtaacaccgtctatggctatgagatgcgtcggaataggttctcgcgattttgtcgaaggtttaagtggggcaacatgggttgatgtggtactcgaacatggaagttgcgttactacgatggctaaagacaaacctacactagatattgaattgctaaagactgaagtcaccaatccagccgttctaaggaaactctgcatcgaagcaaaaatatcgaatacaacaacagatagccgatgtcctacccaaggcgaagcgaccctagttgaagaacaagatgcaaacttcgtctgtaggagaacgttcgtagatcggggatggggaaatggttgtggcttattcggcaaaggcagtcttattacttgtgctaaatttaaatgcgtgacaaaactagaaggtaagactgtccaatacgaaaacttaaaatactcggtaatagtaacagttcatactggagatcaacaccaggttggaaatgaaagtactgaacatggaacaactgcgacaattacgccacaggccccaagtacagaaatacaactaaccgattatggagccttgactctcgactgtagccctaggacaggactggattttaatgaaatggtcttacttacaatgaaagagaaaagctggctagtccacaaacaatggttccttgatttacctctaccttggacatcaggcgcaagcaccagccaagaaacttggaaccgaaaagacttacttgtaactttcaaaacagcacatgccaagaaacaagaagtcgtggtactcggatctcaggaaggtgctatgcatacggctttaactggtgccacagagatccaaacaagtgggaccacgaccatcttcgccggtcacttaaagtgtcgtctaaagatggacaaactaacattgaaaggaatgtcgtacgttatgtgtacaggcagcttcaaattagagaaggaagtcgctgaaacccaacatggaacagtcttagtacaaataaaatacgaagggactgatgcaccatgcaagattccatttagtacgcaagatgaaaaaggggtaacacaaaatggcaggcttataacggcgaaccctatcgttacggacaaagaaaaaccagttaatatagaagcagaaccaccattcggagaatcatatatagtgataggcgcaggcgagaaagctctcaaacttagctggttcaagaaaggatcatctataggcaaaatgtttgaagcgacagcaaggggtgcaagacgtatggccatattgggtgacactgcatgggattttggaagtatcgggggagtattcacctcagttggcaaattagtacaccagatctttgggacagcatacggtgtgttattcagtggagtatcatggacgatgaaaatagggataggcgtgttactcacatggttaggcctaaattcgcgtagtacttcactctcgatgacttgtatagcagtagggttagtcacactgtacttaggggttatggtgcaagcggattctggttgcgttattaattggaaaggcagagaattgaaatgcggttcaggaatattcgttacaaacgaagttcacacttggacagagcaatataagtttcaagctgattctccaaagcgattaagcgccgcaatcggcaaagcatgggaagaaggtgtatgcggaatcagatcagcaacacgactcgaaaatataatgtggaaacaaatttctaacgaattaaatcatatcttgttagagaatgacatgaaattcacagttgttgtcggagatgtcgccggaatattagcacagggcaagaaaatgatcagacctcaacctatggagtacaaatacagctggaaatcatggggcaaagctaaaatcataggggccgatgtgcaaaacacgacttttattatcgatggccccaatacaccagaatgtcctgatgaccagagagcatggaatatttgggaagtggaagactacggatttggcatttttaccactaacatatggttaaaattaagggactcatacacccaagtatgcgatcatagattgatgagtgccgctataaaagattccaaagcggtacacgctgatatggggtactggatagaaagcgagaaaaatgaaacatggaagctggcgcgtgcatcatttattgaagtgaaaacttgcatttggcctaagtcacataccctatggtcgaacggcgtcctagaatccgaaatgataattccgaagatctatgggggacctataagccaacacaattatagacccggttattttactcaaacagcaggaccctggcatctaggtaaactggaactagatttcgacctgtgtgaaggaaccactgttgttgtagatgaacattgtggaaacagaggacctagcctacgcaccacaacagtaactggtaaaatcatacatgaatggtgttgtaggagctgtaccttaccaccactcagatttaaaggcgaagacggctgttggtatggcatggaaatacgtccagttaaggagaaagaagaaaatcttgttaagagcatggtatcagccggctctggtgaggtggatagctttagtttgggcttattatgtatttcaattatgatcgaggaagtgatgaggtctcgatggtcgagaaaaatgctcatgacaggaacgttagctgtattctttctcttaataatgggacaactaacttggaatgacttgataaggctttgtataatggttggagctaatgcatctgacagaatgggtatgggaaccacttatctagctttaatggcaacatttaaaatgagaccaatgtttgccgtaggtctattgttccggcgcctaacaagtagggaagtgttattgcttacaataggattgagcttagtagctagtgttgaactacccaatagtcttgaggaactcggcgacggtctggcaatgggcattatgattttgaagttattgaccgacttccaatcccatcaactatgggctaccctgttgtcgttgacgttcattaaaacgaccttcagcttgcattatgcatggaaaaccatggcgatggttttatcaatagttagcttatttccattgtgcctgagtacgacctcacagaaaactacctggttaccagttctactcggcagcttaggatgtaaaccactgacaatgtttctgatagctgagaataaaatatggggaagaaaaagctggccactcaacgagggtataatggcagtaggaattgtttctattcttttaagttcacttttgaaaaatgacgtaccactagccggaccgctcattgcgggtgggatgttaattgcatgttatgtcatcagtggttccagtgcagatttatctttagaaaaagcagccgaggtaagttgggaggaagaagcagaacacagcggagcgagtcataacatcttagttgaagtccaagatgacggcacaatgaaaataaaagatgaagaacgtgatgacacattgacgatcctcttaaaagctacactcctcgcggttagtggggtttatcctttaagtataccagcaacgctatttgtctggtatttttggcaaaagaagaaacaacgcagtggagtgctatgggatacacctagtccaccggaggtagaaagagcagtattagatgacggaatatatcgtatcatgcaaagggggttgctgggcagatctcaagtaggggtaggagtgtttcaagaaaacgtctttcatacaatgtggcacgtaacaaggggcgccgtattgatgtaccaaggcaaacgattagaacccagctgggcctcagtcaagaaggatctaataagttacggcggaggatggagattacaaggttcatggaatacaggcgaagaagtacaggtcatcgcggttgaacctggcaaaaaccctaaaaacgtacaaaccgccccgggaaccttcaaaaccagcgaaggcgaagttggcgctatcgcattagactttaaacccggaacaagtgggtcacctatagtgaacagagaggggaaaatagtaggtctttacggcaatggagtagtaactacatctggtacatatgtttcggctatcgctcaagcaaaagccagccaagaagggccactacccgaaatagaggatgaggtatttagaaagcgcaatctgacaataatggatcttcaccccggctccggaaaaactaggcgttacttaccggcaatagttcgtgaagccattaaacgtaaattaagaaccttgatattagctccaacaagagttgtagcaagcgaaatggcagaagcccttaaaggcatgcccattagataccagacaactgccgttaaaagcgagcatacaggtaaagaaattgtagatttgatgtgtcacgcaacctttacaatgagactattaagcccagtacgtgtaccaaactacaatatgataataatggacgaagcgcattttactgaccctagttcaatagctgccaggggctatatcagtacaagagtaggaatgggagaagcagcagctatatttatgacagcaaccccaccaggctcagtggaggcattcccgcaatctaatgcagtcatccaagacgaagaacgtgatataccagaacggtcgtggaatagcgggtatgaatggataactgattttccaggaaaaacagtatggtttgtcccgagtataaagtctggtaacgatatagctaattgtcttaggaaaaatggcaagagagtaattcaattaagtcgtaagacatttgacaccgaatatcaaaagaccaaaaataatgattgggattatgtagtgacaactgatattagcgaaatgggtgctaattttagagcggatcgcgttattgacccgcgtagatgtcttaaacctgtaattttgaaagatggtcctgagagagtaatattagcaggtccaatgccagtcacagtggcgagtgccgcgcaacgaagagggcgcattggtagaaatcacaacaaagaaggagaccaatatatatatatgggccaaccattgaacaacgatgaagaccacgctcattggactgaagccaaaatgctattagataatatcaatacaccagaaggaataatcccagcattatttgaacctgaaagagaaaaatcagcggcaattgatggggaatatagactaagaggggaagcaaggaaaacatttgtagagctcatgcgcagaggagatctacccgtgtggttatcatataaggtcgcatcggaggggtttcagtatagcgatagaaggtggtgcttcgacggtgagagaaacaaccaagtcttggaggaaaacatggatgtagagatatggactaaagaaggagaaaggaagaaactaagaccacgatggttggacgccaggacgtacagtgacccgcttgctttacgagagttcaaagagttcgcagcagggagaaggtctgtatcgggtgacttaatcttggaaataggaaaactgccacaacatctaactcaaaaagcccaaaacgcgctagataatctagtcatgttacacaactccgaacaagggggtcgcgcgtacaggcacgcgatggaggaattacccgatactatagaaacgctaatgctgctagccttgatagcagttttgaccggaggggtgaccttgttctttctatctggtagagggttaggcaaaactagcataggtcttctttgtgtcatggcctcatcagtcttattgtggatggcctcagtggaaccacactggattgccgctagcataatcttagagttctttttaatggtgctactgattccagaacctgatcggcaaaggacacctcaagataatcaattggcttacgttgtaataggcttactcttcatgattctcacagttgcagcaaacgagatgggactacttgaaacgactaagaaagacttaggtattgggcacgtagccgttgaaaaccatcatcatgcagcgatgttagatgtggacttgcacccggcaagcgcttggactctctacgccgtagccactaccataattacaccgatgatgcgtcataccatagaaaacacaaccgctaatatcagcctcaccgcaatagcgaatcaggctgctattttaatgggccttgataaaggttggccgataagtaaaatggacataggcgtaccactactagcattagggtgctatagtcaagtaaaccccttaaccctaacagccgccgtactaatgttagtagcgcattacgctattatagggccgggattacaggccaaagcgaccagagaggcacaaaagagaaccgcagccggcattatgaaaaacccaaccgttgacggaatcgttgcaatagatctagatccagtcgtctatgatgctaaatttgagaaacaactgggccaaattatgttactcatactttgtacatctcaaatcttgttaatgaggacaacgtgggctttatgcgaaagcataacgttggcgacaggcccactaacgactctctgggaaggttcgcctggaaaattttggaataccacaatagcggtatcgatggcaaatatatttagaggttcatacctggcaggagcaggtctagcattttcattaatgaaatcactgggaggcggaagaagaggtacaggagctcagggtgaaacactaggagaaaaatggaaaagacaactaaatcaactttcaaaaagcgaatttaatacctacaaacgatcaggtattatggaggtggatcgaagcgaagcgaaagaaggattaaaacgcggagagaccactaaacatgcagttagcaggggtactgctaaattgcgttggtttgttgaacgaaatcttgttaaaccagagggaaaagttattgacctgggatgtggcagagggggttggagttattactgtgccggactaaagaaagttacagaagttaaaggatatactaaagggggccccggacatgaggaacctatacccatggcaacttacggctggaacttagtaaaactccacagtggaaaggatgtattctttataccacctgaaaaatgtgataccttattgtgcgatattggtgaaagctcgccgaaccctacgatagaagagggacgaacattgagagtcctaaaaatggtagaaccctggctacggggcaaccaattctgtataaagatattgaatccgtatatgccgtccgttgttgaaaccctagaacagatgcaaagaaaacacggcggaatgctagtgagaaacccgttatcacgtaactcaacccacgaaatgtattgggttagctgtgggacaggtaacattgtaagcgccgtaaatatgaccagccgtatgttactgaatagatttacgatggcacataggaagcctacatatgaaagagacgtcgatctgggagccgggacaaggcacgtcgctgtagaacccgaggtagctaacttggacattataggacagaggatcgaaaatataaaacatgaacataagtcaacatggcattacgacgaggataatccatataagacatgggcatatcatggcagttacgaggtgaagccatccggttctgcctcttcaatggtcaatggcgtagtaaaactcctaaccaaaccttgggatgtgataccaatggtaacacagatagcaatgacagacacaacaccattcggtcaacagagagtatttaaggaaaaagtggacactcgtacaccaaaagcgaagcgaggcaccgcccaaatcatggaggttacagccaaatggctatgggggttcctatcaaggaataagaaacctcgaatttgtacgagggaagaatttacgagaaaagtcagatcaaatgcagcaatcggggcagtctttgtagacgaaaatcaatggaacagcgcaaaagaagccgttgaagatgaaagattctgggatctagtgcacagagaacgtgaacttcataaacagggaaaatgtgccacttgcgtttacaatatgatgggaaaaagagagaagaaactaggagagttcggaaaagcgaaagggagtcgagccatttggtacatgtggctcggagcgagatttctagagttcgaagcgcttggatttatgaatgaagaccactggtttagcagagaaaattcactatcaggcgtggaaggcgaaggacttcacaaattaggatacattcttcgagacattagcaagattcccggaggaaatatgtatgcagatgacaccgcaggctgggatacacgcatcactgaagacgatttacaaaatgaagccaaaattacggacattatggagcccgaacacgctctgctagcaaaatcaatatttaaactaacatatcaaaataaagttgttagggttcaaagacccgccaaaaatggcacagtaatggacgtcattagtagacgagatcaacggggttctgggcaagtaggtacgtacggattaaacactttcacaaatatggaagcacagttgatcagacaaatggaatcagaaggcatcttctcaccatcggaattagaaacccctaatttggccggtcgcgttttagactggttagagaaacatggagttgaacgtcttaaaaggatggccatatcaggtgacgattgtgtagttaagccaatagatgatcgctttgcgacagccctaactgcattaaatgatatgggtaaagtcagaaaagatatcccacagtgggaaccatcgaaaggatggaatgattggcaacaagtaccgttttgttcacaccattttcatcaactcatcatgaaagatggaagagaaatagtagttccatgtagaaaccaggatgaacttgtcggtagagcccgagtgtcgcaaggcgccggttggtcattacgtgaaaccgcatgtttaggaaaaagttacgcacaaatgtggcaactaatgtacttccaccgaagagatctcagattggctgctaatgccatatgctcagcggtccctgtagattgggttccaacgtccagaacgacgtggtctatacacgcccatcatcaatggatgacaacggaagatatgttaagcgtctggaatcgcgtttggatagaagagaacccatggatggaggataaaacgcacataagcagttggggtgatgtgccgtacctagggaaacgcgaagatcaatggtgtggctctcttataggcttaactgcgcgggcaacttgggccactaatatccaagtagctataaaccaagtaagaagattaataggcaatgaaaactacctggattacatgactagcatgaaaagattcaaaaatgagtcagacccagaaggagcgttatggtaa

SEQ ID NO: 21533 - RNA, 9879 nt, synthetic construct
  misc_feature 1..9879: note = derived and/or modified CDS sequence (opt6) from DENV-1__FJ432736__SS-prME
  source 1..9879: mol_type = other RNA
tctgtaactatgttacttatgttaatgccaactgcacttgctttccacctgactacgagagggggtgaaccgcatatgattgtttcgaaacaagaaaggggcaaaagtttgttatttaaaacgagtgctggcgtaaacatgtgtactttaattgcaatggacctaggagagctatgcgaagacacaatgacctacaaatgcccgcgaataaccgaagctgaaccggacgacgtagactgctggtgcaacgcaactgatacctgggtaacttacggcacctgttcacagaccggagaacaccgccgagataaaaggtcggtagctttagcacctcatgtaggattaggcttagaaacacggacggaaacatggatgagcagtgaaggggcgtggaaacaaattcaaagggtagaaacatgggccctaaggcatcccggatttacagttatagccctatttctagcgcacgccataggtacaagtatcacgcagaaaggtatcatcttcatattactaatgctagtgacaccttcaatggccatgcgttgtgttggaatcggatcacgtgatttcgtcgaagggctttcaggggcgacttgggtcgacgtagtactcgaacatggatcctgcgtaacgacgatggccaaagataaaccgacccttgatatagaattgctaaaaactgaagtcaccaatccagcagtactgcgtaaattatgtatagaagcaaaaatttcaaatacaacaaccgactctaggtgcccgacacagggcgaagcaactctggtcgaagaacaagatgcaaactttgtatgccgacggacgttcgtagatagaggatgggggaatggatgtggcctattcggaaaaggtagcttaatcacatgtgcgaaatttaaatgtgttacgaaattagaaggaaaaattgtccaatatgagaatttgaaatattcagtaattgtaactgtacatacgggggatcagcatcaagttggtaacgagtctacggaacatgggactaccgcaacaattacgcctcaagcgccaaccaccgaaatccaattaaccgattatggtgcactaacattggattgctcacctagaacaggactcgatttcaacgagatggtcttactaaccatgaaagagaaaagttggctagtacataaacaatggtttcttgacctaccactaccctggacaagtggagcatccacgagccaggagacttggaatagacaggacttattagttacattcaaaacagcacatgccaagaaacaagaagtcgttgtgcttggctcacaagaaggcgctatgcacacagcattgacaggagcaactgaaatacaaacaagtggtactacaacaatctttgccggccatttaaaatgtagacttaaaatggacaagctgactttgaaaggaatgtcatatgtgatgtgcactggttctttcaaactcgaaaaagaagttgccgaaacacaacatggaacagtacttgtacaaataaaatatgaaggtacggatgcaccatgtaaaatacctttttcgacccaagatgaaaaaggggtaacgcagaacggacgattaattaccgcaaaccctatagttactgataaggaaaaacccgtaaatattgaagcagagccgccatttggtgaatcatatatcgtgattggtgcaggcgaaaaagcactaaagctatcatggttcaagaaaggatcttccataggtaagatgtttgaagcaactgcacgaggagccagacgaatggctatcttaggagataccgcatgggattttggaagtataggaggcgtatttacctcggttggcaaattaatacatcaaatatttggtacagcatatggagtcctcttcagtggcgttagctggacaatgaaaatcggtattggtgtattacttacatggctaggattaaactcacgaagcacgtcgttaagcatgacatgtatagctgttggccttgtcacactatatctcggggttatggtacaagcagatagtggttgtgtaatcaactggaagggtcgggaactgaagtgcggttccggaatattcgtgactaatgaagtacatacctggaccgaacaatacaaatttcaggcagattcccctaaacggctgtccgcagccatcggcaaagcatgggaagaaggtgtttgtggtataagatccgcaacacgtttagaaaacatcatgtggaaacaaatttccaatgaacttaatcacatattacttgaaaacgatatgaaattaactgtagttgtaggtgacgtagcaggcattctaggacaaggtaagaaaatgatacgtcctcaacccatggaatataagtattcatggaagagttggggaaaagctaaaattataggagcagacgcacaaaacactacctttataatcgatggtcctaatacgccagaatgtccagatgaccaaagggcgtggaatatatgggaagtcgaagattacggattcggaatttttactacaaatatatggctaaaactaagggactcatatacgcaagtatgcgatcaccgattaatgtctgctgccataaaagactctaaagctgtacatgccgatatgggttactggattgagagtgagaaaaatgagacttggaaattggcaagagcgagttttattgaggttaaaacctgtatttggccaaaaagccatacattgtggagtaatggagtactagagtcggagatgataatacccaaaatatacggaggacctatatcgcaacacaactacagaccgggttacctaacccaaacggcaggcccctggcatttaggcaagctggaattagacttcgacttatgtgagggcacgaccgtagtggttgatgagcactgcggaaatcgtggtcctagcttgaggacaacaacagtgacgggtaaaattatacacgagtggtgctgtcgtagctgtacactcccgcccctacgattcagaggcgaagacgggtgttggtatggaatggaaatcagacctgtcaaagagaaagaagagaacctggtaaaaagcatggtttctgcgggaccaggcgaagttgactctttttcccttggccttttatgtatcagcattatgattgaagaagtgatgaggtctagatggtctaggaagatgttaatgacaggtacgttagccgtattctttttgctaattatgggtcagcttacatggaatgatctgatacgattatgcatcatggtgggagctaacgcctttgatagaatgggcatgggaactacctacttggcccttatggccacctttaagatgcgtccaatgtttgccgtgggattactatttagaagactgacgagtagagaggtgctgttgctaacaatagggttaagtttagtagcaagcgtcgaattgcccaacagtttagaggaattaggagacggattggccatgggcattatgatcttaaaattgttaacagatttccaatcacaccaattatgggcgacactattgtcacttactttcattaagacaactttcagcttacattatgcctggaaaaccatggcaatggtcctaagtatcgtatcattattcccattatgtttatctacgacatcacagaaaacgacgtggttgccagttctacttggaagtctgggctgtaaaccactaactatgttcttaatagcggagaataaaatttggggtcgtaagagttggccgctgaatgaaggcataatggccgttggtattgtttctattttattaagttcattgcttaaaaacgatgtaccattagcaggacccttaatagcgggtgggatgctcattgcatgttatgtaatatccggtagcagtgctgacctcagtttagagaaggcggcagaagtctcttgggaagaagaagcggaacactcaggagcaagtcataacatattagtggaggtgcaagacgatggtacaatgaaaataaaagacgaggaaagagacgatacactcactattttactaaaagctacgctattagcggtaagtggggtttaccctctttccatcccagctacactattcgtatggtacttttggcaaaagaagaaacaaaggtcgggcgttttatgggatacacccagccctccggaagtggaacgagcagtactagatgatgggatttatagaattatgcaacgcggactattgggaagatctcaggtgggagtaggagtatttcaggagaatgtatttcacacgatgtggcacgtaacacgaggagcagttctaatgtatcaaggtaaacgattagaacctagctgggcgtcagtcaagaaagatctaatatcttatggaggtggatggagattaagagggagttggaacaccggagaagaagttcaagttatcgcagttgaaccgggcaaaaatcctaagaatgtccagaccgcccccgggacttttaaaactcccgaaggcgaggtaggggctatcgcactggattttaaaccaggtacatcaggttccccaatagtcaatagggaaggtaaaatagtaggattatacggcaatggggtagtaacgacctctgggatatatgtttcagccattgcccaagctaaagctagtcaggaaggtccattaccagaaatagaagacgaggtattccgtaaacgtaacttaaccattatggatctccacccgggatcaggtaaaacaagaaggtaccttccagccattgtacgagaagcaatcaaaagaaaattgagaacattgattctggcccccaccagggtagtagcgtctgagatggctgaagcactgaaaggtatgcccatcaggtaccaaacaacagcagtaaaatctgaacacacaggaaaagaaatcgtagatctaatgtgtcatgcaactttcaccatgaggcttttatcgccggtaagagtgcctaattataatatgataatcatggatgaagcccatttcacagatcccagcagtatagctgctagaggatatattagcacgcgcgtcggaatgggtgaagctgcagcaatcttcatgactgctacaccacctggtagtgtagaagccttcccacaatcaaatgcggtgattcaggacgaagaacgtgatatacctgaacgttcatggaacagtgggcatgaatggataacagattttccgggcaaaacggtctggtttgttccttcaataaaaagtggtaacgatatcgcaaattgcctaaggaaaaatggtaaaagagttattcaacttagcagaaaaacatttgatactgaatatcagaaaactaagaataatgattgggactatgtggtgacaactgacatcagtgaaatgggagcgaattttcgagcagatagagtgatagaccccagaagatgtctaaaaccagtgatactgaaagatggacccgaacgagtaattttagcagggccaatgccagtaacagtagcttctgctgcacaaagaaggggaaggattggaagaaaccacaataaagagggagaccaatacatatatatgggccaaccactaaataacgatgaagaccatgctcattggactgaagccaaaatgcttcttgataacattaatacaccagaaggaattattcctgcattatttgagccagagagggagaagtcagcggctgtagacggagaatataggttaagaggggaagctaggaaaacatttgtagagttaatgagaaggggagacttaccagtatggttgagttacaaagtggcatccgaaggattccaatatagtgatagaagatggtgctttgatggtgaaagaaataaccaggtattggaggaaaacatggacgttgagatatggacgaaggaaggagaacggaaaaagttaaggcctaggtggcttgatgcgcgtacttactctgacccattagctctacgagaatttaaagaatttgcagctggaagacgttcggtctcgggcgatttaatactagaaattgggaaattgcctcaacatttaacacaacgtgcccagaatgcgctcgataatttggtgatgctacacaactcagagcagggaggtcgcgcctatagacatgcaatggaggaattacccgacacaatagaaacgttgatgcttctcgcccttatagcagttctaactggtggagtaacactatttttcctatcaggaagaggcttgggaaaaacgagtataggacttttatgtgttatggcatcgagtgtcttactctggatggcatctgttgaaccacattggattgcagcctctataattctcgagtttttccttatggttttgttaattcctgaaccagataggcaaagaacaccacaggacaatcaattggcatacgtagtaattggattgctctttatgatactaaccgtcgcagccaatgaaatgggtttattggagaccactaaaaaggatttaggaataggccacgtagctgtagaaaaccaccatcacgctgctatgttagatgtagatttacatccagcctcagcctggacactatacgctgtagcaacgaccataatcactcctatgatgcgacatacaattgaaaatacaaccgcaaacatatcattaacagcgatagccaaccaagcggccattctaatgggactggacaaaggatggccaataagtaaaatggatattggggttccgttactggcacttgggtgctattcacaagtaaacccactaacgttgacagcagccgtgcttatgctcgtagcacactacgccataatcggaccggggttgcaggcgaaagctacccgtgaagcacaaaagagaacagcggccggtataatgaaaaatccaacagtcgatggaattgtagcgatagacctggatcctgttgtatacgatgctaaatttgaaaaacaactaggccaaataatgctactcattttgtgcacatcacagatactactaatgcgcacaacttgggcattatgcgaatccattactttggcaacaggaccattaacaacattgtgggaaggatcccccggaaaattttggaacactacgatagcagtgagtatggcaaatattttcagaggtagttacttagccggtgcaggactagccttcagtctcatgaaatcgctgggtggtgggcgtcgtgggacaggagcacaaggagaaacgttaggcgaaaaatggaaaaggcaattaaatcaactgtctaagtctgagtttaacacatataaaagatctggaatcatggaagtggatagaagtgaagcgaaagagggactgaaaagaggagaaacaactaaacacgcagttagccgaggaacggcaaaattacgatggttcgtcgagcgtaaccttgtcaagcctgaaggaaaagtcatcgatcttggctgcggacggggagggtggtcttactactgtgcggggttgaagaaagtaacagaggttaaggggtacacaaaaggtgggccaggtcatgaggaacctataccaatggcaacttacggatggaatctcgttaagctacattctggaaaagatgtgttctttattccacctgaaaagtgtgacacactattatgtgacataggggagagcagcccgaatcctacgattgaggaaggacgaacgctacgcgtattaaaaatggtagaaccttggctacgtggaaatcaattttgtatcaaaatactgaatccatatatgccgtccgttgtagaaacacttgaacagatgcaaaggaaacacggaggaatgctagtaagaaatccactgtcccgaaactctactcacgaaatgtattgggtgagctgcggtacaggtaacattgtaagtgccgttaacatgacaagtagaatgctcctcaatcgctttacaatggcacacaggaaacctacatacgaaagagacgtggacttgggcactggtacaagacatgtagccgttgaaccggaagttgcgaacttggatataatagggcaacggatagaaaatataaaacatgagcacaagagtacttggcattatgatgaggacaatccctacaaaacttgggcttaccatggttcctatgaggtcaaaccttcaggatccgctagcagcatggtaaatggcgtagttaaattattgactaaaccctgggatgttataccaatggtaacgcaaatagcaatgactgacactactccgttcggacaacaacgtgtatttaaagaaaaggtagacaccaggaccccgaaggctaaacgtggcacggcacagataatggaagtaacagccagatggctatggggatttttaagccgtaataagaaacctagaatatgcacgcgagaggagttcaccagaaaagtgagatctaatgcggcgattggagcagtgttcgtggacgaaaatcaatggaactcggcaaaggaagcagtagaagatgagaggttttgggacctggtacatagggagagagagttacataaacaaggcaaatgtgcaacatgtgtatataatatgatggggaaacgcgaaaagaaacttggagaatttggaaaggcaaaagggagccgcgcaatatggtatatgtggctgggggcacggtttctagagttcgaggctttaggattcatgaatgaagatcattggttttcacgcgagaatagcctatcaggcgttgaaggtgagggattacataaactaggatatatattaagagatatttcaaaaattccaggaggtaacatgtacgctgatgatacagcaggatgggatactcgtatcacagaagacgacctgcaaaatgaagcaaaaataaccgacataatggaaccagaacatgccttattagctaaagcgatattcaaacttacataccagaacaaagtcgttagagtgcaacgcccagcgaaaaatgggactgtaatggatgtaattagtagacgtgatcagcgcgggtctggtcaagtaggcacttatgggctaaatactttcacaaatatggaggcgcagttaatccggcagatggaatctgagggcatattctcaccttccgaattagagacacctaatttggctgagagagcacttgattggctggagaaatatggtgttgaacgactgaaacgaatggctatctctggggacgattgcgtagtaaaaccaatagacgatcgtttcgcaacagccttaactgcactaaacgacatggggaaagttcgcaaagatataccccaatgggagccaagcaaaggttggaatgactggcaacaagtacccttctgctctcatcattttcatcaactgattatgaaggacgggagagagattgtagtaccctgcaggaatcaagatgaattggtaggccgtgctagagtgtcacagggcgctggttggtccctccgcgagactgcctgcctaggtaaatcatacgcgcagatgtggcaacttatgtattttcatcgtcgtgatttaagattggcagcaaatgccatatgttcagcagttccagtagattgggtgccgacttcacgaactacttggtcaatccacgcacatcatcaatggatgactaccgaggacatgctctccgtatggaatcgtgtatggattgaagaaaacccttggatggaagataaaacacacataagttcatgggaagacgtaccctacctaggaaagcgtgaagaccagtggtgcggaagtctaatcggtttaactgctagggcaacctgggcgacgaatattcaagtcgctataaatcaggttcggaggttaattggaaatgagaactaccttgattatatgacgtctatgaaacgtttcaaaaacgaatcagatccagaaggggcactttggtag

SEQ ID NO: 21534 - RNA, 9879 nt, synthetic construct
  misc_feature 1..9879: note = derived and/or modified CDS sequence (opt6) from DENV-1__FJ410198__SS-prME
  source 1..9879: mol_type = other RNA
agtgtcacaatgttactaatgctaatgccaactgcacttgcattccacctcactaccagagggggtgaaccacacatgatagtttcaaaacaagaacgcggaaaatctctactttttaaaacatcagctggagtgaacatgtgcaccttaatagcaatggatttaggtgaattatgtgaagacaccatgacatataaatgtccaagaataacagaaaccgaaccagatgacgtagactgttggtgcaatgccactgatacttgggttacatacggcacatgttcgcaaacaggcgaacatcgcagagacaaaaggagcgttgcgttggctcctcatgtcggcttaggacttgaaacacgtacagaaacctggatgagttccgaaggtgcctggaaacaaatacaacgtgtagaaacttgggcacttcggcacccaggatttacagtcatagcactttttctggcacacgcaataggcacgagtattacacaaaaaggaataatatttatattactcatgcttgtaaccccatcaatggcaatgcgctgcgtgggaattggatcaagagattttgtagaaggattatcaggggcaacttgggttgatgtagtattggaacatggaagctgtgtcacaacgatggctaaagacaaaccaacattggatatcgaactactgaaaaccgaagtcactaacccagcagttctgcgaaaactttgtatcgaagcaaaaatttctaataccacaactgactctcgatgtcctactcaaggcgaagcaacattggtcgaagaacaagacgcaaattttgtctgtagaagaacgttcgtcgaccgaggttggggcaatggatgcggactgtttggaaaaggaagcctaataacttgcgcgaaattcaaatgtgtgacgaaactagaaggcaaaattgtacaatatgagaacttaaaatatagtgtaatagtaactgtccatactggagatcaacatcaagtaggcaacgagagtacagaacacggtactacagctactatcacaccgcaagctcccactactgaaatccaactaactgactatggagcattaacactggattgttctcctagaacgggtcttgactttaatgaaatggtactacttaccatgaaagagaaaagttggttagtccacaaacaatggttcttggatttaccactgccatggacaagcggagcctctacatcacaagagacatggaatagacaagacttattagtgacgtttaaaacagcacacgccaagaaacaagaggtagtagtattaggctcacaagaaggagcgatgcatacagccttaacaggtgcgacagaaatacaaacaagcggaaccaccacgatattcgctggtcacctcaaatgcaggttaaaaatggacaaactcacattaaaaggtatgagttacgtgatgtgcacagggagctttaaattagaaaaagaagtagcagagactcaacacgggactgttcttgtacaaattaaatacgaggggacagatgcaccgtgtaaaattccatttagcacacaagatgaaaagggagtgactcaaaacggccggttgattacagctaatccaatcgttaccgataaggaaaaaccggtgaacatagaagcagaacccccatttggcgaatcttacattgtaattggtgcgggtgaaaaggcattgaaactgagctggtttaagaaaggttcgtctatcggcaaaatgtttgaagctactgcaagaggagcccgcaggatggccatactgggtgatacagcatgggatttcggaagtattggtggagtgtttacaagtgttggtaaattagtacatcagatatttggaacagcctatggcgttttatttagtggagtttcatggactatgaaaataggaatcggggttctcctgacatggctaggtttaaacagcagaagtacatcactgagtatgacgtgtatcgccgtaggtctagtcacactttatctgggcgtaatggtgcaagcagactcaggatgcgtaattaattggaagggaagagagttaaaatgcggatccgggattttcgtcacaaatgaagttcatacatggaccgaacaatataagttccaagctgactctcccaagagattgtccgcggcaatcggcaaggcctgggaagagggtgtttgtggtataagaagtgctacaagattggagaatataatgtggaagcagatttccaacgagttaaatcacattttactagaaaatgacatgaaatttaccgtggtagtaggggacgttgctggtattctagcacaagggaagaaaatgatacgaccgcaaccaatggaatataaatattcgtggaaatcttggggcaaagcaaaaataataggtgcggatgtacagaatactacatttatcatcgacggtccgaatacgccagagtgtccagatgatcagcgcgcttggaatatttgggaagtagaagattatggtttcggaatcttcacaacgaacatatggttaaaacttcgagacagttacactcaagtctgtgatcaccgtctaatgtcagcagcaataaaagattccaaagctgttcatgcggatatgggctattggatcgagtctgagaaaaacgaaacttggaaacttgcaagagcctcattcatcgaagttaagacatgtatttggccaaaatcacatacactttggagtaatggcgtactagagagtgaaatgattataccgaagatatatggcggtccaataagccaacacaactaccgaccgggatatttcacccaaacagctggtccatggcacctgggtaagttagaattggactttgacttgtgtgagggtacaaccgtcgtggttgatgaacattgcggtaacaggggtccatcattaagaacgaccactgtcacgggaaaaataatacatgaatggtgctgtcgatcctgtacattgcctcccttaagatttagaggggaagacggatgttggtatggcatggaaatacgtcccgttaaggaaaaagaagaaaacttagtaaaatctatggtaagtgcgggatccggggaggtagactcttttagtttaggtctgctatgcatctctataatgatagaagaggtgatgaggtcacgatggtccagaaagatgttaatgactggcacactagcagtatttttcctactgattatgggacaattaacctggaacgacctaataagactatgcataatggttggtgccaacgcttccgaccgcatgggtatgggcacaacatatttagccctcatggcgacctttaaaatgcgccccatgtttgcagtgggattgctgtttcggcgtctaacgagtagagaggtcttattgttgacgatcggactctcattagtagcaagcgtagaattaccaaatagcttagaagaactgggagatggtctagcaatgggtatcatgatattaaagctactgacagatttccaaagtcatcaactttgggcaaccctacttagcttaacattcataaaaacaaccttttcgttgcattatgcatggaagactatggcgatggtactgagtatagtttcattatttcctttatgcctcagcaccaccagtcagaaaactacatggctacctgttctacttggtagtctaggatgtaaacctcttaccatgtttctaatagctgaaaataaaatttggggccgtcgcagttggccactcaacgaaggaataatggctgtgggaatcgttagcatattgttaagttcattattaaagaatgatgttccgttagccgggccgctaatagcaggcggtatgcttatagcttgctatgtaatttcaggaagctcagcagatctgtctctagaaaaagcagctgaagtgagctgggaagaagaagccgagcatagtggtgcatcacataatatcctagtcgaagttcaggatgacggtacaatgaaaattaaagacgaagaaagagatgatactctgactattttgctgaaagcgacgttgttggcagtgagtggtgtatatccattgtcaataccagcaacactattcgtttggtacttctggcagaagaagaaacaaagatctggagttttatgggatacaccctcaccaccggaagtcggccgcgcagttctagatgatggcatatatcgtatcatgcaaagaggactcttaggacgatcacaagttggcgttggagtttttcaggagaacgtattccatacaatgtggcatgtaacaaggggtgcggtgctaatgtaccaaggtaaaagactagaaccatcatgggcatcagtcaagaaagatttaatttcatatggaggcggatggagacttcaaggatcgtggaatacaggagaagaagttcaagtaatagctgtcgaaccagggaaaaatcctaaaaatgttcaaactgcaccaggtacgtttaaaactcctgaaggagaagttggagcaatagcgcttgacttcaaacccggcacaagtgggagcccaatagtaaatagagaaggaaaaattgtcggtctttatggaaatggggttgtaactacatccgggacctatgtatctgcaatagctcaagctaaagctagtcaagaaggaccattacccgagatagaagatgaagtgttcagaaagaggaaccttacaattatggatttacatccgggctcaggtaaaacgagaaggtatttacccgcgatcgttagggaagcgataaaacgtaaactccgcacgttaattcttgcaccgacgcgagttgttgccagtgaaatggctgaggccttaaaggggatgccgataagataccaaaccaccgcagtaaaatcggaacacaccggcaaagaaattgtagatctaatgtgtcacgctacttttaccatgagactactcagcccagtacgcgtcccgaattataatatgataataatggatgaagcccattttacagacccgtccagcatagcagcacgtgggtacatatcgacccgcgtcggaatgggagaagcagcagcaatctttatgacagctacaccacctgggagtgtagaagcattccctcaatcgaacgctgtgatacaagatgaagaaagagacatccctgaaagaagctggaacagcggctatgaatggataacagatttcccaggtaaaactgtctggttcgttccatctatcaaaagtggcaatgacattgcgaattgcctcagaaagaacgggaaaagggtcatccaactctctagaaaaactttcgacactgagtaccagaaaactaaaaataatgactgggactatgtagtaacaacagacataagtgaaatgggggcaaattttagagctgatcgagtaattgatcccaggcgatgcttgaaaccagtcatattaaaagacgggccagaacgtgtcattttggcaggaccgatgcctgtcacagtagcgtcggccgctcaaaggagaggacgaataggtagaaatcacaataaagaaggagatcaatatatatacatgggacaaccgttaaacaatgacgaagaccatgcacactggacagaggcaaaaatgttactagacaacataaatacaccagaaggaatcatacctgcattatttgagccggaacgagagaaaagtgcagccatcgatggagagtatcgactcagaggagaggcgagaaaaacatttgtagagctgatgcgtagaggagaccttccggtatggttaagttacaaagttgcttcggaagggtttcaatattcggatagaaggtggtgctttgatggggaaagaaataaccaggtgctagaagaaaatatggacgtggaaatatggaccaaggaaggagaacgtaagaaactgcgacctcgttggcttgatgctcgaacttattctgaccctcttgccttacgcgagttcaaagagttcgcagcaggccggaggagcgtaagtggtgatttaattttagaaattgggaaactcccgcagcatttaacccaaagagcgcaaaatgctttggacaacctggtaatgttacataattcagaacaaggtggtagagcttaccgacatgcaatggaagaactaccagacaccattgaaacgttgatgctacttgccttaatcgctgtattgacaggaggtgtaacgctatttttcctaagcggacgtggtttggggaaaacatctattggattgctgtgtgtcatggcatcttcagttttattatggatggcatcagtagaaccacattggatagcagcttctattatcttggagttctttttgatggtattactcattccagaaccggacagacaaaggactccccaagacaatcaattagcctacgtggtaattggacttctatttatgatacttactgttgccgccaatgaaatgggccttttagaaacaacaaagaaagatctaggaatcggtcacgtagctgtagaaaaccaccatcacgccacaatgttggacgtggatttgcaccctgcatccgcatggacgctctacgccgttgcaacaacaatcataacacccatgatgcggcatacgatcgagaacacaacagctaacatatccttaacagccatagccaaccaagcagccatcttaatgggcctagataagggatggccgatatccaaaatggacataggggtacctctcctagcgctaggatgttactcacaagtaaatccactaacgttaacagcggctgtactaatgttagtagcacattatgcaataattgggccgggactacaagcaaaagctacgagggaggcgcagaaaagaaccgcagcaggcataatgaaaaaccctacggtagatggaatcgtggccatagatctagaccccgttgtttacgacgcaaagttcgaaaaacaactaggacaaataatgctactaattctatgcacttcacaaatattattaatgcgcaccacttgggcactctgtgagtcaatcacattagccacaggacctttgacaactttgtgggagggctcaccagggaaattctggaacaccactatcgcggtatcgatggcaaacatttttagaggatcgtatttagcaggagctggacttgcattctcgctcatgaagtcgctgggcggaggcagaagaggaactggcgcgcagggagaaacgcttggagaaaaatggaaacgacaacttaaccaattatctaaatctgagtttaatacgtacaaaaggagtggtataatggaggtggatagatcggaagcaaaagaagggttgaaacgaggcgaaaccacgaagcacgcagtcagtcggggaacggcgaaactacgttggtttgtcgaaagaaaccttgtaaaaccggaggggaaagtaattgacctgggatgcggaagaggaggatggtcttactactgtgctggactcaagaaagttactgaagttaaaggatatacaaagggtggtcctggacatgaagaaccaattccaatggctacatatggatggaatttagtcaaattacatagcgggaaagacgtcttctttatacctccggaaaagtgtgatacacttttgtgcgatataggtgaaagttctccgaacccaacgattgaagaaggacgcaccttaagagtgctaaagatggtggaaccatggctacgaggcaatcaattttgcatcaagattctaaatccttatatgccatcggtagttgaaacactagaacaaatgcagcggaaacacggtggtatgttagtaagaaacccgttatcacgaaactctacacatgaaatgtattgggtctcttgtggaactgggaatatcgtttcagcagtcaacatgacatctcgaatgcttctgaatcgttttacaatggcacaccgcaaacctacttatgagagagacgtggatctaggagcagggactagacatgtagcagtagaacctgaagtagcgaatttagacattataggccagaggatcgagaatattaaacacgaacacaagtcaacgtggcactacgatgaagacaacccttacaaaacttgggcatatcatggatcatacgaagtcaaaccgagtggatctgcttcatcaatggtaaatggagtggtaaagttattaacaaaaccatgggacgtgattccaatggtcacccaaattgcaatgacagacaccacgccatttggacagcagcgtgttttcaaggagaaggtagatacaaggacgcctaaggctaagcggggaacggcacaaataatggaggttacagcaaagtggctatggggttttctgtcccgcaataagaaacctcgtatttgcactagggaagaatttaccagaaaggtaagatccaacgctgcgataggggctgtatttgtcgacgaaaaccaatggaactctgcaaaagaagcagttgaagacgaaagattctgggatctagtgcatcgcgaaagggaactacacaagcagggaaaatgcgcaacatgcgtatacaatatgatgggtaagcgtgagaagaaacttggagagttcggtaaagccaaaggatcaagagctatctggtatatgtggcttggagcgaggttcctagaatttgaagcattgggcttcatgaacgaagaccattggttttccagagaaaactctttatcaggtgtagaaggagaaggattacacaaactgggatatatattaagagatatatcaaatataccaggtggtaatatgtacgcagatgatactgcaggatgggacactaggataaccgaggatgatttgcagaatgaggctagaataacggatataatggaaccagaacatgcactgctagcgaaaagtatatttaaattgacttaccaaaacaaagtagtaagagtacagcggccggccaaaaatggcactgtgatggacgtaatttcccgacgcgaccagagaggtagtggacaggttggcacatatggactcaacacatttaccaacatggaagcccaattaatacgtcaaatggaatccgagggtattttcagtccaagcgagttagaaactccaaacttagcagagagagtattggattggctagaaaaatacggtgtggagagactaaaaagaatggccatctctggggatgattgcgtagtaaaaccgattgatgacagatttgcaacagcgttaacagcattaaacgacatgggcaaagttcgtaaggatataccacaatgggaaccgagcaaaggttggaatgattggcaacaagttcccttctgcagtcaccattttcatcagttaattatgaaagatggtcgagagatagtagtcccatgtagaaaccaagatgagttagtaggcagagcgcgtgtgtctcaaggagcaggatggtcattaagagaaacggcatgtttagggaaatcatacgctcagatgtggcaattaatgtattttcatagacgcgacctaagattagccgccaatgcaatatgttccgctgtgcctgtagattggatacctacatctagaaccacatggagtatacatgctcatcatcaatggatgaccacagaagatatgctttcagtatggaaccgcgtttggattgaggaaaacccatggatggaagacaaaacgcatatcagctcatggggagatgttccatatttaggaaagcgcgaagaccagtggtgtggatcattaattggtcttaccgccagggcgacatgggcaaccaatatacaagtagctatcaaccaagttagacgacttattgggaatgaaaattatctagactatatgacctcaatgaaacgtttcaaaaacgagtctgatcccgaaggcgctctatggtag

SEQ ID NO: 21535 - RNA, 9879 nt, synthetic construct
  misc_feature 1..9879: note = derived and/or modified CDS sequence (opt6) from DENV-1__FJ410199__SS-prME
  source 1..9879: mol_type = other RNA
tcggttacaatgctgttaatgttaatgcctacggccctagcttttcatcttactacacgcggtggtgaacctcatatgatcgtgtcaaaacaagaacgaggtaagagcttgctttttaagacttcagctggagttaatatgtgcaccctaatagccatggatctaggcgaattttgcgaagatacgatgacctataaatgtccgcgaattacggaagcagaaccagatgacgtggactgctggtgtaacgctacagacacatgggtgacatatggtacttgttcacaaacaggggaacatcgaagagataaacgtagcgtagctcttgctccacacgttggactaggcttggaaactagaactgaaacctggatgtctagcgaaggtgcttggaaacaaatacaaagagtggaaacatgggcattaaggcatccagggtttactgtaatagcactctttctagcacatgctataggaacttccatcacacaaaaaggaatcatatttatcttattaatgcttgtaactccaagcatggctatgagatgcgttggtataggatccagggactttgtagaaggtttatcaggcgcgacatgggtagatgtggtactagaacacggaagctgtgttacgacaatggcgaaggataagccaacgctagacattgaattactaaagacagaagttaccaatccggcagtactaagaaaactctgcatagaagccaaaataagtaacacaacgactgatagtagatgccctactcaaggagaagctaccctagtagaagaacaagatgctaatttcgtatgcaggcgaacatttgtagatagaggatgggggaacgggtgtggtctattcggaaaagggtcactaatcacatgtgcaaagtttaagtgtgttaccaagctagaagggaaaactgttcaatatgaaaatttgaagtattcagtaatcgtaaccgtgcacaccggagaccaacatcaagtaggaaacgaatcaactgagcatggaacaacagcaacaataactccacaggcaccatcgacagagattcagctaactgattatggagctcttacattggactgtagtccaaggacaggactagattttaatgaaatggtactacttacaatgaaagagaaatcctggttagtacataaacagtggtttctggatttaccactcccatggacatctggggcttcgacatcacaagaaacctggaatagaaaagatctattagtgacttttaaaaccgcacacgctaagaaacaggaggtagtcgtactaggttctcaagaaggagcaatgcacacagcattaacaggcgcgacagaaattcagacaagcggtactacaacaatatttgccggacatttaaaatgtagattaaaaatggacaagctgacactgaaaggaatgtcttatgtcatgtgtacaggttcctttaaactagagaaagaagtagcagagactcaacacggcacagtgcttgtacaaataaaatacgagggaacggatgcgccctgtaaaataccttttagcacacaagatgaaaaaggagtaacacaaaatggccgtctaatcacagccaatcccattgtaacggacaaagaaaaaccggtaaacatagaagccgagcccccgtttggagaatcttacatagttattggagcaggcgaaaaggctttaaaactatcttggttcaaaaagggaagctctataggaaagatgtttgaagctactgctagaggggctcgaagaatggcgatcctaggagacacagcctgggatttcggttcgattggaggtgtctttacctcggttggcaaactcgtgcaccagatatttggaacggcgtacggggtcctattctcaggtgtatcttggacaatgaaaattggtatcggtgtattacttacatggttaggactaaattcacgttctacatcacttagcatgacctgcatagcggtgggtttagtaacactttacttaggggtcatggtacaagcagattcaggatgtgtaattaactggaaagggagggaactcaaatgtgggagtggaatattcgtaactaacgaggtccacacgtggacagaacagtacaagttccaggctgatagccccaaaagactatcggctgccattggaaaggcgtgggaagaaggcgtgtgtgggataagatctgctacaagacttgaaaacataatgtggaagcagattagcaacgagttgaatcatatattactggaaaacgatatgaaattcaccgtggtagtaggcgacgtcgcaggcatattggcccaaggcaagaaaatgataaggccacaaccgatggaatataaatattcctggaaatcttggggtaaagcaaaaatcataggggcagacgtacaaaacactacatttataatagacggcccgaataccccggaatgtccagacgaccagcgcgcatggaatatttgggaagtagaggactacggatttggcatctttactacaaacatatggcttaaattgagagactcatacacccaagtatgtgaccatagactcatgtcggcagcgattaaagattctaaggcagtccatgcggatatgggatattggatcgaaagtgagaaaaacgaaacatggaaactggcccgagcatcctttattgaagtgaagacttgtatttggccgaagtctcacacactttggagcaatggagtgctagaatcggagatgataatacccaaaaattacggagggccaatcagccaacacaattacagaccaggatacttcactcaaacagctggaccatggcacttaggtaagttggaacttgactttgatttatgtgagggaacgacggtggtcgttgacgaacactgtggcaaccgtggacctagccttagaacaactacagttacgggaaagataatccacgagtggtgttgccggtcatgcacgctcccgccgttgagatttaaaggagaagatgggtgctggtacggaatggaaattcgtccagtaaaagaaaaagaagaaaatttagtaaaatcaatggtctctgcaggctctggtgaagtggattcctttagcctgggattgctatgcataagcatcatgatagaagaggttatgagatcgcgatggagtagaaaaatgttaatgacgggtacgctagcagtgctttttctattaatcatgggccaacttacatggagtgatctaataagactctgcataatggtaggagctaacgcgagtgatcggatgggaatgggtaccacttatcttgcattgatggcaacatttaagatgagacccatgttcgcggttggacttttattcagacgactcacatcccgtgaagtattattactaacaattggattatcacttgtagctagtgttgaactgccgaactcattagaagaactaggtgatggcttagcaatgggaataatgatactaaaattattaactgactttcaatcacaccaactgtgggcaactcttctatcactcactttcattaaaaccacttttagcttacactatgcctggaaaactatggccatggtattaagtatagtcagcctatttccattatgtctatccactacaagccagaaaacaacctggttaccagtactacttggttccttaggctgtaaaccacttaccatgtttctaatcgcagaaaataaaatatggggtcggaaatcgtggccgttaaatgaaggaataatggcagtcggaatagtatcaatccttttgagttcgttgcttaaaaatgacgtgcccctagcaggacctctcattgcgggaggtatgctgatagcttgttatgtaatcagtggatcaagtgcggatctaagtttagaaaaagctgccgaggtaagttgggaggaggaagcagaacattcaggtgcaagccataacatccttgtagaagtacaagacgatggaacgatgaaaatcaaagacgaagaacgtgacgataccctaacaattcttctaaaggctacactacttgcagtttccggggtatatccgcttagcataccggctacattattcgtttggtacttttggcaaaagaagaaacagcgatcaggagtattatgggatacaccgagcccaccagaagtagaaagagctgtgctagacgatggaatataccgaattatgcaaaggggcctgctcggaagatcacaagtgggcgtgggtgtctttcaagagaatgtctttcatacaatgtggcatgtaacaagaggcgcagtgctaatgtatcagggaaaaagattagaaccaagttgggcatcagtcaagaaagatctaatttcatacggtggaggctggagattacagggatcatggaatactggagaggaggtacaggtaattgctgtagagccaggaaagaaccccaaaaatgtacaaacggcgcccggcacatttaagacgtcagaaggggaagtaggagccatagcactggactttaaaccgggaacatcgggtagtcctatagtaaatcgcgaaggcaaaatagtcggtctatacggcaatggagtcgtgaccacatcgggaacatatgtgtccgcaattgctcaggccaaagcctcccaagagggacctttaccggaaatcgaagatgaagtgttccgaaagagaaacttaacaatcatggacttacacccaggtagtggtaagactaggaagtatctaccagcaattgttagagaggctatcaaacggaaactcagaaccctcatccttgcaccaactcgtgtcgtcgcatcggagatggcagaggctttgaaaggaatgccgataagatatcaaacgactgcggttaaaagtgaacatactggaaaggaaattgtagacttaatgtgccacgcaacatttactatgagattgctttcgcctgtgagagtcccgaattataatatgataataatggacgaagcacattttactgacccttctagcatagccgctaggggttacataagtaccagggtggggatgggggaagcagcagcaatatttatgactgcaacgccccctggatcggtggaggcatttccccaaagtaatgctgtaattcaagatgaggaaagggatattcccgaaaggagttggaatagtggctatgagtggatcactgattttccaggaaaaactgtgtggttcgtaccatcaattaaatcgggtaacgacatagctaattgcttacgaaagaatgggaaaagggtcattcagttgtcaagaaaaacatttgatactgaatatcagaagactaaaaacaatgattgggactatgtcgttacgacagatatatcggaaatgggcgcaaacttcagggcagatcgagtaatagatccacgaagatgcttaaaaccagtcattctcaaggatggcccggagcgcgttattttagctgggcctatgccagtaacggtagcatcagcagctcagagacgaggaagaatcggcagaaaccacaacaaagaaggagaccaatacatatacatggggcaaccactgaataacgacgaagatcatgcccactggacagaagcgaaaatgctattagataatataaacacaccagaaggaataataccggccctattcgaaccagaaagggagaagtcagctgcgatagatggcgaataccgattgagaggagaagctcgcaaaacatttgtcgaactgatgcgaaggggtgacctaccagtgtggctatcgtacaaagttgccagtgaaggttttcaatacagtgatagaagatggtgttttgacggggaacggaacaaccaagtactggaggaaaatatggatgttgaaatatggaccaaagaaggagaacgaaagaaattaagaccacgttggcttgacgcacgaacgtactcagatcctttggcattaagagaatttaaagagttcgccgctggaaggcgatctgtgtctggtgatttaatactagagattggtaaattaccacaacatctaacacaacgtgctcaaaacgcactggacaatctggtcatgctccataactctgaacaaggtgggagagcctatagacatgctatggaggaactacccgatactattgaaactttaatgcttcttgcattgatagcagtattaactggtggagtcacattgttctttctatctggccgaggccttggcaaaaccagtatcggattactttgcgtcatggcgtcatccgtactgctttggatggcttcagtcgaacctcactggattgctgcttccataattttagaatttttcctaatggtactcctcattcctgaacccgacagacaacggactccacaagataaccagttagcatacgtagttattggactgttatttatgattttaactgtagcagcgaatgaaatgggattacttgaaacaaccaagaaagacttagggattggtcatgtagctgttgaaaatcaccatcatgcagctatgttagatgttgacctccatccggcttctgcatggacactatatgcagtggctacaacgataattacgccaatgatgagacatacaattgaaaatacaacggccaatataagccttacagccatagctaatcaagccgctatattaatgggtcttgacaaaggttggccaataagtaagatggatattggagtaccgctactcgcgctgggctgttacagtcaggtaaacccactaactttaacagcagcagtactaatgctagtagcccactatgccataattggaccgggattgcaagcaaaagcaacgagagaggctcagaaaaggactgcagcaggaatcatgaaaaatccaactgtagatgggattgtagcgatagatctagaccccgtagtttatgatgcaaaatttgagaaacaactaggccaaatcatgcttttaattttgtgtacatcacaaatattacttatgaggacgacatgggcactctgtgaatccataacactggcaaccggtccattaaccacattatgggaaggttcccccgggaaattttggaacacaacaattgcagtaagcatggctaatatatttagaggatcatatcttgccggtgccgggttagcattttcattaatgaagtctttaggtggcggaaggaggggaacaggcgcgcaaggtgaaactctcggtgaaaagtggaaacgacaattaaatcaattaagcaaatctgaatttaacacttataaaagaagtggaatcatggaggtagatcgaagcgaagcgaaagaggggttaaagcgcggcgaaacaaccaagcacgcagtaagtagaggaacagcaaaattacgatggttcgttgagcgaaatctggtaaagccagaaggaaaagtaatagatctaggatgcggccgtggcggctggagctattattgtgcaggactgaaaaaggtaactgaagtaaagggttatacgaaagggggaccgggacacgaggaaccaattcctatggcaacttatggctggaacttagtaaaattacactcaggtaaagacgtattctttatacctcctgaaaaatgcgacactttgctatgtgatattggagagagtagtcccaacccaacaatagaggaagggaggaccctgagagtcttaaagatggttgaaccttggctacggggcaaccagttttgcatcaaaattctaaacccatatatgccatctgttgtggagacattggaacaaatgcagagaaaacacgggggaatgctggtaagaaacccactatcaagaaacagcacacacgaaatgtattgggtatcatgtggaacaggtaatatcgtcagtgcagtaaacatgacatcgcgtatgctattaaatcgatttacgatggcgcacagaaaaccgacatacgaacgagacgtggaccttggtgccggtacacgacacgtcgccgtggagcctgaagtcgcaaatttagatataattgggcagcgcattgaaaatattaaacatgaacacaaaagtacctggcactatgacgaagacaacccgtacaaaacgtgggcatatcatggttcttacgaggtaaaaccaagtggttctgcaagcagtatggtcaacggagttgtgaagctccttacaaagccatgggatgtcatacccatggtgactcaaatcgcaatgacagacaccacaccgttcggtcaacaaagggtatttaaagagaaagttgacacacgaacacctaaagcgaagagaggtaccgcccaaattatggaggttacggccaagtggctatggggcttcttatcccggaacaagaaaccaaggatttgcacacgggaagaatttactcgcaaagtacgaagtaatgcagctatcggagccgtttttgtggacgaaaatcagtggaacagtgcaaaagaggctgtagaggatgaacgtttctgggacttagtccatcgggagagagaattacacaaacagggcaagtgtgctacttgtgtgtataacatgatgggcaaaagggagaagaaacttggagaatttgggaaagctaaaggatcaagagcaatatggtatatgtggctcggcgcacgattcttggagtttgaggcactgggatttatgaacgaagatcattggtttagtcgcgaaaattcactatccggcgtggaaggagaagggttacacaaattaggctacatcctaagagacatttccaaaattccaggagggaatatgtatgcagatgacaccgcaggatgggacacaagaataacggaagatgaccttcagaacgaggcaaagattacagatataatggaacctgaacatgcgttattagcaaagtcaatcttcaaacttacctatcaaaataaagtagtcagagttcagaggccagccaaaaacggaaccgttatggatgtaatctcaagacgcgatcaaagaggaagtggacaagttgggacttacggccttaacacgttcacgaatatggaagctcagttgattagacaaatggagtccgaaggaatctttagtcctagcgagctagagacacccaatctagcgggtagagtactcgattggctagaaaaacacggcgtggaacgactaaaaagaatggcaatatccggcgacgactgcgtcgtaaaacccatcgacgatcggttcgctactgcactaaccgcactaaatgatatgggtaaagtaagaaaagacatacctcaatgggaaccaagtaaggggtggaacgattggcagcaagttcctttttgcagtcatcatttccatcagttaatcatgaaagacgggcgtgaaattgtagttccttgcagaaaccaagatgaattagtgggcagagctcgagtgtcacaaggggcaggctggtcattaagggaaaccgcgtgccttggaaaaagctatgcgcaaatgtggcagctaatgtatttccatcgtcgggatttgagacttgctgccaacgctatatgtagcgctgtaccagtggactgggtgccaacctcgcgaactacgtggagtattcatgcacatcaccaatggatgaccaccgaagatatgctatcagtctggaaccgggtatggatcgaagaaaacccatggatggaggataaaacacacatctccagctggggtgatgtaccatacctgggcaaaagagaagatcaatggtgtgggagtctgattggcctaactgctagagcaacgtgggcgactaatatccaagttgcaattaatcaagtaagaagacttataggtaacgaaaactaccttgactatatgacatccatgaaacgttttaaaaacgaaagcgatccagaaggtgctctttggtaa

SEQ ID NO: 21536 - RNA, 9879 nt, synthetic construct
  misc_feature 1..9879: note = derived and/or modified CDS sequence (opt6) from DENV-1__FJ432739__SS-prME
  source 1..9879: mol_type = other RNA
tccgttactatgctgttaatgcttatgccaacagcactggcatttcaccttacaacacgaggcggagaaccgcatatgatagtgtcaaaacaagaaagagggaagtcattgttatttaaaacaagcgcaggggttaatatgtgcacgctaatagccatggacctaggcgaattttgcgaagatacaatgacgtacaaatgcccacgaattacagaagcggagccggatgatgtcgactgttggtgtaatgcaactgacacttgggtaacttacggaacttgttcacaaactggagaacatcgacgagataaaagaagcgtcgccttagccccgcacgtcggcctaggactggaaacccgtaccgagacatggatgtcaagtgagggagcttggaaacaaattcaacgtgtcgaaacctgggcactccgtcatccaggattcacagttatcgcgttgtttttagcgcatgcaatagggacaagcatcacccagaaaggtataatatttatactgttgatgttagttactccatcaatggcgatgaggtgtgtaggaattggcagcagagatttcgtagaagggttaagtggtgcaacgtgggttgatgtagtactagaacacggaagctgtgtcactacaatggccaaagacaaaccaaccttagacattgaattactgaaaaccgaagtaacaaacccagcagtattacgtaaattatgtatagaagccaagattagtaacacaacaacggacagcagatgtccaacacaaggagaagctaccttggtggaagaacaagatgccaactttgtatgtaggagaacttttgtagatcgaggatggggtaacggatgtggtttatttggcaaaggatccctaataacatgtgcaaaatttaagtgcgtgacgaaattggagggcaaaacagtacaatatgagaatttaaaatactcagtaattgtgactgtacatacgggagatcaacatcaagtgggtaatgaatcaaccgaacacggtacgacagcgacgattacccctcaggccccttccacagaaatacaacttacagactacggggcattaactttagattgctcgccaaggacaggattagatttcaacgagatggttctactaacgatgaaagaaaaggcttggttagtacataaacagtggtttcttgatctgcctcttccttggacaagtggagcaagcaccagtcaagaaacatggaacagaaaagatctattggtaacatttaaaactgcacatgcgaagaaacaagaagtcgtagtacttggctcacaggaaggtgcgatgcacacggccctaacaggcgctacagaaatacagacttccggaactactaccatatttgcaggtcacctcaaatgtcgtctaaaaatggacaaattgacgttaaagggtatgtcatatgtgatgtgtacaggtagttttaaactagagaaagaagtggcggagacacagcatggtacagtcctagttcaaatcaaatatgaagggactgacgcaccgtgtaaaatcccttttagtacacaagatgaaaaaggggtaacacaaaatggaagactaataacagcaaaccccattgtgacggacaaagaaaaacccgttaacattgaggcagaaccaccattcggggaaagctatatcgtcataggggcaggagaaaaggcattaaaattaagttggttcaagaaaggttcctcaattggaaaaatgttcgaagctacggcaagaggtgccagaaggatggcaatattaggagacactgcgtgggacttcggcagcattgggggagtatttacaagtgtaggcaagctggtccaccaaatctttggaacagcctatggagtcttgttttcaggtgtatcatggactatgaagatcggtataggagttttgctcacttggctgggactaaattcaagaagcacttctctatcaatgacttgcatagccgtgggtcttgtaacactatatctaggcgtaatggtacaagcagattccggttgcgtcatcaattggaaaggaagggaactaaaatgcggaagtggtatttttgtgaccaatgaagtacatacatggacagaacaatacaaatttcaagccgatagccctaaacgactaagtgctgcaataggtaaggcatgggaagaaggtgtctgtggaattagatctgcgacaagattagaaaacataatgtggaaacaaataagcaatgaattaaatcatattctattggaaaacgatatgaaattcacggtagtggtcggtgacgtggcagggatattggctcaagggaagaaaatgattcgaccacaaccgatggaatataaatatagctggaaaagttgggggaaagctaaaattataggagccgatgtgcaaaatgctacgttcatcatagatggaccaaatacaccagaatgcccagacgatcaaagagcttggaacatctgggaagtagaggactacggatttggaatattcactacaaatatttggcttaaacttcgagattcttatactcaggtatgcgatcaccgattaatgtctgcagccattaaagattctaaagccgttcatgcagacatgggctattggattgaatctgagaaaaatgaaacgtggaaacttgctagagcctcatttatcgaagttaaaacttgcatctggccaaaatcgcacacgttatggagtaacggagtcctagaatctgaaatgattatccctaaaatatatggtggaccaataagccagcacaattaccgacctggttatttcacacaaaccgctggtccatggcatctcggcaagttagaactagactttgacttatgcgagggaacaacagtagtagtagacgaacactgtggaaacagaggtccgtcattaagaactacaactgtaaccggcaaaataatccacgaatggtgttgtagatcatgtacgctcccaccgttaagatttaaaggagaagatgggtgctggtacggtatggagattagaccagtcaaagagaaggaagaaaacttagttaaatcaatggtttcggcggggtccggagaagttgattctttttcattaggattattgtgcatatcaatcatgattgaggaggttatgcgaagtaggtggagcaggaaaatgctaatgaccggaatccttgcagtctttttcctactaattatgggtcaacttacttggaatgacttgatacgcctatgtataatggtgggtgcaaatgcttcagacagaatgggcatgggtactacctaccttgctctaatggccaccttcaaaatgcgtcctatgttcgctgtaggacttttgttccgaaggttaacgagtagagaggttctacttttaactattggactcagtcttgttgcctcggttgagttgccaaactcattggaagaattaggtgatggcttggccatgggtataatgatactaaagttacttacagattttcagtctcaccagctatgggctacattgcttagtctgacgtttatcaaaacaacatttagtctgcattacgcgtggaaaactatggcgatggtattgtcaatagtgagcttgtttccactgtgcctttcgactacgagtcagaaaacaacatggctccccgtgcttttaggtagcctgggttgtaaaccactgactatgtttttaattgcagaaaataaaatatggggaagaaagtcatggcctttaaatgaaggaattatggcggtaggaatcgtatctatactactctcctccctactcaaaaatgatgtgcctttggcaggaccactaatcgcaggaggcatgttaatagcatgttatgtaataagcgggtccagcgctgatttatcacttgagaaagcggcagaagtatcttgggaagaagaagcggagcactcaggtgctagtcataatatccttgtggaagtccaagacgacgggacgatgaaaataaaagatgaggaacgagatgatacccttactatactattgaaagctacgttactagcagtctctggagtttacccattaagcatccctgcaacactcttcgtatggtatttttggcagaaaaagaaacaaagatcaggcgtgttgtgggataccccttcacccccggaagtcgaaagagcagtactggatgacggaatttataggattatgcagagagggctcctaggtcgctcacaggtaggtgttggtgtttttcaagagaacgtctttcatactatgtggcatgttaccaggggtgctgtgttgatgtatcaaggaaaaagattagaaccatcttgggcctcagtgaagaaggaccttattagttatggaggcggttggagattgcagggcagttggaatactggagaagaagtccaagtaatagcagtggaacccgggaagaatcccaaaaatgttcaaactgctccaggtacctttaaaactagcgaaggtgaagtaggggccattgccttagattttaaaccaggtacttctggctctcctatagttaatcgagaagggaaaattgtcggattgtacgggaatggtgttgtcacaacatcaggtacatatgtcagcgcgatcgctcaagctaaagcctcccaggaaggtccactcccagaaatagaagacgaagtctttagaaaaagaaatctaactataatggacttacatccaggatcaggaaagacaaggagatatctcccagctatagtgcgcgaagccattaagcgaaaactcagaacgttgatcctcgcacccacacgagtggtcgcctctgaaatggctgaagcattgaaggggatgccaatacggtatcagactacggcagttaaatcggaacatactggaaaagagattgtagacctaatgtgccatgcaacattcaccatgcgcctattaagtccggtaagagtaccaaattacaatatgataatcatggacgaagcacacttcacggatccatcaagtatcgccgcaagagggtacatctctactagagttggtatgggggaagcagctgcaattttcatgactgctaccccaccgggctcggttgaagcctttccacagtcaaatgcagtaatacaggacgaagaacgtgacattcccgaaagatcgtggaatagcggatatgaatggataactgacttccctggcaaaactgtatggtttgttccttcgatcaaatcaggcaatgacattgctaattgcttacgcaagaatgggaaaagggtaatccaactcagccgaaaaacttttgatacagaataccagaaaaccaaaaacaacgattgggattacgtggtaactactgatatatcggaaatgggagcaaacttcagagcggatcgagttatagacccccgccgatgccttaaaccggtaatattaaaagacggacctgaacgagttatcttggcaggaccgatgcccgtcaccgttgcctctgctgctcaaagacgaggaagaattggaaggaaccacaacaaagaaggagatcaatatatttatatgggacaacctctcaacaatgacgaagaccatgctcattggacagaggcaaaaatgctactagacaatataaacactcctgaaggaattattccagcgttgttcgaacctgagagggagaaaagtgccgccatagatggtgagtaccgtttaagaggagaagcgagaaagacttttgtcgagttgatgcgaagaggtgatcttccagtatggctaagctataaagtggcctcggaaggatttcaatactctgatagacgctggtgttttgacggagaacgcaataaccaagttttagaagaaaatatggacgtagaaatttggacgaaagagggagagaggaagaaactccggccacgttggctagatgcaagaacttactcagatccattagcactaagggaatttaaagaatttgccgcgggacgaaggtctgtctccggggatttaatactagaaataggcaagctacctcaacatcttacgcagagggcgcagaacgcacttgataacttagtgatgctccacaacagtgaacaaggcggacgtgcgtatcgacacgcaatggaggaactacctgacaccattgagacactaatgttattagcccttattgctgtgctaacaggcggggttacattattctttctatctggacgaggattgggaaaaacgtcgataggtctactatgtgtgatggctagcagcgttctactttggatggcaagtgttgaaccacactggatcgcagctagtatcatcctagagttctttctcatggttctcttaatccctgaacctgatcgccagcgtacaccgcaggataatcaattagcatatgttgtaataggactcctatttatgatattaaccgtagcagcaaatgagatgggcctattagagacgactaagaaagatttagggataggtcacgttgccgtagagaaccaccatcatgccgctatgctagatgttgatcttcacccagcctcggcgtggacgctttatgctgtggctacgacaataataactccaatgatgagacacacaatagaaaacacaaccgcaaatatttcacttacagctattgcaaaccaagcagctatattaatgggtttggataaaggatggcctattagtaaaatggatataggagttccgttacttgccttgggttgttattcacaggttaatccgctgacgctaacagcggcagtcctcatgttagtggcacactacgccataattggtcctggactacaagctaaagcaacgcgagaagcccagaaacgcacggcagcaggaataatgaaaaaccctacggttgatggtattgtagcaatagatttagaccctgtcgtttacgatacgaaattcgaaaaacaactagggcaaatcatgttactaatattatgtactagccaaatcctcttgatgcgaacgacgtgggcattatgtgaatctataacacttgccactggtccattgacaacattatgggagggttctcctggaaaattttggaacactactattgccgtgtcgatggccaatatttttcgaggatcatatctagctggtgccgggttagccttctcattaatgaaatcattagggggcggaagaaggggcacgggggcacagggagagacgttaggagaaaagtggaaacgccagctaaaccaattaagcaagtcggagtttaacacctataaacgatcgggaataatggaagtagatagaagcgaagccaaagaagggctaaaaaggggtgaaacgacaaagcatgctgtctcccgaggaacggcaaaattacggtggttcgtggagcggaatttggtaaaacctgagggaaaagtgatcgacctagggtgtggacgcggaggctggtcttattattgtgcaggactcaagaaagttactgaagtaaaagggtatacgaaaggaggtcctggacatgaagaaccaattccaatggcaacttatggttggaatctcgttaaattacattccggaaaagacgtctttttcattccgccagagaaatgtgatacacttttatgcgatataggcgaatccagcccgaacccaacgatagaagaaggtagaacacttcgcgttttgaaaatggtggaaccctggctcagaggaaatcaattttgtataaaaatactaaatccttatatgccaagtgtagtcgaaaccttggagcagatgcaaagaaaacatggaggaatgctcgttcgaaacccgcttagtagaaactcaacacatgaaatgtactgggtaagttgcggtacaggaaacatcgtaagcgctgtgaacatgaccagtagaatgcttctgaatcgattcaccatggcccatagaaagcccacatatgaaagggatgttgacttaggggccggcacccgacatgtggccgttgagccagaggttgcgaatcttgacattataggacagcgtattgaaaacataaagcatgaacacaaatccacttggcattatgacgaggataacccatataagacttgggcctatcacggatcgtacgaagtaaaaccttcggggtcagcgagcagcatggtaaatggtgtagttaaattattgacaaaaccctgggatgtaataccaatggtaacacaaatagctatgacagacaccacaccatttggtcagcagcgtgtatttaaagaaaaagtagatacgagaactccgaaagccaaacgaggcacagcacagattatggaagttactgcaaaatggctatggggattcctttcaagaaataaaaagcccagaatttgtacacgagaagagtttaccagaaaagtcaggtctaatgcagccattggcgcagtatttgtagacgaaaatcagtggaacagcgctaaagaagctgtggaggacgaaagattctgggatcttgtacatcgcgaaagagaacttcataaacaaggtaaatgtgcgacttgcgtatataacatgatgggaaaacgtgagaaaaagctaggcgagttcggcaaagcaaaaggatccagagctatctggtacatgtggctaggagcaagatttttagagtttgaagcattaggattcatgaatgaggatcactggttctcaagagaaaattcgttgagcggtgtcgaaggagaaggactacataagttaggttatatactaagagatatatccaagataccaggtgggaatatgtatgcggacgatacggctggttgggatacaaggatcacagaagatgatttacaaaacgaagctaaaattaccgatataatggaacctgaacacgcacttttagcgaaatcaatatttaaactgacttatcaaaacaaagttgtaagagtacaaagacccgccaaaaatggaacagttatggacgtcatcagtcgccgagatcaacgaggcagtggacaggtgggcacatatggactgaacacttttactaatatggaagcccagcttatacgccaaatggaaagtgaagggattttctctccgtcggagcttgagaccccaaatctagctggaagagttctagattggttggaaaaacatggagtagaacgattgaaacgcatggccatatccggggacgattgtgttgtaaaaccaatagacgaccgttttgcgacagctctcacagcacttaacgatatgggcaaagtacgaaaagacatcccccaatgggaaccatctaagggatggaacgactggcaacaagtaccattttgtagtcatcacttccaccaattgataatgaaggatggacgagaaattgtagtcccttgtagaaatcaagacgaacttgtaggtagggcacgagttagtcaaggagctggatggagcttaagagagaccgcgtgtttaggaaaatcgtatgcgcaaatgtggcaattgatgtattttcaccgaagagatttgagattagcagccaatgccatttgttcggcagtaccggttgattgggtccctacaagtcgaacaacctggagtattcacgctcatcatcaatggatgactaccgaagacatgctttcggtttggaatagagtgtggatagaggagaatccctggatggaagacaaaacacacatatcgtcatggggagacgtgccttatctgggcaaacgtgaagaccaatggtgtggatcactcattggactgacagcgagagcaacatgggcaacaaacatccaggtagcaataaatcaggttaggcgtttaattggaaacgaaaactacctcgactacatgaccagcatgaaaagatttaagaatgaaatagatcctgaaggcgccttatggtag

SEQ ID NO: 21537 - RNA, 9879 nt, synthetic construct
  misc_feature 1..9879: note = derived and/or modified CDS sequence (opt6) from DENV-1__FJ410201__SS-prME
  source 1..9879: mol_type = other RNA
tcggtgactatgcttctaatgctgatgcccacagccctagcgttccacctaactacacgcggtggagaaccccacatgatagtatctaaacaagagcgaggaaaaagccttctatttaagacctcagccggagttaacatgtgcactctcatagctatggacctaggagagctgtgcgaggacaccatgacatacaaatgccctagaattacggaagctgaaccagacgacgtcgactgctggtgcaatgcaaccgatacttgggttacatatgggacgtgcagtcaaaccggtgagcaccgaagagataagcggtcagtcgctttagcaccccatgttgggttaggacttgaaacaagaactgaaacgtggatgtcatctgaaggagcctggaagcaaatccaacgtgttgagacatgggccttaaggcatccagggtttactgtcatagcgctatttttagctcacgctattggaacctcaatcacacaaaaaggaataattttcatattactgatgttagttacaccaagtatggctatgcgctgcgtaggaattggaagcagagattttgtagaaggattatccggcgctacatgggtagatgtcgtattagaacacggctcttgcgtcaccactatggccaaggataaaccaactcttgatattgaacttctaaagacagaagtcacgaaccctgctgtgctcagaaagttatgtattgaagctaaaatatcaaacacgactacggatagccgatgccccacacaaggagaggcgacgttagtagaggaacaagacgcaaattttgtctgtcgaaggacatttgttgataggggatggggaaatggatgtggcttatttggcaagggatcgctaataacctgtgcaaagttcaaatgtgtaacaaagctagagggtaaaatagttcaatatgaaaacctaaagtattccgtcattgtcacagtacacacaggagatcaacaccaagtaggtaacgaaagcaccgagcatgggaccactgcgacaataacaccacaagctccaacaacagagatacaactgacagactacggtgcactaaccctggattgtagtcctaggactggtttagattttaacgaaatggtgttattaacaatgaaagaaaaatcatggttggtacataaacaatggtttttagatttgcccttaccttggacaagtggggcaagcacctcccaagagacatggaatagacaagacttgctagtcacctttaaaacagctcatgccaagaaacaagaagtagttgtactaggttcccaagagggggccatgcacaccgccctcacaggagctacggagatccaaacgagtggaacaacgactatatttgctgggcacttaaaatgcagattgaaaatggataaattaacactgaaaggcatgtcctacgtgatgtgcactggatctttcaagctagaaaaagaagtagcagaaacccaacatggaacagtactcgtacaaatcaagtatgaaggcacggatgctccttgcaaaataccattctctacacaagacgaaaaaggcgttacccaaaatggcagacttataaccgcaaatccaatagtgactgataaagaaaagccagtgaatatagaggccgaacctcccttcggtgagagctacatagtgatcggcgctggtgaaaaagcactaaaactttcttggtttaagaaaggaagtagcataggcaagatgttcgaagccacagcaagaggagcacgccgtatggcaatcctaggggatacggcatgggattttggaagcataggaggagtcttcacgagtgtgggtaaattagtgcatcaaatattcggaactgcttacggggttctgttctcaggtgttagttggacaatgaaaattggaataggagtgctcttaacgtggttgggccttaattcaagaagtacaagtctgtcaatgacctgcatagctgttggcctagttaccctctacttgggagttatggtccaagcggactcaggatgtgtaatcaattggaagggacgcgaactaaaatgtgggtccggcatatttgttaccaatgaagtccacacatggacagaacaatacaagtttcaggcggacagtccaaaaagattgagcgccgccatagggaaggcatgggaagaaggtgtttgtggcatcagatctgcgacaagattagagaatataatgtggaaacaaattagtaatgagcttaatcacatattattggaaaatgacatgaagttgaccgttgtagtaggagatgtggcaggaatacttgggcaagggaagaaaatgatacgaccacaaccgatggaatataaatatagttggaaatcgtggggtaaagcaaaaatcataggagctgatgctcagaacacaactttcataatagatgggcccaatacccccgagtgccctgacgaccaaagagcctggaacatttgggaagtagaagattatggatttggaatttttactacaaacatatggcttaagctacgcgatagctacacccaagtatgcgatcacagactgatgtccgcagcaattaaagattcaaaagcggtgcatgcagatatgggatactggattgaatctgagaagaacgaaacttggaaattagcaagagccagtttcatcgaagtcaagacttgtatatggcctaaaagccatactctttggtcaaatggggtcttagaatctgagatgataattccaaaaatatacggtggaccaatatcgcagcacaactatagaccaggatatttcacacaaacagcgggaccttggcatctagggaaattagaattagactttgatttgtgtgagggaacaacagtggttgtagatgaacactgcggtaacagaggtcctagtcttcgaacaaccacagtcaccgggaaaattatccacgaatggtgctgtaggtcttgcacgctgccaccgctaaggtttagaggcgaagatgggtgctggtacggtatggaaatcagacctgttaaagagaaggaggaaaacctagttaagtcaatggtgagtgctggatcgggcgaagtagattcatttagcttaggtttactctgtataagtattatgatagaggaagttatgagatcgcgatggtctaggaaaatgttgatgacggggacattagctgtattctttcttttaattatgggacaacttacatggaacgatcttattaggttatgtattatggtgggtgcaaacgcttcagatcgaatggggatggggacaacttacctagcattaatggcaacatttaagatgagacccatgtttgcagtaggtcttttatttagaagattgacgtcgagagaggtacttttactgacaataggcctctctctagtagccagcgtagaactaccgaacagtttagaggaacttggagatggtctagcaatgggcatcatgattttaaagttgcttacagactttcaaagtcaccagttgtgggcaacgttattgtctcttaccttcattaaaacaacattttctctgcactatgcttggaaaacaatggccatggtgttatcaatcgtatccttattccctttatgtctttccactacatctcagaaaacaacttggttaccggtattattaggaagtctcggatgcaagccactaacgatgtttttaatcgctgagaacaaaatttggggccgaaagtcgtggcccctaaacgaaggtataatggcagtaggtatcgtgtcaatactcttatcatctctactgaaaaatgatgtcccattagcaggacctcttatagcgggtggaatgttgatagcatgctatgtgataagcggatcaagcgctgatctatcattggaaaaagccgcggaagtatcgtgggaagaggaagctgaacattcaggagccagccataatattttagtagaggttcaagatgacggcacgatgaagataaaagacgaggagagagatgacacgctaacaattcttttaaaagcaacactactagcagtatcaggagtgtaccctttaagtatacctgccaccttattcgtttggtatttttggcagaaaaagaaacagcggagtggggtactttgggacactccaagcccaccagaagttgagcgcgcagttttagacgacggaatttatcgcattatgcagagaggtctattaggtcgctcgcaagtaggtgtgggcgtattccaagaaaatgtattccacacaatgtggcatgtaacgcgaggggcagtgttaatgtatcagggtaaaagactcgagcccagttgggcgtcagttaagaaagacctaatcagctacggtggtggttggagacttcgaggatcctggaatacaggagaggaagttcaggtaatcgctgttgaacctggcaagaaccctaaaaatgtccaaacagcacctgggaccttcaaaactccggaaggagaagtgggtgccatagcactagatttcaaaccaggtacaagtgggtcaccaatagttaaccgagagggaaaaattgtcggtttatacggtaatggcgtagtaacaacgagtgggacatacgtaagtgcaatagcgcaagctaaggcttcccaagaaggacctttacccgaaatcgaagacgaagtgtttcgaaaacggaacctaaccataatggatctgcatccgggttccggtaagaccagaagatatttaccggccatcgttcgagaggcaataaaacgaaaactaagaacactcatattagcacccacacgagtcgtagcatcagaaatggcagaagcattaaaaggaatgccgatacgatatcaaacaacagcagttaaatcagaacatacaggcaaggagatagttgatttaatgtgccacgcaacattcacaatgcgactgctatcgccagtaagagttccgaattataatatgataatcatggatgaagcgcacttcactgatccctcaagtatagccgctaggggttatatcagtactcgtgtaggaatgggagaagcagctgcaattttcatgaccgcgacaccacccggatcagtggaagccttccctcaatctaatgcggtaatacaggacgaagaaagagacatacccgaaaggtcttggaatagtggatacgaatggataacggattttccaggcaaaacagtttggttcgttccaagtatcaaatccggcaatgacattgcgaattgcctacgtaaaaatgggaaacgtgtaatacaattatcaagaaagacctttgacactgaatatcagaaaaccaaaaacaatgattgggactacgttgtaactactgatattagtgaaatgggagcgaatttcagagcagatcgcgtaatagaccccagaaggtgtttaaagccggtaatactcaaagatggtccagagagagttatactagctggacctatgcctgtaaccgtagcctcagctgcgcagcggagaggaagaattggtcggaatcataataaagagggagatcaatatatatacatgggtcaacctttaaataatgatgaagatcatgcacattggactgaagcaaaaatgttactggataacatcaatacaccagagggaatcattccagcattgttcgagcccgaaagagaaaagtcagcagcagtagatggtgagtatcgtttacgaggcgaagcaaggaaaacctttgtagaattaatgaggcgcggggacttacccgtttggttatcatataaagtagccagtgaaggattccaatatagtgataggagatggtgttttgacggagaaaggaacaaccaagttctagaagaaaacatggatgtggaaatttggactaaagagggcgaaaggaagaaactaagaccacgatggttggatgcgcgcacatattcagacccattagcactaagggagtttaaagaatttgcagcaggtagaaggtcggtaagcggcgacttaatattagaaatagggaaattacctcaacatctcacgcaaagggcgcaaaacgctctagacaatctcgtaatgctacataatagcgagcagggaggaagggcttatagacatgctatggaggagttaccggacacaattgaaacattgatgttgttagcgctcattgctgttctcacaggcggtgtcacgctattcttcctgagtggaaggggtttgggaaaaacgtccattggcctcctatgtgtaatggcttcttccgtacttctgtggatggcgtccgtagaaccgcactggatagctgcctcaattatcctcgagttctttctcatggtgctgcttataccggaacccgatcgtcaaagaaccccacaagacaaccaattagcatatgtagtgataggcttactctttatgatactcacagtagcggccaatgaaatgggtctgttagaaacaacaaagaaagatctaggaattggtcacgtagcggttgaaaatcaccatcacgctgcgatgcttgatgtagacctacacccagcatctgcttggactctttatgcggtcgcgacaactattataacaccaatgatgcgccacacaatcgaaaacacaacggctaatattagtctaaccgccatcgcaaatcaagctgcaattttaatggggttagataaaggctggcccatatcaaaaatggatataggagttccgcttcttgccttaggctgttatagtcaagttaatccgttaacactaacagcggcggtattaatgttagttgcgcactatgcaataattggcccagggctacaagccaaagcaacaagggaagcacagaaaagaacagccgctggtatcatgaaaaatcccactgttgacggaatcgtcgcaattgacctagacccagtagtttacgacgctaaatttgagaaacaacttggccaaataatgctattaattctatgtacatcacagatattattaatgcgaacaacctgggccctttgtgaaagtattactttagctacgggaccactaacgacattatgggaaggatcccctggtaagttttggaataccacaattgccgtttcgatggcaaacatatttcgagggtcttatttagctggagccggactcgcatttagcttaatgaaatcgcttggcggtggacgccgaggcactggcgctcagggagagacattaggagaaaagtggaaacgacagctgaaccaattatcaaaatcagagtttaacacatacaaaagatccggtataatggaggtagatagatcagaagctaaggaaggactcaaaagaggtgaaacgactaagcacgcagttagtagggggacagcgaagctaaggtggttcgtggagcggaatctcgttaaacctgagggaaaagtaattgaccttggatgcggtcgtggagggtggtcatactattgtgcagggttaaagaaagtgacggaggtgaaaggttatactaaagggggtccgggtcacgaggagccgatacctatggccacatatggatggaacctggtgaaactccacagtggcaaagacgtattctttataccaccagaaaagtgcgacacattattgtgtgacataggagaatcatcacccaacccaacaatagaagaaggacgaacgctcagggtacttaaaatggtagaaccttggttacgtgggaatcaattctgcataaagatcttaaacccatatatgccttccgttgttgaaactttagaacaaatgcaacgaaagcatggtgggatgttagtccgtaatccattaagtagaaattctacacacgaaatgtattgggtttcatgtggaacgggaaacattgttagcgctgtcaatatgacatctcgtatgctactgaataggtttacaatggcgcatagaaaacctacgtatgaacgagatgtggatttgggaacagggaccagacatgttgctgttgaaccagaagtggctaacttagatatcataggccagcgcattgaaaacataaaacacgagcataaatctacatggcactatgacgaagataatccgtacaaaacatgggcatatcatgggtcatacgaggttaagccgagcggatcagcaagttctatggtgaatggagttgtaaaattactaacgaaaccatgggatgtaatacctatggtcacacagatcgcaatgacggatacgacaccatttggtcaacaacgggtattcaaagaaaaggtagatacacgaacgcctaaagcaaaacgaggtaccgcccaaattatggaggtcacagcaagatggctatggggatttctatcgcgtaataagaaaccacgtatttgtacaagagaagaatttacaagaaaggtacgctctaacgctgcaattggagctgtatttgttgatgaaaatcaatggaactctgctaaggaggcggtggaagacgaacgtttttgggatttagtccatagagagcgagagctacacaagcaaggcaaatgtgcaacatgtgtatataatatgatgggaaaacgagaaaagaagttgggcgaatttgggaaagcgaaaggatctcgtgctatctggtacatgtggctaggtgcaaggttcctagaatttgaagctctaggttttatgaatgaagatcattggttttcacgtgaaaacagtctttctggtgtagaaggagaaggattgcataaactgggatacatactaagggacatatcgaaaataccaggagggaacatgtacgcagatgatacagcaggatgggacacgagaattacagaagatgacctacaaaatgaggcaaagattacagacatcatggagccggaacatgctctattagcaaaggcaatatttaaattgacgtaccagaacaaagtagtcagagttcaaaggcccgcaaagaacggtacagtgatggatgttataagtagacgagaccaacgaggatccggtcaagtgggtacatatggattaaatacgttcaccaacatggaagcccaattaataaggcagatggaaagcgaaggcatcttcagtccgtcagaactagagactccaaaccttgctgaaagagccctagactggctagagaagtatggagttgagagattgaagagaatggctatttctggagatgactgtgtagtcaagcctatcgatgacagatttgccactgcactaactgcgttaaacgacatgggcaaagtcaggaaagatattccacaatgggaaccctccaaaggatggaacgattggcaacaagtcccattctgtagtcatcactttcatcagctaataatgaaggatggtagagaaatcgtagtaccatgccgtaatcaagatgaacttgttggcagagcaagagtgagtcaaggtgctggatggagtcttcgcgaaacagcgtgtttggggaaatcgtacgcacaaatgtggcaactgatgtattttcacaggagagacttaagactcgctgcgaacgccatctgcagtgcggtacctgtagattgggttccaacatcacggactacttggtcaatacatgcacatcatcaatggatgacaacagaggatatgctatcagtatggaatagagtatggatcgaagaaaacccgtggatggaagacaaaacccacattagtagttgggaggacgtaccctacctcggtaaacgcgaggatcagtggtgcggatccctaataggacttactgccagagcaacatgggcgaccaacatacaagttgcaattaatcaggtgcgaaggttgataggcaatgaaaattacttaaattatatgacttctatgaagagattcaaaaacgaatcagatcctgaaggtgcactctggtga

SEQ ID NO: 21538 - RNA, 9879 nt, synthetic construct
  misc_feature 1..9879: note = derived and/or modified CDS sequence (opt6) from DENV-1__FJ410203__SS-prME
  source 1..9879: mol_type = other RNA
tccgtaactatgctattaatgttaatgccaacggcactagcttttcatctaactactcgtggaggtgaaccacacatgattgttagtaaacaagaacgtggaaaatcactactattcaaaacatccgcaggagttaatatgtgcacattgattgctatggacttaggagaattatgtgaagatacaatgacttacaaatgccccaggatcacggaagcagaaccagatgatgttgactgctggtgcaatgctacagacacttgggtgacatacggaacatgtagccaaacaggtgagcatcggagggacaaacggagcgtcgcactggcaccacacgtcggattaggccttgagacaagaacggaaacctggatgtcatccgaaggagcttggaaacaaatacagagggtcgaaacatgggcgctaagacatcccggattcactgtcattgctttgttcctggcacatgctataggtacaagcattacacaaaaaggcataatattcattttacttatgctcgttactccatcaatggcgatgagatgtgtgggaataggcagtcgcgatttcgtagagggtctatcaggtgcaacctgggtcgatgtagtgcttgaacatgggtcatgtgtgacaaccatggccaaagacaaacctaccttggacattgagctacttaaaacagaagttacaaacccagcagttctaagaaaactttgtattgaagctaaaatttctaataccactactgattctcgatgcccaacacaaggtgaagccacacttgtggaagaacaagatgcgaatttcgtgtgtcggaggactttcgtagaccgaggatggggaaatggctgcggactttttgggaaaggaagcctgattacttgcgccaaatttaaatgcgtcacaaaattagagggtaaaattgtccaatacgagaacttaaaatattcagtcatagtgactgttcacacaggagatcaacatcaagtaggcaatgagtcgacagaacatggcaccacggcgacaattacaccgcaagcaccaacaacagaaatacaattaactgattatggtgcacttacccttgattgctcaccaagaacggggctagattttaacgagatggtattattgacaatgaaggagaagtcctggctggtgcataaacaatggtttctagacctaccgctaccatggacgagtggggcttcaacgtcgcaagaaacctggaatcgtcaagatctactcgttacttttaaaaccgcacacgccaagaaacaggaagtagttgtactgggatcccaggagggagcaatgcatactgcactcacgggggccactgaaatacaaacaagtggtacgactaccatatttgccggacatctgaaatgcagacttaaaatggataagctaacgctcaaaggaatgagttatgtgatgtgtactgggagctttaaacttgaaaaggaagtggcggaaacccaacatggaacagttttggtacaaattaagtacgaaggtacggacgcaccgtgcaaaattcccttcagtacacaagacgagaaaggagttacgcaaaatggaagattgataacagctaaccccatcgtgacggataaagaaaagcctgtcaatattgaagcagaacccccattcggagaatcttatatcgtaataggcgcaggggaaaaagcgttgaaattatcttggttcaagaaaggatcatccataggaaaaatgtttgaagctaccgctagaggagcaaggcgaatggctatattaggagatactgcgtgggattttgggtctataggaggggtctttacctctgtgggtaagctaatacatcaaattttcgggactgcatacggcgtactcttctcgggcgtatcttggacaatgaagataggaatcggtgtactactaacatggttaggattaaatagccgaagtacttcattgtcaatgacctgtatagctgtaggtctagttaccttatatctaggcgtcatggtccaagctgatagcggatgtgttatcaattggaagggtcgcgaattgaaatgtgggagtgggatatttgtaactaatgaagtacacacatggactgagcaatataaattccaagccgactctccaaaaaggttatctgccgccatcggaaaggcatgggaagagggggtatgtggaatacgctcagctacaagactagaaaatatcatgtggaagcagatatcaaacgaactcaatcatatactactagaaaatgatatgaaacttacagtcgtggtcggagatgtcgctgggattttaggccaaggaaagaaaatgataaggccacaacctatggaatataagtacagttggaaaagctggggcaaagcaaaaataattggagccgacgcccaaaatacaacgtttatcattgatggccctaatacaccagaatgccccgatgaccaaagagcttggaacatctgggaagtggaagattacggttttggcatattcactacgaatatttggttaaaactaagagattcctatactcaagtctgcgaccacagattaatgtcagccgcaataaaagactcaaaagcagtccatgccgacatgggttattggattgaatctgagaaaaacgaaacctggaaactggcgagagcttcattcatcgaagtaaagacctgtatatggcccaagtcccacacgctatggtcaaacggtgttctcgaaagcgagatgataatacctaagatatacgggggacctatttcacaacataattatcggccgggttattttactcagaccgcaggaccatggcacctaggtaaattagagttggattttgacctatgtgagggcacaacggtagtagtggatgaacattgtggaaacagaggaccaagtttaaggacaaccacggtaacgggaaagataattcatgaatggtgctgtcggagctgtactttaccccctttaaggtttagaggagaagatggctgttggtatggaatggagattagaccagtaaaagagaaagaggagaatctagtaaaaagcatggttagtgcaggttctggggaagtcgatagcttcagtctaggcttattatgcataagcataatgattgaagaagtgatgagaagtcgttggagtcggaaaatgctaatgaccggaacgttagctgtatttttccttttaataatggggcaacttacttggaacgatctcataagattatgcataatggtaggggcaaatgcattcgacagaatggggatggggacaacctatctagcactcatggctacattcaaaatgagaccgatgtttgcagtaggcctattattcagaagattaacatcaagagaggtactgctgttaacaattggtctaagtttagttgctagtgtagaattgccaaatagccttgaagaacttggtgatggtctagccatgggaataatgattctcaaattgctaaccgatttccagtctcaccaactctgggctacattactgtcactcacatttattaaaacaacatttagtttacattacgcttggaaaactatggccatggtcctatctatcgtaagtctgtttccactctgcttgagtactacaagtcagaaaactacatggttaccagtactcttaggatcactgggatgcaaaccacttacaatgttcttaatcgctgaaaataaaatatggggacgaaaatcatggccattgaacgagggaataatggccgtcgggatagtatctatattattatccagcctactgaagaatgatgttcctttagctggacccctaatcgctgggggaatgctcatagcctgttacgtaataagcggaagtagcgcagatctatcgctagagaaagcggcggaagtttcttgggaagaagaagctgaacactccggggcttcacataacatattagtcgaggtacaagatgacggaactatgaaaataaaagatgaagaaagagatgatacgttgaccattcttttaaaagccactctattagctgtgagcggtgtatatcctctaagtattccggctacactatttgtttggtatttctggcaaaagaagaaacaaaggtcaggtgtcctatgggacactccatcgccacctgaagtagaaagggcagttttagatgacggaatttatcgtataatgcaacgcggtctattgggcagaagtcaagtgggggtaggagtatttcaagagaacgtctttcatacaatgtggcatgttacaaggggagccgttcttatgtaccaaggtaaacgattggagccttcatgggcatcagtcaaaaaggacctaataagttacggtggagggtggcgcctacgagggtcctggaatacgggcgaagaagtacaggttatcgccgtggaaccaggcaaaaaccctaaaaatgtgcaaacagcacctggtacgtttaagactccagagggagaagtaggggctatagctttggactttaaaccgggcacaagcggatcaccaattgtaaatcgagaaggtaagatcgtaggattatacgggaatggagttgttactactagcggtacttatgtatccgcaattgcacaggcaaaggcatctcaagaagggccacttccagaaatagaagacgaagtttttagaaagagaaatctaacaataatggacttacatccgggcagcgggaagactcgaagatatctaccagccatcgtacgagaagccattaagcgaaaattacgcacactcattttggctccaacgagagtcgtcgccagcgaaatggccgaagcgctgaagggaatgccaattcgatatcaaacaacagcagtcaaaagtgaacacaccggcaaggaaatagttgatctaatgtgccatgctacgtttacgatgcgcctgctctctccagttcgagtacctaattataatatgataataatggacgaggcacactttacggatccttcaagcatcgcagcaagaggatatattagtacacgcgtaggaatgggagaggctgccgccatatttatgactgccacacctccgggaagtgttgaggcattcccgcaatccaacgccgtaatacaagacgaagaacgtgatatacctgagagaagctggaactctgggcatgagtggataacagattttccaggtaaaaccgtttggtttgtaccttccataaaatctgggaatgatatagcaaattgcctgagaaagaacggaaaacgggtaattcaactgagtagaaaaacctttgatacagagtatcagaaaacgaaaaataatgattgggattatgtagttacaacggatattagtgaaatgggagcaaactttagggctgatagagtaatagatccacgtcgttgcctaaaacctgtaatcctcaaagatggacctgagcgtgttatactagcagggccaatgccggtgactgtagcttcagctgcccaaaggagggggagaatagggcgtaaccataataaagaaggagaccagtatatctatatgggtcagccattaaacaacgacgaggatcacgcacactggacggaggcgaaaatgttattagacaacattaatactccagagggaattataccagcattatttgagcctgaaagggaaaaatcagcagctgtggatggtgagtatcgattaaggggtgaagcacgtaaaacatttgttgagctgatgaggcggggtgatctacccgtttggctatcctacaaagtcgcatctgaaggatttcaatactcggacagacggtggtgctttgacggtgaacgtaataatcaagtgctagaggagaacatggatgtcgaaatctggacaaaagaaggggagagaaagaaactacgtcctcgatggctagatgctagaacctatagtgatccacttgcattgagagaatttaaagagttcgctgcaggaagacgatcagtgtcaggagatctgatacttgaaattggaaaattgccgcaacatttaacacaaagagcgcaaaatgcattagacaatctggtaatgctacataattcagaacaaggcggtagagcatacaggcatgccatggaagaactacccgacacaatagaaaccttaatgctccttgcgttaatagcggttttgacaggaggagtgacactattcttcctaagtggaagaggattaggtaaaacgagtatcggtctcttatgtgtcatggcttcgtcagttttattgtggatggcctccgtagaacctcactggattgcagcaagtattatactcgagttctttctgatggtactgttaattccggaaccagataggcagcgaactccacaagataaccaactagcttatgttgtgataggacttttattcatgatactaacagtagcggctaatgaaatgggacttctggaaactactaagaaagatctaggcataggacacgtggcagtggaaaatcatcaccatgccgcaatgcttgatgtagatttacatcctgcttcagcctggacactatatgcagtagccacaactataattacaccaatgatgcgtcatacgatagaaaatacaaccgcaaatatatcattaacagcaattgctaatcaagcagctattttaatgggattagacaaaggatggcctatcagtaaaatggatataggcgtaccattattagcattaggatgctactcccaagtcaaccctcttacattgacagctgccgtattaatgctagtagcgcactatgcaattataggccctggattgcaagcgaaagcgacaagagaagcacagaagaggaccgcagcgggtattatgaaaaatcctacagttgatggtattgtagccatagaccttgatccggtcgtatatgacgccaaatttgagaaacagcttggacaaataatgcttctcattttatgcacgagtcagatcttattaatgaggactacctgggcattatgtgagagcatcacactagcaacaggaccgttaactacattatgggaaggatctcctggtaagttttggaatactacaatagccgtatcgatggcgaatattttccgcggaagttaccttgctggcgctggcttagcattttccctcatgaaatcgttaggcggaggtcgacgcggaactggagctcaaggggaaacattaggggaaaagtggaaacgtcaattgaatcagttgagtaaatccgagttcaatacctacaaacgatctggcattatggaggtcgacagatctgaagcaaaagaagggttaaagcggggtgagaccacaaaacatgcagtttctcgaggtaccgcaaagctaagatggttcgttgaacgtaatttagtgaaaccagaaggaaaagtaatcgaccttggatgtggtcgtggaggatggtcttactactgtgctggcttgaagaaggtcacagaagtaaaaggttacacgaaagggggtcccggccatgaagaaccgattccaatggcaacatatggttggaatttagtaaagttacacagtggaaaagacgtattctttatacccccagagaaatgtgacacattattatgtgacataggtgaatcatcaccgaacccaacaatagaggaaggaagaactcttagagtgttgaagatggtagaaccttggcttagagggaatcaattttgcattaaaatactgaatccatatatgcccagcgtagtagagacgttagaacagatgcagagaaagcatgggggaatgcttgttagaaacccattgtcaagaaattccactcatgaaatgtattgggtatcatgcggtacgggcaatatagtgagtgctgtcaacatgacgtcaagaatgctactaaatcgtttcacaatggcacataggaaacccacatacgaaagagacgttgacttaggtacagggacacgacacgtggcggtcgagccggaggtagcaaacctagatattataggtcaaagaattgagaacataaaacacgaacacaaaagtacatggcattacgatgaagataacccatacaaaacgtgggcatatcatggatcatatgaagtcaaaccgtcaggatcggcatcgtctatggtgaacggagtagtgaagctactcacaaaaccatgggatgtaattccgatggtgacgcaaatagcaatgacagatacaaccccatttgggcaacaaagagtattcaaggaaaaagtggatactcgaacacccaaggcaaagaggggcactgcccaaataatggaggtgaccgcacgatggttgtggggcttcttgtctagaaacaagaaaccaagaatatgcacgcgagaggaatttacaagaaaagttagatccaatgctgcgataggcgctgtttttgtggacgaaaaccagtggaactccgctaaagaagctgtagaagatgaaagattctgggacctcgtgcatagggaacgtgaattacacaaacagggaaagtgtgcaacatgtgtatacaacatgatgggaaaacgggagaagaaacttggtgagttcggaaaagctaaaggttctcgtgcaatatggtacatgtggttaggagcaagatttttagagtttgaagctctaggctttatgaacgaagaccactggttctcaagagaaaatagtttaagtggggtggaaggcgaaggattgcataaattaggttatatattgcgtgacataagcaaaattccaggaggtaacatgtatgcagacgacacggctggatgggatactcgtataaccgaagatgaccttcaaaacgaagctaagatcacagacataatggaaccagagcatgcgcttcttgccaaagcaatattcaaattaacatatcagaacaaagtcgtaagagttcaacgtccagccaaaaacggtactgtaatggacgtaatttctagaagagatcagaggggcagtggacaagtcggaacctacggcttaaacacatttacaaatatggaggcccaattgattagacaaatggaatccgaaggcatttttagcccgtcagagttagaaactccaaacttggcggaacgggctttagactggctagagaagtatggggtagaaagactaaaaagaatggccatttctggagatgattgcgttgtcaaacctattgacgatcgattcgcaacagcgttaactgctttaaatgatatgggtaaagttaggaaagacattccgcaatgggaaccctctaaagggtggaacgattggcaacaagtcccattctgtagtcatcactttcaccagttaataatgaaggatgggcgcgaaattgtagtgccatgtagaaaccaagatgaattagtcggacgagcaagggtaagtcaaggcgctggttggtcgttaagagaaacagcatgcttggggaaatcgtatgcccaaatgtggcaattaatgtactttcataggagagaccttaggctagctgcaaacgcgatatgtagtgcagtccctgtagactgggtgcccacaagtcgaactacatggagtatccatgctcatcaccagtggatgacaacagaagacatgctaagcgtttggaatagggtgtggatagaagagaacccgtggatggaagataaaacccacatttctagctgggaagatgtaccgtatcttggcaaaagagaagatcaatggtgtggatcccttattggtcttacagcacgtgcaacatgggctactaatatccaggtagcaataaaccaggtacgaagacttataggcaatgagaattacctagattatatgacaagtatgaagcgcttcaaaaacgaatctgaccctgaaggcgctttatggtga

SEQ ID NO: 21539 - RNA, 9879 nt, synthetic construct
  misc_feature 1..9879: note = derived and/or modified CDS sequence (opt6) from DENV-1__FJ410204__SS-prME
  source 1..9879: mol_type = other RNA
tccgttacgatgcttctcatgttgatgcctactgcattagctttccacttgacaactcgtggaggagagcctcatatgatcgtatcgaaacaagaaagaggtaagagtctattgtttaagacaagtgcaggggtaaatatgtgtacacttattgcgatggatctaggggaactttgtgaggacaccatgacatataaatgtccacgaattacggaggctgaacccgacgatgtagattgttggtgtaatgcaacagatacatgggtcacttacggtacgtgttcacaaacaggggaacacagaagagataaacgaagtgtagcacttgcacctcatgtgggactgggattagagacgaggaccgagacctggatgagttcagaaggagcgtggaaacaaattcaaagagttgaaacatgggcactccgacacccaggttttaccgtaattgcactgttcttggctcatgctataggaacttcgatcacccaaaaaggtatcatatttatattacttatgttggtaactccaagtatggcgatgagatgcgtaggaatagggagccgagatttcgtcgaaggattaagcggtgctacgtgggttgatgtcgtacttgaacatggcagttgcgtcacaacaatggcaaaagacaaacctacactcgacatagaacttttaaagacagaagtgacaaatcctgccgtattaagaaaactatgcatagaagcgaaaatatcaaatacaacaacagactcaaggtgtccgacacaaggcgaagctacgttagtagaggaacaagacgccaatttcgtgtgtcggcgcacttttgtagatagggggtgggggaacggatgcggcctatttggcaaaggctcattaattacatgtgcaaaatttaaatgcgttacaaaattagaaggaaaaattgttcagtacgaaaatttaaaatactcggtcatagttacagtacacacaggagaccagcaccaggttggtaatgaaagcaccgaacacggtacgaccgccacaattacgccgcaagctcccacgactgaaatccagctcacagattatggagctttaacgttggactgcagcccccgaacgggattagatttcaacgaaatggtcttactaacaatgaaagaaaagagttggttagttcataaacaatggtttctagacctaccactcccatggacatctggagcttctacctctcaggaaacatggaatcgtcaagatttgttagtaacctttaaaacggctcacgccaagaagcaggaagtggtagtcttaggatcacaggaaggagcgatgcatactgctctgacaggagctactgaaatacaaacatcggggactacgaccatattcgcaggtcatctaaaatgtagactaaaaatggataaactcactcttaaggggatgtcgtatgtaatgtgcactggatctttcaaactagaaaaagaagttgccgaaacacaacatggcacagtcctagtacaaataaaatacgaaggaacagacgctccttgtaaaattcccttcagtactcaagacgaaaagggagtaacacagaacggaagactcataacagcaaacccaatcgtcactgacaaagaaaagccagtcaacattgaagcagaaccaccttttggagaatcatatattgttatcggagcgggcgagaaggccttaaaattaagctggttcaagaaagggagtagtataggaaaaatgtttgaagctacagccagaggtgcacgaagaatggcaatactaggcgatacagcgtgggattttggatcgattggcggtgtgttcacctcagtaggtaaactgattcaccagatatttggtacggcatacggagtattattttctggagtgagctggacaatgaaaataggaataggggtactcctgacttggttgggtctcaattcaagatcaacttctttaagtatgacctgtatcgcagtaggccttgtcactctatacttgggcgtgatggtgcaagcagatagtggatgtgtaattaattggaaaggaagggaattaaagtgtgggtcaggtatttttgttacaaacgaggtttatacctggacagaacagtacaaatttcaggcagactcgccaaaaagattaagtgcagccatagggaaagcctgggaagaaggagtttgtggcatacggagcgcaacaaggttagagaatataatgtggaaacaaatcagcaacgaattgaatcatatactattagaaaatgatatgaaacttaccgttgtagtaggtgatgtagcggggatcctgggacaaggcaagaaaatgatcagaccccaaccaatggagtacaaatattcatggaaatcatggggtaaagcaaaaatcatcggagcagatgcgcaaaatacgacgttcatcatagatggtccaaacacacctgaatgtccagacgaccaaagggcttggaatatttgggaagtcgaggattacggatttggtatatttacaacaaacatatggctgaaacttagggatagttatacacaggtatgcgatcataggctgatgtccgcagccataaaagatagtaaggctgtacatgctgatatgggctattggatagaaagcgagaagaacgagacttggaagttagcaagagcttcattcatagaagtgaagacatgtatttggccaaaatctcacacactctggtcaaacggagtactagagagtgaaatgattataccgaaaatatacggcgggcccatctcacagcataattatagaccaggttacttcactcaaacagctggaccctggcatctaggcaaacttgaactagacttcgatttgtgtgaaggaacaacagttgttgtcgatgaacactgcggaaatagaggtcccagtctcagaactacaacggtaacaggaaaaataattcatgaatggtgttgcagatcttgcacgttacccccgcttcgatttagaggtgaagacgggtgttggtatggaatggagataaggcctgtaaaagaaaaagaagagaacttagtaaaatcaatggtctctgcaggcagtggagaggtcgactccttctctctagggttactctgtatctcaattatgattgaagaggttatgagaagtagatggtcgaggaaaatgttaatgacaggaacgctcgcagttttctttctcctaataatgggacaactaacatggaacgacttaatccgcctttgcatcatggtaggagctaatgcatttgatcgtatgggaatgggaaccacatacttagcccttatggccacattcaaaatgagacccatgttcgcagtcggactattgtttcgaaggttaacaagtagggaagtgctgcttttaacaatagggctctccttagtagcatcggttgagttaccaaacagtttagaagaactcggagatgggcttgctatgggaattatgatcttaaaactcctaacagatttccaaagtcatcaattatgggccactctgttgtcgctaacgttcattaagactacatttagcctacactacgcatggaagactatggctatggtacttagtatagtttcgcttttcccgctatgtctgtctaccacctcacaaaagacaacctggcttccagtcctactcggttcgttgggttgtaaacctttaactatgtttctaatagctgagaacaaaatctggggaaggaaatcatggccattgaatgaaggtataatggccgtaggcatagtaagtatactcttgagctctctgttgaaaaacgacgtaccactcgccggcccgctaatagcaggagggatgctcattgcttgctatgtcatttctgggagtagcgcggatctatccttggaaaaagccgctgaagtatcatgggaagaagaagccgagcactcaggcgcaagccataacattctcgtagaggtccaggatgatggaactatgaaaatcaaagacgaagaacgtgacgatacactaacaattttattaaaagctactttattagcagtcagtggagtctacccacttagtattcctgcaacgttgtttgtatggtacttctggcagaaaaagaaacaaagaagtggagtcctctgggataccccttcgccaccggaggtagaaagggcggtattagacgacgggatctatcgcatcatgcagagaggattacttgggcgatctcaagtaggagtcggagtctttcaggaaaatgtatttcacacaatgtggcatgttacaagaggggcggttttaatgtaccaaggaaaaagattagaaccatcttgggcttctgtaaagaaagatctaattagttatggtgggggctggcgtcttcggggatcgtggaatacaggtgaggaagtgcaagttatagcagtcgaacccgggaaaaatcctaaaaatgttcaaaccgcaccaggaacatttaaaacaccggagggagaagtcggagcgatagctttagacttcaaacctggaacaagtggaagtccgatagttaaccgagaagggaaaatagtagggttgtacggcaatggggtagtaacaacttccggtacgtacgtatctgcaattgcccaagccaaggcatcccaggaagggcccttgccggagatagaggacgaagtatttcgtaagagaaatctaactatcatggatttacatcctggtagtggaaaaactcgacgctatttaccagcaatagtaagagaggcaataaaacgaaaattgagaacattgattttagcaccaaccagggtagtagcatcagagatggcagaagcgttaaaaggaatgccaataagatatcaaacgacggcagtaaaatcagaacatacaggcaaagaaattgtcgacctcatgtgtcacgcgacgtttaccatgaggctcctatctccagtaagagtgcccaactataacatgatcataatggatgaagcccattttaccgatccatcatcaattgcagcaagagggtacatatcaaccagggtaggcatgggtgaggcagcggctatatttatgactgcaactccaccaggctccgtagaagcatttccacaaagcaatgccgtcatacaagatgaagaaagggacatacccgagcggtcatggaactcaggtcatgaatggattactgacttcccaggtaagaccgtgtggttcgtaccatctataaagtctggcaacgatattgctaattgtctcaggaaaaacggtaaacgcgttattcaattatcaagaaaaacattcgatactgaataccaaaagaccaaaaacaatgactgggactatgtcgtaactaccgacatatcagaaatgggagcaaattttcgagctgatagagtcatagatcctcgtagatgccttaagcccgtgatacttaaagatggacctgaacgggttatattagccgggccgatgcctgttacggtagcgtcagcagcgcagagacgggggagaatagggcgaaaccataacaaagagggagaccaatatatctatatgggccaaccactgaacaacgacgaagatcatgcccattggacagaggctaagatgctattggacaatattaacacaccagagggtataatcccagcattattcgaaccagaaagagagaaaagtgcggctgtggatggggaatatcgactcaggggtgaagcgcgtaagaccttcgttgaattaatgcgtagaggagatctaccagtgtggttatcatacaaagtagcaagcgaagggttccaatactctgacagaagatggtgctttgatggtgaaagaaataaccaagtactagaagagaatatggacgtagaaatatggactaaagaaggagaaaccaagaaattaagacatcgatggcctgacgcccgtcaatattcagatcctttaggccttagggaatttaaggaatttgctgcaggaagaagaagcgtaagtggagaccttattctcgaaataggcaaattaccacaacacttaactcaacgtgcccaaaacgctttagataatctagtaatgctacacaactctgaacaaggaggcagagcatatagacatgcaatggaagaacttcctgacacaattgaaactcttatgcttttagcattaattgcggtactgactggcggagttacgctattctttttgtcaggaagaggacttggcaaaacaagcataggattgctttgcgtgatggcgagtagcgtattgctgtggatggcctctgtcgaaccccattggatagcagcatcgattatcctagagttctttctgatggtactcttaataccagaacccgatcgacagagaactcctcaggataaccaactggcatacgtagtaataggcttactttttatgattctaacagtagctgcaaatgaaatggggctattggagacaactaagaaagacttgggtattggtcatgtggccgttgaaaatcatcatcacgccgcaatgttagatgtagaccttcaccccgcatctgcatggacattgtacgcggtagcgaccactattattaccccgatgatgcgacacaccatagagaatacaacagcgaatatttctcttactgccatagccaaccaagcggctattctgatgggtctagataagggttggccaatatcgaaaatggatattggcgtgccattactggccctaggttgttactctcaagtaaacccgctgacattaaccgcagccgtcttgatgttggtggcacattacgcaattataggtccaggtctccaagcgaaggcaacaagggaagcacaaaaacggactgcggccggaataatgaaaaatccaactgtcgatggaattgtggccattgatttggatcctgtggtgtacgatgcaaaatttgaaaaacagctaggacaaataatgctactaattttatgtacaagtcaaatcttattaatgcgaacaacatgggcactttgtgaaagtataactttagctaccggaccattgacaacgttatgggaaggatcacctggcaaattctggaataccactatagctgtttctatggctaacatatttcgaggtagttacctggctggcgcgggtctagcatttagcttgatgaaaagccttggtggaggtcgaagaggaacaggggcacagggcgaaactcttggcgaaaaatggaagcgtcagttaaatcaattgtccaaatcagaatttaatacttataaacgctccgggataatggaggttgacaggtcagaagcgaaagaaggactaaaaagaggagaaacaacgaaacacgcagtatctcgcggcacagcgaaattgaggtggtttgtggaaagaaatctggttaaaccggaaggaaaagtcatagacttaggatgtgggaggggcgggtggtcgtattattgcgcagggttaaagaaagttacggaagtaaaaggttatacaaaaggaggccctggtcatgaggagccaataccgatggcaacttatggatggaatttggtaaaactacactcaggcaaagatgtgttctttataccacccgagaaatgcgacaccttactatgtgatatcggagaatctagcccaaatccaacgatagaagaaggaaggactcttcgggtattaaaaatggttgaaccctggttacgaggtaaccaattctgtataaaaatattgaatccttatatgccatccgtcgtggaaacacttgagcagatgcaaagaaagcacggtgggatgctagtccggaatccattaagcagaaattctactcatgaaatgtactgggtatcatgcggaacaggaaacatagtcagtgccgtaaacatgacaagtagaatgcttttaaatcgatttacaatggcgcataggaagccaacttatgaaagggatgtcgatcttggaacagggacccggcacgtagcagtcgagccagaagtggcaaatttggatattataggtcagagaatcgaaaacataaaacatgagcacaagtccacatggcattatgacgaggacaacccgtataaaacatgggcctaccacgggtcttatgaagtaaagccgtcgggaagcgcttcatcgatggttaatggagtagttaagttgttaacgaaaccatgggatgtgatacccatggtaacgcagattgcaatgacggataccacaccattcggtcaacagagggtttttaaagagaaggttgacaccagaacacccaaagcaaaaagaggaacagcgcagataatggaagtaactgcaagatggctatgggggtttttaagtagaaataagaaaccgagaatctgtacgcgcgaagaatttaccaggaaggtacgttcaaatgcagcaataggggcggtatttgttgatgaaaatcagtggaatagtgccaaagaagcggtcgaagatgaacgattttgggacctagtacatagagagagagaattacataaacaaggtaagtgcgcaacatgtgtgtacaatatgatgggcaaacgagagaagaaattaggagaatttggtaaagcaaaaggtagtcgtgcaatatggtacatgtggttaggggctcgttttctagaatttgaggcattaggattcatgaacgaggatcattggttttcacgagaaaattctttgagtggggttgaaggggaaggtctacataaacttggttacatactaagagacattagtaaaatacctggagggaatatgtacgctgatgacacggccgggtgggacactaggataacggaagacgacctgcaaaatgaggccaaaattactgatataatggaaccagaacatgccttacttgcgaaggctatttttaaattgacatatcaaaataaagttgttagagtccagcggccagctaaaaacggaacagtcatggatgttatctctcgtagagaccaacgaggatcagggcaagtaggtacatatggattaaataccttcacaaatatggaagctcagttaatccgccaaatggaatcagaagggatattctcccccagcgagcttgaaaccccgaatctcgcagaacgagcactagattggttagaaaaatatggcgttgaacgtctcaagcgcatggctattagtggggacgattgcgtagtaaaaccaatagatgacagatttgcaacagccttaacggcactgaatgatatgggaaaagtgcgaaaagacataccccagtgggagccaagtaaagggtggaatgactggcaacaagtaccgttctgctcccaccactttcatcagctaattatgaaagacggcagagagattgtggtaccctgcagaaatcaggatgagttggtaggcagagcgagagtatcacaaggagcagggtggagccttagagaaacagcttgcttaggcaaatcctacgcacaaatgtggcaattaatgtactttcataggcgagatctcagattggcagcaaatgctatctgtagtgctgttcccgttgactgggtgcccacatcaagaactacttggtcaattcacgctcaccaccaatggatgacaacggaagatatgctaagcgtgtggaacagggtctggatagaagaaaacccatggatggaagacaagacccacatatctagctgggaagatgtaccatatttaggcaaacgggaagaccaatggtgtgggagcttaataggacttacggcgcgtgcaacttgggcaaccaatattcaagtggccataaaccaagttcggaggttaattggaaacgaaaactatttggactacatgacgagtatgaagcgatttaaaaatgagagcgacccagaaggagcactctggtag

SEQ ID NO: 21540 - RNA, 9879 nt, synthetic construct
  misc_feature 1..9879: note = derived and/or modified CDS sequence (opt6) from DENV-1__FJ432742__SS-prME
  source 1..9879: mol_type = other RNA
tctgtgaccatgttattgatgttaatgccgacggcattggccttccatctaaccacacgtggaggtgaacctcacatgatagtcactaaacaagaacgtggaaaaagtctattatttaaaacctcagctggagtaaacatgtgtaccctaatagcgatggatctaggcgaattatgcgaggacacgatgacttacaaatgtcctagaataacagaagcggagccagatgatgtagactgttggtgtaacgcaactgatacttgggttacctatggtacatgcagccaaactggtgaacatagacgcgataaaagaagtgtagccctagcaccccacgtaggcctcggtttagagactcggacagagacgtggatgagctcagaaggagcatggaaacaaatacaacgagtcgaaacttgggcacttcggcatcctggattcacagtcatcgcgttgtttttagcacatgccatcggaacaagcataacacaaaaaggaattattttcatattattaatgttggtaaccccaagtatggctatgcgttgtgtagggataggatcacgtgatttcgttgaaggtctgagtggcgctacatgggtagatgtggttctggaacatggaagttgcgtgacaacaatggcaaaagataagcccacactagatattgagttactcaagacagaggtaacgaatcctgctgtactacgaaaactatgcatagaagcgaagataagtaataccactacagattcgcgttgtccaactcaaggagaagcaacgttaatggaagaacaagatgccaattttgtctgcaggcggacattcgtggatagagggtggggtaatgggtgcggactattcggcaagggctcattaataacgtgtgccaaattcaaatgtgtaacaaaactggaaggaaaaattgtacaatacgagaacttaaaatattctgttattgttacagttcacaccggagatcaacatcaggttgggaacgaaagtacagaacacggcaccacagctactataactccccaagcaccgactagcgaaatacagctaaccgactatggcgcgctaaccttagattgctcacctcgtaccggattagactttaatgaaatggttctattaacaatgaaagaaaagtcatggttagtacacaagcaatggttcctagacctacctttaccgtggacgagtggagcaagcacgagtcaagaaacatggaataggcaggatttgctagtaacatttaaaacagcccacgccaaaaagcaagaagtcgtagtactaggatcacaggagggcgcaatgcacacagcattaacaggcgcaactgaaatacaaacgtcaggaactacaacaatttttgcgggccacttgaaatgccgattaaagatggataagttgactttgaaaggtatgtcgtatgttatgtgtacgggatcctttaaattagaaaaagaagtggcagaaactcaacatggtactgtcctagtccagataaagtatgaaggaactgacgcaccttgtaaaatcccatttagcactcaagacgaaaaaggtgttacacaaaatggcaggctcatcactgcaaaccccatcgttactgataaggaaaaaccagtgaacatcgaagcggaaccacctttcggcgaaagttatatagttataggagccggagaaaaagcattaaagttaagctggttcaagaaaggatcttcaataggcaagatgttcgaagcaacggctagaggagcacgtagaatggcaattctaggcgataccgcttgggacttcgggtcagtaggtggtgtgttcacatcagtgggtaaattagttcaccaaattttcgggactgcatacggtgttctattttccggagtgtcatggacaatgaagattggaataggggtattgttaacgtggctaggccttaattctagaagtacaagtctaagtatgacctgcatagcagtaggattggtcactctatatttaggagttatggttcaagcagacagtgggtgtgtaatcaactggaaaggacgcgagctaaaatgtgggtcaggtatattcgtaacaaacgaagttcacacatggaccgaacaatataaattccaagctgattctcctaagagattaagcgccgcaataggaaaagcgtgggaagaaggtgtatgtggaatcaggagtgctacacgtttggagaacattatgtggaaacagatcagtaacgaactgaatcacatcctcttagagaatgatatgaagttcacagtcgtagtaggagacgtggttggaattttggcgcaaggtaagaaaatgattagaccacagcctatggagcataagtatagttggaaaagttggggcaaagcaaaaataattggggccgatgtccaaaatacaactttcataattgacggaccaaacactccagaatgtccagacgatcaaagagcttggaacatatgggaagttgaagattacggtttcgggattttcaccacaaacatatggcttaaattacgagactcatatacacaagtatgcgatcatcgattaatgtcagcggcaataaaagactcaaaagctgtacacgctgatatgggttattggatagagagcgagaagaacgagacgtggaaattagcaagggcaagttttatagaagttaaaacgtgtatttggccaaagtcccatacactgtggtccaatggagttttagaaagtgaaatgattataccgaaaatatacggcggtccaatatcacaacataattatcgtccgggatattttacacagacagcaggaccgtggcatttaggtaaactcgagcttgattttgatctgtgtgaaggtacaactgtggttgtggacgaacattgtggtaatagaggccccagcttaagaactactacggtcacggggaaaattatccatgaatggtgttgcagatcttgtacactaccaccattgagatttaagggagaagacgggtgttggtacggcatggaaatacgtcctgtcaaggaaaaagaagaaaatttagtgaaaagtatggtatctgctggttcaggggaagtagatagtttttcactgggactgttatgtatcagcattatgattgaagaagtaatgagatcaagatggagtaggaaaatgctaatgaccgggactctagctgtttttctcttactgattatgggccagctcacttggaatgaccttatccgcctgtgcatcatggttggagctaatgcctcggatcgaatgggtatgggtacaacatacttagccttaatggctactttcaagatgagaccgatgtttgccgttggattgttattccgacgtctgacgagtcgggaagtgctactgttaacaatcggactatctctagtggcatcagtcgaactgccaaattcactagaggaactcggcgacggattagctatgggaattatgatacttaaactcctaacagacttccaaagccatcaactatgggcaactttactgtcgttaacattcattaaaactactctttcacttcattatgcatggaaaacaatggcaatggtcctatcgattgtcagcttattcccgttatgtttaagcacaacttcgcagaaaacaacgtggttgcccgtgctattagggtccctaggctgcaaaccattaacaatgttccttatcacagaaaataaaatatgggggcgaaaaagttggcctctaaatgaagggataatggctgtgggtgtagtatctatcttactcagcagccttttaaagaatgacgttcccctagcgggacctctaatcgcgggaggaatgctaatcgcatgttacgtcatatcaggttcatccgcagacttgagtctggaaaaagcagcggaggtaagttgggaagaagaggcggagcactccggggctagtcacaacatactcgttgaagttcaagacgatggaaccatgaaaatcaaagatgaagaacgggatgacacgctaactatattgctgaaagctacattactagctgtgagtggtgtgtacccacttagtataccggcaacacttttcgtatggtatttttggcaaaagaagaaacagagatcaggagtcttatgggacacacccagtccaccagaggtagaacgagcggtgttagacgacggtatatacagaatcatgcagcgtggtttactcgggaggagccaagtaggcgtcggagtattccaagaaaacgtctttcacactatgtggcatgtaacgcgcggggcagtattgatgtatcaaggcaaaagactcgaaccttcttgggcgtccgttaagaaggatctaatttcctatgggggaggatggcgccttcaaggatcatggaacaccggggaagaggttcaagtaatagcggtagaaccaggcaaaaacccaaagaatgttcaaacagcacccgggacattcaagacaccagagggagaagtaggtgcgatcgccctcgattttaagccaggaacttccggatcaccaatagtaaatcgtgaaggaaaaatagtcggtttatatggaaacggcgtggtcacaacttcaggaacatacgtatcggctatagcgcaagcaaaggcttcacaggaaggacctctaccggagattgaggatgaggttttcagaaaacgaaatcttactatcatggaccttcatccgggcagcggaaaaactcgaagatacttacccgcaatagtaagggaagcaattaagcgaaaactcagaactctgatactcgctcctacacgagttgttgcaagtgaaatggctgaagcattaaaagggatgcctatcagatatcaaaccacggccgtcaaatccgagcatactgggaaagaaatagtggaccttatgtgccacgcgacctttaccatgagactattatccccagttagagtaccaaattacaatatgataataatggatgaggctcacttcaccgatccgagctcaatagctgcccgagggtatatttcaacaagagtaggaatgggggaagcggccgctatatttatgacggcgacaccaccagggagcgtagaagcatttcctcaatccaatgccgtaatacaagatgaagaaagggatatccctgaacgatcatggaactccgggtatgaatggataacagattttcccggtaaaactgtttggttcgtaccatcaataaaaagtggaaatgacattgccaactgtcttcggaaaaatggaaaaagagtcatacaactaagtagaaagacatttgataccgagtatcaaaagaccaaaaacaacgactgggactatgtcgttacaactgatatatcagaaatgggtgcaaactttagggctgatcgagtaattgacccaagaaggtgtcttaaacctgtgatacttaaggatgggccagaaagagttatcttggcaggcccaatgccagttacagtagccagcgcagcgcaacgaagaggtagaattggaagaaatcacaataaagaaggagaccaatacatatatatgggtcagcccctcaataatgacgaggaccatgctcactggacagaagctaaaatgttgcttgataatattaatactcctgaaggaattataccagctttgtttgaacctgaaagggagaaaagtgcggcgattgatggtgagtatcgcctaagaggggaagctagaaagaccttcgttgaactcatgcggaggggtgaccttccagtctggctaagttataaagtagcatcagagggctttcaatattcagacaggagatggtgttttgatggagaacgtaacaatcaagtgctagaagaaaacatggatgtggaaatatggacaaaggagggtgagagaaagaaactacgtccccgttggctagatgcaagaacttattcagaccctttagcgcttagagaatttaaagaatttgctgcaggtagaagaagcgtttctggtgaccttatattagaaattggcaaacttcctcaacatctgactcagagagcacaaaatgcccttgataacttggttatgcttcacaacagcgaacaagggggtcgcgcttataggcacgcgatggaggaattaccagacactatcgaaacattgatgcttcttgctctaatcgcagtactaaccggaggagtaacgttgttcttcctaagtggaagaggactaggtaaaacttcaatcggactactatgtgtcatggccagctcagtactactatggatggcaagtgtagaaccgcattggattgcggcatctataatattagagttctttctaatggtattgttgatacctgaaccagatagacaaaggacaccccaagataaccaactagcttatgtagtaataggattgttatttatgatattaacagttgcagcaaatgaaatgggtctgttggaaacgactaaaaaggatcttggaataggacatgtagcagtcgaaaatcatcatcacgcaacaatgctagatgtagatcttcacccagcatctgcatggactttatacgcagtcgccacaaccataataacgccaatgatgagacatacaattgagaatacaactgcaaatatatcgttaacagctattgcgaatcaggccgcaatcctgatgggtttagacaaaggatggcccatatctaaaatggacataggggtacctttactcgctctaggctgctacagtcaagtgaaccctttgacacttactgctgcagtattaatgctcgtggcgcactatgcaattatcggaccaggattacaggcaaaagccacacgtgaagcacagaaacgcacagcggctggaatcatgaagaacccaacagtggatgggatcgttgcaattgacctagatccggtcgtttatgacgcaaagtttgagaaacagttaggccaaataatgctgttaattctttgtacctcacaaatccttcttatgcgcaccacatgggcactctgtgaatctataactcttgctaccggaccacttacgacgctttgggaaggcagcccaggtaaattctggaatacaacaattgcagtcagtatggccaacatctttagaggttcatacctagctggtgcaggactagccttctcattgatgaagtcactaggcggaggacgtcgaggcaccggcgcacaaggagaaactctaggggaaaagtggaaacgtcaactaaatcaactttctaagtccgaatttaatatatacaaacgtagtgggatcatggaagtagatagatcggaggcaaaagagggcttaaaaagaggagaaacgacaagacatgctgtaagtcgcggtacagctaagctccgctggtttgtagaacgaaacctcgttaagcctgagggcaaagtaatagatctcggatgcggtaggggcggatggtcttattattgtgccggcctaaagaaagtaacagaagtaaaaggttatacaaaaggtggtcctggccacgaagaaccaatacctatggccacatatggttggaacctggtaaaactacattcaggtaaggacgtattctttacaccacccgaaaaatgtgataccctgctttgcgacattggtgaatcatctccaaatcctaccatagaagaggggagaactttaagggtgctgaaaatggtcgaaccttggctccggggaaatcaattttgtatcaaaatactaaacccatacatgccctcagtagtggaaaccctggagcaaatgcaaagaaaacatggtggcatgctggttcgaaacccactttcacgcaatagcacccatgaaatgtactgggtatcatgtgggacaggaaatattgtttcagctgtaaatatgacatcgagaatgttgctcaaccggtttacgatggcacacaggaaacctacatatgaacgcgacgtcgacttaggagcaggaactagacatgtagcagtagaaccagaagtagctaatttagacattattggtcagagaatcgaaaacattaaacatgagcacaaatcgacatggcattatgatgaagataatccttacaagacatgggcatatcacggaagctacgaagtgaaacccagtgggagtgcatcgagtatggtaaatggtgttgtgaagctccttacaaaaccatgggacgtaattccaatggttacacaaatagcaatgacggatacaacaccctttgggcaacaaagagtgttcaaagaaaaagtagatacgagaacgcccaaggccaaacgaggcacagcccagatcatggaagttacagcgagatggttgtggggatttctgtctcgaaataagaaaccaagaatatgtactagagaagagttcacgagaaaggtcagaagtaatgcagcaataggagcagttttcgtagatgaaaaccagtggaatagtgccaaagaagctgtcgaagacgagcgattttgggatttagtacaaaaggaacgagaattacacaagcaagggaagtgcgctacctgtgtatataacatgatggggaaaagagaaaagaaactgggagagttcggtaaggcaaaaggctctagagcgatatggtatatgtggttgggagctaggttcttggagttcgaagcgctaggttttatgaatgaagaccattggtttagcagagaaaattcattgtccggagttgagggtgaaggattacataaacttggttacatattaagagacatctctaaaatcccgggtgggaacatgtatgcagacgacaccgctggatgggataccagaatcactgaagacgatttacaaaatgaggcaaagatcaccgacattatggagccagaacacgcgttactagctacgagtatatttaaacttacatatcaaaataaagttgtacgagttcaaagaccggccaaaaacggaactgtaatggatgtgatatctcggcgagatcagagaggtagcggacaagttggaacctatggcttaaatactttcacaaatatggaggcccagctcattagacaaatggagagtgaaggaatttttcttccttctgaattggaaacaccaaacttagctgaaagggtcctggattggctagaaaaatacggagtggagcgattaaagcgcatggcaataagtggagacgattgcgtagtgaagcccatcgacgatagatttgctactgcattgactgctcttaacgacatgggcaaagtccggaaagatataccacaatgggaaccctcaaagggatggaatgactggcaacaagtgccattttgttcacaccactttcaccagctaatcatgaaggatgggcgagaaattgtagtgccgtgccgcaatcaagacgaattggttggcagagcaagggttagtcaaggcgctggttggagtttaagagaaactgcatgcttggggaaatcatacgcgcagatgtggcaactgatgtattttcataggagagacttacgtctcgcagctaacgctatatgtagcgctgttccagttgactgggtacctacaagtcgaaccacttggagcatacacgcccatcatcagtggatgacgactgaagatatgctctccgtctggaatcgagtatggatagaagaaaatccgtggatggaagacaaaactcatgtctcatcatggggagacgttccttatctaggtaaaagagaggatcaatggtgtggatccctaataggtttaaccgctcgggcaacctgggcgagtaatatacaagtagcaataaaccaggtgagaagattaattggcaacgaaaattatttagattatatgacgagcatgaaaaggtttaagaatgaaggtgatcctgagggggcattgtggtaa

SEQ ID NO: 21541 - RNA, 9879 nt, synthetic construct
  misc_feature 1..9879: note = derived and/or modified CDS sequence (opt6) from DENV-1__FJ410205__SS-prME
  source 1..9879: mol_type = other RNA
tctgtaacaatgctgctaatgttgatgcctacagcacttgcattccatcttactacgagagggggtgaaccgcacatgatcgtatcgaaacaagaacgcggaaaatcacttctctttaaaacatcagcaggagtaaacatgtgtacactgattgcaatggacctaggagaactatgcgaagatacgatgacatacaaatgcccaaggatcactgaaacagaaccggatgatgtagattgctggtgtaatgcaacagacacgtgggtaacgtatggtacttgcagccaaactggcgaacatagacgggacaaaagaagcgtggctcttgcaccccacgtcggcctagggttagaaacacgaacggaaacctggatgagcagtgaaggtgcatggaaacaaatccaacgtgtagaaacttgggcgttgagacaccccgggttcacagtcatagccttatttctagcacacgcaataggtacaagcatcacccaaaaaggaattatattcatcctattaatgctagtcactcctagtatggcgatgagatgcgttggcatcggtagtagagattttgtagaagggttaagtggagcaacctgggtggatgtcgtccttgaacatggctcttgtgtaacaaccatggcgaaagataaaccaacactggacattgaattgttgaaaacggaagttacaaatcctgcagttcttcgaaaactttgtattgaagcaaaaatatccaatactactacagatagtaggtgtcctactcaaggtgaagccacattagtcgaggaacaagatgcaaactttgtttgtcgtcgaacatttgtagaccgaggctggggcaatggttgcgggctatttggtaaaggaagccttattacatgtgcaaaattcaaatgtgttactaaattagaaggtaaaatcgtacaatacgaaaacttaaaatattcagtaatcgtaactgtacacacaggagatcaacaccaagtaggtaatgaatctactgaacacggcacaacggctacaataaccccgcaagcaccaacgacggagatacaattaacggactatggagcgttaacactagactgttctccaagaacaggactagactttaacgagatggtattattaactatgaaagaaaaatcctggcttgtgcataaacaatggttcctcgatctaccgttaccctggacatcaggcgcatcaacatctcaagaaacgtggaatcgtcaagatttacttgtgacttttaaaactgctcatgctaaaaagcaagaagtggtcgttttagggagccaagagggtgctatgcatacggcgctaacaggagctaccgaaatccaaacatccggaacaaccacaatctttgcaggacacttaaaatgtaggctgaagatggacaaactaactttaaaaggcatgtcttatgtcatgtgcacaggatcctttaaattagagaaagagttagcggaaacacaacatggaactgttttagtccaaattaaatacgaaggaacagatgcaccatgtaaaatacccttcagtactcaagacgaaaaaggagtaacacaaaatggaagattaataaccgcgaatccaatagtaacagataaagaaaaaccagtaaacatcgaggccgagcctccttttggtgaaagttatatagtaataggggcaggagagaaggcactaaaactaagctggttcaaaaagggaagttcgataggaaaaatgttcgaggctacagcacgaggggccagaagaatggcgattttaggcgatacggcgtgggatttcggaagcataggaggtgtgtttaccagtgctggcaagctagtccatcaaatttttgggaccgcttacggggtactgttcagcggagtatcatggacaatgaaaattggtataggagtactattgacttggttagggttaaatagtagaagcacgtcgcttagcatgacctgcattgccgtaggtttagtaacactgtacttaggtgtaatggtacaagcagattcaggatgtgtcatcaattggaaagggagagaactaaaatgcggctctggaatctttgtaacaaatgaggtacacacctggacagaacaatataaatttcaagccgatagccctaagagacttagtgctgctataggtaaagcgtgggaagaaggagtatgtggcatacggtcggctacaagattagagaatatcatgtggaaacagatctcaaacgaacttaatcacatcttgttagaaaacgatatgaaatttacagtagttgtaggagatgtagcagggatactggcacaaggtaagaaaatgattcgacctcagcctatggagtacaaatattcgtggaagtcgtgggggaaggcaaaaataatcggagcagacgttcagaataccacttttattatagatggccccaacactccagaatgcccggatgaccagagagcttggaatatatgggaagtcgaggactacggattcggcattttcacgacgaatatatggttaaaactgcgagatagttacacgcaggtatgtgatcatcgtttaatgtccgccgcgataaaggacagtaaagctgttcacgctgacatggggtattggattgaaagtgagaaaaacgagacctggaaactagcaagagcttctttcatcgaggtaaaaacctgtatatggcctaaatctcacacattatggtcgaacggcgtgctcgagtcagaaatgatcatacccaaaatctatggtggtcccatatctcaacataactatagaccaggatatttcacacaaacagcagggccatggcatttaggcaaacttgaattagattttgatctatgtgaaggtacgacagtcgtagtcgatgaacactgcgggaataggggcccgtctttaaggactactacagtaactggtaaaattatacatgaatggtgctgtagatcatgtacactcccacctctaaggtttcgtggagaagatggttgttggtacgggatggaaatcagacctgtaaaagaaaaggaagaaaacttagttaaatcaatggtatcagcaggcagtggtgaagttgattcattcagtttaggcttgctctgtatttcaattatgatcgaagaagtcatgaggagtagatggtcacgaaagatgttaatgactggaacgctcgcggtcttctttctattaattatgggtcaactaacatggaatgaccttataaggctatgcattatggtgggagcgaatgccagcgatagaatgggaatgggaactacttatttagccctaatggctacgtttaagatgcgccccatgttcgccgtaggtttactatttagaaggttgacatcaagagaagtcctcctactgaccatcggtttgtcattagttgcatccgtcgaactaccaaactcacttgaagaattgggggatggcctagctatgggtatcatgattttaaaattgttgacagatttccaatcacatcaattatgggccaccttgctaagtttaacattcattaaaactacattctcccttcattatgcctggaagactatggctatggtcctcagtatagttagtctatttcccctatgcttaagtacaacaagccagaaaacaacatggttgccagtactgctaggaagtctaggttgtaagccgttgaccatgttcctaattgccgaaaataaaatatggggccgtcgttcatggccgttaaacgaaggaataatggccgtaggaatcgtatctatccttcttagctcattactaaagaacgacgtaccattagccggtccgttaatagcgggcggcatgctaattgcttgctatgtaatcagtggtagtagtgctgacctctcattggagaaagcggcagaggtgagttgggaagaagaagcggaacattcaggtgcctcccataacattttagtagaggttcaagatgacggaacaatgaaaatcaaagacgaggaacgagatgatactctgaccatcttattaaaagcgaccctgctagcggtctcgggggtgtacccactgtccattccggcaaccctcttcgtctggtacttttggcagaaaaagaaacaaagatcgggagttctgtgggatacaccctctccaccagaagtagaacgcgccgtgctagacgatgggatctaccgtatcatgcaacgaggtctgttaggcagaagccaagtcggagtcggcgtttttcaggaaaacgtattccacaccatgtggcatgtaactagaggagcagtattaatgtaccaagggaaacgtcttgaaccctcttgggcttcagtcaagaaagatttgatatcatatggcggcggatggagattacagggaagttggaacacaggcgaagaagtacaggtcatcgcagtggaaccaggcaaaaatcccaaaaacgttcaaacggctccagggacattcaaaactccggagggcgaagtaggagctatagcattggattttaaaccaggtacaagtggtagcccgattgtgaaccgtgaagggaaaattgtaggactgtacggaaacggagttgtaactacttcaggaacgtacgtaagcgcgatcgctcaagccaaagcatcacaagaaggaccattacctgagatagaagacgaagtctttcgaaaaagaaatctgactattatggatttacatcctggatccggaaagactcgtagatacttaccagcgattgtgagagaagctataaaacggaaattgagaactctcatcttggccccaacaagagtagttgcttcagaaatggctgaagcattgaaaggtatgcctattagatatcaaactaccgctgttaaaagcgaacacactgggaaagagatcgtagacctcatgtgtcatgcgacctttaccatgcgcttgttaagtccagttagagttccaaattacaacatgataataatggatgaagcacatttcacagatcctagctccatagctgccagaggctacatttcaacgcgcgtaggcatgggggaagcggccgctatattcatgactgcgaccccaccaggcagtgttgaagcctttccacaatccaacgcggtaatccaagatgaagaaagggatataccagaaaggtcgtggaatagtggttatgaatggataacggattttcccggcaagactgtttggttcgttccttctatcaagagcggcaatgacattgcgaattgcctccgtaaaaacggcaaaagagtcatccaactatcaagaaaaacctttgatactgagtatcaaaagaccaaaaacaacgactgggattacgttgtaacaactgatatatccgagatgggagcaaatttcagggctgatcgagtaatagatccaagaagatgcttaaaaccggttatattaaaagatggaccggagagagtgattctagctggacctatgccggtcactgtggcttctgctgcacaacgaaggggcagaataggtcgtaatcacaacaaagagggagatcagtatatctacatgggccaaccattaaacaatgatgaggatcatgctcattggactgaagccaaaatgttgctagataatatcaatactccagaaggaattatacccgctttattcgaaccggagcgtgaaaaatcagcagcgattgatggtgaatatagacttagaggggaagcacgcaagacattcgtggagttaatgagacgaggagatctgcccgtatggcttagttataaagtcgcatcagaaggcttccaatactccgatagacgatggtgttttgacggtgaacgaaataatcaagtcctagaagagaatatggacgtagagatatggaccaaagaaggcgaacgcaagaaattaagaccaagatggcttgatgccaggacttactcagacccgctcgcattacgtgagttcaaagaatttgctgcaggtcgacgatcggtgtcaggagatctgatactggaaattgggaaattgccacaacatcttactcaacgagcacaaaacgctttggataatttagttatgctacataatagtgaacaaggtggacgtgcatatagacatgcaatggaagagttacctgacacaatagaaactctaatgctgttagccctaatagcagttctcacagggggagttacactgttctttctatccggtcgcggattaggtaaaacatcgattggactactatgcgtgatggccagttctgttttactctggatggcttcagttgaaccacattggatagctgcgtctataattctggaatttttcctaatggtacttctgataccagaacctgatagacagcgcacgccacaagacaatcagctcgcgtacgtggtgataggcttattgtttatgatcctaacagtagccgctaacgaaatggggctattagagacaactaaaaaggatttaggaattggacatgtagcagttgagaatcatcaccatgcggctatgttagatgttgacctacaccccgcgtctgcgtggactctctacgccgtggctactactattattacacctatgatgagacatacaattgaaaacacaacagccaatatttcactaacggcaattgctaatcaagcagcgatcctaatgggactagacaaaggatggccaataagcaaaatggatattggggtacctctactcgcacttggttgttatagtcaagtaaatccattaacactgacggccgctgtattgatgttggttgcacactatgctattataggacctggactgcaagccaaagcgacaagagaagcccagaaaagaaccgcggctggcataatgaaaaacccgacagtagacggaatagtggccattgatttagaccctgtagtatatgacgcgaaatttgaaaagcagctaggacaaattatgcttctaatcttatgcacaagtcaaatattactaatgagaacaacatgggccctatgtgagtctattaccttagcgacaggtccattaacaactttgtgggaaggatctccagggaaattttggaatactaccatcgccgtttccatggccaatatctttaggggatcttatttagccggtgcgggtttagcgtttagtctaatgaaatcactaggaggaggaaggcgcggtacaggtgctcaaggcgagacattaggagaaaaatggaaaagacaattaaatcaactgtctaaaagcgaatttaatacctataaaaggagcggaattatggaagtggatcgatcagaagcgaaagaagggttaaagcgtggcgaaacaacgaaacacgcagtttctcgaggaactgccaagttaaggtggtttgtggagcgaaatcttgtaaagcccgaagggaaagtaatagacttagggtgtggacgaggcgggtggagctattattgcgcaggattaaagaaagttacggaagttaaaggatataccaaaggtgggccgggacatgaggaaccaatccccatggccacttatggttggaatctagtgaaattacacagtggaaaagacgttttctttatacctccagaaaaatgcgacactctcctgtgtgacataggtgagtcatcgccaaatccaactatagaagaagggagaaccctaagagtattgaaaatggtagaaccttggttacgtggcaatcaattctgcataaaaatcttgaacccgtatatgccgtcggttgtagaaacattggagcaaatgcaaaggaagcacggtggaatgcttgtgagaaaccccctatcacgcaacagtactcatgaaatgtactgggtatcatgcggaactggcaacatagtttccgctgttaatatgacttccaggatgttactaaatagatttacgatggcccatagaaaacctacttatgaaagagatgtcgacctaggagctggtactcgtcacgttgcagtcgaaccggaagtagctaatttagacatcatagggcagcgtattgaaaatattaaacacgaacacaagtctacatggcactatgacgaagataacccatacaagacatgggcttaccatggctcatacgaggtaaagccatcaggatcagcaagctccatggtcaatggagtggtaaaattactcactaaaccttgggatgtaataccaatggttacacaaatcgctatgacggacacaacgccttttggacaacaacgagtcttcaaagaaaaagtagataccaggactcctaaagcaaaaagaggaacagctcaaatcatggaagtaacagcgaaatggctatggggattcctttcacgtaacaagaaacctcgtatatgtacacgtgaagaatttacaagaaaggtaagatccaacgctgccatcggtgcagtttttgtcgatgaaaatcaatggaactcagcaaaggaggctgtcgaggacgaaagattctgggacttagtacatagggaacgagagttacataaacaaggtaagtgtgcaacctgcgtttataatatgatgggaaaaagagagaagaaattaggagagttcgggaaagctaagggtagtcgcgctatttggtatatgtggcttggagccagatttttagagttcgaagcgcttgggtttatgaacgaagatcactggttttctcgagaaaattccctttcaggggtggagggcgaaggccttcacaaattgggatatattttaagagacataagtaaaatacccggaggtaacatgtacgcagatgataccgctggatgggacaccaggattactgaagatgatttacaaaatgaagctagaataactgatatcatggaaccggaacacgcgttgctagcgaaaagcatatttaaattgacctaccagaacaaagtagtaagagtacaacgacccgccaaaaatggaacagtaatggatgtaataagccggagagatcaaagaggttcgggacaggttggtacatatggattaaacaccttcacgaatatggaagcccaactaattcggcagatggaatcagaaggaatattttctccaagcgaattagaaacaccgaaccttgcggaacgcgttctcgattggttagaaaaatatggagtcgaaaggctgaaacgaatggcaatatccggcgacgactgcgtcgtcaaaccgattgacgaccggttcgccacagcattaacagcgctaaatgatatggggaaggtcaggaaggacataccccaatgggaaccttctaaaggttggaatgactggcaacaagtaccgttctgttcacaccactttcatcaactaataatgaaagacggtagagaaatagtagtgccatgtaggaatcaggatgagcttgtaggcagagcaagagtatcccagggagcaggatggagtcttcgagaaactgcgtgcctcgggaagtcctatgctcaaatgtggcagctaatgtactttcacagacgcgatttacgactagctgcaaatgcgatatgtagcgctgtacctgttgattggatacctacgtctcgaactacatggtcgatacatgcccatcaccagtggatgacaaccgaagacatgcttagtgtatggaaccgtgtgtggatagaagagaacccctggatggaagataaaacacatatttctagctggggtgatgtaccctatcttggtaaaagggaggaccaatggtgtggttcattaattggattgacagccagagcaacctgggcaactaacattcaagtcgcaatcaatcaagtaagacgcttaattggaaatgagaactatctcgattacatgacttcgatgaaaagatttaaaaatgagtccgatccagaaggcgccttatggtaa

SEQ ID NO: 21542 - RNA, 9879 nt, synthetic construct
  misc_feature 1..9879: note = derived and/or modified CDS sequence (opt6) from DENV-1__FJ410207__SS-prME
  source 1..9879: mol_type = other RNA
tctgttactatgttactcatgttaatgcccactgccttagcatttcatttaacaacgcgcggtggggagccacatatgattgtcagtaaacaagaaagagggaaatcactcctatttaaaacttctgcaggagtaaacatgtgtactcttatagctatggatttaggggaattttgtgaagacacaatgacatataaatgtccaagaattacagaagccgaacctgatgacgttgattgttggtgtaacgcgactgatacgtgggttacatatggaacgtgttcacagactggtgaacatagacgagacaaaaggagtgtcgctctagcacctcatgttgggttaggactagaaacgagaactgaaacttggatgagcagtgaaggggcatggaaacaaatccaaagagtggagacgtgggctctcagacatccaggatttatggtaatagcgttatttttggcgcacgctatcggaacttcaatcactcaaaaaggcatcattttcatactccttatgctagtgacacccagtatggcgatgcgttgtgtagggataggatctagggactttgtagaaggtttaagtggtgcaacctgggtagacgtagtattagagcatggaagctgcgtaaccacaatggcaaaagataaaccgacgttagatatagaactattaaagactgaagtaacgaatcctgctgttcttcgaaaattgtgtatagaagctaaaataagcaatactacgacggactcaagatgtcctactcaaggagaagcaacactggtagaagaacaggacgcaaacttcgtttgccgaagaacgttcgtagatcggggctggggtaacggctgcgggctatttggaaagggtagcctaattacgtgtgcgaaattcaaatgtgttacaaaactggaaggtaaaactgtacaatatgaaaatcttaaatattcagtaattgtaaccgttcatacaggggatcaacatcaagtaggaaacgaatccaccgaacatgggacaaccgccaccatcactcctcaagctccaagtacagaaatacaattgactgactacggggcactaaccctagattgttcccctcgaactggactagatttcaatgaaatggtgctactcactatgaaggagaaaagctggttagttcacaaacaatggtttctagacttgcctttgccttggacttctggagcctcaacgtctcaagaaacatggaataggaaagacttgcttgtaacatttaaaactgctcacgcgaagaaacaagaagttgttgtgctcggctcacaggagggagcaatgcatacagctttaacgggagccactgaaattcaaacatcggggacaacgacaatatttgcaggacacctaaaatgtaggcttaagatggacaaattaactctcaaaggaatgtcatacgttatgtgtacgggctcattcaagctagaaaaggaagtagcagaaacacaacatggcacagtattagtacaaatcaaatacgaaggcacagacgcaccttgcaagataccgttttctacccaagacgaaaaaggagtgacacaaaatgggagattgattactgcaaatccaatagtcacagataaagaaaagttggttaacattgaagctgaacctccattcggggaatcttacattgttattggagcaggagaaaaagcactcaaactgagttggtttaagaaggggagtagcataggcaaaatgtttgaggctactgctagaggagcacgtagaatggcgatattaggagatacggcttgggatttcggtagcattggcggtgtttttacaagtgtaggaaaacttgtacatcagattttcgggacagcttacggcgtattgttttctggcgtatcttggacaatgaagataggtattggagtcctactcacttggttaggactaaatagcaggagtactagcttaagcatgacctgtatagccgtcgggttagtgacattatatctgggagtcatggtacaggctgactcaggatgtgtgataaactggaaagggagagaactgaaatgcgggtctgggatatttgtaacaaacgaagtacatacttggacagaacaatataagttccaagcagattcaccaaaacgattatccgccgctataggtaaagcatgggaggaaggtgtttgtgggattagatcagcaacgagattggagaacatcatgtggaaacaaatctccaacgaacttaatcacattcttcttgaaaacgatatgaaattcacagtcgttgtgggagacgtggcaggaatcctggcgcaaggtaagaaaatgatacggcctcaaccaatggaatacaaatactcatggaaaagttggggtaaggcaaagattattggagccgacgttcagaacaccacatttataatcgatggaccaaatacccccgaatgcccggacgaccaacgcgcatggaacatatgggaagtagaggattacggatttggaatatttactactaacatatggttaaaattgagggattcttacacgcaagtttgcgatcataggctgatgtccgcggcaataaaggactcaaaggcagtgcacgcagacatgggatattggatagaatctgagaaaaatgaaacatggaaacttgcaagagcatcgttcatcgaagttaagacgtgcatttggccaaagtctcatactctatggtcaaacggtgtcctagaatcagaaatgatcataccaaaaatatacggaggacctatttcacaacacaattacaggccaggatactttacacagacagcaggcccatggcatttgggtaaattagaactagatttcgacctttgtgaaggaaccacagttgtggtggatgaacattgcggaaacagaggaccaagtttacgcaccacaactgtaacgggaaaaataattcatgagtggtgttgtcgatcttgtacgcttcctccacttagattcaagggtgaggacggatgttggtatggaatggaaataaggcctgtaaaggaaaaagaagagaatttggtaaaatcaatggtatcggcgggttcgggcgaggttgacagtttctcattaggtcttttatgcatctccataatgattgaagaggttatgcgatctcgttggtcaagaaagatgttaatgacaggaacacttgcagtattctttttactgataatgggtcagttgacttggaacgatctgatcagactttgcataatggttggcgcaaacgcctctgatagaatgggaatgggcactacgtatttagctctaatggctacatttaaaatgcgcccgatgttcgcggtaggtttgttattcagaagattaacaagtagggaggttcttcttctcactatcgggttatcactcgttgcctcagttgaactgcctaattcactagaagaactgggagacggactagcaatggggataatgatcttaaagttactgacagatttccaatcacatcaactatgggccacgttattgagcctaacgttcattaagacaacattttcacttcattacgcttggaagacgatggcaatggtactgagtattgtgagtttattcccgttatgtttaagtaccactagccagaaaaccacgtggttaccagtgctacttggatcccttggttgtaagcccctgacgatgtttcttattgcggagaatagaatatgggggagaaaatcatggccgctaaacgagggaataatggccgtcgggatcgtctcaatactattaagttctttgctcaaaaatgatgttcccttagcagggcctttgatagctggaggaatgctgattgcttgctacgttatatcaggatcaagcgccgatctctccctagaaaaggccgctgaggtttcatgggaagaagaagctgaacatagcggagcttcacataatatcctagtggaagtccaggacgatgggacaatgaagataaaagatgaggaacgagatgatactctaacaatacttttgaaggccaccctattagccgtatcgggtgtctaccctttatctataccggctacgctttttgtgtggtatttctggcagaagaagaaacaacgaagcggcgtattatgggacaccccatctccaccggaagtagaaagggcagttcttgacgatggcatatatagaattatgcagcgcggtctattaggacgaagtcaagtaggggttggggtatttcaagaaaacgtatttcataccatgtggcatgttactcgtggcgcggttttaatgtaccagggaaaacggctcgagcctagctgggcatccgtgaagaaagatttgatttcttatggtggtggttggcgtctccagggttcatggaatactggtgaagaagttcaagttattgcagtagaacctggtaaaaaccccaaaaatgtacaaaccgcacctggtacatttaaaacgagtgagggcgaagttggggctatagccttggatttcaaacctgggacatccggaagcccgattgtaaatagagaaggtaagatagtaggattatatgggaacggggtggtaacaacatctgggacgtacgttagtgctatcgctcaagcgaaggcttcccaggaaggaccactgcctgaaatagaggacgaagtattcagaaaaagaaacttgacaataatggacttacatccaggaagtggcaaaacaaggaggtatttgccggccattgtcagagaggccataaagcgaaaattaagaacactaatattagcccctacacgagtagttgccagcgaaatggctgaagcactcaaagggatgcctattcgttaccaaaccactgccgtgaaaagtgaacatacaggaaaagaaattgtagatttgatgtgccatgctacgtttacaatgagacttctatctccagtaagagtaccaaattacaatatgatcattatggatgaagcacatttcacagatccatcgtcaatcgctgctcgcggatacatatctacccgggtaggaatgggagaagcagctgcaatatttatgacagcgacgcctccaggtagtgtagaggcatttcctcaatctaatgctgtaatacaagacgaagagagagatattccagaacgttcatggaacagtggttacgagtggataactgacttccctgggaagactgtctggttcgtaccgagtattaaatccggtaatgacattgcgaattgtctaaggaaaaacggaaaaagagttatacaattgtcacgcaaaacgtttgacactgaatatcagaaaacaaagaataatgattgggattatgtcgtgacaacagacatatcggagatgggagcaaatttccgtgcggatcgtgtgatcgatccgagacgttgtttgaaacctgtgatattaaaagatggacccgagagggtgatattagcaggccctatgccagtcacggtggccagtgcagcacaaagacgaggtcgcatcggccgaaaccataataaagaaggtgaccaatacatatacatgggacagcctctaaacaacgatgaagaccacgcgcactggacggaagcaaaaatgcttttggataatataaatacaccagaaggtattattcctgcattgtttgaaccagagagagaaaagtccgccgccatagacggtgaatatagattacgtggagaggcacgcaagaccttcgtcgagctaatgcgacgtggggacctaccagtatggctctcatacaaagttgctagtgagggctttcaatactctgaccgtagatggtgctttgatggcgaaagaaataatcaagtgctggaggaaaatatggatgtggaaatatggactaaggaaggagaaagaaagaaattgagaccgagatggttagacgcacgcacctacagtgatccccttgcattacgagaatttaaagaatttgcagcaggacgtcgctcagtaagtggagatttaattttagaaatcggtaaattgccccagcatctaactcagagggcgcagaatgcattagataacttagtaatgcttcacaactctgagcaaggtgggagagcctataggcatgcaatggaagagttaccagacacaatagaaacgctgatgctcttagctctcatcgctgttctaactggaggcgtaactctattctttctaagtggtaggggtttgggtaaaacatcaataggattattatgtgtgatggcatccagtgtattattatggatggcttcagtggagccccactggatagccgccagcattatattagagttctttctgatggtattgcttattccagaacctgatagacagagaacgccacaagacaatcaattagcctatgtggtgattggattgttatttatgatacttacagtagctgctaatgaaatgggtctcctcgaaactacaaagaaagacttaggtataggacatgtggcagtagaaaatcatcatcatgcagcgatgctcgacgtggatctacatccggcctcggcatggactctttatgctgtagcaaccactataatcactccaatgatgaggcataccatcgagaatacaacagctaacataagtttgacagcaatagcaaaccaggcagcaattcttatgggactagataaaggatggccaatatcgaaaatggatataggcgtccctttgttagcccttggttgttactcacaagttaaccccttgacgctaactgctgcagtcctaatgcttgtagcacattacgctataattggtccaggtctacaggctaaagcaactcgtgaagctcagaaaaggacagcagcagggataatgaaaaaccctactgtggatggaattgtagcaatcgatcttgacccagtagtatatgatgcaaaattcgaaaaacagctagggcaaattatgttacttatattatgcacctcccagatattgttaatgaggacaacgtgggctctgtgtgaatcaattactttagccacagggccattgaccacattatgggaaggctcaccaggtaaattttggaatactacaatcgccgtttcaatggctaacatctttagaggatcatatcttgcaggagctggactcgcattttcactaatgaagtccttagggggaggtcgacggggtacaggagcacaaggagaaacgttaggagaaaaatggaaaagacaattaaatcagcttagcaaaagtgaatttaacacgtataaacggtccggaatcatggaagttgacagaagtgaagctaaagaaggcctgaaaagaggggaaacaaccaaacatgctgtaagtagaggtactgctaagctcagatggttcgttgaaagaaacttggtgaagcccgagggaaaagttatagacctagggtgtggacgaggcggatggtcatactattgtgcagggctaaagaaagttacggaggtgaaagggtatacaaaaggaggaccaggccatgaagaacccataccaatggccacctacggatggaatctagtaaagttgcattccggcaaagacgtattctttacaccgccagaaaagtgcgatacactattatgcgacatcggagaatcttctccaaatccaaccatcgaagaaggcaggacactacgtgtcctgaaaatggttgaaccgtggttgcggggaaatcaattctgtatcaaaatattaaatccgtatatgccttccgtcgtagaaacgctggagcaaatgcaaaggaaacatggagggatgctggtaaggaacccactctcacgaaactcaactcacgaaatgtactgggtatcgtgtggaacgggaaatatagtaagtgcggtaaatatgacctcaagaatgcttttaaaccggtttacaatggcacacagaaaaccaacgtatgaacgtgatgttgatctgggtgctggaacccgtcacgttgctgttgaaccagaagtagcaaacttggacatcattgggcagagaatcgagaatatcaagcatgaacataagtcgacctggcactatgatgaagataatccatacaagacttgggcctatcatggttcctatgaagtcaaacctagcggttcggcttcgtcaatggtaaatggtgttgtaaaactgcttaccaaaccctgggacgtaattcccatggttacacagattgcaatgacagacactactccgtttgggcagcaaagagtttttaaagaaaaagtagatacaagaacccccaaggcgaaaagaggcactgcacagataatggaagtaacagctaaatggctatggggtttccttagtagaaataagaaaccgagaatatgtaccagagaagaatttacacgaaaggttagaagcaacgcagcgataggagcagtgtttgttgatgaaaatcaatggaactcagcaaaagaagcggttgaagatgagcgcttctgggatctagtacaccgtgaacgggaattacataaacaaggaaagtgtgcaacttgcgtatacaatatgatgggaaaaagagaaaagaagctaggcgaatttggaaaggccaaaggatcgagagcgatctggtatatgtggttaggagcgcggttcctggagttcgaagcattaggatttatgaatgaagatcattggttttcaagagaaaactcgctgtccggggtggagggagaaggattacataaattaggatacatattaagggatatcagtaagatccctgggggtaatatgtacgcagatgacacagctggatgggatacccgcatcactgaagacgatctacagaacgaagcgaaaatcacggacataatggaacctgaacatgccttgctcgcaaagtcgatcttcaaactaacctatcaaaataaagtagttcgtgtacaaaggccagctaaaaacggaacagtcatggacgtgatatccagacgcgatcaaagaggatcaggacaggtgggaacctacggtctaaatacgtttacaaatatggaagcacaattgattagacaaatggaatccgagggaatttttagtccgtcagagttagagacgccaaatctagcaggtagagtgttagattggctagaaaaacatggagtggaacgacttaagcgtatggccataagcggagacgattgtgtagttaaacccattgacgacagatttgcaaccgccttgacagctttaaatgacatgggaaaagtaagaaaagatatcccacaatgggaacctagcaaaggttggaacgattggcaacaagttcctttctgttcccaccatttccaccaactaataatgaaggacggtagagaaatagtcgttccatgtcgcaaccaggacgagttagtgggtcgagctagggtctcacagggtgcagggtggtctctgagagaaacagcgtgtcttggaaaatcctatgcgcaaatgtggcaattaatgtattttcacagaagggatctacgactcgcagctaatgctatctgttccgccgtacccgtagattgggtgcctacaagcagaaccacttggagtatccatgcacatcaccaatggatgacaacagaagatatgctgtcagtgtggaatagagtatggattgaagaaaatccttggatggaggacaaaacacacatatcgtcatggggagatgtaccttacttaggcaagcgtgaagatcaatggtgtggatctcttataggattaacagcccgtgcgacatgggctactaacattcaagtagctataaatcaagtacgtagactaataggtaatgaaaattatttagactacatgacctcaatgaaacgatttaaaaatgaaagcgatccagaaggcgctttgtggtga

SEQ ID NO: 21543 - RNA, 9879 nt, synthetic construct
  misc_feature 1..9879: note = derived and/or modified CDS sequence (opt6) from DENV-1__FJ432744__SS-prME
  source 1..9879: mol_type = other RNA
tcagtaactatgctcctaatgttaatgcctaccgctcttgcgttccacctcactacacgtggaggggaaccccacatgatagtttccaaacaagaacgtggcaaatcacttctctttaaaaccagtgctggagtaaatatgtgtacactaatcgcaatggatttaggtgagttttgcgaagacacaatgacttacaaatgtccacgaataactgaagcggaaccggatgacgtagactgctggtgtaatgcaacagatacatgggtgacatatggaacttgctcacaaacaggagaacataggagggataaacggtccgtcgctttggcaccacacgtcggtttaggtctcgaaacaaggacggaaacctggatgtccagtgaaggggcatggaaacaaatacaacgagtcgaaacttgggccttaagacatcccggctttacagtcattgcactctttttagctcatgcgattgggacatccataacgcaaaaaggaatcattttcatactcctcatgctggttacccctagcatggctatgcggtgtgtaggaataggaagccgagactttgtagaaggattgtccggcgctacatgggtagatgtagttttggaacatggttcatgcgttactactatggcgaaagacaaaccgacactagatatagaactattaaaaactgaagtaacgaacccagcggtacttcgtaaactatgcatagaggcgaaaattagcaacacgacgacagactcaaggtgtcccacacaaggcgaagcaactctagtagaggagcaagacgcaaattttgtctgtaggagaacatttgtggatcgcggttggggaaacgggtgcggactcttcggaaaagggtcccttattacgtgtgcgaaatttaaatgcgtgactaaacttgaaggaaaaacggtccaatatgaaaaccttaaatatagtgtcatagtcacagtacatactggtgatcaacatcaagtggggaatgagtcaacagaacatggaactactgccaccattaccccacaagcaccatcaacggaaatccaattaacagactacggagcccttactctcgactgttctcccagaacaggattagacttcaacgagatggtactactcacaatgaaagaaaaggcgtggttagtccataagcaatggtttctagatttaccattaccatggacgtcaggtgcaagtacttctcaagaaacatggaatcggaaagacctgctagtgacatttaaaaccgcacacgccaagaaacaagaggttgttgtgttaggctcgcaagaaggagcaatgcataccgcactaactggcgccaccgagatccaaacttcaggaacaacaacgatattcgcaggacatttaaaatgccgactaaaaatggataaattaaccctcaaaggaatgagttacgtaatgtgtactggttcttttaaacttgagaaagaagtagccgaaacacagcacggcacggtccttgtacagatcaaatatgaaggcacagacgctccatgtaaaataccattctccacgcaagatgaaaaaggtgtaacacaaaatggccgcctaataacagcaaaccccatagtaacagataaagaaaaaccggtaaatatcgaagccgagccaccattcggagaatcatatattgtcatcggtgccggagaaaaagcactaaaactttcttggtttaagaaagggtcatcaataggtaagatgtttgaagccactgcgcgcggggcacgtagaatggcaattctgggcgacacagcctgggacttcggatctattggtggtgtgttcacttctgttggcaaactggtacatcagattttcggcaccgcttatggagtgctattttcgggagtatcatggacgatgaagatagggataggtgtcttattgacatggctagggcttaactctagaagtacctcactcagtatgacatgcattgctgtggggcttgtaacattgtatttaggggttatggttcaagcagacagtggatgtgtaataaattggaaagggagagaattgaaatgtggttccggcatattcgttacaaatgaagtgcatacttggacggaacaatacaagtttcaagccgatagcccaaaaagactaagcgcggcgataggcaaagcatgggaagaaggggtgtgtggtataagatcggctacgcgattagaaaatataatgtggaaacaaattagtaatgagctaaaccatatattattagagaatgacatgaaatttacagttgtagtaggggacgtagccggcattttagctcaaggtaagaaaatgatacgtccgcaaccaatggagtacaaatacagttggaaatcttggggtaaagctaaaattataggggcagatgtacaaaacgcgactttcataatcgacggacctaatacacccgaatgccctgatgaccaaagagcttggaatatctgggaggttgaagactatggatttggaatcttcacaacgaatatatggctaaaattacgtgactcctatacacaggtctgtgatcaccgattgatgtctgccgcgataaaggattcgaaagctgttcacgccgatatgggttactggatagagtctgaaaagaatgaaacttggaaattggcccgcgcatcattcatcgaagtgaaaacatgtatttggcctaagtcgcacaccttatggagcaacggcgtgctcgaatccgagatgataatacctaaaatatacggtggaccgattagtcagcacaattatagacctggatattttactcagacggccgggccatggcatttgggtaaacttgagttagatttcgacctatgtgaaggtaccactgtcgttgtggacgagcattgtggcaatagaggtcccagcttaaggacgactacagtgacagggaaaataatacatgagtggtgttgtaggtcctgcacattaccgccgctaagattcaaaggagaggatggatgttggtatggtatggaaattcgcccagtgaaagagaaggaggaaaatctggtaaagagtatggtcagtgccggaagcggagaagtagattccttttcccttggacttttatgtatcagcatcatgatagaagaggtgatgcgcagtagatggagcagaaagatgttgatgactgggattctggcagtattctttttgctcatcatgggtcaactgacatggaacgatttaataagactatgcataatggttggtgcaaacgcctcagacaggatgggaatgggcactacctatctggcattaatggctacctttaaaatgagacctatgtttgcagtaggcttgctctttagaaggctaacttcacgtgaagtattattattaacaatcggtctgtcattagtagcttctgtagaacttcctaattcattggaagaactaggtgacggacttgcgatgggtattatgatcttaaaactactgacagattttcaatcacaccaactatgggctacactactaagtttaactttcattaaaaccactttttcacttcattacgcatggaagacaatggctatggtattatccatcgtcagcttattccccttatgcctaagcacaaccagtcagaaaactacgtggcttccggtcctgttaggatctctcggatgtaaacctctaactatgttcttaatcgcagaaaacaaaatttggggtaggaaatcctggccacttaatgaaggaataatggctgtaggaattgtgtctatcttactcagttctttgcttaaaaatgacgtacctttagccggacctcttatcgcgggtggtatgctaatcgcctgttatgtgatttcaggttcatcggcagatttaagtctcgaaaaagctgcagaagtgagctgggaagaagaagctgaacacagtggagcgtcacataacatactcgtagaggtacaagatgatgggacaatgaaaattaaagatgaagaacgtgacgatacacttaccatactcttaaaggcaacccttctagctgtgagtggtgtatacccgttgtccatacccgcgacgctattcgtatggtatttctggcagaagaagaaacgaaggagtggagtattatgggacactccatctccaccagaagtcgaacgagcggttctagatgatggaatatatcgcattatgcaaagaggactactaggtaggtcccaagtcggcgtaggtgtttttcaagaaaatgtatttcatacaatgtggcacgtaactagaggggctgttttgatgtatcagggaaaaagacttgaacccagctgggcttcagttaagaaagatttaatttcatatggtggtgggtggaggctccaaggatcttggaatactggcgaagaagttcaggttattgcggtggaaccagggaaaaatcctaaaaatgttcaaacggcaccgggtacatttaaaacaagtgagggggaagttggcgccattgcattagattttaaaccaggtacttccggtagcccaatcgtcaatagggagggtaagatagtaggattatacggtaatggagtcgtaactacatccggaacatacgtgagcgccatagcacaagctaaagcgtcccaggaaggcccactgccagaaatcgaagatgaggtatttcgtaagagaaatttgaccatcatggacttacatcccggatcaggcaaaacaagacgatacttgccggccattgtcagagaagccataaaacgaaagctacgcaccttaatattagcccctacaagggtagtagcatctgagatggcagaagctctaaaaggcatgccaattagataccagaccaccgccgtgaaatccgaacatacaggaaaagaaatagtggatttaatgtgtcacgcgacattcaccatgagattattaagccctgttcgtgtaccaaattataatatgattatcatggatgaagctcattttacggatcccagttcaatagcggcacgcggttatataagcacaagagtaggaatgggtgaagccgctgcaatttttatgacagcaactccaccaggctcagtagaagcattccctcaaagtaatgccgtaatacaagatgaggaacgagatatccctgaaagatcatggaactcaggttacgaatggataacagactttccaggcaaaacggtatggtttgtgccttctattaagagcggcaacgacattgcaaattgtctaagaaagaacggcaaacgagttatacaactttccagaaaaacatttgacacggaataccagaaaactaaaaataatgactgggattatgtggtaactaccgacatctctgaaatgggagctaattttagagctgaccgagtgatagacccccggcgatgtctaaagcccgttatactcaaagacggaccagaacgcgtcatattagctggtccaatgccggttactgttgcaagcgcagcgcaaagaaggggtcgaattggaagaaaccacaataaagaaggagatcaatacatttatatgggtcagccactcaacaacgacgaagatcacgctcattggacggaagcaaaaatgcttttagacaatattaatacccctgaaggtataatacctgcactattcgaaccagaacgtgaaaagtcagcagctatagacggggaatatcggttaagaggggaagctagaaaaacctttgtcgaactaatgagaagaggagacttacccgtatggttatcctacaaagtagcatcggaagggtttcaatactctgataggcgttggtgtttcgacggagaaagaaataatcaagttcttgaagaaaatatggatgttgaaatatggacaaaggaaggagaaagaaagaaattaagacctagatggctagacgcaagaacttactctgatcccttagccttgcgcgaatttaaagaatttgctgccggtaggagatcagtaagcggagatttgattcttgaaatcggaaaattaccacagcacttaacacaacgggcccaaaatgctctcgacaacttagtcatgttacataattctgaacaaggtggcagagcttaccggcacgcgatggaagaactacctgacacgatagaaacactcatgcttctggcattaatagcagttctaaccggtggtgttactttgttctttctaagcggacgaggactagggaagacttcaatcgggctcttatgtgttatggcctcgagcgtactcctctggatggcctctgttgaaccacattggatagccgcttcaataatacttgagttctttctaatggtattgttgatcccggagcctgatagacaaagaaccccacaagacaaccaattagcctacgttgttattgggctattatttatgatcttaacagtagctgcaaacgaaatgggattactcgaaacaacgaagaaagatttaggaataggtcatgtagcggtcgaaaaccaccaccacgctgcaatgcttgatgtagacctgcacccagcatcagcctggacactctatgctgtagctacaacaataataacaccgatgatgcgtcacaccatagaaaatacaacagccaatatatcattaacagcaatagcgaatcaagctgctatactcatggggttagacaaagggtggccgatcagtaaaatggacattggcgttcccctgcttgcactaggttgttatagtcaggtcaacccgctaacgttaacagcggcagtattaatgcttgtggcacattatgcaataataggaccgggattacaggccaaagcaacacgagaagcacaaaaacgaacggcagccggaataatgaagaatcctacagtggatggtattgtggcaatagatttagatccagtagtatacgataccaagtttgaaaaacaactaggccaaataatgttacttatattgtgtacatcacaaatactcctcatgagaacaacatgggcgctatgtgagtcgatcactctcgcgaccggtccattgaccacactctgggaaggtagtccaggtaaattttggaacacgaccatagctgtctcgatggcaaacatttttaggggtagctatctagccggcgcaggactagcattttcactaatgaaatcgctagggggcggacggagaggtaccggcgcacaaggagagactctaggagaaaaatggaaacgacaattgaatcagctatctaaaagtgagttcaatacttataagaggtcaggcattatggaagtagataggtcagaagccaaggaagggctaaaacgaggtgaaacaacaaaacatgcggtgagccgtggtacagctaagttacgatggttcgtagaaagaaatcttgtcaaaccagaaggaaaggtgattgacttaggatgtggacgaggtggctggtcctactactgtgcagggcttaagaaagtaacagaagtcaaaggatatacaaaaggaggtccgggccatgaagaaccaattcctatggctacttatggttggaacctagttaagctccacagtggaaaagacgtattctttattccacccgaaaaatgcgatacccttttatgcgacatcggtgaatcttctcctaatcctactatcgaagaaggaagaacgctaagagttcttaaaatggtcgagccttggctgcgcggcaatcaattctgcatcaaaatattaaacccatacatgcctagtgtagtagaaacgcttgaacaaatgcaaaggaagcatggaggaatgttagttcggaatcccctgagcagaaactcaacccatgaaatgtattgggtcagttgcggtactgggaatatagtttcagccgtaaacatgacctcaaggatgttacttaatcgctttactatggcgcatcgtaaacctacatatgaaagggatgttgacctgggcgccggaacgaggcacgtagccgtagagccggaagtagcaaatctagacatcataggacaacgaatcgaaaacataaaacatgagcacaagtcgacatggcattacgacgaagacaacccatacaaaacatgggcataccatgggagttacgaggttaagccatctggctctgcttcttccatggtgaacggagttgttaagttacttactaaaccgtgggatgtaatacctatggtgacacaaatcgcaatgaccgacaccacaccattcggtcaacaacgggtattcaaagagaaagttgataccaggactccaaaagcgaaacgagggacagctcaaataatggaggttactgcaaaatggttatggggattcctcagtagaaacaagaaaccacgcatatgcaccagagaagaatttacaagaaaagtacgcagtaacgctgctatcggcgcagttttcgtagacgaaaatcaatggaacagtgctaaagaagccgtcgaagatgagcgattttgggaccttgtccatagggagagggagttacacaaacaaggtaaatgcgcaacttgcgtctataatatgatgggcaaacgggagaagaaattgggtgaatttggcaaagcaaaagggtcaagagcaatatggtacatgtggttgggagcgagatttctcgaatttgaggcattaggattcatgaacgaagatcattggttttcaagagagaactccttaagtggagttgaaggagagggattacacaagttaggctacatacttagagacataagtaaaataccgggtgggaacatgtatgcagatgatacggcaggatgggacactagaatcacagaagatgacctacaaaatgaagcaaaaataacggacataatggagcccgaacatgcacttcttgctaagtcaatttttaaattaacgtatcaaaataaggttgtaagggttcaacgtccagccaaaaatggtacagtgatggatgttatttcacgtagagatcaacggggatcaggccaagtaggaacctatggtttaaacacatttactaacatggaagctcagttaattcgtcaaatggagagcgagggaatctttagcccaagtgaacttgaaacacctaaccttgccggaagggtactagattggttagaaaaacacggcgtggaacgactaaagagaatggcgatatctggtgatgactgtgtagtgaaaccaatcgacgatagattcgcaacagcactaactgcgcttaacgacatgggaaaagtcagaaaagatataccacaatgggaaccttcgaaaggatggaatgactggcaacaagttcctttttgctcacatcactttcatcaactcataatgaaagacggacgtgaaattgtagtcccgtgcagaaaccaggacgaattagttggaagggcgcgagtatcccaaggtgcaggatggtctttaagggaaacagcgtgtctaggtaagtcatatgcccaaatgtggcagcttatgtacttccaccgaagggacctccgactcgccgcaaatgctatttgcagcgcagtacctgtcgactgggttcctacaagtcggactacatggagcatacatgctcatcatcaatggatgaccacagaagacatgctttcagtatggaaccgagtatggatagaagaaaatccctggatggaagacaagacacacatatcgtcgtggggcgatgtcccatacctaggaaaaagagaagatcaatggtgcggaagtctgataggactaacagctagagctacctgggcaacaaacattcaagtagcaatcaatcaagtgcgaagattaataggaaacgagaattacctagattacatgacatctatgaaacgtttcaaaaatgaaattgaccccgaaggcgcactatggtag

SEQ ID NO: 21544 - RNA, 9879 nt, synthetic construct
  misc_feature 1..9879: note = derived and/or modified CDS sequence (opt6) from DENV-1__FJ547060__SS-prME
  source 1..9879: mol_type = other RNA
agcgtaaccatgctattgatgctaatgccgactgcattggcatttcatctcaccactagagggggagaacctcatatgattgtgaccaaacaagaacgtgggaaatcgcttttatttaaaacgtcagctggagtgaacatgtgcaccttaatagctatggacttgggagaactatgcgaagatacaatgacttataaatgcccaagaattacagaagcagaacctgatgacgtagattgctggtgtaatgctacagacacatgggtaacatatggtacatgctcgcaaaccggagaacacagaagagacaaaagatctgtagcactagcgcctcatgttggtttaggactggaaacaagaacggaaacatggatgtcaagtgaaggcgcatggaaacaaatacaaagagtagaaacttgggccctacgccacccaggattcacggtaattgcactgttcctcgcccatgctataggaacatccattacgcaaaaaggaataatcttcatccttcttatgttggtcaccccgagtatggccatgcggtgtgtaggaataggaagccgagatttcgttgaaggcctttcaggagcaacttgggtagacgtggtccttgagcacggatcttgcgtaacaactatggccaaagataaacctaccctagatatagaattactaaaaaccgaagtaactaatccagcagtcctacgcaaattatgcatagaggccaaaatatcaaatactacaacagactcgcgatgcccgacccagggtgaagcaactttaatggaggaacaagacgcaaactttgtatgtagaagaactttcgttgataggggatggggaaatgggtgtggcttatttggaaaagggagccttataacatgtgcaaaattcaaatgcgttacgaaattagaaggtaaaatagtacagtatgagaacctaaaatatagcgtaattgtaaccgtacatacaggagatcaacatcaggttggcaatgaaagtacagaacatggcacaacagctacaatcaccccacaagcacctacatccgaaatacaactcactgattatggagcactaaccctagattgtagtcctcgaacaggtctcgattttaatgaaatggtactcttaacaatgaaagaaaaatcgtggttagtgcacaaacaatggttcctcgatttacctctaccatggaccagtggagcgagtacaagtcaagaaacatggaatagacaagatttactggtcacatttaaaaccgcacatgccaagaaacaggaagttgtcgtgttgggaagccaggaaggagcgatgcatacagcgctaaccggcgcaactgaaattcaaacaagtgggacgactacaatctttgcaggtcacttaaaatgtagattgaaaatggataaattgactctgaaaggaatgtcgtacgttatgtgcaccggctcatttaaactagaaaaagaagtagcagaaacacaacatggaactgttcttgtacagataaaatatgaagggaccgatgctccatgtaaaatccccttctctacacaagatgaaaaaggggtcactcagaatggaagacttataacggcaaatccgatagtcacagacaaagaaaaaccagtaaatattgaagcggagccgcccttcggtgagagttacattgtaataggagctggagagaaagccctaaaactgtcttggttcaagaaaggtagttcaataggcaaaatgtttgaagcaaccgcgagaggagcacggcgaatggcaatcttaggggataccgcatgggattttgggtctatcggtggtgtatttaccagtgtgggaaaattagttcatcaaatattcggtacagcctatggtgtgttatttagcggagttagctggacaatgaaaatcggaataggagttctactaacgtggttgggcttaaatagtagatcaacttctttatcaatgacttgtatagcagttggtctagttacgctctacctaggggtaatggtgcaagctgattctgggtgtgttatcaactggaaaggccgggaactcaaatgcggaagtggaatctttgttactaatgaggtccacacgtggacagaacagtataaatttcaagcagatagccctaaaaggttatctgcagcaatcggtaaggcttgggaagagggcgtatgcggtatacgatcagctacaagattagaaaacatcatgtggaaacaaatatcgaatgagctaaatcatattctcctggaaaacgatatgaaattcacagttgttgtaggtgacgtagtagggatccttgctcaaggtaagaaaatgatcagaccacaaccgatggaacataaatattcttggaaatcgtggggaaaagctaaaatcattggtgcagatgtacaaaatacaacgtttataatcgacggaccaaatactccagagtgcccagatgatcaaagagcttggaatatttgggaagtcgaggattacggattcggcatattcacgacaaatatctggctaaaactccgtgattcttatacgcaagtatgtgaccataggctgatgtcagccgcaataaaagactccaaagcagtgcacgcggatatgggatactggatcgagagtgaaaagaatgaaacctggaaactggctagagcttcgttcatcgaagtaaaaacctgtatatggccaaaatcacacacgctatggagtaatggagtattagaaagtgaaatgatcataccgaaaatctatggagggccaatatcccagcataattaccgaccaggatattttacccagacagcaggtccgtggcatttaggaaagctagaacttgattttgatttatgtgaaggaacgacggtcgtcgtagacgaacattgtggtaatcgaggcccgagcctacgaacaacgactgtaacaggtaagatcatacatgagtggtgttgcagatcttgtactctaccaccgctgcggttcaaaggagaagatgggtgttggtatggaatggaaataagaccggtgaaagaaaaagaggaaaaccttgttaaaagtatggtttctgccggttcgggagaggtcgacagcttctccttaggacttttgtgcatatctataatgatagaagaggtcatgaggagtcgatggagtagaaaaatgctcatgacgggaactttagcagtatttcttctgttaatcatgggacaactgacctggaatgaccttatacgattatgtattatggtaggtgctaatgcaagtgacaggatggggatgggtaccacttacttagcacttatggctacgttcaaaatgaggcctatgttcgcggtaggcctattgttcagaaggctaacatctagggaagtattattactaaccattggattaagcctggtggcgtcagtcgaactacctaatagtctagaagaattaggagacggcttagcaatgggcatcatgattttaaaattattaactgattttcaatcccatcaattatgggcgacattactcagtctcacttttataaaaacaacattatcattacactacgcttggaaaactatggctatggtcttaagcatagtatcattatttcctttatgcctaagcactaccagtcagaaaacgacatggttacctgtccttttaggtagtttgggatgcaaaccattaacaatgtttctaatagccgaaaataaaatatggggaagaaaatcttggccactaaacgagggtatcatggcagtcggagttgtttcaatattactctcatctctactaaagaacgatgttccattagcgggccctctaatagctggaggtatgttaatcgcgtgttacgtgatatccggtagcagtgcagatctttcgctagaaaaggcagcagaagtttcatgggaagaagaagcggaacacagtggagcatcacataacatattagtagaggttcaagatgacgggacaatgaaaatcaaagacgaagaaagggacgatacactaaccatcttattaaaggcaactctattagcggtttcaggagtgtacccgctttcaattcctgctactctctttgtttggtatttctggcaaaagaagaaacagcgtagtggagttttatgggacactccttctcctccagaagttgaaagagctgtattagacgatgggatctatcgaataatgcaacgagggctattaggaaggtcacaagtgggggttggggtattccaagaaaacgtattccatacgatgtggcatgtaacgcgaggtgctgtattaatgtaccaaggaaaaagactagagccatcctgggcatcagtgaagaaagatctgataagctacggcggtggatggcgcttacagggttcctggaatacgggggaggaggttcaggtgattgctgtcgaaccaggcaaaaaccctaaaaatgtacaaaccgcgcctggaacatttaaaacgcccgagggagaggtaggcgcaatcgcactagactttaaacccggtacatctggctcacctatcgtcaatagggaaggaaaaatagtaggactctacggaaatggagtagttaccacttcggggacttacgtatcggctattgcacaaactaaggcaagccaagaagggcctcttccagagatcgaagatgaagtatttcgaaaaaggaaccttacaataatggatctacacccaggatctggaaaaacaaggcgatatctacctgcaatcgtgagagaagccataaaacgcaaactgcgaactctgatattagctcctacaagagtggtcgcatccgaaatggcagaggctttaaaaggcatgccaataaggtatcaaacgacagctgtaaaatcggagcacactggaaaggaaattgtagatttgatgtgccatgcaacattcaccatgagactattgtcaccagtaagggtcccaaattataacatgattataatggatgaggcacattttacggacccttcttctatagccgccagaggttatatttctacacgtgtaggtatgggcgaggcagcagctatctttatgactgcgacaccaccagggagcgttgaagccttcccacaatctaatgctgtaatccaagatgaggagcgagatattcccgagagaagctggaatagtgggtatgagtggataaccgatttccctggcaaaactgtttggtttgtgccgagcataaagtctggtaatgatattgctaattgcctgaggaaaaacggaaaaagggttatacagttaagtagaaaaacgtttgatactgaataccagaaaacgaaaaacaatgattgggactatgtcgtgactacggacataagtgagatgggggcaaattttcgagctgatagagtgatcgatcctcgccgctgcctcaagcccgtaatactgaaagatggaccagagcgtgttattctagcaggaccaatgccagtaaccgtggcttcggcggcacaaagaaggggacgtataggtagaaatcataataaggaaggtgaccaatacatttacatgggtcaacctctcaataacgatgaagaccatgctcattggacggaagccaaaatgctccttgacaatataaatacacctgaaggaataataccagcattattcgagccagaaagggagaaaagcgcagccatcgatggcgaatacaggttgcgtggagaagcgcggaaaacattcgtcgaacttatgaggcgaggggatctcccggtatggttgtcttataaagtcgcatccgaaggatttcaatactcggacagacgttggtgctttgatggcgaacgtaataaccaagttctcgaggaaaacatggacgtagaaatatggactaaagaaggagagaggaagaaactacgaccccgttggttagacgcaagaacatattccgatccattagcgcttagagaatttaaagaatttgcagcaggtagaagatcagtgtcaggtgatttgatattagaaatcggaaaactaccacaacatttgacccaacgagcccaaaatgcgttagacaacttagtaatgctccataattccgaacaaggtggacgcgcctatcggcacgcaatggaagaactcccggataccattgaaacgctaatgcttttggctctaatagctgttctaaccggaggagtaacattgttctttctcagcggacgaggactaggaaaaacctcaataggattattatgcgtgatggcaagcagtgtattgttgtggatggcatcagttgagccacattggattgcagcatcaataatacttgagttcttccttatggtgctcttaatacctgaacctgacagacaacgaactccgcaagataaccaattggcgtatgtagtaataggtctcctttttatgattttgacggtcgcggcaaatgaaatgggtcttctggaaaccacaaagaaagatttaggaataggacacgtagcagtggagaatcaccatcatgcaacaatgctggatgtggacttacatccagcatcagcatggactctttatgcagtagcaactactatcataacacctatgatgaggcataccattgaaaacacaacagccaatatatcactaacggctattgccaaccaagccgccatacttatgggactggacaaaggatggcccataagcaaaatggatattggtgtaccattactcgcactgggatgctattcacaagtaaatccattaactttgacggctgctgtactgatgctagtagcgcattatgcgattattggaccaggactccaagctaaggcaacacgcgaagcccaaaaacgaactgcggccggaattatgaagaaccctaccgtagatgggatcgtcgcaatcgatctagatcctgtagtgtatgacgcgaaatttgagaaacagcttggtcaaatcatgttattgatactatgtacaagtcaaatactcttgatgcgcactacctgggcactgtgtgaaagcatcacgctggcaacgggacctttaactacactctgggaaggatcaccaggtaaattttggaacacgacaatagcagtgagcatggctaatatattccgaggatcataccttgcaggagcaggactcgccttctccttaatgaaatcactaggagggggcagacgtggaactggtgcacaaggtgagacacttggagaaaaatggaaaagacaactaaaccaattatcaaaatctgaatttaacatatacaagagatcaggcatcatggaagtagatagatcggaagcaaaggaaggattgaaacgcggggaaacaacaagacacgctgtcagccgcgggaccgctaaacttcgatggtttgtggagaggaacttagtaaaaccggaaggaaaagtcattgacttaggatgtggccgaggaggatggtcatattactgcgccggactaaagaaagtaacggaggtcaaaggatataccaagggaggacctggtcacgaagaacctataccaatggcaacatatggatggaacttggttaaattacattcaggaaaagacgtgtttttcactcctccagaaaaatgtgatacacttctatgtgatatcggcgagtctagtcccaatccaacaatagaagaaggaagaacattgcgagtattaaagatggttgaaccctggctaagaggtaatcagttttgcataaaaattctaaatccatacatgccgtctgttgttgaaaccctagaacagatgcaaagaaaacatggaggtatgctagtacgaaatcccttgtctcgaaacagtacgcatgagatgtactgggttagctgtgggacaggaaacatcgtctctgctgttaacatgacaagtagaatgttactcaatagattcacaatggcacatcggaaaccgacttatgagagggatgtagatttgggtgcaggaactaggcatgtagctgtagagccagaagtggcaaatttggatataataggtcagcgtattgagaatattaaacacgaacataagtcgacatggcactacgacgaggacaacccgtacaagacgtgggcataccatggatcttacgaagtaaagccctctggctctgcttcatcgatggtaaacggtgtagtgaaactgcttacaaaaccttgggacgtaattccaatggtgactcaaatagcaatgactgacacaacgcctttcggacagcaaagagtctttaaggagaaggttgacaccagaacacccaaggcgaagagaggtacagctcaaattatggaggttacagccagatggctctgggggtttttaagccgaaacaagaaacctaggatctgtacgagagaagagtttacgagaaaagtccgatctaacgctgctatcggggcagtcttcgttgatgaaaatcagtggaatagtgccaaagaagcagtagaagatgaaagattttgggatctagtccaaaaggaaagagagctgcataagcaagggaaatgcgcgacttgtgtctataatatgatgggtaaaagagagaagaagctaggagaatttggaaaggccaagggaagcagagctatttggtatatgtggctcggtgctcgtttccttgagttcgaagctctaggattcatgaatgaagaccactggttcagcagagaaaattctttatcaggagtagaaggagaaggtttacacaaactaggatacatacttcgtgatatatcaaagataccagggggaaatatgtacgccgatgatacagcgggatgggatacccgaattactgaagatgatcttcaaaatgaagctaagataacggatataatggagccagagcacgccttgttagctacttcaatatttaaactgacctatcaaaacaaagtagtaagagtacagcgaccagcaaagaatggtacagttatggatgtcatttcgaggagagaccaaagagggagtggacaggtcggtacatacggattaaacacctttaccaacatggaggcgcaactggttagacaaatggaaagtgaagggatattctcaccctgcgagctagaaatcccaaatttggctgagcgagttctagattggttagaaaaatacggagtggaacgactcaagcgtatggccatctcgggtgacgactgcgttgtaaagccaattgatgatagattcgcaaccgcgttaacggcactgaacgacatgggaaaggtgcgtaaagatgttccgcaatgggaaccctccaagggatggaatgactggcaacaggttccattttgtagccatcattttcaccaattaatcatgaaggacggaagagagattgttgtcccctgtagaaatcaagacgagttagtgggcagagctagagtcagtcaaggtgcaggatggtcattgcgggagaccgcttgcctgggaaaaagttatgcacaaatgtggcaactaatgtactttcaccgacgagacttaagacttgccgcaaacgcaatttgtagcgcggttccagtcgattgggtaccgaccagtcgaacaacatggtccattcacgcacatcatcaatggatgaccactgaagatatgcttagcgtctggaatagggtgtggatcgaagaaaacccgtggatggaggataaaacgcatgtgagttcctggggtgacgtgccatacttaggtaaacgagaagaccaatggtgcggtagtttaattggcctaacggctcgggccacatgggcgagtaacattcaagtagcgattaaccaagtccgacgacttataggcaacgaaaattacctagactacatgacaagtatgaaaaggtttaaaaatgaaggtgacccagaaggagccctttggtaa

SEQ ID NO: 21545 - RNA, 9879 nt, synthetic construct
  misc_feature 1..9879: note = derived and/or modified CDS sequence (opt6) from DENV-1__FJ432745__SS-prME
  source 1..9879: mol_type = other RNA
agcgtaactatgcttctaatgctgatgcctacagcactcgcatttcacttaaccaccaggggtggagaaccccacatggttgtcagtaaacaagaaagaggaaaatcgttactcttcaagacaagcgcgggtgtaaatatgtgtacgctaatagcaatggaccttggagaattatgtgaagacaccatgacatataaatgccccaggataaccgaagcagaaccagatgacgttgattgttggtgcaatgcaacagatacatgggtgacttatgggacatgtagtcaaacaggcgagcacagaagggacaaacgcagcgtagctttagcgccgcacgtcggattgggactagaaacacggaccgagacatggatgagtagtgaaggcgcgtggaaacaaattcaaagagtagaaacatgggctcttagacatccagggttcacagtgatagcgttgtttctagctcatgccataggtacatcaataacccaaaaaggaataatatttatactcttaatgctcgttactccgtcaatggcaatgcggtgcgtaggcattggtagccgagatttcgtagagggtctttcgggtgcaacctgggtagatgttgtattagaacacgggtcatgtgtgaccacaatggctaaagataagccgacattagatattgagcttttaaaaactgaggtaacaaatcctgcaattttaaggaagttatgtatcgaagcaaaaatatcaaatacgactaccgatagtagatgtcctacacaaggagaggcaaccctggtcgaagaacaagacgcaaatttcgtgtgtagaagaacttttgttgacagaggatggggaaacggatgtggattatttggaaagggttctttaattacgtgcgcaaaatttaaatgtgtgactaaattggaaggtaaaattgtacaatatgaaaatcttaaatactctgtgatagtcacagtacacaccggggatcaacatcaagtcggcaatgaatctactgaacacggaacgactgcgactataactccgcaggcaccaaccactgaaatacaattaacagattatggcgcactcacgttagattgtagcccgaggactggtttagactttaatgaaatggttctcctaactatgaaagagaaatcgtggctggtccataaacaatggtttcttgaccttccactcccatggacaagcggagcaagtacatcacaagagacgtggaatcgacaagacttattagttacgtttaagacggcccacgccaagaaacaagaagtcgtagtgctcggaagtcaagaaggagcgatgcataccgctctaacaggagccactgaaatccaaacaagcggtacaacgacaatattcgcaggccatttgaaatgtcggttaaaaatggacaaacttacactaaaaggtatgtcgtacgtgatgtgtactggaagttttaaattagaaaaagaagtagctgaaacgcaacatggaacagtcttagtgcaaataaaatatgaagggacagatgcaccatgtaaaattccgttcagtacacaagacgaaaaaggcgtcacccaaaacgggaggttaataacagctaaccctattgtgacagacaaagagaaaccggtaaatatagaggcagaacctccttttggcgagtcttatatagtaataggagcgggagaaaaggctttaaaactaagttggtttaagaaaggatcaagtatcggaaaaatgttcgaagctaccgctcgaggagcacgaaggatggcaatcttaggagataccgcatgggactttggatctattgggggtgtgttcacaagtgttggaaagttagtacatcaaatctttggaacggcgtatggtgttctgtttagtggagtaagctggacgatgaaaatagggttgggcgttcttttaacatggctaggattaaattctagaagcacttcattaagtatgacatgcattgcagttggattagtgacgttgtatttaggtgtgatggtacaggctgattccggatgtgtgataaattggaaaggcagagaattaaaatgtggtagtggcatctttgtaacaaatgaagtacacacatggacagaacagtataagtttcaggcagactcgcctaaacgactttcggcagccattggtaaggcatgggaggaaggtgtctgcggaatcagaagtgccaccagactggaaaacgtaatgtggaagcaaatcagtaatgaactaaatcatatattattagaaaatgatatgaagtttaccgtcgtcgtgggtgatgttgcgggcatattagcgcaaggcaagaaaatgattaggccccaaccaatggagtataagtattcgtggaagtcttggggaaaagcaaaaatcataggagccgacgttcaaaatacaacatttattatagacggaccgaacactccggaatgtccagatgaccaaagggcttggaacatttgggaagtagaagactacggctttggtatattcaccacaaatatatggttgaaactccgtgactcttatacgcaagtgtgcgaccatcggttaatgtcagcggctattaaagactctaaagcagtacatgcggacatggggtattggattgagtcagagaaaaacgagacatggaagttggctcgagcttcatttatcgaagtaaagacatgcatatggcctaaatctcatacactctggtctaatggagtgctagaaagcgagatgataatacctaagatttatggcggcccaataagtcaacacaattaccgaccaggttactttacacaaacggcgggtccatggcatctagggaaattagaactagatttcgatttatgcgaaggaaccacagtggtagtagacgagcactgtggtaaccggggaccatcattacggactacaactgtaacaggaaaaatcattcacgaatggtgctgtcgctcttgcacactaccaccgctgagattccgcggcgaggatggctgttggtatgggatggagattcgccctgtgaaagaaaaagaagaaaacctagtaaaatctatggtctctgctggttcaggcgaagttgattcattcagcttgggtttactatgtatctctattatgatagaggaagtgatgagatcccgatggagcagaaaaatgctaatgacgggtacactagctgtatttttattgcttataatggggcaactaacttggaacgacctgataagattatgcatcatggtgggggccaacgctagcgaccgaatgggtatgggaacgacctatttggcgttaatggccacatttaaaatgcgaccgatgttcgccgttggcttattatttcgaaggcttactagcagagaagtcctattattgacgattggattgtcattagttgcatcagtcgaattaccaaattcattggaggaactaggagatggactagcaatgggaataatgatactgaaacttcttacggatttccaaagccatcaactatgggctaccttattaagtttaactttcataaaaacgacattttctctgcactatgcatggaaaacgatggctatggttttatcgatagtaagcctttttcctctgtgcttatcgacgacttcacagaaaacgacctggctgcctgtactcctcggtagtttgggatgtaaaccattaaccatgtttctgattgccgagaacaaaatatggggaagacgtagctggccattgaacgaaggcataatggcggtgggtatagtaagcatcttattgtcatcattattaaagaacgatgttccactagcaggtcctttgatagcagggggcatgttaatagcgtgctacgtcataagtggcagcagtgctgatctgtcgctagagaaagcagcagaagtaagttgggaagaggaagcggagcattcgggagcctcccacaacatattagtcgaggtacaagatgatggtactatgaaaataaaggatgaggaaagagatgacactcttactatcctattaaaagcaacattgttagctgtcagtggagtatatccattatcaattccggcaacgctgttcgtttggtacttctggcagaaaaagaaacaacgaagcggagtattatgggatacgccatcaccccctgaagtcgaaagggcagtgcttgacgatggtatataccgcatcatgcaacgtggtttactaggtcgttctcaagtaggagtaggagttttccaagaaaacgtatttcacacaatgtggcatgttacacgaggggctgttctgatgtaccaaggcaaacggctagaaccaagctgggcttcagtcaagaaagatttaatatcatatggtggtggttggagattacaaggaagttggaacaccggagaagaagtacaagtcattgctgttgaaccagggaaaaacccgaaaaatgtacaaactgcgcctggaacatttaaaacacctgaaggagaagtaggggcgatagctctagactttaaaccgggtacctctggcagccctatagtaaaccgcgaagggaaaattgtaggcttgtatggcaatggtgtagttactacaagtggtacgtacgtcagcgccatcgcacaagcaaaagcatctcaagaaggtcctttaccggaaattgaagatgaagtcttccgaaagagaaacttgacaatcatggatctacacccaggatcaggcaaaactagacggtacctgcctgcaatagtacgggaagccataaaaagaaaactaagaacattaattttagcgccaacaagagtagtagcctcagagatggccgaggccctaaaaggtatgccgataaggtatcaaacgaccgcagtgaagtctgagcacactggaaaagaaatagtcgatttaatgtgtcatgctacatttactatgagattgctgagtccagtaagagtacctaattataacatgataataatggacgaggcgcacttcacagacccaagcagtatagcagcacgaggttatatcagtacccgagttgggatgggagaagctgctgctatttttatgacagccacgccacccgggtccgttgaggcatttcctcaatcaaatgccgttattcaagacgaagaaagggatattccggagagatcgtggaactcaggttacgaatggataacagacttcccaggcaaaacggtatggtttgtaccttcaattaagtcggggaatgatatagctaattgcctccggaagaatgggaaacgagttattcagctgtcacgaaaaacattcgacaccgaatatcagaaaacaaagaataacgattgggattatgtcgtgaccacagacatcagcgaaatgggagctaattttagagcagatcgagttattgatccacgccggtgccttaaacctgttatattaaaggacggaccagagcgtgtaatacttgcaggtccaatgcccgtgaccgtagctagtgcagcacaacgacgaggtcgaattggacgaaaccataataaagaaggtgatcaatatatttatatgggacaaccgctgaataacgacgaggaccacgctcactggacagaagccaaaatgcttctagataacataaacactcccgaaggtataatacctgcattatttgaacctgaacgagagaaatctgcagcaatagatggcgaatataggcttcggggtgaagcaagaaaaactttcgtagaactaatgagaagaggggacttaccagtatggcttagctacaaagtcgcaagtgaaggatttcaatattcggatcgacgttggtgctttgacggggaacgtaacaatcaagttctagaagagaatatggatgtagagatatggaccaaagaaggggagcgtaagaaacttcgtccgcggtggttagatgcaagaacttattcagatcccttagctttaagggaatttaaagaatttgccgctgggaggagaagcgtaagtggtgatctaatactagaaataggaaaactgcctcaacacctaacacagcgagcacagaatgcactggataatttagtgatgctacataattcagaacagggagggagggcttacagacacgcaatggaggaactaccggacacaattgaaaccttaatgctcttagcacttatagcggtactaaccggtggggtaaccttattctttttatctggtcgcgggttaggaaaaacgagcataggcttgttatgcgtgatggcttctagtgtattattatggatggccagcgtagaaccgcattggattgctgctagcattatactagagttctttctaatggtactactaatcccagaacctgacaggcaaagaacaccacaggacaatcaattagcgtacgtcgtaattggcctattattcatgatactgacagtagcagccaacgaaatgggacttctggaaacgacaaagaaagacctagggatagggcatgccgcggtcggcaatcaccatcatgcagcaatgctggatgtggatcttcaccccgctagtgcttggactttatatgctgttgcgacgacgattataacaccgatgatgagacatacaatcgaaaacacaacagctaatatatccctaacagccatagcaaaccaggcggcaattctcatgggactagacaaagggtggccaataagtaaaatggacatcggagtcccgttactagcgctaggatgttacagtcaggttaatccactaacattaactgcggctgtcttgatgctagtcgcccattatgccataatcggtccgggtttacaagctaaggctacacgggaagcgcaaaagcgtaccgccgccggtataatgaaaaacccgacagtggacggaatagtcgcaattgatttagacccagtggtctacgatgcaaaatttgaaaaacagcttggacaaataatgctattaatactatgtacttcacaaatattattaatgcgaacaacttgggctctttgtgaatctataactttagctaccggacccttaaccacgctatgggaagggtccccaggtaagttctggaacactacgattgcagtatcaatggcaaatatcttccgaggaagttacttagcaggggcagggctcgctttttctttgatgaaaagcctaggtggcggtcgaagaggaacaggagcacaaggagaaacacttggagaaaaatggaaaaggcagctgaaccagctatctaaatcagaatttaacacgtataaaagatcaggcataatggaagtcgatagatcagaggccaaagaaggactgaagagaggagaaacgacaaaacatgcggttagtcgagggacggcgaaattacgatggtttgtcgaaagaaacttagtaaagcccgagggaaaggtaatcgacctaggttgtggccgcggaggatggtcatattattgtgcgggtctcaagaaagttacagaagtaaaaggctatacgaaaggtggaccgggacatgaagaacccattccaatggcgacctatggttggaacctagtaaaactacattcaggaaaagacgtcttcttcatacctcctgagaagtgtgacactcttttatgtgatataggagagtcaagtcccaatccgacgatagaggaagggcgtactctaagagtattaaaaatggtagagccgtggctgcgtgggaatcaattctgtattaaaatactgaacccatatatgccatccgtagtagaaactttagaacaaatgcaaagaaaacacggcggaatgcttgtcagaaacccactgagcagaaactctacacatgagatgtattgggtgagctgtggaacaggtaacattgttagtgctgttaacatgacttcacgtatgctactgaataggtttacaatggctcaccgaaaacccacttatgaaagagatgtcgatttaggtgccggaacaagacacgtggcagtagaacccgaagtagcaaaccttgatattattgggcaaaggatagagaatatcaaacatgaacataaaagcacttggcactatgatgaagataacccgtataaaacatgggcctatcatggctcttacgaagtaaagccttcaggttctgcctcttcgatggtcaacggagtggtaaaacttttgacgaaaccttgggacgtaattccaatggtcacacaaattgcaatgactgataccacacctttcggacagcaaagagtatttaaagaaaaggttgatactcgaactccaaaggcaaagcggggcacagcgcagataatggaagtaacggcaaaatggttatggggttttctctcaagaaacaagaaaccaagaatatgtacaagagaagaatttaccaggaaggtaaggtcaaacgctgctataggagcagtctttgttgacgagaatcaatggaactctgctaaggaagctgtcgaagatgaaagattttgggatttggtccatagagaacgcgagttgcataaacaaggaaaatgtgcaacttgcgtctataacatgatggggaaaagagaaaagaagttaggagaatttgggaaagcaaaaggatcacgagccatctggtacatgtggttgggtgccagattccttgaatttgaagcactgggctttatgaatgaagatcactggttttcaagagaaaatagcctaagtggagtagagggagaagggttacacaagttgggatacattcttagggacatatctaaaatacccggtggcaatatgtacgctgatgacactgccggctgggatacaaggataaccgaagatgatctccagaatgaagcaaggataaccgacatcatggagccagagcatgcattactagctaaaagcatatttaaattaacatatcaaaataaggtcgttagggtgcagcgaccagctaaaaatggaactgtgatggacgttatttcaagaagagatcagcgtggcagtgggcaagttggtacttatggactaaacacttttacaaatatggaggcgcaattaataagacagatggaaagcgaaggaatattttccccgagcgaacttgaaactcccaatcttgctgaaagggtcttagactggttagaaaaatacggcgtagagaggctcaaaagaatggctatctccggagacgattgcgtagttaagccaatcgatgataggtttgcaacagcactaaccgccttaaatgatatgggaaaggttagaaaagatataccgcagtgggaaccatcaaaaggatggaacgattggcaacaggtacccttttgtagtcatcatttccatcagctaatcatgaaggacggcagggaaatagttgtaccgtgtagaaatcaggatgaattggtcggtcgcgctcgcgtgagccaaggagcgggttggagcctccgagaaacagcctgtttaggtaaatcatacgcacaaatgtggcaattgatgtattttcatagaagagatttaagactggcagcaaatgcgatatgctctgcagtacctgtcgattggatcccgaccagccgtacaacatggtcaatccatgctcaccaccaatggatgactacagaagacatgctgtctgtctggaatagagtatggattgaggaaaatccatggatggaagacaaaacgcatatcagttcatggggagatgttccctacctaggaaaacgtgaggaccaatggtgcgggtcattaataggtctgacggcacgtgctacttgggccacgaacattcaagttgcgatcaatcaagtaaggcgtctaataggtaacgaaaattatctggactatatgacttcaatgaagagatttaaaaatgagtcggatccagagggtgcattatggtaa

SEQ ID NO: 21546 - RNA, 9879 nt, synthetic construct
  misc_feature 1..9879: note = derived and/or modified CDS sequence (opt6) from DENV-1__FJ432746__SS-prME
  source 1..9879: mol_type = other RNA
agcgtgaccatgctacttatgctgatgcctacggcgttagcttttcacttgactactcgcggtggagaaccccacatgattgtatcaaaacaagaaaggggaaaaagtttactatttaaaaccagtgccggtgtgaatatgtgtactttgatagctatggatttaggagagttttgcgaagataccatgacctataaatgtccacgcataactgaagcggaacctgacgacgtagactgttggtgtaatgcaactgatacatgggtaacgtatgggacatgtagccaaacgggcgaacataggagagataaaaggagtgtagcattagctccacacgtgggtttaggtcttgagacacgaacagaaacatggatgagcagtgagggtgcttggaaacagatccaaagagtagaaacgtgggcactaagacatcctggtttcacagtgatagccttatttttagcccatgcgatcggaaccagtataactcaaaaaggtataatttttatcttactaatgctggttactcccagtatggcaatgcgatgtgtcgggataggcagtagagacttcgtagaaggcctctcgggagcaacttgggtggatgttgttctggaacacggttcatgcgtaacaacaatggcaaaagataaacccaccttagatatcgaattgctaaaaacggaagtgacgaatcccgcagtactgaggaaattgtgtatagaggctaaaatttcaaataccactacggattctcgctgccccacacaaggtgaagcaacccttgtagaagaacaagatgccaattttgtgtgtagaagaactttcgtcgataggggatggggaaacgggtgtgggctgttcggaaaaggatctcttattacatgcgcaaaattcaaatgcgtgacgaaattagaggggaaaattgtacaatatgagaacttaaaatacagcgtaattgttaccgttcatacaggggatcaacaccaagtaggaaacgaatcaacggaacacggaactacggccacaataacgccgcaagcacctagtacagaaatacagctgacagattacggggcattgacactagattgtagccctagaacaggcttagacttcaacgagatggtactgttaacaatgaaagaaaaatcttggctagtccacaaacaatggtttttggacctgccattaccctggacaagcggggctagcacaagccaggaaacttggaataggcaggatctattagtgactttcaaaacggcacatgcgaagaaacaagaagttgtagtccttgggtcacaagagggtgcaatgcacaccgcattgacaggcgccacggagattcagacttctggaactacaactatctttgcagggcacttaaaatgtagattaaaaatggataaattaacgctaaaaggtatgtcgtacgtaatgtgcacgggttctttcaaattagaaaaagaagtcgcagagactcaacacggaactgttctcgtacaaattaaatatgaaggaactgacgccccatgcaaaattccattctccacgcaggatgaaaaaggcgtaactcaaaacgggcgcttgataactgctaatcccatagtcaccgataaggagaaaccagttaacatagaagctgaacctccattcggagaaagttacattgtaataggtgctggggaaaaagcgctaaagctgtcgtggtttaagaaagggtcttccattggaaaaatgttcgaagccacggcacgtggagcaaggcgcatggcaatcttaggtgacactgcttgggatttcggttctataggaggtgtatttacgtcggttggcaagctcgttcatcagatatttggtaccgcgtatggtgttctattcagtggagtaagttggaccatgaagataggaataggtgtccttctaacgtggcttggactcaatagccgatcgacatctctgtcaatgacctgcatagcagtggggcttgttactctatatttaggtgtaatggtccaagcagattccggttgtgttataaattggaaaggccgtgagttaaagtgcggaagtggcatatttgtaacaaatgaagttcacacttggacagagcagtacaaatttcaagccgattcacctaaacgtttaagtgcagcgataggaaaagcatgggaagaaggagtatgtggcattagatcagcaacacggttagagaatataatgtggaaacaaataagcaacgaactaaattacatcctgttagaaaatgatatgaaactgacggtcgttgtaggagacgtagcggggatattagcacagggaaagaaaatgatccgacctcaaccgatggaatataaatatagctggaaaagttggggcaaagcgaaaataataggggctgacgttcagaacacaacattcattatagatgggccaaacactccagagtgtccagatgaccaacgagcatggaacatatgggaagtcgaagattacgggttcggaatattcactactaacatatggctgaagctcagagattcatatactcaagtatgtgatcaccgattaatgagtgctgcaataaaagatacaaaagcggtgcatgctgacatgggttactggatcgaatcagaaaagaatgaaacctggaagttagcaagagccagctttatagaggtgaaaacttgtatatggccaaagtcgcatacgctctggtcaaacggggtattggagtcagaaatgataattccaaaaatttatggaggccccatctcacagcataactaccgaccaggatactttacacaaacagctgggccctggcacttaggtaaattagaattagactttgacttatgcgaaggtaccacagtagttgtagacgaacattgtgggaatcgaggtccaagcctaaggactactacggtaacaggaaaaattatacatgagtggtgctgtagatcttgtacactacccccactacgtttcaagggtgaagacggctgttggtatggcatggaaattagacccgtcaaagaaaaagaagaaaatcttgtcaaatccatggtcagtgcgggatccggagaagtggactcattcagtctggggctattgtgtattagtataatgattgaggaggtaatgagatcccgatggagtagaaaaatgttaatgacgggaaccttagccgtattctttctccttattatgggccagttaacatggaatgatctgatacggctgtgcattatggtaggagcaaacgcttcggatagaatggggatgggaactacatatctagcccttatggcaactttcaagatgaggccaatgttcgcagtgggcctgttatttagaaggttgacctcgagggaagtgttactgcttacaataggactgtcacttgtagcttctgtagagttaccgaactctttagaagaattaggtgatgggttagcaatgggtataatgatattaaagctgctaactgacttccagagccatcagttgtgggctacactcttatctctaacattcgtaagaactacatttagtttacattacgcgtggaagacaatggctatggttctttcaatagttagtctctttcctttatgcctcagcactacaagtcagaagacaacatggctcccagtgctattaggatctttaggctgtaaaccgctgaccatgtttctaattgcagaaaataaaatatgggggcggaaaagttggccgcttaacgaggggatcatggcagtcggtattgtgtctatattactcagttcattgttgaaaaatgatgttcccctcgcaggaccactcatagctggcggcatgttaatagcatgttatgtcatatcgggaagttcggcggacctaagtttagagaaagcagccgtggtctcctgggaggaagaagcagaacattcaggagcctctcataatattttggtggaggtacaagatgatggtacgatgaaaataaaggatgaggagagagacgacacacttactattttacttaaagcaacattattagcagtatcgggcgtttatccgttaagcataccggctaccttattcgtgtggtatttttggcagaagaagaaacaacgtagtggtgtattatgggacacaccaagcccaccagaagtggaaagagcggtgcttgacgatggaatctacagaatcatgcaaagaggactattaggccgatcacaggttggagtaggcgtcttccaggagaatgtgttccataccatgtggcacgtaaccagaggggcagtactaatgtatcaagggaaaagactcgagccatcatgggctagtgtaaagaaagatctaatctcatatggaggtggatggagattgcaaggcagttggaacacgggtgaagaggtacaagtaatagccgttgaaccaggtaaaaatccgaaaaatgttcaaaccgccccaggtacatttaagacttcagagggggaagttggtgcaatcgcccttgatttcaaacctggcacctcaggatcaccaatagtaaatcgagaagggaaaattgtaggtctttacggaaacggagttgttactacaagcggaacatacgtatcggcgattgcgcaagcgaaggcatcccaagaaggcccccttcctgaaatagaggacgaagttttccgaaaacgcaatctaacaatcatggatctgcatccaggttcaggtaagacacgacgatacttacccgctattgttagagaagccataaaaagaaaacttaggacccttatcttggccccgacaagagttgtggcgtctgaaatggctgaggcactaaaaggaatgcccattaggtatcaaactacggcagtaaagagtgaacacacgggcaaagagatagttgatctcatgtgccatgcaacatttactatgagactcttaagtcccgtacgagtcccaaattacaatatgatcattatggatgaagctcactttacagaccccagttcaatagccgccagaggttacatatcaactagagtagggatgggggaggccgcggctatttttatgacggccactcccccaggtagtgtggaggcatttcctcagtcgaacgctgttatacaagatgaagaaagagacatacccgaacgatcctggaactctgggtacgaatggataacagattttccaggtaaaaccgtgtggtttgttccatcaataaagagcggcaatgacatagcaaattgcttgaggaaaaatgggaaaagagtgatacaattaagtaggaaaactttcgacaccgaatatcagaaaacgaaaaataatgattgggactatgtagtaacaacggatataagtgaaatgggggccaatttcagagcagatagggtaattgatcctcgccgatgtttaaagccagtaatcttaaaagatggacccgaacgcgtcattctggcagggcctatgcctgtaacagtagcctctgcggcccagaggcggggaagaataggtagaaatcataataaagaaggcgatcaatatatctatatgggccaaccactgaataatgacgaggatcatgcacactggactgaagcgaaaatgttactggataatataaacacacctgaggggattatcccagcattatttgaacctgaacgtgagaaaagtgctgctatcgacggagagtatcgattaagaggagaagctcggaaaaccttcgtggagttaatgcgacgaggggatctacctgtatggctaagctacaaagttgcctcggagggatttcagtactctgaccgaagatggtgcttcgatggtgagagaaacaatcaggtactagaagaaaacatggatgtcgagatctggactaaagaaggtgaaaggaaaaagctaaggccaaggtggttagatgctagaacttatagtgatcctctagccttgagagaatttaaagaatttgccgcaggtcgcagatctgtttcaggagatctcattttagaaataggaaaattaccacaacacttaactcaacgagcacaaaacgcattagacaatcttgtgatgctgcataattcagagcaaggcggcagagcatacagacacgccatggaagaactgccggataccattgaaacgcttatgctactagcgttaatagcagttttaaccggcggtgttaccttatttttcttaagtggacgaggattgggtaagacaagcatcggtctgctttgtgtaatggcgagtagcgtgcttttgtggatggcaagcgttgaacctcactggatagctgcatcaattatcttagagttcttcttaatggtactcctaataccagaaccagacaggcaacgtaccccacaagacaatcaattagcttatgtcgtaataggactgctatttatgatactaacagtagccgcaaatgaaatgggtttactcgaaactaccaaaaaggatttaggtatcgggcacgtagctgttgaaaatcaccatcacgcagccatgcttgacgtagatcttcacccagcatctgcgtggacgctgtacgcagtagcgacaactatcattacaccaatgatgcgtcataccattgagaatactactgcaaacatatccctcacagctatcgccaatcaagcagcaatactaatgggcttagataaaggctggccaatttctaaaatggatatcggagtacctcttctcgcactagggtgttattcacaagtaaaccctcttactttgaccgctgctgtgctaatgcttgtagcacactacgctataataggaccaggactacaagcgaaagctactagagaagcacaaaaacgtacagcagcaggtatcatgaaaaatccaaccgtagacggaatcgtagcgattgacctagaccctgtagtctatgatgcgaaattcgagaaacagctaggacaaataatgttactcattttatgcacgagtcaaatactacttatgagaactacgtgggccttgtgcgagtcaattacactcgcaacgggaccgttaaccacattatgggaaggctcacccggaaaattttggaacacaacgattgctgtatccatggctaatatattcagaggctcgtatctggcaggagctggacttgcattttcattaatgaaatcacttgggggcggcagacgcggaacgggtgcacagggagaaaccctaggggagaaatggaaacgacaactaaaccagctatcgaaatctgagttcaacacatataaacgctcgggcataatggaagtcgataggtctgaagccaaggaagggttaaaacggggcgaaacaacaaaacacgcagtgtctagaggtacagctaaattgcgatggttcgtggaaaggaatctggttaaaccagaaggaaaagtgattgatttaggatgcgggcgaggcggatggtcatattactgtgcgggcctcaagaaagtaaccgaagttaaaggttataccaaaggcggtccggggcatgaggaacctatccctatggctacatatggatggaatttagttaagttgcacagtggaaaagacgtcttctttattccaccagagaaatgtgacacgttactgtgtgacataggcgaatctagtcctaatccaaccattgaagaaggaaggaccctaagagttttgaaaatggtagaaccatggttaagagggaaccaattttgtattaaaatactaaatccttatatgccttccgtggtagaaacgctcgaacagatgcaaagaaagcacggtggtatgctagttagaaatcctctatcaagaaattccacacatgaaatgtactgggtcagctgtggcacgggcaatatcgtatcagccgttaacatgaccagtcggatgttacttaatcgctttacaatggcacacagaaagccaacatacgaaagagatgttgacctcggagcaggtacaagacacgtagcagtcgagccggaagttgctaatttggacataattggccaaagaatagaaaacataaagcacgaacataaatctacatggcactatgatgaagataacccctacaagacatgggcataccatggaagctatgaggtaaagccttctggatcggcgtcgtcgatggttaatggagtagttaagttattaaccaaaccatgggatgtgattcccatggtaacacaaattgcaatgacagatacaacaccttttggtcaacaacgcgtatttaaagaaaaagttgataccagaacccctaaagcaaaacgagggacagcacaaatcatggaagttacagctaaatggctgtgggggttcctatctaggaacaagaaaccgagaatttgtacgcgagaagaatttactagaaaagtaaggtcaaacgccgcaataggagctgttttcgttgatgaaaatcaatggaactcagccaaggaagcagtagaagacgaacgattctgggacttagtgcatcgagaacgggaattacacaaacagggaaaatgcgccacatgcgtatacaacatgatgggtaaaagagagaagaaattaggagaatttggcaaagctaaaggatccagagcaatatggtacatgtggttaggagcaaggtttttagagttcgaagccttgggctttatgaatgaggaccattggttttctagagaaaactcactttcaggagtggaaggagaaggactccacaaattggggtatattctacgtgacatctcaaaaatacccggcgggaatatgtatgctgatgatacggcaggatgggatacaaggataacagaggatgatctacagaacgaagcaaaaatcacagacataatggaaccagaacacgcgttacttgcaaaatctatttttaaattaacatatcaaaataaagtagtacgagtacaaagacctgcgaaaaatggcaccgtcatggatgttataagtagaagggaccagagaggatcggggcaagtaggaacatatggtctaaatacattcactaacatggaggcacaattgataaggcaaatggaatcagaggggatattctcaccgagtgaacttgaaacacctaacttagccggtagagtattagattggcttgaaaaacacggtgttgaacggttaaagagaatggcgattagtggtgatgactgtgttgttaaaccaatcgatgataggttcgctacagcgcttacagcgctaaatgacatgggaaaagtgcgtaaagacattccccagtgggagccctcaaagggttggaatgattggcagcaagtaccattctgtagtcaccattttcatcaattgattatgaaagatggacgggaaatcgtagtcccatgtagaaaccaagatgaattagttggtagagctagagtgtctcaaggcgccggttggagtctaagagaaacggcttgtctgggtaaatcctatgctcaaatgtggcaactcatgtactttcatcgaagagacttgagactagcagctaacgcaatatgctcggctgtaccggtagattgggttcctacttcaagaacaacatggagcattcatgctcaccatcaatggatgacgacagaagatatgttatcagtatggaacagagtttggatcgaggaaaatccatggatggaagacaagactcatatttcctcatggggtgatgtaccatatctaggtaaacgcgaagatcaatggtgtggtagcttaattggcctcacagctcgagctacttgggctacaaacattcaggttgcaataaaccaagtaaggagattgctagggaatgaaaactaccttgattatatgacttcgatgaaacgcttcaaaaacgaaagtgatccagaaggggccctttggtga

SEQ ID NO: 21547 - RNA, 9879 nt, synthetic construct
  misc_feature 1..9879: note = derived and/or modified CDS sequence (opt6) from DENV-1__FJ432748__SS-prME
  source 1..9879: mol_type = other RNA
agcgttactatgctactaatgttaatgcctacagcgttagcatttcacttgacaacaagaggtggagaaccccatatgatagtatcgaaacaagaaagagggaaaagcctattatttaaaacctcagcgggcgtaaatatgtgtacattgattgcaatggacttgggtgaattatgcgaagataccatgacgtacaaatgtcccagaatcacagaaacagaaccagatgatgtagattgctggtgtaatgctacagatacatgggtaacatacggtacatgttcccagaccggtgaacataggagagataaacgttctgttgctctcgcaccacacgtagggttaggactagaaactcggaccgaaacatggatgtcttccgaaggggcttggaaacaaattcaaagggtggaaacatgggcattaagacatcctggctttacagtgatagcactttttctggcacatgctataggcacgagcattacgcaaaaaggcatcatattcattctattgatgcttgtaaccccatcaatggctatgcgatgtgtcggaatagggtccagagattttgtagagggactgagtggagctacatgggtagatgtcgttttagaacacggatcttgcgttaccacaatggcaaaggacaaaccaacactggacattgaactactaaagacagaagttacaaaccctgcggtcctacggaaactatgtatcgaggctaagatctctaatacgacaaccgatagtaggtgccctacacaaggggaagccactcttgttgaagaacaagacgccaattttgtgtgcagacggacttttgtcgacaggggctgggggaatggttgcggcctttttggtaaagggagtttaatcacatgcgctaaatttaaatgtgtgacaaagctagaaggtaaaatcgtacaatacgagaacctcaagtattcggttattgtaactgtacatacaggagaccaacatcaagttggaaatgagtcaaccgagcatggtactactgcaaccataaccccgcaggcaccaactacagaaattcaattaacagattatggtgcactaactctagactgtagtcctagaaccggcttggattttaacgaaatggtactgttgacaatgaaggagaaaagctggcttgtacacaagcaatggtttttagacttaccactcccctggacatcaggagccagcactagccaagaaacatggaatcgacaagatctattagtaactttcaaaactgcacacgccaagaaacaggaagtagtagtcttgggcagtcaagaaggagcgatgcataccgcactgacgggggctactgaaatccagacaagtgggacaaccacaatatttgcaggccatttaaaatgcagattaaaaatggacaaacttacactcaaaggaatgtcgtatgtaatgtgcacaggatcatttaaactggaaaaagaagtcgcggaaacccaacacggtacggtcctagttcagattaaatatgagggaactgacgctccgtgtaaggtaccattcagtactcaagacgagaaaggtgtgacacagaacggtcgtctaatcacagcgaacccgatcgtcacggacaaagaaaaaccagtgaatatcgaagcagaacctccatttggggaatcttatattgttataggcgctggagaaaaggctctaaaattatcatggtttaagaaaggatcatcaatcgggaaaatgtttgaagcaacagcacgaggtgcgaggcgtatggcaatacttggagatactgcttgggacttcggaagtataggtggagtgtttacgtcggtagggaaattagtccatcagattttcggaacggcttacggtgtactctttagcggagtcagttggacaatgaaaataggcattggtgttttattaacttggttaggtttaaactcaagatcgacatcactatccatgacctgtatcgcagtagggctagttacattgtacttgggggtaatggtacaggcagattccggatgtgtaataaactggaaaggaagagaattaaaatgtggaagcggaattttcgtaactaatgaagttcatacatggacggagcagtacaaatttcaggcagacagccctaaaagattatctgcagcaataggcaaggcttgggaagaaggtgtatgtgggatccgttccgcaacaaggcttgaaaatattatgtggaaacagatatctaatgaactaaatcatattcttttagaaaacgatatgaagttcacagtagttgtaggcgatgttgctggaatattagcacagggtaagaagatgataagacctcaacccatggaatacaaatatagttggaagtcatggggcaaggcaaaaattatcggagcagacgtccagaatactacatttataatcgacggccctaacacaccagagtgtccagacgaccaaagggcctggaatatatgggaagttgaagactacgggttcgggatattcacaactaatatatggttaaagctcagggactcatatactcaagtttgtgaccatagactcatgagtgcggctatcaaagattcaaaggcagttcatgcggatatgggatactggatagagtccgagaaaaatgaaacttggaaactagcacgagcttctttcatagaagttaaaacttgcatatggccaaaatcgcatacattatggtcaaatggggtactagagagcgaaatgattattcccaaaatatatggcgggccaataagtcaacacaactataggccaggttattttacgcaggcagcaggaccttggcatctaggtaaattagaacttgattttgacctgtgcgaaggcaccacagttgtagtagatgaacattgtggcaatcgtggtccatcactaagaacgaccaccgtgacaggaaagataatccatgaatggtgttgtaggagctgcacgttgccaccattacgtttcaaaggcgaagatggatgctggtacggaatggaaataagaccagtaaaagaaaaagaggagaacttagtcaagtcaatggtcagtgcaggttcaggtgaagtagattctttctcattggggctactatgtataagtataatgatcgaagaggttatgaggtctagatggagcaggcgcatgctcatgacgggaacgttggctgtattctttttattaataatgggacaattaacatggaatgaccttataagactctgcataatggttggcgcaaatgcatcagatagaatggggatgggaacaacatatctcgccctaatggccacatttaaaatgcgaccaatgtttgctgttggactgctattcagacggttgacctcacgggaggttcttctgcttaccataggactatcattagtagcatcagtggagctcccaaattcactagaagaactcggggacgggctggcaatgggcataatgattctaaaacttctcacagactttcaaagtcaccaactatgggctaccctactgagccttacattcataaaaacaactttctcacttcactatgcatggaagacaatggcaatggtcttgtcaatcgtatccctcttcccattgtgtctgtctacaacgtcacagaaaactacttggttaccagtactattaggttctttggggtgtaaacccttaacaatgtttttaatagctgaaaacaagatatgggggagacgttcatggccgctgaatgaaggcataatggcggttgggatagtatcgatcctgctgtcgagtttactgaaaaatgacgtgccactagcagggccccttattgctggaggaatgttgatcgcatgttatgtaatatcaggcagcagcgccgatcttagtcttgaaaaagccgcagaagtgtcatgggaggaagaagctgaacattctggtgcttcgcataacatattggtcgaagtacaagatgatggaaccatgaaaataaaagatgaagaaagagatgatacacttacaatcttactaaaagccacgttgctcgccgtatcaggtgtctatcctctgtcaatacccgccacgctatttgtttggtacttttggcagaagaagaaacaacgaagtggagtactttgggacacaccaagtccccctgaggtggaacgtgcggtgttagatgatggaatatacagaattatgcaaaggggattattaggcagatcacaagtcggcgttggagtatttcaagaaaacgtattccatacaatgtggcatgtaactcgcggagcagttttgatgtatcaaggaaagcgactcgagccaagctgggcctcagtcaagaaagatcttatttcttacggtggaggctggaggcttcagggcagttggaacacaggcgaggaagtacaagttatcgcagttgagccaggcaagaaccctaagaatgttcaaactgcacccggtacgtttaaaacgccggaaggagaagtaggtgcgattgccctcgatttcaaaccaggcacatcgggatccccaattgtcaaccgtgaagggaaaatcgtgggtttatacggaaatggtgtcgtaacaacatctgggacatacgtatctgcaatcgcacaagccaaagcgtcccaagaaggacctctacccgaaatagaagacgaagtatttcggaaaagaaacttgactataatggacctccatccagggtcaggtaagacccgacggtatttgcccgccattgtccgcgaagcaataaaaagaaaactaagaactttgattctagcgccaacaagagtagttgcatccgaaatggctgaggcactaaaagggatgccaatacgctaccaaactacagccgttaagtctgaacatacagggaaagaaattgtggatttgatgtgccacgcaacattcacaatgagattgttaagtcctgtgagagtacctaactacaacatgattattatggatgaggcacattttactgacccaagctctatagcagcaagaggatatatatctacgagagttggaatgggggaagcagccgctatattcatgaccgcgacgcctccaggctcagtggaagcatttccccagtcaaacgctgtgatacaagatgaagaaagagatatcccagaacgtagttggaatagtggatatgagtggataacggattttcccggtaagacagtttggttcgtacctagcataaaatcgggtaacgacatagcaaattgtttaagaaagaacggaaaaagagttatccagctgagccgaaaaacatttgatacagaatatcagaagaccaaaaacaacgattgggattatgttgtcaccacagatatatcggaaatgggagctaatttcagagcagatagggtgattgaccccagacgatgcttaaaaccggttatattgaaagacggaccagagagagtaatattagctggaccaatgcctgtaacagtcgcaagtgcagctcagagaagaggtcgcataggacgaaatcataataaagagggtgatcagtatatatatatgggacaacctttaaacaacgatgaagatcacgctcactggacagaggcaaaaatgctattggataatataaatacaccagaaggaataataccggcattattcgagccggaaagggagaagagtgctgcaatagacggagaatacaggctgaggggagaagcgcgaaagacttttgtagaactaatgcgacggggcgacctaccagtttggctttcttataaagtggctagcgagggttttcaatactcggatagaaggtggtgtttcgatggtgaaaggaataatcaagtattagaagagaatatggacgtagaaatatggaccaaagaaggagaacgtaagaaattaagaccgcgatggcttgatgcgaggacatatagcgaccccttggccttgagagaatttaaagagttcgccgccggaagaagaagtgtaagtggagatctaatcctcgaaatagggaaacttccacagcacttaacccagcgcgcacaaaacgcacttgataatttagtgatgctccacaactctgaacaaggcggtcgagcttatcgtcacgcgatggaggaattaccagacactatcgaaacattgatgctacttgcgcttatagcagtactaactggaggcgtaacattattcttcctgagcggacgaggcttaggaaaaactagcatcggtttactgtgtgtaatggccagctcagtactcctctggatggcaagtgttgaacctcattggatagctgcatcgatcatattagaatttttcttgatggttctactgataccagagccggaccgacaaaggactccgcaggataatcagttggcctatgtggtcataggattactatttatgatacttacagtagctgctaatgaaatgggtctgctggagactacgaagaaagatctgggcattggacacgtagcggtagaaaaccatcaccatgctgcaatgttagatgttgatctacatccagcaagcgcgtggactctgtatgcggtagcgacaacgattatcacgcccatgatgagacacactatcgaaaatacgacagcaaatatcagcttgacagcgattgccaaccaagctgcgatcctcatgggcctagacaaagggtggccaatatcaaaaatggacattggagtgcccctactcgctctaggatgttactcacaagtgaatccactcacgttaactgccgctgtattaatgttagtagcacattatgccattattggccctggattacaagcgaaagctaccagagaagcacagaaaaggacagctgcaggtatcatgaagaatccaacggtagatgggatagtcgcgatcgatttagatcctgtcgtctacgatgctaaatttgagaaacaacttggacaaataatgctactgatactatgtacaagtcaaatcctattaatgcgaacaacatgggcattgtgtgagagtattacattagctacagggccacttacgactctatgggaaggatctccaggaaaattttggaatacgacaattgcagtatcgatggccaatatatttaggggatcctacctcgccggcgcagggttagcctttagtctaatgaaaagtctgggagggggacgacgcggtacaggagcgcagggagaaacgctcggtgaaaaatggaaacgacaactaaatcagttaagcaagtcagagttcaatacttacaaaagaagtggcatcatggaggttgatcgttcagaagcaaaagaaggtttgaagagaggtgaaaccacaaaacacgcagtcagcagaggaactgccaaattacgatggtttgttgaacgaaacctggtaaaaccagaaggcaaagtcatagacctcggttgcggaaggggcggctggtcgtattactgtgctggacttaagaaagtaacagaagttaaggggtatacaaaagggggacctggccatgaagaaccaatacctatggcaacatatggttggaacttagttaaattgcattctggtaaggatgtattctttattccacccgagaaatgtgatacgttgttatgtgatattggagaaagtagtccaaacccgacgatagaagaaggtagaacactgagagttttaaaaatggtagagccgtggctgcgagggaaccagttttgcataaaaatattaaatccatatatgccatcagttgttgagacactcgaacagatgcagagaaaacatgggggaatgctcgttcgaaacccccttagccgcaatagcacacatgaaatgtactgggtgtcatgcggaactggcaacattgtcagtgcggttaatatgacgagtcgcatgctattgaatcgcttcacaatggcgcatcgaaaaccaacttacgaaagggacgtggatttgggggcggggacacgacatgtagccgtcgagccagaggttgctaatctagatattattgggcagagaatagagaatataaaacatgaacataaatctacatggcactacgacgaagacaatccatataaaacttgggcatatcatggtagttatgaagtgaagccatcaggctcagcatcatctatggttaatggcgttgtcaagttgttaacaaaaccttgggatgtaatccccatggttacgcagatagccatgaccgacaccacgcctttcggccaacaaagagtatttaaagagaaggttgatacaagaacaccaaaagccaaaagaggaaccgcacagataatggaggtaacagcaaaatggctttggggattcctatcccgaaataagaaacctcgaatatgtacccgtgaagaatttacccgcaaagtacggtctaatgctgctattggagcggtttttgtggacgaaaatcaatggaactctgctaaagaagcggtagaagatgaaagattctgggatttggttcatcgtgagcgcgaattacataaacaaggaaaatgcgccacttgcgtatataatatgatgggaaaacgcgaaaagaaattaggtgaatttggtaaagcaaaaggatccagagcgatatggtatatgtggctaggagcaagatttcttgagtttgaagcactaggttttatgaatgaggatcattggttctcacgcgaaaactcgctgtctggggtagaaggagaaggactacataaacttggatatatattacgagatatatcaaaaatacctggaggaaacatgtatgccgacgacacagcaggctgggacacgaggattacagaggacgatctacaaaatgaggccaggattactgatataatggaaccagaacatgccctattggcaaaaagtatatttaagttaacttatcaaaataaggttgtcagggtacaacgtcccgctaaaaatgggaccgttatggatgtgatcagtcgaagagatcaaaggggatcagggcaagtaggaacttacggactaaacaccttcacaaatatggaagcacagctcatccgacaaatggagtctgaaggcatcttttctccttcagaactagagacgccaaacttagctgagagagtacttgattggctagaaaaatacggagttgaaaggctgaaaaggatggcaattagcggagacgactgtgtagtcaagccgatagatgatagattcgctacggcgttaaccgctttgaacgatatggggaaagtaagaaaagacatccctcaatgggagccatccaagggctggaacgattggcaacaagtcccattctgtagccaccatttccatcaattgataatgaaggacggtagggaaatagtagtgccgtgtcgcaaccaggatgagctagtaggaagggccagagttagccaaggtgcggggtggtccctacgggaaacagcttgcttggggaaatcatatgcgcaaatgtggcagttaatgtactttcatagaagagatcttagattggcagctaacgcgatttgttctgccgtacctgtagattggataccaacaagtcgaacaacctggtctatacacgcacatcaccaatggatgacaacagaagacatgctttccgtctggaaccgagtctggattgaagaaaatccatggatggaggataaaacacatataagttcttggggcgacgttccttacctaggaaaaagggaagaccaatggtgcggaagtttaataggtttgacggctcgagcgacttgggctaccaacatccaagtagctattaatcaagtcagaagacttattggaaatgaaaattacttagactatatgacatcaatgaaaagattcaaaaatgaaagtgatccagaaggagctttgtggtaa

SEQ ID NO: 21548 - RNA, 9879 nt, synthetic construct
  misc_feature 1..9879: note = derived and/or modified CDS sequence (opt6) from DENV-1__FJ432749__SS-prME
  source 1..9879: mol_type = other RNA
agcgtaaccatgctcctcatgttaatgcccacggcattagcatttcatttaactacaagaggtggggaacctcatatgattgtaaccaaacaagaaagagggaaaagtttacttttcaaaactagcgccggggtcaatatgtgtacattgatagcaatggatcttggggaactatgtgaagacacaatgacttataaatgtccgaggataacagaagcagaacctgacgatgttgactgttggtgtaacgcgacagatacgtgggtcacatatggaacatgttctcaaacaggcgaacataggagagacaaaagaagtgtagcattagcaccacatgtcggattaggtcttgaaacaagaacagaaacctggatgtcgagcgaaggtgcctggaaacagatacaaagagttgaaacatgggcactgcgccatccgggttttacagtaatagccttgtttcttgcacacgctataggtacatcaataacgcaaaaaggcataatcttcatcctattaatgctagtaacaccttcaatggctatgagatgtgtagggataggatccagagactttgtagaaggactgtcgggggcaacatgggtcgatgttgttttagaacacggatcttgcgttaccacgatggcaaaagataaaccgacgttagacatagaattattaaaaacagaagtaacaaatcccgcagtacttcgaaaattatgtatcgaagctaaaatatcgaatacaactaccgattcgagatgccctacacaaggagaagcgaccctaatggaagaacaagatgcgaatttcgtctgccgacgaacattcgttgatcgaggatgggggaacggctgtggtcttttcggaaaaggtagtcttattacatgcgctaaattcaaatgtgtaacaaaactggaggggaaaatagtacagtatgaaaatttaaaatattctgtgattgtaacagtacacaccggtgatcaacaccaagtagggaacgaatccacggaacatggtacaacagccacaattacaccccaagctccaacatcggaaatacaactcaccgattacggagcattaaccctggattgctccccacgtaccggtcttgactttaacgaaatggttttactaacgatgaaagagaaaagttggctagtacacaaacagtggtttctagacctaccattaccgtggaccagcggtgcaagcacaagccaagaaacatggaacagacaggacttgctggtaacgtttaaaacagcacatgcgaagaaacaagaagtggttgtactcggctcacaagagggagcaatgcacaccgcactgacaggagcaacagaaatacaaacatctggaacaactacaatatttgcaggtcatcttaaatgcagattaaagatggataaacttacactcaaaggaatgtcctatgtaatgtgcaccggtagtttcaaactcgagaaagaggtagcagaaacacaacatggtactgttttagtacaaataaaatacgaaggcacagacgcaccatgtaagataccgttcttgacacaggatgagaaaggtgtaactcaaaatggaagattaattaccgccaaccccatcgtaacagataaagagaaaccggtcaatatagaggcggagccaccttttggtgaatcctatattgtgattggagccggtgaaaaggcattaaagttaagttggtttaaaaagggttcatctataggcaagatgttcgaagctacagcaagaggggcacgacgaatggccatcctgggcgacacggcttgggactttggatcgatcggaggagtgttcacgagcgttggtaagttagtacaccaaatttttggaacagcttacggcgttttattttccggtgtatcctggacaatgaaaataggtataggggttttattgacctggttaggcctaaattcgcgatcaacatctctttcgatgacttgtatagcagttggcctagttacattatacttaggtgtgatggtgcaagccgatagtggatgcgttattaattggaagggcagagaattgaagtgcggctccggaatctttgtgaccaatgaagttcatacgtggacagaacaatacaaattccaggcagactccccaaagagactaagcgcggctatcggcaaggcttgggaagaaggtgtatgcggaatacgttcggcaactagattggagaatattatgtggaaacaaattagcaacgaattaaaccatatcctattagaaaacgacatgaaattcaccgtcgtagtaggcgatgttgtcgggatactcgcacaaggtaagaaaatgatacgaccgcaaccaatggagcataagtacagctggaaatcatggggcaaagccaaaataataggagccgatgtccaaaatacaactttcattatagatggaccaaacacaccagaatgcccagatgaccaacgtgcttggaatatatgggaggtagaggattacggtttcggaatcttcaccacgaatatatggctcaaactccgagatagctatacacaagtatgtgatcacaggctaatgtctgctgctataaaagattctaaagcagtacacgccgacatgggatattggattgaatcagagaaaaatgaaacttggaagctggcgagagccagcttcattgaggtaaaaacatgtatatggcctaagagtcacactctttggagtaacggtgtgctagaatcagaaatgataataccgaaaatatatggtggcccaatcagtcaacataactaccgaccaggctatttcactcaaaccgcaggcccctggcacttaggaaaacttgaattggattttgatctttgcgaaggcacaacagtagttgtagatgaacattgcggcaatcgaggtccctccctgcgaactacaaccgttaccgggaaaatcatacacgaatggtgttgtcgaagctgtacacttcctccattgaggtttaaaggtgaggatggctgttggtatggtatggaaatacggcccgtgaaagagaaagaagaaaatctagtgaaatcaatggtctcagctggatccggcgaagttgatagcttttcactgggtctactgtgtatttctattatgattgaggaagtaatgagatcgcgttggagtagaaaaatgttgatgactggtaccctcgcagtttttctgttgttaattatgggacaactaacttggaacgatctgatccgactttgtataatggtgggagccaatgcttcagaccgaatgggaatgggtactacgtacctagcattgatggcgacattcaagatgcgcccaatgtttgcggtggggctcttatttagaagattaacaagcagagaagtacttctattaaccataggactatcattagtagcttctgtggaacttccaaactctttggaagaactaggagacgggttggcgatgggcataatgatactaaaacttctaactgattttcagagccatcaactctgggcaactctcctttctttaacttttattaaaacaactctgtctttgcattatgcctggaaaaccatggcaatggtattgagcatagtaagcctttttccattgtgcttaagtactacctcacagaaaacaacatggctaccagtgctacttggatcgctgggatgcaaaccactaaccatgtttcttattgcagaaaataaaatatgggggagaaaatcgtggccactaaacgaaggaataatggcggttggagttgtatcgatattgctttcatccttgctgaaaaatgacgtacccctagctggcccactaatcgctggtggcatgttaattgcatgctatgttatatcaggctcaagtgcagatttgagtttagaaaaggcagcagaagtgagttgggaggaagaagcagaacactctggagcatcacataatattctcgtagaggttcaagacgatgggacaatgaaaattaaggatgaggaaagagacgacacattgacgattctgctaaaggcaacgttactggccgtctcaggtgtgtacccactgtctatccctgcaacactttttgtctggtacttttggcagaagaagaaacaaaggtccggtgtcttgtgggatacaccgagtccgccagaagtagaaaaagcagtacttgatgatggaatttatagaattatgcaaagggggttgctcggaagaagccaagttggtgtaggagtattccaggaaaatgtcttccatacaatgtggcatgtcaccagaggagcagtgctgatgtatcaaggtaaacgattagaaccatcttgggcttctgtgaaaaaggacttaatcagttacgggggagggtggaggcttcaaggttcatggaacactggcgaagaagtacaagttatagcagtagaacccggcaaaaacccaaagaacgttcaaacagcaccgggaacattcaaaactccagagggagaagtcggggcaatagcattagattttaaaccaggaacctccggctcacccattgtaaacagagaaggcaaaatagttggtctgtatggcaatggtgtagtcaccacaagcgggacgtatgtcagcgccatagcacaagctaaggccagtcaagaaggtccattaccagagatcgaagatgaagtattccgaaaaagaaatctaacaataatggacttgcacccgggctccggcaagacaagacgctacctaccagcaatagtaagagaggccataaaacgtaaattaaggacactgatcttggcacctactcgagttgtggcatcagaaatggccgaggctttaaaaggaatgccaatacggtatcaaaccactgcagtgaaatccgaacacactggaaaagaaatagtagacttaatgtgccacgcgacattcacgatgagattattatctccagtccgggtaccaaactataatatgataataatggacgaggcccactttacagacccatcctctattgcagctaggggttatatatcaacacgcgtgggaatgggtgaagcggcagccattttcatgacggccaccccaccgggatctgtcgaggcttttccgcaaagtaatgcagtaattcaggacgaagaaagagatatccccgaaaggtcatggaacagcggttatgaatggattaccgatttcccgggaaaaactgtctggttcgtgccttcaataaaaagcgggaatgacatagccaattgtctaaggaaaaatgggaagagagtaatccaactttcacgcaaaacttttgatacagaatatcagaagaccaaaaacaatgactgggattatgtcgtcaccacagacatatcagaaatgggtgcaaatttccgtgccgaccgagtgattgatccacggcgctgtctaaagcccgtaattttaaaagatgggcccgagagagtcattcttgcagggccgatgccagtaactgttgcttcagccgctcaacgacgaggccgtataggacgaaaccataataaagagggagatcaatatatctatatgggtcagccccttaataatgacgaggatcatgcgcactggacagaagccaaaatgctattagataatattaatacacccgaagggataatacctgcgctatttgaacccgaacgagaaaagagtgccgctatcgatggagaatatcgtcttcgaggtgaagctagaaaaaccttcgtagaactaatgagaaggggtgacttaccggtgtggttaagttataaggtagcatccgaaggattccaatattcggataggagatggtgctttgacggagaacggaacaatcaagtgttggaagaaaatatggacgttgagatttggacaaaggaaggcgaaaggaagaaattgagaccgcgttggctagacgcgcgcacatactctgaccctttagcattacgagagtttaaagagttcgccgcgggaaggaggagcgtatcaggagacttaatactcgagattggaaaattaccccaacacctgacccaaagagcacagaatgcactagataatcttgtaatgttacataattcagaacaagggggcagagcctatagacatgcaatggaagaattaccagatacaatagaaaccttaatgctattagctttgatagccgtactaacaggaggtgtaactctatttttcctaagtggccgcggattaggaaagacaagtattggcgtactctgtgtaatggcatcaagcgtcctcctatggatggccagcgtggaacctcattggatagctgcttcaataattctagaatttttcctgatggtattattaataccagaaccagaccgtcaaaggactcctcaagacaaccaattagcttacgtagttataggattgctattcatgattttgactgtggcagcaaacgaaatgggattgttggaaactaccaagaaagacctgggtataggtcatgtagcagtagaaaatcaccatcacgcaacgatgctagacgtagacctacatccagccagtgcatggaccttatacgcagtagcgaccacaattataaccccgatgatgagacatacaattgaaaatactactgccaacataagcctaacagcgatagccaaccaagcagcaatacttatgggacttgacaaaggatggcctattagtaaaatggacattggagtacctttgttagcgctggggtgctactcacaagtcaaccccctgaccctcacggcagccgtgctgatgctggtagcgcattacgccataatcggtccaggtttgcaagctaaagcaacccgagaagcgcagaaaaggacagctgctggaattatgaagaacccaacagtagacggtatcgtcgcaatagatctagatccggtagtgtacgatgcaaaatttgagaaacagttaggacagataatgttacttattctttgcacttctcaaatattactgatgcgaacaacgtgggctttatgcgagtcaatcaccttagcgacaggtccacttactacattgtgggaaggaagtccgggaaagttttggaatactacgattgctgtaagtatggcaaacatcttccggggttcttatttagcgggagctggccttgcgttcagcttgatgaagtcactagggggtggacgtcggggcacgggtgcgcaaggagaaaccctgggagagaagtggaagcgtcagctaaatcaattgtcaaaaagtgagtttaacatctataaaagatcgggtattatggaagttgaccgcagtgaggccaaagagggattaaaaagaggagaaacgactaggcatgccgtttcgagaggcacggcaaaactgcgatggttcgtagagaggaatttagtaaaaccggagggtaaagttatagatcttggctgtgggcgcggagggtggtcatattactgtgcaggtctgaagaaagtcacagaagtcaaaggctacacaaaaggagggccagggcacgaagaacccattcccatggctacttacggatggaatctagtaaaactacactcgggaaaagatgtcttctttacaccgcccgaaaaatgtgatacattattatgtgatataggggaatcatcgccaaacccaacgatagaagaggggcgaaccctaagggttctaaaaatggttgaaccgtggctccgaggaaaccaattctgtataaaaatacttaacccatatatgccttctgttgtagaaacactggagcagatgcaacgaaaacatggcggtatgttggtaaggaacccactatctcgaaattcgacccatgagatgtattgggtttcgtgtggaactggaaatatagtatcagctgttaatatgacaagtcgcatgttattgaatcggtttacaatggctcacagaaagcctacatacgagagagatgtagatctgggggctggaacgaggcatgtagctgtagagcctgaagttgcaaatcttgatataatcggtcaaagaatcgaaaatattaaacatgaacacaaaagcacatggcattatgacgaggacaacccatacaagacttgggcttatcatggatcatatgaagtcaagccatcaggatcggccagctcaatggttaatggggttgtaaaacttctaacaaagccctgggacgtaattcctatggtaacgcagatagcaatgacagatacaactccctttggacaacaaagagtttttaaagaaaaagtagacacaagaaccccaaaagccaaacgaggtaccgcccaaataatggaagtaaccgctagatggttatggggattcctatcacgcaacaagaaaccaaggatatgcacaagagaggaatttactcggaaggttagaagtaatgcagcaataggtgctgtgtttgtagacgagaaccaatggaatagcgcaaaagaggccgtagaagacgagagattctgggacctagttcaaaaagagagagaacttcataaacaggggaaatgtgcaacatgcgtatacaacatgatgggtaagagggaaaagaaactgggagagttcggaaaagcaaaaggatccagagcaatctggtatatgtggctaggagcgagatttttagagttcgaggctttgggatttatgaatgaagaccattggttctcacgtgaaaattcactttctggagttgagggagaaggacttcataaactcggatatattctaagagacatatcaaaaattccaggagggaatatgtatgcagatgatacagccggatgggacacaagaataactgaagacgacctacaaaatgaggcaaaaatcacagacataatggaaccggaacatgctctcttggcgacaagcatttttaaattaacgtaccaaaataaggttgtgcgtgtacagagaccggctaagaacggcactgtcatggatgtaattagtcgtagggaccagcgtggtagtggtcaggtgggaacatacggattaaacacatttacaaacatggaggcacaattgataagacaaatggaaagcgaaggaatatttctaccaagtgagcttgaaacacctaatcttgctgaaagagttctggattggcttgaaaaatatggtgtcgaacgattaaaaagaatggcaattagtggtgacgactgcgttgtgaagcctatagatgacagatttgccacagctctcactgcattaaatgatatgggtaaagttaggaaggatatacctcaatgggaaccatcgaaaggctggaatgattggcaacaagtacccttttgttcgcatcattttcatcaacttataatgaaagacggtagagagatagtagtcccttgcagaaatcaagatgaattagttggtagggctcgagtttcgcagggagctggttggagtctacgtgaaaccgcgtgtctagggaaatcttatgctcaaatgtggcaattaatgtatttccataggcgagacttgagattagctgcgaacgcaatatgctccgcagtgccagtagattgggtgcctacatcgagaactacctggtccatccatgcacaccaccagtggatgacgacagaggacatgttaagtgtttggaacagggtatggatagaagagaatccatggatggaagacaaaacacacgtatcctcctggggagatgtaccctatctaggaaaacgtgaggaccaatggtgtggatcacttataggtcttaccgcacgagcaacttgggcatctaatatacaagtcgctatcaatcaagtgagacgtttgataggaaacgagaactatctagactatatgacatcaatgaagagattcaaaaacgaaggcgatccagagggtgccttctggtaa

SEQ ID NO: 21549 - RNA, 9879 nt, synthetic construct
  misc_feature 1..9879: note = derived and/or modified CDS sequence (opt6) from DENV-1__FJ410212__SS-prME
  source 1..9879: mol_type = other RNA
tcggttaccatgctcttaatgttgatgccgacagcactcgcgttccatctgacaactaggggtggagaaccacatatgatcgtatcgaaacaagaacgtggaaaaagtctattatttaaaacttcggctggtgtgaacatgtgtaccttgatcgctatggatctcggagaattgtgtgaagatacaatgacttataaatgtccaagaatcacagaagcggaacctgacgatgttgattgttggtgcaacgcaacggacacatgggttacatacggcacttgttctcagacaggcgaacacagaagggaaaaacgtagcgtggcattggctcctcatgttggcttgggcctggaaacgagaacagagacttggatgtcgagtgaaggcgcatggaaacaaatacaaagagttgagacctgggcacttagacatccaggtttcacggtgatcgcgctctttctagcacacgcaattggcacttcgataactcaaaaaggtataattttcattctcttaatgcttgttacaccatcgatggcaatgagatgtgtcggaattggcagtagggactttgttgaaggattgtctggcgctacttgggtggatgtcgtacttgaacatggttcatgcgttacaactatggctaaagataaacctacactggacattgagctacttaaaacagaagtcacaaatccggctgtgctacgcaaattatgtatcgaagcaaaaatcagcaacactactactgatagtaggtgcccaacacaaggagaagccacgctagtagaagaacaagatgcaaacttcgtttgcagaaggacatttgttgacaggggatggggaaacggatgtgggcttttcggaaaaggatcactactaacctgcgcaaaatttaaatgtgtaacgaaattagagggaaaaattgtacaatatgaaaatcttaaatattcagttatcgttactgtacatacgggtgaccaacaccaagtaggtaacgaatctacagagcatggaacgaccgccacaataactccccaagcaccaactaccgagatacaattaactgactacggtgctctaacactagattgttcgcctaggaccgggctagattttaatgaaatggtgcttttaaccatgaaagaaaaatcatggctcgtgcataaacagtggtttttggatctacctcttccatggacatcaggagcaagtacatctcaggaaacatggaacagacaagatctcctagtcacttttaaaactgcacacgccaagaaacaagaagtcgtcgtgttaggctcacaggaaggtgccatgcatactgcactaaccggtgccaccgaaatccagacatcaggaaccaccaccattttcgcaggtcatctcaaatgcagactaaaaatggacaaactcactttaaaaggaatgtcgtatgtgatgtgcacagggtcgttcaaactagaaaaagaggtagcagaaacacagcatgggacagtattggtccagattaaatatgaaggaacagatgccccctgtaaaattccattctccacgcaagatgagaaaggggtcacccaaaatggtcgattaataacagcaaatcccatcgttacggataaagagaaaccagtcaacattgaagccgaacctccttttggagaatcatatattgtaataggggcaggagaaaaggctttgaaactatcatggttcaagaaagggtcatcgataggtaaaatgtttgaggcaacagcaagaggagctaggcgaatggcaatattaggtgatacagcgtgggactttggttccatcggtggagtgttcacaagcgtaggtaaattagttcaccagatatttggaacagcctacggcgttttattttcaggagtaagttggacaatgaaaataggaataggagccttactaacctggttgggattgaactctcgatctacctctttatctatgacttgcattgcagtcggattagtcacattataccttggtgttatggtccaagcagactcgggttgtgttataaattggaaaggacgagaattgaaatgcggttccggaatctttgtgacaaacgaggtacacacatggaccgaacagtataaatttcaagcagatagtcctaaaagactttctgcagcgattgggaaagcctgggaagaaggtgtatgtgggataagaagcgctaccagactagaaaacataatgtggaaacaaattagcaacgaactaaatcacattttactggagaatgacatgaaattcaccgtagttgtaggtgacgtagccggaatactcgtacaaggtaagaaaatgataagaccccagccaatggaatataaatattcatggaaaagttggggcaaagccaaaattattggggctgacgtacaaaactctacatttatcattgacggaccgaataccccagagtgtccagacgatcaacgagcttggaatatatgggaagtcgaggactatgggtttggaatttttacaactaatatatggctcaaattacgcgacagctatacgcaagtttgcgaccaccgcttaatgtccgccgcaatcaaagattccaaagcagtacacgcagatatgggctactggatagaaagcgagaaaaacgagacttggaagttagctagagcaagtttcatagaagttaagacttgtatatggcccaaatcgcatacactgtggagcaacggagttttagagtcagaaatgataatacctaagatacatggcggtcccatcagccaacataactatcgaccgggatacttcacacagaccgcaggaccctggcacctgggaaaactagagctagattttgatttatgtgaaggcacaacagtcgtggtggacgaacattgtggaaatagaggacccagcttaaggacgaccacggtcacaggaaaaataatacacgagtggtgctgtcgatcatgtacattaccacctctaagattccggggagaagacggctgttggtatgggatggagatcaggcccgtaaaagagaaagaagaaaacctagttaagtctatggtctctgccggatccggtgaggtggactcattctcattgggcctactatgtatcagcattatgatagaagaagttatgagatctcgatggtcacgaaaaatgttaatgacaggtactttagcggttttcttcctattaattatgggacagttaacttggaatgatctgatacgactctgtattatggtcggcgctaatgcctcagatagaatgggaatgggaacaacatatttggctctcatggcaacattcaaaatgaggccgatgtttgccgttggtttattattccgccgtctcacgtcaagagaagtgcttttattgacaataggcctatcgctggttgcatcagttgaattaccaaatagcctggaggagttaggtgatggtctagcgatgggaataatgatactgaagttacttacagatttccaatcttaccagctctgggcaactctattgtcattaaccttcataaaaaccacgttttcgctacattatgcatggaagacgatggccatggttctctcaattgtatcattgtttcctctatgtctatcaactacttcgcagaaaacaacatggttacccgttctacttgggagtttaggatgtaaacctttaacaatgttcctgatagctgagaataaaatctggggaaggaagtcctggccactgaatgagggtattatggcagtagggatagtttctattctcttatcgtcgctattaaagaatgacgtgccactagcgggtccacttatagctggagggatgttaatcgcatgctatgttatatcaggatcctcggccgatctatcactagaaaaagcagcggaagttagctgggaggaggaagccgagcactcaggggccagtcacaacatattagttgaagtccaggacgatggaacaatgaaaataaaagatgaagagagagatgatacgctcaccatacttttaaaagcaacattactagctgtatccggagtttaccctttatcaatacccgctacattattcgtctggcatttctggcagaagaagaaacagcgatccggagttttatgggatacgccttcacccccagaagtggagagagcagttctggatgacggtatttataggatcatgcaaagagggttgctaggccgatcacaggttggtgtaggagtttttcaagagaatgtttttcatacaatgtggcatgtaacgcgcggagcagttttgatgtatcaaggtaaaagactagagccaagctgggcatctgtaaagaaagatttgatttcatacggtggcggctggagatttcaaggatcgtggaatactggcgaagaagttcaggttatcgccgttgagcctggtaaaaaccctaaaaatgtacagacggcaccaggcactttcaagacgcccgaaggggaggtcggagcaattgctttggattttaaaccaggaacatcgggtagtcccatagttaaccgcgaaggaaaaatagtaggattatatggaaacggggtcgtaacaacgtctggaacatatgtttccgcaatcgcccaagcaaaagcatcccaagaaggacccctacccgaaatcgaggatgaggtattccgtaaacggaaccttacaattatggacctgcacccgggctccgggaaaactcgacgatatcttcccgcgatagtacgtgaagctatcaaaagaaaacttcgtactctaatactagcaccaaccagagtggtcgcatcagagatggcagaggcattgaaaggaatgccaattagatatcaaacaacagcagtaaaaagcgaacataccggtaaggagatagtagatttaatgtgtcacgcgactttcacaatgaggttactaagtcccgtgcgagttccaaattataatatgattatcatggatgaagcgcattttactgatccctctagtattgccgccagaggatatatttcaactagagtcggcatgggcgaagctgcagcaatatttatgactgcaacacctcccggatctatggaagcatttccccagagcaatgcagttatacaggatgaagaaagggacatacccgaaaggtcgtggaactctgggtacgaatggataactgattttccagggaaaacagtatggtttgtcccgtcaattaaggccggaaatgacattgcaaactgtcttagaaagaatggtaaacgggttatccaactatctcgaaaaacgttcgatactgaataccagaaaacgaaaaacaatgattgggattacgtagtaacaacagatataagcgaaatgggtgcaaacttcagagcagaccgggtaatagaccctcgacgctgtttaaagcccgtaattttgaaagatggtcctgagcgagtgattctagcaggtccaatgccagttactgtggcgtccgcagcacagagaagaggtagaataggcagaaatcacaataaagaaggagatcagtatatctacatgggacaacctctaaataacgacgaagaccatgcccattggactgaggctaaaatgctgctagataacatcaatacaccagaaggaatcattccggcactttttgagccagaaagagagaaaagcgccgcaatagatggtgagtatagactcaggggagaagcacggaaaacttttgtggaacttatgagaagaggagacttgccagtttggctctcttataaggttgcatcagaaggattccaatatagtgaccggaggtggtgttttgatggggaaaggaacaatcaagtactggaagaaaacatggacgtcgaaatatggacaaaagaaggagaaaggaagaaattaaggccacgctggctggacgcaagaacttactcagaccccttagcactgagagaatttaaggaatttgcagcaggacgaaggtcagtgtctggcgatctgatactagaaattggtaaattgcctcaacacctgacacaacgggctcagaacgcccttgacaatctagttatgttacataattctgaacaaggtggacgagcttatcgacacgcgatggaggaactgcctgacacaatagaaactttaatgcttctcgcgctcattgccgtactgaccggaggagtcaccttgttctttctttcagggaaaggactaggcaaaacttctattggtcttctgtgtgtaatggcctcttcagtgctactttggatggcatcagtagagccacactggattgcagcgtcgattatactagaatttttcttaatggttttgctgataccagaacccgacaggcaacgaacacctcaggataaccaactagcatacgtcgtgattggtctcttatttatgatcctaacagtagcggccaatgaaatgggactactggagaccaccaagaaagatttaggtataggacacgttgcagttgaaaatcatcaccatgccgcgatgttagatgtagatctgcatcccgcatctgcctggactctctatgctgtcgccacaacgatcgtcactccaatgatgagacatacgatagaaaacacaactgctaacatatcgttaacagcaatagcaaaccaagcagccatactgatgggactagacaaagggtggccaattagtaaaatggatataggagttcctttattggccctaggatgctatagtcaagtaaacccactcacgctcacggcagctgttttaatgcttgtcgcacactatgcaataataggaccgggactacaggctaaagcaactcgcgaagcacagaaaagaacagcagccggcatcatgaaaaatcctactatcgacggcattgtagcaatagatctcgacccggttgtttacgacgcaaaatttgagaaacagctagggcagataatgctgttaatactttgtacaagtcaaatactattaatgcgtacgacatgggcattgtgcgagtccattacactagctactggcccactcacaactctctgggaaggatctccaggaaaattttggaacactacgatagcagtgtcaatggcaaatatattcagaggctcatacttggctggagctggactagcctttagtctgatgaagagtttagggggaggaagaagggggacgggagcacagggtgaaacattgggagaaaaatggaagaggcaattaaaccaattaagcaaatccgagtttaatacttacaagagatctggtattatggaggtagaccgttccgaagcaaaggagggattgaaacgtggggaaacaacaaaacacgcagtctcaagaggcacagcgaagttacggtggtttgttgaacgcaatctagtaaaacccgaaggaaaagtaattgacttaggatgtggtcgagggggatggtcatattactgtgcgggactaaagaaagtgacggaagtaaaaggatacacaaaaggtggtcctggccacgaagaaccgattccaatggcgacttatgggtggaatttagtaaaacttcattctggaaaggacgtgttctttataccacctgaaaaatgtgacacgcttctttgtgatataggtgagagtagcccgaatcccacgatagaagagggaagaacactaagagtattaaaaatggttgaaccatggttaaggggaaaccaattctgtataaaaatattaaatccgtatatgcctagcgtcgtagaaactttagaacaaatgcaaagaaaacatggcggcatgttggtacgaaatcccttatcaagaaacagcacacacgagatgtactgggtaagttgtggtactggaaacatcgtctccgctgtgaacatgacctcacgaatgctgctaaatagattcacgatggcacacagaaagcctacatacgagcgggatgtagacttaggagcaggaaccagacacgtggcagtagagcctgaagtcgcaaacctcgatataataggacaaagaatagaaaatataaaacatgaacataaaagcacctggcactatgatgaagataacccgtataaaacttgggcatatcacggctcatacgaggtaaagccatccggttcagcatccagtatggttaacggcgtagtaaaactattgactaaaccgtgggacgttattcctatggttactcaaatagcaatgacggacacgacaccatttggtcagcaaagggtctttaaggaaaaggtagatactagaacgccaaaagcaaaacggggaacagcacaaatcatggaagtaactgctagatggttatggggtttcctttcccgtaataaaaagcctagaatttgcacacgtgaagaatttacacgaaaagtccgatccaacgcggcaataggagcggtttttgtagatgaaaaccagtggaatagtgcaaaagaagccgttgaagatgatcgcttctgggatctggtacatcgcgagcgcgagctgcacaaacaaggcaaatgtgcaacctgcgtgtataacatgatgggaaaacgtgagaagaaattaggtgagttcggcaaggctaagggcagccgcgcaatatggtacatgtggttaggtgctagatttttagaatttgaagctcttggatttatgaatgaggaccactggttctcacgtgaaaactcgctgtcgggtgtagaaggcgaaggtttacataaattaggttatatattgagggatatttcaaagataccaggaggaaacatgtacgcggatgatactgccgggtgggacactcgtataacagaggacgatttgcaaaatgaggccaaaattactgatattatggaaccggaacatgctttactcgcaaaatctattttcaaacttacttatcaaaataaggttgttcgtgtgcaaagacctgccaaaaacggtactgtcatggatgtaatttctagacgagatcaacggggctccggacaagtaggtacatacggcttgaacacatttaccaatatggaggcacaactcataagacaaatggaatcagaaggaatatttctccccaatgaacttgagacaccaaatctcgccggacgcgtactagactggctcgagaaatacggtgttgaaagactgaaaagaatggccataagtggcgacgattgtgtggtaaaaccgattgacgaccgttttgcgacagcattaaccgcgttaaatgacatgggtaaagttaggaaagatatcccacaatgggagccttctaaaggctggaatgattggcaacaagtacccttttgctcccatcatttccatcagctaataatgaaagacggaagagaaatcgtcgtaccatgccggaatcaagatgaattagtcggtagagcaagggtgagccagggtgcaggatggtctttaagagaaaccgcgtgtttaggtaaatcatacgcgcagatgtggcaattgatgtattttcatcgacgagacttgagactagcggcaaatgcaatatgctccgccgttcccgtagattgggtacctacctcaagaacaacatggagtatacatgcccatcatcaatggatgacaactgaagacatgttaagcgtatggaaccgagtttggattgaggaaaatccgtggatggaagataagacaagaatttcttcctgggaggatgtaccttatctaggtaagagggaagatcaatggtgtggatctttaatagggctcacagcgagagctacatgggccacgaatattcaagtcgcgataaatcaggttagaagattaataggaaacgaaaattactcagattatatgacctctatgaaaaggttcaaaaatgaaagcgagccagagggagctttatggtaa

SEQ ID NO: 21550 - RNA, 9879 nt, synthetic construct
  misc_feature 1..9879: note = derived and/or modified CDS sequence (opt6) from DENV-1__FJ461307__SS-prME
  source 1..9879: mol_type = other RNA
tcggtaacaatgctgttaatgttaatgcccaccgcgttggctttccatctaacaacgagaggtggagaaccacatatgattgtatctaaacaagaacgcggaaaatctttgttatttaaaacatccgcaggcgtaaacatgtgtaccttaatcgccatggacctcggtgaactttgcgaagacacaatgacatataaatgtcccagaataacagaagcagaacctgatgatgtggactgttggtgcaacgcaacggacacttgggtaacctatggtacgtgtagtcaaacaggagaacatcgacgggagaaacggagtgttgctctagcgcctcatgtaggcttaggtcttgaaacgagaacagagacgtggatgagcagcgaaggagcctggaaacaaatccaacgggtagaaacatgggctttgcgccatcctggattcacagtaattgcactatttttggcacatgcaattggaacatcaattacacaaaaaggaattatttttatcctattaatgctagtaactccatctatggctatgagatgtgtaggtattggttctcgggacttcgtagaggggcttagcggtgcaacttgggtagatgtcgttcttgaacatggatcatgcgtcactacaatggcgaaagataaacccacactcgatattgaactattgaaaacagaagtcactaacccagctgttcttcggaagctgtgcattgaggcaaaaatatcaaacacaaccacagacagtagatgccctacacaaggagaagccacgctagtagaagaacaagatgcgaatttcgtatgtcggagaacatttgtagatagaggatgggggaatggctgcggcttgttcggaaaaggatctcttttaacgtgtgcaaaatttaaatgcgtcactaagctagaaggaaagatagttcaatatgaaaacctaaaatactcagttatagtcacagttcacaccggggatcaacaccaagttggaaatgagagtacagaacacggtacaacggcaacaataactccacaagctcctacaacggaaatccaattgactgactacggtgcactgacactagactgctctccaagaaccggcctggacttcaatgaaatggtactactaacaatgaaagagaagtcgtggttagttcataaacaatggtttcttgacttacccctaccatggacgtcaggcgcttcaaccagccaagagacctggaatagacaagatctgcttgtcacttttaaaacagcacatgccaagaaacaagaggtcgtagttttaggtagtcaagagggagcaatgcatacagcactgacgggagcaactgaaattcaaacttcaggcacgacaacaatatttgccggacacctcaaatgtagattaaagatggataaattaacattgaagggaatgtcgtacgtaatgtgcacaggaagttttaaattagagaaggaagtagcagaaacacaacacgggactgtgctagtacagataaaatacgaaggtacagacgctccctgcaaaatcccattttctactcaagatgaaaaaggggtaacccaaaatggtcgacttatcacggccaatccgatcgttaccgataaagaaaagcccgtaaatatagaagccgaacctccttttggcgaatcgtacattgtaatcggcgcaggagaaaaagcattaaaactaagttggtttaagaaaggatctagcataggtaagatgtttgaagcaacggcacgaggggcacgccgaatggccatactaggtgatacagcttgggatttcggcagcattggaggagtattcacatcagttggaaagctcgttcatcaaatttttggcaccgcatacggagttttattctcgggggttagttggacaatgaaaataggaataggagtattacttacctggttaggattaaattcaagatctacaagtttatcaatgacgtgtatagcagttggcctcgtaaccctttatttaggtgtgatggtacaggctgatagtggctgcgttatcaattggaaaggtagggagctgaaatgtggcagtggaatttttgtaactaatgaagtgcatacttggacggaacaatacaaatttcaagcagatagtcccaaacggttaagcgctgcaataggtaaagcatgggaagaaggcgtttgtggaattagatccgccacacgattagaaaatattatgtggaaacaaataagtaatgaactcaatcatatattactggaaaatgatatgaaattcactgtagtcgtgggagatgtagcgggcatattagtccaaggcaagaaaatgatacggccacaacctatggaatataagtattcttggaaaagctggggcaaggcaaagatcataggagccgatgtacaaaactcaacttttatcatagatgggccaaatacgccagaatgcccggacgatcaaagagcatggaacatctgggaagtggaagattacggcttcggtatatttactactaacatttggcttaaactcagagactcatatactcaagtatgcgatcatagactaatgagtgcagcaataaaagacagcaaagccgtacacgctgatatgggctactggatagaatcggagaaaaatgagacttggaaacttgcacgtgcttctttcatagaagtgaagacatgtatttggccaaagagtcatacattatggtccaatggtgtcttagagtccgaaatgattattccaaaaattcacggaggaccaatctcacaacataactatcgaccaggctatttcacccagacagccggaccatggcatttaggtaaactagaattagattttgatttatgtgaaggtacgacggtagtggtagatgaacattgtggaaataggggccccagtctacgaactactaccgttacaggaaaaattatacatgagtggtgttgcagaagttgcaccttgcctccactaagatttaggggagaagatggatgttggtacggaatggaaataagaccagtcaaagaaaaagaagaaaacttggtgaaaagtatggtatctgcaggcagcggtgaagtcgacagttttagcttgggactactatgtatatcaataatgattgaagaagtaatgagaagtagatggtcaagaaaaatgcttatgaccggaactctagcagtatttttcctattaattatggggcaactcacctggaatgatttaataaggctttgcatcatggtaggcgcaaatgcgtcggacagaatgggtatgggaactacttacttagcattaatggcaacattcaagatgcgaccgatgttcgcagtcggtctgttatttagacggttaacgtcccgcgaggttttgctcctcacgatagggttatctctagtagcctcagtagagcttccaaattcgttggaagaactcggggacggattagctatgggcataatgattttgaaactacttacagatttccaatcatatcagttatgggctacattactaagtctaacattcatcaaaactaccttctcattacactacgcatggaaaaccatggccatggttctttcaatcgtcagcttgttcccattatgtttaagcactacgtctcagaaaactacttggttaccagtactgcttggttccctcggctgtaaaccattaactatgtttttaatagctgagaataaaatatggggtcgaaagtcatggccgttaaatgaaggaatcatggccgttggaatagtaagtatacttttgagctctttgcttaaaaacgatgttcctttggcaggaccattgatagccggtgggatgttaatcgcatgttacgtcatatcagggagcagtgcagatttatccctcgagaaagccgcagaggtgagctgggaagaagaagcagaacactccggcgcttctcacaatattctagtggaagttcaagatgatggtaccatgaaaatcaaagatgaagaacgtgacgacactctaactattttgttgaaggcaacgttattagcagttagtggggtataccctctgtcgataccagcaacattatttgtttggcacttttggcagaaaaagaaacagcggtcgggagtactctgggatacgccctctccaccagaagtcgaacgagcagtattagacgatggaatctacaggatcatgcagagaggactccttgggagatctcaagttggcgttggagtttttcaggagaacgtattccataccatgtggcacgtaacccgaggtgcagttctgatgtatcaagggaaacgtttagaaccgtcatgggcatctgtcaagaaagatcttatctcgtatggaggaggatggaggttccaaggatcgtggaatactggcgaagaggtgcaagtcattgcagtcgaacccggcaaaaatccaaagaatgttcagaccgctcctggcactttcaaaactccagaaggcgaggttggagcgatcgctctagactttaagcctggcacttcaggcagccctattgtcaatagagagggaaaaatcgttggcctttatggcaatggcgtggtaacgacaagtggcacctacgtaagcgcgatagcacaagcgaaagcatctcaagagggcccattaccagaaatagaggacgaagtctttaggaaacgtaatttaaccattatggatctacacccgggttctggaaagactcgacgataccttccagctattgtgagagaggcaattaaaagaaagttgagaacgctaatcttggcccctacacgtgtagtagcctccgaaatggctgaagcacttaaaggcatgccaattagataccaaacgacagctgtgaaatctgagcatacaggtaaagaaattgtggacctcatgtgtcatgcgacatttacgatgcggctactaagtcctgttcgtgtacctaactacaatatgatcataatggacgaagcacattttacagatccatcatctatagcggcgaggggttacatctcaacgcgagtcggcatgggtgaggctgcagcaatatttatgaccgctactcctccgggtagcatggaagcatttccacagagcaacgcggttatacaagacgaggaacgagacattcctgaaaggtcctggaactctggctacgaatggataactgactttccagggaaaaccgtttggtttgtcccatcaataaaagcaggaaatgatattgcgaattgcctacggaagaatggcaaacgtgtgatacagttgtcaaggaagacatttgatactgaatatcagaaaacgaaaaataatgattgggattatgttgtgacaactgacataagtgaaatgggggcgaattttagggcagatcgcgttatcgatccaagaagatgtttgaaaccggttattttgaaagacgggccagagagggtcatattagccggaccgatgcctgttacagtagcgtcagcagcccagcgtagaggaaggataggcagaaatcataataaggagggtgatcaatacatttatatgggccaaccccttaacaacgatgaagatcacgcccattggacagaggcaaaaatgttgctcgataatattaacacacccgaaggaataattccagcccttttcgaaccagaaagagagaaaagtgctgcgatagatggagaatacagattaagaggggaagccagaaaaaccttcgtggaattaatgcggcgtggtgatctaccggtttggctatcctacaaggtcgcatctgaaggttttcaatactcggatagacggtggtgcttcgatggtgaaagaaataatcaggtcttagaagaaaatatggatgtagaaatttggacaaaagagggggaaaggaagaaattgcgacctaggtggctcgatgcaaggacatatagcgatcctctagcattgagagagtttaaagagttcgcagcgggaaggcgatcagtatctggggacctgatcttagaaataggtaaactcccccagcacctgacccaacgagcacaaaatgcattagacaatctggtgatgctacataacagtgaacagggtggcagagcctacagacatgcgatggaagaacttcctgatactatagaaacactgatgctgttagcattgatcgctgtactcacaggcggtgtgacgctatttttcttatcgggcaaaggactaggtaaaacatcgataggtctactctgtgtgatggctagctccgttttactatggatggcctccgtagagcctcactggatagcagcatcaataattctagaatttttccttatggttttattgataccagaaccagatcggcaacgtaccccgcaagataatcagttggcctatgtggtcattgggttactatttatgattttaacagttgccgccaatgaaatgggcttattagaaactactaagaaagatctagggattggccacgtcgccgttgaaaaccatcatcatgccgccatgctagatgtagacttacatccagcctcagcatggactctatatgcggtcgctacaacaattatcactcccatgatgaggcataccatagagaacacgacagcgaacatatcactcacagccattgccaatcaagcagccattctcatgggtttagacaagggatggccaatatccaagatggatataggagtaccattactggcactaggttgttacagccaagtgaatccattaacgctaaccgcggcagttttgatgttagtagctcattatgccataataggaccaggtctgcaagctaaagcaacaagagaggctcaaaagagaacagcagcaggaattatgaaaaaccctacaatagacggcatcgtagcgatagatttagatcccgtggtgtatgatgcgaagttcgaaaagcaattaggacaaattatgctattgatcctatgcacctcacaaattctgttgatgagaactacatgggctttatgcgaatctattactctggcgacaggtcctttgacgacattatgggaaggcagtcctggaaaattctggaacacaactattgcagtcagcatggcgaacatttttagaggtagttacttagcaggggcgggattggcgtttagcttaatgaagagtctagggggtggccgacgaggtacgggagcacaaggggaaactctgggagaaaagtggaaaaggcaactaaaccaattatctaagtcagaatttaacacgtacaagaggagcggaataatggaagtagatcgttccgaagcgaaagaaggattgaaaagaggagagaccactaaacacgcggtttcgcgtgggacggcaaaattgcgatggttcgtagaaaggaacctggtaaagcccgaaggtaaagtaatagacttaggttgcggaagaggtggttggagctactactgtgcaggtctcaagaaagtcacagaggtgaaaggatatacgaaagggggaccaggtcatgaagaaccaattccaatggctacatatggctggaacctagtaaaactgcattcagggaaagacgtattctttataccgccggaaaaatgcgacacactgttatgcgacattggggaatcatctcccaatccaacaatagaggagggacgcactttacgcgtgttgaagatggttgaaccatggctcaggggaaatcagttttgtataaaaatactaaacccatatatgccgtcagttgtggaaacattagaacagatgcaaaggaaacatggaggcatgttagttaggaaccccttgagtagaaattcaacacatgaaatgtactgggtgtcttgtggaacgggaaatatagtaagcgcagtaaacatgacgagccgcatgttgttgaacagatttacaatggctcatcgcaaaccgacatatgaaagagacgtcgatttaggggctggtacgaggcatgttgctgtagagccagaagtagctaatttagatattattggtcagcgaatagagaatataaagcacgaacacaagtccacatggcattatgacgaagataatccgtataaaacctgggcatatcatggaagctatgaagtaaagccatcaggtagtgcgtcatcaatggttaatggtgtagtaaaacttctaacgaaaccatgggacgtcattcctatggtaacacaaatagcaatgaccgatacaacaccattcggacaacaacgagttttcaaagaaaaagtggacacaagaacaccaaaggcaaaacgaggtacagcccaaattatggaagtgacagcacgatggttgtggggcttccttagtagaaataagaaaccgcgtatatgcacacgagaagaatttactaggaaagtacgttctaatgcggcaatcggagcagtattcgttgatgagaatcaatggaacagcgcaaaagaggcagtcgaagatgaccgtttttgggacctggtacacagagaacgcgaactacataaacaagggaaatgtgcaacgtgtgtatataatatgatgggaaaacgcgagaagaaattaggagaatttggaaaagcgaagggatctagagcaatttggtatatgtggctgggtgcaagatttttagagttcgaagcattaggatttatgaacgaagatcactggttttcaagagaaaactcactaagtggagtcgaaggggagggacttcataaacttggttacatattaagagatatatcaaaaattcctgggggaaacatgtacgcggacgacactgccggttgggatacaaggataaccgaagacgatctacaaaatgaagctaaaatcacggatataatggaacctgaacatgcgttattagccaagtcaatattcaaacttacctaccagaataaggtcgtaagggtgcagagaccagctaaaaatggaaccgtcatggatgtcattagcagaagagaccaacgtggtagtggccaagtaggtacatacggactaaacacgtttaccaatatggaagcacaactcataagacaaatggaaagcgaaggtatatttctacctaatgaacttgaaacacctaatcttgcaggtcgtgttctggactggttagaaaagtacggagttgaacgcctcaaacgtatggcaataagcggagatgactgtgtagtaaaaccaatcgacgatcgttttgctactgccttaaccgctctaaatgatatgggaaaggtaagaaaagacatccctcagtgggagccttcgaaaggttggaacgattggcaacaagttcctttttgtagccaccactttcatcagttaattatgaaagatggaagagaaatagtggttccatgcaggaaccaggatgagttagttggacgtgctagggtaagccaaggtgccggttggagtctaagggaaaccgcatgtttagggaagtcttatgctcaaatgtggcagcttatgtactttcatcgaagagatctacgactagcagcgaacgcgatttgctcagccgtgcctgtggactgggttcccacgtcaagaaccacttggtccatccatgctcaccatcagtggatgactaccgaagacatgctttcagtttggaaccgcgtctggatagaagagaacccatggatggaggataaaactcgcatatcatcatgggaagatgtaccctacttgggtaaacgggaagatcaatggtgcggaagtttaataggtctaacagccagagcaacgtgggcaacgaatattcaagtcgccataaatcaggtgagacgcctaatcgggaatgaaaactatagcgattatatgatttcaatgaagcgttttaagaatgaatcagagcctgaaggcgctttatggtaa

SEQ ID NO: 21551 - RNA, 9879 nt, synthetic construct
  misc_feature 1..9879: note = derived and/or modified CDS sequence (opt6) from DENV-1__FJ410213__SS-prME
  source 1..9879: mol_type = other RNA
tccgtaactatgcttctaatgttaatgcctactgctctggctttccatctcaccacccgagggggtgaaccccatatgatcgtaacaaaacaagaaaggggaaaatcgctactatttaaaaccagcgcgggcgtaaatatgtgcacacttatcgcaatggatctaggggaactgtgcgaagataccatgacgtataaatgccctcgcatcactgaagcagaacccgacgatgttgattgttggtgtaacgcaacggacacatgggtcacctatggcacttgctcgcaaaccggggaacacagaagagataaacggtcagtagcactcgctccgcatgttggtctgggcctagaaacccgcactgaaacatggatgagcagtgaaggagcttggaaacaaatccaacgggttgaaacatgggcccttcgacaccccggttttaccgtcatagcactatttttagctcacgcaattggcacatcaattacgcaaaaaggaatcattttcatactactaatgctggttactccatcaatggcgatgagatgtgtaggtatcgggagccgagacttcgtagaaggactatctggggcgacttgggtagacgtagtcctagaacacggtagttgtgtaacaacaatggcaaaagataaacccacgttggacatagagcttctgaaaaccgaggtcaccaatccggctgtgctaagaaaattatgcatcgaagctaaaataagtaacactacaacagactcacgatgccctactcaaggagaagcaacactcatggaagaacaagacgcgaattttgtgtgtcgacgcactttcgtagatcgtggatggggaaatggttgtggcctttttggaaaaggttctttaattacttgtgctaaattcaagtgtgttaccaagttggaagggaaaattgtgcaatatgagaatctgaaatactcagtgatagtaaccgtccatacaggagaccaacatcaagtaggcaatgaaagcactgaacacggaacgacagctacaataaccccacaagcgccaacgtccgaaatccaactgacggactatggcgctttaactttggactgttcaccacggacaggactggatttcaatgaaatggtcctattaacaatgaaagagaaatcgtggcttgtacacaagcaatggtttttagacttaccattaccttggacaagtggggcaagcaccagtcaggaaacctggaatcgacaggatcttttagttactttcaaaacggcacacgccaagaaacaggaagtcgtagttttaggatcacaagagggagcaatgcacaccgcgcttacaggtgcgacagaaattcaaacatcaggtacgacaactatcttcgcaggtcatctgaaatgtagattaaaaatggataagttgactttgaaaggcatgagttatgtaatgtgtactggctcattcaagctggaaaaagaggttgcagaaacccagcacggtactgtattagttcaaatcaaatatgagggaacagatgcaccttgtaagatccctttctctacgcaagacgagaaaggcgtaacccagaatggaagactaataaccgcaaatccgatagttacagataaagaaaagccagtcaacatagaggctgagccacctttcggagagtcgtacatcgtaatcggcgcaggcgaaaaagcattgaagttatcatggttcaagaagggtagcagtattggcaagatgttcgaagcgacagcaaggggagctagacgaatggctatactaggcgacactgcatgggacttcggatcagtaggaggggtctttacaagcgtcggaaagttagtgcatcaaatatttggaacagcatacggggttctattttcaggagtaagctggacgatgaaaataggaataggagttctcctaacatggctcggattaaattcgcgatcaacatcattgtcgatgacctgcatagcagtaggtttggtaactctttatctaggcgtcatggtacaagcggattctggttgtgttataaattggaaaggcagggaattaaaatgtggaagtggaatcttcgtcactaacgaagtccacacctggactgagcagtacaaatttcaagcagactcgcccaagagactgagtgcagcaatcggcaaggcatgggaagaaggagtatgcggcatcagaagcgctacaaggttagagaatattatgtggaaacaaatatcaaacgaattaaaccacatacttcttgaaaacgatatgaaatttactgtagtagttggcgatgtcgttgggatacttgcccaaggcaagaaaatgattagaccgcagccaatggaacataaatattcttggaaaagctggggaaaagcaaaaataataggagcggatgttcaaaacacaacgtttataattgatggaccaaacacccccgagtgtccagacgatcaacgagcatggaatatttgggaagtggaagattacggtttcggcatctttacgacgaatatttggttgaaacttcgcgactcatatacacaagtgtgtgaccatcgactcatgtccgcagcaataaaagactctaaagcagtacacgctgatatgggctactggatagaatcagagaaaaacgaaacatggaaactagctagggcatcattcatcgaagtaaagacctgcatttggcctaaatctcatactttatggtcaaatggggtactagaatccgagatgataatacctaaaatctacggaggaccgatcagccaacataattatcgtccaggttatttcacccaaactgccgggccttggcatttaggaaaactagaattagattttgacctgtgtgaagggacaacagtagtcgtagacgaacactgtggtaatcgtgggccgagtctgcgaacgacaactgtcacaggaaaaatcatccatgaatggtgttgtcgatcatgtacgctcccaccgttaagatttaagggagaagatggatgttggtacggcatggaaattcgacctgtcaaagaaaaagaagaaaatctagtaaaaagcatggtatcagcagggtctggcgaggtagattcattctcgcttggcttattatgcatttcaataatgattgaggaagtgatgcggagtcgatggtcaaggaaaatgttaatgacaggaacgctagctgttttccttttattgattatgggccagttaacttggaacgacttaattaggttatgtattatggtgggcgccaatgcctccgaccgtatgggcatgggtaccacttatcttgccttaatggccactttcaagatgaggcctatgtttgctgtgggcttattatttcgacgactgacatcgagagaagttctactattaactataggtttgagtttagttgctagcgtggaacttccaaattcccttgaagaactgggtgatggcctagcaatgggtataatgatcttaaaactcttaacagattttcaatcacaccaattgtgggcaaccctgttatctctcacttttattaagactaccctatctctgcattatgcgtggaaaacaatggctatggtactgtctatagtttctttatttcccctctgcctttcaactacaagtcagaaaactacttggctgcctgtactactcggatcactaggatgtaaaccattgactatgttcttgattactgaaaacaaaatttggggcagaaagagctggcccctaaacgagggtataatggcagtgggagtagtaagcatactgcttagttccttgttaaaagacgatgtgccattggcagggccattgattgctggtggaatgcttatagcatgttacgtaattagtggatcgagcgcagatttatctcttgaaaaagctgcagaggtgagttgggaagaagaagcagaacatagtggagcaagtcataatatcctggtagaagtccaagatgatggaaccatgaaaatcaaagatgaagaaagggatgacaccctgactatactactaaaggctacactcttagctgtatcaggggtctaccccctatcaataccggcaacactattcgtctggtacttctggcaaaagaagaaacaacggagtggggtcttatgggatacacctagtccaccagaggtagaaagagctgtgttagacgatgggatatatagaataatgcaacgcggtctacttggacgttcacaagtcggagtgggcgtctttcaagaaaatgtatttcacacaatgtggcatgtaacaagaggtgctgtactaatgtaccaaggaaaaagattggaaccatcatgggctagtgtgaagaaagatctaatatcgtatggtgggggttggagattacagggtagttggaacacgggggaagaagtacaagtaatcgcggtagaacccggtaaaaatcccaaaaatgtccaaacagctcctggaacattcaaaactccagaaggagaagttggcgcaatagctttagactttaagccaggtacatcaggttctccaattgttaaccgtgagggaaagatagtcggattatatggtaatggtgttgtaactacttctggcacatacgtgagtgctattgctcaggcaaaagcatctcaagaaggaccattaccagagattgaagatgaagtctttcgcaaacgaaacttgactataatggacctgcatccaggatctggaaaaactagaagatatttaccagcaatagtacgcgaggccatcaaaagaaaattaagaaccttaatattagcaccaactcgggttgtggccagcgaaatggcggaggctttaaagggaatgccaattcgatatcaaaccacggcggtaaaatcggaacatacgggaaaagaaatagtagatttaatgtgccatgccacttttacaatgagattattgagtccagttagagtaccaaattataacatgattattatggacgaagcacattttacagatccttcctcaatagcagcaagaggatacataagcacaagggtaggtatgggcgaggctgcagccatatttatgactgcaacaccacccgggtcggtggaggcatttccgcaaagcaatgcggtaatacaggacgaagaaagagacataccagagcgtagttggaactcaggctacgaatggataaccgacttcccaggaaaaacggtgtggtttgtgccttcaataaaatcagggaatgatattgcgaattgtttacgaaagaatggaaaacgagtaattcagttaagcagaaagacattcgacactgagtatcagaaaacgaaaaataacgattgggattatgttgtgactacagacatatccgaaatgggtgcgaattttagagcagaccgagtaatagacccgagaagatgtttgaaaccagtgatattaaaagacggaccagaaagagtcatattggcgggacccatgccagttacagtagcatcagcggcacagaggagagggcgaataggtcgaaaccataacaaagaaggcgatcaatatatttatatgggacaacctctcaacaatgacgaagaccacgcacattggacagaagcaaagatgctcttagataatatcaacacaccagaaggtattattccagctctctttgaaccggaaagagaaaagagcgcggcaatagatggcgaatacagattgagaggggaagcgcgaaaaacttttgtagaactaatgagaagaggtgacttacccgtatggctatcctataaggtagcatccgagggattccaatacagtgatcggagatggtgttttgatggtgaaagaaataatcaagtactagaggaaaatatggatgtcgaaatctggacaaaagagggagaaagaaagaaattgcggcccaggtggctggatgctagaacctattcagaccccctggccttgcgtgaatttaaagaatttgctgccggtcgtagaagcgtcagtggagatctgatactcgaaattggaaaattgccacaacatctgacacaacgagctcaaaatgccctggacaacttagtcatgctccacaattcagaacaaggagggcgcgcatatcgacacgctatggaagaattaccagatacgatagaaaccctaatgctgttggcccttattgcagtccttacaggaggagtaacactattctttctgagcggtcgaggattgggaaagactagcatagggttattatgtgtcatggcgtcttctgttctactgtggatggctagcgttgaaccccactggatagcggcatctataatcctagaatttttcttaatggtactcttaatacctgaacctgatagacaacgaactccacaagacaaccaactagcatacgttgtaataggcttgctttttatgatattaacggtagctgcaaatgagatgggcttattagaaacaaccaagaaagatctaggcattggccatgtagcagttgaaaatcaccatcatgcaacgatgttggacgtggacttacacccagcaagtgcatggacgctttatgcagtcgcgacgacaattataacccccatgatgagacacactattgaaaatacaacagcgaacataagtctcaccgcaatagctaaccaagcggcaatattgatgggactggataaaggatggccgatcagtaagatggatataggagtaccgttattagctttaggttgttatagccaagttaaccctctaactctaacagcagcagtcttaatgttagtagcccactacgcaataataggaccggggcttcaagctaaagccacgcgggaagctcagaagagaacagcggcaggaattatgaagaatcccacagttgacggcatagtcgccatcgacctggaccctgtggtctacgatgcaaaatttgaaaaacaactcggacaaatcatgctactaattctgtgtacgtctcaaatccttctaatgagaaccacatgggccttatgtgagtcgataaccttagccacaggcccattaacaactctgtgggaaggtagtcctggaaaattctggaacactacaatagcagtgtcaatggccaatattttccgagggtcttatctagcgggcgctggattggcattctcccttatgaaatctttaggaggcggtagacgaggaacgggagcacaaggcgagacactaggtgagaagtggaaacgacaattgaaccaactgagcaagagtgaatttaatatatacaaaaggtctggtatcatggaggtggatagaagcgaagctaaggaaggtctgaaacgaggagaaacgactcgacacgccgtctctcgaggcacagccaaactccgttggttcgtggagagaaatctggtcaagcctgaaggaaaagtaatcgacctcggttgcggaagaggcgggtggagctactattgcgcaggtttaaagaaagttacagaagtgaaaggttacaccaaaggtggccctggacacgaggagcctattccgatggctacatatgggtggaacttagttaaactacatagtggaaaagatgtcttctttacaccgcccgaaaagtgcgatacattgctatgtgacatcggagaatcgtctccaaatccgacaatagaggagggtagaacactgcgagtgttgaaaatggtcgagccatggttaagagggaatcaattttgtataaagatactgaacccttacatgccaagcgttgtcgaaacgctagaacaaatgcaacggaaacatgggggcatgttggtccgtaaccctctgtctaggaacagcacgcatgagatgtattgggtatcatgcggaaccggtaacatcgtaagtgctgtgaacatgacgtcgagaatgctattaaaccggttcactatggctcacagaaaaccaacatatgagagagacgtcgatttaggagctggaacacggcatgttgctgtagaacccgaggttgctaatttagatataattggtcaacgcatagaaaatataaaacacgaacataaatcaacgtggcattacgatgaggataatccgtataagacttgggcataccatggatcgtacgaagttaaaccatctggatctgcgtcttcgatggtcaatggagttgtaaagctactaacaaaaccctgggacgtaattccaatggtgacccaaattgcaatgaccgatactacaccttttggtcagcagcgagtattcaaggaaaaagtagatacacgaactcccaaggcaaagagaggtactgcacagataatggaagtgacggcaagatggttatggggatttttgtcgaggaataagaaacctcgtatatgtactagagaggagttcacaagaaaagttcgatcaaatgcagccattggagcggtttttgttgacgaaaaccaatggaactccgcaaaagaagcggttgaagatgagcgattttgggatttggtacaaaaagagagagaacttcataagcaaggaaaatgtgcaacatgtgtatacaatatgatgggaaagagagagaagaaacttggcgaatttggaaaagcaaagggtagtcgcgcaatctggtacatgtggttgggagcgcgttttctcgaatttgaggccctaggatttatgaatgaagatcattggtttagcagggaaaattctctcagtggagtggagggggaaggactacacaaactaggatatattcttcgcgatatatctaaaattccgggtggcaatatgtatgctgatgacaccgctggttgggacacacgtattacagaagacgacttacaaaacgaggctaaaatcactgacatcatggaaccagaacatgctctactagcgacctcaatattcaaattgacatatcaaaacaaagtcgtaagagtgcagcgtcccgcgaaaaatggcacggtaatggatgtaataagtaggagagatcagagaggctcaggacaagtcgggacatatggactcaacacattcactaacatggaagcgcaattgatccgacaaatggaatcggagggaatttttctaccttcagagttagagacacccaacctagcagaacgcgtcttggactggcttgaaaaatatggagtcgaacgactgaagagaatggctatcagtggagatgattgtgtcgtaaaacctatcgatgatagatttgccactgctttaacggccctaaatgatatgggcaaagttagaaaggatatcccccaatgggaaccgtcaaaaggctggaacgactggcagcaagttccgttctgctctcatcacttccatcagttgatcatgaaagatggccgagaaatagtagtaccatgcaggaatcaggatgaattagtaggtcgggcccgagttagtcaaggcgccggatggagcttacgagaaacggcctgccttggaaaatcatacgcacaaatgtggcaactcatgtattttcatagaagagacttacgactagcggcgaatgccatatgtagtgcagtacccgttgactgggtaccgacgtcgagaacaacgtggtctatacacgcacatcatcaatggatgacaacagaggatatgttatccgtttggaacagagtctggatagaagaaaatccatggatggaagataagacgcatgtatcaagttggggagatgtaccatacctgggaaaacgagaagatcaatggtgtggttcactgataggtttaaccgctcgagctacatgggccagcaatattcaggttgcgattaatcaagtaagaagactgattggaaacgaaaattatttagattacatgaccagtatgaaaagattcaaaaacgaaggagacccagaaggagctctatggtaa

SEQ ID NO: 21552 - RNA, 9879 nt, synthetic construct
  misc_feature 1..9879: note = derived and/or modified CDS sequence (opt6) from DENV-1__FJ461308__SS-prME
  source 1..9879: mol_type = other RNA
agcgttacgatgctcttgatgttaatgcctacagccttagcatttcacctaacaacacgaggcggtgaaccacatatgattgttagtaaacaagaacgcggtaaatccttgctatttaaaacatctgccggagtaaacatgtgtacgctaattgccatggaccttggagagttttgtgaagataccatgacttacaaatgtcccaggataacggaagcggaaccagatgatgtagattgttggtgtaacgctaccgatacgtgggtgacttatggaacgtgctcacaaactggggaacacaggcgtgataaacgatctgtggcactagcccctcacgttggtctcggacttgaaacaagagctgaaacatggatgagttcagagggtgcttggaaacaaatacaacgtgttgaaacctgggctctccgtcatcctggtttcactgttatagctctttttctagcacacgcaattgggacaagtattacgcagaaaggtataatctttatactgttaatgctagttacaccgagcatggcaatgagatgtgtaggaatcgggtcacgggattttgtagagggcctttcaggggcaacatgggtcgatgttgtccttgaacatggttcttgcgtaaccacaatggctaaagacaaacccactttagatatcgaactactaaaaactgaagtaacgaacccagctgtattacgaaaattatgcatagaagctaagatcagcaataccacgaccgatagccgatgcccaacacaaggagaagctacactggtcgaagaacaagacgcaaatttcgtatgcagaagaacatttgtagatcgtggttggggtaacggatgtggcctattcggtaaaggcagcttaataacatgtgcgaagtttaaatgcgttaccaagttagaaggaaagacagtacaatatgaaaatttaaaatatagtgtcatcgttactgttcatacaggagatcaacatcaggtgggtaatgagtcaaccgaacacggtactacagcaactatcacgcctcaagccccaagtacggaaattcagttaactgactacggagcgttaactctagattgctctccccgaactggtctggatttcaatgaaatggtgcttttgacgatgaaagagaaaagttggttggtgcataaacaatggtttctagatttgcctctaccgtggacgagtggtgcaagtacatcacaagagacttggaatcgtaaagacctgctagttacattcaagacagcacacgcgaagaaacaagaagtagtagttcttggttcacaagagggagccatgcatacagcactaacgggagcaactgaaatccaaacttcaggtacaacaacaatattcgcaggacacctaaaatgtcgactaaaaatggacaaattaacactcaagggtatgtcctacgttatgtgcacaggctcgttcaagttagaaaaagaagttgcagaaactcagcatggcactgttctagtacaaataaaatatgaaggtaccgatgccccttgtaagatccccttctctactcaggacgaaaagggtgtgacacaaaatggccggctcataactgcgaatcccatcgtaactgataaagaaaaacctgtaaatattgaagcggagccaccatttggagaatcttgtatagtgataggagcaggcgagaaagcacttaaacttagttggtttaaaaaggggtcttccatcggtaaaatgtttgaagcgaccgcccgtggagcaaggcgaatggcgatcttaggcgacacagcttgggattttggctccataggtggagtcttcacttcggtgggcaaattggtccatcagatattcggaaccgcttacggagtcctcttttctggtgtatcctggacaatgaaaattgggataggtgtacttttaacttggctcggtctaaatagtaggtcaacaagcctatcgatgacatgtatcgccgtgggcctcgtaactctttacttaggcgtaatggtacaagccgattctggttgtgtaataaactggaaaggacgtgaacttaaatgtggcagtggtatatttgtaacaaacgaagtacacacgtggactgagcaatacaaattccaagcggattcacctaaaagactcagtgcggcaataggcaaagcatgggaagaaggtgtttgcggaataagaagtgcaacgcgattagagaatattatgtggaaacaaattagcaatgagttgaaccatatccttctagaaaacgatatgaagttcacagtagtagtaggagatgtagcaggaatactcgcgcaagggaaaaagatgataagaccacaacctatggaacataaatattcatggaaaagctgggggaaagcaaaaatcatcggagccgacgtacaaaatactacttttatcatagatggacctaacacaccggaatgcccggatgatcaaagggcttggaatatttgggaagtcgaagattatggtttcggaatctttacaacaaacatctggttaaaactgagggattcatatactcaagtttgcgatcatcgactaatgagtgctgcaattaaggatagtaaagcagtccacgctgacatgggctactggatcgaaagtgagaaaaatgaaacatggaaacttgcccgtgcgagctttatagaagtcaaaacgtgtatatggccgaaaagtcatacactttggtccaacggagttcttgagagcgaaatgatcattccaaagatatacggcggacctattagtcaacacaattatcgacctggctacttcacgcaaacggcaggaccttggcatctgggaaaactagaattagacttcgatctatgtgaaggaacaacagttgtagtggacgaacattgcggaaatcgtggcccttccttgagaaccacgactgtcactgggaaaatcatccacgaatggtgttgtcgttcttgcaccctaccacctctacgcttcaaaggagaggatggttgctggtacggcatggaaatcaggccggtaaaggaaaaggaggaaaatttagtaaaaagtatggtaagtgctggctcaggcgaggtagatagcttctctctaggattattatgcatttccatcatgattgaggaagtaatgcgttcaagatggtctcgaaaaatgctcatgacaggaactttagccgtattctttctactaattatgggacaactaacctggaacgatcttatcaggttatgtataatggtaggagcaaatgcatcagatagaatgggcatgggaacgacatatctcgcgttaatggccacctttaaaatgagaccaatgttcgctgtcggattgttattcagaagattaaccagtagagaagtactactactcacaattggcctcagtttggtggcctcggtagagcttccaaattcgttagaagaactcggagatggcctagcaatgggtataatgattctaaaacttttgacagacttccaaagccaccaactctgggcaacacttctatcccttaccttcatcaaaacaacgttctctttacattatgcatggaaaacaatggcgatggtactatcgatcgtcagtttgtttccattgtgtctgagtacaacaagccagaaaactacttggttgccggttttgctagggagtctagggtgcaagccattgaccatgttcctcattgctgaaaataagatttggggcagaaaaagctggcccttaaatgaaggaattatggctgtcggaatagtaagtatactgttaagttcattacttaaaaacgatgttcctctagcaggaccacttattgcaggaggaatgctgattgcttgttatgttatatcaggtagttctgccgatttatccttagaaaaagcagccgaagtgtcttgggaagaggaggcggaacactcaggtgcaagccacaacattttagtagaagtgcaagacgacggaacgatgaagataaaagacgaagaaagggacgatacccttacaattttgcttaaagccacgttactggcagtatcaggagtttacccacttagtataccagctactttatttgtgtggtatttttggcagaagaagaaacaacgaagtggagtgttgtgggacacgccatccccaccagaagtggaaagagcggttttggatgatggaatatatcgtatcatgcaaagaggacttctaggacgaagtcaggtaggggtcggagtatttcaggaaaacgtatttcacacgatgtggcatgtaacacgaggagcggtactaatgtaccaaggaaaacggctagaaccttcatgggcgagtgtcaagaaagacctaatatcgtatggaggtggttggcggttacaagggtcatggaataccggagaagaagtacaagtgatcgcagttgaacccggcaagaatcccaaaaatgtgcagaccgcaccgggaacttttaaaacttcagagggagaagtcggagcgatagctttagattttaaacctggcacttctggatcaccaattgtaaatagagaaggaaaaatagtaggactatatggtaatggagttgttacgacaagcggtacatacgttagtgctatagcacaagcaaaagcatctcaagagggccctttaccagaaatagaggacgaggtctttcgtaaacggaatcttacaattatggatcttcatcctggatctggaaaaaccagacgctacctaccggctattgtacgggaagcaatcaagcgcaaactaaggactttaatcctagctccaacaagggttgtagcgtccgaaatggcagaagcgttgaaaggaatgcccatacgttaccagactactgctgttaaatcggaacacactgggaaagaaatcgtagaccttatgtgtcacgctactttcacgatgagattacttagtcctgtaagagtaccaaactacaacatgatcataatggacgaagcgcatttcacagacccttcatcaatagcggcaagaggatatataagtactagggtaggaatgggcgaagcggcagcaatatttatgacagccacacctcctggatcagtggaggcatttcctcaatcaaatgcagtaatacaggatgaggagcgcgatataccagagagatcatggaactccggatacgaatggataacagattttccaggaaaaacagtctggtttgtacccagtataaaatccggaaatgatattgcaaactgcctccgaaagaacggtaaacgggtgatacaattatcaaggaaaacatttgatactgaataccaaaagacgaagaataatgattgggattatgtagtaacgactgatataagtgaaatgggtgcaaacttccgggctgatagagttatcgacccaagacgatgcttaaaacctgtaattctaaaggacggtccagaacgagtaatcctggccggaccaatgcctgtaactgtcgcgtccgcagcgcagagacgtggacgtataggcagaaaccacaataaggagggagatcagtatatatatatgggacagcctttaaacaacgatgaagatcacgcacactggacagaagccaaaatgttgctcgataacatcaatacaccagaaggtataatccctgctttatttgaacctgaaagagaaaaatctgcagcgatagacggcgaatatcgtttacgcggggaagctcgtaagacatttgtagaattaatgcgaagaggagatttgccggtgtggttatcatataaagttgcatctgagggttttcaatattccgataggagatggtgctttgacggggaaagaaataatcaggttttagaagaaaacatggacgtagaaatttggacaaaagaaggagaaaggaagaaactacgccctcgatggttggacgccagaacatatagtgacccactggctttacgagagtttaaggagtttgccgctggtcggaggagtgttagcggtgaccttattcttgagataggtaaacttccacaacacctaacacaacgtgcacagaatgcactggacaatcttgtaatgcttcacaattcagaacaaggtggacgggcatatcgccatgcaatggaagaattacctgatacaatagaaacactaatgctcctggctttaatagcggtacttacagggggtgtcactttattcttcctaagtggaagagggctaggaaaaacctccatcggcctattatgtgtgatggcaagttcagtcttactgtggatggcatctgtagagccacattggatagctgcgtccataatcctagagttctttctaatggtactactcataccagaaccggacaggcaacgaacaccacaagataaccaactcgcttatgtcgttatcggcctacttttcatgatattaacggtagcagccaacgagatgggactcttagaaacaactaagaaagaccttgggattggacatgtggcagtagaaaaccaccaccatgcggccatgctagatgtagatctccatccagcatcagcgtggacattatatgcagttgctaccacaattatcacaccgatgatgcgacacactatagagaatactacagctaacataagtttgacggcaattgcaaatcaagccgcaatattaatgggacttgataaaggatggccgataagcaagatggatatcggagttcctctattagcgctaggctgttactctcaagtgaaccctctcactctaactgccgcagtgttaatgctggtagctcactacgcaataatagggcccggacttcaagcaaaagctacccgtgaagcacaaaagcgtacagctgcaggcataatgaaaaatccaaccgtcgacgggatagttgcaatcgatttagatccagttgtatatgacgcgaagttcgaaaaacaattgggtcagataatgttgctcatcctctgcacttcacaaatacttctgatgcgtacaacatgggcattatgcgaatccataacactggctacgggtcccttgacaactctatgggaaggatcgccaggtaaattctggaataccacaatagccgtttctatggcaaatatatttagaggcagctaccttgccggtgcaggactagcgtttagtctaatgaaatcacttggtggtggccgacgaggtaccggagcacaaggagaaacactcggagaaaaatggaaacgtcaactaaatcaactaagtaagtcagagttcaacacttataaaagatcgggaatcatggaggttgatagaagtgaggcgaaagaaggcctgaaaagaggggaaacaactaaacatgcggtaagtaggggaacggcaaaacttcgctggtttgtcgaaaggaatcttgttaagccagagggtaaagtaatcgatctaggttgtggaagaggtggatggtcatattattgcgctgggctcaagaaagtaacagaagtgaaaggatatacaaaaggaggcccgggacacgaggaaccgattccaatggccacatatggttggaacctggtaaaattacacagcggaaaagatgtcttcttcattccaccggaaaaatgtgatactttgctatgcgatattggcgagagttcccccaaccccacaattgaagaaggtaggactctgagggtgctaaaaatggtggagccttggttaagaggaaaccaattctgtatcaaaatactaaacccttatatgccatcagttgtggagacgttagagcaaatgcaaagaaagcacggtggcatgttggttagaaatcctctcagtcgtaactcaacacatgaaatgtattgggtgagctgcggaacaggtaacatcgtatctgcagtaaatatgacatcccggatgctacttaatagatttacgatggcacaccgaaaacccacttatgaaagagacgtagatctcggcgcaggcacaagacatgtcgctgtagagcccgaagtggctaatctggacattataggccagagaattgaaaatattaaacacgaacataaatctacttggcactatgacgaagataatccctataaaacatgggcataccacggttcatacgaagtgaagccatcaggaagcgcatccagcatggtaaacggcgttgtcaaactactaacaaaaccgtgggacgttatacccatggtcactcaaatagctatgaccgacactaccccatttggtcaacaacgtgtcttcaaagaaaaagtcgatactcgaacaccaaaagctaaaaggggaactgcacaaatcatggaagtaacggcaaaatggctctggggtttcctcagcaggaataaaaagcctagaatatgtacacgtgaagaatttactcgaaaagtgaggtcaaatgcagcaataggtgcggtttttgtagatgaaaaccaatggaactccgctaaagaagctgtggaagatgaacggttttgggatttagtccatagggagagggagttacataaacaaggaaaatgtgcgacatgtgtatataacatgatgggaaaaagagaaaagaaactaggtgaatttggcaaggcgaaagggtcaagggcaatttggtatatgtggctcggcgcaagatttttagaatttgaagcgctgggctttatgaacgaggatcactggttcagcagagaaaattccctctcaggggttgaaggtgaaggattgcacaagttaggatatatcctcagagacattagtaaaatacctgggggcaacatgtatgccgacgatacagcaggctgggatacgagaattactgaagatgatctacaaaacgaagcgaaaataacagatataatggagccagagcatgctttactggctaaaagtatattcaaactaacctatcaaaacaaagttgttagagttcaaaggccagcgaaaaacggtacagtaatggatgtcatcagtcgacgagaccaacgagggtcaggtcaagtaggaacttacggactaaacacatttacgaatatggaagcgcaattaataagacaaatggaatcagaaggtattttctcgccatctgaacttgagacgccgaatttagcagggagagttttagattggctagaaaaacacggtgttgaacgtttaaaacgaatggcgatatcaggagatgattgtgttgtgaaacccatagacgataggttcgccactgcgttgacagctttaaatgacatgggaaaggtaagaaaagacattccgcaatgggaacccagtaagggctggaatgactggcaacaggtccccttttgctcacaccatttccatcaactaatcatgaaggatgggcgtgagatcgtcgtaccctgtcgaaaccaagacgaattagttggaagggctcgtgtaagtcagggagcaggatggagccttagggagaccgcatgcctcggaaagtcctatgcacaaatgtggcaattgatgtacttccacagacgagacttgagactggcagcaaacgcaatatgctctgcagttcctgttgattgggtcccgacctcacggacaacttggagtatacacgcccatcaccaatggatgacaactgaagatatgttgtccgtttggaatagggtctggatagaagaaaatccatggatggaagataaaacacacataagctcttggggcgatgttccttatctcgggaaacgggaggatcagtggtgtggaagtcttatcggcttaacagctagagcaacctgggctacaaacatacaagtagcgataaaccaagtaagacgattaattggcaatgaaaactatctcgattatatgacaagtatgaaaagattcaagaacgaatctgacccggaaggggcactatggtaa

SEQ ID NO: 21553 - RNA, 9879 nt, synthetic construct
  misc_feature 1..9879: note = derived and/or modified CDS sequence (opt6) from DENV-1__FJ461310__SS-prME
  source 1..9879: mol_type = other RNA
tctgtaacaatgctactaatgctgatgcctactgctttagcgtttcatctcacaactcgaggcggggaaccgcatatgatagtatccaaacaagaaagagggaaatcattgctctttaaaacatccgcaggagtaaatatgtgtacgttaattgcgatggatctcggagaactatgtgaagatacaatgacttacaaatgtccacgaattacagaagcggaaccagacgacgttgattgttggtgtaatgccacagacacctgggtaacctacgggacatgctcacaaacaggtgaacatcggcgtgataagaggtcggtggccctcgctccccacgtaggactcggtttggaaacacgaaccgaaacatggatgtcatcggaaggagcctggaaacaaatacaacgagtggagacttgggcacttagacatcctggatttacagttatagcactatttttggctcacgcgataggaacaagcatcacacaaaaaggtataatatttatattgttaatgttggtaacccctagcatggctatgagatgtgttgggattggaagtcgagactttgtggaaggactttcaggcgcaacttgggtagacgtcgtcctcgaacatgggtcctgtgttacaacgatggcaaaagataaaccaaccctcgacattgagctgttgaaaacggaagtgaccaacccagccgttctaagaaaactctgtattgaagctaaaatatccaataccacaacagatagtcggtgtcccacccaaggcgaagctaccttagttgaagaacaagatgcaaacttcgtatgccgcagaacgtttgttgatagaggatgggggaatggatgtgggctatttggtaaaggttcactcataacatgtgcaaaatttaaatgtgtaactaaactagaaggaaagatagtacaatacgaaaaccttaaatactccgtaatagtaactgtgcacacaggcgatcaacatcaagtcggcaatgaatctacggaacatggtacgacagcaactattactcctcaagctccaactacagagatacaactgactgactatggagcacttactttggactgctctccacgtaccggtctagattttaacgaaatggtcctgttaacaatgaaagaaaaatcctggttagtgcataaacaatggttcttggacctacctctcccttggacatcaggtgcgtcaacgtctcaagaaacctggaaccgtcaagacctactcgtcacgtttaaaaccgctcacgctaagaagcaagaagttgttgtattaggttctcaagaaggagccatgcacacagctctcacgggagcaaccgagatacaaacgtctggaacaaccaccattttcgccgggcacctaaaatgccgactgaaaatggacaaattgacgttgaagggaatgagttatgttatgtgcactggtagcttcaaacttgaaaaggaagttgctgaaactcagcacggcacagttttagttcaaataaaatatgaaggcacggatgcgccttgtaagatacctttttcgactcaggacgaaaaaggcgttacgcaaaacgggagattaatcacggctaacccgatagtgacagataaagaaaagcccgtaaatatagaggcagaacccccgtttggtgaatcttacatcgtaatcggagctggagaaaaagcacttaaattatcatggttcaagaaaggatcatcaataggaaagatgttcgaagcgacggcacgaggtgctagaagaatggccatactaggtgacaccgcttgggattttggatccattggaggggtttttacaagcgtaggtaagttggtacatcagatttttggtacagcctatggggtgctattcagtggtgtgtcatggactatgaaaattggaataggggttctgcttacctggctagggctcaactctcgatcaacatcgttatctatgacatgtatagccgtcggattaataactctatacttaggtgttatggtccaggcagattctggttgtgtaataaattggaagggccgcgagctcaaatgtggctcaggcatatttgtgacaaatgaggtacatacctggaccgaacaatataaatttcaggcagacagtccaaaaagactaagtgcggcgatcggcaaggcatgggaggaaggcgtatgtggcatcagaagtgcgacaaggctcgaaaatatcatgtggaaacagatttctaacgaattaaaccatattctgttagagaatgatatgaaatttaccgtcgttgtaggcgatgtcgccggtatattagcccaaggaaagaagatgataaggccacaacctatggaatacaagtattcctggaaaagctggggtaaagcaaagattattggagctgatgtacagaatacgacctttattattgacggacctaatactcctgaatgcccagatgaccaaagggcatggaacatatgggaagtagaagattatggatttggtatatttacaacaaacatttggcttaaacttcgggatagctatacacaggtttgtgaccacagattaatgtctgcggccatcaaagacagcaaagccgttcatgcggacatgggttactggatagagagcgagaaaaatgaaacttggaaactcgcacgagcatcattcatagaagtaaaaacatgtatatggcccaaatctcacacattgtggagcaatggcgtactggaaagtgagatgattattccaaaaatatatggaggacctatatcgcagcataattatcgacctggatattttacacaagctgctggtccctggcacttagggaaactcgaacttgactttgatctgtgtgaggggacaacagtcgtagttgatgaacactgtggtaatagaggcccatctttgcgaacaacaactgtcactggaaagataatccacgagtggtgttgccggtcatgcaccctaccaccattacgttttagaggagaagacggatgttggtatggaatggagatacgaccggtcaaagaaaaagaagaaaatctagttaaatcaatggtatcagccggaagcggtgaagttgattcatttagtcttggtttactctgcattagcattatgatagaagaagttatgcgtagtaggtggagtcgaagaatgttaatgactgggacactagcagtattctttttattaataatgggacaacttacttggaatgatttaattagattgtgtattatggtgggcgcgaatgccagcgatcgcatggggatgggtaccacatatctcgcgcttatggcaacttttaagatgagaccgatgttcgcagtcggactactattccgacgtttaaccagtcgagaagttttattgctcacgataggcctgtctctagttgcaagcgtagaacttcctaactcactagaagaacttggcgacgggctcgcaatgggaataatgattcttaaactccttacggacttccaatctcaccaactatgggcaacgttactgtcacttacattcataaagacaactttctctctgcattatgcgtggaaaaccatggctatggtactttcgatcgtttcactctttccgctgtgcctatcaacaacaagccagaaaacgacatggttacccgtacttttagggagcttaggatgcaaaccactaacaatgtttttgatagccgaaaataaaatctgggggcgcagaagctggcccctcaatgaaggtataatggccgtaggaatagtaagtattttattaagcagtttgctcaaaaatgacgtgccgctagcaggacccctgattgctggcggaatgctgattgcatgttatgttatatcaggatcttctgccgatctaagccttgaaaaggcagctgaggtatcatgggaagaggaagctgaacatagcggggcatcccataatatactcgtagaagttcaagacgatggaactatgaaaattaaagacgaggaaagagacgacacacttactatactattaaaagcgacgttattagcagtaagtggtgtttatccactaagtatccccgctaccctatttgtatggtatttctggcaaaggaagaaacaaagatccggcgtactgtgggacacaccgagtccgccagaggttgaacgtgctgtattggacgacggaatctatcgcataatgcaaagaggtttattagggcgaagccaagtaggagtaggcgtattccaagaaaacgttttccatacgatgtggcacgttaccagaggggcagtattgatgtaccaggggaaaaggttggaaccatcgtgggctagtgtaaagaaggacttaataagttatggaggaggatggagactacaaggttcctggaatactggagaggaagtccaggtgattgcagttgaacctggcaaaaacccaaagaacgtacaaacagcaccaggtacatttaaaacacccgaaggcgaggttggagctattgccctggattttaaaccgggaacatcaggaagcccgatagtgaacagagaaggaaaaatagtcggcttatacggaaatggggtagttacaacgtcaggaacatatgtaagtgctatagctcaggccaaagcatctcaagaaggaccactgccagaaatcgaagacgaagttttcaggaaaagaaacttaacgattatggatttacaccccggaagtggcaaaaccagaagatatcttcctgcgatagtacgggaagcaataaaacgtaaattacgaacactaatattagcaccaacgagggtagttgcttcggaaatggcagaagcacttaagggaatgccaatcagatatcaaactactgcggtaaagagtgaacatacggggaaagaaatagtagatctaatgtgccatgcaacgtttacaatgcgcctattaagtcctgtgagagtacccaattacaacatgattattatggatgaagcacattttaccgatccatcgtccattgcagctagagggtacatatcaactagagtgggaatgggggaggcggctgcaattttcatgactgcaacacctcctggttcggtggaagccttcccacaaagtaatgctgttatacaggatgaggagagggatataccagaaagatcatggaactcagggtatgagtggattactgattttcctggaaagactgtctggtttgtgccttcgatcaaatccggaaacgacatagcaaattgtctaaggaaaaacggtaagagagtaatacaattaagcagaaagacctttgatactgaatatcagaaaactaaaaacaacgactgggactatgttgtaacaacagatatatccgaaatgggggctaactttcgcgctgaccgagtcatagacccgagacgttgtttaaaacctgtaattttaaaagatggcccggagcgcgtgatactagcaggtcctatgccagttacagttgcttcggcagcacagcgaagggggcgaattgggagaaatcataataaggaaggggatcaatatatatatatgggacagccacttaataacgacgaagatcacgcacattggactgaggcaaaaatgttattagacaatataaacacgcctgagggcataataccagcattgttcgaaccggaacgtgagaaaagcgctgccatagatggggaatatcgattacggggcgaagctagaaaaacattcgttgaactcatgagaagaggagaccttcccgtctggctatcttataaggttgccagtgagggattccaatattctgaccggaggtggtgtttcgatggagagcgcaataaccaagtattagaggagaacatggatgtagaaatatggaccaaagaaggcgagaggaagaaactaagaccgagatggttagatgcaagaacatatagcgacccacttgctttacgggaatttaaagagttcgcagcaggaagaaggtcagtatctggagacctaatactcgaaattgggaagttacctcagcatctaacacaaagagcacaaaacgcgctagacaatcttgtgatgttacataactcggagcaaggcgggagagcttataggcatgccattgaagaattgcccgatacgatagagacattaatgttattggccttaattgcggtattgacagggggcgttacgttatttttcttaagtggaagaggactaggaaaaacttccattggtctactttgtgtcatggcgtcaagtgtacttttatggatggcatcggtagaaccgcactggatagctgctagtatcatacttgagttctttcttatggttctactgattccagaacccgatcgtcaacgaactccacaggacaatcaattggcttatgtcgtaataggactactcttcatgattttgacggtagcagcgaatgaaatgggccttctggaaactaccaagaaagacctaggaataggccatgtcgctgttgaaaaccatcatcacgcagctatgctagacgtagatttgcatcccgcgtcagcctggacactctacgcagttgctacaactataattacgccaatgatgaggcacacaatagaaaacacaacagctaacataagcctcactgctatagctaaccaagccgcaatactaatgggtctagacaagggctggccaataagtaaaatggatattggagttcccttactagcattgggctgctatagtcaagtgaatccacttacattaacagcagctgtgttgatgttagtcgcacactacgcaatcataggtccggggctgcaagcaaaagctacaagggaagcgcagaaacgcacggcagctggtatcatgaaaaaccctactgttgatggtattgtagcgatagacctagatcccgttgtttatgacgcaaaattcgaaaagcaattaggtcaaataatgctcctgatcttatgtacatcgcagatactattaatgcgaaccacatgggcgttgtgtgaatctataaccttagctacgggccctttgacaacgctgtgggaaggatcccctggcaagttctggaacaccaccatagcagtttccatggccaacatctttcgtggcagctacttagctggggcaggattggcattttctttaatgaaatcacttggcggtggtcgaagaggtacaggcgcacagggagaaactttaggggaaaaatggaaaagacagcttaaccaacttagtaaaagcgagtttaacacatacaagcgaagtggtattatggaggtggatagaagtgaagcaaaggaggggttgaagagaggggaaactacaaaacacgctgtatctagaggcacggcaaaactaagatggtttgttgaacgaaatctggtaaaaccggagggaaaagtcatcgatctcggctgtggtaggggtggatggagctattattgtgctggattgaagaaagtaactgaagtcaagggatatacaaaaggcggtccaggtcacgaggagccaataccgatggccacgtatggatggaatctagtgaaattgcatagtggtaaagatgtgtttttcataccgccagagaaatgtgataccttattgtgtgatataggagaatctagtccaaatccaactatcgaagaaggaagaacattacgagtattgaagatggtagaaccatggctaagaggaaatcagttttgcataaaaatattaaacccgtacatgcccagtgtggtagaaactttagaacagatgcagcgaaaacatggcggaatgctagtacgaaaccctctcagtagaaatagtacccacgaaatgtactgggtcagctgtggaaccggaaacatcgtgtcagctgtaaatatgacctcaaggatgctattgaacagattcactatggcacatcgtaaacctacctacgaaagagatgtagacttgggagcaggtacccggcatgtagccgtagaacctgaagttgctaatttagatataataggacaacgaatagaaaatataaaacacgaacacaaaagtacatggcattacgatgaagacaacccttataaaacttgggcttaccatggctcgtacgaggtgaaaccgtcaggatcggctagctccatggtaaatggagtagtaaaattactcacaaaaccttgggacgttataccaatggttacacaaatagcgatgactgatacaactcccttcggtcaacagagggtttttaaggaaaaggtagatacaaggacgccaaaagcaaaaaggggaaccgctcaaataatggaagtgacagcaaaatggctatggggttttctatcgcgtaacaagaaaccacgtatctgtaccagggaagagttcacacgaaaagtaagaagtaatgcagccataggcgcagtgttcgtagatgaaaaccaatggaactcagctaaagaagcagttgaggacgaacggttttgggacctagtacatagggaaagagaactacataaacagggaaaatgtgcaacctgcgtatacaatatgatgggcaaacgagagaagaaacttggtgagttcgggaaggcaaaaggttccagagcaatatggtacatgtggttgggagcaagattcctagagttcgaggcactaggctttatgaacgaagatcattggttctccagagaaaattcactatcgggtgtggagggtgaaggactgcataaattaggatatattctacgagatatatcaaagataccaggagggaatatgtatgcagacgacacagctggatgggatacacgcataaccgaagacgacttacaaaacgaggcaaggatcacagatatcatggagccagagcacgcgctcttggcgaaatctatttttaaattaacataccagaacaaagtagttcgcgtgcagcgacctgccaaaaacggaaccgtgatggacgttatctcccggcgagaccaacgaggatcgggacaggtgggaacgtacggattaaatactttcacaaacatggaggcccagttgataagacaaatggaaagcgaagggatttttagtccgtcagaactcgaaaccccaaatcttgcagaaagagtgttagattggctagagaaatacggagttgaaagactcaaacgcatggcgataagcggcgatgactgtgtggtaaaacctattgacgaccgctttgcgaccgcattaacggctttaaacgacatggggaaagtacggaaagatattcctcagtgggagccgtcaaaaggctggaacgactggcaacaagtacccttttgcagtcatcactttcaccaactcataatgaaagacggtcgcgagattgtcgtaccatgcagaaaccaagacgaattagttggaagggctcgagtatcacaaggcgcagggtggtccctaagagaaactgcatgcttggggaaatcatacgcacaaatgtggcaattgatgtatttccacagaagagatttacggctagcagcaaatgccatttgtagcgcggttccagttgattggataccgacaagtcgaacgacctggtctatacatgcacaccaccaatggatgacaaccgaagacatgttatcggtctggaatcgggtctggatcgaagaaaatccatggatggaggacaaaacacacattagttcttggggagacgttccatatcttggaaaaagagaagaccaatggtgtggatcgttaattgggttaactgcaagagctacatgggcgacaaacatacaagttgcaattaaccaagtaagacgactaattggaaacgaaaactatttagactatatgacatctatgaaacggttcaaaaatgagtcagacccagagggtgctttgtggtaa

SEQ ID NO: 21554 - RNA, 9879 nt, synthetic construct
  misc_feature 1..9879: note = derived and/or modified CDS sequence (opt6) from DENV-1__FJ906728__SS-prME
  source 1..9879: mol_type = other RNA
agtgttacaatgttactgatgctaatgccgacagcgctagcattccacctaacaacccgaggtggagaacctcatatgatagtatcaaaacaagaaagaggaaaatctcttctatttaaaacctctgcaggagtaaatatgtgtactttaatagctatggacctgggggaactatgtgaagatacaatgacctataaatgtccaagaataacggaagctgaaccagacgatgtagattgctggtgtaacgctacggacacatgggttacatatggaacctgctcacaaacaggagagcaccgcagagacaaaagatcagttgccttagcaccacacgttggtcttgggcttgagactagaacagagacgtggatgtcatctgaaggagcttggaaacaaattcaacgggtagaaacgtgggctctaagacacccgggcttcactgtaattgcattattcttagctcacgctataggaacctccataacacaaaaaggtataatattcatactcttaatgttagttaccccatcgatggctatgcgatgtgttggaataggtagtagagactttgtagagggtttaagcggagccacatgggttgatgtggtattggagcacggttcatgcgtaacaacaatggcgaaagacaaaccgactttggacatagaattgcttaaaaccgaagtgaccaaccctgcggtactaagaaaattatgcatagaagctaaaatatcaaacacaacgaccgactcaagatgtccaacgcaaggagaggcaactttggtagaagaacaggatgcgaactttgtgtgtagacgtacctttgtagataggggttggggtaacggatgcggactatttggaaaaggatctctcattacctgcgcaaaatttaaatgtgtcacaaaattagaaggtaaaatcgtacaatatgaaaacctaaagtattcagtaatagtcacagtccacactggggatcaacatcaagtgggaaatgaaagtacagaacacggaactacggccacaataacgcctcaagcaccgaccactgaaattcaattaaccgactacggagcactgatactcgattgctctcctagaactggcttagattttaatgaaatggtcctactaactatgaaagagaaatcttggttagtacataaacaatggtttcttgatttacctctgccgtggacctctggggcctcgacttcgcaggagacatggaatcgacaggacctcttagttacatttaaaactgcacatgccaagaaacaagaagtagttgtcttaggatcgcaagaaggggccatgcacactgcactaacaggtgcaaccgaaatacaaacttcgggaacaacaacgatttttgcaggccacctaaaatgcagattaaagatggataagctaacgctaaaaggaatgtcatatgtaatgtgcaccgggcccttcaaattggagaaggaagtggcagaaacccaacatggtactgtcttagtacagattaaatacgagggaaccgacgcaccttgtaaaattccgttcagtacgcaggatgaaaaaggagtgactcaaaatggacgtttaatcaccgcaaatccaatagtcacagataaagagaaaccagtcaatattgaggcagaaccaccattcggagagtcatatattgttattggcgctggggaaaaagcgctcaaactctcatggttcaagaaagggtcgtcaattggtaaaatgttcgaagctacagcgagaggcgcacgccgtatggcaatattaggtgatacagcttgggactttggatccataggcggggtttttacgagcgtaggtaaattagttcatcagatattcggtaccgcctacggggtgttgttctctggggtcagctggaccatgaagattggcataggggttttactgacatggttaggattaaacagtcgaagtacatcattaagtatgacatgtattgctgtaggtttggtgaccctttatttaggggtcatggtacaagccgactctggctgtgtaataaactggaaagggagagaactcaaatgcgggagtggaatatttgtaacaaatgaagtacatacatggacagagcaatataaattccaggcggactccccaaaaaggttatccgctgcaatagggaaagcatgggaagagggagtttgcgggatcaggtccgcaactagattagaaaacattatgtggaaacaaataagtaatgagttaaatcatatactattggaaaatgatatgaagttgacagtagtggtcggggatgtagcagggattttgggtcagggtaagaaaatgataagaccgcaaccgatggaatacaaatatagttggaagtcatgggggaaggcaaaaattattggagctgacgcgcaaaatacaacattcatcatcgatggaccgaatacaccagaatgtcccgacgaccaacgcgcatggaacatctgggaagtagaagattatggatttgggatatttactacaaatatatggttaaaattaagagactcctatactcaagtatgcgaccacagattaatgtccgcagcgatcaaagattcgaaagctgttcacgcagatatgggttattggattgaaagcgaaaagaacgaaacgtggaagctagcaagggcctcattcatcgaggtaaaaacatgcatttggcctaagagccataccttatggtcaaatggggtcctggaatctgaaatgatcatacctaaaatctacggaggaccaatttcacagcacaattatcgacctggttactttacacagacagcggggccatggcaccttggcaaactagagttagactttgatctttgcgaaggaacgacagttgttgttgatgaacattgtggaaacagggggccgtctctacgaacgacaacagtcacgggtaaaattatccatgagtggtgctgccgtagttgtacccttccaccgcttagatttcgcggagaagacgggtgttggtatggtatggaaattaggccagtgaaagaaaaggaagaaaaccttgttaagagtatggtgagtgctgggagtggagaagtggactcatttagtcttggactcttatgcatttcaattatgatagaagaggtaatgaggtcaagatggagtagaaaaatgctgatgaccggcacactggcagtctttttcctgctgatcatgggtcaattaacgtggaacgatttaatcagactatgtataatggttggagcaaatgcgagtgataggatgggaatggggacaacatacctggctctaatggcaacctttaagatgcggcccatgtttgcagtaggcctcctgttaagaaggctaacgagtcgtgaagttctcctactaacgataggtttaagcctagtagcaagcgttgaattaccgaacagtctcgaagaattaggcgacgggctcgctatgggcataatgattctaaagttattaacggatttccaatctcaccaactatgggcgacactgctttcattaacatttattaagactaccttctcactacattatgcttggaaaaccatggccatggttttgtcaattgtatcattatttccactttgcctgagcacgaccagtcagaaaactacttggctgccagtactgctgggtagcttaggatgcaaacccctaactatgtttctaatcgcggagaataaaatatggggcagaaaatcatggccactgaatgaaggtatcatggcagttggtatagtaagtatcctattatcttctcttctaaagaacgatgtgcccttagccggaccattgatagcaggcggaatgttgatagcatgttatgtaataagtggttcaagcgcagatttgtcattggaaaaagccgccgaagtgtcgtgggaggaagaggcagaacatagcggagcgagccataacattctagtggaggtacaggatgacggcactatgaaaattaaagatgaagaacgagacgacactttgacaatcctcctgaaggccacattactagctgtatctggggtttaccctttatccatacctgcaacattgttcgtatggtacttttggcagaaaaagaaacaaagatccggtgttctatgggacacgccctcgcctccagaggtcgaacgcgcggtattagacgatggtatatacaggataatgcaaagaggcctgctaggacggagtcaagtaggcgttggggtcttccaagaaaacgtatttcacacaatgtggcatgtgacacgtggagctgtattgatgtatcaaggaaaacgcctcgagccatcatgggcatcagtcaagaaagatttgataagttatggaggaggttggcgcttgagagggtcatggaatacgggagaggaggtacaagtaatagctgttgagccaggcaaaaatcccaaaaacgtgcagaccgccccaggaacattcaaaaccccagaaggggaagttggtgctatagcgctagattttaaacctggaacgagtggctctcctatagtaaatagggaaggaaaaatagtgggtctttatggcaatggcgttgtaactacgagcgggacgtatgttagcgccatcgctcaagcaaaagccagtcaagaaggaccacttccagagatagaagatgaagtcttcagaaaaagaaacctgactataatggacctccacccgggcagcggtaagactagacgttatctacctgcaatagtgcgtgaagccattaaaagaaaactgagaaccctaattctcgcccctaccagagttgtagcatcagaaatggcagaggccctgaagggaatgccaataagataccagacgacagcagtgaaatcagagcacacaggtaaagaaattgtagatctcatgtgtcacgcaacatttactatgagattgctgtcacctgtgcgagtcccaaattataacatgattataatggatgaggcccatttcacggatccatcctcaatagcagctaggggatacataagtacccgagtgggtatgggggaagcagcggctatttttatgactgcaacgccacctggaagtgttgaggcctttccacaaagtaatgctgtcatacaggacgaagaaagagacataccggagcgatcatggaacactggatatgaatggattacagactttccggggaagacagtctggtttgtacctagcattaaaagtggcaatgatatagcaaattgtttacgaaagaatggtaagagagtgatacaattaagtagaaagacgttcgataccgaatatcagaaaaccaaaaacaatgattgggattatgttgtaacaacagatatctcagaaatgggtgcaaattttagagctgacagagtaattgatcctcgacgatgtcttaagccagtaatattgaaagacggccccgaaagggtgatattagctggcccaatgccagtaacagtagctagtgctgcacaacggcgtggaagaatcggaagaaatcacaataaagagggagaccaatatatttatatgggccaaccactaaataatgatgaggaccatgcgcattggacggaagcaaagatgttactcgataacattaacacacctgaaggcataatcccagccctgtttgaaccagaaagagagaagtctgccgccgttgacggagaatatcgactgcgcggagaagctcgtaaaacattcgttgagctaatgaggcgtggtgatttaccagtgtggctttcctataaggttgcatcagaaggctttcaatacagcgatagaagatggtgttttgatggagaaaggaataatcaggttcttgaagaaaatatggatgttgaaatttggacaaaagagggtgaaagaaagaagctaaggccacgatggttggatgccagaacgtatagtgacccgttggctctcagagagtttaaagaatttgcggcagggagacgatcagttagcggggatcttatcttggagataggtaaattgcctcaacatctgacacaacgcgcgcaaaatgcccttgataacttagtcatgttacataattctgagcaaggaggtcgagcttatcggcatgcaatggaggaattaccagacactatcgaaactttaatgctattagctttaatcgcggttttaacgggcggagtaacattgttctttttatctggcagggggttaggcaaaacaagcataggattattatgtgttatggcatccagtgtccttctatggatggcttcggttgagccacactggatagcagcttctattatattagagttctttctcatggtgctattaataccagaaccggatagacaaagaacaccgcaagataatcagttggcctatgtagtaatcggcttacttttcatgatattagcggtagccgctaatgaaatgggcctcctcgaaacaaccaaaaaggacctaggcattggtcatgttgcggtagaaaatcaccaccatgcagcaatgttagatgtggaccttcaccctgcgtccgcatggactttatacgctgtagctacaacaataattacgcctatgatgaggcatacaatagaaaacactactgctaacatctccttaacagccattgcaaatcaggccgcgatcttgatgggcctcgataaaggttggccaatatcgaaaatggatatcggtgtacctttattagcgctcggatgctattcccaagtgaaccctttaacactcacagccgcagtgttaatgttagtggcacattatgctatcattggacctggattacaagccaaagcgacaagggaggcccagaaaagaactgcagcaggaataatgaaaaatccaactgtcgatggtatagtggctatcgaccttgaccccgtagtctatgacgcgaaattcgagaagcaattgggacaaataatgttgctgatcctttgcaccagtcaaatccttttaatgcgaacgacctgggctctatgcgaaagtataactttggccacaggtccacttactactttgtgggagggtagtccagggaaattttggaatacaacgatagcggtatcaatggccaacatatttagaggttcatatttagctggggcaggattagcattctcgttaatgaaaagtctcgggggtggtcgaaggggtaccggggcccaaggggaaacgttgggagaaaagtggaaacgacaattgaatcaattaagcaagtctgagtttaacacatataaacgctcgggtatcatggaagttgatcgtagcgaagccaaagaaggacttaaaagaggagaaactactaaacacgcagtatcacgtggtaccgcaaaattacgctggtttgtcgaacgcaatttagtaaagccagagggcaaagtgatagacttaggttgcggtcgcggcggatggtcttattattgcgcaggtctaaagaaagttacagaagtgaaaggctatacaaagggaggaccaggacatgaagaaccaataccgatggcaacatatggttggaacttagtaaaactacattctgggaaagacgtctttttcattccaccagaaaaatgtgatacactgttatgcgatatcggcgaatcctctccgaatcctaccattgaagaagggcgaactctacgagttctcaaaatggttgagccgtggttacgaggaaatcaattttgtattaagattctcaatccctatatgccatctgtagttgaaacgttagaacaaatgcaacgaaagcacggtggtatgctggtaaggaatccgttaagtcgaaattcgacgcacgaaatgtattgggtttcgtgtggcacgggtaatatagtttcagccgtcaacatgacgagtcgtatgttattaaacagatttacaatggctcaccgaaaaccaacatatgaaagggatgtagacttaggtacgggaactaggcatgtagctgttgagcctgaagttgcaaacctggatattataggtcaaagaattgaaaatattaaacacgaacataagtcaacctggcattatgacgaagataacccgtacaaaacatgggcctaccatggctcttatgaagtaaagccgtcgggtagcgcttcaagtatggtgaatggagtggtaaaactactaactaagccctgggatgtcataccaatggttacacaaatagcgatgacagatacaactccgttcggacaacaacgtgtatttaaagaaaaagttgacactagaacacctaaggcaaaaaggggcactgcccaaataatggaagtgaccgctagatggctttggggctttttatctaggaataagaaaccaagaatctgcacaagagaggagttcacgagaaaggtacggtctaatgccgctataggagcagtcttcgtagatgaaaatcaatggaactcagctaaagaggccgtagaggatgaaagattctgggatctagtacacagagaaagagaattacataaacagggtaaatgtgcaacatgcgtttataacatgatgggtaaaagagagaagaaactaggcgaatttggtaaagcgaagggaagcagagcaatctggtacatgtggttaggtgctagattcttagagttcgaagctctaggattcatgaacgaggaccattggttctcacgggaaaactctctatcaggtgtagagggcgaaggccttcataaactaggatacatacttcgagatataagcaaaattccaggcgggaatatgtatgcagatgacacagcaggatgggatacaagaataaccgaagatgacttacaaaacgaagcgaaaataactgatataatggaacccgaacatgcgctattagctaaagctatttttaaattaacgtaccaaaataaagtggttagggttcaaagacctgcgaaaaatggtacagtgatggatgtaatcagtaggagagatcaaaggggctcaggccaagttggaacatacggtttaaatacatttacgaatatggaagcgcagttaattaggcaaatggagtcagaaggtattttcagtccaagcgaattggaaacgcccaatcttgccgagagagcattagattggctagaaaaatatggtgttgagagattaaaaagaatggctatatccggggatgactgtgtggtaaaacctatcgatgataggtttgctacggcgctcactgctttaaacgacatgggaaaagtccgaaaggatattcctcaatgggagcctagtaaaggctggaatgactggcagcaggtacctttttgttcgcatcattttcaccagcttataatgaaagatggaagagagatagttgttccatgtcgaaaccaagatgaattagtaggtagagcaagggtatcccaaggtgctgggtggtcgttacgtgaaaccgcttgtctgggtaaatcatacgcacaaatgtggcaacttatgtacttccatagaagagacttgagacttgccgctaacgccatatgttcggcagtaccagtagattgggtaccgacaagtcgtactacttggagtatccatgcacaccatcaatggatgacgactgaggacatgctatctgtatggaaccgtgtgtggattgaggaaaacccgtggatggaagataagacacatatatcatcatgggaagatgtcccttatctaggcaaacgagaagatcaatggtgtggtagtctgataggattgaccgcgagagccacatgggcaacgaacattcaagtagcaataaaccaagtcagacgactgatagggaatgaaaactatttagactatatgacgtcaatgaagcgctttaaaaatgaaagtgacccagagggagcattgtggtga

SEQ ID NO: 21555 - RNA, 9879 nt, synthetic construct
  misc_feature 1..9879: note = derived and/or modified CDS sequence (opt6) from DENV-1__FJ461313__SS-prME
  source 1..9879: mol_type = other RNA
tctgtaactatgctgttaatgttaatgcctactgctttagcattccatttaacaacacgaggtggagaaccccacatgatcgtaagcaaacaagaacgaggaaaaagtctacttttcaaaacatccgccggcgtaaatatgtgcacactaatagcgatggatctaggagaactatgtgaagatactatgacctacaaatgtcccaggataactgaagcagaacccgatgacgttgattgttggtgtaatgccacagacacttgggtaacgtacggtacttgctcccaaacaggtgaacaccgccgtgacaaacgatcagtggcgttggctcctcatgttgggttagggttagaaacccgtacagaaacatggatgagttcagaaggagcatggaagcaaatacagcgagtcgaaacctgggctctacgtcatcctgggtttacagttattgcactgttcctcgcccatgcaatagggacgagtatcacccaaaaagggattattttcatattacttatgttagtaactccatcgatggccatgagatgtgttggaattggatcaagagacttcgtcgaagggttaagcggcgccacttgggtagatgtagtattagaacatggatcgtgtgtgacgacaatggcgaaagataaacccactttagacatcgaacttttgaaaactgaagttacaaatcctgcagttctacggaagttgtgtatcgaagctaaaatttcgaatacaactacagacagtcgatgtccaacgcaaggagaagccacactggtagaagaacaggatgctaatttcgtttgtaggagaacttttgtagaccggggatggggtaacggatgtggcctatttggaaaaggcagtttgataacatgtgcaaagtttaagtgcgtaacgaaactagaaggaaaaattgtgcaatatgaaaatttaaaatatagtgttatagtcacagttcacacaggggaccagcatcaggtaggaaatgaatccaccgaacatggaactacagcaactataaccccacaagcccccactacagagatacaactaaccgactatggagcactgacgctggactgctctccaagaacaggtctcgattttaacgagatggttcttcttacaatgaaggaaaagtcgtggctcgtacataaacaatggttcttggatttaccattaccttggacttctggtgcctcaacatcacaagagacgtggaaccgtcaagatttgctagtaacattcaaaacagcgcatgctaagaaacaagaagtggtggtacttggatctcaagagggagctatgcataccgcactgaccggtgcaacagaaatacaaaccagtggtacgaccacaatctttgcaggccatctaaaatgtaggctaaagatggataaactaaccctgaaagggatgagctacgtgatgtgtacaggatcatttaagctggagaaggaggtagcagaaacccaacacggtactgttctggtacagataaaatatgaaggaaccgatgcaccttgtaaaattccattctctacacaagacgaaaagggtgttacacagaatggcagattaatcaccgcgaaccctatagttacggataaggaaaaaccagtgaatattgaagcagaacctccttttggagagagctatatagtaattggcgccggtgaaaaggcattaaagctcagctggtttaagaagggaagctcaatcgggaaaatgttcgaggcaactgcgcgtggtgcaagaaggatggcaattttgggcgacactgcctgggattttgggtcaattggaggggtattcacaagtgtgggtaagttagttcatcagatattcggaacagcatacggtgtgttgtttagcggcgtgtcgtggactatgaaaatcggaataggggtgttactaacatggcttggactaaactcacgaagtacgtccttatcgatgacttgcatcgcagttgggcttgtaactctatatttgggggcaatggttcaggcagattctggatgcgtaataaactggaaaggaagggagttaaaatgtggatcagggatatttgttacgaacgaagtgcatacttggacagagcaatataaatttcaagcagatagccccaagagattatcagcagcaataggcaaagcatgggaggaaggtgtatgcggaataagaagtgctacgcgacttgaaaatattatgtggaaacagatctcaaacgaattaaatcatattttactagaaaacgatatgaaactaacagtagtagttggtgatgtggctggaatactgggtcaaggtaaaaagatgataaggccacaacccatggaatacaaatactcgtggaaatcatgggggaaagccaaaataatcggagcagacgcacagaatactacattcattatagacggtcctaacacgccagaatgtcctgatgaccaacgagcttggaatatctgggaagtggaagattacggctttggtatatttaccacgaacatttggcttaaactaagggactcgtacacccaagtatgtgaccatagactaatgtcagcagcgataaaagatagcaaagcagtacatgctgatatggggtattggattgaaagtgagaaaaatgaaacatggaagttagctcgcgcatcatttattgaagtaaaaacatgtatatggccaaagagccatactctatggtcaaacggtgtactggaatctgaaatgataataccgaaaatatatggaggtccaatatcccagcacaattatagacctggatattttacacaaacggctggaccatggcatctggggaaactggaattagactttgatttatgcgaaggaactactgttgtagtggatgaacattgcggaaatcgtggcccatcactgagaacgaccactgtcactggaaaaataatacacgaatggtgttgtcgatcatgtactctgccgccgttgcgatttagaggagaagatggatgttggtacggcatggaaataagaccagttaaagaaaaagaagaaaatcttgtgaagtcaatggtcagtgctggctctggagaagtcgatagtttcagtctcgggctattatgtatatcaataatgatagaagaagttatgcgatcgcgatggtcccgcaaaatgttaatgacaggaacattagcagtcttcttcctcctcataatgggacaacttacgtggaatgatttaatacgattgtgcattatggtgggggccaacgcctctgaccgaatggggatgggaacaacatacttagctcttatggcaaccttcaaaatgagaccaatgtttgcagttgggttattgttcagaaggctaacctcgcgcgaagtattacttttaacaattggcttatcacttgttgcaagcgtagagttacctaattcgttagaggaattaggagatgggttagcaatgggtataatgatactaaaactactgacagattttcaatcacaccagctttgggcgacgcttctatcgctaacattcattaaaaccaccttttcattacattatgcatggaagaccatggccatggttttaagtatcgtctctctattcccattatgcttatcaacaacatcccagaaaacaacttggctccctgtgttattaggatctttgggctgcaaaccactgactatgtttctaattgctgaaaacaaaatatggggacgaaagtcgtggccgcttaatgaaggaataatggctgtaggaatcgtatcaatccttctttcgtccttattgaaaaacgatgtgcctctagccggtcccttgatagctggcgggatgctgatcgcatgttatgttataagcggttcttcagcagatttatcactggaaaaggcagccgaagtatcatgggaggaagaggcagagcattcgggagcgtcacacaacattcttgtagaagtgcaagacgatggcacgatgaaaattaaagacgaggaaagagatgacactctcactattctattaaaagctacattactcgccgtctcaggcgtgtatccattaagtatcccagcaaccctctttgtatggtatttctggcagaaaaagaaacaacgctcaggcgtcctttgggatacaccctcacctccggaggtagaaagagcagttcttgatgatggaatataccgaatcatgcaacgtggcctactaggaaggtcacaggtaggagtgggggtgtttcaggaaaacgtctttcacacaatgtggcatgtaacacggggcgctgtccttatgtatcaaggaaaaagacttgaaccatcatgggcgagtgtcaagaaagatttaatatcctatggaggaggatggcggttgagaggttcttggaatacaggagaagaagttcaggtaatagctgttgaaccaggtaagaaccctaaaaatgttcaaacagcaccaggtacttttaaaacacctgaaggggaagttggtgctatagccctagattttaaacctggaacgtcaggtagtccaatagtaaacagagaagggaaaatcgtagggctatatggtaatggagtagtgactactagcgggacttatgtgagcgcaatcgctcaagcaaaagcatcgcaagaaggacccttaccagagattgaagatgaagtattcagaaaaagaaatctaacaataatggacctccaccctggttcgggtaaaaccagacgttacttaccggctatagtcagagaggctataaaaagaaaactcagaacgttaatcttagcccccactagagtagtcgccagtgaaatggctgaggctttaaaaggaatgcctattcgctaccaaactacggctgtcaaatctgaacatacaggcaaggagatcgtagacctaatgtgtcatgcaacttttacaatgcgactactctcaccagtgcgtgtacctaattacaacatgataatcatggacgaagctcatttcactgacccttcgtcgatagccgccagaggctatattagtacgagagtaggaatgggggaagcggcagctatattcatgacggccacgccaccaggaagcgtggaagcattccctcagtcaaatgcagttatccaggatgaagaacgagatatacccgaaagatcgtggaactcgggatatgaatggatcaccgacttcccagggaaaacggtttggtttgttccctcgattaaatcgggaaatgacatagcaaactgcctaaggaaaaatggcaaacgcgtgatccaattatcaagaaaaacgtttgatacagaatatcagaagaccaaaaataacgactgggactatgtagtgacaactgatataagtgaaatgggtgcaaattttagagctgacagagtaatagatccaagaagatgcttgaagcccgtaatattgaaagacggaccagaacgagtgattttagctggaccaatgccagtaacggttgcaagcgcagctcagcgaagaggtagaataggtagaaatcataataaggaaggagaccagtatatctacatggggcagccattaaacaacgatgaagatcacgcacattggacggaagcaaaaatgttgctcgataatattaatacccctgagggtataatccctgcattgtttgagccagaaagagaaaaatcagctgccgttgatggagaataccgcttaagaggcgaggctcgcaaaactttcgttgaattaatgagaagaggcgacttgcctgtctggttaagctacaaggtagcgtcggaaggctttcaatatagtgatcgtagatggtgttttgacggagagcgcaataaccaagtcctggaggaaaacatggacgtagaaatatggaccaaggaaggagagagaaagaaattaagaccgcgttggttagatgctcgaacctacagtgacccgctggcacttcgagaatttaaggaatttgccgccggaaggcgttccgtaagcggagacttgatcttagaaataggaaaactacctcaacatttaacgcagagggcccaaaacgccttggataatttggttatgttacataacagtgaacaaggtggacgagcttataggcacgccatggaagaacttcccgacacaatagagacactaatgctactagcgctaatagctgttttaacgggtggcgtaactttattctttttatccggacgaggactcggaaaaaccagtatcggactattatgtgtaatggcttcatctgtattactatggatggcatctgtagagccccattggatcgcggcatcaataatccttgagttctttctgatggtcctgttgataccggaacctgatagacaacgaactccacaagataaccaactagcttatgtggttatcggactcctcttcatgattttgaccgtcgctgccaacgaaatggggctacttgaaacaaccaagaaagatttaggcataggtcatgtcgctgtagaaaaccaccatcatgctgcgatgctagacgtagacctacatcctgcctcagcttggacactatacgcggtcgcaactactatcataacaccgatgatgaggcacacgatcgaaaacacaacagcaaacatctctctgaccgccattgcaaaccaagccgcaatattaatggggttagacaaaggatggccaatatctaagatggatattggtgtgccgctcctcgcactgggatgctacagccaagtaaatcctctaaccttaacagcagcagtcctcatgctagtagcgcattatgcgattattggaccggggctccaagcaaaagcaacacgagaagctcagaaaagaacagcagcgggcataatgaaaaatccgacagtagatggaatagtcgcaatcgacctcgatccagtggtatatgatgctaaattcgaaaaacagctaggtcaaattatgttactaattttatgcacttctcagatattattgatgcgaacaacctgggcattatgtgaatcaatcactctggctacaggccccttaacaactttatgggagggatcaccggggaaattctggaatacgacaatagccgtctccatggctaacatcttcaggggttcatacctcgcgggcgctggtctagctttcagtcttatgaaaagcctaggaggtggccgtaggtctactggagcacaaggtgaaaccctaggagaaaagtggaagcgacaattgaaccaattgagtaaaagtgagttcaacacctataaacgttcaggtattatggaagttgatcgctctgaagcaaaagaagggttaaaacgtggtgaaacaacgaaacatgctgtttcaagaggaaccgcgaaactacgatggtttgtggagaggaatttagttaaaccggaagggaaagtgatagacctaggctgcggaagaggagggtggtcctattattgtgcaggactaaagaaggtcactgaggtaaaaggttatactaaaggaggcccaggccatgaagaacctatacccatggccacttatggatggaatttggtaaaactacactcgggcaaagatgtattctttatccctccagagaaatgcgacacgttactctgcgatattggtgagtcttcacccaatcccacaatcgaagaaggacgaacactacgggtgctaaagatggtggaaccatggctgagaggcaatcaattctgtattaaaatactaaatccttatatgcccagtgtcgttgaaactctggaacaaatgcagagaaaacacggcggtatgctcgtaagaaaccccttaagtcgaaacagtacccatgaaatgtattgggtcagttgtggaacgggaaacatagtttccgcagttaatatgacgtccagaatgcttctaaatagatttacaatggcgcacagaaaaccaacgtatgaacgggatgtagatctagggaccggaacacgacatgtagcagtagaacctgaggtagcgaatctggatataattggtcaacgaatagaaaatataaaacatgaacacaaaagtacttggcactacgacgaagataatccatacaaaacatgggcataccacgggtcttacgaagtaaaaccatcgggctccgcatcaagcatggttaacggagtagttaagctactaactaaaccctgggacgtaatacctatggtaacacaaattgcgatgactgacaccacacccttcggtcaacaaagggtgttcaaagagaaagtcgacacacgcacaccaaaagctaaaagagggacagcacaaataatggaagttacagcgcgatggctatggggatttctttctcggaacaagaaaccacgaatctgtacacgtgaagaatttacaagaaaagttaggtctaacgccgctattggtgcggttttcgtcgacgaaaatcaatggaatagtgcaaaagaggcagtagaagatgaaaggttttgggatttagtacaccgcgaacgagaacttcacaaacaaggaaagtgtgcaacgtgcgtttataacatgatgggaaaaagagagaagaaactgggcgagttcggtaaggcaaagggaagtagagcaatttggtatatgtggttgggcgcgcgatttttagaatttgaagctctcggctttatgaatgaagaccactggtttagcagggaaaacagtttaagcggtgtagaaggagaaggcttacataagttgggatatatcttaagggatatctcgaaaattccaggaggaaatatgtacgcagatgacacggccggctgggacacaaggattaccgaagacgatcttcagaacgaagcgaaaattacagacataatggaaccagaacacgcccttctcgctaaagcaatattcaaactaacatatcaaaacaaagtcgttagagtgcagagacctgctaaaaatggcaccgtaatggatgtaataagcagaagagatcaaaggggatctggtcaagtagggacttatggactaaacacatttacaaatatggaagcccaactaatccgtcaaatggaatccgaaggtattttctctccatcagagttggaaactcccaatttagcagagagggcattaaattggcttgagaagtatggcgtggaaagactgaagagaatggcaatcagtggagacgattgtgtagttaagcccattgatgacagatttgccacagccttaacagcactcaacgacatggggaaagtacgtaaagacattccgcaatgggaacctagcaagggatggaatgactggcaacaggtacctttctgttcgcatcattttcaccagctaatcatgaaagatgggagagaaatagtggtgccatgcagaaaccaagacgagctagttggtcgtgctcgagtatcacaaggggcaggatggtcgcttagagaaacggcttgtctaggaaaaagctatgctcaaatgtggcaattgatgtattttcacagaagggatctaaggctagctgctaacgccatctgttcagctgtaccagtagattgggttccgacctcccgcacaacatggagcatacatgctcatcatcaatggatgacaacagaagacatgctatccgtatggaatagagtttggattgaggagaatccatggatggaggataaaacccacatatcaagttgggaagacgtcccatatcttggtaagagagaagaccagtggtgtggctccctgataggtttaacagcgagggcaacgtgggcaacgaatatccaagtggcaataaatcaagtaaggaggttgattggtaacgaaaattatctggattatatgactagcatgaaacgttttaagaacgaatctgaccctgaaggggcgttatggtga

SEQ ID NO: 21556 - RNA, 9879 nt, synthetic construct
  misc_feature 1..9879: note = derived and/or modified CDS sequence (opt6) from DENV-1__FJ547063__SS-prME
  source 1..9879: mol_type = other RNA
tcggtgacaatgctcctaatgctaatgccaactgcactagcttttcatttaactactagagggggtgaaccacatatgatagtctcgaaacaagaacgtgggaaaagtttattatttaaaacaagtgctggagtaaatatgtgtactttaatagctatggacctcggcgaactatgtgaagatacaatgacttataaatgccccagaattactgaaactgaaccggacgacgtcgactgttggtgcaatgctacggacacatgggttacgtacggaacatgcagtcaaacaggggaacatagacgggataaacgctccgtagcacttgcacctcacgtgggactaggtttagaaactagaacagaaacatggatgtcctctgaaggtgcttggaaacaaattcaacgagtagaaacttgggcactaagacacccaggatttacagttatcgccctatttctagcacacgcaataggtacatcgattactcaaaaagggataatctttatccttctaatgcttgtcacaccttcgatggccatgcggtgcgtagggataggaagtagggacttcgtagaagggctatcaggcgcaacgtgggttgacgtggtattagaacatggaagttgcgttacaacaatggcaaaagataagcccactctcgatatagaattattaaagacagaagttacaaatcctgcagttttacgaaaactgtgtatagaagcaaagataagcaatactaccactgatagcagatgtccgacgcaaggagaagcaaccctagtagaagaacaagatgctaattttgtgtgtagaagaacctttgtagaccgaggttggggtaatggatgcggtctatttggtaagggttccttgattacatgcgcaaagttcaagtgtgtaactaagttagaaggaaaaatagttcaatacgaaaatctgaagtactccgtgattgtaacagtgcatacaggagaccaacaccaagttgggaacgaatccacagaacacggaactaccgccacaataacaccacaagcacctacaacagaaatacaactgacagattacggagctttaacattagactgtagccccagaaccggcctcgattttaatgaaatggttttattaacaatgaaggagaaaagctggttagttcataaacaatggtttttagatttgccgttaccgtggacttccggtgcaagtacgagtcaagagacgtggaataggcaagacttattggtaacattcaaaacagcgcacgccaagaaacaggaagtagttgttctaggttcacaggaaggggccatgcatacagcactaacaggagctacggagatccaaacgagtggtacaactacgattttcgcaggacatcttaaatgtagattgaaaatggataaacttactctaaaagggatgtcgtacgtaatgtgtacagggtcttttaaactggagaaagaactagcggagacccagcacggaacggtgctcgttcaaatcaaatatgaaggaacggatgcgccttgtaaaatcccttttagtacccaagatgaaaaaggtgtcactcaaaatgggcggttgattaccgcaaatcccatagtaactgataaagaaaaacccgtcaacattgaagctgaaccgccgtttggagaaagttatatcgttatcggagcgggtgaaaaagcattaaaacttagttggtttaagaaagggtcctcgataggcaaaatgttcgaggcaacagcaagaggtgcgagacgaatggctatcttaggggatacagcatgggactttggatcgataggtggagtgtttacaagtgtggggaagctagttcatcaaatattcggcacagcgtacggagtactcttctcaggcgtatcatggactatgaaaataggaataggagtccttctaacgtggctaggtctcaattcgagatcaacatccctgtcaatgacgtgtatagcagtaggcctggtaacgctatacttaggagtgatggtgcaagcagatagcggttgtgtaattaactggaaaggtcgggaactgaaatgcggaagtggaatctttgttactaatgaggtacacacttggaccgagcaatataaatttcaagcagactcaccaaaacgcttaagtgcagctattggtaaagcatgggaagagggtgtgtgcggtatacggtccgccactcggttagaaaacatcatgtggaaacaaataagcaacgaactaaaccatattcttctggaaaatgatatgaaattcactgttgtcgtaggtgatgtagccggaatactggcccaaggcaagaaaatgattagacctcaaccaatggaatacaaatactcttggaaatcatggggtaaggcaaaaatcatcggggctgatgtgcaaaatacgacttttataatagatggacctaacacaccagaatgccccgatgaccaaagggcatggaatatttgggaagttgaagattatggctttggaattttcacaactaatatctggctgaaattgcgcgactcgtatactcaggtatgcgaccacagactcatgagcgcagccatcaaagactcaaaagctgtacatgcagatatgggctattggatagaaagtgagaaaaatgagacctggaaactggctcgagcttcatttatagaggtaaaaacgtgtatatggccaaaatcacatacattatggtccaacggcgtgttagaaagtgaaatgataattccaaagatctatggtgggcctatcagtcaacacaactaccgacctggatatttcactcaaacagcgggcccctggcaccttgggaaacttgaacttgattttgatctctgcgaaggtacaacagtagtcgtcgatgaacactgtggaaataggggtcccagcctgagaacgacaacagttactggaaaaattatacatgaatggtgctgtagatcgtgtactttaccaccattaagatttaggggagaagatggatgctggtacggaatggaaatccggcctgtcaaagaaaaagaagaaaacctggtaaaatcaatggtaagcgcaggcagtggcgaagtagattcattttcacttggtcttttatgtatatctataatgatcgaagaagtgatgaggagccgctggtcaaggaaaatgttgatgacaggtaccttagccgttttctttctgctaataatgggccagctcacctggaacgatttaatacggctatgtataatggttggagctaatgcgtcagaccgaatgggaatgggtactacatacttggcacttatggctacttttaaaatgcgaccaatgtttgcagtgggtttattattcagaagactgacatctagagaagttttactattgaccatcgggctcagcttagtagcttcagtcgaactacccaattctttagaggaactaggagacgggcttgcaatgggaatcatgatattaaaattattaactgattttcaatcacatcagctatgggctaccctattaagtcttacgttcataaaaacaacattttctttacattacgcatggaaaacgatggcaatgatactctctatagtaagcctatttccgttatgtttgtctactacttctcagaaaacgacatggttgccagtattgctcgggtctctaggttgtaaacccctgactatgttcttaattgcagagaacaaaatttggggccgtcgcagttggccgcttaatgaaggtattatggcagtaggtatcgtttctatactcttaagcagccttctaaagaatgacgtccccttagcaggaccgctcatcgcaggagggatgctgattgcctgttacgtgatatccggaagctccgcagacctgtcattagaaaaagcagcagaagtttcgtgggaagaagaagcagaacactcaggggcgagccataatattttagtggaagttcaggatgacggtactatgaaaattaaagacgaagaaagagatgatacgcttacgattttactaaaagccacgttgctggccgtttcgggagtttatccattaagtatacctgctactctcttcgtatggtacttttggcagaagaagaaacaacgatcaggagtactttgggatactccttctcccccggaggtcgaacgcgcagtattagacgatggcatctatcgaattatgcaacgaggattacttggacgctcacaagttggcgtcggagtatttcaagaaaacgtgttccataccatgtggcacgtgacacgtggagccgtgttgatgtaccaaggtaaacgactagagccaagctgggcgtcggtaaagaaagatcttattagttacggaggaggttggagactacaaggatcttggaacactggtgaggaagttcaggtaatcgctgtcgagccgggtaaaaacccgaagaatgtccaaacagccccgggaactttcaaaacccctgaaggggaggttggtgccattgcccttgacttcaagccgggaacttccggatcacccatagtaaatagggaaggaaaaatagtcggcttatatggtaatggagtggtcactacttctggcacgtatgtgtctgcaattgcgcaagcgaaggccagtcaggaaggaccactccctgaaattgaggatgaagtatttagaaaacgtaatctaacaataatggatctacaccctggttccggtaaaacaagacgttacttaccggcaattgtccgcgaggcaattaaaaggaagctccgaacacttatcttggccccaacacgcgtagttgcatcggagatggctgaagccctcaaaggcatgccgattagatatcagacgacggcagtaaaaagtgaacatacgggcaaagaaatagtagatttaatgtgtcacgctaccttcacaatgagattattatcacctgtgcgggttcccaattataatatgatcataatggacgaggcacatttcactgatccatcttctattgctgcaaggggctatatttctacccgcgtaggtatgggagaagcagctgccatatttatgactgctacacctccaggatctgtcgaagcctttcctcaatctaatgcagtaatacaagacgaggaaagggatatccccgagaggagctggaactcgggatatgagtggataacagattttccaggaaaaaccgtctggtttgttccatcaattaagtcaggtaatgacatagccaattgtctaaggaaaaatggtaaaagagtgatacagttgtcgcgcaaaacgtttgataccgaatatcagaaaaccaaaaataacgactgggactatgtggtcacaactgatattagcgaaatgggagccaactttcgagcagatagagtaatagatccacggagatgtcttaagcccgttattctcaaggacgggccagaacgcgtgattttagcaggacctatgcctgtcaccgtggcctcagcggcacagaggcgaggacgtattgggagaaaccataataaggaaggtgatcaatatatctatatgggccaaccactaaataatgatgaagatcatgcacactggactgaggctaaaatgttgctggataatataaacacaccagaaggaattattccagccttattcgaaccagaaagggaaaaatcagcagctatagatggtgagtaccgacttagaggagaagcgagaaaaacttttgtagaacttatgagacgaggcgacctacccgtgtggcttagctataaagtggcatcggaagggttccaatactctgatagacggtggtgtttcgatggagaacgcaataatcaggttcttgaagaaaacatggatgtagaaatatggacgaaagagggtgagcggaagaaactaaggccaagatggctagacgcgcgaacctactcggatccattagcccttcgggaatttaaagaatttgctgctggacgtcgtagtgtgtctggcgacctaatattagaaattgggaaactcccacaacatcttacgcaacgagcacaaaacgcgttagacaacctagtaatgttacataactcagagcaagggggaagggcttacaggcatgcaatggaggaattacctgatactatagaaactctgatgctactagcattaatcgctgtattgacaggtggtgtaacgctatttttcctatcaggtagagggttaggtaaaacgtcgattggcctactatgcgtaatggccagtagtgtacttttatggatggccagtgttgaaccacattggatagcggcttcaattatccttgagttctttctaatggtattattaataccagaaccagatagacaacggacgcctcaagacaatcaactggcttatgtagtaataggattgttatttatgatacttactgttgccgcaaatgaaatggggctacttgagactacaaagaaagacttaggcattggacacgtagcagttgagaaccatcatcacgcggctatgctagatgttgatctccacccagcttccgcatggactctatatgcagtcgcaaccactatcattaccccaatgatgcggcacacaatagaaaatacgacagcaaatatttctttgactgcaatagccaatcaagcagccatacttatgggtcttgataaaggatggcctatttctaaaatggacataggtgttccactattagcacttgggtgttactcccaggtcaatccacttactttaacagctgccgtgcttatgcttgtggctcattatgcaataattggaccaggccttcaagcaaaggcaactcgcgaagctcagaaacgtacggcagcaggaatcatgaaaaacccaacagtcgatggaatagtagcaatagacctagatccagtagtatatgacgccaaattcgaaaaacaacttggacaaatcatgctattgattttatgcacgagccaaatcttactcatgcgcactacttgggcactttgtgaatccataacgttagcaacaggccctttaacgactttatgggaaggcagcccaggaaaattttggaatactacaatagctgtgagtatggctaacatttttcgaggatcatatctcgcaggagcaggattggctttcagccttatgaaatcgctcggaggaggtcgaagaggaacgggcgcacaaggtgaaaccctcggcgaaaagtggaaaagacaactcaatcagctttcaaaaagtgagtttaacacctacaagaggtcaggaataatggaagttgatagaagtgaagcaaaggagggtcttaaaagaggagaaactactaaacatgcggtgtccagggggacagcgaaactacgctggttcgtagaaagaaacctagttaagccagaaggcaaagtgatcgatctaggttgtggtcgtgggggctggtcctattattgcgcagggctaaagaaagtaaccgaggtaaaaggttataccaaaggaggacccggccacgaagaaccaatcccaatggctacctacgggtggaacctcgttaaattgcattcagggaaagacgtattctttatacctccagaaaaatgcgacactctcctgtgtgatataggtgaaagcagtcctaacccaacgatcgaagaaggtagaactttacgagtgttaaaaatggttgaaccatggttgcggggtaaccaattttgtatcaagatattaaacccctatatgccatcggttgtagagactctagaacaaatgcaacgaaaacacggaggcatgctagttagaaatccgctccagcgaaatagcacacatgaaatgtattgggtctcctgtggaactggaaatattgtgtccgcggtaaatatgacttcacgaatgctactcaatcgatttacgatggcccatagaaaacctacatatgaacgtgacgtagatttaggagcaggaacacggcatgtcgccgtcgaacccgaagtggcaaatttagatataatcggacaacgtatagaaaatattaaacacgagcacaaaagtacatggcattatgatgaggataatccctacaaaacttgggcataccacggttcttacgaggtaaaacctagcggttccgcgtcatctatggtaaacggagttgtaaagctacttacaaaaccgtgggatgtcataccaatggtcactcaaatcgcaatgacagatacaacgccatttggacaacaaagagtgtttaaagaaaaagttgatacaagaactccaaaagcgaagcgtgggaccgcgcagatcatggaagtaacagccaaatggctgtggggatttttaagtagaaataagaagcctagaatatgtactcgcgaagagtttaccagaaaagtccgaagtaacgctgcaataggggcagtgtttgtcgatgagaatcagtggaactcagcgaaagaagccgtagaagatgaacgattctgggacctagtacaccgtgaacgagagctccacaaacaaggaaagtgcgcaacgtgcgtctacaatatgatgggcaaaagagagaagaaacttggagagttcgggaaagcaaagggaagtagagcaatctggtatatgtggctgggagcacgattcctagagttcgaggctttaggatttatgaatgaagatcattggttctcaagagaaaattctttgagtggagtggaaggagagggtctgcacaaattaggatacattctaagagatataagcaaaatcccgggtgggaatatgtacgctgatgacacagcagggtgggatactcgcattaccgaagacgacttacagaatgaggcaaggattaccgatatcatggaacctgagcatgcgttactagccaaaagtatctttaaattaacataccaaaacaaagtagttcgagtacaaaggccagccaaaaacggaaccgtaatggatgtaattagcaggcgcgatcaaaggggctctggccaagtaggtacatacgggttaaatacatttacaaatatggaggcccaattaataagacaaatggagtcggaaggtatcttttcacctagcgaattagaaacacccaacttagcagagcgtgtattggattggctagagaagtatggcgttgaacgactcaaaaggatggcaatcagcggcgatgattgtgttgtgaaaccgatagacgaccgtttcgcaaccgcactgacagcgctaaacgatatgggaaaagtacggaaagatataccgcaatgggaaccttctaagggatggaatgattggcaacaagtcccattctgttcgcaccactttcatcaacttattatgaaggacgggagagaaatagttgtaccatgtagaaaccaagatgaattagtaggaagggcgagagtcagtcaaggggcggggtggagtttgcgtgaaacagcatgtttaggaaaatcatacgcacaaatgtggcaactcatgtattttcatagaagagacctgcgattagctgcaaacgcaatatgttctgccgtaccggtagactggatcccaacatcacgaacaacctggagcatacacgcgcatcaccagtggatgacaactgaagacatgttatccgtttggaatagagtatggatagaagagaacccctggatggaagataagacccatatatcatcgtggggagacgtaccgtatcttggcaaacgagaggatcagtggtgcggcagtcttatcggattaaccgcgagggccacatgggcaacaaatatccaggttgcaataaatcaagttcgtcgactaattgggaatgaaaattatttggactatatgacaagcatgaaaaggtttaaaaacgaaagtgaccccgaaggtgccctctggtaa

SEQ ID NO: 21557 - RNA, 9879 nt, synthetic construct
  misc_feature 1..9879: note = derived and/or modified CDS sequence (opt6) from DENV-1__FJ410218__SS-prME
  source 1..9879: mol_type = other RNA
agcgttacaatgttattaatgcttatgccgactgcacttgcatttcacttaactacaagagggggtgaaccacacatgattgtcacaaaacaagaacgaggcaaatcgctactttttaaaacttctgctggggttaatatgtgcactctcatagccatggacttaggtgaattatgcgaagatacgatgacgtataaatgtccacgaataacagaagccgaacccgacgacgtggactgctggtgcaacgctacagatacttgggtaacttatggaacctgctcacaaacaggcgaacaccgaagagacaaacgatcggttgctcttgcgccacacgtcggcctaggccttgaaacaagaacggagacctggatgtcatctgaaggcgcatggaaacaaattcagagggtcgaaacatgggctctcaggcacccaggcttcacagttattgcactctttcttgcacacgcgataggaacaagcatcacccaaaaaggaatcatttttattctattgatgttagttacaccgtcgatggcaatgaggtgcgttggcataggctcaagagacttcgttgagggtttatcaggagccacttgggtagatgtagttctggagcacgggagttgcgttaccacaatggccaaagataaacctaccttagatatcgagctcttaaaaaccgaagtgacaaacccagccgtgcttaggaaactatgtatcgaggcgaaaatatcgaatacaactacagatagtcgctgtccaacccaaggagaagcgaccttgatggaggaacaggatgcaaactttgtatgcaggaggacattcgtcgataggggctggggaaatggatgtggattattcggtaaaggttctttaataacatgtgccaaatttaaatgcgtcactaaattagaaggaaaaatagttcagtacgaaaacttgaagtattctgtcatcgttactgttcacactggagaccaacatcaagtaggaaatgagtcaacggagcatggcactacagctacaataacacctcaggcgccgacatcagaaatccaattaacggattatggagccttaacattagattgcagtccgcgcactggactagattttaacgagatggtattattgacaatgaaagaaaagagctggttagttcataaacaatggttcctcgacttaccactcccgtggacatctggagctagtacaagtcaggagacatggaataggcaggacctacttgttacgtttaaaactgcccatgctaagaaacaagaagtagtcgttcttggctcgcaagagggagcgatgcatacggctctaacgggcgcaacggaaatccaaacgtcaggaacgactacaatttttgcaggtcatttaaagtgtagattaaaaatggataaactaacattaaagggaatgtcatatgttatgtgtacaggatcatttaaactagaaaaagaagtagcagaaacccaacacgggactgtattggtgcaaatcaaatatgaaggcactgatgctccatgcaagatacctttttctactcaagatgaaaaaggagttactcaaaacggtcgtcttattactgcaaatccgatagtaacggataaagaaaagccagtgaatatagaagcggaaccaccgttcggagagtcttatattgtcataggtgcaggagaaaaagcactgaagttatcatggtttaagaaagggagtagtataggcaagatgttcgaagcaacagctcgaggtgcacgcagaatggcaattttaggcgatacagcttgggattttggatctatcggcggtgtatttacatcagttggaaagctggtacaccaaatttttgggacagcatatggggtcttattttcgggtgtaagctggacgatgaaaataggaataggagttctcttaacatggcttggattaaacagtagatcgacgtccctctcaatgacgtgtatcgctgtaggcttagttactctatatctcggggtgatggtacaggccgatagcggatgtgtcattaattggaaaggaagagagctcaaatgtggatcaggtattttcgttaccaacgaggtacatacctggactgagcagtataaatttcaggcggatagccctaaaaggttgtctgcagctatcggcaaagcgtgggaagaaggggtatgcgggatccgttcagcaacaaggttagaaaatattatgtggaaacaaatctctaatgagctaaatcacattcttttggaaaatgatatgaaatttactgtagtcgttggtgacgtagtcgggattctggcacaaggtaagaaaatgattcgaccccaacccatggagcacaaatacagttggaaaagctggggtaaggccaagattataggtgccgacgtgcagaatactacattcattatcgatggacccaatacacccgagtgtccagatgatcaacgggcatggaatatctgggaagttgaagattatggtttcggaatatttacaacaaatatttggttaaaacttcgagacagttacacacaagtgtgtgatcacagactcatgagcgccgcaataaaagatagcaaagccgtgcatgcagatatgggctactggatagaaagtgagaaaaacgagacatggaaacttgcaagggcatcctttatagaagtaaaaacatgtatatggccaaagagtcacactctgtggagtaacggagtacttgaatcagagatgattattcccaaaatttatggtgggccaataagtcaacacaattatagaccgggttattttacacaaacagcaggaccttggcacttaggaaaacttgaattagattttgacttatgtgaaggtactacagtagtagttgacgaacattgtggaaatcgaggcccatcactcagaaccacaacagtgacaggaaagataatccatgagtggtgctgtaggagttgcaccctcccaccattgcgatttaagggagaagatggttgctggtacggtatggaaatcagaccagtaaaggaaaaggaagagaatttagtaaaatcaatggtatccgcaggatctggagaggtcgattcattcagcttaggattattatgtataagtattatgatagaagaagtcatgaggtctagatggtctagaaaaatgctcatgacaggtacgttggctgtattcttacttcttataatgggacaattaacatggaatgatttaataagattatgtattatggtgggagcaaacgcaagtgaccggatgggaatgggaacgacttatttagccctaatggctactttcaaaatgagacctatgttcgcagttggcctcttgtttcgtagattgacatcgcgagaggttcttttattaaccattggactctcactcgtagcttccgtcgaactaccaaatagtttagaggaactaggcgacggactagcaatgggcataatgattctaaaattattaacagatttccaaagtcatcaattgtgggcaacactattatcgctgacctttataaagactaccttatcgttacattatgcgtggaaaactatggcaatggtcctaagtattgttagcctatttcctttatgtttatctacgacatcacaaaagacaacctggttacctgtcttattaggctcactcggatgtaaacctttaaccatgttcttgatagtcgaaaataaaatatggggtagaaaatcgtggcccttaaacgaaggaattatggctgtaggggtcgtatcaattctgctatcgtcattattaaagaacgatgtaccacttgcaggcccattaatagcaggaggaatgttaatagcctgttatgtcattagcggatcttcagcagatctcagcttagaaaaggcggccgaagtctcttgggaggaagaagccgaacatagcggtgctagtcataatatcttagttgaagttcaggatgatgggacaatgaagatcaaagatgaagaaagagatgacacattgacaattttactcaaagcgacactcttagcagtttccggcgtttatcccctatcaataccagcaactttattcgtatggtatttctggcagaaaaagaaacaaagaagtggagtcctatgggacacgccgagtcctcctgaagtagaaagggcggtcctagatgacgggatatataggataatgcaaagaggattgttaggaagatctcaagttggtgtcggcgtcttccaagaaaacgtctttcatacgatgtggcacgtaacaaggggagcagttttaatgtatcaagggaaaagacttgaaccaagctgggcaagtgtcaaaaaggatctaatcagttacggaggcgggtggaggcttcaaggatcctggaatacaggtgaagaagtacaagtaatcgcagtagagccaggcaaaaatccgaaaaatgtacaaacagcaccgggtacatttaaaacgccagaaggagaagttggcgctatagcattggacttcaaacccgggacaagcggatcccccatcgttaacagagagggtaaaatagtagggctctacgggaatggagtagtgacaacctctggtacttatgtgtctgcaatcgcccaagctaaagcatctcaggaaggaccattgccggaaatagaggacgaagtgttcagaaaaaggaatttaacaataatggatctacatccagggtcaggaaaaacaaggagatatctacctgccatagtccgagaggctataaagcgaaaattaaggacattaattctagcacccaccagagtggtggcttcagaaatggctgaggctctaaaaggaatgccgatacgctatcaaactacagcggttaaaagtgagcacacaggtaaggaaatagtcgacttaatgtgccatgcaactttcacgatgcgattattgtcccctgtaagagttcctaattataacatgatcataatggacgaggcacactttacagatccatcttctatagccgcacgtgggtacataagcacacgcgtaggaatgggcgaagcggcagctatatttatgacagccactccaccgggctccgtggaggcattccctcaaagtaacgcagtaattcaagacgaagaaagagatattccagaacgatcatggaatagtgggtacgaatggattacagattttcccggcaaaaccgtatggtttgttccatcgattaaaagtggaaacgacattgctaactgcttaaggaaaaatggaaaaagagtaattcaactaagcagaaaaacatttgacactgaataccagaaaactaaaaacaatgactgggattacgttgttacaaccgatataagtgaaatgggcgcaaatttcagagcggacagggttattgatccccgtagatgcttaaaaccggttattctaaaagatggtcccgagagggtaatattagcaggacctatgccagttacagtagcgtcagcggcgcaaaggcgtgggcgaataggacggaatcataacaaagaaggagatcaatatatttacatgggtcaacccttaaacaacgacgaggatcatgctcattggacagaagccaagatgcttttagataatataaacacccccgaaggtatcattccagcgctgttcgaaccagaaagggaaaaatctgcagcaatcgacggcgagtacagattacgaggagaggcgaggaagacatttgttgagcttatgagacgaggagatctcccagtgtggctgagttataaagttgcgagcgaaggtttccaatattcagacagacgatggtgtttcgatggggaaagaaataaccaagttctcgaagagaatatggatgtagaaatatggacaaaggaaggagaaaggaaaaagttacgacctcgatggctagacgcaagaacttattctgatcctctagcattaagagaatttaaagagttcgccgcaggtaggcgtagtgtgtcaggagatcttatacttgagataggaaaactaccacaacacttgacccaacgggcacaaaatgcgttagataatctagtgatgctacacaatagcgaacaaggtgggagagcttacaggcacgccatggaagaactcccagatacaatagagaccctaatgctgttggcattaattgcggtactgactggtggtgtcactttattcttcttaagtggaagggggttaggcaaaacttcaataggactactatgtgtaatggcatcatctgtactgttatggatggcgagtgtcgaacctcattggatcgcggcctcaataatactcgagttctttctaatggtgctccttattcccgaacctgatcgtcaaagaacaccccaagacaatcaattagcttatgtcgtgattggattactatttatgatacttacggtagcagctaacgagatggggctactagaaacgaccaagaaagatttgggtattggacatgtagcagtagagaaccatcatcatgcaacaatgttagatgttgatctgcatccagcatcggcatggacactttatgcggtggctacaaccataataacaccaatgatgagacacactattgaaaatacaacggctaatataagcctaacggcaatagcaaatcaggcagcgatactaatgggtttagataaaggatggccgataagtaaaatggacattggtgtacccctattagctctggggtgttatagtcaagtcaatccactgacgctaactgctgcagttctaatgttagtggctcattacgctataattggtcccggactacaggcaaaagcaactagggaagctcagaaaagaacggctgcgggaataatgaaaaatcctaccgttgatgggatcgtagcaatagaccttgacccagtagtgtatgacgccaaatttgaaaaacagttgggtcaaattatgctactcatcctatgtaccagtcagattttattaatgaggacaacctgggcattatgtgagtcaattacgctagcaacaggcccactaacaacgctgtgggaagggtcgccaggaaaattttggaatacaaccatagcagtatcaatggcaaacatatttcgaggatcgtacctagcaggcgctgggctagcattcagtctcatgaaatccctgggaggaggaagaaggggaactggcgcacaaggagaaaccctaggcgaaaaatggaaacgacaactgaatcagctatcaaaaagtgagttcaacatttacaaaagatcaggaataatggaagtagaccgatccgaagctaaggagggactaaaaagaggagaaactacgcgtcatgcagtatcgcgaggcacagctaaattgcggtggtttgtcgaacgcaatttagttaagcccgagggaaaagtgatagaccttggctgtggaagagggggatggtcttattactgtgcaggcctaaagaaagtaacagaagtaaagggatatacgaaaggaggaccaggtcacgaagaacccatcccaatggcaacctatggttggaacctagtgaaacttcatagcggaaaagatgtgttctttactccaccagaaaaatgtgatacattactgtgtgacataggtgaatcatcaccaaaccccactatagaggaaggcagaaccttgcgtgtattaaaaatggtagaaccatggcttcgtggcaatcaattttgcataaaaatactaaatccttatatgccatctgtcgtagagacattagagcaaatgcaaagaaagcatggaggaatgttagtacgtaacccactttcgcgcaactccactcacgagatgtactgggtatcatgtggaacgggaaatattgtttcggcagttaatatgacaagcaggatgttactaaatagattcactatggcgcacagaaagcccacatatgaaagagacgtagatttaggtgcgggaaccagacatgtagctgtcgagcccgaagtagcgaatcttgatataattggccagcgcatagaaaatataaaacatgaacacaagtccacatggcactatgatgaagacaacccctataagacttgggcatatcatggttcatatgaagttaagccaagcgggtcagcatccagtatggtcaatggtgttgtgaaactactaacaaagccatgggacgtcataccgatggttactcaaatagccatgacagatacaacgccattcgggcagcaacgagtgtttaaagaaaaagtagatacccgaacgccaaaagcaaaacgggggacggcacagataatggaagttacagcacgatggttgtggggatttttatcacgtaacaagaaacctcggatatgtaccagagaagagttcacccgaaaagtaagaagcaatgccgcaattggagcagtattcgttgatgaaaatcaatggaacagcgcaaaggaagctgtagaggacgagcgattttgggacctggtacagaaagaaagggagctccataaacaaggtaaatgcgccacctgtgtgtataatatgatgggaaaaagagagaagaaattaggggagttcgggaaagcaaaaggctcgagagcgatatggtatatgtggctaggggctcgatttttagaatttgaggcgcttgggtttatgaatgaagatcattggttcagcagagaaaattccctatctggagtagaaggcgaaggactccataaactaggctacatcctcagagatatctcaaaaatacccggcggtaatatgtacgcggatgacacagcaggctgggatacccgaatcacagaggatgacttacaaaacgaagcaaaaatcactgacataatggaaccagagcatgcgttattggcgacatcaattttcaaattaacttatcaaaacaaggtcgtaagggtacaacgtcctgcgaaaaacgggacagtaatggatgtgataagcagaagagatcaaaggggttcaggtcaagtcggaacgtacggccttaacacatttaccaacatggaagcgcaattaatcagacaaatggaaagcgaaggtatattttctccaagcgaattagaaatccctaacttagccgaacgtgttctagactggcttgagaaatatggcgttgaacggttaaaacgcatggcgatatccggtgatgactgcgtagtaaaacctatcgatgaccgattcgcaacggccttaacggcactaaacgatatgggaaaagttcgtaaagatgttcctcaatgggaaccgtcaaaaggctggaacgattggcaacaagtaccattttgtagtcatcatttccaccaactcataatgaaggatggaagagagattgtagtaccatgtaggaatcaagatgagctagtaggacgtgcgcgtgtatcgcagggtgcaggatggagtcttagagagacagcatgcttaggaaagtcttatgctcagatgtggcaattaatgtatttccaccgtcgcgacttgcgactagctgcgaacgccatttgctcagcggtgcccgtagattgggttcctacatcacgaacaacgtggtctatccatgcacatcaccaatggatgacaacggaggatatgctttcagtttggaatcgggtatggatagaggagaatccatggatggaggataaaactcacgtaagtagttggggagacgttccatatctagggaaacgagaggatcaatggtgtggctctctaattggactaacagctcgagcaacatgggcttctaatatccaagttgcgataaatcaagtaagaaggctcattggaaatgagaattatctagattacatgactagcatgaaacgttttaaaaatgaaggagatcctgaaggagcactttggtga

SEQ ID NO: 21558 - RNA, 9879 nt, synthetic construct
  misc_feature 1..9879: note = derived and/or modified CDS sequence (opt6) from DENV-1__FJ461316__SS-prME
  source 1..9879: mol_type = other RNA
tctgtaaccatgttacttatgctgatgcctactgctttagcgtttcatctaaccactcgtgggggagaacctcatatggttgtgagcaaacaagaacgcggtaaaagtctgctatttaaaacaagtgcaggagtaaacatgtgcactcttatagccatggacttaggtgagttatgtgaagacacaatgacctataaatgtcctagaatcactgaagcagaaccggatgatgtagattgttggtgtaacgcgacggatacttgggtaacatacggcacatgctcgcaaactggtgagcataggcgtgataaacgctcagtagcattagctccgcatgttggacttggattggaaacgagaacggagacatggatgtcatctgaaggagcatggaaacaaatacaacgagtagaaacatgggcattgcgtcatcctggatttacagtaatagcattgtttttagcgcatgcaataggaacttcgatcactcaaaaaggtataatattcatcctattgatgctagtgactccgagcatggctatgcgttgcgtcggcatagggagccgcgatttcgtcgaaggtctatccggtgcgacctgggtggatgtagttttagaacatggctcttgtgtgactaccatggcaaaagataaaccaactttagatattgaattattaaaaactgaagtaacaaatcctgctatacttagaaaattatgcattgaagctaaaatttctaatacaacaactgactcacgttgtccaacacaaggtgaagcaacactggtagaggaacaagacgctaactttgtttgtcgcagaacatttgtagataggggatggggaaatggatgcggcttattcggcaaaggatctctaataacgtgtgcaaaattcaaatgtgttactaaattagagggaaaaattgttcaatacgaaaatctcaaatattcagtgatagtgaccgtacatacaggagaccaacaccaagtaggaaatgagtcaacagaacacgggaccacagctacaatcacgccacaggctccaacgacagaaatacaactaactgattatggcgctcttaccctcgactgttcaccaagaacaggactagattttaatgaaatggtgctactcactatgaaagagaaaagttggttagtacataagcaatggttcctcgatttacccctaccgtggacgtcaggtgcatcaacctctcaagagacatggaacagacaagacttgttggtcacttttaagacagcacatgccaagaaacaagaagtagttgtcctgggcagccaagaaggagctatgcatacggcgttgactggagcgacagaaatacaaacatccgggacaacaacaatatttgcagggcatcttaaatgtagattgaaaatggacaaactaacactaaaaggaatgtcttatgtaatgtgcacaggtagctttaaactagagaaagaagtagccgagacacagcatggaacagtcttagttcaaattaaatatgaaggaactgatgcaccttgcaaaattccattttcaactcaagatgagaaaggtgtaacacaaaacgggaggttgataacagctaatcccatcgtaaccgataaagaaaaacctgtgaacatagaagcagaaccaccttttggtgaatcatatattgtcatcggagcaggagaaaaggcattaaaactcagctggttcaagaaagggagttctataggtaaaatgtttgaagcaaccgcaagaggggctaggcgtatggccattctaggtgatactgcctgggactttggaagcattgggggagtgtttacaagtgttggaaaattggttcaccaaatatttggtacggcttatggtgtgctttttagcggtgtaagttggactatgaaaataggcttaggtgtattattaacttggttagggctaaattcgcgatcaacttcactatcgatgacttgtatagcggtcggactggtgacgttgtatcttggtgtaatggtgcaggcagactccggttgcgtaatcaattggaagggaagagagcttaaatgcggatctggtatttttgttaccaatgaggtccacacttggaccgaacagtacaaatttcaagcggacagtccgaaaagactctctgcggctattggcaaagcatgggaagaaggagtatgcgggatacgatcagctactagattagaaaatgttatgtggaaacagatttcgaatgagttgaaccatatactgttagagaacgacatgaagttcacagttgtcgtgggcgatgtggctgggattttagcacagggtaaaaagatgatcaggccgcagccaatggaatacaagtactcatggaaatcctgggggaaagcaaaaatcatgggagctgatgttcaaaacactacattcattatagatgggcctaacacgccagaatgtcctgatgaccaaagagcctggaacatatgggaagttgaagactacggatttggtatatttaccacaaatatttggttaaaattgagggactcatatacacaggtatgcgatcatcgcttaatgtccgccgctatcaaagattcgaaagcggtccacgcagatatgggttattggatagagtccgagaaaaatgaaacttggaagctggccagagcttcattcattgaggtgaagacttgtatatggccaaaatcccatacactttggagcaacggtgttctagaatcagaaatgatcattccaaaaatttatgggggaccaataagtcagcataattaccggcctggatactttacgcagacagctggaccgtggcatctaggcaaattagaactagactttgatttatgcgaaggcacaactgtcgttgttgatgaacattgtggaaatagagggccttcactacgaacgactaccgtaaccggaaaaattattcatgaatggtgctgccgatcatgtaccttaccacccttaaggtttagaggtgaagacggttgctggtacgggatggaaattcggccggttaaagaaaaagaagagaacctagttaaatcaatggtatcagcaggaagtggagaagtagatagtttttcattagggttactgtgtatatcaataatgatagaagaagtaatgagatcaagatggtcaagaaaaatgttaatgaccggtacattagctgtctttctgttgcttataatgggccagctaacgtggaatgacctaatcagattatgtattatggttggtgcaaatgcttcagaccgtatgggaatgggtacaacctacttagctttgatggctacatttaagatgagaccaatgttcgcagtcggtttgctgttccgaagactcacctcgcgagaagttctactattaacaataggactatcgcttgttgcgtcagttgaacttcctaactccttagaggaactgggcgatgggctagcgatggggataatgattttgaaactactcacagattttcaatctcaccaactatgggcaacccttttatcgttgacatttattaaaacaacattttctctgcattatgcgtggaaaactatggcaatggtactatcgatagtcagccttttccccctttgcctctccacgacatcgcagaaaaccacttggctgccggtgttacttggctcgctagggtgtaaacccttaacaatgttcctaatagccgagaataaaatttggggccgcagatcgtggcctttaaacgaaggtatcatggctgtgggtattgtctccatattattaagttctttattgaaaaacgacgttccccttgcaggcccgttgatagccggcggtatgctaatagcgtgttacgttatttcggggtcgagcgccgacctttctctggaaaaagcagccgaagtaagttgggaagaagaagctgaacacagtggagcatcgcataatatcttagttgaagtccaagatgacggtactatgaagataaaagatgaagaaagggatgataccttaacaatcctcttgaaggctactcttctagcagttagtggagtttatccgctaagtattccagcaaccttattcgtttggtatttttggcagaaaaagaaacagcgctcaggtgttctctgggatacaccatcaccccctgaagttgaaagagctgtattagacgacggaatatacagaataatgcaacgaggtctcctaggaagaagtcaagttggggttggtgtgtttcaagaaaatgtgtttcatacgatgtggcacgtgaccaggggagcagtattaatgtatcaaggaaaaagactcgaaccgtcgtgggcgagcgtaaagaaggacctcatttcatacggaggagggtggcgcctgcaaggatcatggaatacaggtgaagaagtccaagtgattgccgtggaacccggcaaaaatcccaaaaatgtacaaaccgcacccggtacctttaaaacacccgagggagaggtaggagctattgctttggatttcaaacctgggaccagtggctcacctatagttaacagggaagggaaaattgttggcctgtacggtaacggggttgtgacaaccagtgggacctacgttagtgcaatagcacaagctaaagcatcgcaagaaggtcctctcccagagatcgaggacgaagttttccgaaaacgcaatttgacgattatggatttacatccaggtagcggaaaaacaagaagatacctacctgcaatagttagagaggcaattaaacgtaaattgagaacgctaattcttgctcccaccagagtagtcgcttctgaaatggcggaggcactaaaagggatgccaatccggtatcaaacaacagcggtcaaaagtgagcataccgggaaagaaatagtggatctgatgtgtcatgctacattcactatgaggctgctgagcccagtcagggtaccgaactacaatatgatcataatggatgaggcacactttacagatccatcaagcattgctgccagagggtacatttcaacacgagtgggaatgggagaggccgctgcgatattcatgaccgcaacgccacccggttcagtagaagcgttcccgcaatcaaatgcagtaattcaagatgaggagcgagacataccagaaaggagttggaatagtgggtacgaatggataaccgactttcctggaaaaacagtctggttcgtgccatccataaaaagcggtaatgatatagcgaattgtctcagaaagaatggtaagagagtcattcaactatctcgaaaaacattcgatacagaatatcaaaagacaaagaacaatgattgggattacgtagtcacaaccgatatttcagagatgggtgcaaactttcgcgcggacagagttatagatcctcgaaggtgtttgaagccagtaattttaaaggatggtccagagagagtcattcttgcaggccccatgcccgtcacagttgctagcgcagctcaaagacgtggacgtatcggacgaaatcataataaagagggtgatcaatatatttatatgggtcagccactcaataatgacgaagatcatgctcactggacagaagcgaaaatgctacttgataacattaatacaccagaagggataattccagctttgttcgaaccagagagagaaaaatccgccgctatagatggagaatacagactacgaggcgaggctagaaagacgttcgtggaattaatgcgcagaggagaccttccggtctggcttagctacaaggtagcatcggaagggtttcagtattcagatcgtcgctggtgtttcgatggtgaaagaaataatcaagtgctagaagagaatatggatgtagaaatttggaccaaagagggggaacgcaagaaactaagaccacgatggttagatgctaggacgtatagcgaccctctcgctttgagagaatttaaagagtttgcggcagggagaagatctgtgagcggagacctcattttagagataggaaagctaccgcaacatcttacgcaaagagctcaaaatgcactcgacaacttagtaatgctgcataactcggaacaaggtggacgtgcatatcgacatgcgatggaagaattgcctgataccatagaaactctgatgttattagcgctgatagcggtcctcacagggggcgttaccttattctttttaagtggaagaggcttaggaaaaacatcaatcggtttattgtgtgtgatggcatcctccgtgctcctgtggatggcttcggtagagccacattggattgcagcctcaataattctcgaatttttccttatggtactcctaataccagaacctgatcgacaaagaactcctcaggacaaccaactggcctacgtagttatcggattgctttttatgatattaaccgtagcagcgaacgaaatgggattattggaaacgacgaagaaagatcttggtatcggccatgccgcagtcggtaatcaccatcatgcggcgatgcttgatgtagatctacacccagcttctgcatggacattgtacgctgtcgctaccacaattattacaccaatgatgagacatactatagaaaacactacggcaaatataagtttaacggcaatcgcaaaccaagcagcgatcctaatgggattagataaaggttggccaatttcgaagatggatataggagttccgctcttagcactaggatgttactcacaagtaaatccactaacgctaacagcagctgtcctaatgttagtcgcgcattatgccataataggaccgggcctacaagcaaaagctacgagagaagcacaaaagagaactgcggccggaattatgaaaaacccgacggttgatgggatagtagccatagatttagatccggtcgtctacgatgcaaagttcgaaaaacagttaggtcaaattatgttgctcatcttgtgtacatcacagatattgctcatgagaacaacctgggctctatgtgaatcaataaccttagctacaggaccattgacgactctttgggagggatcacctggaaagttttggaatacaactatagccgtgtctatggccaatatttttagaggcagttacctcgctggtgcaggtctagcattctcattgatgaaatctttaggaggtgggagacgaggtaccggcgcccaaggtgagacactcggggaaaagtggaagaggcaactcaatcagctctcaaaaagtgaatttaatacatataaaagatcaggaattatggaggttgaccgttcagaggcaaaagaaggtttgaagcgaggagaaacaacgaaacatgccgtgagtagaggcacagccaaattaagatggtttgtagaacgaaacctagtaaagccagaaggtaaagttatcgatcttggatgtggtcgaggagggtggtcttattattgcgcaggactcaagaaagtaactgaagttaaaggatatactaagggaggtcccggacatgaagaacctattcccatggcaacctatggttggaatttagttaaattgcactccggcaaagatgtgttctttatacctcctgaaaaatgtgacacacttctatgtgacatcggagaatcttctccaaaccccactattgaagaagggaggaccctacgggttctaaaaatggtagaaccctggttgaggggtaaccaattctgcataaagatcctcaatccgtacatgccctctgttgtcgaaactttggagcaaatgcaaagaaaacatggcggtatgttagtaagaaacccactatctcggaatagcactcatgagatgtattgggtaagttgcggcacaggaaatatcgtttctgccgtaaacatgacgtcaaggatgttacttaacagattcacgatggcgcataggaaacctacttatgaaagggatgtagatctaggtgctggcacccgacatgtagcagtagaacctgaagtggcaaatttggacataattggacaaagaatagaaaatataaagcatgagcataagtcaacatggcattatgacgaggacaatccatataaaacctgggcgtaccatggaagttatgaagtaaaaccatcaggatctgcttcatcaatggtaaatggtgtggtcaaacttttaacaaagccctgggatgttataccgatggtaactcaaatagcgatgacagatactactccattcggccaacaacgtgtttttaaagaaaaggttgacacgagaacaccaaaggcaaaaagagggacggcgcaaattatggaagtcacagctaaatggctttggggttttctttctaggaacaaaaagccacggatttgtacacgagaggaatttacaagaaaagtacgtagtaatgcagcgataggtgcagtgtttgtagatgaaaaccagtggaactcggctaaagaagcggtagaggacgagcggttttgggacttagttcatagggaaagagaattacacaagcagggtaaatgtgcgacttgtgtatacaacatgatgggaaaacgtgagaagaaacttggtgagtttggaaaagctaagggcagtcgagccatatggtacatgtggctaggtgcaagatttctagaatttgaagcacttgggttcatgaatgaggatcattggttcagccgggagaacagtttgagcggagtagaaggcgagggactacataaattgggttatatactcagagatattagtaagataccagggggcaatatgtatgcggacgacacggccggatgggacaccagaataaccgaagacgatttacaaaatgaggcaagaataaccgatattatggaaccagagcacgcgctcctggccaagagcatattcaaactcacttaccaaaataaagtcgtgagggtgcaaaggcccgcgaaaaatggtactgttatggatgtcatctccagacgagaccaaagagggtcgggacaagtaggcacatatggtttaaacacattcactaatatggaagcacagttaataaggcaaatggaatcggagggaatattttccccgtctgaactagaaaccccgaatttagctgaaagggttctcgactggctggagaagtacggcgtagagcgactgaaacgaatggccataagcggagatgattgtgtagtaaaacctatagacgacagatttgcaacagcgctaacggctttaaacgacatgggaaaagtaagaaaagacatacctcagtgggaaccaagtaaaggttggaatgattggcagcaagttccgttctgtagtcatcactttcaccaactaattatgaaggatgggcgagaaatagtcgttccatgccggaatcaagatgaattagtaggccgagcgcgggtatcgcaaggagctggttggagtctaagggaaactgcttgtttaggcaaaagctatgcacagatgtggcaacttatgtattttcaccgccgagacttaagacttgcggctaacgcaatatgttccgctgtaccagtagattggatccctacaagtcgaaccacatggtcaatacacgctcaccatcaatggatgacgactgaagatatgttatcagtctggaatagagtatggattgaagaaaatccctggatggaagacaaaacacatatatcttcttggggtgatgtaccataccttggcaaaagggaagaccagtggtgcggctcactaattggcttgacagctagagcaacttgggctacaaatatacaagttgcaataaaccaggtacgacgactgatcgggaatgaaaattacttagattatatgacttctatgaaacgcttcaagaacgaaagtgatcctgaaggtgcactttggtaa

SEQ ID NO: 21559 - RNA, 9879 nt, synthetic construct
  misc_feature 1..9879: note = derived and/or modified CDS sequence (opt6) from DENV-1__FJ410220__SS-prME
  source 1..9879: mol_type = other RNA
agtgtgactatgttgttgatgttaatgccaactgcattagcatttcacttgaccacacgaggtggagagccacacatgatagtttccaaacaagaaagaggaaaaagtcttttatttaaaacaagtgcaggagttaacatgtgtacacttattgctatggacctaggggaattatgtgaagacacgatgacgtataaatgtcccagaataacggaagcagaaccagacgatgtagattgttggtgtaacgcaactgatacttgggttacatacggcacgtgctcccaaactggagaacataggcgagagaaaagatctgtagcactagctccacatgtaggtctaggattagaaacgcgtacggaaacctggatgagctcagaaggtgcttggaaacaaattcaacgggtagaaacgtgggcattaagacatccaggatttacagtgatagcattattccttgcacacgctatcggtacttcgataacccaaaaaggcatagtatttatacttttaatgttagtgacaccatctatggcgatgaggtgtgtaggaattggatcccgggattttgtagaaggactttctggcgccacgtgggtcgatgttgtactagaacacggttcatgtgttactacaatggctaaagataaacctactttagatattgaattactaaaaacagaagtgactaacccggctgtattgagaaaattgtgtatagaggcaaaaatttcaaatactactactgattcgagatgcccaacacaaggagaagctactcttgtagaggaacaagatgcgaattttgtctgccgtagaacatttgtcgacagaggatggggtaatggctgtggtctcttcggaaaaggttctcttctaacctgcgcgaaatttaagtgcgtcacgaaacttgaaggtaaaatagttcaatatgaaaaccttaaatattcagttatcgtaacagttcatacaggagaccaacatcaagttggtaatgaatccacagaacatggtactacggcgacaattactccacaagcaccgacaacagaaatacagctcacggattatggggcactcacgctggactgttcaccgcgcacgggacttgatttcaacgaaatggtattgctcactatgaaagaaaaatcatggttagtccacaaacaatggtttttggacttaccacttccctggacatctggcgcatcaacttcgcaagagacttggaacaggcaagacttacttgtcacatttaaaaccgcacacgcaaagaaacaagaggtcgtcgtactgggctcccaagaaggagctatgcacactgcattaaccggagcgactgagatacaaacctcgggaaccacaacaatcttcgcgggtcaccttaaatgccgtctaaagatggacaagttaacgctaaaaggcatgagctacgtcatgtgcacaggtagcttcaagctcgaaaaagaggttgcagaaactcaacatggaacagttttggttcaaatcaaatacgaagggactgatgctccttgcaaaataccctttagtacacaggacgaaaaaggagtcacacaaaacggtcgtttaataaccgcaaaccctatcgtcacagataaagaaaaacccgtcaatatcgaggcagaaccgcctttcggagagtcatatatagtaatcggtgctggggaaaaggctttaaagttgtcttggttcaagaaaggatcttctataggaaaaatgttcgaagctactgcccgaggtgcacgacggatggcaatattaggcgacactgcatgggacttcggatccatcggcggcgtatttacatcggtaggaaaactggtgcatcaaatctttggtacagcctatggcgtccttttctccggggtgagttggacaatgaagataggaataggtgtactcctaacatggttaggacttaacagcagatcaaccagcttaagtatgacctgtatagccgtaggtttagttactttatatctaggtgtaatggtacaggctgactcgggttgtgttataaattggaaggggagggaactaaaatgtggaagcggcatatttgttactaatgaagttcatacatggacagagcagtataagtttcaagcagattcacctaaacgactaagtgctgcgataggaaaggcctgggaggaaggcgtatgtggtatccgaagtgccactagacttgaaaatattatgtggaagcaaatatcaaatgaactcaatcacatactgctggagaatgacatgaagttcacagtagtcgtaggggatgtagcaggcattttggtacagggcaagaaaatgattagaccacaacccatggagtataaatatagttggaaatcatggggaaaggctaaaattataggcgccgacgttcaaaatagcacctttataatagacggtcccaatacaccagaatgtcctgatgatcaaagagcttggaacatatgggaggttgaagattacggttttggaatattcacaactaacatttggttaaaactaagggacagctatacacaggtatgtgaccatcgactaatgtcagctgcaataaaggattctaaagctgttcacgcagacatgggttattggatagaatctgagaagaacgaaacctggaaactagcgagagcttcgtttattgaggtaaagacttgtatttggccaaaaagtcataccctgtggtctaatggtgtattagaatccgaaatgataattccgaaaattcatggaggaccaattagtcaacacaactatcgccccggatactttactcagaccgcaggtccttggcacttaggaaaactagaactggattttgatttgtgtgaagggacaacagttgttgtggatgagcattgtggtaatagaggcccgagtcttaggacaactacagtgacaggtaagattatccacgagtggtgttgtagatcttgtacattaccaccattaaggtttaggggcgaggacggatgctggtacggaatggagatacgtccagtgaaggaaaaagaggagaatctggtcaaatccatggtaagtgcagggagcggtgaagtagattcctttagcttaggactcttatgtatctctatcatgattgaagaagtgatgagatcaaggtggtctcgaaaaatgcttatgaccgggacattagcagtattctttctcctaataatgggtcagctaacttggaatgacttgatccggctatgtataatggttggagcaaatgcttccgatcgcatgggtatgggaacaacctatcttgcattgatggcgacgtttaaaatgcgaccaatgtttgccgtaggtttgttattcagaagactaacaagtagggaagtcctgttacttacaatcgggctcagcttggtagctagtgttgagctcccaaactcccttgaagaactaggtgatggccttgccatgggaatcatgattttaaaactactgacggatttccaatcctaccagttgtgggcgaccctattgtctctaacattcattaaaacgacattctcgctacactacgcatggaaaactatggctatggttttatcgattgtatcattatttccactgtgcctttctacaacctctcagaaaaccacatggttacctgtcttacttgggtctctagggtgtaaacctttaacaatgtttctaattgctgaaaataagatctggggtcgaaaaagttggcctttaaatgaaggcataatggcagttggcatagtatcgatcttactgtcatctttattgaagaacgatgttccgctagcagggccccttatcgcaggaggcatgttgatagcctgttatgtgatcagcggaagctcagcagacttatccttagagaaggcagctgaagtttcatgggaagaagaggccgaacattctggtgcatcacataatatacttgtagaagttcaagatgatggaaccatgaaaatcaaagatgaagagagagatgatacgttaactatacttctaaaagctacgctattagcagtatcaggagtctacccactttcgataccagcaactctatttgtatggcatttctggcagaagaagaaacaaagaagcggagtgctatgggacacacctagcccaccagaggtagaacgtgcagtattggatgacggaatttatcgcataatgcagaggggcttgttaggtagatctcaagtaggtgtcggtgtatttcaggaaaacgtcttccacactatgtggcatgtaactcgtggagcagtactaatgtatcaaggaaaaagacttgaaccaagttgggcctctgttaagaaagaccttatatcatacggagggggctggagatttcaaggaagttggaatactggtgaggaagttcaagtcattgcggtcgaaccaggcaaaaatcctaagaatgtacagacggctccgggcacatttaaaacaccagaaggagaagtgggagctattgccctcgacttcaaacctggcaccagcggatccccaatagtaaaccgagaagggaaaattgttgggctgtacgggaacggagtcgtaacgactagcgggacatacgtatccgctatagcccaggcgaaagccagtcaagaaggtccgctgccagaaatcgaagatgaagtatttagaaaaaggaatctaactatcatggatctccatccaggttccggtaaaacgcgaagatatttacctgcgatagtacgggaagctataaagcgtaagttgcgaacattaatattggcacctaccagagttgttgcaagtgagatggcagaagcactaaaaggaatgccaattcgttaccaaacaaccgcagtgaagtcagagcacacgggaaaggaaatcgtggacctaatgtgtcacgccacgtttacaatgcgtctactaagcccagttcgggttccaaactacaatatgatcatcatggacgaggctcattttactgatccctcatcaatagcagcaagaggttacatatcaacccgcgtcgggatgggagaagcagcagcgatatttatgacggctacccctcccggctcaatggaggctttccctcaatcaaacgcagttatacaagacgaagaacgtgatattccggaaaggtcctggaactcagggtacgaatggataacagactttcctggcaaaacagtttggttcgtcccctccataaaagcaggtaatgatattgctaactgcttaaggaaaaacggtaaaagagtaatacaattatcgaggaaaaccttcgataccgaatatcagaaaactaaaaataatgattgggattatgtagtgactacagatatatcagaaatgggcgccaacttccgtgcagatagagtcattgatccacgcagatgtttaaaacctgtgatactcaaagatgggcctgaaagagtaatattagctggtccaatgcctgtgaccgtggcatccgcagcacaacgtagaggacgcattggacgaaatcacaacaaggagggagatcagtacatttatatgggacaacctctgaataatgatgaagatcatgcacattggactgaagccaaaatgctcttagacaatattaacacccccgagggaataatacccgcgctattcgaacctgaacgagagaaaagcgctgcaatcgatggggagtacagattgcgaggagaagccaggaaaactttcgtagagttaatgaggcgaggtgacctcccggtgtggttatcatacaaagtagcatcggagggatttcaatattccgaccgacgatggtgttttgacggggaacgaaacaatcaagtgttggaagagaacatggatgtagaaatatggaccaaagaaggcgaaaggaagaaactccgtccgcgttggctagacgcccgtacatacagtgacccattagcattaagggagtttaaagaatttgcagcaggtagaaggagcgtcagcggagatttgattttggagataggcaaactacctcaacacttaacacaaagagcacagaatgcacttgacaacttagtgatgctacataattcagaacagggagggagagcatacagacatgcaatggaagaactaccagatacaatcgaaacactcatgttattagcacttatagcagtgctaacaggcggagtaaccctgttctttttatcagggaaaggtttaggtaagacatcaataggcttactatgtgtaatggcatcatcagtacttctatggatggcatcagtagaaccacactggatagcagcttccatcattttagagttctttttaatggtactactaatcccagaaccagacaggcaacgaacgccgcaagacaatcaactggcttacgtcgtgattggcttattatttatgatattaacagtagccgctaatgaaatgggactactagagacaactaagaaagatctaggtataggacatgttgctgttgaaaatcatcaccacgccgccatgcttgatgtcgatttacatccagcgtccgcttggacgttatatgcagtggcaacaacgattatcacccctatgatgcggcatacaattgaaaacactacagcaaacatcagcctaacggcgatagcgaaccaagcagccattcttatgggcctagataaagggtggccaatatcaaaaatggatatcggggtaccccttttggcgctaggttgttactcacaagtgaatcctctaacattgactgcagcagtattaatgctagttgcgcactacgctatcataggcccaggactacaggcaaaggctacacgagaggcacagaaaagaactgccgcaggtatcatgaaaaaccccactattgacggcatagtcgcgatagatttagacccagttgtttacgatgcaaaatttgaaaaacaacttggacaaataatgctgctaatcctttgtacgagtcaaatactactgatgcgaactacttgggcactatgtgaatcaatcacattagcgactggccctctaacaacactatgggagggatcgcctgggaaattttggaataccaccatcgccgtgagtatggcaaatatattccgcggatcatatctagcaggggcaggactagcattcagtttaatgaaatcattaggtgggggacgcagaggcaccggtgcacaaggcgagacactaggggaaaaatggaaaagacaactgaatcaactaagcaaaagcgaatttaatacatataaacgatccggtataatggaggtggatcggtcagaggcaaaagaaggtcttaagagaggggaaactaccaaacatgccgttagtagaggtactgccaaacttagatggtttgtcgaaagaaaccttgtgaaaccagaagggaaagtaatcgacttgggttgcggtagaggtggatggtcgtactactgcgcgggattaaagaaagtaacagaagtaaaaggatacactaaaggagggcctggccatgaggagccaattcctatggccacatatggttggaatctggtaaaacttcatagtggaaaagatgtgtttttcataccaccagaaaaatgtgacaccctcctctgtgacattggagaaagtagcccaaatccgacgatagaagaaggtcgtactttgagggttctaaaaatggtcgaaccatggttacgcggcaaccagttttgcattaaaatattgaacccctacatgccttcagtagttgaaacattagaacaaatgcaaagaaaacacggaggaatgcttgtacgaaatccccttagcagaaatagtacacacgaaatgtattgggtatcgtgcggaacgggaaatatagtatcagcagtcaatatgacaagtcggatgcttctaaaccgattcacaatggcccaccgaaaaccaacttatgaaagagatgtggatttgggtgccggaacgagacatgtagctgttgaacccgaggtagccaatctcgacattataggccaacgaattgagaatataaaacatgaacacaagtcaacttggcactatgatgaagataatccatataagacgtgggcataccatggcagttacgaagtcaagccatctggatcagcttcgagtatggttaacggagtcgtaaaattactaacaaaaccctgggatgttattccaatggtaacacaaatagcaatgacggacacgaccccctttggacagcaacgcgtttttaaagaaaaggtagacactcgcacacccaaagcgaagcgtggtacggcccaaattatggaagtcactgcacgttggctatggggctttttaagcaggaataagaaacccagaatttgtacaagagaagaatttacccgtaaggtgcgctccaatgcagcgatcggtgcagtattcgtggacgagaaccagtggaactcagcaaaggaagcggtagaagatgacagattctgggatttagtacatcgtgaacgtgagctgcataaacaaggaaaatgtgcaacctgtgtctacaacatgatggggaaacgcgagaagaaattaggggaatttgggaaagctaagggatcacgtgcgatctggtatatgtggctgggtgcgagattccttgaatttgaagcgcttggtttcatgaacgaagatcattggttctcgagagaaaacagtttgtcgggtgtcgaaggagaaggactacacaaactagggtatatactgagagacattagtaaaattccaggaggaaacatgtacgcggacgatacggcaggatgggacaccaggataacagaggacgatctacaaaatgaagcgaaaataacagacataatggagccagaacacgccttactagccaagtccattttcaaattgacttatcagaataaagttgtaagagtgcagcgaccggctaaaaacggaactgtgatggatgtaatttcgcgcagagaccaaagaggcagtggccaagtcggaacatatggacttaatacgttcacaaacatggaagcccaactgattagacaaatggaaagtgaaggaatcttcttgccgaacgaattagaaaccccaaatctagctggaagagtcttagattggttggagaaatacggagtcgaacgtttaaaaagaatggcaatatctggtgatgattgtgtggtcaaaccaatagacgatagatttgcaacggctctaacagcgttaaatgatatgggcaaagtgcgtaaagacattccacagtgggagccatccaaggggtggaatgactggcagcaagtcccattctgctcacatcattttcaccaattaattatgaaagatggacgcgagattgttgtaccgtgcagaaatcaagatgaactggtaggacgagcaagggttagtcaaggtgcaggttggagtctaagagaaacagcttgcttaggaaaaagctatgctcaaatgtggcaattaatgtacttccataggagagatctacgcctagccgctaacgcaatatgctccgcagtaccagtcgactgggttccaacatcacgaactacatggtctatacacgctcatcatcaatggatgacaaccgaagatatgctaagcgtctggaatagagtatggatagaggaaaacccttggatggaagataaaacccgaatcagttcttgggaagatgttccgtatctaggcaagagggaggatcaatggtgcggaagcctcataggactaactgcgagggcaacttgggcaactaacatacaagtggctattaatcaagtcaggaggttgataggaaatgaaaactatagtgattacatgacatcaatgaaacggtttaaaaatgaaagtgaacctgaaggtgcattgtggtaa

SEQ ID NO: 21560 - RNA, 9879 nt, synthetic construct
  misc_feature 1..9879: note = derived and/or modified CDS sequence (opt6) from DENV-1__JF937649__SS-prME
  source 1..9879: mol_type = other RNA
tctgtaacaatgttattaatgctcatgcctacggctcttgcatttcatttaacgacacgaggaggcgaaccacatatgatagtaagcaaacaagagcgtggaaaaagcctactgtttaaaacaagcgcaggagtgaacatgtgtacattaattgccatggatcttggagaactgtgtgaagacaccatgacatataaatgcccgaggataacagaagtggaaccagatgacgttgactgctggtgtaatactacagatacgtgggttacgtacggtacatgttcgcaaactggtgaacatagacgagataaaagatcggtagcccttgcacctcatgtaggattaggcctagaaacccgcgcagagacttggatgtcgagcgagggtgcatggaaacaaatacaaaaagtagaaacatgggcgctgcgtcaccctggattcacagtcattgctttgtttctagctcatgcgattggtacctcgatcacacaaaaaggaataatattcattctcctcatgttagttactccatcaatggcaatgagatgtgtaggaatcggctcgagagactttgtcgaggggttatctggagcaacctgggtagatgtagtactggaacacggtagctgtgtgacaacgatggcgaaagacaaacctactctagatattgaattattaaaaacagaggttactaatcccgcagttctaagaaaactgtgtatagaggcgaaaatctctaacacaaccaccgattctagatgccctacacaaggtgaggccactctggtagaagaacaagacgccaatttcgtttgcagaagaacattcgtcgaccgtgggtgggggaacggttgcggactttttggaaaaggttccctgataacgtgcgctaaatttaaatgtgtaactaaacttgaaggaaaaatagtgcaatatgaaaacctaaaatattcagttatagtaacggtacatacaggtgatcagcatcaagttggaaatgaatctaccgaacatgggacaacagcaactataacgccacaagcacctacatcagaaatccaactcacagactacggagcactaactctagactgtagtccaagaactggactggattttaacgagatggtcctactgacaatgaaagaaaaatcatggcttgtacacaaacaatggtttctagatctcccgttaccgtggacatcgggagcctcaacgtcccaagaaacatggaatagacaggacctattggttacgtttaaaacagcacatgcaaagaaacaggaagtcgtggtactaggtagccaagaaggcgcaatgcatactgcgcttacgggagcgacagaaatacaaacaagcgggactacaaccatttttgctggacatttaaaatgccggcttaaaatggacaaactaacattaaaaggaatgtcatatgtcatgtgtactggaagtttcaaattagaaaaagaggtggctgaaacacaacatgggacagtcctagttcagataaagtacgaaggcaccgacgcaccatgtaaaatacctttcagcacacaagatgaaaaaggagtaacgcagaacgggagacttataaccgccaaccctattgttacggacaaagaaaaaccggtgaatattgaggccgagcctccgtttggtgaatcatacatagtaataggagcaggagaaaaagcattaaaactaagttggtttaagaaagggagtagtatagggaaaatgtttgaagctacagctagaggggcaagaaggatggcgatattaggagatacggcatgggactttgggagtattggtggagtttttacttctgtaggtaaattagtccatcaaatatttggaactgcatacggggtcttattttcaggtgtatcatggacgatgaagataggaataggagttttactgacatggctggggctaaattcaagaagcacaagcctaagtatgacctgtattgcggtcggattagtaactctttatctaggtgtaatggtacaggcagattccggatgtgtaattaactggaaaggaagagagcttaaatgcggaagcgggatcttcgtaacgaatgaagtacatacatggacagagcaatacaaattccaggcagacagcccaaaacgattaagtgctgctataggaaaggcctgggaagaaggcgtttgcggaataagatcagcaaccagattagagaacatcatgtggagacagataagcaatgaactgaaccatatattattagagaacgacatgaagttcactgtcgttgtcggggatgtagttggtattttagctcaaggtaagaaaatgattagaccgcaacctatggaacataaatacagctggaaatcttggggtaaggctaagataataggagctgacgtacaaaacacgacatttataattgatgggcccaatactcccgaatgtccagatgatcaaagagcatggaatatatgggaagttgaagattacggattcggaatcttcactacaaatatatggttaaaacttcgggactcatatacacaagtgtgtgaccataggttaatgagcgctgcgatcaaagattcaaaagctgtccatgcagacatgggatattggattgaatcagagaaaaacgaaacatggaaactagcccgcgcgtccttcatagaagtaaaaacatgtatttggccaaagtcacatacattgtggtcaaatggagtgttggaaagcgagatgataatacccaaaatctatggaggacccataagtcaacataactatcgaccagggtacttcacacaaacagcagggccatggcatttgggaaaacttgaactagatttcgatttatgcgaaggtacaacggtggtcgtcgatgagcattgtggaaacagaggcccgtctttaaggacgactacagtgactggtaagatcatacacgaatggtgttgccgatcatgtactttacctccgttaagatttaaaggggaagacggttgctggtatggaatggaaatacgaccagtcaaagagaaagaggaaaacctggtaaaaagcatggttagtgcaggttccggagaagttgactccttctctcttgggttactatgcataagcataatgatcgaagaggtcatgaggtcccgttggtctagaaagatgcttatgacaggcactttagccgtattctttctcctaatcatggggcagctgacatggaacgaccttataagatcatgtattatggtcggcgcaaacgcaagcgacagaatgggtatgggcacaacgtatcttgcccttatggctacatttaagatgaggcctatgtttgccgtaggattattattcagaagattgacctcacgagaagtactcctactgacaatagggctaagtctagttgcatcagtagagttacctaactcacttgaggaactgggcgacggacttgcgatgggtataatgatattaaaattacttactgatttccaaagctatcaactttgggcaactttgttaagcctaacatttataaaaaccaccttctcactgcattatgcttggaaaaccatggccatggtcctatctatagtttcgctattaccactgtgcttgtcaacgacatctcagaaaacaacctggttaccggtactcctaggatcactaggctgtaaacccttaactatgtttctaatagctgaaaacaagatatggggaaggaaatcatggccactaaacgaaggcatcatggctgtagggatcgtgtctattctcctcagcagtttattgaagaatgatgtgccattggcaggacctttaattgcaggcggtatgttgatagcatgctacgtcatatcgggtagtagcgctgatctatctttagagaaagcggcagaagtgagctgggaggaagaagctgaacattccggagcatctcacaacatcttagtagaagttcaagacgatggaactatgaagataaaggatgaagaaagagatgatactttaacaattcttttgaaagcaactctattagcagtaagcggcgtttatccccttagcattcctgccacattatttgtatggtacttttggcagaagaagaaacaacgcagtggtgtgttgtgggatacgccatcaccacccgaggtggaacgcgctgtattagatgatggaatataccggataatgcagcgcggtttacttggacgatcacaggttggagtgggtgtctttcaagagaatgtattccacacaatgtggcatgttacgcgcggggcagtactaatgtatcaaggaaaaagactagaacctagttgggcatccgtgaagaaggatttaatcagttatgggggcggatggcgattacaggggtcttggaacacaggagaggaagttcaagtaattgctgtagaaccaggcaaaaaccccaaaaatgttcaaaccgcaccgggaaccttcaaaacaccggaaggtgaagtcggagctatcgcccttgattttaagcctggaacgtcaggctcgccaatagtaaatcgtgaaggaaagatagtcgggctttatgggaatggagttgttactacttcgggaacgtatgtaagtgccatagcacaggccaaagcatctcaagaaggtcccctgcccgagatcgaagatgaggtatttcgcaaaagaaatctaaccataatggacctacatccgggatctggtaaaactcgtaggtatctccccgctatagtccgagaagcaatcaaacggaaactgcgaacattaattctggcaccgactagagtagttgcatctgaaatggcggaagccttgaaaggaatgccaatccggtaccaaacgacggccgtgaagagtgagcacactggcagagagatagtcgacctaatgtgccatgctacctttactatgcggctattatcccctgtaagggtacccaattacaacatgatcatcatggatgaagcacattttacggacccaagtagtatcgccgcaagagggtatatatcaaccagggtgggaatgggagaagcagccgcgatctttatgactgcgaccccgccaggtagcgtagaggcttttccgcaaagtaatgcggtaattcaagatgaagaacgagatataccggagcgcagctggaactcgggttatgaatggatcactgattttcccggtaagacagtgtggttcgtaccctccataaaatcaggcaatgatattgccaactgcctccgtaaaaatggaaaaagagtaatacaattatcaagaaaaacttttgatacagaatatcagaaaacgaaaaataatgactgggattatgttgtcaccacagacataagtgaaatgggtgcaaacttccgcgccgaccgagtaattgacccacgtagatgtctcaaacctgtcatattgaaagatgggccagaacgcgtaatcttggcaggacctatgccagtaacggtagcaagtgccgcacaaagaaggggtcgaataggcagaaatcataataaagaaggtgaccaatatatctacatgggtcaaccgttaaataatgatgaagatcatgcacattggacagaggctaaaatgttgttggacaatataaatactccagaaggtatcattccagcgttattcgagcctgaaagggaaaaatcagcagcaatagatggagaatatcgtcttcgaggagaggcaaggaaaaccttcgtcgaattgatgagaaggggagacctacctgtgtggcttagctataaggtagcctcggaaggatttcagtattccgatagaagatggtgttttgacggagaacgaaataatcaggtactcgaagaaaatatggacgtcgaaatttggactaaggaaggcgaaaggaagaaattacgcccacgttggctcgatgcgcgaacatactcggatcctctagcgttaagggagttcaaagagtttgccgcagggcgaagaagcgtctcaggggatttaattctggagattggaaagttacctcaacacctcacgcagagagcgcaaaacgcactagataatctggttatgctacataactctgaacaagggggtagggcatacagacatgcgatggaagaactccccgacacaatagagacccttatgcttctcgctcttatagccgttttgacaggcggggtcactttgtttttcttgtctggaaaaggtctaggaaaaacctctattggactattatgtgtgatggcaagttcagctctattgtggatggcgtctgtggaaccccattggatcgctgcgtctattatattagagttctttttaatggtactactaattccggaacccgatagacaacgtactccgcaagataatcaattagcgtatgtagtcataggattactcttcatgatcctcactgtagccgcaaacgaaatgggcctccttgagaccacgaagaaagatttaggcataggacacgtagcggtcgaaaatcatcatcacgccacaatgctggacgtggatcttcatcctgcaagcgcctggactctatacgctgtagccacaactatcattacaccgatgatgcgacacaccatagaaaatacaacagcaaacataagtttgaccgcaatcgcaaatcaagcggcaatcttaatgggacttgataaagggtggccaataagtaaaatggacattggagttccacttcttgctctgggttgttattcgcaagtgaatccactaacacttacagccgccgtgcttatgttagtagcccattatgctataataggaccaggcttgcaagctaaagccaccagagaagcccaaaagagaacagcggctggtataatgaaaaacccaactgtcgatggtatcgtggcgatcgatctcgatccggtagtgtatgatgcaaaatttgaaaaacaattaggtcaaataatgctgctaatattatgtacatcccaaatcctgttaatgagaacaacatgggcattatgtgaatctattactctagctactggaccacttacaaccctatgggaaggatctccgggaaaattctggaatacaaccattgccgtaagcatggctaacatatttaggggaagttatctggccggtgcgggtttagccttttcattaatgaaatctttgggtggaggtagaagagggaccggggcacaaggtgagactttaggcgaaaaatggaagcggcaattaaatcaactatccaagagtgagtttaatacttataaacgatccggaataatggaagttgacaggtcagaagctaaggaaggactacgacgaggagaaactaccaagcatgcagtaagtaggggaaccgcaaaattacgatggtttgttgaaaggaacctagtaaaacccgaaggaaaagtaatcgacctaggatgtgggagaggcgggtggtcatattactgtgcagggctcaagaaagtaactgaagtaaagggttatactaaaggtggtccaggacatgaggaaccaattcctatggcaacctatggatggaatttagttaaattacacagcggaaaagatgtcttctttataccgccagagaaatgtgacactctattgtgcgatataggagagtcaagcccaaatcccacaatagaagaaggtagaacattacgtgtattgaaaatggtagaaccctggctacgaggaaatcagttttgtataaagatcctcaacccatatatgccaagcgtagtagaaaccttagaacagatgcagagaaaacatgggggtatgctagtcaggaatccactaagtcgaaatagtactcacgagatgtattgggtgagttgtggaacagggaatattgtatctgctgtcaacatgacatcaagaatgctattgaatcgctttactatggctcatagaaaaccaacatacgagcgcgatgtagacctgggagctggtacgcgtcatgtcgcagtcgagcccgaagttgcgaatttagatatcattggccaaagaatagagaacattaaacatgagcataaaagcacatggcactacgatgaagacaacccctacaaaacgtgggcctaccatggatcttacgaagttaaaccaagtggctcagcatcatctatggtgaacggagttgtcaaattgttgactaaaccttgggatgtaataccgatggtcactcaaatagctatgacagataccacgcccttcggacaacaaagagtgtttaaagagaaagtggatacccgcacgcccaaagcaaagagaggaacagcacaaataatggaagttacagcgagatggttatgggggtttctgtcacgtaacaagaaaccgaggatttgtactcgtgaagaatttacacgtaaagttcgatcgaatgccgcaataggtgcagtttttgtagatgaaaatcaatggaatagtgccaaagaagcagtcgaagatgaaagattctgggatctcgtgcatagagaaagagaattacacaaacaaggtaaatgcgccacctgtgtatataatatgatgggaaagagggagaagaaacttggtgagtttggaaaagcaaaaggatctcgggcaatttggtacatgtggctcggagcaagatttttagagtttgaggcattaggatttatgaacgaagatcattggttcagcagggaaaatagtttatctggagtagaaggagaaggcctccataaactaggctacatcctacgggacatttctaaaataccgggcggcaatatgtatgctgacgatacagcgggctgggacacaaggataactgaagacgatttacagaacgaggcaaagattacggacatcatggaaccagaacacgccctgcttgcgacatcaattttcaaattaacgtatcaaaacaaagttgtaagagtacaacgacccgcacgcaatggcacagtaatggatgttataagtagaagagatcaaagggggtctggacaggttggtacatacggattaaatacgttcacaaacatggaagcgcagctcattagacaaatggaaagtgaaggaatattctcaccaagtgaattagaaacaccaaacttagccgaacgagtcttagactggctagagaaacacggagtggagagattaaagaggatggcaataagcggagatgactgtgttgttaaacctattgacgacagatttgcaaccgcgttaagtgctttaaacgatatgggaaaagtaagaaaggacattccacaatgggaaccgtcaaaagggtggaatgattggcagcaagtccccttctgttcccaccatttccaccaattaataatgaaagacggcagagaaattgttgtaccatgtcgcaaccaagatgaattagtaggtagagccagagttagtcagggggctggctggtctttgcgggaaacagcatgtttaggcaaatcttatgcacagatgtggcaactcatgtacttccatcgaagagatcttcgattagccgcaaacgccatttgctccgcggttcctgttgactgggtgccaacaagcagaaccacatggtcaattcatgcacatcatcaatggatgacaactgaggatatgttaagcgtatggaacagagtgtggattgaagaaaacccatggatggaagacaagacccatataagtagctggggagatgtaccttacctaggtaagcgtgaggatcagtggtgtggctccttaatcgggctcaccgcgcgggccacttgggcaacgaatatacaggtggcaattaaccaagttagaaggcttataggaaatgaaaactatctcgattacatgacttcaatgaaacgatttaaaaatgaatcggaccctgaaggcgcattgtggtaa

SEQ ID NO: 21561 - RNA, 9879 nt, synthetic construct
  misc_feature 1..9879: note = derived and/or modified CDS sequence (opt6) from DENV-1__FJ410222__SS-prME
  source 1..9879: mol_type = other RNA
tccgttacgatgttacttatgctaatgcctactgcattagcatttcatttaacgactcgtggtggtgaaccacatatgattgtaagtaaacaggaacgcggaaaatcactattgtttaaaacgtcggcaggagttaatatgtgtactttaattgctatggacttaggagaattatgcgaagatacaatgacatacaaatgccctaggataacagaaaccgaaccagacgatgtagactgctggtgtaatgcaaccgatacatgggtaacttacggtacatgctcacagacaggggagcaccgcagagacaaacgctctgttgcactggccccacacgtaggattagggctagaaactaggacagaaacttggatgtcatccgagggagcatggaaacaaatacaaagggttgaaacttgggcccttaggcatccgggatttacggttatagcattgtttctggcccatgcaataggcacgtcgatcactcagaagggaataatatttatcctattgatgctcgtaaccccaagtatggctatgcgatgcgtcggaataggatcgagggattttgtagaaggtttgtctggggcgacatgggttgacgtagtgttagagcatggctcttgcgtcacaactatggcaaaggacaaacctacattagatatcgagctattgaaaactgaagtaacaaatccggcagtcttgcgaaaattatgtatcgaagcaaaaatatctaatacaactactgattctcgatgtccaacacaaggagaagcgaccctagttgaagaacaagatgctaattttgtctgcaggagaacgtttgtggatcgggggtggggaaatggttgcggtttattcggaaaaggttcactgataacctgtgcaaagtttaaatgtgtaacaaagctagaggggaagatagtgcagtacgaaaacctaaaatattctgtcatagtaacagtgcacacaggagaccagcatcaagtaggtaacgaaagcacagaacatgggacaacagcaacgattacaccgcaagcgcccacaaccgagatccaactaacagattatggggcactcacactagactgttcccctaggacaggtctagacttcaatgaaatggtactattaacaatgaaagaaaaatcatggttagttcataagcaatggtttctagacctgcctttaccttggacaagcggtgcaagcacaagtcaagaaacgtggaacagacaggacctattagtgactttcaaaaccgctcatgcgaagaaacaagaagtcgtagttcttggttcccaagaaggagctatgcatactgcgctgactggggcaacagagattcaaacatccggtactaccacaattttcgctgggcacttgaaatgtaggttaaaaatggacaaattaactctaaagggtatgtcatatgtaatgtgtacaggcagtttcaaacttgaaaaggaactagcggaaactcaacatgggaccgtcttagtacagatcaaatatgaagggacagacgcgccatgcaaaatcccatttagtacccaggatgaaaagggagttacccaaaatgggagactaatcaccgcaaatccaatcgttacagacaaagaaaaaccagtaaatatcgaagcggaaccaccattcggcgagtcttacatcgtaataggcgcaggagaaaaggctttaaaacttagctggttcaagaaaggatcgagtattggtaaaatgttcgaagctacagcacggggagccaggcgaatggccatactgggtgacactgcttgggactttggatcaattggtggtgtctttactagcgtaggaaaattggttcatcaaatttttggaacggcatatggagttctttttagtggggtgagctggacgatgaaaataggaatcggagtactactaacttggctcggtttaaacagccgatccacaagtttatcaatgacatgtatagccgtaggtctagttacgttgtacttaggcgtgatggttcaagctgattcaggatgtgtaatcaattggaaaggtcgagaattaaagtgcggctcaggaatctttgttacaaatgaggtgcatacttggacagaacagtataaatttcaagcagattcacctaaacggctatccgccgcaatagggaaagcctgggaagaaggagtgtgtggcattcgttcagcaacacgcttagaaaacataatgtggaaacaaatatcgaacgaactaaatcatatacttctagaaaatgatatgaaattcacggtagttgtcggagatgtagcagggatcttagcgcagggcaagaaaatgatacgtcctcaacccatggaatataagtatagttggaaaagctgggggaaggcaaaaataatcggggcagatgtacaaaacacaacctttatcatagacggaccgaacacacccgaatgcccggacgaccaaagagcctggaacatttgggaagtagaagattacggctttggaatttttacaacaaacatctggttaaaacttagggattcgtatacacaggtctgcgaccacagattaatgtccgccgctatcaaagacagcaaagcagttcacgctgatatgggttactggattgaatctgaaaagaacgaaacctggaaattggcaagagcctcttttatagaagtgaaaacttgtatatggccaaaatcacatacgctctggtcgaacggtgttttagaatcagagatgataatcccaaaaatctacggcggtcccatctctcagcataactataggccaggttattttacacagacagctggaccatggcatctaggaaagttagaactagactttgatttatgtgaagggactacagttgtagtggatgaacactgcggaaatagaggaccatcacttaggacaacgaccgtaaccggcaaaattatccacgaatggtgttgccgcagctgcacacttcccccattaagatttcgaggggaagatggatgctggtatggtatggaaataaggcccgttaaagaaaaagaagagaacctagttaaaagtatggtttcagccggatcgggtgaagtagactcgttctctttgggactgttatgtatctcaataatgattgaagaagttatgaggtcacgttggagcagaaaaatgttgatgaccggaacactagcagtatttttccttttgataatgggacagctcacttggaatgatctaataagactgtgcataatggtaggtgcaaatgcttctgaccgaatgggaatgggcactacttatttggcattaatggcaacatttaaaatgagacccatgttcgccgtagggttactgtttcgtaggctaacatcacgtgaggtcctattgttaacaataggcttatctctagtcgcttcagtagagctgcctaatagtcttgaagaactcggagatggtttggctatgggtataatgatactcaaattacttacagattttcaaagtcatcaattatgggccacattattatccttaactttcataaagacaacattttctctgcactacgcatggaaaacaatggctatggttttatcaatagtgtcactcctaccactatgtctatcaacaacctcccagaaaaccacatggctaccggtcttgctaggatccttgggctgcaaacctctaacaatgtttctcatagcagaaaataaaatatggggtagaagaagttggccattaaacgaaggcataatggccgttggaatagtaagtatactgctaagtagtctactaaagaatgacgttcctcttgcaggaccattgatagcaggaggtatgttgatcgcatgttatgttatatcaggaagtagcgcggatctgagccttgaaaaagcagcagaagtatcatgggaagaggaagcagagcactctggggccagtcataacattttagttgaagtacaagacgacggaaccatgaagattaaagatgaagaacgtgatgatacactaacaatactactaaaagcaactttactcgccgtcagtggggtataccccctatcaatcccagcgactttgtttgtatggtatttttggcaaaagaagaaacaaagaagcggggtcctatgggacacccccagtcctccagaagtcgagagagccgttcttgacgatggaatatacaggataatgcaaagaggcttactaggcagatcccaagtaggtgtgggtgtctttcaagagaatgttttccatacaatgtggcatgtaactcgtggggcagtgttaatgtaccaagggaaacgccttgagccttcttgggcatccgttaagaaagacctaataagctatgggggaggctggcgactacaagggagttggaacaccggtgaagaagtacaagtcattgctgtagaacccgggaaaaatccaaagaatgttcagaccgccccaggaacattcaaaacaccagaaggagaagtcggagcgatcgcactagactttaagcctgggacctctggaagtccaattgttaatagagaaggtaaaatcgtaggtctatacggtaacggtgttgtcacaacttcaggtacatatgtgagtgctattgcccaagcgaaagcaagtcaagaaggccccttgccggaaattgaagacgaggtatttagaaaacgaaacctcactataatggatctccacccgggctccggaaaaacgcgtcgatacctccccgcaatagtacgtgaagcgattaaaaggaagttaagaaccttaatactggctcctaccagagtcgtggcctcagaaatggcagaagcattaaagggaatgcccatacgctatcaaacaacagctgtaaaatcagaacatactggcaaagaaatagttgacttgatgtgtcacgcaacattcacaatgcgactcttgtctccggtaagagtacccaactacaatatgataatcatggacgaagcccacttcactgacccatctagtatagctgcccgtggctatatatcaactagggtaggcatgggagaagcagctgctatatttatgacggcaacaccccctggcagcgtcgaagcattcccgcaatcgaatgcggtcatccaagatgaagaacgggatatccctgaaagaagttggaactcaggctacgagtggattacagattttcctggtaaaactgtatggtttgttccaagtattaaatcgggcaatgatattgctaattgtctacgaaagaatggcaagcgtgtcatccagctaagtaggaaaacattcgacactgaatatcaaaagacgaagaataatgattgggattacgtagtaacaacggatatatcagagatgggcgctaattttcgagcggatagagtcattgacccaagaaggtgccttaaaccagtaattttgaaagatggcccagagagagtaattctagctggtccaatgcctgtgacagtggcaagtgcagcacaacgacgagggaggataggacgaaatcataataaagaaggtgatcaatatatctatatgggtcaaccattaaataacgacgaagaccacgcgcactggactgaagcaaagatgttattagacaatatcaatacaccagaaggaatcattcccgccctgtttgagccagaacgtgaaaaatcggcagcaattgacggagaatacagattgagaggtgaggccagaaagacgttcgttgaattaatgagacgtggcgaccttccagtttggctcagctacaaagtggcaagcgaaggcttccaatatagtgatagacgatggtgtttcgatggagaaagaaacaaccaagttttagaagaaaacatggacgtagaaatatggacaaaagaaggcgaaagaaagaagctaagaccgagatggttagatgctagaacttatagcgacccactagctcttagagaatttaaagaatttgcggcaggtagaagaagtgtaagtggcgacttaatattagaaatcgggaagttaccacaacacctgacacaacgagcccaaaatgccttagacaatttagtcatgctacacaactccgagcaaggtggccgggcataccgacacgcaatggaagaactaccagacaccatcgagacgcttatgctgttagctctaattgctgtcctaacaggaggtgttacactcttcttcttaagtggtagaggactaggaaagacttcaattggtcttctttgtgtcatggcgtcaagcgtgctactctggatggcctctgtggaacctcactggatagccgctagtataatattagagttctttctaatggtgttattgattcccgaaccggatcgccagagaacaccacaagataaccaattagcgtatgtggtaattggacttttgttcatgatactaacagtagcagctaacgagatgggattactcgaaactacgaagaaagaccttggaattggtcatgtggccgttgagaaccatcatcatgcggcgatgcttgatgttgacttacacccggcgtccgcatggacactttacgctgtagcaactacaataattacacctatgatgagacacactattgagaacactacagcaaatatctcattaacagctatcgcaaaccaggcagcaattttaatgggactagataagggctggccgatctcgaagatggatattggagtacctttattagcactgggatgttacagccaggttaatcctcttactttaactgcagcagtgctcatgctagtcgcccattatgccatcataggacctggactacaagcgaaggcgacccgtgaggcgcagaaaaggactgcagcgggaatcatgaaaaacccaactgtcgatggtatagtcgccattgacctagaccctgtggtttatgatgcaaaatttgaaaaacaactaggtcaaatcatgctattaatactttgtacaagtcagatattactaatgagaactacttgggccttatgtgagtcgatcactctggctaccgggccactaacaacactatgggaaggttcccctgggaagttttggaacaccactattgccgtatcaatggcaaatatattccgagggagctacctagccggagccggccttgcgttttctctgatgaaatccttgggtggaggtcggcggggcacaggagcccaaggcgaaacactcggagaaaagtggaaaaggcaactaaatcagctgtcaaaatccgaatttaatacttacaaaaggtctggtattatggaagtcgacagaagtgaggctaaggaaggattaaaaagaggggaaaccaccaaacacgcggtgagcaggggtactgccaagttgagatggttcgtagaaaggaacttagtaaaaccagaaggaaaagtaatagatctaggatgtggaagaggaggttggagttactactgcgcaggtctaaagaaagtgactgaagtcaaaggttatacaaaaggaggtcctggacacgaagaacccataccgatggcaacatacggatggaatttggttaaattacattctggaaaagacgtattctttatccctcctgaaaaatgtgatacactcttatgtgacatcggtgaatcctccccaaatccaacaatcgaggagggtaggacgctacgggtattgaaaatggtagaaccatggttaagagggaaccaattttgtataaaaatacttaacccgtacatgccttcagtcgtagagactttagaacaaatgcaacgaaaacacggaggcatgcttgttcgcaatccattgagtaggaacagtactcatgagatgtactgggtaagctgtggaactggaaatatagtctctgcagttaatatgacctcgcgaatgctacttaaccgatttacaatggcccacaggaaacccacatatgagagagatgtcgatctaggtgcaggtactagacacgtagcagtagaacccgaggtggctaacttagacataataggacaaagaattgagaatataaagcacgagcacaaaagtacttggcattatgacgaggataatccgtacaaaacctgggcataccacgggtcatacgaagtaaaaccctccggttctgcaagctccatggtgaatggagtagtcaaacttctaacaaaaccttgggatgtaataccgatggtcactcaaatagcaatgactgatactactccttttggccaacaaagggtattcaaggaaaaagtagacacaagaacgcctaaagctaagcgaggcacagcacaaataatggaagtaacagcaaaatggctatggggattcctaagccggaataaaaagccgcgaatctgcacgcgagaggagttcacgcgaaaagtccggtctaatgccgccatcggagctgtattcgtggatgaaaatcaatggaactctgcaaaggaagcagttgaagatgagagattttgggacctcgtacatagagaaagggaacttcacaaacaaggaaagtgtgctacatgtgtatataacatgatgggtaaaagagagaagaaattaggagagttcggtaaagccaaagggagtagggctatttggtatatgtggctaggtgccagattcctcgaatttgaagctctaggcttcatgaatgaagaccattggttctcgcgtgaaaattcgctctcgggagtcgaaggagaaggactacacaaactaggctatatactgagagatataagtaaaataccaggtggtaatatgtatgccgacgacacagccgggtgggatacccgcattactgaagatgatctacaaaatgaagcacgaatcacagacattatggaacccgagcacgctctattagcaaagagtatttttaaattaacttatcaaaacaaagttgtacgagttcaaaggcctgccaaaaatggcacggttatggatgtgatatcgagaagggatcagagaggcagcggacaggtggggacatatgggttaaacacctttactaacatggaggcgcaacttattcgtcaaatggaatccgaaggtatcttttcaccaagcgaattagaaacacctaacctagcaaaaagagtactcgattggctcgaaaagtatggagtggagaggttaaaaagaatggctatatctggcgatgattgtgttgtaaaacccatagacgatagatttgccacggctttaacagccctaaatgatatgggtaaggtacgaaaagacattccacagtgggaaccatctaaaggatggaacgactggcaacaagtgccattctgtagtcatcattttcaccaactaataatgaaagacggacgagaaattgttgtcccctgccgaaatcaagatgaactggtaggacgtgctagagtgtcacaaggcgcaggttggtcactaagagagactgcgtgtctaggaaagagctatgcacaaatgtggcaacttatgtattttcaccgtagagatttacgtcttgctgccaacgcaatatgctcggcagttcctgtagactggataccaacatcacggaccacatggagtatccatgctcatcatcaatggatgactacggaagacatgctttccgtttggaacagggtttggatcgaggaaaatccatggatggaggataaaactcacatatctagctggggagatgtcccctacttgggcaaaagagaagatcaatggtgcgggagcttaataggccttacagcaagagctacttgggcaactaatatacaagtagcaattaaccaagttagacgtctaataggaaacgagaattatctcgattatatgacatcgatgaaacgattcaagaatgaaagtgatcccgaaggggccctttggtag

SEQ ID NO: 21562 - RNA, 9879 nt, synthetic construct
  misc_feature 1..9879: note = derived and/or modified CDS sequence (opt6) from DENV-1__FJ461319__SS-prME
  source 1..9879: mol_type = other RNA
tctgttacgatgcttttaatgttaatgccgactgcattagcttttcaccttacgactagagggggagaaccacatatggtcgtatcaaaacaagaacgaggtaaatcactactctttaaaacttcagctggagtaaatatgtgcactcttatagcgatggaccttggagaactatgtgaagatacgatgacctataaatgcccacgtataactgaggcggaacccgacgacgttgattgttggtgtaatgcaacggatacatgggttacctacggaacatgctcgcaaactggtgagcacagaagagacaaaagaagtgttgcattggcacctcatgtgggacttggtctagaaacccgtacggagacatggatgtcctcagaaggagcatggaaacaaattcaacgcgtagaaacgtgggcattaaggcacccaggatttactgtcatcgccttatttctggcgcacgcaatagggacttcaatcactcaaaaaggaataatatttatattactaatgttagtcactccgagcatggcaatgcgttgcgtcggaataggaagtcgagattttgtcgaaggactatctggagccacatgggttgacgtcgtactcgaacacgggtcatgtgtaacaacaatggcaaaagataaaccgaccctcgatattgagctgttgaaaaccgaagtaactaatcccgcaatacttcgtaaactgtgcatagaggcaaaaatctcgaataccaccactgattcgagatgcccaactcaaggcgaagccacgcttgtggaggaacaagatgcgaattttgtgtgtaggaggaccttcgtcgaccggggttggggaaacggttgtggcttattcgggaaagggtcactaattacctgtgctaaattcaaatgcgtaacgaaactcgaaggtaaaatagtacagtacgaaaatctcaaatactcggtaatcgtcacagtgcatacaggcgatcaacaccaagttggaaacgaatctacggaacatggaacaacggcgactattactccgcaggctcctacaactgaaatacaattaacggattatggggctctaacattggattgcagcccaaggacaggtcttgattttaatgaaatggtcctcttaaccatgaaagaaaagtcgtggcttgtacacaaacagtggtttcttgacctaccacttccctggacctcgggcgcctcaaccagtcaagaaacatggaatcgacaagatttgttagtcactttcaaaactgcacacgccaagaaacaggaagtggtagttctagggagtcaggaaggcgctatgcatactgccttaacaggagcgaccgaaatacaaacatcaggaactacaaccatattcgcaggtcatttaaaatgtcgcctaaaaatggataagttgacactaaaggggatgtcttatgtgatgtgtacaggttcatttaaactagaaaaagaagttgcagagactcaacatggaacggttttagtgcaaatcaagtacgaaggaacagacgcaccctgtaaaattccgtttagtacacaagatgagaaaggggtaacacaaaatggaaggttaattaccgcaaaccctatcgtcacagacaaagaaaagcctgtcaatattgaggccgaaccaccttttggggaaagctacattgtcattggtgcaggcgaaaaagcattaaaactatcctggtttaaaaagggaagttccattggaaaaatgttcgaagccactgctagaggtgcaagacgaatggcaatactcggagatacagcttgggacttcggatcaatcggtggagtctttacaagtgtgggtaaactcgtgcaccaaatatttggaaccgcatatggcgtactttttagcggagtaagctggaccatgaagataggcctgggtgtactactcacatggcttggactcaattcgcgatccacatcattaagcatgacttgcatcgcagtaggcctagtaactttatatcttggagtaatggtacaagctgattcaggatgtgttatcaattggaaaggacgtgaactaaaatgtggctccggaatattcgttacaaacgaagtacacacatggacagagcaatataaatttcaagcggactcaccaaaaagactctctgcagcaataggaaaagcatgggaagaaggagtatgtggaataaggtcagcaactaggttagagaatgttatgtggaaacagataagcaacgaactaaatcacattctcttggaaaacgatatgaagtttacggtcgtggtgggtgatgtagcaggaatactagctcagggcaagaaaatgatcagaccacaacccatggaacataaatattcgtggaagtcatgggggaaagcaaaaattatcggtgctgatgtgcaaaacacaacgttcatcatagatggtcctaatactccagagtgcccggatgaccaacgcgcttggaacatatgggaggtagaggattacgggttcggaatttttactacgaatatatggctgaaactcagagactcatacacacaagtctgcgatcataggctaatgtcagcagccattaaagattctaaggctgtccatgcagatatgggttactggatagaaagcgagaaaaatgagacatggaagttggcaagagcttcatttatagaggtgaagacctgtatctggccgaagtcgcataccctatggtcaaatggagtgctcgaaagcgaaatgataatcccaaaaatctacgggggaccaatctcgcaacataactacagaccgggttactttacacagaccgcaggaccatggcatttggggaaattagagcttgattttgatttgtgtgagggaacaaccgtcgttgtcgatgagcattgcggcaacaggggtccatcgttgagaactactacggttacaggaaaaattatacacgaatggtgctgccgaagttgcacattgcccccgttgaggtttcgtggagaagatggttgttggtatggaatggaaataagaccagtaaaagaaaaggaagaaaatctagtcaagtctatggtatctgcgggctcaggtgaagtagactcattttctctcggactattatgcatcagtatcatgattgaagaagtaatgaggtcacgttggagtcgaaaaatgttaatgaccggtaccttagctgtattcttattacttataatgggtcaacttacatggaacgatttaatacgattgtgtatcatggtaggtgccaacgcatcggaccgtatgggaatgggaacaacatacttggcgttgatggccacttttaaaatgagaccgatgttcgcagtaggacttctttttcgaagactaacatcgcgcgaagtattattactgaccatcggactaagcctagtggcgtcagtagaacttccaaatagtctagaagaactaggcgatggcctagcgatgggaataatgattctaaaactcttaacggattttcagagccaccagttgtgggctactctattatcattgacatttataaaaactacgtttagtcttcactacgcatggaagactatggccatggtcttaagtatagtgtcactattcccattatgcttaagtaccacaagtcagaaaactacatggttgccggtactattgggctcattaggttgcaaacccttgactatgttcctcattgcagaaaacaaaatttgggggcgtagatcttggcctcttaatgaaggtataatggcagttggaatcgtaagtatattattatcttcattactcaaaaacgacgtacccctagctggaccattgattgcaggaggtatgcttatcgcgtgctacgttataagtggatcaagcgcagatctgtcattagaaaaagctgctgaggtatcatgggaagaggaggcagaacattctggcgcttctcataatatactcgttgaagtacaagacgatggtacaatgaaaatcaaagatgaggaacgtgatgatacgttgacaatattactgaaagctacacttctagcagtctcgggtgtctatccactttccatacctgctacactattcgtgtggtatttttggcaaaagaagaaacaacgtagtggtgtactgtgggacaccccttcaccgccagaagttgaacgagcagtactagatgatggaatttatcgaattatgcagaggggtctgcttggccgaagccaggtaggagtcggagtgttccaggagaatgtctttcacaccatgtggcatgttacaagaggagctgtcctaatgtatcaaggaaaaagactagagccgtcctgggcgagcgtcaagaaagatctaatctcctacggcggagggtggcgcctccaaggaagttggaatacgggagaagaagtacaagtgatagcggtagaacccgggaaaaatcccaaaaacgtacaaaccgcaccgggaacctttaaaaccccggaaggagaagtcggtgctatcgcattagactttaaacctggaacatctggttctccaatcgtgaatagggagggcaaaattgtaggattatatggcaacggcgtggtgactacatcgggaacgtatgtcagcgcaatagctcaagcaaaagcatcacaagaaggcccactacctgaaatagaagatgaagtattcagaaaaagaaatttaaccataatggacctgcatccgggttcaggaaaaacaagacgttacttgcctgcaatagtacgagaggcaataaaaagaaagctaagaacattgatactggcacctacgagggtagtagcctcagagatggcagaagcattaaaaggtatgcctatcaggtatcagactacagcagtaaagtctgagcacactggaaaggagatagttgacctcatgtgtcatgcaacatttacaatgagattactgtcccccgtacgagtccctaattataatatgataataatggatgaagctcatttcaccgacccctcatcaattgctgcaagagggtatataagcaccagagtgggaatgggcgaggcagcagctatatttatgacagcaacgccgcctggaagtgtcgaggcctttccacaaagcaatgccgtcattcaagacgaagaaagagatattccggaaagatcgtggaatagtggctatgaatggattactgatttccccggtaaaacagtgtggttcgtgcccagtattaagagcggaaacgatatagctaactgccttcgtaagaatggtaaaagagtcatacagctatcaagaaaaacatttgacacagagtatcagaaaaccaaaaataatgattgggactatgtagtaacgacggacataagcgaaatgggagccaattttagggcagatcgagtaatagatcctcgaagatgtttaaaaccagtaattctgaaagacggaccagaaagagttattttagccggtccaatgcccgtaaccgtagccagcgccgcccagcggcgaggccgaatcgggcgtaatcacaataaagagggcgatcaatatatttatatgggtcagccgctcaataatgatgaagaccacgctcactggactgaagctaagatgttattggataacatcaatactcctgagggaataattccagcactatttgagcctgaacgtgaaaaatcagcagcaatcgacggagaataccgactacggggagaagcccgaaaaacttttgtcgaattaatgcgccgaggagatttaccagtctggctttcatataaagtagctagcgaaggattccaatattcggatagaaggtggtgctttgatggtgaacgtaacaatcaggtattagaggaaaatatggacgtagaaatctggacaaaagagggtgagcgtaaaaagttacgcccaagatggctagacgcacgcacgtattcagatccacttgcactgagagagtttaaagagttcgcagctggaaggagaagcgttagtggagatttaatactcgagataggaaaactaccacagcatctgacgcaacgtgctcaaaatgcattagacaacctggttatgctacacaacagcgaacaaggtggccgcgcatataggcacgcaatggaagaactacccgacacaatagaaacattaatgcttctggcgctaattgccgtcttaacagggggtgtaacgttattctttctcagcggccgtgggctagggaagaccagcataggtttgttatgcgttatggcatcatcagtattattatggatggccagcgtggagccacattggatagctgcttcgatcatattggagttctttttaatggtcctattgattcctgaacctgatagacaaagaacacctcaggataaccaactagcttacgtagttataggtttgctgttcatgattttaacagtagccgccaatgaaatggggttactggaaaccacaaagaaagacttaggaattgggcatgccgcagtagggaatcatcatcatgcggcaatgttagatgtggatttacatccagcctcagcatggacactttacgccgtagcaaccaccattataacaccaatgatgaggcacacaatcgaaaacacgactgctaatatcagcttaacggccatagccaatcaagcggcaattctgatgggtctagataaagggtggccaatcagcaaaatggacatcggagtaccacttcttgctctaggatgctacagtcaagttaaccctcttacattaactgctgcagtcctgatgcttgtagcacactatgcgataatagggccgggactacaggcaaaagccactagagaagcccagaagcgcactgccgccggaattatgaaaaatccaacagtcgacggaatcgtggcaattgacttagatcccgtagtatatgacgctaaattcgaaaagcagctcggtcaaataatgttattaatcttatgtacatcacagatcttactcatgcgaacaacatgggcgttatgtgaaagcatcacccttgctgccggacccctgacaacgctatgggaaggctcaccgggaaaattttggaacacaactatagccgtgagcatggcgaacatcttcaggggctcatatctagcaggcgcgggactagcattctcgttaatgaaatcacttggaggcggacgacgaggtacaggtgcgcagggtgaaacactaggagaaaaatggaaacgacaattgaatcaactgagtaaatcagaatttaacacatacaaaagaagcggtataatggaagtggacagaagtgaagcgaaagagggtctgaagagaggagaaacaaccaaacatgctgtatccaggggtacagccaaactgcgctggtttgttgagcgtaacctggtcaaaccagaggggaaagtgattgacctgggatgtggtagaggaggttggtcttattactgtgcaggactaaagaaagtaacagaagttaaagggtacacaaagggagggcctggacatgaagaaccaattccaatggcaacttatggctggaatttagtgaagttacacagtggcaaagatgtgttctttattccacctgagaaatgtgacacactactttgcgatattggagaaagtagtccgaatccaactatagaagaagggcgaacactaagggtactcaaaatggtagagccatggttacgtggcaaccagttctgcattaaaattttgaatccgtacatgccaagtgttgttgaaacccttgaacaaatgcaaaggaaacacggcggcatgcttgtaaggaaccctttatcgcgcaacagcacccacgaaatgtattgggtatcctgcggcacaggaaatatagtaagcgcagttaatatgacttcaaggatgttattaaaccgatttaccatggcacatcgtaaacctacatatgaaagagatgttgacctaggagctgggactaggcatgtcgccgtagaaccagaggtagctaatctcgatataataggacaacgtatagaaaatatcaaacatgaacataaatcaacttggcactacgacgaggacaatccatataaaacatgggcataccatggatcttatgaagtgaaaccatctggttctgcaagtagtatggtaaatggggtagtcaaattgcttaccaagccatgggatgtaataccaatggttacccaaatagcaatgaccgatacgactccattcgggcaacaaagggtattcaaagaaaaagtggatacacgtacacccaaagcgaaaagaggaacagcacagataatggaggttaccgctaagtggctgtgggggtttctaagccgaaacaaaaagcctaggatatgcactagagaggaatttacaaggaaagtgcgttctaatgcagccattggcgcggtatttgtagacgagaatcaatggaactcggcaaaggaagccgttgaggatgagagattttgggacttagtacacagagagagagaactgcataaacagggaaaatgtgctacctgtgtgtacaatatgatgggaaaaagggaaaagaaacttggggaatttggtaaagcaaagggcagtagggcaatatggtacatgtggctaggtgcacgcttcctagaatttgaagcacttgggtttatgaacgaagaccactggtttagtagagaaaattctctttctggtgtggaaggtgaaggccttcacaagctagggtatattctaagagatatctcaaaaataccaggtggtaatatgtacgccgatgatacggccgggtgggatacacggataacagaagacgaccttcaaaatgaagccagaataacagacataatggaaccggaacatgctttgttggccaaatcgatatttaagctaacttatcaaaacaaagtagtacgagtacaacgtccagccaaaaatggtactgtaatggatgtaatatctaggagagaccaaaggggtagcgggcaagtaggaacatatgggctaaatacttttactaacatggaagcgcaattgataagacagatggagtctgaggggatattttcccctagtgaacttgaaactcccaacttggctgaaagagtattggactggttggagaaatatggggttgagcgattaaagcggatggctatatccggagatgactgtgtagtaaagccgattgatgatagattcgcgaccgcacttaccgcattgaatgatatgggaaaggttcgaaaagatatcccacaatgggaaccctctaaaggctggaatgattggcagcaagtgccgttttgcagtcatcattttcaccaattaatcatgaaagatggaagagaaatagtagtcccttgtaggaaccaagatgaattagtgggtcgagcaagggttagtcaaggagcaggctggtccttgagagaaacagcatgtttaggaaaatcatatgcccaaatgtggcaactaatgtatttccaccggcgcgatcttagattggctgcaaacgcaatatgttcagcggttccagtagactggataccaacatctagaacaacttggtcaattcatgcacatcaccagtggatgactactgaagacatgttatcagtttggaatcgagtctggatagaagagaatccttggatggaggataagacacacatttcgtcctggggagacgtaccatatctaggaaaaagagaagatcaatggtgtggatctcttattggattaacagcccgcgcaacctgggctacaaacgtacaagtagcaatcaatcaagtacggagactaataggcaatgagaattacctagactatatgactagcatgaagcgcttcaaaaacgaatcagaccccgaaggagcactatggtga

SEQ ID NO: 21563 - RNA, 9879 nt, synthetic construct
  misc_feature 1..9879: note = derived and/or modified CDS sequence (opt6) from DENV-1__FJ461320__SS-prME
  source 1..9879: mol_type = other RNA
agtgtaaccatgctgctgatgttaatgccaaccgcgctagctttccacttgacaactcgaggaggtgaacctcatatgatagttacaaaacaagaacgcggaaaatccctattgttcaaaacaagcgccggtgttaacatgtgtacattaatagcgatggacttaggcgaattatgcgaggataccatgacctacaaatgtcctcgcataacagaagcagaaccagatgatgttgattgttggtgcaacgccaccgatacatgggttacttatggtacgtgtagtcaaacaggagaacacagacgtgacaaaaggtctgtggcactagcccctcatgtagggctaggtttggaaacaagaaccgagacctggatgtccagcgaaggagcatggaaacaaatacaacgggttgaaacgtgggcattacgtcatccaggattcacagtaatagcgctattcctagcacatgcaataggaacaagcataactcaaaaaggtattatatttatactactgatgctagtcacacctagtatggctatgcgctgtgtaggcataggctccagagattttgtcgaaggtttatccggagccacgtgggttgatgtagtcttagaacatggtagctgcgtcacaacgatggctaaagataaaccaaccctcgacatagagttattaaaaacagaggttacaaaccccgcggtattaaggaaattatgcatagaagcaaaaatatcaaatactacaacagactcaaggtgcccaacccaaggtgaagctacgttgatggaagaacaggatgcaaacttcgtatgtcgaaggacctttgtagataggggctggggaaatggctgtggcttattcggtaaaggctctctaataacttgcgccaaatttaaatgtgtaacaaaactcgagggtaaaatagtacaatatgaaaatttaaaatattctgtaattgtgacagtacatacaggtgatcaacatcaggtgggcaatgagagtaccgaacacggcaccacagcaactataactccccaggcaccaactagcgaaatccaactaaccgactatggagcattgactttagattgctcaccccgtacaggcctcgactttaatgaaatggtacttttaaccatgaaagagaaatcttggcttgtgcataaacaatggtttctagacctacctctgccttggacaagtggcgcgagtacctcacaggagacgtggaacaggcaagatctcttagtgacgttcaaaacagcccatgctaagaaacaagaggtggtagtcttaggtagtcaagaaggagcgatgcatacagcgctaactggtgcaaccgaaattcagaccagtgggaccacaacgatttttgctggccatcttaaatgtagacttaaaatggataaacttacattaaagggtatgtcgtacgttatgtgtacaggttcatttaagttggaaaaggaggtagccgaaactcagcatggaacagtacttgtacagataaaatatgaaggcactgacgccccatgtaaaatcccattcagcacgcaagatgaaaaaggagtaacccaaaatgggcgattaatcactgctaatcctattgtgaccgacaaagagaaaccggttaatatagaggctgagcccccttttggcgaatcatatatagtcataggagctggggaaaaagcgttaaaattatcatggttcaagaaagggtcaagcattgggaaaatgttcgaggcaacagctagaggcgctagaagaatggccatattaggtgatactgcgtgggactttgggagtgttggaggagtcttcacatctgtaggcaaattagtacatcaaatctttggaacggcttatggcgtcttatttagtggtgtaagttggaccatgaaaattggaataggtgttctattgacctggttggggctcaactcacgaagcacttcactatctatgacctgtattgccgtcggattggtaaccttatacctgggcgtgatggttcaagctgattctgggtgtgtgattaattggaagggccgtgagctaaaatgtgggtctggaatatttgtcacaaacgaggtacacacctggactgaacaatacaaatttcaagccgactctcctaaaagattatctgcagccataggcaaagcatgggaagaaggtgtttgtggcataagatcagcgacacgtctcgaaaatataatgtggaaacagattagcaatgagttaaaccatatcctgttagaaaatgatatgaaatttaccgttgtagtgggtgatgtagttgggattcttgcacaagggaagaaaatgataagaccccaaccgatggaacataagtattcttggaaaagttggggtaaagcaaaaattattggagcggacgttcaaaacacgacatttataattgatggtccaaacacacccgagtgccccgacgatcaaagagcatggaatatttgggaggttgaagattatggatttggcatatttactacgaacatatggctaaaactgcgtgactcatacacacaggtgtgcgaccaccggctaatgtcggccgctataaaggatagtaaggcagtacatgcggatatgggatactggatagaatccgagaaaaatgagacctggaaacttgcaagagctagcttcattgaagtaaaaacttgtatatggcctaaatctcataccttatggtctaatggagtactagaaagtgaaatgatcataccaaagatatacggcggtccgatttcccaacacaattaccggcctggatattttacacaaacagccggaccatggcacttgggaaaattagagttagattttgatctatgtgaaggcacgactgttgtagtcgacgaacattgcggcaatagaggaccttccctacgtacgactacggtaactggcaaaattatacatgaatggtgctgcagaagttgcactcttccacctctacgattcaaaggagaagatggttgctggtatggtatggaaattagaccagtgaaagaaaaagaagaaaacttagtaaaaagtatggtatcagcaggttccggcgaagtagattcattttcattaggcttattgtgcatttcaattatggtggaagaagttatgcgatcacgctggagtagaaaaatgttaatgacggggacgcttgccgtatttctattacttattatgggtcaactaacatggaatgacttaataaggctatgtataatggttggagcaaatgcgagtgaccgaatgggaatgggtacgacttacttagcactgatggctacatttaaaatccgacctatgtttgctgttggtttattattccgtagattaacttcaagagaggtactcttgcttacaataggattatcattagttgcatctgtagaactaccaaatagcttagaagaactcggggacggtttagctatgggcataatgattctaaaattactgacagatttccaatcgcatcaattatgggctaccttactatcactaaccttcataaaaaccacattatctttacattatgcatggaaaactatggcaatggtattatctattgtcagtttgtttcccctatgcttaagcaccacctcccagaaaacaacttggttacccgttttactagggagcctcggttgcaaaccactaactatgttcctaataacagaaaacaaaatatggggaagaaaatcctggccgttgaacgagggtataatggctgtcggcgtcgttagtattctcctatcctcgttactaaagaacgatgttccactagcgggtccactaatagctggagggatgctaatagcctgctatgtaatttccgggagcagcgcggatttatctctagagaaagcagcagaggtatcatgggaagaagaggcggaacattctggagccagtcataacattctagttgaagtccaggatgatggaactatgaaaattaaagacgaagagagagatgacacactcacaatcttgctgaaggcgaccttacttgccgtttcaggagtttatcctctgtccattccagccacattatttgtttggtatttttggcaaaagaagaaacaacgttcaggagtactttgggatacgccttcccctccggaggttgaaagagcagtacttgacgacggtatctacaggataatgcagcgaggactattaggacgaagtcaagtcggagtaggcgtctttcaagaaaatgtatttcataccatgtggcacgttactagaggtgctgtattaatgtatcaaggtaaacgcctagaaccttcctgggcgtcagtaaagaaggacctcatatcctacggagggggttggaggctgcaaggatcctggaatacaggagaggaagtacaagtcatcgccgttgaaccaggtaagaacccaaagaatgttcaaaccgcgccggggacatttaagaccccggaaggtgaagttggggctatcgcattggactttaagcctggaacgtcgggatcgcctattgtaaatcgagaagggaaaatagttggtttatacggcaacggagtcgtaacgacttcggggacatacgtaagcgctatcgcacaagctaaagcatcacaggagggaccgctaccagaaatcgaggatgaggtctttagaaagcgtaacctcaccatcatggatcttcaccctggtagtggcaagacacgacggtacctaccagcgattgtcagagaggccatcaaacgcaaacttagaaccctgatcctggccccaacgagagtcgtagcaagtgaaatggctgaagctctaaaaggcatgccaattcgttatcaaacgacagccgtaaaatcggaacacaccggaaaggaaattgtagatctgatgtgtcatgctacattcacgatgagactattgtcgccagtaagagtaccaaattataatatgataattatggacgaagcacactttacagacccatcttcgatagctgcaagaggatatataagcaccagagtcggaatgggagaagcagcagctatatttatgacagcaaccccgcccggaagtgttgaagcgtttccacaaagtaacgcggtcatccaagacgaagaacgtgatatcccagaaaggagttggaatagcggttatgagtggataactgatttccctggaaaaacagtttggtttgttccatcaataaaatcagggaatgatatagcaaattgtttaaggaaaaatggaaaaagggtaatacaactatcgaggaaaacctttgacactgaatatcagaaaacaaagaataatgactgggactatgtagttactacagatatatcagagatgggtgctaacttcagagcagatcgagtaattgacccgagacgttgcctgaaaccagtgatacttaaggacggtccagaaagagttatactagcagggccaatgcccgtaacagtagccagtgcagctcaacggagaggaagaataggaagaaatcataataaagaaggtgatcaatatatttacatgggccaacccttgaacaacgatgaagatcacgctcactggaccgaagcaaaaatgctattagataacataaatacccctgagggtataatccctgccctatttgagcctgaaagggaaaagagtgcagcaatagacggagagtatcgattaagaggggaggcgcgaaagacatttgtagaacttatgcgacgaggggatttaccagtgtggttaagttacaaagtcgcaagcgagggtttccagtattccgatcgacgttggtgtttcgatggagaaagaaataatcaagtattggaagagaacatggatgtcgaaatatggactaaggaaggagaaagaaagaaattgagacccaggtggttagacgcacggacgtattcagacccattagcattacgagagttcaaagaatttgcagcagggcgaagatcagtatcaggagatctgatactagaaataggaaagctcccacaacacttgacacaacgcgcccaaaatgcattagataatctagtcatgcttcataactctgagcaaggtggacgggcctataggcatgcaatggaagaactccctgacaccatagaaacactcatgctattggcattaattgcagtattaaccggcggagtaaccctatttttcctctcaggacgtggacttgggaagacgtcaataggtctattgtgcgtcatggcatccagcgttttattatggatggcatcagtcgagccacactggattgctgcctcaataattcttgagttctttcttatggtgctcctaataccggaacctgacaggcaacgaacgcctcaagataaccagttagcctacgttgttataggactcttattcatgatacttacagttgcggcaaatgaaatgggactcctcgaaactacaaagaaagatctaggaataggacatgtagcagtcgaaaatcatcatcacgctaccatgctcgacgtcgatctgcatcctgctagcgcctggaccctatacgctgttgctacaacaataataacaccaatgatgaggcacactatagaaaataccacagcaaacatcagtctaaccgcgattgccaaccaagcagcaatattgatgggactagacaaaggttggcctatttcaaaaatggacataggggttccactacttgcattaggatgttattcacaagttaatccactcactcttacagcggctgttttaatgctcgtagctcattatgcgatcataggccccggattacaagctaaagcgactcgcgaagctcagaaaagaacagctgcaggaataatgaaaaaccctaccgttgatggtatagttgcaatcgatttagatccagttgtatatgacgcgaaattcgagaaacaactaggccaaataatgttattaattctctgcacctctcaaatattattgatgagaacaacgtgggccctctgcgagagtataacgctagccactgggccacttacaaccctatgggaaggttcaccgggaaagttttggaacacaactattgcagttagtatggctaacatattccgtggatcttacctagctggcgccggacttgcattctccctgatgaaatctctagggggcggtcgtagaggaacaggagctcagggcgagactttaggagaaaaatggaaacggcaactcaaccaactatcaaaaagcgaatttaacatttacaagcgcagtggtataatggaggtcgaccgatcggaagcaaaagaaggacttaaacgaggcgaaacaacacgccacgcagttagcagaggtactgctaaactgaggtggtttgtggaaagaaatttagttaaaccagaagggaaggttattgacttgggatgtggacggggtgggtggtcttattattgcgccgggctcaagaaagtaacagaagttaaaggatataccaaaggaggaccaggacatgaagaacccatacctatggctacgtatggttggaatttagtaaaacttcactccggtaaagatgtatttttcacaccgcctgagaaatgcgacacactactttgtgatatcggcgagtctagtccaaatccaaccatagaagagggacggactctgcgggttctaaaaatggttgagccctggttgagaggaaatcagttctgcatcaagattttgaatccgtacatgcctagtgtggtagagaccttagagcaaatgcagaggaagcacggtgggatgctagttcggaacccactatcaagaaactctacacatgaaatgtactgggtttcatgtggaaccggtaatattgtaagcgcagtgaacatgacatcccggatgttgctcaataggtttactatggctcacagaaaacccacatacgaacgagatgtggacctgggtgccggaactagacatgtagcggtcgaacctgaagtagcaaatctagacattataggacagcgaattgagaatatcaaacatgagcataaaagtacatggcattatgatgaagataacccgtataaaacatgggcttatcacggatcatacgaagtcaaaccatccggaagtgcaagcagcatggtaaatggagtagtcaaactcctgacaaaaccctgggatgttatacctatggtaacgcagatagccatgaccgatacaacaccattcggacaacaaagagttttcaaggagaaagtcgacactcgaacacccaaagcaaagcgtggaacggcgcaaataatggaagttacggcacgatggctatggggattcctcagtcgtaataagaagcctagaatatgtactagggaggaatttacacgaaaggtaagatctaacgcagcgattggagcagtattcgtagatgaaaaccagtggaactcggcaaaagaagcggttgaagatgaacgattctgggatctggtgcaaaaagaaagggaactccataaacaaggtaaatgcgctacatgcgtatataacatgatgggaaaaagagagaagaaattaggagagttcggaaaagccaaaggaagtagggcaatttggtacatgtggcttggagcacgatttcttgagtttgaagcgctagggttcatgaacgaagatcactggttcagcagagaaaattctctctcgggtgtagaaggtgaaggactacataaattgggttatatactacgagacatttctaaaataccgggaggcaatatgtatgcagacgatacagcaggctgggatactagaataacagaagacgatttacaaaatgaggccaaaattacagacattatggaaccagagcacgcacttcttgccacgtcgatattcaaattaacatatcaaaacaaagtagtgagggtacaaagaccggctaaaaatggtacggtaatggatgttatctctcggagagaccaacgcggttcggggcaagtaggcacgtatgggctaaacacttttacaaatatggaggcccaattgataagacaaatggaatctgaaggaatattcctaccatcggaactagaaacacctaatttagccgaacgtgttctggattggttagaaaaatatggagtagaacgactaaagcgcatggcaatttctggagatgactgtgtagtgaaaccaattgatgataggttcgcaactgcactaactgcactaaatgacatgggaaaggtaagaaaagacattccgcaatgggagccaagtaaaggctggaatgattggcaacaagttcccttttgctcccatcattttcatcaactgatcatgaaagatggtcgtgaaatcgttgtcccgtgcagaaatcaagacgaattggtcggtcgtgcacgagttagccaaggtgctggatggtcccttagagagacagcgtgccttggaaaatcatacgcgcaaatgtggcaactgatgtactttcaccgtcgagatctacgccttgcagctaatgccatatgtagtgccgtgccagtcgactgggttcccacatctcgtacaacatggagcattcacgcccaccatcaatggatgaccactgaggacatgttatcggtatggaacagagtttggatagaagaaaatccatggatggaagataaaactcatgtgagcagttggggcgatgtaccttacttaggtaaaagggaagatcaatggtgcggctccctcatagggttaacggcaagggcaacctgggcatctaacattcaagtagccataaaccaagtccgtaggcttatcggcaacgaaaattatttggactatatgacatcgatgaaacgttttaaaaacgaaggcgacccagaaggagctttatggtaa

SEQ ID NO: 21564 - RNA, 9879 nt, synthetic construct
  misc_feature 1..9879: note = derived and/or modified CDS sequence (opt6) from DENV-1__FJ410225__SS-prME
  source 1..9879: mol_type = other RNA
tcagttacaatgctgttaatgctaatgccgactgctttagcattccacttgacaacaagaggaggggaaccccatatgatagtatcaaaacaagaaagagggaaatcactgctattcaaaacatcagcgggtgttaatatgtgcacattaatcgcgatggatcttggggaactatgtgaagacacaatgacgtacaaatgccccagaataactgaaactgaaccagacgatgtagattgttggtgtaatgctacagacacgtgggtaacctatggtacttgttcgcaaaccggggaacatagacgcgacaaacgaagtgtagctctggcaccgcatgtaggtttagggttagaaacaagaaccgaaacctggatgtctagcgaaggagcgtggaaacaaatacaaagagtggagacatgggcacttcgtcatccaggttttacagttatcgcgctattcttagcacatgccataggaacgtcgattacccaaaaaggtattatattcatattgttaatgctagtgactccttcaatggctatgagatgcgtaggaataggttcacgcgacttcgtggaaggactctcaggagccacatgggtcgatgtagttctagagcacggctcctgtgtgacaactatggcaaaagataaacctacacttgacattgaattattaaaaacagaagtaacgaaccctgcggtacttcgaaaactttgcatagaagcaaaaatatctaacacaacgacggatagtcgttgtccgactcaaggcgaagcgaccctagtagaggaacaagatgccaattttgtatgtagaagaacatttgttgatagaggctggggcaatggctgtggcctatttggaaaaggatcattaataacatgcgcaaaatttaaatgcgtaacgaaattagaaggtaaaattgtacaatatgagaatttaaaatatagtgtaatagtaaccgttcacaccggagaccaacaccaagtcggtaatgaatcaacagaacacggcaccaccgcaacgatcacgccgcaagcccctacaactgagatacaattaacagattacggtgcgctaacattagactgctctccaaggactggcctagattttaatgaaatggtgttgttaactatgaaagaaaaatcctggctagtccataaacaatggtttcttgatctacccctaccatggacaagcggcgcaagtacgtctcaagaaacgtggaatagacaagacctattagtcacgttcaaaacagcacacgctaagaaacaggaggttgttgtactgggaagccaagaaggagcgatgcatacagcattaacgggcgcaacagaaatacaaacaagtggtactactactattttcgccggccacttaaaatgtaggctaaagatggacaaactgaccttaaaaggcatgtcgtatgttatgtgtacggggagttttaaactagaaaaagaagtcgcagagacacaacatggaacggttctagtacaaataaaatacgaaggaacagacgctccctgtaaaataccgttttcaacacaagacgaaaaaggcgtcacacaaaacgggagattaatcaccgcaaatcccatagttacagataaagagaaaccagtcaacatcgaagcagaacctccgttcggagaatcttacatagtaattggagcgggagaaaaagcactaaaacttagttggttcaagaaaggctcatcgattggcaaaatgtttgaagcaacggccagaggagcacgcaggatggcgatattaggtgacactgcttgggactttggaagtatcggaggtgtatttacgtccattggtaaattggtgcatcaaatattcggcactgcgtatggggtcttgttttcaggagtatcttggacaatgaaaataggcattggtgttttacttacctggttaggactaaatagcaggtctacgagcctgtctatgacttgtatcgctgtaggcttagtcacactttatttaggtgttatggtacaggcagactcgggatgcgttatcaattggaagggacgtgaattaaaatgtggatctggaatatttgtgaccaatgaggtccatacttggaccgaacaatataaattccaggctgatagtccgaaacgtctaagtgccgccattggtaaggcttgggaggaaggagtgtgtggaatacgaagtgcaactcgacttgaaaatattatgtggaagcaaatttccaatgagctcaaccatattttactcgaaaacgacatgaaatttaccgtagttgtaggtgatgtagcagggatattagcgcaaggcaagaaaatgatccggccgcaaccgatggagtataagtatagctggaaatcgtggggtaaagctaaaatcataggtgcagatgttcaaaatacaacttttattatagacgggccgaacacccctgaatgtccagatgatcaacgtgcttggaacatctgggaagtagaggattatggattcggcatttttacaacaaacatttggttgaagttgagagattcgtatacacaggtttgtgatcacaggcttatgtctgctgccataaaagacagcaaagccgttcacgcagacatgggatactggatagaaagcgagaaaaatgaaacatggaagttagccagagcttctttcatagaagttaaaacgtgtatatggccaaagagccacacattatggtcaaatggcgtgttggaatccgaaatgataatacctaaaatatatggtggacctattagtcaacataattacagacccgggtactttacacaagctgcaggtccttggcacctaggtaaattggaactggactttgatttatgtgaaggaacaaccgttgttgttgacgaacattgtggaaaccgcggaccatcactgaggacaactacagttaccggaaaaatcattcacgaatggtgttgtcgtagttgtacgcttcccccattgcgatttagaggggaagacggatgttggtacggaatggagatacggccagtaaaagaaaaagaggaaaatcttgttaaatcaatggtcagcgcgggaagcggagaagtagactcgttttctcttggtcttctctgtatcagtatcatgatcgaagaggtaatgagatcaaggtggtcaaggcgaatgttgatgaccggtacactagcggtcttctttcttttgatcatgggtcagttgacatggaacgacctaatacgtttatgtattatggtcggcgctaatgcctctgaccgcatgggaatgggaactacatacttagcactgatggcaacgttcaaaatgagacctatgtttgcagtgggactcttgtttcgtcggttaacaagcagggaagtactactgttaactataggattaagtctggtagcgtctgtagagctccctaattccttagaagaacttggggacggtttagcaatggggataatgatactaaaactattaacggattttcaaagccatcaactatgggccacattattgagtttaacatttatcaaaacaactttctcactgcattatgcatggaaaactatggcaatggtgttaagtatcgtaagtctgttccccctatgcttatctactacgtctcagaaaaccacatggcttccagtactattaggttctcttgggtgtaaacccctaaccatgtttttaatcgcggaaaacaagatttggggtaggaggtcttggccgttaaatgagggcataatggcagttggaatagtctccattctgctatctagtttactaaagaatgatgtacctctagctggtcctctaatagcaggcggcatgctaattgcttgttatgtgatatctggaagctcagcagatctaagtttagaaaaagctgcagaaatctcatgggaagaggaagccgaacactcgggtgcctctcacaacattttagtagaagttcaagatgatggaacgatgaagataaaggacgaagagagagacgacacgttaacaatcctgctaaaggcaacattattagctgtaagtggagtgtatcctttatcaataccagccactctttttgtatggtacttttggcagaagaagaaacaacgaagtggggtactttgggatactccttcccctcctgaagtcgaaagggcagtacttgatgatggaatttatagaatcatgcaacggggcctattagggaggagtcaggtaggtgtaggcgttttccaagaaaatgtttttcatactatgtggcatgttacgcgcggtgccgtgcttatgtatcaaggtaaaagacttgagccaagttgggcctctgtcaagaaagacttaataagttatggaggtggatggagacttcagggaagctggaatactggagaagaagtacaagtgatagcagtagaaccaggcaaaaacccaaagaatgtccaaaccgccccaggcacgttcaaaactccagaaggagaagtcggcgcgattgcactagattttaagcccggcacatctggatcacccatagtaaacagggagggcaaaatagtcggactctatggaaacggagtcgtgacaacgagtgggacatatgtaagcgcaatagcacaagccaaggcatcacaggaagggcctttaccggaaattgaagatgaagtgtttaggaaacggaatttaacaataatggaccttcatcccggttcaggaaagactcgccgatatctaccagcaatagtaagggaggcaataaaaaggaaattacgaactttgatattagctccgacaagggtagtcgcatctgaaatggcggaagcactgaaaggaatgccaatcagataccaaactactgcagtcaaatcagaacacactggaaaagagatagtggatctcatgtgccatgcaacatttactatgcgactcctttcaccggcgagggtaccaaattataatatgataatcatggatgaagcacattttacggatcccagctccattgccgcccgaggatacatatcaactagagtaggtatgggtgaagcggcagcaattttcatgaccgctactccacctggctcagtggaagcgttccctcaatcaaatgcagtcatacaagatgaggaaagggatattcctgagcggtcatggaactcaggctacgaatggattacagactttcctggaaaaaccgtctggtttgtaccatctattaaatcgggcaatgatatcgccaactgcctgaggaaaaacggaaagagagtgatacaactcagtagaaaaacattcgatactgaataccagaaaacgaaaaataatgattgggattacgtagtcacaacagatatctctgaaatgggggccaatttcagggcagatcgcgtaattgaccctagaagatgtttaaaaccagtaatattaaaagatgggccagaaagggtgatattggcagggccaatgccggttacagtagcatccgcggctcaaagacgaggtagaataggaagaaaccataacaaagaaggagatcaatatatctatatggggcagccacttaacaatgatgaggatcatgcgcattggacagaggcaaaaatgctccttgataatataaacactcctgagggtataatcccggcacttttcgagcccgagagggaaaaatcagccgcaatcgatggagaatataggttaagaggtgaagctaggaaaacttttgttgagttgatgagacgtggtgatctacccgtatggttatcctataaggtagcctcggaaggatttcagtacagcgatagaagatggtgctttgatggagaaagaaataaccaggtcttagaagagaatatggatgttgagatttggaccaaggaaggagaacgaaagaagctaagaccccgctggctagatgctagaacatattccgatccactcgctttacgggaatttaaggaatttgcagccgggcgtagaagcgtatccggcgaccttattctagaaatcggcaaacttccacaacatctcactcaaagggcgcagaatgcacttgacaatcttgttatgctacataattccgaacaaggagggcgcgcatacaggcacgctatggaagaacttccagatacaatcgagaccttgatgctgcttgcactcattgccgtcttaacgggaggtgtgacacttttctttctcagcggtagaggcctaggtaaaacgtcgattggactcttatgcgtaatggcaagtagcgtactactgtggatggcgagtgtagagccacattggatagcagcatctataattttagaatttttcctaatggtactgttaatcccagaacccgatcgccagcgtacgcctcaagacaatcaactcgcatatgtggtaatcggactcttgttcatgattctaacagtcgctgctaacgaaatgggactgctcgaaactacgaagaaagacctagggattggtcatgtagctgttgagaatcatcaccatgcagcgatgctcgatgttgatctacaccccgcctctgcttggacgttatatgccgtcgctacaacaataattacaccaatgatgagacatactatagagaacaccacagccaacataagtctgacagccattgccaaccaagccgctatactgatgggattagataaaggatggcccatatcaaaaatggatataggggtacccctactcgctctaggatgctattcccaggtaaatccgttaacattgaccgcagctgtattgatgttagtagcccattacgctataataggacccgggctacaagccaaagcaacaagggaggcgcagaaacggaccgctgcaggcatcatgaaaaatccgacagtagacgggatagtggcaatagatcttgatccagtagtttacgacgcaaagttcgagaagcagctaggccaaataatgttattgatcctctgcacctcacaaatacttctaatgcgcacaacctgggccctgtgcgaaagtatcacacttgccacggggccactaacaacattatgggaaggaagccctggtaaattttggaatactacgattgctgtgtcgatggcaaatatattcaggggttcatacttagcgggtgctggcctagcattctctctgatgaaaagtttaggcgggggcagacggggaactggagcacaaggggaaactctaggagaaaagtggaaacgtcaactgaaccaactctccaaaagtgagttcaatacatataagagaagtgggataatggaagttgaccgaagcgaagcaaaagaaggcctaaaaagaggcgaaactactaaacatgcagtttcaagaggaaccgcaaaattacgatggtttgtagaaagaaatctggtaaagcctgagggaaaggtcatagatcttgggtgtggaagaggagggtggagctattactgtgcaggacttaagaaagttacagaagtgaagggatatactaaagggggcccaggccatgaagaacctatccccatggctacctatggctggaatctagttaagctccatagcggcaaagatgtatttttcattcctccagagaaatgcgacacgctactttgtgacattggggaatcgtctccaaatccaacaatagaagaaggcagaacactaagagtactgaaaatggtagaaccgtggcttagaggcaatcaattttgtataaaaattttaaatccatatatgcccagcgtagttgaaacgctggaacaaatgcaaaggaagcatggagggatgttggtacgaaatccattgtcaagaaacagtactcatgagatgtattgggtctcttgcggcactggcaatatagtttcagcagttaatatgacatcacgaatgttactaaaccggtttacgatggctcataggaaacctacatacgagagagatgtagacttgggggcaggtaccagacacgtagctgttgaaccagaagtagctaaccttgacatcatcgggcaaagaattgagaatattaagcacgagcataagtccacttggcattacgatgaagacaacccctataagacttgggcttaccacgggagctatgaagttaaaccatcaggatcggctagttcaatggtcaatggcgtagtcaaactactaaccaagccttgggatgtcataccaatggtaacgcagatagccatgacagatacaacaccatttggacagcaacgtgtgtttaaagaaaaagtagacacgcggactcccaaggccaagcgaggaacggctcaaataatggaagttacggcaaagtggctttggggcttccttagccgtaacaagaaacctagaatttgtacgagagaagagttcacacggaaagtgcgatccaatgcggcaattggagctgtatttgtagatgagaatcaatggaactcagcaaaagaggcagtagaagatgaaaggttttgggatctcgtgcatagagagagagagctacataaacaaggcaaatgcgctacttgcgtttataatatgatgggaaaaagagagaagaaattaggagagttcgggaaagcgaaaggaagtcgtgcaatctggtatatgtggcttggtgcaaggtttttagagtttgaagcattaggattcatgaacgaagaccactggtttagtcgagaaaattcattgagcggagttgagggagaaggcttacataaattaggttacatattgagagatatttctaaaataccaggaggcaatatgtatgcggatgacacggcaggatgggacacaagaataactgaagatgacttacagaacgaggcaagaataacagatattatggaaccagaacacgcattgctagcaaaaagtatattcaaactaacttaccaaaataaagtagtacgagtccaacgccctgccaaaaacggcaccgtcatggatgttatatcccgaagagatcagcgaggctcaggccaagtgggaacttatggattaaatacttttacaaatatggaagcacaactaatacgacaaatggagtctgaaggcatattctcaccttccgagctcgaaacacctaatcttgccgagagagtcttggattggctagaaaaatatggtgtagaaaggctgaaacggatggcgatatcgggagacgattgcgtagtaaagccgatagatgacaggtttgctacggcactcacagcactaaacgacatgggtaaagtaagaaaagatataccgcaatgggaacctagcaaagggtggaacgattggcaacaagtaccgttctgtagccaccatttccaccaactaattatgaaagacgggagagaaattgttgtaccgtgcagaaatcaggacgaattagtaggcagggctagagtatctcaaggtgcgggttggagtttgcgagaaacagcttgtcttggaaaatcatacgcgcagatgtggcagctcatgtattttcacaggagagatctccgtttagctgctaacgctatctgtagcgcagtccccgtcgactggataccgacgtcacggacgacctggagtatacatgctcatcaccaatggatgactacggaagatatgttaagtgtctggaacagggtttggatagaggaaaatccgtggatggaagacaagactcatatttcaagttggggagacgtgccctatcttggaaaaagggaagaccaatggtgcggcagcctcataggattgacagctagggcaacttgggccacaaatatccaagttgcaataaatcaagttaggaggcttattggcaacgagaactaccttgattatatgacaagtatgaaacgatttaagaatgagagtgacccggagggagcattgtggtga

SEQ ID NO: 21565 - RNA, 9879 nt, synthetic construct
  misc_feature 1..9879: note = derived and/or modified CDS sequence (opt6) from DENV-1__FJ410226__SS-prME
  source 1..9879: mol_type = other RNA
tctgtaaccatgttattgatgttaatgccaactgcccttgcttttcatctgactaccagaggaggggaaccgcacatgatcgttagtaaacaagaacgggggaaaagtctgctctttaaaacctcagctggtgttaacatgtgtacacttatcgctatggacttaggtgaattttgcgaggacacaatgacttataaatgcccgagaattacggaagcagagccagatgacgtggactgttggtgtaatgcgacagatacgtgggtaacttatggcacatgctcgcaaacaggtgaacatcgtagggataaaagaagtgtagcactggcgccacatgtaggattaggtcttgaaacgaggacggagacctggatgtcctcagagggagcatggaaacaaattcaacgagtagaaacttgggcactgcgtcatcctggatttactgtcatcgcgctatttttagcacacgctattggaacttctattacccaaaagggaataatatttattttgttgatgctcgtaactcctagtatggcaatgagatgtgtcggcatcggcagcagagactttgttgaaggactatctggcgcgacatgggtcgacgtggtattagaacatggatcatgcgtaacaactatggcaaaagataaaccaactctagatatcgagcttctaaaaacagaggtgacaaatccagccgttctcaggaaactttgtattgaagcgaaaatttcaaacacaactacagattcccggtgtccaactcaaggagaagctaccctcgtagaagaacaagacgcaaactttgtctgtcgaagaacattcgtcgacagaggatggggaaatggatgcggacttttcggaaaaggctcccttataacttgtgcgaaatttaaatgtgtaaccaaactagaggggaaaatagtgcaatacgaaaacctaaaatactcagtaatagtaaccgttcatacgggtgaccaacatcaagttgggaacgaatctacggaacatgggaccacggccacaataactcctcaagctccttctacggagatccaactaactgactatggtgctttgacacttgactgttccccaagaaccggattagacttcaacgaaatggtactactgactatgaaagaaaaatcttggcttgtccacaaacaatggttcttggatcttccattgccatggacttcgggagcttctacatcacaagaaacatggaatagacaagacttgctggtaacatttaaaactgctcacgctaagaaacaagaagtggttgttttaggtagccaggagggcgcaatgcatactgcgttaacaggcgcgacagagatacaaacctctgggacgacaacaatctttgcaggacacttgaaatgcaggctaaaaatggacaagttgactcttaaaggtatgtcatatgtgatgtgtactgggtcattcaaactagaaaaagaagttgcagaaacacaacacgggacagttctagtacaaatcaaatacgaaggcacagacgctccatgcaaaatacctttcagtacgcaagatgagaaaggagtaacacaaaacgggcgtctaataactgccaatccaatagttacagataaagacaaaccggtaaatattgaggcggaacccccgttcggggaaagttatatagtaataggggccggagaaaaagcacttaaattaagctggtttaagaaaggatcctcaatcggtaaaatgtttgaagccactgcaaggggagccagaaggatggcaatcttaggagacacagcgtgggattttggatcaataggtggcgtttttaccagtgtaggcaagttggtgcatcagatatttggcacagcatatggcgttctattttctggtgtatcttggacgatgaaaataggaatcggagtacttttaacatggctcggacttaattcaaggtcaacctcgcttagtatgacatgcattgccgttggattggtcactttatatctaggagtcatggttcaagcagacagcgggtgtgttgtaaattggaaagggagagaattaaagtgtgggtctggtatttttgtcactaatgaagtccacacatggactgaacagtacaaattccaggctgactcgccaaaacggttatctgcagcaatcgggaaggcttgggaagaaggggtatgtggaatacgatccgctacacggcttgaaaacattatgtggaaacaaatttctaatgagctaaaccatattctattagaaaacgatatgaaattcacagtggttgttggagacgtagcaggcattctagctcaagggaaaaagatgatacgaccacaaccaatggaatataaatacagctggaaaagctgggggaaagcaaagatcataggcgcagatgtacaaaatactacatttataatcgatggcccaaatacgccagaatgtcccgacgatcaacgagcatggaatatatgggaagtcgaggactacggtttcggaatatttacaacaaatatttggctcaaacttagggatagttacacacaagtttgtgatcaccgtcttatgtcagcagcaataaaagactccaaggcagttcacgccgatatgggatattggatagaaagcgagaaaaacgagacgtggaagttggcacgtgcatcatttatcgaagttaaaacctgcatctggcccaagtcgcacacattatggagcaacggagttttagagtcagaaatgataatacctaaaatatatggaggccctatatcacaacataattatagacctggatacttcacacagacggctggcccttggcatctcggtaaattggagcttgacttcgacctatgtgaaggaacaacggttgtcgtagacgaacattgtggtaatagaggtcccagcctaaggacaaccaccgtgactgggaagatcatccatgaatggtgttgtcgttcttgtacattgccgcctctcagatttaaaggcgaggacggttgctggtatggaatggagataagacctgtaaaagaaaaagaagaaaatttagtaaaatcaatggtatctgccgggagcggggaagttgactcattctcgctagggctactatgcattagtattatgatcgaggaggtaatgaggagtaggtggagcagaaaaatgctaatgacgggcacattagcggtattctttctactaataatgggacaactcacatggaacgaccttatcaggctgtgtataatggtcggcgctaacgcaagtgatcgaatgggcatgggtaccacttatctcgcattaatggcaaccttcaaaatgagacctatgtttgctgtaggtctcctatttagaaggttaacatccagagaagttctactcctaacaatcggattgtcgctcgtcgcatcagtggaactacccaatagcttagaagaactcggcgatggtttagccatgggaataatgatcttaaaattgctcactgatttccaatcacatcagttatgggcaaccctcctaagtttgacattcataaaaacaactttttcattgcattatgcatggaaaacaatggctatggtgctaagcatagtctctctatttccattatgcatgtctaccaccagtcagaaaacaacttggttacctgtattattgggatctcttgggtgcaaaccactaacgatgtttttgattgccgaaaataaaatatggggacgaaaatcatggcccttgaatgaaggcataatggccgtagggatcgtcagtatactactaagtagcttacttaagaacgatgtaccgttagcgggaccactgatagctggtggtatgttgattgcatgttacgtaatttcaggctcaagtgcagacctaagtttagaaaaagcagccgaagtctcctgggaagaagaagcagagcattcaggggcatcacataacatcttagtagaagtacaggacgatgggactatgaaaataaaggatgaggaacgcgatgacacactaacgatccttttgaaagcgactttactcgcagtctctggtgtatatccgctttcaatacctgccactctgttcgtatggtatttttggcagaagaagaaacaacgatctggagtactatgggatacaccgtcaccaccagaagttgagcgggcagtactagatgatggaatatataggattatgcaacgagggctgctgggacgaagccaggtaggagttggcgtatttcaagaaaatgtatttcatacaatgtggcatgtaaccagaggagcagttctaatgtaccaaggcaaacgactagagccgagttgggcctctgttaagaaagacttaatctcatacggtggtggttggagacttcaaggttcatggaatactggagaagaagtccaagttatagccgtggaacccggtaaaaaccccaagaatgtacagaccgcaccgggaaccttcaaaacctctgaaggagaagtgggggcaatagctctcgattttaaacccggaacatcaggaagtccgatagtgaatagagaagggaagatagtaggactttatggaaatggcgttgtaacaacctctggtacctatgtcagtgccatagcgcaggcaaaggcatcacaggaaggaccgctacccgagattgaagatgaagtttttcgcaaaaggaatctaacgataatggacctacatccaggctcagggaagactagaagatatctccctgcgatagtaagagaagctataaaaagaaaacttaggacattaatactcgctccaacgagagtagttgcaagtgagatggccgaagccttgaaaggaatgcccattcggtaccaaacaacggcagtgaaaagcgaacacacaggtaaagaaatagttgatctcatgtgccacgcaacttttaccatgcgactactgagtcctgtaagagtaccaaattataacatgataattatggatgaggctcacttcaccgacccatcttctattgctgctcgaggatacataagcacaagggtggggatgggcgaagcggcagccatctttatgacggcaacacctcccgggtcagtagaagcattcccacaatcaaacgcagttatacaagatgaagaaagagacatccccgagcgttcatggaatagtggatatgagtggataaccgactttccagggaaaacagtatggtttgtgccttcaataaagagcggaaatgatatagcaaactgccttcgtaaaaatgggaagagagttattcaactatcaagaaagacattcgacacagagtaccaaaagactaaaaataacgattgggattatgtcgtaacgactgatatatcggaaatgggtgcaaacttcagagcagaccgagtcatagaccccagacgatgtttaaaaccagtaattttgaaagacggaccggagcgagtaatactagcaggaccaatgcctgtcacggtagcatcggccgcgcagcgacgcggaaggataggaagaaaccataataaagaaggtgaccaatacgtatatatggggcaacctctaaacaatgatgaagaccacgcacactggacagaagcaaaaatgcttctcgataatatcaatacacctgaaggtattataccagccttgttcgaaccagaaagggagaaaagtgctgcaatagatggagaatatcgtcttcgcggcgaagcgagaaagacgtttgttgaactaatgagaagaggggaccttccagtttggttgtcatacaaggtggcctcagaaggtttccaatactctgatagaagatggtgttttgatggagagcgtaacaaccaagtactagaagaaaatatggatgttgaaatatggacaaaagaaggagaacgtaagaaattaaggccgcgctggttagatgctaggacatattcagacccactagccctgagggagttcaaagagttcgctgccggcagacgctcagtatctggagatttaatacttgaaataggaaaacttcctcaacacttaactcaaagagctcaaaacgcacttgacaacttagtgatgctgcataactcagagcaaggtggtagagcatatcgtcacgccatggaagaattaccagatactatcgaaacactgatgttacttgcacttattgcggtgctcactggtggagttacgttattcttcttaagtggacgcggactcggaaaaacaagtattggtctactgtgtgtcatggcgagcagcgtactgctgtggatggcatcagttgaaccacattggatagctgcctcaataattctcgagttcttcctcatggtattactaataccggaaccggatagacagcgaacccctcaagataatcaacttgcatatgttgtgattggcttgctatttatgattttaacggtggcagcaaatgagatgggtttactcgaaactaccaaaaaggacctaggtataggccatgttgcggtagaaaatcatcaccatgctgctatgcttgatgttgacctgcatcccgcgagcgcatggaccctatacgcagtagccaccactattattaccccgatgatgcgacatacgatagaaaacacgactgctaatataagcctaactgcaattgcaaatcaagctgccattttaatgggacttgacaaaggatggccaatttctaagatggacataggggtacctctattagcattaggatgttatagtcaagtaaacccacttacattgactgccgccgtactgatgttagttgcccattatgccattataggtcccggattacaagccaaagcaacccgggaagctcagaaaaggaccgctgcaggtattatgaagaatccgactgtcgatggcatagtcgctatagatttagacccagtagtatacgacgctaaatttgaaaaacaattaggccagataatgcttctgatactgtgcacgagtcaaatactattaatgagaaccacctgggccctatgcgagtctataacactggcaactggaccactgacaacattgtgggaagggtcacccgggaagttctggaacactaccattgcggtaagcatggccaacatttttcggggttcctacctagccggagcggggttggcctttagccttatgaagtcacttgggggcggaagaaggggaaccggtgcacaaggtgaaacactaggtgaaaaatggaaaaggcagttgaatcaactgtcaaagtcggaatttaatacttacaagagatcaggaataatggaagtagatagatctgaggctaaagaaggattaaaaagaggcgaaaccacaaaacatgcggtatctcgagggactgcaaaacttcggtggtttgtcgaaagaaacctggtaaagccagaaggcaaagtaattgacctaggttgcggtagaggtggatggtcctactactgtgccggacttaagaaagtaacagaagtaaaagggtacactaagggcgggcccgggcacgaagaaccaattccgatggccacgtacggatggaacttagtcaaacttcactccggaaaagatgtattctttataccaccagagaagtgtgatacgctcttatgcgatataggggaatcatcacctaaccccactattgaagaagggcgcaccctacgtgtactaaagatggtcgaaccatggttgagaggcaaccaattttgtattaaaatattaaatccatacatgccttctgtagtagagacattggagcaaatgcagagaaagcatggcggcatgctagttagaaacccactttcaagaaactcaacccatgaaatgtattgggttagctgtggaacgggaaatatagtttctgccgttaatatgacatcaagaatgcttcttaataggtttacaatggcccataggaaaccgacgtacgaacgagatgtagacttaggtgcaggaaccagacatgtcgcggttgagccagaggtagcaaatctcgacattataggacaacgaatagaaaatataaagcacgaacataaaagtacctggcattatgatgaagataatccctacaaaacatgggcttaccacggttcttatgaagttaaaccatccggatccgccagctccatggtaaacggggtagtgaaattattaactaagccatgggacgtaattccaatggttactcaaatcgccatgacagataccactccttttggtcaacagagagttttcaaggagaaagtcgatactagaacgccaaaagcgaaacgtggaactgcacagattatggaggtcaccgcaaaatggctatggggatttttgtctcggaataaaaagccaaggatttgtaccagggaagaatttaccaggaaagtacgatctaacgctgctatcggtgccgtgttcgttgatgaaaatcagtggaatagtgccaaagaagcggttgaagatgaacgtttttgggatttagtgcatagagaaagggaattgcataagcaaggcaaatgtgccacctgtgtgtataatatgatgggcaaaagagagaagaaattaggagagtttggaaaagctaagggatctcgtgcaatatggtacatgtggttgggcgccagattcttagaatttgaggccttgggatttatgaatgaggaccactggttttctagggaaaactctttatctggcgttgaaggcgaaggtctccataaattagggtacattcttcgtgacattagcaagattccaggagggaatatgtatgccgatgatacagcaggatgggacacacgcataaccgaagatgatcttcagaatgaagcaaaaattacagacattatggaacctgaacatgcgttactggccaaaagcatcttcaagttaacctaccaaaataaagttgtgagggtgcaaaggccagccaaaaatggcacagtcatggacgtaatatcaagacgtgatcaaagaggtagcggtcaagttggtacctacggacttaatacatttacgaacatggaggcacagctaattcggcaaatggaatctgaaggcatctttagcccaagtgagttagagacaccaaatctcgcagggcgtgtcctggattggctagagaaacacggggttgaaaggctaaagaggatggcaatctcaggcgatgattgcgttgtgaaacctatagatgatagatttgctacggcgttaacggccttaaacgacatggggaaagtacgaaaagatattccgcaatgggaaccaagtaaaggctggaacgactggcaacaagtcccattttgtagtcatcactttcatcaattgatcatgaaagatggaagagaaattgtcgtgccatgcagaaatcaagatgaattagttgggagagcaagagtgtcacaaggtgctggttggagtcttcgagaaacagcatgtttaggtaagtcttatgcacagatgtggcaattaatgtattttcacaggcgagacttgagattagctgcaaatgcaatatgctcagcagttcctgttgattgggtaccaacatctcgtactacatggtctattcacgctcatcaccaatggatgactacagaagatatgttatcggtatggaacagggtctggatagaagaaaacccttggatggaggataaaactcatatttcatcgtggggcgatgtaccctatcttggtaaacgcgaagatcaatggtgtggcagtcttatcgggttaacggcaagggcaacttgggccacaaatatacaagtagctataaaccaggtaaggcgtttaatcggaaatgaaaactacttagactatatgacctctatgaaacggtttaagaatgaatctgatccagaaggtgcactatggtaa

SEQ ID NO: 21566 - RNA, 9879 nt, synthetic construct
  misc_feature 1..9879: note = derived and/or modified CDS sequence (opt6) from DENV-1__FJ410227__SS-prME
  source 1..9879: mol_type = other RNA
tctgtgacgatgttgctaatgttgatgcctacagctttagcatttcatctgacaacccgaggtggggaaccccatatgatagtgtccaaacaagaacgaggaaaaagcctgttatttaaaacttctgcgggtgttaacatgtgtactttaatagcgatggacttgggagaattttgtgaagatacaatgacatacaaatgccccagaataactgaagcagaacccgatgatgtggattgctggtgtaatgcaacagatacctgggtaacctacggaacatgttcacaaacgggtgaacacaggcgagataaaaggtcagttgctcttgctccacatgtcggtttaggactcgaaacaaggacggaaacatggatgagttccgaaggagcctggaaacaaatccaacgagtagaaacttgggccctgagacaccctggttttacagttatagcattattcttggcgcacgcaatcggaacttcgattacacaaaaaggcataatatttatccttctgatgctcgtaaccccttcgatggctatgcgttgtgtcggaattggtagcagggatttcgtcgaaggattatcaggcgcaacctgggtcgacgtagttctagaacacggaagttgcgtaactacaatggctaaagacaaaccgactttagatatcgagttactaaaaaccgaggtaacaaacccagcagtgcttcgtaaactctgtattgaagcaaaaattagcaacaccacaacagactcacgctgcccaacccaaggtgaagctactctagtcgaagaacaggatgctaatttcgtttgcagaagaactttcgtagatcgaggttggggtaatggttgtggactatttggtaaaggctctttaataacgtgtgccaaattcaaatgtgtaacaaaattggaagggaaaatagtccaatatgagaacctaaaatactcagtgatagtcaccgttcataccggagatcaacatcaagttggaaacgaatcaaccgaacatggtacaacggcgaccataactcctcaggccccatctacggagatccaacttacagattacggcgctttgaccttggactgcagtccgcgtacgggattagattttaacgaaatggtcctattaactatgaaagagaaaagttggctagtgcataaacagtggttcctcgatctaccgctaccttggacaagtggggcaagcacatcacaagaaacatggaatcgtaaagatttactcgtaacgttcaaaacagctcatgccaagaaacaagaagtggtagtactcggatcacaagagggagctatgcacaccgcgttaactggcgcgacagaaatacaaacatccggcacgactacgatattcgccggccacctcaaatgccgtttgaaaatggacaaattaacacttaaaggtatgtcatatgtaatgtgtacggggtcatttaaattagaaaaagaagtcgctgaaacacaacatggcacagtattagtccagatcaagtatgaaggaacagatgctccctgtaaaattccgttcagtacgcaagatgagaaaggagttacccaaaacggacgtttaatcacagcgaatcccatagttacggataaggagaagccagttaatatcgaagccgagccaccttttggtgaatcatacatagtgatcggagcaggagaaaaagccctaaaattatcttggtttaaaaaggggtcgagcataggaaaaatgtttgaagcaacagcaagaggtgcaaggagaatggccatactgggggacacggcatgggatttcggatcaataggtggggtcttcaccagcgtcggaaagctagttcatcaaatttttggcaccgcttatggcgtactgttctccggtgttagttggactatgaaaattggaatcggtgtactgctaacttggcttggactaaacagccgcagcacttctttaagtatgacatgtatagccgtaggtctcgtgactctatacttaggagtaatggtacaagctgattcagggtgtgtaataaattggaaaggacgtgagcttaaatgtggttctggtatattcgtaacgaacgaggttcacacttggacagaacaatacaaatttcaagccgatagccctaaaagactgtcagcagcgattggaaaggcttgggaggaaggcgtctgtgggattcgcagtacgacgcgcttggagaatataatgtggaaacaaataagtaatgaattaaatcatatactactagaaaacgatatgaaattcactgtggtagtaggtgatgttgcgggcatattggctcaaggcaagaaaatgataagacctcaaccaatggagtataaatacagttggaaatcctggggcaaagctaaaatcataggagccgacgttcaaaataccaccttcataatcgatggacctaacacacctgagtgtccggacgaccagcgagcttggaatatttgggaagtagaagactatgggtttggcattttcacaacaaacatatggcttaaactaagggacagctacacccaagtatgtgatcatcgacttatgagtgctgcgatcaaggattcaaaagcagtccacgctgacatggggtactggattgaaagtgagaaaaatgaaacatggaagttagcacgtgcctcgtttattgaagttaaaacctgcatttggccaaaaagccacaccctgtggagtaatggcgttctagaaagtgaaatgattataccaaaaatatatggtggcccaataagccaacacaattatagaccaggatactttacgcagactgccgggccctggcatctaggcaaactagaactggatttcgacttgtgcgaggggacaacagttgtagtcgacgaacattgtggaaatagaggaccatccttgaggacaacgactgtgacaggaaagattatacatgaatggtgttgtagaagttgcaccctaccacctctcagatttaaaggggaagatggatgctggtatggaatggagataagacccgtaaaagaaaaggaggaaaatcttgtcaagtccatggtatctgcaggatcaggagaagtcgattcctttagcttgggattactctgtataagcataatgattgaagaagtaatgaggtccagatggagtcgaaagatgctcatgacgggcactttagcggtgtttttcctactaataatgggacaactcacgtggaacgatctaattcggctatgtataatggttggcgcaaatgcaagtgatagaatgggaatgggaacaacatacctagcgctaatggcgacattcaaaatgagaccgatgtttgcggttggtttgctatttagacgcttaactagccgggaagttcttctactaaccatagggttaagtttagtagcatcagttgaattgcctaattcactggaagaactcggtgatggactggcgatggggataatgatcttaaagctccttacagattttcagtcacatcagttatgggcgactctactttcattaaccttcattaaaacaacgtttagtttacattatgcatggaaaacaatggcaatggtcctaagcatagttagtctctttcctctatgtctatccactacttctcaaaagacgacctggctcccagtgcttcttggttcacttgggtgcaaacctttaacaatgtttctcatagccgagaataagatatggggtcgaaaaagttggccactaaatgaaggaattatggctgtgggcattgtatctatattactttcatctctacttaagaacgatgtgccattggcgggtcctctaatagctgggggaatgctgatcgcctgttacgttatctctggatcctcagctgatctttctcttgagaaagccgccgaagttagttgggaggaagaagctgaacactcgggagcgtcccataacatattagtagaagtacaagacgatggaacaatgaaaataaaagacgaagaacgcgacgacacacttacaatactattaaaggctacattactcgcggttagtggcgtttatcctctatcaataccggcaacattgttcgtctggtatttctggcagaagaagaaacagaggtctggagtactgtgggatacacctagtccacccgaagtggaaagagcggttctagacgacggtatctacagaattatgcagagaggactgttaggaagatctcaggtaggcgtaggggtttttcaagaaaatgtttttcacaccatgtggcatgttacgaggggagcagtgcttatgtatcaaggtaaaagactagagccgtcgtgggcttcggttaagaaggatctaatatcatatggaggaggctggaggctacaaggcagctggaatacgggcgaggaagtccaagtaatagcagtcgaaccgggcaaaaatccaaagaacgtacaaaccgccccaggaacatttaagacgtcagaaggggaggttggagccattgcactagacttcaaaccgggaaccagtggaagcccaatcgtaaatagagagggaaaaattgtagggctttacgggaatggtgttgtgactacatcaggtacatacgtcagtgcaattgctcaagcgaaagcatctcaagaaggccccttacccgaaatagaagacgaagtcttccggaaacgcaatcttaccattatggacttacatccagggtcagggaaaaccagaaggtatctcccggctatagtacgagaagccataaaaagaaaacttagaacactaattcttgcaccaactagagtcgtagcatccgaaatggctgaagcccttaaaggaatgccaatacgctatcaaacaacagctgtgaaatcagaacacactggcaaggagatagtagacctaatgtgtcatgcaacttttaccatgcgtttgctatccccggtaagggtaccaaactataatatgattattatggacgaagctcattttacagacccaagttcaatcgccgcaagaggatatataagtacacgcgtagggatgggagaagcagccgcaatatttatgacagcaactcctccagggtcagtagaggcgttcccacaatctaacgcggtaatacaagatgaggaacgtgacattccagaaagatcttggaatagcggttacgagtggattacagattttcctggaaagacagtatggttcgtaccttcaattaaatctggtaatgatatagcaaattgtctacgtaaaaacggaaaaagagttatacagttatcccgtaagacgttcgatacggaataccagaaaacaaagaacaatgattgggactatgtagttacaacagacatctcagaaatgggagcaaatttcagggctgatcgggtaatagaccctagacgttgtttgaagccagtgatattaaaggatggtcccgagagagtgattttggctggcccaatgccagtcaccgttgcttcagctgcacaaagacgtggccgtatagggagaaaccacaataaagaaggagatcaatacatatatatgggtcaaccactcaacaatgatgaagaccacgcccattggacagaagcaaaaatgctactagataatattaacacacctgagggcattatccccgcattatttgaacctgaaagagagaaaagcgctgctatagatggagagtataggttgcgtggagaggcaagaaagacattcgttgaattaatgcgtagaggtgacctacctgtgtggttgtcttacaaggtcgcgagtgaagggtttcaatactcagacaggagatggtgcttcgatggtgaaagaaacaatcaggtccttgaagaaaatatggatgtggaaatatggaccaaagaaggagaaagaaagaaattaagaccacggtggttagatgcaagaacctactctgacccattagcacttcgagagttcaaagaatttgctgcagggaggaggtcagtatccggggatctcatactagaaataggcaagctccctcaacatctcactcaaagagcacaaaatgcactagacaatctagtaatgctacataactcggaacaaggcggacgtgcttatagacacgcaatggaggaattacccgataccatagaaacattaatgctgctagcattaatagccgtcctaactggcggagtaacactctttttcctatcaggaaggggcctaggcaaaactagcataggactgttgtgtgtaatggcgtcttcagtgctgttatggatggcaagcgtcgaaccacattggatcgcagccagtattattttagagttctttctcatggttttgcttataccagaaccggaccgacagcggactccgcaagataaccagctagcctatgttgtaataggtttgctttttatgatactaactgtagctgcgaacgagatgggactcttagaaacgacgaagaaagatctcggaataggacacgtagcggccgaaaatcaccaccatgccgcaatgctggatgttgatttacatcccgcaagtgcttggactttgtatgcagtagcgacgacaattattacgcctatgatgagacatacaatagagaacactactgcgaacataagcctaactgcgattgcaaatcaggcagcaatattaatgggactagataaagggtggccaattagtaaaatggatataggcgttccattactcgcgctaggctgctactcgcaagtgaatcctctaacgttaactgcagcagtattaatgttagttgcacattatgccataatagggcctgggctacaagcaaaggccacgcgggaagcccaaaaacgcacggcggcaggtataatgaaaaatcctacagtggatgggatagttgctatcgacctagaccctgttgtctatgatgcgaagttcgagaaacaactcggtcagatcatgttactgattttatgcacaagccaaatcctactaatgagaactacatgggcactgtgtgaatctatcacgttagctactggcccccttacgaccttatgggaaggaagtcctggtaaattttggaacacaacaatagctgtttcaatggcaaacatcttccgtggctcatacctggcaggggccggattagccttttctcttatgaaatcgttgggaggcggtcgtaggggaacgggtgctcaaggtgaaacattaggtgagaagtggaaaagacagttgaatcaattatcaaagagcgagtttaatacttataaacgatctggtatcatggaggtcgatagatccgaagcgaaggaaggtttaaagcgaggtgaaacaactaaacacgcagtgtcgagaggtaccgcgaaactacgatggtttgtagagcgaaacttagtaaagccggaaggtaaagtgatagatttaggctgcggtcgaggaggatggagctactattgtgcaggtctgaagaaagtcacagaagtaaaaggatatactaaaggaggcccaggacatgaagaaccaataccaatggcaacatatggttggaatttagtcaaactccacagcggaaaagacgtgttctttatcccgccagaaaaatgtgacacgctattatgtgatataggcgaatccagtccaaacccaactattgaggaaggacgaacccttcgggtgctaaaaatggtcgagccttggctaagaggtaatcaattttgtataaaaatactaaatccctatatgccatctgtggtggaaacattagaacaaatgcaaagaaaacatggtggaatgttagttagaaatccacttagccgcaactcaacacatgagatgtattgggtaagctgtggcactggaaatattgtaagcgcggttaacatgacttcgagaatgcttttgaacaggttcactatggcacatagaaaaccaacatatgaaagagatgtggatcttggagcaggtacaagacacgttgccgtggaaccagaggtagccaacctagatataataggacagcgaatagagaatattaagcatgaacacaaaagtacgtggcattatgacgaagacaacccctataaaacctgggcttatcacggtagttatgaggtaaagcctagcggaagtgcttctagcatggtgaatggtgtcgtcaaactattgacaaaaccttgggacgttattccgatggttacacaaatagccatgacagacacgacaccatttggtcaacaacgagtattcaaggaaaaagttgatactagaacgccaaaagccaaaagaggaaccgcccaaatcatggaagtgacagctaaatggctatggggattcctgagtagaaacaaaaagccgagaatttgtacgagagaggagtttacaagaaaagtaagaagcaatgccgcaataggggcagtattcgttgatgagaaccaatggaacagtgctaaagaagcagtagaagatgaaaggttttgggacttggttcaccgggagcgagaattacacaagcaaggaaaatgcgccacatgtgtgtacaatatgatgggtaaaagagagaagaaactaggtgaatttggaaaggccaaaggatctagagcaatatggtatatgtggctcggagcacgattccttgagttcgaagccctaggctttatgaatgaagaccactggtttagtcgcgaaaatagcttatcaggagttgaaggggaagggctgcataagctaggatatatattacgtgacatttccaagattccaggaggcaacatgtatgcggatgataccgcggggtgggataccaggataactgaagacgatttgcaaaatgaagcaaaaataacagatattatggaacctgaacatgcattactagcaaagtcaatctttaaactaacttatcaaaataaagtagtacgagtacaacgaccagctaaaaacggaacagtgatggacgttataagccgacgggaccaaagagggtcaggacaagttgggacttacggcttgaacacatttacaaacatggaagcccaactaataaggcaaatggaaagtgaagggatattctctccaagtgaattggaaaccccaaacctcgcaggaagagtcctagattggctggaaaaacatggtgtcgaacgtctaaaaagaatggcaatttcaggcgacgattgcgtagtgaaacccattgatgatagattcgccacagcattaacagcacttaatgacatgggaaaagtacgaaaagacattccgcaatgggaaccgtcaaagggatggaatgattggcagcaggtaccattctgttcccatcatttccaccaattaattatgaaggacggtcgcgaaattgtagtaccatgcagaaatcaagacgaactcgtaggacgggcgcgagtaagtcaaggggcaggttggagcttaagagaaacagcatgtctaggcaaaagctatgcacaaatgtggcaattaatgtactttcatcggagagatttacgcctagccgctaacgctatctgttcagctgtgcccgttgattgggtaccaacctctcgaacaacctggtctatacatgcacatcaccaatggatgaccactgaagatatgctttcggtttggaacagagtatggatagaagaaaatccctggatggaagataaaacacacatctccagttggggagatgttccttatttagggaaaagggaagaccaatggtgcggaagtttgataggactaaccgcgagagcgacctgggcaacaaacatacaagtggcaataaaccaagtcaggcgactaattggtaacgagaattatcttgattacatgacgagcatgaaaagattcaagaatgaatcagacccagagggggccctgtggtaa

SEQ ID NO: 21567 - RNA, 9879 nt, synthetic construct
  misc_feature 1..9879: note = derived and/or modified CDS sequence (opt6) from DENV-1__FJ859029__SS-prME
  source 1..9879: mol_type = other RNA
agcgtaaccatgttattaatgttaatgccgactgcattggcatttcatttaaccactagaggaggggaaccgcatatgatagtatcaaaacaagaacgggggaaaagcctattgtttaaaacaagtgcgggcgtgaatatgtgcactctgatagctatggatctaggtgaattttgtgaagacaccatgacatataaatgtcctaggattacagaagcagaaccagatgacgtagattgttggtgtaatgccactgacacatgggttacatatgggacgtgttctcaaactggtgaacatcgaagggataaacgcagcgtagctctggcaccgcacgttgggttagggttggaaactagaaccgaaacatggatgtcttccgaaggcgcttggaaacaaatccaaaaagtagaaacatgggcactcagacatccaggttttacagtcatcgcactctttttagcacatgcaataggaaccagcattacacaaaaaggcataatttttattctattaatgttagtaactccatcgatggccatgcgatgtgttggcatcggctcaagagacttcgtagaggggcttagtggcgctacatgggtggatgtggtgcttgaacatgggtcctgtgtaactacgatggcaaaagacaaacctacactagatatagaattgttaaaaacagaagtcaccaatccagctgtcctcaggaaactttgtattgaggccaaaatcagcaacacgacaactgatagtcggtgcccgactcaaggggaagctacattggtggaggaacaagatgcaaactttgtatgtagaagaacatttgtcgatagaggatggggtaatggttgtgggctgttcggtaaaggcagcctgatcacatgtgccaaattcaaatgcgttacaaaactagaaggtaaaacagttcaacatgaaaacttgaaatattcagtaattgtcacagttcatactggggatcaacatcaagtagggaatgagtctactgaacatgggaccacagcaacaataacaccacaagctcccagcacagaaatacaactcacagactatggagcgcttaccctagactgttcacctcggacagggttggacttcaatgaaatggtgctattaactatgaaagaaaaatcatggctggtgcacaaacaatggtttttagacctcccactgccgtggacctctggggcatccacatcgcaagagacctggaaccggaaagatttattagtgacattcaaaactgcgcacgcgaagaaacaagaagtagtcgtactaggtagtcaagaaggggcaatgcacacagccttaacaggtgcaaccgagatacaaacaagtggaactactactatttttgcaggacatcttaaatgccgtttaaaaatggataaattaactctgaaaggcacctcatatgtaatgtgcaccgggtcattcaagttagaaaaagaagtcgccgaaacccaacatggcacagtacttgtgcaaattaaatacgaaggcacagatgcaccttgtaaaataccgttttccacacaagacgaaaaaggtgtaacgcaaaatggacgtttaattactgccaatccaatcgtcactgataaagagaagccagttaatattgaagcagaaccacctttcggagaatcatatattgttatcggagccggagaaaaagctcttaagttaagttggtttaagaaaggttctagtataggaaagatgtttgaagctaccgcgagaggagctcggagaatggctattttgggagacactgcttgggattttgggtcaatcggcggtgtatttacctccgtcgggaagttagtccatcaaatctttggtacagcatatggagttttgttcagtggagtaagctggaccatgaaaatcgggatcggcgtgcttcttacatggttgggattgaatagtaggagtacatcgctaagcatgacgtgcatagcagtgggtctagtaaccctatatttaggggtgatggtccaagcggacagtggatgtgtaatcaattggaaagggcgcgaattaaaatgtggttcaggaatttttgtaactaatgaggttcatacatggactgaacagtacaaatttcaggcagatagcccaaaacgattgagtgctgcaattggcaaggcttgggaagagggagtctgcggaattagatcagcgacgcgtttagaaaacataatgtggaagcaaatctcaaatgagctaaatcacatattactcgaaaacgatatgaaattcaccgtcgtcgtaggagatgtagctggtatattagcgcaagggaagaaaatgatacgaccccaaccaatggaatacaaatactcctggaaatcgtggggtaaagctaagataataggggcggacgttcaaaatacaacgtttattattgatggtccaaatactccagagtgccccgatgaccaaagggcatggaacatttgggaggtcgaggattacgggtttggcatttttacaactaacatatggcttaaactcagagattcatatacacaggtttgtgaccatagacttatgtcagcagcgataaaggatagcaaagcagtccacgcagacatgggatattggatagagagtgagaaaaacgaaacttggaaactagctagagcaagttttatagaagtgaaaacgtgtatctggccaaaatcgcacacactatggtctaacggtgtattagaaagtgagatgatcatacctaagatatatggtggccccatatcccaacataattataggccagggtacttcactcaaacagccgggccctggcaccttgggaaattagaactggacttcgatctgtgcgaaggaactaccgtggttgtagacgaacattgtggcaatcggggaccgtcgctacgaactacgacagtcacgggaaaaataatccatgagtggtgctgtagatcttgtacattgcctccattgcgatttaagggggaagacggctgttggtatggaatggaaattcgtccagtaaaagaaaaagaagaaaatttagttaagtcaatggttagcgctgggtctggagaagtagatagtttcagcctagggttactatgcatatcaataatgatagaagaggtgatgagaagccgttggagtcggaaaatgcttatgacgggaacgttagcagtcttcctgctcctaataatggggcaactaacatggaatgacttaataagattatgtataatggtaggagccaatgcatctgacaggatgggaatgggcactacgtatttagctctaatggccacttttaaaatgaggccaatgtttgctgtcggacttctatttcgaaggcttacatcacgagaggtgctattactgaccatcggcctatctcttgtagctagcgttgagctaccgaacagtttggaagaattaggtgacggattagcaatgggtattatgattctaaaattgcttacggattttcaaagtcaccaattgtgggctacacttctatcattaacgtttataaagactaccttttcgttgcactatgcgtggaagactatggcaatggtattatcaattgtgtctctttttccattatgtttaagtaccacgtcacagaaaacgacgtggttacccgtactgttaggaagtcttggatgcaaacctctaacaatgtttttgatagcggaaaataagatttggggacgaaaatcatggccactaaacgaaggaatcatggccgtaggaatagtatcaatacttttatcatctttattgaaaaatgatgtgccccttgcaggaccactgatagccggtggcatgctgatcgcttgttacgtgatatcaggaagctcagctgacctcagtctagaaaaagcggcggaagtctcctgggaagaagaagcagaacactctggcgcctcacataacatattagttgaggttcaagacgacggcacaatgaagattaaggacgaagaacgcgacgacacactaacaatccttttaaaagcaactttattagccgtttcaggtgtttacccattatcgattccagcaacattattcgtatggtacttctggcagaagaagaaacaaagatccggtgtactctgggatactccaagtccacctgaggtagaacgtgctgttttggatgacgggatctaccgaataatgcaaagaggtttgctcgggagaagtcaagtaggtgtgggtgttttccaagaaaatgtttttcacactatgtggcacgtgactcggggcgcggttcttatgtaccaggggaagagattggaaccgagttgggcctcagttaagaaagatcttatttcctatggaggtggttggagattacagggaagttggaatacaggagaagaggttcaggtcatagcggtggaacccggcaaaaatcccaaaaatgttcagactgctcctggtacatttaaaacatcagaaggagaggttggggccatagcacttgactttaaaccgggaacatctggatcacccattgtgaatagagaaggcaagatagtaggtctctatgggaacggcgtggtaacgacttcaggcacatacgtttcggctatagcacaagctaaagccagccaagagggcccattgccagaaattgaagacgaagtttttagaaaaagaaacctgacaattatggaccttcatccaggaagcggtaaaaccaggcgttacctcccagcaattgttagagaagcaatcaaacgcaaacttaggacactaattctagcccctacgcgggtggtcgccagtgaaatggctgaagcattaaaaggcatgcccataaggtatcaaacaacagcggtaaagggagaacacactggtaaggaaattgttgacctcatgtgccatgcaacctttacgatgcgtctgttatctcctgtaagagtacccaactataatatgattatcatggacgaggctcattttacagacccttcaagtattgcggctcgaggctatataagtactcgtgtaggcatgggtgaagctgcagcaatctttatgacagccaccccaccaggctccgtagaggcatttccacaatccaatgctgtaatccaagatgaggaaagagatatcccggaaagaagttggaactcaggttatgaatggattacagatttcccaggcaaaacagtgtggttcgttcccagtataaagagcggaaatgacatagcaaattgtttacgtaaaaatggcaaaagagttatacaattatcacgaaaaacattcgacacggaataccagaaaactaagaataatgactgggattatgtagtaactactgatatatccgaaatgggagccaatttcagggcagatagggttatcgaccccaggcgttgtttaaaacccgtgatccttaaagacgggcctgaacgagtcatcctagctggacctatgcccgtcacggtagcgtccgctgcccagaggagaggcagaattggaagaaatcacaacaaagaaggtgatcaatatatatatatggggcaacctttaaacaatgacgaggaccatgctcattggactgaagcaaaaatgcttttagacaatatcaatactccagaaggaattataccagctctctttgagccagaacgagagaaaagtgcagcgatcgatggggagtataggttaaggggagaagccaggaagacttttgttgaattaatgaggcgcggtgacttaccggtttggctcagctataaggttgcttcagaagggttccagtactccgaccgcagatggtgttttgatggagaacgtaataatcaagttctcgaagaaaatatggacgtagaaatttggaccaaagaaggagaaaggaagaaattgcgacctagatggcttgacgctcgaacctattcagatccactagccctacgggaatttaaagaatttgcagcaggaagaaggtcagtatctggagatttaatattagaaataggtaaacttccacaacatctgacacagcgtgctcaaaatgcattagacaatctagttatgttgcataattctgaacaaggcggtcgtgcctaccgccatgcgatggaagagttgccggataccattgaaacactaatgctcctagctcttatcgcagttctaactggaggggttaccctcttctttctaagtggacgtggcctaggcaaaactagcattggattgctgtgcgttatggcctcatcagcactactatggatggcaagtgtagagccacactggattgcagctagcattatacttgaatttttcttaatggtccttttaattcctgaacccgatagacaaaggacaccacaagataatcaactcgcatatgtggttataggattattgtttatgatacttacagtagcagcgaatgagatgggactgttggagactaccaagaaagacttggggattgggcatgtggctgttgaaaaccatcatcacgcagcaatgttagatgtagatctccatccagcatcagcatggacactttatgcagtagcaacgaccattataactccgatgatgagacatacaatagaaaacacaaccgcgaatatttcactgacagcaatagccaaccaagcagcaatactcatgggacttgacaaaggatggcctatttcgaagatggatattggcgtccccctgttggccctcgggtgttatagtcaagtaaacccattaacactaacagcagccgttcttatgttagtagctcattatgctataatcggacctggtttacaagcgaaagctacgcgtgaagcacaaaaacgcactgcggctggaataatgaaaaatcccacagtagatggaatagtcgctatagacttagacccagttgtctacgatgcaaaatttgaaaaacagttaggtcagatcatgttgttagtcttatgtacaagccagatcctacttatgcgaactacgtgggcactatgcgaatctataacattagcaacgggtcccctgacaactttatgggaggggagcccaggcaagttttggaacactacaattgctgttagtatggccaatatcttccgcggatcctacttagccggtgcgggattagcattctctctaatgaaatctttaggaggcggccgcagaggaaccggcgcacaaggagaaacattaggagaaaaatggaagagacaactaaatcaactttccaagagtgagtttaacacatataaacgatcgggtatcatggaagtcgaccgcagcgaagcgaaagaggggctaaaacgcggagaaacaactaaacacgctgtttcacgaggaacagcaaaacttcgttggtttgtagaaagaaacctcgtaaagcccgaaggaaaagtcatagatttaggttgcggcagaggtggatggagttattattgtgcgggattaaagaaagtaactgaagtaaaaggctatacgaaaggtgggcctggccatgaagaaccaatccccatggccacatatggatggaatcttgtcaaactacattcgggaaaagacgttttctttatccctcccgaaaaatgcgatacactcttgtgtgacattggagaatcttccccaaatccaacaattgaagaaggcaggacacttcgcgttctaaaaatggtggaaccatggctacgaggaaatcaattttgtataaaaatactaaacccatacatgccatccgtagtagagacgctcgaacaaatgcaacgaaaacacggaggtatgctagtgcggaaccccctgagcagaaattctacacatgaaatgtactgggtgagttgtggtacaggtaacatagtaagtgccgtcaatatgacatctcgtatgttactaaaccgcttcactatggctcatcgaaaacctacatacgaacgcgacgtagacttaggtgctggtacgagacatgtggcagttgagccagaagtagcaaatttagacataattggccaacgaatagaaaatatcaaacatgaacataaaagtacgtggcattacgacgaagataatccctacaaaacctgggcgtatcacggctcctatgaagcaaaaccttctggatctgcaagctctatggtaaatggagtagtaaaactattaaccaaaccatgggatgtaattccaatggttacacaaatagccatgactgatacaactccctttggacaacaacgagtttttaaggagaaagtcgacacaagaacacccaaagcaaagcgagggactgctcagattatggaggtaactgctaagtggctatggggatttttatctaggaacaagaagccccgaatatgtactagagaggaatttacaagaaaggtaagaagtaatgcagcaataggggcagtcttcgtagacgaaaatcagtggaatagtgcaaaagaagcagtggaagatgaacgattttgggatttggtccatcgcgaaagggaattgcacaaacagggaaaatgtgcaacatgcgtttacaacatgatgggtaaaagagaaaagaaattaggcgagtttggtaaagcaaagggatcacgagccatttggtacatgtggttaggagctcgattcttggaatttgaggccttaggtttcatgaatgaagatcattggttttcaagagaaaattcgctttcaggtgttgagggtgaaggcctacataaattagggtatatacttagagatatctcaaagatacctggaggcaatatgtatgcagatgacaccgctggatgggatacccgcatcactgaagatgatttacaaaatgaagcaaagattactgatataatggagcccgagcacgctttattagccaaatcaatctttaaactgacctatcagaataaggtagtacgtgttcaaaggcccgccaaaaatgggaccgtcatggacgtaatctctcgacgcgatcaaagaggcagtggccaagtcggaacttatggtctaaatacctttaccaatatggaagcacaattaataagacaaatggagtccgaagaaatatttagtccatcggaactagaaacccctaatctggcaggcagagtcctagattggctggaaaagcatggcgttgaaagactgaaacgaatggcaataagcggtgacgattgcgttgtcaaacccatagacgatcgcttcgcaactgcactcacggctctaaacgacatgggtaaagtccggaaagatatacctcaatgggaaccgtctaaaggatggaacgactggcaacaagtccccttttgtagtcatcacttccatcaactcattatgaaagatggtagggaaattgtagttccctgtagaaatcaggatgaattagtaggacgtgctcgcgtgtcacaaggcgccgggtggagtttaagggaaacagcatgtcttggaaaatcatacgcccaaatgtggcaacttatgtattttcaccgaagagacttacgcctagccgctaatgccatatgttctgcagtgccagtagactgggtaccgacatcacgtacaacatggtcgatacacgcacatcatcaatggatgacaacagaagatatgcttagtgtctggaatagagtctggatagaagaaaatccttggatggaagataaaacacacatatcaagctggggagatgtaccatatctagggaaacgtgaagatcagtggtgtggaagtctaattggactaacagcaagagcgacatgggcgacaaacattcaagttgctataaatcaagttcgaaggctgataggaaatgaaaattatcttgactacatgacttctatgaaacgtttcaaaaatgaaagcgatcctgaaggagcgctatggtag

SEQ ID NO: 21568 - RNA, 9879 nt, synthetic construct
  misc_feature 1..9879: note = derived and/or modified CDS sequence (opt6) from DENV-1__FJ547065__SS-prME
  source 1..9879: mol_type = other RNA
agcgtaactatgttgttaatgttaatgccaacagcattggcttttcacctaacaacacgaggtggagagccgcacatgatcgttagtaaacaagaaagaggtaaatcattactatttaaaacaagcgcaggagttaacatgtgcacccttatcgcgatggatttaggtgagctttgcgaggataccatgacatataaatgccctagaattactgaaactgagcctgacgatgttgactgttggtgtaacgcaaccgatacctgggtgacatatggaacatgtagtcaaaccggggaacacagaagagataaaaggtccgtagcactagctcctcacgtaggactaggattggaaacaagaacagaaacatggatgtcatcagagggtgcgtggaaacagatacaacgtgtagaaacgtgggcattaaggcaccctgggttcacagtcatcgcactatttcttgcacatgctataggaacaagtataacacaaaaaggaataatatttatattgctcatgcttgtaacgcctagtatggcaatgcgctgtgtaggaattggttctcgcgattttgtagaagggctttccggagcgacttgggttgacgtagttcttgaacatgggtcgtgcgtaaccacaatggcaaaagacaaaccaactctcgacatagaacttttgaaaacagaagtaacaaatccggcagttcttagaaaattgtgtatcgaagcgaaaatttctaatacgacaaccgactcacgatgcccaacacagggggaggctaccctagtggaagaacaagatgctaatttcgtatgtaggaggacttttgtagacagaggttggggaaatggttgtggcttatttggcaagggttcactcataacatgcgcaaagtttaaatgtgtaacaaagctagagggcaaaatagtgcagtatgaaaacctaaaatactcagtgattgtaaccgtacacactggagatcaacatcaagtgggcaacgaatcgacagaacacggaacaacagctacaataactccacaagcacctaccacggaaatccaactcacagattatggagctttaacattagactgtagcccccgtaccgggttagacttcaatgagatggtactactaacaatgaaagaaaaatcttggttagttcataaacagtggttccttgatctccctctcccatggaccagtggggccagcactagccaagagacgtggaataggcaggaccttctagtcacatttaaaacagctcacgccaagaaacaagaggtcgtcgttctgggttctcaagaaggagccatgcacacggctttaacaggagcgaccgagattcagacgagtggaactacaaccatattcgcaggtcatcttaaatgccgattaaaaatggataagctcaccctaaagggtatgagttacgtaatgtgcacaggatcatttaaattagagaaagaagtcgcagagacccaacacggtactgtccttgtacaaataaaatatgaaggtacagatgcgccatgtaagatcccattcagtacacaagatgaaaaaggtgtaacccaaaatggtcgccttataacagcaaatccaatagtcactgacaaggagaagcctgtaaacatagaggcggagccacccttcggagaaagttatatagtaatcggagctggagaaaaggcactaaaattatcttggtttaagaaaggttcttcaatcgggaagatgtttgaggccacagcgcgcggcgccagaagaatggctatccttggtgataccgcttgggatttcggcagtataggcggtgtattcaccagtgtcggaaagctggttcatcaaattttcggaacagcctacggggttttattttcaggagtctcatggactatgaaaataggtattggagtactactaacatggctaggcctcaactcaagatcaacaagtttaagtatgacatgcattgcagtcgggctagttaccctttatctaggcgttatggtccaagctgactcaggatgtgttattaattggaaaggacgagagctgaagtgtggaagcggcatatttgtcacgaatgaagtgcatacgtggacagaacaatataaatttcaagctgatagtccaaagagactatcagcggcaataggtaaagcatgggaagaaggcgtctgtggtataagatcggcaacaaggttagaaaatatcatgtggaaacaaatatcaaacgaattgaatcatattcttctggaaaatgatatgaaatttaccgtagttgttggcgacgttgctggtatattggctcaaggtaagaaaatgatccgtccacaaccaatggaatataaatattcatggaaatcgtgggggaaagcaaaaatcatcggagcagatgtccaaaatacaacatttattattgatgggccaaatacccccgaatgcccggacgacctgcgcgcctggaacatatgggaggtcgaagactatggtttcggaatttttacaacgaacatttggttaaaattacgagattcttacacacaagtgtgtgatcatcgacttatgagcgcagcaataaaagattcaaaagccgtgcatgcggatatgggttattggattgaaagtgagaaaaacgaaacgtggaaattagccagggcttcgtttatcgaagtaaaaacttgcatatggccaaaaagccacacattatggtcaaatggcgtgttggaatcagagatgattattccgaaaatctacggcgggcctatatcacaacataattacaggccaggatacttcacacaagctgccggcccatggcacctcggtaaactagaacttgatttcgatctttgtgagggaaccacagtcgtagtcgatgaacattgtgggaacaggggtccaagtctacgaactaccactgtgacaggaaaaataattcacgagtggtgttgtagatcatgtacattgccacctttaagatttcgtggagaggacggctgttggtatggaatggaaattcgacctgtcaaagaaaaagaagaaaatttagtaaagtcgatggtctctgcgggatcaggtgaagtcgattcgttctcattggggctactctgtatatctataatgatagaagaggttatgcgttccagatggagtcgtcgtatgttgatgactggaaccttggctgtattctttttattaataatgggacaactaacttggaatgatttgatcagattatgtattatggttggtgcgaacgcatcagaccgaatgggtatgggtactacctacttagcactgatggcaacttttaagatgcgtccaatgtttgcagtaggtttactcttcagacgactaacaagcagagaagtgcttcttctaacgatcggcttatccttagtagcgagtgtagaattaccaaatagcttagaagaactcggtgatggactagcaatgggaattatgatactcaaacttctaacagactttcaaagtcaccaactctgggcaacattactcagtttgacctttataaaaactacgtttagtttacactatgcttggaaaacaatggcaatggtcctgtcaatagtatcattatttcctctatgcttgagcactacgagccagaaaactacttggctcccagtattattagggagtctgggttgcaagcctcttactatgttcttaatagcagaaaataagatatggggcagacgaagctggccattaaatgaaggaataatggccgtcggcatcgttagcattctcctaagctcgttgctcaaaaacgatgtgccgttagcaggaccattaatagctggcggaatgcttatcgcatgctatgttataagtggatcgtcagcggatctatctctcgaaaaagcggcagaggtcagttgggaagaagaagccgaacattcaggagcatcgcataacattttggtggaagttcaagatgatggtacgatgaaaattaaggacgaggagcgagatgatactttgacaatattattgaaggccacgttattggctgtatcaggagtatatcctctgtccattcctgcaaccttattcgtgtggtatttttggcagaaaaagaaacaaagaagcggggttctttgggacactccaagtcctccggaggtagaaagagctgttttagacgatgggatttacagaatcatgcaacgaggcttactagggcgaagtcaagtcggagtgggtgtattccaagaaaacgtcttccacacaatgtggcatgtaacacggggtgccgttcttatgtaccaaggtaagagactcgagccatcatgggcaagtgtcaagaaagatctaatctcgtacggaggaggctggaggttacaagggagttggaacacaggagaagaagtacaagtaatagccgtagaaccaggcaaaaatcccaaaaatgtacagactgcacccggaacatttaaaactcctgagggagaagtcggagcaattgcattagattttaaacctggtacaagcgggtcacctattgtgaaccgagaaggaaaaatagtcggattgtatggaaacggtgtagtaacaacgagcggaacatatgtctcggcaatcgcgcaagcaaaagcatcacaagagggcccattacctgaaatcgaggacgaagtatttagaaagagaaatcttacaatcatggaccttcacccaggatcgggcaagacccgtagatatttgccagcaatagtaagagaagcgataaagcgcaaactgaggacacttatcttagccccaactcgcgtagtcgcatcagagatggcagaagcactgaaaggtatgcccattcgctaccagacgaccgcagttaaaagcgaacacactggtaaggagatagtagatttaatgtgtcacgctacatttacgatgcgtctactgtcaccagtaagggttcccaattacaacatgataataatggatgaagctcactttacagatccgagctccatagcagcccgaggttacatcagtacacgggttggcatgggagaggccgcagcaatcttcatgactgcgacacctcccgggagcgtagaagcgttccctcaatcaaacgccgttatacaagatgaggaacgggatataccagaaagaagttggaactccggatatgaatggataacggacttcccgggtaagaccgtttggttcgttccttccattaaatcgggcaatgatatagcaaactgcctacgtaagaacggcaaacgagtaatacaactaagtagaaagacgtttgatactgaatatcagaaaactcgtaataatgattgggattatgtcgtaacgactgacatatcggaaatgggtgcaaattttagagccgatagagtgattgacccacggcgttgcctaaaaccggtgatcctaaaagacggacccgaacgggtaatcttagcaggaccaatgccagtaacggtagcatcagcagcgcaacgtcgcggcaggatcgggagaaaccataataaagaaggagaccaatacatatatatgggtcaacctcttaataacgacgaagatcatgctcactggactgaagccaagatgttgctggacaatattaataccccagagggtataataccagccctgtttgaacccgaaagagaaaagagcgcggccatagatggagaatatagattaagaggcgaagccaggaaaacgtttgttgaattaatgagacgcggtgaccttccagtttggctaagctacaaagttgcatccgagggctttcaatactctgacagaaaatggtgtttcgatggtgagagaaacaatcaagtcctggaagagaacatggacgtcgagatatggacgaaagaaggtgaaagaaagaaattgcgaccacgttggctagatgcccgaacatacagtgacccgcttgctcttagagaatttaaggagtttgcagcggggagaagatcggtctcaggtgatctcatcctagagataggcaaattgccacaacatttaacccagcgagcacaaaatgcgctagacaatctagtgatgctgcataattccgagcaaggaggcagagcgtatcgtcatgccatggaagaactgccagacacaatagaaactctgatgctgctagctttaattgcggtattaacaggcggcgtgactctatttttcttgtcagggaggggtctaggaaagacctctattgggcttttatgtgtaatggcttcttctgtgctcctgtggatggcaagtgttgaaccccattggatagcagcatcaataattcttgagttctttttaatggtattacttattccagaacccgatcgtcaaagaacaccccaagacaaccagttagcttacgtcgtgataggactgttattcatgatcttaacagttgctgcaaatgaaatgggattactagaaaccacgaagaaagatttgggaataggtcatgttgctgttgagaaccatcaccatgcggcaatgctagacgtagacctacatccggcatctgcatggacactatacgcggtggcgacgacaataattacaccgatgatgcgtcatactatcgagaatactacagctaatatctctctaactgcaatagcaaatcaggcggcaatactgatgggtttagacaaaggatggcccataagtaagatggatataggagtacccctcctggctttgggttgctacagccaggttaatcccctcactcttacggcagcggttctcatgttagtagcgcactatgcgataatagggccgggtttacaagctaaggctaccagagaagcacaaaaacgtacagcggcaggcataatgaagaacccaactgtagatggaatcgttgctatagacctagacccagtggtatacgacgcaaaatttgaaaaacaacttgggcaaatcatgctattaatactgtgtacttcgcagatattactgatgcgaactacctgggctttgtgcgaaagtataaccttagctacaggtcctttgaccacgctgtgggaaggatcaccaggtaaattctggaataccacgatagccgtaagcatggctaatatttttcgaggatcttatttagctggagctggtttagcctttagtctaatgaaaagtctagggggcggacgtcgaggcaccggcgcgcagggcgaaaccctaggagaaaagtggaagagacaacttaatcagttgtccaagtcggaatttaatacttataaaagaagtggaatcatggaagttgatcgttcagaagcaaaagaaggactaaaacgaggagagaccactaaacacgcggtaagcagaggaaccgccaaactccgatggttcgttgaaaggaatctagtcaaacctgaaggtaaggtaattgatcttggttgtggacgaggaggatggtcatactattgtgcaggtctaaagaaagtaaccgaagtaaaaggctacacaaaaggaggaccaggacatgaggaaccaatacctatggccacatatgggtggaatctggtaaaacttcacagtggtaaagacgtattctttataccaccagaaaaatgtgacacattattatgtgatataggtgaaagctcacccaacccaacaatagaagaaggacggacattaagagtgctaaaaatggtggaaccgtggttacggggtaaccaattttgtataaagatcttgaacccatatatgccctcagtagtcgaaactcttgagcaaatgcaaagaaaacatggaggcatgttagtcagaaatcctctctcgagaaatagcacgcatgagatgtattgggtcagttgtggaaccggtaacattgtcagtgcggttaacatgacttctagaatgcttttaaaccgttttactatggcacaccgaaaacctacatacgagcgtgacgtagacctcggagctgggactcgccatgtagccgtagaaccagaagtagccaaccttgacataatagggcaaagaatagaaaacatcaaacacgaacataaaagcacttggcattatgatgaagataacccatataagacatgggcttatcacggatcatatgaagttaaacctagcggaagtgcttctagcatggtcaatggggtagtgaaacttttaactaaaccatgggatgttataccaatggtaacacaaatcgcaatgacggacactacaccctttggtcagcaaagagtttttaaagaaaaagttgatacacgaacaccgaaagccaaaagaggtacagctcagattatggaagtgacggcgaaatggctctggggatttctgtcaagaaacaaaaagcctaggatctgcacccgagaagaatttacaagaaaagtcaggtctaatgcagccataggcgccgtattcgtcgacgaaaatcaatggaatagtgccaaagaggcggtcgaagacgagagattctgggatttagtacaccgagagagagagttgcataaacaaggaaagtgcgccacttgtgtttataatatgatgggaaaaagagagaagaaattgggagagttcgggaaagcgaaaggaagtagagcaatctggtacatgtggttgggagcacgattcttagagttcgaggcgctgggttttatgaatgaagatcactggttcagtcgagagaatagtctttcgggtgtggaaggcgaaggattacataaattaggatacatcctgcgagacatatccaaaatacctggcggtaatatgtatgccgatgataccgcaggatgggatacgagaataactgaagatgatctgcaaaatgaggcgcgcataacagacataatggaaccagagcacgccttgcttgcaaaaagcatttttaaactcacataccaaaataaagtggtacgggtccaacgacccgcgaaaaacggtactgtaatggacgtaatctcgagaagggatcaaagaggaagtggtcaagtaggtacatacggattaaatacgttcactaatatggaagcacaactaatcagacaaatggaatccgaaggcattttctcacctagtgaattagagacgcctaacctagcagaacgtgtattagattggttagaaaaatacggcgtagaacgtctcaaaagaatggctataagcggtgacgactgtgtagtaaagccaatcgacgatcgctttgccacagctttaaccgccctaaatgatatgggaaaagtaagaaaggacataccccaatgggagccatcaaaaggatggaacgactggcagcaagttccattttgctctcatcatttccatcaacttattatgaaagacggccgcgagattgttgtcccttgtcgaaaccaagatgagcttgtaggacgtgcaagggtatcacagggagctggttggtctttacgagagacggcatgtttagggaaaagttacgcacaaatgtggcaactaatgtattttcatcgcagggacctgcgtcttgctgcaaacgcaatttgctcggccgtaccagtagactggataccaacttcgagaaccacctggtctattcacgctcaccaccagtggatgacgacggaagatatgttatctgtctggaacagggtttggatcgaagagaatccttggatggaagataaaactcacatttctagctggggtgacgtgccatatctagggaaaagagaagaccaatggtgtggatcacttataggattaactgcccgggcgacctgggctactaacatccaagtagcgattaatcaagtacgacgactaattggcaatgaaaattaccttgactacatgacttcaatgaaacgtttcaaaaatgaaagtgatccagagggggctctctggtaa

SEQ ID NO: 21569 - RNA, 9879 nt, synthetic construct
  misc_feature 1..9879: note = derived and/or modified CDS sequence (opt6) from DENV-1__FJ410230__SS-prME
  source 1..9879: mol_type = other RNA
tcagtaacgatgctattaatgctaatgccaactgcgttggcattccacttaacgacaagaggaggtgaaccacacatgattgtctccaaacaagaaagaggaaaatcactcttattcaaaaccagtgccggggtcaatatgtgcacgttaatcgcaatggatcttggagagctgtgtgaagacaccatgacatacaaatgtccccggataacagaaaccgaaccagacgatgttgattgttggtgcaatgcgacagatacatgggtgacatatggaacatgctcgcagacaggggaacacagaagggataaaagatcagtagcattagctccacacgttggtctagggttggaaacgcgcacagaaacatggatgtcctcggaaggcgcatggaaacaaattcaacgagtcgaaacatgggctttaagacaccctggattcacagtaattgcactcttcttagcacacgctataggtacaagcatcacgcaaaaaggcataatttttatcctactcatgttggtaaccccatccatggcaatgagatgtgttggaatcggatctcgcgactttgtggaaggtttaagtggtgcaacatgggttgatgttgtgttagaacatggcagctgcgtaaccacaatggcaaaagacaaacccacactagatatagaattattaaagactgaagtcactaaccctgccgtactaagaaagttatgcatagaggcaaaaatctcaaatactacaacagattcacggtgccctacacagggtgaagctacactcgtagaagaacaagacgcaaatttcgtatgtcgaaggactttcgttgatagggggtggggtaatgggtgcggactatttggaaagggctcattaattacttgcgcaaagttcaaatgtgtaacaaaattggaaggtaaaatagttcaatatgaaaatctaaagtacagtgttatcgtgaccgtccacacaggagatcagcaccaggtaggcaacgaaagtacagaacatgggaccaccgctacaatcacaccacaagcaccaactactgagattcaactgactgattatggagctttaacgcttgactgctcacctaggacaggattggactttaacgaaatggtactcctaaccatgaaggagaaaagctggttggttcataaacagtggttcctagatctacccctgccatggacaagcggagcaagtacatctcaggagacatggaatcgccaagatctattagttactttcaagacggcgcatgccaagaaacaagaggttgttgtacttgggagccaggaaggtgcaatgcacacagcattaataggtgcaaccgaaattcagacaagtgggacgacaacgatatttgctggtcatttaaaatgccgtctgaaaatggataaactaacactcaaagggatgtcgtatgttatgtgcacagggagtttcaaattagaaaaggaattggcagaaacacaacatggtacagtattagtacaaataaagtatgaagggaccgatgctccatgtaaaattccattttccacacaggacgagaaaggagtaacgcagaacggaaggttaattacagctaaccccatcgttactgataaagaaaaaccagtaaacatagaagctgaacctccgtttggggaatcatacatcgtaattggggcaggagaaaaagcattgaaacttagctggtttaagaaaggatcatccattgggaagatgtttgaggccacagcaagaggggcccgaaggatggcaattctcggggacacagcgtgggactttggaagtattggaggggtattcacaagtgtaggtaaacttgttcaccaaatatttggtaccgcctatggtgtattgttcagcggcgtatcatggacgatgaaaatcggtataggagtattactaacatggttaggcctgaatagccgttcaacttcacttagtatgacatgcatagcagtaggattagttacactttatcttggagtaatggttcaagctgattccggttgtgtgataaattggaaaggaagagaactaaaatgcggcagcggaatatttgttacaaatgaagttcacacatggactgagcaatacaaatttcaagccgactcaccaaagagactatctgctgcaatagggaaggcttgggaagagggagtatgtggaataagaagtgcaacacgattggaaaatataatgtggaagcaaatatcaaatgaattaaatcacatactacttgaaaatgatatgaaattcacagtagttgtgggagatgtcgcgggcatactagctcaaggcaagaaaatgataagacctcaacctatggaacataaatattcatggaaaagttggggcaaagcaaaaattataggtgctgatgtacaaaacactacttttataattgatggacctaatacaccagagtgccccgatgaccagagagcttggaatatatgggaggtagaggattatggttttggtatattcacaactaatatctggctaaaacttcgagattcatatacacaagtttgtgaccataggcttatgagcgcagcaataaaagattccaaggctgttcacgctgacatgggttattggatagaatcagagaagaacgaaacatggaaattggcaagggcgtcattcattgaagtaaaaacttgtatatggcctaagtctcacactttatggtctaacggtgtactagaaagcgaaatgatcattccaaaaatctatggcgggcccattagtcagcacaattaccgtccaggctattttactcaaacagccggtccttggcacttgggcaagctcgaactcgattttgacctatgtgaaggcacaacagtagtagtagacgaacactgtggaaatcgaggtccgagcttaagaacaactacagtgacggggaaaattatacatgaatggtgctgtagatcctgcacgttgcctcccctaagattcagaggcgaagacggctgttggtatggaatggaaataagacccgttaaagaaaaagaagaaaacttagtaaagtcgatggtatccgcgggaagcggagaagtagatagcttctcgctgggtctgttatgcataagcataatgatcgaagaagtcatgcggtctcggtggtcccgaaaaatgctaatgactgggacattagcagtatttttcctcttaattatgggccaactcacatggaacgatctaatcagactctgtattatggtgggcgcgaatgcatcagatcgtatgggcatgggaaccacatatcttgcgttaatggcaacattcaagatgcgacctatgtttgctgttggtttactgtttagaagactaacttcgagagaggtcttgcttctaacaattgggttatcactcgttgcgagtgtcgaattgccaaactcacttgaagaattaggggatggcttagcaatgggaatcatgatactcaagttattaacagatttccaaagtcatcagttatgggcgactttgctaagtctcacatttataaagacaacattttcgttgcactacgcgtggaaaactatggctatggtgttaagcatagtttctctgtttcccctgtgcttaagtacaacatctcagaaaactacctggctgccggtattattgggttccctgggatgtaaacccttaactatgttcctaatagccgaaaataagatttggggacggagatcatggcctctgaatgaaggtatcatggctgttggaatcgtatccattttattgagttcactattgaaaaatgacgtcccccttgcgggtccccttattgcgggcggcatgttaatcgcatgctatgttatatccggctcctccgcagatttatccttggagaaagctgcagaagtatcttgggaggaagaagctgaacactcaggtgcctcacataacatactcgttgaagtacaagatgacgggacaatgaaaattaaggacgaagaaagagacgatacgcttactatcctactcaaagctacgctactcgcagtgtcgggggtttatccattatctatacccgcaactttatttgtgtggtacttctggcaaaagaagaaacaaagaagtggcgtactttgggatactccgtccccgccggaagtcgaaagggcagtactagatgacggaatttataggataatgcaaagaggattactgggacgaagccaagtaggagtcggcgtgttccaagaaaatgttttccatacgatgtggcatgtaacaagaggagccgtattaatgtaccaggggaaaaggttagaaccaagctgggccagtgtgaagaaagatctgatatcctacggtggaggttggagacttcaagggagttggaacactggcgaggaagtgcaggttatagccgtagaacccggaaagaaccctaaaaatgtgcaaaccgctccaggaacattcaaaacacccgaaggcgaagttggcgcaatagctttagattttaaaccaggtacttcaggaagccctatagtcaatagagaaggtaaaattgtgggattgtatggcaatggtgtagtgacaacatctgggacatacgtctctgcaatcgcccaagctaaggcatcacaagaaggtccactgcctgagatagaggatgaagtctttcggaaacgcaatttgactataatggatttacacccaggctcaggcaagaccagacgatatctacccgcgatagtgcgcgaagcaataaaaaggaaattgcgaacattgatattggcaccaacgagagtcgtcgcaagcgagatggctgaagcgttaaagggcatgcccataaggtaccagacaacagcagtaaaaagtgaacataccggtaaagaaatagtggacctgatgtgccacgctacatttaccatgcgtttattaagccctgtacgggttcccaactacaacatgattataatggatgaagcacattttaccgacccttcgtcgatagcagcgagaggttatattagcacacgggtcggcatgggtgaagcagcggcgatatttatgactgccacaccgcctggatcagtagaagcctttcctcagagtaatgcggtcatacaggacgaagaaagagatataccagaaagatcatggaactcgggatatgagtggataacagattttcccggcaagactgtgtggtttgtcccgagcattaaatcggggaatgatattgcgaattgtttaaggaaaaatggtaaaagagttatacagttaagtaggaagacctttgacactgaatatcaaaagactaagaacaacgactgggactacgtcgtaactacagatatctccgaaatgggtgccaatttccgagcagaccgagtgattgatccacgaagatgccttaaacccgtaattctaaaagatggcccagaacgagttatactggccggaccaatgccagtaacagtcgcatcagcagcccaacggaggggtcgaataggaagaaaccataataaagaaggagaccaatacatatacatgggacagccattaaataatgatgaagatcacgcccattggacagaggcaaaaatgttgctggacaacattaatacacctgaaggaatcataccagccctattcgaacccgaaagagagaagtcggccgcaatcgatggggaatatagattaaggggagaagctagaaagacttttgtggaactcatgaggcgtggggatctacccgtgtggttatcatataaagtcgcatcggaaggatttcaatactctgacaggagatggtgctttgatggtgaacgcaataatcaagtcctggaggagaatatggatgttgaaatctggacgaaagaaggcgagcgtaagaaattaagaccgaggtggctagatgcgagaacttactcagatccactagcacttcgtgaatttaaagaatttgccgcaggaagaaggagtgtttctggcgacttaattctagaaataggtaagttacctcagcatttgacccaaagagctcagaatgctttggataaccttgtcatgctccacaattcagaacaaggaggtcgggcttatcgtcacgccatggaagaactaccggacacaatagagacattgatgctcttggccttgatcgcagtattaacgggaggagtcaccttattctttttatctggcagagggttaggcaaaacaagtattggacttttatgtgttatgagttcttctgtgctattatggatggccagcgttgaaccacactggatagcagcctctataatactagaatttttcttaatggtattactaataccagaaccggatcgtcaaaggacacctcaagataaccagttagcatatgtagtaatcggactattatttatgatcttgaccgtggccgcaaatgaaatgggacttttagagacaacaaagaaggacttgggtatcggccacgtagctgtggagaatcaccatcacgctgcaatgttagatgttgatctacaccctgcaagcgcatggacgctatacgcggttgcgactacaataatcactcctatgatgcgacacactattgaaaacacgacagcaaacatttccctaactgcaatagctaaccaagctgccatattaatgggtttagataaaggatggcccatatcgagaatggatattggagttccccttcttgcattaggatgttattctcaagttaatccccttaccctaacagcagcagttctcatgttagttgcacattatgccataattgggccgggactacaggctaaagcgactcgagaagcccagaaaaggacagccgcaggaattatgaaaaatccaaccgttgacggaatagttgcgatcgacttagaccctgtggtttatgatgcaaagttcgaaaaacaattgggccaaatcatgttattaatactgtgtacttcccaaatactattgatgaggacgacatgggcattgtgcgaaagcataacattggctacaggaccactaacgacactatgggaaggaagtcctggaaagttctggaataccaccatcgctgtgagtatggcaaatatatttagagggagctacttagcaggagctggattggccttttcattaatgaaatcacttggaggaggtcgtagaggaacaggagctcaaggggagacattaggtgaaaaatggaaacgacaactaaatcaattaagcaaatctgagtttaatacctacaagcgttcagggataatggaagtcgatagaagcgaagctaaggaaggtttaaaaaggggagagacgactaaacatgctgtaagtcgaggcactgctaaactgaggtggtttgtagaacgcaaccttgtaaaaccagaagggaaggtaatagacttaggatgcggtagaggaggatggtcatattactgtgccggactaaagaaagtgaccgaagttaaaggatatacaaagggtggtccgggccacgaggaacccattccaatggctacatatggctggaatctagttaaattacacagcggaaaagacgtattctttatacccccagaaaagtgcgatacacttttatgcgatattggagaaagttcgccaaatccaacgatcgaggagggccggacattaagggttttaaagatggtcgaaccatggctaagagggaatcaattttgcattaaaatcttaaacccctatatgcctagtgtggtagagacgctagaacaaatgcaacgtaagcatggaggaatgcttgtgagaaatcccctctcaaggaatagtactcatgaaatgtattgggtttcatgcggtacaggtaatattgtatcggcggttaacatgacatcaaggatgttactaaatcgtttgaccatggcacatagaaaaccaacgtacgaacgggatgtagatttaggtgcaggaaccagacatgtagcggtagaaccagaggttgcgaaccttgatattatcggacaacgaatagagaatataaagcatgagcataaaagcacttggcactacgatgaagacaatccgtacaaaacatgggcatatcatgggtcttatgaagttaaaccatcgggatctgcatctagtatggtgaatggtgtagttaagctgttaactaaaccttgggacgtaataccaatggtaacccaaatagcgatgacggacacaacaccgtttggtcaacaaagagtctttaaagaaaaagtggacacacgtacaccaaaggccaaacgaggcacagcacaaattatggaggtaacagctaaatggttatggggctttctaagtcgtaacaagaagccacgaatttgtactagagaggagttcactcggaaggtccgttcgaatgcagccataggagcagtcttcgttgacgagaaccaatggaacagtgcaaaagaagcggtggaagatgaacggttctgggatttagtccatcgtgaacgagagctacataaacaagggaaatgtgcaacctgtgtatataatatgatggggaaacgtgagaagaaattaggtgagtttggcaaagctaaaggctcaagggctatctggtacatgtggctgggagctaggtttctagagttcgaggcactcggtttcatgaacgaagatcattggttctcccgggaaaattcattatcgggagtggaaggagaaggacttcacaaactcggatatatcctaagagatataagcaaaataccgggaggcaacatgtatgcagacgacacagcagggtgggatacgcgtatcactgaagatgacttgcaaaatgaggctcgtattactgatataatggaacctgaacatgcgctactagcgaaaagtatatttaaactcacatatcaaaacaaagttgttagagtgcaaagacctgcaaagaatggtactgtgatggatgtgataagccgacgggatcaacgaggtagcggacaagtaggcacttacgggttgaatactttcaccaatatggaagcccaattaattagacaaatggagtcggaagggatattcagtccgtcagaactcgaaacgcccaacctagccgaaagggtattagattggctagaaaaatatggagtcgaacgactaaaaaggatggcgattagtggagatgattgcgttgtcaagccaatagacgacaggtttgcaactgctctaactgcattaaatgacatgggtaaagtaaggaaagacatccctcaatgggaacctagtaaaggttggaatgattggcaacaagtgcctttttgcagtcaccatttccaccagttgataatgaaagatggaagagaaattgttgtaccatgccgaaatcaagatgaattagtaggtagagctcgcgttagtcagggcgcgggatggtcattacgtgaaacagcgtgtcttggcaagtcttatgcgcaaatgtggcaacttatgtatttccataggcgtgatctgcgacttgcagctaatgctatttgtagtgcggtgcccgtcgattggatacctacttcgaggacgacttggagcatacacgcgcaccatcaatggatgacaaccgaagacatgctcagtgtatggaacagagtatggatagaagagaacccatggatggaagataaaacacatatatcgtcttggggagacgttccatacttggggaaacgagaagatcagtggtgtggttctcttataggattaacggctcgtgcaacatgggcaacgaacatacaggtagctataaatcaagtcagaagactaattggaaatgaaaattatttagattatatgacatccatgaagcgatttaaaaacgaatccgatccggaaggggcgttatggtag

SEQ ID NO: 21570 - RNA, 9879 nt, synthetic construct
  misc_feature 1..9879: note = derived and/or modified CDS sequence (opt6) from DENV-1__FJ410231__SS-prME
  source 1..9879: mol_type = other RNA
agtgtcactatgttactaatgttgatgcctacggcgctggcattccatttaactactcgaggaggcgaacctcacatgatagtaagtaaacaagaaagaggcaaaagcctgttatttaaaacgtctgcaggcgttaatatgtgtacattaatagcaatggatctaggtgaactttgcgaagatacaatgacttacaaatgcccgagaataacggaagtcgaaccggatgacgtagattgttggtgtaacacgaccgacacatgggtaacttatggtacctgcagccaaactggagaacatagacgtgacaaacgttctgtagcacttgcacctcatgtaggattgggtttggaaactagagcagaaacatggatgtcttcagaaggagcatggaaacaaatccaaaaagtagaaacctgggcacttagacaccctggatttaccgtgatagcactatttttggcacatgcaattggtacgagtatcacgcaaaaaggaataatatttatactactaatgttagttactcctagcatggcaatgcggtgcgttggaatcggcagtagagacttcgtagaaggcttatccggtgccacttgggttgacgtagtgctagaacatggctcctgtgttacaactatggcaaaagacaaaccaacccttgacatagagctactgaaaactgaagttaccaaccctgcagtattacgtaaactatgtatcgaagcaaaaatcagtaacacgacaactgattctaggtgtcctacacaaggtgaggctacgcttgtagaagaacaagacgcgaacttcgtatgtcgccgaacattcgtagatagaggatggggaaacgggtgtggcctttttggaaaaggctcattaataacgtgcgcgaaatttaaatgcgtgactaaactggaaggtaaaattgttcaatacgaaaacctaaaatacagtgtaatagtgactgtacacacaggcgatcaacaccaagttggaaacgaatcgaccgaacatggaacaactgcaacgattacgcctcaagccccaacaagtgagattcaattaaccgattatggagcacttactctagattgttcacctagaacaggactagatttcaatgaaatggttcttttaactatgaaagaaaaatcctggttggtgcacaaacagtggtttttggacttgcccctgccatggacgtcaggcgccagcacaagtcaggaaacttggaataggcaggatctattagttacttttaaaacagcccatgccaagaaacaagaagtagttgtgttaggttcccaagaaggggctatgcacaccgccttaacaggggcgacagaaatccaaacaagtggtacaacaaccatctttgctggccatctaaaatgtcgacttaaaatggataaattaacattgaaaggaatgtcttacgttatgtgtactgggagttttaaattagaaaaagaagtagcggaaactcaacatggtacggtcctagttcaaatcaaatacgaaggaactgacgctccttgcaaaatacccttctcaacacaagatgaaaaaggggtcactcaaaatggaaggctaatcacggcaaacccaattgttactgataaagaaaaaccagtaaatattgaagcagagcccccatttggagaatcctatattgtaatcggggcgggagaaaaagccctgaaattgtcttggttcaagaaaggttcgtccatcggcaaaatgttcgaagcaaccgctcgcggagccagaaggatggcaatcctcggagacaccgcatgggattttggttccatagggggagtattcacctccgttgggaagctagtacaccaaatatttggaacagcctatggagttttattctctggagtgtcctggaccatgaaaataggaattggagtgttacttacgtggttaggattaaactcgagatctacatcattatcaatgacctgtatagcagttggattagtaacattatacttaggggttatggttcaagcggattcaggatgtgttattaactggaaagggcgagaactcaaatgtggatccggtatattcgtaactaatgaagttcatacttggactgagcaatacaaatttcaggcagattctcccaaacgcttaagtgcggctataggcaaagcctgggaagagggagtgtgcggaataagaagcgcgacacgcttagaaaacataatgtggagacaaataagcaacgagttgaatcacatcttacttgaaaatgacatgaaattcacagtagtcgtaggagacgtagtaggaatattagcccaggggaagaaaatgataaggcctcagcccatggaacataaatactcttggaaatcctggggaaaagcaaaaataattggggcggatgtgcagaatactacgtttattattgacggacccaacacacctgagtgcccagatgatcaaagagcttggaatatatgggaggttgaagattacggctttggcatattcacaactaacatatggctaaaactacgagattcttatacgcaagtgtgtgaccacagactcatgtccgcagctattaaagacagtaaagcagtacatgccgacatgggctattggattgaaagcgaaaagaatgaaacctggaaattagctcgggccagtttcatcgaagtaaaaacttgtatatggcccaagtctcacactctctggtcaaacggcgtacttgaatcggagatgataatcccaaaaatatatggtggaccaattagccaacataactaccgtccaggatacttcacgcaaacagcaggtccctggcatctaggaaaattagagctggattttgatctatgcgaaggtacaacggtagtagtggatgaacactgtgggaatcgtggcccttcattaagaacaacaacagttacaggaaagatcatacacgaatggtgttgcagatcttgcacactcccacctttacgttttaaaggagaagatggatgctggtatggcatggagatacgaccagtcaaagaaaaggaggagaacttggttaaaagcatggtaagcgccgggtctggagaagtagactctttctctctaggcttgctgtgtatctcaattatgatagaagaggttatgcgatcacgttggtctcgaaaaatgctgatgaccggtaccttggccgtattctttttattgataatgggacaactcacgtggaacgatcttatacgatcttgcattatggtaggagcaaatgcgtctgaccgaatgggtatgggcactacttacctagcactaatggcgacatttaaaatgagaccaatgtttgcggtcgggctattgtttagaaggttaacgagtagagaagtgttactattaactataggtctgtcgctagtagctagtgtagagctaccaaattcattagaggaattaggcgacggtttagctatggggataatgattcttaaacttttaacagattttcaatcatatcaactatgggcgactcttttgtcactgactttcattaaaacaaccttctcattgcattatgcttggaaaactatggcaatggtacttagtattgttagcttattaccactgtgtctctccactacatcacagaaaactacatggttaccagtattactaggcagtcttggatgcaaaccgctgacaatgttcttaatagccgaaaacaaaatatggggcagaaaatcttggcctttgaacgaaggcattatggcagtcggtatcgtttctatactcctatccagccttctcaaaaatgacgttcctttggccgggccgttaatcgccggtggcatgttaatagcatgctatgttatttccggcagttctgcagacctatcacttgagaaagcggcagaagtatcatgggaggaagaagctgaacattcaggagccagccacaacatattagttgaagtccaagatgacggaacaatgaaaatcaaagatgaggaacgcgatgatacattaactatcttactaaaagctacactcctggctgttagtggagtctaccctctatccataccggcgacgctattcgtatggtacttctggcagaagaagaaacaaagatctggagttttatgggacacaccttcacctccggaagtagaaagagcagtattggatgacggaatctacaggataatgcaacggggactccttggaagatcgcaagtgggagtcggtgttttccaagagaatgtctttcatacaatgtggcacgtcactcgaggagcagttctaatgtaccagggaaaacgactggaaccatcatgggcatcagtgaagaaagacctcatatcctacggtggaggatggaggctgcagggcagttggaacaccggggaggaagtacaagttattgcggttgaaccaggcaaaaaccctaaaaatgtgcagaccgcgccaggtacctttaagacaccggaaggcgaagtaggtgcaatcgcccttgatttcaaacctggaacatcgggatcacccatagttaatcgagaggggaaaatagtcggtttgtatggaaatggagtagttacaacctcgggaacctatgtatcagctatagcacaagcaaaggcttctcaagaagggccactgccagaaattgaagatgaagtttttagaaagaggaatttaacaataatggatttacatcctggttccggcaagactagaagatatctacctgcgatagttagagaagcaattaagcgaaaacttagaacgctgatattggcacctactcgtgtagtagcctctgaaatggcagaggctttaaaaggaatgcctatccgatatcaaaccaccgcagttaaaagtgagcatacaggaagggagatagtggatttaatgtgccatgcgacttttacaatgaggctgctgtcccccgttagagtcccgaattataatatgataatcatggacgaggcccatttcactgacccaagttcaatcgctgcccgaggttacattagtacaagagttggaatgggagaggctgccgccatcttcatgactgccacgcctccaggaagcgtggaagcgttcccgcaaagtaacgcagtcatacaagatgaggaacgagatatccctgaaaggtcttggaatagcggctatgaatggatcacagactttccaggcaaaaccgtctggttcgtaccttcaataaaatctggtaatgacatagctaactgcctgcgtaagaacggaaaaagagttatacaattatcgagaaaaactttcgatactgagtatcagaaaacgaaaaacaacgactgggattacgttgtgacaactgatatttccgaaatgggcgcaaattttcgagctgatagggtaatcgatcctaggagatgtctaaagccagtaatattaaaagatggtccagaaagagtcatattagctggaccaatgccagtgaccgtggcatcagccgcccaaagaaggggaaggataggcagaaaccacaataaagaaggggatcaatacatttacatgggacagccgctaaataatgatgaagatcatgcgcactggacagaggccaaaatgttgcttgataatatcaatacgccggaaggaatcatcccagctcttttcgaacctgagagagagaaaagtgcagccatagatggggaatacaggttacgaggtgaggcaaggaagacctttgtggaattgatgagaagaggtgacctaccagtctggttaagttataaggtcgcaagtgaaggtttccagtattctgatcgtagatggtgctttgatggagaaaggaataatcaggttttagaagagaatatggacgtcgaaatttggacgaaggagggcgagaggaagaaacttcggccccgttggcttgatgctagaacttattcagatccgctagcgttgagagaatttaaggagtttgcagcgggtaggaggagtgtttccggagacttaattttggagattggaaaactaccccaacatttaacccaaagagcgcaaaacgctcttgataaccttgtaatgttacacaacagtgaacaagggggcagagcctacagacatgcgatggaggagctacccgataccattgaaactctcatgctactcgcccttattgcggtccttacgggcggcgtgactctgttcttcttaagcgggaaaggccttggcaaaacaagtattggtttactttgcgtcatggctagtagcgctttactatggatggcatcagtcgaacctcattggattgccgcaagcatcatccttgagtttttccttatggttctattgatacccgaacctgacaggcaaagaacaccccaagataaccaattagcgtatgtcgttataggattacttttcatgatcctaactgtagcagcaaacgaaatgggattgttagaaactacgaaaaaggacttgggcataggtcatgtcgctgtagagaaccaccaccacgctacgatgctcgacgttgacctccatccggcatcagcatggactctatatgccgttgcgacaacgataatcaccccgatgatgcgtcataccatagaaaacacaaccgcaaatattagtttaactgcaatagcaaaccaagccgccattctcatggggctagataaaggctggccaataagcaagatggatataggcgtccctttattagcattgggatgctatagtcaagtaaatcctttaacactaaccgctgcagtactcatgctagtcgctcactatgctattataggtcccggtctacaagcaaaagctacaagagaagctcagaaaagaacagctgcaggcattatgaaaaatcctaccgtagatggtatagtagctatagatctagatcctgtcgtatacgatgcaaaatttgaaaaacaactaggacagataatgttgctaatcctatgtacaagccaaatattgctaatgagaacgacgtgggcactctgcgaatccatcactctagctacaggtcccttaacaacactgtgggaaggatcaccaggcaaattttggaacacaacgattgcagtatcaatggcaaatatatttcgaggatcatatcttgctggagcggggttagcctttagtttgatgaaatcactaggtggtggcaggcgtggaaccggtgcacaaggggagactttaggagagaaatggaaacgccaattaaaccagttgtctaaaagcgaatttaatacttataaaagaagcgggataatggaagttgatcgatctgaggccaaagagggcctcagaaggggagaaacaacaaaacacgcagtatcaagaggcactgcaaagttacgatggtttgttgagaggaatcttgtcaagccagagggtaaagttatcgatttaggatgcggaagaggtggatggtcttactattgtgctggtcttaagaaagtaacagaagtaaaagggtataccaagggaggaccaggtcatgaagaaccaataccgatggctacatatgggtggaatctggtaaaactgcacagtggtaaagatgtcttcttcataccgccggaaaaatgtgatacattgttatgtgacattggggagtcaagtccaaatccaacaattgaagagggtcgaacattaagagtccttaaaatggtagaaccatggcttagaggaaatcaattttgtataaaaatacttaacccctacatgccgtcggtcgtagaaactttagagcagatgcagaggaaacacgggggcatgcttgtgagaaacccattatcaagaaacagtacacatgaaatgtactgggtgtcttgcggaacaggtaacatagtctctgcagttaacatgacaagtagaatgctgttaaatagatttacaatggcacataggaaaccaacatatgaacgagacgtagacctcggcgcgggaacaagacatgtggcagtagaaccggaagtagcgaatctagacattatcggacaacgcatcgaaaacataaagcacgagcataagtcaacatggcattatgatgaagataatccatataaaacttgggcttatcatggctcctatgaggtcaaacctagcggtagcgcaagtagcatggtaaatggagtagtaaaacttttaactaagccatgggacgtaataccaatggtaactcaaatcgctatgacagatacgacaccttttgggcaacagcgagtattcaaagaaaaagtagatactaggacacccaaagcaaaaagaggcacggctcagataatggaagtgaccgcaaaatggctgtggggtttcctaagtcgaaacaagaaaccacggatatgtactagagaagagttcacgcgaaaagtaagatcgaatgcagcaataggagcagtatttgtagatgaaaatcaatggaactcagcgaaggaagcagtggaagacgaaagattttgggacctagtccatagagaacgagaactccataaacaagggaagtgcgccacatgcgtatataacatgatgggaaagcgcgagaagaaactaggtgagttcggaaaagcaaaaggctcacgtgctatctggtatatgtggctaggcgctagatttttagaatttgaggctttaggattcatgaatgaggaccactggtttagccgcgaaaactccctaagcggagtagaaggagaaggattgcataagttaggttatatcttgcgagatataagtaagatcccaggaggtaatatgtatgctgatgatacggcgggctgggacaccagaataacagaagatgacctccagaatgaagccaaaattacagatataatggaaccagagcacgcgttactcgctaccagtattttcaaactcacctaccaaaacaaagttgttagagtacagaggccagcgaggaatggcactgtaatggatgttatttcacggagagaccagaggggatctggacaggttggtacatatggattgaacacatttactaatatggaggcccaattaatacgccagatggagtcagaaggaatcttcagcccaagtgaactagagacaccaaaccttgcggaaagagtattggattggctagaaaagcatggcgtagagcgcttaaaaaggatggcaatctcaggggatgactgtgtagttaagccaatcgatgataggtttgctactgcactaagcgctctaaacgacatgggaaaagtccgtaaggacatacctcaatgggaaccctcaaaaggatggaacgattggcaacaagtgcccttttgttcacaccatttccatcaattgataatgaaagatgggcgggaaatcgtagtcccatgtcggaaccaagatgagttggttggaagggccagagtaagtcaaggagcagggtggagtttacgagaaactgcttgtttgggcaagagctacgcacaaatgtggcagcttatgtatttccatcgccgagacttaaggttagctgcaaacgctatttgtagcgctgtaccagtagattgggttccgaccagcagaactacatggtcgattcatgcacatcatcagtggatgacaacagaagatatgctctcagtctggaatcgggtctggatcgaagaaaatccatggatggaagataaaacgcatatatcttcatggggagacgttccgtatctaggaaaaagagaggaccagtggtgcggttcactgattggcctgacggctcgagccacgtgggcgactaatattcaagtggccatcaaccaagtcagacgactaattggaaatgaaaattacttagattatatgacctcaatgaagaggttcaaaaatgaaagcgacccagaaggagcgctctggtga

SEQ ID NO: 21571 - RNA, 9879 nt, synthetic construct
  misc_feature 1..9879: note = derived and/or modified CDS sequence (opt6) from DENV-1__FJ461323__SS-prME
  source 1..9879: mol_type = other RNA
agcgtaactatgttgctcatgttaatgccaactgcattagcattccatttaactactagaggtggagaaccacatatgatagtatcaaaacaagaacgggggaaatccttattgtttaaaactagcgcgggagttaacatgtgcactttaattgcaatggatctcggagaactatgcgaagatacgatgacttataaatgtccacggataacagaagcagaacctgacgatgtagattgttggtgtaatgctacagacacgtgggttacttacggaacatgttctcaaacaggggaacatcgaagagataaaagatcggtagcattagcgccacatgttggtttgggtcttgaaacgagaaccgaaacatggatgagttcagaaggcgcgtggaaacaaattcaaagagtcgaaacatgggtattacgccaccccggctttacagtcatagctctatttttggcacacgcaataggtacaagtatcacccaaaaaggaataatattcatcctacttatgttagttacgcctagcatggctatgcgttgcgttggtataggatccagagattttgtggaagggttatcaggagccacatgggtcgatgttgtgcttgagcatgggagttgcgtcacgacaatggccaaagataaacctaccctagatatagagttgttaaaaacagaagttaccaatccagcagttctccgaaaactgtgtatagaggccaaaataagtaacaccacaacagactcaagatgtccgactcaaggagaagcgacacttgtggaagaacaagatgccaatttcgtttgccgcagaacgttcgtggatcgtggatggggaaacgggtgtggtttatttggaaaaggatcacttattacctgcgcgaaatttaaatgcgtaaccaaattagaagggaaaattgtacaatacgaaaacttgaaatattcagtaatcgttaccgtacatacgggtgatcaacatcaagtggggaatgaatcaacagaacatggaacaactgcaaccataacaccccaagcaccgaccaccgagatacaactaacagattatggtgcattaaccttagattgttctccaagaacaggtctagattttaacgagatggtactcttaacaatgaaggagaaaagttggttggttcacaaacaatggttcctggacttgccactaccatggacatcaggtgcgagtacatcacaagagacttggaaccgtcaagatctattagtaacctttaaaacagctcacgcgaagaaacaagaggtagtcgttttgggatcccaggaaggtgccatgcatacagcattgacaggagccacagaaatacaaacctcgggaacaactacaatttttgctggtcacttgaaatgtagattaaaaatggacaagctcactctcaaaggtatgagttatgtgatgtgcacaggtagttttaaactagaaaaagaagtggcggagacacagcatgggaccgtattggttcagataaaatacgaaggcactgatgcgccctgtaagattccattctcgacgcaagatgaaaaaggcgtgacccaaaacggtcggttaataacggccaatcctatagtaaccgataaagagaaaccggtaaatatagaagcagaacctcctttcggtgaatcttacatcgttattggtgccggtgaaaaagcattaaaattatcatggttcaaaaagggctcatcaataggtaaaatgttcgaagctactgcacgcggtgcaagaaggatggctattttaggtgatacagcatgggattttgggtctatcggaggagtatttacaagtgtaggaaaactcgtacaccaaatctttgggactgcgtatggcgttcttttctctggtgtctcatggactatgaagattggaattggagttctactgacatggttaggtttaaatagccgaagcacctcactgtctatgacttgcatagcagtaggattagttaccttatacttaggcgtcatggtacaagctgattctggttgcgttataaactggaagggaagagaattaaaatgcggctcaggcatctttgtaacaaatgaagtacacacttggaccgaacaatacaaatttcaagccgatagcccaaaaagactctcagctgctattggaaaagcatgggaggaaggcgtatgcggaatacgatcagccactcgcttagagaacattatgtggaaacaaatttccaatgaactaaatcatatattactcgaaaatgatatgaaattaactgttgtagttggtgacgttgctggtattctcggacaaggaaagaaaatgataagaccacaaccaatggaatataaatactcatggaagtcttggggcaaagctaaaataataggagcagacgcacagaataccacatttattattgatgggcctaatacacccgaatgtcccgacgaccaaagggcatggaacatatgggaagttgaagattatggatttggtatattcaccactaatatttggttaaaactaagagactcctacacccaagtctgcgatcacagactaatgagcgctgccattaaagacagtaaggcagtacatgcagatatgggctactggatagaatctgagaaaaatgaaacatggaaacttgcacgcgccagctttatagaagtgaagacgtgcatttggccaaagagtcatacactatggtcaaacggagttttagagagcgaaatgattatcccaaaaatttatggaggtcccatttcccaacacaactacaggcccggatatttcacgcaaacagcaggaccatggcacctcggcaagttagagctcgactttgatctttgcgaaggcacgactgtcgttgtagatgagcattgtggaaatagaggaccttctctccgcaccacaactgtaaccggcaaaattatacatgaatggtgttgtagatcgtgtacattacccccattgagatttagaggcgaagatgggtgttggtatggaatggaaatccgtccagtaaaggaaaaagaagaaaatctagtgaaatcaatggtgtcagcaggctctggagaagtggattccttctcgttaggcctattatgtatttcaattatgattgaggaggtcatgcgctcgcgatggtcaagaaaaatgctcatgacaggcacgctggcagtcttctttttgttaataatgggacaattaacatggaacgatctcataagactgtgtatcatggtgggtgcaaatgcaagcgacaggatgggaatgggcacaacatatcttgcacttatggctacatttaaaatgagacctatgttcgccgttgggctattatttcgtcgtctaacaagcagggaagtcctactactaacgattgggttaagcctagttgcatcagtagagctaccaaactctctcgaagaacttggtgatggactagctatgggcataatgatattgaaacttcttacggatttccaatcccaccaattatgggctacgttgcttagcttgacgttcataaagaccacattctctctacactatgcttggaaaacaatggccatggttctgtctattgttagtttgtttcccttatgtttatctacaacaagtcaaaagactacatggttacctgtattattaggctccttgggttgtaaaccattaacaatgtttcttattgccgagaataaaatttggggtcgaaaatcttggcctctcaacgaaggtataatggcagttggaatcgtatcaatacttttatcgtccttactaaagaatgatgtacctttagcaggacctttaattgccgggggaatgttgattgcttgttatgtcataagcggttcatcagcagacctcagcctagaaaaagctgctgaagtatcatgggaagaagaagcagagcactcaggtgcctcacacaacattcttgtagaagttcaggatgatggaaccatgaaaattaaagatgaagaaagggacgataccctaactatacttctaaaagcaacccttttagctgtgtcgggcgtatatcccctatctatccctgcaacactatttgtatggtatttttggcagaaaaagaaacaaagatcgggagttttatgggatacaccctcgcctccagaagtcgaaagagcggttctggatgatggtatttacaggattatgcaaaggggtttattaggaaggagccaagttggagtgggtgtctttcaagaaaatgtatttcatacaatgtggcacgtgacacgaggagcagttttaatgtatcaagggaaaagattagaaccatcatgggcctctgttaagaaagatttaatcagttacggaggagggtggagactaagagggagctggaatacaggtgaagaagttcaagttatagcggtagagccaggcaaaaatcccaaaaatgtgcaaacagcaccaggtacgtttaaaactccggagggagaagttggggcgatagcactggattttaaacctggtacttccggtagccccatagtgaatcgcgaaggcaaaattgtgggattgtacggaaatggtgtagtcactacaagtggaacttacgtgtcagccatagcacaagctaaagcatcccaagaaggtccattgccagaaatagaagatgaggttttccgaaaaagaaatttgacaataatggacctccacccaggtagcggcaaaacacggagatacctaccagcaatagttagagaagctatcaaacgaaaattgcgcacacttatactcgcaccgaccagagtcgtagcatcggaaatggctgaagccctgaagggaatgcccatacgttatcaaacgacggcagtgaaaagtgaacataccgggaaagagatcgtagacttaatgtgtcatgcaacatttaccatgcgtctgctatctcctgtccgtgttcccaattacaatatgataataatggacgaagcccatttcactgaccccagtagtatcgctgctagagggtacatttcaacacgagtagggatgggtgaggcagctgcaatatttatgactgctacaccgccgggatctgttgaagcgtttccgcaaagtaatgctgtaattcaagatgaagaacgcgatatacctgaacgttcgtggaactctggttatgagtggataaccgatttcccaggcaaaaccgtatggtttgtaccatcgataaaatctggaaacgatatagcgaactgtcttaggaaaaacgggaaacgcgtcatacaattatctcggaagacattcgacactgagtaccagaaaaccaaaaacaatgattgggattatgtggtaacaacggatatatcagagatgggagcaaatttccgagccgaccgagtaattgatccacggcgatgtttaaagccagttatacttaaagatggaccggaacgtgtcattttagctgggccgatgcccgtaaccgttgccagcgcagcccaacgaagaggacgtattgggaggaatcacaacaaagaaggagaccaatacatatatatggggcaaccacttaacaatgatgaagatcacgctcactggactgaagctaagatgctccttgacaatataaatacgcccgaaggtataatcccagctttatttgaacccgaacgagaaaaatcagcagccgttgacggagaataccgattgagaggtgaagcacgtaaaacttttgtggagttaatgcgtagaggagacctaccagtatggttgtcatacaaagttgcttcagagggatttcagtacagtgatagaagatggtgctttgatggcgaacgtaataatcaagtactagaagaaaatatggacgtagaaatttggacaaaggaaggtgagaggaagaaactaagaccaaggtggttggatgcccgaacgtattccgatcccttagctctacgagaatttaaagagttcgccgcaggtagacggtcagtgagtggagatttgatattagaaatcggaaaacttccacagcatctaacacaaagagcacaaaacgctttagataatctcgtcatgctacacaattccgaacaaggagggagagcatatagacacgcaatggaagaactgccagatacaatagaaacactaatgttattagcattgatagcagtacttacaggaggggtcacacttttctttctaagtgggagaggattaggtaaaacttcaataggactactttgcgtaatggctagtagtgtattattatggatggcctccgtagaaccacattggatcgcggcatcaattattttagagttctttctaatggtactcttaattccggaaccggatagacaacgaacgcctcaagacaaccaattggcttacgttgtgataggcttactattcatgattttaacagttgccgctaatgaaatgggcttattagaaacaactaagaaagacctcggaattggacacgtcgccgtagagaaccaccatcacgcagcgatgctagatgtcgatctacatccagccagtgcatggacactatatgcggtcgctacaactattattacaccgatgatgagacatacaattgaaaacacgacagccaatatatcattaaccgctattgcaaaccaggccgcaatacttatgggtctggataaaggatggccgatatcaaagatggatataggggtacccctattagcgttagggtgttactcacaagttaacccacttactctcactgctgctgtattgatgttagtggcacattacgcaataatcggaccgggacttcaagcaaaagcgacaagagaagcccaaaaacgtacagcagcaggaatcatgaaaaatcccacagtagacggaatcgttgcgatagatctggacccggtagtctacgatgcgaaattcgaaaaacaactaggccaaataatgctcttaattttgtgtacctcccagattctcctaatgcgtacaacctgggcgttatgtgaaagcatcacgctcgctacaggaccattaacaacactttgggaagggagtcctggaaagttctggaacactacaatagcagtaagcatggcgaacattttcaggggtagttatcttgcaggggcaggattagctttctctctaatgaagtccttaggcggtggaaggaggggaactggtgcgcagggggaaactttaggcgaaaagtggaaaaggcaactcaaccagcttagcaaatctgagttcaatacgtataagagatcaggaatcatggaggttgatagatctgaggcgaaggaagggttgaaaagaggggagacaaccaaacatgcggtcagcagaggcactgctaaattaagatggttcgttgagaggaacctggtaaaaccggagggaaaggttatagacctaggttgtggtcgcggtggttggagttactactgcgctggacttaagaaagtgaccgaagttaaaggatacactaaaggaggtccaggtcatgaggaacctatcccaatggcaacatatggctggaacttggtaaaactgcattcaggaaaagatgtattcttcatacctccggaaaaatgtgacacattgttgtgtgatataggagaatctagtccgaatccaactatcgaagaaggaagaacactacgcgttctgaaaatggtagaaccgtggttaaggggaaaccaattttgtattaagatactcaatccttatatgccttcagttgttgaaactttggaacaaatgcaaaggaagcatggcggaatgttagtacgcaatcctttgtcacgaaattcaacccatgaaatgtattgggtatcatgtgggacaggtaatatagtcagtgcagttaacatgacatcgagaatgttattgaatcgttttacaatggctcacagaaagcccacttatgaacgagacgttgatctgggcacgggaacgagacacgtagcagttgaaccagaagtagcgaatctagacatcataggacagcgcatcgaaaacataaagcacgaacataagagcacatggcactatgatgaagataacccatacaagacgtgggcctatcatggatcatatgaagtcaaacccagcggaagcgctagtagcatggtgaacggggtagtaaaactattaacaaaaccctgggatgtaatacctatggttacgcagatagcgatgacagacaccacgccctttggacaacaacgagtatttaaagaaaaagtggacacccgaactcccaaggctaaacgaggtactgcacagataatggaagtgaccgcaagatggctttggggattcttatcaagaaataaaaagccaaggatctgtacgagggaagagttcacaagaaaagttagatcaaacgctgccatcggagctgtctttgtggatgaaaatcaatggaactctgcaaaggaagcggtggaggacgaaagattctgggatcttgtacatagggagagagagttacacaaacaaggcaaatgtgctacctgcgtatataatatgatgggaaaaagagagaagaaattgggagaatttgggaaagctaagggatcgagagctatttggtacatgtggcttggcgcgaggttcctcgagttcgaagcattgggattcatgaatgaagaccattggttttcaagagaaaattcgttaagtggtgtagagggggaaggactccataaactaggatatattttaagggatatttctaaaatccctggtgggaatatgtatgccgacgacacagcaggctgggatacacgcatcaccgaagacgatctacaaaacgaagcaaagataacggatatcatggaaccagagcacgcgcttcttgctaaggctatctttaagttgacttaccaaaacaaagtagtgcgtgtacaaagacctgccaaaaacggtacggtaatggatgtcatatctcgtagagaccaaaggggatcaggacaggttggcacatatggtctgaatactttcacaaatatggaagcgcaacttataagacaaatggaaagcgaaggtatattctcaccatccgagctagaaacccctaatttagcggaaagggccttagattggttggaaaaatatggcgttgaacgtttgaaacgcatggcgatttcgggtgatgattgtgtagttaaaccaatcgatgatagatttgctacagcacttacagcactaaatgacatgggaaaagttcgaaaagatataccgcagtgggaaccatctaaaggatggaatgactggcagcaggtacccttctgcagtcatcattttcatcaattaataatgaaagatggccgagaaatagtcgtcccgtgtagaaatcaagatgaactggtaggcagagcgcgagtatcacaaggggcgggttggagcctaagagaaacggcctgtttaggaaaaagttatgctcaaatgtggcaactgatgtatttccatcgacgcgacttacggctggcggcaaacgccatctgctctgccgtaccagtagactgggtaccaacatcaagaacgacatggtctatacacgctcaccatcagtggatgacgactgaggacatgctcagcgtctggaatcgagtatggatagaagaaaatccttggatggaagataagacccacattagttcgtgggaggatgttccatatctaggaaaaagagaagaccaatggtgtggttctctcatcggattaaccgcaagagctacctgggctaccaacatccaagtggcaattaatcaagtgagaagactaataggaaatgaaaactatctagattacatgacgtctatgaaacgttttaaaaatgaaactgatccagaaggagcgctctggtga

SEQ ID NO: 21572 - RNA, 9879 nt, synthetic construct
  misc_feature 1..9879: note = derived and/or modified CDS sequence (opt6) from DENV-1__FJ461325__SS-prME
  source 1..9879: mol_type = other RNA
agcgtcactatgctactaatgttgatgcccaccgcactggcattccacttgaccactcggggtggtgaaccccacatgatcgtatctaaacaagaaagaggcaaaagtttactctttaaaacaagtgccggtgtcaatatgtgtacattaatagcaatggatctaggtgaactttgcgaagatacaatgacgtacaaatgccccagaataacggaaacggaaccagatgatgttgattgttggtgtaatgcaactgacacatgggtcacatacggcacatgttcacaaacgggggaacatagacgcgacaaacgaagcgtggcgcttgctccccacgtcgggctggggttagaaactagaacggagacttggatgtcttcagaaggagcatggaaacaaatacaaagagtagaaacatgggcattaaggcacccagggtttaccgtaatagcactatttttggctcatgcgataggaacgtccattacacaaaagggaataatatttatattgttgatgttagtgacaccatcaatggcaatgcggtgtgtgggaattgggtcgagagactttgtcgaaggtctatcaggggccacgtgggttgacgtagtgttggaacacggtagttgtgtcacaaccatggcaaaagacaaaccaactttggatattgaattgctaaaaacagaagtaacgaacccagcggtgctaagaaaattatgtattgaagctaaaataagtaacacaacaaccgattcaagatgcccgacccagggagaagctactttagtcgaggagcaagacgcgaacttcgtatgcagacgcacctttgtagatagaggttggggaaatggttgtggactgttcggcaaaggatctctaataacatgtgcaaaatttaaatgtgtaactaaattagaaggaaagattgttcagtacgaaaatctgaaatattctgtaattgtaactgtccatacaggtgatcagcatcaagtcggaaacgaaagtacggaacatggtacaaccgcgacaataactcctcaagcaccgactacagagatacagcttacagattatggtgctctaacattagattgtagccctcgtacaggcctggacttcaacgaaatggtattgttaacgatgaaagaaaaatcatggttagtacataagcaatggtttttagacttaccgctgccttggacatctggggcgagcacaagtcaggaaacatggaatcgacaagatttattagtcacgtttaagacagctcatgctaagaaacaagaggtagtagttttggggtcccaagaaggtgccatgcacactgccttaaccggagctacagagattcagacttctggtacgacgaccatttttgctggacacttaaaatgtcgactaaaaatggataaactgacattaaaaggaatgtcgtacgtcatgtgcacaggatcgtttaaactagaaaaagaagttgcagaaacgcaacatggaacggtattggtacagatcaaatacgagggtaccgacgctccttgtaagataccattcagtacacaagacgaaaagggggtcacacagaatggaagattaataacagccaacccaattgttacagataaagaaaaacccgtgaatatagaggcagaacccccattcggtgaatcatatattgtaattggagccggcgaaaaggcattaaaactatcgtggtttaagaaagggagcagtatcggaaagatgtttgaagcaacagcaaggggagcgcgaagaatggcgatattaggagatacagcatgggattttggctcgataggaggtgtgtttacaagtgtaggtaaattagttcatcaaatctttggtactgcctatggagtcttatttagtggtgtgagttggacaatgaagataggaataggagtattgctgacatggcttggtttaaactcgaggagtacatcattgtcgatgacatgcattgcggttgggttagtaacactttatttaggagtgatggtacaagcagattcaggctgtgttattaattggaaggggcgggaattaaaatgtggaagcggaatattcgtaacaaacgaagtacatacatggacggaacagtacaaatttcaagccgactcacctaaaagattgtccgcagccatcggaaaggcctgggaggaaggtgtttgtggaataaggagcgcaacaagactggaaaacataatgtggaagcaaattagtaatgagttaaaccatatattactagagaacgatatgaaattcacagtcgtagtaggcgacgttgccggtattttagcccaggggaagaaaatgataaggccccaaccaatggagtacaaatacagctggaaatcctggggtaaagcaaaaataataggtgcggacgttcaaaacacaacctttataatagacggccccaatacaccagaatgtccagatgatcagcgcgcatggaatatatgggaagtggaagattacgggtttggaattttcactactaacatttggctaaaactacgggactcatatacacaagtatgcgaccatcgactaatgtcagcagcaatcaaggactctaaagccgtgcatgcggatatggggtattggatagaatccgagaaaaatgaaacctggaagttagcgagagcctcattcatagaagttaaaacgtgtatatggccaaaatcgcacacactttggtctaatggggttctagaatcagaaatgataataccaaagatttacggaggcccgataagccagcataactatcgaccgggttacttcacacaagcggcaggcccttggcatctcgggaaactcgagttagatttcgacttgtgtgaaggtacaacagtagtagtagatgagcactgcgggaatcggggcccgagtctcagaacaacaacggtaacggggaagatcatccatgaatggtgttgtagaagttgcacattaccaccgctccgctttagaggggaagatggctgctggtacggtatggaaattcgccctgtgaaagaaaaggaagaaaatttggttaagtcaatggttagcgcaggttctggtgaagtcgatagtttttcattgggactactgtgcatttcaataatgatagaagaggtaatgagaagtagatggtctcgtaggatgttaatgaccggcacattagcggtctttttccttcttattatgggacaactcacctggaacgacttaataagactttgcattatggtaggagcgaacgcgtctgatcgaatggggatggggacaacttacttagctctaatggctacttttaaaatgaggccgatgtttgcggttgggctcttatttagacgactcaccagtagagaagttttattgttaacaattggtctctcgcttgtagcaagtgtagaacttccgaactcactagaagagttaggagatggtttagctatgggaatcatgatactaaaacttttgaccgattttcaatcccaccagttgtgggctactttgttgagtttaacctttattaaaacaacatttagcctacactacgcctggaagactatggcaatggttttatcgatagtatctttattcccgctttgcttaagcactacaagtcagaaaactacatggttacccgtattactggggtccttagggtgtaaaccgttaactatgttcttaattacggaaaacaaaatctggggccggagaagctggccactgaacgagggaataatggcggtgggtatcgtatcaatacttttatcttctctcttgaagaatgatgtaccgttagctgggccccttatagctggaggaatgctcatcgcatgttatgttatttcaggttcgtcggcagatctaagtctggagaaagcagccgaagtgagctgggaagaagaagcagaacatagtggagcgagccacaatatattagttgaagtacaagacgatggcactatgaagataaaagatgaagagagagatgatactctgacaattctattaaaggcgacgctccttgcagtttccggagtttatccgttaagtatccccgctacgctgtttgtatggtacttctggcaaaagaagaaacaaagaagtggtgtgttgtgggacacccccagtccacccgaggtagaaagagccgtattagatgatggaatctacaggataatgcaaaggggcctgctaggaagaagtcaggtaggagtaggagtgttccaagagaatgtcttccacacgatgtggcacgtcacaaggggtgcagtacttatgtaccagggtaagagattggaaccaagttgggcgtctgttaagaaagatctaatttcatatggaggcggttggcgtcttcaaggcagttggaatacgggagaggaggtccaagtaatagcagtggagccaggaaagaaccctaaaaacgtgcaaaccgcaccgggaacctttaaaacaccagaaggggaagtaggagcgatcgccttggattttaaaccaggaacatcaggaagccccatagttaaccgtgaagggaaaattgtgggactttacggaaatggcgtcgtaacaacctcgggaacttacgtatcagcaatcgctcaagcaaaagcctcccaggaaggaccccttcctgaaatcgaggatgaggtttttagaaaacgaaatttgactataatggacctccatcctgggtcaggtaaaactcgaagatatttaccagctatagtccgtgaggcaataaaaagaaaactgcggaccctgatcctagcgccaacgagagttgtagcctctgaaatggccgaagccctaaaaggcatgcctattagatatcaaaccaccgcagtaaaaagtgaacacactggcaaggaaattgtggacctgatgtgccatgcaacatttactatgaggttactatcacccgtacgagtgccaaattataacatgataatcatggatgaagcacatttcactgatccctcgagtattgccgcgcgtggctatataagcacaagagtaggaatgggcgaagcggccgcgatatttatgacggcgacaccacccggtagtgttgaagcgtttccacaaagtaatgctgtgatacaggatgaagaacgtgacatacctgaaaggtcatggaacagcggatacgaatggataaccgatttccctggaaaaacagtctggttcgtgccatctataaagagcggtaatgacatcgctaattgtttaaggaaaaacggtaaaagagtcatacaattatctagaaaaacattcgacacagaatatcagaaaacgaagaacaatgattgggactatgtagtaacaactgacatttctgaaatgggagcgaatttccgtgcggatagagttatagatcctaggcgatgcctcaagcccgttatcctgaaggatggtccagaacgtgttatcctcgcaggaccgatgccagtcactgtagcaagtgcggcccagaggcgtggtcgcatagggcggaatcataataaagagggagatcaatatatatacatgggtcaaccgttaaataatgatgaagaccatgcgcattggacggaggccaagatgttgttagataatattaatactcccgaaggaataatcccagccttatttgaacccgaaagagaaaaatcagctgcaatagatggagaatatcgtttaaggggagaagcaagaaaaacctttgtcgaattaatgagacgtggagatctcccagtatggctgtcatataaagtagcctcggaaggatttcaatattcagacagaagatggtgcttcgatggtgaaagaaataatcaagttctcgaagaaaatatggatgtagagatctggacgaaagaaggagaaaggaagaaactcagacctcgatggttagatgctcgaacatactctgatcctttagccttaagggaatttaaagaatttgcagctggacgacggagcgtctctggagaccttatattagaaattggcaagctaccacagcatttaacacagagggcgcagaatgctctcgataatcttgtaatgctacataatagtgaacaagggggtagggcatatcggcatgctatggaagaattaccagatactatagaaacacttatgctattagctcttattgctgtcctaaccgggggcgttacactattctttttgtcaggaagaggtttagggaaaacctcaattgggttactatgcgttatggcaagctcagtattgttatggatggcttccgttgaacctcattggatagcggcgtcaattatactagagttctttttaatggtacttctcatacccgagccggatcgacagagaactccacaagacaaccagttagcttatgttgtgattggtctgctgtttatgattttaaccgttgcagcaaatgaaatgggactgctagaaacaacgaaaaaggaccttggtatagggcatgtagcagtcgaaaaccatcaccatgccgcaatgttagacgttgatctacacccggctagtgcatggactttgtacgcagtagcaacaacaatcatcacccctatgatgaggcataccatagaaaacactacagcaaatataagtttgacagcgattgcaaatcaagcggccatattgatgggcctcgataaggggtggccaataagcaaaatggatataggcgtccctttacttgcactcggatgctattcacaagtgaatccgttaacactcacagctgcggttttgatgctggtggcccactacgctataataggtcctggcttacaggcaaaagctacgagagaagcgcaaaaacgaacagccgcgggtatcatgaagaaccctaccgtagatggtatagtcgccatagatctggatccagtagtatatgacgccaaattcgaaaaacaattaggtcaaataatgttactcatactatgcacctcacaaattctgttgatgagaaccacgtgggctctgtgcgagtcaataactctggcaacgggtcctctaactactttgtgggaggggtcaccaggaaagttctggaatacaacaatcgcggtcagcatggcaaacatattccgcggatcttatcttgcaggcgccggacttgcgttttctctaatgaaatcattaggagggggcagaagaggaactggtgcacaaggagaaactctaggtgagaaatggaagcggcaactaaatcaattgtccaaaagcgagttcaatacatataagagaagtgggattatggaggttgaccgatcagaagctaaggaagggttaaaaagaggcgagacaacaaaacacgccgtgagtcgtggtaccgcgaaattacgatggtttgtagaaaggaacctcgttaaaccagagggtaaagtcattgatttaggttgcgggagaggtggctggtcttattattgtgccggtctgaagaaagtgacagaagtaaaaggatatacgaagggcggacctggccacgaagaacctattcccatggccacatacggttggaacctagtaaaactacattccggtaaagatgtattctttataccacccgaaaaatgtgatacactactctgcgacataggcgaatcgagccctaacccaacaatagaggaaggaagaacgttacgtgtattaaaaatggttgaaccgtggttgcgaggaaatcaattctgtatcaaaatccttaatccttatatgccttcggttgttgaaacgttagagcagatgcaaagaaagcacggcggcatgttagttagaaatcctctttctagaaattcgacgcatgagatgtactgggtaagttgcggcacggggaatattgtaagcgcagtaaatatgacgagccgaatgttgcttaataggttcactatggcgcacagaaaacccacatacgaaagagacgtcgaccttggtgcaggtactaggcatgtagctgtcgaaccggaagtagccaatcttgacataatagggcaacggattgaaaatataaaacatgaacacaaatccacttggcattacgacgaagataatccctataagacatgggcttaccatggttcgtatgaagtcaagccttcagggagtgcttcaagtatggtaaacggagtcgtaaagttgttgacaaaaccatgggatgttataccgatggtaacccaaattgcaatgacggatacaacccccttcgggcaacaacgagtttttaaagagaaggtagatacaagaacacccaaagccaagcgaggaactgctcaaataatggaggtaactgccaaatggctatggggatttttgtcccggaataaaaagcctaggatttgcacgcgagaagagttcacaaggaaagttcgatctaatgcagcaataggagcagtctttgttgatgagaatcaatggaactcagccaaagaagcagtagaagacgaacgattttgggatctggtacacagggaaagagaattacacaaacagggtaaatgcgccacatgcgtctataacatgatggggaaaagggagaagaaattaggcgaatttgggaaagcaaagggaagtagagcgatatggtatatgtggttaggagccaggttcctagaatttgaagcgttaggattcatgaacgaagatcattggttcagtagagagaatagcttatcgggagttgaaggtgaaggtctacataaattaggctatattttaagagatataagtaaaataccaggaggaaatatgtatgcagatgacacagcaggatgggatacacggataacagaagatgatctacaaaatgaagcacgaattacagacataatggagccagaacacgcattattagcaaaaagcatatttaagttaacatatcaaaacaaagtagtgcgagtccaaaggcccgccaaaaatggaaccgtgatggatgtaattagcagaagagaccagagaggaagcggacaagttggcacgtatggtctgaatacgtttaccaatatggaagctcaattgattaggcaaatggaaagcgaagggatcttttcaccgtcagagctggaaaccccaaatttagccgaaagagtcctcgactggttagaaaagtacggagttgagagactcaaaaggatggccattagtggtgatgactgtgtagtaaaacccattgacgaccgcttcgctaccgcactcaccgccctaaacgacatgggcaaagtaaggaaagatattccacagtgggaaccatcaaaaggatggaacgactggcaacaagttccgttttgttctcatcattttcatcaattaattatgaaagatggcagagaaatagtagtgccatgcaggaatcaagacgaattggttgggagggctagggttagtcagggtgcaggatggagtttaagagaaaccgcgtgtttgggcaaatcatatgcacaaatgtggcaattaatgtattttcatagacgggacctgaggcttgctgcgaatgcaatatgctcagccgtgccagtcgattggatcccaacctcgagaacaacatggagtattcacgctcatcaccagtggatgacgacggaagatatgctgtctgtttggaatcgcgtctggatagaagaaaatccatggatggaagataagactcatatatcaagctggggtgacgttccttacctaggaaagcgagaagatcaatggtgtggatcgctaataggtttgacagcaagagcgacatgggcaacaaatatacaagtcgcaataaatcaagtgagacgattaataggtaacgagaattacctagattatatgacatcgatgaaacgatttaagaacgaatccgatcctgaaggagcattatggtag

SEQ ID NO: 21573 - RNA, 9879 nt, synthetic construct
  misc_feature 1..9879: note = derived and/or modified CDS sequence (opt6) from DENV-1__FJ410232__SS-prME
  source 1..9879: mol_type = other RNA
tcggttactatgttactgatgttaatgcctacggctcttgcattccatctaacaacacgtgggggagaaccgcatatgatagtatcaaaacaagaacgaggtaaaagtttactctttaaaacctcggctggcgtcaacatgtgtaccctgattgcaatggatctgggcgaactatgtgaagacaccatgacttacaaatgtccccgaatcaccgaggcggaaccggacgacgttgactgttggtgcaacgctactgatacctgggtaacatatgggacgtgttcgcaaacaggtgaacatagaagagataaaaggtcagtggccttggcgccacatgtcggcttaggactagaaactcgaactgagacatggatgtcgagtgagggtgcatggaaacaaatacaaagagttgaaacatgggctctgagacacccaggctttaccgtcacagccctatttctcgcacacgccatcggaacaagcattactcaaaaaggcattatattcatattattaatgttagtgacaccgtctatggccatgagatgcgtcggtattggttctagagactttgtagaaggtctgtcaggcgcaacatgggtagatgtagtactagagcatggctcctgtgtcacaaccatggcgaaagataaaccgactctcgacatagagctgctgaaaaccgaagtcactaatccagccgtacttagaaaattgtgtattgaagcaaaaattagtaatacaaccacagatagtaggtgcccaacacaaggagaggccactctagtggaagaacaagacgcaaatttcgtttgtagaaggaccttcgtagacaggggatggggtaacgggtgtggactcttcggaaaaggttcgttaattacatgtgcgaaatttaaatgtgtaacaaaattagaagggaaaatagttcaatacgaaaacttaaaatattcagtaatagtgaccgttcatacaggcgatcaacaccaagttggcaatgaatcgacagaacacggtactaccgcaactataacacctcaagctccaacaacggaaattcaactaaccgattatggagctcttaccttggattgcagccctcgaaccggattggattttaatgaaatggtacttctaacgatgaaagagaaatcgtggttagtacataagcaatggtttctagatcttccattgccatggacatctggagcctcaacttcacaagagacgtggaatcgccaagatctccttgttacattcaaaacggctcatgctaaaaagcaagaggtagtagtattaggaagtcaagagggagcaatgcacacagcactcactggagcaacagaaatacaaacgtcaggtacaactacaatatttgcaggtcatctaaagtgtagacttaaaatggataaattaacgcttaagggcatgtcttatgtaatgtgtacggggtcatttaagttagagaaagaagttgctgaaacgcaacacggtactgtcttagtacaaataaaatacgaaggtaccgacgcaccctgcaagataccgtttagtacccaagacgagaagggagtaacgcaaaacggtcgcttaataactgccaatccgatagtcacagataaagagaagcctgtaaacatagaagcagaaccaccatttggtgaaagttacatagtaataggagcaggcgaaaaagcactaaaacttagctggtttaaaaagggtagttcgataggtaaaatgtttgaggccacagctagaggtgctcgacgtatggcgatacttggagatactgcatgggacttcggatctatagggggagtcttcacgtctgtcggaaagttggtccatcaaatattcggtacagcctacggcgtgttattttccggcgtaagttggacgatgaaaatcggaattggcgttcttttaacctggctaggactaaattccagatcgacatcattgtcaatgacgtgtatagctgttggtttagtaacgttgtatttgggtgttatggtgcaagcagactcaggatgcgtaattaactggaaaggtcgagaattaaagtgtggatcaggaatctttgtaaccaatgaggtccacacctggacggaacaatacaaatttcaggcagactcaccaaagcgactgtctgctgcaatcggaaaggcctgggaagaaggagtgtgcggaatacgatcagcaaccagactagaaaatattatgtggaaacaaatatcaaacgaattaaatcatattttgttggaaaatgatatgaaattaacagtagtcgttggcgatgtcgccggtatcctaggtcaagggaagaaaatgatacgacctcaacctatggaatataaatattcatggaaatcctggggtaaagctaaaattattggagctgatgcgcaaaatacaactttcattatcgacggtccaaatacacccgagtgccctgatgatcagagagcttggaacatatgggaagtcgaagactacggatttggaatctttactacaaatatatggttgaaactacgagacagctatactcaagtttgcgatcatcgattgatgtcagcagcaattaaagatagcaaggctgtccacgcagatatgggatactggatcgaatccgaaaagaatgagacatggaaactagctagagcctcgtttattgaagtaaaaacatgtatctggccaaaatcgcacacactgtggtcaaatggggtcctagaaagcgaaatgataattccaaaaatatatgggggtccaattagccagcacaactacaggccaggttattttacacaaactgccggtccatggcatctcggcaaacttgaattagattttgatttgtgcgaaggtacaacagtggttgtcgacgaacattgtggaaaccgcggaccatcactacgaacaacaactgtaacaggtaagatcatccacgagtggtgctgccggtcatgtacccttccaccgcttcggttccgtggggaagacggatgctggtatggaatggagattcgcccggtaaaagagaaagaggaaaatctcgtaaaaagtatggtttcagcaggctcaggtgaggtagacagctttagtctaggtctactctgtatatctatcatgatagaagaggtcatgcgaagtagatggtcacgtaaaatgcttatgaccggcactttagctgtgttctttttattaatcatgggacaattaacatggaacgacctcatacgactatgtatcatggttggagcgaatgcaagcgacagaatgggaatggggactacctacctcgcacttatggcaacatttaaaatgcgacccatgttcgctgtgggactattattcagaagactaacttccagggaagtcttgctactgaccatcggactctcattagtagcttctgttgaattacctaactccttagaagaattaggagacggtctcgcaatgggtataatgatattaaaattgctcactgactttcaatctcaccagttgtgggctacactcttaagtttaacttttataaaaacgacattcagcctacattatgcatggaagacaatggcaatggtcctatccatagtaagtctttttcctttatgtctctcaacgacctcacagaaaacaacgtggctacccgtattactaggaagcctaggctgcaaaccactaacaatgtttttaatcgccgaaaataagatatggggaagaaaaagctggcccttaaatgagggaataatggcggtcggaatcgtaagtatattacttagttccctattaaagaatgatgtacctctagccggaccattaattgcaggaggcatgttaatcgcgtgctatgtcatatcaggatccagtgcagatttatcattagagaaggctgcagaagtcagctgggaagaagaggcagaacattccggtgcatcccataacatattagttgaagttcaggatgacggtactatgaaaataaaagacgaagaaagggatgacaccttgaccatcctattaaaagctaccctcctagcagtgagcggagtatatcctttatctatccctgctaccttatttgtatggtatttctggcagaagaagaaacaacgtagtggagtcttatgggacacaccgagcccaccagaagtcgaacgtgctgttttagatgacggcatatacagaataatgcaaagagggcttttagggagatcacaggtcggcgtgggagtgttccaagaaaacgtattccatacgatgtggcacgtaactcgcggcgcagtgctgatgtaccaaggaaagcgtctagagccaagctgggctagcgtgaaaaaggatctaatttcctatgggggaggatggagattacgaggtagctggaatactggagaagaagtgcaagttatagcagtagaaccaggtaaaaaccccaaaaatgtacagacagctccaggtacatttaaaactccagaaggcgaagtaggtgcaattgcgttagactttaaacctggaacttcaggatctccgatcgtcaaccgggaaggtaaaatagtaggcctatatggaaacggcgtagtaacaacatccgggacctatgttagcgcaatagcacaagctaaggcttcccaagaaggtcccctacccgagattgaagatgaagtctttcgtaagcggaatctaactataatggatcttcatcccggctcgggaaagacaagaaggtatcttccggcaatagtaagagaagcaattaagcgtaaattacgcacgctaatactggcccctactagagtagtggcctccgagatggctgaagcgttgaaaggcatgccaataagatatcaaacaacagctgtaaagtcagagcacacaggaaaagaaatagttgaccttatgtgtcacgccacatttacaatgaggttattatccccagtcagagtgcctaactacaatatgattatcatggatgaggctcactttacggacccatcttccatcgcggcaagagggtatatatcgaccagagtgggcatgggagaggcagccgctatatttatgacagcaacaccaccaggttcagtagaggctttcccgcaaagcaatgccgtaattcaagacgaagaaagggacatacccgaacgctcatggaatagcggatacgaatggatcacagactttcccggtaagacagtctggttcgtaccgagtataaagagcggtaacgacatagctaattgtttaaggaaaaatgggaagcgtgtgatacaattgagccgtaaaacgttcgatacagagtatcagaaaactaaaaataatgactgggattacgtagtaacaacggacatttcagaaatgggagctaacttccgagcagacagagtaatcgatccgagaagatgtttaaaaccagttatattaaaagatggaccagaaagagtgattctggctggtccgatgccagttaccgtagctagcgcggcacaacgacgtggccgaattggaagaaaccataacaaagaaggtgatcaatatatctatatgggtcaaccactaaacaacgacgaagatcatgctcactggacagaagcaaaaatgctattagacaacataaatacaccagagggaataatacctgctctctttgagcctgaaagagaaaagtctgcggctgtcgatggagaatacagactaagaggtgaagcacgaaaaacatttgtcgaactaatgagaagaggagacctaccggtatggttgtcatacaaagtagcaagcgagggatttcaatacagcgatcgtcgttggtgttttgatggagaacgaaataaccaagtcttagaagagaacatggatgttgaaatatggacaaaagaaggtgaacgtaagaaactaagacccagatggctagacgcaagaacatactcagacccacttgcactccgtgaatttaaggagttcgccgccgggagaagaagcgtaagtggagacttgatactagaaataggaaaactaccgcaacatctgacgcagagagcccaaaatgctctagataaccttgtaatgcttcacaattctgaacaaggaggtcgagcgtacagacatgcaatggaagaacttccagataccatagagacactgatgctactcgcgctcattgcagtactaactggaggtgttacactattctttctcagtggaagaggattgggtaagacatcaattgggttgttatgcgttatggcatcctctgtgctattgtggatggcaagtgtagaaccgcattggatagccgcatcgataatattagagttctttctaatggtgttgctaataccagaaccagatcggcaaagaacaccgcaagataatcaacttgcttatgtagtaataggactactgtttatgatacttactgtggccgcaaatgaaatgggactacttgagaccactaaaaaggatctgggaattggacacgtagctgtagaaaatcaccatcatgccgctatgttagatgttgacctacatccagcaagtgcttggaccctctacgcagtggcaacaacgataattacgcctatgatgagacacacgatcgaaaacacaacggccaacatttcccttaccgcaattgcaaatcaggctgctatactaatgggattagataagggatggcctatctccaaaatggacataggcgtaccattactagccctaggatgttattcacaagtcaatccattaacactaacagccgccgtactgatgttagtagctcattacgcaataataggaccaggacttcaagctaaagcgactagagaagctcagaaacgtacagcggcaggcataatgaaaaacccaacagtcgatggtatagttgccatagacttagatcctgtcgtgtatgatgcgaaattcgaaaaacaattaggacagatcatgctcctgatattatgcacttcacaaattttactgatgagaacgacatgggcactatgcgaaagcatcaccctagccacaggcccattgactacattatgggaaggatcaccagggaaattctggaacacaactattgccgtttctatggctaatattttccgcggatcgtatctggcaggagcgggactagctttttccctgatgaaatcactgggagggggaaggaggggaaccggtgcacaaggagaaaccttaggagaaaagtggaaaagacaattaaatcagcttagcaagtcggaatttaatacctacaaaagatcaggtatcatggaagttgacaggtcagaagcaaaagagggactgaaacgaggagaaactactaaacatgccgtaagtcgcgggaccgccaaactacgatggttcgtggagagaaatttagtaaaaccggaaggcaaagtaattgatttaggatgcgggcggggcggttggagctactattgtgctggtctaaagaaagtaacggaagtgaagggatacacaaaaggtggtccaggacatgaagaaccgataccaatggctacctacggttggaatcttgtcaaattacatagtgggaaggatgtgttctttatacccccggagaagtgcgacactctactgtgtgatataggcgaaagctcaccaaatcccaccatagaagaagggcgaacattacgagttctaaaaatggtggaaccctggcttcgtggaaaccaattttgtataaaaattctgaatccctatatgccgtcagtagtcgaaaccttagaacagatgcaacgcaaacatggaggtatgttggtaaggaacccactaagcagaaactcaacacatgaaatgtattgggtaagttgtggaacgggaaatatagtctcggccgtaaacatgacgtctcgaatgcttctaaatcgttttaccatggctcaccggaaacccacatatgagcgtgacgttgacttgggaacagggactcggcacgtagccgtagaacccgaggtggctaatctagacataataggacaaagaatagaaaatattaaacacgaacacaaatcaacatggcactatgatgaagataatccttataaaacttgggcataccatggcagttatgaggtcaaaccatcagggagcgcaagtagtatggttaacggtgtagttaagctattaacaaaaccgtgggacgtaatccctatggtaacccaaatcgcaatgactgacactacaccttttggacaacaacgagtattcaaagaaaaggtagatacaagaacgccaaaagctaagagaggtaccgcgcaaataatggaagtaacagctcgctggctgtggggatttttaagccggaataagaaacccagaatttgtacaagagaagagttcacacgaaaagtacgcagtaacgcggcaataggagcggtgtttgtagatgagaaccaatggaactctgctaaagaagcggtagaggacgaacgtttttgggacttagtccatagagaaagagaacttcataaacagggcaagtgcgctacatgtgtttataatatgatgggaaaaagggaaaagaagttgggagagttcggcaaagctaaaggttcacgtgccatatggtatatgtggttaggcgctagatttttagaatttgaagctctgggctttatgaatgaagaccactggttctcgcgggaaaattcactatccggagtggaaggtgagggactacacaaactaggatatattttaagagatatttcaaaaataccaggaggaaatatgtatgccgatgataccgctggctgggatacaagaatcaccgaggatgatctacaaaacgaagctaagataaccgatatcatggaacccgaacatgcactattagcaaaagcgatatttaaattaacttaccaaaacaaagttgtcagagtccaacgacccgctaaaaacgggaccgtgatggatgtgatatcaaggagagatcaacgtggctcgggtcaggtaggtacatacggtttaaatacttttacgaacatggaagctcaactgatacgacaaatggagtcagaagggatattcagtccatcagaacttgaaacaccgaatttagctgaacgggcactcgattggctagaaaaatatggtgtcgagcgcttaaaaagaatggcgatctcaggagatgactgtgtggttaaacctattgacgaccgcttcgcaacggcccttactgcactaaatgacatgggcaaagtgcggaaagatatacctcaatgggagccgagtaaaggatggaatgactggcagcaagtacccttttgttcccatcactttcaccaactcattatgaaagacggtcgtgagatagtagtgccatgcagaaatcaagacgagcttgtggggagagcacgagtgtcacaaggcgcaggctggtcgctacgcgaaacagcgtgtctgggaaaatcatacgcacagatgtggcaactaatgtattttcatcgtagggatctacgcttagcagccaacgcgatatgcagtgccgtaccagtcgattgggttccgacctcccgaactacgtggagtattcacgctcatcatcaatggatgacaaccgaggacatgttaagcgtatggaatcgagtttggatagaggaaaatccttggatggaagataagacgcatataagcagttgggaggatgtaccgtatttaggaaaaagagaagaccaatggtgtggaagtcttataggattaaccgctcgagcaacatgggctactaatattcaagtagccattaatcaagtaaggagattaattggaaacgagaactatctagattatatgacttctatgaagcgtttcaaaaatgagagcgatcccgaaggtgcactatggtaa

SEQ ID NO: 21574 - RNA, 9879 nt, synthetic construct
  misc_feature 1..9879: note = derived and/or modified CDS sequence (opt6) from DENV-1__FJ461327__SS-prME
  source 1..9879: mol_type = other RNA
tcagtcacgatgttgcttatgctaatgccgacagcattagcttttcacctaacaacgagaggaggagaacctcacatgattgtatcaaaacaagaacgaggaaaatctctgctatttaaaaccagcgctggagtaaatatgtgcacccttattgctatggacttaggcgaattatgtgaggatacgatgacatacaaatgtcctcgcattacagaaaccgagccagacgatgtcgactgctggtgcaatgccactgatacatgggtaacatatggcacgtgctcacagacaggtgaacatagacgtgataaaagaagtgtcgcactagctccacatgtgggactaggtcttgaaacgagaacagaaacttggatgtcttcagaaggtgcatggaaacaaattcaaagggttgaaacatgggccttaaggcatccaggtttcacagtaatagcgcttttcttagcacacgcaataggaacttcgataactcaaaaaggaattatcttcatactactaatgttagttacaccatccatggcgatgaggtgtgtaggaatcggctcacgtgacttcgtcgaaggactaagtggtgcaacatgggtggacgttgttctggaacatgggagctgcgtaacaaccatggccaaagataaaccaacgttggacattgaactactgaaaacagaagtcacaaatccagctgtattaagaaaactatgtattgaagctaaaatctctaatactacaacggattcaagatgccctacgcagggtgaggctacattagtggaagaacaagatgctaattttgtgtgccgacgtacatttgtagatcgtggctggggtaatggatgcgggttattcggaaaaggaagcctaataacgtgtgctaaatttaaatgcgtaacaaaattagaaggcaaaatagtacagtacgaaaatttaaaatacagtgtcattgtgacagttcacaccggtgatcaacatcaagtcggtaacgaaagcactgagcacgggacaactgctacaatcacaccacaagcaccaactaccgagatacaattaactgattatggcgcattaactttagactgctcaccacggacaggactcgatttcaatgaaatggttctcctaacaatgaaagaaaaatcgtggttagtacataaacagtggtttttagatcttcctcttccttggacgagcggtgcaagcacttcgcaggaaacttggaacagacaagatttgcttgtaaccttcaaaacagcacatgccaaaaagcaagaggtcgtagttcttggctcacaagaaggagcaatgcatacggcgctaacaggtgcgacggaaattcaaacaagtggtacaacaactatctttgccggacatctaaagtgtcggttgaaaatggacaaacttactttaaaaggaatgtcttacgtgatgtgtacaggttcatttaaacttgagaaggaagtagctgaaacgcaacatggaacagtcttagttcagataaaatatgaaggaaccgacgcgccatgcaagatacctttttcgacccaagatgaaaaaggtgtaacacaaaacgggcgtttgattaccgcaaatccaatagttactgacaaagaaaaacctgtgaacatagaagctgaacctcccttcggtgaaagctatatcgtcataggagcaggggaaaaagcgctcaagttgtcatggttcaagaaaggtagcagtatcggaaaaatgtttgaagcaaccgcccgaggggcgagaagaatggcaattttgggagacactgcatgggactttggatccataggaggtgtatttacatcagtaggcaagctagtgcaccaaatctttggtactgcatatggcgtattatttagtggagtttcctggacgatgaaaattggaattggtgtgctactcacttggcttggtttaaacagccggagtacatcgctaagcatgacttgtatagccgtcggtttagtaactctatatttgggagttatggtacaggctgacagcggttgtgtaataaattggaaagggcgagaattaaaatgcggcagcgggatatttgtgactaatgaagttcacacttggacggaacaatataaattccaagcggattcccctaagcgcctatcggcggctatcggcaaagcatgggaagaaggagtctgtggcattcgtagtgctacccgtctagaaaacataatgtggaaacagatcagtaatgaattaaaccatatactattagaaaacgatatgaagttcactgttgtagtaggcgatgtcgccggaatactggcacaagggaagaaaatgattaggccccagcctatggaatataaatattcctggaagagttggggtaaagcaaagattataggtgcagatgtccaaaacacgactttcataatagacggtcccaacacgcctgagtgtccagatgatcagcgcgcttggaatatatgggaagttgaggattacggattcggcatatttacaacaaatatatggttgaaactaagagactcgtatacacaggtatgcgaccatagattaatgtccgcagcaataaaagatagcaaagctgttcacgcagacatgggatattggatagaatccgaaaagaatgaaacctggaagttggcgcgagccagttttatagaagtaaaaacatgtatatggcccaagagtcataccctttggtccaacggagttctcgaaagcgaaatgatcataccgaaaatttacgggggtccaataagtcaacacaactacagacctggttactttacacaggcagcaggaccctggcacttaggtaaacttgagttagattttgatctttgcgaaggaaccactgtggtagtagacgagcactgcggcaatagaggaccatcactcagaactaccacagttacagggaaaattatacacgaatggtgctgccggagttgtaccctacctccactaagatttagaggagaagacgggtgctggtacggtatggaaattagacctgttaaggaaaaagaagaaaatttagtaaaaagtatggtatcagctggatcaggagaggtagattcattctcgctaggactcctgtgtatatcgattatgattgaagaagttatgagaagtcgatggtcacgacgtatgcttatgacagggaccctagccgtgttctttcttctaatcatgggacaattaacctggaacgacttaatacgactctgtataatggtaggcgccaacgcatctgacaggatgggaatgggtacaacatacctcgctctaatggcgacctttaaaatgagacccatgtttgctgtcggcctcctatttagaagactcaccagtcgagaagtgttgctactaacgataggattatcgttagttgctagcgttgaacttccaaattcattagaagaactaggtgatggattagcaatgggcataatgatactaaaactgctaactgattttcaatctcaccaactatgggctacactacttagtctcacctttataaaaaccacattctcactacattatgcctggaagactatggcaatggtattaagtatagtatccttattccctttatgtctaagcacaacgtcccagaaaactacttggttaccagtacttctaggaagcctcggttgcaaacctcttaccatgtttcttattgctgagaataagatatggggacggagaagttggccacttaatgaaggcattatggccgtaggaattgttagcatcttactctcatcattactcaaaaatgatgtacctttagcagggccccttatagctggaggtatgcttatcgcttgttatgtaatctctggcagtagcgctgatttatctttagagaaagctgccgaagtaagctgggaggaggaagctgaacacagtggagcctctcacaatattcttgtagaggtacaagatgatgggacaatgaagattaaggatgaagaaagggacgatacactcacaatactcctaaaggcgacactactcgcggtttctggcgtctatcctttaagcatacctgctacgctttttgtatggtatttttggcaaaagaagaaacaaagatctggagtcttatgggataccccatcaccacctgaagttgagcgagctgtattagatgatgggatatatcgtattatgcagaggggattacttggaaggtcacaagttggagtaggtgtattccaggaaaacgtattccacacgatgtggcatgtaacaagaggagcagtccttatgtatcaagggaaacgactagagccctcttgggcatctgttaaaaaggatctcattagttacggaggtggctggaggctccagggatcttggaacactggtgaagaagttcaagtcatcgcagttgaacccggtaaaaacccaaagaatgtgcaaactgcccctggtacatttaagacaccagagggggaagttggagctattgcacttgattttaagccaggtacctctggatcaccaatcgtgaacagagagggaaaaatagtgggtttatacggtaacggggtcgtgacaacaagtggcacatatgtttcagcaatcgcccaagctaaagcatcccaggaagggcctctccctgaaattgaagacgaagtgtttcgtaagagaaacttaacaataatggatttacacccaggtagtggaaaaacccgaagatatctccctgcaattgttagggaagcaattaaacgcaagttacgcacactaattctagcccccactagggtcgtcgcatcggaaatggcagaagcattgaaaggaatgccgattcgttatcaaactacagctgttaaatccgaacataccggaaaagagattgttgatttaatgtgtcacgcgacatttaccatgagactattaagcccagttcgggtgccgaactataatatgatcattatggatgaagctcacttcacagatcctagtagtatcgcagcacgtggatacataagcacgcgcgtaggaatgggagaagccgctgctatttttatgacagctacaccaccaggtagtgtagaggcttttcctcagtccaacgcagttatccaagatgaagagagagatatacctgaaagaagctggaactcaggatacgagtggataacagatttcccaggaaaaactgtatggttcgtgccttccataaaatcaggtaatgatattgccaattgtttacgaaagaatggtaaacgggttatacaactaagccggaaaacattcgatacagaataccaaaagacaaagaataatgactgggattatgtagtaacaacagacatatcagaaatgggcgccaatttccgggcggaccgtgtgatagacccaagacgatgccttaaaccagtaatacttaaagacggtccggagcgagtaattttagcaggaccgatgccagtaacggtcgcaagtgccgctcagagacggggacgaataggacggaatcacaataaagaaggtgaccagtatatttacatgggtcaacccctgaacaatgatgaagaccacgcacattggacagaggcgaaaatgcttctagataacataaacacacctgaaggtataatcccagctctgtttgagcctgagagagagaaaagtgcagctatagacggcgaataccgtttacgtggcgaggcacgcaaaacatttgtagagttaatgcgtagaggggacctaccagtgtggctatcatacaaggtcgcaagcgaaggatttcagtacagcgatagacgatggtgctttgacggtgaacgcaacaatcaagttttggaagagaacatggatgttgagatttggacaaaagaaggtgaaaggaagaaattaagacctaggtggttggatgcaaggacttattcagaccctctagcgttgcgagagtttaaagaatttgcggcaggcaggaggtctgtctccggagacctcatattggagatcggtaagctaccacaacatctaacacagagggcacagaacgcgctagacaatctagtaatgcttcataattcagaacaaggcggtagagcttatagacacgcgatggaagaattgcccgatacaatagaaacacttatgttattggcccttatcgcagtactgactggcggtgtaaccctcttctttttaagtggacggggtttaggtaaaacatcgataggactattatgtgtaatggccagtagcgtactgttatggatggcgtcagttgaaccgcattggattgcagcatccataattttagagttctttctgatggtgttactaataccagaaccagatagacaaaggacacctcaagataatcaattagcatacgtagttattggattgttattcatgattctaacagtcgccgcaaacgagatgggtcttttggaaaccacaaagaaggatttagggatagggcatgtggctgttgagaaccaccaccacgcagctatgttagacgtggatctgcaccccgcatcagcatggacactttatgctgtggctacgacaataataacccccatgatgaggcatacaatagagaacacaaccgcaaatatttcattaactgcaattgcaaaccaagctgcgattctaatgggattagacaaaggttggcccatatcaaaaatggatatgggagttcctctcttagcgctaggttgctactcacaggtcaatcctttaactcttacagcggctgtactaatgttagttgcacattatgcaataataggaccgggtcttcaagcaaaagcgacaagagaggcacagaaaaggactgctgcaggaatcatgaagaatccaactgtggacggcatagttgccatcgatctcgacccagttgtctatgacgctaaatttgagaagcagttaggacaaataatgctcctaatactttgcacaagtcaaattcttctcatgcggactacatgggcactttgcgaaagcatcactcttgcaacgggtcccttaaccacattgtgggaagggagcccaggcaaattctggaacacgacaatagctgtaagtatggcaaacatttttagaggttcgtacttggcgggagcaggattagccttttctctcatgaaatcgttaggaggcggtagacgcggaactggggcccaaggtgaaacgctaggagaaaaatggaaaagacaattaaaccaattatcaaagtccgagtttaacacgtacaaaagatctggcataatggaggtagatcgcagtgaagctaaagaaggtctaaagcgaggtgaaacaacgaagcatgctgtgtcaagaggcactgctaagctgagatggtttgtagaacggaatctggtcaaaccagagggaaaagtaattgatttgggctgcggaagaggaggatggtcatattactgcgctggactcaagaaagtcactgaagtaaagggctatacaaaaggtggccccggccatgaggaacctattccaatggcgacgtatggttggaatttagtgaagttacactccggaaaggatgtgtttttcataccgcctgaaaaatgtgatacgttactatgtgacataggcgagtcctcaccgaatccaaccattgaagagggtcgaactctacgggtacttaaaatggttgagccttggttacgagggaaccaattttgtataaaaatattaaacccgtacatgccttctgtcgtagagacgttagaacaaatgcaacgtaagcatggagggatgttggttagaaacccgctttcacgcaatagtacacatgagatgtattgggtaagctgtggaacaggaaacatagttagtgcagttaacatgacttctagaatgctattaaatcgttttactatggctcatcgtaagcccacctatgagagggatgttgatttaggggctggaactagacatgtagctgtcgaaccagaagtcgcgaatctagacatcataggacagagaatagagaacataaagcacgagcacaaatcaacatggcactacgacgaagacaacccctataaaacgtgggcttaccatggttcctatgaagttaaacccagtggatccgcatcttccatggttaatggcgtagtaaaactcctcacaaagccgtgggacgtaattccaatggtgacccaaatagccatgactgatactacacctttcggccaacaaagagtttttaaagaaaaagtcgatacacgaacacccaaagcaaaacgagggacagcacagattatggaagtgaccgcaaagtggttgtggggctttctaagtcgaaacaagaaacctcgtatatgcactagagaagaatttacgcgaaaagtacgcagcaacgcagcgataggtgccgtatttgtagatgaaaatcaatggaactccgcaaaagaagcagtagaagatgaaagattttgggatttagtacatcgggaacgagaacttcacaagcaaggaaagtgcgctacttgtgtgtataatatgatgggaaaacgagagaagaaactcggagaatttggcaaagccaagggctcgcgtgcaatatggtacatgtggcttggggccagatttttagaatttgaagcattaggatttatgaacgaggatcattggttctcaagagaaaattcactcagcggtgtagaaggagagggactacataaactaggatacatactcagagatataagtaaaataccaggaggtaatatgtacgctgacgatactgcaggctgggatactcgcatcaccgaggacgatttacaaaatgaagcacgtataacagatattatggaacctgaacatgcactacttgcaaaatcgatatttaaactgacatatcagaataaagtagtgcgggtccaacgacctgcgaagaatggaacggtgatggacgtaatatctagaagggatcaacgaggcagtggccaagtagggacctatggactaaatacatttactaacatggaagcgcaattaataagacaaatggaaagtgaaggaatcttctctccgagtgagttggaaacccctaatttagccgaacgtgtactcgattggcttgagaaatacggtgtagaaagattaaagaggatggcaataagtggggatgattgcgtagtaaaaccaatagatgataggtttgctacagcactaactgcgcttaacgatatgggtaaggtaagaaaggatatccctcaatgggaaccatcaaaaggatggaatgattggcaacaagttcccttctgctcgcaccatttccaccaacttataatgaaagatggccgcgaaatcgtggttccatgccgcaaccaagacgagctagtagggcgggcgagagtgtcacaaggtgcaggctggagcctaagggaaactgcttgcttgggcaagtcttatgcacaaatgtggcaacttatgtactttcaccgcagggacctacgccttgcagctaatgccatctgttcagcagttccagtggattggataccaacaagtcgaacaacttggtctatccatgcgcaccaccagtggatgaccaccgaagatatgctttcggtatggaatagagtatggatcgaagagaatccttggatggaagataaaactcacatttcgtcttggggagatgttccttatttaggcaaaagagaagaccaatggtgtggatctctgattggtcttactgcgagggctacttgggcaacaaatatacaagttgcaataaatcaagtgaggagattaataggaaatgaaaactaccttgactatatgacgtcaatgaaaagatttaagaatgaaagtgacccagaaggagcgctatggtaa

SEQ ID NO: 21575 - RNA, 9879 nt, synthetic construct
  misc_feature 1..9879: note = derived and/or modified CDS sequence (opt6) from DENV-1__FJ461328__SS-prME
  source 1..9879: mol_type = other RNA
tcagtgacaatgttattaatgcttatgcccactgccctcgcgtttcatttgactacccggggcggagaaccccatatgatagtatcaaaacaagaacgaggaaaatccctcttgtttaaaacttctgcaggagttaatatgtgtacacttatagcaatggacttaggagaattatgcgaagatacaatgacttataaatgtccacgaatcacagaagccgaacctgacgacgtagactgttggtgtaatgcaacagacacgtgggttacatacggaacatgcagccaaaccggggaacacaggagagaaaagcgaagcgtagcattagcaccgcatgtgggtttagggttagaaactagaactgaaacatggatgagcagcgagggagcttggaagcaaatacaaagagttgaaacatgggcattaagacacccaggtttcactgtgattgcactcttcttagcacacgctataggaacttctataacacaaaaggggataatatttatcttacttatgctcgtaactccaagtatggctatgaggtgcgtaggaatcgggagtagagactttgtagaaggattaagtggagcaacctgggtagatgttgttttagagcacggatcgtgtgtaacaacgatggctaaagataaacctacattggatatcgaattgttaaaaacagaggtcactaacccagctgtacttagaaaactgtgtatagaagcgaaaattagcaataccacaactgacagtagatgtcctacacagggcgaagcgacattggtggaagaacaggacgctaactttgtgtgtcgtagaactttcgtagatcgcggttggggcaatggctgcggattatttggaaaagggtctcttctgacatgcgcaaagttcaagtgcgttacaaaactagaaggtaagatagtccaatatgaaaatttaaaatatagtgttattgtaaccgtccatacaggtgaccaacaccaagttggtaacgaaagtactgaacacggaacgacagctacgattacaccgcaagcacctacaaccgaaatccaactcacggactacggggcactaactttggattgctcccctagaactggattggattttaacgaaatggtcttgcttacaatgaaggaaaaatcttggttagtacataaacagtggttcctcgatttaccgttaccatggacgagcggagctagcacttctcaggaaacatggaaccggcaagatttgttagtaacatttaagaccgcgcatgcgaaaaagcaagaagtagtcgtattaggctcacaagaaggtgcgatgcacacagcgttaacaggtgcaaccgaaattcaaacctcaggtacaaccaccatattcgcgggtcatctaaaatgtcgtcttaaaatggataaacttaccctaaaaggaatgagttatgtaatgtgtacgggctctttcaaattagaaaaagaggtggcagagacgcaacacggtactgtattagtacaaattaaatatgaaggcacggacgctccctgtaaaatcccattttcaacgcaagacgagaaaggagtaactcaaaacggtagactaattacagcaaatccaatagtaacggataaagaaaaaccggttaatatagaggctgaaccgccatttggagagtcttacatagtaatcggagcaggcgagaaagccttgaaacttagttggttcaagaaaggtagtagcattggaaaaatgttcgaggcgactgccagaggagccagacgaatggcaatcctaggggataccgcgtgggatttcggttcgattggtggcgtgttcacgtccgtagggaagctagtccatcaaatatttggaacagcttacggagtactattttcaggagtcagctggactatgaaaattggaataggtgtgttattaacgtggttaggactaaattctagatcaacttctctctctatgacatgtatcgctgtaggacttgtcaccttatacctcggagtaatggttcaagcagatagtggctgtgtaattaattggaaaggcagagagttgaaatgtgggagtggaattttcgtaacgaatgaagtccacacatggaccgaacagtataaattccaggctgactcgccgaaacggctgtcggctgcgattggtaaagcatgggaagagggcgtatgtgggattcggagtgcaactaggttagaaaatatcatgtggaaacaaatatcgaatgagctaaatcacatcttacttgagaatgacatgaaatttacggtggttgttggtgatgtagccggaatcctagtccaaggcaaaaagatgataagacctcaaccaatggaatataagtattcatggaaatcctggggaaaagcaaagataataggggccgacgtccaaaactctactttcataatagacggaccaaatacacctgaatgcccggatgatcaaagggcgtggaacatttgggaagtagaagattatggtttcggcatatttacaacgaatatatggcttaaactgcgagattcatatactcaggtatgtgaccacaggctgatgtcggcagccataaaagacagtaaagcagtccatgccgacatgggatattggatagagagtgaaaagaatgaaacctggaaattagcacgggcgtcttttattgaggtgaaaacatgcatttggccaaaatcgcacaccttgtggagcaacggagtattagaatctgagatgataattcccaagatacatggtggcccaattagtcagcataactatcgaccgggttattttacgcagactgcaggaccttggcacctcggtaaactagaactggatttcgacttatgcgagggtacaacagtcgtggtcgacgaacactgcggcaaccgaggaccgagcctaagaactaccactgttactgggaagatcattcacgaatggtgctgtcgatcttgtaccctgccaccactaaggtttaggggcgaagatggttgctggtatggtatggaaattcggccagtcaaggaaaaggaggaaaacttggttaaaagtatggtatcggcaggttcaggagaagtcgatagctttagcttaggtctgctatgtatttctataatgatcgaagaagtcatgagatcaagatggtcgcgaaaaatgttaatgactggtacactagctgtatttttcttactaatcatgggacagctgacctggaatgatcttatacgcctatgcattatggtaggtgccaatgcatcggatcgaatgggaatgggcacaacatacttagcactaatggcaacctttaaaatgagaccaatgtttgccgtcggattattattcagaaggctaacatccagagaagtcctcttgctaacaataggattatctttagtagctagcgtggaactgccaaattcactcgaagagttgggagacgggctagcaatgggcataatgatcttaaaacttctaacagactttcaatcgtatcaattatgggccacattactgtccttaaccttcataaagacgacattttcactacactacgcatggaagacaatggctatggtattaagtattgtatcgctttttccactttgtctatcgacaacaagccagaagactacctggctccctgtgctattaggcagtcttggttgtaaacccttaactatgtttttaatagctgaaaacaaaatctggggcagaaaatcttggccattaaatgaaggtatcatggcagttggtatagtgtcgattcttctgtcttcacttctcaaaaatgacgtccccctagcgggaccattaattgccggagggatgctcattgcatgctatgtaataagtgggtcgagtgcagacttgtctttagaaaaagcagccgaagtttcttgggaagaagaagcagaacattcaggagctagccacaatatattggtagaagtacaagatgacggaacaatgaaaataaaggatgaagaaagagacgatacattaactattttattaaaagcaacattattagcagtatctggtgtatatccacttagtattccagcgacgctgttcgtgtggcatttttggcagaaaaagaaacagagatcaggggttttatgggacactccttctcctccggaagtagaacgcgcagtactcgacgatggaatttatcggataatgcagagagggctattaggtcgttcacaagtcggtgttggcgttttccaagaaaatgtattccatactatgtggcacgttacgagaggggcagtactaatgtatcaaggaaaaagattggagccatcgtgggcatccgtcaagaaagatctcataagttatggaggtggttggagatttcaagggagttggaataccggagaagaagtccaagttattgcagtggaacccggcaaaaaccccaaaaacgttcaaaccgcgccagggactttcaaaacgccagaaggggaagtaggagcaatagccctagattttaaaccaggaacatccggaagccctattgtgaatagggaaggtaaaatagttggactctatggaaacggagtcgtcacaacgtctggaacttatgttagcgcaatagcgcaagcgaaagcatcacaagaaggacctctaccagagattgaagacgaagtttttagaaaaagaaacctaacaattatggatctacatccaggtagcggaaaaacaagacgctatcttccggcaatcgttcgggaggcaattaaacggaaattacgaacattgatactagcaccgactagagtagtcgccagcgaaatggcagaagcgttaaaaggaatgccgatacggtatcaaaccaccgccgtaaagtcggaacatactggcaaagaaatagtggatctaatgtgccacgcgacatttacaatgcggctgctgagtccagtacgagtacccaattataatatgattatcatggacgaagcacacttcactgacccaagttcgatagcagcgcgaggttacatatcaacacgcgtgggaatgggagaagccgcagcaattttcatgacagcaactccgcccggtagcatggaagcctttcctcaatcaaatgctgtaatacaagacgaagagagggatatccctgaacgcagttggaacagcggttatgagtggataactgatttcccaggaaaaactgtatggtttgtcccgtctattaaagctgggaatgatatagccaattgtcttcgcaaaaacggtaaaagagtcattcaattgtcaagaaaaacgtttgatacagaataccagaaaactaaaaataatgactgggattatgtagttacgactgatatatcagaaatgggtgcaaatttcagagcggacagggttatagatccaagacgctgcttaaagcccgttattttaaaggatggcccggagcgcgttattttggctggacctatgcctgtcacagttgcatcagctgcccaaaggcgaggacgaatcggaaggaaccataataaggagggcgatcaatatatatacatgggacaacctttaaataatgatgaagatcacgcacactggacagaagcgaaaatgctcttagacaatataaacacaccagaaggcataatccctgcactattcgagccagaacgtgaaaaatcggcagcaatagatggcgaataccgactacgtggggaagctaggaaaacatttgtagaactaatgcgccgtggagatctaccagtgtggttatcgtataaggtggcaagcgaagggttccaatactctgataggaggtggtgtttcgatggtgaacgcaataaccaagttttagaggaaaacatggacgtagaaatatggacaaaagagggcgagagaaagaaattacgtccacggtggttggatgcacgaacatactctgacccattggcactacgagagttcaaagaatttgcagcaggaagaaggagcgtctccggagatttaattctagaaattgggaaacttcctcaacacctaacacaacgagcccagaatgccctcgacaacctcgtaatgttacacaacagcgagcaagggggtagagcctatcgccatgcaatggaggaattgccggacactatagaaacgctcatgcttcttgcactgatagccgtactaacaggcggggtaaccttgtttttcctatctggaaagggacttggaaaaacatctataggactactttgtgtaatggcttctagtgtattactctggatggcgtctgtggaacctcactggattgcagcgagtataatcctagagttctttttaatggtgctcctaattccagagccggacagacaacgaacccctcaagacaaccagctggcttatgtcgttatagggctactattcatgatactgaccgtggcggcgaatgaaatgggacttttagagacaactaagaaagacttaggaataggtcacgtagctgtagaaaaccatcaccacgcagcaatgttagacgtcgatctgcatccggcttcagcatggacactatacgcagttgctactacgataataactccaatgatgaggcatacaattgaaaacacaacagcaaacatcagcttaacagctatcgccaatcaagcagcaatattaatgggtttggacaaaggatggccaatttccaaaatggatataggcgtaccattattagccttgggttgctattcacaagtcaatcctctcactttgacagccgcagtactaatgttagttgcacactacgctatcatcggtccagggttgcaagctaaggcgacaagggaagcacaaaaacgaactgcagctggaatcatgaaaaatcctactatagatggcatagttgcgattgatctcgatcctgtagtatatgacgccaaatttgaaaaacaactagggcaaattatgcttttgatcctgtgcacgtcgcagattttacttatgaggactacttgggcactgtgtgaaagtataactttagctactggcccactaacaacactttgggaaggcagtccaggtaaattctggaacactaccatagcggtatcaatggcaaacattttcagagggtcttatctagctggagcaggtttagcattttcattaatgaaatcccttggcggtggaagacgaggaacaggagcgcaaggtgaaacgctaggagaaaagtggaaacgacaacttaatcaattaagcaaatcagaatttaatacctataaacgttcaggaattatggaggtagatagaagtgaagctaaagaaggtctaaaaagaggagaaaccactaaacacgcagtttcacgtggaacagccaaactccgatggttcgttgaacggaatctggtcaagccagaaggaaaagtcatagacctaggatgtggcaggggcggctggagttactattgcgcggggctcaagaaagtaactgaagtaaagggatataccaagggagggcccgggcacgaggagccgatcccaatggcaacatacggatggaatttagttaagctacatagcggtaaagatgtgttctttattccgcctgaaaagtgcgacactttattatgcgatataggtgaaagttccccgaatcctaccattgaagagggaagaacattgagggtacttaaaatggttgaaccgtggctcagagggaatcaattttgtataaaaatcttaaatccatacatgccatccgtggtcgaaaccctagagcaaatgcaaagaaaacatggtggaatgctagttagaaatccacttagtcgtaatagtacgcatgaaatgtattgggtttcctgtggaactggaaatatcgtcagcgcagttaatatgacttcgagaatgctactcaatcggtttacaatggctcaccggaaacctacatacgaacgcgacgtcgatttaggagcaggaacccgacatgtagctgtagagccagaagtagcaaatttagacataattggtcaaagaatcgaaaacataaagcatgaacacaaatctacctggcattatgatgaagataatccttataaaacctgggcatatcacggaagttacgaagtaaaaccaagtggatctgccagtagcatggtgaatggtgtagtaaaattattaacgaaaccgtgggacgttataccaatggtgactcaaattgcaatgacggacactacgccatttggccaacaacgagtgtttaaagaaaaagttgataccaggacaccaaaggcaaagcgcggtactgcacagatcatggaagtaacagccagatggttatggggctttttatctagaaataagaaaccaagaatatgtaccagagaagagttcacaagaaaagtccgatctaacgcagccatcggtgcggtatttgtggacgagaaccaatggaatagcgctaaggaagcagtcgaagatgatagattctgggacttagtgcatagggaaagagaacttcataaacaagggaaatgtgctacttgtgtgtataatatgatgggaaaacgagagaagaaactaggtgaatttggtaaagccaaaggttctagggcaatatggtatatgtggttaggtgcaaggttcctagagttcgaagccttaggatttatgaacgaagaccattggttctccagagaaaatagtctgtctggagttgaaggggaaggattgcacaaactaggttacattcttagagatattagtaaaataccaggaggaaatatgtatgctgatgatacagccggatgggacacccgtatcacagaggacgacttacaaaacgaagctaagatcactgatataatggaaccggaacacgctctacttgcaaaaagtatttttaaactcacttatcaaaataaagtagtaagagtacaaagaccagccaaaaacggtacagttatggacgttataagtcgaagggaccaacgagggtcggggcaagtgggcacctatggtctaaatacgtttacaaatatggaggcgcaactcataaggcaaatggagagtgaaggtatatttttaccaaacgaactcgaaactcccaatctcgctggcagagtacttgattggctggaaaaatatggagtggaacgcctaaaacgaatggcgataagcggtgacgattgcgttgttaaaccaatagacgatcggttcgccacggcattaactgctttaaatgatatgggtaaagtaaggaaggatatacctcaatgggagcccagcaaaggatggaatgattggcagcaggtacctttctgctcgcaccattttcaccaactgataatgaaagacggacgtgagattgtcgtcccttgccgtaaccaagatgagctagtcgggagagcacgcgtgagccaaggtgctggatggagtttgagggaaaccgcatgtctcggaaaatcatacgctcaaatgtggcaactaatgtattttcacagacgcgatcttagacttgctgcaaatgcaatatgtagtgctgtacctgtagactgggtgccgaccagtcgaactacgtggtcaatacacgcacatcatcagtggatgacgaccgaggacatgttatcggtatggaatagagtatggatagaagaaaatccatggatggaggacaaaacaaggatcagtagttgggaggatgtcccctacctaggaaaacgagaagaccaatggtgtggatcactaataggactaacagctagggcaacatgggcgacaaatatccaagtagcgatcaatcaagttcgaagactgataggaaatgaaaactacagtgattatatgacatctatgaaaaggtttaagaatgagtctgaaccggagggagcactatggtaa

SEQ ID NO: 21576 - RNA, 9879 nt, synthetic construct
  misc_feature 1..9879: note = derived and/or modified CDS sequence (opt6) from DENV-1__FJ410234__SS-prME
  source 1..9879: mol_type = other RNA
agtgtaactatgttattaatgttaatgccgacagctctcgccttccatttgacaacaagaggaggagagcctcatatgatagtttcaaaacaagagcgtggcaagtctctgttatttaagacaagcgcaggtgttaatatgtgcacgctaatcgctatggacttaggtgaactgtgcgaagatactatgacatataaatgccccagaataactgaagcagagccagatgatgtagattgttggtgtaacgcaacggacacttgggtaacgtatggcacttgctcccagaccggggaacataggagggacaaaagatctgtggccttagcacctcatgttggactaggcttggaaacacggaccgaaacttggatgtcctcagagggagcgtggaaacaaattcagagagtcgaaacatgggctttacggcacccaggattcacagttatagcgttattcttagcacatgctataggtacgtcgattacgcaaaaaggaataattttcattctactaatgctcgtaaccccttcaatggctatgcgttgcgtcggcataggaagcagagattttgtagagggcctatcgggagcaacatgggttgatgtcgtcctcgaacacggatcctgtgtgacgactatggctaaagataaacctacattagacatagagctcttaaaaaccgaggtgacaaatccggcagttttaagaaagttatgcattgaagctaagatcagtaatacgactacggacagtagatgcccaacgcaaggtgaagcaacactcgtagaagagcaggatgctaattttgtttgtcgtagaactttcgttgaccgaggctggggaaatggctgcggcctgtttggtaaaggatcgctcattacgtgtgctaagtttaaatgcgtcacgaaactggaaggcaaaatcgttcagtatgaaaacctaaaatatagtgtcatagtaactgtacacacaggggaccagcaccaagttggaaatgagagcaccgaacatggaacgacagcgacaattacaccgcaagctcctactacagaaatacaattgacagattatggtgcgcttactttagattgttcaccgagaactggactcgatttcaacgaaatggttctgctgactatgaaagaaaagagttggctagttcataagcaatggtttctagacctgccattaccatggactagcggcgctagcactagtcaggagacttggaacagacaagacttactcgtgacttttaaaactgcgcacgcgaagaaacaggaagtagtagttctcggatcgcaggaaggagcaatgcatacagcattaactggtgccaccgaaatacaaacttcaggaactacaactatatttgcggggcatttaaaatgtaggttaaagatggataaacttaccctgaaaggtatgagctacgtaatgtgtacgggatcttttaagttagagaaggaagtggcagagacacagcatggaactgtactagtacaaataaaatatgaaggcacagatgcaccctgcaagattccctttagtacacaagacgagaaaggcgtcactcaaaacgggagattaataaccgctaatcccattgttaccgacaaagagaagcctgtcaatattgaagctgaacctccattcggagagagttatattgttataggggcgggtgaaaaagctctgaaattatcctggttcaagaaaggaagttctatcggaaagatgtttgaagctacagcaagaggagcgcgaagaatggcaatactaggcgataccgcatgggactttggaagtataggcggagtattcacctcagtgggtaaattagtacaccaaatatttggaacagcatatggagtattatttagtggagtaagctggacgatgaaaatcgggataggggttctgctaacgtggttagggttgaattcaagatctacaagcctgagcatgacttgcatagctgtcggattagtaaccctttacttaggcgtgatggtgcaagccgatagcgggtgtgttataaactggaaaggccgagaactgaagtgtggctcgggcatttttgtgactaatgaggttcacacatggacggaacaatataaattccaagctgattcgccaaaacgattgagtgcggctataggaaaagcttgggaagagggtgtatgtggaataagaagcgctactcgattagagaacatcatgtggaaacagatctcaaatgaattaaaccatatcctattagaaaatgatatgaaattaaccgtagtggttggagatgtcgcagggatattgggacaaggcaaaaaaatgataagaccacaaccaatggaatataaatatagctggaaatcatggggcaaagcaaaaattattggagctgacgcccaaaatacaacattcattatagatggtcctaacactccggaatgtccagatgatcaaagagcgtggaatatatgggaagtagaagactatggatttggtatttttacgacgaatatatggcttaaactgcgggattcttatacacaggtttgtgatcatcgactaatgtcagcagcaattaaggattcgaaggcagtacatgcggacatgggatactggattgaatcggaaaaaaatgaaacatggaaattagcacgcgctagttttatagaagtaaaaacttgtatatggccgaaatcacatacactatggtcaaacggtgtactcgagtcagaaatgataataccaaaaatatacgggggcccaataagccagcataattatagaccgggatatttcacgcaaacagccggcccttggcacctcggcaaacttgaactggatttcgatttatgtgaaggtaccacggtcgtcgtagacgagcattgcggtaaccgaggaccttctcttcgaactaccactgtaacagggaagataatacatgagtggtgctgcaggtcatgtaccttgccgcctttacgattcagaggtgaggatggttgttggtacggcatggagataagacctgttaaggagaaagaagaaaacttggtcaagtcaatggtttctgcagggagcggcgaagttgattcattctccttaggactgctgtgcatcagtattatgatcgaagaggtcatgcgaagtagatggagtcgaaagatgttaatgacgggtacgttagcagtgttttttctattgatcatgggccagctgacttggaacgatttaattaggctatgtattatggtcggcgcgaacgcctctgaccgaatgggcatgggcacaacctatttagcactcatggccacgtttaagatgcgacctatgttcgctgtaggtctgttatttagacgtttaacatcaagagaggtacttctcctgacgataggtttatcactggtcgcgagcgtagaactcccctcaagtcttgaagaattaggagatgggctggcaatgggaatcatgatcctgaagctgcttactgatttccaaagtcatcaactgtgggcaactctcttatcactaacttttattaaaacagcattcagcttacattatgcatggaaaacgatggctatggtattaagcattgtgtcattatttcccctatgtctctcgacaacaagccaaaagacaacttggttacctgttttattaggttctctaggctgcaaaccattaactatgttcttaattgcagagaataaaatttggggacgcaagtcatggccattaaatgaaggaattatggctgtaggaattgtatcgatattgttgtcttcactgttaaaaaatgacgtccccttagctggcccgttaatcgccggaggaatgttaatcgcgtgttatgtgataagtggttcaagtgctgacctatcacttgaaaaagccgcagaagttagttgggaagaggaggctgaacatagtggtgctagccataatatccttgtagaggtccaagacgatggaacaatgaaaatcaaagatgaagaacgcgatgacacacttaccatacttctcaaagcgacgcttttagccgttagtggtgtttacccgttaagtataccagcaacactatttgtctggtacttctggcaaaagaaaaaacaaagaagcggagtcttgtgggacactccaagtcctccggaagtagaaagggcagtcttagacgatggaatttatcgtatcatgcaaagaggcttattaggacgtagccaagtaggtgtaggggttttccaagagaatgtattccatacaatgtggcacgtgacacgcggtgcggtcctcatgtaccaagggaaaagattggagccatcatgggcaagcgttaaaaaagatcttatcagttacggtggtggttggagattgcgcggatcatggaatactggagaagaagtccaggtaatagcagtagaaccgggaaaaaatccgaaaaacgtacagactgcacctggaactttcaagacgccagaaggggaagtcggagcgattgctcttgacttcaagcctggcacatcgggatcaccgattgtaaatagagaaggtaagatagttggattatatggaaacggagtagtgacaacgtcgggtacatatgtttcggcaatagcgcaagctaaagctagtcaagaaggaccactgcccgagatagaggatgaagtattccgaaaacgcaacttaacgatcatggacctgcatcctggaagtggtaaaacgagacgatatcttcccgcgatcgttagagaagcaatcaaaaggaagttacggacattgatcctagcgccaacaagggttgtggcatctgaaatggcagaagcattaaagggaatgccgattagatatcagacaaccgcagttaaaagtgaacacaccggtaaagagattgtcgacttaatgtgtcatgcgacatttaccatgcgcctactaagtcccgtcagagtcccgaactataatatgataatcatggatgaagcacactttactgatccgtcgagtatagctgctagagggtatataagtactagagtagggatgggtgaagcggcggctatattcatgaccgctactcctccagggtcagtggaggcatttcctcaatcgaatgcggtaatacaagatgaggaaagagacattccagaacgatcatggaattcaggatacgagtggattactgatttccctgggaaaactgtatggtttgttccaagcataaaatctggaaatgatatcgcaaactgtttaagaaaaaacggtaaaagagttatccaattgtcgagaaaaacatttgatacagagtatcagaaaacgaaaaacaacgattgggactatgtagtaacaacagacataagcgagatgggggcaaatttccgcgcggacagggtaatagaccctcgcagatgcttgaaaccagtaatattgaaagatggacccgaaagagtgatattagccggacccatgccagttacggtggcatcggctgcacaacgaagaggaagaatcggaaggaaccacaacaaagagggggatcaatacatatatatgggacaaccgctaaataacgatgaagatcatgcacactggacagaagcaaaaatgctactagataatataaatactccagagggcattataccagctttatttgaaccggaacgtgaaaaaagcgcagcggtagacggggagtaccgactacgcggagaagcgagaaagacatttgtagagttaatgaggagaggagacctacctgtctggctgtcatataaagttgcatcagaaggatttcaatactcagatagaagatggtgctttgacggtgaacgaaataaccaagtgctagaagaaaacatggacgtagaaatatggacaaaggaaggagaaagaaaaaaactacgtccgcgatggctcgacgcaagaacgtacagtgatccgttagcgctgagagaatttaaagaatttgcagcgggtagacgaagtgtttcgggagatctaatattggagatcggaaaactaccccaacatttaactcaaagggcgcaaaatgcattagataatctagtcatgctacataacagtgaacaaggaggtagagcatataggcatgccatggaagagttgccagacaccattgagactttgatgctattagcgctaatcgccgtcctaacaggaggagtaacactgttcttcttaagcggaagggggttaggcaaaacttcaatcggtttgttatgcgtgatggcatcatcagtcctactgtggatggcctcagttgagccccattggatcgcagcaagtatcatcttagagttttttcttatggtactcttaatacctgagcccgatagacaaagaactccacaggataaccaacttgcttacgtggttataggcctactatttatgatactaactgtagcagcgaatgaaatgggattattagaaacaacaaagaaagacttaggcatcgggcatgtagcagtagagaaccatcatcatgcagcgatgcttgacgtagatctacatccagcgtccgcatggacattgtacgcagtcgccactactataattactccgatgatgcgtcatactatagaaaatacgaccgctaatattagcttaacagcaatagctaaccaagcggcaatattaatgggactagataagggttggccaatatcaaaaatggacataggcgtccctcttcttgcactgggatgttactcacaagttaacccattgactttgacagctgctgtattaatgttagtagcgcactacgctattatcggtccaggattgcaagcaaaagccactcgagaagctcaaaaaaggacagcagcaggcataatgaaaaatccaacagtagatggaattgtagcaatagacctagatcccgtcgtatatgacgcgaagtttgagaaacaactgggacagataatgttattaattctttgtacctcacaaatattgcttatgcgaacaacttgggcgttatgtgaaagtatcaccttggccacaggacctttaacaacattatgggaaggaagcccaggaaagttttggaataccaccatagcagtaagtatggcaaacattttcaggggatcatacttggcaggtgctggcttagcttttagtctaatgaagagcctgggaggaggacgacgcggcacaggcgcccagggagaaactttaggagaaaaatggaagcggcaactaaatcaactgtcgaagtcagaatttaatacttataaaagatccggaatcatggaagtggatagatcagaggccaaggagggtttgaagcggggagagacgacaaaacacgcagtaagtagaggaacggcaaaactcagatggttcgttgagcgaaatttagtaaagcccgagggtaaagtaatagacctgggatgtggaaggggtggttggagctactactgtgctgggcttaaaaaggtaacagaagtaaaaggttacacgaaagggggaccaggacacgaagaaccaatacccatggctacatatgggtggaatttggtcaaacttcattcaggcaaagacgtattcttcataccgcccgaaaaatgcgacactcttctttgcgatatcggggaatcatctccaaatcccacaatagaagaaggtagaacactacgtgtcttaaagatggtagagccctggcttcgtggaaatcaattctgtataaagatactgaatccatatatgccatccgtggtggaaaccctagaacaaatgcagagaaaacatggaggaatgttagtgagaaatccactatcccgaaatagtacacatgaaatgtactgggtaagttgcggaacagggaatattgtttctgcagttaatatgacttccaggatgctactaaatcgattcaccatggcccacagaaaaccgacttatgagagagatgtggatttaggaacaggcacccggcacgtagcagttgaaccggaggttgcaaatctagatattatcgggcaacggatagaaaacattaagcatgagcacaagtcaacttggcattatgatgaagataatccgtacaagacatgggcataccacggcagctatgaggtgaaaccatcaggaagcgccagtagtatggtcaatggtgttgtaaagctacttactaaaccttgggatgtcattccaatggttacacaaattgcaatgacagatacaacaccatttggccagcagcgagtatttaaagaaaaagtcgacactaggacgccaaaagcgaaaagaggtactgcacaaataatggaagtgactgctagatggctttggggattcctatcgaggaataagaaaccaagaatttgcactagagaagagttcactagaaaggttagaagcaatgcagctatcggagccgtgttcgtagacgaaaatcaatggaactcagccaaggaggccgtcgaggatgaaaggttttgggacttagtgcatcgtgagagagagttacacaagcaggggaaatgtgcaacgtgcgtctataacatgatgggaaagagagaaaaaaaacttggtgaatttgggaaagcgaaggggagtagagccatatggtatatgtggctgggtgcacgattcctggagtttgaggcattgggattcatgaatgaagaccattggttcagtagagaaaacagtttatccggcgtggaaggcgaaggactacacaagctaggttatatcttaagggatataagtaaaatacctggaggaaacatgtatgccgatgacactgcgggctgggacacaagaataaccgaagatgatttgcaaaatgaggccaagatcacagatattatggaaccagaacatgctctcttggcaaaagctatatttaaactaacttaccaaaataaagttgtgagagtacaaagacctgctaaaaacggcactgttatggacgtgatatcacgaagagaccaaaggggaagtggacaagtgggaacttatggcttaaatacatttaccaacatggaggctcagctcatacgtcaaatggagtcggaaggtattttttcaccttcagaattggaaactccaaatttagcagaaagagcactagattggttagaaaaatacggagttgaaagattaaaaagaatggcgataagtggtgacgattgcgtcgtcaaaccaatcgacgaccgatttgcaacagctctaacagcactgaacgatatgggaaaggttaggaaagatataccacaatgggaaccatccaaaggttggaatgactggcaacaagtcccattctgttcacatcatttccaccaactgattatgaaagacgggagggagattgtggtaccatgccgcaaccaagatgaactcgtaggtagagcacgagtatcgcaaggagctggctggtcattaagagaaacggcgtgccttgggaagtcatatgcacagatgtggcagcttatgtactttcataggcgagatctaaggttggctgcaaacgccatctgtagtgctgttccagtggattgggtaccaacatcacgaactacttggtcaatacacgctcaccatcaatggatgacgaccgaagacatgttatctgtgtggaatagagtttggatagaagaaaacccctggatggaggataaaacacatataagttcgtgggaagatgtgccttatctggggaagagagaagatcaatggtgcggttcattgataggactcacagccagagctacatgggccacgaatattcaggtagcaataaaccaagtccgtcgcctaatcggtaacgaaaactatcttgattacatgacatctatgaaacggtttaaaaatgaatcagaccccgagggagcactctggtaa

SEQ ID NO: 21577 - RNA, 9879 nt, synthetic construct
  misc_feature 1..9879: note = derived and/or modified CDS sequence (opt6) from DENV-1__FJ410235__SS-prME
  source 1..9879: mol_type = other RNA
tcagtgacaatgttacttatgctgatgcccacagctttggcctttcatttaacgactagagggggtgaacctcacatgattgtgtccaaacaagaacgaggtaaatccttgctctttaaaacaagtgccggggtcaatatgtgcacacttatagcgatggatttaggagagttttgcgaagatacaatgacgtacaaatgccctagaataacagaagctgaacccgatgacgttgattgttggtgtaacgcaaccgatacatgggttacatatggcacatgcagccaaacaggagaacatagaagagataaacgatctgttgcactcgctcctcacgttggtcttggcttagaaactcgtactgaaacttggatgagcagcgagggtgcatggaaacaaatacaacgtgttgaaacatgggctttacgacatcctggattcaccgttatagcactttttctagcacatgcaataggcacgtccataactcaaaagggtattatatttatattacttatgctggttacacctagtatggctatgagatgtgtcggtataggttctagggattttgtagaaggtctatcgggagcaacttgggttgacgtcgtactcgaacacggatcatgtgtaaccacaatggcaaaagacaagcctaccttagatatcgaacttctcaaaacggaagtaacaaacccggcagtactacgaaaactatgtattgaggcgaaaataagcaatactaccaccgattcgagatgtcctacacaaggtgaggccacactcgtggaggaacaagatgctaatttcgtatgtagacgaacttttgtggatagaggatggggaaatggttgcggcttattcggcaaaggatctctgataacttgcgctaaattcaaatgcgtcaccaaactagagggaaaaacagtacaatatgaaaatctaaaatatagcgtaatagttaccgttcacactggtgatcaacaccaagtaggtaacgaatctacagagcatggtacaactgcaaccataacgccccaggctccgtctaccgaaatacaattgacagactatggggctttgacattagattgctcacctcgaacaggtttggattttaatgaaatggtactgttaacaatgaaggaaaaatcatggcttgttcataaacagtggttcttggatctacctctaccgtggacaagtggggcatctacctctcaagaaacatggaataggaaagatctcctagttacttttaaaacagcacatgcgaaaaagcaagaggtagtggtactggggtcacaagaaggggctatgcataccgcacttaccggggcgaccgaaatccaaacaagcggcacaactactatcttcgcgggtcatttgaaatgtcgattaaagatggataagctaactctaaaaggcatgagctatgtcatgtgcaccggcagcttcaaacttgagaaagaagttgcagagacccaacatggtactgtgttggtacagattaagtatgaggggacagacgctccctgtaagataccgttcagtacgcaagatgaaaaaggagtaacgcaaaatggtagattaataactacaaaccctatagtaacggataaagaaaagccagtaaacatagaagcggagcctccatttggggagagttacatcgtgataggagctggtgaaaaggctctaaaattatcttggttcaagaaagggagtagtattggaaagatgtttgaggctacggcgcgtggggcacggagaatggcaatattaggggataccgcctgggatttcggaagtatcggaggggtatttacaagcgtaggaaaattggtgcatcaaatatttggtaccgcatatggtgtactcttcagtggtgtgtcctggacaatgaaaatcggaatcggtgtacttctcacttggttaggcttgaacagccggagcacgagtcttagtatgacatgcattgccgttggtttggtaacattgtatttaggagtaatggttcaagctgactcaggatgcgttataaactggaaaggtagagaattaaaatgtggaagtggtatattcgtaactaacgaagtacatacatggacagagcaatacaaatttcaagcggattcacccaaaaggctgtcagcggcaataggaaaagcctgggaagagggcgtttgtggaatcagatccgcaaccagattagagaacataatgtggaaacagataagtaacgaacttaaccatattttacttgaaaatgacatgaagtttacagtggtagttggtgacgtagctggcattttagcgcagggcaagaaaatgattcgaccacaacctatggaatacaaatactcgtggaagagttggggcaaagctaaaattattggagcagacgttcagaataccacatttattattgacggcccaaatacacccgaatgtccagacgaccaaagagcgtggaatatttgggaggtagaagactatgggtttggtatatttaccaccaatatttggttgaaattgagggactcatatacacaagtttgtgaccacaggctaatgagcgcagctataaaagattccaaagcagtacacgcggatatggggtattggatcgagtcagagaaaaatgagacttggaagctggcccgcgcgtcgttcatagaggtaaaaacatgcatctggccaaaatcccatactctctggtccaacggagtgttagagagtgaaatgatcgttccaaagatatatggagggccaataagtcaacataactacagaccaggctacttcacacaaactgctggcccttggcacctcgggaaattggaactagattttgatctttgtgaagggactacagtggtagtggacgaacactgcggaaataggggaccttcattaagaacaacaactgtaacaggcaaaattatacatgagtggtgctgtagaagctgcacattaccaccattaaggttcaagggagaagatggatgttggtatggaatggagatacggcccgtgaaggaaaaagaagagaatttagtgaaaagtatggtgtcagcagggagtggagaagtagactcattcagtttaggccttctatgtatttctataatgatagaggaggtaatgcgatccaggtggagtcgtaagatgctcatgaccggaactttggctgtattctttttacttattatgggtcagttaacatggaatgatctaattcgtttgtgtatcatggtgggcgcaaatgctagtgatagaatgggaatgggaactacatatcttgctctaatggcaactttcaaaatgagaccaatgttcgccgtcggtctattgtttcgacgattaacatcaagagaggttctgctgttgacaataggtctctctctcgttgcgtcggtagaactgcctaatagtttagaagaactaggtgatggtctagcaatgggaattatgattcttaaactcctaaccgattttcagagccatcaactttgggcaacacttcttagtcttacattcattaaaacaactttcagtttgcattacgcctggaaaaccatggcaatggtattaagtatagtgagcttattcccattatgtctgtccacaacatcacagaaaacgacatggctaccggtactactggggtcgctcggatgtaaacctctgactatgtttttaatagcggaaaacaaaatctggggaagaaagtcatggcccctcaacgaaggaatcatggccgtaggaatagtttcaatactcttaagttctctactaaagaatgatgtacccctagctggaccactaatagccggaggtatgttaatagcatgttatgtcataagtggaagttcagccgatttgtcacttgaaaaagcggctgaagtttcgtgggaagaggaagctgagcactctggtgcctcacataatatcttagtggaagtccaagatgacggaaccatgaaaattaaagacgaagagagagacgatacattgacaattcttctcaaagcgaccctcctggccgtttcaggagtatatcctctttcaatccctgccacattatttgtatggtatttctggcagaagaagaaacaacgaagtggagttctatgggacactcctagtccacccgaagtcgaaagagccgtattagacgacggaatttatagaataatgcaacgcggtttacttggcagaagtcaagttggagtaggggtctttcaagagaatgtgttccacaccatgtggcatgttacaagaggggctgtactaatgtaccagggaaaacggctcgaaccgtcctgggctagtgtgaagaaagatttaatctcatatggaggaggatggagactacaaggatcatggaatactggtgaagaagtccaggtcattgccgtagaaccaggcaaaaaccctaaaaacgtacagacagcacccggaacatttaaaacatcagagggggaagtaggtgcaatagcccttgattttaaacctgggacgtcgggcagcccgatagtgaaccgagaaggtaaaattgtgggactttacggaaatggcgtcgtgacaacttcggggacttatgttagtgctatagcgcaagccaaggcttcacaagaaggacctttaccagaaatagaagatgaagtgtttagaaaacgaaaccttactattatggatctacatccaggttcaggaaaaacccggcgttacttacccgcaatagtcagggaagctataaaaagaaaattgcgtactctaattttagccccaactagagtggttgcgtctgaaatggcagaagctctcaaaggaatgcccatacgatatcagaccactgctgttaaatctgaacacacaggaaaggaaatcgtggacttgatgtgtcacgcaacctttactatgagattactaagtccagtaagagtcccaaattataatatgataatcatggacgaagcacacttcacagatccctctagtattgccgcccgaggttatatctcaacgagagtaggcatgggagaagctgcggcaatattcatgaccgcaacgccgcctggcagtgttgaagcatttccacaaagcaatgcaattattcaggatgaagaacgagatatacccgaacgatcctggaacagtggttacgagtggataactgatttccccggtaaaactgtttggttcgtaccttcgataaagtcaggtaatgatattgctaattgccttagaaagaacggaaagagggtaatacaattatcacgcaaaacgtttgataccgaatatcagaaaactaagaacaatgactgggattacgtcgtcacaacggatataagtgagatgggagcgaactttagggcagatagagtgatagatccacgaaggtgtttgaaaccagtgatcttaaaagatggtccagaacgagtaatactggccggacctatgccagtaactgtggcgagcgcagcacaacgacgcggtaggatcggtaggaatcacaataaagaaggagatcaatatatttatatgggccaacctttaaataacgatgaagatcatgctcattggacagaagccaagatgttgctagacaatatcaacacaccggaaggaataattccagccttatttgaacctgaacgagaaaagagtgcggcaatcgatggagagtatcgactaagaggggaggctcgaaaaacttttgtcgaacttatgcgtaggggtgatctacccgtctggctatcatataaagttgccagcgagggttttcaatactctgatagaagatggtgtttcgatggagaaaggaataaccaagtactcgaagaaaatatggacgtagagatatggacgaaagaaggagaaaggaagaaattaagaccaaggtggttagacgcaagaacgtactccgaccccctagcactaagagaatttaaagagtttgccgccggaagaaggtcggtaagcggagatttaattttagagataggaaaattacctcaacatctcactcaaagggcacagaatgcacttgataacctcgtgatgcttcataactcggaacagggagggagggcatataggcatgcaatggaagaacttccggacacgatagaaactttaatgctgttagccttaattgctgtcttaacaggtggtgtcactctgttctttctctcagggcgaggtcttggcaaaacgtctataggattgttatgcgtaatggcaagtagcgttctactatggatggcatctgtagagccccattggatagcagcttccataatcttagaatttttcctaatggttcttctgattccggaaccagaccgacaaagaacaccccaggataaccaattagcctacgtagtcatcggcttactttttatgattctaacagtggctgccaatgaaatgggattgctagaaacaacaaagaaagacctaggtataggtcacgttgccgttgaaaaccatcaccatgcagccatgctcgacgtagatttgcatccggccagtgcatggactctttacgctgtagccacaacgattataacaccaatgatgcggcatacaatcgaaaacacgactgctaatataagtctgacagctatcgcaaatcaagcagcgattctaatgggtctggacaaaggttggccaatttctaaaatggatataggtgtacctttattagcactagggtgttatagtcaagttaatccacttacactcacagcggcagtattgatgttggtggcacattatgcaataatcgggcctggattgcaagcaaaagcgacgagggaagcacagaaaaggacagcagcaggaatcatgaaaaatcccacggtagatggaattgttgcaatagacttggaccctgttgtttatgacgctaaatttgaaaagcaattaggacaaataatgctcttaatattatgcacgtctcaaatactactgatgaggacaacctgggcattatgtgaaagcataactctagcaaccggcccattaactaccctctgggaaggatcaccgggtaaattttggaatactaccatagccgtaagcatggctaatatttttagaggatcatatctagcgggagctggtttagcttttagcctaatgaaatcattaggaggaggccgaagagggacaggtgcccaaggtgaaacattaggggaaaaatggaagagacaactcaaccagttaggaaaaagtgaatttaatacatacaagaggagcggtataatggaagtagacaggtccgaagcgaaagaagggttaaaacgaggcgagaccactaaacatgcggtttcacgaggaaccgcgaaattaagatggttcgttgaaaggaatctagtcaagcctgaagggaaagtaatagatttagggtgcggacgaggagggtggtcatactactgtgcgggactaaagaaagtaacggaggtaaaaggttatacgaaagggggtcccggacatgaagaacccattccgatggctacctatggatggaatttggtaaaattacatagcgggaaagatgtcttctttattcctcctgagaagtgcgacactttgttatgtgatataggagaatcgtcaccgaatccaacgatcgaagaaggcagaacactcagagtcctgaaaatggttgagccctggctcagaggcaatcaattctgtataaaaatattgaacccctacatgccctccgtagttgagacattagaacaaatgcaacgtaaacacgggggaatgttggtgagaaatccactgtcgcgaaactcaacccatgagatgtattgggtatcgtgtggcaccgggaacatagtatcagcagttaatatgacctctaggatgctactaaaccggtttacaatggcacataggaagcctacttatgagagagatgtggatctcggtgccgggacgcgtcatgtagcagttgaaccagaagttgctaatttagacattattgggcaaagaatcgagaatatcaaacatgaacataaatcaacctggcattacgatgaggataatccatataaaacctgggcataccacggaagttacgaagtgaaaccatcgggtagtgcttctagcatggtaaacggtgtagttaaattattaactaaaccgtgggatgtcattcccatggttacacagatagcaatgaccgatactacaccattcggtcaacaaagagtgtttaaagaaaaagtagataccaggacaccgaaggccaaacgtggtacagcgcaaataatggaagtgacggcaaagtggctatggggatttttaagtagaaataaaaagccaagaatatgtacgagagaggaatttactagaaaagtaaggagtaatgcagctattggagcagttttcgtcgacgagaaccagtggaactcggcaaaagaggctgtagaagacgaaagattttgggacctggtacatagggaacgagagttgcacaagcaagggaaatgtgcaacttgcgtgtacaatatgatgggaaaaagggaaaagaaattgggtgaatttggaaaagcgaaaggaagccgagctatttggtacatgtggctaggagcaaggttccttgaatttgaagctcttggtttcatgaacgaagatcattggtttagcagggagaatagtttatcaggagttgaaggtgaaggactgcacaagttaggatatattttgcgtgacatatcaaaaatacctggaggcaacatgtatgcagacgatacagccggatgggacacacgcataaccgaagatgatctgcaaaacgaagctaagatcactgatataatggaaccagaacatgcacttctcgcgaaatctatctttaaactaacctatcagaataaagtggtaagagtacaacgcccagctaaaaacggtaccgttatggatgtaatcagtaggagagaccaaagaggatctggccaggttggaacttatgggctgaatacattcactaacatggaagcgcaactgataagacaaatggagtctgaaggaatattcagcccaagcgagttagagaccccaaatctagcaggaagagtactagattggctagagaaacatggggtcgaaagattaaagagaatggcaatatcgggagatgactgtgtagtaaaacccatagacgacagatttgccacagctttaactgcattaaacgatatgggtaaggtacgaaaagatataccccaatgggaaccatctaaagggtggaatgattggcaacaagtgccattttgctctcatcacttccatcaacttattatgaaggatggtagagaaatagtagtcccctgcagaaaccaagacgagctcgtgggacgtgcacgagtatcacaaggagctggatggagcttgcgagaaacggcatgtttagggaaatcctatgctcagatgtggcaactaatgtattttcacagacgtgatctacgactagctgccaacgccatttgtagcgcggtacctgtagattgggtcccaaccagcaggacaacttggagcatacatgcacaccaccagtggatgactacggaagatatgttgtctgtatggaatagagtgtggatagaagaaaatccatggatggaagataaaacacatatatcatcgtggggagatgtaccctatctgggaaagagagaggaccaatggtgtggatcattaataggactgactgctcgagcaacttgggctactaacatacaagtagccataaaccaggtgcgtagacttataggtaatgaaaattatctcgattacatgaccagcatgaaacgatttaaaaatgaatctgacccagagggtgcattatggtaa

SEQ ID NO: 21578 - RNA, 9879 nt, synthetic construct
  misc_feature 1..9879: note = derived and/or modified CDS sequence (opt6) from DENV-1__FJ410236__SS-prME
  source 1..9879: mol_type = other RNA
agcgtcacgatgttattaatgcttgtaccaacagcacttgcgtttcatctcactactcgcggaggagaaccgcatatgattgttagtaaacaagaacgaggtaaatcactcttattcaaaacttcagcgggagtaaatatgtgtacacttatagcgatggatttaggagaattatgtgaagacacaatgacatacaaatgtccgagaataacagagacagaaccagacgatgttgattgttggtgtaacgcaactgacacgtgggttacttatgggacgtgtagtcaaacgggtgagcatcgaagagataaacgttcagttgcattagctcctcatgtcggtttaggtctagaaacaagaacagagacatggatgagctcagaaggggcttggaaacaaatccaacgagttgaaacatgggcattacgacatccaggtttcacggtcatagcactgttccttgcacacgcaatcggtactagcataacgcaaaaagggataatctttatcttacttatgttagtgactcccagcatggcgatgagatgtgtaggtattggatctcgtgattttgtagaaggactaagcggggcaacgtgggtggatgttgttcttgaacacggtagctgcgttacaaccatggcaaaagacaaacctactctagacattgagttgttaaaaaccgaagtgactaacccagcggtcttaaggaaattatgcattgaggcaaaaatctcaaacaccacaacggatagtagatgccccactcagggggaagctacattggtagaggaacaagatgccaatttcgtctgtcgacgtacatttgtcgatcgaggttggggaaatggatgcggattattcggtaaaggttcgctcatcacatgcgcaaaatttaaatgcgtgacgaaactcgaagggaagatagttcaatacgagaatttgaaatacagcgtcatagtaactgtacatactggggaccaacaccaagttggaaatgaaagcacagaacatgggaccactgcaacaattactcctcaggcaccgacaacagaaatccaactaaccgattacggtgcacttacattagattgctcgcctagaacagggctagattttaacgaaatggtgttactgacaatgaaggagaaatcatggctggttcacaaacaatggtttttagatcttccgttaccttggacatcaggggccagtacctctcaagaaacatggaatcgccaagatctattagtaaccttcaaaaccgctcatgctaagaaacaagaggttgttgttctcggatcccaggaaggagccatgcacacagcactcactggagctacggagatccaaacgagcggaactacaacgatatttgcaggacatctaaagtgcagattgaaaatggacaagttgacattaaaggggatgagctatgtaatgtgtacgggatcttttaagttagaaaaggaggtcgcagaaacgcagcatggaacggttttggtacagataaagtatgaaggaactgacgcgccttgcaaaattccgttttctactcaagacgaaaaaggggtcacacagaatggtagacttatcactgcaaatcccatagtgacagataaagagaaacctgttaatattgaagcagaaccgccatttggggaaagttacattgtaattggggccggtgagaaagctatgaaactatcctggttcaagaaaggaagttcgatcggaaagatgttcgaagcaacggcaagaggtgcgcggagaatggcgatcttgggagacacagcatgggattttggatctattggtggagtgtttacaagcgtaggaaaattggtacaccaaatatttggaactgcctacggagttctgtttagtggtgttagttggacaatgaagataggaataggtgtgttgttaacatggctaggccttaattcgagaagtacaagcctttctatgacatgtatcgcagttggcctagtcaccttgtatttgggtgtcatggtacaagcagattcaggctgcgtaattaactggaaaggtagagaacttaaatgtggctcagggattttcgttaccaatgaagtacatacctggacagaacaatataaattccaggcagactcgcccaaacgacttagtgcagccatcggaaaggcatgggaagaaggggtctgcggaatccgaagtgcaacacggttagaaaatattatgtggaagcaaatttctaacgaactaaatcatattctattagaaaatgatatgaaatttacagtcgtggtaggagacgtagcgggcatacttgcacaagggaagaaaatgatacggccccagccaatggaatataaatattcatggaaaagttggggtaaagctaaaataattggagcagacgtccagaatactactttcatcatcgatggaccgaatacacccgaatgcccagacgatcagcgggcctggaacatctgggaggtcgaagattacgggttcgggatatttactacgaatatatggttgaaattacgcgattcatatactcaagtatgcgatcatcgccttatgtctgcagcaataaaagactcgaaagcggttcatgctgatatgggttactggatagaatcggagaaaaatgagacatggaagctagctagggcttcatttatagaagtgaaaacatgcatatggccgaaatcacataccttgtggtcaaacggagtcctagaaagcgaaatgatcatccccaagatatatggagggcccatttcacagcataactaccgtccaggatactttacacaaactgcaggcccatggcatttgggcaaactggagttagatttcgacttatgcgagggtacaacagtcgtagttgatgagcattgtggaaatagagggccatcactcagaacaactacagtaacgggaaaaatcatccatgagtggtgttgccgaagttgtacactgcctccattaaggttccgaggagaggacggatgctggtacgggatggagattaggccagtaaaggaaaaagaggagaatcttgtgaaaagcatggtatcggcggggagcggtgaagtagattcatttagcctaggattgctatgcataagtataatgatagaagaggtcatgcgttctagatggtctcgaaaaatgctcatgacaggcacattggccgtattctttctactgatcatgggacagctaacatggaatgacttgattagactatgcataatggtaggagcaaacgcctcggatagaatgggaatgggaacgacttatttggcccttatggctaccttcaaaatgcgtccgatgttcgctgtaggcttgctctttaggagattaacaagtagagaagtgttgctactcacaataggtttatcattagtcgcatcagtggaattaccaaattcgctggaagaactcggggatgggttagctatgggtataatgatacttaaacttctaactgatttccaaagccatcaactttgggccacactactatcgttaacttttataaagacaacattcagtctacactatgcttggaaaacgatggcaatggtcctatccatagtttctctatttcctctatgtcttagtacaacgtcacagaaaacaacttggctgcctgtactcttgggttctctaggttgcaaacctctgacaatgttcttgatcgcagagaataaaatatggggtcggagatcctggcctctaaatgaaggtattatggcagttggaatagtttcaatacttctttcttctctacttaaaaatgacgtacccctcgcaggacctttgattgcgggcgggatgttaatcgcttgctatgttataagtggcagcagtgcagatctaagtctcgaaaaggcagcggaggtttcctgggaagaagaagcagaacactctggagcctcacacaacattttggtggaggtacaagacgatgggacgatgaagataaaagatgaggagagagatgatactcttacaatactattaaaagcaacattgttagccgtttcgggtgtataccccctatcgatccccgcaacactatttgtttggtatttttggcaaaagaagaaacaacgaagtggcgtactttgggacacaccatctccgccagaagtagagagagctgtcctcgatgacggtatttacagaattatgcaaagaggactattaggtcgaagtcaagtaggcgttggagtcttccaagaaaacgtttttcatacgatgtggcatgtaacccgtggtgctgtactaatgtaccaggggaagcgcttagagccatcatgggccagtgtaaagaaagaccttataagttacggaggcgggtggaggttgcaaggctcatggaacactggagaagaagtccaagtcatagcagttgagcctggcaaaaatcccaaaaacgttcaaacagccccagggacattcaaaactcctgaaggcgaagtgggtgcaatagctttagactttaaacctggtacgtcgggttcaccaatagttaatcgcgagggaaaaatcgttggattatatgggaacggagtggtgacaacttcgggaacgtatgtatcagcaatcgctcaagcaaaagcgtcgcaagaagggcccttaccagaaatcgaagatgaagtttttaggaagaggaatttaacaattatggacctccaccccggatctggtaaaactagacgatatcttccagctatagtaagggaagcaattaagagaaaattacgaacccttatactagcacctaccagagtcgtcgccagtgagatggccgaagccctcaaaggtatgcctataaggtatcaaactactgctgtaaaaagcgagcatacaggcaaagaaattgtagatttaatgtgtcatgcgacatttaccatgaggctactaagccctgtgcgtgtaccaaattacaatatgataataatggacgaagcccatttcacagacccaagcagcatagccgcaagaggatatataagcacccgagtgggcatgggagaagcagcggcaatttttatgacagcaacaccaccggggtctgtcgaggcttttccacaaagcaatgcggtgatccaagacgaagaacgagacattccagagcgcagttggaactctggttatgaatggataacggattttccaggtaaaacagtttggtttgtaccttcaattaagagtggaaatgacattgctaattgtttaaggaaaaatggaaaaagggtgatccagcttagcaggaaaacctttgataccgaatatcagaaaaccaaaaataatgactgggactatgtggttacgacagatatttctgaaatgggcgcaaattttagggcagatagagtaatagatccacgacgatgtctgaagccagtaatattaaaggacggacctgaacgagttatattggctggaccaatgcccgtgacagtcgctagtgctgcgcaacgccggggacggataggcagaaatcacaacaaagaaggcgaccaatatatttacatgggtcagcctttgaataatgacgaagatcatgctcattggacggaggcaaaaatgttattagataacataaataccccggaaggcataatacctgcattgtttgaacctgaaagagaaaagtcagcagcaatagacggagaatatcgtctccgtggtgaagcaagaaaaacatttgtagagcttatgagacgaggagatttacctgtgtggctctcatataaagtagcctcagagggttttcaatactctgatcgcagatggtgtttcgatggtgaacgtaataatcaggttttagaggagaacatggatgttgaaatttggaccaaggaaggggaaaggaagaaactaagaccacgttggctggatgctagaacttattctgatcctttagccttaagggagttcaaggagttcgctgctggtagaagatcagtatccggagacctgatactagaaattggaaagctaccacagcaccttacacaacgtgcacagaacgctttagataacctagtgatgctccacaatagcgaacaaggaggcagagcttatcgacatgccatggaagaattaccagacaccattgaaaccttgatgttgctagcactgatcgcagtattaacaggaggagtaaccttattctttttaagcggacgtggtttaggcaagacatcaataggtctattatgtgtaatggcttcatcggttttactatggatggcatccgtagaaccacactggattgcggcatctatcatcttagaatttttcttaatggtattgttgatacctgaaccggatagacaacggacaccacaagacaaccagcttgcatatgtggtgataggactactttttatgatattaacagtagccgctaatgagatgggtttactagaaacgacaaagaaagacttagggattggccacgtagcggtggaaaaccatcatcatgcagcaatgttagacgtagatttgcatccagccagtgcttggacactatacgctgtcgctactactattataacaccgatgatgcggcatacaattgaaaatacgactgctaacatatcattaacggctatcgcaaaccaggctgcaatcctcatgggtcttgataaaggatggccgatctcaaaaatggatataggagtacctctattagcacttgggtgttattctcaagtaaacccattaactttaacggctgctgttctaatgctggtcgcgcattacgcaatcattggtccaggactacaggcaaaagcaacgcgggaagcacaaaagcgaaccgccgccggcataatgaaaaatccaacagttgatggaattgtcgcaatcgacttagatccagtagtatatgacgccaagtttgaaaagcaacttggccaaattatgctactcatattgtgtacgagccaaatcctactcatgagaacgacatgggctctctgcgaatcgatcacgctagcaaccggacccctcacaacattgtgggagggatcgcctggcaaattctggaatacaacaatagcagtgtcaatggcaaacatattcaggggttcgtatttagccggtgcaggtttagcattttctttaatgaaaagccttggagggggacgacgaggaacgggggcacaaggagaaaccctaggcgaaaaatggaaaaggcaattaaatcaactaagcaagtccgaatttaacacttataaaagaagtggtattatggaagtcgacaggtctgaggccaaagaagggttgaaaaggggagaaacaaccaaacacgctgtatcccgtgggacagctaaattaaggtggtttgtagaaagaaacctagttaaaccagaggggaaagtaattgatctggggtgtggacgaggcggttggtcttactactgcgccggtcttaagaaagtaactgaagtcaaaggctataccaagggagggccaggccacgaagaacccattccgatggcaacatacggctggaacttagtcaagctacactcagggaaagacgtatttttcatcccaccagagaaatgtgatacgcttttgtgcgatataggggaaagttcgccaaacccaaccattgaagaaggccgcacattgagagttcttaaaatggtcgaaccttggctcagaggaaatcaattttgtatcaagatcctaaatccttacatgccctccgtagtggaaacccttgagcaaatgcaaagaaaacacggagggatgcttgtaaggaatccgcttagtagaaatagcacgcatgaaatgtactgggtatcatgtggaacgggaaatatagtcagtgcagtgaatatgacatctagaatgttattaaaccgatttacaatggcccatcgcaagccaacctatgaaagagacgtcgacctcggggcgggcaccagacacgtggccgtagagccagaagtagccaaccttgatatcatcggccaaagaatagaaaatattaaacatgagcacaaatcaacctggcactatgacgaagataacccatacaaaacatgggcatatcacggatcttatgaagtcaaacccagtgggtctgcttcatcaatggtaaacggagttgtaaaattgctcacaaaaccctgggacgtcattccaatggtgacgcaaatagcaatgacagatacaaccccattcggtcagcaaagagtattcaaagagaaagttgatacaagaacaccaaaagcaaaacgaggaacggcacaaatcatggaagtaactgctaaatggctctgggggtttctttcaagaaacaaaaagcctaggatatgcacgagggaagaatttactcgtaaagtgagatcaaatgcagcaataggagcggtatttgtagacgaaaatcaatggaactcagctaaagaggctgtagaggacgaacgtttctgggaccttgtacacagagagagagaattacataaacaaggtaaatgtgcgacatgtgtatataacatgatgggtaaacgtgagaagaaattaggagaatttggaaaagcaaaaggatccagagccatttggtatatgtggttaggtgccagattcttggaatttgaagcacttggattcatgaacgaagatcattggtttagccgagagaactcacttagcggtgttgaaggagaaggactacacaaactaggatatatactacgagacatttccaagatccccggcgggaatatgtatgcagatgacacagcgggatgggatacccgaattactgaggatgacttacaaaatgaagcgagaattactgacataatggagcctgaacatgcattacttgcaaaatcaatatttaaattaacatatcagaacaaagttgtcagggttcaaaggccggcaaagaatggtaccgtgatggacgttatcagtaggagagaccaaagaggctcgggccaagttgggacctacggtttgaatactttcacaaatatggaggcacaattgatacggcaaatggagagcgagggcatattttctccgtcagaactagagacgcctaacctggcggaaagagtattagattggttggaaaagtacggcgtaaaacgactcaagagaatggcaatttcgggagacgactgtgtggtgaagccgattgatgacagattcgctaccgcccttactgcactaaatgatatgggaaaggttcgaaaagacataccccagtgggagcccagtaagggttggaatgactggcagcaagtaccattctgcagtcatcatttccatcaattaatcatgaaagatggacgtgaaatagtagtcccttgcaggaatcaggatgaacttgtaggtagagcaagggtaagccaaggtgctggctggtccctgagagaaacagcatgccttgggaagtcgtacgctcaaatgtggcaattgatgtattttcatcgccgcgacctaagactagccgctaatgccatatgttctgcggtacccgtggactggataccaacgagccgtacaacgtggagcatacatgcgcatcatcaatggatgacgaccgaagatatgttatcagtatggaatagagtatggatcgaagagaatccctggatggaagataaaacacatatatcaagctggggtgacgtaccgtatctcggaaagcgagaggaccaatggtgcggcagtttaataggcctcactgcaagggcaacatgggccacaaatatacaagtagctataaaccaggttcggcgactaataggaaacgagaattaccttgattatatgacgtccatgaagcgattcaaaaatgaaagcgacccagagggagccctttggtga

SEQ ID NO: 21579 - RNA, 9879 nt, synthetic construct
  misc_feature 1..9879: note = derived and/or modified CDS sequence (opt6) from DENV-1__FJ410238__SS-prME
  source 1..9879: mol_type = other RNA
tcagtaactatgttattgatgcttatgccaacagctctggcttttcatttaacaacgcggggaggggaacctcacatgattgtttccaaacaagagaggggtaaatctttactttttaaaacctcagccggtgtgaatatgtgtacactcatcgctatggatttaggggagttctgcgaggataccatgacatacaaatgtcctcgcatcacggaagcagaaccagatgacgtagattgttggtgtaacgctacggacacgtgggtaacttatggaacatgctcacaaacgggcgaacacagaagagacaaacgcagtgtagctttagctccgcatgttggactaggactagagactagaacagaaacttggatgtctagtgagggtgcatggaagcaaatccaaagagtagaaacatgggctctcagacaccctgggttcacggtaattgcgcttttccttgcgcacgcgattggaacaagtataactcaaaaaggaataatttttatattgctaatgctagtcacacccagcatggctatgagatgcgttggaattggctcaagagatttcgtcgaaggattatcaggtgcgacatgggtagacgttgtacttgagcatggatcttgtgtgacaaccatggcaaaagataagcctaccctcgatatcgaattgttgaaaactgaagtaacgaatccagcagtattgcgcaaactatgtatcgaagcgaaaatatcaaacactacaaccgatagcagatgccctacacaaggtgaggcgactctagtagaggaacaagacgcaaacttcgtttgtcgaagaacctttgttgatagaggatggggtaacggctgtggattgtttggaaaagggtcgctaatcacgtgtgctaaattcaaatgtgttacaaaattagaaggaaaaattgttcaatatgaaaatctaaaatacagcgttattgtcacagtccatacgggagatcaacatcaagtaggcaatgagtccacagaacatggaacgaccgcaaccattacaccgcaagctccatcgacagagatccaactaacagattatggagcattaacattagattgtagtccccgcacgggcctggattttaatgaaatggtactattaaccatgaaggaaaaatcatggctcgtgcacaaacaatggtttctcgatttacctttgccttggacatcaggtgcaagtacttctcaagaaacatggaatagacaagatctattagtaactttcaaaactgcacatgcgaagaagcaagaagtggttgtactgggcagccaagaaggagctatgcatacagcactgacaggagcgacagagatacaaacaagtggtacaacaacaatttttgctggccatcttaagtgtaggttaaaaatggacaaacttacgttaaagggaatgtcgtatgtcatgtgtactggcagtttcaaactagaaaaagaggttgcagaaacacaacatggtacagtattagttcaaattaagtacgagggtacagatgccccatgtaagattcctttttccacgcaagatgagaaaggtgtgacacaaaacgggcgcttaatcaccgcaaaccctattgtaactgataaagaaaaacctgtgaacatcgaagcagagccaccgttcggcgaaagctatatcgtaataggagcgggagagaaagcacttaaactgtcatggtttaagaaaggaagttccattggaaagatgttcgaagcgacagcaagaggagctaggagaatggccattctaggcgacacagcctgggattttggatcaataggaggcgtcttcacttccgttggaaagttagttcaccaaatcttcgggactgcctacggggttctattcagtggagtgagttggactatgaagataggtataggcgtattgttaacctggctggggctaaattcgcgcagtaccagtctctcaatgacgtgcattgctgtcggtttggttacattatatcttggtgttatggtacaagctgatagcggctgtgttattaattggaaaggtagggaattaaaatgtgggtcggggattttcgtgacaaacgaagtacacacatggacagaacaatataaatttcaagctgattcacctaaaagattatccgccgccatagggaaggcctgggaggagggagtgtgtggtattaggtctgctactagacttgaaaatattatgtggaagcaaattagcaatgaactaaatcacatcctactagaaaacgatatgaaactgacagtcgttgtaggggatgtggcagggatactagcacagggcaagaaaatgataaggccacaacctatggaatacaaatattcgtggaaaagctggggaaaggcaaaaataataggtgcagatgttcaaaataccacatttattatagatggaccaaatacgccagaatgccccgatgaccaacgtgcgtggaacatatgggaagtagaagattatggttttggcatatttacgactaacatctggctcaaacttcgagattcatatactcaagtatgcgatcatagattaatgtctgcagccatcaaggatagtaaggcagtacatgcagatatgggatactggattgaatccgaaaagaacgagacttggaaacttgctagggcttccttcattgaggtcaaaacatgcatatggccaaaatcacatactctatggagcaatggagtcctagaatctgagatgataatccctaagatctatggtggcccgatatctcagcataactataggccaggttacttcacgcaaacagcgggaccttggcacctaggcaaactcgaactcgactttgatttgtgcgaaggcactacagttgtagtagatgaacattgtggaaacagaggtccatctctcaggactacaacggttactggaaagataattcacgaatggtgttgccgtagttgcacccttccgcctttgagattcaaaggcgaagacgggtgttggtacggcatggaaattcgacctgtaaaagagaaagaggaaaacttagtaaaatcgatggtaagtgccggatcgggtgaagttgatagtttcagcctaggattattatgtatttctattatgatcgaagaagtaatgcgttccagatggtctagaaagatgttgatgacaggtacattagcggttttctttctattaataatggggcaactaacttggaatgatcttataagactctgtattatggttggagcaaatacttccgaccgcatggggatgggaacaacttatttggcattgatggcaacattcaaaatgcgaccaatgtttgcggtaggactactattcagaagattaacaagtagagaggtattactactgaccataggattgagcctagtcgccagcgctgagctgccaaatagcctagaggaacttggcgatggtctagcaatgggaatcatgatattaaaacttctaacggacttccaatcccaccaactgtgggcaacccttttaagtttaacgttcattagaactacttttagtcttcattacgcatggaaaacaatggccatggtgctctcgatcgttagtctattcccattatgtctatctacgacatcgcagaaaacaacttggttacctgtattactgggtagtcttggctgtaagcccttgacaatgttcttaatagctgaaaataagatctggggacgaaaatcctggcccttaaacgaaggaataatggcagttggaattgtaagtattctcctaagttcactcctgaaaaatgatgtaccccttgcgggacctttaatcgctggcggcatgttaatagcttgctatgtaatttctggatcttcggcagaccttagcttggagaaagcagctgaagtatcatgggaagaagaggccgaacattccggcgcatcacataatatacttgtagaagtacaagatgatgggacgatgaagatcaaagatgaagaaagagatgacacacttacaatattactgaaggctacactattagcagtctcgggggtctatccattgtctatcccagcaactctttttgtttggtatttctggcagaagaagaaacaacgttccggagttttatgggatacacctagtccgcctgaagttgagcgagctgtcttggatgatggaatataccgaatcatgcaacggggtcttctaggaagaagtcaagttggtgttggagttttccaggaaaatgtattccacactatgtggcatgtaactagaggtgcagtcctcatgtaccaaggtaaaagactggaaccatcgtgggctagtgtcaagaaagacttgatttcttatggtggaggttggagactacaaggttcatggaataccggagaagaagtacaagtgattgcagtagaaccaggcaaaaatcctaaaaacgtgcaaactgctcctggaacttttaaaacgagtgagggggaagtcggcgcgatagcgcttgatttcaaacccgggacatccgggtctccaatagtgaaccgtgaaggtaagatagtaggactttatgggaatggcgtagttactacttcaggtacctatgtatctgccatcgctcaggctaaggccagccaagaagggccacttccagaaatagaagacgaagtatttaggaaacgtaaccttacaattatggacttacatccgggatcgggaaagacccgacgttacctgcccgcaatcgtacgagaggctataaagagaagattaaggaccctaatactagcacccactcgagtagtagccagtgagatggctgaagctctgaagggtatgccaatcagatatcaaacaacagcagtgaaaagcgaacacacggggaaagaaatcgtggacctaatgtgccatgcaacattcacaatgagacttttatcaccagtgcgtgtaccaaactacaacatgataataatggacgaggcacactttacggatccatcttcgattgcggcgaggggatatatatccactagagtgggtatgggagaagcagctgccatctttatgaccgcgacaccgcctggaagtgtagaggcttttcctcagtctaatgcagttatacaagacgaagaacgtgatataccggaaaggtcatggaatagcggttatgaatggataaccgactttccgggaaagactgtatggtttgtcccaagcataaaatctgggaatgatatcgcgaactgtcttcgaaagaacggtaagcgtgtgatacagctctctcgaaaaactttcgacactgagtatcaaaagaccaaaaataatgactgggattatgtagtaactaccgatataagtgaaatgggagcgaattttcgagccgacagagttatagatcctcgtagatgcctcaaaccagtaattttaaaagatggaccagagcgagttatccttgctggacctatgcccgtcactgtcgctagtgccgcccaacgaaggggtcgtatcggaagaaaccataacaaagagggtgaccaatatatctatatggggcagcccttaaataacgatgaggatcatgcgcactggacagaagctaagatgcttctagataacatcaacacacctgaagggataatcccagccttgttcgaaccggaacgcgaaaagtccgctgcaatcgatggggagtaccgattaagaggtgaggcaagaaagacatttgtcgagttgatgaggagaggagacctccctgtatggctaagttataaagtcgcgtcggagggctttcagtattcagatcggcgatggtgctttgatggagaaagaaacaaccaagtcctggaagaaaacatggatgtagagatatggacaaaagaaggcgaaagaaagaagttgcgaccaagatggcttgatgcaagaacgtattctgatccattagcactcagggagtttaaagaatttgcagcgggccgaagaagcgttagcggagaccttattctagagattggaaaattacctcaacatcttactcaaagagcacaaaatgctttagataatcttgtcatgttacacaatagcgagcagggtggaagggtttatcgccacgcaatggaagaacttcctgatacgattgaaacactaatgttgttagctctaattgcagtattaacgggaggagtaactcttttcttcctgagtggccgaggactaggaaaaaccagcattggattattgtgcgtaatggcatctagtgttttgttatggatggcgtcagtagaaccccattggatagcagcatctatcatcctagagttctttcttatggttctattgataccagaaccagaccggcaacgaacgccgcaggataaccagctagcctatgttgtcatcgggttactattcatgatcttaactgtagcagccaacgagatgggactactagaaacgacaaagaaagatttaggaattggacatgtagcagttgaaaatcaccatcatgctgctatgttagatgttgatttacatcccgcatccgcttggactttatacgctgtggctacgacaattataacgccaatgatgcgacacacaattgaaaatactacggccaatatttcactgacagcaatcgcgaatcaagcagcaatcttgatgggacttgacaagggctggcctatctcgaaaatggacattggcgttccgttactggctttaggatgctacagtcaggtaaacccgttaacactaacagctgccgtcttaatgctcgtagcacattacgcaataataggtcctggactacaagccaaagcgacacgggaagcacagaaaagaacagctgcaggtattatgaaaaatcccacagtggacggcatcgtagcaatcgatcttgatccagtggtttatgatgctaaatttgaaaaacaactcgggcaaataatgctattaattctttgcacttcgcaaatactacttatgcgaacaacgtgggctttgtgtgaatcgataacgctcgcgacgggacccctgactaccctttgggaaggaagcccgggtaaattttggaacaccacaatcgccgtaagcatggctaatatttttagaggaagttacctggcgggggctggcttagccttttctttgatgaagtctctagggggaggaagaagaggaacaggcgcgcaaggcgaaacgttaggcgaaaaatggaaacggcagttaaaccaactgagtaaaagtgagtttaacacgtataaaagatccggaataatggaggtggatagatcagaagcaaaggaaggactaaaacgaggcgagacaacaaaacacgccgtctccaggggtaccgctaaactaaggtggttcgttgagcgtaacttagtcaaacccgaagggaaagttattgatttaggttgcggaaggggaggttggagttattactgtgccggtcttaagaaagtgacagaagttaaaggctacacaaaaggtggacccggccatgaagaaccaattcctatggccacatatggatggaatttagtaaaactacattcaggtaaagatgtattctttattccacccgaaaaatgtgacacattactatgcgatatcggagaatcaagcccaaatcctaccatagaagaaggtcgaaccttacgtgtactgaaaatggtagaaccatggttaagaggaaatcaattttgtataaaaattttgaacccatatatgccttccgttgtagaaactttggaacaaatgcaaaggaaacatggtgggatgctagtacgtaaccctttgagtagaaacagcacccacgaaatgtattgggtgtcatgtggaactggaaacatagtctcagcagtaaatatgacgagtcgaatgctgctaaatcgttttacaatggcccacaggaaacccacgtatgagagagacgtggatctaggagctggcacccgacatgtagctgtcgagcctgaagtagcaaaccttgacataataggacaaaggatagagaatatcaaacatgaacacaaatccacgtggcactacgacgaagacaacccgtataagacatgggcatatcatggatcatacgaagttaaaccatccggcagcgcctcgtcaatggtcaatggtgtcgttaaactgcttacaaaaccctgggatgtaatacctatggtaacgcaaattgcgatgactgacacaacaccattcggtcaacagagggtatttaaagagaaggtagacaccaggacccctaaagcgaaaaggggcactgcccaaataatggaagtaactgccaaatggctatgggggtttctatcacgtaataagaaaccgcgaatttgtacaagagaagagttcactagaaaggtccgttctaatgctgctataggagccgtatttgtcgacgagaaccagtggaatagtgcaaaagaagctgttgaagacgaaagattttgggacttagtacacagagaaagagaattgcacaaacaagggaaatgtgcaacatgtgtatataacatgatgggaaaacgagagaaaaagttaggagagttcggcaaggcgaagggatctcgtgcaatatggtatatgtggctcggagcacggttcttagaatttgaggctttagggtttatgaacgaagatcactggttttccagagaaaattcattatccggtgtagaaggagaaggtctacataaactaggctatatactcagagatattagcaaaatccccgggggaaacatgtatgctgacgatacggcaggttgggatacgagaataactgaagatgacctacaaaacgaggctaaaataacagatatcatggaaccggaacatgcattactagctaaaagtatctttaaactaacctaccaaaacaaagtagttcgagtacaaaggccagccaaaaacgggacagtgatggatgttattagtagaagagatcaaagaggttcaggacaagtgggtacctacggtcttaatacatttacaaatatggaggcccaattaatacgacaaatggagagcgagggcatattttcaccctcagagttggaaactccaaacctagctggacgtgttctggattggttggagaaacatggagtagagcggcttaaaagaatggctatttctggagatgattgcgtagtaaaacctattgatgacagattcgctactgcacttacagctctgaatgatatgggaaaagttagaaaggatataccacaatgggagccgagcaaaggatggaacgactggcagcaagtaccattctgttcgcaccattttcatcaattaataatgaaagatggtagagaaatcgttgtgccttgtagaaaccaagatgaattagtagggagagcgcgagtatcccaaggggctggatggagtctgagggaaaccgcttgtttaggaaaaagttatgcccaaatgtggcagttaatgtattttcacagacgggacttacgccttgccgcaaatgcaatttgtagcgcagtacccgtagattgggttccgacatcacggacgacatggagcatacacgctcatcaccagtggatgacgacggaagatatgctatcagtatggaatcgagtttggatagaagaaaacccatggatggaggacaaaacacacgtttctagttggggcgatgttccttatttagggaaaagggaggatcaatggtgcggaagcctcataggtctaactgctagggcgacgtgggctacaaatatacaagttgcaatcaatcaagtccgacggttactggggaatgaaaactatttagattacatgacttcaatgaagagattcaaaaatgaaagcgatcctgagggggctttatggtaa

SEQ ID NO: 21580 - RNA, 9879 nt, synthetic construct
  misc_feature 1..9879: note = derived and/or modified CDS sequence (opt6) from DENV-1__FJ410239__SS-prME
  source 1..9879: mol_type = other RNA
tcagtaacaatgttactgatgttgatgccgactgcactagcgtttcaccttacgaccagaggaggagaaccacatatgatcgtttctaaacaagaaagaggaaaaagtttactatttaaaacgtccgccggtgttaatatgtgcacattaattgccatggatttaggtgaactttgcgaagatacaatgacatataaatgcccacggattacagaaacagaaccggatgatgtagactgctggtgtaatgcaacagatacgtgggtgacatacggtacatgtagtcaaactggggaacatagacgggacaaaagaagtgtagctttggcaccacatgtaggacttggattggagacacgtaccgagacttggatgagttctgaaggagcatggaaacaaatacaaagagtggaaacatgggcattgcgacaccctggttttaccgttattgctctttttcttgcacacgcaattggaacatcgattacccaaaaaggaataatattcatactactcatgttggtgaccccgagtatggcaatgagatgtgtaggaattggatcaagagactttgtagagggactgagtggagcgacatgggttgacgttgtactcgaacacggatcttgtgtaaccactatggcaaaagacaaaccaacgctagacatcgaacttcttaaaactgaagtaacgaacccagctgttctccgtaaattatgtattgaagcaaaaatatccaacactaccacagatagcagatgtcccacccaaggcgaagcaacactggttgaagaacaagatgctaattttgtatgcagaaggacattcgtggatagaggatggggaaatggatgcggactgttcggtaaaggttctttaattacctgtgccaaatttaaatgtgtaaccaaattagaaggaaaaatagtgcaatatgaaaacttaaaatactcagttatagtgactgtccatactggcgaccaacatcaagtcggcaacgaaagtacagagcatggtacaactgccacaataacccctcaagcaccaactacagagatacaactaacagattatggggccttaacactggattgctcaccgagaactggattagattttaacgaaatggtcttattaaccatgaaagaaaaatcttggttggttcataaacagtggtttctggacctacccttgccatggaccagcggtgcctctacttcccaagaaacttggaatagacaagatttattggttacattcaaaactgcacacgcgaagaaacaagaagtcgttgtgctcgggagccaagagggtgcaatgcatactgcactgacaggagcaacggaaatacaaacaagtgggacaaccacaatttttgcaggccatctcaaatgccgtcttaaaatggataaactcactctaaaaggcatgtcctatgtaatgtgtacaggctccttcaaattggaaaaagaattagcggaaacacaacacggtacagttctggtacaaatcaaatacgaagggacggatgcaccctgtaagataccattcagtacacaggatgaaaaaggagttactcaaaatggaagactcattactgcgaatccgattgtaacagataaggaaaagcctgtgaatatcgaagcagagccaccgtttggagaatcatatattgttataggagctggggaaaaagctctaaaactaagttggttcaagaaaggtagcagcattggaaaaatgtttgaggcgactgctaggggagcaaggagaatggcaatcttaggggacactgcatgggactttggatccatcggtggcgtgttcacatctgcgggaaaactcgtccaccaaatatttgggacagcctatggagttttattctccggtgttagttggacgatgaaaatagggattggagtacttctaacctggttaggacttaattcaagaagtacctctttaagcatgacatgtatagcggtaggtttagttacactctatttaggagtcatggtacaagcagactccgggtgtgtgattaactggaaagggagggaacttaagtgtggatcaggcattttcgttacaaatgaggtacatacctggaccgaacagtataagtttcaagctgattcgcctaaaaggcttagcgccgctataggaaaagcatgggaagagggggtatgtggtatacggtcagcaacacgcctagagaacataatgtggaaacaaatttcaaacgaattgaatcatatactattagaaaacgatatgaaatttactgtcgtagttggagacgtagcaggcattctagcccaaggcaagaaaatgataagaccacagccaatggaatacaaatattcatggaaatcctggggcaaagctaaaataataggagcagatgtgcaaaacacaaccttcatcattgacgggcctaatacacctgagtgtcccgacgaccaacgagcttggaacatctgggaagttgaggactacggattcggcatattcaccacaaacatttggttaaaattaagagacagctacacacaagtctgcgaccacagactaatgagcgccgcaatcaaagatagcaaagcagttcatgctgacatgggatactggatagaatcagaaaagaatgaaacatggaaattggcaagagcatcttttattgaagtaaagacatgtatatggccaaaaagtcataccttatggtccaatggagttttagaatcagaaatgattataccaaaaatctacggcgggcctatctcacaacataattatagacccggatactttacacagaccgcgggaccatggcatctcggcaaactagaattagacttcgacttgtgtgaaggaactacggtggtcgttgacgaacattgtggaaatagaggcccatcactaaggacaacaacagtcacgggcaaaattatccacgaatggtgttgtagaagctgtacacttcccccactgagatttagaggcgaagatggatgttggtatggaatggaaattaggcccgtaaaagaaaaggaagagaatttagtaaagagtatggtaagtgcgggtagtggtgaggtcgatagctttagccttggactcctatgcatatctattatgatagaagaagtgatgcgatcccggtggtcacgaaaaatgctcatgacaggcactttagcggttttctttctactaataatgggccaattaacatggaacgatcttatacgactgtgcataatggtgggagctaacgcaagtgatcgaatgggtatgggaacgacctatttagcactgatggcaaccttcaaaatgagaccaatgttcgctgtcgggttattatttagacgcctaacatctcgcgaagttctactgttgactatagggctatcattggtagcttctgtagaactcccaaattctcttgaagaattaggagacggcttagccatggggataatgattctaaagttactgactgactttcaaagtcatcaattatgggcgacgctattaagccttacatttattaaaactacatttagtttacattacgcatggaaaactatggcaatggtattaagcattgtttcgcttttcccattatgcctttccactacttctcagaaaacaacctggttaccagtctttctaggaagcctcggatgtaaaccactaaccatgttcttaatcgccgaaaataaaatatggggaagaaggtcctggcctcttaacgagggaataatggcagtcggaatagtatcaatactacttagctcactattgaaaaatgacgtaccattggcaggtcccttgatcgctggagggatgcttatagcatgttacgtcatatcaggttcaagcgccgacttaagtctagaaaaagcagcagaggtaagctgggaagaagaagcagagcacagcggtgcatctcataatatcctagttgaagtccaagatgatggtacaatgaaaatcaaagatgaagaacgcgatgacacgctaacaatcttactcaaagcgaccttactagcagtgagtggagtatatccgttatcaattcctgcaactttgtttgtatggtatttttggcagaagaagaaacaaagatcaggagtcctatgggacactccatcacctcccgaggtagaaagagctgttctagatgatggaatctatcgtattatgcaacggggactgttgggtcgcagccaagttggggtcggtgtatttcaagaaaacgtttttcataccatgtggcatgtaactcgtggcgctgttcttatgtaccaggggaaacgcctggaaccctcttgggcatccgtcaagaaagacctcatctcatatggaggcgggtggcgtctccagggtagttggaatacaggagaagaagtacaggtaatagcagttgaaccaggtaaaaacccaaagaatgtgcaaacagcccccggaacatttaaaacacctgaaggcgaggtcggcgcaattgcactagattttaaacctggtacatccggcagccccattgttaatcgagaaggaaaaatagtcggtctatatggcaacggagtcgttacaacgagtggaacctatgtttcagccattgctcaggccaaagcatcacaagagggtccccttccagaaatcgaagatgaagtcttcagaaaaagaaatttaacaataatggatcttcacccaggttcgggtaaaactcggaggtaccttccagccattgtgagagaggcaatcaaacgaaagctaagaacgcttatactggctcccacacgggtagtggcatctgaaatggccgaggctttaaaaggcatgcccattcgataccaaacgactgcagtaaaatcagagcatactggcaaagagatagtagacctaatgtgtcatgcaacattcacaatgcgtttattaagcccagttagagtccccaactataatatgataattatggatgaagcgcacttcactgatccaagcagtatagcggctagaggttacataagtactagagttggtatgggcgaagctgcggccatttttatgactgcaacgccacccggttccgtagaagcattcccccaaagcaatgcagtaatccaggacgaagaacgagacataccagagcgatcttggaacagtggatacgagtggattaccgactttccaggcaaaacggtttggtttgtcccatcaattaaatccggaaacgacattgccaattgcctaagaaagaatggaaagagagtgatacaactaagccgaaaaacatttgatacagagtaccagaaaactaaaaacaacgactgggattatgttgtaacaacagatatctctgaaatgggggcaaactttcgagccgatcgggttatcgatcctaggcgatgtttaaaaccggtaatattgaaagatggtcctgaacgagttatattagctggaccaatgcccgtaacagtagccagtgcggcccaacgtcggggtagaatagggagaaaccataataaagagggagatcaatatatatatatggggcagccactaaacaacgatgaggatcacgctcactggacagaggcgaaaatgttactagacaatattaacacgcctgaaggaattatacctgctttatttgaaccagagagggaaaaatccgctgcaattgacggcgaataccgactaagaggagaagcgagaaagacctttgttgaactaatgcgaagaggtgatctaccggtttggctttcatataaggttgcatctgaaggattccaatactcagatagaaggtggtgctttgacggagaacgtaataaccaagtactagaggaaaatatggatgtggagatatggacgaaagaaggtgaaaggaagaaacttaggccacgatggttagacgcgaggacatattcagatccactagccttgagagaatttaaagagtttgccgccggtcgaaggtctgtaagcggcgatctgattttggagataggaaagctaccacagcatcttacacagcgagcgcaaaatgccttagataacctagtgatgttgcataacagcgaacaaggagggcgtgcgtatagacatgcaatggaagaactaccagataccatagaaacactaatgctccttgctttgattgccgtactgactggtggggtaacgctattctttctttcaggtagagggctcggaaaaacttctatcgggctgctttgtgtgatggcttcatctgtactattatggatggcatcagtagaaccccactggattgcagcttccattattttagagttctttttaatggtgcttctaattcctgaacctgatagacagagaactccgcaagacaaccaattagcctacgtcgttataggcttactattcatgatactaacagtcgccgcaaatgaaatgggattgttggaaacgacaaagaaagatctgggcataggtcacgtcgctgtagaaaatcatcaccacgctgctatgcttgacgtcgatcttcatcctgccagcgcttggacattatacgcagtagcaacgacaatcatcacaccaatgatgcgacatacaattgaaaacacaacggcgaatatcagcttaacagcgatagcaaatcaagctgcaatattaatgggattagataaaggatggcctatctctaaaatggatattggagtgccattgcttgctttaggttgttattcgcaagtaaatccgttaactctgactgccgcagtgttaatgttagtagcccactatgcaatcataggaccaggactacaagcaaaagcaacacgagaagcacagaaaagaacggcagcgggaataatgaaaaacccgacagttgatggaattgtagccatcgatctagaccctgtggtttacgatgcgaaatttgaaaaacaattaggacagattatgctactaatactctgcacaagccaaattttgctaatgagaacaacttgggccctctgcgaaagcataaccctagctacaggaccgctaacaactctctgggaaggatctccaggtaaattttggaatacaactatcgctgtatcaatggcgaatatttttaggggatcgtaccttgcgggagctgggctagctttctcattaatgaaatcgctagggggaggacgtcgtggtaccggtgcgcaaggtgaaaccctcggagagaagtggaaaagacagttgaatcaattgtctaaatcagaatttaacacatacaaaagatcaggcataatggaagttgatcgaagtgaagctaaggagggcttgaaaagaggtgaaactacgaaacatgctgttagtagagggaccgcaaaacttaggtggtttgtagaacgtaatcttgtgaaacctgaagggaaagtcattgacttgggctgtgggaggggaggatggtcatactattgcgctggtctgaagaaggtaacggaagtaaaaggttacacaaaagggggacctggtcacgaagaaccgatcccaatggccacctatggttggaacttagtcaaactgcacagcggaaaagatgttttctttataccgcctgagaaatgtgatacacttttgtgcgatataggggaaagttccccgaatccaacaatagaagaagggaggacgctgagggtactaaaaatggtggaaccctggttacgaggtaaccagttttgtataaagatactcaacccatatatgccatccgtggtagagaccttggaacaaatgcaaaggaaacacggaggaatgcttgtgcgtaatccattaagtcgaaactcgacacacgaaatgtattgggtcagttgcggaaccgggaatattgttagcgctgtcaatatgacctctaggatgctcttaaatagatttaccatggcacataggaaacccacgtacgaacgagatgtagacctaggagcgggcacccgccatgtagctgttgaaccagaagttgcaaacctagatatcataggacaacgaatagaaaatataaaacatgaacacaaatcgacttggcattatgatgaagataacccttataaaacctgggcttatcatggctcttacgaggtgaaaccatctggaagcgcttcctccatggtcaatggtgtcgtgaagttactaacgaaaccttgggacgtcataccaatggtgacacagatcgcaatgacagatacaacgccttttggtcaacaaagggtttttaaggagaaggttgataccagaactcccaaagccaagcgcggtaccgcgcagataatggaagttaccgcgaaatggttatggggatttctctctcggaataagaaaccccggatctgtacaagagaagagtttacacggaaggtgcgatcgaatgcagcaattggggccgtattcgtagacgaaaatcagtggaatagtgcgaaagaagcagtggaagacgaacgtttttgggacctggtacacagagaacgggaactacataaacaaggaaaatgcgcaacttgtgtctataacatgatgggtaagcgagagaagaaactcggggaatttgggaaagcaaaagggtctagagctatatggtatatgtggttaggagcaagattcttggagtttgaagcactagggtttatgaacgaagatcactggttcagtcgtgaaaatagtttgagcggtgtagaaggagaagggttacacaagttaggttacattcttcgcgatattagtaaaattcccggtgggaatatgtacgcagacgacactgcaggttgggacactagaatcacagaagatgacctacagaatgaagcaagaataaccgatataatggaaccggaacatgctctcttggcaaagagcatatttaaattaacctaccagaataaagtggtcagagtacaaaggcctgcgaaaaacgggactgtaatggatgttattagcagacgagatcagaggggctctggacaagtcggaacatatggattaaatacttttacaaatatggaggcccaactaattcgacagatggaaagcgagggtatatttagtccctctgaactggaaacacccaacttggctgaaagagtcctagactggttggaaaagtacggggtagaaagactcaaacgtatggctataagtggtgacgactgtgtagtgaaaccaattgacgaccgatttgcaaccgctttaactgctcttaatgatatgggaaaggtaagaaaagatattccacaatgggaaccttctaaaggatggaatgattggcaacaagtgccattttgttcccaccattttcaccaactaattatgaaagacggccgagagattgttgtaccgtgccgaaatcaggatgaattagtcggcagagctagagtgagccaaggggcagggtggagtctacgtgagactgcttgcctagggaaaagttacgcacagatgtggcaacttatgtatttccataggagagacttgcgcttagccgctaatgcgatctgttcggccgtaccggtcgactggatccctacatcacgcacaacatggtcaattcatgcacatcatcaatggatgacaaccgaagatatgctctcagtgtggaaccgggtctggatagaagaaaatccctggatggaagataaaacgcatataagcagttggggagacgttccttatttggggaaaagagaagaccaatggtgtgggtccctgataggcctcacggctcgagctacttgggcaaccaacatacaagtagcaatcaatcaagtacgacgcttaatcggcaacgaaaactatttggattatatgacttcaatgaaaaggtttaaaaatgaatccgatccagaaggagcactatggtag

SEQ ID NO: 21581 - RNA, 9879 nt, synthetic construct
  misc_feature 1..9879: note = derived and/or modified CDS sequence (opt6) from DENV-1__FJ410240__SS-prME
  source 1..9879: mol_type = other RNA
agtgtaaccatgttgttaatgttaatgccaaccgcgttagcattccacttaacgactaggggtggagaaccacatatgatagtctcaaaacaagaaagaggtaaatcattgcttttcaaaacttctgcgggggtaaatatgtgtaccctcatagcaatggacctaggtgaattttgtgaagataccatgacatataaatgtccccgaataactgaagcggagcctgacgatgttgattgctggtgcaatgcaacggatacgtgggttacatatggaacttgctcgcaaacaggagaacacaggagagataaacgttcagttgccctagctccacacgtgggactaggactagagacgagaactgaaacatggatgagctctgaaggagcctggaaacaaattcaacgtgttgagacatgggcattacggcacccaggattcacggttatcgccttatttctagctcatgcaatcggaacttctatcacgcaaaaaggcataatattcattttattaatgttagtaacaccaagcatggctatgaggtgtgtaggaatagggtcacgtgattttgtcgagggcttatcgggcgctacctgggtagacgttgtgctagagcatggatcatgtgtgactacgatggcaaaagataaacctacccttgacatagaattgttaaaaaccgaagtaaccaatccagccgtattaagaaaactgtgcatagaagccaaaataagtaatactacaaccgactcgcgctgtccaacccaaggagaggcaacactggtcgaagaacaggatgctaattttgtatgccggaggacgtttgttgatcgtggttggggcaatggatgtggactattcggaaaaggcagcttaattacttgcgcaaaatttaaatgtgtaaccaaattagaaggaaaaactgtgcaatacgaaaatcttaaatattctgtcatcgtaaccgctcatacaggagatcaacatcaagtcgggaatgaaagtacagaacacgggaccacagcgacaattacaccacaggctccaagtactgaaattcaactgactgactacggagcgctcacattagattgcagtccgcgcaccggactcgacttcaatgaaatggtattattaacgatgaaagagaaatcatggcttgtccataaacagtggtttctagatttacctttaccctggacatcaggtgcttcaacaagtcaagaaacatggaatagaaaagatctacttgtaacatttaaaaccgcacacgctaagaaacaagaggttgttgtactggggtctcaagaaggagctatgcacacagcattaaccggagcaacagaaatacaaacgagtggcaccacaacaatctttgcaggccacctaaaatgtagacttaaaatggataaacttacattaaaaggaatgagttatgtaatgtgtaccgggtcctttaaattagaaaaagaggtcgcagaaacacaacatggaacagtgttagttcaaattaaatacgagggaactgacgcaccatgtaagattcctttctcaactcaggatgagaagggtgttacccaaaatggacgcctaattactgctaatcctattgtaacagataaagaaaaaccggttaacatcgaagccgaacctccatttggagaaagttacatagtgattggtgccggtgaaaaagcattaaagctatcatggtttaagaaagggagcagcatcggtaaaatgttcgaagctaccgcccgaggagctcgtaggatggcaatattaggtgatacggcgtgggactttggtagcataggaggggttttcacaagtgtagggaagttagtacatcaaattttcggtacagcttacggtgtattattctcaggagtatcatggacgatgaaaattggtataggtgttctgctcacctggcttggacttaattcaagatcgacaagcctctccatgacctgtatagcagtaggtctagtcactctatatctcggtgtcatggttcaagcagattcaggctgcgtaataaactggaagggacgagaattaaaatgcggttcgggaatatttgtaactaatgaagtacacacgtggacggagcaatataaatttcaggcagattcacctaaacgactcagcgcggctattggaaaagcgtgggaggaaggcgtttgcggaatacgaagcgctacacgtcttgaaaacatcatgtggaaacaaatttcaaatgaattaaatcatatattgcttgaaaatgatatgaaatttactgtagtagtcggtgatgttgcaggtattttggcacaaggcaagaaaatgatccgacctcagccaatggaatacaagtactcctggaagagttggggtaaagctaaaataattggggcagatgtacaaaataccacatttatcatcgacggacctaatacacccgaatgccctgatgatcaacgagcgtggaacatttgggaggttgaggactatggatttggaatctttaccactaatatctggcttaagttgcgtgatagttatacacaagtatgcgatcacagactaatgtcagcagccatcaaagactcaaaagcagtgcatgcggatatgggatattggatcgaatccgagaagaatgaaacatggaagttagctcgggcaagtttcattgaggtaaaaacctgcatctggccgaaaagtcacaccctatggtcaaacggagtgttggagtctgaaatgataattcccaaaatatatggtgggcctatttctcaacacaattatcgccctggatactttacgcaaacagcaggcccgtggcaccttggaaaactagaactagactttgacttatgcgaaggtactacagtagttgttgatgagcattgtggaaaccgaggaccatctcttcggacaaccacagtgactggtaagataattcatgaatggtgttgtcgcagctgtacacttccacctttaaggttcaagggtgaagatggttgttggtacggcatggaaatccgaccagtgaaggaaaaggaagaaaatttagtaaaatctatggtctcagcgggttcaggggaagtagattctttttcactgggattactttgcatatcaattatgatagaagaagttatgagatcaagatggtcaaggaaaatgctaatgacgggtacactcgccgtattctttctcttaattatgggacagctaacttggaatgatctcataagactatgcattatggtgggagcgaacgcgagtgatagaatggggatgggaaccacatatctagctctgatggcgacatttaagatgcggccaatgttcgcagtaggtctcctattcagaagattgacaagtagagaggtgttacttttaacaataggactgagcctggtagctagcgttgaattaccaaactctttagaggaattaggagatggtttagcaatggggataatgatactcaaattacttactgacttccagagccaccagttatgggctaccctactatccctaacattcattaaaactaccttttccttgcactacgcgtggaaaactatggccatggtactatcgatcgtctcactgttccccctttgtttgagtaccacatcccaaaagactacgtggttacctgtgttactggggagtttaggttgcaaacccttaacgatgttccttatagctgaaaacaaaatatggggacgcaaaagctggccattaaatgagggaattatggcggtaggaatagtgagcatattactttcatctttattaaagaatgatgttccgctggcaggtccactgattgcagggggcatgttaatagcctgttatgttatcagtggatcatcagcagatctatcacttgaaaaagcagcggaagttagctgggaagaggaagcagagcattcaggcgcctcccataatatcttagtagaggtccaagacgatggaacaatgaagattaaagatgaagaaagagacgacacattaactatattgcttaaagcgaccctattagctgtgtcgggcgtatatccgctctctatacctgcaaccctcttcgtatggtatttttggcagaaaaagaaacaaagaagtggagtactttgggatacacccagtcctccggaagtggagagagcggtgttagacgacggaatatataggatcatgcaaagaggattactaggaagatcacaagtgggagtaggagtgttccaagaaaacgtgtttcataccatgtggcatgttactcggggtgctgttttaatgtatcaaggaaaaaggttagaaccaagctgggcgtcggtcaagaaagacttaatttcttatggcggaggatggagattacagggctcttggaacactggtgaagaagtacaagtgatagcggtagaacctggcaaaaatcccaagaacgtccaaacagcacctggtacgttcaaaaccagcgaaggtgaagttggggcgattgcgctagatttcaaacccggaacttcaggatcaccaattgtgaacagagaagggaaaatagttggattatacggtaacggagtagttactacgtcagggacttatgtctcagcaattgcacaagccaaagcatcacaggaaggcccactaccagaaattgaagatgaagtattccgaaagcggaatctcacaataatggacttacacccgggatctggaaaaacccgaagatacctgcctgcaatagtaagggaggccattaaaaggaaattgcgtacgttgattttagcccccacacgagtcgtagcgtcagagatggcagaagctctgaaaggtatgcctatccgctatcaaactacagccgtaaaaagtgaacatactgggaaagagatagtagatcttatgtgccacgccacctttacaatgagattactgtcacccgtcagagtacccaactataatatgattattatggatgaagctcattttacggacccaagttctatcgcagctagggggtatataagcactcgcgtaggcatgggagaagcagcagcaattttcatgactgctacccctcctgggagcgttgaagcattcccacaatccaacgccgtaattcaagacgaagaacgagatatacctgaaagatcctggaactcaggatatgagtggattacggattttccgggtaaaacagtgtggtttgtgccatcaataaaatctggaaatgacatcgcaaattgtctaaggaaaaatgggaaacgggtaatccagctatcaagaaaaacatttgatactgaataccagaaaaccaagaacaatgactgggactatgtagtaacaaccgacattagcgaaatgggtgcaaactttcgagcggatagggttatagatcctcgaagatgcctgaaaccagttatattaaaggatgggccagaaagggtgatactggcaggcccgatgccagttacagttgcatccgccgcacaacgacgaggaagaattggcagaaatcacaataaagaaggcgatcaatacatctacatgggtcaacccctcaataacgatgaagatcatgcacactggacagaggctaagatgctactcgataatataaacactccagagggtattataccagcgctatttgagcctgaaagggaaaaatcagccgcaatcgatggtgaatacagactgcgaggtgaagctaggaaaacatttgtagaactgatgagacgtggagacctgccagtttggttatcgtataaagtagcatccgagggatttcagtattccgatagaagatggtgctttgacggtgaaagaaacaaccaagtactagaagaaaatatggatgtagagatatggacgaaagaaggagaaagaaagaaacttcgccctcgatggctagacgcgcgcacatattctgacccacttgcactaagagaatttaaagagtttgcggcaggtaggcgttcagttagcggcgacttaatcctagaaataggcaaacttccccaacatctcacacaaagagcacagaacgctttagacaacttagtaatgctacataacagcgaacaaggaggccgagcttatagacacgcaatggaagaactaccagacaccatagagactctaatgttgttagcattgatcgctgtcttaacaggtggagtaaccctattctttttaagcggacgtggtcttggcaagacgagtattggcttgctgtgtgttatggcatcatccgtacttctttggatggcaagtgtcgagcctcattggatagcagcaagtataattttggagttcttccttatggtgttgttgatccccgagcctgatagacaaagaacaccccaagataatcaattggcttatgtagtaatcggtttactatttatgattctaacggtagcagcaaacgaaatgggtttgttagagactaccaagaaagatctcggtatagggcatgtagctgtagaaaaccatcaccatgcagcaatgttagatgtggatctacatccagcttctgcctggacactgtatgcagtagctaccacgattatcacgcctatgatgaggcacactatagaaaatactacggcaaatattagcttaactgctattgcgaaccaagccgcaatattgatgggtttagacaaaggttggccaatttcgaaaatggacattggggtcccactcctagcactaggttgttattcccaagttaatccattgactttaacagctgcagtattgatgctagtagcccattatgcgatcatcggaccgggtctacaagcaaaagcaacgcgtgaagctcaaaaacgtaccgccgccggaataatgaaaaacccgacggtagatggaatagtagcaatagacttagatccagtagtatatgatgcaaagtttgaaaagcaactagggcaaataatgttattgatcttatgcacatcacaaattctcctaatgaggacgacttgggccttatgcgagtctataactttagcaaccgggcctctcaccacactttgggaaggatctcctggaaaattctggaataccacaatagcagtaagtatggcaaatatcttccgaggatcatatttagccggggccggcttagcgttttctctgatgaagtccctaggaggaggaagacgtggcacaggagctcaaggagaaacactcggagagaaatggaaaagacagttaaatcaactatcaaaatcagagttcaatacgtataaaagatctggcataatggaagtagaccgatccgaagctaaggaagggttaaaaagaggagaaactacgaaacacgctgtgtcaagaggcactgcaaaattacgatggttcgtggaacggaatttagtaaaacctgaaggtaaagtaatagatctcggctgtggaagagggggttggagctattattgtgcaggcttgaagaaagtaacagaagtaaaaggttacaccaaaggtggtccaggtcatgaagaaccaatacccatggctacttacggttggaacttagttaaactgcactctggcaaagacgtattctttattccaccggaaaagtgtgatacgttactgtgcgacataggtgaatcatctcccaatccaacaatagaagaagggagaactctaagggtgcttaaaatggttgagccatggcttaggggtaaccaattctgtataaaaattctgaacccatatatgccgtcggtagtcgaaacattggaacaaatgcaacgaaagcacggtggaatgcttgtaagaaacccgttgtcgcgcaactcaacacatgagatgtattgggtaagttgtggaacaggaaacatagtatccgctgtgaatatgacctcacgtatgctactgaaccgatttaccatggcacaccgaaaaccgacatacgaacgtgatgtagacttaggagctgggaccagacatgtagctgtagaaccagaagttgcaaacttggatatcattggtcagagaattgagaatattaaacacgaacataaatcgacgtggcattatgacgaggacaatccttacaaaacctgggcgtatcacgggtcatatgaagtaaagccatcaggatcagctagcagtatggtaaacggtgttgtcaaattgcttacgaagccctgggacgtgatacccatggttacacaaatagccatgacagatacaacacctttcggacaacaaagggtcttcaaggaaaaagtagatacaagaacgccgaaagccaagagaggtacagcccagattatggaagttaccgctaaatggctttggggtttcctgtcaaggaataagaaaccacggatatgtactagagaggagttcactcgcaaggtaagaagtaatgccgcaatcggggcagtatttgtggatgagaaccagtggaactctgcaaaagaagcggtagaagatgaaagattttgggatttagtgcacagagaaagagaactccacaaacaaggcaaatgtgctacttgtgtgtataatatgatgggcaaacgagagaagaaactcggtgaatttggtaaagcaaagggctcacgagctatatggtatatgtggttaggcgcacgctttttagaatttgaagcgttaggatttatgaatgaagaccactggttcagccgcgaaaatagcttaagtggggtagagggagagggcctccataaactagggtatattctgagggacatttcgaaaataccaggtggaaatatgtatgctgatgacacagcaggttgggacacccgaattacggaggatgatttacaaaatgaagcgaagataactgatataatggagcctgaacatgcgttgcttgccaaaagcatattcaaactcacatatcaaaacaaggttgtaagagtacaaagaccagccaaaaacggcactgttatggacgttattagtagaagggaccaaagaggatcaggccaggtaggaacatatggactaaacacattcacaaacatggaggcacaactaataaggcaaatggaatcagaaggaatattctctccgtctgagctagagacacctaatctcgcaggaagagtgttagattggttagagaaacacggagttgaacgtttaaagcgtatggcaatatcaggagatgactgcgttgtaaaacccatagatgataggtttgccacagcgctgactgcccttaacgacatgggcaaagtccgcaaagatatcccacaatgggaacccagtaaaggatggaatgattggcagcaggttccattctgttctcaccatttccatcaattaattatgaaagatggaagagagatagtcgtgccttgtagaaaccaagacgagctagttgggagagcacgggttagtcaaggagccggatggtcattgagagagacagcttgcttaggaaaaagttatgcacaaatgtggcaattgatgtacttccaccgccgggacttaagacttgctgcgaatgctatttgttctgccgtaccagtagattgggtaccaaccagccggacaacgtggtctatacatgcacatcatcagtggatgactactgaagatatgctctccgtatggaaccgtgtatggatagaagaaaatccatggatggaggacaagactcatatatcttcttggggcgacgtaccatacctaggaaaaagggaggaccagtggtgtggcagtttaataggattgacagcccgagcaacgtgggctacgaatatccaagtagccattaatcaagtgaggcgactaattgggaatgaaaattatttagattacatgacttctatgaaaagattcaagaatgaaagcgatcctgaaggcgccctgtggtaa

SEQ ID NO: 21582 - RNA, 9879 nt, synthetic construct
  misc_feature 1..9879: note = derived and/or modified CDS sequence (opt6) from DENV-1__FJ410242__SS-prME
  source 1..9879: mol_type = other RNA
tccgtgacaatgctattaatgctcatgccgactgcattagcatttcatcttacgactcgaggaggcgaaccacacatgatagtatctaaacaagaaagaggtaaaagtctcctttttaaaacgtctgctggagttaatatgtgcactttgatagcaatggatctcggagaattttgcgaagacactatgacgtacaaatgtccacgtattacagaagcagaacctgatgatgtagattgctggtgtaatgcgacagatacatgggttacctatggtacttgcagtcaaacaggcgaacacagacgagataaaagaagtgtcgctctcgctccacatgtcggattgggcttagaaacaagaacagaaacatggatgtcgagtgaaggagcttggaaacaaatacaaagagtggaaacctgggctctacggcaccctggatttactgttatagctctatttttagctcacgcaataggcacgtccattacacagaaaggaatcatattcatattgttaatgcttgtaactccttcaatggccatgcgatgcgtggggataggatctagagattttgtagaaggactgtcaggggcaacctgggtagatgtcgtattagaacacggatcctgtgtaacaacgatggcaaaagacaaaccgacacttgacatagaactactaaaaacagaagttactaacccagccgtcctaaggaaactatgcatagaggctaaaatatctaacacgacaactgactcgcggtgtccgacccaaggagaagcaacattagtagaagaacaagacgctaattttgtctgcaggaggacatttgtggatagaggctggggaaatgggtgcggtctcttcggtaaagggagtttaataacctgcgctaaatttaaatgtgtaacaaaattggaaggtaagatagtacaatatgaaaatctcaaatattccgtaatagttaccgtacatacaggagatcaacatcaagtaggtaatgaatcgactgaacacggtacaacagcaaccattacacctcaagctccatcgacggaaattcagctcactgattatggagccctgacactagattgttcacctagaactggactagacttcaacgaaatggtactactaactatgaaagaaaaatcatggttggtccacaaacaatggtttctagatctaccacttccatggacatccggagcgtcaacgtctcaagaaacctggaaccgaaaggatctcctagttacctttaaaacggcgcacgcgaagaaacaagaagtagtagtacttggtagtcaagagggagctatgcacaccgcactaacaggagctactgagatccaaacctctggaacaaccactatcttcgcaggacaccttaaatgtcgacttaaaatggacaagttgacgctgaaagggatgtcatatgtaatgtgcacaggtagctttaaactggaaaaagaagtggctgaaacgcaacacgggacagttttagtgcaaatcaaatacgaaggcacagacgcaccatgtaaaataccttttagcacacaagacgagaaaggagtaacacaaaatgggcgcttgattacagccaatccaatagtcactgacaaagagaagccagtgaatattgaggcagaaccaccttttggagagtcatacatagtcataggcgcaggagaaaaagccttaaagctatcgtggttcaagaaaggaagtagtataggtaaaatgttcgaggctacagcgaggggagctcgacgaatggctatcctgggcgacaccgcctgggactttggctcaatcggcggagtctttacaagcgtaggtaaattagtacatcaaatatttggtactgcatatggagtattgttttctggtgtttcatggacgatgaaaatcggcatcggcgtcttgcttacgtggttaggtttaaatagtaggagcacctcattaagcatgacttgtatcgctgtagggctcgttacactataccttggtgtaatggtacaggcagattcagggtgtgtaataaattggaaaggacgagaattaaagtgtgggagcggcatctttgttacaaatgaagtgcacacctggacagaacaatataagtttcaagccgactcccccaaacggttgtcggctgccatcggcaaagcatgggaggaaggagtgtgtggaatacgctctacgacgagactggaaaacattatgtggaaacaaattagtaatgagctaaatcatatactgcttgaaaacgacatgaagttcacagtagttgtaggtgatgtcgctggaatattagcccaaggcaagaaaatgattagacctcaacccatggaatataaatattcttggaaaagctggggaaaagccaaaataataggcgctgatgtccaaaacacaacgtttataatagatggcccgaacacccccgaatgctctgatgatcaacgagcttggaatatatgggaagttgaagattatggcttcggaatctttacgacaaatatatggctaaaattaagggactcatacacacaagtatgcgaccaccgcttaatgagcgctgcgattaaagatagcaaagccgttcacgcagatatgggctactggatagagtctgagaaaaacgaaacttggaaattagcaagggcctcattcatagaagtaaagacttgcatatggccaaaaagccatactctatggtcaaatggggttctagaaagcgaaatgataataccgaaaatttatggtggcccaatttcgcagcataactaccgtccaggatacttcacccaaacagccggtccctggcacctcggaaaactcgaacttgactttgatctatgtgaaggcacaactgtagtagtcgacgaacactgtggtaatcgaggaccgagcttgagaactacaacggtgacaggtaaaataatacacgagtggtgttgtagatcttgtactcttccacctctaagatttaaaggtgaagatggatgctggtatgggatggagattagaccagtaaaagagaaagaagagaatctcgtcaaatcaatggtaagtgcaggttcgggcgaagtcgattctttttcattgggactgctatgtatttcaattatgatagaggaagtaatgcgaagtaggtggtccagaaagatgctaatgacaggaacattagcagtatttttcctgttaataatgggacagttaacctggaacgacttgatacgactatgcatcatggtcggcgcaaacgcaagtgatagaatgggcatgggaactacctatctagcattaatggcaacctttaaaatgaggccgatgtttgcggtcggtttactatttcgaagattaaccagcagagaggtattattgttaacaatcggcttatcactcgtagcgtcagtagaactcccaaattctcttgaggaactcggtgacggtcttgctatgggtattatgattttaaaactgttaaccgattttcaaagccatcaattatgggcaaccctactttcattaacgttcataaaaacaacttttagcctccattatgcatggaaaacaatggcaatggtgctaagtatagtatctttgttcccattatgcttatcgacaacgagtcagaaaacgacttggctacccgtattactaggctctctgggatgtaaaccactaaccatgtttcttatagcagagaataagatatggggaagaaaatcatggccacttaatgaggggataatggcggtaggtatcgtatcaattctcttatcatcattgttgaaaaacgatgtgcctctagcaggccctctcattgcaggaggcatgcttatcgcatgttatgtaatcagcggatcatcagccgatttatctctagaaaaagcagcagaagtatcgtgggaagaagaagccgaacattccggggcatcacataatatcctagtcgaagtacaggacgatggcaccatgaagataaaggatgaggaacgggacgacacattaactatactattaaaagctacattattggctgtatcgggagtctatccactctcaatccccgcaaccctttttgtatggtatttctggcagaagaagaaacaaaggagtggtgtactctgggacacaccatcacccccagaagtggaaagagcagtactagatgatgggatttatagaataatgcaacgtgggttgttgggcagaagccaagtgggagtaggcgtgttccaagaaaatgtatttcacacaatgtggcatgtaacccgtggtgcagtgttaatgtaccaagggaaacgtttagaaccaagctgggcgagtgtaaagaaagatctcattagttacggaggaggatggagactgcaaggatcctggaataccggagaggaagttcaagtaattgcggttgaacccgggaaaaatcccaaaaatgtccagaccgctccaggtacttttaaaacaagcgaaggagaagttggagccatagccctagattttaaaccagggacatccggaagccctatagttaaccgcgaaggcaaaatagtcggattgtatggaaacggagtagtgactacctcaggtacttacgtatcggcgattgcacaagcaaaagcatctcaagaagggccgctaccggagatagaagacgaggtttttaggaaacgcaaccttacaataatggatcttcatcccggtagtggtaaaacaagacggtatttacccgcaatagtgcgagaagcaatcaagcgaaagttaagaacactgatactcgcaccaactcgggttgtggccagcgagatggctgaggctttaaaggggatgccaattagataccaaacaactgctgttaaaagcgagcacaccggaaaagagattgtggatttgatgtgccatgccacattcacgatgcgtttgttatcccctgttcgagtaccgaactacaacatgataataatggatgaagctcattttacggatccttcaagcattgccgcccgtggctatatatctacacgcgtggggatgggagaagcagccgcaatcttcatgacggccactcccccagggtcagtggaagcatttccccaaagtaacgcggtaatacaagatgaagagagagacatcccagagcgatcatggaatagtggatatgaatggataacggacttcccaggaaaaactgtttggtttgtgccatcaataaaatcaggaaacgatatcgcgaattgcttaagaaagaacggcaaaagagttatacaattatctcgaaagacattcgatactgaatatcagaaaactaaaaacaatgattgggattatgtggtcacaacagatatttcggagatgggtgccaactttcgcgcagacagagtcatcgatcccagacggtgtctgaagcccgtaatattaaaggatggtccggaaagagtgatccttgctggccccatgcctgtaacagtggcgagtgctgcccaacgtcgaggaaggataggcaggaaccataataaagagggagatcagtatatttatatgggccaacccttaaataatgatgaggatcatgctcattggactgaagcaaaaatgctacttgataacataaacactccagaaggcataataccagctttatttgaacccgaacgagagaaaagcgcagctattgatggagagtataggctaagaggcgaagcacgtaaaacgttcgtagaattgatgcggaggggtgacttacccgtgtggctatcatacaaggtagcgagtgagggtttccaatattcagacagacgatggtgtttcgacggcgaacgaaataatcaagtattagaggaaaatatggatgttgaaatatggacaaaagagggagaaagaaagaaactgcgacctaggtggctagatgctagaacatactctgatccattagctctcagagagttcaaagaatttgccgctggtagacgatccgtctcaggcgatttaatcttggaaattggcaaattaccacaacatcttacccaacgagcgcaaaatgccctagacaatttagtcatgttacataactcggaacaaggcggtcgcgcttaccgtcacgcaatggaagaattgccagacacaatagaaacgttaatgctattggctcttatcgcagtattaacaggtggtgttacgctgttctttctttcgggaagggggttgggaaaaacttccattgggctattatgcgtgatggcttctagtgttttgctttggatggcatcagttgagccacactggatagccgcgagtatcattttggagttctttctcatggttttgcttattccagaacctgatcgccagagaacacctcaagacaatcagctcgcttacgtcgtaataggtttgctgtttatgatcttgacagttgctgctaacgaaatgggtttattagaaactaccaagaaagatttaggaattggacatgtggccgctgaaaatcaccaccacgctgcaatgctagacgtagatctacacccagcaagtgcctggaccctatacgctgtcgctacaacaataattacacccatgatgagacatacaattgagaacacaacagctaatatatcactaaccgcgattgcgaaccaagctgcaattttaatgggacttgataaaggatggccaatttcgaagatggacatcggtgtgccattactggcgctcggatgctatagccaagtcaatcccctaactttaacagcagcggtactaatgttagtcgcccattacgccatcataggtcctggtctacaagctaaagcgacgcgagaagcacaaaaacgaaccgcagcggggattatgaagaatcctactgtagatggaatcgtagcaattgacctggatcctgtggtatacgatgctaaatttgagaaacagctaggacaaataatgctcttaatcctatgtacgtcgcaaatattacttatgagaacaacatgggcactatgtgaaagtattacattagcaactggtccactaaccaccttatgggaggggagcccgggcaaattttggaatacgactatcgcagtaagtatggctaatatttttagaggaagctaccttgcgggtgccggactagctttttctttaatgaaaagcctcggtgggggccgccgcggaacaggtgcacaaggagagactctgggtgaaaaatggaagcgacagttaaaccaattaagtaaaagtgagttcaatacttacaagaggagtggtattatggaagtggacagatcggaagcaaaggaaggtttaaagcgtggagaaacaaccaaacatgcagtaagtcgtggaacggctaaattacgatggttcgtagagcgaaacctagtaaaaccagaaggaaaagtcatcgaccttggttgtggaagaggcggatggtcatactactgtgccggtttaaagaaggtgacagaagtcaaagggtatactaaaggaggtcccggacatgaagaacccattcctatggccacatatggatggaatcttgtaaagctacacagtggcaaggatgtcttctttattcccccagaaaaatgcgacaccttgttgtgtgacataggagaatcgagccccaatcctacaatcgaagaagggcgtaccttacgggtattaaaaatggtggagccgtggctccggggaaatcagttctgtataaaaattttaaatccatatatgccgagcgtagtagagaccttagaacaaatgcaaaggaaacacggaggtatgctagtaagaaatccattatccagaaattcaacgcatgaaatgtattgggtatcgtgcggcactggaaatatagttagtgcagtcaacatgacaagtagaatgctgctgaaccgctttacaatggcgcatcgcaaaccaacgtacgaaagggatgtagatctcggggcagggacaaggcacgtagcggtggagcccgaagtggcaaatttggacatcattggccaaagaatagagaatatcaaacatgagcataaaagcacatggcattatgacgaagacaatccatataaaacctgggcctaccacggttcatatgaggtaaagccctcaggtagtgcttctagcatggtgaatggagtagtcaaacttctcaccaagccatgggacgtcataccaatggtaactcaaatagcaatgacagataccacaccttttggtcaacagcgagtattcaaagaaaaggttgatacacgaacaccaaaagcgaaaagaggcacagcccaaataatggaagtcactgctaaatggctttgggggtttttgagcagaaataagaaaccaagaatatgcacacgggaagagttcacacgtaaagttcgaagtaatgctgctattggtgcggtgttcgtggatgaaaatcaatggaactccgccaaggaagctgttgaagatgaacggttttgggacttagtccatcgagagcgcgagctacataaacaaggcaaatgtgctacatgtgtatacaacatgatgggaaaaagagagaagaaattaggagaatttggtaaagccaaaggttcacgggcaatttggtatatgtggttaggggcacgcttcctagagtttgaagcactaggattcatgaatgaagaccactggttcagtagagaaaattctttatcaggagtcgaaggagaaggtctacataaactaggttacatactaagagatataagcaagataccaggtggcaacatgtacgcagatgatacggcagggtgggatacgcgaattacagaggatgatttgcaaaacgaagcaaagataactgatataatggaaccagagcatgcactccttgcaaaaagtatatttaagctaacatatcaaaacaaagtagtaagagtacaacggccagctaagaacggcacagttatggacgtgataagtcgaagagatcagcgggggagcggtcaagtgggtacttacggtctaaacacatttacaaacatggaggcgcagctaattcgtcaaatggagagtgaaggcatatttagcccctcagaacttgaaacacctaacttggcgggaagagtactagattggctagaaaagcatggagtagaacgccttaagcgcatggcaatatcaggagacgattgtgtcgtcaaacctatagacgatcgcttcgccaccgcgcttacagctttaaatgacatgggtaaagttagaaaggatattccacaatgggaaccgtctaaagggtggaatgactggcaacaagtcccgttttgtagtcatcacttccaccaattaattatgaaagatggcagagaaatagttgtaccttgcagaaatcaagacgaattagtcggccgagcccgagtatcacagggcgccggatggtcgctacgtgaaacggcatgcttgggtaaaagttacgcccaaatgtggcaactaatgtattttcaccgtagagatttacgactagcagcaaacgcaatttgcagcgctgttcctgttgattgggtcccaacatctcgaacaacatggagtattcatgcccaccaccaatggatgacaactgaggacatgctatcagtatggaatcgtgtatggatagaagagaatccatggatggaagataagacacacattagctcatggggcgatgttccatacctaggaaaaagggaagaccagtggtgtggctcgctaataggattaaccgcaagagcaacttgggcgactaatattcaagtagctatcaatcaagtgcggaggcttataggcaacgaaaattatctggattatatgacatcgatgaagcgtttcaaaaatgaatcagatcctgaaggagcactctggtaa

SEQ ID NO: 21583 - RNA, 9879 nt, synthetic construct
  misc_feature 1..9879: note = derived and/or modified CDS sequence (opt6) from DENV-1__FJ410243__SS-prME
  source 1..9879: mol_type = other RNA
tcagttaccatgttgctaatgttgatgcctacggccctagccttccacctaacaacccggggaggggaacctcatatgatcgtctcaaaacaagaaagaggaaaatcactcttatttaaaacatcagcgggagtaaatatgtgtacgttaatagcaatggatttaggagaattttgcgaagacactatgacatataaatgtcctagaattacagaggctgagcccgatgacgttgactgctggtgcaacgcgacggatacatgggttacttacggaacatgctctcagactggagaacacagaagagataaaagatccgtggccttggccccacatgtaggattaggattggaaacgagaacagaaacatggatgtcttctgagggagcatggaaacaaatacagcgtgtggaaacttgggctcttaggcatcctggtttcacggtcattgcattatttctcgctcacgcaatcgggacgagtattacacaaaaaggaatcatctttatattattaatgttagtaacaccttctatggcaatgcgttgcgttgggatcggttctagggacttcgtggaaggattatcaggagccacatgggtagatgtcgttttagagcacggtagttgcgtcaccacaatggcgaaagacaaaccaactttggatattgaattactgaaaacggaagtgactaatccagcagttctaagaaaactatgcattgaggcgaaaatatctaatacgacaaccgatagtagatgtccaactcaaggtgaagccacacttgtggaggagcaagatgcaaattttgtctgcagacggacctttgtagatagaggttggggtaatggttgtggactgtttggaaaaggttctttaataacctgcgcaaaatttaaatgtgttaccaaacttgaaggaaaaaccgtacagtacgagaatttaaaatacagcgtcattgttaccgtccatacgggtgaccaacaccaagttggaaatgaatcgacggagcatggaacgacagctactattacgccacaagccccatcaacagagatacagcttactgattacggagctttaacattagattgttctccgaggactggactagattttaatgaaatggtgttacttacaatgaaagaaaaagcgtggttagttcataaacaatggtttttagatctccccctcccctggacatcaggtgcatcgacaagtcaagaaacatggaatagaaaagacctacttgtaacatttaagacagctcacgcaaagaaacaggaagtcgtcgtgttaggttcccaagagggggcgatgcatacagcattaaccggcgcaacagaaatacaaacgagcgggacaacgacgatctttgcggggcatcttaaatgccggttgaaaatggataaattaacgctaagagggatgtcgtatgtaatgtgcaccgggtcctttaaacttgaaaaagaagttgcagaaacccaacatggaacagttcttgtgcaaatcaagtacgaaggtaccgatgctccttgtaaaatcccattttcaacacaagatgaaaaaggtgtaacgcaaaacggtagattgatcaccgctaaccccattgtgaccgataaagaaaaacccgtaaatatcgaagcggagcccccgtttggagagagctatattgtaataggcgccggtgaaaaagcactaaaattaagctggtttaagaagggatcatcaataggtaaaatgtttgaagcaacagcacgtggagcacgaaggatggcaatattaggagacacagcctgggattttgggtctatcggtggtgtcttcacatcggtgggcaagctagttcatcaaatctttggcactgcatatggcgtattattctcgggcgtcagttggacaatgaaaatagggataggagtcctattgacttggcttggattgaactcgcgttctacaagcctttctatgacatgcatagcagtaggtctagtcactctttatctaggagtaatggtccaggcggatagcggctgcgtaattaattggaaggggagagaattaaaatgcggatctggtatctttgtaacgaatgaagtacacacatggacggaacagtacaaatttcaagccgactctcctaaaagattaagtgctgctataggtaaggcttgggaggaaggagtgtgtggaataagatccgcgactcgtttagaaaacattatgtggaagcagatatcaaacgaattgaaccatatattgttagaaaatgacatgaaatttactgtggttgtaggtgacgtggctggtatattagcacaaggcaagaaaatgatacggcctcaaccgatggaatataaatattcctggaaatcatggggcaaagcaaaaattataggggcagatgtgcaaaatgcgacgttcatcatagatggaccaaatactcctgaatgtcctgacgatcaaagagcttggaatatatgggaggttgaagattacggatttgggatttttacgactaacatatggttaaaactccgcgattcatacacgcaggtatgtgatcaccgattgatgtcagctgctattaaagacagcaaggcggtacatgcggatatgggatattggattgaatcggagaaaaatgaaacatggaagttagcccgggcatcgtttattgaagttaagacatgcatctggccgaaatctcatacgctatggtctaatggagtcctggagtcggaaatgattataccaaaaatatatggaggcccaattagccagcataactacagaccaggttatttcacacagacagcagggccatggcatttaggaaaattagagttagattttgatctctgcgaaggaacaacggtagtagttgacgagcattgcggtaatagaggtccgagtttgcgaaccacaactgtgacgggaaagattattcatgagtggtgttgcaggtcgtgcaccctgcccccgcttagatttaagggggaagacgggtgctggtacggcatggaaattagacctgtaaaggaaaaagaggaaaacctcgtaaaaagtatggtaagcgcaggaagcggggaagtagacagcttttccttaggattattatgcatatcaataatgattgaggaagtaatgaggagtagatggagccgtaaaatgcttatgacagggacacttgcagtattctttctgctaattatgggacaacttacttggaatgacctaattcgactttgcatcatggttggcgcaaacgctagcgacaggatgggaatgggtactacctatcttgctttaatggcaacttttaaaatgagaccaatgttcgcggtaggattgctatttagacgcttgacttctcgcgaagtactactacttacaatagggttaagcctcgtagcatcggtggaattgccaaattcattggaagaactaggggatggtctcgccatgggcataatgatacttaaactactaacagattttcagagtcatcagctatgggccacgttactttctctgactttcatcaaaaccacatttagtttgcattatgcttggaaaactatggcgatggttttatcaatagtgtctttattcccactctgcctaagcactacaagtcagaaaaccacttggttaccagtattattaggttctttaggttgcaagcccttaacgatgtttctgatcgcagaaaacaaaatatgggggcgaaaatcttggcctttaaacgaagggatcatggcagtaggaatagtctcaatattacttagtagcttactgaaaaacgacgttcctcttgcagggccattgatagcaggcggtatgctaatagcgtgttatgtgataagtggaagctcagcagacttatccctagaaaaagccgctgaggtttcttgggaagaggaagctgaacactcaggtgcatcacataatattctagtagaagtacaagacgatggtccaatgaaaataaaagatgaagagagagatgatatgctaacgatacttttgaaagccacgttactagctgtcagtggagtttatcccctaagtataccagctacactcttcgtctggtacttttggcagaagaagaaacaaaggtccggagtgttatgggatacacctagtcctccggaagtggaaagggcagtgttagatgacggaatatatcgaataatgcaaagaggactattagggagatcccaggtaggagttggcgttttccaggaaaatgtgtttcatacaatgtggcacgtaaccagaggtgcggtactgatgtaccagggtaagcgtcttgaaccgagctgggcgtcagttaagaaagatctaataagttatggaggtggatggaggttacaaggcagctggaacacaggagaagaggttcaagtcatcgcagtcgaacccggcaagaatcccaaaaatgtacaaaccgcacctggaacatttaaaacaagtgagggagaggtaggtgcaattgctcttgattttaaacctggtacctcagggagtccaatagtaaaccgggagggtaaaatagttgggctgtatggaaatggcgttgtaactacatcgggaacgtatgtttcagcaatagcccaggcaaaggcctcgcaagaagggcctttgccagagatagaagatgaggtattcagaaagcgaaatcttacaataatggacctacacccaggatctggaaaaaccagacggtatctaccagcaatagttcgggaagcaataaagcgtaaactacgtacgttaattttagcacccacaagagtggtcgcgagtgagatggcagaagccttaaaaggcatgccaataagatatcaaacgaccgcggttaaaagcgagcatacgggcaaagagatagtagacttaatgtgccatgcgacgttcacaatgagattactaagcccggtaagagtacctaactataacatgattattatggacgaagcacatttcacggatccaagttcaatagcagcaagagggtatatttccacacgcgttgggatgggggaagctgctgcaatatttatgaccgcaacaccaccggggagtatggaagcgtttccacagtcaaatgcggtgatacaagacgaggagcgagatatccctgaaagatcatggaactcaggttatgagtggatcacagactttcctggaaaaacggtctggtttgtaccctctataaagtctggaaatgatattgcgaactgcttaaggaaaaatggcaagagagtcatacaattatctaggaaaacctttgatacggagtaccaaaagacgaagaacaatgactgggactacgttgtcaccaccgatatttcagaaatgggcgcgaattttagagcagatcgtgttatagacccaaggcgctgtttgaagccagtaatcctaaaagacggtccagaacgtgtgatactagcaggccctatgccagtcaccgttgcatcagcggcccaaagaagaggaaggattggcagaaaccataataaggaaggtgatcagtacatctacatgggtcaacctctaaacaatgacgaggaccatgcacattggaccgaagccaaaatgcttctagataacataaatactccagaaggcattattccggctttgtttgaaccagaaagggaaaagtcagcggcgatagacggcgagtataggttaagaggagaagctcgaaaaacgtttgtagaattaatgagacggggtgatttaccagtgtggttaagttacaaagttgcaagtgaaggatttcagtattctgacagacgatggtgtttcgatggtgaaagaaacaaccaagtccttgaagaaaatatggacgtagaaatctggacaaaagagggcgaaaggaagaaattaagaccgcgctggttggatgcaaggacatattctgatccattagctttacgcgagttcaaagagtttgcagcagggaggcgatcagtgagtggagatcttatattggagataggaaaattaccgcaacacttaacacaacgggcacagaacgcgttagataacctagtcattctacacaacagcgaacaaggaggtcgcgcatacagacacgctatggaagagttaccagacacaatagaaaccctcatgttattagcactcatagcagttctaacgggcggagttacgctctttttcctgtccggacgagggttagggaaaacatcaataggcctcctatgtgtaatggcttcaagtgtcttattatggatggcgagtgtagagccccactggattgcagcaagcattattctagagtttttcttgatggtactactaattccggagcctgacagacaaagaacaccccaagataaccaattagcctatgttgtaataggcctcttgtttatgatattaacagttgccgccaatgaaatgggccttttggaaacaactaagaaagacttaggtataggacacgtagcagtcgagaatcatcatcatgcagcaatgctagacgtagacctgcacccagcatcagcttggacattatatgccgtcgcaactacaataatcactcctatgatgagacacacaatcgagaatacaacagcaaatatatcgctcactgcaatagcaaatcaagcagccatattaatgggtctagacaaaggttggcctataagtaaaatggacattggtgtcccattgttagccttaggatgttatagtcaagtaaatccattaacattgacagctgctgttttgatgttggtcgcccattatgccatcataggtcctgggttgcaggcaaaagcgacgagagaagctcagaagaggacagcagcgggaatcatgaaaaacccgactgtagacggaatagtagcaatcgatttagatccggtcgtatatgacacaaagtttgaaaagcagctaggccaaatcatgttattaatattatgtacttcgcaaattctcttgatgagaactacgtgggccttgtgtgaaagtatcaccttagctaccgggccattaaccaccttgtgggaaggatcacctggtaaattttggaatacaacaattgctgttagtatggcaaatatttttaggggctcatatcttgctggtgctggcttagcgttctcgctcatgaagtctttaggaggcggacgacgaggaaccggcgcacaaggtgagacattaggtgaaaagtggaaaagacaattaaaccagctttcgaaatccgagtttaatacttataagcgaagtggtataatggaggtagatcgttcggaagctaaagaaggattgaagcgtggagaaacaactaaacatgcagtctctagaggcacagcgaagttgagatggtttgtcgagcgaaacctagtgaagccagaaggcaaggtcattgacctcggatgcggaagaggaggatggagttattactgtgctgggttgaagaaagttaccgaagttaaaggctatactaagggcggaccaggacatgaagaaccaattcccatggcaacttacggatggaacttagtaaaactacactctggaaaagacgtattctttattccacctgagaaatgtgataccttgctatgtgatataggagaaagctcaccaaaccccactatagaggaggggcgcacattaagagttcttaaaatggtagaaccttggctacgaggaaatcaattttgcattaaaatactaaacccttacatgccctctgttgtggagactctagagcagatgcaacgaaaacacgggggaatgctagtacgaaatcctttgtcaagaaactcaacacatgagatgtactgggtatcatgtggcacaggtaacatcgtaagtgcagtgaatatgacctctagaatgttattaaaccgttttacaatggcacacagaaaacccacgtatgaaagagacgtggacctgggagccgggacaaggcatgtagcagtcgagcctgaagtcgcaaatcttgacataattggtcaacgtatcgaaaatataaaacacgagcataaatccacttggcactatgatgaggataacccatataagacatgggcgtatcatggatcgtacgaggtaaaaccatctgggagtgcatcaagtatggtaaatggcgtagtaaaacttctaacaaaaccatgggacgtaattcctatggtcactcaaatagcaatgacggatactaccccctttggacaacaacgagttttcaaggaaaaagtagacacaagaacccctaaagccaaacgtggaacagcccagataatggaagtcacggccaaatggctatggggctttctatctcgtaataagaaacctcgcatctgtaccagagaagagttcacacgtaaggtgagatctaatgctgccattggtgctgtatttgttgacgagaatcaatggaactcagctaaagaagcagtggaagacgagcgtttctgggacttagtacacagggaacgagaattgcataagcaaggtaagtgtgcaacatgcgtatataacatgatgggaaaaagagagaagaaactgggagaatttggaaaagctaaaggaagtcgagcgatttggtatatgtggctcggggccagatttttggagttcgaagcacttggtttcatgaacgaagatcattggttcagtagagaaaacagtctaagtggagtagaaggcgaaggactgcacaaacttggctatatactcagagatatatctaaaattcctggtggaaatatgtacgcggacgataccgcagggtgggacacacgaataaccgaagatgatcttcagaacgaggcaaagataacagacataatggaaccagaacatgcactattagcaaagagtatattcaaattgacttaccagaataaagtagtaagagtacaacgaccagctaaaaatgggactgttatggacgtaataagcagaagggaccagaggggatcaggacaagtaggtacgtatggtttaaacacgttcactaatatggaagcacaactaataagacaaatggaatcagagggcatattttcaccctccgaactggaaacgcccaacttagctggaagagtattggattggcttgaaaaacatggagtagaaagactgaaaagaatggcgataagtggcgatgattgtgttgtgaaaccgatcgatgatagatttgcaacagctctaacagcgctaaatgacatggggaaagtccgtaaagacataccgcaatgggagccatcgaaaggatggaacgattggcaacaggtaccattctgttcacatcactttcaccaattgataatgaaagatggacgcgaaatagtagttccatgtagaaaccaagatgaattagtcggtagagcaagagtaagtcaaggagcaggttggtcattaagagagaccgcatgtcttggtaaatcctacgcccaaatgtggcagctcatgtatttccatcgacgagacttaagattagcagctaatgccatatgcagtgcggttcccgtggattgggtaccaacttcacgtacgacctggagtatacacgcacatcatcaatggatgactaccgaggacatgttgtcagtatggaatagagtctggatcgaggagaatccttggatggaggataaaactcacatatcctcatggggcgatgttccatacctaggcaagcgcgaagaccagtggtgcggttctttaataggcttaacagcacgtgcgacatgggcaacaaatattcaagtagccattaatcaagtacgtaggttaatcggtaacgaaaattatcttgattacatgacttcaatgaaaagattcaaaaacgaaatagacccggaaggcgctctgtggtaa

SEQ ID NO: 21584 - RNA, 9879 nt, synthetic construct
  misc_feature 1..9879: note = derived and/or modified CDS sequence (opt6) from DENV-1__FJ410244__SS-prME
  source 1..9879: mol_type = other RNA
tctgtgactatgcttttaatgttaatgccgactgcactagcatttcatcttacaaccaggggaggagaaccacatatgatagtgtccaaacaagaacggggtaaatcccttctatttaaaacatccgctggcgttaatatgtgcacattaattgcaatggatttaggagaattttgcgaagatacaatgacctataaatgcccacgtatcacggaagcagaaccagatgatgtagactgttggtgcaatgcaacagacacatgggtgacttatggcacgtgtagtcaaactggcgaacatcgaagagacaaaagatcggtagcgcttgcaccacatgtgggactgggattagaaactcgaacagagacctggatgtcctcagaaggcgcatggaaacaaattcaacgtgtagaaacatgggcacttagacacccaggattcaccgtgatcgcattgtttttagcacatgcaatcggaacctctattacacaaaaaggtataatatttatcttactaatgctggtgacgccatcgatggccatgaggtgcgtgggaatagggagtcgagattttgtagaaggattatccggagcaacctgggttgacgtggtattagaacatggatcgtgtgttaccacgatggcaaaagataaaccaacattggatatagagctattaaaaacagaagtaactaatccggcggtattacgcaaattatgcatagaagcaaaaatctctaacacaacgactgattcacggtgccctacgcaaggagaggccacgctagttgaagaacaagatgcaaactttgtatgtcggaggacgttcgtagaccgtgggtgggggaacggttgcggcttgtttggtaaaggctcattaataacttgcgctaaatttaaatgcgtaacaaaacttgaaggtaaaacggtacagtatgaaaatctcaaatattccgtaatagtaacagttcacaccggagatcagcatcaggtaggcaatgaaagtaccgaacacggtactacagccacaataactccacaagcaccatcaactgaaatacaactgaccgattatggtgctttaacacttgactgtagtccaagaacaggcttagacttcaatgaaatggttttactgacaatgaaagaaaaatcgtggctggttcataaacagtggttcctagatctaccgttgccctggacaagtggagcatctacatctcaggaaacatggaacaggaaagaccttctagtaacttttaaaacggctcatgccaagaaacaagaagttgtagtcttaggctcgcaagaaggagcaatgcataccgccttaacaggtgctacagaaattcaaacaagtggaacgactacgatttttgctggacaccttaaatgtaggttaaaaatgaataaactaacattaaaaggaatgtcatatgtaatgtgtaccgggtcatttaaactcgaaaaagaagttgcggaaacccaacatggaacagtattggtgcaaattaaatacgaaggcacagatgcgccatgtaaaatcccctttagtacgcaagatgaaaaaggtgttacccaaaatggaaggttaataacagctaatcccatagttacagataaagaaaaacccgtgaatatagaagccgagccacctttcggcgaaagttacatcgtgataggggctggagaaaaagcattaaagctatcctggttcaagaaaggatctagtataggaaagatgttcgaagcaacggcaagaggagcaagacgtatggcaattctgggtgataccgcctgggacttcggaagcatagggggcgtttttacaagcgtagggaagttagttcaccaaatatttggtacagcgtacggagtattattttcgggtgtgtcatggacgatgaagatagggataggtgtcttacttacatggctaggactaaatagtagaagcacgagtttaagcatgacatgcatagccgtaggattggtgacactctatttaggagttatggtacaagctgactcaggatgcgtaattaactggaagggtagagagttaaaatgcgggtcaggtatatttgttacaaatgaagtccacacctggactgaacagtacaaattccaggctgatagtccaaaaagactgtcggcggctataggaaaagcatgggaagaaggagtatgtggtattaggtccgcaacacggctcgaaaatattatgtggaaacaaatatcaaacgagttaaaccatattctattagaaaacgatatgaaatttacagtagtagtcggggatgtagccggtatactcgcccaaggtaagaaaatgatcagaccacaaccaatggaatataaatattcttggaaatcttggggaaaggctaaaattatcggggccgatgtacaaaatactacatttataattgatggaccgaacacaccggaatgcccagacgaccaacgagcttggaacatctgggaagtggaagattatggtttcggcatttttacaacaaatatatggttaaatctaagagatagttatacacaggtatgcgaccacaggcttatgagtgcggcaattaaagatagtaaggccgtacatgcagatatgggttattggatcgagagtgagaaaaatgaaacatggaaacttgcaagagcctcatttatagaagttaagacatgtatatggcctaaatcccatactctatggtctaacggtgtattagaaagcgaaatgattattccgaaaatctatgggggtccgatatcgcaacacaattaccggccaggatactttacccaaacggccggaccatggcatcttgggaagttagaacttgatttcgatctatgtgaagggactacagtcgtagttgatgaacactgtgggaacaggggtccatcattgcggacaactacagtgaccgggaaaatcatccacgaatggtgttgcaggagttgcacattaccgcctcttcgattcaaaggggaagatggttgctggtacgggatggagattagacccgtgaaggaaaaagaggaaaacttagtcaaaagtatggtaagtgctggaagtggggaagttgattcattctctctcgggttgctctgcatctctataatgatcgaagaagtaatgagaagccgctggagtcgcaaaatgctgatgaccggtacgttagcagttttcttcttgctcataatgggacaattaacttggaacgaccttattagactatgtatcatggtaggggccaacgcatcagatcgaatgggaatgggcactacatatttggcattaatggctacttttaaaatgagaccaatgttcgcagtcggacttctattcagaagactaacatcccgtgaggtattactcctgacaataggtctatctttagtagcatccgttgaattaccaaattctttagaagaacttggtgatggattagcaatgggtataatgatcctgaaactattaaccgatttccaaagtcatcaactatgggctacactactaagtttgacatttattaagactactttctcgttgcactacgcatggaaaacgatggcaatggttctatcaatagtcagtctcttccccttatgtctaagtaccacctctcagaaaactacgtggttaccggtactactcggatcgcttggatgcaagcctttaacaatgtttttaatagctgaaaacaagatttggggaagaaaatcgtggccactgaacgaaggtatcatggcagtggggatagtatcaatacttttaagttctttgttgaaaaacgatgttccactagcagggcctcttatagcgggtggtatgctaattgcgtgctatgttatatctggatcatcagctgacttaagtctagaaaaggcagcagaagtttcttgggaagaagaagccgaacactccggtgcaagtcataacatcttggtagaagtacaagatgatggcacgatgaagataaaggacgaagaacgtgatgacacattaacaattttattaaaagctacactattagccgtctctggagtttatccccttagcataccagccacacttttcgtttggtatttttggcagaagaagaaacagcgtagtggagtattatgggacactccaagtcctccagaagttgaaagggcagtcctcgatgacggaatttatagaataatgcagcgggggctacttggaagatcacaagttggtgtaggagtctttcaagagaatgtcttccacacaatgtggcacgttaccagaggggccgtattaatgtaccaaggcaaaagactagaaccatcatgggcgtcagtcaagaaagacttaatctcatacggaggcggatggcgtcttcaaggatcatggaacacaggagaagaggtgcaagtcattgccgttgaacccggcaaaaaccccaaaaacgtccaaacagcaccaggaaccttcaagacatcggaaggggaagttggcgcaatagcccttgactttaagcctggtacaagtggtagccctatagtaaacagagagggtaaaatagtaggattatacggtaatggagtcgttactacaagtggaacatatgttagtgccattgctcaagctaaagcgtcacaggaaggacccctaccagagattgaggacgaagtctttcgaaaaagaaatttaacgataatggacctccatcctgggagtgggaaaactaggaggtacttacctgcgatagtccgagaagctattaaacgtaagctcagaacactcatactagctcccacgcgtgtggtagcctcggagatggccgaagccttaaaaggtatgcctattagatatcagaccacagctgtcaaatcggagcacacgggtaaagaaattgtcgatttaatgtgtcatgcaacttttacaatgagattgctatcgcccgtaagagtaccaaattataacatgattattatggatgaagcacattttacagatccatcaagtattgcggcgcgaggatatattagcacccgagtaggcatgggtgaagcggcagccattttcatgacagctacccctccaggttcagtagaagcattcccacaatccaatgcgataatccaagatgaagagagagacataccggaacgttcatggaactccggctatgaatggataacagatttcccaggaaagactgtatggtttgtgccgagtataaaaagtgggaacgatatcgctaattgtttacgtaaaaatggaaaaagagttatacaattatctagaaaaacatttgatacggaataccagaaaactaagaataatgattgggactatgttgttactactgacatctccgaaatgggagcaaacttcagggccgaccgtgttatcgaccctcgacgatgtttgaaaccagtaatactaaaagacggacctgaacgagtcatattggcagggcctatgcccgttacggttgcatctgccgcacagagacggggtagaataggacgaaatcataacaaagaaggtgaccagtatatatatatgggtcagcctctaaataatgatgaggatcacgcacattggactgaagccaaaatgcttttagacaatatcaacacgcctgaaggaattatacctgcgttatttgaaccagaaagggaaaagagtgcggcaatcgacggtgagtatcgattaaggggagaagcacgtaaaacatttgttgaattaatgaggagaggagatctaccagtatggctaagctacaaagtggcttctgaaggcttccaatattccgacagaagatggtgttttgacggagaacgaaataatcaagtcttggaagaaaatatggatgtagaaatttggacaaaagaaggtgaacgaaagaaacttagaccaagatggttagatgccagaacatatagtgatcctttagctttgagggaatttaaagaatttgcagcaggcaggcggtctgtttcgggagatttaatattagaaataggcaagctaccccaacatcttacacaaagagcacaaaacgcactggataatctagtcatgttacacaattcagagcaaggcggccgggcatatagacatgcaatggaagaacttccagatacgatagaaacattaatgctattagctttaatagctgttttgacgggaggcgtaacactatttttcttatcgggcagaggattaggcaaaaccagcatcgggttgctctgtgtaatggctagctcagtgctactttggatggcatcagttgaaccacattggattgctgcctctattatacttgagttctttttgatggttttattaatcccagagccggacaggcaaagaactccacaggacaaccaattagcgtatgttgtaatcggtctcctatttatgatattaacagtagccgcaaatgaaatgggccttctagaaacaacgaagaaagaccttggcataggtcacgtcgcagttgaaaatcatcatcacgcagccatgctggatgttgaccttcaccctgcttctgcatggacgctatatgccgtagcgactacaattataactccgatgatgagacatactattgagaacacaactgccaacatttcactcactgcgatagcaaatcaagctgcaatattaatgggtctagacaaaggctggcctatctccaaaatggatataggcgtacctttattagctttaggatgttacagtcaagttaatccactgaccttaacagcagcagttctcatgttagtagctcactacgctatcatcggtcctggacttcaggctaaagcaacaagagaggcacaaaaacgtaccgcggccggtattatgaaaaaccccacagtagatggtatagttgcaatagacttagatccggtcgtatatgatgctaagttcgaaaaacaacttggtcaaataatgttactaatactatgcacctctcaaatactacttatgcgtacaacttgggctttatgcgaatccataacgttagcgactggcccgctcactactctctgggaaggatcacccggaaagttctggaatacaacaatagcagtctccatggctaacatttttagaggcagttacctggccggtgcagggctagcattttctctgatgaagtcacttggaggaggaagaaggggaacaggtgcacaaggtgaaacattaggcgaaaaatggaaaagacaactcaaccaattaagcaaatcggaatttaatacctataaacgaagtggcataatggaagtcgaccgttctgaagctaaagagggattaaaacgcggagagactacaaagcatgcagtttctcgtggtactgcaaaactacgatggttcgttgaacgtaatttagtgaagccagagggcaaagttatagatcttggatgcggtcgtggaggatggagctactattgtgctggacttaagaaagtaactgaagtgaagggctacactaaaggagggcccggtcacgaggaacccatacctatggcaacatacggatggaacttagtaaaacttcacagtggaaaggacgtattctttataccaccagaaaagtgtgatactctactatgtgacattggagaatcatctccaaaccctacaatcgaagaaggaaggactctcagagtgctcaaaatggttgaaccttggcttcgtggtaatcagttctgcataaaaattctaaacccttatatgccaagcgtagtcgaaacccttgaacaaatgcagagaaaacacggaggtatgctcgtaagaaatccgctaagtagaaattccacccatgagatgtattgggtctcctgcggaactgggaacatcgtatcggctgtaaatatgacaagtagaatgctactcaatcgatttacaatggcacacagaaaacccacctacgaacgggatgtagatttaggagcaggtactagacatgtagcagttgagcctgaagtgcctaatctagatatcattggccaaaggatagaaaacattaaacatgagcacaaatcaacatggcactatgatgaagacaatccgtataagacatgggcgtatcacggatcgtacgaagtcaaaccatcaggatctgcaagcagtatggttaacggagtcgtcaagctattgactaaaccttgggatgtcataccgatggtgactcaaattgcaatgacagatactacgccttttggccagcagcgggtcttcaaagaaaaagtagatacaagaacaccaaaagcaaaaaggggcacagctcaaattatggaagttactgctaagtggctatggggatttttatccaggaataagaaaccacggatatgtactagagaagagtttacacgaaaagttcgatcaaacgctgcaataggcgctgtatttgtcgatgaaaatcagtggaactctgcaaaagaggcagtcgaagacgaaagattttgggatctcgtacacagagaaagagaattacataaacagggcaaatgcgcaacttgtgtctacaatatgatggggaaaagagagaagaaactaggagagttcggtaaagccaaaggatctagagcgatttggtacatgtggttgggagcccgtttcttagaatttgaggctttaggattcatgaacgaagatcattggttttccagagaaaactcactgtctggcgtagaaggcgaaggtcttcataaattaggctatattttacgtgatatttctaaaatacccggaggtaatatgtatgcggatgataccgcaggatgggatacaaggattacggaagatgacttgcaaaacgaagctaagattacagacattatggagccagaacacgcattattagccaaatcgatatttaaactaacgtatcaaaataaggtagttcgtgtacaacggcctgccaagaatggtacggttatggatgtgataagtcgtagggatcagcgaggttcaggccaagtaggaacatacggactaaatacatttacaaacatggaagcccaactgatcaggcagatggaatctgaaggcatattcagcccatcagaattagaaactccaaatctggcaggcagagtcctcgattggttagagaaacatggagtcgagaggttaaaacggatggctatcagtggcgatgattgtgtagtaaaacccatagacgatagatttgcaaccgctctaactgcgcttaatgatatgggtaaagtaagaaaagacgtaccacaatgggagccatccaaaggatggaatgattggcaacaagtacctttttgcagtcaccatttccatcaattaattatgaaagatggcagggagatagtcgtaccttgccgaaaccaagatgaattagtaggacgcgcgcgtgtcagtcagggagcaggttggagtcttcgtgagactgcctgcctaggtaaatcttacgcccaaatgtggcaacttatgtattttcataggagggaccttagacttgcagcgaacgcaatatgttcagctgttcctgtcgattgggtcccaacgtcgcggacaacctggagcattcacgcccatcatcagtggatgacaactgaggacatgctaagcgtatggaaccgggtctggatagaagaaaacccatggatggaggataaaacgcatatatcatcatggggcgacgtgccctatttaggaaaaagagaagatcaatggtgtgggagcttaattggactcaccgcccgcgccacttgggctacgaacatacaagtcgctataaaccaagtaaggcgacttataggaaatgaaaattacctagattatatgacatcgatgaaacgtttcaaaaacgagtcagatccggaaggtgctctatggtag

SEQ ID NO: 21585 - RNA, 9879 nt, synthetic construct
  misc_feature 1..9879: note = derived and/or modified CDS sequence (opt6) from DENV-1__FJ410245__SS-prME
  source 1..9879: mol_type = other RNA
tcggttactatgttactcatgttgatgccgactgctctagcttttcatttaactactagaggtggtgaaccacatatgattgtatctaaacaagaacgcggtaaatcgttattgtttaaaactagcgctggggtaaacatgtgtacattaatcgcaatggacctaggggaattatgcgaagacacaatgacttacaaatgtcccagaatcaccgaaactgaaccagacgatgtcgactgctggtgtaacgcaaccgatacttgggtaacatatgggacgtgttcgcaaacaggtgaacatagaagagacaaaaggtcagtagcattagctccacacgtaggactaggacttgaaacaagaacagaaacatggatgagtagtgaaggagcatggaaacaaatacagcgggtagaaacgtgggccttaagacatccagggttcaccgtaattgccctgtttttggcacacgccattggtaccagtatcacacaaaaaggtattatctttatactacttatgcttgttacgccaagtatggcaatgcgttgtgtaggaataggcagtcgcgacttcgtagaaggccttagcggggcaacttgggtcgatgtagtattagaacatggcagctgtgttacgaccatggccaaagacaaacctaccctagacattgaactactcaaaacagaagtgaccaatccggccgtactccgaaaactttgtatagaagcaaaaatttcaaatacaacaactgacagcagatgtccgacgcaaggagaagcgacattggtggaagaacaagatgcaaatttcgtctgtcgaagaacatttgtagacagaggctggggtaatggctgtggattgtttggcaaaggaagtttgataacatgtgcgaaattcaaatgcgtgactaaactagaaggaaaaattgttcaatacgaaaatctcaaatactcagtaatagttacagttcacacaggagatcaacatcaagtcggtaatgagtccaccgagcacggaacaacggctacaatcaccccgcaagctcctactacagaaatacaactgacagattatggtgctttgacattagattgctccccaagaactggacttgattttaatgagatggtattactaacaatgaaagagaaaagctggttagttcacaaacagtggttcctcgacttaccattaccatggacatctggagcttctacgagccaggaaacgtggaatcggcaggacttgctcgtaaccttcaaaacagcacacgctaagaaacaagaagtagtcgttttaggatcacaagagggtgcaatgcacacagcactcacaggagcaacggagattcagactagcggtaccacgactatttttgcaggccacctaaaatgcaggttaaaaatggacaaattaacattaaaaggcatgagttatgttatgtgcacaggatcatttaaattagagaaagaagtagcagaaacgcaacatggtacggttttggttcagattaagtatgaagggactgacgccccatgtaaaataccattttctacacaagacgagaaaggagtaactcaaaatggacgattaataacagccaatccgatagtgacagataaagaaaagccagtaaatatagaagcagaaccaccctttggtgaatcgtacattgttattggagcaggagaaaaggcactcaagctctcctggttcaagaaaggatcaagtattggtaagatgtttgaagctacggcacgaggcgctagacgtatggctatacttggagacacagcatgggactttggtagtattggaggagtctttacgagtgttggaaagctagtccaccaaatattcggcaccgcatatggcgttctattctccggtgtttcatggactatgaaaatcggcataggggtcctactaacttggctaggattgaacagtcgatcgactagcttgtccatgacatgcatagctgtgggtctagtgaccctatatttaggagttatggttcaagcagactcagggtgcgtaataaactggaaaggtcgagagctcaaatgtggtagcgggatatttgttacaaatgaagttcatacttggacggaacaatataaattccaagctgacagtcctaaacggctatctgccgccatagggaaagcatgggaagaaggagtatgtggcataagatcagcaaccaggcttgaaaatataatgtggaaacagataagtaacgagcttaatcacatacttttggaaaacgacatgaaatttaccgtcgtcgtgggtgacgtggcgggcatcctggcccagggtaaaaagatgattagaccgcaacccatggaatataaatattcgtggaagtcatggggaaaagcgaagattattggcgcagatgtgcaaaataccacctttatcatcgacggccctaacaccccggaatgccctgacgatcagcgagcatggaatatatgggaggtcgaagactacggttttggaatatttacgacaaacatttggctaaaacttagagactcctacacacaggtctgtgatcaccgactaatgagcgccgcaatcaaggatagcaaagctgtacacgcggacatgggatactggatagaatcagagaaaaatgaaacctggaaacttgcacgagctagcttcatcgaagtcaaaacatgcatatggcccaagtcccatactctgtggagtaatggggtacttgaaagtgagatgattattcctaagatttacggagggcctataagccagcataattatagaccaggttatttcactcaggcagcgggaccttggcatctcgggaaattagaacttgatttcgacctatgtgaaggaaccacagtagtagtagacgaacattgcggaaatcgcggtccttcattacggaccactacagtaacaggcaagattatccatgagtggtgctgtaggtcatgcacgttacccccattaagattcaaaggggaagatgggtgttggtacggaatggaaataagaccagtgaaagagaaagaggaaaatttagtaaagtcaatggtgagtgcaggatcaggagaagtagattcgttcagcttagggttactatgtatcagtataatgatcgaagaagtaatgcgaagtagatggagtagaagaatgttaatgacgggaacgttggcggtattctttctactcattatggggcagttgacctggaacgacttgatacgtctctgcattatggtcggtgctaatgcgagtgacaggatgggaatgggaacgacatatttggcactaatggcgacctttaaaatgcgccctatgttcgcagtaggcttgttatttagaagacttacctcaagagaagtccttttattgaccataggcttatcattagtagcaagtgtggaacttccaaactctttagaggaacttggcgacggtcttgccatggggattatgatccttaaacttttaacggactttcagtcacatcagctctgggcgacactactctccctgacattcataaaaacgacgttttcactacactatgcttggaaaacaatggccatggtattaagtatcgttagtctatttcccctatgtttatccacaacaagccagaaaactacttggctaccagtactcttgggttctcttggatgtaaacccttaacaatgttcttaatagctgaaaataagatttggggacgacggtcatggccactaaatgaaggaattatggccgtgggaatagtatcaatcttgttaagttcattactaaagaacgacgtgccactcgcaggaccactgatcgcaggcggaatgctaatagcgtgttacgtaatcagtggatcatcggctgatcttagcttagaaaaagcagcggaggtctcatgggaagaagaagcagaacacagcggggctagccataacatattagttgaagtacaggatgatggaaccatgaaaataaaagacgaagagagagacgatacgctaaccattttgttaaaagcaactctattagctgtatctggcgtatatccactgtctatacctgctactttgttcgtgtggtacttctggcagaagaagaaacaacggtcaggcgtgttatgggataccccctcaccaccagaagttgaaagagcggtcctagatgatgggatataccgtataatgcaaagaggtctacttggtcgcagccaagttggagtaggtgtattccaagaaaatgtatttcacacaatgtggcatgtaacacgtggggctgtccttatgtatcaagggaaaagattagaaccgtcttgggcaagtgttaagaaagacctaatttcttatggagggggttggcgactacagggttcctggaacataggcgaagaagtacaagtaattgcggtagaaccagggaaaaatcctaaaaacgtacagactgctccgggtacctttaaaacaccggaaggagaggtaggtgctatagccttagattttaaacctggtacaagtggaagtcctatagtaaatagagaaggaaaaattgtaggactttatggaaatggagtcgtcacaacgtccggtacatatgtgtccgcaatagctcaggccaaagcgtcacaggagggtcctttacctgaaatagaagatgaggtgtttagaaaacggaacttaacaataatggatttacaccccggatcgggtaaaacaagaagatacctcccagcaatcgttagggaagctattaagaagaaattaagaacactgattttggcaccgactagagtggtagcaagcgaaatggcagaagccttaaaaggtatgccaatccggtatcagacaactgcagttaaaagcgaacacacaggaaaagaaattgttgacttaatgtgccatgccacatttacaatgcggcttttaagtccagttcgtgtacctaactataatatgattattatggatgaagctcatttcactgatccttcatctattgccgcccgaggttatatatcaacaagggtaggaatgggagaagcggccgctatatttatgaccgctactccaccaggaagtgttgaggctttcccacaatcaaatgcagttatccaagacgaagaacgcgatatcccggaacgttcttggaactcaggatatgaatggataaccgattttcctggaaagacggtatggttcgtaccctcaataaagtctgggaatgatatagctaactgcctaagaaagaacggtaagcgggtgatacaactgtccagaaagacatttgatacagaatatcagaaaactaagaacaacgattgggattacgtagttactacagatatatcagaaatgggtgcgaactttagagctgatcgcgttatagatcctagaagatgtctaaaacccgttattttgaaagatggtccagaaagagtgatacttgccggaccaatgccggttaccgtagcgagtgccgcccaaagaaggggtagaataggtaggaatcacaataaagaaggggaccaatatatttacatgggtcagccactcaataatgacgaagaccatgcccactggacagaagccaaaatgttactagataatataaatactccagaaggaataattcccgctctatttgaaccagaacgagaaaagagcgcagctattgacggagaatacagattaagaggagaagctagaaaaacatttgttgaacttatgcgtcgtggtgatctacccgtttggctaagttataaagttgcttcggaaggatttcagtactcagataggagatggtgtttcgatggtgaacgaaacaaccaagtattagaagagaatatggatgtagaaatatggaccaaagaaggtgagcgtaagaaactaaggcctagatggctagacgcgcgaacttattcagacccgctggcactgcgggaatttaaggaatttgcagcgggaaggagaagcgtatccggagacctaatacttgaaataggtaagttacctcagcatctgactcaaagagctcaaaatgcgctagataacttagtaatgctccacaattcagaacagggcggtagagcctaccgtcacgcaatggaggaactacctgacaccatagagacattaatgctattagctcttattgcagttctaactggaggggtgacattattcttcctaagcggacgtggcttaggaaagacatcaattggactattatgcgttatggcaagctcagtcttgctctggatggcaagcgtagagccacattggatagcggcctctatcattctagagttcttccttatggtcttgctcatccccgaacctgataggcaaagaactccacaagataaccaattagcctacgttgttataggattactgtttatgatattaacagtggcggccaacgaaatgggcctgttagaaactaccaagaaagatttaggaataggacatgttgccgttgagaatcatcatcacgcagcgatgttagatgtagatcttcacccagcatctgcatggacattatatgctgtagcaactactataataacgccgatgatgcgacacacaatcgagaacacgaccgcaaatatatctttgacagccatagcaaatcaggctgcaatcctcatgggacttgacaaaggttggccgattagtaaaatggatattggagtccccctattagcgctaggatgttatagtcaagtaaaccccctaacactcactgccgcagtgcttatgttggtggcacattacgcaataataggtccagggttacaagctaaggctacacgagaagcacagaaaaggacagcggcgggaattatgaaaaatccgactgttgacggtattgttgcaatcgatctagatccagtcgtttatgacgcgaagtttgaaaaacaattaggtcaaataatgctcttaatattatgcacgagtcaaatattgctcatgaggacgacttgggcattatgcgagtcaatcaccctagccacgggtccattaactacactgtgggaaggatcacccggaaaattttggaatactactatagcagtatctatggcaaacatttttagaggctcgtacctagcaggagctggacttgcattctccctcatgaaatcattaggaggtggtcgcagaggaacgggcgcacagggagaaacgctaggcgaaaaatggaaacgccagctgaaccagttgagtaaaagtgagttcaatacctacaaaagatcaggtattatggaagtggacaggtcggaagcgaaggaaggtttaaaaaggggcgaaacgacaaagcatgcagtatcacgaggaacggcaaaattaagatggtttgtagaaagaaatttagtcaagcctgaaggaaaagtaatagatttaggatgtggtcgcggaggttggtcatactattgtgcaggccttaagaaagttacggaagtgaaaggatataccaaaggagggccaggacatgaagaacctattccaatggctacttacggctggaacctagtaaaacttcatagcggtaaggacgttttctttattccaccggaaaaatgtgacacactgttatgtgatataggagagagcagcccgaatccaaccatcgaggagggacgaactttacgcgtattaaagatggtggagccatggctcaggggcaatcagttctgcattaaaattttaaacccttacatgccctcagttgtagaaactcttgaacagatgcaaagaaaacacgggggaatgttagtccgaaatccattaagcagaaattccacacacgaaatgtactgggttagttgcggaacaggaaatatcgtctctgccgttaatatgacaagtaggatgctactaaaccgatttacaatggctcaccgaaaacccacatacgaacgagatgttgatttgggcgccggtacgcgacacgtagcagtagaacccgaagtagccaatttagacataataggtcaaagaatcgaaaacataaaacatgaacacaagagcacttggcactacgacgaggataacccctataaaacttgggcttatcacggatcttatgaagtgaaaccgagtgggtccgcgtcaagtatggtaaacggcgtagtaaagttactgacaaagccctgggatgtaataccaatggttacccagattgcaatgacagatacaacgccgtttgggcaacaaagggttttcaaagaaaaagtcgacactaggacaccaaaagcgaaaagaggaacggcgcaaatcatggaagtaaccgcaaaatggttgtggggatttctatcaagaaacaagaaacctaggatttgcacccgagaggagtttacaagaaaagtaagatcaaacgccgcaataggggcggtattcgtcgacgagaaccagtggaactccgcaaaggaagctgtagaagacgaaagattctgggatttagttcatagagaacgagaattacataaacaagggaaatgcgcgacatgcgtttataatatgatgggcaaacgcgagaagaaattgggggagttcggaaaagctaaaggctcacgggcaatatggtacatgtggttaggcgcgcgattccttgaatttgaggctttaggctttatgaatgaagaccattggttttcaagagaaaactcattaagtggcgtagagggagaagggctacacaaattaggatatatactaagggacatttcgaagatacctgggggaaacatgtacgccgatgatactgctggttgggatacccgtatcactgaagacgatctgcaaaatgaagcacgaataaccgatattatggaaccggaacacgcattattagcaaaatcaatatttaaattgacatatcaaaataaagtagtaagagtacaacgccctgcaaagaacgggaccgttatggacgttatttcaagaagagatcaacgagggtcaggtcaagtaggcacctatggattaaatacattcactaacatggaagcccagctgataagacagatggaatccgaaggcatattttcccctagcgaattagagacacccaacctagctgaaagagttctagattggttagaaaaatatggagtagagcgtttaaagagaatggcaataagtggcgatgattgcgtcgttaaacctattgatgaccggtttgctaccgcccttacagctttaaacgatatgggcaaagttaggaaagacattcctcaatgggaaccaagcaaaggatggaacgactggcaacaggttcctttttgcagtcaccattttcaccaactgattatgaaggatggtagagaaatagtcgttccatgtcgtaatcaggatgaattggtggggcgagcacgcgtaagccagggcgccggttggtcgttgagagaaacagcttgtctggggaaaagttacgcacagatgtggcaactaatgtatttccaccggagagatcttaggctagcagccaacgccatatgttcggcggttccagtagactggatcccaacgtcaagaacaacgtggtccattcatgctcaccatcaatggatgactacagaagatatgctatctgtgtggaatagggtatggatcgaagaaaacccatggatggaggataaaactcatatttcatcttggggcgacgtaccatatcttggtaaaagagaggaccagtggtgtggttcgctgattggattgaccgctagagcgacatgggcaacaaatatccaagtagcgataaaccaggtgagaaggctcataggaaatgagaattatttagattacatgacctctatgaagagattcaagaatgaaagtgatccagaaggagcgctctggtga

SEQ ID NO: 21586 - RNA, 9879 nt, synthetic construct
  misc_feature 1..9879: note = derived and/or modified CDS sequence (opt6) from DENV-1__FJ410246__SS-prME
  source 1..9879: mol_type = other RNA
tccgtaactatgttgctaatgttaatgccaactgctttagcattccatttaacaacgcgtggaggtgaacctcatatgatagtttctaaacaagaaagaggaaaatcactactatttaaaacttccgcgggagtcaatatgtgcactcttatcgctatggatctaggggagttctgtgaggacaccatgacatataaatgtccaagaattacagaggcagaacctgacgatgtagattgttggtgtaatgcgactgacacttgggtcacatacggaacgtgttcgcaaacgggagaacatagaagagataaaaggtccgtagcattagcaccacacgtaggtctaggtctggaaacccgcactgaaacttggatgtcttccgaaggtgcatggaaacaaattcaacgagtggaaacttgggcactgcggcatcctggattcacagtaatagcattgtttttggctcatgctattggaacgtcaatcacccaaaaaggaataatctttatactactaatgctggtaaccccttctatggctatgcggtgcgtaggtataggatcacgggatttcgtcgaaggactttcgggagcgacgtgggtggatgtagttctcgagcatggaagttgcgtaacaaccatggcaaaagacaaaccgactttagatatagaactccttaaaacagaagttacgaatccagcagttcttcgaaaattatgtatcgaggccaaaatcagcaatacaacaacagatagtagatgtccaactcaaggagaagctacacttgttgaggaacaagatgctaatttcgtatgtagaagaacattcgtagataggggatggggaaatggttgtggattatttggcaaagggtctctgataacttgtgcaaaatttaaatgcgtcaccaaattagaaggcaagattgtacaatacgaaaaccttaagtatagcgttatagtcacggtacatacaggggatcaacaccaggttggtaatgaatcaacagagcatggcacgaccgcgaccattacgcctcaagcacctagcactgaaattcaattgaccgattatggcgcactaaccttagattgtagtccacgaacaggtttggactttaatgagatggttttattaacgatgaaagaaaaatcgtggctagtacacaaacaatggtttttagacctcccattaccttggacaagtggtgcttcaacatctcaagaaacatggaacaggcaagatctattagtaacatttaaaacagctcatgccaagaaacaagaggtagtagttctaggtagccaagaaggcgcaatgcataccgcactaaccggtgctacagaaatacagacaagcggtacaactactatattcgcaggacacctaaaatgtcgcctaaaaatggataaattgacgcttaaaggtatgtcatacgttatgtgtacggggagctttaaactcgaaaaagaagtcgcggaaacacagcatggtacagttcttgtacaaattaaatatgagggaactgacgctccatgtaaaatcccttttagtacgcaagacgagaagggtgtaactcaaaatggtagattaataaccgcaaatcccattgtaacagataaggataagcccgtaaatatagaagctgaaccgccttttggcgagtcctacatagtcattggggcgggcgaaaaggctttaaaattatcttggttcaagaaaggaagttccataggaaaaatgtttgaagcaactgctagaggtgctcgaagaatggcaatcctaggagatacagcatgggacttcggctcaattggcggagtatttacttcagtgggcaaattagtccaccaaatattcgggactgcttatggcgttctctttagcggcgtgagttggactatgaaaataggtataggcgtcttattgacctggttaggacttaatagtagatcaaccagtctttcaatgacctgtatagcggttggcctagtgaccttatatctaggagttatggtccaagctgacagcggatgcgtaataaactggaaaggaagagaattgaagtgtggcagtggtatattcgttacaaatgaagttcatacctggactgaacaatataaatttcaagccgacagtccaaaacgtctaagtgcggccataggcaaagcatgggaagagggtgtgtgtgggataagaagcgcaacaaggcttgagaatataatgtggaaacaaatttcaaatgaattaaatcatattttactcgaaaacgacatgaaattcacggtagtagtaggagatgtagcagggatattagctcaaggcaagaaaatgattagaccacaaccaatggaatataaatacagttggaagtcctggggaaaagcgaaaataataggagccgatgtccagaatactacatttattatcgatggaccaaacacaccagaatgtccagacgatcaaagagcatggaacatatgggaagtggaagactatggcttcgggatttttactacaaatatctggttaaaactcagggatagttacacccaggtctgcgatcatcgattaatgtcggccgctataaaggatagtaaagcagtgcatgcggacatgggttattggattgaaagtgagaaaaacgaaacatggaaattggctcgagcatccttcatagaagtaaaaacatgcatatggccaaaatcacatacattgtggtccaacggggtattagaaagcgagatgattataccaaaaatatacggaggtcccatatcacaacacaattacagaccaggctatttcacccagacggccggtccatggcacctggggaaactcgaactagattttgatttatgtgaaggaacgacggttgtagttgatgaacattgcggcaaccgtggtccatctctgaggactaccacagttaccggtaagatcatacatgagtggtgctgtaggtcctgcacacttccacctttacgattcaaaggggaagatgggtgttggtacggtatggagataagacctgttaaagaaaaagaagaaaatcttgtgaaatcaatggtaagtgcagggagcggtgaagttgattcattttcattaggtctattatgtatctctataatgactgaagaagttatgaggagtagatggtcgagaaaaatgctaatgacaggtacactcgcggttttctttttactcataatgggacaattaacttggaatgaccttataagactatgcatcatggtaggagccaacgcctcagacaggatgggcatgggcaccacatatttagcactcatggcaacctttaaaatgaggccaatgttcgcagtgggtttacttttccgacgattgacttcccgagaagtgttattacttacgatagggctatccctagttgcttctgtagaactgcctaactccctggaagaactaggagatggtctagctatgggcataatgatactaaagttattaactgacttccaatctcatcaactctgggctacccttctgtccctaacatttatcaaaaccacgtttagcctgcattacgcatggaagactatggcgatggtattaagtatagtatcattgttccctctctgtttaagcaccacgtctcagaaaaccacgtggttacctgtattacttggttcattaggttgcaaaccattaacgatgttcttaatagcggaaaacaaaatttggggtagaaaatcctggccattaaacgagggtataatggcagtaggaatcgtatccattttgctctcaagtttactaaagaatgacgtacctttagcaggtcctctcatagccggtggtatgttaattgcgtgttatgtgatatcagggtcctcggccgatctcagcttagaaaaagctgcagaagtatcctgggaggaagaagcagaacacagtggagcgtcccacaacattttggttgaagttcaagacgacggaacaatgaaaatcaaagatgaggagagagacgatacattaactatattactaaaagcaacacttttggcggtatccggagtatatcccttatcaataccggccacattatttgtttggtatttctggcagaaaaagaaacaaagatccggagtattgtgggatacaccttctccgcctgaggtcgaaagagcagtcttggatgacgggatataccgtattatgcaaagaggactgttaggcaggagtcaagtgggagttggagtatttcaagaaaacgtatttcacaccatgtggcacgtgactcgaggtgcagtactaatgtaccaaggcaaacgactagaaccatcttgggcaagtgtcaagaaagatctaatttcatatggaggaggctggcgactacagggcagttggaatacaggggaagaagtacaggtcatagcagtagaacctggcaaaaatcccaaaaatgtacagacagcacctgggacctttaaaacatctgagggagaagtaggagcaatagcattggattttaaaccgggtaccagcgggagtccaattgtgaatagagaaggtaaaatagtaggtttgtacggcaatggagttgtcacaacatcaggtacatacgtttcggcaattgcgcaagccaaagcctcccaggagggacccctgccagaaattgaggacgaagtattccgtaagcgtaacttaactataatggacttacatcccggcagtggaaaaacccgacgctatttacccgctatagtacatgaagccataaaacggaaactaaggacattaatattggcaccaacccgagtagtcgctagtgaaatggccgaagcgctaaaaggaatgccaatacgatatcagactacggctgttaaatcagaacatactggtaaagagatagtagatctaatgtgtcatgcgaccttcactatgagactactttcaccagtgagggtaccaaactataacatgataattatggatgaagcacacttcacagatccaagttccatagctgcaaggggatatatatccactagagtaggtatgggggaagctgctgccatattcatgactgcaacgcccccgggttctgtagaggccttcccacaatctaacgctgtaatccaagacgaggaaagagatataccagagcgttcttggaactcaggttatgagtggataacggatttccccggtaagacggtatggttcgtacctagtatcaaatcaggaaacgacatagctaattgtttgcggaagaacggaaaaagagtaatacaactcagtagaaaaacattcgatacggaatatcaaaagactaaaaataatgattgggattacgtagtaactactgacatttcggagatgggtgcaaattttagagccgatagagtcatagaccctagaagatgtctcaaacccgtcattttgaaggatggccctgagcgagtaattttggccggaccaatgccagtgactgtggcatcagcagcccaaagaagaggaagaattggtagaaatcataataaagaaggcgaccaatacgtatatatggggcaaccactaaacaatgatgaagaccatgcccattggacggaagccaagatgttacttgacaatattaacaccccagaaggaataatacccgcattatttgaacctgaacgcgagaaaagtgctgcaatcgacggagaatacagactaaggggagaggcgcggaaaacgtttgtagaactaatgaggagaggagacttgccggtgtggttatcctataaagtcgcgtctgagggcttccaatactctgataggcgttggtgctttgatggggaaagaaataaccaggtgttagaagagaatatggatgtagaaatatggacaaaggaaggagagcgtaagaaactcagaccaagatggcttgatgctaggacttattctgaccctttggcgctacgagaatttaaagagttcgcagctggccgcagatctgtgtcaggagatttaattttagaaataggcaaactcccccaacatctaacacaaagagcccaaaatgcgttggataacctagtaatgctacataactctgagcagggaggacgagcatataggcatgctatggaagaattacctgatacaattgaaactctcatgctattagcactaatagcagtattaactggcggagtgacactcttctttctgtcaggaagaggtctaggcaagacaagtataggtctattatgtgtcatggcgtcgagtgtcctgctttggatggcttccgtcgagccccactggatagcagcatcaataatattagagttctttctaatggtgctcttgatacccgaacctgacagacaaagaacacctcaagataaccaactggcgtacgtcgtaataggcctactttttatgatcctcaccgtagcagcaaatgaaatgggacttttggaaacaacgaaaaaggatctaggtattggccacgtagcggtagaaaatcaccaccatgctgctatgttggacgtcgatttacaccccgcatcggcgtggactctatacgcggtagcaacaactataattactcccatgatgcgacacaccatcgaaaacacgacagcgaacatttcactaacagcaatagctaatcaggctgctattcttatgggactagataaaggatggccaatcagtaagatggatataggcgttccgttactagcgcttggctgctattcacaagtcaatcctttgactcttacagcagcggtattaatgttagtagcacactatgcaatcataggcccaggcctccaagcaaaagccacccgtgaggcacagaaaaggaccgcagcaggaattatgaaaaatcctacggtcgacggaatagttgcaattgaccttgatccagtggtgtacgatgcgaaattcgaaaaacaattgggtcaaattatgctactaatcctatgcactagccaaatactactaatgcgtacaacatgggcactatgtgagtctattacgttggctactggcccactaactactctatgggaaggtagcccaggaaaattttggaatactactatagcggtgtcaatggcaaacattttcagaggatcctatctagcaggagcaggactggctttttcactcatgaaaagtttaggaggtgggcgtcgtggtactggggcacagggagagacactgggtgagaaatggaaaagacagctaaaccaattatcgaagtccgaatttaacacgtataaaagaagtgggataatggaagtcgacagatcggaagcaaaagaaggattgaaacgaggtgaaactacaaagcacgccgtgagtcgcggaacagcaaagttaagatggttcgtagaaagaaatctagttaaaccggaaggtaaagtgatcgatttaggatgtggtaggggcggatggtcttattattgcgccggtctcaagaaagtaaccgaggtgaaaggttacacaaaaggaggacccggtcatgaggaaccaattccaatggcaacgtatggctggaatttagtcaagctacattcggggaaggacgtcttcttcatcccacccgaaaagtgtgatacactattgtgcgatattggtgaaagttcgccaaacccaactatagaggaagggcgaacactcagagtactaaaaatggttgagccctggttacgtggaaaccaattttgcattaaaatactgaatccttatatgccaagcgtagtcgaaacattagaacaaatgcagagaaaacacggtgggatgcttgttagaaatccattgtcacgtaattctacccatgaaatgtactgggttagttgcggaaccggcaatattgtttcagccgtaaacatgacatcacgaatgttactcaatcgattcactatggcgcatcgcaaaccaacttatgagcgcgatgtagatctgggggctggtacaagacatgtagcggtagaaccggaagtagctaatttagacattatcgggcaaaggatagagaatataaaacatgaacataaaagcacatggcattacgacgaagataatccttacaaaacgtgggcgtaccatggatcttacgaagtaaaaccttcaggatcagcctccagcatggtgaacggagtcgtaaaactcttgactaaaccatgggatgtaattccgatggttacgcaaattgcgatgactgatacaactccgtttggacaacaaagagtttttaaagagaaggtagatacaagaactcccaaggcaaagagaggcacagctcaaataatggaagttaccgcgaaatggttatggggttttctgtcccgaaataagaaaccgagaatatgtacccgcgaggaatttacgcgaaaagttcgcagcaatgcagccataggagcagtattcgtagacgaaaatcaatggaactccgccaaggaagcagtagaagatgagcgattctgggacttagttcatcgtgaacgcgaattgcataaacaaggaaaatgcgccacttgtgtttacaacatgatgggaaaaagagagaagaagctcggtgagtttggaaaggcaaagggatctcgcgcaatatggtatatgtggttgggggcaagatttctagaatttgaagcactgggattcatgaatgaagatcattggttcagtagagaaaactcactatcaggagtggagggagaaggtttgcataaacttgggtatattcttcgtgatatatcgaaaatacctggaggtaatatgtacgcggacgacacagctggttgggatacccgtattacagaagatgatctacagaatgaagcaaagataacggatattatggaaccggaacatgctttgttagcaaaatccatatttaaactaacataccagaataaagtagttcgcgtccaaagaccagcgaaaaatgggacggttatggatgttatatctaggagggaccagaggggatcggggcaagtaggtacctatggattaaatacttttacaaatatggaagctcagctaatacgtcaaatggagtcagaggggatcttctctccatcagaactagaaactcctaacttagcaggccgcgttctcgattggctcgaacgccatggggtcgaacggttaaaacgcatggcaataagtggtgacgactgtgtagtaaagcctatagacgatcgatttgcgaccgcactcacagcactcaatgacatgggcaaagttagaaaggacattccacaatgggagccaagtaaagggtggaatgattggcaacaagtaccattttgtagtcatcacttccatcaattaattatgaaggatggtcgcgagattgttgtaccctgcaggaaccaagacgagctagttggcagagcacgggtgtcgcagggggccggatggagccttcgcgaaactgcatgtcttggtaagtcatatgctcaaatgtggcaactcatgtacttccataggcgtgacttaaggttggctgccaacgcaatatgttctgcagtaccagtcgactgggttccaaccagtcgtacaacatggagcattcatgcacatcatcagtggatgacaacagaggacatgctctcagtttggaatcgagtatggatagaggaaaatccctggatggaagataagacacatatttcttcttggggtgatgtaccttacctaggtaaacgggaagaccagtggtgtggctcattaatcggcctaaccgctagagcgacctgggcgacaaatattcaagtagcgataaaccaggtaagaagactaatagggaatgaaaattatttagactacatgacttccatgaagcgattcaaaaacgaaagtgacccggagggtgcgttgtggtaa

SEQ ID NO: 21587 - RNA, 9879 nt, synthetic construct
  misc_feature 1..9879: note = derived and/or modified CDS sequence (opt6) from DENV-1__FJ410247__SS-prME
  source 1..9879: mol_type = other RNA
tcagttacgatgctgcttatgttgatgcctactgcactcgcttttcacttaaccaccaggggtggtgaacctcatatgattgtatcgaaacaagaacgtggaaaatcactattatttaaaaccagtgcgggagttaatatgtgcaccctgatcgcaatggatttaggtgaattatgtgaagatacaatgacgtacaaatgtcctaggatcacggaaacagaacccgacgatgtggactgctggtgcaatgcaacagacacatgggtgacttatggaacttgctcacaaactggtgaacatcgaagagataaaagatcagtagcactcgctccacatgtgggattggggttggagacacgaacagagacttggatgtcgagtgagggggcgtggaaacaaattcaaagagtggagacttgggcgctaagacaccccgggtttacggttatcgcgctgttcttagcacacgcaattggaacaagtattacccaaaaaggaataatttttattctcttaatgttagtaacacctagtatggcaatgagatgtgtcggaataggaagtagagatttcgtggaagggctgagcggagcgacctgggtagacgtggtactagaacatggatcgtgtgtcactaccatggctaaagataaaccgacattagacatcgaactgttaaaaacagaagtgacaaatcccgcgattcttagaaaactttgcatcgaagcaaaaatatcaaataccaccaccgattcccgatgtcctacccaaggtgaagcaactttagtagaagaacaagacgcaaacttcgtttgtaggagaactttcgttgacagaggatgggggaacggctgtggtctatttggaaaaggatcgttgataacatgtgctaaattcaaatgtgtcacaaaattagaaggtaaaatagtacaatacgagaacctcaaatattctgtgattgtcacagtacatactggagatcaacatcaagttggcaacgaatctaccgagcacggaactacagcaacaattacaccccaggcgcccacaacagagatacaattaacagattatggagcactaacacttgattgttccccaagaaccggactagactttaatgaaatggtactcctaactatgaaagaaaaatcatggctagtccataaacaatggtttctagacttgccgttaccatggacgagtggagcatcaacaagtcaggaaacatggaacaggcaagatttattagtaacttttaagacagcccacgccaagaagcaagaagtggtggtattagggagtcaagaaggtgcaatgcacacggcactcacgggagcgacagaaatacagacctcaggaacaacaacaatatttgcaggacatttgaaatgtcgattaaaaatggataaattaaccttaaaaggtatgagttatgtcatgtgtacaggctcatttaaattagagaaagaggtcgctgagacccagcatggtactgtcttagtacaaattaaatatgaaggaactgatgcaccatgcaaaattccgttctctacacaagacgagaaaggtgtaacacagaacggacgacttataaccgctaatcccattgtgacagataaagaaaaacccgtgaacatagaggcagaaccgccattcggagaatcttatattgtaattggcgctggtgaaaaagctctaaaactgagctggttcaagaaaggaagttcgataggcaaaatgttcgaagcaacggctcgcggtgcgcggaggatggccattctaggagacacagcttgggatttcggttcaataggtggagtgtttacaagtgtcggcaaattggtacatcaaatttttggaacagcttacggagtgctattctctggagtaagttggaccatgaaaatcggcatcggggtccttttaacatggttaggtctaaatagtagatctacatcattgtctatgacatgtatagccgttggcctagtcactttataccttggtgtcatggtgcaagcggactcaggatgcgtcatcaattggaaaggacgagaattaaagtgtggctcaggtatttttgttacaaacgaggtacatacatggacagaacaatataaattccaggccgattctcctaagagattgtccgcggcaattggaaaagcatgggaagaaggtgtgtgcgggataagatccgcaacgcgtttagagaatataatgtggaagcaaattagtaacgagcttaatcatatattattagaaaatgatatgaaatttacagtcgtagtaggggacgtagcggggattttagcgcaaggtaagaaaatgattcgaccacaaccgatggaatacaaatattcatggaaaagttggggtaaagccaaaataataggtgctgacgtgcaaaatacgacctttattatagacgggcctaacaccccagagtgtcctgatgatcagcgagcatggaatatatgggaagtcgaggattacgggtttggaatttttacaacaaatatatggctgaaactacgcgactcatacacacaagtatgtgatcacagattaatgtcagcggctattaaagattctaaagcagtacacgcagacatgggttactggattgaatcggagaaaaatgaaacatggaagttggccagggccagtttcatcgaagtcaaaacgtgtatttggcccaaaagccacactttgtggagtaatggggtactagagtcagaaatgataattcctaagatatatggtggaccaataagccaacataattatcgtcctggatactttacgcagaccgctggtccgtggcacttaggtaagttagagttggactttgatctgtgtgaaggtacaacagtcgtagtggatgaacattgcggcaatcgaggtccaagtttaagaacaacaacggtaaccggcaagataatacatgaatggtgctgtcgaagctgtaccttaccaccgctgagattcaggggagaagatgggtgctggtatggtatggaaataagaccggtgaaggaaaaagaagagaacttagtgaaatccatggtatcagccggatcaggagaagttgactcattctcgctaggtctactgtgtatatcgattatgatagaagaagttatgagaagtagatggtctaggaagatgctgatgactggtactttggccgtttttctgctattaataatgggacaattaacctggaacgacttgatccgactatgcataatggtaggagcaaacgcttcagacagaatgggaatgggaacaacctatctagctcttatggcaacctttaaaatgcgaccaatgtttgcggtaggtctattgttcaggagattaacttcaagggaagtactactgctcacgataggactttcacttgtcgctagcgtcgaattgccaaactcccttgaagaattaggtgatggattagcgatgggaattatgatactcaaactgctgactgacttccaatcccatcagttatgggcaacattgctgagcctaacattcattaaaactacattcagtttacattatgcctggaaaacaatggctatggtgcttagcatagtctccttatttcctctgtgtcttagtactacaagtcagaaaacaacatggctgcctgtattattaggttcgctcggctgcaaacccctcacgatgttcttgatcgcagaaaaccggatctggggtagacggtcatggccgttaaatgagggtataatggcagttggcatagtatctatattacttagtagtctgcttaaaaatgatgtacccttagcgggaccattaattgccggtggaatgctaatagcatgttacgttatatcgggatcaagtgcagacctctcgttagaaaaagcagctgaagtaagctgggaggaggaagcagaacactcaggcgcttcacataatatcctcgtcgaggtgcaagacgatggaacaatgaaaattaaagacgaggagcgagatgataccctaactatcctcttaaaagcaactctattagcagtgagcggagtatatccattatcaataccagcaacattgttcgtatggtatttttggcagaagaagaaacagcgcagtggagtattatgggatacccccagcccgcctgaggtggagagagcagtgctagatgatggtatatatagaatcatgcaaagaggactcttaggtagaagtcaagtaggagtcggtgtatttcaagaaaatgtatttcacacaatgtggcatgtgacaagaggagcagtgctaatgtaccaaggtaaaagattagaaccttcatgggcaagtgtgaagaaagatttaatatcatatggagggggatggcgacttcaaggttcttggaatacaggagaagaagtacaggttatagcagtagaaccaggtaaaaatccgaaaaatgtacaaacgacaccgggaacattcaagacaccggaaggtgaagtaggagcaatagctctggatttcaaaccaggcacatcaggttccccaattgtaaacagagagggtaaaattgtcggcctgtatgggaatggcgtcgttactacttcagggacgtatgtgtctgctattgcacaagcgaaggcatcccaagaaggacctctaccagagatcgaggatgaagtctttcgcaaacgaaacctgaccattatggatttgcatcccggttcagggaaaactagaagataccttcctgctatagtaagagaagcaatcaaaaggaaattaagaacactgatcttggcgcctacaagagtagttgcgtctgaaatggcagaggcgttaaaaggcatgccaataagatatcaaacgacagcagtcaagtcggaacatacgggtaaagaaatcgtcgacttgatgtgccacgctacattcaccatgagacttctttcacctgtaagagttcctaattataacatgataataatggatgaggcgcacttcacagatccatcttcaatagcggcaagaggttatatatctactagagtcgggatgggggaagccgcagctatatttatgactgccacgcctccgggatcagtcgaggcatttccacaaagtaacgcagtcatccaagacgaagaaagagatatacctgagcgatcttggaacagcgggtatgaatggataactgattttccgggcaaaaccgtctggttcgtaccatctatcaaaagcggcaacgacattgcaaattgtttgcgtaaaaatgggaagagagtaattcaattatcgagaaaaacattcgacaccgaataccaaaagaccaagaacaatgactgggattatgttgttactacagacataagtgaaatgggagcaaactttagagcagacagggtcatagacccaagacgttgcttaaagccagttatattaaaggatggcccagaacgcgttatactagcaggtccaatgccagtgacagtggcttctgctgcacaaagacgtggtagaataggtagaaatcataataaagaaggggaccagtacatatatatggggcaacccttaaataacgatgaggaccatgctcactggactgaagccaaaatgttgctcgataatataaacactcccgaaggaatcataccagctctgttcgaacctgagcgtgagaagtcggcggcgatagatggagaatatagattaaggggcgaagctagaaaaacatttgtcgaattgatgagaaggggagacttaccagtgtggctcagctataaggttgcctccgaagggttccaatacagtgatagaagatggtgttttgacggagaacgtaacaaccaggtgttagaagaaaatatggatgttgaaatatggacaaaagaaggtgaacgaaagaaattgcggccccgatggttagatgcccgcacgtatagtgacccattagcattaagggaatttaaagagttcgcagcaggtaggcgaagtgtaagtggggacctaattttagaaatcggaaaattgccacaacacctaacgcaacgggcgcaaaatgctttagacaatctggttatgctacacaatagcgagcaaggcggcagagcataccgacatgccatggaagaactcccggacacaatagaaacgttaatgttacttgcgctcatcgccgtgcttacgggtggagtcacattgtttttcctttcgggtcgtggcctaggaaaaacctcaatcggattattgtgcgtaatggcttctagcgttctactttggatggcctccgttgagcctcattggattgctgcctcaataatccttgaatttttcttaatggttttacttatcccggaaccggatagacaaagaactccgcaggataaccagcttgcatacgtagttataggattactttttatgatactcacggttgccgctaacgagatgggattattggaaacgactaagaaagatctaggtataggacatgtggcagtgggtaaccatcatcatgcggcaatgctcgatgtagatcttcatcccgctagcgcgtggaccttatacgctgtggcgactactattataacgccgatgatgcgtcatactatagaaaatacaacagcaaatattagcttgacagctatagcaaaccaagctgctattctaatgggattggacaagggctggccgatatccaaaatggacataggagtacccttactagcattgggatgttacagtcaagtgaaccctttaacactgacagcagctgtacttatgttagtggcccattatgcaataattggtccgggattacaagcaaaagctacacgagaagcacaaaaacgcactgcggccggaatcatgaaaaaccctaccgtggatggaatcgtagcaatagatttagacccagtcgtatatgatgcaaaattcgaaaaacaactgggacaaataatgttattaatactttgtacaagtcaaatactgctgatgcgaacaacatgggcactttgcgaatctataacgttagcaacgggcccattgacaacattatgggagggtagcccgggaaaattttggaatacaacaattgcggtgtctatggcgaatatcttcagaggatcctatttagccggtgctggtcttgcttttagcctaatgaaatcgttgggcggtggtcgacggggtaccggtgcccaaggagaaacattaggagaaaagtggaaaagacaacttaaccaactcagcaaaagcgaatttaacacatataaaaggtctggcataatggaagttgaccgaagcgaagcaaaagagggccttaaacgcggagaaactactaagcatgccgtatctcgaggaactgcaaaactaagatggtttgttgaacgtaatttagtaaaaccggaaggtaaggtaatagatctaggttgtggccgagggggctggtcttattattgtgccggtcttaagaaagtcactgaagtgaagggatatacaaaagggggaccaggacatgaagaaccgatacccatggcaacctacggatggaacttagtgaaattacattcgggcaaggacgtgttctttataccacccgaaaagtgtgatactttactatgcgacataggagaatcatcccctaatcctactattgaggaaggaaggacccttcgagtcctcaagatggtcgaaccgtggttgagggggaaccaattctgtattaagatactcaatccctatatgccatcggtggtagaaaccttagaacaaatgcaacgaaaacacggaggtatgttagtaaggaacccgcttagcagaaactccacgcacgagatgtattgggtaagttgtgggactggcaatatcgtctcagcagtcaatatgacatcacgaatgttactcaatcgtttcactatggcgcaccggaagcctacctacgaaagagacgttgacttaggggccggcacccgccacgtagcagtagagcctgaagtagctaatctagatataatagggcaacgtatagaaaatataaaacatgaacacaaatcgacctggcactatgacgaagacaacccatacaaaacctgggcatatcatggtagttatgaagtgaaaccgtcaggctcagcaagttcaatggtcaatggcgtggtcaaacttttaactaagccatgggatgtcatcccaatggtgacacaaatagctatgactgatacaactcctttcggccagcagagggtttttaaggaaaaagtagatacaagaacaccaaaggcaaaacaaggcacggcgcagatcatggaagttacagctaaatggttgtgggggttcctatctcgcaataagaaacccagaatctgtaccagagaagaatttactcgtaaagtaagatcaaacgctgcgataggcgctgtttttgtggacgaaaatcagtggaatagcgcaaaagaagcagtcgaagatgaacggttctgggacctagtccacagggagcgagaacttcacaaacaaggtaaatgcgctacttgcgtctataatatgatgggtaaaagggagaagaaactgggcgagttcggaaaagcgaaagggtctcgagctatttggtatatgtggcttggagctaggttcctggagtttgaagcgctaggatttatgaatgaagaccactggttctctagagaaaactccttatccggggtagaaggagaaggtttacataaattaggttatatcttaagagatattagtaaaataccaggaggtaacatgtatgctgacgataccgctggatgggatacacgaataacggaagatgatttgcaaaatgaagctaggattacggacataatggagccagagcatgctttactcgcaaaaagtatatttaaacttacataccaaaacaaagtcgtaagggtacaacgaccagccaaaaacggtactgttatggacgtaataagtagaagagaccaacggggatcaggacaggtaggaacttacggactaaacaccttcacaaacatggaagcccagctaatcaggcaaatggagagtgaggggatattcagcccaagcgaattggagacaccgaaccttgcagaaagagttctggactggctagaaaaatacggggtagaacgacttaagagaatggctatttccggtgatgattgcgttgttaaacctatcgatgacagattcgcaacggcactaacagcactgaatgacatgggtaaggtacgaaaagatatacctcaatgggagccttccaaaggttggaacgattggcaacaagtacctttttgcagccaccacttccaccaactaatcatgaaagatggaagagaaattgtagtgccgtgccgaaatcaggatgaattagtaggtagagcacgggtgtctcaaggtgcaggctggtcgctacgagaaacagcatgtctaggaaaaagttatgcccaaatgtggcagctaatgtatttccatagacgtgacttgagattagctgcgaacgctatttgtagtgcagttccagtcgattggatcccaacatcgagaacaacatggagcatacacgctcaccaccaatggatgaccaccgaagatatgttaagtgtttggaatcgcgtgtggatagaagaaaatccatggatggaagataaaactcacattagcagctggggtgatgtaccatatcttggtaaaagggaagatcaatggtgcggttcgctgataggcttgaccgctcgagctacctgggcaacaaatattcaggttgccattaatcaggtgagaagactaatcggtaacgaaaattatcttgactatatgacatcaatgaaaagattcaaaaacgagtctgatcccgagggagccttgtggtaa

SEQ ID NO: 21588 - RNA, 9879 nt, synthetic construct
  misc_feature 1..9879: note = derived and/or modified CDS sequence (opt6) from DENV-1__FJ410248__SS-prME
  source 1..9879: mol_type = other RNA
tcggtgactatgttgcttatgcttatgccaacggccttagcctttcatttgactacaagagggggagaaccgcatatgattgtatcaaaacaagaacgaggcaaatcattactattcaaaacttcagcaggagtaaatatgtgcactttaattgctatggatttaggtgagctatgtgaagatacaatgacctataaatgcccacgaataacagaagcggaaccagatgacgtagactgctggtgcaatgcgactgacacatgggtcacgtacggtacgtgtagccaaacaggggaacataggagggataaaaggtctgttgctttagcaccgcatgttgggctcggtctagaaactcgaacagaaacttggatgagttctgaaggcgcttggaaacaaattcaaagagttgagacgtgggcattacgacatcccggttttaccgttatagcactctttttagcccacgctataggaacgtcgataactcaaaaagggataatttttatacttcttatgttagttacaccttctatggcaatgagatgcgttggaatcggatctcgtgattttgtcgagggtttgtccggtgcaacatgggtggatgtagtactggaacacggttcttgtgtgactacgatggcaaaagataaaccaacattagatatagagcttcttaaaaccgaggtcactaatccagcggttcttagaaaactttgcatagaagcaaaaattagtaatacaactaccgacagtaggtgtcccacacaaggagaagcgaccctagtagaggaacaagatgctaactttgtatgcaggagaacttttgttgaccgcggatggggaaacggctgtggattattcgggaaaggctcactaatcacttgtgcaaaattcaaatgtgtgactaaattggaaggtaaaatagtccaatacgaaaatttaaaatacagtgtaattgttactgtacacaccggagaccagcaccaggtagggaatgaatctacagaacatggaacaacggctaccatcacgccgcaggctccaagcaccgaaatccaactaacagattacggagcgttgacgttagactgcagtccgaggacaggtttagacttcaatgagatggtactactaaccatgaaagaaaaatcgtggctagtccataaacagtggtttttggacttacctctaccatggacaagtggagcgtcaacatcgcaggaaacatggaatcgccaagacctgttagtaacgttcaaaacggctcacgcgaagaaacaagaagtagtggtgttaggttcacaagaaggagcaatgcacacggcactgacaggtgcaacagaaattcaaacgagcggaacaactacaatattcgccggccacctgaaatgtcggcttaaaatggataaattaacacttaaaggaatgtcatacgtgatgtgcacaggatcattcaaacttgagaaagaagtagctgaaactcaacatggtacggtactggtacaaataaaatacgaaggaaccgatgccccatgtaaaatacccttttctactcaagacgaaaaaggagttacccaaaatggtagactcattacagctaacccaattgtaactgataaggaaaaacctgtaaatatagaagctgaacctccctttggagaatcctacattgtaataggcgcaggggaaaaagcattgaaacttagctggtttaagaaagggtccagtatagggaagatgttcgtagcaacagcacgaggtgccagaagaatggcgatccttggagacactgcatgggattttggaagcataggaggagtgtttacatcagtaggtaagctagttcaccaaatatttggaacagcatacggagttctattttcaggtgtctcttggacaatgaaaattggtataggagtattactaacttggttgggactcaacagcaggtctacctcgctatctatgacctgcatcgccgttggacttgtaactctttaccttggtgtaatggtccaggctgacagtggctgcgttataaactggaaaggacgcgaattgaaatgcggtagtggtatattcgttaccaatgaggttcacacttggacggaacaatacaaatttcaggcagacagccctaaaaggttgtccgcggcaataggtaaggcttgggaagagggagtttgcggcattcgatcagccacgagactagaaaacatcatgtggaaacaaatatctaatgaactaaaccatatcttattagagaacgatatgaagtttacggtagtagtgggagacgtcgcaggtatattagcacaaggcaaaaagatgatacgacctcagcctatggagtacaaatatagttggaaaagttggggaaaagctaaaataataggggctgatgtacaaaatacaacttttatcatcgatggcccaaatacccctgagtgtcctgatgatcaacgcgcatggaatatttgggaagttgaggactatgggttcggaatcttcacgacgaatatatggctgaaattacgtgatagttacactcaggtttgcgatcacagattgatgagtgcagcgattaaagatagcaaagctgtacatgcagatatggggtattggattgaatctgagaaaaacgaaacatggaaactagccagagccagctttatagaagtaaaaacatgtatttggccaaaatcacataccttatggtctaatggtgtgctagaatcagaaatgataatcccaaaaatttatgggggacctatatcacaacataactatagaccgggatactttactcaaacagcagggccgtggcatttaggtaaactagaattagattttaacttatgcgaaggaaccacagtggttgtggatgagcactgtgggaatcgtggcccatcattaagaactactacagtcactggaaaaatcatccacgagtggtgttgtcgaagttgtacgctaccaccgctaaggtttaaaggtgaagacggatgctggtatggaatggaaataaggcccgtcaaggaaaaggaagaaaatctggttaaatcgatggtgtcggcaggcagtggagaagtagactccttttcactaggtttattgtgtataagcataatgatcgaggaggtgatgaggagtcgctggagtcgtaaaatgcttatgacaggtacccttgcagtattctttttgcttatcatgggtcaactaacgtggaatgatctaataaggctgtgtattatggttggtgcaaatgctagtgaccgaatgggaatgggcacaacatatctcgcattgatggcaacgtttaaaatgagacctatgctggcagtcggtctactattccgaagactcacatccagagaagtactattattaaccataggtttgagcctcgtagcaagtgtcgagctaccgaactcactagaagaacttggcgatgggcttgcaatgggaataatgatattgaaattactaacagactttcaaagtcaccaactgtgggctactcttctatccctaacattcattaaaactacatacagtttacattatgcatggaaaacaatggcaatggtacttagtattgtgagtttgtttcctttgtgcttgtcgactacaagtcaaaagactacctggttacctgtgttacttggaagtctaggatgtaagccactgacaatgttcttaattgcagaaaacaagatatgggggagaaaaagttggcctctgaacgaaggcataatggcagtaggtatcgtcagtatactgctatcttcattacttaaaaatgatgtacctttagcaggaccactaatagcaggcggtatgttaatcgcatgttatgtgataagtgggtcatcagcggatctcagtctcgaaaaagcagctgaagtctcctgggaagaagaggcggaacattccggggccagtcataacatattagtggaagttcaggatgacggtaccatgaaaataaaagatgaagaaagagatgatacccttacgattttgctcaaggcgacacttctagcagttagtggagtttatccattgagtattccagcgacattatttgtatggtatttttggcagaagaagaaacaaagaagtggagtactttgggacacgccaagtcccccggaggtagaaagggctgtcttagacgatgggatataccgtataatgcagcgtggcctattagggcggagtcaagttggagtaggggtcttccaggaaaacgtcttccacactatgtggcacgtgacgagaggagcagtcttgatgtatcaagggaagagattagaaccatcttgggcaagtgtcaagaaagatctaatctcatatggaggcgggtggagactgcagggaagctggaacacaggggaggaagtgcaggtaatagcggtcgagccgggtaagaaccccaaaaatgtacaaaccgcaccgggtacgtttaaaacctctgaaggagaggtcggagcaattgcacttgatttcaaaccagggactagcggatcacctatagttaatagagaagggaaaattgttggtttatatggaaacggagtagtcaccacttctggcacctacgtaagtgcgatcgcgcaggcaaaggcttctcaagaagggccattacctgaaatagagaatgaagtctttcgtaaacggaacctaacaataatggacttacacccaggaagtggaaaaactcgaagatatcttccagctattgtcagagaggcaataaaaagaaaattaagaacactaatacttgctccgacaagggtggtggcaagcgagatggcagaagcccttaaaggaatgccaattcgatatcaaacaaccgcagtaaaaagcgagcacacagggaaggaaatagttgatctgatgtgccatgcaaccttcaccatgcggcttttaagcccagttagagttccaaattacaatatgataatcatggacgaagctcatttcacagacccaagttccatcgccgccagagggtatattagtaccagagtcggaatgggagaagctgcagcaatctttatgacagctactccacctggtagtgttgaagcatttccccaaagtaacgctgttatacaagatgaagaaagagatattccagaaaggagttggaacagcggatatgaatggattacagacttcccaggaaaaacagtttggttcgtccccagtattaagtctggtaatgatatagcaaactgtttaaggaaaaatggtaaacgagtaatccagctgtcccgtaaaacgtttgatacagagtaccagaaaactaaaaacaatgactgggattatgtagtcacaaccgacatcagtgaaatgggtgctaacttcagggctgatcgagtaatagaccctagacgatgcttaaaaccagtaattctgaaggatggcccagagagggtgatattagcagggccaatgccggtaactgttgctagtgcggcacaacgtcgcggaagaattggacgaaaccataataaagaaggagatcaatatatatacatgggtcaaccattaaataatgacgaagaccacgctcattggacagaagcaaaaatgttacttgataacataaacacgccggaaggcattataccagctctttttgagcctgagagagaaaagagcgctgctattgatggtgaatatagattacgtggagaagcccgcaaaacttttgtcgaattgatgcgaagaggggacttaccagtatggctatcatacaaagtagcttctgagggttttcaatatagcgaccggcgatggtgctttgacggtgagaggaataaccaggtactcgaagaaaatatggacgtagaaatatggacgaaagaaggtgagcgcaagaaattacggccaagatggttagatgctaggacatactcggacccactggcgcttagagaatttaaagaatttgcggcgggcagaaggtccgtatcgggtgatctaattctggaaataggaaaactaccgcaacacctcacacagagagctcaaaacgctttagacaatctggttatgctacataattcagaacagggcggtagagcgtatcgccacgccatggaagaacttccagacacaatagaaactttaatgcttctggccttgatagccgtactcacaggtggcgtcacattattctttctgtccggaagaggccttggaaaaacaagtattggactcctatgcgtcatggctagcagcgtactattatggatggcctctgtggaaccacactggatcgccgcctcaattattttggagttctttcttatggtcttattaataccagagccagatcgccagcgaacccctcaagataatcaattggcgtatgtagtcattgggctgttatttatgatcttaactgtagcggctaatgagatggggctactcgagacaaccaagaaagacctaggtattggccacgtggcagtcgagaaccatcaccatgcagccatgcttgatgtggacctccatcctgcgagcgcttggaccttatatgctgtcgccactacaataattacaccaatgatgagacatactattgagaacactactgctaacatcagcttaactgctatagctaaccaagccgcaatactaatgggactagataaagggtggccaatctcaaaaatggatatcggtgttccgttattagccttaggctgctattcacaagttaatccgttaacgctcacagcagctgtattaatgcttgtcgctcactacgcgattattggtccagggttgcaagccaaagcaacccgggaggcacaaaagcgtacggctgcaggaataatgaagaatccaactgttgatggaatagttgctattgatttagacccagttgtgtatgatgctaaatttgaaaaacaattaggacaaataatgcttcttatactatgcactagccagattctcctaatgcggacaacgtgggcgttatgcgaatcgattacattggccaccggtcctttaaccacattgtgggagggttcgcctggtaaattctggaacaccacgatcgcagtgtctatggcgaacattttcagggggtcctacttggcaggggctggtttggcgttctcattaatgaaatcattgggcggaggccgtcggggaacaggagcacaaggtgaaactctaggggaaaagtggaaacgacaacttaatcaactctccaaaagtgaatttaacacatataaacgatcaggcataatggaagtcgatagaagtgaggcaaaagaaggtttgaagagaggagagactacgaagcatgcggttagcaggggtacggcgaaacttagatggtttgttgaacgtaatctagtgaagccagaaggaaaagtgatcgatcttggttgcggcagaggaggttggtcttattattgcgctggattaaagaaagtaactgaggtaaaaggatataccaaaggaggaccaggccatgaagaacctatacctatggcaacttatggatggaatctagtgaaactgcatagtggaaaggacgtattctttattccacccgaaaagtgtgacactttgttatgtgatataggagaatcatcgcccaatcccacaattgaagaaggacgcacactaagggtcttgaaaatggtggaaccatggctacgaggtaaccaattttgcataaaaatattaaacccatatatgccttcggtagtagaaactttggaacaaatgcaaaggaaacatggtggaatgcttgtacgtaacccattaagtagaaacagtacccatgaaatgtactgggttagttgtggcacgggaaatatagtatctgccgtaaatatgacttccaggatgctcctcaatcggttcacaatggcgcatcggaagccaacatatgaaaaagacgtagacttaggcgctggaacacgccatgtagcagttgaaccggaggtcgcgaacttagatataataggtcagaggatagagaacataaagcacgaacacaaatccacttggcactacgacgaagataacccatataaaacatgggcttatcatggctcatatgaagtcaaaccttctggatcagcctcgtcaatggtaaatggagtcgtgaaactcctaacaaaaccatgggacgttatacccatggttacccaaatcgctatgacagatactacaccatttgggcaacagcgcgtatttaaagagaaagtcgatacaaggacaccaaaagctaaaagaggtacggcccaaattatggaagtaacagccaaatggttatgggggtttttgtcacgaaataagaaaccgcgtatatgcactagagaggaatttacacggaaagtaaggtccaacgcagcaataggtgccgtatttgtggatgaaaaccaatggaatagtgctaaggaagctgtagaggatgaaagattttgggacctagtacatagagaaagagaattacacaaacaaggcaaatgtgcgacgtgcgtatataacatgatggggaaacgggagaagaaattgggtgaatttggtaaagccaaaggttcacgtgccatatggtatatgtggctaggggcgcgatttttggaatttgaagccctgggttttatgaacgaagaccactggttcagtagggaaaactctttatctggtgtagaaggggaaggattacataagttagggtacatattaagagatattagtaaaattccaggcggaaatatgtatgcagatgacacggcaggatgggatacaagaattaccgaggatgacttacaaaatgaagcaaaaatcacagatataatggaacctgaacatgcactattagctaaatcaatcttcaagttgacataccagaataaagttgtacgagtacaacggcccgccaagaatggaacggtaatggatgtgatctctagaagagaccaaaggggttcgggacaagtgggaacttacggattaaatacatttacaaatatggaggcgcaactaatacgacaaatggaatctgagggaatttttagtccaagcgaactcgaaactcctaatctcgcgggtagggtgttagattggcttgagaagcacggggtagaaagattgaaacgcatggcaataagtggagatgattgcgtagtcaaaccgatagacgatagatttgcaacagctctaacggctctaaatgacatgggaaaggtacgcaaagacattcctcagtgggagcctagtaaaggatggaacgactggcagcaagttccattctgtagtcaccatttccatcaactaataatgaaggatgggcgtgagatagtggtaccttgtcggaatcaagacgaacttgtaggacgtgctcgtgtaagccaaggagctggatggtcgcttcgggaaacggcatgccttgggaaaagctatgctcaaatgtggcaattaatgtattttcatcgtagagacttaaggttggcagcaaatgcaatctgttcagctgtacccgtagattgggtaccaacaagtaggactacatggagcatacacgctcatcatcaatggatgaccaccgaagacatgctttcagtatggaatagagtgtggatagaagaaaacccatggatggaagataaaacgcatatttcaagctggggagatgttccttacctaggaaaacgagaagaccaatggtgtggatctttgatcggacttacggcaagagcaacttgggcaacaaacatacaagtggcaatcaaccaagtacgacgtttgataggaaacgaaaactatctcgattatatgacatcgatgaagcgttttaaaaatgaatctgatcctgaaggagctctttggtag

SEQ ID NO: 21589 - RNA, 9879 nt, synthetic construct
  misc_feature 1..9879: note = derived and/or modified CDS sequence (opt6) from DENV-1__FJ410249__SS-prME
  source 1..9879: mol_type = other RNA
agtgtaactatgttactaatgttaatgccaaccgcattggcatttcaccttactacgcggggaggtgaaccacatatgattgtatcgaaacaagaaagaggtaaaagccttctgtttaaaacatcggctggtgtaaatatgtgtaccttgatagcaatggacttaggggaattttgtgaagacacgatgacttacaaatgtccacgcataactgaagctgaaccagatgatgtagactgttggtgcaatgctacagatacttgggtaacatatggtacttgctcacaaaccggagaaagaagacgagataaaagaagcgttgctctagctccgcacgtaggtctcggactagaaactaggacagaaacatggatgtcatcagaaggtgcctggaaacaaatccaacgtgtagaaacatgggcactccgacacccgggttttactgtaatagcactgtttttagctcatgcaattggaacatcaataactcaaaaaggaatcatttttattttgcttatgttagtgactccgagtatggcaatgcgatgtgttggggtcggttcacgcgattttgtggagggtttatcgggtgcaacatgggtagacgttgtacttgaacacggatcctgtgtcaccacaatggccaaagacaaaccaacattggacatagaactactaaaaactgaagtaacgaatcccgcagtactgaggaaattgtgtattgaagcaaaaatctcgaatacaaccacagacagcagatgccccactcaaggagaagcgacgttagtagaagaacaagatgctaactttgtatgccgtcgaacatttgtagatagaggatgggggaacggatgtggattatttgggaaaggctcattaatcacgtgcgcaaaatttaaatgtgtcacaaaactagaaggaaaaacagtgcagtatgaaaatctaaaatattcagtcatcgttacagtacatacgggtgatcagcatcaggtagggaacgaatcaacggagcatggaacaacagctactataacgccgcaagctccttcaaccgaaatccaattaacagattatggggcactcacattagactgtagccctaggactggactagacttcaatgaaatggttttacttaccatgaaagaaaaatcatggttggttcataaacaatggtttcttgacttgccgttaccatggacatcaggtgcgtcaacgagtcaagagacgtggaatagaaaggacctcttagttacgtttaaaactgctcatgccaagaaacaggaagtagtagtcctcggtagccaagaaggtgctatgcacacagcacttactggagcaacagagatacaaacttcaggtacaaccacaatatttgctgggcatttaaaatgtaggttgaagatggataaactaacattaaaaggtatgtcatatgttatgtgtactggtagttttaaacttgaaaaagaagttgccgaaacacaacatggcacggtcctagtacaaatcaaatatgaggggaccgatgcaccgtgcaaaattccattctcaacgcaggatgaaaaaggagtaacacaaaacggaagattaattactgcaaatccaattgtcactgacaaagaaaagcctgtgaacatagaggcggagccaccatttggagaatcttatatcgttattggggcgggtgaaaaggcacttaagttatcatggtttaagaaaggatctagcataggcaaaatgtttgaagcaacagctcgtggcgctagaaggatggcaattctaggagatacggcatgggactttggatctattggtggtgtattcacaagcgtaggaaagctggttcatcagatattcggtgcggcgtatggagtattattcagcggtgtgagttggacaatgaagatcggtatcggcgtattattaacttggctaggtctaaatagtcgaagtactagcctctctatgacgtgcatcgccgtaggcctagtaacactatatttgggagtaatggtacaagccgattccggctgtgtaataaattggaaaggaagggagcttaaatgtggttccggcatcttcgttaccaatgaagtccatacatggacagaacaatataaatttcaagccgatagtcctaaacgtttatcagctgcgataggcaaagcctgggaagaaggtgtatgcggcattagaagcgccacccgtttggaaaacataatgtggaaacaaataagtaacgaattaaaccacattttattagaaaacgacatgaaatttacagtagtagtgggagatgtcgcaggaatattggcgcagggcaagaaaatgataagaccacaacccatggagtacaagtacagttggaaatcatggggtaaagccaaaataataggtgctgatgtccaaaataccacgtttattatcgatgggcctaatactcccgaatgccccgacgatcaaagagcatggaatatatgggaagttgaagattatggatttggaatattcacaactaacatctggctaaagctaagggactcctacacacaggtatgcgatcacaggctaatgtcggccgcaatcaaagactcgaaggccgttcatgcggatatgggctactggattgaaagcgagaaaaatgaaacttggaagctcgcgagggcgtcttttatagaggtgaagacatgtatatggccaaaatcacatacgctatggtcgaacggagtcctggaaagcgaaatgattatacccaagatatacggtggccctataagccagcataactatagacccggctactttacacaaactgctggtccttggcatctaggaaaattagagctcgattttgatctctgcgaagggactaccgtagtagttgatgaacattgcggtaatagaggtcccagcttaagaacaacaactgtaacaggtaaaattatccacgagtggtgttgccgatcctgcacattaccacccttgagatttaagggggaagatggatgttggtacggaatggagattaggccagtcaaagaaaaagaagaaaatcttgtaaaatcaatggtcagcgctgggtcgggagaagttgacagcttctcactgggtctgctgtgcataagtattatgatcgaggaagtcatgagaagtcgttggtcccgtaaaatgttaatgactggaacgttagcggtattcttctttctaatcatgggacaacttacatggaatgatcttataaggctttgcatcatggttggagctaatgcgtccgacagaatgggtatgggcacaacatatctagctttgatggcaacttttaaaatgcgaccaatgtttgcggtaggcctccttttcagacgcctgacttcaagggaagttttattgctaactaccggcctatctttagtagcctcggtagaattacctaattctttagaagaactgggtgatggattagcgatggggatcatgatactgaaacttttaacggatttccaaagccatcaattgtgggctactcttcttagcctgacatttataaaaactacattctcactgcactatgcgtggaagactatggcgatggtgctatccatagtaagcctattccctttatgtctatcgacgacatcacagaaaacaacatggctacctgtcttgctgggatcgcttggatgtaaacctctgacaatgtttttaattgcggaaaataaaatatggggacggaaaagctggcccctcaatgaaggaattatggcagtaggtatagtgtccatacttctaagctcattacttaaaaacgatgtacctttagccggacctttaatcgcagggggaatgttaatcgcgtgctatgtaatctctgggagttcagcagatttaagtctagaaaaagcggcagaagtaagctgggaagaggaggcagaacactctggagctagtcacaacattcttgtggaagtacaagacgatggaacgatgaaaattaaagatgaagaaagagatgacactctaactatcctacttaaggcgaccctattagccgtaagtggggtatatccgttatcaattcctgcaacactgttcgtctggtatttctggcagaagaagaaacaaagaagtggagttctttgggacactccttcgccacccgaagtagaacgcgcagtattagacgacggcatctaccgtataatgcagcggggtcttctaggaaggagtcaagtaggtgtcggggtttttcaggaaaacgtatttcacacaatgtggcatgtcacgaggggagcagtcctgatgtatcaaggtaaaagactggagccatcttgggcatcagttaagaaagatttaatcagttacggcggtggatggaggctgcaaggaagttggaacacaggagaggaggtccaagtgattgctgtggaacccggtaagaatcctaaaaatgtccaaactgcacccggaacgttcaagaccagcgaaggagaagtaggcgcaatcgccttagactttaagcccggaacgtcgggatctcctatcgttaatagagaaggtaaaatagtgggtttatacggtaatggagtcgtcaccacttcaggtacttacgtaagtgctatcgctcaggcgaaggcttctcaagaaggacctttacctgaaatagaagatgaagttttccgtaaaagaaatttaacaataatggatttgcatcctggaagcggaaaaactagaagatatttacccgcaatagtaagagaagctataaaacgcaaactaagaacgctcatcctggcgccgacaagggttgtcgcgagcgaaatggcagaggctttaaagggtatgcccataagatatcaaaccaccgcggtcaaaagtgaacacaccggaaaagaaatagttgacctgatgtgtcacgcgactttcacaatgagactgctaagtccggtaagagttcccaattacaatatgattattatggatgaggcccatttcacggatccttcgagtattgctgctaggggatacattagtacgagagttggaatgggtgaagcggctgcaatttttatgacggcaacacctcccggatctgttgaggcatttccacaatcaaatgccgttattcaagacgaagaacgtgacatccctgaacgatcatggaactcgggttatgaatggataaccgactttccggggaaaacagtgtggtttgttccttccataaaatctggcaacgacatcgcaaactgtctacgtaagaatggtaaaagggttattcagttatcacgaaaaacttttgacacggagtaccagaaaaccaaaaataacgattgggattacgtagtaacaacagatatatcagaaatgggtgctaactttagggctgacagagtcatagatccgagacgttgtctcaagccggtaattctgaaagacggaccggaaagagtgatactagcgggaccaatgcctgtaacagtagcaagtgctgctcaaaggcgagggaggataggcagaaaccacaacaaagaaggagatcaatacatatatatgggacaaccactaaataacgatgaagatcatgcacactggaccgaagccaaaatgttattagataacattaatactccggaagggatcattcccgcactgttcgaaccagaacgtgaaaaatccgccgcgatcgatggtgaatacaggctaaggggagaggcgaggaaaacattcgttgaacttatgcgaaggggtgacttgcctgtatggttatcatataaagtagcgagtgagggttttcaatatagtgaccggagatggtgctttgacggcgaacggaataatcaggttctagaagaaaatatggatgtcgaaatctggacaaaggaaggtgagagaaagaaattaagaccaaggtggctggacgccagaacttatagcgatccattagcactaagagagtttaaagaatttgcagcaggaaggaggtcggtgagtggcgacttaatattagaaattggaaaattgccccaacacctcacacaaagggcgcagaatgcgttggacaatctagttatgttacataattccgaacaaggaggcagagcttaccggcacgctatggaggaattgccagacacaatagaaactcttatgctgctggcgttgatagctgtattaacaggtggtgtaaccttgttctttctatcgggtcgaggactcggcaaaacctccatcggactattatgcgtcatggcgtcttctgttctattatggatggcgagcgtagagccgcattggattgcggcatcaataatactcgagttctttttaatggtattgttgatacctgaacccgatagacaacgtactccgcaggataatcaacttgcatacgtggtgatcggactactttttatgatactcacagtagcggcgaacgagatgggactattggagactacaaagaaagatttgggaatcggtcatgtggccgtcgaaaaccaccatcatgcagcaatgttagatgtggacttacatcccgcaagtgcatggacactgtatgctgttgccaccaccataattactccgatgatgagacacactatagaaaatacaacagcaaatatatcattaacagccatcgccaaccaggcagcaattcttatggggttagacaaaggctggccaatttctaaaatggacataggtgtacctctactagcactaggctgttacagtcaagtaaatccactaacgttaactgcggcagtgctaatgttggtagcccattatgcgataattgggccaggattacaggcaaaagctacaagggaagcacagaaaagaacagccgccggaatcatgaaaaatcccacagtggacggaatagtagccatagatctagatcctgtggtatatgacgctaaatttgaaaaacaacttggacaaataatgttactaatcctttgtacgagtcaaattctactaatgcgaacgacctgggcactctgtgagagtatcacattggccacagggcccctgacaacactatgggaaggatcaccagggaaattttggaatacaacgatagccgtgagcatggctaacatcttcagagggtcatatctcgctggagcgggcttagcttttagtttaatgaaatcattaggaggtggaagaagaggtacaggagcacaaggagagaccttaggagaaaaatggaagaggcaattaaatcaactgtcaaaaagcgagttcaacacatacaaaagatcagggataatggaagtagatcggagtgaagcaaaggaaggacttaaacgaggcgaaacaacgaagcatgctgtgagcagaggaacggcaaaattacgttggtttgtcgagagaaacttggttaaaccggaaggcaaggtaattgacctaggttgtggaagaggaggatggtcttactattgtgccggccttaagaaagttactgaagtaaaaggctatacaaagggaggcccaggccatgaagaaccaataccgatggctacctacggatggaatctagtaaaattacattcgggaaaggatgtatttttcatcccaccagagaaatgcgatacgctgctgtgcgatattggggagagttctccaaatccgactatcgaggaaggtcgtaccttacgcgtactaaaaatggtagaaccatggttaagaggcaaccaattttgtattaagatcttaaacccctacatgccgagcgttgtcgaaactttagaacaaatgcaacgaaaacatggcggaatgcttgtaagaaaccctttaagcagaaattctacacacgagatgtattgggtttcctgtggtacggggaatattgtgagcgcagtaaatatgacttcgagaatgttactaaaccgattcaccatggcgcatcgtaaacctacttatgaaagggatgtcgatctaggtgctggaactcgacatgtcgctgtggagccggaggttgcaaatttagacattattggtcaacgaatagaaaacatcaaacatgaacataagagtacttggcactatgacgaagataacccatataaaacatgggcttaccacggaagttatgaagtaaaaccatcaggatccgcgagttcaatggttaacggagtagtgaaacttttaacaaaaccttgggacgttattcccatggtgacccaaatcgcaatgacagatactactccgttcggtcaacaacgggtcttcaaggaaaaagtagatacgagaactcctaaagcgaaaagaggcacggcacaaattatggaagttactgcaaaatggctttggggattcctaagcagaaataagaaaccacgaatttgcactcgagaagaatttacgaggaaagtaagaagcaatgctgcaatcggggcggtttttgtggacgaaaatcagtggaactccgcaaaagaagccgtagaagacgaacgtttttgggatctcgtccatcgcgaaagagaactacataaacaaggaaaatgcgctacatgtgtttataatatgatgggaaaaagagagaagaaattaggtgaatttgggaaagcaaagggtagcagagcaatatggtatatgtggcttggagctcgctttttagaatttgaggctctcggttttatgaacgaggatcattggtttagtagagaaaattcattaagtggtgtagaaggtgaaggactgcataaactcggttacattctacgagacatatcaaaaatacccggtggaaacatgtacgcggacgacactgctggctgggatacaaggataactgaagatgatttacaaaatgaagcgaaaattacagatataatggagccagaacatgcattattagcaaaaagtatctttaaactaacttatcaaaataaagtagttcgtgtgcaaagacccgccaaaaatggtaccgttatggatgtaatttcaagacgagatcaacgtggatccggacaagtaggaacatacgggctaaatacatttactaacatggaggcacaattaataagacaaatggagtcggaaggaatatttagtccttcagaattagaaacgcctaacttagcgggaagggtattagattggttagagaagcacggtgtagaacgtcttaaacgtatggcaatttcaggagatgattgtgtggtcaaacccatcgacgaccgcttcgccacagcactaactgctctaaatgacatgggaaaagttcgtaaagatgtaccgcaatgggaacctagtaaaggttggaatgactggcagcaagtaccattttgttcacaccattttcaccaactgattatgaaggacggtagagaaatagttgtgccatgcagaaaccaagacgagctagttggaagggctcgagtcagccagggagcaggttggagtttaagagaaacagcgtgtttgggaaagtcatatgcacaaatgtggcaactcatgtatttccacaggagggacttgcgactagcagccaacgcgatctgttctgccgttccagtcgactgggtaccaacgagtcgaacaacttggtcaatacatgcacaccaccaatggatgactacagaagatatgctaagcgtatggaatcgagtttggatagaggaaaacccatggatggaggacaagacccacatatcaagttggggagatgtaccttatttgggcaaaagagaagatcagtggtgtggcagcttaataggactgaccgcgagagctacatgggcaactaatattcaagtggcaataaatcaagtacgccggcttataggaaacgaaaactacctcgattatatgacatcaatgaaaaggttcaaaaatgaatccgatcctgaaggagctttatggtaa

SEQ ID NO: 21590 - RNA, 9879 nt, synthetic construct
  misc_feature 1..9879: note = derived and/or modified CDS sequence (opt6) from DENV-1__FJ410251__SS-prME
  source 1..9879: mol_type = other RNA
agcgttacgatgttactcatgcttatgccaacggctcttgcgtttcacctaactactcgagggggagaaccacacatgattgtaactaaacaagaaagggggaaatcgttattattcaaaacctctgcgggagttaacatgtgcactttaattgctatggatctaggggaactatgtgaagatactatgacctataaatgccccagaataactgaagcagaaccagacgacgttgactgctggtgcaatgcaaccgatacatgggtaacatatggtacatgttctcaaactggtgaacatcgaagagacaaaagatcagttgcccttgcaccacatgtcggattgggtctagaaacaagaacagaaacttggatgtccagcgaaggagcgtggaaacaaatacaacgagtggaaacctgggctttgcgacatccgggttttaccgtgattgcattgtttcttgctcatgcaataggaacaagtattactcaaaaaggcataatattcattctattaatgttagtaacaccttccatggcaatgaggtgtgtaggtattggatctcgagactttgtagaaggtttgagcggagctacatgggtagatgtcgtattagaacatggcagttgtgtaaccactatggctaaagataaaccaacattagatatagagcttttaaaaacagaggtcacaaaccctgccgttttaagaaaattatgcatcgaagctaaaatttctaacacaactacggatagtaggtgcccgacacaaggagaggccacactcatggaagaacaagacgctaattttgtatgtagaaggacatttgtagatcgtggctggggcaatggttgtggtctattcggtaaaggctctttaattacctgcgccaaatttaaatgtgtcaccaaactcgaagggaaaatagtacaatacgaaaatctaaaatattctgtcatagtaactgtacacacaggagatcagcatcaagtaggtaatgaatcgactgaacatggcacgactgccacgataactcctcaagctccaacaagtgaaattcaattaacagattatggggcgttaactttagactgttcacccaggacaggccttgacttcaacgaaatggtgcttttgactatgaaagagaaatcgtggttggttcataaacaatggttcctagacttaccactaccctggacaagcggtgcatcgacctctcaggaaacatggaaccggcaggacctgttagtaactttcaaaacggctcacgccaagaaacaagaagtagtggtattgggaagtcaagagggggcaatgcatacagcactaaccggagccacagagattcaaacgtccgggacaacgactatattcgctggacacctaaaatgtagactaaaaatggataaattgactttgaaaggaatgtcatacgtgatgtgcactggaagtttcaaacttgaaaaagaggtggctgaaactcaacatgggacagtcctcgtgcaaattaaatacgagggaacggatgcaccctgcaaaatccctttctcaacgcaagatgaaaaaggagtgactcaaaatgggagacttattactgcgaatccgattgtcacagataaagaaaaacctgtaaatattgaagcagaaccacctttcggagaatcttatattgtcattggcgctggcggaaaagcattaaaactatcttggtttaagaaaggaagtagtataggaaaaatgttcgaagctactgcaagaggggcaaggagaatggcaatactaggagataccgcctgggatttcggttcagtagggggcgtttttacatctgtcggaaaattagtccatcaaatattcggcactgcttatggagtgctattttccggcgtatcttggactatgaaaataggtataggcgtcttactaacatggttaggcctaaattcaaggtctacatctctctcgatgacctgcatcgctgtgggactcgttactttatatcttggtgtaatggttcaagcagatagcgggtgtgtaatcaattggaaagggcgagaactaaaatgtggaagtggcatatttgtgacaaatgaagttcacacctggactgaacaatataaatttcaggcggacagccctaaacgactaagtgcagcaattgggaaggcttgggaagaaggtgtttgtggtataaggtctgcaacaagattagaaaacatcatgtggaaacaaatatccaacgaactcaaccatatcctcttggagaacgatatgaaatttacagttgtcgtgggagatgtagtgggtatactagcccaaggtaagaaaatgataagaccacagccaatggaacataaatacagttggaaatcttggggaaaggcaaaaattataggtgccgacgtgcagaatacaacttttatcatcgatggaccaaacacgccagagtgcccggatgatcagcgcgcttggaatatctgggaagttgaagattatggattcggcatatttacaaccaatatctggctcaaacttcgcgattcatatacgcaagtatgtgatcacagacttatgtcggcggcaattaaagactcgaaagccgtacacgctgacatgggatattggatagaaagcgaaaagaacgaaacatggaaactagcgagggccagctttatagaagttaagacatgtatctggccgaaatcacataccctatggtcgaacggagtcttagaatctgaaatgattatcccgaagatctacggtggacccatatcgcagcacaattataggccaggatattttacccaaacggctggtccgtggcatctcggcaaactagagctagacttcgacttgtgcgaagggacgactgtggtagtcgatgaacattgtggaaatcgaggcccttctctacggacaactacagtaactggaaaaataatacatgaatggtgctgtcgatcatgtacgctaccaccgttaagattcaaaggtgaagatggttgctggtatggaatggaaattcgaccagtgaaagaaaaggaagaaaatctagtaaaatctatggtatctgcgggctcaggagaagttgactcattcagcttaggcttactgtgcataagcattatgatcgaggaagtcatgcggtctcgatggagtagaaaaatgttgatgaccgggacattggctgttttcctattattaataatggggcaactaacttggaacgacctgattagactatgcattatggttggtgctaacgcatccgatcgcatgggaatggggactacctacctagccttaatggccacgttcaaaatgaggcccatgtttgccgtaggactactatttcgtaggcttacatcaagggaagtattgttattaacgataggccttagtttggtagcctccgtggagctaccaaactcattagaagaactaggagatgggctagcgatgggcataatgattttaaagttactaacagatttccagtcccaccaactatgggcgactctcctttctctaacatttataaaaactactctatctttacactatgcctggaaaacgatggcaatggtgctgtcaatcgtgtccctttttccgttatgtctaagtactacaagccagaaaaccacctggttaccggtactcttgggctccttagggtgtaagccgctaacaatgtttcttattactgaaaataagatatggggcagaaaatcttggccactcaatgaaggtattatggctgtcggcgtcgtaagcatattattaagtagtctactaaagaacgatgtaccgttagcaggtcctttaatagcaggaggaatgttaatcgcttgttatgtaatctctggaagctcagctgacctatcactagaaaaagctgcggaagtatcttgggaagaagaagcggaacatagcggagcatcacataacattcttgttgaagtacaagatgatggaactatgaaaattaaagatgaggaaagggatgacaccctaacaattttgttaaaagcaacactgttagccgtaagtggagtatatccattgagtattcccgcaacattatttgtctggtacttttggcagaagaagaaacaacgtagtggtgtcctatgggataccccgagtccaccggaagtagaaagggcggttttagatgacggtatttatagaattatgcaaagaggattacttggaagaagtcaagtaggagtgggagtattccaagaaaatgtgttccacacaatgtggcatgtcactcgtggagccgttttaatgtatcagggaaaacgtttggaacctagctgggcatccgttaagaaagaccttatttcctatggtggcggttggagactacagggctcatggaacacgggggaagaagtgcaggtaatagcagttgaaccaggcaaaaatcccaaaaatgtacaaacagcgcctgggactttcaaaacaccggaaggcgaagttggtgctattgcacttgattttaaaccaggaacatcaggaagtccaatagtaaatcgggagggaaaaatagtggggctatatggaaatggagtcgtaacaacgtcgggtacttatgtatccgctattgcccaagcaaaagcctcgcaggaaggaccgctcccagaaatcgaggatgaagtgttccggaaaagaaacctaacgatcatggacttacacccaggaagcggtaagacaagaagatacctgccagctatagtgcgcgaagcaattaagcgaaaattgcgcactctcatcctggcgccaacgagagtagtcgcctcagaaatggctgaagctctaaagggcatgcccataaggtatcaaactactgctgtaaaatcggaacatacagggaaagaaattgtggatcttatgtgccatgcaacatttacaatgagattactttccccggtgcgggttcccaattacaatatgataataatggacgaagctcattttactgatccatccagcatagcagctagaggttacatatctacacgcgtcggaatgggcgaagctgctgcaatctttatgaccgccaccccaccaggctctgtagaagccttcccccaatcaaacgcagttatacaagatgaagaaagagatattccggagagaagctggaactcgggttatgaatggataacagactttcccggtaaaacggtatggttcgttccatcaatcaaatcgggaaacgacattgccaattgtttgaggaaaaacgggaaaagagttatacaactatctcgaaaaacattcgatacagaataccagaagactaaaaacaatgattgggattatgtagtaacgacagatataagcgaaatgggagcaaactttagggcagatagagtgatagacccgcgtcgttgcttaaaacctgtaatactgaaagatggacccgagagagtaatactagctggacccatgccagtgacagttgcttcagctgctcaaagaagaggcagaattgggagaaatcataacaaagaaggtgatcaatatatatatatggggcaaccattgaataatgacgaggatcatgcgcattggaccgaggctaaaatgttgcttgataacatcaatacccccgagggaataatacctgctctcttcgaaccagaacgagagaaatcagccgcaattgacggagagtatagactacgaggcgaagctcgtaaaacttttgttgaattaatgcgaagaggagatttgccagtatggctttcgtataaagttgcttcagaagggttccaatacagtgataggcgatggtgtttcgacggagaaagaaacaatcaagtattagaagaaaacatggacgttgaaatctggactaaagaaggtgagagaaagaaactgaggccccgttggttagatgcgcggacctactcagaccccttagctttacgagaatttaaggaatttgcagctggaagaagatctgtatctggagacctaatattagagataggaaaattgccccaacatctaacgcagagagcacaaaacgctttggataatctagtgatgctccataactccgaacaaggagggcgagcatatagacatgccatggaggagctaccagacacaattgaaacgcttatgttacttgcactgattgccgtattgacaggtggggtaactctatttttcctgagcggcaggggtctaggtaaaacaagtatcggtctcctgtgtgttatggcatcgagcgtgctgctttggatggcaagtgtcgaacctcattggattgcggcaagtataatacttgagtttttcctaatggttttacttatacctgaaccagaccgtcagcgtacaccccaagacaatcaacttgcctacgtcgtaataggcctgctatttatgattttaaccgtcgctgctaacgaaatgggtctgttggagacgactaagaaagatttaggaatagggcacgtagcggttgagaatcatcaccatgctactatgcttgatgtcgatttacaccccgcatctgcgtggacattatatgctgttgctactaccataattacccctatgatgcgccatactatagaaaatactacagcgaacatcagcctcacagcaatagcgaaccaggcagcgatcttaatgggactcgataaaggttggccaattagtaaaatggacataggagtaccactattagctttaggttgttactcacaagttaacccgctcacactaacagccgcggttttaatgttagtggcacattacgcaatcatcggaccgggattacaggcgaaagcaacgcgagaggcacaaaagagaaccgcggcgggaataatgaaaaacccaactgttgatggtattgtagccatcgatttggatcccgtcgtgtatgacgcgaaatttgagaagcaacttggacagattatgcttcttattctatgtacttcacagatcctactgatgaggaccacgtgggcactatgcgaatcaatcacgttggcaacgggcccgttaaccactctatgggagggatcgcccggtaaattttggaatacaacaatagcagtatcaatggcaaatatatttcgcggatcgtatttggcgggggcaggactcgcattctccttaatgaagtcattgggaggagggaggcgcggaacaggagcccaaggggagactttgggagagaaatggaaaagacagttaaatcagctaagcaaaagtgagttcaatatttataaacgttctgggataatggaggtcgacagaagtgaagctaaggaaggactcaaacgcggggaaacgactcgacatgccgtctctcgaggaacagctaaactgcgctggttcgtagaacgaaatctggttaaacccgaaggaaaggttatagatctcgggtgtggcaggggtggatggagttactattgtgcgggactaaagaaagtaacagaagttaaaggttatactaagggtggtcctggccatgaagaaccgattccaatggctacatatggctggaacctagttaaattacactccggaaaggacgtattctttacaccacctgagaaatgcgatacattactatgtgacattggggagtcatcacctaacccaacaatagaagaggggcgcacgttaagagtacttaaaatggtagagccctggcttcgaggcaaccaattctgcataaaaattcttaatccctatatgcccagtgtagtagaaacactggaacaaatgcaacgtaaacatggaggaatgctagtacgaaatccactttcaagaaattctacgcatgagatgtattgggtaagctgtggaaccggcaacattgtttctgcagtaaatatgactagccgaatgcttctaaatcggtttactatggcacaccgaaaacctacgtatgaacgagacgttgatcttggcgcgggcactagacatgtagcggtagaacccgaggtagcaaatttagatattattgggcaacggatagagaacataaaacatgagcataaatctacttggcattatgacgaagacaacccgtacaaaacatgggcttaccatggctcctatgaagtaaaaccctctggttctgcgtctagtatggttaatggcgtagtcaaacttctaacgaaaccttgggacgttataccaatggtaactcagatcgcaatgacagatactactccatttggtcaacagagagtgttcaaggaaaaagtagatacaagaactccgaaagctaagagaggcacagcccaaataatggaagtaacggccagatggctctggggattcttgtcacgaaataagaaacccaggatctgtacacgagaggaatttacaagaaaagtgagaagtaatgcagctatcggagctgtatttgttgatgagaaccagtggaactcggccaaggaggcagttgaggatgaacgattctgggacctagttcaaaaggaacgtgaattacataagcaggggaaatgcgcgacttgcgtctacaatatgatgggtaagcgagagaagaaattaggagagttcggaaaggcaaaaggttctcgagccatttggtacatgtggttaggagcacggttcctggagttcgaagcactaggatttatgaatgaagatcactggttttctagagaaaacagtttatccggggtagaaggagaaggattacataagttaggatatatacttcgagatatcagtaaaatcccaggaggcaatatgtatgcagatgatacagcggggtgggacactcggatcactgaggacgatttacaaaacgaagcaaaaatcaccgacattatggagccagaacacgcgctcctggctacgagcatatttaaattaacataccaaaataaagttgtaagagtacaacgacctgctaaaaacggcactgttatggatgtaataagtcgaagagatcaacgcggaagtgggcaagtcgggacctatgggctgaacacatttaccaatatggaggctcagttaattcgccaaatggaatcggaaggtatttttcttccatccgaattggaaacgccgaatttagctgaaagggtattagactggttggaaaagtatggagtcgaacgactaaaaagaatggctattagcggagacgattgcgtagtaaagccgattgacgataggttcgctactgcgctgacagcgctaaatgatatgggaaaggttaggaaagacattccgcagtgggaacccagcaaagggtggaatgactggcaacaggtaccgttttgcagccatcattttcaccagctgataatgaaagatggtagggaaatcgtagttccgtgccgcaaccaagatgagttggtgggtcgggcaagagtatcacaaggtgcaggatggagtctccgtgaaaccgcttgtttaggaaaatcatatgcgcaaatgtggcaattaatgtattttcatagacgggacctcagacttgccgctaatgcaatatgcagtgccgtaccagttgattgggtgcccacaagtcgaacaacatggtccatccacgcacaccatcaatggatgaccacagaagatatgctaagtgtatggaatcgagtttggatagaggaaaacccatggatggaagacaaaacgcatgtatcctcatggggagacgtaccatacctgggtaagcgagaagaccaatggtgtggatctttaataggtcttacagcgagagctacctgggcctctaatatccaagttgctataaatcaagtacgccgactgattggaaatgaaaattatcttgactacatgacttcaatgaaaaggttcaaaaatgaaggagatcctgagggagcactctggtaa

SEQ ID NO: 21591 - RNA, 9879 nt, synthetic construct
  misc_feature 1..9879: note = derived and/or modified CDS sequence (opt6) from DENV-1__FJ410252__SS-prME
  source 1..9879: mol_type = other RNA
tctgtaactatgttattgatgctaatgccgacggctttagccttccacttaaccaccagaggaggggaaccccatatgattgtttctaaacaagaacgaggcaaatcattattatttaaaacaagtgcgggtgttaacatgtgtaccttaatagctatggatctgggagaattttgtgaagacacgatgacatataaatgcccaagaataacagaagccgaacctgacgatgttgattgttggtgcaatgcaacagatacatgggtgacatacgggacatgtagtcaaactggggaacacagacgagataaacggagcgtagcattagcgccccatgtaggactaggactcgaaacgcgaactgaaacatggatgtcctcagagggtgcttggaaacaaattcaacgagtcgaaacctgggctctgagacatcctgggttcaccgtaatagctctatttcttgcacacgctataggcacgtcaattactcagaaaggaataatatttatcttacttatgttggttacaccatcgatggccatgagatgcgttggcattgggtcaagagacttcgtggagggcttatccggggcaacttgggtagatgtagttttggagcatggttcgtgcgtaactacgatggcaaaagacaaacctacattagatattgaactgttaaaaacagaagtaacaaacccagctgtacttagaaaattatgtatagaagccaaaataagcaacactacaactgatagtcgctgccctactcaaggagaagcgaccctagtagaagaacaagatgctaattttgtatgcagaaggacgttagtagatagaggctggggtaatggatgtggtctctttggaaagggaagcctaataacatgcgcaaaattcaaatgtgtaactaaactagagggaaaaatagtgcaatacgaaaacttaaaatattccgttatcgtaactgtccatactggagatcagcatcaagtggggaacgaaagtaccgaacatgggaccacagcgacaataacacctcaagcaccatcaactgaaatacaactgacagactacggcgcgctaacattagactgcagcccaagaacagggttggactttaacgaaatggtattactaactatgaaggaaaaatcatggctagtccataaacaatggttcctcgatcttcctttaccatggacaagcggagcatcaacaagtcaagaaacgtggaatagacaagatctattagtaacctttaaaaccgctcatgctaaaaagcaagaggtagttgtactaggatcacaagaaggtgcaatgcacactgccctgacaggtgcaaccgagatccagacaagtggtaccacaactatcttcgctggacatctaaaatgccggctcaagatggacaaattgaccttgaagggcatgtcttatgtaatgtgcactgggtccttcaaattggaaaaagaagttgcggaaacacaacatggaacagtcctggtgcagataaaatatgaaggtactgatgccccttgtaaaatacctttcttaacccaagacgagaaaggagttacccaaaacgggagactgatcacagcaaaccccatcgtaacagataaagaaaagcctgtaaatatagaagcagaaccaccatttggagaaagttatatagttattggagccggggaaaaagcactgaaattaagttggtttaagaaaggatcgtctattgggaaaatgtttgaagcaacagcgcgaggggcacgcagaatggcaattttaggggatacggcctgggatttcggatccataggaggagttttcacaagtgttggtaaactcgtacatcaaatatttggcacagcatatggtgttttattctccggagtatcgtggaccatgaagatcggaataggggttcttctaacatggcttgggctcaatagtcgatcgacctccctgagcatgacgtgcatagcagtagggcttgttacactatatttaggcgtcatggttcaagcggatagcggatgtgtaataaattggaaaggtagagaattaaaatgtgggtcaggtatattcgtcactaatgaggtgcatacttggaccgaacaatataagttccaagcggattcgcctaaaagattatcagctgcgataggaaaggcatgggaggaaggcgtttgtgggattagatctgccacgcgattagaaaatataatgtggaaacagatctccaacgaacttaatcatattctattagaaaatgatatgaaatttactgtcgttgtaggagatgtagcaggcatcctagctcaaggcaagaaaatgattagaccgcaaccaatggaatataaatattcttggaaatcatggggtaaagccaaaataataggagccgatgttcagaacacaacatttatcatagacggtccaaatacgcctgaatgcccagacgatcagagagcatggaatatttgggaagtagaagactacggatttggtatatttacgacgaatatctggctaaaactaagggactcatacacccaagtatgcgactataggcttatgagtgcagctataaaagatagtaaggcagtacacgcggatatggggtactggatagaatccgagaagaatgagacatggaagctagcccgagcttcatttatagaagtcaagacttgcatctggcccaaatcacatacattatggtccaatggtgtcttagaaagtgaaatgataattccaaaaatatatggaggaccgatctcacaacacaactatagaccaggatacttcacccagactgccggaccgtggcacctcggaaagctagaacttgatttcgacctctgtgagggaacaacggttgtagttgatgaacactgcggtaatcgaggaccatccctaaggactacaactgtaacgggaaaaatcattcacgaatggtgttgtcggagttgcacccttcctccactacgatttaaaggggaggatggctgctggtatggtatggagatacgaccagtgaaggaaaaagaggaaaatttagttaaaagtatggtatctgccggatctggagaagtcgactctttttcattgggactactttgcatatcgataatgatagaagaagtaatgcggtcaagatggtcaaggaaaatgctcatgactggtaccctagcagtatttttcttactcattatgggccaactaacctggaacgacctgattagattgtgtattatggtaggtgcaaacgcttcagatcgtatgggtatggggacaacctacttagcactaatggccacattcaaaatgcgaccgatgtttgcggtaggacttttgtttaggaggctaacctcaagggaagttcttctattgactataggattgtcattagtcgccagcgttgaactaccaaactccctcgaagaactaggggatggactagctatgggaataatgatacttaagctgctaactgatttccaaagtcaccaactatgggctactctactcagcttaacgttcattaaaacgaccttcagcttacactacgcatggaaaaccatggccatggtcttatcaatagtatcactattcccattatgtttatcaactacctcacaaaagaccacctggcttcctgtactattaggctctttgggatgtaaaccgctaacgatgttcttaatagcagagaacaaaatatggggccgaaaatcttggccgctgaatgagggcataatggctgtaggcatcgtgagcatacttttaagttctctattgaaaaacgatgtcccgcttgcaggcccattaatagccggagggatgttaatagcatgctacgtaatatcagggagctcggcagatttaagtttagaaaaagcagcagaggtctcatgggaagaagaggccgaacattccggtgcctctcataatattctagtagaagtacaagacgacggaacaatgaaaattaaagacgaggaaagggatgacacactaacgattctgttaaaggctacactattagccgtgtcaggggtatatccattaagcataccagcaacactatttgtttggtatttctggcaaaagaagaaacaacgaagtggtgtgctctgggatactcctagtccgccagaagtagaaagagccgtattagatgacggtatttatagaattatgcaaagggggctgttaggaagatcacaggtcggagtcggagtttttcaagagaatgtgtttcacacaatgtggcacgtaactcgcggcgcagtgctgatgtaccagggaaaacggcttgaaccgtcttgggccagcgtcaagaaagacctcatttcctatggtggcggctggagacttcaaggatcatggaacacaggggaggaagtgcaagttatagctgtagaacctgggaaaaaccctaaaaatgtacagacggcccccggaactttcaaaacgagcgaaggcgaagtaggtgcaattgcactagattttaaaccgggcacctccggtagcccaatagtaaatagggaagggaaaatagtaggtctttacggtaatggagtggtaacaacaagcggcacatacgtcagcgcaatcgcacaagcaaaagcaagccaagaagggcccctaccggagattgaagatgaagtattcaggaagcgaaacttaacaataatggatttacacccagggagtggaaaaaccagacgatatttgcctgcaatcgttcgagaagcaataaaaagaaagctgcgcacgttaatcttagcacctactagggttgtagcgagtgaaatggctgaggctttaaagggaatgcctatacgatatcaaaccactgcagtaaaatcagaacatacagggaaagaaatcgtagacttaatgtgtcacgcgacctttacgatgcgtttactttcgccggttcgtgtacctaattacaatatgataatcatggacgaggcccattttaccgatccctcatccattgcagcaaggggatatatatctactagagtaggaatgggagaagctgcagcaatctttatgacggcgacaccaccaggaagtgttgaagcgttcccccaaagtaacgctgtgatacaagacgaggaacgtgatataccggagagaagttggaacagtggatatgaatggattaccgattttccgggcaaaactgtctggtttgtcccgtccattaaaagtgggaatgacatagcaaattgtcttagaaagaatggtaaacgagtcatacaactttctagaaaaacgtttgatacggaatatcagaaaactaaaaacaacgactgggattatgtagtaacaaccgacataagtgagatgggcgcaaatttccgtgctgatagagtcatagatccaaggcggtgtctgaagcccgtgatactaaaagacggtccggaaagggtgatattagcagggccaatgccagtaacggttgcatctgcagctcaaagaagaggaagaataggtagaaatcacaacaaagagggcgatcaatatatctatatgggacaacccctaaacaatgatgaagaccacgcacactggacggaagcgaaaatgctgttagataacatcaatacaccggaaggaattattcctgccttatttgagccagagcgtgagaaaagcgctgcaatagatggcgagtatagattaaggggtgaagcgagaaaaacattcgtcgaactaatgagacgaggagatttaccggtctggctatcttataaagtagcctctgaaggatttcaatacagcgatagaagatggtgtttcgatggcgagcgtaataatcaggtattggaagaaaatatggacgttgagatatggactaaggagggagaaagaaagaagctgcggccaaggtggttagacgcaagaacatactctgatccattagctctgcgggaatttaaagaatttgccgctggccgccgtagtgttagtggggacttaatactagagattggtaaattaccgcagcatttaacccaaagagctcaaaacgctctcgataatctggtaatgttacacaatagtgaacaagggggacgagcctaccgtcatgcaatggaagaattaccagacactatagaaacgctaatgttactggcattaatagcggtgttaacgggaggagttacattattctttctcagcggacgaggcctaggaaagacaagtataggtcttctgtgtgttatggctagcagtgttttactgtggatggcatcggttgaacctcattggattgctgcatctataatcctagaatttttcctaatggtcctccttattccggaaccagataggcaaaggacacctcaagataatcaattagcatacgtggtgataggccttttatttatgatactaacggtagcagctaacgaaatgggtttattagaaactactaagaaagatctagggattggacacgttgctgtagaaaaccatcatcatgccgctatgcttgatgtggatttacaccctgcctcagcatggacattatacgcggtagcaaccacaatcattacaccaatgatgaggcacaccatagaaaacacgaccgcaaatataagtctaacagcgatcgcgaaccaagcagctatcctgatgggtctagacaagggatggcctatttcgaagatggacataggcgtaccgttactagccttaggatgttatagtcaggttaacccactaaccctaacggctgccgttttgatgctcgtcgcacattacgcgattatcgggccaggacttcaagcgaaggcaaccagagaagctcaaaaacgaacagccgcaggaataatgaagaatccaactgtcgacggaatagtcgcgattgatcttgatccggtagtttacgacgcaaaattcgaaaaacaattgggacagattatgctcctaattctctgtacatcacaaattcttctcatgagaacaacatgggcactctgtgaatcaatcactctcgcaacaggtccattaacaacattgtgggaaggtagccctggtaaattctggaatacaacgattgcagtcagcatggcaaatatatttagaggttcatatcttgcaggcgccggcttagcattttcattaatgaaatcgctcggtggaggaaggaggggaacgggagctcaaggtgaaacgctcggtgaaaagtggaagcgccaactaaaccagttgtccaagtcagagttcaatacgtataaaagaagtggaatcatggaagtagatcgctcagaagcaaaagaaggactaaaacgaggtgaaactacgaaacacgcagtaagccgaggtactgcaaaactaagatggtttgtagaacgtaacctggtcaaaccagaaggaaaagtcatcgacctcggctgcggcagaggaggatggtcatattattgcgctggattgaagaaagttacagaagtgaaaggctatacgaaagggggtcccgggcacgaggaaccgattccgatggcaacctacggctggaacttagtaaaactccactccgggaaggacgttttcttcatcccgccagaaaaatgcgatacgttgctatgtgatatcggtgaatcttcaccgaatcctactattgaagagggacgcactctcagagtactgaaaatggtagaaccgtggttgagaggaaatcagttctgtataaagatcttaaacccatacatgccttcagtagtcgagacgttagaacaaatgcagagaaagcacgggggtatgctagttaggaatccactatcaaggaacagcacacatgaaatgtactgggtatcctgtggaactggtaacatagttagcgcagttaacatgacttcaagaatgctactaaatagattcacgatggcacatagaaaacctacgtatgaacgcgatgtggacttgggcgcgggaacacgacacgttgccgtggagcccgaagtagcgaatttagacattatcggacaaagaatcgagaatatcaagcatgaacacaaatcaacttggcactacgacgaagataatccatacaaaacttgggcatatcacggttcctatgaagttaagcccagtggctcagcatcgagtatggtgaacggagtagttaaactcctaactaaaccctgggatgtaataccgatggtcactcaaattgccatgacagacacaacaccatttggacaacagagagtatttaaagagaaggtggacacgcgaacacctaaagcaaaaagaggaactgcgcaaatcatggaagtgacagctaaatggttatggggatttcttagccggaataagaaacctcgcatttgtaccagggaagagttcacacgtaaagtgaggtcgaatgctgctattggggcagtattcgtcgacgaaaatcaatggaactcagcgaaggaagctgtcgaggacgagagattttgggatctcgttcacagagagcgagaattacataagcaaggaaaatgtgcaacatgtgtatacaacatgatgggtaaacgagagaagaaactcggagagttcggaaaagccaaaggttcacgtgctatctggtacatgtggctcggtgcgcggttcctcgagtttgaagcgcttggattcatgaatgaagaccattggttttcacgagaaaacagcttaagtggcgttgagggtgaagggttacacaaattgggatacattttaagagatatatctaaaatacccgggggtaatatgtacgcagatgacacagccgggtgggatactagaattacagaggacgacctacagaacgaagcaaaaataacggatattatggaacctgaacacgccttgttagcaaaaagtatttttaaactaacataccaaaacaaagttgtaagagtacaacggccggccaaaaacggcacagtaatggacgttatatcaaggagagatcaaagaggatcaggacaagtgggaacatacggcttaaatacattcacaaatatggaagcacagcttattagacagatggaatcagaaggaatattttcgccaagcgaattggaaacaccaaacttagctggaagggtgctagactggttggaaaaacatggagtcgaaagactcaaaagaatggctatcagtggagatgattgtgtcgtaaaacctatagacgatagattcgccacggctctaacagcattgaacgacatgggaaaagtaagaaaggacattccacaatgggaacccagtaagggttggaatgattggcaacaagtcccattttgttcacaccacttccatcaattaattatgaaagacgggcgagaaatagtcgtcccgtgtcgtaaccaagatgaattagtcggacgcgcacgggtctcacagggggcaggatggtcattgagagaaaccgcatgcctcggaaagtcgtacgcacagatgtggcagctaatgtatttccataggagagatctgaggctagcagctaatgccatttgctcggcagttccagttgactgggtacctacatcaagaacgacatggtcaatccacgctcatcatcaatggatgacgactgaggatatgttaagtgtttggaacagagtatggatagaagagaacccttggatggaagataaaactcatatatcctcgtggggtgacgtcccatatctcggcaaaagagaggatcaatggtgtggcagtttaatagggctaacagcaagggctacgtgggcaacaaatatacaggtagcaataaaccaagtaagacgattaataggcaatgagaattaccttgattatatgacttcgatgaaaagatttaaaaatgaatctgaccctgaaggggcattatggtga

SEQ ID NO: 21592 - RNA, 9879 nt, synthetic construct
  misc_feature 1..9879: note = derived and/or modified CDS sequence (opt6) from DENV-1__FJ461331__SS-prME
  source 1..9879: mol_type = other RNA
tcagtaactatgcttttaatgctaatgccgacagccttggcatttcatcttacaacaagagggggagaacctcacatgatagttagtaaacaagaacgcggaaaatctctactgtttaaaacatcggctggggttaatatgtgcaccctgatcgcaatggacttgggagaactgtgtgaagacactatgacatacaaatgtccaagaattaccgaagccgaaccggacgatgttgattgctggtgcaatgctactgatacatgggtgacatatgggacttgtagccaaacaggtgaacatcgtagagacaagcgctccgtggcgttagctcctcatgtgggactcggattggaaacccgtacagaaacatggatgtctagcgaaggtgcttggaagcaaattcaacgagttgaaacttgggctctacgtcatccaggctttacagtaattgccttgtttcttgcacacgcaataggcacatcaataactcaaaagggaattatatttatactgttaatgttagtaacaccatctatggcaatgcgttgtgttggaattggttcacgggattttgttgaaggattatcaggtgcgacatgggtagacgtcgttctcgaacacggatcgtgtgtgacaacaatggcaaaagacaaaccaactctagatatcgaattactaaaaactgaagttacaaatcctgccgttctacgaaaactatgtatagaagccaagatatcgaatacgacgactgactcaagatgtccaacgcaaggtgaagcaaccctagttgaagaacaagatgctaactttgtttgtagaagaacttttgttgatcgaggatggggtaacgggtgtggtttattcgggaagggctcactaatcacatgtgccaaatttaaatgtgtaactaaactagaaggtaaaatagttcaatatgagaatctaaaatactcggtaatagtaactgtacatacaggagaccaacaccaagtcggcaacgaaagcacagaacacggaactacggcaaccataacaccgcaagcacccaccacagagatacaattaactgattatggtgctttaacattagattgtagccctagaacaggtctagatttcaatgaaatggttctgctcacaatgaaagagaaaagttggctagtacataaacagtggttcctagacctaccattaccctggacctctggggccagtacatctcaagagacgtggaatagacaagatctactcgtaacattcaagacggcacatgccaagaaacaagaggtagtggttctaggatcacaggaaggtgccatgcatactgcattaactggggcgacggaaatacaaaccagcggaactactacgatcttcgcaggacacctaaaatgcagattaaaaatggataaactcacccttaaagggatgtcatatgtcatgtgtactggatcctttaaattagaaaaagaagtcgcagagactcagcacggaactgtactcgtacaaataaaatatgaaggaacagatgctccatgcaaaattcctttcagtacacaagatgaaaagggggtaacgcagaatggtcgattaataacagcaaatccaatcgtcaccgataaagaaaaaccagtcaatatagaagcggagccaccatttggtgagtcctatatagtaattggtgcaggagaaaaggctcttaaattgtcttggttcaagaagggcagcagtattggcaaaatgtttgaagctacagccagaggtgcacgacgaatggctattctgggcgacactgcctgggatttcggaagcattggcggagtctttaccagcgttggtaaactaatacatcaaatattcgggaccgcttatggagtattattttcaggtgtatcttggacgatgaaaatcggaataggagtgttattaacctggttagggctgaatagtcgaagtacctctttgtcaatgacatgcatcgcagtcggattagtaactttatatttaggagtaatggtccaagctgactcgggttgtgtaataaactggaaaggtagagaacttaaatgtggatctggcattttcgtgactaacgaagtccacacttggacagagcaatacaaatttcaagcagatagtcccaaaaggttgtctgcagctattggtaaagcgtgggaagaaggagtttgtggaatccgatctgctaccaggttagaaaatattatgtggaaacaaatctcgaatgaactaaatcacatattattggaaaacgatatgaaattgacagtagtggtaggcgatgtggcagggattctcggtcaaggaaagaagatgatcagaccacaaccaatggaatacaaatacagttggaaatcttggggcaaagccaagattataggggctgatgcacagaacacgactttcatcatagacggaccaaatacacctgaatgtccagatgaccaacgagcatggaatatctgggaagtagaagattacggctttggaattttcacgaccaacatatggttgaaattgagggactcgtatacacaggtgtgtgaccataggcttatgtccgcagcgatcaaagatagtaaagcagttcacgccgatatgggatactggatagaatcagagaaaaatgagacctggaaattagctagagcatccttcatagaagtaaaaacgtgtatatggcctaaatcccatacgctgtggtccaatggagtactcgagagtgaaatgataatacccaaaatatacgggggacccatatctcaacataattacagacctggatatttcacacaaactgcaggaccatggcatctaggaaaactcgaattagattttgatttgtgtgaagggacaacagtagtagtagacgaacactgtggtaataggggaccatcattaagaacaaccacagttacaggtaaaataatccatgaatggtgctgtcggagttgcacactacccccactaagattcagaggagaagatggctgctggtacggaatggagattagaccggttaaagaaaaggaagaaaatctggtgaaatcaatggtaagtgcaggtagtggagaagtagactcattttcattaggactattgtgcattagtatcatgatcgaggaggttatgcgatcacgatggtcacggaagatgcttatgacgggtaccctagcagtattctttctgttaatcatgggacaattgacctggaacgatttaatacgactatgcataatggtcggagcaaatgctttcgaccgaatgggcatggggacaacatatcttgccttaatggccacattcaaaatgcgcccaatgtttgctgtcggcttactctttcgtagactaacatctcgagaagtactcctattaacaataggcctgtctttagtagctagtgtagaattgccaaactccttggaagagttaggtgacggattagcaatgggaataatgatattaaaattattaaccgatttccaaagccaccaattatgggccacactattatcgcttacttttataaaaaccacattttctttacattatgcatggaaaacaatggccatggttctctctatcgtctcgcttttcccattatgtctaagtacaacgtcacagaaaacaacatggctgccagtactgctcggatcactcggctgcaaacccttaacgatgttccttatcgcagaaaataagatatggggcagaaaatcatggccattgaatgaaggcataatggcagttgggatagtttctatccttctaagttcactattgaaaaacgatgtccccttggccggtccgttaatagctggaggaatgctaattgcttgctatgtaatatcaggatcatcagctgacctctctttagaaaaggcagcggaagtctcttgggaagaagaggccgaacattctggagcatcacataacatcctagtggaagtccaggatgatggtacgatgaagattaaagatgaagaacgcgatgatactctaacaatcttattaaaggccaccctattagccgtgtcaggagtgtacccactaagtatcccggcaacgttgtttgtatggtacttctggcagaagaaaaagcagcgttcaggcgtgctatgggatacaccctcacctcctgtagtagaaagagcagtgttagatgacggaatttacagaataatgcaaaggggacttcttggaagaagtcaggtaggagttggggtattccaggaaaacgtattccacacgatgtggcacgttacccgaggtgccgtactcatgtatcaaggaaaaagacttgaacccagctgggccagcgtaaagaaggatttaatttcatacggtggaggatggcgtttacggggaagctggaatacgggtgaagaagtacaagtaatcgctgtcgaaccaggcaaaaatcccaaaaatgtccaaactgcaccaggaacctttaaaactccggaaggagaagtgggagcaatagcgttggattttaagccgggcacatccggatcaccaattgtgaatagagaaggaaaaattgtgggtctatacggtaatggagtagtcaccacatcaggaacctatgtatcagcgatagcacaagcaaaagcgtcacaggaaggaccactacctgaaatagaggatgaagtattcagaaaacggaatctcaccataatggacttacatcctggttctggaaaaacacgaagatatctgcccgcaatagttagagaagcgatcaaaagaaaacttcgaaccctcatactggccccgactcgcgtagtcgctagtgagatggccgaggctttaaaaggtatgcccattagataccagactactgcagtaaaaagcgaacacacaggaaaagagattgttgacttaatgtgccatgctacgtttactatgcgtctattatcccccgtaagagtcccaaattataatatgatcattatggacgaggcccattttaccgatcccagcagcatcgcagcacgtggatacatttctacaagagttggcatgggagaagctgccgctatctttatgactgctacaccaccgggatctgttgaagcctttccgcaatctaacgccgtaatccaggacgaggaaagagacattcctgaacgctcgtggaactctggtcatgaatggataactgattttcccggtaagacggtatggtttgtcccctcaattaaatcaggtaatgacatcgccaattgtttgaggaagaacggtaaaagagttatacagctgtcacgtaagaccttcgacactgaatatcagaaaactaaaaataatgattgggactacgttgttacgacagatatctccgagatgggcgctaatttcagagccgatagagtcatagatcctcgacgatgtctcaagcccgtcatactaaaagatggacccgaaagggtgatactcgccggacctatgccagtaacggtcgcatcggctgcgcagaggagaggccgtatcggcagaaaccataacaaagaaggtgaccaatacatttatatgggtcaacctctaaataacgatgaagatcatgcacattggactgaggcaaaaatgcttcttgacaatataaacaccccagaaggcattatacccgcattattcgagccggaacgtgaaaaatctgcagctgttgatggagaatatagactcaggggagaggcgcgaaaaacattcgtagagctcatgcgaaggggagatctccctgtgtggctaagctataaagtagcaagtgaaggcttccaatactctgaccgcagatggtgttttgatggagaaaggaataatcaagtccttgaagaaaatatggacgttgaaatctggactaaagagggggagcggaagaagttaaggccaagatggctcgacgcacggacctattctgatccactggcactgcgggaatttaaagaatttgcagcgggacgtcggtccgtttctggtgacctaattctcgaaatcggaaaactacctcaacatctaacccagcgtgcacaaaatgcactcgacaatctagtaatgctccataattcagaacaaggtggtagagcatatagacatgctatggaggaactacccgataccatagaaactctaatgttgcttgcactaatagccgttttgaccggcggtgttacattattctttcttagcggtcggggactggggaaaacttcaatagggttactttgcgtaatggcaagctcagtactcctatggatggcttctgttgagccacactggatagccgctagcattattctggagtttttcttaatggtattgctaataccagagccagatcgccaaaggactccacaagataatcagttagcttacgtagtgatcggacttctatttatgattcttacggtagcagcaaatgaaatgggtttactcgaaactacgaaaaaggacttaggaataggacatgtggcagtcgagaatcaccatcatgccgctatgctggatgtcgacttgcatcctgctagtgcatggacactctacgctgttgctacaacaattattacacctatgatgcgccatactattgaaaatactacagcaaatatatctttgacggctatagcaaaccaagcggctattttaatgggtttagacaaaggttggcctatttcaaaaatggatatcggagttcccttgttagctctaggttgttatagccaggttaacccactaactctaacggctgcagtcctaatgctagtcgcacactacgccattataggacctggtctgcaagcgaaagcgacgagggaagcacagaaaaggacagcagcaggcataatgaaaaatccgaccgtggacggcatagttgcaattgatttagatccagtcgtttatgatgccaaattcgaaaaacaattgggacagattatgttattaatactgtgtaccagccaaattctactgatgcgcacaacttgggctttgtgtgaatcaattactctggcaacaggcccactaactaccctgtgggaaggaagtccaggtaagttttggaatactaccatagccgtatcaatggctaacatatttagagggtcatacctagctggagctggacttgcattttccttaatgaaatcgcttggaggcggtcgacgaggcacgggagcgcagggagaaactctgggggagaaatggaagcgacaacttaaccaactttccaaaagtgagtttaatacgtacaagcgatcaggaattatggaagtcgacagatctgaagctaaagaagggctaaaaagaggagaaacaaccaaacatgccgtctcacgaggtactgctaaattgcgttggttcgttgaacgaaatctagttaagcctgaggggaaggtaattgatttaggatgcgggagaggaggttggagttactactgtgcaggacttaaaaaggttacagaagtaaaaggttacactaaaggagggcctggtcatgaggaacctattccaatggcgacatacggatggaatttagtaaaattgcattctggaaaagatgtattctttattccaccagaaaaatgtgatactctcctgtgtgacataggagaaagtagtccaaacccaacaatagaagagggtcgtactctccgggtcttgaaaatggtagaaccttggctaaggggcaaccaattctgcataaaaattcttaatccatacatgccctcggtggtagaaacgctagaacaaatgcaaagaaaacatgggggaatgcttgtgagaaacccgctaagccgaaatagcactcacgagatgtactgggtatcttgtggaactggcaacatcgtttcagcagtaaatatgacctctcggatgttacttaacagattcacgatggcacacagaaaaccgacttacgagcgtgacgtcgacctaggaacagggacacgtcacgtcgcagtggaaccagaggtcgcaaatttggacataattggacaacgcatcgagaatataaaacacgagcataaaagtacttggcactatgacgaagataacccctataagacttgggcatatcacggatcatatgaagtaaaaccatcagggtcagctagcagtatggtaaatggcgttgttaaactcttgactaagccctgggatgtaattcctatggttacacaaatagcgatgacggatacaactccattcgggcaacaaagagtattcaaagagaaagttgacacccgaacacctaaagcgaaaagaggaactgctcaaattatggaagttacggcacggtggttatggggatttttatctcgaaacaagaaaccgaggatttgtactagggaagaatttactaggaaagtacgtagtaatgcagctattggcgcagtattcgtggatgaaaaccagtggaactctgccaaagaagcagttgaggacgaaagattctgggacttagtacaccgggagagggaattacacaagcaaggaaaatgcgcaacatgtgtatataatatgatgggcaaaagagagaagaaacttggggagttcggaaaggccaaagggtcacgggctatttggtacatgtggctaggcgctcggtttttagagttcgaggccctgggttttatgaacgaagatcattggtttagcagagaaaattcattatccggcgttgaaggagaaggcctgcacaaacttggttatatactaagagacatctccaaaatacccggtggaaatatgtatgcagatgataccgcaggatgggatactcgaataacagaggacgacctacaaaatgaagccaaaatcacagatatcatggaaccagagcacgctttactcgctaaagctattttcaaattaacgtatcaaaataaagtcgttcgagttcaacgacctgccaaaaatggaaccgtaatggatgtaatatcacgtagggatcaaagaggaagcggacaagttggcacctacggactcaacactttcacaaatatggaagctcaactaatacgacaaatggagagcgaaggtatcttcagtccatccgaacttgaaacgccgaacctagcagaacgcgcacttgactggttagaaaagtacggggtcgaaagactaaaacgaatggcaatatcgggtgatgattgtgtagtcaaaccaattgacgaccgatttgcaactgcattaaccgcgcttaatgatatgggaaaagtacggaaagatatcccacaatgggaaccaagtaaaggatggaatgactggcaacaagtccctttttgtagccaccactttcatcagcttattatgaaggatgggagagagatcgttgtaccgtgcaggaatcaagatgagcttgtaggacgggctagagtaagtcaaggcgcagggtggagtttgcgggaaacagcctgccttgggaaaagttatgctcaaatgtggcaattaatgtactttcataggcgagatctaagactagctgcaaatgcgatatgttcagccgtgccagtagactgggtaccgacatcacgaacaacatggtccattcatgcacatcatcaatggatgactactgaagatatgttgtcagtgtggaatcgcgtctggatagaagagaatccgtggatggaggataaaactcacatatcaagttgggaagatgtaccctatctgggaaaacgagaagatcaatggtgtggcagcttaataggcctaacagcccgtgctacttgggctacaaatatccaagtagcaatcaaccaggtaagacgcctgataggaaatgaaaactatttagattacatgacctctatgaagagattcaagaatgagagcgacccagagggtgcactatggtaa

SEQ ID NO: 21593 - RNA, 9879 nt, synthetic construct
  misc_feature 1..9879: note = derived and/or modified CDS sequence (opt6) from DENV-1__FJ410256__SS-prME
  source 1..9879: mol_type = other RNA
agtgtgacgatgttattgatgttaatgcccactgcactggcatttcatctaacaactagaggaggtgaacctcatatgattgtttcaaaacaagaaaggggaaagagcttactgttcaaaacttctgcaggagtcaatatgtgcacgctaatagcaatggatttaggagagttctgcgaagatactatgacatacaaatgccccaggatcacggaagctgaacccgacgatgtcgattgctggtgtaatgccacagatacctgggtaacatatggaacctgtagtcaaacaggtgaacatagaagagataaaagaagcgtcgcattagctccacatgtaggattaggattagaaacaagaaccgaaacctggatgtcctctgaaggtgcgtggaaacaaatccagaaagtagaaacttgggcccttcggcatccaggatttaccgttatagcgttgtttttagctcacgcaataggtacatccataacacagaaagggattatctttatattactaatgttagttacaccaagcatggccatgagatgcgtcggcattggatcaagagactttgtagaaggattgtctggcgccacctgggtagacgttgttctcgaacacggatcatgcgtaacaactatggctaaagacaaacccacactcgatattgaattactaaaaacagaggtaacgaatccagctgtcctcaggaaattgtgtattgaagcaaaaataagcaataccacaacagattcacgatgtcctacgcagggagaagctacacttgtagaagaacaggacacgaatttcgtatgccgaagaacgtttgtagaccgtggctggggaaatgggtgcggcctctttggtaagggcagcttaataacgtgtgctaaatttaaatgtgtaacgaaattagagggaaaaatcgttcaatacgaaaatttgaaatattcggtcatagttacagtacacacaggtgaccaacatcaagtagggaatgaaagtaccgaacatggtactactgcaaccataactccgcaagcaccatctacagaaatacagctaactgactatggtgctcttacacttgattgtagccctcgaacagggttggatttcaatgaaatggtactgttaacaatgaaagagaaaagttggttagtacacaaacaatggttcctagatttacccttaccatggaccagtggggcgtcaacaagtcaggaaacatggaatagaaaagatttgctcgtaaccttcaagactgcccatgcgaagaaacaagaagtagttgtactaggtagccaagaaggagcaatgcatacagccctaaccggtgcgacagagatacaaacaagtggtacgactacaatcttcgcaggacacctcaagtgtaggttaaaaatggacaaacttacattaaaaggaatgtcctatgtaatgtgtacgggttcgttcaaattggagaaggaagtagcggagacacagcatggaacagtacttgtgcaaattaaatatgaagggacggacgcaccgtgtaaaattccattctccactcaagatgagaaaggtgtgacacagaacggaagactaatcactgcaaatccgatagtgacagataaggaaaaacctgtaaacatagaagctgaaccaccctttggagaaagttacatagttattggcgcaggcgaaaaggcactaaaactaagctggttcaagaaaggctcatcaattggcaaaatgtttgaagccacagcgagaggagcacgacgaatggctatacttggcgatactgcatgggattttggatcaataggtggtgtctttacatcagtgggcaaacttgtacatcaaatttttggaacagcctatggcgtgctattctccggtgtcagctggacaatgaagataggcattggggtgttacttacttggctaggactgaacagtagatcaacatccttatcaatgacctgtatagccgtagggcttgtaacactctatttaggggtcatggtacaagcagactcaggatgtgttatcaactggaaaggacgggagttaaaatgtggatccggtatttttgtaacaaacgaagtgcatacgtggacagaacaatataaatttcaggctgactcaccgaaacgactaagcgcggcaatcggtaaggcctgggaggaaggcgtttgtggcattcgatctacgacacgcctcgagaacataatgtggaaacagatatcaaacgaattaaatcatatattgttagaaaatgatatgaagtttacggtagtggttggtgatgtggcaggcattctagctcaaggaaagaaaatgatacgaccacaaccgatggaatataaatacagctggaaatcctggggtaaggctaaaatcattggggctgacgtacaaaatacgacgtttatcatagatggacctaatacacctgaatgtccggatgaccaacgcgcatggaatatatgggaagtcgaagactacggatttgggatatttactaccaacatatggttaaaattacgtgacagttatacacaagtatgcgatcacaggctaatgtcggcggcgattaaagacagtaaagcagtacatgcagatatgggatattggattgagagcgagaaaaacgaaacgtggaaattggcgcgagctagtttcatcgaagtgaaaacttgtatatggccaaaatcacatacactctggtcgaacggcgtattagaatcagagatgatcatccccaagatatatggcggaccaataagtcaacacaactatagacctggatatttcactcaaacagccggtccatggcacttagggaaattagaattagatttcgacttatgtgaaggtacaacagttgtagttgacgaacactgtgggaatcggggcccgagcctaagaactaccacagtaaccgggaaaataatacatgaatggtgctgtagatcctgcacattaccacctcttagattcaaaggagaggacggatgttggtatgggatggaaataagaccagtaaaagaaaaagaggaaaatcttgtgaagtcaatggtgagcgctggttccggggaagtggattcttttagcttgggattgctctgtatatctataatgattgaggaagtaatgagaagccgttggtcgagaaaaatgctgatgactggcacgttagcagtcttctttctacttataatgggtcaattaacatggaatgatcttatacgactttgtattatggttggagccaacgcctcagatagaatgggaatgggaacgacatatttagcgctaatggcaactttcaaaatgagaccgatgtttgcagtgggactacttttcaggcgtctcacttcaagagaagtgctattattgacgataggattaagtttggtagcctcagtagaactccccaactctctagaagaattgggtgatggcctcgccatgggcataatgatattaaaattattaacagactttcagtcacaccaattatgggcaaccttgctaagtcttacctttatcaaaaccacattttcgttacattatgcctggaaaactatggcgatggtattaagcattgtcagtctctttcccttgtgtctctcaaccactagccaaaagactacctggcttccagtgttgttaggttccctgggctgtaaacccttgacaatgttcttaatcgctgagaataaaatctggggacgtaaatcatggccccttaatgaggggatcatggctgtgggaatagtatcgatattgttatctagccttttgaaaaatgacgtccccttggctggcccgttgatagccggaggaatgttaatagcgtgctacgttatttctggatcttccgcagatctttcattagaaaaagcagcagaagttagttgggaagaagaagcggagcactccggtgcatctcataacatacttgtggaagtgcaagacgacggtacgatgaaaattaaagacgaagaaagggatgatactttaacaattctattaaaggctactttgttagcggtatcgggcgtataccctctgagcataccggcaacactttttgtctggtatttttggcaaaagaagaagcaaagatctggagtattatgggatacccctagtcctccagaagttgaacgtgctgttttggatgacggtatttaccgcattatgcaacgtgggttattaggacggagtcaagttggggtaggagtatttcaagaaaacgtttttcatacgatgtggcacgtcactaggggcgccgtattgatgtatcaaggaaaaagactggaaccgagttgggcgagtgttaagaaagaccttatatcttacggcggcggatggcggctgcaggggagttggaatactggagaggaagttcaagtaatcgcggtcgaacctggcaagaatcccaagaatgttcagaccgcaccaggtactttcaagacaagtgagggggaagtcggagccatagcccttgacttcaaaccaggtacctcaggcagccctatagtaaatagagaaggaaagatagtaggtttatacgggaacggagtagtaacaacctcaggtacatacgtgagtgcaattgcacaagccaaagcgtcccaagaaggtcccctccccgaaatagaagatgaagtattccggaaaagaaacttaacaataatggatctgcacccaggaagcggtaaaacacgtcggtatctgcctgcgatagtaagagaagctataaagagaaaattgagaacactaattctggcaccgacccgagtcgtcgcaagtgaaatggctgaagcacttaaagggatgccgatcagatatcaaaccaccgcagtcaagtccgagcatacaggtaaagagatagtggatctaatgtgtcacgctacatttacaatgagactattatcccctgtcagagtgcccaattataatatgataatcatggacgaagctcattttaccgatccaagcagtatagcggccagaggatacatctcgacccgagttggcatgggggaagccgcagcaatatttatgacagcgactcctccgggatccgtagaggcttttcctcaaagtaacgcagtcattcaggatgaagaacgcgacataccagagcgatcctggaactcggggtacgaatggattacagattttcccggaaaaactgtttggttcgtccctagtataaaaagcggaaacgatatagcaaattgtttgcgtaaaaacgggaaacgtgtaatacaattatctagaaagacatttgacacggagtatcagaaaactaaaaataacgactgggattatgttgtaacgacagatatctccgaaatgggagccaatttccgtgccgaccgggttatcgatcctagacgttgtttgaagccagtgatacttaaagacggacccgaacgcgtaatcctggcagggccgatgcctgtaacagttgcatctgcagcacaaagacgcggacgtataggccgtaaccataacaaagagggagatcaatacatatatatgggacaaccattaaataatgacgaagatcatgcacattggaccgaagcgaaaatgctcctggataacattaatactccagagggcattatacccgcgctatttgaaccggaaagggaaaaatccgctgcaatcgacggagagtatagactaagaggtgaagctagaaaaacttttgttgaattgatgaggagaggcgatttaccagtatggctaagctataaagtggcaagcgagggatttcagtatagcgatcgtcgttggtgttttgatggcgaacgaaataatcaagtcctagaagaaaatatggacgtagaaatatggacaaaagagggagagcgaaagaaattacgtccccgttggctggacgccaggacatattcagatccgctggcattgagagaatttaaagagtttgcagccggacgcaggtcagtatccggagatttaatactagaaattgggaaacttccgcaacacttaactcagcgagctcaaaacgctttagacaatctcgtaatgctacataatagcgaacaaggtggcagagcttacagacacgctatggaggagctgccagataccatagagacactgatgttattagcattgatagcagtactaacgggtggagtaacgttattctttctctcgggtagaggcttaggaaaaacctctatcggcctgttgtgtgtagttgcatcctctgtactactatggatggcatccgtagaacctcattggatagcggcttcaataattctagaatttttcctaatggtactgttaatcccagaaccggaccgacaaagaacacctcaagataaccaactagcatacgtggtgatcggactacttttcatgatacttacagttgcagcgaatgagatgggtctactggaaacaacaaagaaagatctaggtatagggcacgtagctgccgaaaatcaccatcatgcggctatgcttgatgtcgaccttcaccctgcctcagcatggacactgtatgcagtcgctacaactattattactcctatgatgcgtcataccatagaaaacacaacggcaaatatctcattaactgctattgccaaccaagcagcaatattaatgggactagataaaggttggccaataagcaaaatggacattggggtgccactcttggctttgggttgttacagtcaagtaaatcccctaacattgacagccgctgtacttatgctcgtagcacactacgctatcattgggccaggcttacaagcaaaagcaaccagagaagcacagaagagaactgcggcaggtataatgaagaacccaactgtcgacgggatagtagcaatcgaccttgaccccgtggtatatgatgccaaattcgaaaaacagttaggccaaatcatgttacttatattatgcacgagtcaaatattgttaatgaggaccacgtgggctctatgtgagtctataacccttgcaaccggaccattaacaacattatgggaaggatccccaggaaaattttggaataccacaatagcagtcagtatggcaaatatatttagaggatcctacctggccggtgcaggtttagcattttccctcatgaaatcactgggcggagggagacgaggcactggggctcaaggagaaacgctaggcgaaaaatggaaaagacaattgaaccagctcagcaaatcagagtttaatacctacaagcgaagtggaatcatggaggttgataggtcagaggccaaagaaggattaaagcgaggagaaaccacaaaacatgcagtaagtagagggacggcaaaattaagatggttcgtcgaacgaaatttagttaagccagaaggaaaagtaatagacttaggctgcgggagaggagggtggtcgtactactgcgccggactcaagaaagtgacagaagttaaggggtatactaaaggcggtccagggcatgaagaaccaatcccgatggccacctacggatggaacttagtcaagctacacagtgggaaggatgtattctttattccgccagagaaatgtgatacgttattgtgcgacataggagagagttctccaaatccaactatagaagaagggcggacacttagagtgctaaaaatggttgagccctggttaaggggaaatcaattttgcatcaaaatcttaaacccctacatgcctagtgtcgtagaaacgctagagcaaatgcaacgaaagcatggcggaatgctagtaagaaacccgctatccaggaactcgactcatgagatgtattgggtaagttgcgggacaggcaacatagtcagcgctgtaaatatgactagcaggatgttactgaatcgttttactatggctcacagaaaaccaacctatgagcgcgatgtggatttaggagcaggtacgagacacgtcgccgtagaaccggaagttgcaaatctagatattataggacaacggattgaaaacataaaacacgaacacaagtcaacatggcactacgatgaagacaacccttataagacgtgggcataccatggttcctatgaggtgaaaccatctggaagcgcttccagtatggtaaacggcgttgtaaaacttttaaccaaaccgtgggacgtaattcccatggtcactcaaattgcaatgacagatacgactccctttggtcaacagagagtattcaaagaaaaagtggatacgcgcaccccgaaggcaaaaagaggaactgcgcaaataatggaagttaccgctaagtggttgtggggatttctgagtagaaataaaaagccgagaatatgcacaagagaagaatttacccgcaaagtcagaagtaatgcggctataggagcagtttttgttgatgaaaaccagtggaactctgctaaggaggctgtcgaagacgaaagattctgggatctagttcatagagaaagagaattgcacaagcaaggtaaatgcgccacatgcgtctataatatgatggggaaacgagagaagaaactgggtgaatttggtaaagcaaaaggtagtagagccatctggtacatgtggctgggagcaaggtttttagagttcgaagctctaggctttatgaatgaagaccattggtttagccgagaaaactcgctatcaggcgttgagggagaaggattacacaaacttgggtacatattaagagacatatcgaaaataccaggaggcaatatgtatgcagatgatacagccgggtgggatacacgaataacggaagacgaccttcaaaacgaagctaaaattacagatatcatggaacctgaacacgctttattagcaaaatccatcttcaagctaacctaccaaaacaaggtagtaagggtacaaaggccagccaaaaatggtaccgtcatggatgtgatcagcaggcgtgatcagagagggtctggacaggtaggcacctatggcctgaatacctttactaatatggaggcacaactaataagacagatggaaagtgagggtatatttagcccatcagaattggaaaccccaaatctagcagggcgtgttttggattggctagagaagcatggtgctgaacgacttaaaagaatggcaatatcaggagatgactgcgtagtcaaaccaatagatgatcggttcgccacagctctaacagcactcaatgacatgggaaaagtgcgtaaagacattccacaatgggaaccttcaaaagggtggaatgattggcaacaggtgccattctgcagccatcattttcatcaattgataatgaaagatggaagagaaatagtagtaccgtgccggaatcaggacgaattagtcggacgtgcccgtgtaagtcaaggggcaggatggtcattacgagagactgcatgccttggaaagtcatacgcacagatgtggcaactcatgtattttcataggcgtgatctccgattagctgctaacgccatatgctcagctgtacctgtggattgggtacccacaagtcgtacaacctggtcgatacacgctcatcatcaatggatgacaactgaagatatgcttagtgtttggaatagagtctggattgaagagaacccatggatggaagacaaaactcacattagcagttggggagacgtgccatatttagggaagagagaagatcagtggtgcggaagtttaataggcctgacagcacgagcaacttgggcaacaaatattcaggtagcgatcaatcaagtccgaagattaatcggaaatgagaattatttagattatatgacgtctatgaaacgatttaaaaacgagagtgatccggagggagctctgtggtaa

SEQ ID NO: 21594 - RNA, 9879 nt, synthetic construct
  misc_feature 1..9879: note = derived and/or modified CDS sequence (opt6) from DENV-1__FJ410257__SS-prME
  source 1..9879: mol_type = other RNA
tcagtgacaatgctgttaatgttgatgccaacagcgttggcattccatttaacaacccgaggaggggaaccgcatatgatagtaagtaaacaagaaagaggaaaatcattactttttaaaaccagcgccggggttaatatgtgcacattgatagccatggatttaggagaattatgcgaagatacgatgacatataaatgtccaagaatcaccgaagcagaaccggatgatgtagattgctggtgtaatgctacggatacttgggtaacttatggaacttgctcacaaacaggcgaacatcgacgagataaacgaagcgtagctttagcccctcatgtaggactggggctagaaaccagaacggaaacatggatgtcctcagaaggagcctggaaacaaattcaacgagttgaaacttgggcattacgtcaccctggatttactgtcattgctctatttctagcacacgctatagggactagcataacccaaaaaggcataatattcatactgttgatgttagttactccaagcatggcaatgcgatgtgtaggtatcggctcaagagattttgtagaaggattgtcaggcgccacgtgggtggacgtagtcttggaacatggaagctgtgtaacaaccatggcaaaagacaaacccactttagatatagaacttctgaaaacagaagtaacaaatcccgctgtattacgaaaactatgtattgaagcaaaaatctcgaatacaacaactgattcgcgttgtccaacgcaaggagaagcgaccttagttgaagaacaagacgcgaatttcgtatgcaggcgcacatttgtggacagaggctggggtaatggatgtggtttgtttggtaaaggttcactcataacgtgcgcaaagttcaaatgcgtgactaaacttgaaggaaagattgttcaatatgaaaatttaaaatattctgtcatagtgacagtacatacgggtgatcaacaccaagtaggaaatgaatctactgaacacggtacaactgcaacaattactccacaagcaccaaccaccgaaattcaattaactgactacggggcacttactttagattgcagtccgagaacaggacttgactttaacgaaatggttttattgacgatgaaagagaaaagttggctagtacacaaacaatggtttctggacttgcccttaccatggacatcaggagcgtcaacttcgcaggaaacttggaacaggcaggatctgctcgtaaccttcaaaactgctcatgcaaagaaacaagaagtagtcgtcctgggtagtcaagaaggcgctatgcacacggctttaacaggggctacagagattcaaacgtcaggcacaacaaccatatttgccggacatcttaagtgtaggctaaaaatggataaattaactttaaagggcatgtcgtatgtgatgtgtaccggatcatttaaacttgaaaaagaagtggcagaaacccagcacggcactgtgttagtacagataaaatatgaagggacagatgccccctgtaaaattccattcacaacgcaggatgaaaaaggcgtaacgcaaaatggcagactgataacggctaacccaattgtaacggataaagagaaaccggtcaatatagaggcagaaccgccatttggagagagttacatagtgataggtgcaggagaaaaggctttaaaattatcatggttcaagaaaggcagttcaattggaaagatgttcgaagcgactgctagaggtgcaaggcgaatggctattctaggagacactgcatgggactttggctctatagggggtgtattcacatcagttggtaaattagtccaccagatatttggaactgcgtatggtgtattattttcaggggtcagttggaccatgaaaataggaatcggcgtattattaacatggttaggactaaattcaagatccacatcattgagcatgacatgtattgcggtggggttagtaacattatatctgggagttatggtccaagcagactcagggtgcgtaattaactggaaaggcagagagttaaaatgtgggagtggcatattcgtaacaaatgaggtacatacatggacggagcaatataagttccaagcagattcacccaaaagattatcagctgcaattggaaaagcctgggaagagggggtatgcggtattcggtcggctacgagacttgagaatataatgtggaagcaaatttcgaacgaactaaaccatattttgctcgaaaatgatatgaaactgactgtagttgtaggagacgttgctggcatcctagggcagggaaagaaaatgataagaccacaaccaatggaatataaatatagctggaaatcctggggtaaagcaaaaataattggggctgatgcacaaaataccacttttattattgacggaccaaatactccagagtgtccagatgatcagagagcatggaacatttgggaagtagaagactacggattcggaatatttacaactaacatctggcttaaattaagggattcgtatacacaagtatgtgatcatcgtttaatgtctgcggcaattaaggattctaaagccgtacacgcggacatgggatattggatagaatctgagaaaaatgagacctggaaacttgctagagcgtcttttatcgaagtaaaaacatgtatatggccaaagtcgcacaccctatggtcaaacggggttttagaatcggaaatgatcataccaaaaatttacggtggaccgatttcacagcataactacaggccgggatattttacccaaaccgcaggtccatggcacctaggcaaattggaattagatttcgatctttgcgagggtaccacagttgtagtagatgagcattgtggaaatagaggcccgagcttacgaacaacaactgttacaggaaagattatccatgaatggtgttgcagatcatgtactttaccaccactcagatttagaggggaggacgggtgctggtatggcatggaaataaggcccgtgaaggaaaaggaggaaaatctggtaaagtcaatggtttctgcgggctcgggagaagtggactcgttttccctaggattattgtgcattagtataatgattgaagaggtaatgagatcaaggtggtcaaggaaaatgctcatgacaggaaccctagctgtcttctttttactgataatggggcagcttacatggaatgatttgataaggctttgtattatggttggtgccaatgcaagcgataggatgggaatgggcacaacgtacttggctttgatggcgaccttcaaaatgagaccgatgttcgcagtcggtttactattccgacgattaacaagcagggaagtactactcttaacaatcggactatccctggtagcatcggttgaactacctaatagtttagaggaactgggtgatggactagccatgggaataatgatactcaaacttttaacagacttccaatcacatcagctgtgggccacccttctcagtttaaccttcataaaaacaactttttctcttcattacgcttggaagacgatggcaatggttttatcaatagtttcactcttccctctttgcctctcaactactagccagaagacaacttggttacctgtgttgttaggttcccttggatgtaaaccattaacaatgttcctcatagcggagaataaaatatgggggcggaagtcctggcccctaaatgaaggaataatggccgtgggaatagtatctatcctattatcaagccttctgaagaatgatgttcccttagccggacccttaatagcgggaggcatgctaatcgcgtgttacgtgatttcagggagctctgcagacctctcactcgaaaaagcagccgaagtaagttgggaagaagaagcagaacattcaggggcaagccataacatattagtagaagttcaagatgatggtactatgaaaattaaggatgaagaacgagatgacactttaacaatcctgttgaaagccactctcttggcagtgtctggcgtttacccgcttagcatcccagcaactttatttgtatggtacttctggcagaagaagaaacagaggtccggagtgctctgggatactccgtcacctccagaggtagaacgagcagtattagatgatggtatttatagaataatgcagagggggctactgggcagaagccaagttggggttggcgtctttcaagaaaatgtatttcatacaatgtggcacgttacgcgcggagctgttctaatgtaccaaggcaaaagattagagccaagttgggcatcagtgaaaaaggacttaatttcttatggtggtgggtggaggcttagagggtcatggaataccggagaggaagttcaagttattgcagtagaacctggtaaaaaccccaaaaacgtacagactgctcccggtacattcaaaacccccgagggcgaagtaggagctattgcactagactttaagccagggacaagtggatcacccatcgtcaacagagaggggaagattgtaggtttatacggtaacggagtagttactactagcggaacgtatgttagcgctatagcgcaagcgaaagcctcccaagagggcccattaccagaaatagaagatgaagttttccgaaaaagaaatcttactataatggatttacacccggggtctggaaaaacccgccgttatttaccagcaatagtccgagaggcaataaaaagaaaattacgaactttaatactcgcaccaacaagagtcgttgcatcagaaatggctgaagcacttaaaggcatgccgatacggtaccaaacgacagctgtaaaatcagagcatacgggaaaagaaatagttgatttgatgtgccatgctacattcacaatgcgactactctccccggtccgtgtaccaaattacaatatgataataatggatgaggctcattttacagatcctagtagcatagctgcgcgaggatacatatctacacgtgtaggaatgggtgaggctgctgcgatttttatgacagcgactccacccggttcagtagaagcatttcctcagagcaatgctgtaattcaagacgaagaaagggatatacccgagagaagttggaactcaggatacgagtggataacagactttagcggaaaaacagtatggtttgtcccttccatcaagtccggcaatgatattgcaaattgcttacggaagaatggcaaacgagttatacaactcagccgcaaaacgttcgatacggagtatcagaaaactaaaaataacgattgggattatgtagtaacaacagatatatccgaaatgggtgctaattttcgtgcggatagagtaattgatccacgaagatgtctaaagccagtaatattaaaggatggacccgaacgtgttatacttgcaggacctatgccagttactgtggctagcgcggcccagagacgagggcgcataggaagaaattacaataaagaaggtgaccaatatatatatatgggacaaccattgaataatgacgaagatcatgctcactggacggaagcaaaaatgttattagacaatattaacacacctgaaggaataataccagcactttttgaaccagaaagagagaaaagcgccgccgtcgatggggaatatcgattgcgcggtgaagctcgaaaaacctttgttgaattaatgcggagaggagacttgccagtctggctatcttacaaagtcgcgagcgagggcttccaatactcagatcggcgctggtgctttgatggcgaacgcaacaatcaagtcttagaagaaaatatggatgtcgagatatggaccaaagaaggggacagaaagaaactacgaccacgatggttagacgcgagaacttattctgatcctcttgccctgagagagctaaaagagtttgcggctggacgccgttcagtatctggagatttaattttggaaataggaaaactgccgcaacatttgacgcagagagctcaaaacgcactagataatcttgtcatgttacataatagtgaacaaggaggtcgagcatatagacatgcaatggaagaactacctgatactatcgaaaccttaatgctattagcattaatagccgtcttgactggtggggtgacactatttttcttatccggccgtggcttaggtaaaacaagtatcggactgctttgtgtgatggcatcatctgtcctgctctggatggcatcagtggagccccattggatcgcagctagcattatcttggagttctttcttatggtgttacttataccggaaccagatcgtcaaaggacaccccaagataatcaactagcttatgtggtaataggcctactattcatgattttaactgttgcagcaaatgagatggggctactcgaaactaccaagaaagacctaggaattggtcatgttgcggtagaaaatcatcaccacgctgcgatgttggatgtagatctacacccagccagtgcgtggacgctctatgccgtagctacgacaattattacgcccatgatgcgacatacaattgagaacactacggcgaacatctctttaacggcaatagcaaatcaggcagccatacttatgggccttgacaaaggctggcccataagcaaaatggatataggtgtaccgttattggccttaggatgttacagtcaagtcaacccccttactctaacagcagcagttctgatgttagtggcccactatgcaataattggaccgggtttgcaagcaaaagctaccagagaagctcaaaaacgaacagcggctggaatcatgaagaacccaactgtcgatggcatagtcgccattgatctagacccagtagtatatgatgcaaaattcgagaaacaattagggcagattatgttgttaattttgtgtacctcacaaattctcctgatgcgaactacttgggccttatgtgaaagtattactctggcaactggacctctaacaaccctttgggaagggtcaccaggcaaattctggaatacaaccatagcagtttcaatggcgaacatattccgcggatcatacctagcaggggcgggcctcgcattcagtttaatgaaatctctagggggaggaagacgagggacaggcgctcagggggaaacacttggtgagaaatggaaaagacaattgaatcaattaagtaagtctgaatttaatacatataaaagatcagggattatggaagttgacaggagtgaagcaaaagaagggttaaagagaggagaaacgacaaaacatgccgtatcacgtggtacagcaaaacttagatggtttgtggaacgtaacctagttaaacctgaaggtaaggttatcgacctcggttgcggacgtggaggttggagttactattgtgcgggcctaaagaaagtaactgaagtaaaaggatatacaaaaggtggaccggggcacgaagaacccataccgatggcaacgtacggatggaacctagtgaaactccatagcgggaaagacgtatttttcattccacctgaaaagtgtgatacattactatgcgacataggagaatcctcccctaatccaacgattgaagaaggacgtacattgcgggtactaaaaatggtcgaaccttggctccggggtaatcaattttgcattaaaatactaaatccgtatatgccgagcgtggtggaaacgttagaacaaatgcaacgtaagcatggaggaatgttggtacgaaatccccttagcagaaatagtacacacgagatgtactgggtctcttgtggcacaggaaacattgtcagcgcggtaaacatgacatcccggatgctgctaaaccggtttacaatggcacataggaaaccaacatacgaacgtgatgtggacttaggaacaggcaccaggcacgtggctgtggaaccagaagtcgcgaacctagatataataggacaacgaatcgaaaacattaaacatgaacacaagtcaacgtggcactacgacgaagataacccatacaagacatgggcgtaccacgggagctacgaagtcaaaccaagtggttccgcaagtagtatggttaacggggttgtgaaattgttgacaaaaccatgggacgtaattcccatggtaacgcagatagcaatgactgatacaactccgttcgggcaacagcgtgtgtttaaagaaaaagtggataccagaacaccaaaagcaaaacggggaactgcccaaatcatggaagttactgcacgatggttgtggggtttcctaagtcgtaacaagaaaccccgaatctgcactcgtgaagaatttacccgaaaagtaagatctaacgcagctataggagcggtattcgtagacgaaaaccaatggaactcagcaaaagaagcagtcgaggacgaacggttctgggatctggtacacagggagagagaactccataaacaaggtaaatgtgctacatgtgtttacaatatgatgggaaagcgcgagaagaaacttggagagttcggaaaagcaaaaggttcaagggccatctggtatatgtggcttggggccagatttctagaatttgaagcattaggattcatgaacgaagaccattggttcagtcgggaaaatagccttagcggcgtagagggtgaagggctccacaaattaggctacatattgagggatatatcaaagatacctggtgggaatatgtacgctgacgacaccgccggttgggatacaagaataaccgaagacgacctacaaaacgaagcaaaaataactgatataatggaaccagaacatgcactcctagccaaagctatattcaaacttacctatcaaaataaggtagtgagagttcaacgaccggcgaaaaatggaactgtcatggatgtgatctcaaggagggaccaaagaggaagtggtcaagttggaacgtacggcttaaacactttcaccaatatggaagcacaattaatacgacaaatggagagcgaaggcatatttagccctagcgaattagaaacaccaaacttagccgaaagagctttagattggctagaaaagtacggagtagaacgccttaaacgaatggcaataagcggcgatgattgcgtggtaaaaccgatagatgaccggtttgcaacggctctaacagcgctaaacgatatgggaaaggttcgcaaggatattccacagtgggaacctagtaaaggctggaatgactggcaacaagtacctttttgttcacatcattttcatcaattgataatgaaagatggcagagaaatagtagttccttgccggaatcaagacgagttggtaggacgagccagagttagtcaaggagctggatggagcttaagagaaaccgcctgtctaggcaagtcatatgcacaaatgtggcaactaatgtattttcatagaagagatcttagactggcagcgaacgctatatgttctgcggtccccgttgattgggtccccacatcaaggacaacatggtccatacatgcccaccatcaatggatgacgacagaggatatgttaagcgtgtggaatagagtctggatagaagaaaatccctggatggaagataaaactcatatatctagttgggaggatgttccatatctagggaagcgagaggaccaatggtgtgggtctctcataggcctcacagcacgcgcgacttgggcaacaaatattcaagtcgctattaaccaggtcaggagactaatcggaaacgaaaactacctggactatatgaccagcatgaaacggtttaagaacgaatctgatcctgagggtgctctttggtga

SEQ ID NO: 21595 - RNA, 9879 nt, synthetic construct
  misc_feature 1..9879: note = derived and/or modified CDS sequence (opt6) from DENV-1__FJ461332__SS-prME
  source 1..9879: mol_type = other RNA
tctgttacgatgctgttaatgttaatgcctacagcattagcgtttcatttaacaactagaggtggtgaaccacacatgatagttagcaaacaagaacgtggaaaaagtttactatttaaaacaagtgcaggcgttaatatgtgtacccttattgcaatggatcttggagaattatgtgaagatacgatgacttacaaatgccctcgaataacagaagctgaaccagatgatgtagattgctggtgtaatgcaacggacacctgggtaacatatggaacttgttcccaaaccggtgaacatagaagagacaaacggagtgtagctctagcgccccatgtaggacttggtcttgagacgagaactgagacatggatgagcagtgaaggggcatggaaacagattcaaagagtagagacctgggcactaagacacccaggatttacggtaattgctctatttttagctcatgcaatcggaacatcaatcacacaaaaagggataatttttattctattgatgctggtgacgccgagtatggcaatgcggtgcgtagggataggatcacgagattttgtggaaggactaagtggagcaacatgggtagacgtggtgttagaacatggctcttgtgtaacgactatggctaaagacaaaccaaccctcgacatcgagttattaaaaacggaagtaacaaatccagcagttttacgaaaactctgtattgaggctaaaatatcgaataccactaccgactcacgatgtccaacgcaaggggaagcaactctagtcgaagaacaagatgctaattttgtctgtagaagaacctttgtagacagaggatggggtaatggctgcggattgtttggaaaaggttcactgatcacttgcgcaaaatttaaatgcgttacgaagctcgaaggaaaaattgtccaatatgaaaatcttaagtattcagtaatagtaaccgttcatacgggtgatcagcatcaagtcgggaatgaaagcactgaacatggtacgactgcaactataaccccacaagctcctaccacggaaatacaactaacagactatggtgcattaaccttagattgttcgcctagaacaggtctagactttaatgaaatggttttgctaactatgaaagagaaaagttggttagtccataaacaatggtttttagatctacccctaccatggacttctggagcatcaacatcccaagaaacatggaataggcaggaccttttagtgacgttcaagacagctcacgcgaagaagcaagaagtggtagtacttggttctcaagagggtgctatgcatactgcattaacgggagctacggaaatccaaacatcaggtacaacgacaatattcgccgggcacctcaaatgtcgtttgaaaatggataaattaacattaaaaggaatgagttatgtaatgtgtacaggtagtttcaaacttgaaaaagaagtggccgagacacaacatggcactgttttagtacaaattaaatacgaaggaaccgatgccccatgcaaaataccattctcaacacaggacgaaaaaggtgtaacacaaaacggacgactaataacggcaaatcctattgtaactgacaaagaaaaaccagtgaatatagaagcagagccgccattcggagaatcctacatagtaataggagcgggagaaaaagccttgaagctaagttggtttaagaaagggagttcgattgggaaaatgtttgaagctaccgcgagaggagcaaggcgaatggctatacttggggatacagcatgggattttggatcaataggaggagtatttacatcagttggaaagctaatccatcaaatttttggtactgcatacggagtcttattctcaggtgtatcttggacaatgaagattggtatcggagtattacttacttggctagggcttaatagtaggtcaacaagtctatcgatgacatgtatagcggttggactggtaacattatatcttggagttatggtgcaagccgacagcggttgcgttataaattggaaaggcagagagctaaaatgtggttctggtatattcgttactaacgaggtacatacttggacagaacagtacaaattccaagctgatagcccaaaaagattatcagcagcaattggaaaggcttgggaagaaggtgtatgtggaattagaagtgcgacacgcttagaaaatattatgtggaagcaaatcagtaacgaattaaaccacatactactagaaaatgatatgaagttaactgtagtagttggtgatgtcgcgggtattctaggccagggcaagaaaatgatcagaccacaaccaatggaatataaatactcctggaagagttggggaaaagcgaagataataggggcagatgcgcaaaatacaacttttataattgacggtcctaacacgccagagtgcccagatgaccaacgcgcatggaatatttgggaagtggaagactacggttttggtatatttacaacaaatatttggctcaaattacgagactcatatacccaagtttgcgaccatcgcttgatgagtgcagcaattaaagatagtaaagcagtccacgcagacatgggatattggatagaatcagagaaaaatgaaacatggaaacttgcaagagcgtcgttcattgaagtaaaaacctgcatttggcccaagagccacacattatggtcaaacggcgtcttagaaagcgagatgataataccaaaaatatatggagggcccattagccaacataactataggcctggttacttcactcaaacagcgggaccgtggcatttagggaagttggaacttgacttcgatctgtgcgaaggtacaacagtagtagtagatgaacattgtggtaatcgcggaccatcgttacgaaccactacagtcaccggcaagataatacacgaatggtgctgcagatcttgtactctaccccctttacgattcagaggggaagacggatgttggtacggcatggaaatccgtccagtaaaggaaaaagaagaaaatcttgtaaaatcaatggtttcggcaggatcgggtgaagttgactcctttagtctagggctgctctgtatatctatcatgatagaggaggttatgagatcaagatggtcaaggaaaatgttaatgactggaacattagcggtattctttttattaataatgggacagttaacctggaacgatctcattagactatgtataatggttggcgcgaatgcattcgatcgcatgggtatgggcacaacatatctcgctcttatggccacatttaaaatgaggcccatgttcgcagtggggcttctatttagaagattaacaagtcgggaagtcctgcttttaacaataggattatccctagtggcaagtgtcgaattaccaaattccctggaggaactcggtgacggtctcgcaatgggaattatgattcttaaactattgaccgatttccaatcccatcagttatgggctacactcttgtcccttacatttataaaaaccacattttcactgcattacgcctggaaaaccatggctatggtactttcaatagtcagtctttttccgctgtgcttatccacgacatcacagaaaactacatggctccctgtacttctcggctctctgggctgtaagcctttaacaatgttcttgatagctgaaaataaaatatggggaagaaaatcctggcctctgaatgaaggtataatggcggtgggcatagtctcaatcctcctctcatcattactaaagaacgatgtacctttagctggtccattaatagccggtggtatgctaattgcatgctatgttattagtggttcatccgcagacctcagcctggaaaaagcagccgaagtaagctgggaagaagaagctgagcattcaggagcaagccacaatattcttgtagaggtacaagatgatgggacaatgaaaataaaagatgaagaaagagacgatacgttaacaatactacttaaagctactcttctggctgtttctggagtatacccactttctataccggctacactcttcgtgtggtacttttggcaaaagaagaaacagagatctggagtattatgggacacaccctcacctcctgtcgtagagcgagcagtactcgacgatggaatttacagaataatgcagcggggcttacttggaagatctcaagttggggtaggcgtttttcaggagaacgtttttcatacaatgtggcacgtaactcgcggagctgtccttatgtatcaaggaaaacggctggaacctagttgggcaagtgttaagaaagatctgatatcatacggaggcggttggcgtcttcgcgggagctggaatacgggagaggaagtgcaggtaattgcagtcgaacctggcaaaaaccctaaaaacgtacaaacagcccctggaacttttaaaacgccggagggcgaggtcggcgctatagcattagattttaaaccaggtacttctggaagtcccatcgtgaaccgcgaagggaaaatagtaggactttatggtaatggagttgtcacaacctcgggtacatacgtaagtgcgatagcacaagctaaagcaagtcaagaaggtcctttgccagaaattgaggatgaagtctttcgtaaaagaaatttgacaataatggatctccatccaggatccgggaaaacgcgtcgataccttccggctatagtaagggaagctattaaaagaaaactaagaacactaattctagcgccaactcgtgtcgtcgcatctgaaatggcagaagcattaaaaggtatgccaattcggtatcaaacgacagcggtgaaatcagaacataccggtaaagaaattgtggatttaatgtgtcatgcaacatttacaatgcgattactgtcccctgtgcgagtacctaactataatatgataatcatggatgaggcacattttaccgacccatctagtattgcagcacgaggttacataagcactagggtagggatgggagaagcggctgcaattttcatgacagcaacacctccaggttctgtagaagcgttcccccaatctaatgcagtgatacaagatgaggagagggatattcccgaaagaagttggaatagtgggcacgaatggattacggactttccaggaaaaacggtatggtttgtgccctctatcaagagtggaaatgacatagccaattgtttaaggaaaaatgggaagagagtcatccaattatcacggaaaaccttcgataccgaatatcagaaaaccaagaacaatgattgggattacgttgttacgacggatatttccgagatgggggcgaattttagggcggaccgagtgatagatccgaggcgatgtttaaaacctgtaatcctgaaagatggtcctgaaagagttattttggctggacctatgcccgtaactgtagctagtgcagcgcaaaggcgtggaagaataggaagaaatcataataaagaaggcgaccaatatatttacatgggtcagcctttgaacaatgatgaagaccacgcacattggacggaggcaaagatgttattagacaatataaacacacccgaagggataatcccggcattatttgaaccagaacgagagaaaagtgctgcagttgacggagaatatagattacgcggagaagccagaaaaacgtttgtcgaactcatgcgtcgaggcgacttacctgtttggttgtcgtataaggtggcatcggaggggtttcaatattcggaccgccgctggtgttttgacggtgaacggaataatcaggtattagaagaaaatatggatgtggaaatatggacaaaggaaggggagaggaagaaactaagaccccgatggctcgatgcacgaacctattcggacccattagcgctacgcgagtttaaggaatttgcagcgggtcggagaagcgtatccggagatttaattttagagattggaaagttaccacaacacctcacccaaagggcgcaaaatgcccttgataacctagtcatgctgcataattcagaacaaggagggagagcgtatagacatgcaatggaagaacttccagacaccattgaaacactcatgttattagcattgattgctgttctaactggaggagtcactctgttctttctatcaggtaggggtctgggaaaaacgtcaattggcctactctgtgtgatggcttcaagtgtattattatggatggcgagtgtcgaaccgcattggatcgctgcttcaataatcttagagttctttcttatggttcttttaattccagaaccagatcggcaaaggacgccgcaggataatcagttagcttacgtggttattggacttttgtttatgatactaacggtagctgcaaacgaaatgggattactcgaaacaaccaagaaagacttgggtataggacatgtcgccgtcgaaaatcaccatcatgcagcaatgctggacgtggaccttcatccagcctcagcatggacgctatacgcagtggctacaactatcataacacccatgatgagacacacaatagaaaacacaactgccaatatcagcttaacagcaattgcaaatcaggccgcaatactcatgggacttgataaaggttggcccatttcaaaaatggatataggagtgccattgttagcgttggggtgttatagtcaagtaaatccactcacattgactgcggcggtacttatgctagttgcacattacgctattatagggcccggattacaagcaaaagcgaccagagaagctcagaagagaacggcagctgggattatgaaaaaccctacggtagatggtatagtggcaatagatctagaccctgtagtatatgatgtgaaattcgaaaagcaattaggacagattatgttactcattttatgcaccagccaaattttgctcatgaggacaacttgggctttatgcgaatcgatcacactcgcaaccggcccattaacaacgctttgggagggatcacctggcaagttttggaacacgactatagcggtgtctatggcaaatatattcagaggttcgtatcttgccggtgcaggtttagcatttagtttaatgaaaagtttaggaggcgggaggaggggaacaggagcccagggtgaaacgctaggagaaaaatggaaacggcagctaaatcaacttagcaagtcggaatttaatacatataaaagatcaggaattatggaagtagacagatcagaagcaaaagagggattaaaaagaggagagactactaagcacgcagtatctagagggaccgcaaaactgagatggtttgtggagagaaatttggtgaaacccgaaggcaaagtgattgatctaggatgcggtcgaggtggatggagttattattgcgcgggtctgaagaaagtaaccgaagtaaagggttacactaaagggggccccggacacgaagaacctatcccaatggcaacatatggatggaacttagttaaacttcatagtggcaaggatgtattctttattcctccagaaaaatgcgacacactcctatgtgatataggagaatcgtccccaaatccaactatagaggaaggaagaaccttaagggtactaaaaatggtagaaccatggcttagaggaaatcagttttgtataaaaatactaaatccgtacatgcctagtgttgtggaaacattagaacaaatgcaaagaaaacatgggggaatgttagtgcgaaatccactatctcgcaactctacgcacgaaatgtactgggtctcttgtgggacagggaacatagttagcgccgtaaacatgacatctagaatgttactcaaccgtttcacaatggcacatcgcaaacctacgtacgagcgagacgtagaccttggtactggcacacgtcatgtcgcagtagagcccgaggtagctaaccttgatataattggtcaacgaatcgaaaatatcaaacatgaacataaaagtacttggcattacgacgaagataatccatataagacttgggcttatcacggaagttatgaagtaaaaccgtcaggatccgcaagcagcatggtaaacggggtggtaaaattactaacaaaaccttgggacgtgataccaatggtaacgcagattgcaatgacagatacaacaccttttgggcagcaaagagtatttaaagaaaaagtagacacacgaactccaaaagctaaaagaggaacagcgcagataatggaagtcacagcccgatggctatggggatttttaagtcgaaacaagaaaccacgcatatgtacccgtgaagaatttactcgtaaagttagaagcaacgcagcaatcggggctgtgttcgtagatgaaaatcagtggaatagtgcaaaagaagcagttgaggatgaacgattctgggacttagtccatagggaaagagaactacacaagcaagggaaatgtgctacatgcgtgtataacatgatgggcaaacgcgagaagaaattaggagaatttgggaaggcgaaaggaagtcgagctatatggtacatgtggctaggagctaggttcctcgaatttgaggctctaggatttatgaacgaggaccactggttcagtagagaaaattccctttcaggcgttgaaggcgaaggacttcataaacttggatatatactacgagacatctccaaaattccaggtggaaatatgtacgccgatgatacagcgggatgggatacgaggatcacagaagacgatcttcagaatgaggcgaagattactgacataatggaaccggaacatgcactccttgccaaagcaatattcaagttaacgtatcaaaataaagttgttagagtacaaaggccagccaaaaacgggacggttatggatgtaatatcaaggcgggatcagagaggttccgggcaagtgggcacatatggccttaacacgtttaccaatatggaggcccaacttataaggcaaatggaatcagagggcattttctctccttcagaattagagacgccaaacctagcagagagagctctggactggttggaaaagtacggagtagagaggcttaaaagaatggctataagcggagacgactgcgttgtaaaaccaatagacgatagatttgcgaccgccctcacagctttaaatgatatgggaaaagtaagaaaagatatccctcaatgggagccgagcaagggatggaatgattggcaacaagttcctttttgcagtcaccactttcatcagctgattatgaaagacgggcgtgaaatcgttgtaccatgtagaaatcaagacgaacttgtcggaagggcaagagtgtcacaaggggcgggatggtctttaagagaaacagcctgtttaggaaaatcctacgcacagatgtggcaattaatgtatttccacaggcgagatttaagacttgcggcgaatgctatttgtagcgcagtaccagtagactgggtaccgacaagcaggacgacttggtccattcatgcccatcatcaatggatgacaactgaagacatgctatcagtatggaaccgagtgtggatagaagaaaacccatggatggaagataagactcacatcagcagctgggaggacgtaccgtacctagggaaacgagaagatcaatggtgcggatctctgataggattgacagcaagggctacatgggcaactaacatccaggtagctataaaccaagtgcgtagattaataggaaatgaaaattatctagactacatgacatcgatgaagagatttaaaaatgaatctgatcctgaaggagccctttggtaa

SEQ ID NO: 21596 - RNA, 9879 nt, synthetic construct
  misc_feature 1..9879: note = derived and/or modified CDS sequence (opt6) from DENV-1__FJ461333__SS-prME
  source 1..9879: mol_type = other RNA
agcgtaactatgcttctaatgctcatgcccactgcgttggcatttcacctgacgactaggggtggagaaccccacatggttgtatcaaaacaagaaagaggtaaatctcttttattcaaaactagcgctggggtcaacatgtgcacgttaatagcaatggatttaggagaattatgtgaagacactatgacgtataaatgcccaagaattactgaagcagaacccgacgatgtagactgctggtgtaacgctacagacacttgggtaacctatggtacttgcagtcaaaccggggaacatagacgagataaaagatccgtagcacttgcaccacacgtaggccttggcctcgaaacacgaacagaaacgtggatgtcaagcgaaggggcatggaaacaaatccaacgtgtagaaacctgggctctaagacatcctggatttacagtaatagcactatttttagctcatgccattggtacgagtataacacaaaaaggaataatattcattctgctaatgttggtaactccaagtatggccatgagatgtgttggaataggctctagggattttgttgaagggttatcaggcgcaacgtgggtagacgtggtcctagaacatgggtcctgcgtaaccacaatggcaaaagacaaacctactctcgatattgaactacttaaaacggaagtcaccaatccagccatattgcgaaaactctgcatcgaagcaaaaatatctaataccacaacagattctaggtgtccaacgcaaggtgaggctacattagtagaagaacaagatgccaattttgtttgcaggcgtacattcgttgatcgaggttggggcaatggttgcgggttatttggcaaaggttctctaataacgtgtgctaaatttaaatgtgttactaaactagaaggaaaaatagtgcaatacgaaaacctgaaatactccgtcatagttaccgtccatactggagatcaacaccaggtaggaaacgaatctactgaacacggtacgacagcaacaataaccccacaagcacccaccacagaaatacagcttacagattatggggcgttgactctggattgtagcccaagaacaggcctcgattttaacgagatggtcttacttaccatgaaagagaaatcatggttagtacataagcaatggttcctggatctgccgctcccgtggacaagcggcgcctctacttcccaagaaacatggaatagacaagacctattagttacctttaaaacagcgcatgcaaagaagcaggaggtggttgttctgggttcacaggaaggggcaatgcacaccgccctcaccggagccacagaaattcagacgtcaggaactactaccatatttgcaggtcatcttaaatgcagattaaaaatggataaattaactttaaagggtatgagttacgtaatgtgcacaggtagctttaaattagaaaaagaggtcgctgagacacaacacgggacagtattggtacaaatcaaatatgagggtactgatgcaccttgtaaaattccctttagtacgcaagatgaaaaaggcgtaactcaaaatggacgattaattacagctaatccaatcgtcactgataaggaaaaacctgtaaatatagaagcagaacccccgttcggagaaagttatattgtgattggagctggcgaaaaagccttgaaattgagctggttcaagaaaggaagcagcataggtaaaatgtttgaagcaacagcaaggggagcaagacgcatggctatcctcggagatacagcttgggactttgggagtattggaggtgtttttacaagtgttggcaaattagtacaccaaatatttgggaccgcctatggtgtactattctcaggagtaagctggaccatgaaaattggactaggcgttctgttaacatggctcggtttaaacagtaggtccacaagtttaagtatgacatgtatagcagttggcttagtaaccctatatctgggggtgatggtacaagcagactcagggtgcgtgatcaactggaaaggaagagaactaaagtgcgggagtggaatatttgtaactaatgaagtacacacctggactgaacaatataaatttcaggcagacagccctaagagactaagtgcagccataggaaaggcctgggaggaaggagtatgcggaatacggagtgccactcgtctagagaacgtcatgtggaagcaaatttctaacgaacttaaccatatactattagaaaacgacatgaagtttactgtagtagtcggggatgttgcgggaattttggcccaaggaaagaagatgatacgaccacagccgatggaacataaatattcatggaaatcttggggaaaagctaaaatcataggcgcggacgtacaaaacactacctttataatagatggcccaaatacgccagaatgcccagatgatcagagggcatggaatatatgggaggtagaagactacggtttcggaattttcacaacaaatatatggttgaaattacgagatagctatacccaggtatgcgaccaccgacttatgtcggctgctattaaagacagtaaagctgtacacgcagacatggggtactggattgaatcagagaaaaacgaaacatggaagttagcacgtgcttctttcatagaagttaaaacttgtatctggcctaaatcgcacactttatggtcaaacggtgtgctagaaagtgagatgattataccgaaaatatatggaggaccaattagtcaacataattaccggcccggatactttacacaaaccgcaggaccatggcatttagggaaactagagctggacttcgatctgtgtgaaggaacaacagtagttgtggacgaacactgcggtaatagaggtccgagtctcagaaccacaaccgtcacaggaaaaatcattcacgaatggtgttgtcgatcctgcacacttccgccattacgttttagaggtgaagacggatgttggtatggaatggaaatacgccctgtaaaagagaaagaagaaaacctagttaaatcgatggtatctgcaggcagtggtgaggtggattcttttagccttggactattatgtataagtatcatgatcgaggaagtcatgcgatcccgatggtcgaggaagatgttaatgacaggtactttagctgtatttctgttgctaatcatgggacaacttacttggaatgatttaatcagattgtgtatcatggttggagctaacgccagtgatagaatgggaatgggaacaacatatttagctcttatggctacgtttaaaatgagaccgatgtttgccgttggactattgtttagacgtttgacatcacgagaagtcctcctattaacaatcgggttgagcctagtagccagcgttgaattacctaacagcctggaggaattaggggacgggctagcaatggggataatgatacttaaattactgacagatttccaatcgcatcagctatgggccaccctactatccttaaccttcattaagacaacatttagccttcattacgcatggaaaactatggcaatggttttgtcgatagttagcctatttccattgtgcctatcaaccacgtcccagaaaaccacatggttacccgtattattgggatcactaggttgtaaacccctaacaatgtttctcatcgcagagaacaagatttggggtagacgctcttggcccttaaacgagggtatcatggcggtaggtatagtatctatattattatcatcacttctaaagaacgacgtcccgttagccgggcctctgatcgcaggaggaatgctgatcgcatgttacgtaatatccggttcgagcgccgatttgagtctagagaaagctgctgaggtatcttgggaggaagaagccgaacactcgggagcttcgcataatatattggtagaagtccaagatgacggtacaatgaaaataaaagatgaggagagggatgatacacttaccatactgcttaaagcaacgcttctagcagtatcaggagtatatccactatcaataccggcaacgttatttgtatggtatttctggcagaaaaagaaacaaaggtctggagttttatgggatacaccttccccaccagaagtcgaacgggctgtcctcgatgatggaatataccgtataatgcaaaggggcctactagggagatcacaagtaggcgtcggagtatttcaggaaaatgttttccacacaatgtggcatgttactagaggcgcagttcttatgtatcagggaaagaggctagaaccatcctgggcgagtgtcaagaaagaccttattagctacgggggcggctggaggctccaaggaagttggaatacaggggaagaggtacaagtaatagcggtcgaaccaggcaagaacccgaaaaatgtacaaacagcaccaggaacctttaaaacaccagaaggagaagttggcgctattgcacttgatttcaagcccgggaccagcggcagtcctattgtaaacagggaaggcaaaatcgtcggcttgtacggcaatggagtagtaactacaagcggaacgtatgtaagtgctatagcgcaagcgaaagcatcgcaagaaggccccctacccgaaattgaagacgaggtatttagaaagcgcaatctaacaataatggatctccaccctggatctggaaaaactagacggtacttaccggccatagtcagggaggcaataaagcgaaagttacgtacattaatacttgcgccgactagggtagttgcgagtgaaatggcagaagcgctaaaagggatgcctatacgttatcaaaccacagctgtaaaaagtgaacatacagggaaggaaatagtagatttaatgtgtcatgctacctttacaatgagattactgagcccggttcgagttcccaactataatatgatcatcatggatgaggctcacttcaccgacccatcttctatagccgctaggggatacatatctacccgagtaggtatgggagaagcagcagcgatatttatgaccgcaacgccacccgggagtgtcgaagcattcccccaatcgaatgccgttatacaggacgaagagagagatattcctgaaagaagctggaactctggttatgagtggatcacagatttccccggaaagacagtttggtttgttccgagcataaaatctggaaacgatatagctaattgtttgagaaagaacggcaaacgggtaatacagctcagccgaaagacatttgatactgaatatcagaaaaccaagaataatgattgggactacgtagtcaccacagatataagtgaaatgggcgcaaatttcagggctgaccgcgtaattgacccacgtcggtgtttaaaaccagtcatcttaaaagatggcccggaaagagttatcctcgctgggcctatgccagtcacggttgcgtctgccgcacaacgaagaggtaggataggaagaaaccacaataaagaaggggaccagtacatatatatgggtcaaccactaaataacgacgaggaccatgctcattggacagaagcaaagatgttgttagacaacataaacactcccgaaggaataataccagccttgtttgagcctgaaagagaaaaatcagcagccatagatggtgaatatagacttcgaggcgaagccaggaaaacatttgttgaactaatgagacgaggagatctaccagtgtggctttcttacaaagttgcaagcgaaggattccaatatagtgataggcggtggtgtttcgatggtgagcgaaataaccaagtgctagaagagaacatggatgttgagatatggaccaaagaaggggaaaggaagaaattacgcccaagatggttagatgctcgaacatacagtgatccactcgcactaagagagttcaaagagttcgctgccggtcggagaagcgtttcaggagatcttatactggaaatcggaaaacttccacaacatctgacacagagagcgcaaaatgcactagacaatcttgtaatgctgcacaattcagaacaaggagggcgtgcatatcgacatgcaatggaagaattaccagacacaatagaaacactaatgctgcttgcattaatagcagttttaacaggaggggttaccttgttctttctttccggaaggggattgggtaagacaagtattggtctactctgcgtaatggcatcaagtgtactcctttggatggctagtgtagaaccccactggatagcagcatctataatcctagagttcttcttgatggtactattgataccagaacctgataggcaaagaactccccaggataatcaattggcctatgtggtaattggtctgttgttcatgatacttacagtcgcagccaacgaaatgggtctactcgagactacgaaaaaggaccttggaataggacacgcagcggtcggtaatcatcatcacgcagcaatgctggacgttgatttacatccggcttctgcatggactttgtatgcagtcgcaacaaccattataactcccatgatgaggcataccatagaaaatacaactgcgaacatcagtttaactgcaattgcaaaccaagccgcgattttaatgggattggacaaagggtggcctatttccaaaatggatattggtgtaccgttactagcgttaggatgctatagtcaagttaatccgctgactttgacggcggctgtgctgatgctggttgcccactatgcaataatagggccaggactacaagcaaaggccacacgtgaagcacagaaaaggacagcagctgggataatgaaaaatcctaccgtagatggtatcgtcgctattgatttagatcctgtggtctacgacgcaaagttcgaaaaacaactaggtcaaataatgctccttatactttgcacaagtcaaatacttctaatgcggacaacgtgggcactatgtgaaagcatcacccttgcaaccggtcctctgactacattatgggaaggctctcccggaaagttttggaatacaacgattgccgtgtccatggcaaatattttccgtggatcctatctagcaggcgcaggattggccttctctctaatgaaatctctgggaggaggccgacgagggaccggcgcgcaaggtgaaacattaggggaaaagtggaaaagacaactaaaccaactgtcaaaaagcgagttcaatacgtacaaacgatcaggtataatggaggtcgatcgaagtgaagcaaaagaagggttaaaaaggggtgaaaccaccaaacacgcggtttcaagaggaacagccaaacttagatggttcgtggaacgaaatctcgtcaagccggaaggtaaagtaatagatctgggctgtggaagaggcggctggagttattattgtgcgggactaaagaaggtgacagaagtgaaggggtacacgaaaggtggcccgggacatgaggaaccaatcccgatggcgacctacggttggaatttagtgaaactacacagcggtaaagatgtgttctttataccaccagaaaagtgcgacacactgttatgcgatataggcgagagctcgcctaacccaactatagaagaaggtagaaccctaagagtcctaaagatggttgaaccatggctaagggggaatcaattttgcattaaaatccttaacccatatatgcctagcgttgtagaaacattggaacagatgcagagaaagcatggtggtatgttggtaagaaatccattatctagaaattctactcatgaaatgtattgggtttcatgtggtacgggtaatatagtatcagcggttaacatgacaagtaggatgctattaaaccggttcaccatggcacataggaagccaacgtatgaaagagatgttgaccttggcgcaggtacgcgacacgtagcggtcgagcccgaagtggcgaacctagatataataggacagaggatcgagaatatcaaacatgaacataaatcaacatggcattatgacgaagacaatccttacaaaacctgggcgtaccacggttcttacgaagttaaaccaagcggctctgcatcaagcatggttaacggtgtagtcaaattattaacaaaaccatgggatgtcataccaatggtaacacaaatagcaatgaccgacactactcctttcggacagcaacgtgtatttaaagagaaagtagatacacgtactcccaaagcaaaaagaggaactgcccaaataatggaggtgacggcaaagtggctatggggttttctgtctagaaataagaaaccccgcatatgtactcgtgaagaatttacacggaaagttagatctaatgccgcgataggtgcagtatttgtagatgaaaatcagtggaactcagctaaggaagccgtagaagatgaacgcttttgggatttggtacatcgtgaaagggagctacataagcaaggtaaatgcgccacttgcgtttacaatatgatgggcaaacgagagaagaaattaggggaatttggaaaagcgaaaggttcacgagccatctggtatatgtggttaggagcgagatttttggagttcgaagccctaggctttatgaatgaagatcattggttcagtagagaaaacagtttaagcggagtagaaggcgagggattacataagttaggatatatattacgagacatatccaaaattcccggtggcaatatgtacgccgacgacacagccggatgggatacgaggataaccgaagatgatttacagaacgaagccagaattactgatattatggaaccagaacacgcactcttggcgaaatctattttcaaactaacgtaccaaaataaagtcgtgcgggtccaacggcctgccaaaaatggcacggttatggacgtaatatcgaggagagatcaaaggggcagcggacaagttgggacctatggattgaatactttcacaaatatggaagcgcaattaattcgacaaatggaaagcgaaggcatatttagtccttcagaacttgaaacaccaaatttagcagagagggtgcttgactggctagagaaatacggcgtcgaacggctgaaacgtatggcgatcagtggagatgactgcgtagttaaaccaatcgatgacagatttgctacagcactaactgctttaaatgatatgggcaaagtccgaaaagacatcccccaatgggaaccatccaaaggatggaatgattggcaacaggtccccttttgttcacatcatttccaccagttaataatgaaggatgggagagaaatagtcgttccatgtcgtaatcaagacgaattagttggtagagctagagtgagccagggcgctggatggagcctgagagaaaccgcttgcttaggcaaatcatacgcccaaatgtggcagctgatgtatttccaccgtcgggatcttagattagcggctaatgctatatgctcagctgtaccggttgactggatcccaacatcaaggactacttggtcaatccatgcacaccatcaatggatgacaactgaagatatgctatcagtttggaatagagtgtggatcgaagaaaacccttggatggaggataagacacatatatctagctggggagatgtaccttacttaggaaaacgcgaagatcaatggtgtggctcattaatagggctgacggcgagggctacttgggcaacaaatgtccaggtagcgattaatcaagttaggagattaataggcaatgagaattatttagactacatgacatcgatgaaacgcttcaaaaatgaaagtgaccctgaaggagcgttgtggtaa

SEQ ID NO: 21597 - RNA, 9879 nt, synthetic construct
  misc_feature 1..9879: note = derived and/or modified CDS sequence (opt6) from DENV-1__FJ410262__SS-prME
  source 1..9879: mol_type = other RNA
agcgtaaccatgctattgatgctaatgcctacagccttagcattccatttgactacaagaggtggtgaaccccacatgatagtgagcaaacaggaacgggggaagtccttactttttaaaacatctgctggtgttaatatgtgcacacttatagctatggatcttggagaattttgcgaagatactatgacatacaaatgtccaagaatcacagaagcagaacctgacgatgtggattgttggtgtaatgctacggatacatgggtcacctatggtacatgttctcaaactggagaacacaggcgtgacaaaaggagcgtcgctctcgcgcctcatgttggtctgggactagaaacaagaactgaaacatggatgtcctctgaaggcgcttggaaacagatacaaagagtggaaacatgggcactacgtcatcctggattcactgtgatagcattgttcctagcccacgccattgggacgagcattacacaaaaagggattatttttatattattaatgctagtcactcccagtatggcgatgcggtgcgtcggcattgggtcgagagatttcgttgaaggactatctggcgctacatgggtcgacgtagttctggaacatggcagttgtgttactacaatggccaaagataaacctacacttgatatagaactacttaaaactgaagttacaaatccggctgtactacgaaaactttgtatcgaagcaaaaataagtaacactacaacagactcacgttgccccacgcaaggagaagcgacattagtagaagaacaagatgcgaattttgtttgtcgtcgaacctttgtcgatagaggttggggtaacgggtgtggtctctttgggaaaggatctctaataacttgtgctaaatttaagtgcgtaactaagctcgaagggaaaacagtccagtacgaaaatctaaagtatagtgtcattgtcacagtgcatacaggggatcaacaccaagttgggaatgaatcaaccgagcatggcaccacagctacaataactcctcaagctccatcaaccgagatacagttgactgattacggagctttgactctagactgctcaccaaggacaggcttagactttaacgaaatggtactattaactatgaaggagaaaagctggctagtccataagcaatggttcttggacttacctttaccttggacaagtggtgctagtacatcacaagaaacatggaacagaaaggatctattggttacgtttaaaacggcacacgctaagaaacaagaggtagtagttctaggaagtcaggagggcgctatgcatacggcgttgacaggagcaaccgaaatccagacatctggaacaaccacaatatttgcaggacatttaaaatgccgacttaaaatggataagctaacattgaaagggatgtcatatgttatgtgcactggatcatttaaactagagaaagaagtcgcggaaacacaacacgggacggtcctagttcaaattaaatacgaagggacagatgctccttgtaagataccattttccacacaagatgaaaaaggtgttacccaaaacggaagattaatcacagctaacccaatagtgacagataaagaaaaaccagttaacattgaagcagagccgccattcggagagtcttatattgtaataggagctggagaaaaagcgttaaagctaagctggttcaagaaagggtcctctataggaaaaatgttcgaagctactgcaagaggcgcgaggagaatggcgattttgggagatactgcctgggactttggaagtatagggggtgtttttacgagcgttggaaaattagttcatcaaatatttggaacagcatacggagttctatttagcggtgtatcatggactatgaaaatcggaatcggagtactcctaacttggctaggtcttaacagtaggtctacatcattatcaatgacgtgcatagctgttggtctcgtgactctttatttaggagtgatggtgcaagcagactctggatgtgtgataaattggaaaggcagagaattaaaatgtggatccggaattttcgtaacgaatgaagtacacacgtggaccgaacaatataagtttcaggcagatagcccaaaaagactgtctgcagcaattgggaaggcatgggaagaaggcgtctgcggtataagaagcgcaacaagattagaaaatataatgtggaagcaaatttcgaacgaactaaatcatatattactggaaaatgacatgaaatttaccgttgtcgttggtgatgtagcgggtattcttgcccaaggtaagaaaatgatacgcccgcaaccgatggaatacaaatatagctggaaatcttggggtaaggccaagataataggagcagacgtacaaaacaccacgtttattattgacggtcctaacacccctgaatgtccagatgatcaaagagcatggaatatatgggaagtagaagactatggtttcggaatcttcactacaaatatatggttaaaactacgagattcgtatacacaagtttgcgatcacaggctaatgtccgctgccataaaagactctaaggcggtacacgccgacatgggttattggatagaaagtgagaaaaatgaaacgtggaaactagcacgggcatcgtttatagaagtcaaaacatgtatctggcctaaaagccatacgttatggtcaaatggtgtgttggagtcggaaatgataattccgaaaatttatggaggtccaatatctcaacataattatcggccaggttactttacacagacagcgggaccttggcaccttgggaagctagaacttgatttcggactatgtgagggaactactgttgtggtggacgaacactgcggaaatagagggcccagtctacgcacaacaacggttacaggaaaaataattcatgaatggtgttgtagatcatgcacgttaccacccttaagattcaaaggagaagacggatgttggtacggaatggaaattcggccagtaaaggaaaaagaggaaaatttggtaaaaagtatggtatccgcaggatcaggcgaagttgatagtttctcactcggactgctatgtatatcaataatgatcgaagaagtaatgagaagtaggtggagccgaaaaatgttgatgacgggtaccctagcagtattctttctactaattatgggtcaacttacgtggaatgacctaataagactttgtattatggtaggggctaacgctagtgatcgcatgggtatggggacaacatacttagcgctgatggccacttttaagatgcgacccatgtttgccgttggacttctattcaggagattaacatctagagaggtgctattgttaacaatcggcttgtccttggttgcctcagttgaattgccgaatagtttggaagaattaggcgatgggttagcaatgggcatcatgatattaaaattgctaactgacttccagagccatcaattatgggctactttactctcattaactttcattaaaacaacattctctctacactatgcatggaaaacaatggccatggttcttagcattgttagcttgttcccactgtgccttagcacaacaagtcagaaaactacatggctacccgtactattagggtcattaggatgcaaaccgttgacaatgttcctaatagcagaaaataaaatttgggggagaaaatcctggccgctaaacgaaggaataatggcggtaggtatagtcagtattttgttgtcgtcattactcaaaaacgatgtaccacttgcaggtccactaatcgctggaggaatgttaatagcctgctacgtgataagcggaagcagcgctgatctcagtctagaaaaagcagctgaagtttcttgggaggaagaggcagagcattctggagcgtcccacaatatactcgtcgaagtacaagatgacggcacaatgaaaataaaagatgaagaacgcgatgatacacttacgatattgttgaaagccacattattggctgtatcgggtgtctacccattaagtattccagcaaccttgtttgtatggtacttttggcaaaagaagaaacaaaggagcggagtgttatgggatacccctagcccaccggaagtggaaagggcagtcctcgatgatgggatttacagaatcatgcaaaggggactcctgggaagatcgcaagttggcgtgggggtatttcaagaaaatgtattccatacaatgtggcatgtgacaagaggcgcagtgttaatgtatcaaggaaagagattagaaccttcttgggcgtccgttaagaaagacctcatcagctatgggggaggctggagacttcaaggtagttggaatacgggtgaagaagtgcaagtgatagctgtggaacctggaaagaacccaaagaatgtacaaacggccccaggaacgtttaaaacaagtgagggggaggtaggcgccattgcgttggacttcaagccaggaacgagtggctcccctattgttaatagggagggtaaaatagtaggcctatatggtaatggcgtggtgacaaccagtggcacatatgtttccgctatcgcgcaagcgaaagcatctcaggagggtcctttaccagaaatagaagacgaagtgttcagaaaacggaatctgacaataatggaccttcatccaggaagtggaaaaactaggaggtatctaccagctatagtccgagaagccataaagagaaaattgagaacgttgattctagccccaacacgtgtagttgcttcggagatggcagaggctttaaaggggatgccgatccggtatcaaacgactgcagtaaaatctgaacataccggaaaggaaattgttgacctaatgtgtcatgcaacgtttactatgcggttattatcaccagttcgcgttccaaattacaacatgattataatggatgaagcacattttacggacccatctagcattgccgcacgaggatacattagcaccagagttgggatgggagaagcggcagctatttttatgactgcgacccctccgggatcggtggaagcgtttcctcaatcaaatgcagtaatacaagacgaggagcgagatataccagaaaggtcatggaatagcggttatgagtggattacggatttccccggcaaaacagtctggttcgtaccctcaattaagtccggaaatgacattgcaaattgcctcaggaaaaatggtaaaagggtgattcagttgtcaaggaaaacatttgacacagagtatcaaaagactaaaaacaatgactgggattacgttgtgaccacagacatctccgaaatgggggctaattttagagcagaccgcgttatagatccaagaaggtgtttaaagcctgtaatactaaaagacggtcccgagagagtaatactagccggtcccatgcctgtgactgttgctagtgcagcacaaaggcgaggtagaatcggtaggaatcataacaaggaaggagatcaatatatatatatggggcagcccttaaataacgacgaagaccatgcacattggacagaagccaagatgcttctagacaacataaatacgccagaaggaattataccagccttattcgagccggagcgcgaaaagtcggcagcaattgatggggagtatcgtctacgaggtgaagcaagaaaaactttcgtcgaattaatgagacgtggagatcttcctgtgtggttgtcatacaaagtagcgagtgaaggatttcaatattccgaccgacgatggtgcttcgacggcgaacggaacaatcaagtactagaagaaaatatggacgtcgaaatctggacaaaagaaggagaaaggaagaaattgcgtcctagatggctagatgcaaggacttattctgacccactggccctgagagaatttaaagagttcgctgctggacggcgttcagtttctggtgatctgatactcgaaattggcaaacttccacagcacctcactcaacgagcacaaaatgctctggacaatctggtaatgttacataatagtgagcaaggcggcagagcatatcggcacgctatggaagaacttccagatacaattgaaacattgatgctattagcgttgatcgcggtacttacaggaggagttaccttattctttctatccggaagaggattagggaaaacttcgataggccttttatgcgtcatggcaagtagtgttttattatggatggcaagcgttgagcctcattggatagccgcatcaattatcctagagttctttcttatggtattacttatcccagaaccagatagacaaagaacaccacaagataatcaactcgcttatgtagtgattgggcttctattcatgatattgactgttgcggcaaatgagatgggattactagaaacgactaagaaggatttgggcattggacatgtggcagttgaaaatcatcatcatgcggcaatgcttgatgttgatttacatcccgcttcagcttggacactatatgcagttgcaacgacaataatcactccaatgatgcgccatacaatagaaaatactacagctaacatatctctaactgcaattgcaaatcaggcagcaattttaatgggtctcgataaggggtggcctatcagtaaaatggacataggggtgcctttactcgcacttgggtgttattcccaggtaaaccctctcacgctaactgcagccgtccttatgctagtcgcgcattatgcaataattggccctggattgcaagcaaaagcaaccagggaagcgcagaaacggacagctgctggcatcatgaaaaacccaactgtcgatggaatagtagcaatagacctcgatcccgtagtttacgacgcaaaattcgaaaaacagctaggacaaataatgctgttaattctatgtaccagccaaattctattaatgcggacgacatgggccttgtgcgagtcaattactcttgccactggaccattaactacactttgggagggtagcccaggcaagttctggaatactacaatcgccgtgtcaatggccaatatatttagaggatcatatctcgccggagctggattggcattttcactaatgaaatctctaggtggaggtagaagaggtacaggagcacaaggggagacactaggagaaaaatggaagcggcaactaaaccaattgtctaagagcgagttcaatacatataaaagaagtggaataatggaagtcgatcgttcagaagccaaagagggtttaaagaggggagagacgactaaacacgccgtatcacggggtactgcaaaattacgctggttcgtggaacgaaatttggtaaaaccagaaggaaaagttatcgatttaggttgtggtagaggcggatggagctattattgtgctggattgaagaaagtcactgaagtaaagggctacacaaagggcggacctggacatgaggagccgatcccaatggcaacttatgggtggaatttagttaaactgcattcaggtaaggatgttttctttattcctccggagaaatgcgacactttactttgtgacatcggagaatcatcgccaaatccaactattgaggaaggaaggactctaagagtactgaagatggtagaaccatggttgcgagggaatcaattctgcataaagatattaaatccgtatatgcctagtgtagtcgaaacattagagcaaatgcaacgaaaacacgggggcatgctagtccgcaaccctttatcacggaacagcacacacgaaatgtactgggttagctgtggaacaggtaatatcgtaagcgcagtaaatatgacatcgagaatgcttttgaatcgttttacaatggcacacaggaaaccaacctatgaaagggacgtagacttgggagcgggaacgaggcatgtagctgttgaacctgaagtcgccaatcttgatataataggtcaacggattgagaacataaaacacgaacataaatcaacctggcactacgacgaagataatccctataaaacctgggcgtatcatggatcttacgaagtcaaaccatccggatcagcaagctcaatggttaatggagttgtaaaactattaactaagccgtgggatgtaatccctatggtcacccaaatagccatgaccgatacaacacccttcggacaacaacgcgtctttaaagaaaaggtggatacgaggacaccgaaggcgaagagaggtactgcacaaattatggaagtaactgcaaaatggctctggggatttctttctaggaataagaaaccgagaatttgtacacgtgaagagttcacaaggaaggtaaggtccaacgcagcaatcggcgcggtttttgtagatgaaaatcagtggaactccgcaaaagaagcggttgaagatgaaaggttttgggaccttgtccatcgggaacgcgaattacacaaacaaggaaagtgtgcaacgtgtgtttacaacatgatgggtaaacgggaaaagaaacttggggaatttggaaaggcaaaaggaagtagagctatatggtatatgtggctaggagcaagatttttagagttcgaggctttgggcttcatgaatgaagaccattggttcagtagggaaaatagcttatcaggagtagaaggcgaaggcctgcacaagctaggttatatccttcgtgacattagtaagatacctggtggcaacatgtacgcggacgataccgccggatgggatacaaggataacagaagatgatttacaaaacgaagcaaagattaccgatattatggaacctgaacacgctctgttagcaaaaagcatttttaaattaacatatcaaaataaagtcgtgcgtgtacagagaccagctaaaaacggaactgtcatggatgtcatatcgcgtagggaccaacgaggatctggacaagtaggtacttatggtctgaacacgtttacgaatatggaagcacagctaatcagacaaatggaaagtgagggtattttctctccctcggagttggaaacaccgaatttagcaggaagggtgttagactggcttgaaaaacacggtgttgaacgtttgaaacgaatggccatatctggagatgactgtgtagtcaaacctatagatgacagatttgctaccgctctcacagcactaaatgatatgggtaaagttagaaaagatataccgcaatgggaacctagtaaagggtggaacgactggcaacaggttccgttctgtagccaccacttccaccagttgataatgaaagatggacgtgaaattgtcgtaccatgtagaaatcaagatgagttagttggtcgcgcaagagtaagccaaggagcggggtggtcacttagagaaacggcttgtctagggaaatcatatgcgcaaatgtggcaactgatgtactttcataggcgagatttaagactagcagcaaatgctatttgcagcgctgtaccagtcgattgggttcctacatcaaggactacttggtcaattcatgctcatcatcaatggatgaccacagaagacatgctatctgtttggaatcgagtatggatagaggagaatccctggatggaagataaaactcatatctctagttggggtgacgtcccatatctaggtaaacgagaagatcagtggtgcggatccctgattggtcttacggcacgagctacatgggcaacgaatattcaagtagctattaatcaggttagaagattgatcggaaacgagaattatctagactatatgacttctatgaagcgctttaaaaatgaatctgatcccgaaggggcactatggtga

SEQ ID NO: 21598 - RNA, 9879 nt, synthetic construct
  misc_feature 1..9879: note = derived and/or modified CDS sequence (opt6) from DENV-1__FJ410263__SS-prME
  source 1..9879: mol_type = other RNA
tcagtcacaatgctgctaatgttgatgccgaccgcgcttgcattccacctaactacaaggggcggggaaccacacatgattgtatccaaacaagaacgagggaaatctctactttttaaaacatctgctggtgttaatatgtgcactttaatagcaatggatctaggggaattatgtgaagacattatgacgtataaatgtccaaggattacagaaactgaaccagatgatgtagactgctggtgcaacgcgaccgatacctgggtaacctacgggacgtgttcccaaactggagaacatcgaagggataaaagatcggttgcattagcaccacacgtaggattaggtttagaaacgagaaccgaaacttggatgagttctgaaggcgcatggaaacaaatacaacgagttgaaacgtgggcattaaggcatcctggtttcactgtgatagcgttatttcttgcacatgcgataggtacgtcaattactcagaaaggtattatttttatactattaatgttagtcaccccttcaatggcaatgagatgtgtcggaatcggtagtagagattttgttgaaggactttcgggagccacttgggtcgatgtagtcctcgaacacggatcttgtgttactacgatggctaaagataaaccgacattagatattgaattgcttaaaacagaagttacaaacccagcggtattaagaaaactgtgtatagaagcaaaaatttcaaataccacaaccgattcacgatgcccaacacaaggagaagcaactctggtggaagaacaagacgctaacttcgtttgccgcagaacctttgttgatagaggatgggggaacggttgcggtttgtttggtaaaggtagcttaatcacgtgcgcaaaatttaaatgtgtgactaaattagaaggaaaaatcgtgcaatatgaaaatttaaaatactcagttattgtcacagtgcataccggagaccaacatcaggttgggaatgaatctaccgagcacggtacaactgcgaccataacaccacaagcaccaacgacagaaatacagctaacagattatggagcacttaccttagattgttcacctaggaccggtttagacttcaacgaaatggttttattaactatgaaagaaaaatcatggctggtgcataaacagtggtttcttgatttacccttgccttggactagcggggcatcaacaagtcaggagacatggaatagacaggacttactcgttacttttaaaactgcccatgccaagaaacaggaagtcgtagtattggggagccaagaaggagctatgcatacagcgttgaccggtgccaccgaaatccagacaagtggaacaacaacaatttttgcgggtcatcttaaatgtaggctcaaaatggacaaactaaccctgaaagggatgtcatatgtaatgtgtactggatctttcaaattagagaaagaggttgccgaaacgcagcatgggaccgtgttagtgcaaattaaatatgaaggaacagacgcaccatgtaagataccatttagtacacaagacgagaaaggagtaacacagaacggtagactaattactgccaatccaatcgtaacagacaaagagaaacctgtaaacatagaggcagaaccgccatttggcgagagttacatcgttattggggcaggcgaaaaagccttgaagctaagctggtttaagaaaggtagtagtataggaaaaatgttcgaagcgacagcaaggggagctagaagaatggctattcttggtgatacagcttgggattttggtagcattggtggggtttttacctcagttggaaagttagtgcatcagatctttggtacagcctatggggtgctatttagcggtgtcagttggactatgaaaataggaatcggagtactgttaacatggttgggactaaactccagaagcacttctctaagcatgacatgtatagcagtagggctagtgactctctatttaggcgtaatggtgcaagcagacagtggctgtgtaattaactggaaagggagggaattgaaatgtggttccgggatattcgtcactaacgaagtacatacgtggacagaacagtacaagttccaggcagacagtcctaagcgtctaagcgccgctataggaaaagcatgggaagaaggggtatgtggaatccgctcagcaaccagattagagaacattatgtggaaacagatcagcaacgaattaaatcatatattgcttgaaaatgatatgaaattcactgttgtcgtaggagatgtggctggtatcttggcacaaggaaagaagatgatcagacctcaaccaatggaatacaaatactcatggaaaagttggggaaaagctaaaataattggtgcggacgtccagaacactacattcattattgacggacctaacacaccagagtgtccagacgaccaacgagcctggaacatctgggaggtagaagattatggtttcggcatattcaccactaatatatggctaaaactacgtgatagctacactcaggtttgcgatcaccgtttaatgagcgcagcaataaaagattcaaaagcagtccatgccgatatgggctactggatagagagtgagaaaaacgaaacatggaagttagcgagagcgtcattcattgaggttaaaacgtgcatctggccgaaatctcatactttatggagtaatggagttcttgagtctgaaatgattataccaaaaatatacggtggaccgataagccaacacaattatcgaccaggctacttcacgcaagcagcaggcccctggcacttaggcaaattagaactcgattttgacttgtgtgaaggaacgaccgtagtagtagatgagcattgcggaaataggggacccagcttacgtactactacggtgacaggtaagataatacatgaatggtgttgtaggtcatgcactctgccgcctttaaggtttagaggcgaagacggctgttggtatgggatggagatacgacctgttaaagaaaaagaagaaaatttagtgaaaagcatggtatcagctggatctggcgaagttgactccttcagtttaggcttactttgcatatctattatgatagaagaggtcatgagatcaaggtggagtcgtcgaatgttaatgaccgggacacttgctgtgttctttttacttatcatgggtcaattaacgtggaacgatttaatacgtttatgcataatggtcggggcaaacgcttctgacagaatgggaatgggtaccacctatctggcgctcatggctactttcaaaatgcgaccaatgttcgcagtcggtctcttatttaggcgtctaacctcaagggaagtactattgttaacaattggtctaagtctagtagccagcgtagaattaccaaatagtttagaagagttgggagatggcttagcaatgggtatcatgattctaaagttgctcacggacttccaaagccatcaactttgggcaactttattatcactaacatttatcaagacgacattttcactgcattacgcgtggaaaaccatggccatggtgttgtctattgtatcactgttcccactatgtctttcaacgacaagtcaaaagactacctggttgccagtcctgctaggatcattgggttgcaaacccttaacaatgtttcttattgcggaaaataaaatatggggaaggcgatcatggccactgaacgaaggtattatggcagtcggcattgtatcaattttattgagctcactactgaagaatgatgttccacttgccggccccttaatagcaggaggaatgctcatagcctgttacgtaatatcgggaagtagcgcggatctcagcttggaaaaagctgcagaagtatcatgggaggaagaagctgaacactcaggagcgagtcacaacattctggttgaagtacaggacgatgggaccatgaaaataaaagacgaagaaagggatgataccttaaccatattactcaaggcgaccctgttggctgttagtggagtctatcctctttctatccctgctacactatttgtttggtacttttggcagaagaagaaacaacgttctggcgttttatgggataccccatcaccgccagaagtcgaacgtgccgtactggatgatgggatttatagaataatgcaacggggactattaggacgatcacaagttggcgtaggagtgtttcaagaaaatgtgttccacaccatgtggcatgtcacccgaggagcagtcctaatgtatcaagggaaacgattagagccttcgtgggcttctgtaaagaaagacttgatcagttatggaggtggctggagacttcagggaagctggaatactggagaagaagttcaagtaatcgcagttgaaccagggaaaaacccgaaaaatgtacaaactgcccctggaacgtttaaaactcctgaaggagaagtaggagcaatagccttagatttcaaaccaggaacctcagggtcaccaatagtaaatagagaaggaaaaatagtcggattgtatgggaacggcgtggtaactacttcgggaacatacgtgtcagctattgcccaagctaaagccagccaagaaggaccgcttccagaaatagaggatgaggtatttcgcaaaaggaacttaacaattatggatttacacccagggagcggaaaaacaagaaggtatcttcccgcaatagtacgagaagcaataaaacgcaaactaaggacactaatactagctccaacacgtgtagtagccagcgaaatggccgaagcattgaaaggaatgccaataaggtatcaaactactgcagttaaatctgaacacaccggaaaagaaatagtcgacctaatgtgtcatgccacgtttacaatgaggttactgtcgccagtacgcgttcctaactacaacatgattataatggatgaggcacactttactgacccatcgagtatcgctgctaggggatatatctcgactcgagtaggtatgggagaagcagcagcaatattcatgactgctacaccacctgggagtgtcgaggctttccctcaaagcaacgctgtaatacaggatgaagagagagacatcccagaacgaagttggaatagcgggtacgaatggataacagactttccgggaaaaaccgtttggtttgttccatctataaaaagcgggaacgacatagcgaattgtttacgtaaaaatgggaagagagttatacaattaagccgaaaaacatttgatacagaataccaaaagacgaagaataatgattgggactacgtagtaaccactgatataagtgaaatgggcgctaactttcgtgccgatagggtgatagatccacgaaggtgcttaaaacctgttatcctcaaggatggaccagaaagggtcatcctggcagggccgatgccggtcactgttgcctctgctgcgcaaagaaggggaagaatcggacgcaatcataacaaagagggagatcaatacatatatatgggacaaccgctgaataacgatgaagatcatgctcactggactgaagctaaaatgctactggataacataaatacaccagaaggaataatcccagcattattcgaaccagaaagagagaaaagtgcagctatagatggtgaatatcgacttcggggagaggcacgtaaaacattcgtggaactaatgagaagaggggacttacctgtctggctctcttataaggttgcatctgaaggctttcaatatagtgatagaagatggtgcttcgacggtgaacgcaataatcaggtactagaagagaatatggatgttgaaatatggacgaaagaaggtgaaaggaagaaattaaggcctagatggctggacgctaggacctattctgacccattagcattaagagagtttaaggaatttgctgcaggtcgtagatcagtcagcggtgatttaatcctggaaataggtaagctaccgcaacatcttacacaacgcgcgcaaaacgctctagataacttggtaatgcttcacaattctgaacaaggagggagggcttataggcacgccatggaagagttgccggataccattgaaactctaatgttattagcgttaatagcagttctcaccggtggtgtaacattgttctttctaagtggccggggattgggtaagacgtccataggacttttatgtgtgatggcatcgagtgttctattatggatggctagcgtcgaacctcactggatcgctgcctcgataatattagaatttttccttatggtattactcatccccgaaccggatcgacaaagaaccccacaagacaatcaattagcatatgtagtcattggccttctcttcatgatactaactgtggcagcaaatgaaatgggattattagaaacgacaaagaaagatttgggcataggacacgttgctgtagaaaatcaccaccatgcagcaatgttggacgtggacttacacccagcaagtgcctggacactatacgcggtagccactacaattataacaccgatgatgagacatacaattgaaaacacaacagccaacatcagcttaacagcaatagcaaaccaggctgccatactcatgggactagataagggttggcccatatcaaaaatggatattggtgtcccattacttgcattaggttgctacagtcaagtaaacccgttgacattgacggcagctgtattaatgttggtagcacactatgctataattgggccaggattacaagcgaaggcaactagagaagcacagaaaagaacagcagctggaatcatgaaaaatccaactgtagatggaatagtcgccatcgatctggatccagtcgtttatgatgctaaatttgaaaaacaactaggccaaatcatgctattaatattatgcacctcacaaatattgctaatgcgcacgacttgggcgttgtgcgaatcaatcactctagcaactgggccattaaccactctatgggaaggctccccaggcaagttctggaataccaccatagccgtatcgatggctaatatcttccgtgggtcttaccttgcgggagcgggtctggccttttcacttatgaagtctttaggtggaggacgacgaggcaccggcgcacaaggagagacattaggggaaaaatggaagcgccaactcaatcaactaagcaaatcagagttcaacacatacaaacgatccggaattatggaggtagatcgaagcgaagcaaaggaggggctaaagagaggagaaaccactaagcatgctgtttctcgaggaaccgcaaaattaagatggtttgttgagcggaatttagtaaaacctgaaggcaaggttatagatttgggatgtggaagaggtggatggagctattactgtgcgggtctaaagaaagtcactgaggtcaaaggatatacgaagggtggcccaggccacgaagaaccgattcctatggcgacctatggatggaatctagtaaagctgcatagtggtaaagatgtatttttcattccaccagagaagtgtgacacacttctttgtgatataggagagagctcaccgaatcctacgatagaagaaggacgaacgctacgagtactcaaaatggtggaaccttggctaagaggaaaccagttctgcatcaaaatattgaatccatatatgccctcggttgttgaaacattagaacaaatgcaacgtaaacatggcggaatgctcgtcagaaatcccttaagcagaaattccacgcatgagatgtactgggtctcatgtggaacagggaacattgtaagcgcagtcaacatgacttccagaatgttactgaatcgtttcacaatggcgcacagaaagccaacatatgagagagacgtagacttaggagcaggaactagacatgttgcagtggagcctgaagtggcaaatttagatataataggacagcgaatagaaaacataaaacatgagcacaaaagtacttggcactacgatgaggacaacccctacaaaacttgggcctatcatggtagttatgaagttaaaccaagcgggagtgcttcatctatggtgaatggcgtggtcaaattgttaactaaaccatgggacgttataccaatggtcactcaaatagccatgacagatactaccccttttggtcaacaacgcgtgtttaaagagaaagtagatacacggactcctaaggcgaaacggggcacggcccagataatggaagtgacagcgaaatggctctgggggttcttgtctagaaataaaaagccaagaatatgcacacgtgaagagttcacaagaaaagtaagatccaatgccgcaataggcgcagtattcgtagacgaaaatcaatggaactcagcaaaagaagcagtagaagacgaaagattttgggatttagtacatagagaaagagagttacacaaacagggaaagtgcgcgacatgcgtgtataacatgatgggaaagcgagagaagaaacttggagagttcggcaaggcaaaaggaagtagagcaatatggtatatgtggttgggagcccgctttttagagttcgaagcattaggcttcatgaatgaggatcattggttctctcgagaaaatagtttatcaggcgttgaaggagaaggtttgcataagctcggatatatactaagggatataagtaagatcccaggtggaaatatgtacgctgatgacacagcaggttgggacacacgtattactgaagatgatttgcagaacgaagcacgaattaccgacatcatggaaccagagcacgctctcttggctaagtcaatatttaagctgacttatcaaaataaagtcgtgagagtacaaagaccagcaaagaacggaacagtcatggacgtaatatcgagacgcgatcaaagaggatcaggtcaagtaggaacatatggactaaatacatttaccaatatggaggcccaactcataagacaaatggagagtgaagggatcttctcgcccagcgaacttgaaaccccgaacctggctgaacgagttctggattggttagaaaaatatggagtagagagattgaaaagaatggcaatatccggagacgactgtgtggtaaaaccaattgatgatagatttgcaactgcactcacggcactcaatgacatggggaaagtgaggaaggacatacctcaatgggaaccaagcaagggttggaatgattggcagcaagttcccttctgctcacaccatttccaccaactcatcatgaaagatggaagagaaatcgtagtgccgtgcagaaaccaggatgagctagtcggcagagcacgggttagtcagggtgctgggtggtcattgagagagacagcatgcttaggaaaatcgtatgctcaaatgtggcaacttatgtattttcatagacgagatcttaggcttgcggcaaatgccatttgcagcgcagtaccagtagattggataccaacttcacgaaccacatggtcaattcatgcacatcaccagtggatgacaactgaagatatgttgtccgtatggaatagggtatggatcgaggaaaacccatggatggaagacaagactcacatttcgtcctggggagatgtaccttatttaggcaaacgcgaggaccagtggtgtggatcactaataggattaacagcgagagctacctgggcaactaacattcaagtagcaataaatcaggtaagaaggctcattggaaacgaaaactatctagattatatgacatcgatgaaacgatttaaaaatgagtcggatcctgaaggagcattgtggtaa

SEQ ID NO: 21599 - RNA, 9879 nt, synthetic construct
  misc_feature 1..9879: note = derived and/or modified CDS sequence (opt6) from DENV-1__FJ410264__SS-prME
  source 1..9879: mol_type = other RNA
tcagtaaccatgctactaatgctaatgccgaccgccctcgcgttccacttgacaaccagaggaggtgaaccgcacatgatagtaacgaaacaagaacgcggaaagagcttgttgtttaaaaccagtgctggagtaaatatgtgtacactaatagctatggatcttggtgaattatgtgaagataccatgacatacaaatgtccaagaattacagaagccgaacctgatgatgtagattgctggtgcaatgctacggacacatgggtaacttatggtacatgcagtcaaacgggagaacaccgaagagacaaaagatcagttgcactggctccacacgtaggtcttggcctagaaactagaacggaaacctggatgagcagtgaaggcgcatggaaacaaatacaaagagtagaaacatgggctttacgacatccgggcttcactgtaatcgcattgtttctagctcatgcaattggcaccagtattacgcaaaaaggcataatatttattctcctcatgttagtcacacctagtatggccatgcggtgtgtgggaatcggctcgagagatttcgttgaaggcttatcaggagcgacttgggtggatgttgtattggaacatggaagctgtgtaacaacaatggccaaagacaaaccaacattggatattgaattattaaaaacagaagtaaccaacccagcagtacttagaaaactatgcatagaagcaaaaatatctaatacgactacggactcaaggtgtcctacacaaggcgaagccactctcatggaagaacaagacgcaaatttcgtgtgtcgtaggacatttgtcgacagaggttggggaaacggatgtggtctcttcggtaaaggatcattaattacctgcgctaaatttaaatgcgtaaccaaattagaaggtaaaatagtacaatacgaaaacctgaaatactcagttatagtaacggtgcataccggagatcagcatcaagttgggaacgaatcgactgaacatggaacaacagcaaccattacaccacaagcacctacgtctgaaatacagcttactgactatggggcactaaccctagattgcagccctcgaacgggcttagacttcaacgaaatggttctactaactatgaaagagaaaagctggctagttcataaacaatggtttcttgacctgcccctaccatggacttccggagcatcaacatcgcaggaaacttggaatcgccaagatcttttagttacattcaaaacagcacatgccaagaaacaagaagtagtagtattaggttcccaagaaggtgcaatgcatactgcactcacaggggcgacagaaatacaaacgtccggcactactactatatttgcagggcatttaaaatgtaggctgaaaatggacaaacttacattgaaaggtatgagttacgtgatgtgtacaggaagtttcaaactggaaaaagaggtagccgagacccaacatggaacagtccttgtgcaaattaaatacgaagggacagacgcgccttgtaaaattccatttagtactcaggacgaaaaaggtgtaatacaaaacggtaggttgataactgctaatcccatcgtcactgataaagaaaaaccggtcaatattgaagcagaacctcccttcggagaatcatacatagtaatcggagcgggagaaaaggctttgaaactttcttggtttaagaaagggagttcaataggtaaaatgttcgaagctacggctcgaggagccagaaggatggcaatattaggggatacagcctgggacttcggttcagtaggaggagtatttaccagcgtcggcaagttagttcatcaaatattcgggacagcctatggcgtattattcagtggtgtcagttggacgatgaaaatcggcataggagtattactaacgtggcttggcttaaattcacgatcaacatcccttagcatgacttgtatagcagtaggattagttacactgtacttaggtgtaatggttcaagcagattcgggatgtgttattaattggaaaggccgcgaactcaaatgtggaagcggaatctttgtaactaatgaagtgcatacctggacggaacaatacaaatttcaagcagatagcccaaaaagattgagtgcagctataggaaaggcatgggaagaaggagtctgcggtattagaagtgccactcggctcgaaaatataatgtggaaacaaatttctaatgaacttaatcatatattactagagaatgacatgaagttcacggtagtcgtaggtgatgtcgtgggcatactggcccaaggaaagaaaatgattagaccgcaaccgatggaacacaaatattcttggaaaagctggggaaaagccaaaattatcggagcggatgtacaaaatacgaccttcattattgacgggcctaatacaccagaatgcccagacgatcaaagggcttggaatatatgggaagtggaagattatggattcggaatctttacaactaacatatggttgaaacttagagattcgtacacacaagtttgtgatcacagattgatgagtgctgcaataaaagattcaaaagcagttcatgcagacatgggctactggatcgagagcgagaaaaatgaaacttggaagttagctagagcaagttttattgaagttaagacatgcatatggccaaaatctcatacactttggtctaacggagtactagaatcagaaatgatcatcccgaagatatacgggggaccaatctcgcaacataattaccgacctggctacttcacacaaacagcgggaccatggcacttaggcaagctagagctagactttgatctgtgtgaaggtaccacagtagtcgtcgacgagcactgcggaaatcgagggccttccctacgaaccaccaccgtaactggcaaaataatccacgaatggtgttgtcggtcttgtacattgccgcccttacgtttcaaaggagaagacggatgttggtacggtatggaaattagacctgtaaaagagaaagaggaaaatctcgtaaaatcaatggtaagcgctggaagtggcgaggtcgactctttcagcctgggtttactgtgtatatcgattatgatagaagaagttatgaggagtagatggtctagaaaaatgctaatgaccggaaccctagctgtattcctactattgattatgggccagttgacttggaatgatttaatacgattatgtataatggttggagcaaatgcatctgacaggatgggtatgggaacgacctatttagcgctaatggcaacctttaaaatgcgcccgatgttcgccgtaggactactctttcgacgtttaacgagtagggaggtactattactgaccattggtctatcattagtagcctcagttgaattacctaattcattagaggagctaggcgacggattagcaatgggcattatgatattgaaactcttaacagattttcaatctcaccaattatgggcgactctactttcattaacatttattaaaaccacgttgtcacttcactatgcttggaaaacgatggcaatggttttatcaatagtgtctttatttccattatgtctgagtacaacctcacaaaagactacatggctaccggtcctactgggttcgttaggatgtaaaccattaacgatgtttctgattaccgagaacaaaatatggggtcgaaaatcctggcctctaaatgagggcataatggctgttggggtcgtcagcatcttattgtcaagtttactcaaaaacgacgtcccattagcaggaccgcttattgcagggggtatgttaattgcatgttatgtcatcagtggcagttcagcagatttgagtttagagaaggctgcagaggtgtcgtgggaagaagaagcagaacactcaggcgctagccataacattcttgtagaggtccaagatgacggaacaatgaaaattaaggacgaagaaagggatgatacactaactattctacttaaggctaccttgttagcagtatcgggtgtctatccgttgagcattccagcaacattgtttgtatggtacttctggcagaaaaagaaacaacgcagcggcgttttatgggatacgccttcaccaccagaggtcgaaagggccgtactagacgacgggatataccgaataatgcaaagaggattactgggaaggtctcaagtaggcgtaggagtattccaagaaaatgttttccacactatgtggcatgtcacacgtggggcagttttaatgtatcaaggtaagagactagaaccgtcgtgggcctcagtcaagaaagatctaatttcatatggaggaggatggcgcctacaaggatcatggaatactggtgaagaagttcaggttatcgccgtggaaccgggcaaaaatcccaaaaatgttcagacggcaccaggcactttcaaaacaccggagggtgaggtaggagccatagcgctagattttaagccaggaaccagcgggagtccaatagtaaaccgtgaggggaaaatagtgggcttatacggaaacggagtagttacaacctcagggacttacgtatcggcgatagcgcaagcaaaagcaagccaagaaggcccgttacctgaaattgaggacgaagtctttaggaagaggaacttaacgataatggatttacatccgggatctggtaagacaaggaggtacctccctgcaattgtaagagaagcaattaaacgcaaactacgtacactaatactagccccgacacgcgttgtagcctctgaaatggcagaggctttaaaaggaatgcccattcgataccagactactgccgtaaaaagtgagcatacgggcaaagaaatagtcgacttgatgtgtcatgcgacatttactatgagacttttatcgccagtaagggtacctaactataatatgataataatggacgaagcacattttactgacccaagctcgatagctgcacgaggatacatcagcactagagttggaatgggagaagcagcggcgatcttcatgaccgctactccacccggttcggtagaggcttttccccaatcaaatgcagtaatacaggacgaagaaagagacataccagaaagatcttggaactcaggttatgaatggataactgattttcccggtaaaaccgtttggtttgtcccttcaattaagtctggcaatgatatagcaaattgcttgaggaaaaatggaaagagggttatccaattatcacgaaaaacattcgataccgaatatcagaaaactaaaaataatgattgggactacgttgtaacaacggatataagtgaaatgggcgctaactttagagcagatcgtgtaatagacccgagaaggtgtcttaaaccggtaatactaaaggatggaccagaaagggtaattttagccgggcctatgccagtaacagttgcatcagcagcgcaaagaagagggcgaatcggcagaaatcacaacaaagaaggagatcaatatatatatatgggccaacctttaaacaacgacgaggatcacgcacactggacggaagccaagatgctattagataacattaatacacccgaaggaataataccagcgctatttgagcccgaaagagaaaaatcagcagctattgatggtgagtacagactgagaggtgaagctagaaaaacttttgtggaacttatgagacgtggcgatttgcctgtatggttatcctacaaagtggcgagtgaaggattccaatatagtgatcgtcgatggtgttttgacggtgaacgtaacaaccaagttttggaagaaaacatggatgtcgagatatggacaaaagaaggcgaaaggaagaaactaagaccacgctggctagacgcgcgtacctacagtgatccactagcattgagagaatttaaggagtttgcagcaggaagacgttcggtatccggagacctaatacttgagataggaaaactcccgcaacatcttacacaaagagcacaaaatgctttagacaatttagtgatgttacataactctgaacaagggggaagggcgtaccgacacgctatggaagaattacctgatacaattgaaacattgatgttattagccctcattgcggttctcacaggcggagtgactttgttcttcctgtctggcagaggccttggaaaaacgtctataggactactttgcgttatggcttcgagtgtattactctggatggcaagtgtagaacctcactggatagccgccagcatcatactcgagttctttctcatggtattgttaatcccggaacctgatcgacaacgtactccgcaagacaatcaactggcttacgttgtcatcggattgctctttatgattttaactgtagctgcgaatgaaatgggcttgctagagacaaccaagaaagatctcggtatcgggcatgtagctgtcgaaaatcaccaccatgctacaatgttggacgtcgaccttcatcctgcatcagcatggacgctatacgcagtagcgacaacaattatcacccctatgatgagacatacaatagaaaacacaacggcaaacatatcactaactgcgattgcgaaccaagcggctatactcatgggattagataagggttggcccatatcaaaaatggacatcggagtcccactcctagcgctagggtgttatagtcaagtgaatcctttgactttaacggctgcagtcttaatgttagtagcacattacgccattatcggacccgggttacaggctaaagcaactagagaagctcagaaacgtacggctgcgggaataatgaaaaacccgaccgtagacggaatagtagcgattgatctcgatcctgttgtttatgatgcgaaatttgagaaacaactcgggcaaattatgttacttatactgtgcaccagccaaattcttcttatgcgaacgacctgggctttgtgtgagagtataaccctagccaccggaccactgacgacactctgggaggggagtccaggaaaattttggaatacaaccatagccgtatcgatggcaaatatctttcgaggatcctacctcgcaggagcaggacttgctttttctctaatgaaaagccttggaggtggtagacgtggaacaggtgcgcagggtgagactcttggtgaaaaatggaaaagacaactaaatcaactcagtaaaagcgagttcaatatatacaagcggagcgggattatggaagtagatcgaagtgaagcgaaagagggattaaaacgtggagaaactacaaggcatgctgtatctagaggcaccgcaaaactccgatggttcgtagaacgtaatctcgtaaagccagagggaaaagtgattgatttaggttgcggtcggggaggctggagctattactgtgctggattgaagaaagtgaccgaagtaaaaggctatacaaaagggggtcccggacacgaagaaccaatacctatggcgacttatggttggaatttggttaagttgcatagcggaaaagatgtattctttacacccccggaaaaatgtgatacacttttatgtgacataggagaaagtagccctaaccccacaatagaagaaggacgcacattgcgtgtactaaaaatggttgaaccttggctaagaggaaaccaattctgtataaagatcttaaatccatatatgcctagcgtggtagaaacattagaacaaatgcaaaggaaacatggtgggatgttggtgcgaaacccactttcacgaaactctactcatgaaatgtattgggtctcatgcgggactggtaacattgttagtgctgttaacatgacaagtcgtatgttgttgaaccgatttacaatggcgcacagaaaaccaacgtacgaaagggacgtcgacttgggagccggtacgaggcacgtagcggtggaacccgaagtggcaaatttagatataatagggcaaaggattgaaaatataaagcatgagcacaaatcaacatggcactatgatgaggataacccttacaaaacgtgggcataccacgggtcctatgaagttaagccctccgggtcggcctcgtccatggttaacggtgtagttaaattattaacaaagccatgggatgtcataccgatggtcactcaaattgctatgacagatacaacaccattcggacaacagagggtatttaaagaaaaggttgacacgcgaacaccaaaagcgaaaaggggaacagcgcaaattatggaagttacagcgagatggctctggggattcttgagccgtaataaaaagccacgaatttgcacccgggaggagttcacgcgaaaggttaggagcaacgcagcaataggagctgtttttgtggatgaaaatcaatggaactctgcaaaagaagcagtagaagatgaaaggttttgggacttggtacaaaaagaaagagagttgcacaagcaaggtaaatgcgcgacttgtgtctacaacatgatgggaaaacgagagaagaaactaggggagttcggtaaagcgaaaggcagtagagcaatctggtacatgtggttaggagctcgtttcctagaatttgaagctctcgggtttatgaacgaagaccattggttttcaagagaaaactcgttaagcggagtggaaggagaagggttgcataaactaggatacatactcagagacatatcaaaaataccgggaggaaatatgtatgcagatgacacagccggatgggatactagaattacagaggatgatttacagaatgaagcaaaaataactgatattatggaaccggaacatgctcttttggcaacaagtatttttaaactcacatatcagaataaagtggttcgtgttcaaaggccagccaagaatggaacagtaatggacgtaatatcccgaagagatcaaagaggaagcgggcaagtaggaacatacggattaaatacgttcacaaacatggaagcccagcttatcagacaaatggaatctgaaggaatattcttgccttcagagttggaaacacctaatctggcagaaagagtacttgactggctggaaaaatatggtgtggaaagattaaaaaggatggctataagtggagatgattgtgtggtgaagcctatagatgataggtttgcaacagcattgacagcgctaaacgatatggggaaggtccgtaaagatattccccaatgggagccatcaaaaggctggaacgactggcaacaggtaccattctgctctcatcacttccatcaactaattatgaaagatggaagagaaattgtcgtaccatgtaggaatcaagatgagcttgtcggtcgagcgagagtcagtcagggcgcaggttggagcctacgagagactgcatgcctaggaaaaagttacgctcagatgtggcaactaatgtattttcataggagagacctacgattagcggctaacgcaatctgttcggcagtcccagtagattgggtgccaacatctagaacaacatggagcatacatgctcatcaccagtggatgaccactgaggacatgttaagcgtatggaatagggtatggattgaggaaaatccttggatggaagataaaactcatgtatcaagctggggagacgtaccctaccttggtaaaagagaagatcaatggtgcggatctctaatcggattaacagctcgtgcgacatgggcttctaacatccaagtagcaataaatcaagttaggcgacttattggcaatgagaactacctcgattatatgacaagcatgaaaagatttaaaaatgaaggggaccctgagggagcactctggtag

SEQ ID NO: 21600 - RNA, 9879 nt, synthetic construct
  misc_feature 1..9879: note = derived and/or modified CDS sequence (opt6) from DENV-1__FJ410265__SS-prME
  source 1..9879: mol_type = other RNA
tcagttacaatgttgttaatgttaatgcccacagctcttgcttttcacctaaccacaagaggaggagaaccacatatgattgtatcgaaacaagaaagaggtaaaagtttgctttttaaaactagcgccggagtgaatatgtgcacgctaatagcaatggacttaggtgaactatgcgaagacactatgacttacaaatgccccaggatcaccgaaacagaaccagatgatgttgactgttggtgtaatgcgacagatacatgggtcacatatggtacatgctcgcaaactggagaacatagaagggacaaacgtagcgttgcattggccccgcatgtaggtttaggtttagaaacaaggactgaaacatggatgtcatcggaaggtgcttggaaacaaatacaacgcgtcgaaacttgggccctcagacacccagggtttactgttatcgccctgtttctcgctcacgccatcggtacgtctatcacacaaaaaggtataatattcatattactcatgttggtaaccccgtctatggcaatgagatgtgttggcatagggtcacgagactttgtggaaggtttaagtggagctacttgggtagacgtggttttagagcacggatcctgtgtaactacaatggctaaagataaacccactttagatattgaactcttaaaaaccgaggtaaccaatccggctgtccttaggaaactatgtattgaagctaaaatcagtaatactactaccgactccaggtgcccaacccaaggagaagcaactttggtagaagaacaagatgcgaatttcgtatgtagaagaacatttgttgataggggatggggtaacggttgcggattattcggcaaaggctctttgataacgtgcgcaaaattcaaatgcgttacaaaactcgaaggtaaaatcgttcaatacgaaaatcttaaatatagtgtcatagttacggtccatacgggtgatcaacatcaagtaggcaatgaatctacagaacacgggaccactgccacaattacacctcaggcacctactacagagatacagctaacagattacggtgccttaaccctcgactgtagtcccagaactggactagatttcaatgaaatggttctacttacaatgaaagaaaaatcatggctcgtacataaacaatggttcttagatttaccattaccctggacatcaggcgcctctacaagtcaggaaacgtggaatagacaagacttattagtgacgttcaaaacagcacatgcaaagaagcaagaagtagttgttctcggatctcaagaaggagccatgcatactgcactaacaggggcgacagagattcaaacgagtggtacaaccacgatctttgcaggacacctcaaatgcaggctaaaaatggataaattgaccttaaagggcatgagctatgtaatgtgtacaggctcgtttaaacttgaaaaggaagtggctgaaacacaacatggtacagtattagttcaaatcaaatatgaaggaacagatgcaccctgtaagatacccttcagtacacaagatgaaaaaggggttacacaaaatggaaggctgataacggctaacccaatcgtaacagataaagagaagcctgtcaacattgaagccgaacctcccttcggagaatcctatatcgttataggtgctggagaaaaagctctaaagttatcatggtttaagaaaggctcctcaatcggaaaaatgttcgaagcaacagcgcgtggagcccggaggatggctatcttaggagacaccgcttgggactttggttcaattggaggcgtttttacatccgtgggaaaattagttcatcagatctttggcacagcatatggagttttattcagtggagtatcatggactatgaaaattggtataggtgttttgcttacttggttagggctaaattcgcgttccactagcctgtccatgacatgtatagctgttggcttagtgactctttatctcggggtcatggtccaggcagacagcgggtgtgttataaattggaaaggtagagaactcaaatgcggctcaggcatttttgttaccaatgaggtgcatacatggaccgaacaatataaattccaagctgattcacctaagcgtctatctgcggccattggaaaagcgtgggaggagggcgtatgtggtatcaggtcagcaacacgactggagaacattatgtggaaacaaatatcaaatgagctgaaccatatattactcgaaaacgatatgaaatttacggttgtcgtgggagacgttgcaggaatactggcccaaggtaaaaagatgatacgaccacaaccgatggaatacaagtatagctggaaatcctgggggaaagctaagattataggcgctgacgtacagaatacgacctttattattgacggacccaatacgccagaatgtccagatgaccaaagggcatggaacatttgggaagtagaagactatggattcgggatattcactacgaacatatggctcaaattaagagatagttatactcaggtttgtgatcacagattaatgtctgctgccatcaaagactcaaaagctgtacacgcagacatggggtattggatcgagtcagagaaaaatgagacttggaaactggccagggcctcctttatagaagttaaaacttgtatttggccgaagagtcacaccttatggtcaaatggcgtgttagaatctgagatgataataccaaaaatttatggtgggcctataagtcaacataactaccgaccgggatattttacacaagcagcaggaccatggcatctaggaaagctggaactagacttcgatctgtgcgaaggaacgaccgtcgtcgttgatgagcattgtggcaataggggccccagcctcagaaccactaccgtcacaggaaaaataattcatgagtggtgttgtcgttcgtgcactctaccaccgctgagattccgaggggaggatggatgttggtacggcatggaaatcaggcccgtaaaagaaaaagaggaaaatttagtaaagtcaatggtgtctgcaggaagtggggaagtagattccttttcgctgggattactttgtacaagcattatgatcgaggaagtaatgcgctctcgatggagccgaagaatgttaatgaccggaaccctagcggtgttctttttactcataatgggacaattaacctggaatgatctgatacgactctgtataatggtgggtgcaaatgcgtctgaccgaatgggaatgggcactacctaccttgcattaatggcaaccttcaagatgagaccaatgttcgcagtaggcttgctatttagaagattaacttcgcgtgaagtattgcttttaaccataggtctcagcttggttgcgagcgtagaactcccaaattcgttagaagaacttggagacggactagccatgggtataatgattttaaaactgctaaccgatttccaaagtcaccaattatgggcaaccctactgagtttgacctttattaaaactacattcagtttacactatgcttggaaaacaatggctatggtcttatccatcgtaagtctatttcccctttgcttaagcacaacatctcagaaaacaacctggcttcctgtattactaggttcgttaggatgtaagcccttgacaatgtttcttatagccgaaaataagatatggggacgaagatcttggcctctcaatgaaggaataatggcagtaggaattgtatctattttactgagctctttgcttaaaaacgatgtacctctagcaggcccacttatcgctggaggcatgcttatcgcttgctatgtaataagcggatctagtgctgatctaagtttagaaaaggccgctgaagtttcatgggaagaagaggccgagcactcaggggcaagtcataacatcctagtagaggtgcaagatgatggtacaatgaagataaaggatgaagaaagagacgacactctcacaatactccttaaagcaacgctattagcagtatcaggcgtttacccgctatcaatccccgcaacactattcgtttggtacttttggcagaagaagaaacagcgaagtggagtactgtgggatacccccagtccacctgaagtggagcgagcggtgcttgatgatgggatatacagaattatgcaaaggggactacttggaagaagtcaggttggggtcggagtgtttcaagagaatgtttttcacaccatgtggcatgtcacccgaggagccgtacttatgtatcagggtaaaaggctagaacccagttgggccagtgtcaagaaagatcttatttcatacggaggaggatggcgacttcagggctcctggaacacaggagaagaggtacaagtaatagcagtagagccggggaaaaatccgaaaaatgttcagactgcaccggggacatttaaaacaccagaaggggaagttggggctatagcgttagattttaaacccggtacatcaggttcacctatcgtgaaccgagagggtaaaattgtcggattatacggaaatggggtagtaacaacgtcaggcacatacgttagcgccatagcacaggctaaagcaagccaagaaggcccacttccagaaattgaagacgaagtcttcagaaaaagaaatcttactattatggacctacatcccggatctggaaagacaagaagatatctaccggcaatagtacgagaagcaattaaacgtaagctacgtacattaatactcgctcccactagagtagtagcgtctgaaatggcagaagcgttaaagggtatgccaattcgttaccaaaccaccgcggtcaaaagtgagcatacaggcaaggagatagtcgaccttatgtgtcatgcgacgtttactatgcgacttttatctcctgtacgggtaccaaattacaatatgattataatggacgaagcgcattttactgatcctagctccattgctgctagaggatatatttcaactagagttggaatgggtgaagccgccgccatttttatgacagccacgccacctggatcagttgaagcatttccgcaatctaatgcagtgattcaagatgaagaaagagatataccagaaagatcgtggaactctggctatgaatggattacagattttccaggaaaaactgtctggttcgttcctagcattaaatctggtaatgatatcgctaattgtctaaggaaaaatggaaaaagagttatccagcttagcaggaaaacttttgatacggaatatcagaaaacgaagaataatgactgggattatgtcgtcaccacggatatttctgaaatgggagcgaactttcgagctgacagggttatcgacccccggcgttgcctcaaacctgttattctgaaggatggcccagaaagagtcatattggctggcccaatgcccgtgaccgttgcttccgctgcccaacgcagaggacgaataggtaggaatcataacaaagagggggatcagtatatatatatgggtcagcctctaaacaatgacgaagaccatgcccactggacagaagcaaaaatgttactagataacattaacaccccagaaggcataatccctgcgcttttcgaacctgagcgcgagaaaagtgcagccattgatggtgaatatagacttcgaggtgaagcaaggaagacgtttgtggaacttatgcgcagaggcgacctaccagtctggctttcatataaggttgctagcgagggattccaatacagtgatagaagatggtgcttcgatggtgaaaggaacaatcaagtacttgaagaaaacatggacgtagaaatatggaccaaggaaggagaacgtaagaaactacgacctagatggttggatgcaaggacctactccgaccctctcgcattaagggaatttaaagagttcgcggcggggagacgatcagtcagtggtgacctgatactagaaattggaaagttaccacaacacctcacccaacgagcacaaaacgcgctcgacaacttagtaatgctccataactctgaacaaggtggacgcgcgtaccgtcatgctatggaagaattgccagacactatagaaactttaatgcttctagccttaatcgcagttttaacagggggagtgaccttattctttctctcagggcgtggactcggtaaaacatccatagggctgctctgcgtaatggcttctagtgtgttgctttggatggccagtgtcgaaccacattggattgcagctagtataatactcgagttctttctgatggtactacttattccagaacccgaccggcagagaaccccgcaagacaaccagttggcctatgtagtaataggactattgtttatgatactcaccgtcgctgcaaacgaaatgggactattagaaacaacaaagaaagacctagggataggacatgtagcagtcgaaaaccaccaccacgcagcaatgctagacgtcgacttacatccagcttccgcttggactttatatgcagtggcgaccacgatcattaccccaatgatgagacatacaattgaaaatacaaccgcaaacatctctctgaccgccatagcaaatcaagcagcaatcctaatgggtttagataagggatggcctatatcgaaaatggacatcggtgtacccttactggccctcggttgttattctcaagtcaatccccttactttaaccgcagctgtacttatgttagtggctcactatgcgatcatcggtcctggactacaagcaaaagcaacacgagaggcacagaaaagaactgcagcgggtatcatgaaaaatcccactgtagatggcatagtagctattgacctcgatcctgtggtctatgatgcaaagttcgaaaaacaattaggacagatcatgttactcatactatgtacctcgcaaatactcctaatgcggacaacttgggcattatgcgaatcaattacacttgccacgggacccctgactaccctatgggaaggctcaccaggcaaattctggaatacaacgatagccgtatcaatggcgaacatattccgcggatcatatttggcaggagcaggattagcgtttagtctaatgaaatccctaggtggaggcagacgcggaacaggagcacaaggtgaaacgttaggagagaaatggaaaaggcaattgaatcaactcagcaagtccgaatttaacacatataaacggtcaggtataatggaagtagataggtcagaggctaaagaaggtttgaagcgcggggaaacgacaaaacacgccgtatcgagaggtacagcaaaactaagatggtttgtggaacgaaatttagttaaaccagaagggaaagtaatagaccttggctgcggtcggggaggatggagttactactgcgctggactaaagaaagtaacggaagtcaaaggttatacaaagggtggccctggtcatgaagaaccaattcccatggcaacatatgggtggaacctcgtgaaattacatagcgggaaagatgttttctttataccaccggaaaaatgcgatacgttactttgcgacattggtgaatcttctcctaatcccacaatcgaagaggggcgtaccctgagagtcttaaaaatggtcgaaccgtggctgcgagggaatcaattttgtataaaaatcctaaatccatatatgccaagcgtagtagaaactttggaacaaatgcaacgaaagcacggaggtatgcttgtgcgcaacccccttagcagaaattctacacatgaaatgtattgggtgagttgtggaaccggaaatatagtgtctgcggtaaatatgacaagtagaatgctattaaatcgtttcaccatggctcatagaaaacctacttatgaaagagacgtagatttaggagcaggaacacggcacgtagcagtcgaacctgaagtggctaacttggacattattggccagagaattgaaaacataaaacacgaacataagtcaacatggcattatgatgaagataatccttacaaaacatgggcttaccacggttcgtatgaggtaaagccaagcggctcagcaagcagcatggttaatggggttgttaagctattgactaaaccatgggacgtcataccaatggtaacacaaatagcaatgactgatacgacaccattcggccagcagagagtttttaaggagaaagtagatactagaacgcctaaggcaaagaggggcaccgctcaaattatggaagtaacggcaaaatggttatggggatttttatctaggaataagaaaccgagaatatgtacgcgagaagaatttacacgtaaagttaggtcaaatgctgcgataggcgctgtttttgtggatgagaaccagtggaactccgcgaaagaagcagtggaagatgaacgattctgggatttagttcaccgggaacgagaattacataaacaaggaaaatgcgcaacatgcgtgtataacatgatgggtaaaagagagaaaaagttaggagaatttggaaaggctaaagggagtcgtgccatctggtacatgtggcttggagcaaggttcctcgagtttgaagcattaggttttatgaatgaagatcactggttctcccgtgaaaatagtctttcaggggttgagggcgagggtttacacaaacttgggtatattctccgagatatatcaaagattcccggaggtaacatgtacgcagatgacacagcagggtgggatacacgcattacagaggatgacttacaaaatgaagcaaaaatcacagatatcatggaacccgaacatgcgttgttggcaaaaagtatcttcaaattaacctatcaaaataaagtagtcagggtacagcgtccagccaaaaacggaacagtgatggacgtaatttctagaagggatcaacgtggatccggacaggtagggacatacggtcttaatacatttactaacatggaagcccaattgattaggcagatggaaagcgaaggaatattcagtccatcagaattggagacacccaacctggcagaacgcgcattggactggctagagaagtatggcgtcgaaaggctaaaacgtatggcgattagcggggacgattgcgtggtcaaaccaatcgacgatcgctttgcaacagcactaacagcgctgaacgacatgggtaaagttcgtaaggacataccccaatgggaaccttcaaagggttggaatgactggcaacaagtacctttttgtagccaccactttcatcaattaataatgaaggatggcagagagatcgtagtaccctgccgaaatcaagacgaacttgtcgggagggcacgagtatctcaaggagcaggttggtcgttaagagagacagcatgcttaggaaaatcttacgcacaaatgtggcaactaatgtactttcacagaagagatttaaggttagcggctaacgcaatatgttcagctgtacctgtggattggataccaacatcacggacgacatggagtattcacgcacaccaccaatggatgacaaccgaagacatgcttagtgtttggaaccgagtttggatagaagaaaatccatggatggaagacaaaacgcatatctcttcctggggtgatgtaccctatctaggaaaacgagaagaccaatggtgtggatctctaattggtctaacggctcgagcaacctgggcaacaaatatacaagtcgcaattaaccaggttcggagattaatagggaatgaaaattatctggattatatgacatcaatgaaacgatttaaaaacgaatcagatccggaaggcgcactttggtaa

SEQ ID NO: 21601 - RNA, 9879 nt, synthetic construct
  misc_feature 1..9879: note = derived and/or modified CDS sequence (opt6) from DENV-1__FJ461336__SS-prME
  source 1..9879: mol_type = other RNA
tcggttaccatgcttcttatgctcatgcctactgcattggccttccatttgacgactagaggtggggaaccgcatatgatcgtcagtaaacaagaaagaggaaaatctcttctattcaaaaccagcgctggagtaaatatgtgcacgctcatagcaatggatcttggagaactatgcgaggacacgatgacttataaatgcccgagaatcaccgaaaccgaacccgatgacgttgattgctggtgcaacgccacagatacgtgggttacttatggtacttgttcacaaacaggagaacatcgacgcgataaaagaagtgttgcattggcaccacacgtaggactagggctggagacacgcacagaaacatggatgtcttccgaaggagcatggaaacaaattcaaagggtcgagacttgggctttaaggcatcctggatttactgtaattgcactatttttagcacacgccattggtacctccataacacaaaagggaatcatttttattttgttaatgcttgtaacccccagcatggcgatgcgctgcgtgggaatcggaaatcgcgatttcgttgaaggattatcaggcgcaacatgggttgacgtagtgctggagcatggtagttgtgtaacaacaatggcaaaagataaacctacgttggatatagagttactaaaaactgaggtaactaacccggctgtacttcgaaaactatgcatagaagctaaaattagcaatacgacgaccgattctagatgtccaacacaaggagaagctacacttgtagaggaacaagatgcgaattttgtatgccgcagaacttttgtcgacagaggctgggggaatggttgcggacttttcggaaaaggaagtctcatcacatgtgctaaattcaagtgcgtaactaaacttgaaggtaaaatcgtccaatatgaaaatttgaagtactcggttatagtcacagtacacaccggtgatcaacatcaagtaggtaatgaatcaaccgaacatggcacgactgctacaataacaccgcaagcgccaaccacggagatacaacttacggattacggcgcattaacgcttgattgcagtccaaggacaggattagattttaatgagatggtccttctaacaatgaaagaaaaatcctggctggtacataagcaatggtttctagatcttcctttaccctggacatctggcgcatcaactagccaagaaacttggaatagacaagaccttctggtcacgtttaaaacagctcacgcgaagaaacaagaggtagttgttttaggtagccaagagggcgctatgcacacagcgttaacaggggctactgagatacaaacatcaggaacgacaacaatatttgctggccatctaaaatgcaggcttaaaatggataaactcacgttgaaaggaatgagttatgttatgtgtactggtagtttcaaactagaaaaagaagtggccgaaacgcaacatggaactgtcctagtacaaataaagtatgaaggcaccgatgcgccttgcaaaataccgttttcaacccaagatgaaaaaggagttacccaaaatggaagattgattacagcaaatcccatcgttacagacaaagaaaaaccagttaatatagaagcagaaccaccatttggagaaagttatatagtgataggagccggtgaaaaagcattaaaacttagttggtttaagaaaggtagctcaataggaaaaatgtttgaagcaacggcacgtggagccaggcggatggcaatattaggagacacagcatgggactttgggagtataggaggtgtacttacttcagttggaaaacttgtacatcaaatatttggaacagcctacggggtattattcagtggtgtatcatggacgatgaagatcggtatcggagtacttcttacatggctaggcttaaactcaagatcaacatctttaagtatgacatgtattgcagttggattagtaacattatacctgggagtaatggttcaggctgattcaggttgcgttatcaattggaaaggaagagaattaaaatgtgggagcggaattttcgtaacaaacgaagtccatacatggacagaacaatacaagtttcaggccgacagcccaaaacgattatcagcagcaataggcaaggcttgggaagaaggtgtgtgcggcataagaagcgccaccagattagaaaatattatgtggaaacaaatatcaaatgagctaaaccatatattactagaaaacgatatgaaatttacagtggtagtgggagatgtagcggggatattggctcagggcaagaaaatgatacgcccccagccgatggaatataagtattcttggaaatcttggggtaaagcaaaaattataggtgcagatgtccagaacacaactttcattatagatggtcccaatacgcccgagtgtcccgacgatcagcgcgcatggaacatatgggaggtagaggactatgggttcggaatttttactactaacatatggttaaaactaagggattcgtatactcaagtatgtgaccaccgcctaatgtccgcagccataaaagattcgaaagccgttcatgcagatatgggctattggattgagtctgaaaagaacgaaacgtggaaactcgctagagcatcattcatagaagtaaaaacatgtatatggccaaaatcccatactctgtggtcaaacggagtattagaaagtgaaatgataataccaaagatatacggaggacccatctctcaacacaactacagacctggatactttacgcaaactgcaggaccttggcatctcggaaaactcgaactggattttgatctttgcgaaggaactacagtagtggtcgatgaacattgtggcaatcggggaccatcactcagaaccaccactgtaacaggtaaaattattcatgaatggtgctgtcgtagttgtactctaccaccattaaggtttagaggcgaagatggctgctggtatggtatggagatacggcctgtcaaagagaaggaagaaaacctggtcaaatccatggtcagcgctggctcaggtgaagtggattctttcagtttaggactgctatgcatttcaataatgattgaagaagttatgcgctcaaggtggtcaagaaaaatgttaatgacaggcactcttgctgttttcttcctcttaatcatggggcaattgacttggaacgatttaatacgcctttgtataatggtaggcgctaatgcatctgataggatggggatgggaaccacctacctagcacttatggcaacctttaagatgaggccaatgtttgcagtagggctactatttcggcgattaacatcacgtgaagtacttcttctgactatcggactcagcctagtagcaagtgtggaactaccaaattccctagaagaattgggagatgggctagctatgggtataatgatacttaaattattgacagattttcagagtcatcaattatgggcaacgttgcttagcctaactttcatcaaaactactttcagtttacattatgcatggaagactatggcaatggtcctatctatagtaagcctgttccctctttgtctttcaacaacatcgcagaaaacgacatggctacccgtcctgctaggctcgttaggatgtaaaccactaacgatgttcctaattgccgaaaacaaaatatggggccgcagaagctggccattgaacgaaggaatcatggctgttggaatagtaagtatattactaagctcactactgaagaatgatgtgcctcttgctgggcccctaattgctggagggatgttaattgcatgctatgtaatttcaggtagtagtgcggatctatcattagaaaaagctgcagaagtatcatgggaagaagaggccgaacactcaggggcatctcacaatatactcgtcgaggtacaggacgatggaacaatgaaaattaaagatgaggagagggacgatacattaacgatactattaaaggcaacattgttagcagtatcaggtgtatacccacttagtatacctgctacgctatttgtatggtatttttggcagaagaagaaacagcggtctggggtcttatgggacactccatctccgccagaagttggtagagcagtactcgatgacggaatatacaggataatgcaacgaggcttactgggacggagccaggttggtgtgggcgtattccaagaaaatgtttttcataccatgtggcatgtaacaagaggagctgtcttaatgtaccaaggaaaaagattggaaccgtcgtgggcaagcgtgaaaaaggacctaatttcatatgggggaggatggcggctgcaaggttcatggaacactggagaagaagtccaagttatcgctgtggaacccgggaagaatcccaaaaacgtccagactgctccgggaacatttaaaaccccagagggtgaagtgggggcaatcgctttagactttaaaccaggcacctccggtagtccaatagtaaaccgcgagggcaagatagtcggcttatatgggaacggagtagttactaccagtggaacgtacgtttccgccatcgcgcaagctaaagcgagccaagagggtcctttaccagagatcgaagacgaagtgttccgcaagaggaacctcacaataatggatctacatccaggaagcggaaagactagaaggtacttaccagcaatagttagagaagctatcaaaagaaaactaagaactctaatcctagcgcctactagagtcgtggcatcagaaatggctgaggcattaaaagggatgcctatacgataccaaacgacagctgtgaaaagtgaacacactgggaaggaaatagtagatctaatgtgccatgctacgttcacgatgcgattattatcacctgtgcgtgtgcccaattataacatgataataatggatgaagcacactttaccgatccaagtagtatagcggcaaggggttatatatctactcgagtaggcatgggagaagcagctgcaatttttatgactgcaactcctcccggcagtgttgaggcttttccgcaaagtaacgctgtcatccaggatgaggagcgagatataccagaacgaagttggaactctggctacgaatggatcacagatttcccagggaaaactgtctggttcgtcccaagcatcaaatccggaaatgacatagctaactgccttagaaagaacggaaaacgcgttatacaacttagtaggaagactttcgacacggaataccagaaaactaagaacaatgattgggactatgtagtaacaacagacatctcggagatgggcgcaaacttcagggctgacagagtaatagatcccagacgatgtttaaaacccgtaatccttaaggacggaccagaacgggttatattagcaggcccgatgccggtaacagttgcctctgccgctcaaagacgaggacgaatcggtcgtaatcataataaagaaggagatcagtacatatacatgggtcaaccccttaacaatgatgaagatcacgcccattggacagaagcaaagatgttattagacaatatcaacactccagaaggtatcattcccgcccttttcgagcccgaaagagaaaaatcagcggcaatcgacggcgaatatcggctaagaggagaagctcgaaaaaccttcgtagaacttatgcgacgaggtgatctgccagtatggttaagttacaaagtggcgagtgaaggatttcaatatagtgacagacgttggtgctttgatggtgaaaggaataatcaagtattagaagaaaacatggacgtggaaatatggacaaaggaaggtgagagaaagaaactccgccctcgttggttagacgcgaggacttattcagatccattagcactaagagagtttaaagagtttgcagccggccggaggagcgtaagtggtgacctgatcctcgaaattggaaagttacctcaacatttaactcaacgtgcccaaaatgccttggataatttagtaatgttacacaactctgaacaaggtggacgtgcatacaggcatgcaatggaagagttgcccgacaccatagagacgttaatgctattagcattgatagccgtgctaactggaggagtcaccctattctttctcagtggtaggggccttggaaaaacctcgatcggactactttgcgtaatggctagctccgtccttctgtggatggctagcgtagaaccacactggatcgcggcttctataatattggaatttttcctcatggttctactaataccagagcctgatcgccagcgaacccctcaggataaccaacttgcctacgtagttataggactgttgtttatgatacttacagtagctgcgaatgaaatgggattgttagaaacaaccaagaaagacttaggcataggacatgttgcagtggaaaatcatcatcatgcagccatgttagatgttgacctacatccggcaagtgcatggacactatacgctgtcgcgacaactattataactccgatgatgcgacacactatagaaaatactacagccaacatctctctcacagcaatagctaatcaagcagcaatacttatggggctcgacaaaggatggccaatctcaaaaatggacatcggtgtaccgctacttgctctagggtgctatagtcaggttaatccactcacactcacagcagcagtcctaatgcttgttgcccactacgccattattggtccaggtttacaagctaaagctaccagggaagcccagaaaagaaccgctgcgggaatcatgaagaatcctactgtagacggcatagtagcaatcgacttagacccggtggtttacgatgcgaaattcgaaaaacagctaggccaaatcatgcttctcatactttgtacgagccaaatcctgttaatgagaaccacttgggcattatgtgaaagcataacattagcgacgggaccacttacaacgctctgggaaggatcaccaggaaaattttggaacaccaccatcgctgtttcaatggcaaatatttttcggggaagttatcttgcaggcgcaggtctagcattcagtttaatgaaaagcctaggaggtggtagaagaggaaccggagcacagggcgagacgctcggggagaaatggaagcgacaactaaatcaactaagcaaaagcgaatttaatacatataagagatcgggaataatggaagttgatcgatcagaggccaaagagggactgaaacgaggagaaactaccaaacacgcagtcagtcgtgggacagctaaattgagatggtttgtcgaaagaaatttagtaaagccggaaggcaaagtaatagatttaggatgtgggcgaggagggtggtcatattattgtgctggactcaagaaagtaacagaagttaaagggtatactaaaggaggtccaggtcatgaagaaccgatccccatggcaacttatggttggaacttagtcaaacttcacagtggaaaagacgtcttctttataccgcccgagaaatgtgatacactattgtgcgatatcggagaaagcagtccaaaccccactatcgaagaaggacgaaccctaagggtattaaaaatggtagaaccatggttacgaggaaatcaattttgtattaaaatattaaatccatacatgcccagtgtggtagaaactctcgagcagatgcaaaggaagcatggcgggatgttggttaggaatcctcttagtaggaatagtacacatgaaatgtactgggtcagctgtggaacgggtaatatcgtatcggccgtcaatatgacaagcagaatgttattgaacagatttacaatggctcatcgcaaaccaacctacgagcgtgacgtagatctaggtgctgggaccagacacgttgcggtagagcctgaagtggcaaatctagacataattgggcaacgaatagaaaacataaaacatgaacataagagcacttggcattacgacgaagacaacccatacaaaacgtgggcctaccacggctcgtacgaggtaaagcccagtgggagtgcgtcatcaatggtgaacggagtggttaaacttctgacaaagccgtgggacgtgataccaatggtaacacaaatagcgatgacggatactacaccatttggtcaacaaagagttttcaaggagaaagttgatacacgaaccccaaaagcaaagagagggactgcccaaatcatggaagtaacggcaaaatggttatggggtttcttatctagaaacaaaaagccaagaatatgtactcgagaagaatttacacgtaaggttaggtccaacgcggccatcggcgcggtatttgttgacgaaaaccagtggaactcagcaaaggaagcagtagaagatgaacgcttctgggatttggttcatcgagaacgagaactacataaacagggtaagtgtgcgacatgcgtttataatatgatggggaaacgagaaaagaaactcggcgaatttggtaaagccaaaggcagtcgagctatctggtatatgtggttaggggctcgattcctagaatttgaagcactaggattcatgaatgaagaccattggttctcgcgagaaaattcattaagtggagtagagggagagggtcttcataaattaggatatatcttaagagatataagtaacataccaggtggtaatatgtacgcggatgataccgccggatgggatactagaatcacagaggacgatttacagaatgaagcacgaataacagatattatggaaccagaacacgcgcttcttgccaaaagtatttttaaattgacctaccaaaataaggtggtacgtgtacaacggcctgcaaagaacggaacagtaatggacgtgatttcaaggcgggatcaaagaggctcaggtcaagtaggtacctatggattaaatactttcacaaatatggaagcgcaattaatacgccaaatggaatctgaaggaatcttcagcccatcagaactggagacaccgaatctagcagaaagggtacttgactggttggaaaaatacggagtggagagattaaaacgaatggcaatatcaggggatgactgcgtggtaaaacccatcgacgatagatttgctacggcattaacagccttaaacgatatgggaaaagttcggaaagatattcctcaatgggaaccatcaaaaggttggaacgactggcagcaagtaccattttgcagtcatcattttcaccaattaataatgaaagacggaagagaaatagttgtaccatgtagaaaccaggacgagctagttggccgggcacgggtaagccagggagcgggttggtcactacgtgagaccgcatgtcttggaaaatcttacgctcagatgtggcagctaatgtacttccatagaagagacctgagattagcagcaaatgcaatctgttcggcggtgcctgtagattggattccaacaagtcgcacaacctggagtattcatgcacaccatcaatggatgacaacagaggatatgttatccgtttggaacagggtttggattgaagagaatccttggatggaggacaaaacccatatctcttcgtggggagatgtaccttatcttgggaagcgtgaagaccaatggtgtggaagtttaattggtctaactgctcgcgctacgtgggcaaccaacatacaagtggccataaatcaggtaagaagacttatcggaaatgaaaactacttggattacatgaccagtatgaagcgtttcaaaaatgagagtgacccagagggtgcactttggtaa

SEQ ID NO: 21602 - RNA, 9879 nt, synthetic construct
  misc_feature 1..9879: note = derived and/or modified CDS sequence (opt6) from DENV-1__FJ410266__SS-prME
  source 1..9879: mol_type = other RNA
tctgtcactatgctattaatgcttatgcctaccgcattagcctttcatcttactacccgtggtggtgaaccccatatgattgtgactaaacaagaacggggtaaatccctactatttaaaacatctgccggagtcaatatgtgcacattaatagcaatggatttaggtgaactgtgcgaagacacaatgacatacaaatgtccaagaattactgaagcagaaccagacgatgtcgactgttggtgcaatgcaacagacacatgggttacatatggaacatgttcccaaactggtgaacacaggcgcgataaacgatcagttgcgctagcaccacacgtaggacttggattagaaacaagaacagaaacatggatgtcatctgaaggggcttggaaacaaatacaacgtgtcgaaacttgggcattacgccatccgggttttacggtaattgcattattccttgctcatgcaattggaacaagcatcacccaaaagggaataatattcattcttttaatgctcgttacgccatcgatggctatgcgatgcgtcggaatcggtagtagagattttgtggaagggctgtcaggtgcaacctgggttgatgtagtgctggaacatggatcgtgtgtcaccaccatggcgaaagataaacctacactggacatcgaacttttgaagacagaagtaactaatccggcagtattaagaaagttatgtatagaagcaaaaatatctaatacaacaactgactcgcgatgtcctactcaaggagaagcaactttgatggaggaacaagatgctaattttgtatgtcggcggacttttgtcgacagaggatggggtaatggatgtggacttttcggaaaaggttccctaataacgtgcgctaaatttaaatgtgtgacgaaactagaagggaagatagtacaatatgaaaatttgaaatactcggtgatagtaacggtacatacaggagaccaacaccaagttggaaacgaaagtaccgaacatggaacaacggccactattactccacaagccccaacaagtgagatacaactaacagattacggagcattaactcttgattgttctccgcgcaccggtctcgactttaatgaaatggtcttactgactatgaaagagaaatcatggttagttcacaagcagtggtttcttgacttgcctctaccatggacttccggcgcttcaacctcgcaagaaacatggaataggcaggatcttctcgtaacatttaagacagcgcatgccaagaaacaagaggttgtagtattaggcagtcaggaaggcgcaatgcacaccgcacttacaggagcaaccgaaatacaaacatcaggcacaacaaccatattcgcaggccatttaaaatgtcgtcttaaaatggataaattaacattgaaaggcatgtcctatgtgatgtgtaccggctcctttaaactggaaaaagaagtagcagaaacgcaacatggaacagtacttgtacaaataaaatacgagggtacagatgcgccatgtaagatcccgttttctacgcaggacgaaaaaggtgttacccaaaatggaagattgatcacagcaaatccgatagtaacagacaaagaaaaaccggtaaatattgaagcggaaccaccgtttggcgaaagttatatcgtaataggcgctggagaaaaggctctaaaactgtcatggtttaaaaagggaagcagtatcggcaaaatgtttgaagcaaccgctagaggggcgcgccgaatggcaattcttggtgacacagcgtgggattttggcagtataggaggtgttttcaccagcgtaggaaaactggtgcaccaaatattcggaacggcatatggtgtattattttcgggggtctcttggacgatgaaaatcggcataggggttttacttacttggttagggttaaattcacgttctacgagcctttcaatgacatgcattgcagtcggtttagttactctctatttaggcgttatggttcaggctgacagcggctgcgttatcaattggaaaggaagagaactaaaatgtggcagcggaatttttgtaaccaatgaagtccatacttggacggaacaatataaatttcaagcggacagcccgaaaagactaagtgcagcaatagggaaagcgtgggaagaaggagtctgcggcattcgcagtgctactagattggagaatattatgtggaaacaaatcagcaatgagctgaatcatatcttgttagaaaatgacatgaagtttacagtcgttgttggtgacgtagtaggtatcctcgcccagggcaagaaaatgatcaggcctcaaccgatggaacataaatactcctggaagtcatggggaaaagcaaagataataggagccgacgtccaaaacaccacgttcataatcgatggtccaaatactccagaatgcccagatgaccaacgtgcctggaacatttgggaagtagaagactatggattcgggatttttacaacaaacatctggttgaaattaagagacagttacacgcaggtatgcgaccatcgcctaatgagcgctgcaatcaaagacagtaaagcggtacacgcagatatgggatactggatagaaagtgagaagaatgaaacctggaaattagcacgtgcatcttttattgaagtaaaaacttgtatatggcccaaaagccatacattatggtcaaacggggtattagaaagtgaaatgataattccaaaaatctacggcggccctatttcacaacataattaccgaccagggtactttacacagactgcaggaccatggcatttaggaaaattggaactcgatttcgacctgtgtgaaggtacaactgtcgtagttgacgaacattgtggcaatagaggacctagtctgcgtactacaacagtaactggtaagataattcatgaatggtgctgccgctcttgcacgcttccacctttaagatttaaaggtgaggacggatgctggtacggaatggaaattaggccagtaaaagaaaaagaggaaaatctcgtaaaatcaatggtctcagcagggtcaggagaggtagatagcttttcattaggactattgtgtatttcaataatgattgaagaagttatgcggagccgctggagcaaaaagatgctaatgacggggacccttgcggtatttttactgttgataatgggacagctaacttggaatgacctaatcagactatgtattatggttggggccaatgcgtcagatagaatgggcatgggaactacttacttggctttgatcgccaccttcaaaatgcgtcctatgttcgctgtcggtctgctattccgacgtcttacttcgcgagaagttctactcctcaccattggcctctcgttagtagcaagcgtagaactaccaaattccctagaagaactcggagacggcctcgcgatgggaataatgatattaaaactattaacagattttcaatcacaccaattatgggcgactttattatctttcaccttcatcaaaacgacgctgtcgcttcattacgcatggaagacaatggcaatggtattgtcgatcgttagcttatttcccttatgtctgtccactacaagtcaaaagacaacatggttaccagtcctacttggttctctaggatgtaaacctctaactatgttcctaatagccgaaaacaaaatatggggtcgcaaaagctggcctttgaacgaggggatcatggctgtaggagtggtcagtatactgttgtcgtcattactgaagaacgatgttcccctagcaggtcctctcatagcaggcggaatgctaatagcatgctacgttatatctgggtcatcagcagatctatcactagagaaagcagcagaagtttcatgggaggaagaggcagaacacagcggagcatcccataatatcctggtagaagtccaggacgatggtaccatgaagatcaaagatgaggagcgggacgacactctaaccatattattgaaggcaactcttctcgcggtctccggagtataccctttatcaatcccagccacgttattcgtatggcacttttggcaaaagaaaaagcaaaggagcggcgtactctgggatacaccatcaccccctgaggtggaaagagcagtattagacgatggaatatatcgcataatgcagagagggctactaggcaggagccaagtaggagtgggcgttttccaagagaatgttttccatacgatgtggcatgtaaccagaggagcggttctaatgtaccaaggaaaacgattagaaccaagctgggcttctgttaagaaagacctgatatcatatggtggagggtggagactccaaggcagctggaacactggagaagaagtacaggtcatagcagtagagcccggcaaaaatcccaaaaatgtacaaactgcaccagggaccttcaaaacacctgagggcgaagtaggagctattgcgctggatttcaaacccggaacttcggggagtcctatagtaaacagagagggaaaaatagtaggactatacggaaatggtgtagttactacttcaggaacgtatgtctcagccatagcacaagccaaggcttcccaggaaggaccacttcctgagatagaagacgaagtatttcgcaaacgtaacctaacaattatggatctacatccaggatccgggaagacaagacgatacttgcccgccattgtgagagaagccataaaaagaaagctcagaacactaatcctcgctccaacacgcgttgtagcaagcgagatggccgaagccttaaaaggcatgcccatccgttaccaaactactgcggtgaagtccgaacataccggcaaagaaatagttgacttaatgtgccatgcgacatttacaatgagactgttaagtccggtaagggtaccaaattataacatgataataatggatgaagcacactttacggacccgagctcaattgctgcaagaggttatatatcaacgagggtaggaatgggagaagcagctgcaattttcatgaccgcaacgccacctgggtcagtggaagccttcccacaaagcaatgcagtcatacaagacgaagagagggacatacccgaacgttcatggaactctggttatgaatggataactgactttccaggaaaaacggtctggttcgtacctagtataaagtcaggaaatgacatcgcgaattgccttaggaaaaatggcaaaagagtcatccaactgagtagaaagacgtttgatacagaatatcagaaaacgaaaaacaatgattgggattacgtagttacgactgatatatcagagatgggagccaacttcagagctgacagagtcatagatccaaggcgttgcttaaagccggtgatacttaaggatggcccagaaagagtgatcttagctggtccaatgcctgtaaccgttgcgagcgccgcacagagacgaggaaggatcggaaggaatcacaacaaagaaggagatcaatacatatacatgggacaacctttaaacaacgacgaagaccacgcacattggacagaagcgaaaatgctactagacaacataaacacgcctgagggtataattccagcactatttgaacctgaaagggagaaaagcgcagctatagatggagaatatagactaagaggagaagcccgaaagaccttcgtagagctcatgcggaggggtgatctacccgtatggttgagctacaaagtggcctccgaagggttccagtatagtgaccgccgctggtgctttgacggtgagaggaataaccaagtcctggaagaaaatatggatgttgaaatctggacaaaagaaggtgaacgaaagaaactccgccccaggtggttagatgctcgaacttattcagatcctttggctctacgcgaatttaaggaatttgcagcggggagaagatcagtctcaggagatttaattctagaaataggaaaacttccccaacacttgactcagagagcacaaaatgctctagacaacctggtaatgttacataactcagagcagggtggcagggcttatcggcacgcgatggaagaattacccgatactatagaaacattaatgctactagcattaatagcggtattaacagggggagttacactattctttctaagtggccgcggattgggaaagacatcaattggactactatgcgttatggcgagtagtgtactactatggatggcgtccgttgagccacattggatcgcagcgtcgattatattagagttctttctgatggttttattaataccagaaccagatcgacaaagaacaccccaagacaaccaattagcgtatgtcgtcataggactactctttatgatcttaacggtagcagcaaacgaaatgggactactagagacgactaagaaagatcttggaattggacatgtagcagtagaaaaccatcatcatgctaccatgttagacgtagatttacacccagcatcggcgtggacactgtatgcagtcgcgacgacaataattacgccaatgatgcggcatacaatagaaaacaccactgcaaacatatcgctaaccgctattgcaaaccaggcagcaatccttatgggcctcgataagggatggcccatatctaagatggatattggtgtaccgttacttgctctaggctgttactctcaggttaaccccttaacacttacagcagccgtattaatgctagttgcccattacgccattataggccctggattacaagctaaagcaactagggaagcccaaaaacgtacggcggccgggattatgaaaaacccgaccgtggatggaattgttgccatagatctagacccggttgtgtacgatgctaaatttgaaaaacagttgggacaaataatgttgttaatcttatgtacatcacaaatccttttgatgagaaccacatgggctttatgcgaatcaataacccttgctacggggccgttaaccaccttatgggaaggatcgcctggcaaattttggaatacaaccatcgctgtatccatggcaaatatatttagaggcagctatttagcaggagctggattagcattttctttaatgaagtcattagggggtggaagaaggggaacaggagcacaaggcgaaaccttaggtgaaaagtggaagaggcaattaaaccagctcagcaaatctgagtttaatacatacaaaaggagtggtattatggaagttgatcgatcagaagctaaggaaggtcttaaaagaggcgaaaccactcgacatgccgtaagcagaggtacagctaaattaaggtggtttgttgaaagaaatttagtgaaaccggagggtaaggttatcgacttaggatgtggtagaggcggctggtcatattattgtgctgggcttaagaaagttacagaagtgaaaggatataccaaaggaggtccggggcatgaagaacccattcctatggctacatatggatggaatctcgttaaacttcactcaggaaaagatgtattctttacaccccctgaaaaatgtgacacgctattatgcgatatcggagagtcaagccctaatcccacaatagaagaaggacgtacactccgagtcttaaaaatggtcgaaccatggctgaggggaaatcaattttgtattaaaatactgaatccctacatgcccagtgtagttgaaacactggaacaaatgcagagaaaacatggtggaatgttagtcagaaatccattaagccgaaatagcacgcatgaaatgtattgggtttcgtgtggtacaggaaacatcgtatcggcagtcaacatgacttctagaatgctcttaaacaggtttaccatggcacaccgcaagcctacctatgagagggatgttgatttaggtgcaggcacacgtcatgttgctgtggaaccagaagtagcaaatttggacatcataggacaaagaatcgaaaatattaaacatgaacataaatctacctggcattatgatgaagacaatccatacaagacatgggcatatcacggttcgtatgaagtaaaaccaagtggttcggcatccagcatggtcaacggtgtagtaaaattgttaacaaagccatgggatgttataccaatggttacgcaaattgcgatgacagacacaacgccattcggccaacaacgggtattcaaggaaaaagttgatactcgaactcccaaagctaagagaggcacggcacagattatggaagtaacagctaagtggttatggggattcttatcgcgaaacaaaaagccccgaatttgcactcgtgaagaatttacaagaaaagtaaggagcaatgctgctatcggagcagttttcgtcgacgagaatcaatggaactctgcaaaagaagcagtggaggacgagagattctgggatctggttcagaaagaaagagaattgcacaaacaaggaaaatgcgctacatgcgtatataatatgatgggcaagcgagaaaagaaacttggtgaatttgggaaagcaaagggttcaagggccatatggtatatgtggttaggtgctcgcttcctcgagtttgaagcattaggattcatgaatgaagaccattggttttcaagagaaaattcgttgtccggcgtggaaggcgaaggactacataaattaggctatatacttagggacatctcaaagatcccgggaggtaatatgtatgcagatgatacggccggttgggatacaagaataacagaagacgaccttcaaaacgaagctaaaatcacagatatcatggaacccgagcatgcattacttgcaacctctatcttcaaattgacatatcagaacaaagtggtccgggttcaaaggccagctaagaatggcacggtaatggacgtaatctcaaggcgggatcagagaggaagcggacaagtcggaacttatggattaaatacatttactaatatggaagcacaacttatacgacaaatggaatcggagggcatattcctccccggagagttagaaacgccaaatctagcagagagggttttggattggttagagaagtatggagtggaaagattaaaacgtatggctatatccggagatgactgtgtggttaaaccgattgatgatcgattcgcaactgcactgacagccctaaatgatatgggtaaagttaggaaagatatcccacagtgggaaccaagcaagggttggaatgattggcaacaggtacctttctgcagccaccattttcatcaactgataatgaaagacggaagagaaatagttgtaccttgcaggaatcaagatgagctggtaggacgggccagagtaagtcaaggagcaggatggtcactgcgagaaacagcctgtttggggaaaagttatgcgcagatgtggcaattgatgtactttcatagacgggatctacgtttagcagcgaatgcgatatgtagtgccgttcccgttgactgggttccaacttcaagaacgacctggtcaatccacgctcaccatcaatggatgactaccgaagacatgctatcagtatggaatagagtctggatagaagagaatccctggatggaggacaaaacccacgtatcaagttggggagatgtaccttacctaggcaaaagagaagatcaatggtgtggcagcttgatcggcctaactgcaagggctacatgggcatcgaacattcaagtagcaattaaccaagtaaggagattaatcggtaatgaaaactatctagattatatgacaagcatgaaaagattcaaaaatgaaggggatcccgaaggcgcattatggtaa

SEQ ID NO: 21603 - RNA, 9879 nt, synthetic construct
  misc_feature 1..9879: note = derived and/or modified CDS sequence (opt6) from DENV-1__FJ410269__SS-prME
  source 1..9879: mol_type = other RNA
tcagtaacgatgttattaatgttaatgccgacagcattggcatttcacctgacaacaagaggtggtgaacctcatatgattgttacgaaacaagaaagaggaaaatccttgttgtttaaaacctcagcaggggttaatatgtgtacattaattgcgatggacttgggggaactatgtgaagatacaatgacctacaaatgtcctcgtataacagaagcggaaccggacgatgtggattgttggtgtaacgcaaccgatacatgggttacatatggtacctgttcgcaaacaggagaacacagacgcgataaacgaagtgtggcgctagcaccacacgttggtctaggcttagagactcggactgagacatggatgagttcggagggggcatggaaacaaattcaaagggttgaaacatgggcattaagacatcctggctttacagttatcgctttattcttagcgcacgccattgggacctccataacacaaaaaggcatcatattcatattactcatgttggtgactccgagtatggcaatgcgatgtgtaggaattggaagtagagatttcgtagaaggcctatccggtgcaacttgggtagacgtagtattggaacatggtagttgcgtaacgaccatggcaaaagacaaacccacattagacatagaactgctaaaaacggaggtaacaaaccccgcggtattacggaaactctgcattgaagctaaaatatcaaatactactaccgactcacgatgtccaacacaaggggaggctactctcatggaagaacaagatgcgaatttcgtctgcagacgcactttcgtcgacagaggttggggaaatggttgtggactttttgggaaaggcagcttaatcacgtgtgccaaattcaaatgtgttacaaaactcgaaggcaaaatcgtccaatatgaaaacctcaaatacagcgttatcgtgacggttcatacaggcgatcaacaccaagttggtaacgaatcaaccgaacatggtaccacagctacaattacgcctcaagcccctacatccgaaatacaacttactgactatggcgctctcacactagattgctctccacgtacaggactggactttaacgaaatggttcttttaacgatgaaagaaaaatcatggttagtacataaacaatggtttctagatttgccattaccgtggacaagtggtgcaagcaccagccaggaaacttggaacaggcaagaccttctcgtaaccttcaaaaccgcccatgcgaagaaacaagaagtagtagtgttaggtagtcaggagggagcgatgcacacagctctaactggagcaactgaaatacaaacaagtggaactactacaatattcgcaggtcacttaaaatgcaggttaaaaatggacaaattgacactcaaaggaatgtcttacgttatgtgcacagggagctttaaactagagaaagaagtcgcggaaacccaacatggtacagtgttggtacaaataaaatatgagggcacggacgcaccatgtaaaatacccttttcaacacaagacgaaaaaggagttatacaaaatggacgactaatcaccgccaaccctattgtcactgacaaagaaaaaccagtaaatattgaggctgaaccaccatttggagagtcctacatagtaattggagttggcgaaaaagccctaaaactatcatggtttaagaaaggctcatccattgggaaaatgtttgaagcaaccgctcgcggtgcacgccgaatggcaattctcggagatacagcgtgggactttggctcaatcggaggagtgtttacctcagttggcaaattggtacaccagatattcggaaccgcatatggagtattattcagtggagtttcgtggacaatgaaaattgggattggagtattattgacatggcttgggcttaatagtcgaagtacttccctaagtatgacctgcatagcagtaggattagttacgctatacctaggagtcatggtgcaagccgactctggatgtgtaataaattggaagggtcgggaactaaagtgtggctccggcatttttgtgactaatgaggttcacacgtggaccgagcaatacaaatttcaagctgactctccaaaacgactaagtgcagcaatcggtaaggcatgggaggaaggggtgtgtggtatacgaagtgttacgagactagaaaatatcatgtggaaacaaatatctaatgaattaaatcatatactactcgaaaacgacatgaaatttacagtggtagttggggatgtcgtaggaatattagctcagggcaagaaaatgataagaccacagccaatggaacataaatattcgtggaaatcatggggaaaagctaaaattataggagctgatgtacaaaatacaacttttattatagacggtcctaacaccccggaatgtccggacgatcaacgagcctggaatatctgggaagttgaagattacggatttggaatatttaccactaacatatggctgaagttaagagactcctatacacaggcttgtgatcaccgattaatgagtgcagcgataaaagattccaaagccgtacatgcggacatgggctactggatagaatccgagaaaaatgaaacgtggaaactagcaagagcgtcatttattgaagtgaaaacctgtatatggccaaaaagtcatacactgtggtccaacggagtactagagagtgaaatggtgatacctaaaatctatggaggacctataagccaacataattatcgccctgggtatttcacgcaaaccgcaggtccctggcatctaggaaaactggagcttgactttgacttatgtgaaggaaccacggtcgtagttgatgaacattgtggaaataggggacctagccttaggaccactacagttaccggaaaaataatacatgaatggtgctgtagaagttgtactcttccaccgttacggttcaaaggagaagatggttgctggtatggcatggaaatacgacccgttaaagagaaggaagaaaatttggtaaagtcgatggtaagcgctggatctggggaggttgatagtttcagcttgggacttttatgtatctctattatgattgaagaggttatgcgtagtagatggagcaggaagatgttaatgaccggaactttggcagtatttttattgctaataatgggtcaactaacttggaatgatttgataagattatgtattatggtaggagctaacgcatctgacagaatgggaatgggaacaacctatctagctctaatggcaacatttaaaatgaggcctatgtttgcagtaggcttactctttaggcgcttaacatcacgggaggtactcttgcttacaatcggactttcattagttgcctcagtggagatcccaaattcattagaggaattgggagacggattagcgatgggcatcatgatactaaaattgctgacagactttcaaagtcaccagctttgggcaactctcttgtcgcttacttttataaaaacaaccttaagtttacactatgcttggaaaacaatggcaatggtattatcaatagtttcattatttccgctatgcctaagtacaacaagccagaaaacaacatggctacccgttcttttaggatcattgggatgtaaaccactgacaatgtttcttatcgccgaaaataaaatatgggggcgaaagtcatggcctttaaatgaaggaatcatggcggttggagtagtatctattctactcagtagtctccttaaaaacgatgttccactagcgggccccttaattgcagggggaatgctaatagcatgttatgtcatttccggctcatcagccgacctatcacttgaaaaagctgcagaagtatcatgggaggaagaagcagaacattcaggagctagtcataatatcctagtcgaagtacaagatgacggcacgatgaaaattaaagatgaggaacgtgacgatacactgacaatactattaaaggcgacactacttgctgtatccggtgtataccctttgagtattccagcaacattattcgtgtggtacttctggcagaagaagaaacaacgaagcggagtcttatgggatacaccgagcccaccggaggtggaaagggccgtattagacgatggtatctatcgcataatgcaacggggattattagggcggagtcaagtgggggtaggcgtattccaagaaaacgtgtttcatacaatgtggcatgtgaccagaggtgcagtactcatgtatcaaggcaaacgattagaacctagttgggcttcagtcaagaaagacttgatttcctatggcggagggtggaggctacagggatcgtggaatacgggtgaggaggtacaagtaattgcagtggaaccaggtaaaaatcccaaaaatgtccaaacggcccccggtaccttcaaaacaccagagggagaagtaggtgcaatcgcattggatttcaaaccaggaacttctggatcaccaatagtaaaccgagaaggtaaaattgtgggtctatatggcaacggagtcgttacgacatcaggaacatatgtatctgcaatcgcacaagcaaaggcttctcaagagggccctctgccagaaattgaggatgaagttttcaggaaacggaacctcaccataatggatctccacccgggtagtggcaaaaccaggcgttatttgccggcaatagtacgcgaagctattaaacggaaacttaggacactcatccttgcaccgactcgtgttgtagcgtcagaaatggcagaggcacttaaggggatgccaatcagatatcaaactaccgccgttaagagtgagcacactggcaaagaaatagtggatctaatgtgtcacgcaacctttaccatgaggttattatcaccagtcagggtcccaaactataatatgatcatcatggatgaagcccattttactgacccaagttcaatagcagccagaggttatatttcaacaagagtaggaatgggtgaagctgctgcaatatttatgactgcgactccgcctggaagtgtagaagcattccctcaatcgaatgcagttatacaagacgaagaacgcgatataccggaacgtagttggaacagcggatatgaatggattacagactttcctggaaaaacagtctggtttgtaccaagtattaaatcgggaaatgatatagctaactgtttaaggaaaaacggaaagagagtaatccaattaagtagaaaaacgttcgacacagagtaccaaaagacaaagaacaatgattgggattatgtagtaactactgacatttctgaaatgggggcaaactttagggcagacagggtgatagatcctagaaggtgtttgaaacccgtaatcctaaaagatgggccagaaagagttatattagcaggtccgatgccggttacggtagcttccgcggctcaaaggagaggaagaattggaaggaatcataataaagaaggggaccagtacatttatatgggacaaccgctaaataatgatgaagaccatgcacattggacagaggcaaaaatgcttttagataatataaacactcctgagggtataatacctgcgctgttcgaaccagaacgagaaaaatctgcagctatcgacggagaatatagacttcgaggggaggctcgcaaaacattcgttgaattgatgcgacgtggcgatcttcctgtttggttaagctacaaagtcgctagtgagggcttccagtactcagacagaagatggtgcttcgatggagaaagaaataatcaagtgctagaagaaaatatggatgtagaaatttggactaaagaaggagagcgaaagaaactacggccccgatggctagatgcacggacatacagcgatcctctcgctctacgcgaatttaaagagttcgcagcaggaagacgttctgtaagcggagacttgattttagaaataggcaaattgccccaacacctaacccaaagagcacaaaatgctctggataacttagtcatgttacacaattcagaacaaggaggaagggcctaccgtcatgcgatggaggaattacccgacaccattgagactctaatgcttctagccctaattgccgtgttaacagggggagtgacactattcttcctttcaggcagaggtttagggaaaacatcaataggattattatgcgtgatggcgagcagtgtattactctggatggcttccgtagaaccgcattggatcgcggctagtatcatactagagttctttttaatggttcttcttatccccgaaccagacagacaacgaaccccgcaagacaatcagttggcctatgtagtgatcggcttgttatttatgatacttacggtagccgcgaacgagatgggactgttagaaacgaccaagaaagatctgggaattggtcacgtagcagtggaaaatcatcatcacgcaacgatgcttgacgtagacctccacccggcttcagcatggacattatacgcagtggcaaccacgataataactcctatgatgagacacacaatagaaaatacgacagcaaatatatcccttactgctatcgcaaatcaagcagcgatattaatgggacttgacaaaggctggcctattagtaaaatggacataggagttccattattggcgctaggttgttattcccaagtcaaccctttaacacttaccgctgccgttctaatgcttgtcgcccattatgcaataattggccccggcttacaagcgaaagccacgagagaagctcaaaagagaaccgcggctggtataatgaaaaacccaacggtggatggtatagtagctatcgacctagaccctgtagtttatgacgccaaattcgaaaaacagctgggccaaataatgctattaatattatgcacatcccaaattttgttaatgcggacaacatgggccctgtgtgagtcaataacattagcaaccggaccgttgacaaccttatgggaaggctcaccgggcaaattttggaatactacaatagccgtaagcatggccaatatatttcgagggagctaccttgccggcgcaggtctcgcatttagtcttatgaaatctctagggggagggcggcgagggacaggtgcgcaaggagaaacgttaggagaaaagtggaaaagacaattaaatcagttgtcaaaatcagagttcaatatttataaaagatcaggtattatggaagttgataggagtgaggcaaaagaaggattaaaaaggggagaaaccacaagacacgctgttagccgaggaactgccaaactgagatggttcgtagaacgtaacctagttaaaccagaaggaaaagttatagacctaggatgcgggagaggcggttggtcatactactgtgcaggactaaagaaagtcactgaagtgaagggctatacaaaagggggtccgggacatgaagaaccgattcctatggcaacttacgggtggaatcttgtgaaacttcacagcggtaaagacgtattctttacaccaccagaaaaatgcgatactttattatgtgatattggggaatcttccccaaatcccacgatcgaagaaggcagaacactgagagtactcaaaatggtggaaccttggctgaggggaaaccaattctgcatcaaaatactgaacccctatatgccatcggtagtagaaacactcgaacaaatgcaacgcaaacatggaggtatgttagttagaaatcctttaagtcggaactcaacacacgaaatgtattgggtaagttgtgggactgggaacatcgtatccgcagtgaacatgacctcccggatgttactaaatagatttactatggcacatagaaaaccaacgtacgaaagagatgtagacttaggagcaggaacacgacacgtggcagtggagccagaagttgcaaatttagatatcataggacagagaatcgagaacataaagcacgagcacaaatcaacttggcattatgatgaagataatccatacaagacatgggcatatcatggtagctacgaagtgaaaccatccgggagcgcgagtagtatggtaaacggtgtagtaaaattattaacgaagccctgggacgtgattccaatggtaacccaaatagcaatgactgatacaacgccatttgggcaacagagggtattcaaagagaaggtagacactaggactccaaaagctaaacgtggcactgcccaaattatggaggtaacggcaagatggctttggggatttttatcccgtaataagaaaccgagaatctgcacacgcgaggagttcaccaggaaggtaagatcaaacgcagcaatcggggctgtatttgttgacgaaaaccaatggaacagtgcaaaggaagcagtagaagacgaacgattctgggacttagtacaaaaggaacgggaacttcacaagcaaggtaaatgtgcgacctgtgtgtataatatgatgggaaagcgagagaagaaactcggcgagttcggcaaggcaaagggatcaagagctatctggtatatgtggcttggggcgcgtttcttagaatttgaagccttaggcttcatgaatgaagatcactggttcagtagagaaaattccttatcaggcgtggagggtgaggggttacataagctgggatatattcttcgagacatatcaaaaataccaggtgggaatatgtacgctgacgacactgccggctgggatacacgaataactgaagatgatcttcaaaacgaagcaaaaatcacagatataatggaaccagaacacgcattattggcaacctcgattttcaagttgacatatcaaaataaagttgttagggtacaacgaccagctaaaaacggtactgttatggatgtaatatctagacgagaccaaagaggatcaggccaagtaggtacgtacggattgaacacattcacaaatatggaagcacaactgatcagacaaatggaatctgaaggaatatttttaccctcagaacttgaaaccccaaatcttgcagaaagagtattagattggctagagaaacacggtgtagaacgtttaaagagaatggcaattagcggcgacgattgtgtagtaaagcccatagacgatcgatttgcaacagcccttactgccttaaatgatatgggaaaagttagaaaggatataccacaatgggaaccaagtaaaggttggaatgattggcagcaagtacccttttgctctcatcatttccatcaacttattatgaaggatggtcgcgagatagttgtaccttgtcgtaatcaagacgagttggtaggacgggcgcgagtctctcagggtgccggatggtcgttaagggaaacagcgtgcctcggaaaaagttacgcacaaatgtggcaactgatgtattttcatagacgtgatctgcgcctagctgcaaacgcaatatgttctgcggtacccgtggattgggtaccgacaagtcggacaacatggtcaatacatgcccatcaccaatggatgacaaccgaggacatgctaagtgtttggaatcgagtctggatcgaagaaaacccttggatggaggataaaacccacgtatcttcttggggcgatgtcccatatctaggcaaaagagaagaccaatggtgcggatccctgattggattgacagccagggccacgtgggcttcaaacatccaggtagcaataaaccaggtacgccggcttatagggaacgaaaactatctagattatatgacatccatgaagagattcaaaaatgaaggtgatccagagggcgctttgtggtaa

SEQ ID NO: 21604 - RNA, 9879 nt, synthetic construct
  misc_feature 1..9879: note = derived and/or modified CDS sequence (opt6) from DENV-1__FJ410273__SS-prME
  source 1..9879: mol_type = other RNA
tctgttacaatgttattaatgctaatgccgacagcattagcatttcacctgacaactaggggaggggaaccgcatatgattgtaagtaaacaagaaaggggaaaaagcctactatttaaaacttctgccggagtcaatatgtgtacattgatagctatggatctaggtgaactttgcgaggacacgatgacttacaaatgcccaagaattacggaggcagaaccagacgatgtcgattgctggtgcaacgccacagacacttgggttacttatggtacttgctctcaaactggagaacatagaagagataaaagaagcgtagcattggctcctcatgtaggtttaggattagagacgaggactgaaacctggatgagctcggaaggagcatggaaacaaattcaacgagtcgaaacttgggcattacgtcatccaggatttaccgttatagccctattcttagcgcatgcgataggaacatctattactcaaaaaggaattatatttattttactaatgctagttaccccatcgatggctatgcgatgcgttggtataggttcccgcgattttgttgaaggtctttcgggtgcaacttgggtggacgtagtacttgagcatggtagttgtgttaccacgatggctaaagataaaccgactttagatatagaactactgaaaacggaggttaccaatccggcagtattgaggaagttatgcatagaagcaaaaattagtaacacaacaacggatagcagatgcccaacgcaaggagaagcgactctggtagaagaacaagacgcaaactttgtttgtaggaggacgttcgtagaccgaggctggggtaatggctgtggtctattcggcaaaggctcactcatcacatgtgccaaattcaaatgcgtaacaaaactggaaggaaaaattgtacaatacgagaacctaaaatattcagtcatagttacagtccacacaggcgatcaacatcaagtgggcaatgagtcgacagaacacggtacaacggctaccataacaccacaggccccatcaaccgagatacaacttactgactacggggcgctaacccttgattgctctccaagaactggcttagattttaatgaaatggtattattaaccatgaaagagaagtcatggttagttcacaagcaatggtttcttgatcttccactaccttggacaagcggagccagcaccagtcaggaaacatggaatcggcaagatttgctagtcaccttcaaaaccgcacacgctaagaaacaggaggtagttgtactaggtagtcaggaaggagcaatgcataccgcattaactggcgcaacagaaatacaaacaagcggtacgacaacgatatttgcaggccatctcaaatgtaggttgaaaatggataaattaactctcaaaggtatgagctacgtcatgtgcacgggttcatttaaattagaaaaagaagtggcagaaacacaacatggaacagtattggtacagattaaatatgaaggaaccgatgcaccatgtaaaataccatttagtacacaagacgaaaagggcgtgacacagaatggaaggctcatcacggcaaaccctatagttactgataaagagaaaccagtgaatatcgaagctgaaccaccgtttggagaatcgtatatagtaataggggctggtgaaaaggcgttgaagctatcttggtttaagaaaggctccagtatcggtaaaatgtttgtcgctacagcgaggggtgcccgtagaatggcaatcctaggcgatacagcctgggattttggatcaataggaggggtattcacatctgtaggaaaattagtacatcaaatcttcggtactgcatatggagtgctttttagcggtgtaagctggaccatgaaaatcggaattggtgttctccttacttggcttggtctcaattctcgaagcacctctctcagcatgacttgcatagcggtaggcttagttacgctatacttaggagttatggttcaagcagactcaggatgtgttatcaactggaaaggtcgagaactaaaatgcggatcgggaatattcgttacaaacgaggtacacacatggaccgaacaatataaattccaagctgatagtccgaagaggctttctgccgcgataggaaaggcttgggaagagggagtttgtgggattagatcagcaacaaggttagaaaacatcatgtggaaacaaatatctaatgagctaaaccatatcttgctagaaaacgatatgaaatttactgttgtcgtaggtgacgtagctggtattctaacgcaaggtaagaaaatgatcagacctcaaccaatggaatataagtattcatggaaaagctggggaaaagctaagataattggagctgacgtacaaaacacgacatttataatcgacggaccaaacaccccagaatgccccgatgaccaaagagcatggaacatctgggaagtagaagactatggtttcggtatatttacgacgaatatctggctaaaattgagggacagctacacacaagtgtgtgaccaccgcttgatgagcgcggcaatcaaagacagtaaggcagtgcatgctgatatgggttactggattgaatccgagaagaacgaaacctggaaactagcgcgtgccagttttatagaagtgaagacctgtatctggccgaagagtcatacattatggtccaatggcgtactagaatcagaaatgattatcccaaaaatttacggaggaccaatatcccaacataactatagacctggatattttacgcagacggcaggtccgtggcacctaggtaaactagagttagattttaatctttgtgaaggcacaactgtagtagtagatgaacattgcggaaatagagggcctagtctgagaacaactacggtcactgggaaaattatacacgaatggtgctgcagatcctgtacactaccaccgctaagattcaaaggcgaagatggatgttggtatggcatggaaatccgaccagtaaaagaaaaagaagaaaatctagtcaaatctatggtttctgccggctctggtgaggtagactccttcagcctgggcctcttgtgtatatctatcatgatagaagaggtgatgcgcagtaggtggtcgagaaaaatgctaatgaccggcacacttgctgttttcttcctattgataatgggccagctgacttggaatgatcttattagattgtgcataatggtcggcgcaaatgctagcgaccggatgggcatgggcactacgtaccttgcactaatggcaacttttaagatgagaccgatgctagctgtaggacttttattcaggcgcttgacaagtagggaggtattgttacttaccatcggcctgagtctagtggcatctgttgaactcccaaacagcttagaggaattaggggatggactggcgatgggaataatgatattaaaattactcacagactttcaatctcaccagctctgggctactctcttatcccttacatttatcaagacaacgtactccttgcattatgcatggaagactatggctatggtattatcgatagtttcactgttcccactatgcttatctacgaccagccagaagactacttggctcccagtcttgctaggcagcctaggctgtaaacctcttacgatgttcttgatagccgaaaataaaatttgggggcgtaaaagctggccactaaatgaaggtattatggcggtcggaattgtgagtatcttactgtcttcacttttgaaaaatgacgtaccattagcaggccctctaatagcaggcggtatgctcatagcatgctatgttatcagtggcagttctgctgacttatcactagaaaaagctgccgaagtgtcctgggaggaagaagctgaacacagtggcgcatctcataatatattagttgaagtacaagatgacggtacaatgaaaataaaagatgaagaacgggatgatacattaacgattttactaaaagcaacattattagctgtcagcggtgtgtaccctctctcaatacctgcgactcttttcgtttggtatttttggcagaaaaagaaacaaagatccggtgttttatgggacactccctcgccccctgaagtcgaaagggctgtactagacgacggtatatatcgcattatgcagagaggcttgctcggcagaagccaagtgggagtcggggtatttcaagaaaatgtttttcacacaatgtggcacgtaacaaggggagcagtattgatgtatcaagggaaaaggctagaaccctcatgggcatcagtcaagaaagatttaatttcttacggtggaggctggaggttacaaggtagttggaacactggtgaggaagtacaagtaatcgcggttgaacccggtaaaaaccccaaaaacgtccaaacagccccgggcacgtttaaaacttccgaaggggaagttggagctatagcattagactttaagcctggtacatcaggtagtcctatagtaaacagagagggaaaaatagtagggttatatgggaacggtgtggtgaccacctctggcacgtacgtcagcgctattgcacaagctaaagctagtcaagaagggccattaccggaaatagaaaatgaagtatttagaaaaagaaacctaactatcatggacctccaccccgggagtggaaaaactagaaggtacctaccagcaatagttcgtgaagcgatcaaacgaaaattacgaacattgattctagcaccgactagagttgttgcatcagagatggcagaggccttaaagggcatgcccattcgatatcaaaccactgcagtgaaaagtgaacacaccggaaaagagattgttgatctcatgtgtcatgcaacatttaccatgcgtttgctaagcccggtacgggttcccaattacaacatgattataatggatgaagcccattttacggatccatcaagtattgcagccagaggatacataagtactcgagtgggtatgggcgaagcggcagccatattcatgactgcgacaccaccgggatcagtagaggcttttcctcagtctaatgcggtaattcaagatgaggaaagagatatacccgaacgaagctggaactccgggtatgagtggataacagacttcccaggtaaaacggtttggttcgtaccttctataaagtcaggaaatgacatcgcaaattgcctaaggaaaaatggaaaacgcgtaatacaactaagcagaaaaacattcgataccgaataccaaaagactaaaaataatgattgggactatgtagtgaccacagatatatcagagatgggcgctaatttccgagcagacagagtcatcgaccccagaaggtgcttaaaaccagtaattttaaaagatggccctgagagagtaatactagcaggacctatgccggttacagttgcatctgcagcccaaagacgtggacgaataggaaggaaccacaataaagagggtgatcaatatatatatatgggccaacctctcaacaacgacgaagaccacgcgcactggactgaagcaaaaatgttactagacaatattaacacaccagagggaattataccagcgttatttgagccagaaagggaaaaatccgctgcaattgacggagaatatagactccgaggcgaagcccgtaaaacctttgtagaattaatgaggaggggagacttaccagtatggttgtcgtataaggtggcttcggaaggtttccaatacagcgaccgccggtggtgctttgacggagaacggaataatcaggttctcgaggaaaatatggatgtagaaatttggactaaagagggtgagcgtaaaaagctgagaccacgctggctagatgcaagaacatacagtgacccattagcacttagggaatttaaagagttcgcagctgggcgtaggagtgtatcaggagatttaatattagaaatcggcaaattacctcagcacctcactcaacgagcacaaaatgctctcgataatttggttatgctccataactctgaacaaggaggcagagcgtaccgtcatgctatggaggagcttcctgatactattgaaacactgatgttgttggcattaattgctgttttaacaggtggagtgaccctattcttcttatcaggtcgtggattaggaaaaacaagtatcggtttactctgtgtaatggctagctcagttctattgtggatggcaagtgtggaaccccattggattgctgcatcaataattttggagttctttctgatggtattattgatcccagagccggataggcaaagaacgccacaagacaaccagcttgcatacgtagttattggattgttgtttatgattctcaccgttgcagctaacgaaatggggctattagagactacaaagaaagatctgggcataggccacgttgcagtagaaaatcaccatcacgcagcaatgttggacgtagatctccaccccgctagtgcatggacactctatgctgttgctactacgattattactcctatgatgagacatactatagagaatacaaccgcaaatatatcacttacagcgatcgcaaatcaggcagcaatcttaatgggactagataaaggatggcctatctctaaaatggatataggggtaccgctactcgctttaggatgttactcgcaagtaaacccccttaccttaactgctgctgtcctgatgctagtagctcactacgcgattataggaccagggcttcaagcaaaagccacacgtgaagcacaaaagaggacagccgcaggcatcatgaaaaatccgactgtcgatggaatagtagccatagaccttgacccagtagtatacgatgctaaattcgaaaaacaactaggccaaattatgctgctgattctgtgtacaagtcaaattctgcttatgagaactacatgggcgttatgtgaatcgatcacacttgccacaggaccattaacaacattatgggaaggctcccctgggaaattttggaatacgactatagcagtaagtatggcaaatattttccgaggaagctacctagcgggtgccggtttagcattcagcttaatgaaaagccttggaggtggacgcagaggtactggagcacaaggggaaacattaggcgagaaatggaagaggcagcttaatcaattaagtaaaagtgaatttaatacatacaagcgatccggaataatggaagtggacagaagcgaggccaaagaaggtctcaaaagaggcgaaacaaccaagcacgcggtgtcgagaggtactgctaaactacgttggtttgtagaaagaaatttggtcaaaccagaaggaaaagttatcgatttaggatgcggcagaggaggatggagctattattgtgcaggactaaagaaggttacggaagtgaaaggatatacaaaaggtggtccaggccatgaggaacctataccgatggccacatacggatggaatctagtcaaacttcatagtggaaaagacgtgtttttcattccacctgaaaagtgtgatacattattgtgtgatataggggaatcgtcaccaaaccctacgatagaggaaggaaggacactacgagtcctaaaaatggttgaaccgtggctaagaggaaatcaattttgtatcaaaatcttaaatccctatatgccatctgtagttgaaacattggaacaaatgcagcgaaaacacgggggtatgctagtacggaaccctttaagtcgtaatagcacccatgaaatgtactgggtcagctgtggaactggtaacattgtttctgcagttaatatgacgagccgcatgctcttgaaccgctttaccatggctcataggaaacctacatatgagcgagacgtagatctcggagcaggaactagacacgtagctgtagaaccggaagtcgcaaaccttgacataattggtcagagaatagaaaacatcaaacacgaacacaaaagtacttggcactatgacgaagacaacccatataaaacatgggcttatcacggatcttacgaagtcaaaccatctggctcagcaagctcaatggttaacggagtagtaaaattactaacaaagccttgggacgtaataccaatggtaactcagatcgctatgactgacactaccccattcggacaacaaagagtctttaaagagaaggttgacactcgaacccctaaagccaagcgagggacagcacaaataatggaagtaacagctaaatggctttgggggttcctaagtcgcaacaagaaaccacgcatatgtacaagggaagagtttactagaaaggttaggtcaaatgcagccatcggcgcagtatttgttgatgaaaatcaatggaactctgcaaaggaggcagtcgaagacgaacgcttctgggatttagttcatcgggagagagaactccataaacaaggaaaatgcgctacttgcgtgtacaacatgatggggaaaagagagaagaaacttggtgaatttggcaaagcgaaaggctcacgtgccatatggtacatgtggttgggagcaagatttttagagttcgaagcccttggctttatgaatgaagaccattggttcagcagagaaaattctcttagtggcgtagaaggcgaaggtttacataaactaggatacatattaagggatatttcaaagatacccggtggaaacatgtatgcagatgacacagcagggtgggacaccagaataactgaagatgatctacagaatgaagccaaaattaccgatataatggagccagaacacgcactattagcaaaaagcatctttaagctaacgtaccaaaacaaagttgtaagggttcaaagacctgccaaaaacggaacagtcatggacgtcatttcacgtagagaccaacgaggttccggtcaggtaggtacgtatggattaaatacattcactaacatggaagcacaattaattaggcaaatggaatctgaagggatattttctccctcagagctagaaactcctaacctggcaggccgggtgcttgactggctggagaaacatggtgtcgaaagactcaaaaggatggctatatcaggtgatgattgtgtcgtaaagccgatagatgaccgttttgcaactgcactcacagcattgaatgacatgggtaaagtaaggaaagatatcccacaatgggaacccagtaaagggtggaatgattggcaacaagtgccattctgttcgcatcactttcatcagctaataatgaaagatggacgtgaaatcgtagttccttgtagaaaccaggatgagctagttgggagggcaagggtcagtcaaggagctggttggagtttacgcgaaactgcgtgcttgggtaagagttacgcacaaatgtggcaattgatgtactttcaccgtagggatttaaggctagcagcaaatgcgatctgctctgctgtgccagtagactgggtacccacttccaggaccacatggagcatacatgcccatcaccaatggatgacaactgaggatatgttgtcggtttggaatcgagtttggatagaggagaatccgtggatggaagataaaactcatatttcctcttggggtgacgtaccctatttaggaaaacgagaggatcaatggtgcggatcactcataggattaaccgctagagcaacatgggcgactaatattcaagtcgctattaaccaagttagaagactaatagggaacgaaaattacctcgactacatgaccagtatgaagcgctttaaaaatgagtcagaccccgaaggggcattatggtga

SEQ ID NO: 21605 - RNA, 9879 nt, synthetic construct
  misc_feature 1..9879: note = derived and/or modified CDS sequence (opt6) from DENV-1__FJ410276__SS-prME
  source 1..9879: mol_type = other RNA
tcggtaaccatgttcctaatgttaatgcctactgctttagcatttcatctcacgacacggggaggtgaaccacatatgatagtgtctaaacaggaacgtggaaaaagtttattatttaaaacatcagctggagtaaatatgtgcaccctaatcgcaatggacttgggagaactatgtgaagacaccatgacatataaatgtcccagaataacagaaacagaacccgatgatgtggattgttggtgtaatgcaacagacacctgggtaacttatggaacttgctcacaaacgggtgaacatcgtcgcgataaacgtagtgtagctctagcaccacatgttggattaggactcgaaactcgaacagaaacatggatgtcatctgaaggagcttggaaacaaatacaacgagtagaaacatgggcgctgagacatccaggttttactgtaatcgctctattccttgcacacgcgataggaacctctatcacacaaaaaggtattatctttatattactaatgcttgttactccctccatggcaatgagatgtgtgggaataggaagccgggactttgtggaaggactttcaggtgcaacctgggtagacgtagtactagaacatggctcgtgcgtaacaacgatggcgaaagataaaccaacactcgatatagaactattaaaaactgaagtaactaaccctgcagtcttaagaaaactatgtatagaagcaaaaatatctaacacaactacagatagccgctgtccgacacaaggagaagcaactttagtagaagaacaagacgccaattttgtttgtcgacgaactttcgtcgacagaggctggggcaacggatgtgggttatttgggaaaggatcattaatcacatgcgccaaatttaaatgcgttacgaaactcgaaggtaaaattgttcaatatgagaacctaaaatattcagtaattgtaacagtacacaccggggatcaacatcaagtaggcaatgagtctactgaacatggtactactgccactatcactccacaggctcccactaccgagatacagctcacggactatggagcgcttacgctcgattgttccccacggacaggtttagattttaatgaaatggtgttgctaacaatgaaagaaaaatcttggctagttcataagcaatggtttttagatctaccacttccatggacatcgggtgcttcaacaagtcaagaaacatggaatagacaggacctacttgtcactttcaaaactgctcatgctaaaaagcaggaagttgtcgttttgggtagtcaagaaggagcgatgcacacggcgctaacaggggcgaccgagattcaaacgagtgggacaacgactatctttgcaggacatcttaaatgccgattaaaaatggataaactaacactaaagggtatgtcgtatgtgatgtgtactgggtcgtttaaactagaaaaagaactagccgaaacacaacacggcactgtgctagtgcaaattaaatatgaaggaacagatgctccttgtaagataccattcttaacacaagacgagaagggagtgacacagaacggacgcttaataacagcaaatccaattgttactgataaagaaaaacctgtaaatatcgaagcagagccaccgtttggcgaatcatatatagtaatcggggcaggcgagaaggcactgaaactatcgtggttcaagaaaggatcaagtatagggaagatgttcgaggcaacagcgagaggagcacgacgaatggcaatattaggggacacagcatgggattttggatcgatcggaggtgtattcactagcgttggtaagttagttcatcaaatcttcggaacagcatacggcgtgttatttagtggagtatcgtggacgatgaaaataggaataggagttcttctgacctggctcgggcttaacagtagatctaccagtttgtctatgacttgtatagctgtaggactggtcacattatacctaggagttatggtacaagctgatagtgggtgtgtaattaactggaagggacgggagcttaaatgtggtagtggaatattcgtgactaatgaagttcacacatggaccgaacaatataaattccaagccgattctccaaagcgactcagcgcagccatcgggaaagcgtgggaagagggtgtttgtggtattcgatcagctacacggctcgaaaacatcatgtggaaacaaataagtaatgaattaaatcatatattactcgaaaacgacatgaaattcactgtagtagtaggagatgtggcaggaatattggcacaaggcaagaaaatgatacgtccacagcctatggaatacaaatattcatggaaaagttggggtaaagcaaagatcattggcgcggatgtacaaaacacaacttttatcattgatggtccaaatacgccagagtgcccggacgaccagcgagcgtggaacatctgggaagttgaagactatggatttgggatattcacgacgaatatatggctaaagctcagagactcgtatacgcaggtatgtgatcatagattgatgtcagccgcaattaaggactccaaagctgtacatgcagatatgggatactggatagaaagtgagaaaaacgaaacttggaaactagcgagggcttcgttcattgaagtgaaaacatgcatttggccaaaaagccatacactatggtctaatggagtgttggaaagcgaaatgataataccaaaaatctacggaggacccatcagccaacataactatcgacctggatattttactcagacagcgggaccgtggcatctaggaaagctggagttggacttcgacctctgtgagggaacaactgtggtagtagatgagcattgtggtaaccgaggacctagtcttaggacgacaacagttactgggaaaatcatacatgagtggtgttgtcggtcatgcacattacctcctctccgctttcgtggtgaggatggctgctggtatggtatggaaataaggccagtgaaggaaaaagaagagaatttggtaaaatcaatggtatctgctggatcaggtgaagtggattctttctctctcggacttctatgcataagtataatgatagaagaggtaatgagaagtaggtggagcagaaaaatgttaatgacgggaactttggcagtattctttttgctaattatgggtcaattaacttggaatgacctgatccgcctatgtataatggttggtgctaatgcttcggatagaatggggatgggtacaacttaccttgcactaatggctacttttaaaatgcggcccatgttcgctgtgggtttactttttcgtaggttaacatcacgtgaagtcctattattaacgatagggctatctctggtagcaagtgtcgagctgcctaattcgttagaggaactaggagatggcctagccatgggcatcatgatcttaaaacttttgacagatttccagtctcaccaactttgggctacgttgctatcacttacattcattaaaacaacattttcgcttcattatgcatggaaaacgatggcaatggttctatcaatcgtctcattatttccattatgccttagtacaacatctcagaagacaacgtggttgcctgtactattgggtagtttaggctgtaaaccgcttacaatgttcctaattgcggaaaacaaaatatggggcaggaggagttggccgctaaatgaaggcataatggctgtagggatagtctctatcttattatcaagtcttctaaagaatgacgtaccattagccggtcccctaatagcgggcggaatgctaattgcatgttacgtaataagcggctcgtctgcagatctatcgttagaaaaagcagctgaagtttcctgggaagaagaagccgaacatagtggtgcgagccacaatatattagttgaagtccaagacgatggaacaatgaaaataaaagacgaagagagggatgataccctaacaatcctacttaaagccacacttctcgctgtcagcggcgtgtatcctctaagtattccagcaaccctgttcgtctggtatttttggcagaaaaagaaacagaggtccggagtactttgggacacaccctcgccaccggaagtagaaagagcagtcttagatgatggaatctaccgtataatgcaaagaggattactgggtcgatctcaagtcggtgtaggtgtgttccaagagaatgtgttccacacgatgtggcacgtcactagaggagctgtcctaatgtatcagggcaaaagactagagcctagttgggccagtgtcaagaaagacttaatatcctacgggggtggttggagacttcaaggttcctggaatacgggtgaagaagtacaggtgatagccgtcgagccaggcaaaaatcccaaaaatgttcaaactgctccaggtacgtttaaaacacccgagggagaggttggcgcaatcgcgctagattttaaacctggcacatctggctcaccgatagtaaacagggaaggaaaaattgtaggcctgtatggaaatggtgtggtcacaacaagcggaacctacgtttctgcaatcgcacaagcgagagcttcccaagaaggccctcttccagaaattgaggatgaagtatttcgtaaacgaaatctgaccataatggacttacacccaggatcaggcaaaacaagaagatatctaccagctatcgtcagagaagctatcaaaaggaaactaagaacactgatactcgcacccactagggtggtagcttccgagatggctgaagcactgaaaggaatgccgataagatatcagacgacggcagttaaatcagaacacacaggaaaagaaatagtagatctaatgtgccatgcaacatttacaatgagacttttatcccctgtgagagtaccgaactacaacatgataataatggacgaagctcattttactgacccaagttcaatagccgcccgcggatacatatcaacgagagttggcatgggagaggcggcagccattttcatgactgcaacaccgccaggctcagtagaagcatttccgcagtcgaatgctgtaattcaagacgaggaaagggatataccggagaggtcttggaatagcggctatgaatggataactgatttcccgggtaaaacggtgtggtttgtaccgagcataaaatcaggtaatgatattgccaactgcttgcgtaagaatggaaaaagagtaatacaattatcacgaaaaacgttcgacacagaataccagaagactaaaaataatgactgggactatgtagttacaacggatatatctgaaatgggagcgaatttcagagcagatagagtaatagacccacggaggtgccttaaacctgtaatcctaaaagatggaccagaaagggtaatattagctggcccaatgcctgtcacagtggccagtgccgcacaacgaaggggaagaattggacgcaatcataataaagagggagatcaatatatatacatgggccaaccattgaacaacgatgaagatcacgcgcactggactgaggctaagatgttattagataacataaatacgccggaaggcataatacctgcgctatttgaaccagaacgagagaaaagtgccgctatagatggtgagtataggttacgaggagaagctagaaaaacattcgtagaattaatgcgacgcggagatctaccggtatggctatcgtacaaagtcgcttcggagggtttccaatattcagataggcggtggtgttttgacggtgaaaggaacaatcaagttctagaggaaaatatggatgtggaaatttggactaaagaaggcgaaagaaagaaactgagaccaaggtggttagacgcgcgtacatattccgaccccttggcactgcgagaatttaaagaatttgctgctgggcgtaggtcggtgagtggcgacttgatcctggagattggcaaacttccacaacatctaacgcaaagagcacagaacgcattagataaccttgttatgcttcataattcagaacaagggggtcgcgcgtatcgccatgctatggaagagttacccgatacaattgaaacactcatgctattagcattgattgctgtattaacgggtggtgtcacactattctttttgtcaggaaggggtctagggaaaacaagtatagggctgctttgtgtgatggcatcatcagtacttttatggatggcatcggtagaaccccactggatagcagctagtatcatattggagttctttctaatggtactgcttatacctgaacctgacaggcaaagaactccgcaggacaatcaattggcatatgtagtaattgggctcctattcatgatcctgaccgtggcagcaaacgaaatgggattattagaaaccacgaagaaagatctaggaataggccacgtagctgtggaaaaccaccatcatgcagccatgctcgacgtagacctacaccctgcctccgcctggaccctgtatgcggtagcaacaacgattattacaccaatgatgagacacacgatcgaaaatactacagcgaatataagtctcacagcaatagcgaatcaagcagcgattctaatgggcctagacaaagggtggccaataagcaaaatggatatcggagttccattgttggctctgggatgttacagtcaggtgaaccccttaaccctcacagcagcagtactcatgctcgttgctcactatgcaataattggacccggcctgcaagccaaggccactagggaagcccaaaagagaactgcagcaggtattatgaaaaatcctactgtcgacgggattgttgctatagacttagaccccgtggtatatgatgctaaatttgaaaaacaattaggacagatcatgctacttatattatgtacatcgcaaatcctgctcatgcgaacaacgtgggcattgtgtgaaagcataacgcttgctacaggtccactgacaactttatgggaaggcagtccaggaaaattttggaatactaccatagccgtttcaatggcgaacatattcagggggagctacttagccggtgcaggacttgcattctcactgatgaaatctctaggtggaggacgccggggaaccggagcccaaggagaaacacttggggaaaaatggaaaagacagttaaatcaattatccaaatccgaatttaacacctacaaacgaagtggtataatggaggtcgacagatccgaagctaaagaaggtttaaaacgaggcgaaaccacgaaacatgctgtatccagaggaacagcaaaactaagatggttcgttgaacgtaatttagtcaaacccgaaggtaaagtgattgatctggggtgtggaagaggtggttggtcttactattgtgccggtcttaagaaagttacagaggttaaaggctataccaaaggtggcccaggtcacgaagaaccaatccccatggcaacttacgggtggaatcttgtaaaactgcattcaggaaaagatgttttctttattccacccgaaaaatgcgataccctactatgcgatattggagaaagctcaccaaatcccacgatagaagaggggcggactctaagagtccttaaaatggttgaaccttggttacgtggtaaccaattctgtattaagatattgaacccttatatgccatcggtagtagaaaccctagaacagatgcaaaggaagcatggaggcatgctagttcgcaacccgctatcacgaaacagtacacacgaaatgtattgggttagttgcgggacgggaaatattgtctctgcagtcaatatgacctcacgcatgctattaaatcgctttaccatggcccacaggaaaccaacatatgaaagagacgttgatttaggcgcgggaacacgtcacgttgctgtagagccagaggtagcaaatctagatataatcggtcaaagaatagaaaatattaaacatgaacacaaatccacctggcactatgatgaagataatccgtataagacatgggcatatcacggtagctatgaagtaaaaccctctgggagcgcatcttctatggtaaatggtgttgtaaaattactaacaaaaccatgggatgtaataccaatggtaacacaaattgccatgacagatacaactccttttggccaacagcgagtctttaaagaaaaggtggacacgcgcactccaaaggcaaagcgaggtacagctcaaatcatggaagtgaccgcaaaatggctttggggatttttgtcacgcaataagaaaccacgaatatgtactagggaggagtttacaagaaaggttagatcaaacgcagctattggcgcggttttcgtcgatgaaaatcaatggaatagcgcaaaagaagctgtagaggacgagagattctgggatcttgtgcatagagaaagagaacttcacaaacagggtaaatgcgcaacgtgtgtttacaacatgatgggtaaacgtgagaagaaactcggtgagttcggaaaagcaaaggggagcagagcaatatggtacatgtggttgggagcccgcttccttgaatttgaagcgttaggattcatgaacgaagatcattggtttagcagagaaaattcactgtctggagtagaaggagaaggattacacaaacttggatatatattaagagacatcagcaaaataccaggaggtaatatgtatgctgatgacacagccggatgggacacgcgaataaccgaagatgacctccagaatgaagcacgcataacagacatcatggaaccagagcatgcactcctcgctaagtcaatattcaaattaacgtatcaaaataaggttgttagagtccaaaggcccgctaagaatggaaccgttatggatgtaatctcccgacgcgatcaaagaggatcgggacaagttgggacgtacgggctcaacacatttacaaacatggaagcgcaactaataaggcaaatggaatccgagggaatattcagcccctcggagttggaaactccgaatctagcagaaagggttctcgattggttggagaaatatggcgtagaaaggttaaaaagaatggcaatttcaggtgatgattgcgttgtaaaacccatagatgacagattcgcaactgcacttaccgccttaaacgatatgggcaaagtaagaaaggacattccacagtgggagcctagtaaaggctggaatgattggcaacaagtaccattttgctcgcatcatttccatcaactaataatgaaggacgggcgagaaattgtagtgccatgcagaaaccaggatgagctagtgggtagggctcgagttagccaaggagcaggctggagtttacgcgaaacagcgtgcctaggaaaatcttatgcgcaaatgtggcaattaatgtatttccatcgccgagaccttcgattggctgcaaacgcaatttgcagcgccgttccagttgattggatcccaactagccggactacatggagtattcatgcacatcaccaatggatgacaacagaagatatgttgagtgtatggaaccgcgtctggatagaagaaaatccatggatggaagacaagacgcatattagttcatggggagacgttccttatttgggaaaacgcgaggatcaatggtgtgggagtttaatcggattaacagcaagagcaacatgggcaacaaacatccaagttgctattaaccaggtaaggagattaatcgggaacgaaaattacttggactatatgacatctatgaaaagatttaagaacgaatcggatcccgaaggcgcactatggtag

SEQ ID NO: 21606 - RNA, 9879 nt, synthetic construct
  misc_feature 1..9879: note = derived and/or modified CDS sequence (opt6) from DENV-1__FJ410278__SS-prME
  source 1..9879: mol_type = other RNA
agcgtaactatgcttttaatgctaatgccgacagctttagcatttcatcttactacaagaggaggagagccgcatatgatagtttccaaacaggaaagaggaaaaagccttctctttaaaacatcagcgggagtgaatatgtgcacacttatagcaatggatcttggtgaactctgtgaggacacaatgacatataaatgcccacggattactgagactgaacctgatgacgtcgattgctggtgtaatgcgactgacacatgggtaacttacggaacctgctcacagacaggtgaacacagaagggataaacggtctgttgcattagctccacacgtgggccttggacttgaaacacgtacggaaacatggatgtcaagcgaaggcgcttggaaacaaatacaacgagttgaaacatgggctctacgacatcctggatttacagtcattgcacttttcctagctcacgctataggtacgagtataacgcagaaaggtatcatttttattttattaatgctagtaactcctagcatggcaatgcgttgtgtgggaatagggtctagagacttcgtagaagggttatcaggagctacatgggtggatgtagtcttagaacacggcagttgtgtaacaactatggcaaaagacaagccaacgttagacattgagctattaaaaacggaggtaacaaatcccgcggttctccgaaaattgtgcattgaggcaaagataagtaatacaactacagattctaggtgtcccacacaaggagaagctacgttggttgaagaacaagatgccaattttgtttgtcgtcgcacttttgtcgaccggggatgggggaacggttgcggactgtttggtaaggggagcttgataacatgcgcgaaatttaaatgcgtgaccaaacttgaaggtaaaatagttcaatacgaaaatctaaagtatagtgttattgtcacggtgcatactggcgaccaacaccaagtaggaaatgaaagtactgaacatgggacaacagcgacgataactccacaggcacctactactgaaatacagcttacagactacggcgctttgacgcttgactgttcaccgagaactggattagacttcaatgagatggttcttctaactatgaaagagaaaagctggttggtacataaacagtggtttttagatttgcctttaccatggacttcgggagcatcaactagccaagaaacttggaaccgacaagatctattggtcaccttcaagacagcccatgccaagaaacaagaggttgtggtgttgggaagccaggaaggagcaatgcacactgctctcaccggggcaaccgaaatacaaaccagcggaacaacgactattttcgctggacatttaaaatgtcgattaaaaatggacaaactcactctcaaaggaatgtcatatgtaatgtgtactggttcttttaagctggaaaaagaagtagctgaaactcaacacgggacagtattagtacaaataaaatacgaaggaacggacgcgccatgtaaaatccccttctcaacacaagatgaaaaaggagtcactcaaaatggaagattaataacagcgaacccaatagtaacagacaaggaaaaaccagtcaatatagaagcggaaccgcccttcggagaaagctatatagtgattggcgccggtgagaaggctctgaaattatcttggttcaaaaagggatcatcaataggtaaaatgttcgaggcaacagctagaggtgcaaggagaatggcaattttgggagacacagcatgggattttggatcgattggaggagtcttcacaagtgttgggaagttagttcaccaaatctttggcaccgcttatggcgttctgttttcgggggtttcctggacgatgaaaatcggaataggtgtgctcctaacgtggttaggtctaaacagtagaagtacgagcctcagcatgacgtgcatagcggtaggactaattacattatatttgggcgtgatggttcaagcagattcaggttgtgtcataaattggaagggacgagaattaaagtgtggtagtgggatatttgttactaacgaagtacatacatggacagaacaatataaatttcaagcggacagtccaaaaagattaagtgcggccattggcaaggcttgggaggaaggcgtatgtggaatacgaagtgccactagattggagaacataatgtggaaacagatttcgaacgaactaaatcacatcttacttgaaaacgatatgaagtttacggtagtagtgggagacgttgcgggaatccttgcgcaaggcaagaaaatgattcgaccccaacctatggagtacaagtattcatggaagtcgtggggcaaggcaaaaattataggggcggatgtacaaaatacgacatttattatagatggtccaaatactccagaatgtccagatgaccaaagagcttggaatatatgggaagtagaggactatgggtttggaattttcacgacgaacatctggcttaagttacgagatagttatacccaagtctgcgatcataggttgatgagcgcagcaattaaggacagcaaggcagtacacgcagatatgggatattggattgaaagtgagaagaacgaaacttggaaattagcacgagcatcgttcatagaggtaaagacatgtatatggccaaagagtcacacactttggtcaaatggagtcctggagtcggaaatgatcatcccaaaaatctatggaggcccaatatctcaacataactatagaccaggttatttcactcaggcagcgggtccgtggcatctaggcaaactagaactggatttcgatctctgtgaaggaactaccgtagtagtcgacgaacattgcggcaacaggggccctagtcttagaacaacaactgtaacaggaaagataattcatgaatggtgctgtcgaagctgcaccctaccaccgcttcgatttaggggtgaagacggttgttggtatggaatggagatacgcccagtaaaagaaaaagaagaaaatctcgttaaatctatggtatcagctggaagcggcgaagtagatagttttagtttaggtctattgtgcattagcataatgatagaggaagtcatgcgatcaagatggtctaggagaatgctgatgacaggtacacttgcagtattctttctattaataatggggcagttaacgtggaacgatctaataagattgtgcatcatggtaggagcaaacgccagcgaccgtatgggtatgggtacaacgtacctagccctaatggctacttttaagatgagaccaatgtttgctgtcggattattatttcggagattgacatctcgagaagtccttctcttaacgataggtttatccttagtagcaagcgttgagctacctaattctctagaggaattaggcgacggactagcaatgggaataatgattctcaaattgctaacagatttccagagccaccaattgtgggctaccttattatccttaacttttataaaaacaacattctctctgcactatgcatggaagacaatggcaatggtactaagcatagtttcattgtttccactatgtctaagcaccacgagccagaaaacgacatggttacctgtacttttaggctctctggggtgtaagcctctaactatgttcctaatcgcagagaataagatttggggaagaagaagttggccgctcaatgagggaataatggctgttggtatagtatctatactcctaagtagcctactcaaaaatgatgtccccctagcaggtccactaattgcgggcggaatgctgatagcatgttatgttataagtgggtcaagtgctgacttaagtctagaaaaagctgcagaagtcagctgggaggaagaagcggaacacagcggtgcttcacataacatcctagtcgaagtccaagatgacgggaccatgaaaattaaagatgaagagagggatgatacacttacaatactccttaaggctacactacttgcagtaagtggcgtctatcctctttcaataccagcaactttattcgtttggtacttctggcaacgtaagaaacaaaggagtggcgtactgtgggatacaccgagtcctccggaggtagagagagcagttctagacgatgggatatatcgaataatgcaaagagggcttttaggtagaagtcaagttggggtaggtgtattccaagaaaacgtattccacacaatgtggcatgtcacgagaggagcagtactaatgtaccagggaaaaaggcttgaaccctcttgggcgtccgtgaagaaagatttaatatcatacggcggtggatggcgacttcaaggaagctggaacactggagaggaagtacaggtcatagcagtagaaccaggcaaaaatcccaaaaatgttcagacagcacctggtactttcaaaacgcctgagggtgaagttggcgctattgcgctagattttaaaccaggaacaagtgggtctccaatagtaaatagagaaggaaaaattgtgggactatacggaaatggcgtagtaactacttctgggacatacgtgtcggcaatagcacaagccaaagcatcacaagaaggacctctcccagaaattgaggatgaagtttttcgaaaacgcaatctaaccattatggacctacacccaggatcgggaaaaacccgaagatatctaccagcaattgtacgtgaagctataaaaagaaaacttagaacgctcatactggcacctacaagggtcgtcgcatccgaaatggccgaagcattaaaagggatgccaattagatatcaaacgaccgccgtcaaatccgaacacactggtaaagagattgtagatttaatgtgccatgcaacttttactatgagattactctccccagtacgcgtaccaaattacaacatgataatcatggacgaagcccattttactgacccgtctagtatagccgctaggggttacatttcaaccagagtcgggatgggagaagccgccgctattttcatgaccgcaactcctccaggtagcgtagaagcgtttccccaatcaaacgcagtcattcaagatgaggaacgtgatataccagaaagatcgtggaactctggatatgagtggattaccgattttccaggtaaaacggtatggttcgttccaagtattaagtcaggtaacgatatcgcaaactgccttcgtaaaaatggtaaacgtgttattcaattatcccgcaaaacttttgacaccgagtatcagaaaaccaaaaataatgattgggattatgttgtaacgacagacattagtgaaatgggcgcaaacttccgagccgatagagtaatcgacccaagaaggtgcttaaaaccagtaatcctcaaggacggtcccgaaagagtaatattagccggaccaatgccagtcactgtagcatctgccgcccaacgcagaggtagaatcgggaggaatcacaacaaggaaggagaccaatacatatatatgggtcaacctttgaataacgacgaggaccatgcccactggactgaagcgaagatgctactggacaatataaacacgccagagggaataataccagcactatttgaacctgaacgcgagaaaagtgctgctatcgacggtgaatacagattaagaggcgaggcaagaaaaacattcgttgaattaatgaggagaggggacttaccggtttggctaagttacaaagttgcttcggaaggtttccaatacagtgatagaagatggtgctttgatggtgaaaggaataaccaggtgttggaagagaatatggatgtggaaatctggacaaaagaaggggaaaggaagaaactccgcccaagatggttagatgcaagaacatatagtgacccattagcactacgagaatttaaagagttcgctgcaggtagaagaagtgtctcaggagatttgatactagagataggaaaattaccccaacatctaacacaaagagcacaaaacgctttagacaatttggtaatgttacacaatagcgagcaagggggacgggcgtacagacacgcaatggaggaacttccggacacgattgaaacacttatgctactggctcttatagcagttctaacgggaggggtcacactatttttcctatcaggaagaggactgggaaaaacatcaatagggctattatgtgtcatggcgtcatcagtacttttatggatggcatcagtcgaaccgcactggattgcggctagtattatattagaatttttcttaatggttctactaataccggaaccagacagacaacgaacgcctcaagataatcaacttgcctacgtcgtaatcggtctattatttatgatccttactgtagcagctaatgagatgggactactagaaacgaccaagaaagacctaggaattggacatgttgctgtagaaaatcatcaccacgcagcaatgttagacgtggatctccaccccgccagcgcctggacattatacgcagtagctacaacaatcattacacccatgatgaggcatacgattgagaatactacagctaatatatcgttaacagcaatagcaaatcaagctgcaatactaatgggtcttgataaaggttggcctatatctaaaatggacattggggttccattattggccctgggttgctactcgcaagtaaatccccttacgctcactgcagcagtactgatgctagtagcacattatgctattataggaccaggtctccaagcaaaagctactcgggaggcacagaaaagaactgcagctggtataatgaaaaatccaactgtagacgggatcgtagcaatagacctagaccccgttgtatacgatgctaaattcgaaaagcagctgggacaaatcatgctgttaatactgtgcacatcacagattttgttaatgaggactacgtgggccttatgcgaatccatcactttagctactggtccattaacaactttatgggaaggctctcctggaaagttctggaacacaactattgcagtgagtatggcaaacattttcaggggaagctacttggccggagcaggcctagccttctcactcatgaagtctcttggtggtgggagaagaggaactggagctcagggtgagacgctaggagagaagtggaagcgccaattaaatcagctctctaaaagtgaatttaacacatacaagagaagtggcataatggaggtagacaggtcagaagcaaaagaaggattaaagcgcggggagacaactaaacatgctgttagtagaggcacagcgaaactcagatggttcgtggagcgtaatttagttaaaccagaggggaaagttatcgatttgggctgtggacggggtggctggagttactattgcgccggtttgaagaaagttacagaagtaaaaggttatacaaaagggggccctgggcatgaagaacccataccgatggccacatatggatggaatctagtcaaactccactcagggaaagacgtcttcttcataccaccggagaaatgcgacacactattatgcgatattggagagagcagcccgaaccctactattgaagaggggcgaaccctaagagtacttaaaatggtcgagccttggttacgcggaaaccaattctgtataaaaatcttaaacccttacatgccttctgttgtagaaactttagaacaaatgcaaagaaagcatggtggaatgctagtgcggaaccctttgtctagaaattctacacacgagatgtattgggtatcatgtggcactggcaatatagtaagtgcagttaatatgacaagtagaatgcttcttaacagatttactatggcacatagaaaaccaacatacgagagagacgttgatttaggtgccggaacaaggcatgttgctgttgaaccagaagttgctaatctcgatatcattggccaacgtattgagaacatcaaacatgaacataagtcaacctggcactatgatgaagataatccttacaagacatgggcataccatggaagttatgaggtcaaaccaagtggatctgcttcatctatggtgaacggagtagttaaacttttaacaaaaccttgggatgtaataccaatggtgacgcaaattgcgatgaccgacaccacacccttcgggcaacagagagttttcaaagaaaaggtagatacgcgaacaccaaaagctaagaggggtaccgcacaaatcatggaggtgacagccaaatggctgtggggatttttgtctcgaaacaagaagccaaggatatgcacaagggaagaatttaccagaaaggttagatctaacgccgctataggagccgtctttgtggacgaaaatcagtggaactctgctaaggaagcggtcgaagatgaacgattttgggatcttgtgcatagagaaagagaactgcacaagcaaggaaaatgcgctacatgtgtctataacatgatggggaagcgggaaaagaaactcggggaatttggaaaagcgaaaggtagtagagcgatatggtatatgtggttgggtgcccggtttctagagtttgaggctctagggttcatgaacgaagaccactggtttagtcgtgaaaattcgctatcgggtgtcgaaggagaaggcttacacaaactcggctatatactacgtgatatcagtaaaataccgggcggaaatatgtatgcagacgatacagccgggtgggataccaggattacagaagatgatctccagaacgaagcccgtataacagacattatggaaccagaacacgcattattggcaaaaagtatcttcaaactcacgtaccaaaataaagttgttagagttcaaaggcccgcgaaaaacggaacagtaatggatgtgattagtagacgtgaccagcgtggttctggtcaagtgggaacatatggactcaataccttcactaacatggaagcacaattaataagacagatggagagcgagggtatttttagtcctagcgaactcgaaacacccaacttggctgagagagtactcgactggctcgaaaaatatggtgtggaacgattaaagagaatggcgatatcaggagatgattgtgttgtgaagccaatagacgatagattcgctacggcattaacggcgctaaacgatatggggaaagtcagaaaagatatcccccaatgggaaccgtcaaaagggtggaatgattggcaacaagtaccgttttgttcacatcattttcaccagttaataatgaaagacgggagggaaatcgtagtgccatgtagaaatcaggatgagttagttggacgagctcgcgtgtcgcagggtgccggttggagtctgagagaaacagcatgccttggaaagtcatacgctcagatgtggcaactgatgtattttcacagaagggatctaagactagcagccaacgcaatatgcagtgccgtacctgtagactggatcccaacttcaagaactacgtggtctattcacgctcaccatcaatggatgacgacggaagacatgctatcggtatggaatagagtatggatcgaggaaaatccatggatggaagataaaacacatatcagtagttggggtgatgtaccatacttaggtaagcgtgaggatcaatggtgcggtagccttatcgggctgacagcacgagccacctgggcaaccaatatccaagtagctataaatcaagtccgacgtctcataggcaacgaaaattatttagattatatgaccagcatgaaaagattcaaaaatgaatccgatccagagggtgctctttggtaa

SEQ ID NO: 21607 - RNA, 9879 nt, synthetic construct
  misc_feature 1..9879: note = derived and/or modified CDS sequence (opt6) from DENV-1__FJ410279__SS-prME
  source 1..9879: mol_type = other RNA
tccgtcacaatgctacttatgttaatgcccactgcactcgcgtttcatctaacaacaagaggtggagaacctcacatgatagtgagtaaacaagaaagaggtaaatcgttgctgtttaaaacaagtgccggtgtaaatatgtgtactcttatcgccatggatttgggcgaattttgtgaagataccatgacatacaaatgtccaaggatcacagaagcagaaccggacgatgtggattgttggtgcaacgcaaccgatacttgggtaacttacggaacttgctcccaaacaggcgaacacagacgagataaacgatcagtagccttagctccgcatgtaggcttgggattagaaacgcgaacagaaacgtggatgtcaagtgagggcgcttggaaacagatccaacgggtagaaacttgggcactacgacaccctggctttacggtaatagctctatttcttgcccatgctataggcacgtccatcactcaaaaagggataatctttattctcctcatgctcgtcacaccaagtatggcgatgaggtgcgtaggaatcggttcaagagattttgtagagggattaagcggggccacgtgggttgacgtggtactggaacatggtagttgtgtaactacaatggctaaagataaaccaacactggatatcgaactcttaaaaacagaagtaacaaatcccgcggttctccggaaattatgcattgaagctaaaattagtaatacaacaaccgacagccgatgtcctacacaaggtgaggcaacactcgttgaggaacaagatgcgaattttgtttgcaggcgaacctttgtggatcgcgggtggggtaatggatgtggtttattcgggaaaggatctttaataacatgcgcgaaatttaaatgcgtaactaagttagaaggaaagatcgtacaatatgaaaatctcaaatattccgtgattgtaactgtccatacaggtgaccaacatcaagtagggaatgaatcaacagaacatggaaccacagcgaccataacgcctcaagccccttctaccgagatccaactcacagattacggcgcattaaccctggattgtagcccccgaactggtttagattttaatgaaatggtactccttacaatgaaagaaaaatcttggttggtacacaagcaatggtttctagatctccctcttccatggacttcaggagcatctacatcccaagaaacgtggaatagacaggatcttctagtaacttttaaaacagcacacgccaagaaacaagaagtagtggttttgggatcccaagaaggagcaatgcataccgcactgacaggagcgacggaaatacaaacatctggtacaactacgatttttgctggacatttgaagtgcagactgaaaatggacaagctcacgttaaaaggaatgtcatatgtaatgtgtactggatcatttaagttggaaaaggaagtagctgaaacacaacatggaaccgtattagtgcaaatcaaatacgaaggaaccgatgcaccctgcaaaatcccattttccacccaagatgaaaaaggcgttacacaaaatggcagacttataacagcgaatccaatcgtaacagacaaagaaaaaccagtcaatattgaagcagaaccaccctttggtgagtcatacatagttatcggtgctggagagaaggctttaaaattaagctggtttaagaaaggatcatcaattggcaaaatgttcgaagcaaccgcacggggcgctagaaggatggcgatactcggggacaccgcatgggattttggatcaatcggcggagttttcacaagtgtcggaaaattagtacaccaaatattcggaacggcttacggagtactatttagcggcgtaagctggacaatgaaaatcggaataggagtactcttaacgtggcttggtctcaacagtagatcgacatctctaagcatgacgtgtatagctgtaggtctggtaaccctctatcttggggttatggtccaggcagatagtggatgtgttattaattggaaaggtagagaattaaaatgtgggagtggtatttttgttactaacgaagttcacacatggaccgagcagtataaattccaggcggattctcccaaaagattgagcgccgccataggcaaggcctgggaggagggggtctgcgggataagaagcgcaacaagattagagaatataatgtggaaacaaatatccaacgagttaaatcatatacttctagagaacgatatgaaatttactgtggtagtaggtgatgtcgcaggtattctcgcacagggaaagaaaatgatccgccctcaacctatggaatacaaatattcctggaaatcctggggaaaagcaaaaattataggagccgacgtacaaaatacgacttttattattgacggtccaaatacaccagaatgtccagatgatcagcgagcatggaatatatgggaggtcgaagactatggttttggtattttcactacgaatatatggttaaaattacgtgactcatatactcaggtttgtgaccacaggctcatgtcagctgctataaaggactcaaaggcggtgcatgccgacatgggatattggattgagagcgagaaaaatgagacctggaaactagcgcgtgcatcctttatagaggtcaaaacctgtatttggcctaagagccatactctatggtcgaatggcgtcctcgagagcgaaatgattattcctaaaatctacggtggaccaatatcgcagcacaactatcgacccggctattttactcaaacggccggaccatggcacttaggaaagctagaactagattttgacttatgtgaaggtaccacggtagtcgtggatgaacactgtggaaataggggaccctctttaagaaccacaactgtaacgggcaagatcattcatgaatggtgttgtagatcttgtaccctaccacctcttagatttaaaggagaagacggttgttggtacggaatggaaatccgacccgtaaaagaaaaggaagaaaacctcgttaagagtatggtctccgcaggaagcggcgaagtcgattcattcagtctcgggttattatgtatttcaattatgatcgaagaagtaatgagaagtaggtggtcccgtaaaatgttgatgacagggacgctggcagtattctttctgttaataatggggcagctaacatggaacgacctgattagactctgtatcatggttggcgcgaatgcatcagacagaatgggtatgggcaccacgtatttagcattgatggctacattcaaaatgagacccatgtttgccgtcgggctgcttttcaggcgactaacttcaagggaagttttattattgacgatagggttatccttagtagcctctgtagagttaccaaactctttagaagaactgggggatggattggcaatggggataatgatcctcaagttgttaaccgattttcaatctcaccaactatgggcaacgttattgtctctaacattcatcaaaacaacattcagtctgcactacgcatggaaaacaatggccatggtactatctatcgtgagcttattccctttatgtttatcaactacctcccagaaaactacctggttaccggttttgttaggctcattaggatgcaaaccgctgacaatgttcctaattgccgaaaataaaatatggggaaggaaaagttggcctctcaatgaaggaataatggcagtaggtatagtcagcatactcctatcaagtttattgaagaacgacgtacctttagcaggaccccttatcgccggtgggatgcttattgcatgttacgtaatatcagggtcaagtgcagacctaagcctggagaaagctgctgaagtaagttgggaagaagaagcggagcactcgggcgcctctcacaacatactcgtagaagtacaagatgatggtacaatgaaaatcaaagatgaagagagggacgatactctgactatactcttgaaagctactctattggcagtctctggagtttaccctttatcaataccagcaacactatttttatggtatttctggcaaaagaagaaacaacgaagtggagtactatgggatacaccatcccctcccgaggtggaaagggcggtattggacgatggtatatatagaataatgcaacgtggattgttaggaagaagtcaggtgggcgttggcgtgtttcaagaaaatgtatttcatacaatgtggcacgtcacgagaggggcagttttaatgtaccaaggaaaacgtctagagccatcatgggcaagcgtaaagaaagatctaatatcttacggtggcggttggcgattgcagggaagctggaacactggagaggaggtacaggtgatagcagttgagcctggcaaaaaccctaaaaatgttcaaacagcaccaggtactttcaaaacatctgagggtgaggtaggtgccatagcgctagatttcaaaccgggaacatctggttcaccgattgttaatcgagaagggaagatagtgggactatatggaaatggtgtcgtaacgacaagtggcacttatgtatcagcaatagcacaggccaaagcaagtcaggaaggtcctttaccagaaatagaagatgaagttttcagaaagagaaacctaacgataatggatctacatcccgggtctggtaaaacgcgtaggtacttaccagcaatcgtcagagaagcaatcaaaagaaaattgaggacattgatcctagcacccactagagtagtggcctcggaaatggcagaagcccttaaagggatgcctattcgatatcaaacaacggccgttaagagcgagcacacaggcaaagagatagtggatctcatgtgtcacgcaacgttcaccatgagacttttatcacctgttcgcgtacctaactacaacatgataataatggatgaagcccactttacagacccgtcttcaatagcagctagaggatacatctcaacgagagtcgggatgggtgaagcggctgcgatctttatgaccgcaacccctcctggatccgttgaagcgttccctcagagcaatgcagtcatccaagacgaagaacgggacattcctgaaagatcatggaactcggggtacgagtggataacagattttcccggaaagacggtatggtttgtgccaagtattaaatcaggaaatgacatagccaattgtttgaggaagaatggaaaacgtgtaattcaattatccagaaaaacatttgacactgaatatcagaaaacgaaaaacaatgactgggattatgtagtgaccaccgacattagcgaaatgggagctaatttcagagccgatagagtaatagacccgcggagatgtttgaagccagttatacttaaagacggacctgaacgcgtaatattggcagggccgatgcctgtaacagttgccagtgcagcacaaagacgaggtcgaatcggcagaaaccacaacaaagaaggcgatcaatatatatacatgggacaaccattaaataatgacgaagaccatgcacactggactgaagctaaaatgttactcgataacatcaatacccccgaaggaataataccagctctatttgaaccagaacgggaaaaatcagcagctatagacggtgaatatcgtcttcgaggcgaagcacgaaaaacattcgtagagttaatgcgtaggggagatcttcctgtctggttaagctataaagtagcgagtgaaggttttcaatattctgatagaaggtggtgcttcgatggcgaacggaataatcaagttctagaagagaatatggacgtggaaatttggacaaaagaaggtgaacggaagaaacttcgcccacgctggcttgacgctagagtatacagtgatccactagcgctacgtgagttcaaggaatttgcagcgggcagaagatcagtaagtggagacttaatattggaaataggaaaattaccgcagcatttaacgcaaagagcgcaaaatgccttagacaacttagttatgcttcataatagcgaacaaggtgggagggcatatagacatgcaatggaggaattaccagatacaatagaaacgctaatgttactagcgttaatcgcggtattaactggtggagtcacattattctttttaagtggaagaggcttagggaagacatcaataggcttactatgcgtcatggcttcttctgtactcttatggatggcttctgtagagccacattggatagccgcgagtattatattagaatttttcttgatggtattacttatcccggaaccagatcgacaaagaacaccacaggacaatcagctagcttacgttgtgattggtttattattcatgattttaaccgtagccgcaaatgagatgggattgctagaaacaactaagaaagacctcggaattggacacgttgcagtagaaaaccatcaccatgcagcgatgcttgatgttgacctacatcctgcctcggcatggacactctatgccgtagcaacaacaatcatcactccaatgatgcgacatacaatagagaacacaaccgcaaatataagtctaactgcaatagctaaccaagcagcaattttgatgggcctggacaaaggatggcctatatcaaagatggatattggagtacccctacttgcgcttggatgttatagtcaggtcaatccattaactctgacagcagcagtgctaatgctcgtcgcacattacgcgattataggccccggccttcaagccaaagcaactagagaagcccagaaaagaactgctgccggtatcatgaagaatccaaccgttgatggtatagtagcgatagacttagatccagtcgtatacgacgcaaaattcgagaaacaattaggccaaataatgctgctaatattatgcacttcacaaatactcctaatgcgtacaacatgggccctgtgtgagtctattacacttgctactggtcctttaacgacattatgggaaggatcgccggggaaattctggaacacaacgatagcagtctccatggcaaacatctttagagggtcatatcttgctggggccggtttagcttttagtctaatgaaatccttgggtggtggaaggagaggaacaggagcccaaggagaaactctaggggagaaatggaaacgtcaactaaatcaactttcaaaatctgagttcaatacatataaacgtagtggcatcatggaagtggacaggagcgaagcaaaggaagggcttaaaaggggtgaaacaacaaaacatgctgtatctagaggtactgcaaaattacgctggtttgtagaacgtaatttagtgaaaccagaagggaaggtgatagacctcggatgcgggcgagggggttggagttactattgtgccggactgaagaaagtaaccgaggtaaaaggttatacgaaaggcggtcccggtcacgaggagcctataccaatggcgacatatggttggaatctagtaaagttacacagcgggaaagacgtattcttcataccgccggaaaagtgcgacacattactatgcgatataggcgaatcttcgccaaatcctacaattgaagaaggaagaacgttgagagttttaaaaatggttgaaccgtggctacgtgggaatcaattctgtataaagatattaaatccctacatgccatcagtagtggaaacacttgaacaaatgcagagaaagcatgggggaatgttagtacgaaatccgttaagtcgaaacagcacacacgaaatgtactgggtatcgtgtgggacggggaatatagtttccgctgtcaatatgacgagccgaatgctattaaacaggtttacaatggcgcaccggaaaccaacatacgaaagggatgttgacttaggagctggaacacgtcatgtcgctgtagagcctgaggtcgcgaatcttgatatcatcggccaacgcatagaaaatatcaagcacgaacataaatcgacctggcactacgatgaggacaatccttataagacatgggcataccatgggagttacgaagtcaagccatcagggagtgcttcaagtatggtaaacggggtcgtgaaattgttaaccaaaccttgggacgtaataccgatggttacacaaattgcaatgactgacacaactccgttcggacaacaaagagtatttaaagaaaaagttgataccagaacacccaaagccaaacgtggcacagctcaaattatggaggttacagccaaatggctctggggctttttaagcagaaataagaaaccgcgaatttgcacgagagaagaatttaccagaaaggtccgatcaaacgctgccataggggcggtatttgttgacgaaaaccaatggaactccgctaaagaagccgttgaggatgagcgattttgggatttagttcaccgagaaagggaattacataaacaaggtaaatgtgcaacatgtgtgtacaacatgatgggaaaaagagagaagaaactcggtgaatttggtaaggcgaaaggtagtagagcaatttggtatatgtggctcggagctagatttttagagtttgaagcccttggattcatgaacgaggatcactggtttagcagagaaaactctttatcaggagtagaaggagaaggattacataaattgggatatattttacgagatattagtaaaattccaggaggaaatatgtatgcagacgatactgctggctgggacaccagaataacggaagatgatttacaaaacgaagcaaaaataacggatattatggaaccggaacatgcgctactagctaaatcaatttttaaactaacttatcagaacaaagtagtccgtgtccagaggccagctaaaaacggtaccgtaatggacgttataagtcgaagagatcaaagaggtagcggacaggttggcacatacggattaaatacattcaccaacatggaggcacaactaatccgtcaaatggagagcgaaggaatattcagtccgtcagaattagaaacgccaaatctcgcaggtcgagtgttagactggttggagaaacatggcgtagaaagattaaaaagaatggcgatatctggagatgattgcgtggtaaaaccaattgacgacagatttgcaaccgcccttactgctctaaacgacatgggaaaggttcgaaaagatatcccgcagtgggaacccagcaaaggttggaacgactggcagcaagtccctttttgttcacaccacttccatcagttaatcatgaaagacggacgagaaattgtagtaccgtgtagaaatcaagatgagctcgtaggacgtgcacgcgtatcccaaggcgcaggttggtcactaagagaaacggcttgcctgggaaaatcttacgcacaaatgtggcaattgatgtacttccacagaagagatctaagactcgcggcaaatgcgatttgttctgcagttcctgttgattgggtaccaacatctaggacaacgtggagtatacatgcccatcatcaatggatgactacagaagacatgctgagtgtatggaacagagtctggatcgaagagaatccttggatggaagacaaaacccatatatcgtcatggggagacgtaccatatttggggaagcgtgaagatcaatggtgcggatctttgatcggcttaacggcgagagctacgtgggcaacaaatatccaggtcgcaattaaccaagtaagaagattaatagggaacgaaaattatctggactatatgacgtcgatgaaacgattcaaaaacgaaagcgatcctgaaggggcgctctggtaa

SEQ ID NO: 21608 - RNA, 9879 nt, synthetic construct
  misc_feature 1..9879: note = derived and/or modified CDS sequence (opt6) from DENV-1__FJ410283__SS-prME
  source 1..9879: mol_type = other RNA
agcgtaactatgttactaatgctgatgccaacagcattagcatttcacctgactacgagagggggtgaacctcatatgattgtaagtaaacaagaaagaggaaaaagtctactttttaaaacgtctgctggtgttaatatgtgtactttaattgcaatggatctaggtgaattatgcgaagacacaatgacatacaaatgcccacggatcacagaaaccgaacccgacgatgttgactgttggtgcaacgcaacagacacttgggttacatatggaacatgttcacaaacaggagaacacagacgagacaaaagatcagtagcactagctcctcacgtagggttaggacttgagacgcgaactgaaacctggatgagctccgaaggagcatggaaacagatccaacgagttgaaacgtgggcactacgccaccccgggtttacagtaatcgcgttgttcttagcacatgctatcggcacatctataacccagaaaggaataatctttatcttattaatgttggtaaccccatcaatggcaatgcgatgcgtaggaatcggtagtagggatttcgtagaaggtttgagcggtgcaacttgggtggatgtggtattagaacatgggagctgtgtgactactatggcgaaagataaaccaactttagatatcgaactattaaaaacggaagttacaaaccctgctgtattaaggaaattatgtatcgaagctaaaatcagcaatacgacaacagactcaagatgtcctacgcaaggagaagcaacattagtagaagaacaggatgcaaatttcgtatgtagacgaactttcgtagatagggggtggggcaatggttgtggactattcggcaaaggttcactaatcacatgtgcaaaatttaaatgcgtaacgaaattagaagggaaaatagttcaatacgaaaatctgaaatattcggttatagtaactgtccacaccggggatcaacatcaggttggcaacgaatccacggaacacggaacaactgccaccatcactccacaagcacccactacagaaatacaactaacagattacggggcccttacgttagactgcagtcctagaacgggcttagacttcaatgaaatggtactactaacgatgaaagagaaaagttggctagtccacaaacaatggtttctagacctccctctcccgtggacaagcggggcaagcactagccaggagacttggaataggcaagatttactcgtaacctttaaaaccgcccacgcaaagaaacaggaggtcgtcgtactcggtagccaagaaggagcgatgcatactgcactgacaggcgcaactgaaattcagacatcgggaacaacgacgatatttgcgggtcatttaaaatgtaggttaaaaatggataaattaaccttaaaaggaatgagctacgttatgtgtaccggatccttcaaactagagaaggaactagccgaaactcaacacggtaccgtattagtacaaatcaaatatgagggaaccgatgcgccatgtaaaatccctttcagtacacaagatgaaaaaggcgtaacacaaaacggtcgcctcatcacagcaaacccaatcgtgacagacaaagagaaacccgtgaatatagaagcagagcccccgtttggtgaatcctacattgttataggggctggcgagaaagcactcaaactatcttggttcaagaaaggctcatcgataggtaagatgttcgaagcaaccgcgcgaggagcacgaaggatggcgatcctgggcgatactgcttgggatttcggtagtataggtggggtttttacaagtgcaggtaagttagttcaccagatattcggtacagcgtatggtgttctttttagcggagtatcctggactatgaaaataggaatcggagtactcttaacatggctagggctcaacagccgatctacaagtttaagcatgacttgtatagctgtaggtctagttaccctttatcttggcgtaatggttcaagctgactcaggttgtgtcataaattggaagggtcgtgagctaaaatgcggaagtggaatttttgttacgaatgaagtccacacatggactgagcaatataaatttcaagctgatagtccgaaacgtttgagtgcagccataggcaaagcatgggaagaaggagtgtgtggcatacgctccgctacaagattggagaatataatgtggaagcaaattagtaacgaattgaaccatatactcttagaaaatgacatgaagttcacagttgttgtaggagatgtagcaggtatactagcacaaggaaagaaaatgattcggccacaaccgatggaatacaagtatagctggaaaagttggggtaaggccaagataattggtgcagatgtccaaaatacaacttttattatcgatggaccaaacacacctgaatgtcctgacgaccagagggcatggaatatatgggaagtcgaggactatgggtttggaatcttcacaactaacatatggctaaaacttagggattcatatactcaggtctgcgaccatagactcatgagcgcggctatcaaggattcaaaagcagtacatgccgatatgggatactggattgaaagtgagaaaaatgaaacatggaaattagctagagcaagttttatcgaagttaaaacgtgtatctggccgaaatcacacacgctatggtctaatggcgttctagaatcagagatgatcatccctaaaatatacggaggacccatatcgcagcataattacagaccaggttacttcacgcaaactgctgggccatggcacttaggtaagctagagctcgatttcgacttatgtgaaggcaccacagtggttgtagatgaacattgtggtaaccgaggaccgtctctaaggacgacaactgtaactggtaagataattcacgaatggtgctgtagatcctgcacactaccgcctctaagattccgcggggaggatggctgctggtacggaatggaaatacggcctgtaaaagaaaaagaagagaacctagtaaagagcatggtatcagcaggttcgggtgaagtagacagcttttcactaggcttactttgcatatcaattatgatagaagaagtaatgcggtcacgctggtctcgaaagatgctcatgacagggacactagcagtattctttcttcttatcatgggacaactgacatggaatgatttaataagactttgtataatggtgggtgctaatgcttcggaccgtatgggtatggggacgacatatcttgcactaatggcaactttcaaaatgaggcccatgttcgccgttggattactttttcgtagactaacgagtagagaagtattgttattaacaatcggactttcgttagtggcttcagtcgagctccctaattctttagaggagttaggcgatggattagctatgggaataatgatactcaaacttctgacagatttccaatcccaccaactctgggccacactcttgtcactaacgtttataaagacgacattctctctacactacgcctggaaaactatggctatggttctttcaatcgtgtccctatttccactgtgcctcagtacgactagccagaaaacgacatggctaccggttttactaggttccctgggatgcaaaccactaactatgtttctaatcgcagaaaacaagatttggggtagacgaagttggcctctaaatgagggtataatggcagtaggtatagtatcaatcctattaagttcccttctgaaaaatgatgtacctttagcaggaccgctaattgcaggaggaatgctaattgcctgttatgtaataagtggttctagcgcagacttaagcctagaaaaagccgcagaggttagttgggaggaagaagccgaacattcaggcgcttcacacaacatattagtagaagttcaagatgatggtacgatgaagataaaagacgaagaacgagatgacaccttaacaatactattgaaggcaacattacttgccgtaagtggcgtgtatcctctttcgattcctgctactttatttgtatggtatttttggcagaagaagaaacaaagaagtggtgtattatgggatacaccttcacctccagaagtagaacgtgctgttttggatgatggaatctatcgcataatgcaaagaggactgttggggagatcacaagtaggagttggggtgtttcaagaaaacgtatttcacaccatgtggcacgttacccgcggagcagtattaatgtaccaaggtaagagactagaaccgagctgggcatctgtcaagaaagatttaatttcatacggtggtggttggcgcttacaaggatcctggaacacaggcgaagaagtacaagttatcgcagttgagcctgggaagaaccccaaaaatgttcaaactgctccaggaacatttaaaacacccgagggagaagtcggtgctattgcactagattttaagcccggaaccagtggctcacctatagtcaaccgcgaaggaaaaattgtaggtctctatggaaatggggtagtaacgacctctgggacatacgtgagtgccattgcgcaggcaaaagctagtcaagaaggccccttaccagaaatcgaagatgaggtgtttcgtaaacgcaatttgacgattatggatttacatcccggatccggaaaaacacgtcgttatttacccgcaatcgtcagagaagccataaagcggaaactgcgaactctaatactagcccccacgcgtgtagtcgcttctgaaatggcagaggctttaaaaggtatgcctattagataccaaaccaccgctgttaaaagtgaacataccggaaaagagatagtcgaccttatgtgtcatgctacatttacgatgcgactgctttcacccgttcgcgttccgaattataatatgattattatggatgaggcacatttcacggatccaagcagcatcgccgcgagaggatacatatctacgagagttggaatgggtgaagcagctgctatctttatgaccgctaccccaccgggtagtgttgaagcctttccccaatcaaacgctgttatacaagatgaagaaagggacataccggaacgatcatggaacagtggatatgagtggattaccgacttccccggcaagacagtatggtttgtcccaagcataaagagcggcaacgacatcgctaactgtttgcgaaagaatggcaaaagagttatacaactatcacggaaaacgtttgacaccgaatatcagaaaactaaaaataatgactgggactatgtggtaactaccgatatatcagaaatgggtgcaaactttcgcgccgatagagtaatagatccacgtagatgtctaaagccggtaattttgaaggacggaccggagagagtgattctagccggaccaatgccagttaccgtggcatcagcggcacagcgaagaggtaggataggtagaaatcataataaggaaggtgatcaatatatttatatgggccaaccactaaacaatgacgaagaccatgcccattggacggaagccaaaatgctactagataacataaatacacctgaagggataataccagccttgttcgaacctgaaagagagaaatcggcagctattgacggagaatataggctacgaggggaagcgcgaaagaccttcgtagagttaatgagaagaggagacctgccggtatggctaagctataaagtagcaagtgaaggtttccaatatagtgacagaagatggtgctttgacggtgaacggaataatcaggtcttagaagaaaatatggatgtggagatttggacaaaggagggggaaagaaagaaattaaggccgagatggctcgatgctagaacatattcggatcctttagcgcttcgagaatttaaggaatttgcagccggcaggaggagtgtttcaggcgatcttatattagaaataggtaagctcccacaacacctaacacaaagagcccaaaatgcgttagataatctagtcatgttacacaactctgaacaaggcggtcgagcctatcgacacgccatggaagaattaccagatacgatcgaaactctaatgctcttagctttaatcgcagtattaacagggggtgtgactctattctttctttctggtagaggattaggtaaaacgtcaatcggcttgttgtgcgttatggctagttctgtactattatggatggccagcgttgagccgcattggattgcagcttcaataatccttgaatttttcctaatggttttgctgattccagaaccagacaggcagagaacacctcaagataatcagttagcctatgtagttatcggattactctttatgatacttaccgtagcagcaaacgaaatggggctcttagagacaactaagaaagatctggggattggccatgtggccgtcgagaaccatcatcatgcggcaatgttagatgtggacttacatccagcatcagcctggacactatacgcagtagccacaacgatcataactccaatgatgagacatacgatcgaaaatacgacagctaatataagtcttactgccatagcgaaccaagctgcgatcttgatgggacttgacaaaggttggccaatatcgaagatggacatcggtgttccattgcttgccttaggctgctactcacaagtcaatccattaaccttaacagcagccgttctcatgctggtagcacattatgctattattgggcctggactacaagcaaaagcgactagagaagctcaaaagagaaccgcagcaggaatcatgaaaaatcctacagtggacgggatcgtagcaatcgatctagatccggtcgtctacgatgcgaaatttgagaaacaacttgggcaaatcatgctactaattctctgtacaagccagattttattgatgcgaaccacatgggcattatgtgaaagcataacattagccaccggaccactaacaacactctgggaaggtagtcctggtaaattttggaacacaacaatagctgtaagtatggctaacatcttccgaggatcgtacttagctggcgccggtttagcttttagtttaatgaagagtttagggggaggtagacgtggtactggagctcaaggcgagacgctgggcgaaaaatggaaacgccaattaaatcaactaagcaagagcgaatttaacacatacaaaagatcaggtattatggaagtagacagatcagaggcaaaagaaggattaaagaggggtgaaacaacaaaacatgctgtcagtaggggaacagcgaaactgcgatggtttgttgaaaggaatttagttaaaccggagggtaaggtgattgatttgggatgtggcaggggcggttggagctattattgcgctggattaaagaaagttacggaagttaaaggatacacaaaagggggacccggccacgaagaaccgataccaatggccacatacggttggaatttggtcaaactccattccggaaaagacgtattctttatcccgcctgaaaaatgcgacacccttttatgtgatatcggagagtcatccccaaacccaacaatagaggaagggagaactttaagagtgttgaaaatggttgaaccatggctaagaggaaaccaattttgtatcaaaatacttaatccatatatgcccagtgtagtagaaacacttgaacaaatgcaaagaaaacacggaggtatgttggtaagaaatccactttcaagaaattcaacacatgaaatgtactgggtaagttgcgggacgggaaatatagtaagcgccgttaatatgacctcaagaatgctacttaatagatttactatggcacatcgcaaacccacatatgaaagagacgtcgatctcggagcaggtacaaggcacgtagcagtggagccagaagttgctaacctagatattataggacagagaatagaaaacattaaacatgaacataaaagcacgtggcactatgatgaagacaatccctataaaacatgggcatatcacggtagttacgaggtcaaaccgtctgggtccgccagtagtatggttaacggtgtggtaaaactacttaccaaaccttgggacgtaataccaatggtcacacaaattgccatgactgacacaactccctttggccaacaaagggtttttaaagaaaaagtagatacgcgcacaccaaaagctaagagaggaaccgcccagattatggaggttaccgcaaaatggctatggggctttctttccaggaacaagaaaccacgaatatgtactcgtgaggagtttacaaggaaggttcgctccaatgcggcgatcggagctgtatttgtggatgaaaatcagtggaatagtgctaaagaggcagttgaagatgaaagattttgggatctagttcatagagaacgagagttacacaagcaaggaaaatgtgcaacatgcgtctataacatgatggggaaacgagagaagaaactaggcgagttcggtaaagccaaaggatcacgagctatatggtatatgtggttgggtgcaaggtttttagagttcgaagcgctaggatttatgaatgaggatcattggttttcaagagagaacagtctatctggagtagaaggtgaaggactacacaaactagggtacattttacgagacatatcgaaaattccaggaggaaatatgtatgctgacgacacagcaggttgggatacacgaatcaccgaagatgatcttcaaaatgaagctaggatcacggatataatggaacctgaacacgccttactcgcaaagtcaatatttaagttaacataccaaaataaagttgttagagtacaaagaccagccaaaaatggtacagttatggacgtaataagtaggagggaccaaaggggaagtggacaagttggaacttatggactcaatacgtttacgaatatggaagcccaactaatcagacaaatggaatcggagggcatattttctcccagcgaactggaaacacccaatctagctgaacgcgtcctagattggttaggaaagtatggggtcgaacgattaaagcgtatggcaatatccggcgatgactgtgtcgtgaaaccgattgatgatcgattcgcaacggcattgacagcattaaatgacatgggaaaagtaagaaaagacattccacaatgggaacccagtaaaggctggaacgattggcaacaagtgcccttttgttcacatcactttcatcaattaatcatgaaagacggtagagaaatagtcgtgccatgcagaaaccaagacgaattagtaggaagggctcgggtatcacagggcgctggctggtccctgcgcgaaacagcatgcctcggaaagagctatgcacaaatgtggcagctaatgtattttcacaggcgagacctaagattagcagctaatgctatttgctcagcggtgccagtcgactggatcccgacgtcaagaacaacatggtctatccatgcacatcatcaatggatgaccacagaagatatgctttctgtttggaatagggtgtggatagaagaaaatccatggatggaagataagacacatataagctcatggggagacgtaccatacttagggaaaagagaagaccaatggtgtggatcgttgatcggactaactgctagagcaacctgggctacgaatattcaagtagcaatcaaccaagtacgacgactaataggtaatgagaactaccttgattatatgacaagcatgaaacgatttaagaacgaatcagacccagaaggagctctatggtaa

SEQ ID NO: 21609 - RNA, 9879 nt, synthetic construct
  misc_feature 1..9879: note = derived and/or modified CDS sequence (opt6) from DENV-1__FJ410284__SS-prME
  source 1..9879: mol_type = other RNA
tcggttactatgctcctaatgctcatgcccactgctctagcatttcacttaactacgagaggaggtgaacctcatatgattgtgacaaaacaagaaagaggaaaaagtttactatttaaaacttcagcaggagttaatatgtgtactttaatagcgatggacttaggagaactatgtgaggacactatgacatacaaatgtccgcgtataacagaagctgaacctgacgatgtcgattgctggtgcaatgctacggacacttgggtcacatacgggacatgttcccagactggggaacacagaagagataaacgatcggtagcactagctccacacgttggtctcggtctagaaacccgcacggaaacctggatgtctagcgagggagcctggaaacaaattcaaagagtagaaacgtgggctctaaggcacccaggtttcactgtaattgcattatttttggctcatgccataggaaccagtataacacaaaaaggaataattttcatcttgcttatgttagtaacaccaagcatggcgatgcgatgcgtaggtataggatcaagagattttgttgagggcttaagcggagctacatgggtcgatgtagtcctagaacacggaagttgcgtaaccacgatggccaaagataaacctacactagacattgagttgttaaaaacagaggtaacaaatccagccgtcctaagaaaattatgtatcgaggccaaaataagtaacaccactactgacagcagatgtccaacacaaggtgaagctactttaatggaagaacaagacgcaaacttcgtttgcaggagaacattcgtagacagaggatggggtaacggatgcggattgtttggaaaaggaagtcttatcacttgtgccaaattcaaatgcgtaacaaaattagaaggcaagatagtccaatatgaaaatcttaaatactcagtgatcgtaacagttcatacgggcgaccagcaccaagtaggtaacgaatccacagaacacgggacgaccgccacgataacaccacaagcgcctactagcgaaatccaattgacggattatggagctctaaccttggattgttcaccgcgtacgggattggacttcaatgagatggttctgctaacaatgaaagaaaagagctggctagtacacaagcaatggttcctagacttaccattaccttggacaagtggcgcatccacttcacaggaaacatggaataggcaggacctcctcgttacatttaaaactgcacacgctaaaaagcaagaagtagtcgttttagggtcacaagagggagctatgcacacagcattaacaggcgcgacagaaatacaaacaagtggaacaactactatctttgcaggtcatttaaaatgcagactcaaaatggataaactaacgttaaagggtatgtcttatgtaatgtgcactggaagttttaaattagaaaaagaagtcgctgaaacccagcacggaactgttttagtacaaatcaaatatgaagggaccgatgcaccttgtaaaattccatttagtacccaagacgagaaaggagttatccaaaacggtcgtctcatcacagcaaatcccatcgtaacagacaaagaaaaacccgtcaatatcgaagccgaaccaccttttggagagtcgtacatcgtaataggagtaggggaaaaagcacttaagttaagttggttcaagaagggcagcagtataggaaaaatgttcgaagctacagctaggggagccagaagaatggccatactgggagatacggcgtgggactttggctcaattgggggagtatttacgagcgtcgggaagttagtacaccaaatatttggcacagcatacggagtactcttttccggagtatcatggactatgaaaataggaataggggtactactgacttggttggggttgaatagtcgatcaacgtccctgagtatgacttgtatagcagtgggcctagttactctttatttaggtgtaatggttcaggcggatagtgggtgtgtcataaattggaaagggagagaactgaaatgtggatcagggatatttgttactaacgaagtacacacgtggactgaacaatacaaatttcaagcggattcaccaaaacgtcttagcgcagccatcggtaaagcatgggaagaaggggtgtgcggaattagatctgcgacacggctcgaaaacataatgtggaaacagatttcgaatgaacttaatcacatactactagaaaatgatatgaaattcactgttgttgtaggtgatgttgtcggaatactggcacaaggaaagaaaatgataagaccacagcctatggaacataaatatagttggaaatcctggggaaaagcaaaaataataggtgcagatgttcagaataccacgtttataatagacgggcccaatactccggagtgcccagatgatcaacgagcctggaacatttgggaagtagaagattacggatttggtatattcaccacaaacatttggctaaaactacgagattcgtatacacaggcctgcgatcatcgattaatgtctgcagcaataaaagatagtaaagcagtacatgcagatatgggctactggatagaatccgagaaaaatgaaacatggaaactagcgagagctagctttattgaagtgaaaacatgcatttggccaaagtcccacaccctctggtccaatggtgtacttgaatctgaaatggtaatacctaaaatttacggaggtcctattagtcaacacaactaccgaccaggttattttacacagactgcgggaccatggcatttaggaaaacttgaattagactttgatttatgtgagggaacaacagtagtcgttgatgaacattgtggtaaccgtggtccatccttaagaactacaacggtaacggggaagattatacacgaatggtgttgtaggagttgcactttacctccactccgatttaaaggcgaagacggatgctggtacggtatggaaatccgtccagttaaagagaaagaagaaaaccttgtaaagagtatggtatcagccggatctggagaggtagatagttttagtctcgggttgttgtgtatatctatcatgatagaagaagttatgcgaagccgatggagcaggaaaatgttgatgacggggactcttgcagtgttcttactacttatcatgggccaacttacgtggaatgatctaatcaggttatgtataatggtaggtgcaaacgcatccgacaggatgggaatggggaccacgtatttagcactaatggcaacttttaaaatgcgacccatgttcgctgtgggcttactgtttcgacgattaacatcaagagaagttttactactaacaatcggcctatcattagttgcttccgtagaactaccaaattcattggaagagttaggggatggactcgcaatgggaatcatgattttaaaactactgacagactttcaatctcaccaattgtgggccacccttctttctttgacttttataaaaacaaccctctcactccattatgcctggaaaacaatggcaatggttctctcaattgtatcgctctttccactgtgcctttccaccacgtcgcaaaagacaacatggctcccagtgttactagggtccctaggttgcaaacctttgacaatgtttctcatagccgaaaacaaaatctggggccgtaaaagctggccccttaacgaaggtataatggctgtcggagtagtaagtattttacttagcagtttactaaagaatgacgtaccgttagcaggacctctgattgcagggggcatgctaatcgcctgttatgtaataagtggaagttccgccgatcttagtctcgaaaaagcagcagaagtaagttgggaagaagaagcagaacattcaggtgcgagccataatatcctagttgaggttcaagacgacggaacaatgaaaataaaagatgaggagaaagatgacacgctaacgattttactaaaggcaacgctcctagcagtatctggagtttatccgctttcaatacccgcaacgctatttgtatggtacttctggcagaagaagaaacagagatcaggtgtcctatgggacactccatctccaccggaggtagaaagggctgtacttgacgatgggatttaccgtattatgcagagagggcttttaggaagatcacaagtaggcgtaggagtatttcaggagaatgtattccatacaatgtggcatgtgacccgaggagcagtattaatgtatcagggaaagagattggagccatcctgggcatcagtgaagaaagacttgataagttacgggggagggtggcgtcttcaaggaagttggaatacaggggaagaggttcaagttatagctgtcgagccgggcaaaaatcccaaaaatgtacaaacagcacctgggaccttcaaaactccagagggtgaagtgggcgctattgccctagacttcaaaccgggaacaagcggatcccccattgtaaatagagagggaaagatagttggtctgtacggaaatggcgttgtcacaacttcaggaacatatgtatctgcgattgcacaagctaaagcctctcaagagggaccattaccagaaatcgaggatgaagtttttcgtaaaagaaatttaactataatggatttacatccgggcagcggaaaaactagaagatacctgccagcaatcgtccgtgaagcgactaagcgaaaactgcgtactttaatcctggcaccaacgcgggtagttgcatcggagatggccgaagcattgaaaggcatgccgatacgataccaaacaacagccgttaaatccgagcatacaggaaaagaaatagttgacttaatgtgtcatgcaacttttacgatgaggctactatctcctgtacgagtacccaattataatatgataataatggacgaagctcactttactgatccaagttccatcgcagcaagaggctacatatccacaagagtaggaatgggtgaagcagcagctatttttatgacagcaacgccaccggggagcgtcgaggcttttccccaatctaatgcggtcattcaggatgaagaacgggacatacctgaaaggtcatggaactcaggatatgagtggataacggattttcctggaaaaacagtttggtttgttccttcgattaaaagtggtaacgatatagcgaactgcttaaggaaaaacggcaaacgagtaattcaacttagtcggaaaaccttcgacacagaatatcaaaagacgaaaaacaatgattgggactacgtagttacaacagatatcagcgaaatgggcgcaaattttagagctgaccgggttattgatccaagaagatgtctaaaacctgtaatattaaaagacggccctgagcgcgtgatactagccggacctatgccagttacagtggcatcggcagcacaacgacgcggacggataggtagaaaccataacaaagaaggagaccaatatatatatatgggacaaccgctaaataatgatgaggaccatgcgcattggacagaggctaaaatgctgctagacaatattaatactccggaaggtatcattcccgcactgtttgaacccgaaagggaaaagagtgctgctatagatggtgaatacagattacggggcgaagcaagaaagacgtttgtggaactaatgaggcgaggcgatctgccagtatggctctcatataaagttgcatcggaaggattccaatatagcgacagaagatggtgtttcgacggagaacgaaataatcaagtactggaggaaaatatggatgtcgaaatatggacaaaagaaggtgagcgcaagaaactacgacctcgatggttggacgctcggacgtattctgacccgcttgcacttcgagaatttaaagagttcgctgcaggacgaagaagcgtttctggtgatcttattctagaaatcggcaaattaccacaacatctgacgcaacgtgcccaaaatgcattagataacctagtaatgcttcataattctgaacagggcggtagagcatatcgacacgcgatggaagaattgcctgacacgattgaaaccctaatgttgctggcgcttattgcagtcctgacgggaggggtaactctcttctttttatcagggcgaggattaggtaaaacatcgattggcctattatgcgtcatggcctctagtgtattgctatggatggcttcggtagagccccactggatcgctgcctcgataatactggaatttttcctaatggtattattaatacccgaaccagacagacagcgaactccgcaagacaatcagttagcttatgttgttattggacttcttttcatgatcttgacagtagcggcaaatgaaatggggttgttagaaacaactaagaaagatttaggaatcggtcatgtagcggttgaaaatcaccaccatgccacaatgctagatgtcgacttacacccggcgtctgcgtggaccttgtacgcagttgcaacgacaattattactcctatgatgcgtcatacaatcgagaatacaactgctaatataagtttaacggcgatcgcaaatcaagcagctattttaatgggccttgataaaggttggcctatatcaaaaatggacattggagtcccgttactggcactgggctgttattcacaggttaaccctttgacattaacagctgcggtactaatgttagtagcccattatgccataatcggtcccggtttacaggcaaaagcgactcgagaagcgcaaaagagaaccgctgctgggataatgaaaaatcccacagtcgatggtattgtcgcaatagatctcgacccagttgtctacgatgcgaaatttgaaaaacaacttggacaaataatgttgctgatactttgcacttcgcagattctgttaatgcgaacaacgtgggctctttgtgaatctatcacactcgccacgggtccgttaaccacgttatgggaagggtcacctggaaaattttggaacacgacaatagcagtgtcgatggcaaacattttccgcggttcgtatctggcaggagcaggcttagcattctccctaatgaaatcattaggcggtggaagacggggtacaggtgcacaaggtgaaacgctcggagagaaatggaagagacagttaaatcagttgagcaaatctgaatttaatatatataaaagaagcggaatcatggaagtagaccgaagtgaagcaaaagaaggtttgaaaaggggagagactacgagacacgctgtttcaagaggtacagccaaattaagatggttcgtagaacggaacctcgtaaaacctgaaggaaaagtaatcgatcttggctgcggaagaggaggttggtcatattattgtgcgggtctgaagaaagtaactgaggttaaaggatatacaaaaggagggccagggcacgaggaaccaattccaatggctacatatggatggaatttagtaaaattgcattcgggtaaggatgtattctttacacccccggagaaatgtgacacactcttatgcgatattggggaaagttctccaaatccaacgatcgaagaaggaagaacacttagggtcttaaagatggttgagccctggttgcgaggaaatcaattctgcataaaaattctgaatccctatatgccaagtgtggtggaaacactagagcaaatgcaaaggaaacatggtgggatgcttgttcgaaatccgctatcaagaaattcaacccatgaaatgtattgggtaagctgcggaacagggaatatcgtttcggcagtcaacatgacatcacgcatgctcctaaatagattcacgatggcgcatcgcaagcccacttatgaaagagacgtcgacttaggtgctggtactcgacacgttgcagtcgaaccagaagttgcaaatcttgatattattggacaaagaatagaaaacataaagcacgaacataagagtacatggcattacgacgaggacaacccatataagacttgggcttaccatgggagctatgaggtaaaaccgagcggttcagcgtcatcgatggtcaacggtgtagtaaaattactaacgaagccgtgggatgtaataccaatggttacacagatcgctatgacagatacaacacctttcggacaacaaagagtgtttaaagagaaagtggatacccgaacaccaaaagctaaaagaggtacggctcaaatcatggaagtgaccgcgcgctggctttggggatttttatcgagaaacaagaaaccaaggatatgcacaagagaggagtttactcgaaaagtcagatctaatgcagcaataggggcagtattcgttgacgagaaccaatggaatagtgcaaaagaagcagtagaagacgaacgcttctgggatctagtacaaaaggaacgagagttacataaacaaggtaaatgtgcaacttgcgtctataacatgatgggaaagagagagaagaaactgggagagttcggtaaggccaaaggaagcagggctatctggtacatgtggctaggggcaaggtttctagagtttgaagcgctcggttttatgaacgaagaccattggttctcaagagaaaattcactctcaggggttgaaggagaaggattgcataaactaggctatatcctaagagatatcagtaaaattcctggaggtaacatgtatgccgatgacactgcagggtgggatacgcgaatcacggaggatgacttacaaaacgaagcaaaaataactgatataatggaacccgagcacgctttactagccacatcaatttttaaattaacttaccaaaacaaagtagtcagggtgcaaagacctgcgaaaaacggaacggtcatggatgttatttcacgccgagatcagagaggttcaggtcaggttggaacatatggtcttaatacttttactaatatggaagcacaattaataagacaaatggagagcgaaggaatatttttgccaagtgaattagaaaccccaaatttagcggaaagagtccttgattggctagaaaaacatggagtagaacggctaaagaggatggcgataagcggagacgattgcgttgttaaaccaattgatgatcggtttgctactgctctaacagcactaaacgacatgggaaaggtcagaaaagatataccgcaatgggagccttcaaaaggttggaacgattggcagcaagtacctttctgttcacatcactttcatcaactaatcatgaaagacggtagagaaatcgttgtcccatgccggaaccaagatgaattagtaggacgtgcaagagtcagtcaaggagcaggatggtcacttagagaaacagcttgcttagggaagtcatatgcacagatgtggcaattaatgtattttcacagaagagatctgcgcctagcagcaaacgctatctgctccgcagtaccagtcgattgggtaccaacatcccgtacaacctggtccatacatgcacatcaccaatggatgactactgaggatatgctatccgtatggaatagagtatggattgaggagaacccatggatggaagataaaacccatgtttcaagttggggagacgtaccttacttaggaaaaagagaggatcaatggtgcggctctttaattgggttaacagcaagggcgacttgggcatctaatatacaagtagcaattaaccaagtaagaagattaataggtaatgaaaattacttggattacatgacctccatgaagagattcaaaaatgaaggagatccagaaggtgcactatggtaa

SEQ ID NO: 21610 - RNA, 9879 nt, synthetic construct
  misc_feature 1..9879: note = derived and/or modified CDS sequence (opt6) from DENV-1__FJ410285__SS-prME
  source 1..9879: mol_type = other RNA
tcagtgacgatgcttctgatgttaatgcctacagcattggcatttcaccttacaacacgcggaggagaacctcatatgatagtcagcaagcaagaaagagggaagtctctcttatttaaaacatcggctggagtaaacatgtgtactctaattgcgatggatctcggagaattatgcgaagacacaatgacttataaatgtcccagaattacagaaacagaaccagatgacgttgactgttggtgtaatgctacggatacatgggtcacctatggtacatgttcacaaaccggcgaacatagacgagataagcgatctgttgccttggcaccacatgttggtctcggtcttgaaacaagaacagaaacatggatgtcaagcgaaggggcatggaagcaaatacagcgtgtggaaacgtgggcactacgacaccctggcttcacagttatcgcgctgttcctagcccatgtcataggaactagcatcacacaaaaaggaataattttcatcttactaatgctagttacgcccagtatggccatgaggtgtgtaggtataggctcgcgagactttgtagaaggcttaagtggtgcaacgtgggtagacgtggtgttagaacacggatcatgtgttacaacgatggccaaggacaaacctacccttgatattgaactattaaaaactgaagttacaaatcccgctgtactaagaaaattatgtatcgaagccaaaatatcgaacactacaactgacagccgatgccctactcaaggtgaagcaacattagtcgaagaacaagacgctaattttgtatgtcggcgtacattcgtggaccggggttggggtaacggatgcggactatttggaaaagggagtctaataacatgtgcaaaatttaaatgcgtaacaaaactagaaggtaagatagtacaacatgaaaatctgaaatactcggttatagtaaccgtccacacgggcgaccaacatcaggtaggaaacgaaagtacggaacatggaacaacagcgaccatcacgccacaagcgccaacgactgaaatccagctgacggattatggagcactcagtttagactgttcgcctagaacaggattagactttaatgaaatggtgcttcttacaatgaaagaaaagtcctggctggtgcataaacaatggtttttagacttgccgctgccctggacaagtggcgcaagcaccagccaggaaacttggaacagacaggaccttctcgtaacctttaaaaccgctcatgccaagaaacaagaggtagtcgtcctaggatctcaagagggggcgatgcatacagcactgacaggcgctacagaaattcaaacatccggtacgacgaccatatttgcgggacatctcaaatgtcgattaaaaatggataaactaacgttaaaaggtatgtcatatgtaatgtgcacagggagcttcaaactagaaaaagaagtggcagaaacgcaacatggcacagttcttgttcaaatcaaatacgaaggcaccgatgcgccatgcaaaatcccgttctccacacaagatgagaaaggggtaacacaaaatggaagacttatcacagcaaacccgattgtaaccgataaagaaaagccagtcaatatagaagcagaaccacccttcggcgagagctatattataataggggcgggagaaaaagcattaaaattaagctggtttaagaaaggaagttctatcggcaaaatgttcgaggcaacagcacgaggagcaagacgaatggctatattaggtgacacagcctgggatttcggttccataggaggggtgttcacatcggtgggtaagttagtccaccaaatatttggcacagcatatggggtgttattttccggagttagttggacaatgaaaatagggataggagttctgttgacttggctaggtctaaactcccgaagtaccagtttgagtatgacatgtatcgcagtgggcctagttacgctatatctaggggtcatggtgcaagcggatagtgggtgtgtcataaattggaaaggaagagaactaaaatgcgggtcagggatattcgtaacaaacgaggtacatacatggacggaacaatataaattccaggccgacagtcctaaacgcctaagcgcggcaataggtaaggcatgggaggaaggagtttgtgggattcgtagtgcaacaaggctcgagaacataatgtggaaacaaataagcaacgaactaaatcacattctcctagaaaacgacatgaaatttactgtggtagtaggtgatgtagcaggcatattagcccaaggtaagaaaatgataagaccacaaccaatggaatacaaatactcatggaagtcctggggcaaagcaaaaatcataggtgctgacgtacagaacaccacctttataatagatggcccgaatactccagaatgtcccgatgatcaacgtgcgtggaacatttgggaggtagaagattatggcttcggaatattcacgacaaatatctggctcaaattgcgagactcctacacccaagtgtgcgaccatagacttatgtcggctgcaataaaagacagtaaagcagttcatgcagatatgggttattggatagaatccgagaaaaatgaaacgtggaagctagctcgagcgtcatttatagaagtcaaaacatgtatatggccgaaatctcacaccctatggtcgaacggtgtactggagtcagaaatgataattcccaaaatttatggaggcccgatttcgcaacataactatagaccgggatattttacgcaaactgcaggtccctggcatttaggaaaattagagttggacttcgacttgtgcgaaggcactaccgtagtggttgacgaacattgcggaaatcgaggaccttctttaagaacaacgaccgttaccggaaaaattatacacgaatggtgttgtagatcttgtacattgccccctcttagattcagaggagaagatggctgctggtacggaatggaaataagacctgtaaaagaaaaggaagaaaatcttgtgaaatcaatggtaagtgcaggtccgggtgaagttgattctttttcgttaggactactgtgtataagcataatgattgaagaggtaatgagaagtaggtggagtagaaaaatgctgatgacaggcacattagccgtatttttcctgctaataatgggacaattaacgtggaacgacttaataaggctgtgtattatggtgggagcaaatgctagcgatagaatgggcatgggaacaacgtatctggcccttatggcaacttttaaaatgcgacctatgttcgcagtaggcttacttttcagaagactaacatctcgtgaagttttgttgctaacaattggattaagcctagtcgcaagcgtagaactacccaatagtttggaagaactcggagatggactagctatgggcataatgatactcaagctcttagcagatttccaatcacatcaactatgggcaacactacttagccttacttttatcaaaacaactttctcattgcactatgcctggaagactatggcaatggtacttagtatcgtctctttattccctttatgtttgagcacaacctctcagaaaactacttggttaccagttttattaggctcattaggatgtaaacctttaactatgtttctaattgccgagaacaaaatatggggacgtagatcctggccattaaacgaaggaataatggctgtcggcatcgtgtccatactactatctagcctactaaagaatgatgtacccttagcagggcctctaatagcgggtggtatgttgattgcctgttacgttatatctgggtcatccgcagatctatcgctggaaaaagctgctgaagtatcgtgggaggaagaggctgagcacagtggtgcaagtcacaatatacttgtagaggtacaagatgatggcacaatgaaaataaaagatgaagaaagagacgatacactgactatactgctaaaggcaacactgttggccgtctcgggagtatatcccctcagcattccggccacactctttgtttggtacttttggcaaaagaagaaacaacgcagcggagttctttgggacactccatcgcctccagaagtcgaacgcgcggtactagacgacggcatttaccgaatcatgcagcgagggctccttggcagaagtcaagtaggtgtaggcgtatttcaagagaacgtgttccacactatgtggcatgtcactaggggagcagttctaatgtaccaagggaaaagattagaaccttcgtgggcatctgtcaaaaaggatctaatttcctacggcggcggatggcgactccaaggaagttggaatacaggagaagaagttcaagtaattgcagtagaacctggtaaaaatcccaaaaatgttcaaacagcgccagggacattcaaaactccagaaggcgaggttggggcgattgccctagactttaaacctggtacatcgggaagccccattgtcaacagagaaggcaaaatagtcggattgtatggtaacggggtggttactacgtcaggcacttatgtaagtgctatagcacaagctaaggcttcccaagagggtccgctaccagaaatagaagacgaagtctttaggaaaaggaatttaaccattatggacctccatccaggaagtggaaaaacacgaagatacttacccgcaatagtgagagaggctataaaaaggagactacgaacattaattttagctccaactcgagtagtcgcctctgaaatggcggaggctttaaaaggaatgcctattcgttaccaaacaactgctgtcaaatcagaacatacaggaaaagaaatcgtggatctaatgtgccatgcaacctttacaatgaggctgctctcacctgtgagagtaccgaattacaatatgatcattatggacgaggctcatttcactgatcccagttcaatagcagctagggggtacattagtacacgtgttggaatgggagaagctgcagcgatttttatgacagcaacaccgcctggatctgtggaggcttttccccaaagcaacgcagtaatacaagacgaggaacgtgacatcccggagagaagttggaatagtggctatgaatggattacagactttcctgggaaaacggtctggtttgtaccatcaattaaatctggaaatgatatagccaattgccttagaaagaatgggaaaagagtaatacaattatcaaggaaaactttcgacactgagtatcaaaagactaaaaacaatgattgggactatgtggtaaccacagatatatcagaaatgggagcaaatttcagggcagatagagttatagaccccagaaggtgcctaaaaccggttatcctaaaagatggtccagaacgcgtgattttagctggccccatgccggtcacagtcgctagcgcagcacaacgaagaggtagaataggaagaaaccacaataaagaaggagaccaatatatctatatggggcaaccactaaataacgacgaggaccacgcacattggacagaagctaaaatgttattagacaatataaatacacccgaaggaatcataccggcactattcgaaccggagagggaaaaatccgcagctatagatggcgagtatcggctaaggggtgaagctcgaaagaccttcgtggagctaatgagacgcggtgatttgcctgtatggcttagttataaagtagctagtgaaggttttcagtactcagacagacgatggtgttttgacggagaaagaaataatcaagtgctagaggaaaatatggatgtagaaatttggactaaagaaggggaacggaagaagttaagacctagatggctcgatgcaagaacatattcagatccactagctttgagggagtttaaagagttcgcggccggacgacgtagtgttagtggagatttgatattagaaattgggaagctaccacaacatttaactcagagggctcaaaatgctttagacaaccttgtgatgctgcataactcggaacaaggagggagagcgtaccgtcacgccatggaagaactgccagatactatagaaacgcttatgctcctagccttgatagcggtattaacagggggagttactctattctttttatccggcaggggtctgggcaaaacctcaattggccttttgtgtgtaatggcttctagtgtattgctttggatggcaagcgttgaacctcattggatcgcagccagtattatcttggagttctttttgatggtactcttaataccagaaccggacaggcaacgcactcctcaagataatcaacttgcgtatgtggtcataggtctattatttatgatactaacagttgcagcaaacgaaatgggcttgctcgaaaccacaaagaaagacctaggtattggtcatgtggctgtggaaaatcatcatcatgctgccatgctagatgtagacctgcatcctgctagtgcttggaccctctatgccgtagctacgacaataataacaccaatgatgcgacatactattgagaatactacagctaatatctcattaactgctattgccaaccaagcagcgatactgatgggactagataaaggatggccaatttctaaaatggacataggcgtaccacttctagccttaggttgttattcccaggtaaacccgttaaccctcactgcagcagtacttatgctagtagctcattacgcgattataggcccaggactacaagctaaagctacaagagaagcccaaaaacgcacagctgctggcattatgaaaaatccaactgtagacggcattgtggcaatcgacctggatccagttgtctatgacgccaaattcgaaaaacaactaggacaaatcatgctattgatcctatgcacaagccagattctattaatgagaaccacatgggcattatgtgaatccattactctcgccaccggaccgttgacgacactttgggagggcagtcccggaaagttttggaacaccactatagcagtatcaatggcaaatatatttcgagggtcctatctagctggagctggactagctttttccctcatgaaaagccttggaggcggcagaagagggacaggagcacaaggcgaaacactaggtgaaaaatggaaacgccagctgaaccaactctccaaatcagagttcaatacgtataaacgctctggtatcatggaagtagacaggtcggaagctaaagaaggactaaaaagaggagaaacaaccaaacatgcagtctcacgaggcacggcaaagctaaggtggtttgttgagcgaaacttagtaaagccggaaggaaaagtaatagatctaggttgcggaaggggaggttggtcctattattgtgccgggttgaaaaaggttacagaagttaaagggtacaccaagggagggccaggccatgaagaaccaattcccatggctacttatggatggaacttagtaaaattacatagcggaaaagatgtatttttcattccaccggaaaaatgtgacacattactgtgcgatattggagagtcatcacctaacccaactatagaagaagggcgtacacttcgagtattgaagatggtggaaccctggttacgtggaaatcagttctgtataaagattttaaacccatacatgcctagtgtagtagaaacactagaacaaatgcaaaggaaacacgggggaatgctagtgagaaaccccttatcacgaaatagcacacatgaaatgtattgggtttcatgcggtactgggaatattgtatctgctgtaaatatgactagcagaatgttattaaatagatttacaatggctcacagaaagccaacatacgaacgtgatgtagatttgggggcaggcactagacatgttgcggtagaacctgaagtggctaacctcgacatcataggacaaagaatagaaaatattaaacatgaacacaaaagcacatggcactacgacgaagataatccatacaaaacctgggcctatcatggtagctatgaagtcaaaccgtcgggatcagcatcctcaatggttaatggtgtggtgaaattactaactaagccatgggacgttatcccaatggtaacacaaatagcaatgacagacactactcctttcggacaacagagagtcttcaaagagaaagtagacacaaggactcccaaggcaaagaggggtacggcacaaataatggaggtgacagcgaaatggctctgggggtttcttagcaggaacaagaaaccaagaatttgtactagagaggagttcacaagaaaagttcgttcgaatgctgcaataggagcagtatttgtggatgaaaaccagtggaactcagcaaaagaggcagtggaggacgaaagattttgggacttagtacatagagaaagagaactacataaacaggggaagtgcgcgacatgtgtttacaatatgatgggaaaaagagaaaagaaacttggtgagtttgggaaggcaaaaggctctagggccatatggtatatgtggctcggagcacgattccttgaatttgaggccttaggctttatgaacgaagaccattggttctctcgagaaaattcactttcaggagtcgaaggcgaagggctccataaattggggtacatactacgagatatatcaaagataccaggtggaaatatgtatgcggacgataccgccggatgggacacacgtataactgaagatgacctacagaatgaagccagaattactgatatcatggaaccagaacatgccttgttggctaaaagtatattcaaactaacttatcaaaataaagtagtaagagtacaaagaccagccaaaaatggtacagttatggatgttatttcaaggcgcgatcaacgcgggtcgggacaagttggtacttatggcttaaatacatttaccaacatggaagcccaacttattcgccaaatggagtctgaagggatcttttccccttctgaattagaaacacccaacttggctgagagagtgctagattggctggaaaaatacggcgttgaaagattaaaacgaatggccataagcggagatgactgcgtagttaaacctatagacgacaggtttgcaacagcactcaccgctcttaatgacatgggaaaagtaagaaaagatataccacaatgggaacctagcaaaggctggaatgactggcaacaagtaccattttgttcccaccattttcatcagctgatcatgaaagatggtcgagaaatagtcgttccatgcagaaaccaggatgaattagtcggacgtgctcgagtgagtcaaggagcagggtggtcactccgagagacagcatgtttaggaaaaagctatgcgcaaatgtggcagttaatgtattttcatagacgcgacctaaggttggcagctaacgcgatatgtagtgcggtacccgttgattggatacccacaagtagaacaacctggtcgattcatgcacatcaccaatggatgactactgaagatatgctaagtgtctggaatcgcgtatggatagaagagaatccgtggatggaagataaaactcatatctcatcctggggagacgtaccctatctaggtaaaagagaagaccaatggtgtggaagtttaattggtttgacggcaagagcaacatgggctaccaatatacaggtggcaataaaccaggtaaggcgtcttataggcaacgaaaactatttggactatatgacatccatgaagagatttaaaaacgagagcgaccctgagggcgcattatggtaa

SEQ ID NO: 21611 - RNA, 9879 nt, synthetic construct
  misc_feature 1..9879: note = derived and/or modified CDS sequence (opt6) from DENV-1__FJ410286__SS-prME
  source 1..9879: mol_type = other RNA
agcgtcactatgctattgatgctaatgccgacggcactagcttttcatttgacgacacgaggaggggaaccgcacatgatagtatcaaaacaagaacgaggtaaaagcctcttgttcaaaacaagtgctggtgtgaatatgtgtacattaattgcgatggatctgggagaattatgtgaggacactatgacatataaatgtccgcggatcacagaagctgaaccagatgatgtcgattgttggtgtaatgcaacagatacctgggttacttacggaacatgctcacaaacaggggaacaccgccgagagaaaagatctgttgcattagccccacatgtcgggctcgggcttgaaacaagaacggagacctggatgagttctgagggcgcttggaaacaaatacaacgggtggaaacatgggctttacggcatccaggctttactgtaattgctctcttcctagcacacgctataggaacttctattactcaaaaaggcatcatattcattttactaatgttagtcactcctagcatggcaatgcgatgcgtgggtataggatcgagagattttgttgaaggcttatcaggggcgacctgggttgacgtagttttagagcacggttcgtgtgtaactacaatggcgaaagacaaacctacattagatatagaactgctaaaaaccgaagtcacgaatcctgcagtgctcaggaagttatgtatagaagcaaaaattagcaacacaacgacggatagtagatgcccgacacaaggcgaggctactttagtcgaggagcaagacgcaaacttcgtgtgcagacgaaccttcgtagacaggggatggggaaatggatgtggattgtttggcaaaggtagccttcttacatgtgcgaaatttaaatgtgtaacgaaactcgaaggaaaaatcgtacaatatgaaaatctaaaatactctgtaatagtgacagtacatactggtgaccaacatcaagtcggcaacgagtcgaccgaacatggaacgactgccacgatcacaccgcaagcgccaactaccgaaatccaactaacagactatggggccctcacactcgactgtagtccgagaaccggattagattttaatgaaatggtactactcacaatgaaagagaaaagttggctagtccataaacaatggtttctcgacttaccgttaccttggacttcaggagcgtcaacaagtcaggaaacatggaacagacaggatcttctagtaacatttaaaaccgcacatgcgaagaaacaagaagtcgtagttttgggttcgcaagaaggggctatgcacacggctttaacaggagcaaccgagatacagacatccggcacaactacaattttcgcgggccacttaaaatgtcgtttgaagatggacaaattaacgttgaagggaatgtcatacgtgatgtgcacagggagctttaaattggagaaagaggtagcagagactcaacacggaaccgtgctcgtgcaaatcaaatatgagggaactgatgcaccatgtaaaatcccattctcaacccaagacggtaaaggagtaacccaaaatggacgacttataaccgcgaatccaattgtaaccgataaagagaaacctgttaacatcgaagcagagcctcctttcggtgaatcgtacattgttataggtgccggggagaaagccctgaagttatcttggttcaagaaaggatcaagtatagggaaaatgtttgaggctactgcgagaggtgcaagacgtatggcaatattaggtgatacggcatgggacttcggttcaatagggggagtatttacaagcgttggtaaacttgtccatcaaattttcggtactgcatatggcgtgttgtttagcggcgtcagctggactatgaagataggaataggcgtactcctgacttggttaggcctcaattctcgaagcacctcgctatctatgacttgcatcgcagtcggattagtcacattatatttaggggttatggtccaggccgattcgggttgtgttataaactggaaggggagggagctaaagtgtggttctggtattttcgtcactaacgaggtccatacttggacagaacaatataaattccaggcagattcaccaaaacgtttgtcagcagctatcggcaaggcatgggaagagggagtgtgtggaattagatcagctactcgtttagagaacattatgtggaagcaaatctccaacgaacttaatcatatattactggaaaatgatatgaaatttactgtcgttgtaggtgatgtagctggaatattagtgcagggcaagaaaatgatacgaccacagccaatggaatataaatacagttggaaatcttggggcaaagcaaaaattatcggtgccgatgtacaaaattcgacatttattattgacggtcccaatacaccagaatgtccagatgaccagagagcgtggaacatatgggaagtagaagactacggtttcgggattttcactacaaatatctggttaaaattgagagattcatatacgcaagtgtgcgatcatcgcttaatgagcgctgccattaaggatagcaaagctgtacatgctgatatgggctattggatagaatcagaaaagaatgaaacatggaaattagctcgcgcgagttttatagaagttaaaacttgtatttggccaaaaagccatactctgtggtccaatggtgttcttgaatctgaaatgataatcccgaaaattcatggcggaccaattagccaacacaactaccgtcctggttattttacccagaccgcaggaccttggcatttaggtaaactggaactagactttgacttatgtgaaggaacgactgtcgtagtcgatgagcattgtggcaatcgaggacctagcttacgaacgacaaccgtaactggtaagataatacatgaatggtgctgtcgtagttgtaccttaccgcccttgcgattcagaggagaagacggatgttggtatggcatggaaatcagacccgtaaaagaaaaagaagaaaacctagtaaaaagtatggtctccgctgggtctggggaagttgactctttttcactaggtcttctttgcatatcgatcatgattgaggaagtaatgcgtagtagatggtcaaggaagatgctaatgacagggaccttagcagtattctttctcctaattatgggacagctaacatggaatgacctcataagactttgtataatggtcggggcaaacgcaagtgatagaatgggaatgggaactacatacttagctttgatggctacatttaaaatgcgcccaatgtttgctgtaggtttattattccggaggcttacaagcagggaagttctacttttaacaattggtttatctttagtggccagtgttgaactgcccaactctttagaagaattaggagatggcttagccatgggaataatgatcctaaagttgctcactgattttcaaagttatcaactgtgggctacactattgtcgttaactttcataaaaacaacatttagtttacattatgcttggaaaactatggctatggtactaagcattgtcagtttatttccgttgtgtctttctactactagccagaaaactacatggctaccggtactcttgggatcgttagggtgtaaacctttgaccatgtttctcatagctgaaaataaaatctgggggcgaaaatcatggccactcaacgagggaattatggctgtaggcattgtatctatattgctgagttcattactcaaaaatgatgtgccgttagcagggccattaatagcaggaggaatgctgatcgcgtgttacgtgatttcaggctcgtcagctgatctttctctggagaaagcagcggaagtaagctgggaggaagaagccgaacactctggcgccagtcataatattttggtagaagtacaggatgacggcacaatgaaaataaaagacgaggaaagagatgacacacttacaatcctattgaaagccacattgctagctgtatccggcgtctaccctttatcaataccagcaacattattcgtttggcatttctggcagaagaagaaacagcgatcaggtgtactgtgggacaccccctccccgccggaggtagagagagcagtcttggacgatggtatctataggattatgcaacgtggtctactcggtagatctcaagtcggtgtaggagtttttcaagaaaatgtatttcatactatgtggcatgttacaagaggcgcagttctaatgtaccaagggaaacgactagaaccctcatgggcaagtgttaagaaagacttaatatcatatggcggaggatggaggttccaaggctcatggaacactggagaggaggttcaagtgattgctgttgagcctgggaaaaaccctaagaatgttcagactgcaccaggaacgttcaaaactcctgaaggggaagtgggagcaatcgcactggatttcaaaccaggtacatccgggtctcctatagtaaacagggagggaaaaattgttgggctttacggaaacggtgtagtgactacaagcggaacttacgtctcggccatcgctcaagcaaaggcttcgcaagaagggccattaccggaaatagaagatgaagtgtttaggaaaagaaatctaacaattatggatttacatccaggtagtggaaaaacgagaaggtacttaccagcaattgtcagagaagcaatcaagcgaaaattaaggacactaattttagcaccaactcgagtagttgcgagcgaaatggccgaagcactcaaaggaatgccaattaggtaccaaacaacggccgtaaaaagtgaacatacagggaaagaaatcgtagacttgatgtgtcatgccacatttacaatgcgcctattgagtcctgtcagagtacctaattataatatgattataatggatgaagcgcattttaccgatccttctagcattgcagctagggggtatatatcaactcgggtgggaatgggagaagctgcagcaatattcatgacagcaacacctcctggatcaatggaagcgttccctcaatctaatgcagtgatacaagatgaggaacgagatattccagagagatcatggaactcagggtacgaatggattacggactttcccggtaaaactgtatggtttgtaccatctattaaagctggaaatgatatagccaattgccttaggaaaaatggtaagagagtgattcaattaagcagaaaaactttcgacacagaatatcagaaaaccaagaacaatgactgggactacgtggtgactactgatatctccgagatgggtgctaactttagagcggatcgtgttattgacccaagacgatgcctaaaaccggtaatattgaaagatggaccagagagagtaatattagccggtccaatgccagtaactgtagctagcgccgcgcagagacgaggccgcatagggaggaatcacaataaagaaggcgatcagtacatttacatggggcaacctttaaacaacgacgaagatcatgcacattggacggaagcgaaaatgctcctagataatataaatacaccggaagggataatacctgcactctttgagccggaacgagaaaaatcagcagcaatagatggtgaatatcggctcaggggagaagcacgtaaaacattcgtagaacttatgagacgcggagacctacccgtgtggttaagctacaaggttgctagtgagggcttccaatattctgataggcggtggtgttttgatggggaacgaaacaatcaagtactggaagagaatatggatgtcgaaatatggacaaaagaaggtgaaagaaagaaattaagaccacggtggttggacgctcgaacttacagtgacccacttgcactaagggagttcaaagaatttgctgcaggccgcagaagcgtctccggtgacctcatactagaaataggtaaattaccacaacatttaacccaaagagcacaaaatgcgctcgataaccttgtaatgctacataacagtgaacaaggcgggagagcttacagacatgcaatggaggagctcccagacacaatagaaactctcatgcttttagccttgattgctgtactaacaggtggagtcaccctattctttctatcggggaaaggactgggcaaaacaagtattggccttttatgcgtgatggcatcttccgtgctattatggatggccagtgttgaacctcattggatagcagcttccataatattagagttctttctcatggtactactaattcctgaaccggacagacagcgaaccccacaggataaccaattagcttatgtagtcataggtcttctctttatgatcctaacagtagcagctaatgaaatggggctacttgaaacaacaaagaaagatttggggatcggacacgtagcagttgaaaaccatcatcatgcggcgatgctcgacgtagatttacatcccgcttctgcgtggaccctatacgctgtagccacaacgataatcacgccaatgatgaggcatacaatagaaaatacaacagctaacattagcttaactgctattgcaaatcaagctgcgattttaatgggcctagataaaggatggccgatttcaaaaatggacataggagtaccactattagcgttagggtgttattcccaagtaaatccattgacattgaccgcagcagttcttatgttagttgcccactatgcaattatcggtcctggattacaagctaaagcaaccagagaagcccaaaaacgaaccgcggctgggattatgaagaatcctactattgatggaatcgtagcaatcgatttagatcctgttgtttacgacgcgaaattcgaaaaacaattgggacaaataatgttacttattctttgtacaagtcaaatcttgttaatgaggacaacctgggcactatgtgaatctataacattggccacaggaccattaactacgctctgggaaggctccccaggaaaattttggaacacaacgatagcagtatcaatggcaaacatattcagaggatcttatcttgcaggagccggtctcgcctttagtttaatgaaatctctcggaggagggcgtagaggaacgggagcgcaaggtgaaacattaggcgaaaaatggaaaaggcagctaaatcaactatcgaaaagcgaatttaatacctacaaacgatccggtataatggaagtagatcgtagtgaagctaaggaaggattaaaaagaggcgaaacaaccaaacatgcagtatctagagggacagcaaaactccggtggtttgtagaaagaaacctcgtcaaacctgaaggcaaggtgatagacttgggatgtggtagaggcggatggagttattattgtgcgggtctaaagaaagtaacagaagtaaaaggatacacaaagggaggccctggtcatgaagaacctatccctatggccacatatggctggaacttggtaaaacttcactcgggaaaggacgttttcttcataccccctgaaaaatgcgatacactcctctgtgacattggtgagtcatcaccgaatccaacaatcgaagaaggtagaactctaagagtcttaaaaatggtagagccctggttaaggggcaaccaattttgcattaaaatactaaatccgtacatgccaagcgtcgtggaaacgctagaacaaatgcagagaaagcatggtggaatgctagttagaaacccactatcgagaaactccactcacgaaatgtactgggtttcttgcggtacgggtaatattgtgagtgcagtaaatatgacgtctaggatgttgttgaatagatttacaatggcccatagaaaaccaacgtatgagagggacgtagatttaggtgcgggtactcggcatgtagcagtagagccagaagtcgctaacctagatattataggacaaagaattgagaacataaaacacgagcataaatcaacatggcattatgatgaagacaacccgtataaaacttgggcatatcatgggtcgtatgaagttaaaccctctggatcagcaagcagtatggtcaacggtgtggtaaaactgttgaccaaaccatgggatgtaattccaatggttactcaaattgcaatgacggacaccacaccgtttggtcagcaaagagtatttaaggaaaaagtcgacacgagaactcctaaagccaaacgtgggactgctcaaataatggaggttacagctagatggttgtggggctttctaagtagaaataagaaacccagaatttgtactagagaagaatttacacgtaaggtacgaagtaatgccgcaattggagccgtatttgtagatgaaaaccaatggaactcagcaaaagaagccgtcgaggacgacagattctgggatctagttcatagagaaagggagttacataaacaaggtaaatgcgcaacatgtgtgtataatatgatgggcaaaagagagaagaaattaggagaatttggcaaagcgaaaggttctagagccatctggtacatgtggcttggagctagattcctcgagttcgaagcactaggattcatgaacgaggaccattggttcagcagagaaaattccctgagcggagtggaaggagaaggtttgcacaaattaggatatatcctaagggatatcagcaagataccagggggaaatatgtatgcagacgatacggcaggatgggatacaaggattacagaagatgacttacaaaatgaagcaaaaataacagatatcatggaacccgagcacgccctacttgcgaaatcgatattcaaactaacataccaaaataaagtcgttcgagtccaaagacctgccaaaaacggtacggttatggacgtgatatcccgcagagatcaaagaggatccggacaggtgggtacttacggactcaatacctttactaacatggaggcacaacttataagacaaatggaaagcgagggtatctttctccccaacgaactcgaaactcctaatttagccgggcgtgtactagactggctggagaaatatggtgtggaacgccttaaaagaatggcaataagtggtgatgattgtgtagtcaaaccaatagacgaccggtttgccactgctcttacggctctcaacgacatgggcaaagtacgaaaagatattccccaatgggagccatcaaaagggtggaacgactggcagcaagtaccattttgttctcatcattttcaccaactaataatgaaggatggtcgagagatagtggtgccctgtcgtaatcaagacgaattagtaggacgggcaagagtatcacaaggtgcgggatggtcccttcgcgaaactgcctgtctcggcaagagttatgcacaaatgtggcaattaatgtactttcatagacgtgacttacgtttagccgctaacgccatatgttctgcagtgcctgtagattgggtaccgacttcacgaacaacctggagtatacacgcacatcatcaatggatgacaacagaggatatgctaagtgtttggaatagagtgtggattgaagaaaatccttggatggaagataaaacgcgcataagctcatgggaagacgttccttatctaggtaaaagagaggaccaatggtgtggttctttaataggtctaacagctcgtgcaacttgggcaaccaatattcaagttgctataaatcaagtaagacgactaattggaaatgaaaactactcagactatatgacatcaatgaaaagattcaagaatgagtctgaaccagaaggtgcgttgtggtaa

SEQ ID NO: 21612 - RNA, 9879 nt, synthetic construct
  misc_feature 1..9879: note = derived and/or modified CDS sequence (opt6) from DENV-1__FJ461339__SS-prME
  source 1..9879: mol_type = other RNA
tcggtgactatgctcctaatgcttatgccgactgctctagcgttccatctaactactcgaggcggtgaaccgcacatgatcgttagtaaacaagagcgtggtaaaagtttgttattcaaaacctcagctggagttaatatgtgcacgttaatcgcaatggatctcggtgaattttgtgaagacaccatgacatataaatgtccgagaatcacagaagcagaaccagatgacgtggattgctggtgtaatgccactgacacctgggtcacatatggaacatgttcacaaacaggtgaacacagaagagacaaacgtagtgtagccttggctccacatgtgggattgggccttgaaactcgaactgagacgtggatgagttccgaaggagcctggaaacaaatccaacgagtagaaacttgggccttaaggcatccaggatttacagttattgcacttttcctagcccacgccataggcacaagcatcacacaaaaagggataatattcatattacttatgttagtaacaccttcgatggcgatgcgatgtgtgggaataggatctcgggatttcgttgagggcttatcaggcgcgacatgggtggatgtggtgttagaacacggaagttgtgttacgactatggccaaagataaaccaacattagacatagagcttttgaaaactgaagttacaaatccggcagtcctacggaaactatgtattgaggctaagatctctaacacgaccactgacagtcggtgtcctacccaaggagaggcaactttagtggaagaacaagacgcaaactttgtttgccgacgaactttcgtcgatagaggatggggaaacggatgcgggttatttggaaaagggtcattgataacttgtgcgaagtttaaatgcgttacgaaattagaaggtaagattgtacaatatgagaatttgaagtattcagttattgtcactgtccatactggggaccaacatcaagttggaaatgaaagcacggaacatggcactactgcaacaattactccacaagcaccaagcacggaaattcaacttacagattacggtgccctaacactggattgtagtcctaggactggcttggattttaacgaaatggtacttttaaccatgaaagagaagtcttggctagttcacaaacaatggtttctcgatctccctctgccatggacgtcaggagcatcaacatcccaagagacttggaacaggcaagatctgctcgtaacttttaaaacagcacatgccaagaaacaagaggtcgtcgtactaggttcgcaagaaggagcgatgcacacggcgttaaccggcgctactgaaatacaaactagcggcacaacaacaatttttgcaggtcatctaaaatgtagactcaaaatggacaagctcactctgaaagggatgagttatgtgatgtgcaccggatcatttaagttagagaaggaagtggcggaaacacaacacggaacagtcctagtacaaataaagtacgaaggaactgacgctccttgcaagattcctttctcaacacaagacgaaaagggagtaactcaaaacggacgactaataacggcgaaccccatagtcactgataaagaaaaacctgtaaacattgaagcggaaccaccttttggcgaatcgtatatagtaatcggagctggtgaaaaagcgttaaaattgagctggtttaaaaagggtagctcgataggaaaaatgttcgaagccacagcaagaggcgcacgtcggatggctattttgggcgatacagcctgggactttggctcaatcgggggagtctttacttcagttggaaagttagtgcatcaaatcttcggtactgcgtatggggttttgttcagtggagtttcctggactatgaaaatcggaattggcgtcttacttacatggcttggattaaatagtagatcaacctcactatcaatgacatgcatagccgtggggttagtaactttgtatttgggggtaatggttcaggctgactcaggttgcgttatcaattggaaaggacgagagctaaagtgtgggtctggtatctttgtaacgaacgaagtccacacatggacggagcaatataaattccaagctgattcccccaaaagattaagcgcagccatcgggaaagcctgggaagaaggagtctgtggaatccgatcagcaacgcgtctagagaatatcatgtggaagcagatcagcaacgaactaaatcatatcctattggaaaatgacatgaaattaacagtagtagttggggacgttgcagggattcttgcacaaggaaagaaaatgataagaccacagccaatggaatataaatacagttggaaatcgtggggtaaggctaagataataggcgcagacgtgcaaaatactacctttataatagacggcccaaacacacctgaatgccctgacgaccaacgcgcatggaacatctgggaggtagaggattatggcttcggaatatttacaacaaatatatggctcaaattaagggattcgcatacacaagtatgcgatcacagattaatgagtgctgctataaaggattcgaaagctgttcacgcggatatgggctactggatagaatcagagaagaacgaaacttggaaattagcacgtgcctcatttatagaggttaaaacatgcatatggccgaaaagtcatacactatggagtaatggcgtattggaaagtgaaatgataatcccaaaaatttatggagggcccatcagtcaacataattatagacccggctattttactcaaacagctggaccttggcacttaggtaaactagaactagatttcgacctatgcgaggggacgacagtagttgtagatgaacattgtggtaatagaggtccttcactgaggactacgacagtaactggaaaaataattcacgaatggtgttgtagatcatgtactctgccgcccttaagattcaaaggtgaggatggatgttggtacggtatggaaataagaccagtaaaggaaaaagaagagaacctagtgaagagtatggtatctgcgggatctggagaagtggatagctttagtctgggactcctatgtataagtataatgatagaagaagtaatgaggtcaagatggagtcgaaaaatgctaatgactggtaccctcgcagtatttttcctactaataatgggacaattgacgtggaatgacttaattaggttgtgcataatggtaggggcaaacgcatcggataggatgggcatgggcaccacctacttagctcttatggcaaccttcaaaatgaggccaatgttcgccgttggtctactgtttaggagactcacttctcgagaagttttgctcctgacaataggcttgtcacttgttgcatctgttgaacttcccaatagtctcgaggaattaggagacggtttagccatgggtataatgatacttaaattactcaccgacttccaacctcatcagttatgggcaacattactttcactcactttcatcagaacaacattttcacttcactacgcttggaaaacgatggcaatggtgctatcaatagtgagtctatttccactttgtctaagcacaacctcccagaaaacaacttggttacccgttcttctaggttccctaggttgcaaaccgctcacaatgttcctcatagcagaaaacaagatttggggaagaaaaagttggccactaaatgaaggaataatggcagtaggaattgtatccatattactcagttctcttttgaaaaacgatgtaccgttagccggaccactaatagctggaggcatgctaatcgcatgctatgtcatatcaggaagttcagccgatttatcactggagaaagcggctgaagtcagttgggaagaggaagctgaacattcgggagcaagccataatatccttgtcgaagtccaagacgatggaactatgaagatcaaagatgaggaaagggacgatacattaaccatcctactaaaagctaccctgctagcagtgtcaggggtctatcccttatcaataccagccactttatttgtttggtatttttggcagaagaagaaacaaagaagcggtgtcctctgggatacaccttcacctccagaagtggagcgagctgttttagacgatggtatttatcgaattatgcaaaggggcctactcggtagatcacaggttggcgtgggagtctttcaagaaaacgtttttcacaccatgtggcatgtgacacgtggtgccgtattaatgtatcagggtaaacgactagagccctcttgggcatcagtcaagaaagatctgattagctatggaggcggttggcggttacaaggctcatggaacaccggcgaagaagtacaagttattgcagtcgaaccgggaaagaatccaaagaatgtgcaaaccgcacccggcacatttaagacatcagagggagaagtgggcgccattgctttagactttaaaccaggaacgtcgggtagccctatcgtaaaccgtgaaggcaaaatcgtgggactatacggaaacggggtggttactaccagcggaacttatgtctcagcaattgctcaagctaaagcgtcccaagagggaccgttacctgaaatagaagacgaagtatttcgaaagaggaatttgactattatggacctccaccccggatctgggaagaccagaagatatttaccagcgatagtacgagaagcaatcaagagacgcctcaggaccctaattttagcacctacccgcgtagtagcttctgaaatggctgaggcgcttaagggtatgccgattcgatatcagacaactgctgtgaaatcagagcacacgggtaaggagatagtcgatttaatgtgtcacgctacttttaccatgagattgctatcaccagtacgcgtacccaattataatatgattattatggacgaagctcattttactgatccaagctcaatagccgcacgcggttatattagtaccagagtaggaatgggcgaggcagcagctatattcatgactgcgactccacctggatcggttgaggcattccctcagagcaacgcagtaattcaagatgaagagagagatattcctgagcgatcttggaatagtggctatgaatggataaccgattttccaggcaaaactgtgtggttcgtaccatctataaaatcgggaaatgatatcgcaaactgcctaaggaaaaatgggaaacgcgtaattcaactgagtagaaagacatttgacaccgaataccagaaaactaaaaacaatgattgggattatgtggttacaacagacatctcggaaatgggagccaatttcagagccgatagagtaatcgacccaagaaggtgtttaaaaccagtaatattaaaagatggacctgaaagagtaattttagcaggacccatgccggttacagtagcaagtgctgctcaacgacgtggcaggatcggaaggaatcataataaggaaggcgatcaatatatatatatggggcaacccctaaataacgatgaagatcacgcccattggacagaagccaaaatgctgcttgataacattaatacgcctgaaggcataatccccgcactttttgagcccgaacgggagaaaagtgcagcgatcgatggagaatatcggttaagaggagaagctagaaaaactttcgtagagctgatgagaagaggggacttgcctgtttggctaagctataaagtcgcgtctgaaggttttcaatatagtgataggagatggtgttttgatggtgaaagaaacaatcaagttcttgaagagaatatggatgtggaaatatggacaaaagagggagaacgcaaaaagttacgaccacgttggttggatgccagaacttattcagacccacttgccctaagggagttcaaggagttcgctgcaggaagaagaagcgtatcaggggatcttatcttagaaataggcaaacttccacaacatctaactcagcgagcgcaaaacgcgctagacaacttagtaatgctgcataactcggaacaaggcggacgagcctatagacatgcaatggaagaactccccgacactattgagacattaatgctactagcgctaattgcggtcctcactgggggagtaaccttattctttttatcagggagaggattaggaaaaacctcgattggactactgtgcgtcattgcaagctcagttctcctttggatggcaagtgttgaacctcattggattgctgcatcgataattttagagttctttttaatggtactgctgattccagaacctgaccgtcaacgaactcctcaggataaccagcttgcttacgtagtgattggtttgcttttcatgattttgactgtagctgcgaacgaaatggggttactggaaacaaccaagaaagacttaggaatcggacatgtcgcggtcgaaaatcaccatcatgctgcgatgctagacgtagatctacatccagcatccgcatggacattatatgcagttgcaactactattatcactcccatgatgaggcatacgattgaaaacacgacagctaacattagtctaacggccatagccaatcaggccgcaatattaatgggcttagataaaggatggcctatttccaagatggacataggggtcccattgcttgctttaggatgttatagccaagtaaatcctttaaccttaacggcagcggttttaatgctagtggctcactatgccataatagggccaggtctacaagcaaaagcaacgagagaagcgcaaaagagaactgcggcaggaattatgaaaaatccaactgtggatggcatagtagcaatcgatctcgatccggtagtttatgatgcgaaattcgaaaagcagctcggccaaatcatgttattaattctttgtacatctcagatcctgttgatgcgtaccacatgggcgctatgtgaatcaatcaccttagctactggaccattgacaacgttatgggaaggttctccaggaaaattttggaacacaacgattgcagtcagcatggcaaatatctttcgggggagctacttggctggtgtaggattagcattctccttaatgaaaagcctaggaggcggaaggaggggtacaggtgctcaaggagaaacgcttggagaaaagtggaaaaggcaacttaatcagctatcgaaatctgaatttaatacttataaacgaagtggtattatggaagtagatcgttcggaggccaaggaaggattaaaaagaggagaaacaaccaaacacgcagtaagtaggggaactgcgaaattgagatggtttgtcgagagaaacctagttaaaccagaggggaaagttatagatctaggttgtggaagagggggatggtcctattactgtgcgggactaaagaaggtaactgaagttaaaggatatactaaaggtggaccgggacacgaagaaccaataccaatggccacatatggttggaatttagtaaaacttcactctggcaaagacgtattctttattccacctgaaaagtgcgatacattgctttgtgatataggcgaaagttcacctaaccctacaatcgaagagggaagaaccctacgcgtattaaaaatggtagaaccttggctgagaggaaatcaattttgtataaaaatccttaatccctacatgccaagcgtagtagaaacactagaacaaatgcaaagaaaacacggtggcatgttagtacgaaacccgttaagccgaaattcaacccacgaaatgtattgggtcagctgcggtacaggaaacatcgttagcgcagtcaacatgacttcgcggatgctgctcaatcgttttacaatggcacatagaaaacccacttacgaaagggatgttgaccttggagcaggaactcgacatgtggcagttgaacctgaggtagctaatcttgatataataggtcaaaggatcgaaaatataaaacatgaacataagagtacgtggcattatgatgaagataacccatacaaaacatgggcttatcatggctcatacgaggtaaaaccttccggatccgccagtagtatggtaaatggggtagtcaaattattaaccaaaccatgggacgttatacctatggtaacgcagatagcaatgactgacaccacgccattcggacaacaaagagtgttcaaagaaaaagtggatacaagaacacccaaagcaaagcgaggcacagcgcaaataatggaagtaacggcaaaatggttatggggttttcttagtcgcaataagaagccacgaatatgcaccagggaagaatttaccagaaaagtacgatcaaacgcggcaattggtgctgtcttcgtagatgagaaccaatggaactcagcaaaggaagcggttgaagatgaacggttctgggacctagttcatcgtgaacgagaattgcataaacaaggtaaatgcgcgacatgcgtatacaacatgatgggtaaaagagagaagaaattgggtgaatttggtaaggcgaaagggtcacgtgcaatctggtatatgtggttaggagctagatttttagaatttgaggctctaggtttcatgaatgaggaccattggttttcaagagaaaattcattaagtggggtcgaaggagaaggattacataaattagggtacatactaagagacatctcaaaaataccagggggaaatatgtacgctgacgacacagcgggctgggatacacgtattaccgaagatgatttacaaaatgaagcgaaaataacagatatcatggaaccggaacatgctctactagccaagagcattttcaaattaacttatcagaataaagtggtaagagtacaacgccctgctaaaaatggaaccgtaatggatgtgatatcaaggagagaccaaagaggatcagggcaggtagggacatacggcctaaatacctttactaacatggaggcacaactgataaggcaaatggaatccgaaggaatattttctccgtcggaacttgaaacaagcaatcttgcagggagagtcctagattggttggaaaaacatggagttgagcggttaaagagaatggccataagtggagacgattgtgttgtaaaaccgatagacgaccgcttcgcaacagctttaaccgccctgaatgatatgggaaaagtaagaaaagacataccacagtgggaacccagtaaaggctggaacgactggcaacaagtcccattctgctcacatcattttcatcaacttattatgaaggatggcagagaaatcgtcgtgccgtgtcggaatcaagatgagctagtagggagggcacgggtaagccagggagcaggttggagtttacgagaaacagcttgtttgggaaaaagctatgctcagatgtggcaattaatgtattttcacaggcgagacttaagacttgcagccaacgctatctgctcggctgtccccgtagattgggtcccgacaagtaggacaacatggtctatccatgcccaccatcaatggatgacgacagaggacatgctaagtgtgtggaacagagtgtggatagaagaaaatccctggatggaagacaagactcacgtgagcagttggggagatgtaccatatttgggaaaacgagaggatcaatggtgcggatcattgatcggattgacggcgagagctacctgggcaacgaacatacaagttgcgataaatcaagttagacgactacttggcaatgagaactacttagactatatgacaagtatgaaacggtttaaaaatgaaagcgatcctgaaggagcactatggtga

SEQ ID NO: 21613 - RNA, 9879 nt, synthetic construct
  misc_feature 1..9879: note = derived and/or modified CDS sequence (opt6) from DENV-1__FJ882515__SS-prME
  source 1..9879: mol_type = other RNA
tccgtgacaatgctccttatgctaatgccaacagcacttgcattccatctcaccaccagaggtggagaaccacacatgatcgttacaaaacaagaaaggggcaaatcacttctctttaaaacaagtgcaggggtgaatatgtgcacactaatagcaatggatcttggcgagttatgtgaagacactatgacatacaaatgcccaagaatcacggaagcagaacccgacgatgttgattgttggtgtaatgcaacagatacatgggtaacatacggaacttgctcacaaacaggtgaacatcgaagagataaaaggtctgtagcactagctccacacgtaggcttaggattggagacaaggactgagacgtggatgagctccgaaggtgcttggaaacaaatacagcgagtcgaaacgtgggcgttaagacatccaggcttcacggtgatagctttgtttcttgctcacgccatcgggacttcaattactcagaaaggaattatctttattctattaatgttagtcactcccagtatggcaatgagatgcgttggtataggctcaagggacttcgtggaaggactttcgggcgcgacatgggtagacgtcgttctcgaacacgggagctgcgtaaccacgatggcaaaagataaaccaactttagacatagaactcctgaaaacggaagtgacgaatccggctgtgctacgcaaactttgtattgaagctaaaatatctaatacaacaactgactcgcgttgtccaacacagggcgaagcaacgctaatggaagaacaagatgccaattttgtttgtaggagaactttcgtagacagaggatggggtaatggttgcggcctattcggaaaaggttctctaatcacgtgcgcaaagtttaaatgtgttaccaagttagaagggaagatagtccagtacgaaaatctcaagtactcagtaatagttacagttcataccggtgaccagcaccaagtaggaaacgaatccactgaacatggcacaacagcgacaataactcctcaagcacctacgtccgaaatccagttgaccgattacggtgcattgacactggattgctctccacgaactggactagactttaacgaaatggtgctactgacaatgaaggagaaatcctggttagtccacaaacaatggtttttagatcttcctcttccttggacgtctggggcttctacctcacaagaaacctggaatcgtcaagatctattagtgacttttaaaacggcccatgccaagaaacaggaggtcgtagtattggggagccaagaaggagcgatgcatacggcattaacgggagcaacagaaatccagacctcaggaacaacgaccatttttgcggggcatttgaagtgcagattgaaaatggataaactaactttgaaggggatgagctatgtcatgtgcaccggatcattcaaactagaaaaagaggtggcagaaactcaacatggaacagtacttgttcaaataaagtacgaagggaccgatgcaccgtgtaaaataccgtttagtacacaagacgaaaaaggagtgacgcagaatggaaggttgataacagcaaatccaatagttacagacaaggaaaaacccgtcaatatagaagccgagccaccgttcggagaaagttacatagtaattggagctggtgaaaaagcattaaagttgagctggttcaagaaaggttcaagtattggcaaaatgttcgaagcaacagcccggggtgcaaggagaatggctatacttggagatactgcgtgggactttggaagcattggcggagtatttacatcaataggtaagttggttcaccaaatatttggcacagcctacggagtgttattttcaggtgtctcgtggaccatgaaaatcggaataggcgtactactaacttggctaggccttaacagcagatccacatcgctaagcatgacatgcatagccgtcggattagttacgttgtatcttggagtaatggtacaagctgattcggggtgtgtaataaactggaaaggcagagaattaaaatgcggttctggcattttcgtgacaaatgaggtgcatacatggacagagcaatacaagttccaagcagattcacccaagaggttatcggccgcaattgggaaagcctgggaagagggagtttgtggtatacgatcggccacaagacttgaaaacattatgtggaaacaaattagtaatgaactaaaccacatactcctcgagaacgatatgaaattcactgtagtggtaggcgatgtagtagggattctagcccaaggtaagaaaatgatcagaccacaaccaatggagcataagtattcgtggaaatcatgggggaaggcaaaaataataggagctgatgtgcaaaatactactttcataattgatggtcctaacacaccggaatgccccgatgaccaaagagcgtggaacatatgggaagtagaagattatggatttggtatttttacaacaaatatttggttaaagatgcgagactcctatacccaggtgtgcgatcatagactaatgagtgctgcaataaaagactctaaggcagtccatgcagatatgggatactggatagaatccgagaaaaatgaaacttggaagctagcgcgcgcatctttcatagaagtcaaaacgtgtatatggccaaaatcgcacactctctggagtaatggtgttcttgaatcagaaatgataattccaaagatatatggtggaccaatttcgcaacataattataggcctggatactttacccaaaccgcaggtccttggcatctcggtaaattagaattagattttgatctatgcgaaggaacaactgtagtagttgacgaacactgtggcaacagaggaccttctttgcgaacaaccacagttactggcaaaataattcatgaatggtgttgcagatcatgcactttgccaccgctgcgtttcaaaggagaggacggatgctggtacgggatggagataagacctgtcaaagagaaggaagagaatttagtaaaatccatggtatccgcaggatcgggagaggtcgatagcttcagcctcggtttactatgtatctctataatgattgaggaagtaatgcgttctagatggagccgaaaaatgttaatgactggtacgttagctgtgtttctgttactcatcatgggccaactgacatggaatgatcttattaggctttgtattatggtaggcgccaacgcttcagatcgaatgggcatgggaactacatatctcgcattaatggcgacgttcaaaatgcgaccaatgtttgcagtagggttactttttagacgtttaacttcccgtgaagttctcctacttacaatagggttatcattagttgcgagcgtagagttacccaacagtttggaggaactaggagatggtcttgcaatgggcatcatgattctaaaattacttacagatttccaatcgcaccaactttgggcaacgcttctatctttaacttttataaagacaaccttatcgttgcattatgcatggaaaacaatggccatggtccttagcatagtatctttaataccgctatgtctgagtacaacatcccaaaagaccacctggttaccagtattactaggctcattaggttgtaaacccttaaccatgtttcttatagcagaaaataaaatctggggaagaaaatcttggcctttgaacgaaggtataatggcggtgggtgtggtgtctatcctgttatcttctttattaaagaatgacgtgccactagctgggccactaatcgctggtggcatgttgatagcatgctatgtcatttcaggttcatctgccgacttatcactagaaaaggccgctgaagtgagttgggaagaagaagctgaacattcaggagcctctcataatatattagttgaagtacaagacgacggtacgatgaaaattaaagatgaagaaagagatgacacactcacaatattgcttaaagcgacacttttagccgtatccggagtttatccactgagcataccagcaactttatttgtatggtacttttggcagaaaaagaaacaacgtagtggagtgttatgggatacacccagtccgccagaagtggaacgtgcagtgttggatgacggcatctacaggataatgcagagaggacttttaggaagatcccaagtgggggtgggtgtgttccaagagaatgtcttccatactatgtggcatgttacgagaggtgcagttctaatgtatcagggaaaaagactagagccatcttgggcatcagtcaagaaggatctaatatcatacggaggagggtggcggttacaagggtcgtggaatacgggtgaagaagtacaggtgattgctgtggagcccggcaaaaatccgaagaacgtacaaacggcgcctggtaccttcaagacaccagagggagaagtaggtgcgatagcactagattttaaaccggggacatcaggcagccctatcgtaaaccgagaagggaaaattgtcgggttatatggaaacggagtagtaacaacttcgggaacatatgtatcagcgattgcccaagctaaagcaagtcaggagggcccactaccagagatagaggatgaggttttcagaaaaagaaatttaacaattatggatctgcatccgggttcaggaaaaacgcgaagatacttaccagcaatagtcagagaagctataaaaagaaaattgcgtaccttaattctagcaccaacgagagttgtagcatcagaaatggccgaagccctcaaaggcatgcctatacgttatcaaacgactgctgtaaaatctgagcataccggcaaagaaattgtagacttgatgtgtcacgcaacattcacaatgcgtcttctaagtcccgtaagagtacctaactataatatgattatcatggacgaagcgcatttcacagatccatcaagtattgcagccagaggatacattagtactagagtgggaatgggagaagctgctgctatatttatgactgcgaccccgccaggtagtgtcgaagcattcccacaatctaatgcagttatacaggatgaagaacgagatattcctgaacggtcctggaatagcggatacgaatggatcactgactttcctggcaagactgtttggtttgtgccatcaattaagtctggaaatgatatagctaattgtctaaggaaaaatgggaagagagtcatacaattgtcccgaaagacattcgacactgaataccagaaaacaaagaataatgattgggattacgtcgtaacgaccgatatatctgaaatgggagcaaacttcagagcagaccgagtgattgatccgcgtagatgcctaaaaccggtcatccttaaagatggaccagaacgtgtgatcttagcagggcctatgccggtgactgttgcatctgcagctcaacgaagaggacgcataggtagaaatcataacaaagaaggcgatcaatatatttatatgggccaaccactaaacaatgacgaagatcatgctcactggactgaagccaagatgcttctagataatattaacacgccggagggtataataccagccttatttgaacccgagagggagaaaagtgccgccatagatggagagtatagattgcgaggagaagcaaggaagacattcgtagagttgatgagaaggggcgacttaccagtttggttatcgtataaagtagcctctgaagggttccagtactcagataggaggtggtgcttcgacggcgaaagaaataatcaagttcttgaggaaaatatggatgtcgaaatttggacgaaagagggcgaacgtaagaaactcaggcctagatggcttgatgcacgtacatattctgacccattggcgttaagggaatttaaagagttcgcagcaggaagacgaagtgtttcaggagatctaatcttagaaatagggaaattaccccaacacctgactcaaagagcccaaaatgcattagataatctagttatgcttcataatagtgaacaaggaggaagggcatacagacacgctatggaagaactaccggacacaattgagacattaatgctccttgcattaatagccgtattaacaggcggtgttactctcttcttcttaagtggaagggggctaggcaaaacaagcataggtttgctgtgtgtaatggcttcatcagtcttactgtggatggcctcggtagaaccgcactggatcgcagcttcaataattttagagttctttttgatggtattactgataccagaacccgataggcaacgcactcctcaagacaatcaattagcatatgtcgttatcgggttattgtttatgattttgacagttgcggcaaatgaaatgggattattggaaactactaagaaagacttagggatcgggcatgttgcagttgaaaatcatcaccacgccacgatgttagacgtagacttacatccagcctcagcatggacgttatatgcagtagccacgactatcattactcctatgatgcgccatactatagaaaataccactgccaatatcagcttaacagcaatagccaatcaagcagcgattctaatgggactcgataaaggctggcctatttccaaaatggacattggtgtacctttacttgctttgggatgctattcccaagtaaacccacttacactcactgccgccgtcttaatgctagtagcccattacgcgataattggtccaggattgcaagcgaaggccacacgtgaagcgcagaaaagaaccgcagctgggataatgaaaaatccgacagttgacgggatcgtcgcaattgatttagacccagtggtctacgatgcaaagtttgaaaagcaattaggccaaatcatgctgttaatactgtgtacgagccaaattcttcttatgaggacgacttgggccctgtgtgaatccatcactttggcaacaggaccgttaactacactatgggaaggctcaccgggaaaattctggaacaccactattgcagtgtcaatggcgaatatctttagaggcagttatctagccggtgcaggccttgcatttagcctcatgaagagtttgggtggaggtagacgtggaacaggcgcgcaaggggaaacgttgggagaaaaatggaaaagacaattaaatcaactaagcaaaagcgaatttaatatatacaaacgtagtggaataatggaagtagataggtcggaggcgaaagaaggcctcaaacgaggagaaacaacccgacacgctgtaagtagaggaacagcaaagttaagatggttcgtcgaacgaaatctagtcaaacctgaaggtaaggtaatagacttaggttgcggaagaggcggatggtcatattactgtgccgggcttaagaaagttacagaagtaaaaggttacactaaaggaggtccgggccatgaagaacccatccccatggctacttacggttggaaccttgtgaaactacattcaggaaaagatgtatttttcacaccacccgaaaaatgcgacaccctgctatgtgatatcggagaaagctctccaaacccaacaatagaagagggtcgaacattaagagtactgaaaatggtagaaccatggttgcgagggaatcaattttgtatcaaaatactcaatccatacatgccgagtgtggtcgagacgctagagcaaatgcagagaaaacacggcggaatgctcgttcgtaaccccctatcgagaaattcaacgcacgaaatgtattgggtgagttgtggtacaggaaatatcgtatcagctgtaaatatgaccagcaggatgcttttaaatagatttacaatggctcatcgcaaaccaacatacgagaaggacgtagatttaggggccggtacaagacacgtcgcagttgagccagaagtagcaaatcttgacataatcggacaaaggatagagaatattaaacatgaacacaagtcgacctggcattacgatgaagataatccctacaaaacatgggcatatcatggctcgtatgaagtgaaaccatcgggatcagcatccagcatggtaaatggagtggtcaaattactaacgaaaccgtgggatgtgatcccaatggtaacacaaatagccatgacagacactacgccgtttggccaacaaagagtatttaaggaaaaagtcgacactagaacgcctaaagcaaagagaggaacagttcaaatcatggaagtaactgcacgctggctctggggatttctatccagaaataagaaaccacggatatgcactcgggaagagtttactagaaaagtacgaagtaatgcggcaataggcgcagtatttgtcgatgaaaatcaatggaactcagccaaggaggcagttgaagacgaacgcttttgggatcttgtacagaaagagcgagaattgcacaaacaaggaaaatgcgcgacttgcgtatacaatatgatgggaaaacgtgaaaagaaactaggagagtttggaaaggctaagggcagcagggcgatttggtatatgtggttaggcgcaaggttcctagagttcgaggcattaggatttatgaatgaagatcattggttctcgagagaaaattctttatctggggtagaaggagagggactgcacaaactaggttatattttaagggacatttccaagatacccggaggtaacatgtacgcagacgataccgcggggtgggatacaaggataactgaggacgacttacaaaatgaggcaaagatcactgacataatggaacccgaacatgccctacttgctacatcgatttttaaactcacttatcaaaacaaagtagtcagggtacagagacctgctaaaaacggaactgtcatggacgtaataagtagaagagatcaacgaggatcgggccaagtagggacatacggattaaacacatttacaaatatggaggcccaattaatacgccagatggagtcggaaggtattttcttaccaagtgaactcgaaacacctaacttggccgagagggtattagattggctagagaaatacggagtagaaagactgaagcgcatggccatctcaggagacgactgtgttgtaaaacccatagatgatagatttgctactgcattaacagcactaaacgacatgggaaaagttcgtaaagacattcctcaatgggaaccctcaaaaggctggaatgattggccacaagtcccacattgttcgcatcacttccatcaactgattatgaaagacggacgcgaaatcgtagttccatgtcgcaatcaagatgaattagtgggacgagcaagagtaagtcaaggcgcgggttggagcttaagagaaacagcctgcctaggaaaatcatacgcacaaatgtggcagctcatgtacttccaccgaagagaccttagactagcagcaaatgccatatgttctgctgtccccgtcgattgggtgccgacttcacgaacaacatggtctatccatgctcatcatcaatggatgacaaccgaagacatgttatcggtatggaaccgagtttggatcgaagaaaatccatggatggaagacaaaacacatgtctcaagttggggtgacgttccatatttaggtaaacgggaggaccaatggtgtggatctttaatcggactaaccgcacgagcaacttgggcatcgaatattcaggtcgcaattaatcaagtaagacgcctcataggtaacgagaattatctagattacatgacttctatgaagagatttaagaacgaagacgatcctgaaggtgcactctggtag

SEQ ID NO: 21614 - RNA, 9879 nt, synthetic construct
  misc_feature 1..9879: note = derived and/or modified CDS sequence (opt6) from DENV-1__FJ882517__SS-prME
  source 1..9879: mol_type = other RNA
agcgtgactatgctgttaatgttaatgccaacggcgctcgctttccatctaacgacccgagggggagaaccccatatgattgtttctaaacaagaaagaggtaaatccttactgttcaaaacgtctgcaggggttaacatgtgtacattaattgctatggacctcggtgaattttgcgaagacacaatgacttataaatgtccaaggatcaccgaagccgaaccagacgatgttgattgctggtgcaatgctaccgatacctgggttacctatggaacgtgcagccaaacaggagagcatagaagagataaaagaagtgtggcgttagcaccacacgtaggacttggattagaaaccagaacagaaacctggatgtcctctgaaggtgcttggaaacaaatacaaagagtagagacatgggcacttcgacatccaggcttcacagtaatagcattatttcttgcacacgcgattggtacctcaataacacaaaaaggtataatcttcatattgctgatgctagttacgccatcgatggcaatgcgatgtgttggtatagggagccgtgatttcgttgaaggactaagcggggcaacttgggtagacgttgttttagaacatggtagttgcgttacaacgatggcaaaagacaaaccaaccctggatatagaattgttaaagacagaagttacgaacccagctgtactaagaaagctgtgtattgaagcaaaaatttcgaacacaacaacagattcacggtgtcctacgcaaggtgaagcaaccttagtagaggagcaagatgcgaatttcgtgtgtagaagaacttttgtcgaccgaggatggggaaacggttgcgggttgttcggaaaaggttcgcttataacctgcgccaaatttaagtgcgttacaaaacttgaaggtaaaacggttcagtacgaaaacttaaagtactcggtgatcgttacggtgcacacaggggaccaacatcaagttgggaacgagagcaccgaacatggtactaccgcgacaattacgccacaagcaccaagtaccgaaattcaattaacggattacggggcactaacactagactgctcccccagaacaggcttggacttcaacgaaatggtgctacttacaatgaaggagaaaagctggctagttcacaaacagtggtttcttgacttgccattaccgtggacaagtggcgcgtctacaagtcaagaaacttggaacagaaaagacctgttagttacgtttaaaacagctcacgctaaaaagcaggaagttgtagtacttggaagtcaagagggtgcaatgcataccgcacttacgggagccacggagatccaaacaagcgggactacgacgatatttgcaggacatcttaaatgtagattaaaaatggacaaactgacgttaaaggggatgtcctatgttatgtgcactggatcatttaagttagaaaaagaagtggcagaaacacagcatggtacagtactcgtccaaataaaatatgaaggtacagatgcgccttgtaagattcctttcagtactcaagacgaaaagggtgtaacacaaaacggtagactaataactgcaaaccccatagtaacagacaaagaaaaaccagtaaatatcgaggcagaacctccatttggtgaaagctacatcgtaatcggtgcaggagaggaagcattaaaactatcctggtttaagaaaggcagcagcatcggtaaaatgtttgaagcgactgcaagaggagctagaagaatggctatcttaggagacactgcctgggattttggatcaataggaggtgtttttacaagtgttggaaagctggtacaccagatattcggcactgcgtatggtgtattgttttcaggtgtcagctggactatgaagataggaattggagtgctacttacttggttaggattaaatagtcgttctacgtcgctgtccatgacctgtattgcagttggcttagttacattgtacctaggtgttatggtacaagccgattctgggtgcgtcattaactggaaaggaagagaactaaagtgtggctcaggaatattcgtcacgaatgaagtgcatacatggacggagcaatataagtttcaagccgattctccaaaacgcttaagtgcagccataggaaaagcatgggaggaaggtgtgtgtggcatacggagtgcgacaagattggaaaatataatgtggaaacaaatatctaacgaactaaatcatatattgctagaaaatgacatgaagttcaccgtggtagttggtgatgtagcaggaatcttggcacaaggtaagaaaatgataagaccacaaccgatggaatataaatactcatggaaaagttggggtaaagctaaaataattggcgctgacgtacaaaatactacattcattatagatggacctaatacacctgaatgccctgatgatcaaagggcctggaacatttgggaggtagaagactatggtttcggtatttttaccactaacatttggctaaaactaagagatagttatacacaagtctgtgaccatagattgatgagtgccgcaataaaggactctaaggcagttcacgcggatatgggttattggatagagagcgagaaaaatgaaacgtggaaattagcacgagcatcatttatagaggtaaaaacgtgtatatggccgaagtctcatacactatggtcaaacggggtactggaatcagaaatgattattcctaaaatatacggtggacctatctctcaacataattatcgacctggctactttacacaaactgccgggccttggcatctcggaaaacttgaacttgacttcgatctctgcgaggggacaacagtagtagtcgatgaacattgcggaaaccgaggtcctagtctgcgcacaacaaccgttactggaaagataatacatgaatggtgttgtcgcagttgcacgttaccaccattaagatttaaaggcgaggatggttgttggtatggtatggaaataagaccggttaaagaaaaagaagaaaatctagttaagtccatggtctcagccggatcaggagaagtagacagtttttctctaggtctgttgtgtatttcaataatgatagaagaagtaatgcgatctcgctggagccgcaaaatgctaatgactggcacgcttgcagtcttctttctattaatcatggggcaactaacgtggaatgatctcattaggttatgcatcatggtcggagcaaacgcttccgaccggatgggtatgggcactacatacttggcattaatggtaacctttaaaatgagaccgatgttcgcagttggcttattatttagacgattaacaagtcgtgaagtactcttgctgaccatcgggctatcactggttgcatcagtggaattgccaaacagcttagaagaattgggggatggactagcgatgggaatcatgattttaaagctactcactgactttcaatcgcaccagctctgggcaactttgctgtcattaaccttcataaagactacgtttagcttacattatgcgtggaaaaccatggcaatggtacttagcattgtatcactctttccattgtgtttaagtacaacaagccagaaaaccacctggcttcctgtgttattgggatcattaggatgcaaaccactaaccatgtttttgatcgcagagaataaaatttggggaagaaaatcttggcctcttaatgaaggcataatggccgtcggaatagtgtcgattctattaagtagtttattgaaaaatgatgtgcccctagcaggaccgcttatagcaggaggaatgctaatcgcatgctacgtaatatcaggttcatcagctgacttatcccttgagaaggccgcggaagtgtcatgggaagaggaagctgaacattcaggagcatctcacaacatacttgtagaggtacaagatgacggtactatgaaaataaaggacgaggaaagagacgatactttgacgatacttcttaaagcaactcttttagccgtctcaggcgtatatccactgtctatccccgcaacactatttgtatggtacttttggcaaaagaagaaacaaagatcaggagtactatgggacacccccagtccaccggaggtagagagggcagtcctagatgacggcatctacaggattatgcagcgggggttactagggcgatcacaagttggagtaggagtattccaagaaaacgtattccataccatgtggcacgtgacacgtggcgcagttctgatgtatcagggaaaaagattggagccttcatgggctagcgtaaagaaagatcttataagttatggagggggctggcgattacaagggtcatggaatactggtgaagaagtacaagtaattgctgtagaaccaggcaaaaatcccaaaaacgtgcaaacagccccaggtacatttaaaacaagtgaaggggaagttggtgctatagctttggactttaaaccgggtacatctggatcacccattgttaatcgggaaggaaaaatagtaggattatacggtaatggcgtagtaactacgtcaggaacatacgttagcgcgatagcacaggccaaggcttctcaagaaggtccgctcccagaaatagaagacgaagttttccgtaagcgtaacttaaccataatggatctccatcctggaagcggaaaaacccggcgatatttaccagcaattgtacgggaagcaattaaaagaaagttgcgtacgctaatattagctccgacgagggttgtggccagtgagatggcagaggctttgaagggcatgccgatcagatatcaaacaacagccgtaaaatctgaacatacgggaaaggagatagtagacttaatgtgtcatgctacatttacaatgaggttattatcaccggtgagagtacctaattataatatgattattatggatgaagcacactttacagacccgtctagtatagccgcccgaggttacataagtacacgtgtgggtatgggagaggctgcagcgatatttatgactgctacaccacctgggtccgtggaagcctttcctcaaagcaacgcggtaatccaagatgaggaacgggatataccagaaagaagctggaatagcgggtatgaatggataacggattttccaggtaagaccgtttggtttgttcctagtataaaatcaggaaacgatatagcaaactgccttaggaaaaatgggaaaagggtaattcagcttagtaggaaaacatttgatacagaataccagaaaacgaagaataatgactgggactatgtcgtcacaactgatatctccgagatgggggcgaatttcagagcagacagagtgattgatccacggcgatgtttgaaaccggtaattctcaaagatggtcccgaaagagtaatactcgcaggtcctatgcctgtaactgtagcgtccgctgcacagagacgcggacggattggacgaaaccacaataaagaaggtgatcaatacatttatatgggtcaacctctaaataatgacgaagaccatgcacactggactgaggcaaaaatgttactagacaacataaacacgccagaaggaataatcccggctttattcgaacctgagagagagaaaagtgcagcaatagatggcgagtacagattaaggggagaggcaagaaagacattcgtagaactaatgaggcgtggtgaccttccagtatggctatcctataaggttgcttctgaagggtttcaatacagcgaccggaggtggtgctttgacggtgagcgtaataaccaggtactcgaagaaaatatggatgtagaaatatggacaaaagaaggtgaaagaaagaaactaagaccgaggtggttagacgctagaacatactcagacccattggcacttcgggagtttaaagaatttgcagccggaaggagatccgtcagtggagacctgattcttgaaatcggaaaattgcctcaacatctaactcaacgagctcaaaatgcgctagataacttggtaatgttacacaattcagagcaaggaggtcgcgcttatagacatgctatggaagaactcccagataccatcgaaactttaatgctattagctttgatcgcagttctaacaggaggtgtcactctgttctttctgagtggaagaggattaggcaaaacatcaattggacttctatgtgtaatggcatcctcagtattgttgtggatggcctccgtcgaaccacattggatagcagcatcgatcattctggagttctttcttatggttttactaatacctgaacctgatagacagagaacaccacaggataaccaactcgcctatgtagtaatcggactactattcatgatattgacggtagctgcaaatgaaatgggtttactcgagacaacgaagaaagatctcggtattggacatgttgcggtcgagaatcaccaccatgcagcaatgttagatgtagacttacacccagcaagtgcttggaccctctatgctgtcgcgactactatcataactccaatgatgcgccataccatcgaaaatactacagcaaacatatccttaaccgcaattgctaatcaagcggcaatcttaatgggcctagacaaaggttggcctatatcaaaaatggacattggagtcccacttttagccttaggctgttatagtcaagtgaatcctcttactttaacagctgcagtgttgatgctagtagcgcactatgccataattggtccgggactccaagctaaagccactagagaagcacagaaaaggacagcagcaggaataatgaaaaaccccacagtggatggtatagtcgctatagatctggaccctgtggtctatgatacaaagttcgagaaacaattaggtcaaattatgttgttaatattatgcacgtctcaaattctactaatgaggactacgtgggcactttgcgagtctatcacgctggcgactggacccttaaccacgttatgggagggttcgcctggaaaattctggaacacaacgattgccgtaagcatggcaaatatattcagaggttcctatttagcgggtgctggattagcattttcgttaatgaaaagtctaggtggcgggagacggggaactggagcgcaaggagaaacactaggagaaaaatggaagcgtcagttaaaccaattgtctaagagtgaatttaatacatataaacgatcaggcataatggaagtagacaggagcgaagctaaagaaggattaaaaagaggagaaactaccaaacacgcggtatcccgtggaactgccaaacttcgatggtttgtagaaagaaacttagtaaaacctgaaggaaaagtcattgatttaggatgcggaagaggtggatggtcttactattgcgccggattgaagaaagtaaccgaagtgaaaggatatacaaaaggtggtccagggcatgaagaacctattccaatggcaacctatgggtggaacctagtaaaactccattctgggaaagatgtattctttattccgccagagaaatgtgatacactactctgtgatataggtgagtcctcaccgaatcctactatcgaagaggggaggacactaagagttctcaaaatggttgaaccgtggctgcgaggaaatcaattttgcataaagatactcaacccatacatgccctctgtcgttgaaacattggaacaaatgcagcgaaagcacggaggaatgttagttaggaacccattatcaagaaacagtactcacgaaatgtattgggtatcttgcggcactggaaatattgtaagtgccgttaatatgacgtccagaatgctcttgaacagattcacgatggcacaccgcaagccgacatacgaaagagatgttgatcttggtgcaggaactaggcatgtagccgtagaaccagaagttgctaacctagatataatcggtcaacgaattgaaaacatcaaacatgagcacaagagtacatggcactacgatgaagataacccatataagacttgggcgtatcatggttcatacgaagtaaaaccttcggggagtgctagttcgatggtgaatggtgtggtgaagctattaacaaaaccttgggatgttataccaatggtgacccaaatagcaatgactgatactacacccttcggccaacaacgggtatttaaagaaaaagtcgatacacgaacacctaaggccaaaagaggaactgctcagataatggaagtgactgccaaatggctatggggattcttgtctcgaaataagaaaccaaggatttgtacacgagaagaatttacaagaaaagtacgatccaatgcagctataggtgcagtattcgtcgacgaaaaccaatggaactcagcgaaagaggcggtcgaggatgaaagattttgggacttagtacatagggagcgcgagctgcacaaacagggaaagtgtgctacttgtgtttataacatgatgggcaaacgcgaaaagaaattaggcgaatttggaaaagcgaaaggtagccgtgccatttggtacatgtggcttggtgccaggtttcttgagttcgaggcacttggatttatgaatgaagaccattggttcagtagggaaaattcattgtcaggtgtcgagggagagggacttcacaaattgggatatattttgcgggacattagtaaaataccaggcggaaatatgtacgctgatgatacagcaggttgggatacacgaatcaccgaggacgatttacaaaacgaagccaaaataactgatattatggaaccagaacatgcattattagctaagagcattttcaaactcacataccaaaacaaagtagtcagagtccaaagaccagcaaagaatggtactgtgatggatgtaatcagtagaagagatcaaagggggagtggtcaggttggaacatacggtcttaatactttcacgaacatggaagctcaattgataaggcaaatggaatccgaaggaatcttttcaccaagtgaattagaaactcctaatcttgcggggagagttttagattggttagagaagcatggggtggaaagattaaaaaggatggcaatttcaggagatgattgtgtagtgaaaccaatcgatgatagatttgcaactgcattgactgcgttaaatgatatgggaaaggttaggaaggatattccacagtgggaaccgagcaagggatggaatgactggcaacaagttccattttgttctcaccacttccaccaattaattatgaaagatggtcgagaaatagttgtaccctgccgaaatcaggacgagttagtaggcagagctagggtatcacaaggagcaggatggtcactcagagaaacagcatgtttgggaaaatcgtacgctcaaatgtggcaactcatgtacttccacaggagagacctaagactagcggcaaatgcaatatgttctgcagtaccagtggattgggtacctacgagcagaacaacatggtcaatacacgcacatcatcagtggatgaccaccgaagatatgttaagcgtatggaatagagtctggattgaagaaaatccgtggatggaagataaaacccatatttctagctggggagacgtcccatacctaggcaaaagagaagaccagtggtgcggcagcctaataggcctcacggccagagctacgtgggcaacgaacatacaagtggcaataaaccaagttagacgcttaattggtaacgaaaattaccttgattacatgacgtcaatgaagaggttcaaaaatgagtcggaccctgagggggcattatggtaa

SEQ ID NO: 21615 - RNA, 9879 nt, synthetic construct
  misc_feature 1..9879: note = derived and/or modified CDS sequence (opt6) from DENV-1__JQ287661__SS-prME
  source 1..9879: mol_type = other RNA
agcgtaactatgctactgatgttaatgccaactgcgctggcattccatcttactacgaggggtggagaaccacacatgatcgttaccaaacaagaacggggcaaatctttactattcaaaacaagtgcgggtgttaacatgtgcactctaattgccatggacttaggagaattatgtgaggatactatgacatacaaatgcccgaggataacagaggcggagcccgacgatgttgattgctggtgcaacgcgactgatacgtgggttacctatggcacttgttcgcaaaccggagaacatcgccgcgacaaaagatcggtcgctttagcaccgcatgtgggattaggtttagagacaagaacagaaacgtggatgagctcggaaggagcatggaaacaaattcaacgagtcgaaacttgggcattaaggcatccaggatttacagtcatagctctgtttttagcacacgcaattggaactagcataacacaaaaaggcatcatatttattttattaatgcttgttacaccatcaatggccatgcgatgtgttggaatcggtagcagagatttcgttgaaggcctatcaggagccacctgggtagacgttgtattggaacatggtagttgcgtaacaacaatggcaaaagacaaaccaacgcttgatatagagctactcaaaaccgaggtcactaatcctgctgttctacgaaagttatgcattgaagcaaagatatctaatactactaccgactcccgatgccccacacagggggaagcgactctaatggaagaacaagatgcaaattttgtatgtcggaggacttttgttgaccgtgggtggggtaacggatgcggattgtttgggaaagggtccttaattacttgcgcaaaattcaagtgcgtaaccaaacttgaaggaaaaatagttcaatacgaaaacctaaaatacagtgtaatagtgactgtgcatacaggagatcaacatcaagtaggcaatgaatctactgaacacggcactaccgctacgataacaccgcaagccccgacatctgaaatacaattgactgactatggagcattaactctagattgctctcctagaacggggttagacttcaatgaaatggttttattgacaatgaaagaaaaatcatggctcgttcataagcaatggtttttggacctccccctaccttggacgtctggggcatctacaagtcaggagacctggaatagacaagatttattagttacttttaagacagcacacgctaagaaacaagaggtagtagtactaggttctcaagaaggcgcaatgcacaccgcattaacaggcgccaccgagattcagacaagtggaaccacaacaatatttgcgggacatctaaaatgtagactaaagatggacaaattgacgctcaaaggcatgtcatatgtcatgtgcacaggttctttcaaactagaaaaagaagtagcagaaacacaacacggtacggtattggtacaaatcaaatatgaaggcacagacgcgccatgcaaaataccgttctctactcaagacgaaaaaggagtaactcaaaacggtcgattgatcaccgcaaatcccatagtaacggataaagaaaaaccagtaaacattgaagcagagccaccattcggcgaatcgtatattgtaataggagcgggcgaaaaagccctcaaattgtcgtggtttaaaaagggcagtagcatcggaaagatgttcgaagccacagcccggggtgcaaggcgaatggccatactcggagatacagcttgggactttggaagtataggcggtgtatttacctcaattgggaagttagtccaccagatatttgggaccgcctatggtgtcttattctccggtgtgagttggactatgaagatcggaatcggggttttattaacatggttagggctgaacagccgatcaactagcttgagtatgacatgcatagcagtaggcttagtgacgttatatttaggggtcatggtacaagcagactctggatgcgtcataaactggaaaggaagggagctaaagtgtggcagcggaatttttgtaactaatgaagttcacacctggactgaacagtacaaattccaggcagactcccccaaacggttatctgcagcaataggtaaagcatgggaagagggcgtatgcggtattcgatcagcaacgcgcctggaaaacgtaatgtggaaacaaatatcgaacgagcttaatcatattctgttagaaaatgacatgaaattcaccgtagtcgttggggacgtcgtaggtatactagcacaaggaaagaaaatgattcgtccgcaacctatggaacacaagtactcttggaaatcatggggtaaagcaaagatcatcggagcagacgttcaaaacacaacttttataattgatggaccaaacactcctgaatgtccagatgatcaaagggcctggaacatctgggaggtagaggattacggctttgggatattcacgacaaacatatggttaaagatgagagattcttacactcaagtctgcgatcatcgactaatgagcgccgccatcaaagattcgaaagccgtacacgctgacatgggttattggatagaatctgagaaaaacgaaacgtggaaactggcgagggcgtcctttatagaagtcaaaacatgtatatggccaaaatcccatactttgtggtctaatggagtactagaaagcgaaatgattataccgaagatttatggaggcccgatatctcaacataactatcgaccgggatactttacccaaacggctggtccgtggcacctgggaaaattagagttggattttgatctatgtgaagggactacggtagtggtagacgaacattgcgggaaccgtggcccgagtttacgcacgacaacggtcacaggaaagatcattcatgagtggtgttgcagaagttgtacgcttccaccactccggttcaagggagaggatggttgctggtatggaatggaaatacggccagtaaaagaaaaagaagaaaatctagtaaaaagtatggtgtctgctggttcaggagaagtagattcttttagtttgggattactctgtatatctattatgatagaagaagtaatgaggagtagatggagcagaaaaatgcttatgacaggaacactagcagtatttttattacttataatggggcaattaacttggaatgatctcatacgactatgtataatggtcggggccaatgcaagtgacagaatgggaatggggacaacatatttagcattaatggctacattcaagatgcgtcctatgtttgcagtcggactattattccgaagattaacctctcgcgaagtattactcctgacaatcggcttaagcctagtggcttctgtcgaactacctaatagtctagaagagttgggagacggactagcaatggggattatgatcttaaaattattaactgatttccaatcccatcaattatgggctacattactcagccttacattcattaaaacgacactcagcttacactatgcatggaagacgatggccatggtattaagtattgtatctctgattccactttgtttatcaacaacaagtcaaaagaccacttggttaccagttttgctaggttcactaggttgtaaaccattaactatgttccttattgcggagaacaaaatatggggaagaaaatcctggccacttaatgaaggaattatggctgtcggtgttgtctctatcctattatcaagtcttctgaaaaatgacgtaccgctagctggaccacttatagccggtggcatgctaatagcctgctacgtaatttcaggatcgtcagccgatttgtcgttagaaaaagctgcggaagtgtcctgggaggaagaagcagaacacagcggtgcatctcacaatattttagttgaggtacaggatgacggcactatgaaaataaaagacgaggaacgcgatgatacactgactatcctcctaaaagcaacattgttggcggtgagtggggtttatcccctgtcaattccagctacgctttttgtttggtatttttggcagaagaagaaacagcgatctggagttctctgggatacaccatctcctcccgaagtagagcgtgcagtattggatgatggaatatatagaatcatgcaacggggacttttgggcagaagccaggtaggagtaggcgtatttcaggaaaacgtattccatactatgtggcatgtaactaggggagcagtactgatgtaccaagggaaaagattagaaccttcgtgggccagtgtgaagaaagatttaatatcatacggcgggggttggcggcttcaaggaagttggaatactggagaagaagttcaagtaattgctgtagagccaggtaagaatccgaaaaatgtacaaaccgcaccggggacatttaaaacaccagagggtgaggttggggcaattgcattagatttcaaaccaggtacgtcaggcagtccaatagtaaatagggaaggaaagatagtaggcttgtacgggaatggcgttgtaactacaagtggaacttatgtaagtgcaattgcacaagcaaaagctagtcaggaaggaccgctgcctgaaatcgaagacgaagtttttcgcaaaagaaatttaacaattatggatctccatccaggaagcggaaagacgagaagatacctaccagctatagtccgcgaagctattaaacgaaaattaaggacacttattttagcacctaccagggtggtagcaagtgaaatggcagaggctttaaaaggtatgccgatcagataccaaacaactgcagtcaaaagtgagcacaccggaaaagaaatagtcgacctaatgtgtcatgctacttttacaatgaggttactttcacccgtgagagtacccaattataatatgattattatggacgaagcacatttcacagatccatcatcaattgccgcgcgagggtatatatcaacccgcgttggaatgggagaagctgccgcaatttttatgactgcaactccaccaggcagcgtagaagccttcccacagtcgaatgcagttatacaagatgaggagagggatataccggaaaggtcctggaactcaggatatgaatggataacagactttccagggaaaacggtctggtttgtcccttccatcaaaagcggaaatgatatagcgaattgtcttaggaaaaatggaaaaagagtaatccaactatcgcgcaagacatttgacaccgagtatcagaaaactaagaataacgattgggattacgtagttactactgacatcagcgaaatgggtgcaaatttccgagctgatcgagtgatagacccaagaaggtgcctcaaaccagtcatcttaaaagatggcccggaaagagttattctcgcgggaccaatgccggtcacagttgcgagcgcggcacaacgtagggggagaataggcaggaatcataataaagaaggagaccaatacatatacatggggcaaccattgaacaacgatgaagaccatgcacattggactgaagctaaaatgctacttgataatataaatacaccagaggggataattccagctctttttgagccggaaagggaaaaatcagccgctattgacggtgagtataggctccgtggcgaagcgagaaagacttttgtagaactaatgaggagaggagacttaccagtatggctctcttataaagtagcctctgaaggatttcagtactcagatagaagatggtgtttcgatggcgaaagaaataatcaggtcttggaagaaaacatggatgtagaaatttggacgaaagagggtgaacggaagaaattaagacctagatggctggacgcaagaacttatagtgatcccttggcattaagagagttcaaagagtttgccgccggtagaagatctgttagcggagacttgatcctagaaataggtaaattaccccagcatctaacccagcgtgcccaaaacgctttagataatttagttatgctacataactcagaacaaggaggtcgagcttataggcacgcaatggaagaattacctgacacaatcgaaactttaatgttacttgctctcattgcagtgctaaccggaggagtaacgctattctttttaagcggacgtggactcgggaaaacgtcaattgggctgttatgcgttatggcatcttcagtcttactgtggatggcaagcgttgaaccccactggatagcggcatcgataatcctggaatttttcctaatggttttattaatcccagagcctgatcgtcagaggacacctcaagacaatcaattagcttatgtagtgattgggttactatttatgatcttaacggtcgctgcaaacgaaatgggtttactggaaacaacaaagaaagacctaggcataggacacgtagccgtagaaaatcaccaccacgcaaccatgctagatgtagatcttcatccggcaagtgcatggacactatatgcagttgcaaccactatcataacccctatgatgcggcacactatagaaaatacaacagcaaatatctcgcttactgcaatagcaaatcaagcggcaatattgatgggtttggataaaggatggcctattagcaaaatggatattggtgtaccattgttagcactcggatgctattcacaagtaaaccccttaactctaactgcagcagtactcatgttggtcgctcattacgccataatcggacctggactacaagcgaaggctactcgtgaggcgcagaaaagaacagctgcaggtatcatgaaaaacccgactgtcgacggaatagtcgcaatcgatttagacccggtggtatacgatgcaaaatttgaaaagcaattaggccaaattatgctgttaattctttgcacaagtcaaatactgcttatgcgaactacctgggccttgtgcgagtccataacgttagcgacaggaccattaacgacattatgggagggttcccccggaaaattctggaacacaacaatagcagtatcgatggcaaacatcttcaggggtagttacctagccggtgcaggtctcgcgttctctctaatgaaatccctcggaggagggaggcggggaacaggcgcgcaaggagaaacactgggtgaaaaatggaaacgccaactaaatcaactaagtaaatctgaatttaatatttacaagcgatccggtattatggaagtggatagatctgaagcaaaggaagggttgaagagaggagaaaccacaagacacgctgtaagcagagggaccgccaaactcagatggtttgtcgagcggaatcttgttaaacctgagggcaaggtgatagacttaggatgtggccgaggaggatggagttattattgtgccggtttaaagaaagtgacagaagtaaagggctatactaaaggtggtccaggacatgaggaaccaataccgatggcgacttatggatggaatttggtaaaactacatagtggaaaagatgtgttcttcacaccacctgagaaatgtgacacgctgctatgcgatataggagagagctcaccaaatcccacgatagaagagggacgtacactgcgtgtcctcaaaatggtagaaccatggctaagaggaaatcaattttgtataaagatcttaaatccttatatgccttctgttgtagaaaccctagaacaaatgcaaagaaaacatggaggtatgctagttagaaatcctctgagtcgtaattccacccatgaaatgtactgggtgtcatgcggaactggaaatattgtttcagcagttaatatgacaagtagaatgttattaaacagattcaccatggcacatcgaaaacccacatacgagaaagatgtggatcttggagcaggaactagacacgtagctgtagaacccgaggtagctaacttggatattataggtcaaagaatcgaaaacattaaacatgaacacaaatctacttggcattatgacgaagataatccatacaaaacgtgggcataccacggatcatatgaagtaaagccatcaggatcagcaagctccatggttaacggcgtagtaaaactattaacaaaaccatgggacgtaatcccgatggtaacccaaattgcgatgacggacaccacgccattcgggcaacaacgggttttcaaagaaaaagtagacacgagaaccccaaaggctaagagaggaaccgttcaaatcatggaggtaactgctagatggctgtggggatttttgtctcgcaataagaaaccacgaatttgtacacgggaggagtttacaagaaaagtgcgcagtaacgcagcgatcggtgccgtgtttgttgacgaaaaccaatggaactcagcaaaggaagctgttgaggatgaacggttctgggatctagtaaagaaggaacgcgaacttcacaagcaagggaaatgtgcaacatgtgtatataatatgatggggaaacgcgagaagaagttgggtgagttcggtaaagccaaagggtcgcgcgcaatatggtatatgtggctaggagcgagattcttagagttcgaagcactgggatttatgaatgaggatcactggttcagcagggaaaactcactatcaggagtagaaggagaaggattacataaattagggtacattctaagagatatatcaaaaataccgggtggaaacatgtatgccgacgatactgcagggtgggatacacgaataactgaggacgatttacaaaatgaagccaaaattacagatattatggaacctgagcatgccctgctcgccacttcaatttttaaactgacctatcagaataaggtcgtaagagttcaacgccccgccaaaaatggaacggtaatggacgttatctcccgtagagaccaacgtggatcagggcaagtggggacctacgggctgaatacattcactaatatggaagcacaactaattagacaaatggaaagtgagggaatttttctccccagcgaactggaaacacccaatttggcagaacgggttctcgattggctagaaaaatatggggttgaaagattgaaaaggatggctatctctggagatgactgtgtggtaaagccaattgatgataggtttgcaaccgctttgacggcactaaacgacatgggcaaagtcaggaaagacatacctcagtgggaaccatcaaaaggatggaatgactggcagcaagtaccattctgcagccatcattttcatcaactgataatgaaagatggcagagagatcgtagttccatgcaggaatcaagatgagctagttggtagagcaagagtgtcccaaggggcaggatggtcattaagagaaacggcctgtctgggaaaaagttacgcgcaaatgtggcaattaatgtattttcatagaagagatctacgattagcggcaaacgcaatctgctccgcagtgccggttgactgggtacctacgtcaagaacgacctggagtattcatgctcaccaccaatggatgacaactgaagatatgttgtcagtttggaatagggtatggattgaagagaacccttggatggaagacaaaactcacgtaagtagttggggagatgtgccttatttaggtaagagagaagaccagtggtgtggatcacttattggcttgacggccagagcaacatgggcttcaaatattcaggtagctataaatcaagtccggagattaatagggaatgaaaattacctagattacatgacatcaatgaaaagatttaaaaacgagggggacccagaaggtgcattatggtaa

SEQ ID NO: 21616 - RNA, 9879 nt, synthetic construct
  misc_feature 1..9879: note = derived and/or modified CDS sequence (opt6) from DENV-1__FJ882518__SS-prME
  source 1..9879: mol_type = other RNA
tcagtgacgatgctgttaatgcttatgcctacagcactggcatttcacttaaccacacgcggaggggaaccgcatatgatcgttacaaaacaagaacgaggtaaaagcctactgtttaaaacttcagcgggagtcaatatgtgtaccctcatagcaatggacttgggggaattatgtgaagatacgatgacctataaatgtccaagaataacagaagcagaaccagacgatgtagattgctggtgtaatgcaaccgatacgtgggtaacttacggtacttgttcacaaactggagaacacagaagagataaacgatcagttgctctcgctcctcatgttggacttggattagaaacgagaaccgagacttggatgtcgtcagaaggtgcgtggaaacaaattcaaagggttgaaacttgggcattaagacatccgggtttcactgttattgcgctgttcttagctcatgctataggaacgtctattacacaaaaaggaatcatatttatcttactaatgttagttacaccaagtatggccatgagatgtgtcgggataggatcgcgggattttgtagaaggccttagcggggctacttgggtagatgttgtcttagaacatgggagttgtgtaacaacaatggcaaaagacaaaccaactttagatatagagcttctgaaaacagaagtcaccaatccagccgttttaaggaaattatgcatcgaagcaaaaatctctaatactacaactgatagtcgttgccccactcaaggagaagccactttaatggaagaacaagatgcaaactttgtgtgtagaaggacctttgtagatagagggtggggaaatggttgcgggttatttggcaaaggcagcttgattacttgcgccaaatttaaatgtgttacaaaacttgagggaaagatcgtccaatatgaaaatttaaaatactcagttatagtaactgttcatacaggggaccaacaccaagtaggtaatgaaagtacagaacacggaaccaccgcaacaataaccccacaagcacctacgtctgaaatccagcttacagattatggcgcactgactctcgactgttcgccgagaaccggattagactttaacgaaatggtactcctaactatgaaggagaaatcatggttagtccacaaacaatggtttctagatcttccgttaccatggacaagtggtgcatcaaccagtcaggaaacatggaaccgacaagaccttttagtcacgttcaaaacagcacacgctaagaaacaagaagttgtggtcttaggaagccaagagggcgcgatgcatacagcactaaccggagcaactgagatacaaacatccggaaccacaacaattttcgcgggccacctaaaatgtagattaaagatggataaattaacactcaaaggcatgtcctatgtcatgtgtaccggcagcttcaaacttgaaaaagaagttgcggaaacccaacatggaacggttctcgtacaaattaaatacgagggtacagacgctccttgtaaaataccattttccacgcaagatgagaaaggggttacacaaaatggcagattaatcacagctaatccaatcgtaactgataaggaaaaaccagttaatatcgaggctgaaccacctttcggtgagagttatatcgtaatcggtgcaggagaaaaggctttaaaactatcttggttcaagaaaggtagtagtattggtaaaatgtttgaagcgactgcacgtggcgctcgtcggatggcgatactcggcgataccgcgtgggattttggcagtgttgggggtgtttttacgagtgtgggaaaattagtccatcagatatttgggacagcttatggggtgctattttctggtgtaagttggacgatgaaaattggtataggtgtgctccttacgtggttagggttaaattctaggagcacaagcctaagtatgacatgcatcgcagttggccttgttacattgtatttaggtgtaatggtacaagcggactccggttgtgtaataaactggaaggggagagaattaaaatgtggcagtggaattttcgttaccaatgaagtccatacatggacagaacaatataaattccaagccgactctcctaagaggttaagcgccgcgataggcaaagcatgggaagaaggagtttgcggaataagatctgccacacgattagaaaatataatgtggaagcaaattagtaatgaattaaaccacattttacttgaaaatgacatgaagtttacagttgttgtcggtgatgtcgttgggatactagcccagggtaagaaaatgattcgacctcaaccgatggaacataaatactcatggaaatcatggggcaaagcgaaaattattggggcagacgttcaaaacacgacattcataattgacggcccctcaaccccggaatgccctgatgatcaaagagcatggaatatatgggaagtcgaagattatggattcggaatattcacaacaaacatttggctaaaattacgcgattcatacactcaagtgtgcgatcatagacttatgtccgcggcaatcaaagattctaaagcagtacacgccgatatggggtattggatagagagtgagaaaaatgaaacttggaaattagcaagagcttcttttatagaagtaaaaacctgcatatggccaaaaagccatacactgtggtcaaatggagttttggaatccgaaatgataattccaaaaatatacggaggtcctatttcacaacataattatcggccggggtattttactcaaactgcagggccttggcatctaggcaaactggaattggattttgatttatgcgaaggaacaacggtagttgtggatgaacactgtggcaatagaggcccgagcctacgcacaacgactgtaacgggtaaaattatccatgaatggtgttgccgaagctgtacactacctcctttacgatttaaaggtgaagacggttgttggtatggaatggaaatcaggccagttaaggagaaagaagaaaatttggttaaaagtatggtaagtgcaggctcaggcgaggtagactcgttttctctaggactcctttgtatttcaatcatgatagaggaagttatgcgtagtcgatggtcaaggaaaatgctaatgaccggtacactggcagtatttttacttctcattatgggacaattgacatggaatgacctaattagattgtgtataatggttggagcaaatgcatctgaccgcatggggatgggaaccacctatcttgcattaatggcgactttcaaaatgagacctatgtttgcagtaggcctgctctttaggcgacttacttctcgcgaagtcctgcttttaacaataggcctgagtttagtcgcttcagtagaactacccaactctttggaagaattaggagacggcctagcgatgggaattatgatactcaagttgctaacggattttcaaagtcaccaactgtgggcaacactcttgagcctaacgttcataaaaactacattaagtcttcattacgcttggaaaaccatggccatggtattgtctattgccagcttgttcccactctgtttaagtacaacctcccagaaaaccacatggttaccggtgttgcttggctctcttgggtgcaaacctcttactatgtttttgataacagagactaaaatctgggggagaaaatcttggccactgaacgagggaatcatggcagtaggggtagtttcaatcctcctgagtagcttgctaaagaatgatgtaccactggcagggccgcttatagcagggggcatgttaatagcgtgttatgtcataagtggcagttcagcagatctatctctagaaaaggctgcagaagtgtcttgggaagaagaagcggaacattctggtgccagtcacaacattctagttgtggtacaagatgacggtactatgaaaatcaaagatgaagaacgagacgacactttgaccattttgttgaaggccactctactagcagtatcgggagtctatcccttgtccattccagctacactgtttgtatggtatttttggcaaaagaagaaacagagaagcggagtattatgggacacaccgagcccgccggaagtagagcgggcagtattggatgacggaatatatcgaataatgcaacgaggtttactagggaggtctcaggttggcgtgggagtatttcaagagaacgtattccacacaatgtggcatgtcacaagaggggcggtacttatgtatcagggaaaaaggttggaaccctcttgggctagtgtaaagaaagatctaatatcctatggcggcggttggagattacagggatcgtggaatacaggtgaagaagttcaagtaatagcagtagaacccgggaaaaatcccaaaaatgtccaaaccgctcctggaacatttaaaacaccagaaggagaagttggagcgatcgcgcttgactttaaaccaggaacttccggaagtcctattgttaaccgagaaggtaagatagtcggattgtatggcaacggagtagtcactacatctggtacatacgtaagtgccatagcacaagctaaagcgtcacaggagggtccactaccagaaatagaagacgaggtatttcgaaaacgaaacctaactattatggatcttcatcctggcagcggaaaaacaagacgctatttacccgcgatagttcgggaggcaataaaaagaaagttacgcactctaatcctagcaccgactagggttgtcgcttcggaaatggccgaggccttaaaagggatgccaatacgctaccaaaccacagcagtgaaaagcgaacacacaggtaaagagatcgttgatttgatgtgtcacgcaacctttacaatgcgactactaagtcccgtacgtgtgccaaactacaatatgataattatggatgaagcccatttcacagacccttcaagcattgctgctagaggatacattagtacacgagtaggtatgggagaagcggcagcaatttttatgacggcaacaccgcccggaagcgttgaagcctttccacaatcaaacgcagtaatacaagacgaggagagagacatacccgaaagatcatggaatagtggttatgagtggatcaccgactttccaggaaaaactgtatggtttgtaccaagcataaagagtggcaatgacatcgcaaactgtttacgtaaaaatgggaaacgagtaatacaattgagcaggaaaacgtttgatactgaataccagaaaaccaagaacaacgactgggattatgtcgtcacaacagacatttcagaaatgggcgcgaactttagagccgatagggtaattgacccccgtaggtgccttaaaccagtaattttaaaggatgggccagaaagagttatcctagctgggccaatgcctgtcactgtagcgagtgctgcacagcggagaggtagaataggaagaaatcacaataaggaaggggaccaatacatctatatgggtcaacctcttaataatgatgaagatcatgctcactggaccgaagctaagatgttgctagataacataaacacaccagaagggattattcctgcactattcgagcccgaacgggagaaaagcgcagcaattgatggcgagtatagactaagaggagaggccagaaaaacattcgttgaacttatgaggcgtggcgatctaccagtgtggcttagctataaggtagccagcgagggatttcagtactcagatcgcagatggtgcttcgacggagaaagaaataatcaggtattagaggagaacatggacgtggaaatttggactaaggaaggtgagaggaagaaactaaggccgagatggctagatgcgagaacctatagtgatcccctagctttgcgtgaatttaaggaatttgctgcaggtaggagatctgtaagtggcgacttgattctcgaaattggtaaacttcctcaacatctaacgcaaagagcacaaaatgcccttgataacctagtaatgctccacaatagtgagcaaggcggcagagcatatagacatgctatggaggaactacctgacacaattgaaaccctgatgttgctagctttaatagccgtactgacaggtggcgtcactcttttctttttatctggcagaggactaggtaaaacaagcataggattactatgtgtcatggctagcagtgtactactatggatggcctcagtggaacctcactggatcgccgcatccattattttagagttctttctaatggtcttattgataccagagccagacagacaacgaacaccgcaagacaaccaattggcatacgtagtcatcggactactctttatgatattaaccgttgccgcaaacgaaatgggacttctggaaacaactaagaaagatttgggcattgggcatgtcgctgtcgaaaaccatcatcacgcaacaatgttagacgtggatctgcacccggcttctgcttggacattatatgccgtggctacaacaattatcacccctatgatgaggcacaccattgaaaatactacagccaatatcagtctcaccgccattgctaatcaagcagctattttaatgggacttgacaaaggatggccgatcagtaaaatggacataggcgtgccgcttctcgctttgggatgttatagccaagttaacccgctcacactgacagcagcagtattaatgctagtcgcgcattatgcgattataggacctggactacaagctaaagcgactagagaggcccagaaaaggacggctgcaggcataatgaaaaatccaacagtagacggtatcgtagccattgacttagatccagtagtatacgacgccaaatttgaaaaacaacttgggcaaatcatgctattaattctatgcactagccagatattgcttatgcgtactacttgggccctatgcgaaagtataacacttgctacaggtcccttaactactttatgggaaggatctcctgggaaattctggaataccacaattgcggtttccatggcaaacatatttagaggttcatatctcgcaggcgcgggtttagcgttcagtttaatgaagagtttgggaggaggacgcaggggaacgggagcacaaggtgaaacattaggtgaaaaatggaaaaggcaacttaaccaactatctaagtcagaatttaatatatataaacggtcaggaattatggaagtagatcggagtgaagcgaaagaaggacttaagcgcggggaaacaacgagacacgcagtatctagaggaacagcaaaattaaggtggttcgtagaaagaaatttagttaagccagaaggtaaagtaatagacttgggatgtggaaggggtgggtggtcatattattgtgcgggactcaagaaagtaacagaagtgaaaggatacacaaaaggaggaccaggacatgaggagcccatccctatggctacatacgggtggaatcttgtaaaacttcattcaggaaaagatgtattctttacaccgccagagaagtgtgatactcttctatgcgacattggagaatcatccccaaaccccactatcgaagagggaagaaccttgagagttctgaaaatggtagaaccgtggctaagaggaaatcagttctgcataaaaatcctaaacccgtatatgccaagcgttgtcgaaacacttgagcaaatgcaaagaaagcacgggggcatgttagtacgaaatcccttgtcacgcaattccacacacgaaatgtattgggtttcgtgcggaacaggcaatatagtaagcgctgtaaacatgacatctcgaatgctactaaatcgatttaccatggctcatagaaaacctacctatgaacgtgatgttgacctaggggctggaacaagacatgtagccgtggagccagaagtggctaacctcgatataatcggtcaaagaatagaaaacattaagcatgagcataagtccacatggcattatgatgaagacaacccatataagacatgggcataccatgggagctatgaagtcaaaccaagtggatctgcaagttctatggtgaatggtgttgttaaactgctaacgaagccgtgggacgtcatcccaatggtcacgcaaatagccatgaccgatacaacaccattcggccagcaaagagtttttaaagaaaaagtggatacaagaactccaaaggcaaaaaggggcaccgcacaaataatggaagtaacagctcgttggttatggggctttttatcacgcaacaagaagccacgcatttgtacccgggaagaatttacaaggaaagttagatcaaatgcggctataggggccgtcttcgttgatgaaaatcaatggaactcagccaaagaagcggtagaagacgaaaggttttgggatttggttcagaaggaaagagagttgcataaacaaggaaaatgcgcaacatgcgtttataacatgatgggtaaacgggagaagaaattaggtgaatttggaaaagctaaagggagtagagcaatctggtatatgtggttaggtgcacgctttctcgaatttgaagcattaggatttatgaacgaggaccattggttctcaagggaaaattctctaagcggtgtcgaaggagaggggttacacaaactaggttacattctacgagatataagtaagataccagggggcaatatgtatgcagatgatacagcaggatgggatacacgaataacggaggatgacttacaaaatgaagctaaaatcaccgacatcatggaaccagaacatgctctgctggcaacctcaatcttcaaactaacttaccaaaacaaagtagtacgagtacagcgtccagccaagaatggcactgtaatggacgtgatcagcagacgagaccaaagaggatcaggacaagtcggaacctatggcttgaatacatttacaaacatggaggcacaattaataagacaaatggaatctgaaggcatatttttaccaagtgagttagaaactccgaatttagcggaacgggtcttagattggttggaaaaatacggagtagagcgattgaaacgtatggccatttcaggcgacgactgtgtagtaaaacctattgatgatcgtttcgcaactgctttaacggcattgaatgacatgggaaaggttagaaaagacattccacagtgggaaccatcaaaagggtggaatgattggcaacaagtacctttttgttcacaccatttccaccagcttattatgaaagatggaagagaaattgtcgtaccttgtcgaaaccaggatgaattagtaggcagagcaagagtatctcaaggagctggttggtccctaagagaaaccgcctgtcttggtaaatcttatgcacagatgtggcagctaatgtattttcaccgccgggacctgcgcttggcagcgaatgcaatctgttctgcggtccccgtagattgggtccccacctcacgaaccacatggagtatccacgcacatcatcagtggatgacaacagaggacatgttatcagtctggaatagggtttggattgaagaaaatccttggatggaggataaaacacatgtatcctcctggggcgatgttccataccttggtaagagagaagaccaatggtgtggatctctgatcggtttgacagctagagctacgtgggcgtctaatatacaggtcgcaataaatcaagttaggaggctcataggcaatgaaaactacttggactacatgacatcaatgaaaaggttcaaaaacgagggagatccagaaggtgctctctggtaa

SEQ ID NO: 21617 - RNA, 9879 nt, synthetic construct
  misc_feature 1..9879: note = derived and/or modified CDS sequence (opt6) from DENV-1__FJ882519__SS-prME
  source 1..9879: mol_type = other RNA
agcgttacaatgcttcttatgttaatgccgacagcactcgcatttcatctgacaacaagaggtggtgaacctcacatgattgtgagtaaacaagaaagaggtaaatcacttctttttaaaacgtctgccggtgtaaacatgtgcacattaatagcgatggatttgggtgaattttgtgaagacactatgacttacaaatgtcctagaattacagaagcagaaccagacgacgtcgactgttggtgcaatgcgactgatacctgggtaacatatggaacttgttcccaaacaggcgaacaccgtagagacaaaagatccgtagcactcgctccacatgtaggtttaggcttagaaaccaggacggaaacttggatgagtagtgagggagcctggaaacaaattcaacgagtagaaacttgggcattacgacatccagggtttactgttattgcattatttctggcacacgctattggaacgtccataacgcaaaaaggcattatatttatactactcatgttagtgaccccctcaatggcaatgagatgtgtaggcataggttcgagagatttcgtggaaggactttctggagcaacctgggtagatgtagtactagagcatggatcgtgcgtaacaactatggctaaagataaaccgacattggatatagaattactaaaaacggaggtaaccaatcctgcagttttacgaaaactatgcatcgaagcgaaaatatccaatacaacgacggatagccgttgccctacacaaggtgaagcaacattggttgaagaacaagacgcaaactttgtctgtcgcaggacatttgttgaccgaggttggggaaacggatgcggtctattcggaaaaggatccctaattacatgcgcaaaatttaaatgtgtaactaaattggagggaaaaatagtacagtacgagaatttaaaatacagcgtaatcgtaacagtacacactggtgaccaacatcaagtagggaatgagtcaactgaacacgggacaacagcaacaattacaccacaagccccgagtacagaaatccaactaacagattatggagcacttacactggactgctcaccacggacgggactggattttaacgagatggtgttattgacaatgaaagagaaaagttggttagtgcacaaacaatggttcttagacttgcccttaccatggacatcaggagcgtcaacatctcaggaaacttggaatcgcaaagacttgctagtaacatttaaaactgctcatgccaagaaacaggaagtagttgtattaggttcccaggagggggctatgcacaccgcactaacaggcgctacagagatacaaacatcgggaacaactaccatattcgccggtcaccttaaatgccgcttaaaaatggataaattaaccctaaaaggtatgagttatgttatgtgcacaggatcttttaaattggaaaaagaagtggcagagacccagcatgggacagttctagttcaaattaagtacgaaggaacagacgctccatgcaagatacccttttcgacacaggacgaaaagggtgttacgcaaaacgggcgactaataactgctaacccgattgtgactgacaaggaaaaacctgtaaatattgaggcagaaccccctttcggggaatcatatattgtcattggagcgggagaaaaggctttaaaactcagctggtttaagaagggttcttctattggtaagatgttcgaagctacggctagaggcgctagacgtatggctatattgggagacaccgcgtgggacttcggatctataggtggggtgttcacaagcgtcggaaaattagtacaccaaatatttggaacagcatatggcgttctattttcaggtgtttcgtggacaatgaaaataggtattggagtgcttttaacctggttgggactcaacagccgtagcacttcactttcaatgacttgtatagcagtaggtcttgttacactctatttaggcgtaatggtgcaggctgattcgggttgtgtcattaattggaaaggaagagaattaaaatgcgggagtggaatattcgtgactaatgaagtgcatacgtggacggaacagtacaaatttcaagctgattcaccaaagcgattatcagcagcaataggaaaagcatgggaggaaggagtttgcgggataagaagtgcaacaagactcgagaatatcatgtggaaacagataagtaacgaactcaaccacatacttctcgaaaatgacatgaaatttacagtcgtagttggggacgtcgctgggatactcgcccaagggaagaaaatgataagaccccagcccatggaatataaatatagctggaagtcgtgggggaaagcaaagattattggtgctgacgtacagaacactacatttataatagacggaccgaatacaccagaatgccctgacgaccaaagggcatggaatatatgggaagtcgaagattacggttttggtatttttacaaccaatatttggctgaagttacgggacagttatacccaagtatgtgatcacaggcttatgtccgctgccataaaagatagcaaagctgttcacgcagatatgggatactggatcgaatctgaaaagaacgaaacctggaaattagcacgagcttcgttcatcgaggtcaagacttgtatttggccaaaaagtcatactctatggtctaatggcgtccttgaaagcgaaatgataatacccaaaatttacggaggaccgatttcccagcataactataggcctggctatttcacgcagactgcaggtccttggcacttagggaagctcgaattggacttcgatttatgtgaggggactacagtagttgtcgacgagcactgcggaaatcgaggcccatcgctaagaactactacggtcacgggtaagataatccatgaatggtgctgcagatcgtgtacactcccacctctaaggttcaaaggtgaagatggatgttggtacggtatggagataagacccgtaaaagagaaggaggaaaatttagtaaaatctatggtgagtgcgggtagcggagaagttgacagcttttctctaggattattatgcatatcgataatgatagaagaagtgatgagatcaaggtggtctcggaaaatgttgatgaccggcacattggcggtctttttcctattgataatgggtcagctcacttggaatgatttaattcgtttatgtataatggtcggagcaaatgctagcgatcgtatggggatgggtaccacttacttagccttgatggccacatttaaaatgagacctatgtttgcagtcggcttgctattcagaaggttaacgagcagagaagtgctgcttctgacgattggactttccctcgttgcaagtgtagaattgccaaactcgctagaagaactaggagacgggttagcaatggggatcatgatattgaaacttttaacggattttcaaagtcaccaactatgggctaccttattaagtttaacattcattaaaacgacattttctctacactatgcttggaaaaccatggcaatggtcttatctattgtcagcttgttcccgctgtgcctatcaacaacatctcagaaaaccacgtggctgcctgtattactagggagcttagggtgtaaaccactaactatgttcctcatcgctgaaaataagatttggggaagaaagtcttggccactgaacgaaggcataatggctgtgggaattgtttctatactgttatcgtctttattgaaaaatgacgtaccgttagctggaccgttaatcgctggtggtatgctgatagcatgttatgtaatctcaggatctagcgcagatctatcattggaaaaagctgcagaagtctcttgggaagaagaagcagagcacagtggagcgagtcacaatatattagttgaggtacaggacgacggcacaatgaaaataaaagatgaagagagagatgatactttgactatcttactgaaggcaacacttttggccgtttctggtgtgtatccattaagtatacctgcaacactatttgtatggtacttttggcagaagaagaaacaacgatccggagttctatgggataccccgagcccaccagaagtcgaacgcgccgtcttagatgacggtatttaccggatcatgcaaagaggacttctaggaagatcgcaagtgggggttggagtatttcaggaaaatgtattccataccatgtggcatgtgacaagaggagcagtattaatgtatcagggaaaacgccttgaaccgtcatgggcaagcgtgaagaaagacctcatctcttatgggggagggtggaggttacaaggtagttggaatacgggcgaggaagtacaagttatagcagtcgaaccaggtaaaaatcccaaaaatgtccaaaccgcaccagggacttttaaaacctctgaaggtgaggttggtgcaatagcacttgatttcaagccggggacatcaggaagcccgattgtaaacagagaaggcaaaattgtcggcttgtacggtaatggagttgtcacaacgtcgggaacttacgtatcagctattgcacaagctaaggcatcacaggaaggccctctacccgaaatagaggatgaagtcttccgtaaacggaaccttacaattatggacctacatccaggttctggtaaaacaaggcgttatttaccggcaatagtcagagaagcaataaaaaggaaacttaggacattaatcttagcacccacacgagtagtagcatcagaaatggccgaggcactcaaaggaatgccaattagatatcaaacaacagcagtgaaaagtgagcataccggtaaagaaatagtagatttaatgtgccacgctactttcacaatgaggcttttgtcacccgtcagggtgccaaattataacatgattataatggacgaagcccattttacagacccatcaagtatagcagcacgcggctatataagtacaagagtcggaatgggcgaagctgcggccatatttatgactgcgactccaccgggtagtgtagaggcctttcctcagtccaatgctgtaatacaggatgaggaacgtgatattcctgagagatcatggaatagcggatatgaatggattacagattttcctggaaagacagtgtggttcgttccgagtatcaaatcaggcaacgatatagctaattgtcttaggaaaaacggcaaacgtgtgattcagctaagtagaaaaacctttgacacagaataccaaaagaccaaaaataatgattgggattacgtagtaaccactgacataagtgagatgggtgcgaactttagggcagatagagttatagatcctcgacggtgcttgaaacctgtaatattaaaagatggacctgagcgtgtaatattagcggggccgatgcccgtaacagttgcctcggcagcacaacgacgagggaggattggcaggaaccataacaaggaaggggatcagtacatttatatgggccagccattaaataatgatgaagatcatgcccactggaccgaggccaaaatgttgctagacaatataaacacgcccgaagggattataccagcattatttgaacctgagcgtgaaaaatccgcagcgattgacggagaatatagactcaggggagaagccagaaaaacattcgtagaactcatgcgacggggagacttaccggtgtggttatcatataaagtagcatcagaggggttccaatactcagatcgacgctggtgctttgatggtgaacgaaataatcaggtattggaggagaatatggatgtagagatctggactaaagagggtgagaggaagaaattaagaccacgctggttagacgcccgaacttattctgaccctttggccttacgagaatttaaggaatttgccgcgggaagaaggagcgtatccggcgacctaatcttagaaataggaaaactgccccaacacttaacacaacgagcacaaaatgcattagataatctagtaatgttgcataactcggaacaaggtggtagagcctaccgacatgcaatggaagaattaccagatacaatagaaacattaatgttgttagcactaatagcggtgctcactggcggtgttacactcttctttctttcaggaagaggcttgggaaagacttctataggcctgttatgcgttatggcaagtagtgttctgctatggatggcaagtgtagaaccacactggatagccgcaagtattatactagaatttttcctcatggtattattaatacctgaacctgataggcaacgaacaccacaagataaccaattggcctatgtggtaatagggttactatttatgattttaacagtagctgcaaatgagatgggtttgctagaaacgacgaagaaagacctgggaataggacacgtggccgtagagaaccatcaccatgctgccatgctggatgtcgacctacacccggcatccgcttggacactctacgcggtcgctacgacaataattacacccatgatgaggcatactatagagaatacaacagccaatatatccctgaccgcaattgcgaatcaagcagctattctaatgggattagacaaggggtggcctattagtaaaatggatataggagttccgttattagcactaggatgttacagccaagtcaatccattaactttaactgcggcggtgctcatgttggtggcacattacgctataatcggaccaggtttgcaggcgaaggcaacacgtgaggctcagaaaaggacggccgccggaataatgaaaaaccctactgtagacgggattgtagctatagatcttgatccagtagtatacgatgcaaagttcgaaaaacaattaggacaaattatgttattaatactctgcaccagtcaaatactccttatgcgcacaacatgggctctatgtgaaagcattactctcgctactgggccattgaccactctatgggaagggtcaccgggcaaattttggaatacaaccatagccgtatcaatggctaatattttcagaggcagctatcttgccggtgcaggtttagctttttctctcatgaaatcactcggcggagggagaagaggcactggggcccaaggagagacactgggagaaaaatggaaacggcaacttaatcaattaagtaaatctgagttcaacacatataaacgcagtggtatcatggaggtggatagatcggaagctaaagaaggtttaaaaaggggtgaaacaactaaacatgctgtatcaagaggaacagccaaattaagatggttcgtcgaaaggaatctagtaaagccagaagggaaggtcattgatctgggctgcggtagaggcggatggagttattattgtgccggccttaagaaagttactgaggtgaaaggttataccaaaggaggcccaggtcatgaagaaccaatacccatggcaacgtacggatggaatttagtgaaacttcattctggtaaagatgttttctttatcccacctgaaaaatgcgacacgctactctgtgatattggtgaatccagtccaaatccaacaatagaagaaggtcgaacgctgcgagtgctcaaaatggttgaaccatggctacgaggtaatcaattttgcatcaaaatacttaacccttatatgccaagtgtggtagagacactggaacaaatgcaaagacgtcatgggggcatgctggtaagaaacccactaagtcggaacagcactcatgaaatgtattgggtatcatgtggtactggtaacatagtaagcgcggttaacatgacttctaggatgctcctgaatagattcacaatggcacaccgcaaaccaacttatgagcgtgatgtggatttaggagcaggcactcgacacgtcgctgtagaacctgaggtagccaatctagacattattggtcagagaatagaaaatataaaacacgagcataagtctacttggcactacgacgaagataatccttataaaacctgggcatatcacggttcatacgaagttaaaccgtcagggtcggctagttccatggtaaatggagtagtgaagctacttacgaaaccgtgggacgtaatcccaatggtcacgcaaattgccatgactgatactaccccatttggtcaacaaagagtatttaaagaaaaagtggatactaggacacctaaggccaaacgaggaactgcacagataatggaggtaacggctaaatggctatggggattcctaagcaggaataagaaaccacgaatatgtacaagagaagagtttacaagaaaggtgagatcgaatgcggcaattggtgcagtgtttgttgatgagaaccaatggaactctgctaaagaggcggtggaggacgaaagattttgggatttggtccaccgagaacgagaattacataagcaaggaaaatgcgcgacttgtgtctataatatgatgggtaaaagggagaagaaattaggagagtttggaaaagctaaagggtcgagagcgatctggtatatgtggttaggggcaaggttcctagaatttgaagcgctcggattcatgaacgaagatcactggttctcacgtgaaaacagcttatcaggtgtagaaggagaagggctacataaattaggatacatacttagagatataagtaagattccagggggcaatatgtatgcagatgatacagcaggctgggatacaagaataacggaagatgatttacaaaatgaagcaaaaattacagatattatggaacctgaacatgcattgctagccaaaagcatattcaagttaacttaccagaataaagtagttcgtgtacaaagacccgctaaaaatggaactgtgatggacgtaatctcaagaagagatcaaagaggttcaggccaagtaggtacctacggattaaatacatttacgaacatggaagcgcaactaattagacagatggagagtgaaggaatatttagtccatctgaactcgaaacaccgaacttggcgggcagggttctcgattggctagagaaacatggcgtggaacgccttaaaagaatggcaataagtggagacgactgtgtagtaaaacctatagacgatagattcgcgactgccttaaccgctttaaacgacatgggaaaagtaagaaaagacataccacaatgggaacccagtaaaggatggaacgattggcaacaggtaccgttttgttcgcatcatttccatcaactaataatgaaggatggtcgcgaaatagtggtgccgtgcagaaaccaggatgaattagtaggaagggcacgagttagtcaaggggccggatggagtctccgagaaacagcatgccttgggaaaagttacgcacaaatgtggcaacttatgtactttcacagacgagaccttagattagccgctaacgcaatctgcagtgcagtcccagtagattgggtaccaacttctagaacgacttggagtatacatgcacaccaccaatggatgactacagaagacatgttgagcgtatggaatcgagtgtggatagaagagaatccttggatggaagataagacgcatatatctagttggggtgatgtaccgtatttaggcaaaagagaggaccagtggtgtggctctcttattggtctaacagcccgtgccacatgggcaacgaatatacaagtagcaataaatcaagttcgaagattaatcggaaacgaaaattaccttgattatatgacgtcgatgaaaagattcaaaaatgaatcggaccccgaaggggctctttggtga

SEQ ID NO: 21618 - RNA, 9879 nt, synthetic construct
  misc_feature 1..9879: note = derived and/or modified CDS sequence (opt6) from DENV-1__FJ882520__SS-prME
  source 1..9879: mol_type = other RNA
agcgttacaatgctactaatgctaatgccaacagccttggccttccatctcactacacgaggaggggaaccccatatgatagtatcaaaacaagaacgagggaaatcacttttattcaagacaagtgcgggggttaatatgtgcacactaatagcaatggacctaggagaattatgcgaagatacgatgacatataaatgtcccaggattactgaagtcgaaccggacgatgtggattgttggtgtaacaccactgatacctgggtcacttatggtacgtgcagtcaaaccggagaacataggcgagacaagagatcggttgcattggccccacacgtaggtcttgggttagaaacgagagctgaaacctggatgagttcggaaggagcctggaaacaaatacaaaaagtggaaacatgggccttaagacatccagggtttacggttattgctctgtttttggcgcatgcaatagggacatctataacccaaaaagggatcatattcatacttcttatgctggttaccccatcaatggccatgcggtgtgtagggataggtagtagagattttgtggagggtttatccggagcaacgtgggtagatgtagttttggaacacggatcttgtgtaacaacaatggcaaaggacaaaccaacactggatatagagctacttaagaccgaggttaccaatccagctgtactaagaaaattatgtattgaagcaaaaataagtaacacgacaacagattcaagatgccccacgcaaggtgaggcgactcttgtagaggaacaagatgcaaattttgtctgcaggagaacatttgttgacagaggctggggaaacggttgtgggttattcggaaaagggtcactaataacatgcgcgaaattcaaatgcgttacgaaattagaaggaaaaatagtacagtacgaaaacctgaaatacagcgtgattgtaacagttcacactggtgatcaacatcaagttggtaacgaaagtacggaacacggcacaactgcgacgatcactccacaggcaccaacaagcgaaatacagctaactgattatggggcactaacattagattgttccccaagaacaggactcgattttaacgagatggttttgctcacaatgaaggagaaatcatggctagtacacaaacagtggtttttggatctaccactaccatggacatccggggcctcaacctcgcaagaaacctggaaccgtcaagatctcctagtaactttcaaaacagcacacgctaagaaacaggaagttgtagttctaggatcacaagaaggagccatgcacactgcattaactggagctacagagattcaaacaagtggaactacgacaatattcgctggacatctcaaatgccgtcttaagatggataaactgacactaaaaggaatgtcctatgtcatgtgtacaggttcatttaaactagaaaaagaggtcgcagaaacacaacatggcactgtgcttgtccagattaagtacgaaggaaccgatgctccctgtaagattccattcagcacgcaagacgagaagggagtaacacaaaatgggcgccttatcaccgctaatccgattgttactgataaagaaaaaccagtaaacattgaagctgaaccaccatttggagaaagctatatagttatcggtgctggagagaaagcgctaaagttgtcatggttcaagaaaggatcatctataggaaaaatgtttgaggcaacggcaagaggagcaaggagaatggcgattttgggcgatactgcatgggactttgggagcatcggtggtgtatttacctcggtaggaaaattagtccatcagatctttggaacagcttatggagttttgtttagtggggtctcatggaccatgaagatagggataggagtactcctgacatggttaggtctaaattcaagaagtacctcgctttccatgacctgtattgccgtgggacttgtaacattatatctaggcgtaatggtccaggctgacagcggttgtgtaataaactggaagggtagagaactcaaatgcggatctggaattttcgtaactaacgaggtacacacgtggactgaacagtataaatttcaagccgattcacctaaaaggctctcagctgcgataggaaaggcgtgggaagagggtgtatgtggtattagaagcgccacgagactagagaatattatgtggagacagataagtaacgagttaaatcatatattattagaaaatgacatgaaatttacagtcgtcgtaggagatgtggtaggtatccttgcacaaggtaagaagatgattcggccacaacctatggagcataaatacagttggaaatcatggggtaaagcgaaaattataggggcagatgtacaaaacacaacttttattattgacgggccgaatacccctgaatgcccagacgatcagcgtgcttggaatatctgggaggtagaggattacggatttggaatctttactacaaacatatggctaaaacttagagacagctacactcaggtgtgtgaccatcggttaatgtcggctgctataaaggacagcaaagcagtacatgcggatatgggatattggatagaaagtgagaaaaacgaaacctggaaactggcacgagccagcttcatagaagtgaaaacctgtatatggccaaaatcccatacactttggtcaaatggagtcttagaatccgaaatgatcatacctaaaatatacggcggaccgatcagtcagcacaactatagacccggctatttcacacaaacggctggaccatggcatttaggaaagttagaactagattttgacctttgtgaaggaactaccgttgttgttgacgaacactgcgggaatcgaggcccttcgcttcgaaccacgaccgtgacgggaaaaataatacatgaatggtgttgtcggagttgtacattacctccactaagatttaaaggagaagacgggtgctggtacggaatggaaattagaccggtaaaagaaaaagaagagaatttggtaaaatccatggtgtcagcaggaagtggggaagtcgacagcttctctttaggattgctttgtatatcaataatgatagaagaggttatgcgaagtagatggtcgaggaagatgctaatgactggaactctcgccgtattctttctcctgataatgggacagctcacttggaacgacctgattcgatcgtgcataatggtcggggcgaatgccagtgatcgaatgggcatggggacgacgtacctagctttaatggctactttcaaaatgcgtccaatgttcgcagtagggttactctttaggcgattaacctcccgcgaggtattattattgacaataggtctatcgctggtcgccagtgttgaattacctaacagtcttgaagagttaggtgacggactggcgatgggtataatgatactaaaattactaactgatttccagagctatcaattatgggctaccctgttatcgctgacttttattaaaaccacattcagtctacactacgcgtggaaaactatggcgatggtattatcaatcgtatctttactgcccttatgtcttagcaccaccagtcagaaaactacatggttaccagtattacttggatccttagggtgtaaaccactcacaatgtttctgattgctgaaaacaaaatttggggtaggaagtcttggcccttgaatgaaggaataatggcagtagggatagtatcaatattattaagctctcttcttaagaatgatgtgccacttgcaggccctcttatagcaggaggaatgttaatagcttgttatgtaatttccgggtcttcagctgatcttagtctagaaaaagcggccgaagtcagttgggaagaagaggccgaacattcgggagcaagccacaatatcttagtagaagtacaagatgacggaactatgaaaattaaagacgaagaacgcgacgatacgcttacgatattgttgaaggcgacactactagcggtatctggggtttatcctctaagtatacctgctacgctgttcgtatggtatttttggcaaaagaagaaacagcgaagcggagttctctgggatacaccaagtcccccagaagtagaaagagccgtccttgatgacggcatatatcgaataatgcaaagaggattgttgggaagatcacaagtaggtgtaggagtattccaagagaacgtatttcatactatgtggcacgtgacaagaggtgccgtgctaatgtaccaaggtaaaagattagagccaagttgggccagcgtgaagaaagatttaatttcatatggtggtggttggcgtctacaagggtcatggaatacaggagaagaggtgcaggttattgcagtagaaccaggcaaaaatcctaaaaacgtgcaaacggctcctggaacttttaaaacacctgaaggggaagtaggtgcaattgcgcttgattttaaaccaggaacctcaggcagtcccatcgtcaacagggagggaaagatcgtgggtttgtatggtaatggggtggtcacaacttctggtacctacgtaagtgctattgcgcaggcaaaagcgagtcaagagggtcccttaccagagattgaagatgaggtctttaggaaaagaaacttgacaataatggacttacacccaggaagtggaaaaacacgtagatacttacctgcgattgttcgtgaagctataaagcggaaattacgtaccttaatacttgcaccaacgagagttgtcgcctctgaaatggcagaagcactcaaaggaatgccgattcgatatcaaactaccgctgtaaaatctgaacacacaggccgcgaaatagtagacctgatgtgccacgccacctttaccatgaggcttttgtcgcccgttagagtacctaattataacatgattataatggatgaagcacactttacggatccatccagtatagcagctagaggatacatttccacgagagttggtatgggggaggcagcagctatttttatgaccgccacaccaccggggagtgtggaagcgtttccacaaagtaatgcagtgattcaagacgaggaaagggacataccggaacgatcctggaactccgggtatgagtggataactgatttccctggcaagaccgtttggtttgtaccaagtataaaaagcggtaatgacatagctaactgtctacgaaagaacggcaaaagagttatacaactgtcaagaaaaacattcgataccgagtatcagaagacgaaaaataacgactgggattatgtcgtcaccacagacatatcggaaatgggtgctaatttccgggctgaccgagtcatagacccccgtcgatgcctcaagccagtaattcttaaagatggacccgaaagggtaatactagcagggcctatgccagtgactgttgcctcggctgcccaacgaaggggcagaatcggcagaaaccataataaagaaggcgaccaatatatttatatgggacaaccactgaacaacgacgaagaccatgcacattggactgaagcaaaaatgctcctggataatattaatacacccgaaggtatcatcccagcgttatttgaacccgagagagaaaaatcggcagccatcgacggagaatacaggctgcgtggggaagcacgaaaaacattcgttgaactaatgagaaggggagatttgcccgtctggttaagttacaaggtagcaagtgaggggtttcagtattctgacagaaggtggtgtttcgatggcgaaaggaataaccaggtacttgaggagaatatggatgtagagatctggaccaaagaaggagaacgaaagaaactacgcccaaggtggctagatgctcgtacatattcggatcccctggcactacgggaatttaaagaatttgcagccggtagacgatcagtgtcaggtgacttaatcctagaaattgggaaacttccacaacacttgactcagagagctcaaaacgcattagacaacctggttatgttgcataacagtgaacaaggaggacgcgcgtatcgacacgcaatggaagaactcccagatactatcgagactttaatgctattggcactaatagcagttttaacaggaggggttactctattctttctgtctggtaggggcttaggaaaaacaagcatagggctcctgtgcgtaatggcgagttctgcattgttatggatggcatccgtagagccacactggatagcggcttccataatattggagtttttcctaatggtacttttaataccagagccagatagacaacgaaccccgcaagataaccaattagcgtatgtagttataggcttattatttatgatattaactgtagctgcaaatgaaatgggtttgcttgaaactactaaaaaggatcttggaattggacatgtggccgtagagaaccatcatcatgcaactatgttagacgtagatcttcatccggcgagtgcatggacgttatatgcagttgctacaactattataactcccatgatgagacataccattgaaaacacgacagcgaacatatcacttaccgcaatagcaaatcaagcagcaattttgatgggtttagataaaggctggcctatttcaaaaatggatataggagttcctttattagctctaggatgttactcacaggtaaacccgttaaccttaaccgccgcagtactcatgttagttgcacattatgccattatcggaccaggtctacaagcaaaagctacccgtgaggcccagaagagaacggcagcaggaattatgaaaaacccgacagttgacgggattgtcgcaatcgatctagatcctgttgtatacgatgcaaagttcgaaaaacaattaggtcagataatgctattgatattatgtacaagccaaatactactgatgagaacgacatgggctttatgtgaatcaattacacttgctacaggtcctttgactactttatgggaaggtagccctggtaaattttggaacacaacaatagcagtatctatggcaaacatattcaggggtagttatctcgccggagcaggtttagcgttctcattgatgaaatccctaggcgggggacggcgaggcacgggagcacaaggggaaacattaggggagaaatggaaaagacaattaaatcaactaagcaagtcagaatttaacacatataaacgttcaggaattatggaagtcgatcgtagcgaagcaaaagaagggcttagacgaggtgaaacaacgaaacacgcggtatcgagaggtacagccaaattgcgatggtttgttgagagaaatcttgtcaaaccagaaggaaaagtcatagatttaggctgtggtagaggaggctggagttattattgtgctgggctgaaaaaggtaactgaagttaaaggttatacgaaaggaggtccaggacatgaagaacccataccgatggctacgtatggttggaatttagtgaaactacattctggaaaagacgttttctttattcctcctgaaaaatgcgacactcttctatgtgacataggagagagtagtcccaaccccactattgaagaaggccgaactttacgcgttctgaaaatggtagaaccttggttacgaggcaatcagttctgcatcaaaattctaaacccctatatgccgtcagtagtcgaaaccttagaacaaatgcaaagaaagcacggagggatgttagttcgtaacccattatcacggaacagtacacacgaaatgtattgggtttcatgcggaacaggaaacatagttagcgcagtcaacatgacttcacggatgctactaaaccgtttcaccatggcacacagaaagccaacgtacgaaagagatgtggatctaggagctggaactcgtcatgttgccgtagaaccagaagtagcaaatttagacataattggtcaaagaatagaaaatataaaacatgagcataagagtacgtggcactacgatgaagataacccatacaaaacctgggcctatcacggttcgtacgaagtgaaaccgagtgggtctgcttcatccatggttaacggggtagtcaaactactcactaagccatgggatgtaataccaatggttacgcagattgctatgacagatacaacaccgtttggacaacaacgtgtttttaaagaaaaagtcgatacgagaactcccaaagctaaacgaggcactgcgcaaataatggaggtaacagctcgatggctgtggggctttctaagcagaaataagaaaccgagaatatgcaccagagaagaatttacgagaaaagtaagatcgaacgcagcaataggtgcagtctttgttgacgagaatcaatggaacagcgccaaagaagcagtagaagatgagcgcttctgggacttagttcaccgagaaagggaacttcacaaacaagggaaatgtgcaacctgtgtatataacatgatgggaaagagggagaagaaactaggagagttcgggaaagcaaagggcagtcgagcgatctggtacatgtggcttggagctcgtttccttgagttcgaagcattaggattcatgaacgaagatcactggtttagccgtgaaaatagtctatccggtgtcgaaggtgagggcctgcataagttaggttatatcctacgcgatatatcaaagataccgggaggcaacatgtacgccgatgacacagcgggatgggatacaagaataactgaggacgacttacaaaatgaggccaaaattacagatataatggaaccggaacacgcgctattagcaaccagcatatttaaattaacctaccaaaacaaggtagtcagagtgcaacgcccagctaggaacggtactgtaatggatgtaattagtagacgtgaccagcgcggaagtggacaagtaggtacatatgggttaaacacatttaccaacatggaagcacagttaataagacaaatggaaagtgaagggattttcagtccctctgaattagagacaccaaatttggccgaaagggttttagattggttagaaaaacatggagtagaacgattaaaaaggatggccattagtggagatgattgcgtcgtaaaacccatcgacgatcgttttgcaactgcgttatcagccttaaatgatatgggaaaagtgagaaaagacataccacagtgggaaccaagtaagggatggaatgattggcaacaagtacccttctgcagtcaccactttcaccagctcataatgaaagatggccgtgagattgtagtaccctgcaggaaccaagatgaattagttggcagagctagggtgagtcagggagcaggatggagtttgagagagacagcatgtcttgggaaaagttacgcccaaatgtggcaattaatgtatttccaccgaagagatttacgactagccgcgaacgcgatatgcagtgcggtccccgtagactgggtaccaacaagtcgtactacttggtcaatccatgctcatcatcaatggatgacaacagaagacatgttgtctgtttggaatagagtatggattgaagaaaatccatggatggaagataagacacatatctctagttggggagatgtaccgtacctaggtaaacgtgaagatcaatggtgcggatctctcatcgggcttactgctcgcgcaacgtgggcaacaaacattcaagtagcaataaaccaggtaagaagactgattggcaacgaaaattatctagattacatgacttctatgaagcgtttcaaaaacgaaagtgatccggaaggggcactatggtga

SEQ ID NO: 21619 - RNA, 9879 nt, synthetic construct
  misc_feature 1..9879: note = derived and/or modified CDS sequence (opt6) from DENV-1__FJ882523__SS-prME
  source 1..9879: mol_type = other RNA
tcagtgacaatgttgttaatgctaatgcctacggcactcgcattccatcttacaacaagagggggtgaaccgcatatgatagttacaaaacaagaacgaggtaaaagtctactattcaaaacaagcgcaggagttaacatgtgtacgctaatagcaatggatttaggcgaattatgcgaagacaccatgacgtataagtgcccaaggattactgaagcagaaccagatgacgtggactgctggtgtaacgccacagacacatgggtaacgtacggtacgtgtagtcaaacgggcgaacatagacgagacaaaaggagcgtggctttggcgcctcatgtgggtttgggactggaaacacgaacagaaacttggatgtcaagtgaaggagcttggaaacaaatacaaagagtcgagacgtgggcactgagacatcccggtttcacggtaatagctttatttttagcacacgcgataggtacatctataacccaaaaaggaatcatctttattttactaatgctagttacaccgtctatggcaatgagatgtgttggcataggaagccgcgactttgtagaaggcttaagtggagccacgtgggtagatgttgtacttgagcatggtagctgtgttactactatggctaaagataaacctactttagacatcgagctattaaaaacagaggtaacgaatccagcggtattgcgtaaattatgtatagaagcgaaaatctctaacactactacagattcgcgatgtcccacacaaggtgaagccacattgatggaagaacaagatgcgaatttcgtttgtcgtaggactttcgttgacaggggttggggaaatggttgtgggctgtttggaaaaggatctcttattacctgcgctaaattcaaatgcgtcacgaaactggagggaaaaatagtacaatacgaaaatttgaaatattcggtcattgtaacagtacacacaggagaccaacatcaagtagggaatgagtcaactgaacatggcactacggctacaataacaccccaagctccaacttcagagatacaactgaccgattacggagctttaacattagattgttcaccaagaacaggattggacttcaatgaaatggtgttgctgacaatgaaagaaaaatcctggctagttcataagcaatggtttttggacttgcccctgccctggacgagtggtgcgagcacaagtcaggagacatggaaccgccaagatttgcttgtaaccttcaaaacggctcatgcaaagaaacaggaagttgtggtgctaggttcacaagagggtgcaatgcacacagctttaactggagcaactgaaatacaaacgtctggaactaccacgattttcgccggccatttgaagtgcaggcttaaaatggacaaactaacgcttaaaggtatgtcttatgtgatgtgtactggaagttttaaactcgaaaaggaagtagcggagacacagcatggcacggtcctagttcaaataaaatatgaagggactgatgccccatgtaagattccatttagcacccaagatgaaaaaggagttacccaaaatggacgacttataactgcaaatcccatagtaacggacgaagaaaagcctgttaatatcgaagccgaaccgcctttcggggagagttatatagttattggcgcaggggaaaaagcattaaaattatcatggtttaagaaaggatcttctattggaaaaatgttcgaggctacggcgagaggggctagacggatggcaattttgggtgacactgcttgggattttggaagcataggaggggtatttacctcagtagggaaattagttcaccagatcttcggtacagcatatggtgttttattcagtggagtctcttggactatgaaaattggtataggagtacttctaacatggctcggacttaattcgcgaagtacaagtttatcaatgacttgcatagcagtcggtttggtgacgctttatttgggtgtaatggtacaagcagacagtggatgcgtaataaattggaagggacgagaactcaaatgtggctctggaatctttgtgactaacgaagtgcatacatggacagagcaatacaaatttcaggcagattctccgaaaaggttatctgcagccataggaaaagcatgggaagaaggggtttgtggcataagatctgcaacaagactggaaaatataatgtggaaacaaatatctaatgaactcaatcacattttactagagaatgatatgaaattcactgttgtagtaggcgatgtagtcggcatactagcacaggggaagaaaatgatcaggcctcaaccaatggaacataaatattcatggaaatcatggggaaaggcaaaaataataggcgcggacgtacaaaacacgacattcattattgacggtcctaatactccggaatgcccagacgatcaaagagcctggaatatatgggaggttgaagactacggttttggtatatttacaactaatatttggttaaaacttcgagactcttatacacaagtatgcgaccaccgtcttatgagcgcagcaataaaagatagcaaagcagtccacgccgatatggggtactggattgagagcgagaaaaatgaaacctggaaactcgcacgggcaagttttatcgaagttaaaacatgcatctggccaaaatcccatactttatggtctaatggggtgcttgaaagtgaaatgattattccaaagatttacggaggtccaatctcacaacataattatagaccggggtatttcacccaaacagcgggaccgtggcatctgggtaaacttgaattagattttgatctatgtgagggaacaacggttgtagtagatgaacattgtggaaacagaggcccatcccttagaactacaacggttacgggaaaaattatacacgaatggtgttgtcgaagctgtactctgccgccgttgcgatttaagggggaggatggatgttggtatggcatggaaattcgaccagtaaaagaaaaagaagagaacttagtaaagtcgatggtatctgcggggtcaggagaggtagactcctttagtcttggactattgtgcatatcaattatgatcgaggaagtgatgagaagccgctggagtcgaaagatgttaatgacaggaactcttgctgtgtttttactgctaatcatggggcaactgacatggaacgaccttattcgattatgcataatggtcggagctaatgcatctgatagaatggggatgggaactacctaccttgcattaatggcaacattcaaaatgagaccgatgtttgcagtaggcttattgttcagacgactaacctctagagaggtattgctcttaacaatagggttatcactggtagcatctgtagagttgccaaattcattagaggaattgggagatggactcgcaatgggtataatgatcctaaaactgctgacagattttcaatctcatcagttatgggcgactctattgtctctgacttttataaagactaccttgagtttgcattatgcatggaaaactatggctatggtgctaagcatagtgtctctatttcccctatgtttatctacaacgagccagaaaacaacctggttacctgtacttttaggtagtttgggatgcaaaccactgaccatgtttttaatcgccgaaaacaaaatttggggaagaaagtcttggccactgaacgagggaattatggcagttggcgtagtttctatactccttagttcattactgaaaaacgacgtgcctttggcaggacctctcatcgctggcggaatgttgatagcatgctacgttatcagtggttcttctgccgatttgagcctagagaaagctgcagaagtgtcttgggaggaggaagcggaacattctggtgcttcacataacatcctagtagaagtgcaagatgacggaacaatgaaaattaaggatgaggaaagggatgacacgctaacaatactactaaaagcgacattgctggccgtctccggcgtttatccgctatccatccctgcgacactatttgtttggtatttttggcagaaaaagaaacaaagatcaggggttctgtgggacactccatctccacctgaagtggaacgagccgtattagatgatggaatttatagaattatgcagaggggattgttggggcgctctcaagtaggagtgggggtttttcaagaaaatgtgttccataccatgtggcatgtaacccgtggggccgtactgatgtatcaaggaaaacgtttggagccaagttgggctagtgtcaagaaagacctaatatcgtatgggggaggctggagacttcaaggatcttggaacacgggggaagaagtacaagtaatagcagtcgaacctggcaaaaatcccaaaaacgttcaaactgctcccggtaccttcaaaacgccagagggcgaagttggagcaattgcactagatttcaaacctggtacgtcaggcagcccaatcgtgaatagggaaggtaaaattgtaggattgtacgggaacggagtggtaactacaagcggaacctacgtatcagcaatcgctcaggcaaaagcctctcaggagggaccgttaccggaaatagaggatgaagtatttagaaaaaggaatctcacaatcatggatctacaccccgggagcggaaaaacacgtagatatctcccggctatagtaagggaggcaattaaacgcaagctaagaacgctaattttagctcctactagggttgtagcaagtgaaatggctgaagcacttaaaggtatgccaatcagatatcaaactacagccgtaaaaagcgaacacactggcaaggaaatcgtagacctaatgtgtcatgccacattcacgatgcgtcttctatcccctgtgcgtgtcccgaattataatatgattattatggacgaagctcacttcaccgatccttcctccatagcagcgagaggctatataagtacgcgagtaggaatgggcgaagccgcagcgatttttatgactgcgacaccccctggaagcgtagaggcatttccacaaagcaacgcagtcattcaagatgaagagagagatattccagaacgatcttggaactccgggtacgaatggataactgactttccaggtaaaaccgtatggtttgtaccgagtataaaaagtgggaatgatatagctaattgtttgcgcaaaaatggcaagagagtgatacaacttagcaggaagacctttgatacagagtaccaaaagaccaaaaacaatgactgggattatgtagttacgactgacatctcagaaatgggagcgaattttagagcggatcgagtcattgatccaagacgttgtttaaaacccgtaatactaaaagatgggccagaacgcgttatactggctggtcccatgcctgtaacggttgcgtcagcagcacagcggcgaggcaggataggccgaaatcataataaggaaggtgaccaatatatttacatgggacagccgctgaacaacgacgaggatcacgcccattggactgaggcaaaaatgctactagacaatataaatactccagagggaataattccagctctattcgagccggaacgtgagaaatcggccgcaatagacggagaataccgtttacgtggagaagctagaaagacattcgtagagcttatgagacgaggagatctgcctgtctggctatcttataaggtagcatcagaaggattccaatactcagaccgacgttggtgttttgatggagagaggaataaccaagtattagaagaaaacatggatgtagagatttggactaaagaaggcgagcgcaaaaagctaagaccgagatggttagatgcccgtacttatagtgatcccctagcattacgggaatttaaggaatttgcagctggtagaagatcagtttctggagacctgatccttgaaataggaaagttgccgcaacaccttacgcagcgcgcacaaaatgcattagataatctcgtgatgctgcataattcagaacagggaggacgtgcatataggcacgcgatggaagaattacccgatacaattgaaaccctcatgttactcgcactcatcgcagtgttaacaggaggggttactctattctttttatcgggaagaggactaggcaagacatctataggattgctatgtgttatggcctcttcagtactattgtggatggccagtgtagaaccacactggatcgcagcgtctataatactggaatttttcctcatggtactacttattcctgaacctgaccgacaaagaacaccgcaagacaatcagctagcttatgttgtgatcggactgctttttatgattctaacagttgctgccaatgagatgggactgttagaaacaactaagaaagatctcggaataggacacgtagctgtcgaaaatcatcatcacgctaccatgctagatgtagacttacatccagcatcggcgtggactttatatgcagtagctacgactatcataacgccaatgatgagacacacaatagaaaatacaacagccaacatctcattgacagcaatcgcgaatcaggcagctattcttatgggattagacaaaggatggccaatatctaaaatggacataggagttcctctgctagctctcggttgttattcacaagtaaatccccttacactgacagcagcagtcctaatgctcgttgcccattatgcaatcatcggacccggattgcaagccaaagccactcgagaagcacagaaaagaaccgcagctggcatcatgaaaaacccaactgtcgatggaattgtcgcgattgatcttgacccggtcgtatatgacgcaaaattcgaaaagcaattaggtcaaatcatgttgctaattttatgtacttcacaaattttactgatgcgcaccacctgggctttgtgtgaatctataactctggcaactggacctttaactacgctatgggagggttcgcctggaaaattttggaataccacaatcgctgtatcaatggcaaatatctttaggggttcatatcttgctggagcaggtttagcattctcactaatgaaatcgttgggaggtgggagacgaggaacaggagcacagggagaaacactaggcgagaaatggaagcgccagttaaaccaactttctaagtcagaatttaacatctataaacgtagtggaatcatggaggtagacagatcagaggcaaaagaagggctaaaacgaggtgaaacaacacgacatgcagtgtcgaggggtactgccaaactcagatggtttgtagaaagaaaccttgtgaaaccggagggaaaggtcatagacttgggttgtggacgtggcggatggagttattattgtgcaggattgaagaaggtaacagaagtgaaaggttatacaaaaggtggtccaggacatgaagaacccataccaatggcaacttacggttggaatctagtgaaattgcatagcggaaaagacgtgttcttcactccacctgaaaagtgcgatacattactatgcgacattggtgaatcgtctcccaacccaacaatagaagaagggcgaacactgagggtactaaaaatggtagaaccttggttaagaggtaatcagttctgtataaagattcttaacccttacatgccaagtgtcgtagaaacattggaacaaatgcaaagaaaacacgggggaatgttggtcagaaatccattatcgagaaacagcacacatgaaatgtattgggtaagttgtggtacgggtaatattgtatcagcagttaacatgacaagtcgaatgctcctaaatcgattcacaatggcgcatagaaaaccaacatatgaaagagatgtagacttaggcgcaggaacgagacatgtagcagttgagccggaagtagcaaatctggacatcatcggtcaaaggatagagaatataaagcacgaacataaatcaacatggcattatgatgaagataacccctacaagacatgggcctatcacggttcatatgaggttaaacccagtgggtccgcatcgagtatggtcaatggtgttgtaaaattgttaacgaagccgtgggatgttattcctatggtgacacagattgcaatgactgatacgactcccttcgggcaacaacgagtttttaaggaaaaagttgataccagaacacccaaagcgaagagaggaaccgctcagataatggaggtaacagctcggtggctatggggattcttgtctagaaacaagaagccacgaatttgcacgagggaggagttcacacgaaaagtacgttctaatgcagctattggggctgttttcgttgatgaaaaccaatggaactccgctaaagaagcagtcgaagacgagaggttttgggatcttgttcagaaagaacgagaacttcataaacaaggtaagtgcgctacgtgtgtatataacatgatgggaaaacgagagaagaaattaggcgaatttggcaaagcaaaaggcagcagagctatttggtacatgtggttaggagccagattcctggaatttgaggctttagggttcatgaatgaagaccactggttttctagagaaaactcgttaagtggagttgaaggggaagggttacataaactaggatacatattaagagatatatctaagattcctggagggaacatgtatgcagacgatacagcaggatgggatacaagaattaccgaggatgacctacaaaacgaagcgaaaatcaccgacatcatggaacctgaacatgccctactagcgacctcaattttcaagctaacttaccaaaacaaagtagtcagggtccagagaccagccaaaaatgggacagttatggatgttataagtcgacgagaccagcgaggcagcggtcaagtaggaacttacggtttaaacactttcactaacatggaagcacaactaatacgccaaatggaatctgagggaattttctcaccaagcgaactagaaataccaaacctagccgaacgtgtattagattggttagaaaaatatggcgttgaaaggcttaagcgcatggcaatatctggcgatgattgcgttgtaaaacctatagatgatcgtttcgcaacagctcttacagcactgaatgacatggggaaggtacgaaaggacgtgccacagtgggagccaagtaaaggatggaatgattggcaacaagttcctttttgctctcatcatttccatcaacttatcatgaaagacggtagggagattgtagtaccctgtcgaaaccaggatgagctggtaggtagagcacgagtttctcaaggagccggatggagtctaagagaaactgcttgtctaggaaaaagctatgcacaaatgtggcaactcatgtatttccacagacgagacctgagactagctgcaaatgctatttgcagtgcagtaccagtagattgggttccaacttccagaactacttggtcgatacatgcgcatcatcagtggatgacgactgaagacatgttatctgtatggaatagagtttggattgaggagaatccctggatggaggataaaactcatgtgtcatcttggggcgatgtaccatacttgggaaagagggaagatcaatggtgcggaagtttgataggcctcacagcacgagctacttgggcatcaaatatccaagtagcaattaaccaagtacgaaggttaatcggtaatgaaaattaccttgactatatgacctccatgaaacgctttaaaaatgaaggtgatcctgaaggagccctatggtga

SEQ ID NO: 21620 - RNA, 9879 nt, synthetic construct
  misc_feature 1..9879: note = derived and/or modified CDS sequence (opt6) from DENV-1__FJ882524__SS-prME
  source 1..9879: mol_type = other RNA
agcgtaacaatgttactcatgttaatgccgacagctttagcgttccacttgactacaagagggggcgaacctcatatgatagtgacaaaacaagaacggggaaaaagtctactttttaaaacaagtgcaggagtgaatatgtgtactctaatagcaatggatttaggcgaactatgcgaagacacaatgacctacaaatgcccacgaatcacagaagctgaaccagatgatgtagattgttggtgcaacgcaacagatacatgggtaacttatggcacgtgtagtcaaacaggtgaacatcggagagacaaacgttctgttgcgttagcaccacatgtaggattaggtttagaaacacgaactgaaacttggatgtcatcagaaggcgcttggaaacaaatccaaagagtagaaacatgggcattacgacatcccggtttcactgttatcgcacttttccttgcgcatgctattggtacatccataacccagaaaggaataatctttatcttgttgatgttagtaactccatcaatggcgatgagatgtgttgggataggctctcgtgattttgtggaaggattaagtggtgcaacatgggtggacgtagtattagaacatggaagttgtgttacaaccatggcaaaagataaacctactctggatatagaattgctaaaaaccgaagtgacaaatcccgcagtgttacgtaaattatgtatagaagctaaaatcagtaacactacaacagattcaaggtgtcccactcagggtgaagctactttaatggaagaacaagatgcaaattatgtatgccgacgtacattcgtagacagagggtggggaaatggctgtggtttatttggtaaaggctctttaataacttgtgcaaaattcaaatgcgttacaaaattggaagggaaaatagtacagtatgaaaatttaaaatattctgtgatcgttacagtccatactggcgaccaacatcaggtaggaaacgaaagtacagaacatggtactactgccacaattacaccacaggctccgacatctgaaatacaactcacagattatggggctctaacattggactgctcaccacgcaccggtttagattttaacgaaatggtactgttaacgatgaaagaaaaatcatggctagtccataaacagtggtttttggaccttcctttaccatggacaagtggcgccagtacatcacaagaaacttggaatagacaggatctactcgttacgttcaagacggcacatgctaaaaagcaagaagtagttgtactaggttcgcaagaaggcgcgatgcacaccgctcttacaggagctacagaaatacaaacctcaggaacaacaaccatattcgcaggacacctaaagtgtagattgaaaatggataaactaacactaaaaggcatgtcgtatgtaatgtgtacagggagttttaaacttgaaaaagaggttgcagagactcaacatggtactgttctcgttcaaataaaatatgaaggaactgatgcgccatgcaaaataccgttttctacgcaagacgaaaagggagttactcaaaacggccgattaattacagcaaacccgatagtaacagataaagaaaaaccagtaaatatagaagctgaaccaccatttggagagagctatatagtgattggcgccggtgaaaaggccttaaaattaagttggttcaagaaaggatcttccatcggaaagatgtttgaggcgacggcccgcggagcacgacgaatggccattcttggagatactgcctgggattttgggtcaattggcggggtattcacaagtgtaggaaagctcgtacatcagatatttgggactgcatatggtgtgttgtttagtggcgtaagctggacaatgaagatcgggatcggggtcctcctaacttggctagggctaaacagccgctcaacatctcttagcatgacctgcatcgcggttggacttgtaacattatatctcggtgtaatggttcaagcggattctggctgtgtcataaactggaaaggaagggagctaaaatgtggatcaggcatatttgttacaaacgaggttcacacatggacagaacaatataaattccaggcggattcaccgaaaagacttagtgcggccataggaaaggcatgggaagaaggggtttgtggcattaggagcgcaaccaggttagaaaatataatgtggaagcaaatatcaaacgaactaaaccacatattgttagaaaatgatatgaaatttaccgtcgtcgttggagatgtggtagggatattagcccaagggaagaaaatgatccgtccacagccgatggaacataaatacagttggaaatcatggggcaaagctaaaatcattggggctgatgttcaaaacacgacttttattatagacggaccaaacacgccggaatgtccagatgaccagcgcgcatggaatatatgggaagttgaggattacggatttggaatattcactactaatatatggctcaagctacgtgattcatatacacaagtttgcgatcatcgactgatgagtgctgcaataaaagactcaaaggccgtacacgcggatatggggtattggatagaaagcgagaaaaatgaaacatggaaactggcaagagcctcatttatcgaagtaaaaacatgtatatggcctaaaagtcatacactatggtctaatggagtactggaaagcgaaatgataatcccaaagatttatggagggcccatctctcaacacaactatagacctggttacttcactcaaacagctggcccatggcatctaggtaagttagaattagattttgacttatgtgaagggacaacggtggttgtagatgaacattgtgggaacaggggaccatcgttacgtacaacaacggtaacgggtaaaataattcatgaatggtgttgtaggtcttgcactctgcctccgctcagatttaagggagaagatggttgctggtacggaatggaaatccgcccagtaaaagagaaagaagaaaatctggtaaaatccatggttagcgcaggtagcggagaagtagactcattcagtctaggattgttgtgtatttcaattatgatagaagaagtgatgagatcaagatggtcaaggaaaatgttgatgacaggtacacttgcagtatttctcttactgattatggggcaactaacttggaacgacctaatccgactatgcatcatggtaggtgcaaatgcttcagaccgaatgggaatgggaacaacatatcttgccttgatggctacattcaaaatgcgcccgatgttcgcagtaggccttctgttcaggaggttgacttcaagagaagtattattactaactatagggctgtcattagtggcttccgtcgagctcccaaacagcctcgaagaattaggcgatggtttggcaatgggaataatgatcttgaaattacttactgactttcagtcccatcaattgtgggcgactttactaagtctaacatttataaaaacaactttaagcctacactatgcttggaagaccatggcaatggtactgagtatcgtctcactttttccgttatgcttatcgacgacatcacagaaaaccacatggttacctgtgcttcttggatctttaggttgtaagcctcttacaatgttcctgatcgcagaaaacaaaatatgggggagaaaatcatggccactaaatgaagggatcatggctgtcggtgttgtttcaatattactctcttccttactcaaaaatgacgttccactagcaggaccactaatcgcaggagggatgctaatcgcatgttatgtaatcagtgggagtagcgctgatcttagccttgaaaaagcagcagaagtatcatgggaagaggaggctgagcacagtggcgcatctcataacattttagttgaagtacaagatgacggtacaatgaaaataaaagatgaggaaagagacgacaccctaactatattactaaaagcaacattgttagcagtttccggagtatatccactttccatccctgcgacgctttttgtgtggtacttttggcagaagaagaaacaacgatcgggagtattatgggacactccaagtccacctgaggttgagagggccgtcttagacgatggaatatatcgtattatgcagcgtggattactaggacgatcacaagtcggtgtaggcgtttttcaagaaaatgtatttcacacaatgtggcatgtcacaagaggggcagtgctaatgtatcaagggaaacgcctagagccatcatgggcatctgtcaagaaagatctaatttcatatggtggtggatggcgcctacaaggatcttggaatactggagaagaagttcaagtaattgcggtagaaccaggtaaaaatccgaaaaacgtacagactgcacctggaacatttaaaacgccggaaggcgaggtgggagctatagcacttgacttcaaacccggaacttctggtagcccgatcgtaaatagagaaggaaaaatagttggactttatggaaatggtgtagtaacaacaagcggtacatacgttagcgctatcgcacaggcaaaggcaagtcaagagggaccattaccggaaatcgaagatgaagtattcaggaaaagaaacttgaccattatggacttacacccaggtagtggcaaaactagaagatacctgccagcaattgttagagaagcaattaagaggaaactgcgtaccctaattttggcacctactagagtcgttgcctcggaaatggcggaagcacttaaaggtatgccaattagataccagaccactgccgttaaaagtgaacacacaggtaaagaaattgtagatttaatgtgtcacgcaacttttactatgagattgttaagtcctgtcagagttccaaactataatatgattataatggatgaagctcattttacagatccaagctcgattgcagctagagggtacattagtacgcgtgttggtatgggcgaagctgcagccatattcatgacagcaaccccacctgggtcggtcgaagcgttcccacaaagcaatgcggtaattcaagacgaagaacgcgatatccccgaacgaagctggaactcaggatatgaatggattacagattttccgggaaagaccgtctggttcgttccaagcattaaaagtgggaacgatatagctaattgcttaaggaaaaatggaaaacgagtaatacaactctctcggaaaacatttgacacggaataccagaaaacgaaaaacaatgactgggattacgttgtaaccacggatatttccgaaatgggtgctaatttcagagcagatagggttatagatccgagaagatgtctaaaaccggttattctcaaggatggaccagaacgtgttatactcgcaggcccaatgccagttactgtggcatcagcggcacaaagaagggggcggataggaagaaaccacaacaaagaaggagatcaatatatatatatgggccagcctctaaacaacgatgaagaccacgcccattggacagaggcaaaaatgttactggataatataaacacccccgagggaataataccagcactcttcgaacctgagagagagaagagtgcagcaatagatggtgaataccgattacgtggagaggcgcgaaaaactttcgtcgaactgatgcgtagaggcgatctacctgtttggttgtcttataaagtagcaagtgagggctttcaatactctgatagaagatggtgttttgacggtgaacgtaacaatcaggtccttgaggaaaacatggatgtagaaatatggaccaaagaaggtgaacggaagaaactaagaccacgttggctagatgcgcggacttattccgaccctctcgcgttgagagagttcaaagagttcgctgcaggtcgtaggtcagttagtggtgacctaatcttagaaattggaaaattaccacaacacctaacacaacgtgcgcaaaatgcacttgataacctcgttatgctacataactccgaacaaggaggacgggcatacagacatgctatggaagaactaccagacactatagagacattgatgctattagctctaatagccgttctcactgggggagtcactttattctttctttcgggtagaggcttagggaaaacgtcaattggactcttatgtgtcactgcgagttctgtgctgctgtggatggcaagtgttgagccccattggattgcggcttctataatattagagttctttctaatggttttattaattccagaacccgatagacaaagaactccgcaagacaatcaattggcctatgttgtgatagggctactttttatgattcttactgtcgcagctaatgagatgggattactagaaaccaccaagaaagatctaggaatcggtcatgtcgcggttgaaaatcaccaccatgctacaatgctagatgttgacttacacccagcatcagcatggactctctatgcagtagccacaacaataataactcctatgatgcgtcacaccatagaaaacacaactgcaaatattagcttaacagctatagcaaatcaagccgcaatattaatgggtcttgataaaggatggccaatctcaaaaatggacattggggtaccattactagccttaggttgttatagtcaagtgaatccacttaccctcacagctgcggttctaatgctagttgctcactatgcaattatcggacctggtcttcaagccaaagctactagagaagcgcagaaaagaaccgccgcagggataatgaaaaatccgactgttgacggaattgtagctattgatctggatcctgtagtttacgacgcgaaattcgaaaaacaactaggccagataatgctattaatactctgtacaagtcaaatactactgatgcgaacaacctgggctttatgcgaatccattactctcgcaaccggcccccttaccaccctttgggaagggtccccggggaaattctggaatactacgatagccgtgagcatggctaatatattccgtggtagttatttagcgggtgcggggttggccttctcattaatgaagagtttaggagggggacgtcgaggtaccggtgcgcaaggggagaccttaggagaaaaatggaaacgacaattgaaccaattgagtaaaagcgagtttaatatatataaacgaagcggaataatggaagtggacagaagtgaggcgaaggaggggttaaaacgaggagaaaccacaagacacgcagtctcccgtggcactgcaaaactacgttggttcgtcgaaagaaatctagttaaacccgaagggaaagtaattgacttggggtgtggtagagggggatggtcatattactgtgcagggcttaagaaggtgacagaagtaaaaggatacacgaaaggaggtccaggacatgaggaacctataccaatggcaacatacggatggaatctagttaaacttcactcaggaaaagacgtatttttcactccacctgagaaatgtgatactctattatgcgatattggcgaatcaagcccaaacccaacgatcgaagaaggacgtacattacgggtactcaaaatggttgaaccttggttaagaggcaatcagttttgcataaaaatattgaatccatatatgccaagtgtagtcgagacgttagagcagatgcaacggaaacatggaggaatgctagtaagaaatccattgtcaagaaactcaacgcacgagatgtattgggtatcctgcggtactgggaatatcgtttcagcggtcaacatgaccagccgaatgttactaaacagatttacaatggcgcatcggaaaccaacgtacgagcgagatgtagatcttggagcaggaacacgacatgttgcagtggaacccgaagtagcaaatcttgatattataggacaaagaattgaaaacattaaacacgaacacaagagcacgtggcactatgacgaagataatccgtacaaaacttgggcctatcacggaagctacgaagtcaaaccatccggctcagcctctagcatggtgaatggtgtcgttaaattactaactaaaccatgggatgtaataccaatggttacacagattgccatgacggataccactccattcggtcaacagagagttttcaaagaaaaagttgacactagaactccgaaagcgaaacgtggcactgctcaaattatggaagtcactgcacgctggttgtggggtttcctaagtcggaataagaaacctcggatttgcactagggaggagttcacacgcaaggtacgatcaaacgcggctataggagcggtgtttgtcgacgaaaaccaatggaatagtgctaaagaagcagttgaggacgaaagattttgggatctcgtacaaaaggaaagggagcttcacaagcaaggaaaatgcgcgacttgtgtctacaacatgatgggaaaaagagagaagaaacttggtgagttcggaaaagcaaaagggtcaagagcgatatggtatatgtggcttggggccaggtttctagaatttgaagctctcggctttatgaatgaggaccattggttttcaagagaaaattctttatctggagtggagggtgagggtctgcataaattaggatacatactaagggatataagcaaaattccaggaggcaacatgtatgcggacgatacagcagggtgggacaccaggatcacagaagacgaccttcaaaatgaagcaaaaattaccgatatcatggagcccgaacacgccttactcgccaccagtatatttaaacttacataccaaaacaaagttgttagggtacaacgtcctgccaaaaatggaacggtgatggatgttatctcaagacgagaccaaagaggctcggggcaggtaggaacatatggtctgaatactttcaccaacatggaagcccagttgatacgacaaatggaatccgaaggtatatttagtccgtcagaactcgaaatacctaatttagcggaaagggtactcgattggctagaaaagtacggagttgagcgactcaagagaatggctatatctggggatgattgtgtagtgaagcctatcgatgacagatttgccactgcactaacagcattaaacgacatgggaaaagtccgaaaagatgtcccacagtgggagccatcgaaagggtggaatgattggcaacaagtcccattttgttcgcatcactttcatcagcttataatgaaagacggtcgagagatcgtggttccatgtcgaaaccaagacgagttagtcggtagagctcgagtaagccaaggggctggttggtcactaagagaaactgcttgtttggggaaatcctacgcgcagatgtggcaacttatgtattttcacaggcgagacttaagactagccgctaatgcaatctgctcggccgttccagtagattgggtgccaacaagcagaacaacgtggtcaatacatgctcatcaccaatggatgactaccgaagatatgctatcagtgtggaatagagtatggattgaagagaacccatggatggaagacaagactcatgtatcttcgtggggtgatgtcccatatctaggcaaaagagaagatcaatggtgtgggagcttaataggcttgactgcaagagcaacttgggccagcaacattcaagtagctataaatcaagttcgccgattgattggaaacgaaaactacttagattatatgacatccatgaaaaggtttaaaaatgagggtgacccagaaggtgcactgtggtaa

SEQ ID NO: 21621 - RNA, 9879 nt, synthetic construct
  misc_feature 1..9879: note = derived and/or modified CDS sequence (opt6) from DENV-1__FJ882525__SS-prME
  source 1..9879: mol_type = other RNA
tcggttaccatgttgttaatgttaatgcccactgcacttgcctttcacctgactaccagaggaggagaaccacatatgattgtttcgaaacaagaaaggggcaaaagccttcttttcaaaacgagtgctggtgtgaatatgtgtactcttgtcgccatggacttaggagagttctgtgaagacactatgacctataaatgtccccgaataactgaagccgaacccgatgacgttgattgttggtgcaacgctactgatacgtgggttacgtatggtacgtgcagccaaactggagaacatagaagagataaaagaagtgtcgcgttggcaccgcacgtaggactaggattagaaacaagaacggaaacatggatgtcgtcagaaggcgcatggaaacaaatacaacgcgtggaaacatgggcattaagacatccaggtttcacagtgatagcactattcctagcacatgcaatagggacgagtataacgcagaaaggtattatatttatattattaatgctagtaactcccagtatggcaatgagatgcgttggtataggttctcgggattttgtagagggtttgtcgggcgctacgtgggtagacgtggtattagaacacgggagttgtgtaacaacgatggcaaaagataaaccaacgctagacattgagttactgaaaacagaagtcacaaacccagcagttcttaggaaactatgcattgaggcaaaaatcagcaatacaaccacggattcacgatgccctacgcaaggagaggcaaccttagtggaggaacaagacgcgaactttgtatgtcgccgcaccttcgttgaccgcggctggggtaatggttgcgggttatttggaaaaggtagtttaataacatgtgctaaatttaaatgtgtaactaaactagaaggtaaaaccgtgcaatacgagaacttgaaatatagcgtgattgtaactgttcatacgggagatcaacaccaagttggcaacgagtcaactgaacatggcactactgcgacaataactccgcaagctccgagtacagaaatacaattaacggattatggagcattgactcttgattgttcaccaaggacagggctggactttaatgaaatggtcttactaacaatgaaagagaaaagctggctggtacataaacagtggttcttagacttacctcttccgtggaccagcggagcaagcacctcacaagaaacttggaatcgaaaagatctcctagtaacgttcaaaacagcacatgccaagaaacaagaagtagtagtattagggtcgcaggaaggagcaatgcatactgcactaacgggtgcaacagaaatccagacatctggaaccacaacgatatttgccggacacttaaaatgccgtcttaaaatggataaattgacattaaaaggcatgtcgtatgtaatgtgcacgggatccttcaaattagagaaagaagtcgcagagactcaacacgggaccgttttagtacagataagatacgaaggaaccgatgcgccatgtaaaataccattcagtacgcaagatgagaaaggtgtaactcaaaacggcagactaattacagctaatcccatagttactgataaagaaaaaccagtaaacattgaggcagaacctccctttggtgaatcatatattgtcataggcgccggtgaaaaagcactaaaattaagttggtttaagaaaggaagtagcatcggaaaaatgttcgaagccacggcgcgaggtgctcgtcgcatggcaattcttggagacacagcatgggattttggctctattggtggagtctttacgagtgtcggtaaattagtacaccaaatattcggaactgcatatggagttcttttcagtggagtgagctggacaatgaaaattggtatcggagtactattaacatggttaggcttaaacagccgatctacttctcttagtatgacttgcatagctgtaggcctagttacactatatcttggtgtaatggttcaagctgactccgggtgcgtgataaattggaaaggcagagagctaaaatgcggatcgggaatatttgtaaccaatgaagtccatacgtggacagaacagtataaattccaggcagacagccctaaacgcttatctgccgctatcggaaaagcctgggaagaaggagtatgtggtataagaagtgctacaaggctcgaaaacattatgtggaagcaaatatccaatgaattgaatcacattctattagaaaatgatatgaaatttacagtggttgtaggggatgtagcaggtatccttgctcaggggaaaaagatgatacgaccgcaacccatggaatataagtactcatggaagtcgtggggcaaagcaaagattataggtgcggatgtacaaaatacaacatttattattgatggccccaacacccccgagtgcccagacgaccaaagggcctggaatatctgggaggttgaagattacggcttcggcatatttactacaaacatttggttgaaacttagagacagctatacgcaggtttgtgaccatagactcatgtcagctgcgattaaagacagcaaagccgtacatgccgatatgggatattggatagagagtgaaaagaacgagacttggaagttggcaagagcatcattcatagaagtaaagacatgtatatggccaaagagccatacattatggtcgaacggtgttcttgaatctgaaatgattatcccgaaaatatacggcgggcctatatcgcaacataattatagacccggatatttcactcaaacagcaggaccatggcatttgggcaaactagaattagactttgacctatgcgaaggaactacggtagttgtagatgagcattgtggcaatcgtggtcccagccttagaactacaactgtcacagggaaaataatacatgagtggtgttgtagaagctgtactctccctccactaagatttaagggtgaagacggctgctggtatggaatggaaataaggccagttaaagaaaaagaggaaaacttggtaaaatctatggtttcggctggatcaggagaagtagattcgttcagccttggcttattgtgtatatcaatcatgattgaagaggtgatgagaagtcgctggtctaggaaaatgttaatgacgggtaccttggctgtgttcttcctcttaataattggacaacttacatggaatgatctaatccggctatgtataatggtaggggcgaatgcatcggatagaatgggaatgggaacaacttacctagcattaatggccacctttaagatgcggccaatgttcgcggtcggtctcctttttagaagactcacaagtcgtgaagtgcttctactaacgatcggcttatctcttgtagcaagtgttgagttacccaatagcttagaagaacttggagacggcttggcaatgggcatcatgatattaaaattgttaacggattttcaatcgcaccaactatgggcgacattgctatctttaaccttcatcaagacgacctttagtttacattacgcatggaaaacaatggcaatggtcctatcaattgtatctttatttcctttatgcctaagtactacgagtcagaaaacaacatggctgcccgtactgttggggtcactgggttgtaagcctttaaccatgttcctgattgcagaaaataaaatatggggacgccggtcttggccgctaaatgaaggaattatggcagtaggcatagtaagtatactattaagtagtcttcttaaaaatgatgtcccactcgcaggtcccttgatagcgggcggtatgctgatagcgtgttacgtaatttctggttcttcggcagatctgagtctggaaaaagcagcagaagtaagctgggaagaggaagccgaacactcaggtgcgtcgcacaatatacttgtggaagtgcaggatgatgggacgatgaaaataaaggatgaagagagagacgatactttaaccatattattaaaagccaccttattagcagtttctggagtatatccattgtcaataccagcaacattatttgtttggtacttttggcagaagaagaaacaacggtccggtgtcctatgggacactccttcacctcctgaagtggaaagagcagtactagacgatggcatctacagaattatgcagcgtggccttctcggaagatcccaggtaggtgtaggcgtattccaagagaatgtgtttcatacaatgtggcacgtaactcgaggtgcagttttgatgtaccaaggaaaacgactcgaaccctcctgggcaagtgtgaagaaagatttaataagctatggagggggatggagactgcaagggagttggaataccggagaagaagtacaagttatagcagtcgagccgggaaagaacccgaaaaatgtacaaactgcaccaggcacttttaagacatcagaaggcgaagtgggtgctatagccctagacttcaaaccaggtacatcgggaagcccaatagtaaatagagaggggaagattgtgggtctatacggcaacggcgtagtcacaacaagtggaacatacgtatcagcaatcgcacaggcaaaggcttctcaagaaggtccacttccggagattgaagacgaagtattcagaaaaaggaaccttacaataatggacttacaccctggcagtggaaaaacaagaagataccttccggcaatagtccgagaagccataaaaagaaaactgagaacccttatattagcaccgactcgagttgtggctagtgaaatggctgaagccttgaagggaatgcctattcgataccaaactacagctgtcaaatccgagcataccggcaaagagatcgtggatctgatgtgccatgcgacatttacgatgaggctgctatctcccgtacgagtaccaaactacaatatgatcattatggacgaggcgcactttaccgatccttctagcatagctgccagaggatatataagtacaagagttggtatgggtgaggcagcggcaatatttatgactgcgactccgccgggtagtgttgaggcttttccacagtctaatgcagtgatacaagacgaagaaagggacattcccgagaggagctggaactcgggatatgagtggatcacagattttccaggaaaaacagtatggtttgttccatcaataaaatccggaaatgatattgctaattgcttaagaaagaatggaaagcgagttatccaattatcaagaaaaaccttcgacacagagtatcagaaaactaaaaacaatgattgggattatgttgttacaacggatattagtgaaatgggggctaactttcgggctgatagggtcattgatccaaggagatgcctaaagcccgtgatacttaaggatggaccagagagggtaatccttgctgggccaatgccagtaacagttgccagtgcagcccaacgtagaggtagaattggaagaaaccacaataaagaaggggatcagtatatctacatgggacagccactaaacaacgatgaagatcatgcacattggacagaagcaaagatgttactggataatataaacacccccgaaggcattattcctgccttgtttgagcctgagagagagaaatccgccgctattgacggtgaatatagacttagaggtgaagccagaaagacattcgtagaactaatgcgaagaggtgatttacccgtttggttgtcgtataaagtagcgagcgagggttttcagtactccgatagaagatggtgctttgatggagagcgaaacaatcaggttttagaagaaaatatggatgtagagatttggactaaagagggtgagagaaagaaattaaggccccggtggttagacgccaggacctattcggacccattagcacttagagagttcaaagaatttgcagctggacgtcgctcggtttcgggagatttaatattagagattggaaagctgccccaacacctgacgcagagggcccaaaatgcgctcgataaccttgtgatgttgcataatagcgaacaagggggtagggcatatagacatgccatggaagaattgccggataccattgaaacgttaatgcttctagcccttattgctgttcttactggaggggtaacgctatttttcctttcgggaaggggactcggaaaaacaagtatcggtctgttgtgtgtaatggcttcatcagttctgctttggatggcttcggtagaaccacactggatagccgcgagtataatattagagttcttcttaatggtattattaattccagaacctgatagacaacgaactcctcaggacaatcagcttgcctacgttgtcatcgggctgctatttatgattttgactgtcgctgcgaatgaaatgggactattagaaaccacgaagaaagacctcggtattggtcatgtagcagtagaaaatcatcaccacgctgccatgttagatgtagatttacatcccgcatcggcttggacattatatgcggtagccaccaccattataacaccaatgatgagacacacaatagaaaacacaacggcaaatataagtctaaccgccatagcaaatcaagctgcaatcctaatgggattagataaaggctggccaatatcaaagatggacataggcgtgcctttactcgctttagggtgttatagccaagtcaatcccctgaccttaacagctgcagtattaatgttggtagcacactatgcaataataggcccagggttacaagcgaaagcaacacgtgaagcacaaaaacgaacagcggcaggaataatgaaaaacccgacggtagatggaattgtagccatcgacttagatccagtcgtatacgacgctaaatttgaaaaacaacttggacagataatgttgctaatcctgtgtacaagtcaaattttattgatgcgaacaacatgggcattatgcgaatcaataactttagcaacaggtccgcttactacgctatgggaaggcagccccggaaaattttggaatacgaccatagctgttagtatggctaacatatttcgaggatcatatctcgctggcgcaggactagcgttttctcttatgaagtcgctaggcggaggccgtagaggtaccggagctcaaggagaaactttaggtgaaaagtggaagaggcagcttaaccaactcagtaaatcggagttcaacacgtataagagatcgggcattatggaagttgatagatccgaagctaaagagggcctaaaacgaggcgagacaacaaaacacgccgtaagcagaggtacagcaaaattgaggtggtttgttgagcgaaattttgttaagccagagggaaaggtaatagatttaggttgtggtcgagggggatggtcttactattgtgctggattgaagaaagtaacagaggttaagggttacactaaagggggacccggtcacgaagaaccgattccaatggcaacttatgggtggaatttagtaaaacttcactccggtaaagacgtattctttataccaccagaaaagtgtgataccctactatgtgatataggcgaaagtagtccaaaccctacgatagaagaaggacgcaccttaagagtattaaaaatggttgaaccttggctaagaggaaatcaattttgcataaaaatattgaatccgtacatgccttcagttgtagaaacactagagcgaatgcaaaggaaacacggcgggatgctagttaggaacccattaagtcgcaattcaacgcacgaaatgtactgggtgtcatgcggtacaggaaatatagtttccgcagtaaatatgacatctaggatgctgttaaatagattcacaatggcccacagaaaaccaacatatgagcgggacgtagatttaggtgctgggacaagacatgtcgcagtagaacctgaagtcgcaaatctagatattattgggcaacgaattgaaaatataaaacacgaacacaaaagtacctggcattacgatgaagataacccttataaaacatgggcatatcatggtagctatgaagtaaaaccatccggttcagccagttctatggttaatggcgtagtcaagttgttaactaaaccttgggatgtcatcccgatggtcacccagattgcaatgacagataccactccgttcggccagcagagagtattcaaagaaaaggtcgatacacgtacccctaaagccaaaaggggaacggcacaaatcatggaagtgacggcaaaatggctatggggatttttgtcgcgaaataagaaaccccgaatctgtacgagagaagagttcacacgcaaagttaggtcaaatgcagctataggtgcagttttcgttgacgaaaaccaatggaatagtgcaaaagaggctgtagaagatgaaagattttgggatttagtccatcgggaaagagaactccataaacaaggaaaatgtgcaacgtgcgtttacaacatgatgggcaagagagagaagaaactaggagaatttggaaaggccaaaggaagtagagcaatatggtatatgtggctcggagccagattcttagaatttgaggctttgggctttatgaacgaagatcattggttctcacgcgagaacagcctctcaggtgtagaaggcgaaggcttgcataaactcggatatatcttacgagacatctctaaaatacctggtgggaatatgtatgccgatgatacagcaggatgggatacgcggattactgaagatgatcttcaaaatgaagcgaaaattacagacataatggagccggaacacgctttattagcgaaaagtatatttaagttaacataccaaaataaagtggttcgagtgcagcgacctgccaaaaacggaacagttatggacgtgatttctagacgagatcaacgcggtagtggacaagtgggtacgtatggattgaatacattcacaaatatggaagcacagttaattagacagatggaatcagaagggatattctcacctagtgaattggagacccctaatttggcagggcgagtattggattggcttgaaaagcacggtgttgaacgattaaaacgaatggcaatatccggcgatgattgtgtagttaaaccaatcgatgacagatttgcaactgcattaactgcattaaacgatatgggtaaagttaggaaagacattcctcaatgggaaccaagcaaaggatggaatgactggcaacaagtaccattttgttctcatcacttccaccaactaattatgaaagacggacgggaaatcgttgtaccatgtcggaatcaagacgaactggtcgggagggcacgagtctctcaaggcgctggatggagcctacgagagactgcatgtctcgggaaatcttacgcacaaatgtggcagttaatgtacttccaccgacgggatttacgtctagccgctaacgctatatgttcggctgtcccggtagactgggttcccacctcgcgaactacttggtcaatccatgcacaccatcaatggatgactacagaagacatgctaagcgtatggaatagagtctggattgaggaaaatccttggatggaagataagacccatatttcgtcatggggtgatgtaccgtatttaggtaaacgagaggatcaatggtgcggttctctaataggacttacggcccgcgcaacatgggctacaaacattcaagtggcgatcaatcaggtacgtcgactaataggaaatgaaaactatctagactacatgacaagtatgaaaagatttaaaaacgaatcggatcccgagggtgctctatggtaa

SEQ ID NO: 21622 - RNA, 9879 nt, synthetic construct
  misc_feature 1..9879: note = derived and/or modified CDS sequence (opt6) from DENV-1__FJ882526__SS-prME
  source 1..9879: mol_type = other RNA
agtgtaactatgttactcatgttaatgccaactgcattagcattccacttaacgactcgcgggggagaaccgcatatgatagtttcaaaacaagaacgcggaaaatccttgttatttaaaacaagtgcgggtgtcaatatgtgtacattaatagcgatggatttaggagaattttgtgaagacacaatgacatataaatgcccgcgaatcacggaagcagaacctgacgacgtagactgttggtgtaatgcaacagatacgtgggttacttatggtacctgttctcaaacgggagagcaccgacgcgacaaacgtagcgtcgcattggcgccacatgtcggtctgggattagaaacgcgaacagaaacttggatgagtagcgaaggagcgtggaaacaaatccaaagggtagaaacatgggctttgcgacacccaggctttactgtgatcgctttattcttagcgcacgccatagggacttccataacacagaaaggcataatttttatccttttaatgcttgtgacaccatcaatggcaatgaggtgcgtgggaataggctccagagattttgtagaaggactgagcggagctacttgggttgatgtagtactcgaacatggtagctgtgtgactacaatggccaaagacaaaccaaccttagatatagaattgctgaaaacagaagttacaaacccagcagtactgcgaaaattgtgtattgaagcaaaaatatcgaatacgacgaccgactcgaggtgtcccacgcaaggagaagcaacgctcgtagaagaacaggatgccaattttgtctgtcgaaggactttcgtagatcgaggttgggggaatggttgcggtttatttggaaaaggttctttaataacttgcgcaaaattcaagtgtgtcacgaaattagaagggaagattgtacagtatgaaaacttaaagtactcagtcattgtcaccgtccatactggtgaccaacatcaggtagggaatgaatccaccgaacacgggactaccgcaacgattacgcctcaagccccgtcaacagagatacaactgacagactacggcgcgctcactttagattgttctcctcgcacaggactggatttcaacgaaatggtactcttgacaatgaaagagaaaagttggctagtgcacaaacaatggtttttagatcttccactaccatggacgagtggtgcatcaacaagtcaggaaacatggaataggaaagatcttttggtaacttttaaaactgcccatgctaagaaacaagaagtcgttgtattaggatcccaagaaggtgccatgcacacagcccttacaggcgcaactgagatacagaccagcggaactacaacgattttcgcaggacacctaaaatgtcgattaaaaatggacaaacttacattgaaaggaatgagttatgttatgtgcacagggtcttttaaattggaaaaggaagtagcagaaactcaacatggcaccgtactcgttcaaattaaatatgaaggaacagatgcgccgtgtaagatcccattttcaactcaagatgaaaaaggggtaactcagaacgggcgtttaattacagccaatccaatagtgacagataaagaaaagcctgttaacatagaagccgaaccccctttcggtgaatcatatattgtaatcggagcaggggaaagggcgcttaaactttcatggtttaagaagggaagcagcatcgggaaaatgtttgaggcaacagctaggggagcacgaagaatggccatactaggtgatacggcatgggactttggttccatagggggcgtctttacttctgtcggaaaattagttcaccaaatattcggtacagcatatggcgtactatttagtggagtgagctggacaatgaagatcggtataggcgtccttctaacttggttaggactaaattctagatcaacaagtctaagtatgacatgtatcgctgtaggtttagtaacgctgtacttgggtgtaatggtacaagcagactccggctgtgttattaattggaaagggagagaactaaaatgtggatcgggaatattcgtgactaatgaagtacacacgtggacagaacaatataaatttcaagcagacagcccgaaacgtctaagcgccgcaatagggaaggcatgggaagaaggcgtctgcggaataaggagcgccacaagattagaaaacataatgtggaagcaaatatcaaatgaattgaaccatatattattagaaaatgacatgaagttcactgtggtggtcggagatgttgctggtatactagcacaaggtaagaaaatgatccgacctcagcctatggaatataaatattcttggaaaagttggggcaaagcaaaaattataggagcagacgttcagaacaccacattcattatagatgggcctaatacacccgagtgcccagatgaccaacgagcttggaacatatgggaagtagaagattacggatttgggatctttacaactaatatttggctgaaactcagagattcatacacccaagtatgtgatcatagattaatgtcagcagcaataaaagatagtaaagctgtacatgcagatatgggatactggattgaatcggaaaagaatgaaacatggaaactggcgagggccagctttatcgaggtgaagacgtgtatttggccgaaatcacacaccctatggtcgaatggtgtgttagaatctgaaatgataattccaaagatttatggtggacctatctctcaacacaattatagacctggctattttacacaaacggcaggcccctggcacctaggaaaattggaattagactttgatctctgtgaagggacgacagttgtagtagatgagcattgcggcaacaggggaccctctttgagaactacgacagtgacaggaaaaataatacatgaatggtgctgcagaagctgtacgcttccaccactgagatttaaaggtgaggatggctgttggtatggaatggagatacgaccagttaaggagaaagaagaaaacttggtaaaatctatggtatctgcaggatcaggcgaagttgacagcttttctttaggcttgctatgtataagcatcatgattgaagaagtgatgagatcgagatggtctcgcaaaatgcttatgaccggtacactggcggtctttttcttgttaatcatgggacaattaacgtggaatgatctaataaggttatgtataatggtaggagcaaatgcttctgatagaatgggtatgggaactacctacctggctttaatggcaactttcaaaatgagaccaatgttcgcagtgggtcttctgttccgaagactgacaagtagagaagtcctcctgttaaccataggacttagtctggttgcttctgtggagctacctaatagtttagaagaacttggtgatggtttagctatgggcattatgatcttgaaacttctgacggattttcagtcacatcaattatgggcaacactcttatcattaacgttcataaaaacaacattttctcttcattatgcatggaagactatggcgatggttttatcaatagtatccctttttccactctgcctcagtacgacatcccagaaaactacgtggcttcctgtccttttaggatcattgggatgtaaacccctcacgatgtttttaatcgcagagaataaaatttgggggagaaaaagctggcccctaaatgaaggcatcatggcagttggtatcgtttcaatattacttagcgcactgttgaaaaatgatgtccccctagcaggtccacttattgcaggaggtatgttaattgcttgctatgtgatcagtggttcatcagcggacttgtcgctagaaaaggcagcagaagtatcctgggaagaagaggcagagcactcaggggctagccataacattctcgtcgaggtccaggacgacggcactatgaagataaaggacgaggaacgggacgacacacttacaattttgctaaaagcaaccctcctcgcagtatctggagtatacccactatcaattccagcaacattattcgtgtggtacttttggcagaagaagaaacagaggagcggcgtgttgtgggacaccccatcaccgcctgaagttgaaagggctgttttggatgacggtatatatcgaattatgcagcgaggattactaggccggtcacaagtcggtgttggcgttttccaagaaaatgtcttccataccatgtggcatgtcacaagaggggctgtgttaatgtatcaaggaaaaagattagaaccaagttgggcaagtgttaaaaaggatttaatcagctatgggggaggatggagattacaaggatcgtggaatactggtgaagaagttcaagtaatagccgtagaacccggcaaaaatcctaagaacgtgcaaactgcacccggaacgttcaaaacatccgaaggcgaggtaggagcgattgcactagattttaaaccaggtacgagcggttctccgatagtaaatagagaaggtaaaatagtcggcctgtacggaaacggcgtcgttacaacgtcggggacttacgtttctgcaatcgcacaagctaaagcgagccaagaggggcctttaccagaaattgaagatgaggtttttagaaaacgaaatctcacgattatggacttacatccaggatcaggtaagacaagacgttacttaccggcgatagtaagagaggcaataaagagaaaacttagaacattaattcttgctcctacacgagttgtagcttcagaaatggctgaagctctgaaaggcatgcccatcagataccaaactacagctgtgaaatcggaacacacaggtaaagaaatagtagacctgatgtgtcatgcaacctttaccatgagattattatctccagtaagggtacctaattataacatgataataatggacgaagcacattttacggatccaagtagtatagccgcaagaggatatatatcgacaagagtaggaatgggggaagctgctgcaatatttatgaccgccacgcccccaggatcagtagaggcttttccacaaagtaacgctgtcatccaagacgaagaaagggatataccagaacggtcgtggaactctgggtatgagtggattaccgattttccaggaaagacggtatggtttgtaccctctattaagagtgggaatgacatcgctaattgtcttcgtaaaaatggaaaaagagttatccagctatcgcgcaaaacttttgacacagagtatcagaaaactaaaaacaacgactgggactacgttgtaactaccgacatttcagaaatgggagcaaactttagggcagacagggtaatagatcccagaaggtgcttaaaacctgttattctgaaagatggaccagagcgagtgattttagcgggaccaatgccggtaaccgtcgcatcggcagcacaacgacgcggacgaataggcagaaatcataataaggaaggagaccaatatatatacatgggtcaaccacttaacaacgatgaagaccatgcacactggacagaagcaaaaatgttgcttgacaacataaacaccccagaaggtatcattccagcactctttgaacctgaaagggagaaaagtgcagctattgatggtgaatacaggttacgaggcgaagctcgaaaaacattcgtcgaattaatgcgtagaggagatttacctgtttggctcagctacaaggtagcgtctgaagggtttcaatattctgaccgaagatggtgttttgatggcgagcgtaataaccaagttctggaagagaacatggatgtagaaatttggaccaaggagggcgaacggaaaaagctaaggccacgctggctggacgcaaggacatattccgatcccttagcattacgtgaatttaaagaatttgcggctggtagacggagtgtatcaggagatttaattttggagataggaaaactaccccaacatctaactcaaagagcccaaaacgctctagataatctcgtgatgttacacaactcagagcaaggaggtagagcataccgtcacgcaatggaagaattacctgacacgatagaaacactcatgttacttgctctaattgccgttttaacaggtggcgtaacgttatttttcttaagcgggagggggctaggaaagacatcaataggcttattgtgcgtaatggcatcgagcgtgttgctttggatggcgtctgtcgagccacactggatagcagctagcatcatcctcgaatttttcctaatggtattattaatcccagaacctgatcgacaaagaacaccccaggataaccagcttgcttatgtggttattgggctattatttatgatattaacagtagcagctaacgaaatgggcctcctagagacaactaaaaaggacttaggtattggccatgtggccgtagaaaaccaccatcacgcagcaatgttagacgtagatctacacccagctagtgcatggacactatatgctgttgcaacgacaataataactcccatgatgcgccataccatagaaaacactaccgcaaatatttcacttactgctatcgcgaatcaagcagccatcttaatgggattggacaaaggttggccaataagtaagatggacattggtgttcccttattagccttagggtgctactcacaagtgaatccgttaacactaactgcagccgtcctcatgttagtcgcacactatgccataataggccccggcttacaagcgaaagctacacgagaagcgcaaaaacgaacagcagcgggaataatgaaaaatcccacggtcgatggtatagtcgcgatagatctggatccggtggtgtatgatgcaaagttcgaaaaacaattgggtcagatcatgttgttaatcctatgtacaagccagatattattaatgagaaccacctgggcactttgtgaatctatcactcttgccacaggaccactcactactttgtgggaaggctctcctgggaaattttggaataccacaatagcagtttctatggcaaatatatttagaggcagctacttagctggggcgggactagcattttccttaatgaagagtttgggaggaggaagacgaggaacaggtgcacaaggggaaacattaggtgagaaatggaaaagacaactcaaccaactttcgaaatcagaatttaacacatacaaaaggtcaggaataatggaggtcgatcgctcagaagccaaagaagggcttaaaagaggtgagacaactaaacatgcggtttctcggggaaccgctaagttacgttggtttgtcgagagaaatttggttaaacctgaaggtaaggtcattgacttagggtgtgggcgaggaggttggtcgtactactgtgctggactcaagaaagtcacagaagttaaaggttatacaaaaggaggacccgggcatgaggaaccaataccaatggctacgtatggatggaacttagtaaaacttcatagcggaaaagacgtctttttcataccaccggaaaagtgcgatacattattatgcgacatcggggaatcaagcccaaacccaacaatagaagaaggaagaacactacgcgtgttaaaaatggttgagccgtggttgagggggaaccagttctgcattaagatactaaacccctatatgccgagtgtggtagaaacattagaacaaatgcaaagaaaacatggaggtatgcttgtgcggaatcccctttcaagaaattctactcatgagatgtactgggtttcatgtggaactgggaacatcgtaagtgcagtgaacatgacatctaggatgcttttaaatagatttactatggcgcatcgaaaacccacatatgagagggacgttgacttaggtgcggggacacgtcatgtggctgtcgaaccggaagtagcaaatcttgatattatcggtcagcgcatagaaaacataaaacatgagcataaatcaacatggcactacgacgaagacaacccttataaaacttgggcctatcatggatcgtatgaggtaaagcctagtggctcagcaagtagtatggtcaatggtgtagtaaaacttttgacaaagccatgggatgtaataccaatggtcacacaaatagctatgactgatacaactccatttggccaacaacgagtattcaaagaaaaggtggacactaggaccccaaaagcaaaaagaggtacagcgcaaattatggaagtgactgcaaagtggttgtgggggttcttaagtaggaataagaaaccaagaatctgtacaagagaggaatttacgaggaaagtaagaagcaatgcagcgataggtgcagtttttgtagacgagaatcagtggaactcagctaaggaagcagttgaggatgaaagattctgggacttagtacaccgcgaacgtgaattacacaaacaaggtaaatgcgctacatgtgtctacaacatgatgggtaaacgagagaagaaattaggtgagtttggaaaggctaaaggaagtagggcaatatggtatatgtggttaggtgcgcgatttcttgagtttgaagcacttggttttatgaatgaagatcactggttttcacgagaaaacagcctttcaggagtcgagggagaaggtctgcataagttgggctatatcctcagagatatatcaaaaataccagggggaaacatgtacgcagatgataccgctggatgggacacgcgaataacagaagacgatttacaaaacgaagcaaagatcaccgacataatggaaccggagcacgcattactggctaaatccatattcaagttaacatatcaaaataaagttgtacgcgtgcaacgacccgccaaaaacggaaccgtgatggacgtaatcagcagacgagatcagagaggtagtgggcaagtaggtacatatggattgaataccttcacaaacatggaggcccaattaataagacaaatggaatcagaaggcatatttagccctagtgaactagaaacgcctaacctagctggccgagtccttgattggttagagaaacacggcgttgaacgcctaaaacgcatggctatttctggagacgattgtgttgtaaaaccaatagatgaccgatttgccaccgcgttaacagcgcttaatgatatgggaaaagtacgaaaagatataccccaatgggaaccatctaaggggtggaatgattggcaacaagttcccttttgttctcatcattttcatcaactaataatgaaagacggtagagaaatagtagttccatgccgtaatcaagacgaactcgtagggcgcgcacgggtttcgcaaggagctggttggagtctacgagaaacggcatgccttggtaaaagttacgcccaaatgtggcaattaatgtactttcatagaagagatttgagattggctgcaaacgcaatatgttccgcagtcccggtagattgggtaccaacctcgagaacaacatggtctattcatgcacatcatcaatggatgacgacagaagatatgttgtcggtatggaaccgcgtgtggatagaggaaaatccttggatggaagataaaacacacatatcatcgtggggagatgtcccgtatttaggtaaacgtgaagaccaatggtgtggaagtctaataggcttgacggctcgagctacttgggcgaccaatattcaagtagcaatcaatcaggtaaggcgcttaattggaaatgaaaattacctggattatatgacaagtatgaaacgttttaagaatgaatcagacccggaaggagcactgtggtaa

SEQ ID NO: 21623 - RNA, 9879 nt, synthetic construct
  misc_feature 1..9879: note = derived and/or modified CDS sequence (opt6) from DENV-1__FJ882527__SS-prME
  source 1..9879: mol_type = other RNA
tccgtcacgatgttattaatgttgatgcccacggctttagcgtttcatcttactactagaggaggagaaccccacatgattgtgagcaaacaagaacgaggtaaatcgttactgtttaaaacatcggcaggggtaaacatgtgtactttgatagcaatggacttaggcgaattttgtgaagacacgatgacgtataaatgccctagaattaccgaagcggaaccggacgatgtagattgttggtgcaacgcaaccgatacctgggttacatacggtacatgttcacaaacgggagaacatcgacgagataaaaggagcgttgcattagcaccacatgttggactaggtttagaaactagaactgaaacatggatgagctcggaaggggcttggaaacaaatacaacgagtagaaacttgggcgcttcgtcacccgggatttactgttattgctctatttttagcgcatgcgatcggtacctcaataacgcaaaaaggaataatctttatcctattaatgctagtcaccccgtcaatggcaatgagatgtgtaggaatagggtctagagattttgtagaaggactcagcggagcaacttgggttgatgtagtattggaacacggtagttgcgtaacaacaatggctaaagataaacccacgctcgacattgaacttttaaaaactgaagtcacgaatccggccgtactaagaaaactttgcatagaagcgaaaatcagtaatacaacaaccgacagtcgttgtccaacccaaggggaagcaacattagtggaagaacaagacgcgaattttgtgtgcagacgaacatttgttgacaggggatggggaaatggctgtggattatttggaaaggggtcactaattacttgtgcaaagtttaaatgcgtaactaaactcgaaggtaagacagttcaatacgaaaatcttaaatattctgtcatagtcacagttcatacaggagatcaacatcaagttggtaatgaatcaacggaacacggcactactgcaacgataacacctcaagcacctagtacagaaattcaattgaccgattatggggcgttaacattagactgttctccaagaactggattagacttcaatgaaatggtgctacttacgatgaaggaaaaatcatggctagttcacaaacaatggtttttagacctccctttaccatggacatctggggcgtcaacgtcacaagaaacgtggaatagaaaagacttgttggtaacatttaagactgctcatgctaagaaacaagaagttgtagtattagggtcacaagaaggtgctatgcacacagccctgactggagctacagaaattcaaaccagtgggacgactacgatatttgcaggacatttaaaatgcagattaaaaatggataaactgaccttaaagggaatgtcctacgtcatgtgtacaggatcctttaagctagaaaaagaagtagctgaaactcaacacggcacagtgttagttcaaattaagtacgaaggcacagatgcaccgtgtaaaatacctttcagtacacaggacgaaaaaggcgtaacccaaaacggacgtctaattacagctaatccaatagtgacagacaaagaaaaacccgttaacatagaagcggaacctccatttggtgaaagttatatagttatcggcgccggtgaaaaagcactcaagctaagctggttcaagaaaggaagctcaattgggaaaatgtttgaagcaacagctcggggagcaagacgaatggcaattctaggcgatactgcatgggatttcggatcgattggtggggtatttacgtccgtgggaaaattagtgcaccaaatatttggtacagcatacggtgtgttattttctggtgttagttggacaatgaaaataggtataggcgtattattaacttggttaggactaaatagcagaagtacatctttaagcatgacatgcattgcagtgggattggtaactctctatctaggagttatggtccaagccgattcaggatgtgtcatcaattggaagggcagggaattaaagtgcggctccggaatatttgtaacgaatgaagtccatacttggactgagcagtacaaatttcaagctgacagtcctaaaagactcagcgctgccattggtaaggcttgggaagaaggagtatgcgggattcgatcagcgacaagactcgaaaatataatgtggaagcaaataagtaatgagctcaaccacattttactcgagaatgacatgaaatttactgtggtagtaggggatgtagctggcattcttgctcaaggcaagaaaatgatccgaccacaacctatggaatataagtactcttggaagtcatgggggaaagctaagataattggagcagacgtacaaaacacaacgtttatcatagatggaccaaacacgccggaatgtccagatgatcaacgcgcgtggaatatatgggaagtggaagattatggattcggaatttttacaaccaatatatggttaaaacttagagattcctatactcaggtttgtgaccataggctaatgtcagctgctattaaagatagcaaagctgtccatgctgacatgggttattggatagaaagcgagaaaaatgagacctggaaactagcaagagctagttttatagaagtaaaaacttgcatttggccaaagtcgcacacgttatggagtaatggagtactagagagtgaaatgattattccaaaaatatatggtggaccaatatcacaacataattaccggccaggatatttcactcagacagcaggtccatggcatttagggaaactagagctagactttgatttatgtgaaggtaccacagtagtggtagatgagcattgtggcaatagaggaccttcactaagaaccacgacagtcaccggcaagataatccatgagtggtgttgtaggtcttgtacactgccacctttacgttttaagggagaagacggatgttggtatggtatggaaataagaccagtaaaagaaaaagaagaaaaccttgtaaaaagcatggtgtctgctggatccggggaagtggacagtttcagtttaggtctactatgcatatcaataatgatcgaagaggttatgagaagtagatggtcacgaaaaatgctaatgacaggaactctggctgtcttctttcttctcataatgggacaattgacatggaacgatttaataaggctgtgtattatggtcggtgcaaacgcaagtgatcgcatgggaatgggaaccacatatttggctctcatggctacctttaaaatgagaccaatgctagcggtggggctcttatttagaagactgacttctcgagaggttttattactaacgataggattatcgttagtagcatctgttgaattacccaattcactagaagaattaggggatggtttggcgatgggtatcatgatactaaaattgctaacagattttcaaagtcatcaattgtgggctacgttacttagtcttacgtttatcaaaaccacattcagcctccattatgcatggaaaacaatggctatggtactatcaattgtatcactatttcctttatgtctctcgaccaccagtcagaaaaccacgtggttgccggtgttattaggaagcctagggtgtaaacccctagcaatgtttttaattgctgagaacaaaatctggggcagaaaatcctggcctttaaacgaaggtataatggcggtaggaatagtttcgatcctgttaagctctctcctaaagaacgacgtcccactagcaggaccactaattgcaggaggtatgctaatagcatgctacgtcatctccggaagttcagctgatctctccctcgaaaaggcagctgaagtaagttgggaagaggaggctgaacattctggtgcaagccacaacatactcgttgaagtccaagatgatggtaccatgaaaataaaagatgaagagagggacgacaccttaaccatattactcaaagcaactttgctagccgtatccggggtatatccactgtcaataccagcaacattgtttgtttggtacttttggcaaaagaagaagcaaagaagcggagtactctgggatacgccttcccctccagaggtagagcgcgcagttcttgatgatgggatttacagaataatgcagagagggttactaggtcgaagtcaagtgggcgttggagtatttcaagaaaatgtatttcacacaatgtggcacgtaacgagaggggccgtactcatgtaccaagggaaacgactggagcctagttgggcaagcgttaagaaagatttaataagttatggcggagggtggcgattacagggttcctggaataccggtgaagaagtacaggtaatcgctgtagagcctggtaaaaatcctaaaaatgtacaaacagcgccagggacgtttaaaacaagtgaaggagaggttggcgctatagctcttgacttcaagccggggacttcaggatctccaatcgtaaatcgtgaagggaagatagtgggcctatacggaaacggagtggttacgaccagtggaacctatgtgtccgctatagcacaggctaaagctagtcaagaagggcctttacctgagatagaagacgaagtgttccgaaaaaggaatctcacgattatggatctgcaccccgggagcggcaaaactagacgctacctaccagcaatcgtaagggaggcaataaaacgtaaattgagaaccctaatattggcaccaacccgtgttgttgcgtcagaaatggcagaggctttaaaaggaatgccgatcagataccaaacaactgccgttaaatctgaacatacaggaaaggagattgtggatttgatgtgccatgcaacttttacaatgcgattactaagtccagtgagggtacctaattataacatgataataatggacgaagctcactttaccgacccatcttctatagccgcaagaggatatatttcaacacgcgtagggatgggagaagcagcagcaatattcatgacagcaacaccaccaggcagcgtggaagccttcccacagagtaacgcagttattcaagacgaggaaagagacattccagaacgttcatggaatagtggatatgagtggattactgactttcctggaaaaacagtctggtttgtaccatctataaagtcaggaaacgatattgcgaactgtcttcgtaaaaatggaaaacgagttatacaactatctcgtaaaactttcgatactgaataccagaaaaccaaaaataacgattgggactatgttgttacaacagatattagcgaaatgggagcgaatttccgagctgatagagtcatagacccacgtcgatgtttaaagccagttattttaaaggatggtcccgaaagggtaattttagctggaccaatgcctgtaacagtagcctccgcagcacagcgtcgcggacgtataggaagaaaccataataaagaaggagatcagtatatttacatgggacaacctctcaataatgacgaagaccacgctcattggacagaggcaaaaatgcttttggataacataaatactccagagggtatcattccagcattattcgaaccagaaagagaaaagtcagctgcaatagatggggagtaccgcctaagaggcgaagccaggaaaacttttgtagaactaatgagacgtggagacctcccggtctggctaagttacaaagtggcttctgaaggatttcagtattctgaccgcagatggtgttttgatggtgaacgaaataaccaagttctagaagaaaatatggatgtagagatatggacgaaagaaggggagaggaagaaattgaggcctagatggttagatgcgagaacgtactcagatccattggcgttacgggaatttaaagaatttgcagcaggaagaagatcagtgtctggagatcttatcctagaaattggcaaattaccccaacatttaacacagcgcgcacaaaacgcccttgataaccttgtaatgttacacaactccgagcaaggtggacgtgcatatagacacgccatggaggaattaccagacactatagagacgctcatgttgctagcgctcatagcagtacttaccggtggagtgacattattctttttaagtggccgaggactggggaaaacgagtattgggttgctttgtgtcatggcaagtagcgtattattatggatggcatcagttgagcctcattggatagctgcttcaataatattagagttcttcttaatggtgttgctgattccagaaccagacaggcaacgaactcctcaagataatcaattagcctacgtagtcataggactgttatttatgatcttgacggtggcagccaacgaaatggggctattagaaactacgaagaaggaccttggaatagggcatgtcgcggtagaaaatcaccatcatgcagcaatgctggacgtcgatttgcatccagcatcagcatggacgttatatgccgtcgccacaacgattattacacccatgatgaggcacacaatagaaaacacgacagcaaatatatctctaactgcaatcgcaaatcaggcagcaatattaatggggctagataaaggatggccgataagtaagatggatatcggagttcctctactagctctcggatgctactcacaagttaaccctctaacacttacggcagcggtactaatgctagttgcacattatgcaataataggcccaggcctgcaggctaaagcaacaagggaagcacagaaacgaacggccgcaggaattatgaaaaacccaacagtcgacggaattgttgcgatcgacctcgatcctgtagtatatgatgccaaatttgagaaacaacttgggcaaattatgttactaatactatgcacctcgcaaatactattgatgcggactacttgggctctttgtgagagtataacccttgccacagggccattaactacattatgggaaggatcaccgggaaagttctggaacacaacgatagcggtatcaatggctaatatttttcgaggttcatatttggccggtgcaggcttagcgttcagtctgatgaagagtttgggaggaggacgacgcggaacaggtgcacaaggcgaaacattgggagaaaaatggaaacgacagctcaatcaattgagtaaatcggaatttaacacctataaacgttcaggtataatggaggttgacagatcggaggcaaaggaaggtttaaaacgtggagagactactaaacacgcggttagtcgcggaaccgcaaaactaagatggttcgttgaaagaaatttagtaaaaccagagggaaaagtcatagatcttggttgtggaagaggaggatggtcctattattgcgccggactcaagaaggtaacagaagtcaaaggttatacgaaaggcggacccggtcacgaggaaccaattcccatggcaacctacggctggaacttagtaaaattacatagtggtaaagatgtcttctttattcctcctgagaaatgtgacacattattgtgtgatataggtgaaagtagtccaaatccgactatcgaggagggtaggactttgagggttctaaagatggtagaaccctggcttagaggaaaccaattttgtataaaaatccttaacccttacatgccttccgtagtggaaacactcgaacaaatgcagcgaaaacacggagggatgctggtacgcaatccattatcacgaaacagtacacacgagatgtattgggtgagctgcggaaccggtaatatagtcagtgcagtaaacatgacatcccgtatgttactgaatcgttttacaatggcccataggaaaccaacttatgaaagagacgtagacttgggagcgggtactagacatgtagccgttgaaccagaagtagctaacttagatattattggacaacgaatagaaaatatcaaacacgaacataagagtacttggcactacgatgaagataacccctacaaaacttgggcataccatgggagttatgaggtgaaaccatcaggtagcgcatcctcaatggtgaatggcgtcgtcaaactattgacaaaaccatgggatgtaataccaatggttacacaaatagcaatgacagatacgaccccattcggtcagcaacgcgtgttcaaggaaaaagttgatacccgaacgccaaaggcaaaaaggggtacagcccaaataatggaagtaactgcaaaatggttatggggattcttgtctagaaataagaaacctagaatatgcactcgcgaagagtttacgcgaaaggtaagatcaaacgctgccatcggtgcagtatttgtcgatgaaaatcaatggaactcggcaaaggaggccgtagaggatgaaagattctgggacttagttcatagagaaagggagctccataagcaaggaaaatgcgccacatgcgtttacaacatgatgggaaagcgggagaagaaactcggagaatttggtaaagctaagggatcaagagccatctggtacatgtggctaggcgcacgatttttagagttcgaagcattgggtttcatgaatgaagatcattggttctctcgagaaaactctttatctggtgttgaaggggagggactacacaagttagggtatatattaagagatatatcgaaaatcccaggtggcaacatgtacgccgatgatactgctggctgggatacccggatcacagaggacgatttacaaaacgaggctaagataacggatataatggagccggaacacgcattgttggcgaaatcaatctttaaacttacttatcaaaataaggtggtgagagttcaacgaccagccaaaaacggcaccgttatggatgtcatatcgaggagggatcaaagaggatctggtcaggtcggtacttacggactgaacacatttacgaatatggaagcacaactaattagacaaatggagtcagagggaatcttctctccatcagaactagaaacccctaatttagcagggagagtacttgattggttggaaaaacatggtgttgaacgcttaaaaaggatggcgatcagtggagacgattgcgttgtaaaaccaatagacgatcgttttgctacagcacttacagcactcaacgacatggggaaggttagaaaggacattccacagtgggaaccatctaaaggctggaatgattggcaacaagtccctttctgcagtcatcattttcaccaactcattatgaaagacggtagagaaattgtagtgccctgccgaaatcaagatgaattggttggacgagctcgagtaagtcaaggcgctggatggagtcttagagaaacagcttgtctaggtaaaagttatgcgcaaatgtggcaattgatgtactttcaccgcagagatctaagattggcagctaatgctatatgctcagctgtcccagttgactgggtaccgacaagtagaacgacgtggagtatacatgcacaccaccaatggatgaccacagaggacatgctgagtgtgtggaaccgagtatggatagaagaaaacccatggatggaggataaaacgcacatttcttcttggggagacgttccatacctaggtaaaagagaagatcagtggtgtggttcattgatcggtttaaccgcaagagctacgtgggctaccaatatacaggtggcaataaatcaggtgcgtagattaatcggcaacgaaaattacctcgactacatgacgtctatgaaaaggtttaagaatgagagcgatccagagggagctttatggtaa

SEQ ID NO: 21624 - RNA, 9879 nt, synthetic construct
  misc_feature 1..9879: note = derived and/or modified CDS sequence (opt6) from DENV-1__FJ882529__SS-prME
  source 1..9879: mol_type = other RNA
agtgttactatgttgttaatgctgatgccaactgcacttgcatttcacttgacaaccaggggtggagaaccacacatgattgtttcaaaacaagaacgcggcaagagcttacttttcaaaacatctgcgggagtgaatatgtgcactctaatagctatggatcttggagaattttgtgaagatacaatgacatacaaatgcccaaggataacggaagctgaaccagacgacgtagattgctggtgtaacgccaccgatacttgggtaacatacgggacttgctcccaaaccggggaacatcgccgtgacaaaagatctgttgcgttagctccgcatgtagggctaggactcgaaaccagaactgaaacctggatgagttctgaaggagcttggaaacaaatacaaagagtagaaacttgggctctacgtcacccagggttcactgtcatagctctatttctcgcgcatgctattggaactagcatcacacaaaaagggatcatatttatattgcttatgttagtaactccaagtatggcaatgaggtgcgttgggattggatccagagactttgtcgaaggactttccggtgctacatgggtagacgtagtcttggaacacggctcatgtgtgacaactatggcgaaagataaacctacattagatatcgaactactcaaaacggaagtcacaaaccctgccgtattgaggaaattgtgtattgaagcaaaaatttcaaatacaacaacagatagtcgatgtcctacgcaaggggaagccactttggtagaagaacaagatgctaactttgtttgtcgaagaacttttgtcgatagaggttggggaaacggctgcggtctttttggtaaaggaagtttaatcacatgtgccaaattcaaatgtgtcaccaaattggaaggaaaaatagttcaatacgaaaatttgaagtactccgtaattgtgacagtacacacgggcgatcagcaccaagttggaaacgagtccacagaacacggaactacagccactataacgccacaagcacccagcacagaaatacaactgactgactacggggcacttaccctagattgttccccaagaactggactggattttaatgagatggttctattaaccatgaaagagaaatcatggctagtccacaaacaatggttcctagacttgcctcttccctggacgtcaggagccagtacatctcaggaaacctggaacaggcaagatctattggttacattcaaaacagcacacgccaagaaacaagaagtagtcgtactgggatcacaagagggagcaatgcataccgcacttaccggtgctactgaaatacaaacaagtgggactactacaatctttgcgggacacttgaaatgcagacttaaaatggacaaattaaccctaaagggaatgtcctatgtcatgtgcactggttctttcaaactagaaaaagaagtggcagagactcaacatggaactgtgttggtacaaataaaatatgagggaacagatgcaccctgtaaaataccgttttcaacccaagatgaaaaaggagtcacacagaatgggcgtttaattacggctaatcccatagtaacggataaggaaaaacccgttaatatagaggctgaacccccattcggagagagttatatagtcatcggcgccggggaaaaggccttaaaactttcttggttcaagaaagggagttccatcggtaagatgtttgaggcaaccgctagaggtgcacgtagaatggctatattaggcgataccgcatgggatttcgggtccattggaggagtctttaccagtgtcggtaaattggtacaccagatctttggaacagcatatggcgttctgtttagtggcgtatcttggacaatgaaaattggaattggtgtcctacttacttggttgggcctgaatagcaggagtacaagtctatcgatgacgtgcatcgcggttggcttagtgacgctttatttaggagtaatggtacaagcagatagtggatgtgtcattaattggaaagggcgagagttaaaatgcggatccggcatatttgtaacaaatgaagtacatacttggacagaacaatataagtttcaagctgattccccgaaaaggctctcagccgcaataggtaaggcttgggaggaaggtgtatgtggaatacgcagcgccaccagattggaaaacataatgtggaaacaaatatcaaacgaactgaatcatattttactagagaatgatgttaaatttacagtggtcgtaggggatgtagcaggcatactagctcaaggcaagaaaatgataaggccgcaaccaatggaatacaaatatagctggaaaagctggggcaaagcaaagataataggggcagacgtacaaaatacaactttcataatcgatggcccgaacactcctgaatgtccagatgaccaaagagcttggaacatttgggaagtagaagattacggttttggaatattcacgactaatatttggctcaaacttcgagatagctacacacaggtttgcgatcaccgtttaatgagtgcggccatcaaggatagtaaggctgttcatgccgacatgggatattggatagaatcagagaaaaatgagacatggaaacttgcaagagcaagttttatcgaagtcaagacgtgcatttggcccaaaagtcatacactctggagcaatggcgtcttagaaagcgaaatgataataccaaaaatatacggcggcccaatatctcagcataattatagacctggatatttcacccaaacagcgggcccctggcatctaggcaaattggagcttgattttgacctctgcgaaggcactacggtagtagttgacgaacattgcggaaacagagggccaagtcttcgaacgacaacagtaacagggaaaataattcacgaatggtgctgccgatcctgtacgttaccaccacttcgattcaaaggagaagatggctgctggtacgggatggaaataaggcccgtaaaagaaaaagaagaaaatttagtgaaatctatggtatcagcaggatctggcgaggtggacagttttagtttagggttactctgcatctctataatgattgaagaggtaatgagatcaagatggagtagaaaaatgttgatgacagggaccctggcagtatttttcttactgataatgggtcaattgacttggaacgatctaatacgtttatgtattatggtgggagctaatgcttcagacagaatgggaatgggaactacatacttagcattaatggcaacctttaaaatgagaccaatgttcgcagtaggattacttttcaggcggttaacttctcgggaagtattattgcttacaattggactatcattggttgcatcagtagaactgccaaatagtttagaagaactcggggatgggctagctatgggcataatgatattaaaactactaacagatttccaaagccatcagttgtgggcgacattgctatcattaacattcataaagacgaccttcagcctgcactatgcttggaaaacaatggcaatggttttatcgatagtcagtttatttccactctgtctatcgacaacttcacagaaaacaacatggctaccggttttattaggtagtttaggatgtaaaccattaacaatgttcctaatagctgaaaacaaaatatggggaaggaagagttggccactaaatgagggaataatggcagtcggcatcgtaagcattttgttaagttcgctgctcaaaaatgatgtcccgttagcaggccccttgattgcgggtggaatgttaattgcatgctacgtaattagtggatccagtgctgatttgtctttagagaaagcggctgaagtatcgtgggaagaagaggcagaacatagtggagcttcgcacaacatactcgttgaagtgcaggatgatggaaccatgaaaattaaagatgaagaacgcgacgatactctgacgatcctactcaaagctactctattagcagttagcggtgtatacccacttagtatacctgcaactcttttcgtatggtatttctggcagaaaaagaaacaaagatctggggtcctatgggacacgcctagcccaccagaggtcgaaagggcagtcttagatgacgggatatatcgaattatgcaaaggggattgctcggaagatcacaagttggagtaggcgtcttccaagagaatgttttccacaccatgtggcacgtaacacgtggagctgtactgatgtaccaagggaaaagactggagccaagctgggcatctgtaaagaaagatctgatatcatacggtggcggctggcgactacaaggttcatggaacacaggtgaagaggtacaggtcatcgctgtcgaacctggtaaaaatcccaaaaatgtacaaacagcaccgggaaccttcaaaacatcagaaggtgaagttggagcaatagctctagactttaaaccaggcacatccggaagtccgatagttaatcgcgaaggaaagatagtaggtctgtacgggaacggagtcgttacgacatcgggtacatacgtctcggcgattgctcaagccaaagcgagccaggagggtcccctgcctgaaatcgaagatgaagttttcagaaaacgaaatcttacaatcatggatttgcatccaggaagtggtaaaaccagacgatatctgccagcgattgttcgtgaggcaatcaaacgaaaattacgtaccctgattttagctcccacccgcgtagtcgcatctgaaatggcagaagcattaaaaggaatgcctataagataccaaacaactgcagttaaatcagaacacacaggtaaagagatagttgacctaatgtgccatgcgaccttcacaatgagactactgtcccctgtgcgtgtcccaaattacaatatgattattatggacgaggcacattttaccgatccctcgtctatagccgcccgtggctatatttcaactagggtggggatgggtgaggcggcagccatttttatgactgctactccacccggatcagtagaagcattcccccaatcgaatgcagttatacaagacgaagaaagagatataccggaaagatcgtggaactcaggttatgaatggatcacggattttccgggaaaaacagtctggtttgttccgagtataaaatcaggaaatgacattgccaattgtttaagaaagaatggcaaaagagttattcaattatctcgaaaaactttcgatacagagtaccagaaaaccaaaaacaacgactgggattatgtagtcacaaccgatattagtgagatgggtgctaactttcgcgccgacagggtcattgatccaagaagatgcctaaagccagtaatcttaaaagatggaccagaaagagtaatactagctggaccaatgccagtcactgttgctagtgcagcacaaagaagaggacgaattggcaggaatcacaacaaggaaggggaccaatacatttacatgggccaacctttgaataatgatgaggatcacgcccattggaccgaagcaaaaatgctacttgacaacataaatacgccagagggaatcattccagctctttttgagcctgaaagagaaaaatccgcagcaattgacggagaatatagattaagaggagaagcaagaaaaactttcgtggaattaatgagacgaggcgacttacctgtatggttaagttacaaagtagcaagtgaaggatttcaatactcagatagaagatggtgtttcgatggagagagaaacaatcaggtacttgaagaaaatatggacgtagaaatatggacaaaggaaggcgaacgcaagaaattacgcccacgatggctagatgcaaggacttatagcgatccgcttgcattaagggaatttaaagaatttgctgcagggcgacgttcagttagtggcgatcttattctagagataggaaaactgccacagcatttgacacagcgagctcaaaatgcattagataatcttgtgatgctgcataattcagaacaaggtggtcgagcatacagacacgctatggaagagttacctgatactatagaaacgctgatgcttttagcgctgattgcagtattaactggtggggtcacattgttcttcctgtcaggacgaggcctaggcaagacaagcataggactactgtgtgttatggcatcaagtgtattattatggatggctagcgtagagccccattggatagcagctagcataatcttagagttctttttgatggtattgttaatacctgagccagatagacagagaactcctcaagacaaccaactggcatatgtggtcatcggattactttttatgatacttacagttgcggcgaatgaaatgggacttcttgaaacaacaaagaaggatttagggataggccatgttgcagtagagaatcatcaccacgcggcaatgctagacgtagacctacatccagcgagtgcctggacgctatacgctgtagcaactactatcatcacgccaatgatgcgacacacaatcgaaaacacaacagcgaatatatcgttaactgctatagctaaccaggcagcaatacttatgggtctagacaaagggtggcctatatcaaaaatggatataggtgtgccactactggcgttagggtgttacagtcaggttaatccattgacattaacggccgctgtccttatgttggtagctcactacgcaattattggacctggacttcaggcaaaggccactcgtgaagcccagaaaagaacagccgccggtataatgaaaaacccaaccgtcgacgggattgtcgctatcgaccttgatcccgttgtatatgatgcgaaatttgaaaaacaactcggccagatcatgttactcatactgtgcacaagccaaatattattaatgaggacgacttgggctctatgtgaaagcattactctagcaacgggtccattgacaacactttgggaaggatcacctggaaaattttggaacactacaatagcagtcagtatggcgaatattttcagaggttcttatcttgctggagcaggattagcttttagtctaatgaaatcactaggcggcggaagacggggaactggagcgcagggagaaacactcggtgaaaaatggaaacgccaactcaatcagcttagcaagagcgagttcaacacatacaaacgcagcggtattatggaggtagatagatcagaagcaaaagaaggcctaaaaaggggagaaactactaaacatgcagtttcaaggggtacagctaaactgcgttggtttgtggagcgaaatctcgttaagcctgagggcaaagttatagacttaggttgtggtcgcggaggctggagttattattgtgcgggattgaagaaagttacagaggtaaaaggctacactaagggtggccctggacacgaggagccaataccgatggccacgtacggatggaatctagtgaagctgcattcgggaaaagatgtgttcttcatacccccggaaaaatgtgatacactactgtgtgatataggtgagagcagcccaaaccccaccatagaggagggacgcacactgagggtattgaaaatggtagagccttggctgagaggtaaccagttctgtataaagatccttaacccatatatgcctagcgtagtagaaacactagaacaaatgcaaagaaagcacggcgggatgctagttcggaatcctttatcacgaaacagcacgcatgaaatgtattgggtatcatgcggtacaggaaacatagtttccgccgtaaacatgacaagtcgaatgttgctcaataggtttaccatggtacatcggaaaccaacatacgaaagagatgtggatttaggagcgggcacacgtcatgttgcagtcgaaccggaagtagcaaatttggatattatcggacagagaattgaaaatatcaaacatgaacataaaagcacatggcattatgatgaagataatccatacaagacttgggcatatcatggcagttatgaggtaaaaccaagcggctcagcctcgtcgatggttaacggggttgtaaaactgttaactaaaccatgggacgttatccccatggtaactcaaattgctatgaccgatacaacgccattcggacaacagagagtcttcaaagaaaaggttgacacaaggacaccaaaagccaaacgtgggaccgcacaaataatggaagtaacagcaaaatggttatggggatttttatcaaggaataagaaacctaggatatgcacacgagaagagttcacaagaaaagttagatcaaatgccgcgataggagcagtatttgtagatgaaaaccaatggaactcagccaaggaagcagtggaggacgaaagattttgggatcttgtacacagagaaagagaactacacaaacaaggtaaatgtgcaacatgcgtgtacaacatgatggggaaaagagaaaagaaacttggtgaatttggaaaagcgaaaggttctagagcaatatggtacatgtggttgggcgcaaggttcctagagttcgaggcactaggtttcatgaatgaagatcattggttcagtagagaaaactcattatcaggggtagaaggagaaggattacataagctaggatatattcttagagatatttcaaaaataccaggtggaaatatgtacgcggacgacactgccggctgggacaccaggataacggaggatgacctgcaaaatgaagctaaaataacagatataatggaaccagaacatgctttgttagcgaaatctattttcaagttgacctaccaaaataaagtagtaagggtgcaaaggccagcgaagaatggaaccgtaatggatgtaattagcagaagagaccaaagaggaagcggacaggtaggtacctacggcttaaacaccttcactaacatggaggcccaactcataagacaaatggaatcagaaggtatattttcgccctccgaattggagactcctaacttagcgggacgcgtacttgattggcttgaaaaacacggagtcgaaaggctgaaaagaatggcaatatcaggcgatgactgtgtggttaaaccaatcgatgacaggtttgcaacagcattgaccgcactaaatgatatgggtaaggtacgaaaggacatcccacaatgggagccgagtaaaggttggaatgattggcagcaagttcctttttgctctcatcactttcaccaactaataatgaaagacggcagagaaatagttgtaccttgtagaaaccaagacgagctagttgggagagcacgagtatcccaaggtgctggctggtcactaagggaaacggcctgtctgggtaaatcttatgcacaaatgtggcaactcatgtattttcatagacgcgacctaaggctagccgcaaatgctatttgttctgccgtaccagtggattgggttcctaccagccgaaccacatggagtattcatgcacatcatcagtggatgactaccgaagatatgttgtcggtttggaaccgcgtatggatagaagagaatccttggatggaagacaagacacacataagctcatggggcgatgttccttacctggggaaaagagaagaccaatggtgcggttcactgataggattgactgcccgggccacatgggctacaaatatacaagtggccataaatcaagttagaagattgataggcaacgaaaattatctggattacatgacttctatgaaaaggtttaaaaacgagagtgacccagagggagcattatggtaa

SEQ ID NO: 21625 - RNA, 9879 nt, synthetic construct
  misc_feature 1..9879: note = derived and/or modified CDS sequence (opt6) from DENV-1__FJ882530__SS-prME
  source 1..9879: mol_type = other RNA
tcagtgacgatgcttttaatgctaatgccaacggcattggcgtttcatctcactactagaggaggtgaaccccatatgatcgtaagtaaacaagaacgaggtaaatctctactatttaaaacttcagcgggggtaaatatgtgtaccctcattgctatggatttgggggaattttgtgaagacacgatgacttacaaatgcccacgaataactgaagcggaaccagatgatgtagattgctggtgtaacgcgacagatacatgggtaacgtacggaacctgttcgcaaactggcgaacatcgcagggacaaacgatccgtagctctagcacctcatgtaggtttggggttagaaacaaggacagaaacgtggatgtcttcggaaggtgcatggaaacaaatccaacgcgttgagacctgggcattacgacatccgggttttactgtaatagcactgttcctggctcacgcaatagggactagcattacccagaaagggattatattcatacttctcatgctagtaactccaagcatggcgatgagatgtgttgggataggatctagagatttcgttgagggtttatccggagcaacatgggtagatgttgtgctcgaacacggatcgtgcgttactacgatggcaaaagacaaacctacgcttgatatagagttacttaaaaccgaagtaacaaaccccgcggtgttacggaaactttgtatagaagccaaaatatctaacactacaaccgacagtagatgtccaactcaaggcgaagcgactcttgtcgaagaacaagatgctaatttcgtatgtcgtcgaacattcgtagaccgtggatggggcaacggatgtggacttttcggtaaaggatccctgataacttgcgctaaatttaaatgtgtaaccaaattagaaggtaaaacagtacaatacgagaatttaaaatatagtgtgattgtaacagtacatactggggaccaacatcaagtgggtaatgaatcgacagagcacggaacaactgcaactatcacacctcaagccccttctacagagattcaactcacagattacggcgccctaactctggattgttcgcctagaacaggtctggattttaatgaaatggtattacttacaatgaaagaaaaatcatggttagttcataaacaatggttcttggatcttccactaccatggacatcgggcgcaagcacaagtcaagaaacgtggaatcggaaagacttgctagtgacctttaaaactgctcatgccaagaaacaagaagtcgtcgtgcttggaagtcaggaaggtgccatgcatacagctttaacgggcgcaacagagatacaaacaagtggtacaactactatatttgcggggcatttaaaatgtcgactcaaaatggacaaattaacactaaaagggatgagctatgttatgtgtacgggatcattcaaattagaaaaagaagtggcagagacacaacatggaacagtcctagttcaaattaaatacgaaggtacggatgcaccatgtaaaatacccttctcaacccaagacgaaaaaggagtaactcagaacggcagactcataacagcgaaccccattgtaacagataaagagaaaccagttaacatcgaggctgaaccaccattcggagaaagttacatcgttataggggcaggagaaaaagcactaaagttatcgtggttcaagaagggaagctcaatcggcaagatgttcgaagcaacagcacgaggagcgcgaaggatggccatactcggcgacacagcgtgggattttggaagtataggaggggttttcaccagtgttgggaaattagttcaccaaatttttggtacggcttacggggtattgttcagtggtgtatcttggaccatgaaaatagggataggggtgctattaacgtggcttggtctgaactcacggagcacatccttatcaatgacctgtattgccgtaggcctagtaaccctctacttaggtgttatggttcaagcagatagcggctgcgttataaactggaaaggcagggaactaaagtgcgggagtggcatttttgttacaaacgaggttcatacatggacagaacaatataaatttcaagcagacagcccaaaacgattatctgcagctattggtaaggcatgggaagaaggcgtctgtggcattcgaagtgccacgcgcctagaaaacataatgtggaaacagatatcgaacgaactaaaccatatattactggaaaatgacatgaaatttacagttgtagtaggagatgtcgcaggtatattggcccagggcaagaaaatgatacgaccacagcctatggagtataagtatagttggaagagttggggaaaggcaaagattataggagcagatgtacaaaacacgactttcatcattgacgggccaaatactccagaatgccctgatgaccaaagagcttggaacatttgggaggtcgaagattacggtttcggaatattcaccacaaacatttggttaaaactgagagattcccatactcaagtatgtgatcatcgtttaatgtctgccgccattaaagatagcaaagcagttcatgccgatatgggctactggatagaaagcgagaaaaatgaaacttggaaattagcacgtgctagttttattgaagttaaaacatgtatttggccaaaatctcacaccttatggagcaatggagtattagaatctgaaatgataatccctaaaatctatgggggacctataagccaacataactaccgtccaggctacttcactcagaccgcaggtccatggcacttaggaaaattagaactagattttgacttatgtgaaggaacaactgttgtcgttgacgaacattgtggaaacaggggtccgtcgttgaggacaacgaccgtgactggtaagatcatacatgagtggtgctgtaggtcatgcacattacctcctcttcgtttcaaaggcgaagatggatgttggtatggcatggaaatcaggcccgtaaaagagaaagaggaaaacttagtaaaaagcatggtcagcgctggtagcggtgaagttgatagcttttcactagggttgctctgtatatcgattatgatagaagaagtgatgaggtccagatggtctcgtaagatgttaatgactgggacactagcagtcttctttttattaattatgggtcagctgacatggaatgacctcatccgactttgtatcatggtaggagcaaatgccagcgatcggatgggaatgggtacgacctacctcgcgttaatggccacattcaaaatgaggccaatgtttgcagttggtttattattccggagactaacaagcagggaagtattattattgaccattggattatcgcttgtagcaagtgtagaactaccaaacagtttagaagagttaggcgatggcttagctatgggaataatgatattaaagctacttacagattttcaatcacaccagttatgggcaacgttactgagccttacgtttattaagacgaccttttctctacattacgcgtggaaaacaatggctatggttctatctatagtatctctttttccgttgtgtctgtctacaacaagtcaaaagacaacatggttacctgttcttctcggatctctaggatgtaagccactcactatgtttttaatagcggagaacaagatatggggacgtaaatcatggccattaaacgaaggaatcatggcggttggcatagtaagtatactgttaagttcgcttttgaaaaatgatgtacccttagcaggccctctcatcgcaggaggaatgcttatagcttgctacgtaatctcaggctccagtgcggatctctcactagaaaaagcagcagaagtaagctgggaagaggaggcagaacatagcggagcgagtcacaatatattagtcgaagttcaggacgatgggaccatgaagattaaagatgaagaaagggacgatacgctcactatactactaaaagcaacgttactagcagttagtggagtatatccattaagtatacccgcgacgcttttcgtatggtatttttggcaaaagaagaaacaacgtagtggtgtcctttgggatacccctagcccaccagaagttgaaagagctgtattagatgatggaatttacaggataatgcagcgtggcctactaggaagatcccaagtaggtgtcggagtttttcaagaaaatgttttccatacaatgtggcatgtcactagaggcgcagttttaatgtatcaaggaaaacgtttagaaccgtcatgggcatcggttaagaaagacctaatctcatatggaggcggttggcgtttacaaggtagttggaatacgggtgaggaagtacaagttattgctgttgaaccaggcaaaaatcccaaaaatgtgcagacagcacctgggacttttaaaacctcggaaggagaggtaggagcaatagcactagactttaaaccaggaaccagcggatcaccaatagtgaacagagaaggtaaaatcgtcggattgtatggtaatggtgtagttaccacttctgggacatatgtttcagcaatcgctcaagcaaaagcatcacaagaaggaccccttcccgaaattgaagatgaagtatttcgaaaacgtaatctgacgataatggatctgcaccctggtagcggtaaaacccgacgctatcttccagccattgtgagagaggcgatcaagagaaaactaagaacattaattctagcaccaacacgtgtagtagcttcagaaatggccgaggcattaaagggtatgccgataagatatcaaactactgccgtaaaatccgaacacacgggtaaagagattgttgacttgatgtgtcacgccacctttacaatgagactactctccccggtaagagtacccaactacaatatgataataatggatgaagcgcatttcactgacccttcatcaatagcagcaagaggatacatttcgactagagtagggatgggtgaagcagctgctattttcatgactgcgacgcctcctggatcagtcgaagcatttccgcaaagcaacgctgtcatccaagacgaagaaagagatataccagaacgaagctggaactcaggatacgagtggattaccgactttcccggaaaaaccgtatggtttgttcctagtattaaatcagggaatgacattgcgaactgccttcgtaagaacggaaagagggtgatacagctaagtaggaagacatttgatactgaatatcagaaaaccaaaaataacgattgggattatgttgtaacaaccgacatttcggagatgggagcgaacttcagagccgaccgagtaatagacccacgaagatgcttaaaaccggtgatcctaaaggacggacctgagagagttatattggcgggacctatgcctgtcacggtagcgtctgcggcacaaagaagaggtagaattgggcgtaatcacaataaagagggagaccaatatatttatatgggccaaccattaaacaacgatgaagatcatgctcactggactgaagcgaagatgttacttgacaatattaacaccccagagggaataataccagcactgtttgagccagaacgcgagaagagtgcagctattgatggcgagtacaggctgaggggagaagcaagaaaaacgttcgtcgaacttatgcgaaggggcgacttaccggtatggttatcttataaagtagcctctgaaggatttcagtactcagaccgaaggtggtgctttgatggcgaaagaaataaccaagtgctcgaagagaatatggatgtggagatatggactaaagaaggcgaacgtaagaaactacgacccagatggctagatgctcgaacatactcggatccgttagctctaagagagtttaaagagttcgccgccggaaggaggagcgttagtggcgaccttattctagaaataggcaaattaccacaacatctaacacagcgggcccaaaatgctcttgataatctagtaatgcttcacaatagtgaacaaggtggacgtgcttaccgacatgctatggaagaactgccagacacaatcgaaacattaatgctacttgcactaatcgccgtactaacgggaggcgtgacacttttctttctttcggggcgtggtttagggaaaacctctattggacttttatgtgtaatggcatcaagcgtactcctctggatggcgagtgtagagccacattggatcgctgcatcaataatactagagttctttctaatggtacttctaatccccgaacccgaccgccagcgtaccccacaagacaatcaactagcttacgttgttatcggtttacttttcatgatcttaacagtagctgctaatgaaatgggcttgttggaaacaaccaagaaagatttaggcattgggcatgtagctgtcgaaaatcatcatcacgcagccatgctcgacgttgatttacatccagcaagtgcatggacactctatgcagtggctacaactatcataacgcctatgatgcgtcatacaatagagaatacgactgcaaatataagcctaacagcaatcgccaatcaagcggctattttaatgggtttagataaaggttggcctatatcaaagatggacataggcgtacctcttctagccttgggttgttattcacaggtcaatccattgacgttaacagccgcggtgttaatgctagtcgcccattatgctatcatagggccgggactacaagcgaaggcaactcgtgaagcacaaaagcgcaccgcggctggcatcatgaagaatccaacggtagatggaatcgtagcaatcgacttggatcccgtcgtctatgacgcaaagtttgagaaacaactaggacagatcatgctcttaatactgtgtacaagtcagatactgttaatgcgcactacatgggccttgtgtgaatcaataactctagcaacgggccctctcacaaccctatgggagggttcgcctggtaaattctggaatacaacgatagctgtatcaatggcgaatatattccgaggatcttatttagcaggagcaggtttagcattctcactgatgaaatctctcggaggtgggagaaggggcaccggcgcacaaggggagaccttaggagaaaaatggaaaagacagctaaatcaattatcaaaatcagaatttaatacttataaaagaagtggaatcatggaagtagatagaagtgaggcaaaggagggcttaaaacggggtgaaacaactaaacacgcagtatcccgaggaacagcaaaactgcgctggttcgtggagcgaaatctcgttaaaccagagggaaaagtgatcgatttaggatgcggaagaggagggtggagttattactgtgcaggacttaagaaagtaacagaagtaaaaggctacactaaaggaggaccaggacacgaggaaccaattccgatggcaacctacggctggaatctggtaaaattacatagtggtaaagacgtatttttcatacctcctgaaaaatgcgatacactcctatgtgacataggtgaatcctcacccaatccaacaatcgaagaaggaagaacattaagagtcctaaaaatggtcgaaccctggcttcgtggtaatcaattttgtataaaaatactgaacccttatatgccttcggttgtagaaactttagaacaaatgcaacgcaaacacggtggaatgcttgtacgtaacccgttgagtcgaaatagcacacatgaaatgtattgggtttcatgtggaactggtaatatcgtgagtgcagtaaatatgacatcacggatgctcctaaaccggtttacaatggcgcacagaaaacctacttacgagcgcgatgttgatctcggcgcaggtacgcgtcatgtggcagtggaacctgaagtagctaatttagacatcataggccaacgtattgaaaatattaagcatgagcacaaatctacgtggcattacgatgaggataacccttacaaaacctgggcatatcacggatcatatgaagtcaagccatcaggaagtgcaagtagtatggtgaatggagtggttaagctcctaacaaaaccttgggatgtcataccaatggtaacacaaatcgcgatgacagacaccacaccatttggtcagcagcgtgtttttaaagagaaagtagatacgcgaacaccaaaggcgaaaaggggaaccgctcaaatcatggaggtaacagccaagtggttatggggttttctcagcagaaataaaaagccaagaatatgtacgagagaagaatttactagaaaagtaagatccaatgctgcaataggtgcggtctttgttgatgagaaccagtggaacagcgcgaaagaagcagttgaagacgaaagattttgggacttggttcatcgcgaaagagaactacataaacagggaaagtgtgcgacttgcgtatataacatgatgggaaaaagagagaagaaactcggggaatttggaaaggcaaaaggtagtagagctatttggtatatgtggctaggcgcacgattcttagaatttgaagccctaggcttcatgaacgaagatcattggttcagtcgagaaaatagtctaagtggagtggagggggaaggacttcataaattaggatacatacttagagacatttcaaaaattccgggaggaaatatgtacgccgatgataccgctggttgggatacgagaataacagaagacgacttacaaaatgaagctaaaattactgacataatggagccggagcatgcattactagcaaaaagtatattcaagctaacgtatcaaaacaaagttgtcagggtccagagaccagctaaaaacggcactgtaatggatgtaattagtaggagagatcaacggggaagtggtcaagtgggaacatacggattaaacacattcacaaatatggaagctcaattaatccgtcaaatggaaagtgaggggatattttctccatcagaattggaaactcctaatttagccggcagagtattagattggctagagaaacatggagtagaaagattgaaaagaatggctatatcgggcgacgattgtgtcgttaaacccattgatgatcgatttgcgacggctttaaccgcacttaatgacatgggtaaagttagaaaggacatcccccaatgggaaccaagtaaaggctggaacgactggcaacaagtgccattttgttcccaccattttcaccaacttatcatgaaagatggtagggagatagtagtaccttgtagaaaccaagacgagttggtgggtcgggcgagggtatcacaaggagcaggatggagtttaagagagacagcctgccttggaaagtcatatgctcaaatgtggcaattaatgtatttccacagaagggatttgaggctagccgccaacgcaatatgtagcgcggttccagtagactgggtacctacttcaaggacaacttggtctatccatgctcatcaccaatggatgactacagaagacatgttatctgtttggaacagagtttggattgaagaaaacccttggatggaggacaaaacacatatatcatcctggggcgacgtcccataccttgggaaacgagaagatcaatggtgcggatcattgataggattaaccgcgcgtgcaacttgggcaaccaacatacaggtcgctataaaccaagtacggcgtttaattggaaacgaaaattatttggattacatgacatcaatgaaaagatttaagaatgagagtgacccggagggagctttatggtaa

SEQ ID NO: 21626 - RNA, 9879 nt, synthetic construct
  misc_feature 1..9879: note = derived and/or modified CDS sequence (opt6) from DENV-1__GQ868605__SS-prME
  source 1..9879: mol_type = other RNA
tctgtgactatgttgttaatgctgatgccaactgctcttgcatttcatctgactactcgaggaggagaaccccacatgatagtaacaaaacaagaacgaggaaaatcgctattgttcaaaacctccgtaggtgtgaatatgtgcacgctaattgctatggacctgggtgaactttgcgaagacacaatgacctacaaatgtccacggataaccgaagccgaacctgatgacgtagattgctggtgcaatgccactgatacgtgggtcacctacggtacgtgttctcaaactggtgaacacagacgagataaacgaagtgtcgctctagcaccgcatgttggtctaggtctggaaacacgaaccgaaacgtggatgtcttcggaaggtgcttggaaacaaatccaaagagttgaaacatgggcattaagacacccgggttttacagtcattgctctgttcctagctcacgccatcggaacctcaattacacaaaaaggaatcatatttattttattaatgctagttactccatcaatggccatgcgatgcgtaggaattggttcgagagattttgtagaaggcttaagtggcgctacgtgggttgatgtagtcctagaacatgggtcctgcgtgacaaccatggcaaaagacaaaccaaccttagacatcgaacttctaaaaactgaagtcaccaacccagcagtattacgaaaattatgtatcgaagctaaaatatcaaataccaccactgacagtcgttgtccaacacaaggggaagctacacttatggaagaacaagacgctaactttgtttgtcgccgcactttcgtagatagaggatggggcaatggctgtggcttgtttggtaaagggtcattaataacatgcgctaaatttaaatgtgtaacaaaacttgaaggaaaaatcgttcaatatgaaaatctaaaatatagtgtgatagttacagtacacaccggcgaccagcatcaagttggtaatgagtctactgaacacggtacaaccgcaacgataactccccaagcccctacttccgaaatacaattgacagattatggagcactcaccttagactgctcgccaagaacaggattagactttaatgagatggttttactaaccatgaaagagaaatcgtggctcgtacacaaacagtggttccttgatcttcctctaccctggacgtcgggagcgtcaacctcacaagaaacctggaatagacaagacctactggtaacctttaaaacagcacacgctaagaaacaagaagttgtagtattaggctcccaagagggggccatgcacaccgcactcacgggggcaacagaaatccaaacctcaggtacaaccacgatattcgccggtcatctaaaatgtagactaaaaatggataaattaacgctaaaaggtatgtcctatgttatgtgtacaggctcgtttaagttagaaaaagaggttgcagaaacacaacatggaactgttttagtacagataaaatatgaaggaactgatgcgccttgtaaaataccattttctacgcaagatgagaagggagtcactcagaatggacgactaattacagccaatccgatagttacagacaaagaaaaacctgtaaatatagaagcagaaccgccattcggggagtcatacatagtgatcggagttggcgagaaagcattaaaactttcctggtttaagaaaggatccagtatagggaaaatgttcgaagctacagctagaggagctaggaggatggctatacttggtgacaccgcttgggattttgggagcattggaggagtttttacttcagtaggcaaattagtacatcaaatcttcggaacagcttacggcgtactgttctctggtgttagttggacaatgaaaataggaataggagtccttttaacatggcttggattgaacagtagatcaacatctctatcaatgacatgtatagcagtgggattagttactttgtatctaggggtcatggttcaagctgatagtggatgcgtaataaactggaaggggagagaactgaagtgtggatctgggatctttgtcactaatgaagtacacacatggaccgaacagtacaaatttcaagcggactctccaaaacggttatccgccgcgataggaaaagcgtgggaggagggcgtatgtgggattcgctccgcaacacgtcttgaaaatattatgtggaagcagattagtaatgaactcaatcatattcttctggagaatgacatgaaattcaccgttgttgtgggagacgttgttggaatcctcgcccaagggaagaaaatgattagaccacagcctatggaacacaaatatagctggaaatcgtggggaaaagccaaaataataggcgccgatgtacagaacactacgttcataatcgatgggcccaatacacccgaatgtccagacgatcaaagggcttggaatatatgggaagtcgaggattatggttttggaatttttacgaccaatatttggctaaagttgagggatagctatacccaagtgtgtgaccacaggctaatgtcagcggcaataaaggattccaaagcggtgcacgcagatatgggatactggatagaaagtgagaaaaatgatacttggaaactcgcgagagcaagtttcatcgaagttaaaacatgtatatggccgaaatcacatacgctgtggtcaaacggagttttagaatccgaaatgatcattccaaagatatacggaggtcctattagtcagcacaattatagacctggttacttcacgcaaacagcgggcccctggcatctcggaaaacttgaactcgattttgacctttgcgaaggaacgacagtggtggtagacgagcattgcggcaaccgaggcccctcactccgaacgaccactgtaacaggaaaaataatccacgaatggtgctgccggagctgcacacttccgccgttaagatttaagggtgaagatggttgctggtatggcatggagatcaggccagttaaggaaaaagaagaaaatctggtcaaaagtatggtttctgcagggtctggggaagttgactctttttcccttggtctactgtccatttccattatgatcgaagaggtaatgcggagcagatggtcacgaaaaatgttgatgacaggaacgttagcagtgttcttattgctaatagtaggccaactcacctggaacgatctaattaggttatgcatcatggtaggtgctaatgcctccgatcgaatgggtatgggtacgacatatcttgcattgatggcgacatttaagatgagaccaatgttcgctgtaggattactcttccggcggcttacgagtcgagaggtattactcctgacgattggcttaagcctagtagcatcggtagaattgccaaacagtcttgaggaacttggagatggcctggctatgggaataatgattttaaaactactaacagatttccagagtcatcagttatgggcaactctcttatcactgacctttataaagacagccctatcattacattatgcttggaaaacaatggctatggtattgtcaatagtcagcctttttccactatgtctatcaaccacaagtcagaaaactacgtggctcccagttctcctaggttccctaggctgtaagcccctaacaatgtttctaatcgcagaaaataaaatttggggaaggaaaagttggcctctcaacgaaggaattatggcagttggagtcgtaagcatattactcagcagcctgctcaaaaatgacgtacccttggcaggacccttaattgctgggggtatgttaatagcatgttatgtaatatccggcagtagcgctgatcttagcctggaaaaagcggcagaggtatcatgggaagaagaagcagaacatagtggagctagccataatattttggtagaagtacaggacgatgggacaatgaaaattaaagatgaagaacgagacgatactctaacaattctcttaaaagcgacactcctagccgtatcaggggtatatcccttgtctataccggcgacgttatttgtatggtatttctggcagaagaagaaacaaagaagcggagtattgtgggacaccccctcaccgcccgaagtcgagagagcggttctcgacgacggaatatatcgtataatgcaaagagggttgctaggaagaagtcaggttggagttggcgtctttcaagaaaatgtattccacacgatgtggcacgttacaagaggtgctgttctaatgtaccaaggaaaaagacttgaaccttcgtgggcttccgttaagaaagatttgatcagttatgggggcggctggagactgcaaggttcatggaatacaggtgaggaagtacaagttattgcagtagaaccaggaaagaatccaaagaatgttcagacagcccctggcacgttcaaaactcctgaaggagaagttggagctatagctctagatttcaagcccggtacctcaggatctccaatcgtaaatagagaaggtaaaatagttggattatatggcaatggagtagtgaccacctcagggacctatgtaagcgcaatcgctcaagcaaaagcaagccaagagggcccgcttccagaaatagaagacgaagtcttccggaagcgaaatttgacaataatggatcttcacccaggctccggaaagacacgcaggtatctaccagcaattgtaagagaagcaatcaagagaaaactaagaacgttaattctcgctccaacaagggtggttgctagtgaaatggcagaagcactaaagggaatgccaataagataccaaacaactgcagtcaaatctgagcacacaggaaaagaaatcgttgacctaatgtgtcacgcaacttttacaatgagattattaagtccagtgagagttcccaattacaatatgataattatggatgaagctcacttcacagatccaagttctatagcagcgagggggtacataagtacccgagtaggcatgggagaagcggccgcaatattcatgactgcaacaccacctgggagtgtcgaagcatttccgcaaagcaatgcggtaatacaagatgaagaaagagacattcctgaacgcagctggaactcaggatacgaatggataacagactttcctggaaaaacggtctggttcgtaccatctatcaaatctggaaatgacatcgctaattgtctaaggaaaaatggaaagcgagtaatacaacttagtagaaaaacattcgagaccgaatatcagaagacaaagaacaatgactgggattatgtcgttacaactgacataagtgaaatgggtgcaaacttcagagcagaccgagtaatagatccgcgaagatgtttaaaacctgtaattcttaaagatggcagtgagagagtaatactagctggaccaatgccggtaaccgttgctagtgcagcacagagacgaggcagaattggtaggaatcacaataaagagggtgatcagtatatatatatgggacaaccattaaataatgacgaggaccatgcacattggacagaagccaaaatgttactagataacattaatacaccggaaggaattataccagcccttttcgaaccagaaagagaaaaatcagcagctatagatggtgagtacagattacgtggagaagcacgcaaaacatttgtcgagctaatgagaagaggtgatctaccagtatggttaagctacaaagtggcttctgaaggatttcaatacagtgaccgcagatggtgctttgacggagaacgcaataatcaagtactagaagaaaatatggacgtggaaatctggacgaaagagggagaacgtaagaaattgaggccacgatggctagatgcacgaacttacagcgatcctctagctttacgagaatttaaggaatttgcggctggacgtaggagtgtctctggagacctcattatcgaaataggaaagttgccacagcatcttacacaaaaagcacagaacgctttagacaacctggtaatgctccacaattctgagcaaggaggtcgtgcttacagacatgcaatggaagagttaccagacactatagagacattaatgctcttagccctcatagctgttctcacagggggtgtaaccctattctttctctcagggagaggtctaggaaaaacaagtataggcctattatgtgtaatggcgtctagtgtactactttggatggccagtgtagaaccccactggattgcagcttctataattctcgaatttttcctaatggtattgttaatacctgagccagatagacaaagaacaccgcaggacaatcaacttgcctacgtcgtaattggactattgtttatgattcttacagtagctgcaaacgagatgggcttacttgagactaccaagaaagacttagggataggacacgtggcagtcgaaaaccaccaccacgctacaatgttggacgtagatttacatccagcgtcggcttggacgttatacgccgtggcaaccaccattattaccccaatgatgcgacatacgatagaaaatacaacagcaaacatctccttgactgccattgcgaatcaagcggcgatattgatgggactcgacaagggctggcctattagcaagatggacataggcgttccgttactagcattaggttgctactcacaagttaatcctctaacactcacagctgcagtcttaatgttggtcgcgcactatgcaataataggtcctggcctacaagctaaagccacaagagaagcgcagaaaagaacggctgcgggaattatgaaaaacccaactgtagatggaatagtcgctatagatttagatcctgtagtgtacgacgcaaaatttgaaaaacaattgggacaaatcatgttactaatactttgtacaagtcaaatattattgatgcgaacaacttgggcgctctgtgagtcaataacactcgcaacaggaccacttaccacattatgggaaggtagcccaggaaagttttggaatacaacaatagctgtgagtatggccaacatctttcgaggatcgtacctggccggggcaggattagcgttttcattgatgaaaagccttggcggaggacgacgcggtactggggcacagggcgagacattaggcgaaaaatggaagcgacaattgaatcaactaagtaaaagtgagttcaatatatacaaacgatcgggaataatggaagttgataggagcgaagcgaaggaaggcctaaaaagaggggaaacaacccgccacgccgtgtcaagaggtacggcgaaactaagatggtttgtagagagaaatctcgtaaaacctgaggggaaagtcatcgatttaggttgtgggagaggtggatggagttattactgtgctgggctcaagaaagtaactgaagtcaaaggctacactaaaggtggtccaggtcacgaggaaccaatacctatggccacttatggttggaatttagttaaattacatagtggtaaagacgtgttctttacgcccccagaaaaatgtgataccctactttgcgatattggagaatcgagcccaaacccaactatagaagaagggaggaccttgcgagtcttaaaaatggtagagccatggctacgaggtaatcaattctgcatcaaaatattaaacccatatatgccctccgtcgttgaaacacttgaacagatgcagcggaagcacggcggaatgttggtgaggaatcccttgtcaagaaacagcactcacgaaatgtattgggtgagttgtggaaccggtaacatcgtatctgcagtaaatatgacctcacgtatgttactaaatagatttacgatggctcaccgcaagccgacctacgagagggatgtagatttgggggctggaaccagacatgtagcagtagaaccagaagtagcaaatttagacataataggacaaaggatcgaaaacataaaacatgaacacaaaagtacatggcactacgacgaagacaatccttacaagacatgggcataccatggctcctacgaagtcaaaccgagtggaagtgctagttcgatggtaaatggtgtcgttaaactgctaactaaaccttgggatgttattcccatggtaacgcaaattgcaatgaccgacacaacaccattcggacaacagagagtctttaaagaaaaagtagacactcgtacaccgaaagcaaaaagaggcacagcacaaataatggaagtaacagcccggtggctatggtcatttctgagtagaaataagaaacctagaatatgtacgagagaagagttcacaagaaaagttaggtcaaatgcagctatcggtgcggtgttcgtagatgaaaatcaatggaacagtgcaaaagaagctgttgaagatgaaagattttgggacctggtacagaaagaacgggaactacacaaacaaggaaagtgtgcaacatgcgtgtacaatatgatgggaaagagagagaagaaactaggtgaatttggaaaagcaaaaggttcaagggccatctggtatatgtggttgggtgctcgtttccttgagttcgaggctttaggttttatgaatgaggatcactggttttcacgggaaaacagtttatccggagtagaaggggagggattacacaaacttggatatatactaagagatatctctaaaatacccggaggtaatatgtatgcggatgacaccgcggggtgggacactaggataacagaagacgatcttcagaatgaagctaaaataactgatataatggaaccagagcacgcactcctagccacgtcaattttcaaacttacatatcagaataaagtggtgcgcgtgcagagaccagcaaagaatggaacggttatggatgtcatatcccgaagagaccagcgaggatccggacaagtaggtacatatggacttaacacattcacaaatatggaagcgcaactcataagacaaatggagtcagaaggaatattcttaccaagtgaactagagaccccgaatcttgccgaacgggtattagactggttagagaagcatggcgttgagcgattgaaaagaatggctataagtggtgacgattgtgttgtaaaaccaattgatgatcgcttcgcaacggcgttgactgccctaaatgacatgggcaaagtgcgtaaagatattcctcaatgggaaccatcgaaagggtggaatgattggcaacaagtgccattctgttcacatcattttcatcaattgattatgaaagacggccgggaaatagtagtcccatgcagaaaccaggatgaactcgtaggcagagctagagttagccaaggagcagggtggagtttacgggaaaccgcgtgtttaggaaagagttacgctcaaatgtggcaactcatgtattttcacagacgggacttgagattggcagctaatgccatctgttctgccgtgcctgtcgactgggtaccaacaagtaggacaacctggtcaatccatgcacatcatcaatggatgacaacggaagatatgctcagcgtttggaacagagtatggattgaggagaatccctggatggaagataaaacacatgtaagttcttggggtgacgtaccctacctcggtaaacgagaagatcaatggtgtggcagtctgatcggtttaacagctcgagccacatgggcaagtaatattcaagtggccattaatcaggtaagaagactaataggcaacgaaaactacctagattatatgaccagcatgaaacggtttaaaaatgaaggtgatccggaaggagcattatggtag

SEQ ID NO: 21627 - RNA, 9879 nt, synthetic construct
  misc_feature 1..9879: note = derived and/or modified CDS sequence (opt6) from DENV-1__FJ882534__SS-prME
  source 1..9879: mol_type = other RNA
agtgttactatgctgcttatgttgatgcctactgcgttagcttttcatttaacaacaagaggtggagaaccgcatatgattgtctcaaaacaagaacgtggaaaatctctattatttaaaacgagtgcaggagtcaatatgtgtactctcattgctatggatttgggagaattatgtgaagatacaatgacatacaaatgccctcgaattacagaagcagaaccagatgatgtggactgctggtgtaatgcgaccgatacatgggtgacatatggaacgtgttcacaaaccggggaacatcgtagggataaaagatcagtagcattggcaccacatgtcggcctaggtttagaaacaagaaccgaaacatggatgagttccgaaggtgcttggaaacaaatacaacgcgtagaaacgtgggcacttcgacatccgggatttacagtcatagctctattcctcgcgcatgccataggtacgtccataacccaaaaaggaatcatattcatattactcatgttagttactccaagcatggcgatgcgctgtgtaggcatcggtagtcgcgacttcgtagagggattatcaggcgcaacatgggtagatgttgtactagagcatggaagctgtgtgaccacgatggcaaaagacaaaccaactctagacatagagttattgaaaacagaggttacgaacccggccgttttacggaaattatgtatagaagccaaaattagtaacactaccactgatagcagatgcccaacgcaaggagaagctaccttggtagaggaacaagatgcgaatttcgtctgcaggcgaacatttgttgataggggatggggaaatggctgtggactatttggtaaaggatcgctcataacgtgtgcaaaattcaaatgcgtcacaaaattagaaggtaaaatagtacaatatgaaaatctaaaatattcagtgatagtcactgttcatactggcgatcaacaccaagttggtaatgaatcaaccgaacatggtaccacagcaaccattacgcctcaagcaccaacaacagaaattcaactgacagattacggtgcattaacacttgattgctcaccgcgaaccggattggatttcaacgaaatggtattattgaccatgaaagaaaaatcatggctggtccacaaacaatggtttttagacctaccattgccttggaccagcggagcgtcaactagccaggagacctggaatcgacaagacctattagttacgtttaaaactgcacatgccaagaaacaagaggtagtagtcttaggacctcaagaaggagctatgcataccgcgttaaccggagcaactgagatccagacctcaggaacaacaacaatatttgctggacacctaaaatgccgactgaaaatggacaaactaactctaaaaggtatgagctatgtcatgtgtacaggatcattcaaactggaaaaagaagtggcagaaacacaacatggaaccgtactcgtgcaaataaaatacgaagggacagatgctccttgcaaaatacccttctctacacaggatgaaaaaggtgtaacccaaaatggccgcctaataacagctaatccaatcgtcactgataaagaaaaacctgtaaatattgaagccgaaccgccatttggagaatcttacatcgtaataggtgctggtgaaaaagcactcaaactttcatggttcaagaaaggttcatctattgggaaaatgttcgaggcaacggctcgtggagcaagacgaatggcaatattaggagatacagcgtgggatttcggtagcattgggggagtattcacatcagtagggaagctagtgcatcaaatttttggtaccgcatacggtgttctattttcaggcgtgagctggactatgaaaattggaattggtgtcttactcacatggttaggtctaaattcaagatctacatctctatcaatgacatgtattgcagttggcctagttactctatatcttggagtgatggtacaagcggacagtggctgcgtaataaattggaaaggccgagaattgaaatgtggtagtggcatatttgtcacaaatgaagtccacacatggacagagcaatacaaatttcaggcggatagtccgaagcgattgtccgcagcaattggcaaggcttgggaagaaggagtctgtggcataaggtcagcaacacgattagaaaatataatgtggaaacaaatttcgaatgagttaaatcatatcttgttggaaaacgacatgaaattgactgtagttgtcggtgacgtggcaggcatcttaggtcaaggtaagaaaatgattagaccacaaccgatggagtacaaatattcttggaaaagttggggtaaagctaaaatcatcggtgcagatgcacaaaatacgacgttcataatagatggaccaaatacccctgaatgtcctgatgaccagagggcttggaatatatgggaagttgaagattatggatttggaatttttacgactaacatttggctaaaactaagagattcctacactcaagtttgtgaccacaggctaatgtccgcagccataaaggattcaaaggcggtgcatgccgatatgggatactggatagaaagcgagaaaaacgagacttggaagctggcaagggcctctttcatagaagtgaagacctgtatctggccgaaatcccatactttgtggtcaaacggagtattagagtccgaaatgataatcccgaagatttacggagggcccatctcacaacacaattatcgaccaggatattttacacaaaccgccggtccttggcatttgggaaaattagaactagattttgatctgtgcgaaggaaccactgtagttgtagatgaacattgcggtaaccgaggtccttcgttacgcacaacgacagtcactgggaagataattcatgaatggtgttgtaggagttgcacactcccaccgctgcgattcaggggtgaagatgggtgttggtatggtatggagattcggccagtcaaagaaaaggaagaaaatttagtaaaaagtatggtaagtgcaggatcaggcgaagtagactcttttagtcttggtctcttatgtatcagtattatgattgaagaagttatgagatcgaggtggtcgcgtaaaatgctaatgacaggcacactcgcagttttcttccttttaataatgggacaacttacctggaacgatttgatccgcttatgcattatggtcggcgcgaacgcctcggaccgcatgggaatgggtacaacatacttagcattaatggctaccttcaagatgagaccaatgttcgcggtcggactgttatttagaaggttaacatctcgagaggttctcctccttacaattggactctccctcgtagcatccgtagaattaccaaactctctagaagaacttggtgatggactagcgatgggcataatgattcttaaactattaacagattttcaatcccatcaattatgggctacacttttatcgctcacgtttatcaagactacttttagcctacattacgcttggaagacgatggcgatggttttgtccatagtctcgttattcccgttgtgtctttcaacgacatcacagaaaactacgtggctccccgtactattaggttcgttgggatgcaaacccctcaccatgtttttaattgttgaaaataagatatggggcagaaagtcctggccactaaacgaaggaattatggcagtaggtattgtaagtattcttctaagcagtctgctcaaaaatgacgtccccctagcagggccgctgatagctggtggaatgttaattgcttgctatgttatcagtggatctagtgcagatctaagcctagagaaggcagcggaggttagctgggaagaagaggctgaacatagcggtgcatcacataatatcctagttgaagtacaagatgatggtaccatgaaaatcaaagatgaagagagagacgataccctcacaatattgctcaaggcaactctactagccgtttcaggtgtgtatccgctaagtataccagcaacgttgtttgtatggtatttttggcagaagaagaaacaaagaagtggggtgctatgggatactccctcacctccagaagtcgaaagagcagttttggatgatggaatatatcggataatgcagagagggctgctcggacgttctcaagtaggtgtaggagtcttccaggagaatgtattccatactatgtggcatgtgacaagaggcgctgtattaatgtaccaggggaaacggctcgaaccctcgtgggcaagtgtaaagaaagatttaataagttatggaggtggttggagactcaggggttcatggaatacaggagaagaagttcaagtaattgccgtagagccagggaaaaaccctaaaaacgtacaaactgcaccaggaacttttaaaacaccggagggagaagtgggtgccatcgcattggacttcaagccaggtacttcaggaagtcccattgttaatagagagggaaaaatagttggtctatatgggaatggcgtcgtgaccacaagtggaacgtacgtatccgccatagcccaagctaaggcatctcaagaaggaccactgcctgagatcgaagacgaagtatttagaaagcgaaatttaactataatggatctacatcctggctctgggaaaaccagacgatacttaccagctatcgtaagagaagcgatcaagcggaagctacgaacactaatactggcaccgacacgagtagttgctagtgaaatggccgaagcgcttaaggggatgccaataagatatcagacgacagccgtaaaaagtgaacacacaggtaaagaaatcgtagaccttatgtgccacgcaacctttacaatgcgcctcttaagtccggttagagttcccaactataacatgataataatggatgaagcgcactttacagacccgagttctatagctgccagagggtacatatcaacccgagtgggaatgggcgaagcagcagccatttttatgactgcaacgccgcctggatcagttgaggcttttccccagagtaatgctgtgattcaagatgaagaacgagatatccctgaacgatcctggaatagtggatatgaatggataacagactttccaggaaagacagtatggttcgtgccatctatcaaatcggggaatgatatagcgaactgcttgcgcaagaatggcaaacgagtaattcaactatccaggaaaacattcgacacagaatatcagaaaacgaaaaacaatgactgggattacgtggttacaacagatattagtgaaatgggggcaaatttccgggccgatagagtaattgatcctagacgttgcctaaagccggtcatattgaaggatgggcctgaacgggtgatcctcgccgggccgatgccagtaacagttgcttctgcagcacagagacgcggccgcataggaagaaaccataacaaagaaggggatcaatacatatatatgggccaaccgttaaacaatgatgaggatcacgctcactggacagaggctaaaatgctacttgacaacattaacacacccgaagggatcattccagctctattcgaacctgagagagagaaaagtgcagctgttgatggtgaatacagattaagaggagaggccagaaaaaccttcgtcgaactaatgcggagaggagacctgccagtttggttatcttataaagtagctagtgagggctttcagtactcagatcggaggtggtgttttgacggtgaaagaaataaccaggtacttgaagaaaacatggatgtagaaatatggaccaaagaaggagaacggaagaaactgcgacccagatggcttgatgcaagaacgtattccgaccccttagcattgcgagaatttaaggagttcgcagcaggaagacgcagcgtttccggggatcttatattagagataggcaaattaccacaacatttaacacaacgagcccaaaatgcacttgataatcttgttatgttgcacaacagcgagcaaggagggagagcatatcggcacgccatggaagaactcccagatacgatagaaaccttaatgctgctagctttaattgccgtgcttaccggaggcgttacattattctttttgtctggccgcggcctaggcaaaacaagcatcggattattatgcgttatggcatcatcagttcttctatggatggctagcgttgaaccacactggatagcagcttctataattttagaatttttcctaatggtattactcatccccgagcctgacagacaaagaacaccacaagacaatcagctggcatatgtcgtcataggtcttctatttatgatcctcacagtagcggctaatgagatggggcttcttgaaacaacaaagaaagatttaggtatagggcacgtagcggtagaaaatcatcatcacgcagcaatgttagatgttgatttacatcctgctagcgcttggactttgtacgcagttgcaacaacaataattacccctatgatgcgtcacacaatagaaaatacaacagccaatattagtctaacagcaatagctaatcaagcggcaattttaatgggcctagacaaaggttggccaatctcaaagatggacatcggagtcccgttattagctttaggttgttatagtcaagtaaatcccttgacccttactgcagctgtcctcatgttagtcgcacactatgccatcattgggcccggattacaagcgaaagctacgcgtgaagcgcaaaaacgaacagcggcagggataatgaagaaccctacagtagatggtatcgtagctatagaccttgaccctgtagtatatgatgctaaattcgaaaaacaactagggcagataatgcttctgatactctgcacatctcaaattctattaatgaggacaacgtgggcattatgcgaatcaatcacattagccactggtccgctgacaacattgtgggaaggctctccgggaaagttttggaataccacaatagctgtaagtatggcaaacatttttcgcggctcttatctggccggtgcaggccttgcattctcgttgatgaaaagcctaggaggaggtagaagagggacaggcgcacaaggagaaacattgggagaaaagtggaaacgccaacttaatcagttgtccaaatctgaatttaatacatataaaagatccggaattatggaagttgatcgaagcgaagcaaaggaaggcttaaaacgaggggaaactacaaaacatgcagtctcaagagggacggctaagttaagatggtttgtggagcggaacttagttaagcccgagggcaaagttatagatttagggtgcggaagaggtggatggtcatattattgtgctggattgaagaaagtaacagaagtaaagggatatacaaagggaggaccaggacatgaagaacccataccaatggctacatatggctggaacctagtgaaattacacagtggaaaggatgtattctttataccaccagagaaatgcgatacccttctgtgtgatatcggagaatctagtcctaaccccactattgaagaagggcgaacacttagagtattaaaaatggtagaaccatggctaagaggaaatcaattctgcataaaaatcttaaatccatatatgccttctgtagtcgaaacattagagcaaatgcaacgaaaacatggaggaatgttggtaaggaatcctctaagtagaaacagcacgcacgaaatgtactgggtaagttgtggaacgggaaatattgttagtgccgttaatatgacaagtcgaatgttgttaaacagattcacaatggctcatcgcaaacccacatacgagcgggacgtcgatttaggtacaggaacccgacacgtagcagttgagccagaagtagctaatttggatatcattggacaaagaatagagaacatcaaacacgaacataaatctacatggcattatgatgaggataacccatacaaaacatgggcatatcatggatcatatgaagttaaacccagcgggtcagcatccagcatggtgaatggtgttgtaaagttactaacaaaaccatgggacgtcatacctatggtgacacagattgccatgaccgataccacccccttcggtcaacaacgggtgtttaaggaaaaggttgacacgcgcaccccaaaagccaaacgtggaacagcccaaataatggaagtaacagcacgctggctatggggatttctaagcagaaataagaaaccacgtatttgcacccgcgaagaatttacacgcaaagtacgaagtaatgcagctatcggtgccgtatttgtagatgaaaatcaatggaatagtgcaaaggaagctgtagaagatgagaggttctgggatctggtacatcgcgaacgcgaactccacaaacaaggcaaatgcgcgacatgtgtatacaacatgatgggaaaacgagagaagaaattaggagagttcgggaaagcaaaaggaagtagggcaatatggtacatgtggcttggagcgaggtttcttgagttcgaagctctaggtttcatgaacgaggaccattggttttcacgagaaaatagtttgtcgggcgtagaaggcgaaggacttcacaaattaggatacatcttacgagacatctctaaaattcccggcgggaatatgtatgccgacgatacagccggatgggatactcgcataactgaagacgatttgcagaatgaagcgaaaattacagacataatggagcctgaacacgcacttctagcgaaagccatatttaaattaacctaccaaaacaaagtagtgagagtgcaaagacccgcaaagaatggaacagtaatggacgtaatatcacgccgtgaccaacggggatcgggtcaagtaggaacttatgggttgaacacttttacaaacatggaagcccaactaataagacaaatggaaagcgagggaatatttagccctagtgaattagaaacaccgaacctagcggaacgggctctagattggctggaaaaatacggcgtggaaagattaaaacgaatggcaataagtggagacgattgcgtcgtcaaaccgattgacgatagatttgccacagctctaacagccctcaatgacatggggaaggttcggaaggatattccacaatgggaaccctcgaaaggctggaatgactggcagcaagtacctttctgcagccatcatttccaccaactaataatgaaagacggtcgagagatagttgttccctgtagaaaccaagatgagctagtcgggagggctagggtctcacagggtgccggatggtctctaagagaaaccgcatgcctcggaaaatcttatgcccaaatgtggcagctcatgtactttcacagacgtgacttaagactagcagctaatgccatttgctcagcagttccggttgattgggtccctacaagtcgaacaacttggtcaattcatgctcaccatcagtggatgacaacagaagatatgttatcggtatggaatcgtgtgtggatagaggaaaatccatggatggaggataaaacacacatttcaagttgggaagacgtaccgtacctcggaaagcgcgaagaccaatggtgtggaagtctcattggactaacagccagagcaacatgggcaactaacatacaggtagccattaatcaagtgagacgcctgatcggtaacgaaaattacctagattatatgacctcaatgaaacggttcaagaacgaatcagatcctgagggagcattgtggtag

SEQ ID NO: 21628 - RNA, 9879 nt, synthetic construct
  misc_feature 1..9879: note = derived and/or modified CDS sequence (opt6) from DENV-1__FJ882536__SS-prME
  source 1..9879: mol_type = other RNA
agcgttacgatgttactgatgcttatgccaaccgctcttgcattccacctaactaccagaggcggagaacctcatatgatagtttcgaaacaagaacgtggcaaaagccttttatttaaaacatccgcaggagtaaacatgtgcacactaatagcaatggatctaggagaattatgtgaagatacaatgacatataaatgtccaagaatcaccgaagcagaacctgatgatgtcgactgttggtgcaatgctacagacacatgggtcacctacggcacctgtagtcaaacaggtgaacacagaagagataaaagatcagtggcgttggctccgcatgtaggacttgggttggaaacgcggacagaaacttggatgtcatcagaaggagcatggaaacaaatacaaagagtagaaacctgggcactacgacacccaggtttcacagtcatcgcgttattccttgctcatgctatcggcacatcaatcacgcaaaagggaattatcttcatactattaatgttagtaaccccgtcaatggcaatgagatgcgttgggatcggtagccgtgactttgttgaaggtctctccggagcaacgtgggtagacgtcgttttagaacacggtagctgcgtaaccacgatggcgaaagataaaccgaccctcgacattgaattactcaaaacagaagtaacaaatcctgcagtactaagaaagctatgtatagaagcaaaaataagtaatacgaccacggattcgaggtgtccaacacaaggtgaagcaacattggtcgaagaacaagacgccaactttgtgtgtcgaaggacatttgtagatagaggatggggaaatggatgcggtctatttggaaagggatcgttaataacgtgcgccaagtttaaatgtgtaaccaaactagaagggaagatagtacaatacgaaaatctaaaatattccgtgattgtaactgttcatactggtgaccaacatcaagttggcaatgagtcaaccgaacatggtaccacagccactataactccacaagcgccaactacagagattcaactaacagattatggtgcacttaccttagattgcagcccccgaaccgggcttgattttaatgaaatggtattattgactatgaaggagaaatcatggctcgtacataaacaatggtttttagacctaccattaccttggacctccggggcgtctacttcacaagaaacatggaatcgacaagatttacttgtaaccttcaaaactgcccacgccaaaaagcaagaagtggtagtacttggaagtcaagaaggtgctatgcatacagcccttaccggagcaactgagatccaaacttcagggactacaacgattttcgcgggtcatctgaagtgtaggttaaaaatggataagctaacccttaaaggaatgtcgtatgtcatgtgcacaggtagttttaaacttgaaaaggaagtagcagaaactcaacacggaacagtattagttcaaattaaatatgaaggtactgacgcaccatgcaagataccgtttagcacgcaagacgaaaaaggcgtcacacagaatgggcgcttaattacggccaatcctatagtcacagataaagagaagccagtgaacatagaagctgaaccacccttcggggagtcttacatcgtgatcggtgccggtgaaaaagcactaaaattatcgtggttcaagaaaggaagctcgatagggaagatgttcgaagcaactgcaaggggagcgaggagaatggctattttaggcgatacagcatgggactttggaagcatcggtggagtattcacaagcgtgggtaagctagtacatcaaatatttggtaccgcatacggagtactgttttcaggagtgagttggaccatgaaaataggtataggagtactgctcacatggctaggccttaatagtagaagtacaagcctatcaatgacttgtatcgctgtgggcctagtaacattatacttaggagttatggtacaagcagacagtggttgcgtcattaactggaagggacgcgaattaaagtgtggaagcggaatatttgtaacgaacgaagttcatacttggacggaacaatacaagtttcaggccgattcacccaagagactcagcgcagcgataggaaaggcttgggaggaaggggtctgtggtataagatcagcaacaagattggaaaatataatgtggaagcaaatatctaacgaacttaatcacatattattagagaatgatatgaaattaacagtagtagtcggagatgtagctggtatactaggtcaaggaaagaaaatgatacgtcctcagcctatggagtataaatacagttggaaaagttggggaaaagcaaaaataatcggtgcggacgctcaaaatactacgtttattatagatggacccaacacaccagagtgccccgatgatcaaagagcatggaacatatgggaggttgaagactacggttttgggatctttaccaccaatatttggttaaaacttagggacagttacacacaggtttgcgatcacaggctcatgtcagctgcaataaaggattccaaggcagtgcatgcggacatgggctattggattgaaagtgagaaaaacgaaacatggaaactagcgagagctagtttcattgaagtaaaaacatgcatttggccaaaatcacatacattatggagtaatggtgttcttgaaagcgagatgattatacccaagatatatggcggacccattagtcaacataattatcgacccggatacttcactcaaaccgccggtccgtggcacctggggaagctcgaattagattttgacttatgtgaaggcacgactgtcgtggtagatgaacactgtgggaatcggggtccaagtctaagaacaacaacggtaactggaaaaatcattcatgaatggtgctgcaggtcctgtaccttaccaccattgcgatttagaggcgaagatggctgctggtatggtatggaaataagacctgtaaaagaaaaagaggagaatttagtaaaatcaatggtaagtgccggttcgggagaagtagacagtttttccttagggttgctgtgtataagtataatgatagaggaagtaatgagaagccgatggtcacgcaagatgttgatgactggcactcttgcagtattctttttgttgataatgggacagctcacctggaatgatctaatacgattatgcataatggtaggagcaaatgctagcgatagaatgggtatgggaacaacgtatctagcccttatggctacatttaaaatgaggcctatgttcgctgtaggacttctctttcgtagattaacttctcgcgaggttctgttactcaccataggattatcactggttgcttcagttgaactccccaatagcctcgaagaacttggtgatggtctcgcaatgggcataatgattctcaaacttttaactgactttcagtctcaccaactttgggcgactctattgagtctaacgttcataaaaacgaccttttctttacactacgcgtggaaaactatggcaatggtactaagcatcgtcagcctatttccgctgtgtttgtcaacaacgagccagaaaaccacatggctgccagtgcttttaggatctctgggatgcaaaccgttaactatgtttttaatagctgaaaacaagatttggggtagaaaatcatggcccttgaatgaaggaataatggcagtgggaatcgtaagtatactactttcttcgctactgaaaaatgatgtgcccctagctgggccattaatagcagggggtatgctcattgcatgctatgtgattagtggttctagtgcggacctcagcttagaaaaagcagcagaagtatcatgggaagaagaagctgaacatagtggagcaagccataatatcttagtggaagtacaagatgacggaactatgaaaatcaaggatgaagaacgtgacgatacattaactatactattgaaagcaacattacttgcagtctctggggtttacccgttatcgattccagcaacattattcgtatggtatttttggcaaaagaagaaacaaaggtcaggagttttatgggatacgccatcgccacctgaagtcgagcgagctgttctcgatgatggtatatacagaataatgcagcgtggactattaggtagatcgcaagttggtgtcggagtctttcaggaaaatgtttttcatacaatgtggcatgtgacaagaggcgcagtacttatgtatcaaggtaaaagattagaaccgagttgggcaagtgtgaagaaagatttgataagttatggaggtggttggcgattaaggggatcctggaatacaggagaagaagtacaagtaatagcagtagagccaggtaaaaatcctaaaaatgtacagacggcacctggaacatttaaaactccagagggggaagtgggagcaatagcacttgattttaaaccagggacatcaggatccccaattgtcaacagagaaggtaaaatcgttggactatatggcaatggggttgttactacctcaggaacttacgtatcagcaattgcacaggccaaggcaagtcaggaagggcctttaccggaaatagaagacgaggttttcaggaagagaaaccttacaattatggatttgcaccctggcagcggcaaaacacgtagatacctccccgcgattgttagagaagcaataaaacgaaaactaaggacacttatcttagctcctaccagagtcgtcgctagtgaaatggccgaagcattaaaaggcatgccgatcaggtaccaaacaacggctgtcaaatctgaacacaccggaaaagaaattgtagatctcatgtgtcatgcgacatttaccatgagattattatctcctgtaagggtccccaactacaacatgattataatggatgaagcacactttacggatccgagtagcatcgcagctagaggatacatctctacccgtgtaggcatgggtgaagcagctgctatatttatgacagcaactcctcccggcagtgtagaggcttttcctcaaagcaatgcggtaattcaagatgaagaaagggatataccggaacgctcgtggaactcgggatatgaatggataacagattttcccggcaaaacagtttggttcgtgccatctataaagagcggaaatgacatagcgaattgtttaaggaaaaatggcaaacgagtaatccaacttagtaggaaaacttttgacacagagtatcagaaaacgaaaaataacgattgggattatgtggtaacaactgatatttcagaaatgggagcaaattttagagctgacagagtaatcgatccgcgtagatgtcttaaaccggtgatactcaaagacggaccagaaagggtcatactagctggaccaatgcctgtaacggtagcatcggccgctcagagacgaggaagaataggcaggaatcataacaaagagggagatcagtatatatacatggggcaaccattaaacaatgatgaggatcatgcacactggacagaagcaaaaatgcttctggataatatcaatacccctgaaggaataatacctgcactctttgagcctgaacgagagaaaagcgcggcggtagacggggaataccggttaagaggagaagcgagaaaaacgttcgtagaactaatgagacgtggcgatttgcctgtatggctgtcgtacaaagttgcatcagagggcttccaatatagtgatagaagatggtgtttcgacggtgaacgcaacaatcaagtactagaggagaacatggatgttgagatatggacgaaggagggagagaggaagaaattgagaccaaggtggttggacgctcgtacatattctgacccacttgcattgcgagagttcaaagagttcgcagcgggccgaagatcggtttcaggtgaccttatactagaaattgggaaattaccccaacatcttacgcagcgagcacaaaatgccttagacaatttggtgatgcttcataacagcgaacaaggaggccgagcgtacaggcacgcaatggaagaactgccagacactatagaaacgttaatgctactcgctctaatagcagtgctgacaggtggagtaactttgttctttttatcagggcgaggcctcggtaagacaagtatcggactgctatgcgttatggctagcagtgtattattatggatggcttcggtcgagccgcattggatagcagcttctattatactcgagttctttctgatggtcttgcttattcctgaacccgatcgccaacgaacgccacaagacaaccaactcgcatacgtcgtgataggacttctatttatgatactaacggtagctgctaatgaaatggggttactagaaacaactaagaaagatttaggtatcggccacgtggccgtagaaaatcaccatcacgctgctatgttagatgtggatttgcatccggcatcagcttggacactctacgcagtcgcaaccactataattaccccaatgatgaggcatacgatcgaaaatacgacagcaaacatttcgcttacagccatagccaaccaagccgccattctgatggggctagataaagggtggccgatatccaaaatggacattggagtaccactcttagcgttaggttgctattcgcaagttaacccgctgacattgactgctgcagtactaatgttagttgcacactacgcgatcattggtccaggattacaagccaaagcaactagggaggctcagaaaagaactgcagctggaataatgaaaaacccaacagttgacggtatagttgcgatcgacttagatcctgtagtatacgatgcaaaatttgagaaacagctcgggcaaataatgctactgatattatgtacgtcacaaattttattgatgcggacgacttgggccttgtgcgagtccataactttagcaaccggaccattaactactctttgggaaggaagccctggaaagttttggaatacaacaatcgcagtttccatggcaaatatattccgaggatcctatttggctggagcaggattagcattctcgttaatgaagtccctaggcggaggacgcagaggaactggcgcccaaggcgaaacgttaggcgagaaatggaagcgtcagcttaatcaactatctaagagtgagtttaacacttacaagcggtcaggcataatggaagtcgatcgaagtgaagcaaaagaaggacttaagaggggcgaaacaacaaaacatgctgttagccgtggaacagctaagctacgctggtttgtcgaaagaaatttagtaaagcccgagggtaaagtcattgaccttgggtgtggtagaggaggttggtcgtactattgcgcgggtctaaagaaagtaactgaagtcaaaggatatacaaaaggtggacctgggcatgaggagcctataccaatggccacgtatggttggaacctagttaaattacatagtggcaaagatgtgttctttattccgccagagaaatgtgacactctgttatgtgacattggggaatcttcccctaatccaacaattgaagaaggacgaacattaagggtactcaaaatggtggaaccatggctgaggggtaaccaattttgtatcaaaatactaaacccgtatatgccatcagttgtcgaaacactggaacagatgcaaagaaaacatggagggatgttagtgagaaatcccctatcgagaaatagtacacacgagatgtactgggtatcatgtggtacaggtaatatcgtctccgctgtgaatatgacaagtagaatgttactcaataggtttaccatggcccatagaaaaccaacatacgaacgagacgtagatctcggtacaggcacaaggcatgtcgcagtcgaacctgaagtagcgaacttagatatcatcggtcagagaatagagaatataaaacatgaacacaagagcacatggcactatgatgaagataacccttataaaacatgggcctaccatgggagttatgaagttaaaccttccggatcagcttcctcaatggtaaatggtgtggtaaaacttctaacaaagccgtgggatgtcattcccatggtaacacaaatagcaatgacggacacaactcctttcggacaacaacgagtttttaaagaaaaggtcgacacgcgcactccaaaagcaaaacggggtactgcccagattatggaagtcacagcacgctggctttggggattcttgagccggaacaagaaaccgcgtatatgtacaagagaagagttcacgcgcaaggtacgaagcaacgcagcaattggtgcagtatttgtagacgaaaaccaatggaacagtgcaaaagaagcagtcgaagacgaaaggttttgggatttggtccatagagaacgggaactgcataagcagggcaaatgtgctacgtgtgtttacaatatgatgggaaagagagaaaagaaacttggagagttcggaaaggcgaaaggcagtagagcgatctggtatatgtggctgggagctcgattcctagaatttgaagcccttggattcatgaatgaggatcactggttctcccgagaaaatagtttatctggcgtggagggagaagggttacataaactgggctatatactccgcgatatatcaaaaattccaggcggcaatatgtatgcagatgatactgccggatgggatacaagaatcacggaggatgacctacaaaacgaagcgaaaattactgatataatggaaccagagcatgcccttttggcgaaagcaatatttaaattgacttatcaaaacaaggtagtgagagtgcaaaggccagccaaaaatggcaccgttatggatgttatatcccgacgagaccaaaggggcagcggacaagttgggacatacggtttaaatactttcactaacatggaagctcaattaattagacaaatggaatcagaaggtatattcagcccctccgaacttgaaacacctaatcttgccgaacgagcccttgattggctagaaaaatatggtgtggaaaggttgaaaagaatggctatttcaggagatgattgtgtcgttaagccaattgatgatcgctttgcaactgccttaactgctttaaacgatatgggaaaggtgagaaaggacataccccaatgggaacctagcaaaggttggaacgattggcaacaagttccattttgttctcatcatttccaccaactcattatgaaagacggtagagagatagttgtaccgtgtagaaatcaagatgaacttgtaggacgcgcccgtgtaagtcaaggggcgggctggtcactccgagaaacggcgtgcttagggaaatcatatgctcagatgtggcagctaatgtactttcaccgtcgtgatctacgtctagcagccaatgcaatttgttcggctgtgcctgtggactgggtccctacgtccagaactacctggagtatccacgcacatcatcagtggatgacaactgaagatatgttatcggtatggaatagggtatggatagaagaaaatccttggatggaggataagacgcacataagctcatgggaagacgtgccatacctcggaaaaagagaagaccaatggtgtgggtctctcatcggattgacagcaagagcaacgtgggcgaccaatatccaagttgctataaaccaagtacgtagactcatagggaacgaaaattatctggactacatgactagcatgaagagattcaagaatgagtcagacccagaaggagccttatggtaa

SEQ ID NO: 21629 - RNA, 9879 nt, synthetic construct
  misc_feature 1..9879: note = derived and/or modified CDS sequence (opt6) from DENV-1__FJ882537__SS-prME
  source 1..9879: mol_type = other RNA
tcagttacaatgcttctcatgcttatgccaacagcattagccttccatcttacgacacgtggtggggaaccgcatatgatagtttcaaaacaagaacgaggaaaatctttgttatttaaaacgtctgcaggcgtgaatatgtgtacgcttatagctatggacctaggagaactgtgcgaagatacaatgacgtataaatgcccaaggataacagaagtcgaaccagacgatgttgattgctggtgtaatacaaccgatacatgggtgacatacggaacttgtagccaaacaggtgaacatcgtcgagataaacgatccgtagccctagccccacatgtaggtctgggactagaaacgcgcgctgaaacatggatgtccagtgaaggagcttggaaacaaatacaaaaagtagaaacttgggcattacgtcatcccggctttacagttatagcgctatttctagcacacgcaataggaacctcaattactcaaaaaggtataatttttatattattaatgttagttactccgagtatggccatgaggtgcgtcggaattggaagtcgtgatttcgtagaaggcctaagcggtgccacatgggtagatgtagtattagaacatggaagctgtgtaacaacaatggcaaaagacaaaccaacacttgatatagaactgttaaaaacagaagtaacgaaccccgcagtccttaggaaattgtgtatcgaagcgaaaattagcaacacaaccacagattccagatgtcccactcaaggtgaagccaccctagtcgaagaacaagacgccaattttgtctgccgccgaacgtttgtagacaggggttggggaaatggttgcggactgtttggaaaaggtagtttgataacatgcgccaaatttaaatgtgttacgaaactcgaagggaaaattgtacaatacgaaaacttgaaatacagcgtgattgtcaccgttcacacaggcgatcagcatcaagttgggaacgaatcaaccgaacatggaacaattgcaactattacaccgcaagctccaaccagtgaaatacaactcacggactacggtgcgttgacgcttgattgtagtcccagaacaggcctcgacttcaacgaaatggtattgctgacaatgaaagaaaaatcttggttggttcacaaacaatggttcctcgatctaccactaccatggacaagtggcgctagtactagccaagaaacatggaatagacaggatctattagtcacatttaaaaccgctcatgcgaagaaacaagaagttgtagtattaggatctcaggagggtgcaatgcatactgctctaactggagcaactgagatccagactactggtactacgactatatttgctggccatttaaagtgtcgactcaagatggacaaactaacattaaaaggaatgagttatgtaatgtgtacagggtcatttaaattagaaaaagaagttgctgagacccaacatggcaccgtcttggttcagattaaatatgaaggaacagacgcaccgtgcaaaataccgttttccacacaagatgaaaaaggagtaacgcaaaacggacgattaataacagcaaaccctatagtcactgataaggaaaaacccgtaaacatagaagccgaaccaccattcggtgaatcttatatagtaattggagcaggggaaaaggcattgaagttaagctggttcaagaaaggaagttcaattggaaagatgtttgaagcaaccgcgcgaggggcaaggagaatggcaatactaggtgacacagcatgggatttcggtagcatcggaggtgttttcaccagtgtcggcaagctagtccatcaaatattcggaactgcttacggtgtactgtttagtggtgtgagctggacaatgaaaatcggaattggagtgctcctaacttggctgggtttgaactcacgtagtacaagtctgagcatgacatgcatagccgtagggttaataactctttaccttggtgtaatggtccaggctgattcgggatgtgtcataaactggaagggaagagaattaaagtgtgggtctggtatatttgttactaatgaggtgcacacatggaccgaacagtataagtttcaagcggactctcccaaacgcctatcagccgcaattggcaaggcttgggaggaaggtgtttgcggtatacgaagtgctaccagactagagaacattatgtggcggcaaatatcgaatgaattgaatcatattctcctagagaatgacatgaagtttacagttgtagtgggggatgtcgtaggaatactagcacaaggaaagaaaatggtaagaccacagccaatggaacacaaatattcctggaaatcatggggcaaagctaaaataatcggcgcagatgtacaaaacaccacatttattattgacggtcccaatacacctgaatgcccagatgatcaaagagcatggaacatctgggaagttgaggactacggtttcggtatttttactactaatatatggctcaaacttagagattcatacactcaagtgtgtgaccacagattaatgtcagcggcaataaaagattcaaaggcagtacatgctgatatgggatattggatcgaatctgagaaaaatgaaacatggaaattagcgagagcatcttttatagaggtcaagacatgcatttggcccaaatcacatacactgtggtccaacggtgtattagaaagcgaaatgatcataccaaaaatttatggcgggccgatttcccaacacaattacaggcccggttactttactcaaacagctgggccgtggcatctaggaaaattagaattagatttcgacctatgcgaaggcacgactgttgtggtcgacgagcattgcggcaacagggggcctagtttgagaacgacaacagtaactggcaagattattcatgagtggtgctgccggagttgtacattaccccctcttagattcaaaggggaggatggttgttggtacggaatggagataaggcctgttaaagaaaaagaggaaaatcttgtaaaatcaatggtatctgcaggttcaggtgaggtagatagtttcagcttaggtctattatgtatatcaattatgatagaagaggtaatgcgttcgcgctggtcaagaaaaatgctgatgactggtactctcgcagtgttctttctactcataatgggccaactaacctggaatgatctaattcgatcatgtattatggtcggggctaacgcatctgatcgtatggggatgggaactacttacctcgctctaatggctacctttaagatgaggccaatgtttgcggtaggactcttatttagaaggcttaccagtagagaggtactattattaacaatcggtctatccctagtagctagcgttgaattaccaaattcattagaagaactcggtgatggattagccatgggaataatgattctaaaactcttaacagatttccagtcctatcaactgtgggcaaccttgctatcacttacttttattaaaacaacattctctttacattatgcatggaaaaccatggccatggtcctctctattgtgagtctgttaccactgtgcctttcgactacatctcagaaaacaacatggttaccggtgctcctaggatcactagggtgtaaaccattaactatgtttttgattgcagaaaacaaaatatggggaagaaaaagctggccgctaaatgaagggataatggccgtaggaatcgtctctattttattatcaagtttactgaaaaacgatgttccattagcgggaccactcatcgcagggggaatgttaatagcgtgctatgtaatatctggaagtagtgcagatctgtcactagaaaaagctgcagaagtttcgtgggaagaagaagcagaacactctggtgctagtcacaacatcttggtagaagtacaagacgatggtacgatgaaaataaaagatgaagaaagggatgacaccctcactattctactaaaagctaccctacttgccgtaagtggagtctatccgttgagtataccggccaccctattcgtatggtatttttggcaaaagaagaagcagaggtcaggggtcttatgggacacgcctagtccaccagaagtagaaagagcagtgcttgatgatggaatctaccgaatcatgcagcgaggattattagggagaagtcaagtaggggtcggcgtatttcaggagaatgtatttcatacgatgtggcatgtaaccagaggagcagtactaatgtatcaagggaaaagattagaaccgtcctgggcatccgtaaagaaagacttaatctcttacggtggtggttggaggctacaggggagttggaatacaggagaagaagtacaagttatagctgtagaaccggggaaaaatccgaaaaacgttcaaactgcacccggtacattcaaaacacctgaaggagaggtaggagcgatcgcgttagatttcaaaccaggaacatcggggagtcctatagttaatagagagggaaaaatagtaggcctgtatggaaatggtgttgttacaacatcaggcacatatgtgagtgcaattgcacaagcaaaggcttcccaagaaggacctctacccgaaatcgaggacgaagtttttaggaaaagaaatctaactataatggatctacatcctggatccggtaaaacaaggcgataccttccggccattgtgcgagaagcaatcaaacggaaattgagaaccctaatactagcacctacaagagtggttgcctcagagatggccgaagcgttgaaaggaatgccaatacggtaccagactacagcagtaaaatcggagcacaccggtcgtgaaattgtggatttaatgtgccacgcgacattcacaatgagattactatcacccgtgcgcgttccaaactacaacatgataataatggacgaggcacattttactgacccatctagcatagctgcgcgagggtacatatcaaccagggtcgggatgggcgaggctgcagccatttttatgacagcaacacccccaggatcagtagaggcttttcctcagtcaaatgcagttatacaagatgaagaaagggatattcctgagaggtcatggaactctggatatgagtggataacggacttccccggaaaaacggtatggttcgtgccatcaattaagtccggtaacgatattgcgaattgtcttcggaaaaatgggaaaagagtaatacaattaagccgtaaaacgtttgacacagagtaccaaaagactaaaaataatgactgggactacgtagtcacaacagacatatctgaaatgggagcaaacttcagggctgacagagtgatcgacccaagaagatgtctcaagcccgtcatattaaaagatggacccgaacgcgtaatactagctggtcccatgcctgtgacagtagcatctgctgcacaaagaaggggaagaattgggaggaatcacaacaaggaaggagaccaatacatctatatggggcaacccctgaacaacgacgaagaccatgcacactggactgaagcgaaaatgcttcttgataatattaatacgccagaggggataataccagccctattcgaaccagaacgcgaaaaatcagctgctattgatggcgaatatcgtttacgtggggaggcgcgtaaaacgtttgtcgaactcatgagaagaggggacttacctgtttggcttagctacaaggtagcatcggaaggattccagtattctgacagacgatggtgctttgacggagaaagaaataatcaagtcctggaggaaaacatggacgttgaaatatggaccaaggaaggtgaacgtaaaaagctccgcccaagatggctagacgcgagaacttattcagacccactagcacttcgagagtttaaagagtttgcggccggaagaagaagtgtatcaggtgacttaatactagagataggaaaactgcctcaacatcttacccagcgtgcccaaaatgcgttagataatctcgtgatgctacataattcagaacaaggtggacgagcatatagacacgcaatggaagaactaccggacacaatagaaacactgatgctgctagcactaatagccgtgctaacaggtggtgtcacactatttttcctttcagggaggggtctaggaaaaaccagtataggtttgttgtgcgtaatggcaagttcagcactactatggatggctagtgtggagcctcactggatcgcagcatctataattctggagttctttttaatggtactcctaattccggaacctgatagacagaggacaccgcaagataaccaactggcatatgtggtaataggtctcctgttcatgattttaactgtagctgctaatgaaatgggattattggagaccaccaagaaagacttaggaatcggacatgtagcagtcgagaatcatcaccatgcaactatgctggacgtagatctacacccagcttcggcatggaccttatatgcggtggcgaccacgataattactcctatgatgagacacaccattgaaaatacaactgcgaacataagtcttacagctatagcaaatcaagcggctatacttatgggcctggataagggatggccaattagtaaaatggatattggtgtacctttactagcacttgggtgctattcacaagtaaaccctttaacattaacggcagcagttctgatgttggtcgcacattatgctatcattggaccagggctacaagccaaagctacacgtgaagcgcagaaaaggacagcagcagggatcatgaaaaatccaacagtagatggaattgtcgccatcgacttggatccggttgtttacgacgctaaattcgagaagcagttgggacaaataatgctcttaattctatgtacatcacagatcctgttgatgcgcacaacctgggctctgtgcgaaagcataactttggcgacgggtccactaactaccctatgggagggaagcccagggaagttttggaacacgactattgcggtgagtatggccaatatattccgaggaagctacttagccggcgctggattggcatttagcttaatgaagtctctcggaggtggtagaagaggtacaggcgcccagggagagacactaggagaaaaatggaaaaggcaactgaaccaactttctaagtctgagtttaacacctataaacgaagtgggataatggaagtcgatcgctcagaagccaaagaaggactgagaagaggcgagaccaccaagcacgcagtcagtagaggaacggcaaaactcagatggtttgtagaaagaaatttggtaaaacccgaggggaaagttatagatctaggatgcggaagaggaggctggagttattactgcgccgggttgaagaaagtcacggaagtaaaaggatataccaaaggaggtcccggacatgaagaaccgattccgatggctacttatggatggaacttagtgaaattacattcaggtaaagacgtatttttcatacctccagaaaaatgtgatacactactttgcgatatcggagaaagttcgcccaaccctacaatagaagaaggtagaaccttacgagtgctaaagatggtagaaccttggcttagagggaatcaattctgtataaaaatattaaatccctacatgcctagtgtagtcgaaactcttgaacacatgcaacgaaaacacggtgggatgctggttagaaacccattatcaagaaattcgactcacgagatgtattgggtgagttgcggtaccggcaacatcgtgagcgcggtgaatatgacctctaggatgttattaaatagatttacaatggcacatagaaaaccaacctacgaacgagatgtagacctaggcgcaggtacgagacacgtagccgtggaacctgaggttgctaatctagatataatcggacagaggatcgaaaatataaaacatgaacacaaatcgacatggcattatgatgaggataatccctataaaacgtgggcctatcatgggtcatatgaagttaagccatcaggttcagctagttctatggttaatggtgtggttaaattgttaacaaaaccatgggatgttatcccaatggtaacgcaaatagccatgactgatacgaccccttttggtcaacagagagtatttaaagagaaagtcgacacccgaaccccaaaagccaagagaggaacagcacaaataatggaagtaactgccaggtggctgtggggtttccttagccgaaacaaaaagccacgaatatgcactagggaagaatttacaagaaaagtaagatcaaacgcagcaatcggcgctgtattcgtggatgaaaatcaatggaatagcgctaaagaagccgtcgaagacgaacggttctgggatttagtacacagggaaagggaattacataaacagggaaaatgtgctacatgtgtttataacatgatgggcaaacgagaaaagaagctaggagaatttgggaaagccaagggatccagagcaatttggtatatgtggcttggagcgcgcttcttagagttcgaggctttaggattcatgaacgaagatcattggttttcccgtgagaactcattaagtggtgtcgaaggggaaggtttacataaactcggatacatcttaagagacataagtaaaattccaggaggcaacatgtacgcagatgacaccgcaggttgggatacacgcataactgaagatgatttgcagaatgaagccaaaataaccgatataatggaacccgaacatgcacttttagcaacttcgatttttaaactaacctaccaaaataaggttgtgagggtccaaagacctgccaagaacggaactgttatggacgttattagccgccgtgaccaaagggggtctggtcaggtcggtacttatggcttaaacacctttacaaatatggaagctcaattaattagacagatggaatctgaaggaatcttctctccgtcagaactggagacaccaaacctagccgaaagagttttagattggctagaaaaatacggagtcgagcgcttaaagagaatggccatatccggagacgattgcgtagttaaacctattgatgacaggttcgctacagcgttgacagcattgaatgacatgggcaaagtgaggaaagacatacctcaatgggagcctagcaaagggtggaacgattggcaacaggtaccgttttgttcacatcactttcaccagctaataatgaaagatggaagggagatagtagtgccttgtagaaaccaagacgaactcgtaggtagagcaagagtgagtcaaggggccggttggagtcttcgagaaacagcttgcttaggtaaatcttatgcacaaatgtggcagcttatgtattttcatagaagagatcttagattagctgccaatgcaatctgtagtgccgtcccggttgattgggtacccacgtctcggacaacgtggtccattcatgctcatcaccaatggatgactacagaagatatgctatcggtctggaatagggtttggatagaggaaaatccatggatggaagacaaaactcacatatcttcctggggtgacgtaccatatttaggcaagcgagaagatcaatggtgtggctcgctaataggacttacagcgagggcaacttgggctactaatatacaggtagcgatcaatcaagtaagaagacttataggcaatgaaaattacctagattacatgacgagtatgaagcgatttaaaaatgagtccgatccagagggggccttatggtaa

SEQ ID NO: 21630 - RNA, 9879 nt, synthetic construct
  misc_feature 1..9879: note = derived and/or modified CDS sequence (opt6) from DENV-1__GQ868606__SS-prME
  source 1..9879: mol_type = other RNA
agcgtaacaatgttattaatgttaatgccgacggccttagcatttcatctaacaaccagaggtggggaaccacacatgatagtaagtaaacaagaaagagggaaatctttattatttaaaacttcagccggcgtaaatatgtgcacattgatagccatggatttgggagagttctgcgaagacacgatgacctataaatgtcctcggataacggaagctgaacctgatgatgttgattgttggtgtaatgctaccgacacttgggttacatacgggacatgctctcaaaccggagaacatagaagggacaaaagatcagtagcactagcaccacacgtcggtctaggtttagaaaccaggacagagacgtggatgtcaagtgaaggagcatggaaacaaatccaacgagttgaaacttgggccctgagacatccaggattcaccgttattgcactatttttagcgcacgcgataggaacgtctattacacaaaagggcatcatatttatattactaatgttagtaaccccctctatggcaatgagatgcgttggcattggatcaagagatttcgtggaaggactcagtggtgcaacatgggtagatgttgttcttgaacatggtagctgtgtaaccactatggcaaaagacaaacctactttggatatcgaattactaaaaacagaagtaaccaatcccgcagtactgcgcaaattatgcatagaagctaaaatatcaaacacgactaccgattccaggtgcccaacacaaggtgaagcaacattagtcgaagaacaagacgcaaatttcgtatgtaggaggacctttgtagatagaggatggggaaatgggtgtggtctgttcggaaaaggatcgctaatcacatgcgctaaatttaaatgcgtaacaaaactagaaggaaaaacagttcaatatgaaaacttgaaatatagtgtaatagtaacggtacacaccggagatcaacatcaagtagggaatgaatccacagaacatgggacaacagcgaccattactccacaggccccaagtactgagatccaattaacagactatggggctttaacattggactgcagcccaagaaccggacttgactttaacgagatggtactcctcactatgaaagaaaaatcctggttagtacacaaacaatggtttttagatcttccgctaccgtggacaagtggagcttccacttcacaggaaacatggaaccgaaaagatcttctagtaactttcaaaaccgcgcacgccaagaaacaagaagttgttgtattgggaagtcaagagggcgctatgcatacagcactaactggagccactgaaattcaaacgtctgggacaacgacgatcttcgcaggacacctaaaatgtaggctcaaaatggataagttaaccctcaaaggcatgtcgtatgttatgtgtactggaagttttaagctggaaaaagaagtcgccgagacgcaacatggaactgttctcgttcagataaaatatgaaggcactgatgctccgtgcaaaataccgttttcaacgcaagatgaaaagggagtcacccaaaacggaagactcattactgcgaacccaatcgtgacagacaaagagaagccggtaaatattgaggccgaaccacccttcggtgaatcgtacattgttataggagctggagaaaaggctctcaaactatcctggtttaaaaagggaagctcaatcgggaaaatgtttgaagcaactgcaagaggagcgagaaggatggcgatactaggcgatactgcatgggattttggctctataggtggagtatttacatccgttggcaagctagtgcaccaaatatttggaacagcatacggggtcctattttctggtgtatcgtggacaatgaaaataggcataggtgtgctgttgacctggttggggcttaactctaggagtacgagtctaagtatgacatgcatagcagttggcctagtcaccctatatttaggggtaatggttcaggcagactctggatgtgttatcaattggaaaggtcgggaattaaagtgcggttcgggaatcttcgtcacaaatgaagtacacacatggactgagcaatacaaattccaagcggattctccaaaacggttgagtgctgctatagggaaagcatgggaggaaggcgtatgcggtattcgatcagctacacgattggagaacataatgtggaaacaaatcagtaatgaattaaaccatattctgctcgaaaacgacatgaaatttactgtagtcgtaggcgatgtagctggaatccttgcacaaggcaagaaaatgatccgtccacaaccaatggaatataaatactcatggaaatcatggggtaaagcgaaaataataggtgctgatgtacagaacacgacattcattatagatggaccaaatacaccagaatgccccgatgatcagagagcatggaatatatgggaagtggaagattacgggtttggtatatttacaacaaatatttggcttaaattgagagacagttatacccaggtgtgtgatcatcgtctaatgtcagccgcaatcaaagactccaaagcggtacatgcggacatgggctattggattgaatcggagaaaaatgaaacatggaaattagctagagcaagtttcattgaagttaaaacttgcatctggccaaagtcccatacgctatggtcaaatggagttttagaaagtgaaatgataatccctaaaatatatggaggaccaattagccaacataatcacaggccaggctatttcacgcaaactgcaggaccatggcatttgggaaaactagaattggacttcgacttgtgtgaaggtactacggttgtggtagatgaacattgtggaaatagagggccttcattaaggacaacaactgtgacaggtaagataatccacgaatggtgttgcagatcgtgtactcttccgcctttacgttttaaaggtgaagacggttgctggtatggtatggaaatacgacctgtaaaagaaaaagaagaaaatctagttaaatccatggtatcggcaggaagcggggaagtagactcattttctttaggtctcttatgtattagtattatgattgaagaagtcatgcgaagtagatggagccgcaagatgttaatgactggtacattagcagtgttctttttattgatcatgggacaattaacttggaacgacttaattagattatgtattatggtcggagcgaacgcaagtgataggatgggtatgggtacgacatatttggccctaatggcgacatttaagatgcggccgatgtttgctgtcggtttactttttagacgtttaactagcagagaggtgttactgttgacaattggattaagccttgtcgcgtcagtagaactcccaaattccttagaggagcttggtgatggcctcgcaatggggatcatgattttaaagctgttaactgattttcaatcacatcaactatgggcaacacttctatctttaacattcataaagactacattttctctccactatgcatggaaaactatggcaatggtgttatcaattgtaagtttatttccgctgtgtctatcgacaaccagtcagaaaacaacctggctaccagtattactaggttcattaggttgtaaacccttgacaatgtttctcatcgcggagaataaaatttggggacgaaaaagttggccccttaatgaaggaataatggcagtaggtatagtgtcgatccttctatcctcacttctaaagaatgacgttccattagcaggcccgttaattgcagggggtatgctaatagcgtgttacgtaataagtggttcttctgcagatctaagtctagaaaaagctgctgaagtatcctgggaggaagaagccgagcactctggtgcttcgcataacattttagtagaggttcaggacgatggtactatgaaaattaaagacgaagaaagagatgatactttaactatactcttgaaagccaccctactagcagtctctggagtttacccactttcgattcctgccactttattcgtctggtacttctggcagaaaaagaaacagaggtctggagtactttgggatacaccttcacctccagaggttgaaagggcagttctagacgacggaatttatagaatcatgcaaaggggtttactagggcggtcacaagtcggggtgggtgtctttcaagaaaacgtgttccatacaatgtggcatgtaacaagaggagccgtcttaatgtaccaaggtaaacgattagaaccgtcatgggcttctgtcaagaaagatttaatatcatacggtggtggatggaggcttcaaggtagttggaacacgggagaggaggttcaggtgatagccgtggaaccaggtaaaaaccccaaaaatgtacagacagcacctggcacgtttaaaacaagtgaaggggaagtgggagcaattgccctagattttaaaccaggcacatctggttcaccaattgtaaatagagaaggaaaaattgtgggtttatacggaaatggcgttgttacgactagcggaacatacgtttcagcgattgcacaagctaaagcaagccaagaaggaccgctaccagagatagaagatgaagtattccgaaaacggaatcttacaatcatggatctacaccctggaagcggtaaaactcggagatatctacctgccatagtgagagaagctattaaaaggaaattacgaactctaatattagcaccaacgagagtagttgcctcagaaatggcagaagcattgaaagggatgccaataaggtatcaaactacagcagtcaaatctgaacatacaggaaaggagatcgtggaccttatgtgccacgctactttcaccatgagattgctctcacctgtacgagtgcctaactacaacatgataataatggacgaagcgcatttcacagacccgtcgtctattgccgctcgtggatacattagcaccagagttggaatgggagaagcagcagccatatttatgacagcaaccccgccgggtagtgtagaagcattccctcagtcaaatgcagttatccaagatgaggagcgggatattcctgaaagaagctggaactcaggttacgaatggataacagacttccctggtaaaacagtgtggtttgttccatcaataaaaagcggcaacgacatagcaaactgtctcaggaagaacggtaaacgcgttattcaactctcaagaaaaacgtttgatacggaatatcaaaagactaagaacaacgactgggattatgtagtgaccacagatatatccgaaatgggtgcaaactttcgcgccgatcgtgtaattgacccacgccgatgtcttaaacccgtcatattaaaggatggtccagaacgagtaattctcgcaggaccaatgcccgttacagttgccagcgcagcacaacggagaggacggatagggaggaaccacaataaagagggggatcaatatatctacatgggtcaaccactaaacaacgacgaagatcatgcacattggactgaagctaagatgctacttgataatattaatacacctgagggcataatacctgccttattcgaaccggaacgagaaaagagcgctgcaatagacggagagtatcggctgagaggggaagcaaggaaaacatttgttgaattaatgaggcgaggagatttacccgtctggctatcatacaaagtagcatctgaaggttttcaatattcagatcgccgttggtgcttcgatggagagcgtaataaccaagttttggaagaaaatatggacgtagaaatatggactaaagaaggagagaggaagaaattaagaccaaggtggctggatgccaggacgtacagtgatcccttagcattacgggagtttaaagaatttgcagcagggcggaggagcgtatcaggcgacttaattttggaaatcggaaaactacctcaacaccttacacaaagggcacagaatgcactggataaccttgttatgcttcacaacagcgaacaaggtggaagggcttacaggcatgccatggaagaacttcctgatacgatagaaacgctaatgctactcgcgctaatagctgtacttacgggtggagtaactttattctttttgagtgggagaggcttaggaaaaactagcataggacttttatgtgtcatggcttcatccgtacttctatggatggcttctgtggaaccgcactggatcgctgctagtattattttggagtttttcttaatggtattattgattcctgaaccggatcgacaaagaacaccacaagataatcaactagcgtacgtagtaattgggttattgtttatgatactgacagttgccgcgaacgaaatgggactgttggaaaccaccaagaaagatctcggaatcggacacgtagcggttgaaaatcatcaccatgctgcaatgcttgatgttgatttacaccctgccagcgcttggaccctctacgctgtagcaactaccatcattactcctatgatgcgccacaccatagagaataccacggcgaatattagcctgactgctattgcaaatcaagcagccatcttaatgggtttagataagggctggccgatatcgaaaatggatataggtgtcccattgttagcactcggatgttactctcaagtaaacccattaactctgaccgctgccgtgctaatgctcgttgcacactatgcaatcattgggccaggtctacaagctaaggcgaccagagaggcacagaaaaggactgctgctggtataatgaaaaatccaacagtcgacggaattgtagctatcgatttagatccggtagtatatgacgcaaagtttgagaaacaattgggacaaataatgctgttgatcctctgtacatcacaaatccttctaatgcgcaccacatgggcactatgtgaatccataaccctagcaacagggccgctcacaacactctgggaaggttcacctggaaagttttggaatacaacaatcgctgtatcaatggcgaatatcttcagagggagttatcttgctggtgctggcttagcgttttctctaatgaaatcattagggggaggacgaagaggtacgggggcgcagggtgaaacattaggagagaagtggaagcgacaactaaatcaactctcaaagtctgaatttaatacatacaagcggtcaggaataatggaagttgaccgatcagaagcaaaggaaggattaaaaagaggagagacaacaaaacacgcagtaagtcgtggaactgcaaaattgagatggtttgtcgaacgcaatctggtgaaacctgaaggaaaagtaattgacttgggatgtgggcgaggtggttggagttactattgtgcaggtctgaagaaagttaccgaggtaaaaggatataccaagggaggcccgggccacgaagaaccaataccaatggcgacctatggctggaatctcgttaaattacattcaggtaaagatgttttctttattccaccagagaaatgcgatacgttactgtgcgacataggagaaagctcacctaatccgaccatagaagaaggaagaacactacgcgtgctgaaaatggtagaaccatggctacggggcaaccaattttgcataaagatactaaatccttatatgccttctgtagtagaaacgctcgaacagatgcagcgaaaacatggaggtatgctggtcagaaaccccctcagtagaaattctactcacgaaatgtattgggtaagttgcggaacaggaaacatagttagcgcagtcaatatgacttcaagaatgctgctaaacagatttacaatggctcatagaaagccaacatatgaaagagacgttgacttgggtgcgggaacgcgccatgtagcagttgagccagaagttgctaatctagatatcataggacaaaggatcgaaaacattaaacacgaacacaaatcaacatggcactacgacgaagacaatccatacaagacctgggcataccatggttcgtacgaagttaaaccaagcggatctgcatcatcaatggtaaatggagtagtcaaattattaacaaaaccgtgggacgtgataccaatggtaacgcaaatagcaatgactgataccaccccatttggtcaacagcgcgtttttaaagaaaaagtagacacacgtacgcctaaagcaaaacgaggcaccgcacaaattatggaagtaacagctaaatggctatggggatttttgtccagaaataagaaaccccgtatctgtacacgtgaagagttcaccagaaaagtaagatctaacgccgccattggagcagtgtttgtcgacgaaaaccagtggaacagtgcaaaggaagccgttgaagacgaacgcttttgggatttagtgcatagagagagagaactgcataaacagggcaaatgtgcaacgtgcgtctataatatgatgggaaaaagggagaagaaattaggtgagttcgggaaggcaaaagggtcccgggctatctggtacatgtggttaggagcaagatttcttgaatttgaggccttaggattcatgaatgaggatcattggtttagtcgcgaaaattcactgtcgggggtggaaggtgaaggattacataaactagggtacattctacgcgatataagcaaaataccaggtggaaatatgtacgcagacgataccgctggatgggacacgcggataaccgaagatgatttgcaaaatgaagccaaaataacagatataatggaacccgagcatgcgctattggcgaaatcaattttcaaactcacttatcagaataaagtagttagagtgcagcgtccggcgagaaatggcacagtaatggacgtaatatcacgacgcgaccaacgtgggtcaggacaagtaggcacttatggcttgaacacattcacaaacatggaagctcaactaataagacaaatggagtccgaaggtatattcagtccctcagaacttgaaacgccaaatctagccggtagggtgttagattggttagaaaaacacggggtggaacggctgaaacgaatggctattagtggtgatgattgtgtagtaaaacccatagacgaccgctttgcgacagctctgacagccctcaacgatatggggaaagttcgcaaagatataccccaatgggaaccatccaagggttggaatgattggcaacaggtaccattttgcagtcatcattttcatcagctaataatgaaggatggtcgagaaattgtagtaccctgcaggaaccaggatgaattggtgggccgagcacgtgtaagtcaaggtgctggttggtcattgagagagacagcatgtttaggaaagtcctatgcccagatgtggcaactcatgtatttccataggcgggatttgagattagcagcgaatgctatatgctcagccgtaccggtggattgggtaccaacaagtcgtacaacatggagcattcacgcacaccatcaatggatgacaacagaggatatgttgtcagtgtggaaccgagtatggatagaagaaaacccctggatggaagacaaaacacatatctctagttggggagatgtcccttacttaggcaaacgagaagatcaatggtgtggatctcttataggattaactgcgagggcgacatgggcaacaaacatacaagtagccataaaccaggtacgaagactgataggtaatgaaaattatctcgactatatgacatcaatgaagagattcaaaaatgaatcagaccccgaaggtgcactatggtaa

SEQ ID NO: 21631 - RNA, 9879 nt, synthetic construct
  misc_feature 1..9879: note = derived and/or modified CDS sequence (opt6) from DENV-1__FJ882539__SS-prME
  source 1..9879: mol_type = other RNA
tcagttacaatgctattaatgctaatgcctacagctctagcatttcatttaactactagagggggagaaccacatatgatcgttagtaaacaagaacggggaaaaagccttttattcaaaacatccgctggtgtgaacatgtgcaccttaatagcaatggatttaggagaattttgtgaagatactatgacatataaatgccccaggataacagaagcagaaccggatgatgttgattgttggtgtaacgcgacagacacttgggtcacgtatggaacttgtagccaaacaggggaacatcgtagggacaaaaggagcgtagcattagcaccgcatgtaggattaggattagaaacaagaaccgaaacttggatgagctctgaaggagcgtggaaacagattcagcgggttgaaacttgggcattacggcacccagggtttaccgtgatcgctttatttctggcacatgcaatcggaactagcataacccaaaaaggcatcatcttcattttgttgatgctagtaacgccgtctatggcaatgcgttgcgtcggcataggctcacgggattttgtagagggccttagcggagctacatgggtagatgtagtcttggaacatggatcctgtgttaccacaatggctaaagataaacccactcttgacattgaattgttaaaaactgaagtcactaatcctgccgtactaagaaaattatgcatagaagcaaaaatatctaatactacgaccgattcccgttgtccaacgcaaggtgaagcgacattagtcgaagaacaagatgccaattttgtttgccgtagaaccttcgtggatagagggtggggcaacggatgtggtttatttggcaaaggctcactgataacttgcgctaaattcaaatgcgtaacgaaactagagggaaaaactgtccaatacgaaaatcttaaatacagcgtcatagttacggtacacactggtgatcagcaccaggttggaaatgaatcgaccgagcatggtacgacggccactataacaccacaagcgccatccacggaaattcaattaacagactatggggcgctcacattagactgttcaccaagaaccggacttgacttcaatgaaatggttttgttaacgatgaaagaaaaatcttggttggtacataagcaatggttccttgatttaccgctaccttggacgtcaggtgctttggcctcacaggaaacttggaacagaaaagacttattggttacatttaaaactgcccacgcaaagaaacaagaggttgtcgtactaggatctcaagaaggagctatgcacacagcactgacgggtgcaacggaaatacaaacaagtggtaccaccacgatatttgcgggccatctaaaatgccgacttaaaatggataaattaacactaaaaggaatgtcatatgtgatgtgcacaggcagtttcaaattagaaaaagaggtagccgaaacacaacatggcacggtattagtccaaataaaatatgagggaacagatgccccttgcaagataccgttctcgacacaagacgaaaaaggcatcacacaaaacggaagattgataactgcaaaccccattgttacagacaaggagaaacctgttaatatagaagcggaaccaccgttcggcgaatcgtatattgttatcggcgcaggggaaaaagctcttaaactaagttggtttaagaaaggctcctctataggaaagatgttcgaagcaacggcgaggggagccagaagaatggccatacttggagatacagcatgggattttggttctattggtggcgtgtttacgtccgtagggaagttagtacatcagatattcggaacagcatacggtgtcctgtttagcggagtttcatggacgatgaagataggaataggagtgctcctaacatggttaggtttaaacagtaggtcaacttcactatctatgacctgcatcgcagtaggccttgttaccttatacctaggagtaatggtccaggcagattcaggttgcgtgatcaattggaagggaagggaactaaaatgtgggagtgggatattcgtaactaacgaggttcacacttggaccgagcaatataaatttcaagcagactcaccaaaacggctgagtgcggctataggaaaggcttgggaagaaggagtatgtggtataagaagtgcaacgagacttgaaaacataatgtggaaacagatatcgaacgagctaaatcatattttactagagaacgacatgaaattcacagtggtagtgggcgatgttgcaggcattctagcccaaggcaagaaaatgatacgaccacaaccaatggagtataaatacagttggaaatcatggggcaaagctaaaataatcggtgccgacgtacagaatactactttcataatcgacggcccaaacaccccagagtgtccagatgatcaacgagcctggaacatctgggaagtagaagattacgggtttggaatattcacaacgaatatatggctaaaactacgagacagttatacacaagtatgtgatcatagacttatgagtgcagcaataaaggattcgaaagctgtccatgctgacatgggttactggattgagagtgagaaaaatgagacttggaaactcgcgcgagccagcttcatagaagtaaaaacttgtatatggccgaagagtcatactttgtggagcaatggtgtattagagagtgaaatgattatcccaaagatatatgggggtcccataagtcaacacaatcacaggccgggatatttcactcagactgcaggtccatggcatttaggaaaattagagctcgacttcgacctctgtgaaggaaccacagtcgtagtagacgaacattgtggaaatagaggaccctccctaagaacaacaacagtcactggtaagattatacacgagtggtgttgccgatcatgcacattaccgcctttacgatttaagggcgaggatggttgctggtatggtatggaaattaggccagtgaaagagaaagaagaaaatcttgtcaaatctatggtttcagcaggatcaggggaagtagactcatttagtctaggattgttatgtattagtataatgatagaagaagtgatgagaagtagatggtcccgtaagatgttaatgacaggcaccttagccgttttctttctattaataatgggtcaactcacttggaatgacctaattcgactttgcattatggtaggcgcaaatgcgagcgacagaatgggtatgggaacaacatatttagccttgatggctacctttaaaatgcgccccatgtttgcagttggcttacttttcagaagattaacatccagggaagtattgttactgacaattggacttagcctcgtagcatctgttgagttgccaaatagcctagaagaattaggggacggcttggcaatgggaatcatgatactaaaacttttgactgactttcaaagccaccaactttgggccacgctcttgagtcttacttttatcaaaacaactttctcactacattatgcttggaagacaatggcgatggtgttaagtatcgtatcgctatttccattatgcctatctaccacatcgcaaaagactacatggttacccgtactgctcggcagtctaggatgtaaacctttaactatgtttctaatcgcggaaaataaaatttggggacggaaatcgtggccacttaacgaggggattatggcagtaggaatagtttcaatattacttagtagtctacttaaaaatgacgttcccctagcgggacctctaatagcgggtggcatgctaattgcttgttatgttattagtggaagctcagcagatttatcgttggaaaaggctgcagaggtttcatgggaggaagaagcggaacatagcggtgcatctcacaatattctcgtagaagtacaagatgatggtaccatgaaaataaaagacgaggaaagggacgatactctaacaatcttgttaaaggcaactctcttggcagtgtcaggagtataccctctttccataccagcaacgctttttgtatggtatttttggcagaaaaagaaacagaggagcggtgtactttgggatacaccaagcccgccagaagtagaaagggcggtgttagatgatggcatctatagaatcatgcaaagaggccttttaggccgttcacaagtgggcgtaggagtattccaagaaaatgtgttccatactatgtggcatgtaactcggggtgctgtactaatgtaccaaggaaaaagacttgaaccatcatgggcgagtgttaagaaagacttaatttcgtatggcggaggttggagactacaaggatcatggaacacaggagaagaagtacaagtgatagccgtcgagcccggtaaaaatccgaagaatgtacaaacagctcccggtacattcaaaacatctgaaggggaagttggcgctatagcgttggatttcaagccgggaaccagcggatctcctattgtgaacagggaaggaaagatagtaggtctatatggaaacggtgtagttacaaccagtggtacatacgtaagtgctatagcgcaagccaaagcctcccaagaaggcccgttaccagagatagaagatgaagttttcagaaaacgaaatctaaccataatggatttacacccaggttccggaaaaacaagacgatacctacccgctattgtgagggaggctattaaacgtaaattacggacactgatcttggcaccaaccagagtggtggcatcagaaatggcagaagcattaaagggaatgcctataagatatcaaaccacagcagtcaaatcggagcatacaggaaaggagattgtggatctaatgtgccatgcaacattcacaatgagattacttagcccggttagagttccaaactacaacatgataataatggacgaagctcactttaccgatcctagttcaattgcagcaaggggatatataagtactagggtaggcatgggagaagccgcagctatattcatgacagcaactccgcccggttccgtagaagcattcccacagtcgaatgcggttatacaagacgaggaaagagatatcccggaacgcagttggaatagtggctacgaatggataaccgattttcccggtaaaacagtttggtttgttccaagtattaagtcgggaaatgacatagcgaattgtttacgcaagaacgggaagcgagtaatacaattatcaagaaaaacgttcgatactgagtaccagaaaaccaaaaacaacgactgggattatgtagtaacaaccgatatatcagaaatgggagctaatttccgagcggatagagtcatagatccgagacgatgtttgaaaccagtaattctcaaggacggtcctgagcgggtcattttagcaggtccaatgccagttacggttgcaagcgcagcacaacgacgggggcgcataggtcgaaaccacaataaggaaggagatcaatatatatacatgggccaaccgctaaacaacgacgaggaccacgcacattggactgaggccaaaatgcttttagataatataaacacacctgaaggaataatccccgcactcttcgaaccagagagagagaaatccgccgcgatagatggagaatatagattacgaggcgaagcccgaaaaacattcgtagaactaatgcgacggggcgaccttccagtttggttatcatataaggttgcttcagaagggttccagtactcggatcgcagatggtgttttgatggagaacgaaataaccaggttctagaagaaaatatggatgtggaaatatggacgaaagaaggtgaaagaaagaaattgcgaccgaggtggcttgacgcacgaacttatagcgatccactcgcactacgcgagttcaaagagttcgcagcagggagaagaagtgtgagcggggacttaattctcgagataggtaaacttccacaacatctaacgcaacgagcccagaatgcgctagacaatctagttatgttacataacagcgagcaaggtggcagagcgtaccgacatgccatggaagaattaccagatacgattgaaacccttatgctccttgcacttatagctgttttaacaggcggtgtaacgcttttcttcttgtcgggcagaggactcggtaaaacatctattggtctactttgtgttatggcatcgtcggttctactatggatggcgagcgtagaaccccattggattgctgctagtatcatattagagttcttcctaatggtcttattaataccggagcctgatcgacaaagaaccccacaagacaatcaattggcatatgtagtaatagggctattgtttatgattcttacagtagctgccaatgagatgggacttttggagactactaagaaagatttagggataggacatgttgcagtggaaaaccatcatcacgcagcgatgctagacgtagacttacatcctgcatcagcctggaccttgtatgcggtcgctaccacaattatcacgcccatgatgcgtcatacgatcgaaaatacaactgcaaatatttcgttaacagccatagcaaatcaggcagctatattaatggggttggataaaggttggccaattagtaaaatggatattggagtacccttattagcgcttggctgctattcccaagtcaaccctttaaccctaaccgcggccgttttaatgctcgttgcacactacgcgattataggtccaggtttgcaagcgaaagctacgcgagaagctcaaaaacgtaccgccgccggtattatgaaaaacccgaccgtagacggcatcgtagccatagacctagacccagtagtatatgatgcaaaattcgaaaaacaattaggacaaataatgctattaatattatgcacatcacagattctattgatgagaactacgtgggccctctgtgaaagtataaccctagctactggaccgttgactaccttgtgggaaggtagcccaggtaaattttggaacacgacgattgcagtttctatggccaacatttttcgaggctcatatctagcgggagcaggcctagcttttagcctaatgaaatccttaggaggcggcagacgtggcacaggagcgcaaggggaaacactgggagaaaaatggaaacgtcagctaaatcaactgagtaaatcggagtttaatacgtataaaaggtcgggaataatggaggtagacagatctgaagcaaaagaagggctaaaaaggggtgaaacaacaaaacatgcagtatcacgtggaacagctaaattaagatggtttgtggaacgaaatcttgtaaaacctgaaggtaaagtgatagatctcggatgcggtcgagggggctggagctactactgcgcgggactaaagaaagtaacagaagtaaaaggatacacaaagggagggccggggcatgaggaaccaattcccatggcaacctatggatggaatcttgtaaaactgcacagcggcaaagacgtgtttttcataccacctgagaaatgcgacactcttctatgtgatataggtgaaagctctccaaatcccactatcgaggaaggaagaacattaagggtattgaaaatggtagaaccttggctacgaggaaatcaattctgtattaaaatattaaatccatacatgcccagcgttgttgaaacactagaacagatgcagagaaaacacggaggcatgttagtccggaacccattgagtcgaaattcaactcacgagatgtactgggtttcgtgtggaacaggaaacattgtgtctgccgtgaacatgacgtcgaggatgctgttaaaccggttcacaatggcacatcgtaaacccacatatgaaagagatgtagatctaggagctgggactcgccatgtcgcagtggaaccagaagttgcaaacttggatataattggacaacgcattgagaatataaaacatgagcataagtctacttggcattatgacgaggacaatccatataaaacatgggcctaccatggatcctacgaagtaaagcccagtggcagcgcgagctctatggtgaacggagtcgtcaaattactaaccaagccatgggatgtgataccaatggtaacacaaatagcaatgacagatactacaccattcggacaacaacgtgtttttaaagagaaagttgataccagaacaccaaaagcaaaaagagggacagcacaaattatggaagttacagcaaaatggctgtggggatttttaagtagaaataagaagccacgaatttgtacaagagaagaatttacacgcaaagtccgatcaaacgcagcaataggggctgtctttgttgatgaaaatcaatggaactcagcgaaggaagcagtagaggatgaaagattttgggatctagtgcacagagagcgtgagttacataaacagggaaagtgtgccacttgcgtgtataacatgatgggcaaacgagagaagaaacttggagaatttggaaaagcaaagggaagccgggcaatatggtatatgtggttgggagcaagatttttagagttcgaagcgcttggtttcatgaatgaagatcactggttcagtagagaaaacagcttgtcaggtgtggagggagagggtttgcacaaattgggttatattttgagagacatcagtaaaataccaggcggtaatatgtacgccgatgacacagctggatgggacacacgcattactgaagacgaccttcaaaatgaagctaaaataactgatattatggagcctgaacatgcattattagctaagagcattttcaagctcacctaccaaaataaggtcgttagagtccaaagacccgcaaagaatggcacggtcatggacgtaatatctagaagagaccagagggggagcgggcaggtaggaacatatggcttgaatacctttactaacatggaagcacaactcatacgacaaatggaatcggaaggaatatttagtccatcagaattggaaacacctaatcttgcgggaagagtattagactggcttgaaaaacacggcgtggaacgtttaaagcgcatggctatatcgggtgacgattgcgttgttaagcccatagacgacaggttcgctactgcattgacagccttaaatgatatgggtaaagttagaaaagacatcccccagtgggaaccgtctaaaggatggaacgattggcaacaagtccctttctgcagccatcactttcaccaactaattatgaaggatggcagagagatagtcgtgccatgccgcaaccaagatgaattggtaggacgagcaagggtgtcgcagggagctggatggtcccttagggagacagcttgcttaggaaaatcatacgcgcagatgtggcaattaatgtattttcatcgcagagatttacgattagcggcgaatgctatttgtagtgctgtacctgtagactgggttccaacgagcagaacaacatggagcattcacgcacatcaccaatggatgacaacagaagatatgctatccgtatggaaccgagtgtggatcgaagaaaatccttggatggaagacaaaactcatatatcaagctggggtgatgtaccctatttagggaaacgtgaagatcaatggtgtggaagtctgataggattgacggcacgagctacgtgggcaactaatatacaagtggcaataaatcaagtgagacgattaatcggaaatgaaaactatttagactacatgacaagtatgaagcgattcaaaaatgagtctgatcctgagggtgccctctggtaa

SEQ ID NO: 21632 - RNA, 9879 nt, synthetic construct
  misc_feature 1..9879: note = derived and/or modified CDS sequence (opt6) from DENV-1__FJ882541__SS-prME
  source 1..9879: mol_type = other RNA
agtgttactatgttactaatgttaatcccaacggcgttggcttttcaccttacgacacgtggaggagaacctcatatgatcgtctctaaacaagaaagaggcaaaagcctactttttaaaacctcagccggtgtaaatatgtgcacgttaattgcaatggatctcggggaactgtgcgaagatactatgacctataaatgtccacgaatcacagaagttgaaccagatgacgttgactgctggtgtaatacgacagacacatgggtaacatatggcacctgtagccaaacgggtgaacatcgtagagacaaacggtctgtagccctagcaccgcatgtgggattaggtcttgaaacccgtgccgaaacgtggatgtccagtgagggtgcgtggaaacaaatacaaaaagtggaaacctgggcacttcgccaccccggtttcactgtaatagcgctatttttagcacacgcgataggtacaagtatcacccaaaaaggaattatttttatattattaatgcttgtcacacccagcatggctatgcgttgcgtgggaattggctctagagactttgttgaaggtctgagcggagcaacttgggtagatgtagtcttagaacatggcagttgcgtaacaacaatggctaaagataaaccaacacttgatatagagttactcaaaactgaagttactaacccagctgtcctccgaaaactatgtatcgaagcaaaaatatctaacacgacaactgattccagatgcccaactcaaggagaagcaacattagtggaggaacaagacgcaaacttcgtttgtagaagaaccttcgtagatagaggttggggcaacggttgcggattatttggtaaaggatccctaataacatgcgctaaattcaaatgtgtaacaaaattggaaggaaagatagtacaatatgagaacttaaaatattcagttatagtaacagttcacacaggagatcaacatcaagtcggtaacgaatcaaccgagcacggaacgaccgctacgataacaccacaagcgccaacctcagaaattcaattgaccgactatggagcacttactttggattgttctcctagaacgggactagattttaacgagatggtactgctaacaatgaaaggaaaaagttggctagtgcataagcaatggtttttagacttaccgttaccttggacgtcaggcgcaagcactagccaagaaacatggaaccggcaagacctattagtaacttttaaaaccgcacacgccaagaaacaagaagtagtcgttctaggatcacaagaaggtgcaatgcacacagcattaacaggggcaacggaaatacaaacatccggtacaacgacaattttcgcagggcatttaaaatgtagattaaaaatggataagttaacgctaaaaggaatgagttacgtcatgtgtacaggcagtttcaaactagaaaaagaggtggctgaaacccaacatggaacggttctcgtacaaattaaatatgaagggacagacgcgccctgcaagataccgtttagtacccaggatgagaaaggcgttacacaaaatggtagacttatcacagcaaacccaattgttactgataaggaaaaaccagtgaatatagaggccgaacctccttttggtgaaagttatatagtaattggcgctggagaaaaagcactgaaactgagctggtttaagaaaggctctagcataggaaaaatgttcgaagcaacagctagaggtgcaagaagaatggcaatactcggggatactgcctgggatttcggcagtataggaggggtattcacatcggtggggaaacttgtacatcaaatatttggaactgcttacggtgtcttgtttagtggcgtaagttggactatgaagattggaatcggagtgttactaacttggctaggactaaactcacgttcaaccagcctgtctatgacttgtattgcagtaggccttgtaactctatatctcggcgttatggtacaagccgactctggttgcgtaataaattggaaaggtcgagagctaaaatgtggctcaggtatttttgttacaaacgaagtacacacatggacagaacagtataaatttcaggccgattctccaaagagattgtctgcagccattggcaaggcttgggaggaaggagtatgtggaatacgtagtgcaactaggctagaaaatataatgtggagacagatatccaatgaactaaaccatatcctattagaaaatgatatgaaatttacagtagtagtaggagatgtagtaggaatattagctcaaggtaagaaaatgatcagaccacaaccaatggagcataaatactcttggaaaagttggggcaaggctaagataataggagctgacgtccagaatactacttttataatagatggaccaaacactccggaatgcccggatgaccagagggcatggaacatttgggaagtggaagactacggttttgggatctttacaactaacatatggttaaaactccgagactcttatacccaagtatgtgaccacagactaatgtccgcagctataaaggatagtaaagcggtacacgctgatatgggatattggatagagtctgagaaaaatgaaacgtggaagttagccagagcttcattcattgaagtcaagacatgcatatggccaaaaagtcatacattgtggagtaatggcgtcctagagtcagagatgataataccaaagatatatggaggaccgatttcacaacataactatcgaccaggatattttacacagaccgcaggaccatggcatctaggtaaattggaattagactttgacctatgtgagggtaccacggtagtggtagatgaacattgtggcaacagaggaccttcactacggacaactacggttacaggcaagatcatacacgagtggtgttgtcgaagttgcacacttcccccattacgattcaaaggagaagatggttgctggtatggtatggagattaggccagtaaaggagaaagaagagaacctcgttaagtcaatggtgtcagccgggtcgggcgaagtagatagcttttctctcggattattgtgtatcagtataatgattgaagaagtgatgcgttctagatggtctcgaaaaatgctaatgactgggaccttggcagtgttctttctattaattatgggtcaattaacctggaatgacttaatcagatcttgtattatggtgggtgcgaatgcatcggacaggatgggaatgggaacaacttacttagccttaatggcaacttttaaaatgcgaccgatgttcgcagtgggactattattcagaagattaacctcacgggaggtactactactaaccataggactgagtttagtcgcttcagttgaattgccaaatagtcttgaggaattaggcgatggcttagctatgggaatcatgatacttaaactattgaccgattttcaatcataccaattatgggcaaccctattgagcctcacattcattaaaacaacttttagcttgcactatgcgtggaaaaccatggccatggtcctgtccattgtgtctctactaccactttgcctatctacaactagccagaaaaccacatggttgccagtgctactgggttcccttggttgcaaacctctgactatgtttttgatcgcagaaaacaaaatatggggtagaaaatcatggccactgaatgagggtataatggctgtcggaatcgtgtccattctactgtcttctctgctgaagaatgacgtaccactagccggtccacttatagcaggcggaatgttgatagcctgctatgtcatatctgggagctcggctgacttatcactagaaaaagctgcagaagtgtcatgggaggaagaagcggaacacagcggggcgtctcataacatattagtagaggtacaggacgacggcactatgaaaataaaagatgaagaaagagatgacactctaacgatactattaaaagcaacgttattggctgtttcaggggtttatccgctctcgatacctgcgacattatttgtatggtatttttggcagaagaagaaacaaagaagtggagtattatgggatacaccttcgcctcctgaagtcgaacgtgctgtgctagatgatggaatttatagaataatgcaaagaggcttactagggaggagtcaagtaggtgtgggagtctttcaagaaaatgtttttcatacaatgtggcacgttacacgaggtgcagtgctcatgtatcaaggcaaacgtttggaaccctcatgggcttctgttaagaaagatttaataagttatgggggaggatggcgtctgcaaggatcatggaatacgggggaagaagtccaggttatagcagtagaaccaggcaaaaaccctaaaaatgttcaaactgcaccaggcaccttcaagacgcctgagggggaagtgggcgctatcgcactcgattttaagcccggtacgtctggctctccaatcgtaaatcgagagggcaagatagttgggctctatggtaatggcgttgtgactacatcaggaacgtacgtcagtgcgatagctcaagctaaggcaagtcaggaaggtcctttacctgagatcgaagacgaagtatttagaaagcggaatctgacgattatggacttgcatccaggttctggcaaaacacgaagatatttgccagcaattgtacgagaagcaataaagagaaaactacgcacattgatcttggccccaacacgggttgtagcttcagaaatggcagaagccctaaagggaatgccgataaggtaccaaacaacagcagtcaaatcagagcacacgggaagagagatagtagatttaatgtgccatgctacatttactatgcgactgctttccccggtcagagtaccaaattataacatgattatcatggacgaagcacactttaccgacccctctagtattgctgctcggggttatatcagcactcgagtaggcatgggagaagctgcagctatctttatgacggcaaccccacccggatcagtcgaagcatttccgcaaagtaacgctgtgattcaagacgaagaacgagatattccggaacgatcgtggaatagcggctacgaatggataactgatttccccggaaaaacagtgtggtttgtgccaagtataaaaagcggaaacgacatagcaaactgcttgaggaaaaatggaaaaagggtgattcaattaagccgcaagacattcgatacagagtaccagaaaactaaaaataacgattgggactatgtagtgacgacagatatatctgaaatgggagccaacttcagggctgatcgagtaatagatccgagaaggtgtttgaagcctgtcatcttaaaggatggaccagaacgagttatcttagcaggaccgatgccagttacagttgcgtccgccgctcaaagacgaggtagaataggcagaaatcacaacaaggaaggggaccaatatatttacatgggacaaccgttaaataatgatgaagatcacgcacattggactgaagctaaaatgttacttgacaacataaacacaccagaaggaatcataccagctctatttgaaccagaacgcgagaaaagtgctgcaatagatggagaatatagattacgaggagaagctagaaagacgtttgttgaactcatgagacgaggggaccttccggtctggcttagctacaaagtggcttcagaaggttttcaatattcagatcgacgttggtgctttgatggtgaacgtaataatcaagtactagaggaaaatatggacgtcgaaatatggacaaaggaaggagagaggaagaaattacgaccaagatggttagacgcacggacttattcagatccacttgcacttagagaatttaaggaatttgccgcggggaggcgtagtgtttctggggatctgatattagagataggcaaactcccgcaacacttaacccagagagctcagaacgcattagataatttagtcatgctacacaacagtgagcaaggtgggagggcatatcgccacgccatggaagaactacctgacacgatagaaacgttgatgctattagcactcatagcagtattaactggcggagttacgttgttctttttatcgggcaggggcctaggaaaaacatctattggcttgttatgcgtaatggcatctagcgctctattgtggatggcaagtgtagagccacactggatagctgcaagcatcatattggaatttttcctaatggtcttgctcatcccagaacccgaccgccaaaggactccacaagacaatcagttagcatatgtggtgattggactattattcatgatactcactgtggctgcgaatgaaatggggctgctcgaaactacgaagaaagatcttggaataggacatgtggcagtagaaaaccaccaccatgcgacgatgttggacgtggatttacacccggcgtcggcctggactctctacgctgtagcaacaactattataacgccaatgatgaggcatactatcgagaacacaacagcgaacatttcgctgaccgccattgcgaaccaagctgcaattttaatgggccttgataagggctggcccatttcaaaaatggatataggagtacctttgttagctttagggtgttactctcaagttaatccacttaccttaacagccgcagtgttaatgttagtagctcattacgcaattatcggacccggtttacaagcgaaagctactagagaagctcaaaagcgtactgcggccggtataatgaagaatccaacagtcgacgggattgtagcaatagatttagatcctgtagtctacgacgcaaaatttgagaagcaattaggacaaattatgctattaatactttgcacctcacagatactcttaatgcgtacgacctgggctttatgtgaatcaataacactggcgacgggaccactgactaccttgtgggaaggatcccccggaaagttttggaacaccacaatagcagtatcaatggcaaacatttttcgaggatcttatctagctggggccggcttggcgtttagtttaatgaaatctctaggagggggacgaagaggaacaggcgcacaaggagaaacactaggcgaaaagtggaaacggcaacttaaccagttaagtaaaagtgaatttaacacttacaaaaggagtggaataatggaagttgatcgttcagaagcaaaagaaggccttaggcgcggagaaacaacaaaacacgcggtgagtagagggacggctaaactccgctggtttgtagaaagaaatctcgtcaaaccggaaggcaaagttattgacttgggttgtggaagagggggttggagctactattgtgcgggactcaagaaagttactgaagttaaaggttataccaaaggtggtccgggacatgaagaacccatacccatggccacttatggatggaacctcgtaaagctccattctggaaaggacgtatttttcatacctcctgaaaaatgtgatactttgttatgcgatattggagaatcatccccaaacccaactatagaagaaggaaggaccctcagagtcctgaagatggtggaaccttggttacggggtaaccaattttgtattaaaatattgaacccatatatgccatcagttgtcgaaaccctagaacaaatgcaaagaaaacatggtggcatgctagtcagaaacccgctttccaggaatagcacacatgaaatgtactgggtcagttgtggtactggaaacatagtatctgcagttaatatgacgagtcggatgttactaaacaggttcactatggcccacagaaaaccaacctacgagagggacgtggatcttggggcaggtacgcgtcacgttgcagtcgaacctgaagtagcaaatttagacataataggtcaaagaatagaaaatattaagcatgaacataaatcaacgtggcactatgacgaagataatccgtataaaacatgggcttaccatggatcatacgaagtaaaaccatctggctcagcatcatcaatggtcaatggagtcgtaaagttattgactaagccttgggacgttatcccaatggtcacccaaattgcaatgactgacacgactccattcggtcaacagagagtctttaaagagaaggtagatactaggacaccgaaggcaaaaaggggcacagcccaaattatggaagtaacagcaagatggttatggggcttcctatcaagaaacaaaaagccacgcatatgtacaagagaagaatttacaagaaaagtacgaagcaacgcagccataggagcagtatttgtagatgagaaccagtggaactctgccaaggaagcggtagaagacgaaagattctgggatttggttcatcgggagagggagttacataaacaaggtaaatgtgcgacctgtgtttataacatgatgggtaaacgggaaaagaagttgggtgagtttggtaaggcgaaaggctcgcgggccatatggtacatgtggcttggggcaagattcttggaatttgaagcgctagggtttatgaacgaagatcactggttctcaagggaaaattccctctctggggtcgaaggcgagggattacacaaactaggctacatcctacgagatataagtaaaatacctggtggtaatatgtatgctgatgacactgcaggttgggatactcggataacggaagatgatctacaaaacgaagcaaagataactgacataatggagccagaacacgcgttgttggcgacgagtatattcaaactaacttatcaaaacaaagtagttagagttcaaagacctgctagaaatgggactgttatggacgtaattagtagaagagatcagcgagggtcaggtcaagttggaacatatggacttaacactttcactaacatggaagcacaactaatacgccagatggaaagtgaaggtatatttagtccctctgaattagaaactcctaatttagcagaacgagtacttgattggctagagaagcatggagtagagcgactaaaaagaatggcaatatctggagatgactgcgtcgtgaaacccattgacgaccgattcgcgacggcgttatcggcgttaaatgatatggggaaagtacggaaggacataccgcagtgggaaccttcaaagggatggaatgattggcaacaagttcccttttgctcacatcattttcatcaactaataatgaaagatgggagagagatagtggtaccatgtagaaatcaagatgagctagtgggaagggctagagtgtcacaaggggcaggatggtcccttagagaaacagcctgtcttggtaaatcctacgcccaaatgtggcaacttatgtactttcataggagggacttgagactagcagctaatgctatatgcagtgcggtcccagttgattgggtccccaccagtagaacaacttggtctattcatgctcatcaccaatggatgacaacggaagatatgctcagtgtctggaatcgagtctggatcgaagagaatccttggatggaggacaaaacgcacataagctcttggggagatgtcccttacctcggaaaaagagaagaccaatggtgtggtagtttaataggtttgactgcacgggccacatgggcaactaatatccaagtagcaatcaatcaagttcgcaggctcattggaaacgagaactacctagactatatgacctctatgaagagatttaaaaatgaaagtgacccggaaggagccttatggtaa

SEQ ID NO: 21633 - RNA, 9879 nt, synthetic construct
  misc_feature 1..9879: note = derived and/or modified CDS sequence (opt6) from DENV-1__FJ882542__SS-prME
  source 1..9879: mol_type = other RNA
tctgtaactatgttactcatgcttatgccaacagctctggcatttcatctcacaaccaggggaggtgaaccgcacatgatcgttacaaaacaagaaagaggaaaatccttgttgtttaaaacttcagctggtgttaatatgtgtacattgatagccatggacttaggcgaattatgtgaagatactatgacgtacaaatgcccgagaattacagaagccgaacccgacgatgtggattgttggtgtaacgcaaccgatacttgggtaacgtatggtacatgttcacaaacaggagaacacaggcgagataaacgatctgtagcacttgcaccccatgtgggattaggactagaaactcgaaccgaaacatggatgagcagtgaaggagcatggaaacaaatacaacgagtagaaacctgggctttgcgacatcccggattcaccgtcatagcactatttcttgcccatgctatcggcacatcaattactcaaaaaggtataatctttatcctattaatgctagtgaccccatcaatggcaatgcgatgcgtaggtattgggtcacgagactttgtagaaggactcagtggcgccacttgggtcgacgtcgttttagaacatggtagttgtgtaaccactatggcaaaagataaaccaacattagatatagaattgctaaaaaccgaggtaacgaaccccgcggtacttcgaaaattatgtatcgaagccaaaatcagcaatacaacaactgatagtcgttgtccaacccaaggagaggctaccctaatggaagaacaagatgcaaattttgtatgcagacgtacctttgtcgaccgcggatggggaaatgggtgtggcttatttgggaaaggatccctaataacatgcgccaaattcaaatgtgtgacgaaactagaaggaaaaatagtccaatatgaaaatcttaagtacagtgtgattgttacagtacacaccggagatcaacaccaagttgggaatgaatctaccgaacatggaactactgcaacgataaccccacaagcacctacttcagaaatccaattaacagattacggtgccttaacgttagactgtagcccacgtactgggttggatttcaatgaaatggtcctattaaccatgaaggagaaaagctggctagtccacaaacaatggttcttagatctgccactaccttggacatcaggagcttcaacctcccaagaaacatggaatagacaagacctattagttacattcaaaactgcccatgctaagaaacaagaggtagtagtccttggatcacaggaaggagctatgcatacggcacttactggagccactgagatacagacttcaggtacaactactatatttgcaggtcacttgaagtgcagattaaaaatggacaaacttactttgaaaggtatgtcgtacgtaatgtgtactggatcatttaagctagaaaaagaagttgctgaaacccagcatggtacagtccttgttcaaataaaatacgaaggcactgatgcaccatgtaaaattccctttagtacacaagacgaaaaaggcgttacacagaacggaaggttaataacagctaacccaatagtaactgataaagaaaaacccgtaaatatcgaagcagaacccccttttggggaaagctatatcgtaataggcgccggcgaaaaagcactaaaactttcctggttcaagaaaggaagctctataggcaaaatgttcgaagcgaccgcaagaggtgctagacgaatggcaatactgggggataccgcatgggattttggtagtgttggaggtgtatttacaagtgttggtaaattagtacatcagatctttggaacagcatatggagtattattttctggcgtaagttggaccatgaaaataggcattggagttctattaacatggctgggattgaactccagaagtacaagtctctcgatgacttgtattgcggttggattagtcaccttgtatctaggtgtaatggtacaagctgactcaggctgtgttataaattggaaagggcgcgaactcaagtgcggctctgggattttcgtaacaaatgaagtacatacctggaccgagcaatacaagtttcaagcggatagtcctaagcgattaagtgcagcaataggtaaagcatgggaagaaggagtatgtggcatccgctcagctactcgcttagaaaacatcatgtggaagcaaatttcaaatgaactcaatcatatcctactagagaacgacatgaaattcaccgtggttgtgggagatgtagtgggaatactagcccaaggaaagaagatgatacgtccacaacctatggaacataaatattcttggaaatcatggggaaaggccaaaattataggcgcggatgttcagaacaccacgttcatcatagatggaccatctacgccagaatgcccagatgatcaacgtgcctggaacatatgggaagtggaggactacggtttcgggatctttacaactaatatatggttaaaacttcgtgattcctatactcaagtatgtgatcacagactgatgagtgcagcaataaaggacagtaaagcagtccatgcagatatgggatactggatcgagtcggagaaaaacgagacgtggaaactcgctcgcgcgagttttatagaagtgaaaacgtgcatttggccgaaatctcacacattatggagcaacggagtactagaaagcgaaatgattataccaaaaatttatggaggacccattagtcaacacaactatcgaccaggttacttcacgcaaactgctggtccatggcacttaggaaaacttgaacttgattttgacttgtgtgagggaactacagtggtagttgacgaacactgcggcaatcgaggaccaagtctgagaaccacaaccgttacggggaaaatcatacatgaatggtgctgtcgatcatgtacgctaccacctttgaggtttaaaggagaagatgggtgttggtacggaatggaaataagaccggttaaggaaaaagaagaaaatcttgtgaaatccatggtctcagctggatcaggagaagtcgattcattttctttaggactattgtgcattagtataatgatagaagaagtaatgaggtctaggtggtcacgaaaaatgttgatgacaggcacactggccgtatttctattactcataatgggacaattaacttggaatgatttaatcagattatgcataatggttggcgcgaatgcgtcagacagaatgggtatgggcacaacgtatttagcgttgatggccacattcaaaatgagacctatgtttgcggttggactattatttcgacgtttaacatctcgagaagtcctattattaactataggactttctttggtagcgtccgtagaacttcctaactcgctggaagaactaggtgacgggctagcaatgggaataatgatactcaagttattaaccgactttcagagtcaccaattatgggcaacgctactatccctcacattcatcaagacaactctgtcacttcattatgcatggaaaactatggctatggttctgtccatcgcttcattattccctttatgcctatccacaacaagccagaaaacgacatggttaccagttttattaggcagtctagggtgcaagcctctaactatgtttttgattacagaaacaaagatatgggggcgtaaatcttggcctttaaacgaaggtattatggcagttggggttgtgtccatcctgcttagctcactccttaaaaatgacgtaccactagctggtcccttaatagctggtgggatgctaatagcatgttatgtcattagcggtagttcggcagatctctctttggagaaagcggcagaagttagttgggaagaagaggcagaacactcaggagcatcgcataatatccttgtggtagtacaggatgatgggactatgaaaataaaggatgaagaacgagatgatacgttgaccatattgctaaaagctacattgctagctgtttccggggtatatccactttcaatacccgcaacattattcgtttggtacttctggcagaaaaagaagcagcgaagcggcgtactctgggatacgcctagtccaccggaagtggaaagggcagtccttgatgacgggatttacagaatcatgcagcgaggtctcttaggaagaagtcaggtgggcgttggagtatttcaagaaaacgtttttcacaccatgtggcatgtaacccgtggtgcagttctaatgtatcagggcaaaagattggagccttcatgggcatcagtcaagaaagatttgataagctatggtggtggctggagattacaaggctcttggaacacaggagaagaagtacaagtaatcgccgtagaaccagggaaaaaccccaagaatgtacaaacagcacctggcacttttaaaaccccagaaggggaagttggagccatagccttagacttcaaaccaggcactagcggaagtcctatagtgaacagggagggaaagatcgttgggttgtatggaaacggtgtagtcaccacaagtggtacgtacgtgtcagcgatcgcgcaagcgaaggcttcccaagaaggaccactaccagaaattgaggacgaagtatttagaaaaaggaacttgacaattatggacctccatcccgggtcaggaaagacaagacgatatttgcctgcaatcgtgcgtgaggcgataaaacgaaaattgagaaccctgattctagcgccaacacgtgtcgtcgcaagcgaaatggcagaagcacttaaaggaatgcccatacgatatcagacaaccgcggtaaaatctgaacataccggcaaggaaatagtagatttaatgtgtcatgctacatttactatgaggctactgtcgccagtgcgtgttccgaactataatatgataatcatggatgaagcacattttacagacccgagcagcatagcggctcgaggatacatatcaacaagagtgggaatgggagaagctgctgcgatttttatgacagcgactccccctggatcagtagaagcattccctcaatccaacgctgtaatacaagacgaagaacgtgatataccagagagatcttggaacagtgggtacgagtggataactgacttccccggcaaaacggtatggttcgtcccgagcattaaatctggtaatgatattgccaactgtctacgaaagaacggaaagagagttatacaattatccaggaagacatttgacacagaatatcagaagactaaaaataacgactgggattacgtggttactacagatatttcagagatgggcgcaaattttagggcagaccgagttatagacccccgaagatgccttaaaccagtaattctcaaggacggtcctgaacgtgtaatattagccggtcccatgccagtaacagtagcatcagcagctcagcgtcgagggagaatagggcgtaaccataataaagaaggagatcaatacatttatatggggcaacctttaaataacgatgaagatcacgcccattggacggaagctaaaatgctgttagataacataaacacccctgaaggaataataccagcattatttgaacctgaacgagaaaaatctgcggccatagatggtgaatatcgcctcagaggagaggcaagaaagacttttgttgaacttatgagaagaggagacctaccagtttggctgagctataaagtcgcctcagagggttttcagtatagtgacagacgttggtgttttgatggagaacgcaataaccaagtattagaagaaaacatggacgtcgagatatggacaaaagaaggagaaaggaagaaattacgaccacggtggctagacgcaaggacctactcagacccgctagccctacgtgaatttaaagaatttgcagctggaagaagatctgtcagtggtgatctgatattagagatcggtaagttaccacaacatcttacgcagcgagcacaaaatgctctggacaacttagttatgttacataatagtgaacagggaggcagagcataccgtcatgcaatggaggaactacctgatacaattgaaacactcatgttattagccttgatcgccgtactaactggtggaatgactctattctttttaagtggccgtggacttggtaagacatcaatcggattattatgcgtcatggcatcttctgttttactttggatggcatcggtagagccgcattggattgcagcatcaataatactcgagttctttcttatggtattactgattccagaaccggatcgccaaagaacacctcaggataatcaactggcatacgtcgttataggtttactattcatgattctcacagtcgctgccaatgaaatgggcctgttagaaacaacgaagaaagacctcggcatagggcatgttgctgtagaaaatcatcatcatgctactatgttagacgtggatctacatcccgcgagtgcgtggacactatatgccgtcgcaacaactataataaccccaatgatgcgccatacaatcgaaaacacaaccgcgaacatttctcttactgcaatagcaaatcaggcggctatattgatgggcttagacaaaggttggcctatttcgaagatggatataggtgttccgttactagctctaggatgctatagccaagtgaaccccttgactctaacagctgctgtactgatgttagtagctcactatgcgataattggcccaggactgcaggcaaaagccacacgagaagcccagaaaagaaccgcagcaggaataatgaaaaatccaacagtagatggcattgtagcaatagacttagatccagtcgtttatgatgcaaagttcgagaagcagcttggtcagataatgttactgatattatgcacttcgcaaatcctattaatgcgcacgacatgggcactatgtgaatcaattacgttagcaactggtccattaacaacgctatgggaaggttccccaggtaaattttggaatacgactatagcagtgagtatggcaaatattttcagggggtcataccttgcgggagctggactagccttttcgttaatgaagagtttgggaggaggacgaaggggtaccggggcgcagggagaaacattaggagaaaaatggaagagacagctgaaccaattaagcaagagtgagttcaacatatataagcgatcaggtataatggaagtagaccgatccgaagctaaggaaggacttaaacgtggggaaaccacaaggcatgccgtttccagaggaacagcaaaactgcggtggttcgtcgaacgaaatctcgttaaaccagaaggcaaggtaattgacctaggatgtggaagagggggatggtcatactactgtgcaggactgaagaaagttacagaagtaaagggttacactaagggaggaccaggacatgaagaacccatacctatggcaacctatggttggaacttagtgaaactccactcgggaaaagatgtcttctttaccccaccggagaaatgtgatacgctcctgtgcgacatcggagagtcttcaccaaacccgacaattgaagaaggtagaaccctaagagtacttaaaatggtagaaccttggcttaggggaaatcagttctgcataaaaatattaaacccatatatgccatctgtagtagagactctggaacagatgcaacgcaaacacggagggatgctagttaggaaccccctttccagaaattcaacacacgaaatgtactgggtaagttgtggcacaggaaatatagtaagtgccgttaatatgacgagcaggatgctactaaatagatttacaatggcccatcgaaaacctacgtatgagagagatgttgatttaggagctggaacgagacacgtggcggtagaaccggaagtagctaacttggatatcataggtcaacgcatagagaatatcaaacacgaacataagtcaacctggcactatgatgaagataacccatataagacttgggcatatcacggctcttatgaggtcaaaccgagtggatctgcatcttcaatggtgaacggtgtcgttaaattactcactaaaccttgggacgtaatacctatggtgacacaaatagcaatgactgatactactcccttcggacagcaacgtgtttttaaagaaaaagtagatactcgaactcctaaagcgaagagaggaactgcgcaaataatggaagtaacagctaggtggctttgggggtttttaagtaggaacaagaaaccacgtatttgtactagagaagaatttacacgcaaagtacgaagcaatgcagcaataggtgctgtcttcgtagatgaaaaccagtggaatagtgcaaaagaagcagtggaagatgagagattctgggatcttgtacaaaaggaaagagagctacataaacaagggaaatgtgcaacctgtgtatacaatatgatgggaaagagagagaagaaattaggagagttcgggaaagccaaaggttctagagctatatggtatatgtggctgggagccagattcctagagttcgaggctttagggtttatgaatgaggatcactggttcagtcgtgaaaattcactaagcggggtagaaggagaaggcctacacaagttgggatatatcctcagagacatctcaaaaattcctggagggaatatgtacgccgatgacacagcgggttgggacacaaggataacagaggatgatttgcagaacgaagcaaagattactgatataatggaacctgaacacgcattgttagccacatcaatttttaaattaacttatcaaaataaagtggttcgtgtgcagcgccccgcgaaaaacggtacagttatggatgtaatttcaagacgagaccaacggggttcaggacaagtcggaacatatggtttaaacacctttacgaatatggaagctcagctgataaggcaaatggaaagtgaaggaatatttcttccctcagaactagaaacaccaaacttagcagagagagttttagattggcttgagaaatacggagtagagagactcaaaaggatggcgatttctggagatgactgtgtcgttaagcccatagatgatagatttgccacagcactaactgctttaaatgatatgggaaaggtccggaaagacataccacaatgggaaccaagcaaaggttggaatgattggcaacaagtaccattttgtagccaccatttccatcaattaataatgaaagatggacgtgaaatagttgtaccgtgccgtaaccaagatgagctcgttgggagagctcgggtcagccagggggctgggtggtctctgagagaaacggcatgcttgggtaagagttacgcacaaatgtggcagctgatgtactttcatcgacgagacctcagactggcggcaaacgcaatctgttcagcagtaccggtagattgggtccctacatcaaggaccacatggtcaatccacgcacaccaccaatggatgacaaccgaagatatgctttctgtatggaatagagtatggattgaggagaatccatggatggaagataaaactcatgtatccagttggggagatgttccataccttgggaaaagagaagaccaatggtgtggctctttgattggactgacggccagagcaacttgggcaagcaacatacaagttgctattaaccaagttcgtaggctcattgggaatgaaaactacttagattatatgacatctatgaaaagatttaaaaacgaaggagacccagaaggagcattatggtaa

SEQ ID NO: 21634 - RNA, 9879 nt, synthetic construct
  misc_feature 1..9879: note = derived and/or modified CDS sequence (opt6) from DENV-1__FJ882543__SS-prME
  source 1..9879: mol_type = other RNA
tctgtaactatgctacttatgttaatgcctacagccttagcctttcatttgacgacacggggaggagaaccacatatgatagtaactaaacaagaaagaggaaaatccttactctttaaaacatccgcaggcgttaatatgtgcacgttgatagcaatggacctaggcgaactatgcgaagatactatgacatacaaatgcccaagaataaccgaagcagaaccagatgatgtagattgttggtgtaatgctacagatacttgggtgacctatggtacatgcagccaaaccggcgaacaccgacgagacaaaagatcagttgcattggcaccacacgttgggctgggccttgaaacaagaactgaaacgtggatgtcctcagaaggagcatggaaacaaatacaacgagtagaaacctgggctctaaggcacccaggattcacagtcatagcacttttccttgctcatgctataggtactagcattacgcaaaaaggcataatattcatactactaatgttagtaacgccatcaatggcaatgaggtgtgttggaatcggaagtagggatttcgtagaaggcttatctggtgcgacctgggtcgatgttgtactagaacacggctcgtgcgtcaccacgatggcaaaagataaaccaacacttgatattgaattgctaaaaaccgaagtaactaatcctgcagtactaagaaaattatgcatagaagcaaaaatttcgaataccacgacggatagtagatgtccgacccagggagaagccacattaatggaagaacaagacgcgaactttgtgtgtaggcgaactttcgtagatagaggttggggaaatggttgtggtttatttggaaaaggaagtttaattacgtgcgcaaaattcaaatgtgttactaaattggaagggaaaatagtccaatatgaaaatctaaaatattcagtaatcgttacggttcatacaggggatcaacatcaggttggcaatgaaagtactgagcacggtactacagcaaccataacaccacaagcacctacttcagaaatacaactaactgattatggtgcgttgactttagattgcagcccccgaaccgggctagattttaacgaaatggtattactaaccatgaaagagaaatcatggctagtgcacaaacaatggtttctagatcttcctttaccatggacgagtggggcttctacctcccaagaaacttggaacagacaagatctattagtgacattcaaaactgcacacgctaagaaacaagaagttgtggttcttgggagtcaagagggtgcaatgcacacggcactgacaggagcaacagaaatacaaacttcaggaacaactactatttttgcaggtcatctcaaatgtcgtctgaaaatggataaacttacactaaaaggtatgtcttatgtaatgtgcacaggatcatttaaactggaaaaagaagtggctgaaacacagcacggaaccgttctcgtccaaattaaatatgaaggaacagacgccccatgtaaaattccattctctacacaagacgagaaaggtgtcactcaaaatggacgtttaattacagcaaatccaattgtaacagataaagaaaaaccagtaaacatagaagctgagccaccttttggcgagtcatacattgttataggtgctggagaaaaagccctcaagttatcatggtttaagaaaggatccagcataggaaaaatgttcgaagctacagcaaggggagcaagaagaatggcaattttgggagatacagcttgggattttggcagtattgggggagtatttacgagtataggcaagttagtacatcaaatattcgggaccgcttatggagttttattcagtggtgtaagctggactatgaagatcggaataggtgttctgctgacatggctagggttaaattcgcggtcaacatccttgtcaatgacatgtatagcagtaggcctggtaacgctctatctcggagttatggtgcaggctgactccggatgtgttataaattggaaaggacgggaattaaaatgtggatcaggtatctttgtaacgaatgaggtgcatacttggaccgaacaatacaaatttcaagcagacagtccaaaacgtttatcggccgcaatcggaaaggcatgggaggagggcgtttgtggaataagaagcgcaactagattagaaaacataatgtggaaacaaatcagtaacgaattgaaccatatacttctcgaaaatgatatgaaatttacagtcgtagtaggagatgttgtaggtatccttgcccagggtaaaaagatgatccgaccacagccaatggaacacaagtatagctggaaatcctggggaaaagcaaaaataataggggctgatgtacaaaatacaactttcattatcgacggcccaaacaccccagaatgtccggatgatcaaagggcttggaatatttgggaagtcgaggactatggattcggaatatttacaaccaacatctggctaaaaatgagagactcatacactcaggtctgtgatcatcgattaatgtccgcggcaataaaagactccaaggccgtacatgcggatatgggttactggatcgaatcggagaaaaatgaaacctggaaacttgctagggcttcttttatagaagtcaaaacttgtatctggcctaaatcgcatactctatggtcaaatggagtattggaatcagaaatgatcattccaaaaatttatggaggaccaatctcacaacacaaccatcgtccagggtattttacacaaaccgccggaccttggcatcttggtaaattggagctagattttgatctatgcgaggggaccaccgtagtagtagatgaacattgtggaaaccgagggccatcgctgaggacaacaaccgtaaccggtaaaataatacacgaatggtgctgtaggtcttgcactttgccgccactccgctttaagggcgaagatggatgttggtacggtatggaaataagaccggtaaaagagaaagaagaaaacttagttaagtcaatggtatccgcgggcagtggagaagttgacagctttagcctaggattactctgtattagcatcatgatcgaagaagtaatgagatctagatggagtagaaaaatgttaatgaccggcaccctagccgtatttcttttgctaattatgggacaactcacttggaacgacctcattcgactttgtataatggtgggcgcaaatgcatccgatagaatggggatgggcacaacttacctagcacttatggctacgtttaaaatgcgaccaatgtttgcagttggcctcctttttagaagactaacaagcagggaggtgcttctactcaccatagggctatcactcgttgcttctgtggagctcccaaacagtttagaagaattgggtgacggtctcgcaatgggcataatgatcttaaaattattaacagattttcaaagccatcaattgtgggctgcacttttaagtctaacgttcataaagactacgctatcgcttcactacgcatggaaaacgatggcaatggttttgagtatagtcagtctaatacctctgtgcctcagtacgacgagtcagaaaacaacctggttacccgtattactagggagtttaggatgtaaaccattgactatgtttttaattgcagaaaacaaaatttggggacgtaagtcgtggccattaaacgaaggaatcatggcagtcggggtcgtatcaatactattatcaagtttacttaaaaatgacgtccctctagccggaccattaatagctggaggaatgttgatcgcttgttatgtaattagcggctccagcgctgacctaagccttgagaaagcagccgaagtaagttgggaagaagaagctgaacatagcggcgcttcacacaacatcctagtagaggtacaagacgacggtacaatgaaaataaaagatgaagaacgagatgatacactgactatattattaaaagcgacattgttagctgtgtcaggagtttacccattgtctataccggcgactctatttgtgtggtatttttggcagaagaagaaacagcgatcaggggtgttatgggatactccaagtcctccagaggtagaaagagcggtactagatgacggcatttacaggataatgcaaagggggctgttagggagatcacaggtaggtgtaggggtgttccaagagaatgtatttcatacaatgtggcatgtcactcgaggagcggttttaatgtatcagggaaaacgcttggagccatcctgggccagtgtcaagaaagatctaatatcctatgggggtggctggagactacaaggatcttggaatactggcgaagaggtgcaggttatagcggtggaacccggtaaaaaccctaaaaacgtacagaccgcccccggaacgtttaagacgccagaaggagaagtcggtgcaatcgcactggactttaagccggggacatccggttcccccatagtaaatagggaagggaaaatagtaggtttatacggaaatggtgtagtaacgacaagtggcacgtatgtatcagcaatagcacaggcgaaagctagccaagaaggacccctgccggaaatcgaagacgaggttttccgtaaaaggaatctcacgataatggatctacacccaggctcagggaaaacacggcggtacctcccagcaatagtaagggaagcaataaaacgaaaattgagaactcttatattagctcccactagagtggtcgctagtgaaatggccgaggcattgaagggcatgccgatacgttatcagacaacagctgtaaaatcagaacatacaggtaaagagatagttgatcttatgtgccatgcgacatttacaatgcgacttctatcaccagtccgagtaccaaattacaacatgataataatggatgaagcgcactttactgacccatccagcatagctgcaagaggatatatatcgacgcgagtaggtatgggagaagcagcggctatatttatgaccgctacaccaccgggttctgtagaggcattcccccaatctaatgcagtgattcaagatgaagaaagagacattccagaaagatcatggaatagcggctatgaatggataaccgattttctaggcaaaacggtatggtttgtgccaagcataaaatcgggtaatgatatagcaaattgtttacgtaagaacggaaagagagttatacaacttagtagaaaaacattcgataccgagtatcagaagactaaaaataatgattgggattacgtcgtgacaaccgatatatcagaaatgggggccaactttagggcagatcgggtaattgatccacgtcggtgcttaaaacctgttattttaaaggacggtcccgagcgagtaattctagctggtcctatgccagttactgttgcgtcagcagcacaaaggagaggcaggataggacgaaaccataataaagaaggcgaccagtatatatatatgggacaaccactcaacaatgatgaggaccatgcccactggacggaagcaaaaatgttattggacaatataaatacaccagaaggcatcataccagcgttgtttgaacccgagcgggaaaagagtgcagctattgatggagaatatagattacgtggtgaggcaagaaagactttcgttgagcttatgagaagaggggaccttcctgtgtggttaagttacaaagtggcttccgaagggttccagtattcggatcgcagatggtgtttcgatggagaacgaaataatcaagttcttgaagaaaacatggatgtggaaatttggacaaaggagggggaaaggaagaaattacgtcctcgatggctagacgcacgcacgtatagtgatccactcgcgttaagagaatttaaagaatttgcagcaggtcgacgaagcgtgtcaggcgatttaatattagaaatcggtaaattgccacaacatctcactcagagagctcaaaacgctttggataatctcgtcatgttgcataactcggaacaaggagggcgagcctaccgtcacgcaatggaagaattacctgacaccatcgaaaccctcatgctactagcgttaatagcggtgcttactggaggcgtaacactctttttcctatcaggtagaggattagggaaaacaagcattggcttactatgcgtaatggcatctagtgtcctattatggatggcgagtgtagagccgcattggatagcggcgtcaataatactagagttcttcttaatggtattattaatccccgaacctgatcggcaacgtacaccgcaagacaaccaactggcttacgtcgtaataggattgttgtttatgattttaactgtagcagccaacgagatgggtctattagagaccaccaagaaagatttaggtataggtcacgtagcggtagagaaccaccatcacgcaacaatgctcgacgtagatctgcatccagcttcggcatggacgctctatgcggtcgcaaccacaataattacgccaatgatgcgacatactatagaaaatactacagctaacatctcattgacagctattgccaatcaagcagctatattaatgggattggacaaaggatggccaataagtaagatggacattggagtgccgctcctagctttaggatgttactctcaagttaatccattaacattgactgccgcagtattaatgcttgtagctcattatgctatcataggccctggactacaagcaaaagcaacccgtgaggctcaaaaacgcaccgctgcaggcattatgaaaaatccaacagtcgacggtatagtagccatcgatttagatccagttgtatatgacgcaaaatttgagaaacagttaggacaaataatgctattaatactctgtacatcacaaatattactaatgaggactacgtgggcactgtgtgagtcaatcacactagcaacagggccgctaacgactctctgggagggttcccccggtaaattttggaatactacgattgcagtcagcatggcaaatatctttagagggtcctaccttgcgggagctggccttgcgttctcgcttatgaagtccttaggaggtggtaggcgaggaacaggggctcaaggtgaaacactaggcgagaagtggaaacgacaattaaatcaattatctaagtctgaatttaacatatataaaagatctggaattatggaagtagacaggtcagaggccaaagagggattaaaaaggggagaaacgacaagacatgcagtatcgagaggaaccgcaaagctaagatggtttgtagaacgtaacctagtgaagccagaaggaaaagtcattgatctggggtgcggtagaggtgggtggtcttattattgtgctggtcttaagaaagtcaccgaagtaaagggttatacaaaaggaggaccgggacatgaagaaccgatccctatggccacatatggatggaatctggttaaattgcattcaggtaaggatgttttcttcactccaccagaaaaatgtgatacacttctctgcgatataggagagtcatcgccgaatccgactattgaggagggacgtacgttaagggttctgaagatggtcgagccatggttgcgaggcaatcagttttgtattaagatactcaacccctacatgccatctgtggtagagaccttagaacagatgcagaggaaacacggtggaatgctggttagaaatcctctatcacgaaatagcactcatgaaatgtactgggtaagttgtggaacaggaaacattgtcagcgcggtaaacatgaccagtcgaatgttgctgaatagattcactatggctcaccgaaaacctacttatgaaaaagacgttgatctgggtgctggtactcgacatgtagcagtcgaaccagaagttgccaacctggacataataggtcaaagaatcgagaacattaaacatgaacacaagtcgacgtggcattatgatgaggataatccctataaaacttgggcataccatggatcttatgaagtaaaaccttcgggaagtgcttctagtatggtgaacggagtagtaaagttgttaacaaagccttgggacgtcattcccatggttacacaaatcgctatgacagatactacaccctttggtcagcaacgagttttcaaagaaaaagttgatacaagaactccaaaggcaaaacgaggaacagtacagattatggaagtaaccgcgaggtggctatggggttttctctcaagaaataagaaacctagaatatgtactagggaagagttcactcgaaaagttcgtagtaacgcagctataggtgcggtgtttgtagatgagaaccaatggaactcagcaaaagaagcagtagaggatgaacggttctgggatctagtgaagaaagaacgagagttgcacaaacaagggaaatgtgcgacatgcgtatacaatatgatgggaaaaagagagaagaaacttggagagttcggcaaagctaaagggtccagggcaatttggtatatgtggttaggggcgagattcctagaatttgaggccttgggctttatgaacgaagatcactggttctcgagggaaaattcgttatcaggggtcgaaggagaaggcctccacaaacttggttatatattacgggatatttcgaaaataccaggaggtaatatgtacgcagatgatacggcaggatgggacacaagaattacagaagatgaccttcaaaatgaagcaaaaattacagatattatggaaccagagcatgcattattagcaacgagtatttttaaactaacatatcaaaacaaggtagtaagagtgcaaaggccagctaaaaatggaacggttatggatgtgatatcgagaagagaccaaaggggctcaggacaagtaggtacgtacggcttgaatacatttactaatatggaagcacagctaatacgtcaaatggagtcggaaggaatatttctcccgtcagaactcgaaacgcccaatctagctgaaagagtattagattggttagagaaatatggagtagagagattaaaaagaatggccataagtggtgatgactgcgtagtaaaaccaatagatgatcggtttgccacagccttaactgctctgaacgacatgggaaaagttagaaaagacatcccacaatgggaacctagtaaaggatggaacgactggcagcaagtgccattttgcagtcaccatttccatcagcttataatgaaagacgggcgagaaatagtagttccatgtagaaatcaagacgagttagtagggagggcaagggtgagtcagggtgctggctggagtttacgagagaccgcatgtttagggaaatcgtatgcacagatgtggcagctaatgtactttcatagacgcgacttaagattagctgctaatgctatctgttcggctgtccccgtagactgggtccccacaagtaggactacatggtcgattcacgctcaccatcaatggatgacaaccgaagatatgctctcagtttggaacagagtgtggattgaggaaaacccgtggatggaagataaaacacatgtcagctcatgggaagatgtaccttatctaggtaaacgtgaagatcaatggtgtggcagcttaattggactgacggcgagagctacatgggcttcaaacattcaagtagcgataaaccaagtcaggcgcctaattggtaacgagaactatcttgattacatgacctcaatgaaacgtttcaagaatgagggcgatccagaaggtgcattgtggtaa

SEQ ID NO: 21635 - RNA, 9879 nt, synthetic construct
  misc_feature 1..9879: note = derived and/or modified CDS sequence (opt6) from DENV-1__FJ882544__SS-prME
  source 1..9879: mol_type = other RNA
agtgtaactatgttattaatgctaatgccaaccgcgctagcctttcatctaactacccgaggaggggaacctcacatgatagtaagcaaacaagaacgaggtaaatctttgttattcaaaacatcagcaggagtaaatatgtgtacactaatagccatggatttgggagaactatgtgaagatactatgacgtataaatgcccaaggatcactgaaactgaacctgatgatgtggattgttggtgcaatgcaaccgacacatgggtgacatacggaacatgcagccaaacaggagaacacagaagagataaaagatcggttgcgctagcaccccacgtaggactcggactggaaacaaggacagaaacatggatgtcaagtgaaggagcatggaaacaaatccaaagggtagaaacgtgggctctcagacatcccgggtttacggtaatagcactattccttgcacatgcgatagggacaagtattacccaaaaaggaattatctttatacttttaatgttggttacgccgtcaatggccatgcgttgtgtaggcatcggaaaccgagattttgtagaaggattatctggcgcaacttgggttgatgtcgtactagaacacggatcctgtgttacgactatggcaaaagacaaaccaacgctagatatcgaattattaaaaaccgaagtaacgaatcctgcagttttaagaaaactttgtatagaagcaaaaatatcaaatacaacgaccgattctagatgccctactcaaggagaagctacgctagtagaagaacaagatgcaaacttcgtatgcagacggacatttgttgacaggggatggggtaatgggtgtggattattcggtaaaggtagcttaataacatgtgcaaaattcaaatgtgtgacaaaactggaaggtaaaatcgtccaatacgaaaatctaaaatatagtgtaatagttaccgtacatactggtgatcaacatcaagtaggtaatgaatcaaccgaacatggtactactgctaccataaccccacaagcaccgactactgagatacaattaacggactatggagccttaacactcgattgctctcccaggaccggcttagatttcaacgaaatggttttactaactatgaaagagaaaagctggctagttcataaacagtggtttctagatctacccctaccgtggaccagcggtgcgagtacgtcacaggaaacgtggaaccgtcaggatcttctcgtaacttttaaaacggcacacgccaagaaacaagaagtcgttgtacttggaagtcaggaaggggctatgcatactgcattaacaggagctacggaaatacagacttccggtacgacaactatatttgcaggacacctgaaatgcagattaaaaatggacaaattaacacttaaaggtatgtcatatgtaatgtgtaccggttcattcaaattagaaaaagaagtagccgaaacgcaacatgggacggtactcgttcaaattaaatacgagggaacagatgcaccatgcaaaataccatttagtacacaagatgagaaaggtgtgacacaaaatggaagactaataacagcaaacccgatcgttacagacaaaggcaaaccagtcaatatcgaggcagaaccacccttcggggaaagttacattgtaataggagcaggagaaaaagctcttaaactgagttggttcaagaaaggatcatcaatcgggaaaatgtttgaagcaacagctagaggcgcccgtaggatggcaatattaggagacacggcatgggatttcggctccataggaggtgtattcacctcagtaggtaaacttgtccatcaaatttttgggactgcgtatggagtgctctttagtggagtaagttggacaatgaagataggaataggcgttttattaacttggttgggattaaatagtcgtagcaccagtttgtcgatgacatgtatcgcagttggtctagttaccctttacctcggagtaatggttcaagctgacagtggctgtgtgatcaactggaaaggacgggaattaaagtgcggaagtggcatattcgtcaccaatgaggtgcacacatggacagaacagtacaaatttcaagcagattctcccaaacggctctcagccgcaattggtaaagcctgggaggaaggcgtttgtgggatacgcagcgcaactagactcgagaacatcatgtggaaacaaatctcaaatgaattgaatcatatcttactagaaaacgatatgaaatttacagttgtcgtgggcgacgtagcaggaattttagcgcagggaaagaaaatgataagaccacaaccaatggagtataagtattcatggaaaagttggggtaaggcaaaaatcataggtgccgatgttcagaacacaacatttataattgatggaccaaacactccagagtgtcctgacgatcaaagagcttggaatatctgggaggtagaagattacggctttggaatctttaccacaaatatatggctaaaacttcgagattcttacacccaagtgtgcgatcatagattaatgtcagcagcgattaaagactcgaaagccgtacatgcagatatgggatattggatagaatcagagaaaaatgaaacttggaagctggcaagagcaagtttcatcgaagtaaaaacttgcatttggccgaaatcccatacactatggtcaaacggagtactcgaaagcgagatgataataccaaagatctacggaggtcccatttctcaacataattatcgacctggctattttacgcaaactgctggaccctggcacctgggtaaattagaattagactttgatttatgcgaagggactactgtagtagtagatgagcattgtggcaatagaggaccctcccttagaacaactacagtaacgggtaagattatacacgaatggtgctgtaggagctgtactcttcctccacttcggttccggggcgaagatggatgctggtatggaatggaaataagacctgtcaaagagaaagaagaaaacctagtgaaatcaatggtcagtgcagggtcgggcgaagttgattcattctcgttagggttgctttgcatatcaatcatgatcgaagaagtaatgagatcccgatggtcaagaaagatgttaatgaccggaaccttagctgttttcttcttattgataatgggacaactaacatggaatgatttaatacgtttatgcatcatggtaggcgccaacgcgtcagacagaatgggaatgggtacaacataccttgcattaatggcaacatttaagatgagaccaatgttcgctgttggtctgttatttagacgtctaactagcagagaggtcttactattaactatagggctttctttagttgcaagcgtagaattacccaattccctggaagaactaggcgatggactagcaatgggaattatgatcctaaaacttttgactgactttcaatcacatcaactctgggcaacacttctatccctaacgtttataaagaccactttctcactgcattacgcatggaaaacaatggcaatggtactatccatagtatcgctatttccgctttgtttgagtactacaagtcagaaaactacgtggttacctgttttgctgggcagtcttggatgtaaaccgctgacaatgttcctgattgctgaaaataaaatatggggacgtagatcatggcccctgaacgaaggcataatggcagttggcattgtatcgatattactttcgagcctactgaaaaatgatgtcccactagctggaccactgatagctggtggtatgctaatcgcatgttatgtaatttcgggaagttcggcagatttaagtctcgagaaagccgcagaagttagctgggaagaagaggccgaacattcaggagcatcgcataatatattagtcgaagtacaagatgatggtacaatgaaaatcaaagacgaagaacgagacgacacattaactatattgttaaaagctaccttactagccgtctcgggagtatatccactttctataccggcaactctattcgtatggtatttttggcagaagaagaaacagagatctggagtcctatgggatacacccagcccgccagaagtcggacgagccgtgctcgatgacggtatatatcgtataatgcaacgaggactacttggacgttcacaagtaggggttggcgttttccaagaaaacgtttttcacacgatgtggcacgtaacaagaggagccgtattgatgtaccaaggtaaacgattagaaccgtcctgggcttctgtaaagaaagacctaattagctacggcgggggatggagattgcaagggagttggaacacaggagaagaagttcaagtgatagctgtcgaaccaggcaaaaatcccaaaaacgtgcagaccgcaccaggaacgttcaaaacacctgaaggcgaggtaggtgcaatagcactggatttcaagccggggacatctggttcaccaattgtaaatcgcgaaggcaaaatagttggcctgtatgggaacggcgttgttactacttcaggtacatacgtaagcgcgatagcccaggcaaaggcttcacaagaagggcctttacccgaaatagaggatgaagtatttagaaaaagaaacttaacaatcatggatttgcatccaggcagcggtaagacacgtcgatacttaccagcgattgttagagaagcaataaaaagaaagttaaggaccctaattttagcgccgactcgggtagttgcaagtgaaatggccgaagcgttaaagggtatgccaattaggtaccagacaacagctgtgaaatcagaacatacgggaaaagagatcgtggacttaatgtgtcacgctacatttacgatgagacttctttcaccggtaagagttcctaattacaatatgatcatcatggacgaggctcatttcacagatccaagtagtatagcagccaggggctatatttcaaccagggtaggcatgggagaagcagcagcaatcttcatgactgccacaccaccgggttcagtggaagcattcccacaaagtaatgcagtcattcaggacgaggaaagagatatcccagaacggagttggaactccgggtacgaatggataactgattttccaggcaaaacagtatggttcgtaccttccataaagtcggggaatgatatagccaactgcttacggaagaacggaaaaagagtaattcaacttagccgtaaaacatttgatacagaataccaaaagactaaaaacaatgactgggactatgttgtgactactgatataagtgaaatgggtgccaactttagagcagatagagttatagatccaagaagatgtctcaaaccggttatactaaaagacgggcccgagagagtaatattagccgggcctatgccggtcactgtagctagcgccgctcagcgcagggggcgcattggtcgaaatcacaacaaggaaggcgatcaatacatatatatgggccagcctcttaataacgacgaagatcacgctcattggacagaagcgaagatgcttctggataatataaatacgccggaaggtataataccagccttatttgaacctgagagagagaaatctgcagctattgatggtgaatatagattaagaggcgaggcaagaaaaacatttgttgagctaatgcgacgaggcgacctaccagtgtggctatcctacaaggtagcgagcgaaggattccaatattctgacagacgttggtgctttgatggtgaacgaaacaaccaagtattagaagagaacatggacgtggagatctggaccaaggaaggcgaaaggaagaaactacgcccacgatggcttgatgcacgcacttactctgacccactcgcattaagagagttcaaagagttcgccgcaggtcgtagaagtgtttcgggggatctaattctagaaatcggtaaacttccgcagcatctaacccaaagagcacaaaacgcactagataacctagtaatgttacacaatagcgagcagggcggaagggcatatcgtcacgcgatggaagaacttccggatactatagaaacgcttatgctgctcgctcttatcgcagttttaacaggtggcgtaacattgttcttcttgagcggaagaggattggggaaaacttccattggtttattatgtgttatggccagcagcgtgttactatggatggcgtcagtagaaccccactggatagcagcaagtataatactagaatttttcctaatggtccttctaatacctgagcccgacagacagaggactcctcaagataatcaacttgcgtatgttgtgatcggccttttatttatgattttaactgtcgcagcaaatgagatgggtttattagaaactactaagaaagatttagggatcggtcacgttgcagtggagaatcaccaccatgcagctatgcttgatgtagacctacatcccgctagcgcatggacattatatgcagttgcgacaaccataataacccctatgatgcggcacaccatagaaaataccacagctaatattagtttaacagcgatagcgaatcaggctgcaattctaatgggcttagataaaggatggccaataagtaaaatggacataggagttccactcctcgcattaggttgttacagccaggtaaatccgctcacgctaacagctgcagttttgatgctagtcgcccattatgcaattattggaccaggcctacaagcaaaagcaacaagggaagcacagaaaaggacggcggcgggaattatgaaaaatcctactgtcgacggcattgtagccattgatttagatccggtagtctatgatgctaaattcgaaaagcagttaggacagataatgctgctcattttgtgtacatcacaaattctcctaatgcgcactacgtgggcgttgtgcgaatcaataactttggcaacggggccgttaactacactatgggaaggctccccaggtaagttttggaatacgacaattgctgtttcaatggcaaatatttttaggggctcgtatttagcaggagcaggccttgcattttcactaatgaaatccctcggtggtggtagacgtggaaccggcgctcagggtgaaacactaggcgagaaatggaagcggcaacttaaccaactctcgaagtccgagtttaatacctataaaagatcgggcataatggaggtcgatagaagcgaagcaaaagaagggctaaaacgaggtgagacaacgaaacatgctgtcagccggggtacagccaaactaagatggtttgttgaacgtaatcttgtaaaaccggaaggaaaagtaattgatctagggtgtggaaggggcgggtggagctactactgtgcaggattaaagaaggtcaccgaggtaaaaggttatacgaaagggggaccaggccatgaagaaccaatccccatggcgacgtatggttggaacctagttaaattgcacagtggtaaagacgtatttttcattccaccggagaagtgtgacacacttttatgcgacataggagaaagttctcctaacccgacgatcgaagaaggtcgcacccttcgagtgctaaaaatggtggaaccctggctaagaggaaaccaattttgcatcaaaattctgaatccatatatgccttctgtcgtagaaacgctagaacaaatgcagcgaaaacacggaggaatgctagtaaggaacccattgtcaaggaacagtacgcacgaaatgtattgggtctcatgtggtactggaaatatcgtatccgcggtaaacatgacgtcacgaatgctactcaaccgatttacaatggcacaccgaaagccaacatacgaaagagatgtagatctaggtgccggtacgcgccacgtagcggtagaaccggaagtagcaaacctagacattataggacagcgaatcgaaaacattaaacacgaacataagtcaacatggcattacgatgaagataatccgtataaaacctgggcctatcatggatcctacgaagtaaaaccgagtggatcggcgtcatcgatggtaaatggcgttgtaaagctactgacgaaaccatgggatgtcatcccaatggtaacccaaatagctatgactgacacgaccccattcggccaacagcgagtattcaaagagaaagttgatacaaggacacccaaagctaaacggggaaccgcccaaataatggaagttaccgctaaatggttatggggttttctatctcgaaataagaaaccgcgaatatgtacgcgagaagagttcaccagaaaagtaagaagtaatgcagcgatcggtgcagtatttgtagacgaaaaccaatggaactcagcgaaagaggcagtagaagatgaaagattctgggatctcgttcatagagaaagagaacttcataaacagggtaaatgtgccacatgcgtttataatatgatgggtaagcgagagaagaaactaggggagttcggtaaagcgaaaggttcacgtgctatatggtatatgtggctgggagcacgatttctagaatttgaagcactaggatttatgaatgaagaccactggttttcaagagaaaatagtcttagcggtgtagaaggtgagggattacacaaactaggctacattctacgggatatttctaacataccaggcgggaatatgtacgcagatgacactgctggctgggacacacgaatcacagaagacgatttacagaacgaagcccgtataacagatattatggagccggaacatgcgttattagcaaaatcgatatttaaacttacttatcaaaataaagtagtcagagtacaaagacctgcgaaaaacgggacagttatggacgtaatttcacgaagagaccaacggggatccggacaagtaggaacctacggcttaaatacctttacaaacatggaggcacaactgataagacaaatggaaagtgaagggatcttcagtccctcagagttagaaactccgaaccttgcagagagagtcctagattggttagaaaaatatggtgtagagcgacttaaaagaatggcaataagtggtgacgattgcgttgtcaagccaattgatgatagattcgccactgcgcttacagctttaaatgatatgggaaaagtccgcaaagacataccccaatgggaaccatccaaaggttggaatgattggcaacaagtgcctttctgttctcatcacttccatcaacttatcatgaaagatggtagagagatagtggtcccatgtagaaatcaagatgaattggtcggcagagctcgtgtgagccagggagcaggttggagtctaagagagacagcatgtttaggaaaaagttatgctcaaatgtggcaactaatgtattttcacagaagagatctccgcttggccgcgaatgccatttgctctgccgtaccggtggactggatccccacatcacgtaccacgtggagtatccacgctcaccaccaatggatgacgaccgaggatatgctgagcgtgtggaatagagtatggatagaagaaaatccatggatggaagacaaaactcatatatcaagttggggagatgtaccttatttaggtaaaagagaggatcaatggtgtggctcattaatcgggctaaccgcaagagcaacctgggcaaccaacattcaggtggcaattaaccaggtacgaaggctgattgggaatgagaactacctagactacatgacgagtatgaaaaggttcaaaaacgaatcggatcctgaaggtgctctgtggtaa

SEQ ID NO: 21636 - RNA, 9879 nt, synthetic construct
  misc_feature 1..9879: note = derived and/or modified CDS sequence (opt6) from DENV-1__FJ898371__SS-prME
  source 1..9879: mol_type = other RNA
agtgtaacaatgctattgatgctaatgccaaccgcactagcttttcatttgaccacccgcggaggtgaaccccatatgatagttaccaaacaggaacgaggaaaatccttattatttaaaacgtcagcaggagtcaacatgtgtacattaatagcaatggacctaggagaattgtgcgaagacaccatgacatacaaatgcccacgaatcacagaagctgaaccagacgacgtagattgctggtgcaatgctactgacacgtgggtaacctatgggacgtgtagccaaactggagaacaccgacgtgataaacgaagtgttgctctagctcctcatgtgggattaggattagagacaagaacagagacttggatgtcttcagaaggagcatggaaacaaattcaacgtgtagaaacttgggcgctaagacatcctggttttaccgtcatagcactatttttagcacatgcaataggcacatctattacacaaaaaggaataatattcatactattaatgctcgtcacaccatcaatggcgatgagatgtgtaggcattggatcaagagacttcgtggaaggtctgtcgggcgcaacgtgggtcgacgtagtactagaacacgggagttgcgtgacaactatggctaaagacaaaccgacgttagatatagaacttttaaaaacagaagtgacaaatccggcggtgcttcggaaactatgtattgaggcaaaaataagtaatacgactactgattctcgatgtccaacacaaggcgaagctactcttatggaggaacaagacgccaactttgtatgccgtcgaactttcgtcgatcgtggctggggcaatggctgtggcttatttggaaaaggtagcttgataacttgtgcaaaatttaaatgtgtaacaaaactagaaggaaaaatagtacagtacgaaaatcttaaatattcggtaatcgttacagtccacacgggtgaccaacatcaggtaggaaatgaatcaacagagcacggaacaaccgcaacaattacaccgcaagccccaacctctgagattcaactaaccgattatggtgccttaacgctggactgttcgcctagaactggattggacttcaacgagatggtactacttacgatgaaagaaaaatcatggctagttcataaacaatggttcttagatctgccattaccatggactagcggcgcatcaacttcacaagaaacatggaaccgtcaagatttattggtgactttcaaaacagctcacgccaagaaacaagaagtcgtggtgttaggaagccaagaaggagccatgcatacagctttaactggggcaacggaaattcaaacgtctggaacaacaacaattttcgcaggtcatttaaaatgtcgattaaaaatggacaaactaacactcaaaggcatgtcatatgtaatgtgtacgggatcttttaaattggagaaagaggtagcagaaacgcagcatggcacggtcttggtgcaaataaaatacgaggggaccgatgccccgtgtaaaattccatttcttacacaagatgaaaaaggggttacgcaaaatggaagattgataacagccaatcctatcgtaacagacaaagagaaaccagtaaatatagaagcagaaccgcctttcggcgaatcatacatagttatcggcgccggtgaaaaggctttaaaattgtcatggtttaagaaaggcagttcaatcggcaaaatgttcgaagctactgcgagaggcgctagacgtatggcaatccttggagacacagcctgggactttggcagtatcggaggggtttttacaagcgtgggcaagctggtacatcaaatttttggcactgcttacggtgttcttttcagcggagtatcatggacaatgaaaataggaatcggagtattactaacttggttaggactaaattcgcgttctacctctttgagtatgacttgtatcgcagtagggctagtaactttgtatcttggggttatggtacaagcagatagtggttgcgtcataaattggaaaggtagagaactgaaatgcggtagtggtatattcgtcactaatgaagtgcatacatggacggagcaatataaattccaggccgattcaccaaaaagactaagtgccgcaataggaaaggcttgggaagaaggcgtctgtggcatacgttcggccacaagactggaaaatataatgtggaaacaaatatccaacgaattaaaccatatactgttagaaaatgatatgaagttcacagtcgtcgttggtgatgtagtagggatactggcacaaggcaagaaaatgattaggccacaaccaatggaacacaagtactcttggaaatcatggggcaaagccaaaattattggcgccgatgtgcaaaacacaacattcattattgatgggcccaacaccccggaatgccccgatgaccagagagcatggaatatatgggaagtagaagactatgggtttggaatattcactacaaatatctggttgaaactacgcgatagccatacacaggtctgcgaccacagactgatgagtgccgcgataaaagattctaaagcagttcatgcagatatgggctactggatcgaaagtgagaaaaatgaaacttggaaactagcaagagccagtttcatcgaagttaaaacatgtatatggccaaaatcccacaccttatggtcaaacggtgtattagagagtgaaatgataataccgaaaatttatggaggaccgatatcccaacataactatcgtcctggatatttcactcaaacagcgggaccatggcaccttggtaaactagaattagatttcgatttatgcgagggaaccacggtcgtcgtcgatgaacactgcggtaaccgcggtccatcattgcgcacaacgacagtgacgggtaagatcatacacgaatggtgctgtagatcttgtacactgccaccccttagatttaaaggagaagacggttgttggtacgggatggaaataagaccagtgaaagaaaaagaagaaaatctggtcaagagcatggtgtctgcgggaagtggagaggttgattcatttagcctagggctcctatgcataagtataatgatagaagaagtcatgaggagccgttggagtagaaaaatgctgatgacaggaactctcgcagtgtttctactactcataatggggcagttaacatggaatgaccttataagattatgtatcatggtaggtgcaaatgcgtctgatcgaatgggtatgggcacaacttacctagccttaatggcaactttcaagatgagaccgatgttcgcagtgggattattatttcgcaggttaacttctagggaagtgctccttctcacaataggactgtctctagtggcttctgtcgaacttccaaacagtttagaggagctgggggatggacttgcgatgggtataatgattcttaaattattgacagactttcagtcacaccaactttgggcaacattactgtcattaacattcattaaaacaacactctcactgcactacgcatggaaaactatggctatggtcttaagcatcgtatcactatttcccttatgcctatcaacgacgagccagaaaacgacttggctaccagtccttctaggctcattaggatgtaaaccattaacaatgttccttatagcagaaaacaagatatggggaagaaaaagctggccactaaatgagggaataatggctgtaggagtagtctcgatcttattgtcatcactactcaaaaatgacgtacctcttgctggtccattaatcgcaggaggaatgctaattgcttgctatgtcattagcggcagtagtgcagacctatcccttgagaaagcagcggaagtatcgtgggaagaggaagcagaacactctggagctagccataacatcctagtagaggttcaagatgacggaacaatgaaaataaaagacgaagaacgtgacgataccttaactatacttttaaaagcaactctcctagctgtctcaggcgtttatccattaagtattccagcaaccttatttgtgtggtatttctggcagaagaagaaacagagatcaggagttttgtgggacacaccttccccgccggaagttgaacgggccgttcttgacgacggcatttatagaatcatgcaaagaggactactcggtaggtcacaagttggcgtaggagtattccaagaaaatgtttttcatactatgtggcacgtaaccagaggagcagtactaatgtatcaaggaaaaaggttggaacccagttgggcaagtgtgaagaaagatctaatatcctacggcgggggctggagattacagggatcttggaacacaggtgaagaggtacaagtaatagcagtcgagccaggcaaaaatccgaaaaacgttcaaacagcaccaggaacattcaaaacgccagagggtgaagttggagcgatagcgctagactttaaacctggaacttcaggttcacctatagttaatagggaaggtaaaatagtggggctatacggtaacggggttgtgacgacgagtggaacatacgtgtcagcaatcgcacaagcgaaggcttcacaagaaggccctttacccgagatagaggatgaagttttccgtaaacgaaacctaactataatggacttgcacccaggatcagggaaaaccagaaggtacctcccagccattgtaagagaagcaataaaaagaaaattaagaacgctaatactagcaccaacaagagtagtagcgtctgaaatggccgaagcgctaaagggtatgccaatccgatatcaaaccaccgctgttaagagtgaacatactggtaaagagattgtagatttaatgtgtcatgcaactttcacgatgaggctattaagtcctgtccgagttccaaactataacatgataataatggacgaggcacactttactgacccaagttcaatagctgcacgaggctacatttcaacaagagtaggtatgggtgaagcagcagctatattcatgacagctacacctccaggaagtgttgaagcctttcctcaatccaatgcagtgatacaggatgaagaaagagatatcccagagagaagttggaactctggatacgaatggataacagattttccaggtaaaactgtatggttcgttcctagtattaaaagtggaaatgatattgccaactgtttaaggaaaaatggtaaacgggtaatacaacttagtcgtaaaacatttgacacggagtaccaaaagaccaaaaacaatgactgggattacgtagtaacaacagatatttctgaaatgggggcaaactttcgagctgaccgcgtaatagacccaagaagatgtctaaagccagttatattaaaggatgggccagaaagagtcatattggcagggccaatgcccgttacagttgcgtcagcggcgcaaagacgaggcagaattggtcgaaaccataataaagagggcgaccaatatatttatatgggtcaacctctaaataacgatgaagaccatgcacactggactgaggccaaaatgttattggataatataaatactccagaaggaattatcccagctttatttgaaccagaaagggagaaatcagcagcaattgatggcgagtatagattgagaggtgaggcgagaaaaacgtttgtagaactgatgagacgaggagatctacctgtatggcttagttataaggtcgcaagtgaaggatttcagtatagtgataggcgttggtgttttgacggagaaagaaataaccaagttttggaagagaacatggatgtagaaatatggaccaaagaaggagaaagaaagaaactacgaccccgatggttagatgcgaggacgtactcagatcccctcgcgctaagagaatttaaggaatttgccgctggtcgtagatccgtctcaggtgatttaattctagaaattggcaaactaccacaacatttgacacagcgcgcacaaaacgccctggacaatttagttatgttacataactctgaacagggaggtcgcgcttataggcacgccatggaagaactaccagatactatcgagacgctaatgctcctagcactaattgcagtcttgactggtggcgtcacattatttttcttgagcgggaggggcttaggaaaaacttcaataggcctcttatgtgtaatggcgagttcagtactcctatggatggcatccgttgagcctcactggatagccgctagtatcatattggagttctttttaatggtgctacttatacctgaaccggatcgacagagaaccccacaagataatcaactagcctatgtagtaataggattgttgtttatgatattaacagtcgctgcgaatgaaatgggccttttggagacgacaaagaaagatttaggtatcggccatgtagctgttgaaaaccaccatcacgctaccatgttagacgtggacttacatccagcatctgcatggaccctatatgcggtggctactacaattattacgccaatgatgagacacacgatagagaacacaaccgctaatatatcactaacagcaatcgctaatcaggcggccatattgatgggattagataaaggatggcccataagcaaaatggatataggcgtaccgctacttgcactaggatgctactctcaggtcaatccattgacactgacagctgcagtacttatgctcgtggcacattatgcaattataggaccgggtctccaggccaaagctacgcgcgaagcgcaaaagcgaaccgcagctggaatcatgaaaaaccctacagtcgacggcattgtagccatagacctcgatcctgttgtatatgacgcaaaattcgaaaaacaactgggccaaataatgctcctgatcttatgcacatcacaaatattacttatgagaaccacctgggctttgtgtgaatcaatcacgctggccacgggaccattaactactctgtgggaaggaagccctggcaaattttggaatacaaccattgctgtaagtatggccaacattttccgaggatcctacctcgcgggtgccgggttggcttttagcctaatgaaatcattaggcggtggacgacgtggaacaggagctcaaggagaaaccttaggggaaaagtggaagaggcaactcaatcaattaagtaagagcgagttcaatatatataagagatctggtataatggaggtagatcggagtgaagcaaaagaaggtctcaaacgtggtgagacgacaagacatgctgtatcacgaggtacagccaagctaagatggtttgtagagagaaatttggtaaaacctgaaggcaaagttattgaccttggatgcgggagaggcggctggtcttactattgtgctggtctaaagaaagtaacagaggttaaaggatatacaaaaggaggaccaggccatgaagaacccatacctatggcaacttatgggtggaacttggtaaaacttcattcaggaaaagacgttttctttacacccccggaaaaatgtgatactctgctatgtgacattggcgagtcatctccaaaccctacaatagaagaaggccggacacttcgtgtcttaaaaatggtagaaccttggcttcgtgggaaccagttttgcattaaaattttaaatccatatatgccttccgtcgttgaaaccctagagcaaatgcaacgaaaacacggtggtatgttagtacgaaacccactgagtagaaatagcactcacgaaatgtattgggtgtcttgtggtacaggtaatatagtatcagcagttaacatgacatccagaatgctactcaacagatttactatggcacatcggaaaccaacctatgaacgagacgtggacttaggagcaggaacacgacatgttgcagtagaaccagaagtagctaaccttgacatcattgggcaaagaattgaaaacataaaacatgaacataaatccacatggcattatgacgaagataatccttacaaaacttgggcataccatggatcatacgaagtaaaacccagtggtagcgcctcgagtatggttaacggcgtggtcaagttactgacgaaaccatgggacgtgataccgatggtcacacaaatagcgatgacagacactacaccatttggacaacaacgagttttcaaagaaaaagtagatactagaactccaaaagctaaacgtggaaccgcccaaataatggaagtgactgcaagatggttgtgggggttcctcagccgtaacaagaaaccccgaatttgcactagggaagaatttactcgtaaggtaagaagcaatgcagcgattggtgctgtctttgttgatgaaaaccaatggaactctgcaaaagaagcggttgaggacgaaaggttctgggatcttgtgcaaaaagaaagggaactacacaagcaaggaaaatgcgctacatgtgtatataacatgatggggaaacgagagaagaaacttggtgaatttgggaaagcaaaaggttctcgagcaatttggtacatgtggctcggggcacgcttcttagagtttgaggctttaggattcatgaacgaagaccactggttcagtcgggaaaatagcctcagtggtgtggaaggtgaagggttgcacaaattaggatatatactccgcgatatcagtaaaattccaggtggaaatatgtatgccgacgacacagcgggctgggacaccagaataacagaagacgatttacagaatgaggccaaaattactgacataatggaaccagaacatgcgttacttgctacttcaatattcaaactgacatatcagaataaggtagttagagtacaacgacctgccaaaaatggcacagttatggacgtcataagcagaagggaccaaagaggatcaggtcaagtaggaacgtatggattaaacacgtttacaaatatggaagctcaattaatacgtcaaatggagagtgaaggaatcttcctaccctctgagcttgaaacgcaaaacctagcagaaagggtacttgattggttggaaaaatacggtgttgaaagactaaagcgcatggcaatatccggagacgattgtgtagtaaaacccattgacgaccgattcgcaactgctttgactgccttgaacgatatggggaaagtacgaaaagatataccacaatgggaaccctcgaaagggtggaacgactggcaacaggtacccttttgttcacatcatttccatcaattaataatgaaggacggccgcgagatcgtagttccttgtaggaaccaggatgaacttgtggggcgcgctcgagtatctcaaggcgctggttggtcattaagagagacagcatgcctgggtaaatcttatgcccaaatgtggcagcttatgtactttcatcgacgcgatctgcgattagctgccaacgccatctgttcggcagtacccgttgattgggtccccacgtcacggacaacctggtcaatccatgcgcaccaccaatggatgaccactgaagatatgttgtctgtatggaatagggtatggatagaagaaaatccttggatggagaataaaactcatgtttcctcatggggagatgttccttatttaggtaaacgagaagaccaatggtgtgggagcctgatcgggttaacagcaagggctacgtgggcatcaaacatacaggttgcgattaaccaggttcggcgactaattggtaacgagaactatttggactacatgacgtcgatgaaaaggttcaaaaatgagggcgaccctgaaggggctctctggtaa

SEQ ID NO: 21637 - RNA, 9879 nt, synthetic construct
  misc_feature 1..9879: note = derived and/or modified CDS sequence (opt6) from DENV-1__FJ882545__SS-prME
  source 1..9879: mol_type = other RNA
tcggtaacaatgttactaatgttgatgccaacagcattagctttccacttaacgacgagagggggagaaccacacatgatagtaagcaaacaagaaaggggaaaatctctactttttaaaacctcagcgggagtaaatatgtgcacattgattgctatggatttaggagaactgtgcgaagatacaatgacatataaatgtccaagaattacagaagcggaaccggacgatgttgactgctggtgcaacgcaactgatacatgggttacttatggaacttgttctcaaacaggcgaacatagaagagataaacgaagtgtagcactagcaccacacgtaggtttgggtctcgaaacaagaactgaaacatggatgtcctcagaaggtgcttggaaacaaattcaaagagtagaaacatgggcacttaggcacccgggatttacagtaatagctctctttcttgcacatgcaattggaacaagtatcacacaaaaaggtattatatttatactcttaatgctagtcacaccgtctatggcgatgagatgcgtgggaattgggagccgggattttgtagaaggtctctcgggagcaacttgggtagatgtagttttagaacacgggtcttgtgtgaccactatggcaaaagacaaacccacattggatatagaacttttaaagacggaagtaacaaatccggcagtattaagaaaattatgcattgaagctaaaatatcgaacactactaccgattcaaggtgtccaacgcaaggagaagcaactttagttgaagaacaagacgcaaattttgtatgcagaagaacttttgtagatagaggctggggaaacggctgcggactatttggcaaaggctcattgataacatgtgcgaagtttaagtgtgttaccaaactagaggggaaaattgtccaatacgagaacctaaaatattcagtaattgtcacagtacatacaggtgatcaacaccaggtcggaaatgaaagcaccgaacacggtacaacagcaaccataacaccccaagcaccaaccaccgaaatacaattaactgattatggagctctaacactcgactgctccccaaggacgggtctagatttcaacgaaatggttcttttgacgatgaaagaaaagtcctggttagttcacaaacagtggttcttagatctaccactgccgtggacttccggagcgagcacatctcaagaaacatggaataggcaagacctcttggtcacgttcaagacagcgcacgcaaagaaacaggaagtagtggtgctaggatcccaagaaggcgctatgcatactgctctaactggggccaccgagatccaaacgtcaggtactacgaccatttttgcaggccatcttaaatgtaggttaaagatggataaattaacccttaaaggaatgtcatatgtaatgtgtacaggtagcttcaagctagaaaaagaagtggcggagacgcaacacggtacagtgttagtgcagataaagtatgaaggtaccgacgcaccctgtaaaattccattctctacacaagacgagaaaggggtaacacagaacggcagactaataacggcaaaccctatagtaacggataaagagaagcctgtaaatattgaggcagaacccccattcggggaatcatacatagtaatcggggcaggcgaaaaagccctcaagttgtcatggtttaagaaaggatcttccattggtaaaatgttcgaggcaacggcacgaggagcaaggagaatggcgatcctaggagatacagcgtgggattttggcagcatcggtggcgtatttacgtcggtcggtaagctagttcatcaaattttcgggacggcatacggtgtgctctttagtggtgtgtcttggaccatgaagatagggatcggtgtattattaacatggttgggcctaaacagcagatccacctccctcagtatgacttgtatagctgttggcttagtgacgctatatctcggtgttatggtgcaagcagattccggatgtgtcattaactggaagggaagggagcttaaatgtggcagtggtatctttgtaacaaatgaagtgcatacttggactgaacaatataagtttcaggccgattcccctaaaaggctctccgctgcaataggaaaggcatgggaagagggagtttgcggtatacgcagtgcaactagattagaaaatattatgtggaagcaaataagcaatgagctaaaccatatactcttagaaaatgatatgaaactcaccgtagtagttggagatgttgcaggtattcttggtcagggaaagaaaatgatcaggcctcaacccatggaatacaaatacagctggaaatcatggggtaaagcgaaaataattggtgctgatgcacaaaatacgacattcattatcgatggaccgaatactccggaatgtcccgatgaccaacgcgcatggaatatttgggaggttgaagattatggctttggaatctttacaaccaatatatggttaaaactacgcgacagctacactcaggtgtgtgatcataggctaatgtcagccgccataaaagacagtaaggccgtacatgctgacatgggatactggatagaatcggagaaaaatgagacctggaagttagctcgggccagttttatagaggttaaaacttgcatatggcctaaatcgcacacactttggagtaacggcgtactagagtctgaaatgataattcccaagatctatggaggacctatatcccagcacaattatagacctggttattttacacagactgctggaccgtggcatttaggtaaattagaacttgattttgacttatgtgaaggaacaactgtagttgttgatgaacattgtggtaatcgaggaccgtctttacgaacaactacggttactggaaagataattcacgaatggtgttgtcgatcttgcaccctacccccgttgcgttttaggggagaagatggatgttggtacggaatggagatacgcccagtaaaagaaaaagaagagaacctcgtaaaatctatggtaagcgcaggctccggagaggtagattcattctcactaggactattgtgcatatcgataatgatagaagaagtaatgcgatcacggtggagtcggaaaatgttaatgacaggaactctggctgtattcttcctattaataatgggacagttaacctggaatgacttaattcgactttgcataatggtgggagctaatgctagtgacagaatgggcatgggtacaacatacctcgcactcatggctactttcaaaatgagaccgatgtttgcagtaggactgttatttagacggcttacttcacgtgaagttttacttttgactattggactctcgttggtggcatcagtggagctacccaattctcttgaagaactaggagacggattagcaatgggtatcatgatacttaagctacttaccgacttccagtctcatcaattatgggctacattactatcattaacatttataaagacaacattctcactccactatgcgtggaaaaccatggctatggtattatccatagtgtcgctatttccattatgccttagcacaacatctcagaaaactacctggttgcccgtgttattaggctcacttggttgcaaaccactaacgatgtttttaatcgctgagaacaaaatatggggaagaaaatcctggccacttaacgaaggcataatggcagtaggaatagtctctatattattgagcagtcttctcaaaaatgacgtcccattagcggggcccttgatcgcaggcggaatgcttatcgcatgctatgtaatatccgggagctcagcagacttgtccttggagaaggccgcagaggttagctgggaagaggaagctgaacacagtggcgcctcacataatatacttgtagaagtccaagatgatggtacaatgaaaattaaagatgaagagagggatgacactctaacaatactattaaaagcaactcttctagccgtttcgggcgtatacccactgtccatccctgcaacactattcgtatggtatttttggcagaagaagaaacagcgtagcggggtattgtgggatacgccaagcccgccagaggtagaaagagcagtattagatgatgggatttacaggataatgcagcgcggtttattaggcaggtcgcaagtaggtgttggtgtatttcaagagaatgtatttcacactatgtggcatgtaacccgaggcgcagttttaatgtatcaaggtaaacgactagaaccttcgtgggcgtcagtgaagaaagatctaatctcgtatgggggaggttggagactccggggcagctggaatactggtgaagaagtgcaggtaatagcagttgaacctggtaaaaatcccaaaaatgtgcaaacggctccgggaactttcaaaacaccggaaggggaagttggtgcgattgcgcttgattttaaacctggcacatccggatctccaattgtgaatcgagaaggtaaaatagttggactttacggaaacggcgtagtgactacatccggaacatatgtaagcgcaatcgcacaagccaaggctagtcaagaggggccattacctgagattgaggacgaagtctttcgaaaaaggaacttgactataatggatttacaccctggaagtggaaaaacaagaagatatttgccagccatagtaagagaagcaataaaacgaaaattaagaaccttaatattagcaccgacgagagtagtggcttcagaaatggcagaggcactaaaagggatgcctattcggtaccaaacaaccgccgtcaagagtgaacacactggcaaagaaatagttgacttaatgtgtcacgctacatttacaatgcgtctattatcgccagttcgtgtaccgaactataatatgattattatggacgaagctcattttaccgatccctcgagcatagctgcgaggggctacatttcgacccgagtcggtatgggcgaggcagcggcaattttcatgacggccacaccaccaggttcagtagaagcgtttccacaatcaaacgcggttatccaagacgaggagagggatataccggagagatcatggaatagcggctacgagtggataacggacttcccaggaaaaacagtatggtttgtaccatcaataaaatctggaaatgatattgcaaactgcttaaggaagaatggaaaaagagtcatacaactcagtagaaaaacctttgacacagaataccagaaaactaagaataatgattgggattatgttgtcacgactgatatctctgagatgggagctaacttccgggctgacagagtcattgatccgaggagatgtttgaaacccgtcatactaaaagacggacccgaacgcgtaatactagctggacccatgcctgtaactgttgcatccgctgcacaacgacgaggacgtatcggaagaaatcataataaagagggagatcaatacatttacatgggtcaaccattgaacaatgacgaagaccatgcacactggacagaagccaaaatgttattagataatataaataccccagaaggtatcattcccgctttattcgaaccagaaagagagaaatcggcagcagtagatggggaatatagattacgaggtgaggcacgcaagacatttgtggaactgatgagacgaggagatctaccggtatggttatcatacaaggtggcatcagaaggatttcaatatagcgaccgcagatggtgtttcgatggtgaaagaaataatcaagttttggaagagaatatggatgtggagatctggaccaaagaaggcgagagaaagaaacttcgtccccgatggttagatgcaagaacatactcggacccactggccctacgagaatttaaagaatttgctgctggtagaagatcagtctcaggcgatttgatattggaaataggtaaactaccccaacatttaacacaaagagctcaaaacgccttagataatctagttatgctacacaatagcgaacagggaggaagggcttaccgccatgctatggaagaacttccagatacaatcgagacactaatgctcttagctctaattgccgtactcacgggcggagttacactattctttcttagtggcagaggattagggaaaaccagtatcggtcttctttgtgtcatggccagttcggttctattatggatggcaagtgtagagcctcactggatagcggcatcgataatactagagtttttcttaatggtactgttgattcctgaaccggataggcagagaacaccacaagacaatcagttagcctacgtagttatcggactactatttatgatattgacggtagcagctaacgagatgggcctcctagaaactactaaaaaggatttaggaattggtcatgttgcagtcgagaaccatcaccatgctgctatgttagatgtagatctacatcccgccagcgcttggacgttatacgccgtggctacaacgataataactccaatgatgagacatacaatcgaaaacacaacggctaatatttccttaacagctatagcgaatcaggcggcgattcttatgggcctggacaaaggatggcctatctcaaaaatggatataggtgtccccttattagcattaggctgctacagccaagtcaatcctctgactttaaccgccgcagttcttatgctagtggctcattatgctataataggacctggattgcaagctaaagctacgagggaggctcaaaaacgaaccgctgcgggaataatgaaaaatccaaccgtagatggcatagttgcaattgatctggaccctgtagtatatgacgctaagttcgagaagcaattaggacaaataatgttactgatcctgtgcacttcacaaatcctcttaatgagaacaacatgggctctgtgtgaatccataacattagccaccggaccgttaacgacattatgggaaggctcccctgggaaattttggaatacaacgatcgcggttagtatggctaatatttttagaggctcgtatctcgccggtgctggacttgctttttcattgatgaagtcattaggtggagggagaagaggtactggcgcacaaggagagaccctcggtgaaaaatggaaacgtcaacttaatcaattaagcaaaagtgagttcaacacttataaaaggtcaggcatcatggaagtcgacaggtccgaagccaaagaaggcttaaaaaggggcgagaccactaaacatgcggtaagtcgaggcacagcaaaactacggtggttcgtcgaaaggaatctcgtcaagcccgaaggtaaagtgattgaccttggttgcggtagaggtggctggtcgtactattgcgctggactaaagaaagtaacagaggtcaaaggttacactaaaggtgggcctggacatgaagaacccattcctatggcaacatacggatggaacctcgtcaaattacattctggaaaggatgtgttcttcataccaccagaaaaatgtgacaccctactatgcgacataggcgaatcatctccaaatcctacgatagaagaaggaagaactttgcgagtacttaaaatggtagagccttggctgaggggaaaccaattctgtataaaaatccttaacccttatatgccatcagtagtggaaaccttagagcaaatgcaacgtaagcacggcggtatgctcgttcgaaatccattatcaagaaattcaacgcatgaaatgtactgggtttcatgtggcaccgggaatatagtaagtgcggtgaatatgacatctagaatgcttctcaatagattcactatggcacatcgtaaacctacatatgaacgtgatgtagatctgggaacaggaacaagacatgtagcagtggaaccggaagtagcaaacttggacataattgggcaaagaattgagaatattaaacatgagcataaatcgacttggcactatgatgaagataacccgtataagacgtgggcttaccatggaagttatgaagtaaaaccttcaggatccgcgtctagcatggttaatggagtagtcaaattgcttacgaaaccctgggatgttatccctatggtaacacaaatagctatgacggatactaccccgtttgggcaacaacgagttttcaaagaaaaagttgacactagaacgccaaaggcaaaacgtggtacagcacaaatcatggaagttacggcaagatggctttggggatttttgtctagaaacaagaaaccaagaatttgtacccgagaagaatttacacgtaaggtcagaagtaacgccgcaataggagccgtattcgttgatgaaaaccaatggaacagtgcaaaagaagcggtcgaagatgaaagattttgggatctggtacatcgggagagagagttacacaaacaaggcaagtgtgcaacttgcgtatataacatgatgggaaaacgggagaagaaactaggagagttcggtaaagcaaaaggatcaagggcaatatggtacatgtggcttggtgcaagatttctcgaatttgaagcactcgggtttatgaatgaagaccattggtttagtcgagaaaattcactatccggggtagaaggagaaggattgcataaactaggatatatattgagagatataagtaaaatccctgggggaaatatgtacgcagatgatactgcaggctgggacaccagaataaccgaagacgatctacaaaatgaagctaagattacagatataatggagcctgagcatgctttattggccaaagcaatatttaaattaacatatcaaaacaaagtagtaagagtccaacgaccagccaaaaacggaacagtaatggatgttatcagtaggagagaccagaggggcagtggacaggtaggaacatatggactcaatacatttacaaacatggaagctcaactcatccgacaaatggaatcagaaggtattttcagccctagcgaacttgagactccgaatctggcagaaagggccttagactggttggggaaatacggcgtcgagagactcaaaagaatggcaattagcggagatgattgcgtcgtaaaaccaattgacgaccgcttcgcaacggcactgaccgcactaaatgatatgggaaaagtccggaaagatattcctcaatgggaaccttcgaaaggctggaatgactggcaacaggtgcctttctgtagtcatcactttcaccagttgataatgaaagatggacgggaaatcgttgttccgtgtaggaatcaggatgagttagtagggcgcgctagggtatcacaaggtgcagggtggtcgctacgagaaaccgcttgcctaggaaagtcgtatgcacaaatgtggcagcttatgtactttcatcgccgagatcttagattagctgcgaacgcaatatgctctgctgtcccggtagactgggtaccgacgagtcgtacaacctggtccattcatgcacaccatcaatggatgactactgaagacatgttgtcagtctggaatcgcgtatggatagaggagaacccctggatggaggacaaaacacatatctcaagttgggaagacgtaccataccttggtaagagggaggatcaatggtgcggttccttgataggcttaacagcaagggctacatgggcgactaatatacaagtcgcgataaatcaggtgagaagactcataggaaatgaaaactacttagattacatgacgtccatgaaacggtttaaaaacgaaagtgacccagaaggtgcattatggtag

SEQ ID NO: 21638 - RNA, 9879 nt, synthetic construct
  misc_feature 1..9879: note = derived and/or modified CDS sequence (opt6) from DENV-1__FJ898372__SS-prME
  source 1..9879: mol_type = other RNA
tcggtgactatgctattaatgctaatgccgaccgcactggcatttcacttaacgacaagaggcggagaaccccacatgattgtatcaaaacaagagagggggaaatcattattatttaaaacatccgcaggagttaatatgtgtactctgatagccatggacttaggcgaactatgcgaagacacaatgacatacaaatgcccaaggattaccgaagcagaaccggacgacgtggactgctggtgtaatgcaaccgatacttgggtaacgtacggaacgtgtagtcagaccggcgaacataggagagataaacgatcagtggctctagcaccacatgtaggcttaggactagaaacaagaaccgaaacatggatgtcatcagaaggcgcctggaaacaaatacaaagagtggaaacgtgggcattaaggcatcctggttttacagttatagctttatttctggctcatgctattggaacctcaattacacaaaaaggcatcatatttattcttcttatgctcgtaacgccgtcaatggccatgcgatgcgtgggaattggttcccgcgattttgtggaaggactaagcggagctacttgggttgatgtggtactagaacacggtagctgtgtgacaacaatggcaagggacaaaccaacacttgacattgaacttttaaaaactgaagtgacaaatccagcggtattgcgaaaattgtgtatagaagcgaaaataagcaacaccacaacggacagtcgatgcccaactcaaggcgaagcgacattagttgaagaacaagacgcgaacttcgtttgtagaagaacttttgtagatcgcggttggggaaatggttgcggattattcggaaaagggtccttaattacatgtgcaaaatttaaatgtgtcactaaactcgaaggaaaaattgtgcaatatgaaaacttaaaatatagcgtgatcgtaaccgtacacactggggatcagcatcaggtaggaaacgaatcaaccgaacacggaaccacagcaactataacaccgcaagcaccgacaacagagatccaactaaccgattatggagctctcacgttagactgtagtcctaggactggcctggacttcaacgagatggttttattaactatgaaagagaaaagttggctcgtacataaacaatggtttctcgacttacccttaccctggacttcaggcgctagtacatcacaagaaacgtggaatcgtcaagatctcttagtaaccttcaaaacagcccacgctaagaaacaagaggtcgttgtcttggggagtcaggaaggtgcaatgcacacagctttaactggtgcaaccgagatacaaacgagtggaactacaacaatttttgcgggtcacctaaaatgtcgcttgaaaatggacaaattaacccttaaaggaatgtcatacgtaatgtgcacaggtagcttcaaattagaaaaagaagtagccgaaacccaacacggaacagttctggttcagataaaatacgaaggcaccgacgcaccctgcaaaattcctttcagtacacaagacgagaaaggagttacacagaatggaagactaataacagcaaatccaatagtcacggataaagagaaaccagttaatattgaggctgaaccaccattcggggaatcatatattgtcataggagcaggggaaaaagcactcaaactaagttggtttaagaaaggtagttccattggcaaaatgtttgaagctacggcacgaggtgctcgtagaatggccatactaggagatacggcctgggattttggcagtataggtggagtattcacaagtgtcggaaaattagtgcatcaaattttcggaacagcgtatggagtactgttttcgggtgtaagttggaccatgaaaataggaattggcgtactactaacatggcttggactaaactcacgttcgacaagtctatccatgacatgcatcgcagtaggcttagtaacgctatacttaggagtaatggtacaagccgacagcggatgtgtgatcaactggaaaggtagagaactaaaatgtggaagtgggatatttgttacaaacgaagtccatacgtggactgaacagtacaaattccaggctgactcgccaaaacggctgtcagccgccattggtaaagcctgggaagaaggcgtctgtggaattagatccgctacacgtctcgaaaatataatgtggaaacaaatatcgaacgaactgaatcacatattattggaaaacgatatgaagctaactgttgtcgtcggagacgtagcaggcattcttggtcaaggcaagaaaatgatacgaccacaaccgatggagtacaaatactcatggaaaagctggggaaaagcgaaaataataggtgccgatgcgcaaaacactactttcataatagacggcccaaatactcctgaatgccctgatgaccaacgagcttggaatatttgggaagtcgaagactacggattcggaatatttacaacgaatatctggttaaaactacgcgattcgtatacacaagtatgtgatcatcggttaatgtcagcagcgattaaggactctaaagctgtacatgcagatatgggatactggatagaaagtgagaaaaatgaaacatggaaattagctcgggcttcatttatcgaagtaaagacgtgcatatggcccaaatcccatacattatggtcaaacggtgtactcgaatcagaaatgatcataccaaaaatatatggaggccctatatcacaacataattatagaccaggctattttacacagaccgcagggccttggcacttggggaaactagaattagatttcgatttatgcgaaggcaccactgtagtagtagatgagcactgtggaaatcggggacccagtctacgcacaacgactgtaactggaaaaattatacatgagtggtgttgcagatcatgcactctgcctccccttaggttcaggggcgaagacggctgttggtatggcatggagatcagaccagttaaagagaaagaagaaaatctagttaaaagcatggtttcagcaggatccggcgaggttgacagcttcagccttggactattatgtatttcaattatgatcgaagaagtcatgagaagtcgatggtcaagaaaaatgcttatgacaggtacgttagctgtattctttttactaattatgggccagctgacctggaatgacttgatacgactatgtattatggtgggcgcaaatgcctctgaccgtatgggaatgggaaccacgtatctagcattaatggccactttcaaaatgagaccaatgttcgctgttggattattgttccggaggctcacaagtagagaggtgttacttcttactataggtttaagtcttgtagcaagcgtagaattacctaacagccttgaagaacttggcgacggattagccatgggtataatgatattaaaattactcactgattttcagtcacaccaactatgggcaacactactatcgttaactttcataaaaacgacattttccctccattacgcttggaaaactatggcaatggttctgtccatagtctctctatttcccctatgtttatcaacaacatcgcagaagacaacatggcttccggttctattaggaagtttagggtgtaaacccttaacgatgttcttaatagcagaaaataaaatatggggacgcaaatcatggccattaaatgaaggcataatggcagttgggattgtcagtatcctactatcatctctgttgaagaatgacgtacctttagctggacctctaatcgctggaggaatgcttattgcatgttatgtaatatctggttcgtccgcagatctctcgcttgaaaaagcagccgaggtctcttgggaggaagaagctgaacactctggcgcaagtcacaatatcctagttgaagtacaagacgatggaacgatgaagatcaaggacgaagaacgagatgatactttgaccattcttctcaaagctaccctattagcagtatccggggtttatccattgagtataccggcaacactattcgtatggtatttctggcagaagaagaaacagaggtccggagtgctatgggatactcctagtcccccagaagtcgagagagctgtcctcgatgacgggatctatagaatcatgcaaaggggactattgggccgcagccaagtgggagtcggagtatttcaagagaatgtcttccataccatgtggcacgtgactagaggagcggtactgatgtatcaagggaaaaggctggaaccgtcatgggcttctgttaaaaaggacttaatatcatacggaggcggttggcgactacgcggtagttggaatacaggagaagaagtgcaagttattgcagtagagcccggtaagaatcctaagaatgtacagacagcacctggtacatttaagactcccgaaggggaagtaggtgcgatcgcattagactttaagccaggtacatcaggatcgcccatcgtgaatcgtgaaggaaaaatagttggcctatatggtaacggggttgttacaaccagtggaacttatgtatctgccatagcgcaggcaaaagcatctcaggagggaccactccccgagatagaagatgaggtatttcgaaaacgaaatctcactatcatggacctccatccaggatccgggaaaacaaggagatacctacctgctattgttcgtgaagcaataaaaagaaagctaaggaccttgatattagcacctactagggttgtcgcatcagaaatggcagaggcccttaaagggatgcctatacgataccagactacagccgtgaaatctgaacatactggtaaagagatcgttgatttgatgtgtcatgcaacttttacgatgcgattactaagcccagtaagagtgccaaactacaatatgattattatggatgaagctcatttcacagatccaagtagtatagcagcgaggggttacatatctactagagtgggcatgggggaagccgctgcaatatttatgacagctacaccaccaggatctgttgaagcatttccacaaagcaacgctgtgatacaggatgaagaaagagacatcccagaacgttcctggaactctggatatgagtggatcacagatttcccaggaaaaactgtctggttcgtgccgagtataaagtcaggtaatgatatagcaaattgtctaaggaaaaatgggaaaagagttatacaacttagcagaaaaacctttgacacagagtatcagaaaactaagaacaatgattgggattacgttgtcacaacagatatttctgaaatgggagcaaattttagggcggacagggtaatagacccccgtagatgcttgaagcctgtcatattaaaggatggcccagagcgggtcatacttgcgggtccgatgcctgtaacggtagctagcgcagctcaacggcgaggaaggattgggaggaaccataataaggaaggagatcaatatatatatatgggacagccactgaataatgacgaagatcatgcccattggacggaggcaaagatgcttcttgataatataaatacacctgaaggaatcattcctgcattattcgaaccagagagggaaaagtcggcagcggtcgatggtgaatataggcttaggggagaagcgagaaaaacgtttgtcgaacttatgaggagaggtgatttaccagtttggttatcatataaagtcgccagcgaaggatttcaatatagcgataggcgatggtgctttgacggagaaagaaataaccaagtactggaggagaacatggatgttgaaatatggacaaaggaaggagagaggaaaaagttaagacccagatggctggatgcaagaacatattcagacccattagccttacgtgaatttaaagagtttgcggctgggagacgttcagttagcggggatctaatcctagaaatcggtaaactacctcaacatctcacacaaagggctcaaaatgctttagacaatttggtaatgctccacaacagtgagcaaggagggcgagcttataggcacgcaatggaggaactaccggacactatagaaacattgatgttgttagcactaatagcggtattaacagggggagtaactcttttcttcctctctggacgcgggcttgggaagactagcattggacttttatgtgtaatggcatcatcggtattattgtggatggcatctgttgaacctcattggattgcagcatcaataatactcgagttctttctcatggtcctcctaattcccgaaccggataggcaacggacaccacaagacaatcagttagcttatgtcgtcataggcttacttttcatgatattgacagtagctgcaaatgaaatgggcttattagaaaccaccaaaaaggacctcggtataggccatgttgcagttgaaaaccaccatcatgctgctatgttagacgtagatctacacccagcctccgcatggacactatatgcagtagcaacaaccattataactcccatgatgcgccatacaatagaaaatacaacagccaatataagtctaactgccatagcgaatcaggcggctatcctaatgggtttggacaaaggatggcccataagcaagatggacataggtgtccctcttcttgcattggggtgttacagtcaggtaaacccactaacgttgaccgctgctgtactgatgcttgttgctcattatgccataatagggcctggactccaagccaaagccacaagggaagcgcagaagagaacggcagcgggaattatgaaaaatccgacggtagatggaattgtcgccattgatttagacccagtggtgtatgacgcaaaatttgaaaaacaattaggtcaaattatgttattaatactctgtacatcacaaatactattaatgagaactacctgggcactgtgtgaatcaatcacactagcgacgggcccattaacgacactatgggaaggcagcccagggaaattctggaatacaacgattgccgtttccatggccaacattttcagaggttcctacctagcaggcgcaggtctcgctttctctctaatgaaatcattaggcgggggtagaagaggaaccggagcacaaggcgaaacattaggcgaaaagtggaaaagacaactaaatcaattaagtaaaagtgagttcaacacttacaaaaggagtggaatcatggaagtagacagaagcgaggccaaagagggcttgaagagaggggagacaacaaaacacgcagtgtcgcgaggcacggctaaactgagatggttcgtagaaaggaatctggtaaaacccgaggggaaggtgattgaccttgggtgcggaagagggggttggagctattattgtgccggactaaagaaagtaactgaagtaaagggttatacaaaaggaggtccaggacatgaggagcccatacccatggctacatatggttggaatctagtaaagttgcacagtggcaaagatgtattctttataccacccgaaaagtgtgatacactactatgcgatattggtgagagtagtcctaatcccacaatagaggaaggtcgcacactaagagttctcaaaatggtagaaccttggttgagaggaaatcagttctgcataaagatactaaatccctatatgccgagtgtagtagagaccctcgaacaaatgcaaagaaaacatggagggatgctagtcagaaaccctcttagtaggaacagtactcacgaaatgtattgggtttcatgtggtacgggtaacatagtttcagcggtcaatatgacaagcagaatgttattaaataggtttactatggcacatagaaagcccacttacgaacgagatgtagacctcggaacgggcacaagacacgtagcagtagaaccggaggtagccaatctagatataataggacaaagaattgagaatataaagcacgagcataagtcaacttggcactatgacgaagataacccctataaaacctgggcgtaccacggttcctatgaagtgaaacctagtggatctgcaagctcgatggtaaacggagtagtaaaattgctaaccaagccgtgggacgttattcccatggttactcagatagcaatgacagacaccactccctttggacaacaaagagtatttaaagaaaaggtagatacgcgtaccccaaaagcaaagcgaggcactgcacagattatggaagtaacggcgcgatggctatgggggtttttaagtagaaacaaaaagccgagaatatgtacaagggaggaatttaccagaaaagtgagaagtaacgctgcgataggtgcagtatttgtcgatgagaaccaatggaactcggcaaaagaggccgtcgaagatgagagattttgggatcttgttcatcgagagcgtgaattacacaagcagggaaaatgtgcaacgtgtgtctataacatgatgggcaagagggagaagaaactgggtgagttcggaaaagccaaaggttcacgagccatatggtatatgtggttaggtgctagattcctagaatttgaagcccttggatttatgaatgaggaccattggtttagtcgtgaaaacagtctctcgggtgtggagggggaaggcttacacaaacttggatacattttaagagatatttccaagatacccggaggaaatatgtacgcagacgacaccgcaggctgggatacgagaataactgaggatgatctacaaaatgaggccaaaataactgatataatggaacccgagcatgcactgctagccaaagcaatattcaaactaacctatcagaacaaagtagtaagagtacaaagaccggccaaaaatggcacagtgatggatgttatatctaggcgagatcaacgaggatccggacaagtaggaacctatggcttaaacacctttactaatatggaggctcagttaatacgacaaatggagtctgagggtatattctcaccaagcgaactagagacgccaaaccttgctgaacgagcattggattggttagaaaaatatggcgtagagagattaaaaaggatggctatctctggcgatgattgtgtggtcaaaccaatagatgaccgattcgcgactgccttaacggccctgaatgacatgggtaaagtgaggaaggacatacctcaatgggaaccatctaaaggatggaacgactggcaacaagttccgttttgtagtcaccacttccaccagcttattatgaaagatggtcgagaaattgttgtcccatgtagaaatcaagacgaacttgtaggacgagcacgggtatctcaaggggcaggctggagtctgcgagagacagcttgcctaggaaaatcatacgcacaaatgtggcaattgatgtactttcataggcgagatttacggttagcggctaacgcaatatgttcggccgtcccagtagattgggtcccaacgagtcggacaacgtggagtatacatgcacatcatcaatggatgacgacagaggacatgttaagtgtatggaaccgagtctggatagaagagaatccatggatggaggacaaaactcatatttcatcatgggaggatgttccatatctcggaaaaagagaggaccaatggtgtgggtccctgataggtctcaccgctcgagctacatgggcaacaaatatccaggtggcaattaatcaagtacggaggttgataggaaatgaaaactaccttgactacatgacaagtatgaaacgattcaagaacgagtccgatccagaaggcgctctctggtga

SEQ ID NO: 21639 - RNA, 9879 nt, synthetic construct
  misc_feature 1..9879: note = derived and/or modified CDS sequence (opt6) from DENV-1__FJ898373__SS-prME
  source 1..9879: mol_type = other RNA
tcagtaacgatgctactaatgttaatgccgacggctttggcgtttcatctgactactagaggtggcgaacctcacatgattgttagcaaacaggaacgaggaaaatcattactatttaaaacatccgcaggggtgaatatgtgtacacttattgcaatggatctgggagaactatgcgaagatacaatgacttacaaatgtccacgtataaccgaagtagaaccagacgatgtagactgctggtgcaacactacagacacttgggtaacgtacggtacctgctcacagactggtgaacacagaagagacaaaagatctgtagcattagcaccacatgtagggttaggtttagaaacaagggcagaaacttggatgagtagtgagggagcatggaaacaaatacaaaaagttgaaacttgggctttaaggcatccggggtttacggtaatagcattattcctagcacatgctataggtacaagtataacacaaaaaggcataatatttattttactcatgctagttacaccctctatggctatgcgatgcgtagggatagggagtcgtgatttcgtagaaggtttatctggagctacgtgggtagacgtagtcttagaacatgggtcatgcgtcacgaccatggctaaagataaaccaacactagacatagaactactcaagactgaggtcaccaacccagcagttctaagaaaactgtgcatagaagctaaaatcagtaatacgacaacagactcacgatgccccacacaaggggaagcaacgttagtagaggagcaggatgcaaattttgtttgccgaaggacatttgtagaccgcggctggggaaatggatgtggcctttttggaaaaggtagtttgataacctgcgcaaaatttaaatgcgtaacaaagttagagggtaagatagtacaatacgaaaacctgaagtactcggtaattgtgacggttcatacaggagatcaacatcaggtgggcaatgaaagcactgaacacgggacgatagcaacaataacaccacaagcacctacctcagagatacaactcactgattatggagcgttaaccttggactgttctccacgaacaggattagacttcaacgaaatggtactattaacaatgaaggaaaaatcttggttagtacataaacaatggttccttgatctaccattaccgtggacgagtggagcatcgacatcacaagaaacttggaaccgtcaagatctcctagtaacctttaaaacagctcatgcgaagaaacaagaagtcgttgttttagggtcccaagaaggggcaatgcatacggcattaacgggagctaccgaaatacaaacgacgggcacaacgacaatattcgccggccacttaaaatgccgactaaaaatggataaattgaccttgaaaggtatgtcatacgtcatgtgcacgggatcatttaaactagaaaaagaggtcgctgaaactcaacacgggaccgttctagtgcagataaaatatgaaggtacagatgcaccatgtaagataccattttcaacacaagatgaaaaaggtgtaacacaaaatggaagattaataacagcaaaccctatagtaactgacaaggaaaagccagtcaacatagaggcagaacctccattcggggagtcttacattgtaataggcgcaggagagaaagcattgaaattatcgtggtttaagaaaggatcgtctataggaaaaatgttcgaagcgacagccagaggcgcccgtcggatggcaatcttgggagatactgcgtgggactttggatcgattggtggggtctttacatctgttggaaaattagtacatcaaatttttggaacagcatacggtgttctattttcaggtgtgtcatggacgatgaaaatagggataggagtcttattaacatggctaggacttaattcgagaagcacatcgttatcgatgacctgcatcgctgttgggttaataactctttatctgggagtcatggtacaggctgactcaggatgtgtgataaattggaagggtagggaattaaagtgtggatcaggaatctttgtaaccaacgaagtacatacttggactgagcaatataagtttcaagctgattcacctaagaggttaagcgcagcagtgggaaaggcatgggaagaaggcgtatgtggaatacgcagcgccacaagactagaaaatattatgtggagacagatatctaatgagttaaatcatatactattagaaaatgatatgaaattcacagtcgtagtcggtgatgtcgtaggtatactagcgcaaggcaagaaaatggtacgacctcaacctatggagcataagtatagttggaaatcatggggtaaggctaagattataggagccgacgtccaaaacactacttttataatcgacggacccaacacacccgaatgcccggatgaccaacgagcatggaatatttgggaagttgaagattacggttttggtatttttaccacaaatatctggctaaaacttagagattcctatacccaagtatgtgaccatagacttatgtccgcggctataaaggactccaaggctgttcacgccgatatgggttattggatagaaagcgagaaaaatgagacatggaaacttgctcgtgcgtctttcattgaagttaaaacttgtatctggcccaaaagccatactctatggagtaatggcgtactcgaaagcgaaatgataatacccaagatttatggaggtccaatctcacaacataattaccgccctggatatttcactcagacagccggcccatggcatctaggcaagttagaattggattttgacttgtgtgagggaacgaccgtggttgtggacgaacattgcggaaataggggcccctcgctacgaactactaccgtaaccggaaaaattatacatgaatggtgttgcaggagctgcactttaccaccgttacggttcaaaggggaagacgggtgttggtatggaatggagataagacccgtaaaagaaaaggaagaaaacctggtaaagagtatggttagtgcaggatccggagaagttgacagttttagcctaggactcttatgcatatcaattatgatagaagaggttatgcgttccagatggtcacgcaaaatgttgatgacgggaacgttagcggttttctttctactcataatggggcaactgacatggaatgatttaatccgttcctgcataatggttggtgcaaatgcttcagaccgaatgggaatgggtacaacctatttagccttaatggccacgtttaagatgagaccaatgttcgccgtaggcttactatttcggagactaacaagccgggaagtactgctccttaccataggtctttctctggtggcctctgtggaattaccaaactctctggaagaattaggagatggattagcgatgggtataatgattctcaaacttttaacagattttcaatcttatcaactatgggctaccttactatccctaaccttcatcaaaactacattttcactacactatgcatggaaaacaatggccatggttttgagtatagtatcattactacctctgtgcttgtcaacaacatctcagaaaactacatggttgcctgtattactaggtagtctaggatgtaaaccattaacaatgtttctaattgccgagaacaaaatatggggaagaaaatcctggccacttaatgaaggaataatggcggtcggcattgtaagtatactattatcctcactacttaaaaacgatgtaccactagcaggccccttaatagcaggaggtatgttaatagcctgctatgtaatatccggatcttctgccgacttgtcattagagaaagcagcagaagtgagctgggaagaggaagccgaacatagtggtgcatcacataatatcctagtagaagtacaagacgatggaacaatgaaaattaaggacgaagagagggatgacacactcaccattctattgaaagcaaccttgcttgccgtttctggtgtatatccactatcaattccagctactttattcgtatggtatttctggcaaaagaagaaacaacgatcgggagttctatgggatacaccatcaccgcccgaagtcgaacgcgctgtattagacgatggaatataccgtattatgcaaagaggtctcctaggccgaagccaagtaggagtaggagtattccaagagaacgttttccacacaatgtggcatgtcacacgtggtgcagtacttatgtatcagggtaaacgcctggaaccatcatgggctagcgtcaagaaagatctaatcagctatggcggaggatggcgactgcaaggtagctggaacacaggtgaagaggtccaggtgatcgctgtggagccaggaaagaatcccaagaatgtccaaactgctccaggtacctttaaaactccagaaggcgaagtgggggcaatcgcactagacttcaaaccgggaacgtctggctcgcctatagtaaatagagaagggaagatagtcggtctatatggtaacggtgtggttaccacctctggcacctacgtctcagctattgcacaggctaaagcatcacaagaaggaccacttccagaaatcgaagatgaggtttttcgaaaaagaaacttaaccattatggatcttcatccaggttcaggtaaaacgagaaggtacttaccagctatagtgagggaagcgattaaaagaaagctaaggacattaatcttagccccaacgcgagttgttgcctcagagatggcagaagcgttaaaagggatgccaataaggtatcaaactactgcagtcaaatcagagcatacaggtcgcgaaatcgttgacctcatgtgtcatgccacgtttactatgcggcttctgtcgccagttcgagtacctaactacaatatgataattatggatgaagctcacttcacggacccgagtagcatagcggcccgtggttacatctcaacaagagtcggtatgggggaagctgccgcgatatttatgaccgctacgccgccaggctcagtcgaggcttttccacaatctaatgccgtaattcaagatgaggagcgcgacataccagaaaggtcgtggaactcaggatatgaatggatcacagacttcccaggaaaaacggtttggttcgtgccttctatcaaatcaggtaatgatatagccaattgtttaaggaaaaacggaaaacgcgtcatacaattaagtcgtaaaacattcgacactgagtaccaaaagacgaaaaataatgactgggattacgtagtaacaaccgatataagcgaaatgggggctaactttagagctgacagggtgatagaccctcgacgatgcttaaagcctgtgatcttaaaagatggtccagagagggtgatattagcggggccaatgcctgtcactgtagcaagcgcagcacaacggcggggaaggattggtaggaaccacaataaggaaggtgatcaatacatatacatgggacaaccactaaataacgatgaagaccatgctcattggacagaagctaagatgctgctagataacataaacacaccggaaggaattatacctgccttgtttgaacctgaaagggaaaaatcagcagcaatagatggcgaatatagattacgaggtgaggccagaaaaacttttgtcgaattgatgagaagaggagatttaccggtgtggttatcatacaaggtggcatctgagggatttcagtattcagaccgtagatggtgcttcgatggggaacgtaataatcaagtattagaagagaatatggatgtcgaaatttggactaaggaaggagaaaggaagaaacttcgaccaagatggctggacgccagaacctatagcgaccctctagcactaagagaatttaaagaatttgcagctggtagacgtagtgtgagtggtgatttaattctagaaataggtaaactaccgcaacatctaactcaacgtgcacaaaatgccttggataatttagtgatgttacataacagcgaacagggaggtagagcttacagacacgctatggaagaacttcctgatacaattgaaactctcatgctactcgcactaattgcggtattgactggcggggttacattgttctttctatcgggtcgaggtttaggaaagacgtctatagggctcctatgcgttatggcttcaagcgcattgctatggatggcatccgttgaaccacactggatagcagcatcaataatcctagagttcttcttaatggtcctgctaatacctgaaccggacagacaacgtacaccacaagataatcaactggcgtacgtcgttatcggccttttgtttatgatccttacagtagccgcaaatgagatgggcttgctcgagactacgaagaaagacttaggtatagggcacgtagctgtggaaaaccatcatcatgcaacgatgcttgacgtggacttgcatccagccagtgcttggacactatatgctgtcgccactacaatcataacacctatgatgaggcacacgattgaaaatacaaccgcaaatatcagcttaactgccatagcaaaccaagcggcaatattaatgggcttagacaaaggatggccaatatcgaaaatggatataggagtgcccctcctagcactaggttgctattctcaagtaaatccattaacactaaccgcagctgttttaatgttggttgcacattatgcgataattggaccaggattacaagctaaagcaactagagaagcccaaaaacgaacggcagcaggaatcatgaaaaatccaactgtagatggcattgtagccatagatctcgaccctgttgtatatgatgctaaattcgaaaaacagttgggacaaataatgcttctaatactctgtacatctcagatattattgatgcgaacaacctgggcgctgtgcgaaagtataaccctagccactggtcctttaacaactttatgggaaggatctcccgggaaattttggaataccacaattgcggtctcaatggcaaatatttttcgtggttcttacttagccggtgctgggcttgctttctcgctcatgaaaagtctaggtggtggccgtagggggaccggggcacaaggagaaacactcggggagaaatggaaacgccaattaaatcaactaagtaaatcagagtttaatacgtataaaagaagcgggattatggaggtcgatagaagcgaagcgaaagaaggactaagaaggggagaaacaacaaaacacgcggtgtcaagagggacggcaaaactacgatggtttgtagagcgtaatctagtgaaacccgaaggtaaagtgatagatctaggatgcgggcgtggcggctggagttactattgcgcggggcttaagaaagtgactgaagtaaaaggatatacaaagggaggtcctggtcatgaagaaccgattcctatggccacttatgggtggaacctcgttaaattacattccggaaaggatgttttctttataccaccagagaaatgtgatacattactatgtgacattggagagagctcgccgaatccaactatagaagagggaagaaccttacgagttttaaaaatggtggagccctggcttaggggaaaccaattttgtattaagatcctcaatccatatatgccatcagtggtggaaacacttgaacatatgcaacgcaagcatggagggatgcttgtaaggaatccattatcaagaaactccacacatgaaatgtattgggtaagctgcgggactgggaatatagtatccgccgtaaatatgacaagccgcatgttacttaatagatttacaatggcacatagaaaacccacatacgaacgtgatgttgacttgggagcgggaacgcgacacgtggcagtagagcctgaagtagccaatctagacattataggtcaacgtatcgagaatataaagcacgaacataaatcaacttggcactatgatgaagataacccttataagacgtgggcatatcatggcagttatgaagttaaaccatcaggttccgcgtcaagcatggtaaatggcgttgtaaaactacttacaaaaccatgggacgtcattcctatggttactcaaatagctatgacagacacaacaccctttggtcagcaaagagtgtttaaagagaaggtagatacaaggacaccaaaagcaaaacggggtacagcacaaattatggaagtgactgctcgttggttatggggatttttaagtcgcaataagaaacccagaatctgtacgagggaagagttcacccgaaaagtgcggtcaaacgcagcaattggagcagtatttgtcgatgaaaatcaatggaactctgctaaagaagcagtcgaagatgaaagattctgggacctggtgcacagggaacgagagctccacaaacaaggaaaatgtgcgacctgcgtgtataatatgatgggtaaacgcgaaaagaaactaggagagtttggaaaggcaaaaggaagtagagccatttggtatatgtggttaggtgcgagattcttagagtttgaggctttaggttttatgaatgaagatcattggttcagtagggaaaatagtctgtctggtgtagaaggggaaggcttacataaactcggctacatactccgtgatatatcaaaaattccaggcggcaacatgtacgctgacgataccgctggttgggatactagaataaccgaagatgatctacagaatgaggctaagataacagacataatggaaccggagcatgccctgctagccacctcaatctttaaattaacttaccaaaacaaggtggtccgcgtacaaagaccagccaaaaatggaacggtgatggacgttatctcaagaagagatcaaagaggtagtggacaagttggtacatacggcttaaacactttcacaaacatggaagctcagctcatccggcaaatggagtctgaaggaatattttctccctctgagttagaaacaccaaatctcgcagagcgagtacttgactggcttgaaaaatatggagtcgaacggctcaaaagaatggcaataagtggagatgactgtgtcgtcaagccgatagatgatcgatttgcgactgcactaactgccctcaatgacatgggaaaagtaagaaaagatatccctcaatgggagccttctaaagggtggaatgattggcagcaagtacctttttgcagtcatcatttccatcaattaatcatgaaggatggcagagaaatagtagttccgtgtagaaatcaagatgagctagttggtcgggccagagtatcccagggagcaggttggtctctcagagagacagcttgtctcggaaaatcctacgcccaaatgtggcaactaatgtatttccacaggagagatctgagattagcagcgaatgctatctgctcagctgtgccggtcgactgggtgccgacatcacgaaccacatggtcaatacatgcgcatcatcagtggatgacaacagaggatatgctgagtgtctggaaccgcgtttggatcgaagaaaacccatggatggaggataaaactcacatatcatcatggggtgatgtaccttaccttggtaaacgagaagatcagtggtgcggcagcttaataggattaactgcacgagcaacatgggctacaaatatacaggtagctatcaatcaagttagaagactcattggtaatgaaaactacttagattatatgacaagtatgaaaagatttaaaaatgaaagtgatcccgaaggagcactatggtag

SEQ ID NO: 21640 - RNA, 9879 nt, synthetic construct
  misc_feature 1..9879: note = derived and/or modified CDS sequence (opt6) from DENV-1__FJ898374__SS-prME
  source 1..9879: mol_type = other RNA
tcggttaccatgcttttgatgttgatgcccactgctctcgcattccatctaaccactagagggggagaaccacatatgatagtcactaaacaagaacgcgggaaaagtttactgttcaaaacttctgctggtgtaaatatgtgtaccttaatagcaatggacttaggggaattatgcgaagataccatgacatacaaatgtcccagaattacagaagcagaaccagacgatgtagactgttggtgtaatgcaactgacacttgggtaacttatgggacttgtagtcaaacgggggaacatcgaagggataaaagatcggtagctctagctccacatgtcgggttaggattagaaacaagaacagaaacttggatgagttcagaaggcgcttggaaacaaatacaacgcgttgaaacatgggccctaagacacccgggtttcaccgtaatagctctatttctagcccatgcaattgggactagcattacacaaaaaggaatcattttcatactcttgatgttagtgactccctcaatggccatgcgctgtgttggaattggctcaagagattttgtagaaggattatccggagctacttgggttgatgttgttctagaacatggaagttgtgtaacaactatggcgaaagataaacctactctagatatagagttactgaaaactgaagttacaaatccagcagtgcttcgaaaattgtgcatagaagcaaaaatatctaataccactactgacagtagatgtccaacgcaaggtgaagccacccttatggaagaacaagatgctaacttcgtttgcagacgcacgtttgttgatagagggtggggaaacggctgtggattatttggcaaaggatcgctcatcacatgtgcgaaattcaaatgcgtaacaaaactcgaaggtaaaatagtacaatacgagaacctaaaatactcggtaatcgtaacagtccatacaggtgatcaacaccaagtgggtaacgaatctacagaacatggaacaacagctactataactccacaagcacccacgtctgagatccaacttacagactacggagctcttacattagattgttcaccaagaactggtttagattttaatgaaatggtactgttaacaatgaaagagaaaagttggttagtgcataaacagtggtttttggatttaccattaccatggacaagcggcgctagcacaagtcaagaaacgtggaataggcaggacttgttagtaaccttcaagacagcacacgccaagaaacaagaagttgttgtactaggtagtcaggagggagccatgcatactgcgttaacgggagcaacagaaattcaaacttccggaacaactactatatttgcaggccaccttaaatgtagactaaaaatggacaaattaacattaaaaggcatgagttacgtaatgtgcacaggaagttttaaattggaaaaagaagtagccgaaacgcaacatggaacagtgcttgttcagataaagtacgagggtactgacgccccctgcaaaataccctttagcactcaagatgagaaaggagtgattcaaaatggaagacttataacagcaaatccaatagtaacggataaagaaaagccagtcaacatagaagcagagcccccgtttggagagtcctacatagtgattggcgtcggggaaaaagcattaaaattaagttggtttaaaaagggtagctctataggaaaaatgtttgaagcaacagcaagaggagcaagaaggatggccatactcggagataccgcttgggatttcggcagcataggtggcgtgtttacatcagtagggaagttagtacatcaaatctttgggacagcatatggagttttatttagtggcgtgagttggacaatgaagattggaatcggtgtactattaacatggcttggacttaattctaggagtacttcattgtcaatgacatgtatagctgttggactggtaaccttatatttaggtgtaatggttcaggctgactcaggatgtgtcataaattggaaaggaagagaattaaagtgtggcagtggaatctttgtcactaatgaagtacatacgtggactgagcaatataaatttcaagcagatagtcccaaacggttatcagctgctattggtaaggcgtgggaagaaggggtttgcggtatacgatctgtgacgaggttagaaaacatcatgtggaagcaaattagtaatgaattgaaccacattcttctggaaaacgatatgaagttcacagtcgtagtaggagatgtagtcggtatactagcacaaggtaagaaaatgataagaccacagccaatggaacataaatatagttggaagagttggggcaaggctaaaataatcggtgcagatgtccagaacacaacatttataatcgacggaccaaacacacccgaatgccccgacgaccaacgagcatggaatatatgggaagtagaggactacggattcggtatattcacgaccaacatctggttgaaactgagagattcctacacacaggcttgcgatcatcggctaatgagcgctgccataaaagattctaaggctgtccatgccgatatgggatattggattgaatcagagaaaaatgaaacttggaaattagcaagagcaagtttcatagaggtaaaaacctgcatttggccaaaaagtcacacactctggagtaacggggtgctggaatccgaaatggtaatacccaaaatatatggtggaccaataagtcaacacaattaccgcccgggttatttcacacaaactgctggtccctggcacctaggtaaacttgaactggacttcgatctttgtgaaggtaccacagttgtagttgacgaacactgtggaaataggggaccctcactaaggactacaactgtgaccggaaaaatcattcacgaatggtgttgccggagctgcacattaccaccgctacgatttaaaggtgaagacggctgctggtacgggatggaaattagacctgtaaaagaaaaggaggaaaatctagtgaagagtatggtgtccgccgggagtggagaagtagattctttctcattgggcttgttatgcatatcaataatgatagaggaagtaatgagatcgcgctggagcaggaagatgcttatgacgggaactctggcggtctttctcctattaattatggggcaactcacatggaatgatttgataagactctgcatcatggtgggagcaaatgcgtcagataggatggggatgggaactacctatttagcactaatggcaacctttaaaatgaggccgatgtttgcagttggattactatttagacggttgacgagccgagaagtattacttttaactataggtttgagtcttgtagcaagcgttgagctacccaatagtcttgaggagctaggagatggactagctatgggaataatgatcctcaaacttctaacggatttccagagtcaccaactatgggccaccctcctctcattaactttcataaagacgacactatcattacattatgcatggaaaacgatggcaatggttctttctatagtatcactatttcccttgtgtctatcaactacatcacaaaagactacctggctccccgtgctcctcgggagcctgggttgtaagcctttaacaatgttcttaattgccgaaaacaaaatttggggaagaaagagctggccattaaacgaaggaattatggcggtaggcgtagttagtatattactttcatcattactgaaaaacgatgtaccgctagccggcccattaattgcgggaggaatgctaatagcgtgttatgttatttcagggtcaagtgcagacttaagtttggaaaaagctgcagaagtgtcgtgggaagaagaagcggaacattcgggggcttcgcacaatatactcgtggaagtacaggatgacggcaccatgaaaattaaagacgaggaacgagatgataccctgacaatattgcttaaagcgactttattagcagtttcaggcgtttatccattgtctataccggcaacgttatttgtttggtatttttggcagaagaagaaacaacgatctggggtcctctgggacacaccgagtcctccagaagtagagagagctgtattggatgacgggatataccgtataatgcagcgaggtttattaggaaggtcgcaagttggcgttggagttttccaagaaaatgtcttccataccatgtggcacgttacacgaggtgcggtacttatgtatcaaggaaaaaggttagagccttcgtgggcatccgtaaagaaggatctaatctcctacggagggggatggcgcttacaagggtcatggaacacgggagaagaggtacaagttattgcggtagaaccaggcaaaaatcccaaaaatgtacaaacagctcctggtacattcaaaacaccagaaggagaagtaggcgcaattgcattagattttaagccgggaacaagcggaagtcccatcgtgaatagagaagggaagatagtcggtctatatggaaacggcgtcgtcacaacctcaggaacgtatgtttccgccattgcacaagcaaaggcatcacaagagggtcccttacctgagattgaagatgaagtgtttagaaagagaaatttgacaataatggatcttcatcccggctcgggaaaaacgagaaggtatcttccggcaatcgtcagggaagcaattaaaagaaaattaagaacattaattctggcccccacaagagtcgtagcatcggaaatggcagaagccttaaaaggaatgccaatacggtatcaaacaacagctgtaaaatcggaacatacgggcaaagagatagtagacctaatgtgccatgcgacttttactatgaggttattgtcaccagtaagggttccaaattataacatgataattatggatgaggcccattttactgatccttcatcaattgcagctcgcggatatataagtaccagggtaggaatgggtgaagccgcagcaatctttatgactgccacacctccaggatcagttgaagcctttccgcaaagtaacgcggtaatccaggacgaagaacgagatataccagaaagatcctggaactcaggctatgaatggataaccgacttccccggaaaaaccgtctggttcgtaccctctattaaatctgggaatgatatagctaattgcttgaggaaaaatggaaaacgagttattcaactttcgagaaagactttcgacacagaatatcagaaaaccaaaaacaacgattgggattatgtagtaacgacggatataagcgagatgggtgcgaattttcgcgcagatagggtcatagatccaaggaggtgtctcaaacctgtcatcctgaaggatggacccgaacgagtaatacttgccggtcctatgcctgtaactgtagcaagcgcagcacagagaagaggccgaataggcagaaaccataataaagagggagaccagtacatttacatggggcagccattaaacaatgacgaagatcatgcccactggactgaggccaaaatgcttttagacaacatcaacacccccgaagggattatacccgcgttgtttgaacccgaacgtgagaaaagtgccgcaattgacggtgaatacagattgaggggagaagcacgaaagactttcgtagaattgatgcggagaggtgatctacccgtgtggctaagctataaagttgcaagtgaagggttccaatattccgacagacgctggtgttttgatggggagcgcaacaatcaagtcctagaagagaacatggatgttgagatttggacaaaagagggcgagcgaaagaaactaagaccccgctggttggacgcccgaacctactctgatccactagcactaagagaatttaaagaatttgcggccggtcgccgatccgtgtctggcgaccttatcttggaaataggaaaactccctcaacatttaacgcaacgagctcagaatgcgctggacaatcttgttatgctccacaatagtgaacaaggcggtcgcgcataccgccacgcgatggaggagctacctgacactatagaaactttaatgctattggcgttaatagctgttttgacaggaggcgtcacactattctttttaagcggaagaggcctagggaaaacctcaatcggcttattatgtgtaatggcatcttcagtactactttggatggcatctgttgaaccacactggatagccgcgagtattatattggaatttttccttatggtactgttaatacccgaacctgatcgacagagaacaccacaagataaccaattagcttatgtggtgatcgggctgttatttatgatcctgactgtggctgcaaacgaaatggggttactcgagacaacgaagaaagatctgggaataggacatgttgcagttgaaaatcatcatcacgctaccatgctagacgtagacttgcaccccgcaagtgcttggacactatacgccgtagcaacaactatcataacaccgatgatgcgtcacactatcgaaaacacgaccgcaaacatttccttgactgcgatagcaaaccaagctgctatactgatgggcctagataaaggttggcccataagtaaaatggatattggagtacccttgctcgctctaggttgctactcacaggtaaatccacttacactaacagccgcagtgctgatgcttgtggcgcattacgccataataggacctggtttgcaagcaaaagcaactagagaagcacaaaaacgaacagcggctggcattatgaaaaacccaactgtggacggcatagtagctatagaccttgatccagtagtttatgacgccaaatttgaaaaacaactggggcagattatgcttcttatattatgcacttcacagatattactgatgaggacgacttgggcactttgtgaatcaattacattagcaaccgggcctttaactaccctatgggaggggagtccaggaaagttttggaatacaactatagccgtatctatggcgaacatatttaggggatcatatttagcaggagctggtttagcgtttagccttatgaagagtctgggtggtgggagaagaggcacaggagctcagggagagaccctaggagaaaaatggaaacgtcaactaaatcaactaagcaagagcgaatttaacatatataagcgaagtggaattatggaggttgaccgctcagaagcaaaagaaggtctcaaaagaggcgagaccacccgacacgcggtttcacgaggaacggccaagctacgttggtttgttgaaagaaacctagtaaagccggagggtaaagtcattgacctaggatgtggtagaggaggatggtcctattattgtgctggactaaagaaagtgactgaggtcaaaggttatacaaagggtggtcctggtcacgaagaacccatccccatggctacatacggctggaacttagtaaaactccatagcggcaaagacgtgttctttacaccacccgagaaatgcgatacactcttgtgtgacatcggggaaagtagtccaaatccaacaatagaagagggcagaacactaagggttttaaaaatggtagaaccatggctacgcgggaatcagttttgcataaaaatactcaatccgtacatgccttcagtcgtagaaacactggaacaaatgcaacgtaaacacggtgggatgttagtccgaaacccattaagtagaaatagtacccacgaaatgtattgggtatcatgtggtacaggaaacatcgtaagtgcagtgaacatgacttctagaatgttactgaatagatttactatggcacataggaagcctacatacgagagagatgtagacttgggagctggaacaagacatgtcgcagtagaacccgaagtagcaaatttagacataataggacagagaattgaaaacattaaacacgagcacaaatcaacttggcattatgatgaggacaacccttataaaacctgggcttaccatggctcctatgaggtaaaacctagtggtagcgcgagtagtatggtcaacggtgtggttaagttattaacaaaaccatgggacgttatcccaatggtgacgcagatagctatgacagatacaacgcccttcggacaacaacgtgtcttcaaagaaaaggtagacacacgaacaccaaaagcaaagagaggtaccgcacaaattatggaagtgaccgccagatggttatggggttttcttagcagaaataagaaaccacgaatttgtacacgagaagaatttacaagaaaggtcagatcaaacgcagcaataggtgctgtcttcgtagatgaaaaccaatggaactccgcaaaagaggcagtagaggatgaaagattctgggacctagtccaaaaagagagggaactacacaaacagggaaagtgcgcaacatgtgtgtacaatatgatggggaagagagagaagaaactaggcgaatttggaaaggcaaagggatctagagcaatttggtatatgtggttaggcgcacgcttccttgagttcgaagctctcggattcatgaatgaagatcactggttctcacgcgaaaatagcttaagtggggtcgaaggagagggactgcataaattagggtatattttaagggacatcagtaaaataccgggtggaaatatgtacgctgatgatacggcagggtgggatacaagaataaccgaggatgatctccaaaacgaagctaagattacagatataatggagccagaacatgctctgttagccacgtcaatatttaaattaacctatcaaaataaggtagtccgagtacaaaggccagcgaagaatggaacagtgatggacgttatctcacgaagggatcagcgcggaagtggccaagtcggaacatatgggttgaatacattcactaatatggaagcacaattaatcaggcagatggaatctgagggaatcttcttaccaagtgagctcgaaacgcccaacttagccgaaagagttctagattggttagagaaacacggagtcgaaaggttaaaacggatggctatatcgggcgacgattgtgtcgttaaacctatagatgacagatttgcgacagcacttacggcgttgaacgatatgggaaaagtgagaaaagatattcctcaatgggaaccctctaagggttggaatgattggcaacaagtccccttctgttcacatcattttcatcagttgatcatgaaagacgggcgcgagattgttgtgccctgtaggaatcaagatgagcttgtaggtagagcacgagtttcccaaggggcaggatggtcgctacgagaaacagcatgtctgggaaaatcgtatgctcagatgtggcaactgatgtatttccataggagagatctacgattagccgctaatgccatttgttcggcggtaccagtagactgggtaccaacaagtagaacaacatggagcatacacgcccatcatcagtggatgaccacagaagatatgctaagtgtatggaatagagtatggatagaagaaaacccatggatggaggataaaacccacgttagtagttggggagatgtcccttacttgggcaagagagaagatcaatggtgtggctcgctcattggtctaactgcacgagctacatgggcttcaaacatacaagtagctataaatcaagtgaggagacttatcgggaacgaaaattacctagattacatgacgagtatgaaaagatttaagaatgaaggagacccagaaggggcactgtggtag

SEQ ID NO: 21641 - RNA, 9879 nt, synthetic construct
  misc_feature 1..9879: note = derived and/or modified CDS sequence (opt6) from DENV-1__FJ898375__SS-prME
  source 1..9879: mol_type = other RNA
tcggtaacaatgcttttaatgttgatgccgacagcattggcatttcaccttactactcgtggaggtgaaccgcatatgatagttagcaaacaagaaagaggaaaatctttgctttttaaaacttctgctggtgtaaatatgtgcacattaattgcaatggatcttggtgaattttgtgaagacacaatgacatacaaatgtccaagaattactgaagcagaacctgatgacgtagattgctggtgtaatgccactgatacctgggtgacatacggaacctgctcgcaaacgggggaacaccgaagggataaacgaagcgtagctcttgcccctcatgttggcctaggacttgaaacacgtaccgaaacatggatgtctagtgaaggagcgtggaaacaaattcaacgcgtagaaacgtgggcactgagacaccctggatttactgttatggccttgttcctagctcatgccataggtacttcgattacacaaaaaggaattatatttattttactaatgttagtaactccatctatggccatgaggtgtgtgggcataggttcccgagactttgtggagggcctaagtggagcaacatgggtggatgttgtgcttgagcatggatcctgtgtgaccacaatggcaaaagacaaaccaactttggacatagagctattgaaaacagaggtaactaatcctgccgtgttacgaaaactctgtattgaagcgaaaatttcaaatactactacggactctcgatgtccaacccagggggaggccactttagtcgaagaacaagacgctaattttgtatgcagacgaactttcgttgatagaggttggggcaatggatgcggtttattcgggaaaggcagcttaattacttgtgcaaaatttaaatgtgttacgaaactagaagggaaaaccgtacaatatgaaaatttaaaatacagcgtcatagttacggttcatacaggcgaccaacaccaagtgggaaacgaaagcacggaacatggaacaacagcgaccatcactccccaagcaccaagcacagaaattcaattgacggactacggagctttaacattagattgcagtccaagaactggtttagacttcaacgaaatggttctactcactatgaaagagaaaagctggttggtacataaacaatggttcttggatctaccgctgccgtggacatcaggagcgagcaccagtcaggaaacgtggaaccggaaagatctcttagtgacgttcaagacagctcacgccaaaaagcaggaggttgttgtacttggttcccaagaaggagccatgcataccgcattaacaggagcgacagaaattcagacctcaggaacaacaactatatttgcaggccatttaaagtgcaggctgaaaatggataaactaacactaaaaggtatgtcatatgtcatgtgtaccgggtcatttaaactagagaaggaggtagctgaaactcaacatggtacagtcttagtacagataaagtatgaaggcaccgatgcaccgtgcaaaatcccattctctacgcaggacgaaaaaggcgttactcaaaatggtagattgattacagctaatccaatagtaacggacaaagaaaaaccagtgaatatagaagcagagccaccctttggagaaagttacatagtcattggcgctggggaaaaggccttaaaactttcgtggttcaagaaaggttctagcatcggaaagatgttcgaagcaacagcccgaggtgcaaggagaatggcaatactgggagataccgcctgggattttggctctataggcggagtgtttacatccgtcggtaagttggtgcatcaaatattcggcacagcctatggggttctatttagcggtgtaagttggaccatgaaaattgggataggtgtactgttgacgtggctaggacttaatagccgctcaactagcctttcaatgacgtgcatagcagtgggacttgtaacactttaccttggagtaatggttcaagcggactcgggatgcgttattaactggaagggcagggagttgaagtgtggtagcgggatatttgtaacaaatgaagtacacacatggacagaacaatataaatttcaagcagactcacctaaaagactatccgctgcgataggaaaggcttgggaggaaggcgtttgcgggattcgtagtgctaccagactcgaaaatatcatgtggaaacagatcagcaacgaactcaatcacatattattagagaacgacatgaaattcacagtagtcgtcggggatgtagctggtattttagctcaaggtaaaaagatgattagacctcaacccatggaatataaatatagttggaaatcatggggaaaagcaaagataatcggagcagatgtacaaaacaccacattcataatagatggaccaaacacaccagaatgccccgacgatcaacgagcttggaatatctgggaagtggaagattacggttttggtatattcacaacaaatatttggctcaagctcagagattcatacactcaagtctgcgatcaccgattaatgtccgcagcaatcaaagactctaaagctgtccatgcagacatgggttattggattgaaagcgagaaaaatgaaacctggaaattggcacgtgcatctttcattgaagtcaaaacatgcatttggccaaagtcccatactctatggagcaatggagtattggagtccgaaatgattatccctaaaatatatggtggtcccatttctcagcacaattaccgaccgggatacttcacccaaacagctggtccatggcatttgggaaaacttgaactcgattttgatttatgtgaaggtacaacggttgtagtagatgagcactgcggtaatcggggaccatcgttgcggacaaccacagttacagggaaaattatacatgaatggtgctgccgaagttgtacgctacctcccctaagattcaaaggagaagatggctgttggtacggaatggaaataaggccagttaaagaaaaggaagaaaacttggtaaaaagtatggtatcggcagggtcaggtgaagtcgactcatttagtttgggattgttgtgcatatcgattatgattgaggaagtaatgcgatcccggtggagtcggaaaatgctaatgaccggaacgttagcagtattcttcttactcattatggggcagctaacatggaacgatcttattcgactctgcattatggtcggcgctaatgcctcagaccggatgggaatgggaacgacatatttagcactaatggccacgtttaagatgcgcccgatgtttgccgtaggtttattgttcaggcgactcacttcgagggaagtcttactactaactatcggattgtcgttagttgcatccgtcgaattaccaaacagcctcgaggaactaggggatgggttagcgatgggaatcatgatcttaaaactgcttactgattttcaatcacaccaattatgggccacacttctttccttaactttcattaagacaacattctctttgcactatgcgtggaaaactatggctatggtattatccatagtttcgctctttcccctatgtttaagtacaacgtctcagaagacgacgtggttgcctgtgctacttggatccttggggtgtaaacctctcacaatgttcttaattgctgagaacaaaatatggggaaggaaaagttggccacttaatgagggaataatggcagtgggcatagtatcaatactacttagctcattattgaaaaacgatgtacccctagcggggcccttaatagccggcggtatgttgattgcatgctacgtcatctcgggtagttctgctgacctgagtctagaaaaagcggctgaagtgagttgggaggaagaagcagagcacagtggagcgagtcataatatacttgtagaggtacaagatgatggcactatgaagataaaagatgaagagagagatgatacgctaacaattttattaaaagcaaccctattagcggtctcgggagtttatccactatccattcctgccacattatttgtttggtatttttggcaaaagaagaagcaaagaagcggggtcctttgggacacccctagccctcctgaagtggaaagagcagtccttgacgacggaatttaccgaatcatgcaacgggggctactggggaggtcacaggtaggagtaggcgtttttcaggaaaatgtttttcacaccatgtggcatgtgacgagaggggcggtccttatgtatcaaggtaaaagattagaaccgtcatgggcatctgtcaagaaagatttaatttcgtatggaggcggatggaggctgcaaggaagctggaatactggagaggaggtccaggtgattgcagtagaacctggcaaaaatccgaaaaatgtccagacagctcctggtactttcaaaacaagcgaaggagaagtcggcgccatagcactcgattttaaacctggcacatcaggatcaccaattgttaatcgagaaggaaaaatagtcggtttgtacggaaacggagttgtaaccacctccgggacatacgtaagcgctatcgctcaggctaaagcatcacaagaaggcccattacctgagatagaggatgaagtcttcagaaagagaaatctaaccataatggacctacaccccggcagcggaaaaaccagaagatatttaccggccatagtcagagaagccattaaaaggaaactacggacattaatacttgcaccaactagagtagtagcatcagaaatggcagaggcactaaaaggaatgcctatacgatatcaaaccacagcggtgaagtcagaacacactggcaaagaaatcgtcgatttgatgtgtcatgcaacattcacaatgagattattgagccctgtcagagttccaaactacaatatgattattatggatgaggctcactttaccgatcccagtagcattgccgctagagggtatatcagtaccagagtagggatgggagaagcagccgctattttcatgactgcaactcccccaggatctgtagaagcgtttccacaaagtaatgctgtgatacaggatgaggagcgtgacattccggaaagatcatggaactccggttatgagtggattacagacttccccggaaaaacggtatggtttgtgccctcgatcaaaagcggcaatgacattgctaattgtttaaggaaaaacggaaaaagagtgatccagttatctcggaagacttttgacaccgaataccagaaaacgaaaaataatgattgggactatgtcgtcacgacagacatttctgagatgggagcaaacttccgagcagatagagtcatagacccgagaaggtgtttaaaacctgtgattttgaaagatggtccggagcgagttatcttggcaggtccgatgcccgtcacagtggctagcgccgcgcaaaggagaggaagaatagggcgaaaccacaacaaggaaggcgatcaatatatatatatgggtcaacctctgaacaatgacgaagaccacgcacattggactgaagcaaaaatgctattggataatataaataccccagaaggaataataccagcattgttcgaacctgagcgagaaaaatccgctgcaatagacggagagtacagattaagaggagaggcaagaaaaacctttgtggaattaatgagaagaggcgacctaccagtatggctatcacacaaggttgcctctgaaggcttccaatattctgatagaagatggtgttttgatggcgagcgtaataatcaagttttagaagagaatatggatgtcgaaatatggacgaaggagggcgaaagaaagaaactccgaccaagatggttagatgcaagaacttactccgatccgcttgctcttagagaatttaaggaatttgcagcaggccgtagatccgtgtcgggggatttgatattagaaatagggaagttacctcagcacctaactcagcgagcacaaaatgcgctagataacctagttatgttacacaactcagaacaaggagggagagcttataggcatgcaatggaggaactgccagacaccattgaaacgctgatgctactagccctaattgcagtattgacaggcggcgtaaccttattctttctaagtgggaggggattagggaagacctcaataggactattatgcgttatggcttcatcagtactcctatggatggcatcagtagaaccgcattggatagcggcatcaataattttagagttctttcttatggtattgttaatacctgaaccagacagacaaagaacaccacaagataaccagttagcttacgttgttattggacttttattcatgatacttactgttgcagccaacgaaatgggattgctggaaacaacgaagaaagatttaggcatagggcacgtcgcagtggaaaaacatcatcacgcagcgatgctggacgtagacctacatccggcatctgcctggactctgtatgcggtcgcaactacaataattactccgatgatgagacatacaatagaaaatactacggcaaacatatcacttactgcaattgcaaaccaggccgctatcttgatgggtttggacaaaggttggcctatatctaagatggacatcggagtaccacttttagctctgggatgttacagtcaagtcaacccattgaccctaacagcagcagttttaatgctagtggcgcactatgcgattatcggacctggtctccaagctaaagcaacgagagaagcgcaaaaacgaaccgcagctggtataatgaagaatccgactgttgatggaatcgttgctattgatctagatcccgtcgtttacgacgccaaatttgaaaaacagcttggacaaataatgttactaatcttatgtacaagccaaatactgttaatgcgaactacatgggcattatgcgagagtataacattagcaacgggaccactaacgacattatgggagggctccccggggaaattttggaataccacaatcgctgtatcaatggcaaatatttttcgtggcagctacttagccggagcaggattagcatttagcctaatgaagagtcttggcggtggaagacgcggcacaggagctcaaggagaaacattaggcgaaaagtggaaacgacagcttaatcagctttcaaaatcagagttcaatacctacaaaagatctggaataatggaagtagatcgctcggaggcaaaggaaggtctaaaaagaggtgaaactactaagcacgctgtcagcagagggacagcaaaattgagatggtttgttgaaagaaacttagttaaacccgagggtaaagtcatagatctcggttgtggtcgaggcgggtggtcctattattgcgctggcctcaagaaagttacagaagtaaaaggttataccaaaggtggtcctggtcacgaagaaccaatacccatggcaacctacggatggaatttagtaaaattgcatagcggaaaagacgtcttcttcataccaccggagaaatgcgatacgttactatgtgatataggagagtctagtcctaaccctactatagaagaaggtcgtaccttacgtgtattaaagatggtagaaccctggctaagaggaaatcaattctgcataaaaatactgaatccgtatatgccaagtgtggtagaaacccttgagcagatgcaaaggaaacatgggggaatgctcgttagaaacccattatctcgaaatagcacccatgaaatgtactgggttagttgtggaacaggaaatatagtgtcagccgttaacatgacatcgagaatgctattaaatagattcaccatggcacacagaaaaccaacatacgaacgagacgttgatttaggggccgggacacgtcacgttgcggtcgaaccggaagtggcaaatctcgatattataggacaacgaatagaaaacataaaacatgagcacaaatccacatggcactatgatgaagacaatccctataagacctgggcctaccatgggtcctatgaagtaaagcccagcggaagtgctagcagtatggttaacggtgttgtaaaattactaacaaaaccgtgggacgttataccaatggtaacgcaaattgctatgaccgatacgacgccatttggacagcaaagagtcttcaaagagaaagtcgatactagaacgccaaaagcgaagagaggaacagctcagataatggaggttacggctaaatggttatggggattcttatcgagaaacaagaaaccacgaatatgtaccagagaagagttcacaagaaaagtaaggagtaatgctgcaataggcgccgtgttcgtagacgaaaatcaatggaacagtgctaaggaagcggtagaagatgaacggttttgggacttagtccatagagaaagggaactacacaagcaaggaaaatgcgcaacttgcgtctacaacatgatgggaaaacgagagaagaaactaggggaatttgggaaagccaaagggagtagagcaatatggtatatgtggttaggagccaggtttttagaatttgaagccctcggatttatgaacgaagaccactggtttagtagagaaaattcattaagcggagtagaaggagaaggtttgcacaagctcggttatattctacgagatatatcgaaaattccgggtggaaatatgtacgccgatgatacagccggctgggacaccagaataacggaagatgacctgcaaaatgaggctaaaattactgatattatggaaccagaacatgctctactggccaaaagtatatttaaactaacgtatcagaataaggtggtacgagtacaaagaccagccaaaaatggtactgtaatggatgtaataagcagacgagatcaaaggggatctggccaagtaggcacctatggattaaatacattcaccaatatggaggcacaattgataagacagatggaatctgaaggtattttctccccctcggagcttgaaaccccaaacctggccggaagggtgcttgattggctagaaaaacatggcgttgaacggcttaaacgaatggctattagtggggatgattgtgtggtaaaacctatagatgatcgatttgccacagcactgactgcattgaatgacatggggaaagttagaaaagatattccccagtgggaaccttctaaaggttggaacgattggcaacaggttcctttttgcagtcatcacttccatcaactaatcatgaaggatggacgagaaattgtagtaccttgccggaatcaagacgaattagtaggacgagcgcgcgtatctcaaggagcgggctggagtttacgcgaaaccgcctgcttaggtaaatcctatgctcaaatgtggcaactgatgtattttcataggagagacttgagattagcagctaatgcaatttgttcggcagttccagtagactgggtaccaacctctagaactacgtggagcattcatgcacatcaccaatggatgaccacagaagatatgttatccgtctggaatagggtatggattgaagaaaacccttggatggaagacaaaacacacatttcatcatggggcgatgtaccctatctagggaagcgtgaagatcaatggtgcggaagccttatcggacttactgcacgcgcaacgtgggcaactaatatccaggtcgcaataaatcaagtgagacgccttattggaaatgagaattacttagactacatgacgtccatgaagagatttaaaaatgaatctgatccagaaggagccctatggtaa

SEQ ID NO: 21642 - RNA, 9879 nt, synthetic construct
  misc_feature 1..9879: note = derived and/or modified CDS sequence (opt6) from DENV-1__FJ898376__SS-prME
  source 1..9879: mol_type = other RNA
agcgtcacgatgctgctaatgctcatgcccactgcgttggcttttcacctcacaaccagaggaggtgaacctcatatgatcgtaacgaagcaagaaagagggaagagtttattgttcaaaacgagtgcaggagttaatatgtgcacattgatagcaatggatcttggagaactttgtgaagacaccatgacgtacaaatgtccacgcattacagaagctgaacccgacgacgtcgattgctggtgcaatgcaacagacacatgggtaacttacggtacatgctcccagacaggtgaacatagaagagacaaaaggagtgtcgcacttgctccccatgtggggttaggattagaaactagaaccgaaacatggatgtccagcgaaggagcatggaaacaaattcaacgagtcgaaacatgggcattgcgacaccccggttttaccgtaatcgcactgttcttagcccatgtaatcggcacgagcataacacaaaaagggattatatttatattgttaatgttagtaactcctagcatggcgatgagatgtgtcggaattggttctagagattttgtagaagggttaagcggtgctacctgggtagatgttgttttagaacatggatcgtgcgttacgacaatggcgaaagataaaccaacattagacatagaactactgaagactgaagtgacaaacccagctgtgctacgaaagctgtgcattgaagctaaaataagcaacacaaccactgattccagatgtccgacacaaggagaagccacactaatggaagaacaagacgcaaactttgtctgcagaaggacatttgttgataggggatggggaaacggttgcgggttatttggcaagggcagtttaataacttgtgcaaaatttaaatgtgtcaccaaattagaagggaagattgttcaatatgaaaacctaaaatatagcgtaatagtgacggtgcatactggtgaccaacaccaagtagggaatgagtcaacagaacatggaactacagctaccattacacctcaggcccccacatcagaaatccagttgactgactatggtgcgcttactttagattgttcaccacgtacaggtctagacttcaacgagatggtgctattgacaatgaaagagaaatcatggctagttcataaacaatggtttctcgacttgccgctaccgtggacgagtggcgcaagtacttctcaagaaacatggaatagacaagacttacttgtgacattcaaaacagcacatgccaagaaacaagaagtcgttgtcttaggctcccaggaaggagctatgcacaccgctcttactggggccacagaaatccagacaagtggcaccactaccatattcgctggtcatctaaaatgcagactaaaaatggataaattaaccctcaaaggcatgtcatatgtaatgtgtactggatcttttaaacttgagaaagaagtggcagagacacagcatggaacagtcctcgtacaaataaaatacgaaggcaccgacgccccatgtaaaattccatttagcacacaagacgaaaaaggtgtcacacaaaatgggaggctaatcacagccaacccaatagtaactgacaaagaaaagccagtgaatatagaggcagagccaccatttggggagtcgtatatagtgatcggagctggcgagaaggcattaaagctatcatggtttaaaaagggttctagtataggaaagatgttcgaagccactgcgcgtggtgcccgcaggatggcgatattaggtgatactgcctgggattttggatcaataggaggcgtatttaccagcgtggggaaacttgttcaccaaatattcggaacagcatacggggtactattctccggcgtaagctggacgatgaaaattggaataggtgtcctattaacctggttaggactaaactcaagatccacgtcgctttcaatgacatgtattgctgttggtttagttacattataccttggagtaatggtacaagcagactctggttgtgtaatcaactggaagggtagagaattgaaatgcggaagtggaatattcgtaactaacgaagtacacacttggacagaacaatataaattccaggccgactcgccgaaaagactatctgcagctataggaaaagcgtgggaagaaggagtctgcggaatacgctcagcgacaaggctcgagaatataatgtggaaacaaatatcgaatgaattaaaccatatattactagagaacgacatgaaatttacagttgtggtaggggacgttgtaggcattcttgcccagggaaagaagatgataagacctcaaccgatggaacataagtatagttggaaatcatggggaaaagcaaaaataattggtgctgacgtacaaaatacaacttttattatcgatgggccaaacacacctgagtgtccggatgaccaaagggcctggaacatatgggaagtcgaagactatggttttggcatttttacaaccaacatatggttaaaactgcgtgacagccacacgcaggtatgtgaccaccgattaatgtccgcggccataaaagacagtaaagcggtacatgcagacatggggtattggattgaaagcgagaagaatgagacctggaagctggctagagcatcttttattgaagtaaaaacttgcatctggccaaaatcacataccttatggagcaatggggttctagaatctgaaatgataatcccaaagatttatgggggtccgataagtcaacacaattatagaccgggctattttacgcaaactgcagggccttggcatttagggaaattagaactggactttgacttgtgcgaaggcaccacagttgtagtggatgaacattgtggaaacagaggccccagcctaagaaccactacagttacgggcaagataatccacgagtggtgttgtagaagctgtacacttccacccttgcgttttaaaggtgaggatgggtgttggtacggaatggaaataagacctgttaaagaaaaagaagagaatctcgtaaaaagtatggtatctgccgggtccggcgaggtagattcattcagtcttggattattatgcatttcaataatgattgaggaagtaatgagatcacgatggtcacgaaagatgttaatgactggaacattagcagtttttctattattgataatggggcaattaacttggaatgatcttattcgcttatgtattatggttggagctaatgccagtgaccggatgggaatggggactacgtacttggctctaatggcgaccttcaaaatgagaccaatgtttgcagtaggcttactttttagaaggctcacttcacgtgaagttctattgctcaccataggtttatcattggtagcaagtgtcgagttgccaaatagcctggaagaattgggagatggattagctatgggtataatgattttaaaactactcacagacttccaatcacaccagctctgggctaccctacttagcttaacattcataaaaactactttaagtttgcattatgcctggaaaactatggcgatggtactaagcattgtaagtctttttcctttatgtttgtcaacaacaagtcaaaagactacatggctcccagtactgctgggctcattgggatgtaaaccactggcaatgtttttaatcgctgaaaataaaatatggggtagaaagagttggcccttaaatgaaggtataatggcagtgggagtagttagcatcttactaagtagcctattaaagaatgacgtgccgctagctgggccgctaatagcagggggcatgctaatagcttgttacgtgatttcgggatcatcagccgatctctcgcttgagaaagcagccgaggttagttgggaagaagaagcagaacattctggcgcttcacataatattctagtagaagtccaagacgatggaacaatgaaaatcaaggatgaagaaagggatgatacattaactattctattaaaagccacgttgttagcagtctcaggtgtgtatcccttaagcattcctgcaacacttttcgtttggtatttttggcagaaaaagaaacaacgatcgggagttttatgggatacgcctagtccaccagaagtagaaagagcagtgttagacgatggtatttacagaataatgcagagaggtttacttggacgaagccaagttggcgtaggtgtatttcaagaaaacgtttttcacacaatgtggcatgtgacacgaggagcagtactaatgtatcagggaaaaaggctagaacctagttgggcaagcgtaaagaaagatttgattagttatggtgggggctggaggttgcaggggtcatggaacacaggagaggaggttcaggtaatagcggttgaacctggcaaaaatcccaaaaatgtccaaacggctccaggtacgttcaaaaccccggaaggcgaggtaggggcaattgcactcgatttcaaaccagggacgtcaggctcaccgatagtcaatcgagaagggaaaattgtaggcttatatggaaacggtgttgtaacaacatccggaacctatgtcagtgcaattgcacaagctaaagctagccaggagggtcccttaccagaaattgaggatgaagtttttcgtaaaaggaatcttacaataatggacctacacccaggatccgggaaaactaggcgatacttgcccgcaattgtacgagaagcgattaaaagaaaactacgcacattaattcttgcacccacacgtgtcgtagcttcagaaatggctgaagctctcaaaggcatgccaattagatatcagactactgcagtaaaaagtgaacacactggtaaagagatcgtagacttaatgtgtcatgccacattcacaatgagactgctgtcacccgttagagttccaaattacaatatgatcattatggacgaggcacattttacagaccccagtagcatagccgcgagaggatatatatcaacacgtgtcggaatgggagaagcagcagcaatatttatgacagctactccacctggttctgttgaggcttttccacagtccaatgcagtcatacaagatgaggaaagggacattcctgaacgatcttggaatagtggctacgaatggattacagattttcccggtaagacggtttggtttgtaccttccatcaaatcaggcaatgatatcgctaactgccttcgcaaaaatggtaaaagagttattcagctgtctaggaaaacttttgatactgaatatcaaaagacaaagaataatgactgggactacgtagtaactaccgacatttcagaaatgggggctaacttccgtgcggaccgagtaattgatccgcgacgatgccttaaaccggtcatcttgaaagacggaccagaacgagtaatcttagcgggaccaatgcctgttacagttgcaagcgcagcccaaaggagaggaagaataggaagaaatcataataaggaaggagaccaatacatttatatgggacaacctcttaataatgacgaagatcatgcccattggactgaagcaaaaatgttattagataatattaacaccccggaaggtataataccagcactattcgaacccgaacgtgagaaaagtgcagctatagatggagaatatcgattacgcggagaagcacgcaaaacatttgtagaacttatgcgtcgaggggacttaccagtttggctatcatataaggtagcctccgaaggtttccaatactctgatagaaggtggtgcttcgacggagagagaaacaatcaagttctggaagagaatatggacgttgaaatatggacaaaagagggagaaaggaagaaactccgcccgcgctggctcgatgctcgaacatatagtgatcctttagcattacgcgagtttaaagaatttgcagcaggtagaagatcggtaagtggggatttaatactcgagatagggaaattgcctcagcatcttacgcaacgtgcgcaaaacgccctggacaatttagtaatgttgcacaattcagaacagggagggcgtgcataccgacacgcaatggaagaattaccagataccatagaaaccctaatgctgttggcactaatcgcggtcttaacaggcggggtgacgttattctttttatcaggtcgaggtttggggaaaacaagtataggattattatgcgtaatggcgtcttcagttttactctggatggcatctgtagagcctcactggattgcagcatctataatacttgaatttttccttatggttcttttgattccggagcctgacagacaaaggaccccgcaggacaatcaattggcttatgtggttatcggattacttttcatgatacttacggtagctgcgaacgagatgggtttgctcgagaccacgaagaaagacctagggatcggacacgtggcagttgagaaccatcatcacgctacaatgctagacgttgacttacatccagctagcgcatggacattgtacgccgttgccactacaataataacaccaatgatgcgccacacaattgaaaatactacggccaatatctctttaactgcaattgccaatcaagcagccatcctcatgggattagataaaggctggccaattagcaaaatggacataggagtaccgttgttagctcttgggtgttatagtcaagtaaatccgttgacgttaacagcagcagtcctgatgctcgtagctcactacgcaattataggcccagggttacaagcgaaagcgactagggaggcgcagaaacggactgcagccggcataatgaaaaatccaaccgtagatggtatagttgcaatagacttagatccagttgtatatgacgcaaaatttgaaaaacaattaggacaaataatgctcctgatactatgtacttcacaaatattattgatgagaaccacgtgggcattatgtgagagcataacactagctacaggtcctctaaccactttatgggaaggaagtcctggaaagttctggaatacaacgatagcggtgtcaatggctaacatctttaggggttcatatttggctggagcaggcttagcattttcacttatgaaatcacttggtgggggtagaagaggtactggagctcaaggggaaaccctaggcgagaaatggaagcgccaattgaatcaattaagcaaatcggagttcaacatctataaaagatcaggaattatggaagttgatagatccgaagctaaagaaggtcttaaaaggggagaaactacgagacacgcagtaagcaggggtacagctaaacttaggtggtttgtcgagagaaacttggtaaaacccgaagggaaagtaatagatctcggatgcgggaggggtgggtggtcttattactgtgctgggctaaagaaagtaacagaagtaaagggatacacaaaagggggacccggtcatgaggaaccaataccgatggccacttacggttggaatttagtaaagttgcattccggaaaagatgttttctttactccaccggagaaatgcgatacactactttgcgatattggagaatcaagccctaatccaacaatagaagaaggtagaacactacgtgtgctaaaaatggtggaaccctggttaaggggtaaccaattttgtattaagattctaaatccatacatgccaagcgtggttgagaccttggagcaaatgcagcgaaagcatggtggtatgctggtgagaaaccctctcagtagaaatagcactcatgagatgtattgggttagctgtggtactggaaatattgtttctgctgtgaatatgacgtctcgtatgcttctaaataggttcacaatggcacatagaaaaccaacttatgagagagacgtggacctgggagccggaacacggcatgtagccgtagaacctgaagtagcaaacctagacataattggacaaagaatagaaaatatcaagcatgaacacaagagcacgtggcattatgatgaagataatccttataaaacttgggcttatcatggttcttatgaagttaagcctagtggatccgcttcgagtatggtcaatggtgtagtcaagctcttaacaaaaccatgggacgtgataccaatggtaactcaaatagcaatgactgatactacacccttcggccaacaaagagtgtttaaagaaaaagtagatacacgtactccgaaagcgaaacgaggaactgctcagataatggaagtcactgctcgttggctgtggggattcttatctagaaataaaaagccaaggatttgtacccgggaagagttcacgaggaaagtcagatctaacgcggccattggagcagtttttgtagatgagaatcagtggaacagtgcaaaagaagcggttgaagacgaaagattttgggacttggtacagaaggaaagagaactacacaaacaaggaaaatgcgctacttgtgtatataatatgatgggaaaaagagagaagaaactaggggagttcggaaaggctaaaggtagtagagcaatctggtatatgtggttaggcgcgcgtttcttagaatttgaggctttagggtttatgaacgaagaccattggttttcgcgcgaaaattcattgagtggtgttgaaggagagggactacataaattgggatatatactcagagacataagtaagataccaggtggtaatatgtatgctgacgacacagcggggtgggacaccagaataaccgaggatgacctgcaaaatgaagcaaaaattacagacatcatggagccagaacacgccctactagcaacaagcatatttaagctaacgtatcaaaataaggtcgtaagagtacagcgacctgccaaaaatggaactgtgatggacgttatatcgagaagagatcaaagaggaagcggtcaagtaggcacgtacggcctaaatacatttaccaatatggaagcacaactcattcgacagatggaatcagaaggaatcttcctgccttccgaactcgaaactcaaaatctcgcggaacgagttttggattggctagaaaagtacggtgttgaacgtctaaaaagaatggctatatctggggatgactgcgtagtaaagcctattgacgatagattcgccacggctctaaccgcgcttaacgatatggggaaagtacggaaagatataccccaatgggaaccatcaaaaggttggaacgattggcaacaagttcccttttgttcccaccattttcatcaactgatcatgaaagatggtagagagatagtagttccctgccggaatcaggacgagctcgtagggagggcaagagtttcacaaggggcaggttggtcactgagagaaacagcgtgtcttgggaaaagctacgcgcaaatgtggcaactaatgtatttccacaggcgggacttgcgcctggcggcgaatgccaattgttccgctgtgccagttgattgggtcccaacaagtagaactacatggtcaatacatgcccatcaccaatggatgacaaccgaagacatgctctccgtgtggaatagagtctggatcgaagaaaacccatggatggaagataagactcatgtgtcatcatggggagatgttccgtaccttggtaaacgagaggaccaatggtgtggatccctgattggcttgacagcacgagcaacatgggcttcaaatatacaagtggctatcaatcaagtaagacggctaataggaaacgaaaactacttagattatatgacttcgatgaaaagatttaagaatgagggagaccctgaaggagccttatggtaa

SEQ ID NO: 21643 - RNA, 9879 nt, synthetic construct
  misc_feature 1..9879: note = derived and/or modified CDS sequence (opt6) from DENV-1__FJ898379__SS-prME
  source 1..9879: mol_type = other RNA
tctgttactatgttgttaatgctaatgcctacagcattagcatttcacttgacaacacgtggtggagaaccccatatgatagtttcaaaacaggagagggggaaaagcctgctgtttaaaacttcagctggagttaatatgtgcacactcatcgccatggatttaggtgaattatgtgaagacactatgacatataaatgtccgagaataacagaaactgaacctgacgatgtcgattgctggtgcaacgcaacagatacatgggtaacttatggtacttgtagtcagacgggagaacacagaagagacaaaagaagtgtagctctcgctccacacgtaggactcggtttagagacaagaacagaaacttggatgtccagcgagggtgcgtggaaacaaatacaaagagtcgaaacttgggctttaagacaccctgggtttacagtaatagctttgtttttagcacatgtaataggaacgtcgatcactcaaaagggaattatattcatactacttatgctggtaaccccctccatggcaatgaggtgtgtcgggataggatcaagagactttgtcgaaggacttagtggggcaacatgggtagacgttgtcctagaacatggctcatgcgtaactacaatggccaaagataaacccacgctcgacatagaacttctaaaaaccgaagtaactaacccagccgtacttcgtaaactctgtatagaggcaaaaatctccaacacaacgactgattcaaggtgtccgacgcagggtgaagctaccttagttgaggaacaagatgctaactttgtgtgcagacggacatttgtggaccgcggctggggaaatggctgtggactattcggtaaagggtcattgatcacatgtgctaaattcaagtgcgtcactaaacttgaaggaaaaatagtacaatatgaaaacttaaaatatagtgtcatcgtcactgtacacactggtgatcaacaccaagtgggtaacgaaagtacagaacacggcacaaccgctactatcacaccccaagctcctacaaccgaaatacaattaaccgactatggtgcactcacactcgattgtagcccaagaacaggtttagactttaacgagatggtcttattaacaatgaaagaaaagtcttggctagtccacaaacaatggtttcttgatttacccctaccatggaccagtggtgccagcactagccaggaaacctggaatcggcaagatctgctagtgactttcaaaacagcccacgccaagaaacaagaagtggtagtattaggctctcaagagggtgcaatgcatacagctctaacaggggccactgagatacaaacatcaggcaccacaacaatattcgcaggacacttaaaatgtagattgaaaatggacaaattaactttaaaaggaatgagttatgtaatgtgcactgggtcttttaaattagagaaggaagttgcagaaacacagcatggcacagtactggttcaaataaaatacgaaggaaccgatgcaccgtgtaaaattcccttctcaactcaagacgaaaaaggggtaacccaaaatggaaggctaataactgctaatccgatagtaacagataaagaaaaacctgtaaatatcgaagcagaaccgccatttggagaaagttatattattatcggtgcaggagaaaaagcattgaaactcagttggttcaagaaaggcagttccattggaaagatgtttgaagctacagcaagaggagcaaggagaatggcaatattaggggacaccgcatgggatttcggctcaattggcggtgtgtttacaagtgttgggaaacttgtacaccaaatttttggtaccgcatatggcgtactattttccggagtttcatggaccatgaaaatagggatcggtgtactcttaacatggcttggtctaaattcccggtctacgtctctgagtatgacatgcatagcagtaggcttggttaccttatatctaggagttatggtccaggctgattcaggttgtgtcattaattggaaggggagggaactaaaatgtggatcgggtatcttcgtaacgaatgaggtccacacctggactgaacaatataaatttcaagccgactcacctaaacgcctctcagctgctataggcaaagcatgggaggagggagtgtgcggcatacgttcagccacacggttagaaaatataatgtggaagcagatatcaaatgagttaaaccatattttattagagaatgacatgaaattcacagtagtggttggggacgttgcgggaatacttgcgcagggtaagaaaatgataagaccccaaccgatggaatataaatattcctggaaaagttggggaaaagcgaaaataataggagcagacgtgcaaaacacaacattcatcattgatggacctaacaccccagaatgtccagacgatcagcgggcgtggaacatatgggaagttgaagactacggctttggaatattcactaccaatatatggcttaaattacgtgatagctatacacaagtgtgtgaccatcgcttaatgtctgcggcgatcaaggattcaaaagcagtacatgcggatatggggtactggattgagtctgagaaaaatgaaacatggaaattagctcgtgctagtttcatagaagtcaaaacgtgtatttggccgaaaagccacacgctatggtctaatggtgttttagaatctgaaatgattatacctaaaatatatggaggtccaatatcacaacataactatcgaccaggatatttcacgcaaaccgctggcccctggcacctgggtaagttagaacttgattttgatctttgtgaggggacaacagtggtagtagacgaacactgtggaaataggggcccatctcttcgaacaactacggtcactggaaaaattatacacgaatggtgttgcagaagttgcacattacccccgcttaggtttaggggcgaagatggatgctggtacgggatggagattagaccagtaaaggaaaaagaagaaaacctggtcaaatcaatggtaagtgcgggttcgggagaagtagatagcttctcactggggttactttgtatcagtatcatgatagaggaagttatgaggtcgagatggagccgaaaaatgctcatgactggtacactagcagtattctttctgctcataatgggacaattaacatggaatgatttaatccgactttgcattatggtaggggcaaatgcgtcagatcgaatgggaatgggaacgacatatctcgccctcatggctacttttaaaatgaggccgatgtttgcagtcggactgttatttaggagattgacctcgagagaagtactgctcttaacaataggtctatccctggtagcctcagtggaactgccaaattcattagaagaattaggagatggtttagcaatgggtataatgattctaaagttattgacagactttcaatcacaccagttgtgggcaacgttactttccttaacctttattaaaacaacattttccctacactacgcatggaagactatggcgatggtactatcaattgtatcgttatttccattatgtttatcaacaacgagtcagaaaacgacctggttaccagtgctcctagggtcactaggctgtaaaccgcttactatgtttctcattgcagaaaataaaatttggggtagacgcagctggccacttaatgaaggtataatggctgtagggatagtgtctatattactaagctcactattaaagaacgacgttcccctagcgggcccactcatagctggaggtatgttaattgcatgttacgtgatttccggatcttcagcagacttgtcactagagaaagcggcagaagtatcatgggaagaagaagccgagcatagtggagcatcgcataacatcttagtcgaagtacaagacgatggtacaatgaaaataaaagacgaagaacgtgatgatacactaacgatcctcttgaaagcaactttattagcagtatctggggtatatccattatctatccccgcgacactctttgtatggtatttttggcagaagaagaaacaaagatcaggtgttctatgggatacaccttctccaccggaggtagaacgagctgtgctagacgatggtatttatcgtataatgcagagaggattactggggcgtagtcaagtcggagtcggagtattccaagagaatgtattccatacaatgtggcatgtaacaaggggagcagttctaatgtatcaggggaaaagattagagccgtcctgggctagtgttaaaaaggacttaatttcatacggtggaggttggcgattgcaagggagctggaatacgggtgaggaagtacaagtaatcgcagtagaacctggcaagaatcccaaaaatgttcaaaccgcgccaggaacctttaaaaccccagagggagaggtaggtgcaatagcactagattttaaaccaggcacaagtggctctcctattgtaaatagagaggggaaaatcgtcggtttgtacgggaacggcgtagtgacaacgtctggtacgtacgtatcagccatagctcaagcaaaggcgtcgcaagaaggaccactaccagagattgaagatgaagtttttagaaagaggaatcttacgataatggatcttcatcccggaagcggaaaaacacgtcggtacttaccagcaatcgtccgagaagcaattaagcggaagctaagaaccttaattctagcaccgacacgggttgtcgcttcagaaatggctgaagcattaaaaggaatgccaataagatatcaaacgactgctgttaaatctgaacataccggaaaagagatagtcgatttaatgtgccacgcgaccttcacaatgagattattgtctcctgtacgtgtcccaaactacaatatgataataatggacgaagctcattttactgacccgtctagcatagcagctagaggttatataagcactagggtcggcatgggagaagcggctgccatttttatgacagcaacacctccaggtagtgtagaggcatttccacaatcaaacgcagtcatacaagacgaagaacgtgatataccggaacgatcatggaactcaggttacgaatggataactgattttcccggaaagaccgtatggtttgtacctagtattaaaagcggaaatgatatagctaattgtcttagaaagaatggtaaacgagtaatccaactatctagaaaaacttttgacacagaatatcagaaaactaaaaataacgattgggattacgttgtcacgacagatatatctgagatgggagcaaattttcgagcagatcgagtcattgaccccagaagatgcttaaaaccagttattcttaaagatgggccagaacgagtcatcttggcaggaccaatgcctgttaccgtagcatcagctgcccaaaggaggggaagaattggaagaaaccataataaggaaggagatcaatatatctatatgggacaaccgctcaataatgacgaggatcatgcacattggacagaggctaaaatgttactcgacaatattaacactcctgagggtataattcctgcactgttcgagccagagcgtgaaaaatcagccgcaatagatggggaatacagacttagaggcgaagcgcgaaagacttttgtagagttaatgagacgaggtgacctcccagtatggctgagctataaagtagcaagcgagggatttcaatatagcgatcgaagatggtgcttcgatggagaacgtaataatcaagtattagaagaaaatatggacgtagaaatctggacaaaggagggtgaacgtaagaaattacgccctcgttggctcgacgcccgtacatattctgatccccttgccttaagagagttcaaggaatttgcggccggtcggagatctgtgtctggggatcttatactagaaataggtaaacttccccaacacttgactcaacgagcgcaaaatgctttagacaacttagtaatgctacataatagtgaacaaggagggagagcatatagacatgcgatggaagaactgcctgacacaatagaaacactcatgttgctagcacttattgcagtcttaactgggggagtgacattattctttttatccggcaggggactgggcaaaacatcaataggtctattatgtgttatggcgtcatcagtcctcttgtggatggcgtcagtagaaccgcattggattgcagcaagcataattttagagttctttttaatggtactactaatccccgaaccagacagacaaagaacaccacaggacaatcaactagcttacgttgtgataggtttactcttcatgattctaaccgtagctgccaatgaaatgggactattggaaaccacaaagaaagatctggggatcggtcatgttgctgtggagaaccatcatcacgcagccatgctagacgttgatttacatccagcgtcagcttggacgttgtatgcagtagcaaccacaattattaccccaatgatgcggcatactatagaaaacacaacagccaacatcagtctgacggcaatagcaaaccaagccgcaatactaatgggtctagacaaagggtggccaataagcaaaatggatattggagtaccattgttagctttgggatgctacagtcaagtcaatccgctcacactcacggcagcagtactcatgttagtagctcactacgctattataggtcctggattacaagccaaagctacaagagaagcacagaagagaacggccgcgggaataatgaaaaatccaacagtagatggaatagtggccatagatttggatcctgttgtgtacgatgcaaaatttgaaaaacagctaggccaaatcatgttactaattttatgtacctcccagatactactcatgaggacaacgtgggcgctatgcgaaagtataacactggccaccggaccacttactacactttgggaaggatctcctggcaaattctggaatacaaccatcgccgtgagcatggccaatatttttcgcggctcatacctagcgggggcgggtttagcattctcattaatgaaaagtctcggcgggggaaggagaggaacaggtgcacaaggagaaacgttaggagaaaaatggaaacgccaattgaaccaactaagtaaatcggaatttaacacctataaaagatctggaattatggaagttgatcggagtgaggcgaaagaggggctgaaacgtggtgagacaaccaaacacgccgtgtcaagaggaacagccaaactccgttggttcgtcgaaaggaacttagtaaaaccggaggggaaggtaattgatttaggctgtggaagaggaggatggtcatattattgtgcaggcctaaagaaagtaacagaagtaaaaggttatacaaaagggggaccaggtcatgaagaaccgatcccaatggctacttacggatggaacttggtaaaattacactccggtaaggacgtcttctttataccacccgagaaatgtgatactttactgtgtgacattggggaaagttcgcctaatccaaccatagaggaaggcagaacgttgagggtcctcaagatggtagaaccatggcttagaggaaatcagttttgcatcaagattttaaatccctacatgccatcagtagtagaaactttagaacagatgcaacgaaaacacggtggtatgttggtaagaaatccgttaagtagaaatagtacccacgagatgtattgggtttcgtgtgggacaggcaacatagttagtgccgtaaatatgacaagtcgtatgttattaaataggttcacaatggcgcatagaaaaccgacatacgagagagacgtagatctcggagccggcacaagacacgtagcagttgaaccagaagtagctaatctcgacataataggtcagcggatagaaaacataaaacatgaacataagagcacatggcattatgatgaggataacccctataagacctgggcataccatggttcttacgaagtgaaacccagcggaagtgcctccagtatggtcaacggagtggtcaaattactgactaaaccttgggacgttatcccaatggtaacgcaaatagctatgactgatactacaccttttggccagcagcgcgtctttaaggaaaaagtcgacactaggacaccgaaggccaagagaggaaccgcacagattatggaagtgaccgctaaatggctttggggatttctgagtaggaataagaaaccacgcatatgcacgcgggaggaatttactcgcaaagtccgaagcaatgctgcgatcggtgctgtgtttgttgatgaaaaccaatggaacagtgcaaaagaggcggtagaggacgaaagattttgggatcttgttcatagagagagagaactacacaaacaaggcaaatgcgcgacttgtgtatacaatatgatgggaaaacgagaaaagaaacttggggaatttgggaaagcaaagggctcaagagccatctggtacatgtggttaggcgctcggttcttggaatttgaggctttgggcttcatgaacgaggatcattggttttcacgcgaaaatagtttgagtggagtcgaaggagaaggtttacataaacttggctacattttaagagatatatccaaaatacctggcggcaacatgtatgccgacgacacagctggctgggacaccaggattacagaggacgatcttcaaaatgaagctagaattacggacataatggaaccagaacacgccttattagcaaaatctatattcaagctaacatatcaaaataaagtagtacgggtgcagagacccgccaaaaatggaacggttatggatgtaattagcaggcgagaccaaagaggtagtggacaagtagggacgtatggactaaacacatttactaatatggaggcacaacttatacgacaaatggaatcagagggtatattcagcccaagtgagcttgaaaccccaaatctagcagagcgagttttagactggctagaaaaatacggtgtcgaaagacttaagagaatggcaattagcggggatgattgcgtagtaaagcccatagatgatagattcgcaacggcgttgacagcactcaatgatatgggtaaagttaggaaggacattccacaatgggaaccttcaaaaggttggaatgactggcaacaagtacctttctgtagtcatcatttccatcaacttataatgaaggacgggcgtgagatagtagttccttgtagaaatcaagacgagttagttgggcgagcacgagtctcccaaggggcagggtggtcattacgcgaaacagcgtgcttgggtaaaagttatgcgcaaatgtggcaactaatgtattttcataggagagatttacgcttagccgccaatgcgatatgctcagcggtaccggttgactggatacctacgagtcgaaccacctggtccatacacgcgcatcatcagtggatgactacagaggacatgttgagcgtatggaacagggtatggattgaagaaaatccctggatggaagataagacccatatatcttcttggggtgacgtaccgtatcttggcaaaagagaagaccaatggtgcggcagcttgattggactgactgcgagagccacttgggcaacaaatatacaagtagctattaaccaggtaagacgactaataggcaacgagaattatctagattacatgacgtctatgaaaaggttcaaaaatgaatcggaccctgaaggagccctttggtag

SEQ ID NO: 21644 - RNA, 9879 nt, synthetic construct
  misc_feature 1..9879: note = derived and/or modified CDS sequence (opt6) from DENV-1__GQ199773__SS-prME
  source 1..9879: mol_type = other RNA
agtgtaactatgcttctcatgttaatgccaacagctcttgcattccacctcacaacccggggtggagaacctcatatgatcgtttctaaacaagaacgaggtaaatcattattatttaaaacctccgcaggcgtaaatatgtgtactctaatcgcgatggacttgggcgaattttgcgaagatacaatgacatataaatgcccacgcattactgaagctgaaccagatgacgttgactgttggtgtaatgcaacagatacttgggtaacctacggcacatgtagtcaaacaggtgaacacaggagagataaaaggtcagttgcattagcaccacacgtcggattggggcttgaaactcgaactgagacgtggatgagtagtgaaggcgcatggaaacaaattcaaagggtcgaaacatgggctttgagacatcccggattcactgtaatagcattgtttttagcacatgcgataggcacgagtataacccaaaaaggaatcattttcattttacttatgctagtgacacccagtatggcaatgcgatgtgtgggcattggaagcagagacttcgtcgagggcctgtctggagcaacctgggtagatgtagtcctggaacacggatcatgcgtgacaacaatggcgaaagacaaaccaacacttgacattgaattattgaaaactgaagtgacgaacccagccgtgctgagaaaactctgtattgaggcaaaaatcagtaatacaacaacggacagtcgttgtccgactcaaggagaagcgaccctggttgaagaacaagatgcaaattttgtctgtaggaggacattcgtagaccgaggatggggtaatggttgtggtctattcggaaaaggttccttaataacttgtgctaaattcaaatgcgtgacaaaactcgaaggaaaaactgtccaatatgaaaatttgaaatatagtgtaacggtaacagtgcatacgggagatcaacatcaggtcggaaatgagtctacggagcacggaacgacagccacaatcacgccgcaagctccttcgactgaaatacaattgactgattatggtgccttgacattagactgctcaccaagaacaggactcgattttaatgagatggtactactaactatgaaagagaaaagttggctcgtgcataaacaatggttcctagatttaccacttccttggacgagtggagcatctaccagccaagagacttggaaccgtaaagatttattagtaacttttaaaaccgcacatgcgaagaaacaggaagtagtagttttaggaagtcaagaaggggcaatgcatacagcgctaaccggcgcaacagaaatacaaacttccggaaccacaactatttttgcaggtcacctcaaatgccgcctaaaaatggataaattaacgctgaagggtatgtcttatgtgatgtgcactggcagtttcaagctggaaaaggaagtagccgaaacgcagcacggtacagttcttgttcagattaaatatgaaggaaccgatgccccgtgcaaaattccattctccacgcaggacgaaaagggtgtcacgcaaaacggccgattaatcacagctaatccaatagttactgacaaagagaaaccggtaaacatagaggctgagccaccatttggagagtcatacatagtaatcggagcaggcgagaaggcattaaaactgagctggtttaagaagggcagttccattggaaaaatgtttgaagcaacagcgcgtggggcacgccgaatggccatattaggcgacacagcttgggactttggaagcattggtggtgtgttcacaagcgtgggcaagctggtacatcagatattcggaaccgcctatggtgtattgttcagcggagtatcatggactatgaaaattggaatcggtgttttactaacatggctaggacttaactccagaagtacttcattaagtatgacgtgcatcgctgttggattggttactttataccttggggtaatggttcaagccgattctggatgcgtaataaattggaagggacgggaactaaaatgcggaagtggaatattcgttaccaatgaggtacacacatggaccgagcaatacaaattccaggcggatagccctaaaagactctcagcagcaatcggtaaggcttgggaagaaggggtttgtggcatccgttcagcaacgagactagagaatataatgtggaaacagattagtaacgaattgaaccacatccttttagaaaacgatatgaaattcactgttgtagtcggagacgtagcaggaatcctagctcaaggcaagaaaatgatacggccacaaccaatggagtataaatactcgtggaaaagttggggtaaagcaaaaatcattggagcagatgtacaaaacactacttttataattgacggaccaaacactccagaatgtcctgacgaccaaagggcctggaatatctgggaggtcgaagattacggattcggcatattcactaccaatatatggttaaaactaagggattcttatacccaagtatgtgaccaccgactgatgtcggcagcaattaaagattcaaaagctgtccacgctgatatgggatactggattgaatcagagaaaaatgaaacgtggaagttagctagagcatcattcattgaagtcaaaacgtgcatttggccaaagtcacatacattatggtcgaacggggtgttggaatcagagatgataataccaaagatatatgggggcccgatatcacaacataattacaggcctggatactttacacagactgcagggccttggcatttaggcaagctggaactagattttgacttatgcgaaggtaccacagtagttgtagatgagcattgcggaaatagaggcccatctcttcgtacaaccacagtaacgggaaagataattcatgaatggtgctgtagaagttgcacactaccgccactgagatttaaaggagaggatgggtgttggtatggtatggaaatccggcccgtcaaagaaaaggaggagaatttagttaaatccatggtatcagccggaagtggtgaagtagatagtttcagtctggggttattgtgtattagcataatgattgaagaggtaatgagaagtaggtggtctagaaaaatgttaatgacaggtacactcgctgtattctttcttttgataatgggacagttaacttggaatgatctaatacgattgtgtatcatggtaggcgcaaatgcctctgaccgaatgggaatgggtacaacttacctggcgttgatggcgacatttaagatgagacctatgttcgcagtaggcttactatttaggagattaacaagtcgcgaagtattattattaacaataggactctccttggtggcttccgtggaattaccaaattcactcgaagaattaggcgacggattagctatgggtataatgatcctcaagttacttaccgacttccaatctcatcaattatgggctacactgttatcacttacctttattaagacaacgttcagtttacattacgcatggaagacaatggcaatggttcttagcattgtcagcttattccctttgtgcctctcaactacaagtcaaaagactacttggcttcctgtccttttgggatcgctggggtgcaagccattgactatgttcttaatcgccgaaaataagatatggggcagaaaaagctggccgctaaacgagggcattatggctgttggaatagtctcgatcctactatcaagtttacttaaaaacgacgtacctctagcgggaccgctaatagcgggagggatgctcatcgcatgttatgttataagtggatcatctgccgatctgtctctcgaaaaagcggctgaagtaagttgggaagaggaagcagagcactcaggagcctcacacaatattttagtagaagtgcaagacgacggtacaatgaagattaaagatgaggaaagagacgatacacttacaatactattaaaggcaacactacttgcagtaagtggagtttatccattaagtataccggccaccctctttgtatggtatttctggcaaaagaaaaagcaaagaagtggggtcttatgggacaccccctctcctccagaagtagaaagagcggtactagacgacggaatatatcgtatcatgcagcgaggtttactcggtagaagtcaggtcggagtaggggtgtttcaggagaatgtattccacactatgtggcatgtcactagaggggcagtattgatgtaccagggtaaaaggttagaaccgagttgggcctcagtcaagaaagatttaatcagctacggaggaggttggcgtttacagggatcctggaacactggagaagaggtccaagtaatagccgtagaaccaggaaagaatcctaagaacgttcaaactgctccagggaccttcaaaacatccgagggggaggtcggagcgatagcacttgacttcaagccgggaacgtccggttcaccaatcgttaatagagaaggaaaaatagttggattatacggaaatggggtagttactacaagtggcacatatgtaagtgcaatcgcacaagcaaaggcgtcacaagaaggacctcttcctgagatagaagatgaggtttttcggaagagaaatctcactataatggatttacatcccggaagtgggaaaacaagaagatatctgcctgcaatagttagagaggcaataaagaggaaactccgtactttgatactagctcctacaagagttgtagcaagtgaaatggcagaagcactaaaaggaatgccaataagatatcagactacagcagtcaaaagtgaacatactggtaaggaaatagttgacctaatgtgccatgctactttcacaatgcggttacttagcccagttagagtacctaattataacatgataataatggatgaggcacactttactgatcctagttcgatagccgccagaggctatatctccaccagagtaggtatgggcgaggcggcggctatattcatgactgcaacaccacctggatcagtagaagcgtttccacaatcaaatgctgtcatccaagacgaagaaagggatataccagaacgatcatggaacagcgggtatgaatggatcaccgacttcccaggaaagacagtttggtttgtaccctcaataaaaagtggcaacgatatcgctaactgcctgagaaagaacggaaaaagagttatacaactctctcgaaaaacttttgatactgaatatcagaaaactaagaacaacgattgggactacgtcgtaacaactgatatttcagaaatgggagcaaacttcagagccgatagagtaatcgatcccagaaggtgcttgaaaccagtaattctaaaagatggtcccgaacgagtgatactggcaggcccaatgccagtcacggtggcatctgcagcgcagagaaggggccgtattggaagaaaccataataaagaaggtgatcagtatatatacatgggacaaccattaaataacgacgaggatcacgcgcactggaccgaagccaagatgctcttagataacattaatacgcctgaagggatcattcctgccttatttgaaccagaaagagaaaaatctgcggcaattgatggagaatatcgtctcagaggagaagctagaaagacatttgtagaactaatgagacggggagacttgccagtttggctaagctataaggtagccagtgaaggcttccaatactcagataggagatggtgttttgacggtgagaggaataatcaagtgctagaggagaatatggatgtagagatatggacaaaagagggggaacgaaagaaactcagacctaggtggttagatgcgagaacttatagtgatccattagcattacgggagttcaaagaatttgccgcaggaaggcgttccgtatcgggagacctcatattagaaataggtaaattaccacaacacctgacccagagggcacaaaatgctttggataatcttgttatgttgcataacagcgagcaaggaggacgagcttaccgtcatgccatggaagaacttccagatacaatagaaacactaatgcttctagcgttgatagccgtacttactggtggagtaactctattcttcttatcgggtcggggtttggggaaaacgtcgattggtttactatgcgtaatggcatcctcagtactactatggatggcatctgtagagcctcactggatagcagcgagcatcattttagagtttttcttaatggtactgctcataccagaaccggacaggcaaagaacccctcaggacaaccaattagcatacgtggttatcggattattatttatgatcttaacagtagctgccaatgaaatggggttactggagactactaagaaggatcttgggattgggcatgtagcggtcgaaaaccaccatcacgcagcaatgttagatgtagacttacaccctgcctccgcgtggacgttgtacgcagttgcaacaacaataatcactccgatgatgagacacacgattgaaaacacaacagctaatataagtctcacggctattgcaaatcaggcggccattttaatggggctcgataaaggttggccgatatccaaaatggacatcggagtacccttgttagccctgggctgttattcccaagttaacccgctaacactgactgccgccgtcttaatgttagtagctcattatgctataatcggaccaggtttacaagccaaagcaacccgagaagcccaaaaacggactgctgccggaataatgaagaaccccacggtagacggaattgtagcgattgatctggaccccgttgtatacgatgcaaagttcgaaaagcaattgggccaaattatgcttttgatcttgtgcacaagccagatactactcatgagaaccacgtgggctctatgtgaatcaattacgctagctacagggccgttaaccactttatgggaaggctctcctggtaaattttggaacaccacaattgctgtaagtatggcaaatatattcagaggatcatatttagccggggcaggattagcattctcactgatgaaatcacttggtggaggacgtagaggaacaggagcacaaggcgaaacactaggcgaaaaatggaaaagacaactaaatcaactatccaaaagtgaatttaatacttacaaacggagcggtataatggaagtagacagaagtgaggcaaaagaaggactaaagcgtggtgaaactacgaagcacgcagtatcaagaggaactgcaaaattacgttggtttgttgaaagaaatctagtaaagcccgagggtaaagtaatagacctaggatgtggccggggtggctggtcttattattgtgctggactcaaaaaggtaaccgaagtcaaaggctatactaaagggggtccaggtcatgaagaaccgataccaatggctacatacgggtggaatcttgttaagttacactcaggaaaagatgtattcttcattccaccagagaaatgtgatacacttctatgcgatatcggggaaagtagtcctaatcctacaattgaagaaggtcgaactttaagagtgttaaaaatggtagaaccatggctaaggggaaatcaattctgtattaaaattttaaacccttatatgccatctgtcgtagaaaccttggaacaaatgcagcgcaaacatggaggaatgctcgtcagaaatccactgtctagaaactcaacccatgaaatgtattgggtttcatgcggaacaggtaacatagtttccgcagtaaacatgactagcagaatgttattaaatagatttacaatggcacatcgtaaaccgacctatgaaagagacgttgatcttggtgcaggtacacgtcacgtagcagttgagcctgaggtagccaatctggatatcatagggcagagaatagaaaatataaaacacgaacacaaaagtacctggcattacgatgaagacaatccatacaagacctgggcttaccacggtagttatgaagtcaagcctagcggaagtgcgtcttcaatggttaacggagttgttaagttactaactaaaccctgggacgtgatacctatggtaacacaaatagcaatgaccgatacaacccctttcggtcaacagagagtattcaaagagaaagtagacaccagaactccgaaggcaaagaggggtacggctcaaattatggaagtaaccgccaaatggctatggggctttctaagtagaaataagaaacctcgtatctgtacccgagaagagtttacaagaaaagtacgaagcaacgcggctatcggtgcagtattcgtcgacgaaaatcagtggaatagtgcaaaagaagctgtcgaggatgaaaggttttggaatctcgttcaccgggagagagaattacacaaacaaggcaagtgtgcgacgtgtgtttacaacatgatgggcaaacgagagaagaaattgggagaatttggcaaagcaaagggttcccgtgccatttggtatatgtggttaggagcaagatttcttgaatttgaagctcttggattcatgaacgaagatcactggtttagtcgagaaaattcactaagcggcgtggaaggtgaagggttacataaactaggatacatacttagagatatcagcaaaattcctggaggcaacatgtatgcggacgacactgcaggatgggatacgcgaataacagaagacgacttacaaaatgaagccaagataacggacataatggaaccagaacatgcactattagccaagtctatctttaagttaacttatcaaaataaagtagtgagagttcaaagaccagccaaaaatggtactgtgatggatgtcattagcaggcgggaccaaaggggaagtggtcaagtaggaacatacggattaaatacattcacaaacatggaagcacaattaatacgacaaatggaatcggagggcatcttcagtcctagtgaacttgaaactccaaacttggcaggaagagttttagattggctcgaaaaacacggggtggaacgtcttaagcgtatggcaatatctggtgacgattgtgtagtaaaacctatagatgacagattcgctactgcgctcactgctctaaatgacatgggaaaagtgagaaaagatattccacaatgggagccatcaaaaggatggaacgattggcaacaggttccgttctgttctcatcattttcatcagctaattatgaaggacggtagagaaatagtagtgccttgtaggaatcaagacgaattagtaggtagggcaagagtatcccaaggcgccggatggtcgttaagagaaaccgcctgtttaggtaaaagctacgcacaaatgtggcaattaatgtacttccaccgccgcgacctaagactcgcagcgaatgcaatatgttcagctgtcccagtcgattgggttccaacctctagaaccacgtggtccatacacgcacaccaccagtggatgacaaccgaggacatgctatcagtttggaacagagtttggatagaagaaaatccctggatggaagataagactcatatctcgtcgtggggtgacgttccttacctaggaaaaagagaagatcaatggtgcggttccctgatcggtctaactgcgagagccacctgggcaacaaacatacaagtagccataaatcaagttcgacgattgattggaaatgagaactatctcgactacatgaccagtatgaaaaggtttaaaaatgaatccgatcccgaaggcgctctatggtaa

SEQ ID NO: 21645 - RNA, 9879 nt, synthetic construct
  misc_feature 1..9879: note = derived and/or modified CDS sequence (opt6) from DENV-1__JF937596__SS-prME
  source 1..9879: mol_type = other RNA
agtgtcacaatgctactaatgttaatgccaacggcactagcttttcaccttactactcgagggggagaaccccacatgattgttaccaaacaagaacgagggaaaagcctactatttaaaacatcggctggtgtaaatatgtgcaccctaattgcaatggatctaggagaactttgtgaagacacaatgacatataaatgcccgcggatcacagaagcagaacccgatgatgtggattgctggtgtaatgcaacagatacctgggtcacatatggaacatgtagccagacaggagaacatcgtcgtgataagagatcagtcgcattggcgccacatgtaggtttaggattagaaactcgtactgaaacttggatgtcctcggaaggggcttggaaacaaattcaaagggtagaaacgtgggctctacgacacccaggttttaccgtaatagcattatttctagcgcatgcaatcggcacttcaataactcaaaaaggaataatcttcattctattaatgttagtgacgccgtcaatggcgatgcggtgcgtcggcataggctctagagacttcgtcgaaggactcagcggcgctacctgggtagatgtggtattggaacatggaagttgtgtcaccaccatggcaaaagacaaacccaccctagatatcgaactcttaaaaacagaagttacaaacccagcagtactaagaaaactttgcatagaagcaaaaatatcgaacaccacaaccgatagccgatgtcccactcaaggcgaagcgacgctgatggaagaacaagacgcgaatttcgtatgccgtcgaacgtttgtagatagaggatggggaaacggttgtggtctatttggtaaaggatcactaattacatgcgctaaatttaaatgtgttactaaactagaaggaaagatcgtacagtacgagaatcttaagtatagcgtaattgttacagttcatacgggggatcaacaccaagttggtaatgaaagtacagaacacggaactacagctaccattacaccacaagctcctacatcagaaattcaattaacagactacggagcgcttactctcgattgtagcccaagaacaggactagattttaacgaaatggtattacttacgatgaaggaaaaatcatggttagtacataagcagtggttcctagacttaccacttccatggacatctggtgcgagtacatctcaagagacttggaacaggcaagacttgttagtaacatttaaaactgcccacgcgaaaaagcaagaagtagtggtactaggtagccaagaaggagccatgcataccgcattaacaggagcaacagaaatacagacaagtggtacaactaccattttcgcagggcatctaaagtgccgattgaaaatggataaacttaccttaaagggcatgtcctacgtgatgtgcacggggagcttcaaattggaaaaagaagtcgcagaaacacaacatggaacggtattagttcaaattaaatacgaaggcacggacgcaccttgcaaaataccgtttagtacacaagacgaaaaaggagtgatacaaaatggcagacttatcaccgcaaatccaatagtcactgataaagaaaaaccggtgaacatcgaagctgaaccgccatttggagagagctatattgtcataggggttggtgaaaaagccctaaaattaagttggtttaagaaagggagctctataggaaaaatgtttgaagcaacagcacgaggagcgaggaggatggccatactaggtgacacagcatgggatttcgggtctataggcggagtatttacatcagtgggcaaactcgttcatcaaatctttggaacagcctacggagtcctatttagtggagtaagttggacgatgaagattgggataggcgttcttttaacgtggctcgggcttaattcaagaagtacgtcattatccatgacatgcatagctgtaggtctggttacactatatttaggcgtgatggtgcaagcagattccggttgtgtcataaattggaaaggacgtgaactcaaatgtggaagcggtatattcgtcactaacgaagtgcatacgtggactgagcagtataaatttcaagcagacagccctaaaagactatctgcagcaatagggaaggcttgggaagaaggtgtgtgcggaattagatcggccactcgccttgaaaacataatgtggaaacagataagcaatgagctgaatcatatcttactagagaatgatatgaagttcacagtagtagtaggggacgttgtggggatcctagcacaggggaagaaaatgataagaccacagccaatggaacacaaatacagttggaagtcttggggaaaggcaaaaataatcggcgcagatgtacaaaatacgaccttcataatagacggaccaaacaccccagaatgcccagatgaccagagggcgtggaatatttgggaagtggaagattatgggtttgggatatttactacaaacatttggctaaaattgagagacagctacacccaagcgtgtgaccatcgtttaatgagcgccgccataaaggatagtaaggcagttcatgcagatatgggttactggatcgagtcggagaaaaatgaaacatggaaactagcgagagccagcttcatagaagttaaaacatgcatatggccaaaaagccatacactctggagtaatggtgtacttgaaagcgaaatggtaattccaaaaatatatgggggacccatttcacaacataattatagaccagggtattttacacaaaccgccggaccatggcatctagggaaactcgaactcgactttgatctctgcgagggcactacggtggttgtcgacgaacattgtggaaaccgaggtccgagtttgcgcacgacgacagtaacgggaaagataatacatgagtggtgttgtagatcttgtactctaccgcctcttagatttaaaggagaagatggatgctggtatggaatggaaattaggcccgttaaagaaaaagaagaaaacttagttaaatctatggtgagtgccggaagtggcgaagtagattcgtttagcttaggacttttgtgtataagcataatgattgaagaagtgatgagatcacgttggtcacgcaagatgttaatgacggggacattagcagtttttctcttgctaattatgggacaattgacctggaatgatttaataagattatgcataatggtaggtgctaacgcatcagatagaatgggaatgggcacaacctacctagcgctgatggcaacctttaagatgcgaccaatgtttgcggtaggacttttatttagaagacttacctcccgggaggttttattattgacgattggtttaagtctagttgcctcagtagaattacccaacagcttggaagaacttggagacgggctggcaatgggtataatgatcttgaagttattaactgattttcaatcgcatcagctatgggctacattattaagtcttacttttattaaaaccacattatctctacactacgcatggaagacgatggcaatggtgcttagtatagtttccctatttccactctgtttgtcaaccacaagccagaaaacgacatggttaccggtattgttaggctcgttgggatgtaaaccccttacaatgttcctgattgccgaaaataaaatttggggcaggaaatcctggccattgaacgaaggaataatggcggtaggcgtagtaagcattttgctaagctctttactgaaaaatgatgtacctttagcaggtccacttatagccggcggtatgctaatagcttgttatgtgatatctggttctagtgcagatctcagcttagagaaagcagcagaagtttcatgggaagaagaagcagaacatagcggggcaagtcataacattttagtcgaggtccaagatgacggaacaatgaaaatcaaggacgaagaacgtgacgatacacttacaatattattgaaagccactctattagcagtgtctggagtgtatccgctgtcaatacccgctacactatttgtatggtacttttggcagaagaagaaacaaagatcaggtgtcctttgggacaccccgagcccgccggaggtcgagagagcggtcctagatgatgggatttatagaatcatgcaacgtggtcttttaggtaggagccaagtcggtgtaggcgttttccaggaaaacgtatttcatactatgtggcatgtaacgcgcggagccgtactgatgtaccaaggaaaacgacttgagccatcatgggctagcgtgaagaaagatcttataagctatgggggtggttggcgacttcaaggctcatggaatactggtgaagaggtccaagtaatagctgtggaaccgggtaaaaaccccaaaaatgtccagacagcccccggtacattcaagacccctgagggagaagtcggagccatagcattagattttaaacctggaacttcggggagccccatagttaatagagaaggaaagatagtaggactttacgggaatggagtagtaacaacgagcggtacttatgtaagcgcgatagcgcaaacgaaagcaagtcaggaaggtcctctacccgaaatcgaagacgaagtattccgaaaacgaaatctcacaataatggatctgcacccagggtcaggcaaaacccgtaggtatttacccgcgatcgtgagagaagctataaaacgaaaactaagaaccctgatattagcaccaacacgagtagtcgctagtgaaatggcagaggctttaaaaggaatgccaattagatatcaaaccactgctgtgaaaagcgaacatacaggaaaagagattgttgacctgatgtgccatgcgacatttactatgagactgctctcaccagtaagggtacctaattacaatatgataataatggatgaagcacactttaccgacccgtcgagcattgcagctaggggttacataagtacaagagtcgggatgggcgaagcagcagccatttttatgacagccacaccacctggctcagtcgaagcgttcccacaaagcaacgcggtcatacaagacgaggagagagacataccagagcgtagttggaacagtggtcacgaatggatcacagatttcccaggcaaaactgtatggtttgttccaagtatcaagtctggaaatgacatagcgaattgcttaaggaaaaatgggaaaagagttattcaactctctagaaaaaccttcgatacagagtatcagaaaaccaaaaacaatgactgggattacgtagttactacagatataagcgaaatgggtgcgaatttccgcgcggatcgcgtgattgatccgcgtcgttgccttaaaccagtcatactcaaggatggtccggaaagggttatcctagcgggacctatgccagtaacggtagcgagtgcggcccagagaagaggaagaataggacgaaatcataataaggagggtgaccagtacatatatatgggtcaacctttgaataatgacgaagatcacgcacattggactgaagcaaagatgctactggacaacattaacacacctgagggcattatacctgcattgtttgaacccgaaagagagaaaagtgccgctatagatggagaatacagactaagaggggaagctagaaaaacgtttgttgagcttatgagaaggggtgacttgcctgtttggctctcttacaaagtggcgtcggaagggtttcaatattcggaccgaagatggtgctttgacggtgaaaggaataatcaggttttggaggagaatatggacgtagaaatatggacgaaggaaggagaaaggaagaagctaagacccagatggttagatgctcgaacatactcagatcctttagcacttcgagaatttaaagaatttgctgctggacgtcgaagcgtatccggggacttaatattagaaattggcaaattaccacaacacttaacacagagagctcaaaacgcactagacaatttagttatgttgcacaatagtgaacaaggtggtagagcgtaccggcatgctatggaggaattacctgacactattgaaacactgatgcttctagcattaatagcagtattaacgggaggcgtgacactgtttttcttaagcggaaggggattaggtaaaacgtcgattggcctgctttgcgtaatggcatcatctgtattattgtggatggcttccgttgagccacattggattgctgcctcgataatcttagagttctttttaatggttctgttaatcccagaaccagacagacaacggacacctcaagataatcaacttgcgtacgtagtaatcggcttactgttcatgatattaacagtcgcagcaaatgaaatgggactactcgaaactacgaagaaggatttaggcattggccacgttgcggttgaaaaccatcaccatgctaccatgttagacgtagatctacaccctgcctctgcgtggaccttatatgctgtcgcaacaaccattataacacctatgatgcggcataccatagaaaacacaaccgctaatatttctttaaccgcaatagcaaaccaggcagctatcctcatgggactggataagggttggccgataagtaaaatggatataggtgtacctttacttgcgttgggatgttattctcaagtgaatccgttaactttaaccgctgctgtgctaatgctcgttgcccactatgccataatagggccaggtttgcaggcaaaagcaactagagaagcccagaaaagaacagccgcaggtataatgaaaaatccaacagtagatggaatagtggctatcgacctggatcccgttgtctatgatgccaaatttgagaaacagttaggccaaataatgttactaatactatgtacgagtcagatcttactcatgagaacgacgtgggctctttgtgaatcaattacgctcgcgacgggaccattaacaaccttatgggagggttcaccaggaaaattttggaacacaacaatagccgtatcaatggcaaatatattccgaggctcatatttagcaggagcaggattagctttttcactaatgaaatctcttggaggaggacgtagaggaacaggtgcacaaggtgaaaccctaggtgaaaagtggaaaaggcaactaaatcaattgtctaaatcagagttcaatatctataaaagatcaggaataatggaagtcgacagatcagaagcaaaagaaggtttaaaacgcggggaaacaacaagacatgctgtaagcagagggacagctaagctccgttggtttgtggaacgtaacttggtaaaacctgaagggaaagtaattgatctgggctgtggtagaggtggctggtcttattactgtgctggactcaagaaagtcactgaagtaaaaggatataccaagggtggtccaggtcatgaggaaccaattcctatggcgacttatggatggaaccttgttaagttacattcagggaaagatgtgttctttgcaccacccgaaaaatgcgacactctattatgcgatattggcgagagctctccaaatccgacgattgaagaagggagaactctacgggtcttgaaaatggtagagccttggctacgtggaaatcaattttgtataaagatacttaatccatatatgccatcggtagttgagacgctggaacaaatgcaaaggaaacatggtggaatgttggtacgcaatccgttaagtcgtaactcgacccacgaaatgtactgggtgagttgcggtacgggtaacatcgtaagtgcagtcaatatgacatctagaatgctcttaaacaggtttacgatggcacatcgaaaaccgacatatgaacgtgacgttgacttaggcgctgggacgaggcacgtcgcagttgaaccagaagtagctaaccttgatattatcggccaacgcatagagaatatcaaacacgaacacaagtctacttggcactatgatgaagataacccatacaaaacgtgggcttatcatggaagctatgaagtcaaaccttcgggatcagcgtcttcaatggtaaatggagtcgtaaaactattgacaaagccgtgggacgtaattccaatggtaacacagattgcaatgactgataccactcccttcggtcaacagcgagttttcaaggaaaaagtggatacgagaacacccaaagcaaaaagagggacagcacaaataatggaggtaacggcccgatggttgtgggggttcttaagccgaaataagaaaccaaggatatgcacacgggaggagttcactcgaaaagtcagaagcaatgctgcaattggtgcagtattcgttgatgaaaaccagtggaactccgcaaaagaagcagtagaagatgaacggttctgggacctagttcaaaaggaaagggagctacacaaacagggtaagtgtgctacttgtgtctacaacatgatgggtaaacgtgagaagaaattgggagagttcggaaaagcaaaaggaagtcgagccatttggtatatgtggctaggcgcaagattcttagaatttgaggcgttaggttttatgaacgaagatcattggttttcccgagaaaattcactatcaggcgtcgaaggggagggactacacaaattaggctatattctaagagacatttctaaaatacccgggggaaatatgtacgctgatgatactgcgggatgggatacgaggataactgaagatgacctacaaaatgaagcaaaaattacagatataatggaaccggagcatgctctgctggccacctcaattttcaaattaacatatcaaaacaaagtggttagagtccagagacccgccaaaaatggaactgtaatggatgtcataagcagaagggaccaacgtggaagtggccaagttggaacatatgggctaaacacattcactaatatggaagcccaattaataaggcaaatggaatccgaaggaatattccttccgtcagaattagagacacccaatctggcagaaagagtactagattggttagaaaagcatggtgtggaacggttaaaaagaatggcgatctccggagacgattgtgtagttaaaccaatcgatgatagatttgctactgcactgactgccttgaatgacatggggaaggtaaggaaagacataccacagtgggaaccatcaaagggctggaacgattggcaacaagtaccattttgtagtcatcactttcatcaattaataatgaaggatggacgggagatcgtagttccgtgtagaaatcaggacgaactggtaggccgtgcacgcgttagtcaaggtgcaggatggtcattaagagaaacagcatgtcttggtaaaagttatgctcaaatgtggcaattaatgtactttcacagacgtgacttacgactagcagcaaatgcgatatgtagtgctgttccagttgactgggtaccgacaagccgaaccacctggagtatacacgcgcatcatcagtggatgaccaccgaagacatgttgtcagtatggaatagggtatggattgaagaaaatccgtggatggaggataaaacgcatgtaagttcttggggagacgtaccatacttaggaaaacgggaagatcaatggtgtgggtctcttatagggcttacagctcgtgcaacatgggcgtctaatatacaagtagcaataaaccaggtcaggcgcttaataggtaacgagaattatctagattatatgacaagtatgaagcgttttaaaaatgagggggacccagaaggtgcactctggtaa

SEQ ID NO: 21646 - RNA, 9879 nt, synthetic construct
  misc_feature 1..9879: note = derived and/or modified CDS sequence (opt6) from DENV-1__FJ898380__SS-prME
  source 1..9879: mol_type = other RNA
agcgttacaatgttactaatgttgatgccaacagcattagcatttcatttgacaacgcgaggtggagagccccatatgatcgttagtaaacaagaaagaggtaagagcttattgtttaaaacatcagccggggttaatatgtgtactctcattgcaatggatttaggagaactgtgtgaagacactatgacctacaaatgtcctcgaatcactgagaccgaaccggatgacgttgattgctggtgcaatgcaactgatacctgggtgacttatgggacgtgttctcagacgggagaacatcgtcgcgacaaacgttccgtggccttagcaccccatgtaggattagggcttgaaacgaggacagaaacttggatgtcatctgaaggtgcatggaaacaaatccaaagagtagagacttgggctcttaggcatccaggatttaccgtaatagcgctatttctagcacatgcaatcggtaccagcattactcaaaaaggaattattttcatcctcctgatgttggttaccccatccatggccatgagatgtgtgggaatcggaagtcgagatttcgtagaaggattgtccggagcgacttgggtagatgtagtactagaacatggaagctgcgtaacaaccatggcaaaagacaaaccaaccctagacatagaactattaaaaacagaagtaactaacccagccgtacttcgaaaattatgtattgaggccaaaatatctaatactacaactgattcaagatgtcctacccaaggcgaggccactcttgtagaagaacaagatgcgaactttgtctgtagacgtacctttgtagatagaggatgggggaacggatgtgggctttttggcaaaggctcacttattacatgcgcaaaatttaaatgtgtaactaaattggaaggtaaaattgtgcaatacgaaaacttgaaatactcagtaattgtgacggtacatactggtgatcagcatcaggtgggaaacgaaagcacagaacatgggacaactgcaacgattactccccaggcacccacgaccgagatacagttaactgactatggggcactgacattggactgttcaccaaggacaggtttagatttcaatgagatggtattgctaacaatgaaagagaaaagctggttagtccataaacaatggtttctagacctgccattaccttggacaagcggcgcttctacttcgcaagaaacttggaatagacaagatctattggtgacattcaaaacagctcatgccaagaaacaagaggtcgttgttcttggatcgcaagaaggtgctatgcatacggctttaacaggcgcgactgaaatccaaacctctgggactacaacaatcttcgctggtcatctaaaatgcagattaaaaatggataaactcacactaaaaggtatgagttacgtcatgtgcaccggtagcttcaaattagaaaaagaagttgcagaaacacaacatgggactgtcctagttcaaataaaatatgaaggtaccgacgcgccatgtaaaatacctttctcaacccaagatgagaaaggcgttacacaaaacgggcggcttataacagcaaatccgattgtgacagataaagaaaaacccgttaacatagaagccgaacccccgtttggcgaatcatatattgtgataggggctggagagaaagcattaaaactttcatggttcaagaaaggctcaagtataggaaaaatgtttgaagcgacggcacgtggagcaagaaggatggcaatactaggagatacagcatgggattttggttcaatcggaggcgtatttacaagtgtcggaaagctagttcatcaaatattcggtactgcatatggtgttttattttcgggagtatcatggaccatgaaaataggcattggtgtgttgcttacttggctcggattaaattcgagatcaacaagtttgagtatgacttgcattgcggtcggcttagttacattgtacctcggggtaatggtacaagcagactcgggctgtgtgataaattggaaaggaagggaactaaaatgcggtagtggcatttttgttacgaacgaagtacacacctggactgaacagtataaattccaggcagactcaccaaaacgattgagtgcggctataggaaaagcatgggaagaaggcgtatgtggaatcaggagtgcaactaggctcgagaatataatgtggaaacaaatttcaaatgaattaaatcatatattacttgagaacgatatgaaattcacggtagttgttggagacgtagcaggaatactcgcccaaggcaagaaaatgataaggccccagccaatggaatacaaatacagctggaaatcatgggggaaggcgaaaattataggtgcggatgtacaaaataccacatttataatagacggaccaaatacgccggagtgtcccgatgaccaacgagcatggaatatttgggaagtagaggactatggatttggtatattcacgaccaacatatggctaaaattaagggattcttatacacaggtgtgtgatcatcgcttaatgtcagctgccataaaagattctaaagcggttcacgctgatatgggatattggatagaaagtgagaaaaatgagacgtggaaacttgcaagagcatcctttatagaagtgaaaacgtgcatctggccgaaatctcacaccttgtggagcaatggtgtactagaaagtgaaatgataattccaaagatatacggaggaccaattagtcaacacaattacagaccgggctattttacccaagcagcaggaccatggcacttaggcaagttagagttggacttcgatctctgtgaaggtacaacagtagtagtcgatgaacattgtggaaaccggggcccatcacttcgaacaacaacggtaaccggtaaaattatacacgaatggtgttgcaggagttgcacgctacctcccttgaggtttaaaggagaggacggctgttggtatggaatggaaattcgacccgtcaaagaaaaagaagagaatttagtaaagagcatggtgtcggcaggttccggtgaggtcgattcgttcagcttgggacttctctgtataagtataatgatagaggaagtgatgagaagcagatggtccagaagaatgcttatgacaggtacgttggctgtattctttctgcttataatggggcaattaacttggaatgatttgattcggctatgtataatggtaggagccaacgcttcggataggatgggtatggggacaacgtatcttgcactaatggccacgtttaaaatgaggcccatgttcgctgtcggcctattgtttaggagactcacatctagagaagttctgctacttacaatcggactaagccttgtcgcctcagtagagctaccaaattccctagaggaattaggtgatgggctggctatgggtataatgattctgaaattgttaacagactttcagtcgcatcagctgtgggccacattacttagtctaacttttattaaaacgacattttcgctacactacgcatggaaaactatggctatggtattatctatagtttcgctctttccattgtgcttatcgaccactagccagaaaactacatggttgcctgtacttcttggtagtctcggttgtaaaccactaacaatgttcctgatagcagaaaataaaatatggggcaggcggagctggcccttaaacgaaggcatcatggcagtgggtattgttagcattttactaagttccctgcttaaaaatgatgtacctttagcaggtcctttaatagccggtggaatgttgatagcatgctatgttatatctggaagttcagcggatttaagtttggaaaaagcagcagaagtctcatgggaggaggaagcagaacactcaggtgcgtcacacaatattttagttgaagtgcaagatgatggaactatgaaaattaaggatgaagagagggacgatacactaaccatactattaaaagcaacgcttttagcagttagtggagtatatcccctatcgatacctgcaactctcttcgtatggtatttctggcaaaagaagaaacaacgatcaggcgtgctttgggacacaccttcccctccagaagttgaacgtgcagtattagacgacggtatatacaggatcatgcagagaggcctactaggtagaagccaagtgggtgtaggggtattccaggaaaatgtttttcacactatgtggcatgtaacaaggggagcggttttaatgtaccaaggaaaacgactagaacccagttgggcgtcagtcaagaaagatttaataagttatggcgggggatggcgcctacagggaagctggaataccggggaagaagtgcaagtaattgcagtagaacctggtaagaaccccaaaaatgtacaaaccgcgccaggaacatttaaaactccagaaggggaagtcggtgccatagcgctggattttaaacccggaacttcagggagccctatagtaaatcgtgaaggaaaaatagtcggattgtacggcaatggagtagtaactacgagtgggacgtatgtttcggcaatagcccaagcgaaagcatcacaggaaggacctttgccagaaatcgaagatgaggtatttagaaagagaaacttaacgatcatggacctacacccaggaagcggtaaaacgagaaggtacttgccagctattgtgagggaagcgattaaaaggaaactacgcacacttatcttggcaccgaccagagtcgtcgcatctgagatggccgaagcactgaaaggaatgcccatacgataccaaactacagctgtgaaatcagaacatacgggaaaggaaattgtggatttgatgtgccacgcaacctttacaatgcgtctcctgagtcctgttagagtgccaaattataacatgataattatggatgaggcacactttactgacccaagttctatagcagcgaggggatacatttctactagagttggaatgggagaagcggccgctatatttatgactgctacgcccccaggttcggttgaggcctttccacaaagcaatgcagttatccaagacgaagaaagagatatccctgaaaggagttggaactccggttatgagtggataacagatttccctggaaaaacagtgtggtttgtgccaagtataaaaagcgggaatgacattgctaattgcctgcgtaaaaacggaaagagagtaattcaattatcgagaaagacgtttgatacagaataccagaaaacaaagaataacgattgggactatgtggtaactacagatatctctgaaatgggtgctaacttcagagccgatagagtaattgatcccagaagatgtttaaaacccgttattctgaaagacggtcccgaaagggttatattggctgggcccatgcccgttaccgtagcgtcagccgcacaaagacggggcaggataggaagaaatcacaacaaggaaggcgatcaatatatctatatgggccaaccacttaacaatgatgaagaccatgcgcattggacagaagcgaaaatgctattagacaatataaacactccagaaggaattataccagctctttttgaaccagaaagagaaaaatctgcagcgattgatggggaatatcgcctacgcggggaggcgagaaaaaccttcgtcgagttgatgcggcggggagacctaccagtttggttatcttacaaagtggcttctgaaggctttcaatattcagaccgaagatggtgttttgatggcgaaagaaataaccaagtattagaggaaaacatggatgtcgaaatttggaccaaagaaggcgaacgaaagaaactacggcctagatggttagacgctagaacatatagcgaccctcttgcattgagagagttcaaagaatttgccgcaggtaggagatctgtgtcaggagatctcatcttagagataggtaagctcccgcagcacctaactcaaagagcacaaaacgccctggacaacctagtcatgctacataatagcgaacaaggaggacgtgcttatagacacgcaatggaagaattacctgacacaatagaaaccctaatgttactggcactaattgccgtcctgactggaggggtaacgttgtttttcctgtcgggcagggggttaggaaaaacctcaatcggacttttgtgcgtgatggcatccagtgtattattgtggatggcatcagtagagccacactggatagcagcaagtattattctagagttctttctaatggtacttttaatcccagaacctgaccgacaaagaacaccacaagacaaccaattagcatatgtagtaataggcctgttgttcatgatattaactgttgcagcaaacgaaatgggattactagagacaaccaagaaagatttggggatagggcatgttgccgttgaaaatcatcaccacgccgcgatgctagacgtggatttacatcctgcaagtgcatggacactatatgcggtagctacaaccataattacaccaatgatgcgtcacacgatcgagaatactaccgctaatatatcacttacagcaattgcgaaccaagcggcgatattaatgggtttagacaaggggtggcccatatctaaaatggatatcggagtaccgctgctagcacttggctgttactcgcaagtgaacccacttactcttacagctgccgtcctaatgttagtcgctcattatgcaataataggaccaggattacaggccaaagcaacccgtgaagcacagaaaagaacagcagcagggattatgaagaatcccacagtagatggtatagtggcaatcgaccttgatcccgtagtctacgacgccaagtttgaaaaacaactaggacagattatgttgttaattttatgtacttcgcagatattactaatgcgtaccacgtgggccctgtgtgagagtataactttagctacaggcccattaacgaccctatgggagggatctcctggaaaattttggaacacaacaattgctgtatctatggcgaatatatttagaggaagctatcttgctggagcggggctggcattttcgctgatgaaatcactcggtggtggtcgacgaggcacgggagcccagggcgaaaccttgggtgagaaatggaaacggcaattaaaccaattgtctaaatcagagtttaacacgtataagcgatcagggattatggaagtagatagatcagaggcaaaagaaggtcttaaaagaggagagaccactaaacatgcagtgtcgagaggcaccgcgaaacttcgctggtttgttgaaagaaatctagtaaaaccagaagggaaggtaatagatctcgggtgcggaagaggaggttggagctactattgtgcaggtttgaagaaagtaacagaggtaaaaggatatactaaaggcggaccgggacacgaggagccaatacctatggcaacatacggttggaatttggtaaagctacattcaggtaaagatgtattctttattccacctgaaaaatgtgacacattactgtgtgatataggtgagtccagccctaatccgacaatagaagaggggaggactttaagggtcttgaaaatggtcgaaccttggttacgtggcaaccagttttgcataaaaatattaaacccctatatgccatcagtagtcgaaacactagaacaaatgcaaagaaaacatggcggtatgctagtccgtaatcctctaagcagaaatagcacacacgaaatgtactgggtttcttgcggtaccgggaatatagtgtccgcagtcaatatgactagccgtatgcttctaaacagatttacaatggcgcatcggaaacctacctatgaacgcgatgtagatctaggagctggaactagacatgttgccgtcgaaccagaagtagcaaatttagatatcatcggtcagagaatagaaaacataaaacatgagcacaagagcacttggcattatgatgaggataacccttataagacctgggcttatcatggctcgtatgaagtaaagccttctggcagcgcctccagcatggtcaatggggtagtcaaactattaacaaagccctgggacgttataccaatggtcacgcaaattgcgatgacagatactacaccttttggacaacaaagggtgtttaaagaaaaagtggacacgcgaactccaaaggcaaaaagaggaacagcacagataatggaagtcacagcaaagtggttgtgggggtttttatctaggaacaaaaagccgcgtatttgcactagagaggagtttacgagaaaagttaggagtaatgctgcgataggcgctgtcttcgttgatgaaaatcaatggaactcagcgaaagaggcggtagaggatgaacgattctgggatctagttcacagagagcgagaattacataaacaaggaaaatgcgcaacatgcgtgtacaatatgatgggtaaaagagaaaagaaactgggggaatttggtaaagcaaaaggcagtcgagcaatctggtacatgtggctaggggctagattcttggaatttgaagcgctagggttcatgaacgaggatcattggttcagccgagaaaattccctttccggagtagaaggtgaaggactccacaaactggggtatatcttaagggatatatccaaaataccaggaggtaacatgtatgcagatgataccgctgggtgggatactaggataacggaggatgatcttcaaaatgaagcccggattactgatattatggaacccgaacatgcgctactagcaaaaagtatcttcaaactaacgtaccaaaataaagtcgtaagagtacaaagacccgcaaagaatggcacggtcatggatgtaattagtagaagagaccaaagaggcagtggtcaggtaggcacgtatgggctaaatacgttcacaaacatggaagctcaattgatacgacagatggagtcagaaggaatattctcgccttccgaattagaaacacccaatttagctgaaagagtgttagattggttggaaaaatatggggttgaacgattaaaaaggatggcaatttcgggagatgactgcgtagtcaaacctatcgatgataggtttgcaacggcattaacagctcttaacgatatggggaaagtcagaaaagatataccacagtgggaaccatcgaaaggttggaacgactggcaacaggtcccgttctgttctcatcacttccaccaactgataatgaaagatggaagggagatcgtagttccttgcaggaatcaagatgaactcgtaggtcgagctcgcgtcagtcaaggcgccggatggagtctacgcgagacagcatgtctaggaaaatcatatgcacaaatgtggcaattgatgtatttccatcggagagatttacgattggcggctaatgcgatttgctcagcggttccggtagactggatcccaacaagtcgaacgacatggagtatccatgcacatcaccaatggatgactactgaagatatgctttctgtatggaaccgcgtgtggatagaagagaacccttggatggaagacaaaactcatataagcagttggggagatgtcccatatctaggaaaaagggaggatcaatggtgcggatcactaataggtttaacagcacgagcaacctgggccacaaatatacaagttgctattaaccaagtgagaaggctaataggtaatgagaactatctggactacatgacatcaatgaagagatttaaaaatgagtctgatcctgaaggtgctctgtggtga

SEQ ID NO: 21647 - RNA, 9879 nt, synthetic construct
  misc_feature 1..9879: note = derived and/or modified CDS sequence (opt6) from DENV-1__FJ898382__SS-prME
  source 1..9879: mol_type = other RNA
tcagtaacgatgttattaatgttaatgcctaccgctttagcttttcatctaactactcgtggaggggaaccacacatgatagtttctaaacaagaacgaggaaaatcactactttttaaaacaagtgctggagtaaatatgtgcactcttatagcaatggatcttggcgaactttgcgaagatactatgacttataaatgcccgcgtattacagaaaccgaaccggatgatgtagattgctggtgcaatgctacagacacgtgggtaacctatggtacatgttcacaaaccggtgaacataggagagacaaacgttcagttgcgctggctccacatgtagggctgggcttagaaacaagaactgaaacctggatgtcttctgagggagcatggaaacaaatacaacgagtagaaacgtgggccttacgacatcctggatttacagttatcgcgttattccttgcgcatgcgatagggacgtcaattacgcagaaagggatcatattcatcttgttaatgttggtcaccccatcaatggctatgagatgtgttggcataggtagtagagactttgtagaaggtttaagtggggccacatgggtggatgtagtattagaacacggatcatgtgtaacaacaatggctaaagataaacctacactcgatattgagttattaaaaaccgaagtcactaatcccgcggtactccgaaaactttgcatcgaggcgaaaattagcaataccactactgactctcgttgccctactcaaggtgaagcaacactggtggaggagcaagacgcaaacttcgtatgtaggagaacgtttgtagatagaggatggggcaatggatgtgggttattcggaaaaggatcgttaattacgtgtgcgaaatttaaatgcgtaacaaaactagaaggtaaaatagtacaatacgaaaatttgaaatattcagtgatagtcacagttcacactggggaccaacatcaagttggcaatgaaagtacggaacatggaacaaccgcgacgattaccccgcaagcgcctacaactgagatacaattgactgactacggtgcacttacattagattgctccccacggaccggactagattttaacgaaatggttctgctcacgatgaaagaaaaatcctggctcgtacacaaacaatggttcctggatttaccactgccgtggacatccggagcaagcacctcgcaagagacgtggaacagacaagatcttttggttactttcaaaaccgcccatgccaagaaacaagaggtagtcgtgctaggctctcaagaaggtgctatgcatacggcattaacaggtgcaaccgaaatacaaacgagtggtacaacaacaatctttgcaggacaccttaaatgtagactaaaaatggataaactgacgctaaaaggtatgagttacgtaatgtgtactggttcttttaaattagaaaaagaggtagcggaaacacaacacggtacagttctggtccaaatcaagtatgaaggtactgatgcaccttgcaaaataccattttctacacaagatgagaaaggcgtcacacagaatggtcggttgattacagctaatcccatagtcacagacaaagagaaaccggtcaatattgaagcagaaccaccgtttggtgaatcttatattgtaatcggagctggagagaaggctttaaaactaagttggttcaagaaaggcagcagcattggaaaaatgttcgaggctacagctcgtggcgcacgaagaatggcaattttgggagatactgcttgggacttcggcagtatcggtggcgtctttacgagcgtcggaaaattagtacaccaaatcttcgggacggcatatggtgttctcttttccggagtttcttggactatgaaaataggaattggcgtacttcttacatggttaggactaaattcaagaagtacgtctttaagcatgacctgcatagctgtaggattagtcactctatatttgggagttatggtccaggcagactctggctgtgtcataaattggaaaggtagggaactcaaatgtggctccggaattttcgttactaatgaagtacatacgtggactgagcagtataaatttcaagccgattcaccaaaaaggctgtccgccgcaatagggaaagcctgggaagaaggtgtgtgtggtattagatcagcaacgagactggaaaatataatgtggaaacaaatatccaacgaattaaatcatattctattggaaaacgacatgaagtttacagtagtggttggagatgtggcaggcatactggcacaaggtaagaaaatgataagaccacaacctatggagtacaaatatagctggaagtcatggggtaaagctaaaatcattggagcagacgtacaaaacacaacctttataatcgacggaccaaatactccagaatgtcctgatgatcaacgtgcatggaacatttgggaagtggaagattatggatttggtatatttacgacgaacatttggctaaaactccgggacagttacacgcaagtatgcgaccaccgcctaatgagtgcagctattaaagacagcaaagcagtccatgcggatatgggttactggattgagtcagagaaaaatgaaacatggaaactagcaagagccagtttcatcgaagttaaaacttgtatctggccaaaaagtcatacactctggtctaatggcgttttggaatcagagatgatcatacctaaaatttacggcggacctatatctcaacataattatcgacccggttactttactcaggcggcagggccttggcacctagggaaactagagttagatttcgacttatgtgaaggaacgaccgtagtcgtcgatgaacattgtggtaatagagggccatcactccgaactacaacagttacaggcaaaataatccacgaatggtgctgccggtcctgtacgttacccccattaaggttcagaggcgaggacggatgctggtatggaatggaaatacggccagtaaaagaaaaagaagagaatttagtaaaatccatggtgtcagctggctcaggtgaagtagatagctttagcctgggactactttgtatcagcattatgatagaagaagtaatgcgatcgagatggagtagacggatgctaatgacggggactctggccgtgttctttctactcattatgggtcagcttacgtggaatgatttaattcgactttgtataatggtcggagcgaacgcttcagacagaatgggaatgggtacgacctatctagcactgatggctacttttaaaatgagaccaatgttcgcagtaggacttctatttcggagattgacaagtagagaagtattgcttctaaccatagggctgagtttggtagcatctgttgagttgcccaactcacttgaagaactcggcgatgggcttgcaatgggaataatgattctaaagttactaacggatttccaatcgcatcaactgtgggcgacactactcagtttgacgttcatcaaaactacatttagtttacactatgcatggaaaactatggcaatggtcctttcgatcgtatctttgtttcctttatgcctttcaacaacatcacagaaaactacctggctcccggttctactaggcagcctcggctgcaagcctctaactatgtttcttatagcagaaaataaaatttgggggaggcgttcatggcctttgaatgaaggcatcatggcggtgggaatcgtgagtatactattaagctcactactaaagaatgacgtgccactcgcgggacctctaattgcaggaggcatgctaatcgcttgttacgttatatctggaagtagcgccgacctctcgcttgaaaaggctgctgaagtatcgtgggaagaagaagcggagcatagcggggcttcacataatatattagtcgaagtccaggacgatggaacgatgaaaataaaggatgaagaaagagatgatactttaacaatactgttaaaggcaacactattagcggttagtggagtataccctttatctatccccgctacgctatttgtttggtacttttggcagaagaagaaacaaagatctggcgtcctctgggatactccttcacctccagaagttgaacgggcagtattagacgatgggatatacagaataatgcaaaggggcttattaggcagatctcaagtgggtgtaggggtgtttcaagaaaacgtctttcacacaatgtggcatgtaacacgtggagcggtcctaatgtatcagggaaaaagactggaaccatcctgggcatcggtcaagaaagatctaattagctatggaggcgggtggcgacttcagggaagttggaacactggtgaagaagtacaggtgatagctgtcgaaccaggcaaaaatcccaaaaacgtacagacagcaccaggcacattcaaaaccccagaaggtgaggttggcgcaatagcactggatttcaaacctggtacaagcggttcacccatagtgaatagagagggcaaaatcgtaggtttatacggtaacggagtcgtaacaacaagcggaacttacgtatccgctatcgcacaagccaaggcatcacaagaaggacccttgccagaaatagaagatgaagtatttcggaaacgcaaccttacgattatggacttacatcctggatccggtaagacgaggcgctatttaccagcaatcgtaagagaggctattaaaaggaaacttcgaacacttatcctggcaccaacaagagtagtagcttctgagatggccgaagcgttgaaagggatgccgatacgataccaaactacagcggttaaatcagagcacacaggaaaagaaatagttgatctaatgtgtcacgccactttcacaatgagattactatcacctgtacgagtgcctaattacaatatgataatcatggatgaggcacactttaccgatcctttctcgattgcagcacgaggttacatcagcacacgagttggcatgggtgaggcagcagcaatattcatgacagccacaccacctggaagtgtcgaggcttttccacaatcaaacgccgtaatccaagatgaagaacgagatataccggaaaggtcgtggaacagtggatatgagtggattactgattttcctggcaaaacagtgtggtttgttccatcaattaagagcggaaatgacatcgcaaactgtttgaggaaaaacggaaaaagagtaatacaactatctcggaaaacattcgatacggaataccaaaagactaaaaacaacgattgggattatgtagtaaccacagatattagtgagatgggggcaaactttagagcagaccgtgtcatcgaccctagacggtgtttaaaaccagtaatcctaaaggacggacccgagcgagtgatactggcaggtcccatgccggtcacagtagcgtccgcggcacaaagaagagggagaatcggtcgtaaccacaataaagaaggagaccaatatatatatatggggcaaccgttgaataatgacgaagatcacgcccattggacggaagcaaagatgcttttagataatatcaatactccagaaggaattatacctgccctcttcgaaccggaacgagagaaatcggccgctattgatggtgaataccgtttaagaggagaagcgaggaaaacattcgttgaactaatgcgaaggggcgacttgcccgtctggctatcttacaaagtcgccagtgaaggattccaatactctgatagacggtggtgttttgatggggaaaggaataaccaagtcttggaggaaaatatggatgtggaaatttggaccaaagaaggagagcgaaagaagttgagacctcgctggctcgacgcccgcacttattcagatcccctcgcactcagggaatttaaggaatttgctgccggacgtaggagtgtaagctccgatcttatacttgagattggcaaattaccacagcatctaacgcagcgagcacaaaatgctttagataacctcgttatgcttcataattcagaacaaggaggaagggcgtatagacatgctatggaggaactcccagatacaatagaaacactaatgttgctcgctctaatagcagtactcaccggcggagtaacattgtttttcttgtcgggtagaggactagggaaaacaagtatcggacttttgtgtgtgatggccagctccgtgttactttggatggcgtcagtagaaccacactggatcgctgccagtataattttggagttcttcttaatggtgctgctcattccagaacctgatagacaaagaaccccgcaagataaccagctagcatacgtagttatagggctcctatttatgatactaacagtagcggcaaatgagatggggctcttggaaacaactaaaaaggatctcggaataggtcatgtggcagtagaaaaccatcaccacgctgcaatgctggatgttgacttgcatcctgcatcagcctggacgttatatgcagtagcgactacaataattacaccaatgatgaggcatacaatcgaaaatacaacagcaaatatcagtctcactgcaatagctaaccaggctgcaattctgatgggactagacaaaggttggccaattagtaagatggacataggcgttcctctcttagcattaggatgctactcacaagttaatccgttgacgttaacagcagcagtattaatgctagtagctcattacgctatcattggtcctggtttgcaagctaaagccacgcgtgaagcgcaaaagcgtactgcggccggtataatgaaaaaccctactgtagatggaattgtggcaatcgatcttgaccccgtagtttatgatgcaaaatttgagaaacaattggggcaaataatgttgctaatattgtgcacttcacaaatattattaatgagaactacgtgggctctgtgtgaatcaataaccctagcaaccgggcctctaacaactctatgggaaggatcgccaggaaaattttggaatactacgatcgccgtctcaatggccaacatattccggggttcgtatttagccggagctggattagctttttcacttatgaagtctctagggggtggcaggcgaggcacaggtgctcaaggagaaactctaggagaaaaatggaaaaggcaactcaatcaattaagtaagagcgagttcaatacttataaaaggtccggcataatggaagtagaccgctcagaagcaaaagaaggattgaaacgaggagaaacgactaagcacgcagtgtctcgtggaacagcgaagttacggtggtttgtggagaggaatttggttaaaccagaaggcaaggttattgatctggggtgtggccggggaggttggtcctattactgtgctggtctaaagaaagtcacagaagtaaaaggttatactaaaggaggtccaggacatgaagaacctatccctatggctacatatggctggaatcttgttaaacttcatagtggaaaggatgtattctttataccaccagagaaatgcgacacactattatgtgatatcggagaatcaagccctaatcctacaattgaagaaggacgaacgttacgcgtactcaaaatggtcgaaccatggctgcggggaaaccaattctgtatcaaaatcttaaatccctatatgccaagtgtcgtagaaactctagaacaaatgcaaagaaaacacgggggtatgctcgtgagaaacccattaagccgaaattcaactcatgaaatgtactgggtctcttgcggcacaggaaacattgtatcagctgtaaatatgacatcgaggatgcttttaaataggtttacaatggcacatagaaaaccaacatatgaacgagacgttgatctaggggcgggtacgcgacatgtagccgtagaaccagaagtagcaaacctcgatattattggacagagaatcgaaaacatcaagcacgaacataaatcgacgtggcattatgatgaagacaatccgtacaaaacatgggcgtatcacggttcttacgaagtcaaaccaagcgggtcagctagctccatggttaacggagtggtcaagctattaaccaaaccatgggacgttattcccatggtcacacaaatagcaatgacagacactacaccatttggtcaacaacgggtatttaaggaaaaggtagatactagaacccccaaagcgaaaagaggtactgcacagatcatggaagttactgcaaaatggctttggggctttctttcaaggaataagaaaccacgcatatgtacacgcgaagagttcacccgtaaggttaggagcaacgcagcaataggagctgtgtttgttgacgagaatcaatggaactcagctaaagaagcagtagaagatgaacgattttgggatctcgtgcacagagaaagagagttacataagcaaggaaagtgcgcaacttgtgtatacaacatgatggggaagagggagaagaaattaggtgaatttggtaaagcgaagggcagtcgcgcaatatggtacatgtggctaggagcaagatttctggagttcgaggccttaggatttatgaacgaggatcattggtttagcagggaaaattcattatccggagtggaaggtgaaggattacataaattggggtacatactaagagatataagtaaaataccaggaggcaatatgtacgctgacgatacggcgggttgggacaccagaatcacagaagacgacctccaaaacgaagcgaggataactgatatcatggaaccagaacatgcactactagcaaaaagtatcttcaaactaacatatcagaacaaggtagtacgagtgcaacgtccggctaaaaacggcacagttatggatgtaatatcaaggcgtgatcagaggggaagtgggcaagtaggtacttatgggttaaacacgtttactaacatggaagcacaactaatcagacaaatggaatcagaaggtattttctcacccagcgaactggaaactcccaaccttgcagaaagggtactagattggctggagaagtacggcgtagaacgacttaagcgtatggcaattagtggcgacgactgtgttgttaaaccaattgacgatagattcgcaacggcactaactgcgctaaatgacatgggaaaagtaaggaaggacattccacaatgggagcctagcaaagggtggaacgactggcaacaagttcctttttgtagccatcattttcatcagttaataatgaaagacgggcgtgaaattgttgtgccctgtagaaaccaagatgagctggtcgggagggctagagtatcacaaggagccgggtggagtctgcgagaaacggcatgtttaggtaagtcttatgcacagatgtggcaactcatgtattttcaccgtcgggatcttcgattagcggcgaacgcaatatgctctgcggtacccgtagactggataccaacaagtagaacaacttggagtatacatgcgcatcatcaatggatgacgactgaagatatgctctcagtttggaacagagtgtggattgaggaaaatccctggatggaagacaagacacatataagtagttggggtgacgtgccgtacttagggaaaagagaagatcagtggtgtggttctctcattggtttaactgcgagggcaacttgggcaactaatatacaagtagcaattaaccaagtcagacgcttgataggtaatgaaaactacctcgactacatgacatcgatgaaaagatttaaaaatgaatcagacccagagggagctttatggtaa
